United States Patent 11,655,510 (EXPERIMENTALLY VALIDATED SETS OF GENE SPECIFIC PRIMERS FOR USE IN MULTIPLEX APPLICATIONS) - sequence listing, part 2

SEQ ID NO: 19208 - DNA, 22 bp, Artificial sequence
  synthetic polynucleotide sequence
tgatgggaggaatcaggtgtga

SEQ ID NO: 19209 - DNA, 20 bp, Artificial sequence
  synthetic polynucleotide sequence
aaggccaacaaggtccccga

SEQ ID NO: 19210 - DNA, 20 bp, Artificial sequence
  synthetic polynucleotide sequence
ccacttgcccagctggacca

SEQ ID NO: 19211 - DNA, 20 bp, Artificial sequence
  synthetic polynucleotide sequence
cacagcaagcctcccagaca

SEQ ID NO: 19212 - DNA, 18 bp, Artificial sequence
  synthetic polynucleotide sequence
ctcgctcaaggggccaga

SEQ ID NO: 19213 - DNA, 18 bp, Artificial sequence
  synthetic polynucleotide sequence
tggccacccatgagccca

SEQ ID NO: 19214 - DNA, 20 bp, Artificial sequence
  synthetic polynucleotide sequence
cattgaccacagctccacca

SEQ ID NO: 19215 - DNA, 22 bp, Artificial sequence
  synthetic polynucleotide sequence
ttcacgaacgatcctggatgca

SEQ ID NO: 19216 - DNA, 22 bp, Artificial sequence
  synthetic polynucleotide sequence
agcaagaaacagggctagcgca

SEQ ID NO: 19217 - DNA, 18 bp, Artificial sequence
  synthetic polynucleotide sequence
gtctccaccgccgaccga

SEQ ID NO: 19218 - DNA, 19 bp, Artificial sequence
  synthetic polynucleotide sequence
gggagccaatgtccccgga

SEQ ID NO: 19219 - DNA, 20 bp, Artificial sequence
  synthetic polynucleotide sequence
cctcagcatgaggaacacga

SEQ ID NO: 19220 - DNA, 18 bp, Artificial sequence
  synthetic polynucleotide sequence
caatccgatggccagcaa

SEQ ID NO: 19221 - DNA, 20 bp, Artificial sequence
  synthetic polynucleotide sequence
ctggatcggcggctacggaa

SEQ ID NO: 19222 - DNA, 20 bp, Artificial sequence
  synthetic polynucleotide sequence
tccctcctgagccatggaga

SEQ ID NO: 19223 - DNA, 19 bp, Artificial sequence
  synthetic polynucleotide sequence
ccgacgactccactcacca

SEQ ID NO: 19224 - DNA, 18 bp, Artificial sequence
  synthetic polynucleotide sequence
caactggcacaaggccca

SEQ ID NO: 19225 - DNA, 18 bp, Artificial sequence
  synthetic polynucleotide sequence
cggcggcggaactagcca

SEQ ID NO: 19226 - DNA, 21 bp, Artificial sequence
  synthetic polynucleotide sequence
ttgagctgctccacgatgaga

SEQ ID NO: 19227 - DNA, 20 bp, Artificial sequence
  synthetic polynucleotide sequence
tctgggcagacggctaagga

SEQ ID NO: 19228 - DNA, 21 bp, Artificial sequence
  synthetic polynucleotide sequence
tcttcagacccctgctgctca

SEQ ID NO: 19229 - DNA, 22 bp, Artificial sequence
  synthetic polynucleotide sequence
tggacaccaagccagcttacca

SEQ ID NO: 19230 - DNA, 21 bp, Artificial sequence
  synthetic polynucleotide sequence
ctgacctccctgactgaacca

SEQ ID NO: 19231 - DNA, 18 bp, Artificial sequence
  synthetic polynucleotide sequence
tgcgcaagaccctggcaa

SEQ ID NO: 19232 - DNA, 20 bp, Artificial sequence
  synthetic polynucleotide sequence
gaagaaggcagccttcagga

SEQ ID NO: 19233 - DNA, 20 bp, Artificial sequence
  synthetic polynucleotide sequence
gacaccggctggtccacgca

SEQ ID NO: 19234 - DNA, 18 bp, Artificial sequence
  synthetic polynucleotide sequence
cgggggtccgtgcctgga

SEQ ID NO: 19235 - DNA, 18 bp, Artificial sequence
  synthetic polynucleotide sequence
tggaggacacgaccctca

SEQ ID NO: 19236 - DNA, 18 bp, Artificial sequence
  synthetic polynucleotide sequence
ctaggcacgcgttcacca

SEQ ID NO: 19237 - DNA, 18 bp, Artificial sequence
  synthetic polynucleotide sequence
gggatccgcgggcttcca

SEQ ID NO: 19238 - DNA, 21 bp, Artificial sequence
  synthetic polynucleotide sequence
tggtcagcgtttggggacaga

SEQ ID NO: 19239 - DNA, 21 bp, Artificial sequence
  synthetic polynucleotide sequence
ctgtgatggtagctcagccca

SEQ ID NO: 19240 - DNA, 22 bp, Artificial sequence
  synthetic polynucleotide sequence
agaatggagcagaagaggcaga

SEQ ID NO: 19241 - DNA, 22 bp, Artificial sequence
  synthetic polynucleotide sequence
tacaggatgctgagacaccaca

SEQ ID NO: 19242 - DNA, 20 bp, Artificial sequence
  synthetic polynucleotide sequence
tcccagatctcgggtcagca

SEQ ID NO: 19243 - DNA, 21 bp, Artificial sequence
  synthetic polynucleotide sequence
atatagatggctgctcgccaa

SEQ ID NO: 19244 - DNA, 22 bp, Artificial sequence
  synthetic polynucleotide sequence
tgtaccatgggtagaagcctca

SEQ ID NO: 19245 - DNA, 21 bp, Artificial sequence
  synthetic polynucleotide sequence
tgagtggccagacttccccaa

SEQ ID NO: 19246 - DNA, 18 bp, Artificial sequence
  synthetic polynucleotide sequence
ggcggaggatggcggaca

SEQ ID NO: 19247 - DNA, 21 bp, Artificial sequence
  synthetic polynucleotide sequence
ttgcatccagacctaccgcga

SEQ ID NO: 19248 - DNA, 21 bp, Artificial sequence
  synthetic polynucleotide sequence
acacctccagagtacgtcgga

SEQ ID NO: 19249 - DNA, 20 bp, Artificial sequence
  synthetic polynucleotide sequence
tctcaagcgcggttcggtca

SEQ ID NO: 19250 - DNA, 20 bp, Artificial sequence
  synthetic polynucleotide sequence
tcgagctgcctgacctagca

SEQ ID NO: 19251 - DNA, 21 bp, Artificial sequence
  synthetic polynucleotide sequence
cgtctacgtcctggccaacga

SEQ ID NO: 19252 - DNA, 20 bp, Artificial sequence
  synthetic polynucleotide sequence
ctgctcctcccaacgctgca

SEQ ID NO: 19253 - DNA, 18 bp, Artificial sequence
  synthetic polynucleotide sequence
cccgcctcccattgagga

SEQ ID NO: 19254 - DNA, 19 bp, Artificial sequence
  synthetic polynucleotide sequence
ggcagttgatccaagggca

SEQ ID NO: 19255 - DNA, 21 bp, Artificial sequence
  synthetic polynucleotide sequence
ttcagctgcattaccagcaga

SEQ ID NO: 19256 - DNA, 18 bp, Artificial sequence
  synthetic polynucleotide sequence
cccaggcgaccaccgtga

SEQ ID NO: 19257 - DNA, 18 bp, Artificial sequence
  synthetic polynucleotide sequence
tggcacctccagcaacca

SEQ ID NO: 19258 - DNA, 22 bp, Artificial sequence
  synthetic polynucleotide sequence
aagaagtagtctgagaggccca

SEQ ID NO: 19259 - DNA, 21 bp, Artificial sequence
  synthetic polynucleotide sequence
ggctggctgtgaagctggaca

SEQ ID NO: 19260 - DNA, 22 bp, Artificial sequence
  synthetic polynucleotide sequence
aaatttgcaggcttccagggga

SEQ ID NO: 19261 - DNA, 20 bp, Artificial sequence
  synthetic polynucleotide sequence
cgggcccatcattggccaga

SEQ ID NO: 19262 - DNA, 20 bp, Artificial sequence
  synthetic polynucleotide sequence
actggcgcattctcccagga

SEQ ID NO: 19263 - DNA, 20 bp, Artificial sequence
  synthetic polynucleotide sequence
cctcagcacaagtggcccca

SEQ ID NO: 19264 - DNA, 19 bp, Artificial sequence
  synthetic polynucleotide sequence
caccagatccctccggcca

SEQ ID NO: 19265 - DNA, 20 bp, Artificial sequence
  synthetic polynucleotide sequence
cagctctacctgggggccaa

SEQ ID NO: 19266 - DNA, 20 bp, Artificial sequence
  synthetic polynucleotide sequence
cttctggagagagcacagca

SEQ ID NO: 19267 - DNA, 21 bp, Artificial sequence
  synthetic polynucleotide sequence
gatacagatcaggtgcgcaca

SEQ ID NO: 19268 - DNA, 20 bp, Artificial sequence
  synthetic polynucleotide sequence
gaggttgaccacaccaggga

SEQ ID NO: 19269 - DNA, 20 bp, Artificial sequence
  synthetic polynucleotide sequence
cggggcagtgtatgcaccaa

SEQ ID NO: 19270 - DNA, 20 bp, Artificial sequence
  synthetic polynucleotide sequence
ccacggtcagcacaacagca

SEQ ID NO: 19271 - DNA, 21 bp, Artificial sequence
  synthetic polynucleotide sequence
ggtgttccagcagtaccccga

SEQ ID NO: 19272 - DNA, 21 bp, Artificial sequence
  synthetic polynucleotide sequence
cagtggccaacaccttcacca

SEQ ID NO: 19273 - DNA, 21 bp, Artificial sequence
  synthetic polynucleotide sequence
tcccagaacgcagcaactcca

SEQ ID NO: 19274 - DNA, 21 bp, Artificial sequence
  synthetic polynucleotide sequence
ctgtggccatgatcctcacca

SEQ ID NO: 19275 - DNA, 22 bp, Artificial sequence
  synthetic polynucleotide sequence
gaagtccctgctgggaaacaca

SEQ ID NO: 19276 - DNA, 20 bp, Artificial sequence
  synthetic polynucleotide sequence
ctcctcctactcgcagcaca

SEQ ID NO: 19277 - DNA, 20 bp, Artificial sequence
  synthetic polynucleotide sequence
tgaccaccacgggaggcaca

SEQ ID NO: 19278 - DNA, 21 bp, Artificial sequence
  synthetic polynucleotide sequence
ggcagagctgtacctgaacga

SEQ ID NO: 19279 - DNA, 21 bp, Artificial sequence
  synthetic polynucleotide sequence
aggacctcagcgagaaaggaa

SEQ ID NO: 19280 - DNA, 18 bp, Artificial sequence
  synthetic polynucleotide sequence
tgccacatcaccatgcca

SEQ ID NO: 19281 - DNA, 20 bp, Artificial sequence
  synthetic polynucleotide sequence
gcggccacataggatgtgga

SEQ ID NO: 19282 - DNA, 21 bp, Artificial sequence
  synthetic polynucleotide sequence
ccagcatagtcccagactcga

SEQ ID NO: 19283 - DNA, 19 bp, Artificial sequence
  synthetic polynucleotide sequence
tcactgagtggctgcggga

SEQ ID NO: 19284 - DNA, 20 bp, Artificial sequence
  synthetic polynucleotide sequence
aaagagccccacgtggcaga

SEQ ID NO: 19285 - DNA, 20 bp, Artificial sequence
  synthetic polynucleotide sequence
tggcacaggtgtccacccaa

SEQ ID NO: 19286 - DNA, 20 bp, Artificial sequence
  synthetic polynucleotide sequence
cacccactctcgggtcacca

SEQ ID NO: 19287 - DNA, 21 bp, Artificial sequence
  synthetic polynucleotide sequence
ttcagggccgtacactgctca

SEQ ID NO: 19288 - DNA, 20 bp, Artificial sequence
  synthetic polynucleotide sequence
tgggctgagacaggtgtgga

SEQ ID NO: 19289 - DNA, 20 bp, Artificial sequence
  synthetic polynucleotide sequence
atggggctgtgcatagggga

SEQ ID NO: 19290 - DNA, 22 bp, Artificial sequence
  synthetic polynucleotide sequence
tgataccagcccacaactctca

SEQ ID NO: 19291 - DNA, 18 bp, Artificial sequence
  synthetic polynucleotide sequence
gcctgcagtctcagcgaa

SEQ ID NO: 19292 - DNA, 18 bp, Artificial sequence
  synthetic polynucleotide sequence
gcagcagctcgatcagca

SEQ ID NO: 19293 - DNA, 19 bp, Artificial sequence
  synthetic polynucleotide sequence
gaggaagagagcaggccca

SEQ ID NO: 19294 - DNA, 18 bp, Artificial sequence
  synthetic polynucleotide sequence
tatgcacaactcggccca

SEQ ID NO: 19295 - DNA, 18 bp, Artificial sequence
  synthetic polynucleotide sequence
cgttctcagcaagcggga

SEQ ID NO: 19296 - DNA, 18 bp, Artificial sequence
  synthetic polynucleotide sequence
gctcccagactcggagga

SEQ ID NO: 19297 - DNA, 20 bp, Artificial sequence
  synthetic polynucleotide sequence
cagttccagagcctgaccca

SEQ ID NO: 19298 - DNA, 18 bp, Artificial sequence
  synthetic polynucleotide sequence
ggcctcccgacatccaca

SEQ ID NO: 19299 - DNA, 19 bp, Artificial sequence
  synthetic polynucleotide sequence
tgcctgaagatgaaggcca

SEQ ID NO: 19300 - DNA, 21 bp, Artificial sequence
  synthetic polynucleotide sequence
aaaacttcaactggaacgcca

SEQ ID NO: 19301 - DNA, 18 bp, Artificial sequence
  synthetic polynucleotide sequence
agcggccagcctagagga

SEQ ID NO: 19302 - DNA, 18 bp, Artificial sequence
  synthetic polynucleotide sequence
aagcagggctgctgggga

SEQ ID NO: 19303 - DNA, 18 bp, Artificial sequence
  synthetic polynucleotide sequence
ggaccctgacgacagcca

SEQ ID NO: 19304 - DNA, 19 bp, Artificial sequence
  synthetic polynucleotide sequence
gcgttggacagggagctga

SEQ ID NO: 19305 - DNA, 21 bp, Artificial sequence
  synthetic polynucleotide sequence
agttcacaaactgcggcccaa

SEQ ID NO: 19306 - DNA, 20 bp, Artificial sequence
  synthetic polynucleotide sequence
ataggtggcagtgccactga

SEQ ID NO: 19307 - DNA, 18 bp, Artificial sequence
  synthetic polynucleotide sequence
cccagaactgcctcccga

SEQ ID NO: 19308 - DNA, 18 bp, Artificial sequence
  synthetic polynucleotide sequence
ggcgggagctctcccgga

SEQ ID NO: 19309 - DNA, 18 bp, Artificial sequence
  synthetic polynucleotide sequence
gtcataccacgccgacga

SEQ ID NO: 19310 - DNA, 18 bp, Artificial sequence
  synthetic polynucleotide sequence
tcatcgccatcacagcca

SEQ ID NO: 19311 - DNA, 20 bp, Artificial sequence
  synthetic polynucleotide sequence
cagcagaagtggagacccga

SEQ ID NO: 19312 - DNA, 18 bp, Artificial sequence
  synthetic polynucleotide sequence
ggtggcaagagaagggca

SEQ ID NO: 19313 - DNA, 20 bp, Artificial sequence
  synthetic polynucleotide sequence
ggtgggaccgatgtggcaca

SEQ ID NO: 19314 - DNA, 20 bp, Artificial sequence
  synthetic polynucleotide sequence
ctcgggcgggagcagcagca

SEQ ID NO: 19315 - DNA, 20 bp, Artificial sequence
  synthetic polynucleotide sequence
ctactggcgaagcagtccca

SEQ ID NO: 19316 - DNA, 20 bp, Artificial sequence
  synthetic polynucleotide sequence
gagcacccggttgagacgga

SEQ ID NO: 19317 - DNA, 20 bp, Artificial sequence
  synthetic polynucleotide sequence
cctgtgcatgaggaccccca

SEQ ID NO: 19318 - DNA, 22 bp, Artificial sequence
  synthetic polynucleotide sequence
aataaaagcagaccgacacgca

SEQ ID NO: 19319 - DNA, 19 bp, Artificial sequence
  synthetic polynucleotide sequence
ttgaccctcggtggcgcaa

SEQ ID NO: 19320 - DNA, 20 bp, Artificial sequence
  synthetic polynucleotide sequence
cctccgaatggctcccgcta

SEQ ID NO: 19321 - DNA, 20 bp, Artificial sequence
  synthetic polynucleotide sequence
ctgctcaccctgaagagcaa

SEQ ID NO: 19322 - DNA, 22 bp, Artificial sequence
  synthetic polynucleotide sequence
aagctgccctcattcacaggca

SEQ ID NO: 19323 - DNA, 20 bp, Artificial sequence
  synthetic polynucleotide sequence
tgagaacggcctcctaggca

SEQ ID NO: 19324 - DNA, 20 bp, Artificial sequence
  synthetic polynucleotide sequence
gtgcgcatgtcaggcaggca

SEQ ID NO: 19325 - DNA, 19 bp, Artificial sequence
  synthetic polynucleotide sequence
tccagatccacaagcccaa

SEQ ID NO: 19326 - DNA, 20 bp, Artificial sequence
  synthetic polynucleotide sequence
aacggggaggactagaggca

SEQ ID NO: 19327 - DNA, 21 bp, Artificial sequence
  synthetic polynucleotide sequence
gcagttcaggcgaagaagcca

SEQ ID NO: 19328 - DNA, 20 bp, Artificial sequence
  synthetic polynucleotide sequence
cttgcaaacggggcctggga

SEQ ID NO: 19329 - DNA, 18 bp, Artificial sequence
  synthetic polynucleotide sequence
catggcgggacaggagga

SEQ ID NO: 19330 - DNA, 23 bp, Artificial sequence
  synthetic polynucleotide sequence
gaacgacaagacatatcgaacga

SEQ ID NO: 19331 - DNA, 18 bp, Artificial sequence
  synthetic polynucleotide sequence
tgagcgacgccgcagcga

SEQ ID NO: 19332 - DNA, 18 bp, Artificial sequence
  synthetic polynucleotide sequence
cctccagccgcaaccgca

SEQ ID NO: 19333 - DNA, 22 bp, Artificial sequence
  synthetic polynucleotide sequence
gaatacttggaaccgctggcaa

SEQ ID NO: 19334 - DNA, 21 bp, Artificial sequence
  synthetic polynucleotide sequence
gctctcacaatgctggcgaga

SEQ ID NO: 19335 - DNA, 21 bp, Artificial sequence
  synthetic polynucleotide sequence
ttgaggtcatccagggcacga

SEQ ID NO: 19336 - DNA, 22 bp, Artificial sequence
  synthetic polynucleotide sequence
aaaaacagcatcctgctgggca

SEQ ID NO: 19337 - DNA, 18 bp, Artificial sequence
  synthetic polynucleotide sequence
tcaccaaccgcctgacca

SEQ ID NO: 19338 - DNA, 18 bp, Artificial sequence
  synthetic polynucleotide sequence
cgtagcaatgggacccca

SEQ ID NO: 19339 - DNA, 18 bp, Artificial sequence
  synthetic polynucleotide sequence
gcagtggcttccaaggga

SEQ ID NO: 19340 - DNA, 18 bp, Artificial sequence
  synthetic polynucleotide sequence
tcgcacggtcataggcca

SEQ ID NO: 19341 - DNA, 21 bp, Artificial sequence
  synthetic polynucleotide sequence
gcggggacaactctccaggaa

SEQ ID NO: 19342 - DNA, 21 bp, Artificial sequence
  synthetic polynucleotide sequence
ctccaaaagccaggctggtga

SEQ ID NO: 19343 - DNA, 20 bp, Artificial sequence
  synthetic polynucleotide sequence
ccccgacgtcctagagagca

SEQ ID NO: 19344 - DNA, 18 bp, Artificial sequence
  synthetic polynucleotide sequence
tcccgtgacggctcagca

SEQ ID NO: 19345 - DNA, 19 bp, Artificial sequence
  synthetic polynucleotide sequence
caccagagtcgtccccaga

SEQ ID NO: 19346 - DNA, 20 bp, Artificial sequence
  synthetic polynucleotide sequence
gagactgggaatcgacagga

SEQ ID NO: 19347 - DNA, 20 bp, Artificial sequence
  synthetic polynucleotide sequence
tcagaacacaagcacaggca

SEQ ID NO: 19348 - DNA, 17 bp, Artificial sequence
  synthetic polynucleotide sequence
tccacctgcgcagccca

SEQ ID NO: 19349 - DNA, 18 bp, Artificial sequence
  synthetic polynucleotide sequence
ataccccgacgttcccca

SEQ ID NO: 19350 - DNA, 18 bp, Artificial sequence
  synthetic polynucleotide sequence
cacagtgtgggtgggcca

SEQ ID NO: 19351 - DNA, 21 bp, Artificial sequence
  synthetic polynucleotide sequence
ggaggtggaactctacgcaga

SEQ ID NO: 19352 - DNA, 20 bp, Artificial sequence
  synthetic polynucleotide sequence
ggatgcggaggtaggctcca

SEQ ID NO: 19353 - DNA, 19 bp, Artificial sequence
  synthetic polynucleotide sequence
cagatcgccaacccggcca

SEQ ID NO: 19354 - DNA, 21 bp, Artificial sequence
  synthetic polynucleotide sequence
ccagtctcacccacatccaca

SEQ ID NO: 19355 - DNA, 21 bp, Artificial sequence
  synthetic polynucleotide sequence
tgccaaaccacacgctcggga

SEQ ID NO: 19356 - DNA, 21 bp, Artificial sequence
  synthetic polynucleotide sequence
gtatgcggatgaagcacggga

SEQ ID NO: 19357 - DNA, 22 bp, Artificial sequence
  synthetic polynucleotide sequence
atctccacatgacagggaggaa

SEQ ID NO: 19358 - DNA, 21 bp, Artificial sequence
  synthetic polynucleotide sequence
tcatcctccaacgttggggca

SEQ ID NO: 19359 - DNA, 21 bp, Artificial sequence
  synthetic polynucleotide sequence
ctcacacaatgggcagcacga

SEQ ID NO: 19360 - DNA, 21 bp, Artificial sequence
  synthetic polynucleotide sequence
atggtctgatcggccacagca

SEQ ID NO: 19361 - DNA, 18 bp, Artificial sequence
  synthetic polynucleotide sequence
cgtggaccacagcaccca

SEQ ID NO: 19362 - DNA, 19 bp, Artificial sequence
  synthetic polynucleotide sequence
cctggaagccagcaccaga

SEQ ID NO: 19363 - DNA, 20 bp, Artificial sequence
  synthetic polynucleotide sequence
ctgcaacaagagctgaccga

SEQ ID NO: 19364 - DNA, 18 bp, Artificial sequence
  synthetic polynucleotide sequence
gggaagccattagggcca

SEQ ID NO: 19365 - DNA, 23 bp, Artificial sequence
  synthetic polynucleotide sequence
gtaaactgtgcaaccatccagca

SEQ ID NO: 19366 - DNA, 20 bp, Artificial sequence
  synthetic polynucleotide sequence
ctgtgctgggccacaacaga

SEQ ID NO: 19367 - DNA, 20 bp, Artificial sequence
  synthetic polynucleotide sequence
ctgtcaaccctaaaccccga

SEQ ID NO: 19368 - DNA, 21 bp, Artificial sequence
  synthetic polynucleotide sequence
actcgtcccactgtaacccca

SEQ ID NO: 19369 - DNA, 21 bp, Artificial sequence
  synthetic polynucleotide sequence
agcagacattccccaggacca

SEQ ID NO: 19370 - DNA, 21 bp, Artificial sequence
  synthetic polynucleotide sequence
tgtgcatcaggatcgaggtca

SEQ ID NO: 19371 - DNA, 20 bp, Artificial sequence
  synthetic polynucleotide sequence
tcctctccagcaagccgaca

SEQ ID NO: 19372 - DNA, 21 bp, Artificial sequence
  synthetic polynucleotide sequence
agtgtcgctgcaaagcctcca

SEQ ID NO: 19373 - DNA, 19 bp, Artificial sequence
  synthetic polynucleotide sequence
ctcaccaccggctgcgaga

SEQ ID NO: 19374 - DNA, 22 bp, Artificial sequence
  synthetic polynucleotide sequence
aataacctgggggacttcagca

SEQ ID NO: 19375 - DNA, 22 bp, Artificial sequence
  synthetic polynucleotide sequence
catacgctaccccatgatccca

SEQ ID NO: 19376 - DNA, 20 bp, Artificial sequence
  synthetic polynucleotide sequence
gaactggtaggcctgcagca

SEQ ID NO: 19377 - DNA, 20 bp, Artificial sequence
  synthetic polynucleotide sequence
atggaactctggcccaggga

SEQ ID NO: 19378 - DNA, 22 bp, Artificial sequence
  synthetic polynucleotide sequence
acctctggggagtatcaaggga

SEQ ID NO: 19379 - DNA, 20 bp, Artificial sequence
  synthetic polynucleotide sequence
cctgagggggtgaaactcga

SEQ ID NO: 19380 - DNA, 19 bp, Artificial sequence
  synthetic polynucleotide sequence
cccaggggcagggcgtaga

SEQ ID NO: 19381 - DNA, 21 bp, Artificial sequence
  synthetic polynucleotide sequence
tgcgtgggaaggagtgcagca

SEQ ID NO: 19382 - DNA, 21 bp, Artificial sequence
  synthetic polynucleotide sequence
catacagcccaaatcccacca

SEQ ID NO: 19383 - DNA, 18 bp, Artificial sequence
  synthetic polynucleotide sequence
ccaactccagcagcacca

SEQ ID NO: 19384 - DNA, 18 bp, Artificial sequence
  synthetic polynucleotide sequence
ggcaaccgttgagtccca

SEQ ID NO: 19385 - DNA, 20 bp, Artificial sequence
  synthetic polynucleotide sequence
cgcagcaaccagtggcggta

SEQ ID NO: 19386 - DNA, 21 bp, Artificial sequence
  synthetic polynucleotide sequence
ctggaccgggtgttcaaacca

SEQ ID NO: 19387 - DNA, 21 bp, Artificial sequence
  synthetic polynucleotide sequence
cagaagcccggacattgcaga

SEQ ID NO: 19388 - DNA, 23 bp, Artificial sequence
  synthetic polynucleotide sequence
aaaaatggacaccttgctgccaa

SEQ ID NO: 19389 - DNA, 18 bp, Artificial sequence
  synthetic polynucleotide sequence
aaggcagtgcggccccca

SEQ ID NO: 19390 - DNA, 20 bp, Artificial sequence
  synthetic polynucleotide sequence
ctggctgagctgctccgaca

SEQ ID NO: 19391 - DNA, 19 bp, Artificial sequence
  synthetic polynucleotide sequence
tgggacacacaacacagca

SEQ ID NO: 19392 - DNA, 18 bp, Artificial sequence
  synthetic polynucleotide sequence
cgagctgctgaccggcca

SEQ ID NO: 19393 - DNA, 20 bp, Artificial sequence
  synthetic polynucleotide sequence
caccacacaatcaaagcgga

SEQ ID NO: 19394 - DNA, 18 bp, Artificial sequence
  synthetic polynucleotide sequence
ggccaccacgaagcggca

SEQ ID NO: 19395 - DNA, 18 bp, Artificial sequence
  synthetic polynucleotide sequence
tggctgggagaatgacca

SEQ ID NO: 19396 - DNA, 19 bp, Artificial sequence
  synthetic polynucleotide sequence
cctctcatacaagcgccca

SEQ ID NO: 19397 - DNA, 21 bp, Artificial sequence
  synthetic polynucleotide sequence
tcaggcatctctggcagcgaa

SEQ ID NO: 19398 - DNA, 22 bp, Artificial sequence
  synthetic polynucleotide sequence
actagtcagactatccgcacca

SEQ ID NO: 19399 - DNA, 19 bp, Artificial sequence
  synthetic polynucleotide sequence
cagcggattggactgagca

SEQ ID NO: 19400 - DNA, 19 bp, Artificial sequence
  synthetic polynucleotide sequence
cagcacacagatggagcca

SEQ ID NO: 19401 - DNA, 20 bp, Artificial sequence
  synthetic polynucleotide sequence
ttgggcccacagacccaaga

SEQ ID NO: 19402 - DNA, 25 bp, Artificial sequence
  synthetic polynucleotide sequence
acaagatgcaagaacacagcctgca

SEQ ID NO: 19403 - DNA, 18 bp, Artificial sequence
  synthetic polynucleotide sequence
cggtgactgcagccgcaa

SEQ ID NO: 19404 - DNA, 21 bp, Artificial sequence
  synthetic polynucleotide sequence
caggaggaggtacccatgtca

SEQ ID NO: 19405 - DNA, 21 bp, Artificial sequence
  synthetic polynucleotide sequence
gtagcaaggaacctcgtgtca

SEQ ID NO: 19406 - DNA, 22 bp, Artificial sequence
  synthetic polynucleotide sequence
taagtgtttcccaggaggccaa

SEQ ID NO: 19407 - DNA, 21 bp, Artificial sequence
  synthetic polynucleotide sequence
gaaatggagaggccagtacga

SEQ ID NO: 19408 - DNA, 20 bp, Artificial sequence
  synthetic polynucleotide sequence
ggtagttcaggaggcagcca

SEQ ID NO: 19409 - DNA, 18 bp, Artificial sequence
  synthetic polynucleotide sequence
cgaccctccaaggacgaa

SEQ ID NO: 19410 - DNA, 18 bp, Artificial sequence
  synthetic polynucleotide sequence
caggcagcagaacaggca

SEQ ID NO: 19411 - DNA, 21 bp, Artificial sequence
  synthetic polynucleotide sequence
caatcggcgtgtgtagggaga

SEQ ID NO: 19412 - DNA, 21 bp, Artificial sequence
  synthetic polynucleotide sequence
ggagggggccagagaaagtga

SEQ ID NO: 19413 - DNA, 18 bp, Artificial sequence
  synthetic polynucleotide sequence
cagcccaggaaaacggca

SEQ ID NO: 19414 - DNA, 19 bp, Artificial sequence
  synthetic polynucleotide sequence
gatatgcactccagccgga

SEQ ID NO: 19415 - DNA, 18 bp, Artificial sequence
  synthetic polynucleotide sequence
agacaccgctcatcccga

SEQ ID NO: 19416 - DNA, 19 bp, Artificial sequence
  synthetic polynucleotide sequence
cagacccccacagtccaca

SEQ ID NO: 19417 - DNA, 22 bp, Artificial sequence
  synthetic polynucleotide sequence
tatcggactctaactgagccca

SEQ ID NO: 19418 - DNA, 18 bp, Artificial sequence
  synthetic polynucleotide sequence
tgcgatccatccacagca

SEQ ID NO: 19419 - DNA, 18 bp, Artificial sequence
  synthetic polynucleotide sequence
gagaggcggctccgggga

SEQ ID NO: 19420 - DNA, 20 bp, Artificial sequence
  synthetic polynucleotide sequence
aagcagcagcaagataggca

SEQ ID NO: 19421 - DNA, 18 bp, Artificial sequence
  synthetic polynucleotide sequence
agcccactgccctgacca

SEQ ID NO: 19422 - DNA, 18 bp, Artificial sequence
  synthetic polynucleotide sequence
ggtgggcagggagaagca

SEQ ID NO: 19423 - DNA, 18 bp, Artificial sequence
  synthetic polynucleotide sequence
gtggttcccacagcccca

SEQ ID NO: 19424 - DNA, 18 bp, Artificial sequence
  synthetic polynucleotide sequence
agtgacgtccacagcgga

SEQ ID NO: 19425 - DNA, 22 bp, Artificial sequence
  synthetic polynucleotide sequence
atgccacagtatcgagggagaa

SEQ ID NO: 19426 - DNA, 20 bp, Artificial sequence
  synthetic polynucleotide sequence
ccagcacccatacaggccga

SEQ ID NO: 19427 - DNA, 18 bp, Artificial sequence
  synthetic polynucleotide sequence
agagacggctcacccgaa

SEQ ID NO: 19428 - DNA, 18 bp, Artificial sequence
  synthetic polynucleotide sequence
gtccacatcatcccggca

SEQ ID NO: 19429 - DNA, 20 bp, Artificial sequence
  synthetic polynucleotide sequence
tggagagaccaccagggaca

SEQ ID NO: 19430 - DNA, 18 bp, Artificial sequence
  synthetic polynucleotide sequence
agggctcccgctcggaca

SEQ ID NO: 19431 - DNA, 22 bp, Artificial sequence
  synthetic polynucleotide sequence
atcatcggattccacggtcaga

SEQ ID NO: 19432 - DNA, 18 bp, Artificial sequence
  synthetic polynucleotide sequence
cgaccagcaccctccgga

SEQ ID NO: 19433 - DNA, 18 bp, Artificial sequence
  synthetic polynucleotide sequence
aacccacaggagccagga

SEQ ID NO: 19434 - DNA, 20 bp, Artificial sequence
  synthetic polynucleotide sequence
tagacgcaagttgtgcagca

SEQ ID NO: 19435 - DNA, 21 bp, Artificial sequence
  synthetic polynucleotide sequence
caccgacaattccaagctcga

SEQ ID NO: 19436 - DNA, 20 bp, Artificial sequence
  synthetic polynucleotide sequence
gagagcacctcctacacgga

SEQ ID NO: 19437 - DNA, 18 bp, Artificial sequence
  synthetic polynucleotide sequence
ggaacagcaggccgcaga

SEQ ID NO: 19438 - DNA, 18 bp, Artificial sequence
  synthetic polynucleotide sequence
aacgctcgtatgcagcga

SEQ ID NO: 19439 - DNA, 21 bp, Artificial sequence
  synthetic polynucleotide sequence
cctcgctacagtggtccagca

SEQ ID NO: 19440 - DNA, 21 bp, Artificial sequence
  synthetic polynucleotide sequence
ttcttgctggcaagcctggca

SEQ ID NO: 19441 - DNA, 21 bp, Artificial sequence
  synthetic polynucleotide sequence
atcccattcaagccaggcaca

SEQ ID NO: 19442 - DNA, 20 bp, Artificial sequence
  synthetic polynucleotide sequence
tctaccaccatgccaccgga

SEQ ID NO: 19443 - DNA, 22 bp, Artificial sequence
  synthetic polynucleotide sequence
caagcggaaagccatcagcaga

SEQ ID NO: 19444 - DNA, 20 bp, Artificial sequence
  synthetic polynucleotide sequence
gtctgaatgcaccgcaggca

SEQ ID NO: 19445 - DNA, 21 bp, Artificial sequence
  synthetic polynucleotide sequence
agagtccagcccattgagaga

SEQ ID NO: 19446 - DNA, 21 bp, Artificial sequence
  synthetic polynucleotide sequence
acatcggtagagagtggccca

SEQ ID NO: 19447 - DNA, 18 bp, Artificial sequence
  synthetic polynucleotide sequence
acagcggtgccaacagca

SEQ ID NO: 19448 - DNA, 18 bp, Artificial sequence
  synthetic polynucleotide sequence
ggaggcactggtgccaca

SEQ ID NO: 19449 - DNA, 21 bp, Artificial sequence
  synthetic polynucleotide sequence
gagctcgtaaggagctccaga

SEQ ID NO: 19450 - DNA, 21 bp, Artificial sequence
  synthetic polynucleotide sequence
cgatgacaactggctctggga

SEQ ID NO: 19451 - DNA, 21 bp, Artificial sequence
  synthetic polynucleotide sequence
cgaacccacagtcttcaggga

SEQ ID NO: 19452 - DNA, 18 bp, Artificial sequence
  synthetic polynucleotide sequence
cgcgttcctccaggggca

SEQ ID NO: 19453 - DNA, 18 bp, Artificial sequence
  synthetic polynucleotide sequence
ctgcgagacatcaccgca

SEQ ID NO: 19454 - DNA, 18 bp, Artificial sequence
  synthetic polynucleotide sequence
cagtccagggggtccaca

SEQ ID NO: 19455 - DNA, 21 bp, Artificial sequence
  synthetic polynucleotide sequence
cgcaaaagagtgaggactgga

SEQ ID NO: 19456 - DNA, 18 bp, Artificial sequence
  synthetic polynucleotide sequence
gaaagggccacatgcaga

SEQ ID NO: 19457 - DNA, 20 bp, Artificial sequence
  synthetic polynucleotide sequence
aggaggcgttggtcagagga

SEQ ID NO: 19458 - DNA, 21 bp, Artificial sequence
  synthetic polynucleotide sequence
ttccccaggacaccttggtga

SEQ ID NO: 19459 - DNA, 19 bp, Artificial sequence
  synthetic polynucleotide sequence
gcagaacggagagccgaga

SEQ ID NO: 19460 - DNA, 19 bp, Artificial sequence
  synthetic polynucleotide sequence
ccagagacagccttgggga

SEQ ID NO: 19461 - DNA, 21 bp, Artificial sequence
  synthetic polynucleotide sequence
caccaaaacccctgctgccaa

SEQ ID NO: 19462 - DNA, 19 bp, Artificial sequence
  synthetic polynucleotide sequence
ggcagctcttcccagcgga

SEQ ID NO: 19463 - DNA, 21 bp, Artificial sequence
  synthetic polynucleotide sequence
aacgagagcaggtgaacgtca

SEQ ID NO: 19464 - DNA, 19 bp, Artificial sequence
  synthetic polynucleotide sequence
gccattggacccaggccca

SEQ ID NO: 19465 - DNA, 20 bp, Artificial sequence
  synthetic polynucleotide sequence
gggggtcagcatgctgagga

SEQ ID NO: 19466 - DNA, 20 bp, Artificial sequence
  synthetic polynucleotide sequence
gacacccacagcagtcccga

SEQ ID NO: 19467 - DNA, 25 bp, Artificial sequence
  synthetic polynucleotide sequence
cctgcccagacgtaagaaaagtgca

SEQ ID NO: 19468 - DNA, 25 bp, Artificial sequence
  synthetic polynucleotide sequence
gcagcactgttcacaagagccaaga

SEQ ID NO: 19469 - DNA, 20 bp, Artificial sequence
  synthetic polynucleotide sequence
agccccaggagggcatggaa

SEQ ID NO: 19470 - DNA, 25 bp, Artificial sequence
  synthetic polynucleotide sequence
gttacagaggagagagacacagaga

SEQ ID NO: 19471 - DNA, 20 bp, Artificial sequence
  synthetic polynucleotide sequence
aaagctcctgcaagatggga

SEQ ID NO: 19472 - DNA, 18 bp, Artificial sequence
  synthetic polynucleotide sequence
ggccaggatggctgagga

SEQ ID NO: 19473 - DNA, 18 bp, Artificial sequence
  synthetic polynucleotide sequence
ggccatggtgctccccca

SEQ ID NO: 19474 - DNA, 20 bp, Artificial sequence
  synthetic polynucleotide sequence
gatggaggtcaccggctcca

SEQ ID NO: 19475 - DNA, 18 bp, Artificial sequence
  synthetic polynucleotide sequence
cgcctgcagggcctgcaa

SEQ ID NO: 19476 - DNA, 20 bp, Artificial sequence
  synthetic polynucleotide sequence
accatcgcctccgaactcca

SEQ ID NO: 19477 - DNA, 22 bp, Artificial sequence
  synthetic polynucleotide sequence
ttcattgctgccctggaagaga

SEQ ID NO: 19478 - DNA, 18 bp, Artificial sequence
  synthetic polynucleotide sequence
aggaagaggccgccggga

SEQ ID NO: 19479 - DNA, 18 bp, Artificial sequence
  synthetic polynucleotide sequence
tgacacccaggggcggca

SEQ ID NO: 19480 - DNA, 18 bp, Artificial sequence
  synthetic polynucleotide sequence
cctcctcgagggccctca

SEQ ID NO: 19481 - DNA, 18 bp, Artificial sequence
  synthetic polynucleotide sequence
ccgggatcgcagggctca

SEQ ID NO: 19482 - DNA, 19 bp, Artificial sequence
  synthetic polynucleotide sequence
ctcgcttcctacgcgcgca

SEQ ID NO: 19483 - DNA, 20 bp, Artificial sequence
  synthetic polynucleotide sequence
tggcagaagactggtcccca

SEQ ID NO: 19484 - DNA, 20 bp, Artificial sequence
  synthetic polynucleotide sequence
cctgggaagactcctcccaa

SEQ ID NO: 19485 - DNA, 22 bp, Artificial sequence
  synthetic polynucleotide sequence
aacacaggcttcacagtggcaa

SEQ ID NO: 19486 - DNA, 22 bp, Artificial sequence
  synthetic polynucleotide sequence
ccatcaggtccagtactgcaca

SEQ ID NO: 19487 - DNA, 21 bp, Artificial sequence
  synthetic polynucleotide sequence
taccaccccctgatcctggaa

SEQ ID NO: 19488 - DNA, 21 bp, Artificial sequence
  synthetic polynucleotide sequence
gtgtatctcgtgccacagcca

SEQ ID NO: 19489 - DNA, 21 bp, Artificial sequence
  synthetic polynucleotide sequence
ctgtggaaccagtaggggcaa

SEQ ID NO: 19490 - DNA, 21 bp, Artificial sequence
  synthetic polynucleotide sequence
actgcctttcgccaaaggaga

SEQ ID NO: 19491 - DNA, 21 bp, Artificial sequence
  synthetic polynucleotide sequence
tgagcccacagagagacgaca

SEQ ID NO: 19492 - DNA, 18 bp, Artificial sequence
  synthetic polynucleotide sequence
atcgcggggtgctggcga

SEQ ID NO: 19493 - DNA, 17 bp, Artificial sequence
  synthetic polynucleotide sequence
cgccgccgacaggcaga

SEQ ID NO: 19494 - DNA, 21 bp, Artificial sequence
  synthetic polynucleotide sequence
gcgagagaaacaagtgcagga

SEQ ID NO: 19495 - DNA, 20 bp, Artificial sequence
  synthetic polynucleotide sequence
ctgctgccaccgagtcccta

SEQ ID NO: 19496 - DNA, 18 bp, Artificial sequence
  synthetic polynucleotide sequence
gtgggagtgccccaggca

SEQ ID NO: 19497 - DNA, 22 bp, Artificial sequence
  synthetic polynucleotide sequence
gatgggcaactggaaccaggaa

SEQ ID NO: 19498 - DNA, 21 bp, Artificial sequence
  synthetic polynucleotide sequence
agtgtccaaactgggaaggca

SEQ ID NO: 19499 - DNA, 19 bp, Artificial sequence
  synthetic polynucleotide sequence
ttcaccagggagcacccca

SEQ ID NO: 19500 - DNA, 20 bp, Artificial sequence
  synthetic polynucleotide sequence
gtggcagagagggcacagga

SEQ ID NO: 19501 - DNA, 21 bp, Artificial sequence
  synthetic polynucleotide sequence
gggacacaaacacccatcgga

SEQ ID NO: 19502 - DNA, 20 bp, Artificial sequence
  synthetic polynucleotide sequence
gctagaactccgtgagccca

SEQ ID NO: 19503 - DNA, 20 bp, Artificial sequence
  synthetic polynucleotide sequence
ggcaccggagcaggtagaga

SEQ ID NO: 19504 - DNA, 18 bp, Artificial sequence
  synthetic polynucleotide sequence
ggggctcagtggtgacca

SEQ ID NO: 19505 - DNA, 20 bp, Artificial sequence
  synthetic polynucleotide sequence
agccacaagtgactgggcca

SEQ ID NO: 19506 - DNA, 21 bp, Artificial sequence
  synthetic polynucleotide sequence
tggagcagtgctaggatggaa

SEQ ID NO: 19507 - DNA, 20 bp, Artificial sequence
  synthetic polynucleotide sequence
ctaagggcgtgctgggacca

SEQ ID NO: 19508 - DNA, 20 bp, Artificial sequence
  synthetic polynucleotide sequence
gtctgacccagttggcccca

SEQ ID NO: 19509 - DNA, 18 bp, Artificial sequence
  synthetic polynucleotide sequence
ggcaggatgtgcatgcca

SEQ ID NO: 19510 - DNA, 19 bp, Artificial sequence
  synthetic polynucleotide sequence
ttgtggcagacctcacaca

SEQ ID NO: 19511 - DNA, 21 bp, Artificial sequence
  synthetic polynucleotide sequence
tcaggcaagaaccccaacaca

SEQ ID NO: 19512 - DNA, 20 bp, Artificial sequence
  synthetic polynucleotide sequence
gtagaacagcgacgcctcca

SEQ ID NO: 19513 - DNA, 22 bp, Artificial sequence
  synthetic polynucleotide sequence
agcagaatctcccaaagggcca

SEQ ID NO: 19514 - DNA, 18 bp, Artificial sequence
  synthetic polynucleotide sequence
ggcatggggacggctgca

SEQ ID NO: 19515 - DNA, 20 bp, Artificial sequence
  synthetic polynucleotide sequence
ccagcttgagtccgggagca

SEQ ID NO: 19516 - DNA, 19 bp, Artificial sequence
  synthetic polynucleotide sequence
ggggtaaggaggcggggta

SEQ ID NO: 19517 - DNA, 19 bp, Artificial sequence
  synthetic polynucleotide sequence
tggagcaggagcaggtcca

SEQ ID NO: 19518 - DNA, 21 bp, Artificial sequence
  synthetic polynucleotide sequence
atcagagttcaaggggcagga

SEQ ID NO: 19519 - DNA, 22 bp, Artificial sequence
  synthetic polynucleotide sequence
tcatctacccatgaatcccgca

SEQ ID NO: 19520 - DNA, 20 bp, Artificial sequence
  synthetic polynucleotide sequence
tccttgtaccagaagcccca

SEQ ID NO: 19521 - DNA, 21 bp, Artificial sequence
  synthetic polynucleotide sequence
gggaggcagcagacttgggta

SEQ ID NO: 19522 - DNA, 20 bp, Artificial sequence
  synthetic polynucleotide sequence
cttccccggttcggaagtga

SEQ ID NO: 19523 - DNA, 20 bp, Artificial sequence
  synthetic polynucleotide sequence
ctctccgggggaaaaggcga

SEQ ID NO: 19524 - DNA, 21 bp, Artificial sequence
  synthetic polynucleotide sequence
tctgaaaacggcttgctgcga

SEQ ID NO: 19525 - DNA, 22 bp, Artificial sequence
  synthetic polynucleotide sequence
aaagcaggataaggctgccaga

SEQ ID NO: 19526 - DNA, 22 bp, Artificial sequence
  synthetic polynucleotide sequence
gaatcgcacatgaatgccagca

SEQ ID NO: 19527 - DNA, 21 bp, Artificial sequence
  synthetic polynucleotide sequence
cctgctcacctacaagcctga

SEQ ID NO: 19528 - DNA, 20 bp, Artificial sequence
  synthetic polynucleotide sequence
gcacggtcaagcactcggga

SEQ ID NO: 19529 - DNA, 21 bp, Artificial sequence
  synthetic polynucleotide sequence
tcttcccatggcgacctcaga

SEQ ID NO: 19530 - DNA, 19 bp, Artificial sequence
  synthetic polynucleotide sequence
gcccgaacgcttggtcgca

SEQ ID NO: 19531 - DNA, 21 bp, Artificial sequence
  synthetic polynucleotide sequence
gctgcttccaggagaagtgga

SEQ ID NO: 19532 - DNA, 20 bp, Artificial sequence
  synthetic polynucleotide sequence
aggctgggccacaaaaggga

SEQ ID NO: 19533 - DNA, 18 bp, Artificial sequence
  synthetic polynucleotide sequence
cagggcactgaggacgca

SEQ ID NO: 19534 - DNA, 18 bp, Artificial sequence
  synthetic polynucleotide sequence
gccctggcagagcgcaga

SEQ ID NO: 19535 - DNA, 19 bp, Artificial sequence
  synthetic polynucleotide sequence
ccatcgccagactcgccca

SEQ ID NO: 19536 - DNA, 20 bp, Artificial sequence
  synthetic polynucleotide sequence
cctgagctgggtgtgggaga

SEQ ID NO: 19537 - DNA, 21 bp, Artificial sequence
  synthetic polynucleotide sequence
agctgatccaagcccagcgaa

SEQ ID NO: 19538 - DNA, 19 bp, Artificial sequence
  synthetic polynucleotide sequence
ggaggccggctgactcaga

SEQ ID NO: 19539 - DNA, 20 bp, Artificial sequence
  synthetic polynucleotide sequence
gaaacccggctggagaggca

SEQ ID NO: 19540 - DNA, 20 bp, Artificial sequence
  synthetic polynucleotide sequence
gaggcggaggagcacaggga

SEQ ID NO: 19541 - DNA, 21 bp, Artificial sequence
  synthetic polynucleotide sequence
cggccgaaaagagtcccagga

SEQ ID NO: 19542 - DNA, 21 bp, Artificial sequence
  synthetic polynucleotide sequence
agctgagattcgctaggggga

SEQ ID NO: 19543 - DNA, 20 bp, Artificial sequence
  synthetic polynucleotide sequence
taccagagcttgggcagcca

SEQ ID NO: 19544 - DNA, 23 bp, Artificial sequence
  synthetic polynucleotide sequence
gcacatagagaggagagagacca

SEQ ID NO: 19545 - DNA, 20 bp, Artificial sequence
  synthetic polynucleotide sequence
ccctggaactctcgcagcca

SEQ ID NO: 19546 - DNA, 20 bp, Artificial sequence
  synthetic polynucleotide sequence
gcgctgctgggccctagaca

SEQ ID NO: 19547 - DNA, 18 bp, Artificial sequence
  synthetic polynucleotide sequence
cgaccactggcggctgga

SEQ ID NO: 19548 - DNA, 21 bp, Artificial sequence
  synthetic polynucleotide sequence
tgctgagcttgagggtggcca

SEQ ID NO: 19549 - DNA, 20 bp, Artificial sequence
  synthetic polynucleotide sequence
ctgtcgctgcagcgggagca

SEQ ID NO: 19550 - DNA, 20 bp, Artificial sequence
  synthetic polynucleotide sequence
gccgagtcggagtcgctgga

SEQ ID NO: 19551 - DNA, 18 bp, Artificial sequence
  synthetic polynucleotide sequence
ggccccgaacggagctga

SEQ ID NO: 19552 - DNA, 20 bp, Artificial sequence
  synthetic polynucleotide sequence
cttgaggtggtgccgcgtga

SEQ ID NO: 19553 - DNA, 20 bp, Artificial sequence
  synthetic polynucleotide sequence
tacactgaccaggctggaca

SEQ ID NO: 19554 - DNA, 18 bp, Artificial sequence
  synthetic polynucleotide sequence
tggacgaagatgcagcca

SEQ ID NO: 19555 - DNA, 22 bp, Artificial sequence
  synthetic polynucleotide sequence
aggagccttcctccaaaaggga

SEQ ID NO: 19556 - DNA, 22 bp, Artificial sequence
  synthetic polynucleotide sequence
tcgagcccaaaggtatggctga

SEQ ID NO: 19557 - DNA, 21 bp, Artificial sequence
  synthetic polynucleotide sequence
taggagcccagttgaagacca

SEQ ID NO: 19558 - DNA, 22 bp, Artificial sequence
  synthetic polynucleotide sequence
gtaaaaccaggccacagagaga

SEQ ID NO: 19559 - DNA, 21 bp, Artificial sequence
  synthetic polynucleotide sequence
acacagggacctcagtgtcaa

SEQ ID NO: 19560 - DNA, 20 bp, Artificial sequence
  synthetic polynucleotide sequence
atcagaaccctggaccggga

SEQ ID NO: 19561 - DNA, 21 bp, Artificial sequence
  synthetic polynucleotide sequence
cccgacgacatccaaagcaga

SEQ ID NO: 19562 - DNA, 19 bp, Artificial sequence
  synthetic polynucleotide sequence
gtcccgcggggtatgagga

SEQ ID NO: 19563 - DNA, 21 bp, Artificial sequence
  synthetic polynucleotide sequence
tacaggagtcagccatccaca

SEQ ID NO: 19564 - DNA, 18 bp, Artificial sequence
  synthetic polynucleotide sequence
tgggggtggtggcagcga

SEQ ID NO: 19565 - DNA, 21 bp, Artificial sequence
  synthetic polynucleotide sequence
gccgcggaggtatatgggaca

SEQ ID NO: 19566 - DNA, 21 bp, Artificial sequence
  synthetic polynucleotide sequence
ttgaaacgaccaggtggtgca

SEQ ID NO: 19567 - DNA, 20 bp, Artificial sequence
  synthetic polynucleotide sequence
aacgtccctagcacgaagca

SEQ ID NO: 19568 - DNA, 18 bp, Artificial sequence
  synthetic polynucleotide sequence
cggctgcccggttgagga

SEQ ID NO: 19569 - DNA, 22 bp, Artificial sequence
  synthetic polynucleotide sequence
tccagccagtgaagaagcctca

SEQ ID NO: 19570 - DNA, 22 bp, Artificial sequence
  synthetic polynucleotide sequence
ggaaggtgcattcaacgcgaca

SEQ ID NO: 19571 - DNA, 22 bp, Artificial sequence
  synthetic polynucleotide sequence
acctccaagcagcagagaagca

SEQ ID NO: 19572 - DNA, 21 bp, Artificial sequence
  synthetic polynucleotide sequence
ctcatccctcgaatccgagca

SEQ ID NO: 19573 - DNA, 18 bp, Artificial sequence
  synthetic polynucleotide sequence
gccgcccgaggtctacga

SEQ ID NO: 19574 - DNA, 18 bp, Artificial sequence
  synthetic polynucleotide sequence
tggccacgacgtcccgca

SEQ ID NO: 19575 - DNA, 21 bp, Artificial sequence
  synthetic polynucleotide sequence
caagtcctacgaagcccagga

SEQ ID NO: 19576 - DNA, 18 bp, Artificial sequence
  synthetic polynucleotide sequence
gccacgctgccaccagca

SEQ ID NO: 19577 - DNA, 21 bp, Artificial sequence
  synthetic polynucleotide sequence
gagactgattcaagctgccaa

SEQ ID NO: 19578 - DNA, 18 bp, Artificial sequence
  synthetic polynucleotide sequence
ccacagagcacatggcca

SEQ ID NO: 19579 - DNA, 22 bp, Artificial sequence
  synthetic polynucleotide sequence
tccagatggcaggcaagaagga

SEQ ID NO: 19580 - DNA, 20 bp, Artificial sequence
  synthetic polynucleotide sequence
tacaacgatgcctgagggga

SEQ ID NO: 19581 - DNA, 21 bp, Artificial sequence
  synthetic polynucleotide sequence
catgacggaccgcacatctga

SEQ ID NO: 19582 - DNA, 20 bp, Artificial sequence
  synthetic polynucleotide sequence
taagggcaagtgagacctca

SEQ ID NO: 19583 - DNA, 21 bp, Artificial sequence
  synthetic polynucleotide sequence
gggcatgggggactgaaagga

SEQ ID NO: 19584 - DNA, 21 bp, Artificial sequence
  synthetic polynucleotide sequence
ggagccaatgtccacgtccca

SEQ ID NO: 19585 - DNA, 20 bp, Artificial sequence
  synthetic polynucleotide sequence
cacaggtactaccgaccgga

SEQ ID NO: 19586 - DNA, 21 bp, Artificial sequence
  synthetic polynucleotide sequence
cggctaaacatccactgagca

SEQ ID NO: 19587 - DNA, 19 bp, Artificial sequence
  synthetic polynucleotide sequence
cacctggggaagctgggga

SEQ ID NO: 19588 - DNA, 21 bp, Artificial sequence
  synthetic polynucleotide sequence
agtggagtctcaagggtgaca

SEQ ID NO: 19589 - DNA, 18 bp, Artificial sequence
  synthetic polynucleotide sequence
ccctgcaggagcagccaa

SEQ ID NO: 19590 - DNA, 19 bp, Artificial sequence
  synthetic polynucleotide sequence
acaacgtcccacggagcca

SEQ ID NO: 19591 - DNA, 23 bp, Artificial sequence
  synthetic polynucleotide sequence
ggccagtggagaagttggaacca

SEQ ID NO: 19592 - DNA, 25 bp, Artificial sequence
  synthetic polynucleotide sequence
acagtcagaaacactgagaagcgga

SEQ ID NO: 19593 - DNA, 21 bp, Artificial sequence
  synthetic polynucleotide sequence
tgcagagcttccgagaccaca

SEQ ID NO: 19594 - DNA, 22 bp, Artificial sequence
  synthetic polynucleotide sequence
aactcagagaggaaatgcccca

SEQ ID NO: 19595 - DNA, 22 bp, Artificial sequence
  synthetic polynucleotide sequence
atcttgaacagaggtcccggaa

SEQ ID NO: 19596 - DNA, 21 bp, Artificial sequence
  synthetic polynucleotide sequence
gtcagagctggaactgtccca

SEQ ID NO: 19597 - DNA, 19 bp, Artificial sequence
  synthetic polynucleotide sequence
ggtcaggtccccagcgtga

SEQ ID NO: 19598 - DNA, 18 bp, Artificial sequence
  synthetic polynucleotide sequence
gcgctcctgctcagccca

SEQ ID NO: 19599 - DNA, 19 bp, Artificial sequence
  synthetic polynucleotide sequence
gaggctgtgaggaggcaca

SEQ ID NO: 19600 - DNA, 18 bp, Artificial sequence
  synthetic polynucleotide sequence
tgtagagtgcgcaggcca

SEQ ID NO: 19601 - DNA, 20 bp, Artificial sequence
  synthetic polynucleotide sequence
cacagcagcgactggcccaa

SEQ ID NO: 19602 - DNA, 20 bp, Artificial sequence
  synthetic polynucleotide sequence
tagccaaagccatcacacca

SEQ ID NO: 19603 - DNA, 22 bp, Artificial sequence
  synthetic polynucleotide sequence
cataagcagggaacaaagccga

SEQ ID NO: 19604 - DNA, 20 bp, Artificial sequence
  synthetic polynucleotide sequence
ccttggtgagcgtcagggca

SEQ ID NO: 19605 - DNA, 22 bp, Artificial sequence
  synthetic polynucleotide sequence
cagagagggaggacaacaggaa

SEQ ID NO: 19606 - DNA, 20 bp, Artificial sequence
  synthetic polynucleotide sequence
cggaaccacacgcgcctcga

SEQ ID NO: 19607 - DNA, 22 bp, Artificial sequence
  synthetic polynucleotide sequence
tatggatccccatgaagcccta

SEQ ID NO: 19608 - DNA, 19 bp, Artificial sequence
  synthetic polynucleotide sequence
gaccaggagcaggcgctga

SEQ ID NO: 19609 - DNA, 20 bp, Artificial sequence
  synthetic polynucleotide sequence
aggaggatcagcagcgcaca

SEQ ID NO: 19610 - DNA, 21 bp, Artificial sequence
  synthetic polynucleotide sequence
acaacaaaagggggtgcccca

SEQ ID NO: 19611 - DNA, 22 bp, Artificial sequence
  synthetic polynucleotide sequence
atggacacagtcacagggccaa

SEQ ID NO: 19612 - DNA, 21 bp, Artificial sequence
  synthetic polynucleotide sequence
caaagcaggaagtgcagggga

SEQ ID NO: 19613 - DNA, 20 bp, Artificial sequence
  synthetic polynucleotide sequence
ctcggaatagatgctgcgca

SEQ ID NO: 19614 - DNA, 21 bp, Artificial sequence
  synthetic polynucleotide sequence
gcatgagggggtcttcaggaa

SEQ ID NO: 19615 - DNA, 18 bp, Artificial sequence
  synthetic polynucleotide sequence
cgagaggatggggcagca

SEQ ID NO: 19616 - DNA, 18 bp, Artificial sequence
  synthetic polynucleotide sequence
tagcaccgcctccaggca

SEQ ID NO: 19617 - DNA, 20 bp, Artificial sequence
  synthetic polynucleotide sequence
accccagagacaggaccaga

SEQ ID NO: 19618 - DNA, 18 bp, Artificial sequence
  synthetic polynucleotide sequence
aaggcactgtccagcgca

SEQ ID NO: 19619 - DNA, 20 bp, Artificial sequence
  synthetic polynucleotide sequence
cagaagtcaccggcccccaa

SEQ ID NO: 19620 - DNA, 20 bp, Artificial sequence
  synthetic polynucleotide sequence
ctggtagcaggggtagggga

SEQ ID NO: 19621 - DNA, 21 bp, Artificial sequence
  synthetic polynucleotide sequence
atgcgtcaccatagccatcca

SEQ ID NO: 19622 - DNA, 22 bp, Artificial sequence
  synthetic polynucleotide sequence
aagataccgacagagctcagca

SEQ ID NO: 19623 - DNA, 20 bp, Artificial sequence
  synthetic polynucleotide sequence
tcccagtcaatcgcaggcca

SEQ ID NO: 19624 - DNA, 20 bp, Artificial sequence
  synthetic polynucleotide sequence
attggccaggtccaggagca

SEQ ID NO: 19625 - DNA, 20 bp, Artificial sequence
  synthetic polynucleotide sequence
tgactgtggcggcgggtgga

SEQ ID NO: 19626 - DNA, 20 bp, Artificial sequence
  synthetic polynucleotide sequence
gaggtacagtagggtccaca

SEQ ID NO: 19627 - DNA, 20 bp, Artificial sequence
  synthetic polynucleotide sequence
gggaggagctggtagggaga

SEQ ID NO: 19628 - DNA, 20 bp, Artificial sequence
  synthetic polynucleotide sequence
aaatgggcctgggacggaga

SEQ ID NO: 19629 - DNA, 21 bp, Artificial sequence
  synthetic polynucleotide sequence
tgactccaagagaagcccaga

SEQ ID NO: 19630 - DNA, 19 bp, Artificial sequence
  synthetic polynucleotide sequence
tcccaagtagcagccccca

SEQ ID NO: 19631 - DNA, 21 bp, Artificial sequence
  synthetic polynucleotide sequence
agcgctgactctacagccaca

SEQ ID NO: 19632 - DNA, 18 bp, Artificial sequence
  synthetic polynucleotide sequence
acagctggctggacagca

SEQ ID NO: 19633 - DNA, 20 bp, Artificial sequence
  synthetic polynucleotide sequence
tgtgacgatgaggaggggga

SEQ ID NO: 19634 - DNA, 19 bp, Artificial sequence
  synthetic polynucleotide sequence
gtggcggctggtcagtgga

SEQ ID NO: 19635 - DNA, 18 bp, Artificial sequence
  synthetic polynucleotide sequence
cctgaggagggcccacga

SEQ ID NO: 19636 - DNA, 20 bp, Artificial sequence
  synthetic polynucleotide sequence
accggccagttgaagtgcga

SEQ ID NO: 19637 - DNA, 21 bp, Artificial sequence
  synthetic polynucleotide sequence
ccctccaccagcactcagaga

SEQ ID NO: 19638 - DNA, 22 bp, Artificial sequence
  synthetic polynucleotide sequence
agaagtgaaatccccaggtcca

SEQ ID NO: 19639 - DNA, 20 bp, Artificial sequence
  synthetic polynucleotide sequence
atgacagaccgcaaccggga

SEQ ID NO: 19640 - DNA, 22 bp, Artificial sequence
  synthetic polynucleotide sequence
attgccagggttcacacaagga

SEQ ID NO: 19641 - DNA, 22 bp, Artificial sequence
  synthetic polynucleotide sequence
acaaccatgatgccagaggaga

SEQ ID NO: 19642 - DNA, 19 bp, Artificial sequence
  synthetic polynucleotide sequence
tttctgggatggcgaccaa

SEQ ID NO: 19643 - DNA, 22 bp, Artificial sequence
  synthetic polynucleotide sequence
gtagaacccctgggaataagca

SEQ ID NO: 19644 - DNA, 20 bp, Artificial sequence
  synthetic polynucleotide sequence
gactgacggggaggagagaa

SEQ ID NO: 19645 - DNA, 21 bp, Artificial sequence
  synthetic polynucleotide sequence
ggactggatcaacaccgggga

SEQ ID NO: 19646 - DNA, 18 bp, Artificial sequence
  synthetic polynucleotide sequence
gtgacccactccggggga

SEQ ID NO: 19647 - DNA, 18 bp, Artificial sequence
  synthetic polynucleotide sequence
ccgccacaggcctggtga

SEQ ID NO: 19648 - DNA, 18 bp, Artificial sequence
  synthetic polynucleotide sequence
ggctggaggccccactca

SEQ ID NO: 19649 - DNA, 20 bp, Artificial sequence
  synthetic polynucleotide sequence
atcctaagggccgccacaca

SEQ ID NO: 19650 - DNA, 19 bp, Artificial sequence
  synthetic polynucleotide sequence
ctcggtcttccagccggca

SEQ ID NO: 19651 - DNA, 20 bp, Artificial sequence
  synthetic polynucleotide sequence
tgtgctcggggacccagaga

SEQ ID NO: 19652 - DNA, 21 bp, Artificial sequence
  synthetic polynucleotide sequence
ggagtccaggagccttaggaa

SEQ ID NO: 19653 - DNA, 21 bp, Artificial sequence
  synthetic polynucleotide sequence
gccaaccagtgcctctcccaa

SEQ ID NO: 19654 - DNA, 22 bp, Artificial sequence
  synthetic polynucleotide sequence
aaacaggaccccatgttcagga

SEQ ID NO: 19655 - DNA, 21 bp, Artificial sequence
  synthetic polynucleotide sequence
tgcaggataccaaggctccca

SEQ ID NO: 19656 - DNA, 22 bp, Artificial sequence
  synthetic polynucleotide sequence
atctgctaataggccaggtcca

SEQ ID NO: 19657 - DNA, 22 bp, Artificial sequence
  synthetic polynucleotide sequence
tgaagacacagctggatcacga

SEQ ID NO: 19658 - DNA, 20 bp, Artificial sequence
  synthetic polynucleotide sequence
tggctcaggaacatccccca

SEQ ID NO: 19659 - DNA, 20 bp, Artificial sequence
  synthetic polynucleotide sequence
gagagggagagggagatgga

SEQ ID NO: 19660 - DNA, 20 bp, Artificial sequence
  synthetic polynucleotide sequence
ggattggagggacagggaga

SEQ ID NO: 19661 - DNA, 20 bp, Artificial sequence
  synthetic polynucleotide sequence
ctgaacgacaagcacctgga

SEQ ID NO: 19662 - DNA, 20 bp, Artificial sequence
  synthetic polynucleotide sequence
ctgggcacgaccctgtctca

SEQ ID NO: 19663 - DNA, 20 bp, Artificial sequence
  synthetic polynucleotide sequence
ggacgccgcctcctaccgaa

SEQ ID NO: 19664 - DNA, 20 bp, Artificial sequence
  synthetic polynucleotide sequence
gatgtagctgccagggacca

SEQ ID NO: 19665 - DNA, 20 bp, Artificial sequence
  synthetic polynucleotide sequence
agtcggagctccaggaggaa

SEQ ID NO: 19666 - DNA, 20 bp, Artificial sequence
  synthetic polynucleotide sequence
gggcctcacaatggagacca

SEQ ID NO: 19667 - DNA, 21 bp, Artificial sequence
  synthetic polynucleotide sequence
aagaggaggcgaacagagaga

SEQ ID NO: 19668 - DNA, 20 bp, Artificial sequence
  synthetic polynucleotide sequence
atttctgccaaggcgactga

SEQ ID NO: 19669 - DNA, 18 bp, Artificial sequence
  synthetic polynucleotide sequence
gaaccgggacggacagca

SEQ ID NO: 19670 - DNA, 18 bp, Artificial sequence
  synthetic polynucleotide sequence
ccctcattctggcccaga

SEQ ID NO: 19671 - DNA, 20 bp, Artificial sequence
  synthetic polynucleotide sequence
ccgagggaggggcagaagca

SEQ ID NO: 19672 - DNA, 20 bp, Artificial sequence
  synthetic polynucleotide sequence
agcccggcctcccaggtaca

SEQ ID NO: 19673 - DNA, 21 bp, Artificial sequence
  synthetic polynucleotide sequence
ctccagcaaagccaaccctca

SEQ ID NO: 19674 - DNA, 21 bp, Artificial sequence
  synthetic polynucleotide sequence
tccccacacctgtctcaacca

SEQ ID NO: 19675 - DNA, 21 bp, Artificial sequence
  synthetic polynucleotide sequence
atccggactcagaccaagcca

SEQ ID NO: 19676 - DNA, 20 bp, Artificial sequence
  synthetic polynucleotide sequence
tatgtgggtgcagaactgga

SEQ ID NO: 19677 - DNA, 19 bp, Artificial sequence
  synthetic polynucleotide sequence
cgcgcaggatggcaggcaa

SEQ ID NO: 19678 - DNA, 21 bp, Artificial sequence
  synthetic polynucleotide sequence
caacaggcactcatcaccgca

SEQ ID NO: 19679 - DNA, 20 bp, Artificial sequence
  synthetic polynucleotide sequence
aaaggccgcgtgaacagcca

SEQ ID NO: 19680 - DNA, 19 bp, Artificial sequence
  synthetic polynucleotide sequence
gcagcagaggtggcaggga

SEQ ID NO: 19681 - DNA, 18 bp, Artificial sequence
  synthetic polynucleotide sequence
agacctcccagcgccgca

SEQ ID NO: 19682 - DNA, 18 bp, Artificial sequence
  synthetic polynucleotide sequence
ggctctgacgtggcggga

SEQ ID NO: 19683 - DNA, 20 bp, Artificial sequence
  synthetic polynucleotide sequence
aacctccagtggcgcacaca

SEQ ID NO: 19684 - DNA, 20 bp, Artificial sequence
  synthetic polynucleotide sequence
tccagcaatccaccttggca

SEQ ID NO: 19685 - DNA, 18 bp, Artificial sequence
  synthetic polynucleotide sequence
cgcccccacgcagcacca

SEQ ID NO: 19686 - DNA, 23 bp, Artificial sequence
  synthetic polynucleotide sequence
cagagcggatctgaaatacccaa

SEQ ID NO: 19687 - DNA, 20 bp, Artificial sequence
  synthetic polynucleotide sequence
cctcgccatgcagacgggaa

SEQ ID NO: 19688 - DNA, 20 bp, Artificial sequence
  synthetic polynucleotide sequence
ggacaaggaggcctgaccca

SEQ ID NO: 19689 - DNA, 21 bp, Artificial sequence
  synthetic polynucleotide sequence
gctaggcctggatgagagaga

SEQ ID NO: 19690 - DNA, 21 bp, Artificial sequence
  synthetic polynucleotide sequence
cattgtgctccgagtcaggga

SEQ ID NO: 19691 - DNA, 20 bp, Artificial sequence
  synthetic polynucleotide sequence
cgcctgtacctcacccccga

SEQ ID NO: 19692 - DNA, 20 bp, Artificial sequence
  synthetic polynucleotide sequence
attgcagctggaggagtcca

SEQ ID NO: 19693 - DNA, 21 bp, Artificial sequence
  synthetic polynucleotide sequence
atgtgagcgtggaggaggaga

SEQ ID NO: 19694 - DNA, 20 bp, Artificial sequence
  synthetic polynucleotide sequence
cacatcactgcggtggccca

SEQ ID NO: 19695 - DNA, 22 bp, Artificial sequence
  synthetic polynucleotide sequence
acaagtacaccaagagcagcca

SEQ ID NO: 19696 - DNA, 21 bp, Artificial sequence
  synthetic polynucleotide sequence
atgcatggcagagcttgggca

SEQ ID NO: 19697 - DNA, 21 bp, Artificial sequence
  synthetic polynucleotide sequence
ggcgacaggatagaccaagca

SEQ ID NO: 19698 - DNA, 19 bp, Artificial sequence
  synthetic polynucleotide sequence
tgcagtgagggttcagcca

SEQ ID NO: 19699 - DNA, 20 bp, Artificial sequence
  synthetic polynucleotide sequence
agagcgggcctgccctccaa

SEQ ID NO: 19700 - DNA, 20 bp, Artificial sequence
  synthetic polynucleotide sequence
acgcttgggcatgcagcgca

SEQ ID NO: 19701 - DNA, 20 bp, Artificial sequence
  synthetic polynucleotide sequence
aaggggcctggagagtcaca

SEQ ID NO: 19702 - DNA, 21 bp, Artificial sequence
  synthetic polynucleotide sequence
agtccttgaagactggccaca

SEQ ID NO: 19703 - DNA, 20 bp, Artificial sequence
  synthetic polynucleotide sequence
ccgagggagacgacttacca

SEQ ID NO: 19704 - DNA, 21 bp, Artificial sequence
  synthetic polynucleotide sequence
ttggtgaaggggctctgagga

SEQ ID NO: 19705 - DNA, 22 bp, Artificial sequence
  synthetic polynucleotide sequence
aaaccagagcacagacagagca

SEQ ID NO: 19706 - DNA, 20 bp, Artificial sequence
  synthetic polynucleotide sequence
tcggggaggctgacggtgga

SEQ ID NO: 19707 - DNA, 21 bp, Artificial sequence
  synthetic polynucleotide sequence
gtacaggaagggatggctgga

SEQ ID NO: 19708 - DNA, 20 bp, Artificial sequence
  synthetic polynucleotide sequence
atgcccagtcacctgctgga

SEQ ID NO: 19709 - DNA, 21 bp, Artificial sequence
  synthetic polynucleotide sequence
gaaggtggtgaagacccacga

SEQ ID NO: 19710 - DNA, 20 bp, Artificial sequence
  synthetic polynucleotide sequence
tgggcacctgaggtggagga

SEQ ID NO: 19711 - DNA, 18 bp, Artificial sequence
  synthetic polynucleotide sequence
cgcggggactgcacgaca

SEQ ID NO: 19712 - DNA, 20 bp, Artificial sequence
  synthetic polynucleotide sequence
atccagaaccaacagctgga

SEQ ID NO: 19713 - DNA, 21 bp, Artificial sequence
  synthetic polynucleotide sequence
tccgaagccccaccaaaagca

SEQ ID NO: 19714 - DNA, 21 bp, Artificial sequence
  synthetic polynucleotide sequence
agccaggtgaccactagagga

SEQ ID NO: 19715 - DNA, 22 bp, Artificial sequence
  synthetic polynucleotide sequence
tgaagctgcagaatgccagcaa

SEQ ID NO: 19716 - DNA, 20 bp, Artificial sequence
  synthetic polynucleotide sequence
ggttaactccccaacgccca

SEQ ID NO: 19717 - DNA, 21 bp, Artificial sequence
  synthetic polynucleotide sequence
tgctggcaagctgcaccctga

SEQ ID NO: 19718 - DNA, 19 bp, Artificial sequence
  synthetic polynucleotide sequence
tccagtgcttgcaccagga

SEQ ID NO: 19719 - DNA, 21 bp, Artificial sequence
  synthetic polynucleotide sequence
agactgccagcacctgagcta

SEQ ID NO: 19720 - DNA, 21 bp, Artificial sequence
  synthetic polynucleotide sequence
atagccatacagggcatccca

SEQ ID NO: 19721 - DNA, 20 bp, Artificial sequence
  synthetic polynucleotide sequence
atcgctgcccgtgatagcca

SEQ ID NO: 19722 - DNA, 19 bp, Artificial sequence
  synthetic polynucleotide sequence
cgcaccggcctcttgagga

SEQ ID NO: 19723 - DNA, 18 bp, Artificial sequence
  synthetic polynucleotide sequence
gtggacggacgccgtgca

SEQ ID NO: 19724 - DNA, 20 bp, Artificial sequence
  synthetic polynucleotide sequence
atactggatctcggcccgca

SEQ ID NO: 19725 - DNA, 21 bp, Artificial sequence
  synthetic polynucleotide sequence
atggactccatcccactggaa

SEQ ID NO: 19726 - DNA, 20 bp, Artificial sequence
  synthetic polynucleotide sequence
gtaggggatgcagccgtgga

SEQ ID NO: 19727 - DNA, 21 bp, Artificial sequence
  synthetic polynucleotide sequence
cgccacacaacagcacgcaca

SEQ ID NO: 19728 - DNA, 18 bp, Artificial sequence
  synthetic polynucleotide sequence
cgctgtccagcgaggcca

SEQ ID NO: 19729 - DNA, 21 bp, Artificial sequence
  synthetic polynucleotide sequence
caggatgatggaggatgcgga

SEQ ID NO: 19730 - DNA, 19 bp, Artificial sequence
  synthetic polynucleotide sequence
ggctcgctgcaggagctca

SEQ ID NO: 19731 - DNA, 18 bp, Artificial sequence
  synthetic polynucleotide sequence
tcccaagctcagtcccca

SEQ ID NO: 19732 - DNA, 18 bp, Artificial sequence
  synthetic polynucleotide sequence
gcagcgtgggacttcaca

SEQ ID NO: 19733 - DNA, 21 bp, Artificial sequence
  synthetic polynucleotide sequence
tgccagaagaagacccggcca

SEQ ID NO: 19734 - DNA, 20 bp, Artificial sequence
  synthetic polynucleotide sequence
aattcgggggtctcaggcga

SEQ ID NO: 19735 - DNA, 18 bp, Artificial sequence
  synthetic polynucleotide sequence
tgtcgggcgcgggttcga

SEQ ID NO: 19736 - DNA, 18 bp, Artificial sequence
  synthetic polynucleotide sequence
tggtcgggtcgctgcgga

SEQ ID NO: 19737 - DNA, 21 bp, Artificial sequence
  synthetic polynucleotide sequence
agaccttccacaaacagccga

SEQ ID NO: 19738 - DNA, 18 bp, Artificial sequence
  synthetic polynucleotide sequence
cgtccagggagcgcagga

SEQ ID NO: 19739 - DNA, 21 bp, Artificial sequence
  synthetic polynucleotide sequence
gcccaacctccacttgcagca

SEQ ID NO: 19740 - DNA, 19 bp, Artificial sequence
  synthetic polynucleotide sequence
tgagaagaagcgcagtcca

SEQ ID NO: 19741 - DNA, 19 bp, Artificial sequence
  synthetic polynucleotide sequence
caaggccagtccccagcca

SEQ ID NO: 19742 - DNA, 20 bp, Artificial sequence
  synthetic polynucleotide sequence
tcaagcccagaccgtgagga

SEQ ID NO: 19743 - DNA, 21 bp, Artificial sequence
  synthetic polynucleotide sequence
acccaacccagtgcacaagga

SEQ ID NO: 19744 - DNA, 21 bp, Artificial sequence
  synthetic polynucleotide sequence
tctcacggtggcgtatggaca

SEQ ID NO: 19745 - DNA, 21 bp, Artificial sequence
  synthetic polynucleotide sequence
tctgaaaagaatcggggccca

SEQ ID NO: 19746 - DNA, 19 bp, Artificial sequence
  synthetic polynucleotide sequence
ggggccttcagcagtgcca

SEQ ID NO: 19747 - DNA, 21 bp, Artificial sequence
  synthetic polynucleotide sequence
tcagctgtgggactacgacca

SEQ ID NO: 19748 - DNA, 18 bp, Artificial sequence
  synthetic polynucleotide sequence
aggccagcccgtacccca

SEQ ID NO: 19749 - DNA, 19 bp, Artificial sequence
  synthetic polynucleotide sequence
cctcagagctggcagggca

SEQ ID NO: 19750 - DNA, 19 bp, Artificial sequence
  synthetic polynucleotide sequence
tcgaagtcagaggcgtcca

SEQ ID NO: 19751 - DNA, 20 bp, Artificial sequence
  synthetic polynucleotide sequence
gagatgggaaacggggcgga

SEQ ID NO: 19752 - DNA, 20 bp, Artificial sequence
  synthetic polynucleotide sequence
gcaggaaggtcagcagcgca

SEQ ID NO: 19753 - DNA, 20 bp, Artificial sequence
  synthetic polynucleotide sequence
gccggaagcgctacgagcca

SEQ ID NO: 19754 - DNA, 20 bp, Artificial sequence
  synthetic polynucleotide sequence
ccgacacttcgggcagtgga

SEQ ID NO: 19755 - DNA, 20 bp, Artificial sequence
  synthetic polynucleotide sequence
tactgtgccccaaccgccta

SEQ ID NO: 19756 - DNA, 21 bp, Artificial sequence
  synthetic polynucleotide sequence
cgatggaccacagcttctgga

SEQ ID NO: 19757 - DNA, 19 bp, Artificial sequence
  synthetic polynucleotide sequence
gaatgggcagcggcgagga

SEQ ID NO: 19758 - DNA, 20 bp, Artificial sequence
  synthetic polynucleotide sequence
gcaaagccagctccggtcca

SEQ ID NO: 19759 - DNA, 19 bp, Artificial sequence
  synthetic polynucleotide sequence
gcagataccccagctccca

SEQ ID NO: 19760 - DNA, 20 bp, Artificial sequence
  synthetic polynucleotide sequence
cagagctgacatcaccgtca

SEQ ID NO: 19761 - DNA, 18 bp, Artificial sequence
  synthetic polynucleotide sequence
ctccctgtcggcacccca

SEQ ID NO: 19762 - DNA, 19 bp, Artificial sequence
  synthetic polynucleotide sequence
ggggagtgggtgtgaggga

SEQ ID NO: 19763 - DNA, 19 bp, Artificial sequence
  synthetic polynucleotide sequence
cgcgactcccacgcagaca

SEQ ID NO: 19764 - DNA, 19 bp, Artificial sequence
  synthetic polynucleotide sequence
taagagcgtctgagggcga

SEQ ID NO: 19765 - DNA, 20 bp, Artificial sequence
  synthetic polynucleotide sequence
gaggtgctgcaagccctgga

SEQ ID NO: 19766 - DNA, 18 bp, Artificial sequence
  synthetic polynucleotide sequence
gcgcccagcagtcccaca

SEQ ID NO: 19767 - DNA, 20 bp, Artificial sequence
  synthetic polynucleotide sequence
ggatccacttgaacaagcaa

SEQ ID NO: 19768 - DNA, 20 bp, Artificial sequence
  synthetic polynucleotide sequence
tgaagctgcacctctgtcca

SEQ ID NO: 19769 - DNA, 23 bp, Artificial sequence
  synthetic polynucleotide sequence
gtagaagcaggagattccagaga

SEQ ID NO: 19770 - DNA, 23 bp, Artificial sequence
  synthetic polynucleotide sequence
gaaactgcaagatcagagcagca

SEQ ID NO: 19771 - DNA, 21 bp, Artificial sequence
  synthetic polynucleotide sequence
aggatgagcgcatggagctca

SEQ ID NO: 19772 - DNA, 21 bp, Artificial sequence
  synthetic polynucleotide sequence
ggggcgtgcaaggaagaacca

SEQ ID NO: 19773 - DNA, 21 bp, Artificial sequence
  synthetic polynucleotide sequence
acaggtgggtacagatgagga

SEQ ID NO: 19774 - DNA, 21 bp, Artificial sequence
  synthetic polynucleotide sequence
gcccagatagaagggctggga

SEQ ID NO: 19775 - DNA, 20 bp, Artificial sequence
  synthetic polynucleotide sequence
aagcctgccgagccatggta

SEQ ID NO: 19776 - DNA, 21 bp, Artificial sequence
  synthetic polynucleotide sequence
aagcggtcgaggattcagcga

SEQ ID NO: 19777 - DNA, 20 bp, Artificial sequence
  synthetic polynucleotide sequence
ctgaggcatcagccatcgaa

SEQ ID NO: 19778 - DNA, 21 bp, Artificial sequence
  synthetic polynucleotide sequence
gaagtcaagcctcagagggca

SEQ ID NO: 19779 - DNA, 22 bp, Artificial sequence
  synthetic polynucleotide sequence
aaaccaacagctgtgctccaca

SEQ ID NO: 19780 - DNA, 18 bp, Artificial sequence
  synthetic polynucleotide sequence
cagctgtcctggggccca

SEQ ID NO: 19781 - DNA, 20 bp, Artificial sequence
  synthetic polynucleotide sequence
ctccagcatctcccacccca

SEQ ID NO: 19782 - DNA, 18 bp, Artificial sequence
  synthetic polynucleotide sequence
cgcagctcccactcgcca

SEQ ID NO: 19783 - DNA, 21 bp, Artificial sequence
  synthetic polynucleotide sequence
gcgagacatggtcagcagcca

SEQ ID NO: 19784 - DNA, 20 bp, Artificial sequence
  synthetic polynucleotide sequence
gtcagccacagaggggctca

SEQ ID NO: 19785 - DNA, 20 bp, Artificial sequence
  synthetic polynucleotide sequence
gagtacaggtcagcgctgca

SEQ ID NO: 19786 - DNA, 22 bp, Artificial sequence
  synthetic polynucleotide sequence
cattgaaagccaggctggagca

SEQ ID NO: 19787 - DNA, 19 bp, Artificial sequence
  synthetic polynucleotide sequence
gtgggagccaggctccgaa

SEQ ID NO: 19788 - DNA, 21 bp, Artificial sequence
  synthetic polynucleotide sequence
cgtactccaggtgctccagga

SEQ ID NO: 19789 - DNA, 21 bp, Artificial sequence
  synthetic polynucleotide sequence
atgccagccccaaaaccagca

SEQ ID NO: 19790 - DNA, 21 bp, Artificial sequence
  synthetic polynucleotide sequence
ttggtaggacaggcgcttgga

SEQ ID NO: 19791 - DNA, 20 bp, Artificial sequence
  synthetic polynucleotide sequence
ctggtggcgggaacgtctca

SEQ ID NO: 19792 - DNA, 19 bp, Artificial sequence
  synthetic polynucleotide sequence
ctccgcagctccatcgcca

SEQ ID NO: 19793 - DNA, 19 bp, Artificial sequence
  synthetic polynucleotide sequence
tccatggtccagaagtgca

SEQ ID NO: 19794 - DNA, 21 bp, Artificial sequence
  synthetic polynucleotide sequence
cctgactccacaccttcagca

SEQ ID NO: 19795 - DNA, 19 bp, Artificial sequence
  synthetic polynucleotide sequence
gttctcccggagagcccca

SEQ ID NO: 19796 - DNA, 19 bp, Artificial sequence
  synthetic polynucleotide sequence
gcatccctcgctggcagga

SEQ ID NO: 19797 - DNA, 21 bp, Artificial sequence
  synthetic polynucleotide sequence
gcagcagagccatctccccta

SEQ ID NO: 19798 - DNA, 21 bp, Artificial sequence
  synthetic polynucleotide sequence
agggaagagggaggaactgca

SEQ ID NO: 19799 - DNA, 20 bp, Artificial sequence
  synthetic polynucleotide sequence
gccctagaaaatcgaagcca

SEQ ID NO: 19800 - DNA, 19 bp, Artificial sequence
  synthetic polynucleotide sequence
agggcagcagacaaaacca

SEQ ID NO: 19801 - DNA, 22 bp, Artificial sequence
  synthetic polynucleotide sequence
atgacgaccattacaaccggca

SEQ ID NO: 19802 - DNA, 20 bp, Artificial sequence
  synthetic polynucleotide sequence
tagggggagcaagaagggga

SEQ ID NO: 19803 - DNA, 18 bp, Artificial sequence
  synthetic polynucleotide sequence
gctggaacgcggacggga

SEQ ID NO: 19804 - DNA, 18 bp, Artificial sequence
  synthetic polynucleotide sequence
aatggcgcacccgggcca

SEQ ID NO: 19805 - DNA, 21 bp, Artificial sequence
  synthetic polynucleotide sequence
ccgacactgaaagacaaggca

SEQ ID NO: 19806 - DNA, 21 bp, Artificial sequence
  synthetic polynucleotide sequence
tgtcagtagaaccccagcaca

SEQ ID NO: 19807 - DNA, 20 bp, Artificial sequence
  synthetic polynucleotide sequence
caagaccctggagcaagcca

SEQ ID NO: 19808 - DNA, 20 bp, Artificial sequence
  synthetic polynucleotide sequence
tgctctgccccaagccccca

SEQ ID NO: 19809 - DNA, 21 bp, Artificial sequence
  synthetic polynucleotide sequence
caggcatcaccaccttcccaa

SEQ ID NO: 19810 - DNA, 21 bp, Artificial sequence
  synthetic polynucleotide sequence
gctgcctctgaaaggcctgga

SEQ ID NO: 19811 - DNA, 22 bp, Artificial sequence
  synthetic polynucleotide sequence
agaagccaccacttcagatgga

SEQ ID NO: 19812 - DNA, 21 bp, Artificial sequence
  synthetic polynucleotide sequence
aagatgaagacgcaggtggga

SEQ ID NO: 19813 - DNA, 23 bp, Artificial sequence
  synthetic polynucleotide sequence
cagctccacaacaaatcgcagca

SEQ ID NO: 19814 - DNA, 21 bp, Artificial sequence
  synthetic polynucleotide sequence
cccgagagaaggcattggaga

SEQ ID NO: 19815 - DNA, 23 bp, Artificial sequence
  synthetic polynucleotide sequence
ctaaaaaatgactccccgctgga

SEQ ID NO: 19816 - DNA, 21 bp, Artificial sequence
  synthetic polynucleotide sequence
tcagacagagcagggttgaca

SEQ ID NO: 19817 - DNA, 20 bp, Artificial sequence
  synthetic polynucleotide sequence
gacggtcgacaggtggcgaa

SEQ ID NO: 19818 - DNA, 20 bp, Artificial sequence
  synthetic polynucleotide sequence
gtgcagggcagcttgacgga

SEQ ID NO: 19819 - DNA, 22 bp, Artificial sequence
  synthetic polynucleotide sequence
ggaagaggccccaaaattgcca

SEQ ID NO: 19820 - DNA, 22 bp, Artificial sequence
  synthetic polynucleotide sequence
aaatagtaggcatcccgcctca

SEQ ID NO: 19821 - DNA, 21 bp, Artificial sequence
  synthetic polynucleotide sequence
gtgagcaccgaacgtgagaga

SEQ ID NO: 19822 - DNA, 22 bp, Artificial sequence
  synthetic polynucleotide sequence
atcgtcctgcctgacatcagga

SEQ ID NO: 19823 - DNA, 21 bp, Artificial sequence
  synthetic polynucleotide sequence
gatacagacgcagcctccaga

SEQ ID NO: 19824 - DNA, 22 bp, Artificial sequence
  synthetic polynucleotide sequence
atccatgcactcacctgaggga

SEQ ID NO: 19825 - DNA, 19 bp, Artificial sequence
  synthetic polynucleotide sequence
ggggcagaagaagagcaga

SEQ ID NO: 19826 - DNA, 20 bp, Artificial sequence
  synthetic polynucleotide sequence
cttccgaacagtaatcccga

SEQ ID NO: 19827 - DNA, 19 bp, Artificial sequence
  synthetic polynucleotide sequence
ccgcccactgcctgagaca

SEQ ID NO: 19828 - DNA, 19 bp, Artificial sequence
  synthetic polynucleotide sequence
ctctgtccccagctcgcca

SEQ ID NO: 19829 - DNA, 21 bp, Artificial sequence
  synthetic polynucleotide sequence
atgccagcagttccctgagca

SEQ ID NO: 19830 - DNA, 18 bp, Artificial sequence
  synthetic polynucleotide sequence
gctgcacagcctgggcca

SEQ ID NO: 19831 - DNA, 22 bp, Artificial sequence
  synthetic polynucleotide sequence
ttcaaactcagcttgagcccca

SEQ ID NO: 19832 - DNA, 21 bp, Artificial sequence
  synthetic polynucleotide sequence
aaggacagcaggtctgggtga

SEQ ID NO: 19833 - DNA, 20 bp, Artificial sequence
  synthetic polynucleotide sequence
acggaccacagcaacagcca

SEQ ID NO: 19834 - DNA, 20 bp, Artificial sequence
  synthetic polynucleotide sequence
ccgccaagatgtccgcctga

SEQ ID NO: 19835 - DNA, 21 bp, Artificial sequence
  synthetic polynucleotide sequence
cagcaggacgagatcctccaa

SEQ ID NO: 19836 - DNA, 20 bp, Artificial sequence
  synthetic polynucleotide sequence
cagtcagacagggtggggca

SEQ ID NO: 19837 - DNA, 21 bp, Artificial sequence
  synthetic polynucleotide sequence
gatccacagccacagtccaga

SEQ ID NO: 19838 - DNA, 21 bp, Artificial sequence
  synthetic polynucleotide sequence
ctcgataagggaggacgtgga

SEQ ID NO: 19839 - DNA, 20 bp, Artificial sequence
  synthetic polynucleotide sequence
gggcggaggatcagacggaa

SEQ ID NO: 19840 - DNA, 19 bp, Artificial sequence
  synthetic polynucleotide sequence
gtgcctgggcctctcagga

SEQ ID NO: 19841 - DNA, 22 bp, Artificial sequence
  synthetic polynucleotide sequence
ataaacgggagagtggtcagca

SEQ ID NO: 19842 - DNA, 18 bp, Artificial sequence
  synthetic polynucleotide sequence
tgcacggaggcagggcca

SEQ ID NO: 19843 - DNA, 21 bp, Artificial sequence
  synthetic polynucleotide sequence
gctgtaggaacaaggcggaga

SEQ ID NO: 19844 - DNA, 19 bp, Artificial sequence
  synthetic polynucleotide sequence
tgacgacgtgcctctccca

SEQ ID NO: 19845 - DNA, 20 bp, Artificial sequence
  synthetic polynucleotide sequence
aggccttcggtgagcgaaga

SEQ ID NO: 19846 - DNA, 21 bp, Artificial sequence
  synthetic polynucleotide sequence
accacatagccagtagctgga

SEQ ID NO: 19847 - DNA, 23 bp, Artificial sequence
  synthetic polynucleotide sequence
gtaacaacggaacctagtccaga

SEQ ID NO: 19848 - DNA, 22 bp, Artificial sequence
  synthetic polynucleotide sequence
acaaaggcacacgacaggagga

SEQ ID NO: 19849 - DNA, 19 bp, Artificial sequence
  synthetic polynucleotide sequence
gccggtctgggaagctgca

SEQ ID NO: 19850 - DNA, 19 bp, Artificial sequence
  synthetic polynucleotide sequence
cagggggcactcttcccga

SEQ ID NO: 19851 - DNA, 20 bp, Artificial sequence
  synthetic polynucleotide sequence
aggacctctcaagtccccga

SEQ ID NO: 19852 - DNA, 21 bp, Artificial sequence
  synthetic polynucleotide sequence
gccatgccaagccaagagcca

SEQ ID NO: 19853 - DNA, 20 bp, Artificial sequence
  synthetic polynucleotide sequence
aagcccccagtcccaatcga

SEQ ID NO: 19854 - DNA, 19 bp, Artificial sequence
  synthetic polynucleotide sequence
gaccctctgcagagcggca

SEQ ID NO: 19855 - DNA, 21 bp, Artificial sequence
  synthetic polynucleotide sequence
cggccccagaactgcaacaca

SEQ ID NO: 19856 - DNA, 21 bp, Artificial sequence
  synthetic polynucleotide sequence
tcatggtcacagcatgcagga

SEQ ID NO: 19857 - DNA, 18 bp, Artificial sequence
  synthetic polynucleotide sequence
gcccggggactgaagcca

SEQ ID NO: 19858 - DNA, 20 bp, Artificial sequence
  synthetic polynucleotide sequence
acagaagggtgacgctggca

SEQ ID NO: 19859 - DNA, 21 bp, Artificial sequence
  synthetic polynucleotide sequence
tggagcctgaagtccccgaga

SEQ ID NO: 19860 - DNA, 21 bp, Artificial sequence
  synthetic polynucleotide sequence
tggattcacgaagggctggga

SEQ ID NO: 19861 - DNA, 21 bp, Artificial sequence
  synthetic polynucleotide sequence
agcgaggatgccctatcagca

SEQ ID NO: 19862 - DNA, 21 bp, Artificial sequence
  synthetic polynucleotide sequence
aattgggctggacaaaaggga

SEQ ID NO: 19863 - DNA, 18 bp, Artificial sequence
  synthetic polynucleotide sequence
gctgcagcagggtgacca

SEQ ID NO: 19864 - DNA, 20 bp, Artificial sequence
  synthetic polynucleotide sequence
gaagatgaggaagccgctga

SEQ ID NO: 19865 - DNA, 18 bp, Artificial sequence
  synthetic polynucleotide sequence
agctggagcagggggaga

SEQ ID NO: 19866 - DNA, 20 bp, Artificial sequence
  synthetic polynucleotide sequence
gaaagagcaggaacccggaa

SEQ ID NO: 19867 - DNA, 21 bp, Artificial sequence
  synthetic polynucleotide sequence
aagacgaggctgagagtgaca

SEQ ID NO: 19868 - DNA, 18 bp, Artificial sequence
  synthetic polynucleotide sequence
ccacccctcggtcggcaa

SEQ ID NO: 19869 - DNA, 18 bp, Artificial sequence
  synthetic polynucleotide sequence
gttgcaggtgggcgagga

SEQ ID NO: 19870 - DNA, 18 bp, Artificial sequence
  synthetic polynucleotide sequence
gaagagcaggaagccgga

SEQ ID NO: 19871 - DNA, 18 bp, Artificial sequence
  synthetic polynucleotide sequence
cgtgcaacattcccggca

SEQ ID NO: 19872 - DNA, 18 bp, Artificial sequence
  synthetic polynucleotide sequence
gcgtcctgggcaatagca

SEQ ID NO: 19873 - DNA, 18 bp, Artificial sequence
  synthetic polynucleotide sequence
cagcgccattgcacagga

SEQ ID NO: 19874 - DNA, 18 bp, Artificial sequence
  synthetic polynucleotide sequence
ccgtgagccttcccgcca

SEQ ID NO: 19875 - DNA, 21 bp, Artificial sequence
  synthetic polynucleotide sequence
gaaaccactacgaccccacca

SEQ ID NO: 19876 - DNA, 20 bp, Artificial sequence
  synthetic polynucleotide sequence
gtcccctccgcgcatcagga

SEQ ID NO: 19877 - DNA, 18 bp, Artificial sequence
  synthetic polynucleotide sequence
cagcgccattgctcagga

SEQ ID NO: 19878 - DNA, 18 bp, Artificial sequence
  synthetic polynucleotide sequence
cccacgtccaggtgcaga

SEQ ID NO: 19879 - DNA, 18 bp, Artificial sequence
  synthetic polynucleotide sequence
cgtgcacacctggaacca

SEQ ID NO: 19880 - DNA, 21 bp, Artificial sequence
  synthetic polynucleotide sequence
ccttgtagaggcgtacccaca

SEQ ID NO: 19881 - DNA, 18 bp, Artificial sequence
  synthetic polynucleotide sequence
acaacggccagtaccgca

SEQ ID NO: 19882 - DNA, 20 bp, Artificial sequence
  synthetic polynucleotide sequence
gtcaccctgcttgagagcca

SEQ ID NO: 19883 - DNA, 19 bp, Artificial sequence
  synthetic polynucleotide sequence
ccggaggactacccccaga

SEQ ID NO: 19884 - DNA, 18 bp, Artificial sequence
  synthetic polynucleotide sequence
gctcccctcgaggcccca

SEQ ID NO: 19885 - DNA, 18 bp, Artificial sequence
  synthetic polynucleotide sequence
gcgagatgcagagccaga

SEQ ID NO: 19886 - DNA, 20 bp, Artificial sequence
  synthetic polynucleotide sequence
caggaagccggagaaggtga

SEQ ID NO: 19887 - DNA, 18 bp, Artificial sequence
  synthetic polynucleotide sequence
cgacgccgtcaccggcaa

SEQ ID NO: 19888 - DNA, 18 bp, Artificial sequence
  synthetic polynucleotide sequence
cctcaggctccagcctca

SEQ ID NO: 19889 - DNA, 20 bp, Artificial sequence
  synthetic polynucleotide sequence
tgacaagggggagatgggca

SEQ ID NO: 19890 - DNA, 21 bp, Artificial sequence
  synthetic polynucleotide sequence
aagtagatgccacgcagggga

SEQ ID NO: 19891 - DNA, 22 bp, Artificial sequence
  synthetic polynucleotide sequence
aggaccagagggagagaaagga

SEQ ID NO: 19892 - DNA, 19 bp, Artificial sequence
  synthetic polynucleotide sequence
tgagcacgatgcttccaca

SEQ ID NO: 19893 - DNA, 20 bp, Artificial sequence
  synthetic polynucleotide sequence
cacaggaagggactggggaa

SEQ ID NO: 19894 - DNA, 20 bp, Artificial sequence
  synthetic polynucleotide sequence
aagctgcctccccagcccga

SEQ ID NO: 19895 - DNA, 20 bp, Artificial sequence
  synthetic polynucleotide sequence
caaaggagaagctggaccca

SEQ ID NO: 19896 - DNA, 18 bp, Artificial sequence
  synthetic polynucleotide sequence
tcagcaccgtgagcccca

SEQ ID NO: 19897 - DNA, 20 bp, Artificial sequence
  synthetic polynucleotide sequence
gctgaagctcggggatgaga

SEQ ID NO: 19898 - DNA, 25 bp, Artificial sequence
  synthetic polynucleotide sequence
atcgtcctcatcagcaaacaagcca

SEQ ID NO: 19899 - DNA, 18 bp, Artificial sequence
  synthetic polynucleotide sequence
cccggactaccgtcagga

SEQ ID NO: 19900 - DNA, 18 bp, Artificial sequence
  synthetic polynucleotide sequence
gctacgggcagacggaca

SEQ ID NO: 19901 - DNA, 18 bp, Artificial sequence
  synthetic polynucleotide sequence
tggagctgcagcacagca

SEQ ID NO: 19902 - DNA, 18 bp, Artificial sequence
  synthetic polynucleotide sequence
ccctgggagctacaggca

SEQ ID NO: 19903 - DNA, 19 bp, Artificial sequence
  synthetic polynucleotide sequence
gctggaggagagaagggca

SEQ ID NO: 19904 - DNA, 19 bp, Artificial sequence
  synthetic polynucleotide sequence
tacccgtgtgtagagccca

SEQ ID NO: 19905 - DNA, 20 bp, Artificial sequence
  synthetic polynucleotide sequence
agggaggtggtgacagacca

SEQ ID NO: 19906 - DNA, 18 bp, Artificial sequence
  synthetic polynucleotide sequence
gtcagcagagccaaggca

SEQ ID NO: 19907 - DNA, 18 bp, Artificial sequence
  synthetic polynucleotide sequence
gagtcagggggccggtga

SEQ ID NO: 19908 - DNA, 18 bp, Artificial sequence
  synthetic polynucleotide sequence
ctctcaggagcgggccca

SEQ ID NO: 19909 - DNA, 18 bp, Artificial sequence
  synthetic polynucleotide sequence
ccccctggacaagcggca

SEQ ID NO: 19910 - DNA, 20 bp, Artificial sequence
  synthetic polynucleotide sequence
cagcagcagcagtaccggca

SEQ ID NO: 19911 - DNA, 20 bp, Artificial sequence
  synthetic polynucleotide sequence
ggcatgaactcagggagcga

SEQ ID NO: 19912 - DNA, 21 bp, Artificial sequence
  synthetic polynucleotide sequence
cccaacagcacacaagtccca

SEQ ID NO: 19913 - DNA, 21 bp, Artificial sequence
  synthetic polynucleotide sequence
aggacccacaccaccaccaga

SEQ ID NO: 19914 - DNA, 19 bp, Artificial sequence
  synthetic polynucleotide sequence
tagctgactgccgcagcca

SEQ ID NO: 19915 - DNA, 21 bp, Artificial sequence
  synthetic polynucleotide sequence
cagccaggctctgcaaactca

SEQ ID NO: 19916 - DNA, 22 bp, Artificial sequence
  synthetic polynucleotide sequence
aatgcctctgtaagacggagca

SEQ ID NO: 19917 - DNA, 21 bp, Artificial sequence
  synthetic polynucleotide sequence
gagggccacacaacagatgga

SEQ ID NO: 19918 - DNA, 25 bp, Artificial sequence
  synthetic polynucleotide sequence
actaggacctaaaaccagggaccaa

SEQ ID NO: 19919 - DNA, 20 bp, Artificial sequence
  synthetic polynucleotide sequence
gcggcctgggaggataagga

SEQ ID NO: 19920 - DNA, 19 bp, Artificial sequence
  synthetic polynucleotide sequence
cgtgagctcccacgtgcca

SEQ ID NO: 19921 - DNA, 21 bp, Artificial sequence
  synthetic polynucleotide sequence
gcctgcacctcaagctcctca

SEQ ID NO: 19922 - DNA, 18 bp, Artificial sequence
  synthetic polynucleotide sequence
ccatgacgcgggcctgca

SEQ ID NO: 19923 - DNA, 21 bp, Artificial sequence
  synthetic polynucleotide sequence
gaagaagatctccccacccca

SEQ ID NO: 19924 - DNA, 18 bp, Artificial sequence
  synthetic polynucleotide sequence
ctgtgggactggggggga

SEQ ID NO: 19925 - DNA, 20 bp, Artificial sequence
  synthetic polynucleotide sequence
gcggaaacccagcgtcccta

SEQ ID NO: 19926 - DNA, 22 bp, Artificial sequence
  synthetic polynucleotide sequence
acctcggcccttaatacaggca

SEQ ID NO: 19927 - DNA, 22 bp, Artificial sequence
  synthetic polynucleotide sequence
tcaagaggaagcaatgcctcca

SEQ ID NO: 19928 - DNA, 21 bp, Artificial sequence
  synthetic polynucleotide sequence
catccttgactacccgcagca

SEQ ID NO: 19929 - DNA, 20 bp, Artificial sequence
  synthetic polynucleotide sequence
ctgcacactgagctccctca

SEQ ID NO: 19930 - DNA, 20 bp, Artificial sequence
  synthetic polynucleotide sequence
gggaaggcggcttcaggcca

SEQ ID NO: 19931 - DNA, 18 bp, Artificial sequence
  synthetic polynucleotide sequence
aaggtggtcacgacccca

SEQ ID NO: 19932 - DNA, 19 bp, Artificial sequence
  synthetic polynucleotide sequence
tccagcaccttcctcacca

SEQ ID NO: 19933 - DNA, 21 bp, Artificial sequence
  synthetic polynucleotide sequence
ttccctactcaacggtcagga

SEQ ID NO: 19934 - DNA, 18 bp, Artificial sequence
  synthetic polynucleotide sequence
gcctggcagctcgtggga

SEQ ID NO: 19935 - DNA, 21 bp, Artificial sequence
  synthetic polynucleotide sequence
ggttgccaccgtatgatccca

SEQ ID NO: 19936 - DNA, 20 bp, Artificial sequence
  synthetic polynucleotide sequence
ctccttggctgcccaccaca

SEQ ID NO: 19937 - DNA, 21 bp, Artificial sequence
  synthetic polynucleotide sequence
gcgaaccagctacaatggcca

SEQ ID NO: 19938 - DNA, 21 bp, Artificial sequence
  synthetic polynucleotide sequence
gtgttggtgctgcacagggaa

SEQ ID NO: 19939 - DNA, 21 bp, Artificial sequence
  synthetic polynucleotide sequence
agaggctaatgtccagaccca

SEQ ID NO: 19940 - DNA, 19 bp, Artificial sequence
  synthetic polynucleotide sequence
tcgatggcaacgtggcgga

SEQ ID NO: 19941 - DNA, 21 bp, Artificial sequence
  synthetic polynucleotide sequence
agggagaggacatggcctcca

SEQ ID NO: 19942 - DNA, 20 bp, Artificial sequence
  synthetic polynucleotide sequence
ctccagttgtggcccacaga

SEQ ID NO: 19943 - DNA, 21 bp, Artificial sequence
  synthetic polynucleotide sequence
aagccaccagggatttggaga

SEQ ID NO: 19944 - DNA, 20 bp, Artificial sequence
  synthetic polynucleotide sequence
ggtctagctcaggggctgga

SEQ ID NO: 19945 - DNA, 20 bp, Artificial sequence
  synthetic polynucleotide sequence
tgaggagtggggatggccaa

SEQ ID NO: 19946 - DNA, 23 bp, Artificial sequence
  synthetic polynucleotide sequence
gaaacagcatcccatacagcaca

SEQ ID NO: 19947 - DNA, 20 bp, Artificial sequence
  synthetic polynucleotide sequence
gtggagccaatgctgtggaa

SEQ ID NO: 19948 - DNA, 21 bp, Artificial sequence
  synthetic polynucleotide sequence
tgagcaccttcagagatggca

SEQ ID NO: 19949 - DNA, 19 bp, Artificial sequence
  synthetic polynucleotide sequence
cctaccgcgccgagtggaa

SEQ ID NO: 19950 - DNA, 18 bp, Artificial sequence
  synthetic polynucleotide sequence
agtcgcggcagctggcca

SEQ ID NO: 19951 - DNA, 21 bp, Artificial sequence
  synthetic polynucleotide sequence
aggtttggacgcccgctccaa

SEQ ID NO: 19952 - DNA, 20 bp, Artificial sequence
  synthetic polynucleotide sequence
gccgtgtgcagacgcctgca

SEQ ID NO: 19953 - DNA, 18 bp, Artificial sequence
  synthetic polynucleotide sequence
cacccatgtccaggccca

SEQ ID NO: 19954 - DNA, 20 bp, Artificial sequence
  synthetic polynucleotide sequence
gacaggctccagtgacacca

SEQ ID NO: 19955 - DNA, 18 bp, Artificial sequence
  synthetic polynucleotide sequence
agccttctgggccacaga

SEQ ID NO: 19956 - DNA, 18 bp, Artificial sequence
  synthetic polynucleotide sequence
atcagagctcagcgggga

SEQ ID NO: 19957 - DNA, 20 bp, Artificial sequence
  synthetic polynucleotide sequence
tatccctgggctatgcggca

SEQ ID NO: 19958 - DNA, 19 bp, Artificial sequence
  synthetic polynucleotide sequence
tgtgggactagagagggca

SEQ ID NO: 19959 - DNA, 22 bp, Artificial sequence
  synthetic polynucleotide sequence
ttcagggaggagaggctagaga

SEQ ID NO: 19960 - DNA, 20 bp, Artificial sequence
  synthetic polynucleotide sequence
caagtctggccaggtccaca

SEQ ID NO: 19961 - DNA, 20 bp, Artificial sequence
  synthetic polynucleotide sequence
atgggaagaccgcgtctcca

SEQ ID NO: 19962 - DNA, 20 bp, Artificial sequence
  synthetic polynucleotide sequence
ccttgcgcctcagccccaga

SEQ ID NO: 19963 - DNA, 20 bp, Artificial sequence
  synthetic polynucleotide sequence
gttcgcgtcaaggcccggga

SEQ ID NO: 19964 - DNA, 20 bp, Artificial sequence
  synthetic polynucleotide sequence
tccggagtctccagggcaga

SEQ ID NO: 19965 - DNA, 20 bp, Artificial sequence
  synthetic polynucleotide sequence
caagtgcagcgccaacccca

SEQ ID NO: 19966 - DNA, 18 bp, Artificial sequence
  synthetic polynucleotide sequence
ccgcgcccctgtctagca

SEQ ID NO: 19967 - DNA, 20 bp, Artificial sequence
  synthetic polynucleotide sequence
ctcactcatcaggaccctca

SEQ ID NO: 19968 - DNA, 21 bp, Artificial sequence
  synthetic polynucleotide sequence
cacccccaacgtgtacaagga

SEQ ID NO: 19969 - DNA, 22 bp, Artificial sequence
  synthetic polynucleotide sequence
tgaatcttgcaccacctccaga

SEQ ID NO: 19970 - DNA, 21 bp, Artificial sequence
  synthetic polynucleotide sequence
ttggaggattgcacagctgga

SEQ ID NO: 19971 - DNA, 21 bp, Artificial sequence
  synthetic polynucleotide sequence
caggttggaaccagcgactca

SEQ ID NO: 19972 - DNA, 21 bp, Artificial sequence
  synthetic polynucleotide sequence
actgaacccaaggctttccca

SEQ ID NO: 19973 - DNA, 19 bp, Artificial sequence
  synthetic polynucleotide sequence
ttccctggagagaggccca

SEQ ID NO: 19974 - DNA, 21 bp, Artificial sequence
  synthetic polynucleotide sequence
gagtagcttcaggcctccaca

SEQ ID NO: 19975 - DNA, 18 bp, Artificial sequence
  synthetic polynucleotide sequence
ggcagctgtgggaccgga

SEQ ID NO: 19976 - DNA, 18 bp, Artificial sequence
  synthetic polynucleotide sequence
ctccggggaccaattgca

SEQ ID NO: 19977 - DNA, 20 bp, Artificial sequence
  synthetic polynucleotide sequence
ggctccccaactccaccaca

SEQ ID NO: 19978 - DNA, 20 bp, Artificial sequence
  synthetic polynucleotide sequence
tagttccaagggtcgcagca

SEQ ID NO: 19979 - DNA, 22 bp, Artificial sequence
  synthetic polynucleotide sequence
caataccattgcctcagaggga

SEQ ID NO: 19980 - DNA, 19 bp, Artificial sequence
  synthetic polynucleotide sequence
cgggggaggcttcagtcga

SEQ ID NO: 19981 - DNA, 21 bp, Artificial sequence
  synthetic polynucleotide sequence
gcaacaagaaggagcctgaga

SEQ ID NO: 19982 - DNA, 22 bp, Artificial sequence
  synthetic polynucleotide sequence
gtgaagaagaagtccatgcgga

SEQ ID NO: 19983 - DNA, 18 bp, Artificial sequence
  synthetic polynucleotide sequence
cctccacccgcagcgcaa

SEQ ID NO: 19984 - DNA, 18 bp, Artificial sequence
  synthetic polynucleotide sequence
gagcgccttgagcccgga

SEQ ID NO: 19985 - DNA, 21 bp, Artificial sequence
  synthetic polynucleotide sequence
acagcttcgaaaccagcccaa

SEQ ID NO: 19986 - DNA, 21 bp, Artificial sequence
  synthetic polynucleotide sequence
aacaggtccaggaagtcagga

SEQ ID NO: 19987 - DNA, 20 bp, Artificial sequence
  synthetic polynucleotide sequence
gggcaagtgataaacagcca

SEQ ID NO: 19988 - DNA, 18 bp, Artificial sequence
  synthetic polynucleotide sequence
agagcaagggctcgggca

SEQ ID NO: 19989 - DNA, 18 bp, Artificial sequence
  synthetic polynucleotide sequence
cctgccgcgacaccgaga

SEQ ID NO: 19990 - DNA, 22 bp, Artificial sequence
  synthetic polynucleotide sequence
taagcagaagagctgatggcca

SEQ ID NO: 19991 - DNA, 18 bp, Artificial sequence
  synthetic polynucleotide sequence
ccatgaacccgggcggca

SEQ ID NO: 19992 - DNA, 18 bp, Artificial sequence
  synthetic polynucleotide sequence
cgctgcggatcggctcca

SEQ ID NO: 19993 - DNA, 21 bp, Artificial sequence
  synthetic polynucleotide sequence
tcgcttcaacctggacagcca

SEQ ID NO: 19994 - DNA, 21 bp, Artificial sequence
  synthetic polynucleotide sequence
cgggcatcgcaaagtagggga

SEQ ID NO: 19995 - DNA, 21 bp, Artificial sequence
  synthetic polynucleotide sequence
ccactctcaacagcccaccca

SEQ ID NO: 19996 - DNA, 20 bp, Artificial sequence
  synthetic polynucleotide sequence
aaggcagagggttgagggca

SEQ ID NO: 19997 - DNA, 20 bp, Artificial sequence
  synthetic polynucleotide sequence
ggagctgccactaacagcca

SEQ ID NO: 19998 - DNA, 19 bp, Artificial sequence
  synthetic polynucleotide sequence
gtctccggtgggctcagca

SEQ ID NO: 19999 - DNA, 21 bp, Artificial sequence
  synthetic polynucleotide sequence
cacccagaggagtgacttcca

SEQ ID NO: 20000 - DNA, 21 bp, Artificial sequence
  synthetic polynucleotide sequence
ccctggagaggctcattcgga

SEQ ID NO: 20001 - DNA, 22 bp, Artificial sequence
  synthetic polynucleotide sequence
tgcagctgccaaagtggtgaca

SEQ ID NO: 20002 - DNA, 22 bp, Artificial sequence
  synthetic polynucleotide sequence
tggacaagaatgccaggcctca

SEQ ID NO: 20003 - DNA, 18 bp, Artificial sequence
  synthetic polynucleotide sequence
aagcagctggaatcgcca

SEQ ID NO: 20004 - DNA, 21 bp, Artificial sequence
  synthetic polynucleotide sequence
gcaaaaaggaagccctcgaga

SEQ ID NO: 20005 - DNA, 18 bp, Artificial sequence
  synthetic polynucleotide sequence
cccaacccagttcagcca

SEQ ID NO: 20006 - DNA, 19 bp, Artificial sequence
  synthetic polynucleotide sequence
ccggagactggtcacagca

SEQ ID NO: 20007 - DNA, 21 bp, Artificial sequence
  synthetic polynucleotide sequence
tgacccaaaaggaagacggca

SEQ ID NO: 20008 - DNA, 20 bp, Artificial sequence
  synthetic polynucleotide sequence
agttcctcccactccagcca

SEQ ID NO: 20009 - DNA, 19 bp, Artificial sequence
  synthetic polynucleotide sequence
gggccaggatcctggcaga

SEQ ID NO: 20010 - DNA, 21 bp, Artificial sequence
  synthetic polynucleotide sequence
gcttcagggcttctggcagca

SEQ ID NO: 20011 - DNA, 21 bp, Artificial sequence
  synthetic polynucleotide sequence
ccgtacagacatgcgggctga

SEQ ID NO: 20012 - DNA, 21 bp, Artificial sequence
  synthetic polynucleotide sequence
tgtttagggcagtgctggaga

SEQ ID NO: 20013 - DNA, 24 bp, Artificial sequence
  synthetic polynucleotide sequence
catatatgaaggtgagaagcagca

SEQ ID NO: 20014 - DNA, 18 bp, Artificial sequence
  synthetic polynucleotide sequence
gctgcaaggcatcacaca

SEQ ID NO: 20015 - DNA, 19 bp, Artificial sequence
  synthetic polynucleotide sequence
cctctgcagcccctcccaa

SEQ ID NO: 20016 - DNA, 21 bp, Artificial sequence
  synthetic polynucleotide sequence
cctctcagaggtgcctgagga

SEQ ID NO: 20017 - DNA, 18 bp, Artificial sequence
  synthetic polynucleotide sequence
ccatcaccacgtgggaga

SEQ ID NO: 20018 - DNA, 21 bp, Artificial sequence
  synthetic polynucleotide sequence
caacagagtagggtagccgca

SEQ ID NO: 20019 - DNA, 18 bp, Artificial sequence
  synthetic polynucleotide sequence
caacacccctcgtggcaa

SEQ ID NO: 20020 - DNA, 18 bp, Artificial sequence
  synthetic polynucleotide sequence
agacagccaccaccacca

SEQ ID NO: 20021 - DNA, 25 bp, Artificial sequence
  synthetic polynucleotide sequence
agggcagaagggaaggcatttccaa

SEQ ID NO: 20022 - DNA, 20 bp, Artificial sequence
  synthetic polynucleotide sequence
gagctctgcaggggccagga

SEQ ID NO: 20023 - DNA, 18 bp, Artificial sequence
  synthetic polynucleotide sequence
ccgcccacccacctctga

SEQ ID NO: 20024 - DNA, 18 bp, Artificial sequence
  synthetic polynucleotide sequence
gccgtgccaccagctgca

SEQ ID NO: 20025 - DNA, 21 bp, Artificial sequence
  synthetic polynucleotide sequence
gaactacaccagcactgggca

SEQ ID NO: 20026 - DNA, 20 bp, Artificial sequence
  synthetic polynucleotide sequence
tactgcagcaggcggtagga

SEQ ID NO: 20027 - DNA, 22 bp, Artificial sequence
  synthetic polynucleotide sequence
caaacgactcgaacacggtgca

SEQ ID NO: 20028 - DNA, 19 bp, Artificial sequence
  synthetic polynucleotide sequence
ctggtagtggtgccgggca

SEQ ID NO: 20029 - DNA, 20 bp, Artificial sequence
  synthetic polynucleotide sequence
gtctggcgaggctgagcgaa

SEQ ID NO: 20030 - DNA, 20 bp, Artificial sequence
  synthetic polynucleotide sequence
tggtcagatggtacggacga

SEQ ID NO: 20031 - DNA, 22 bp, Artificial sequence
  synthetic polynucleotide sequence
gtccggaacatcagcactggaa

SEQ ID NO: 20032 - DNA, 21 bp, Artificial sequence
  synthetic polynucleotide sequence
ctccagccaacttaaccagca

SEQ ID NO: 20033 - DNA, 19 bp, Artificial sequence
  synthetic polynucleotide sequence
cccctacccagcacaccca

SEQ ID NO: 20034 - DNA, 22 bp, Artificial sequence
  synthetic polynucleotide sequence
aggtggaagaggaagagaggga

SEQ ID NO: 20035 - DNA, 21 bp, Artificial sequence
  synthetic polynucleotide sequence
ctgggactgtccatcgaggaa

SEQ ID NO: 20036 - DNA, 22 bp, Artificial sequence
  synthetic polynucleotide sequence
gtaatgttccaggagcaaggga

SEQ ID NO: 20037 - DNA, 22 bp, Artificial sequence
  synthetic polynucleotide sequence
gctaacaaggaaagcccctgga

SEQ ID NO: 20038 - DNA, 19 bp, Artificial sequence
  synthetic polynucleotide sequence
tcggtgagcaggtgaggca

SEQ ID NO: 20039 - DNA, 18 bp, Artificial sequence
  synthetic polynucleotide sequence
agaccaaggactcgggca

SEQ ID NO: 20040 - DNA, 18 bp, Artificial sequence
  synthetic polynucleotide sequence
gctcggggttgaaggcca

SEQ ID NO: 20041 - DNA, 20 bp, Artificial sequence
  synthetic polynucleotide sequence
ggagtgcacaggccagcaga

SEQ ID NO: 20042 - DNA, 20 bp, Artificial sequence
  synthetic polynucleotide sequence
agcagaagagcaggctgcca

SEQ ID NO: 20043 - DNA, 22 bp, Artificial sequence
  synthetic polynucleotide sequence
accagcagtgacgacacaacca

SEQ ID NO: 20044 - DNA, 21 bp, Artificial sequence
  synthetic polynucleotide sequence
cagtcccggggattagaagga

SEQ ID NO: 20045 - DNA, 22 bp, Artificial sequence
  synthetic polynucleotide sequence
aatcgtgtgacgaggacacaga

SEQ ID NO: 20046 - DNA, 19 bp, Artificial sequence
  synthetic polynucleotide sequence
ggtcagactgcgaggggga

SEQ ID NO: 20047 - DNA, 21 bp, Artificial sequence
  synthetic polynucleotide sequence
tgcccagctacgaggaggtca

SEQ ID NO: 20048 - DNA, 18 bp, Artificial sequence
  synthetic polynucleotide sequence
ctcgagggcggccaagca

SEQ ID NO: 20049 - DNA, 21 bp, Artificial sequence
  synthetic polynucleotide sequence
ccaggaccacctaccagcaga

SEQ ID NO: 20050 - DNA, 21 bp, Artificial sequence
  synthetic polynucleotide sequence
agagaccccagcatgaaggta

SEQ ID NO: 20051 - DNA, 20 bp, Artificial sequence
  synthetic polynucleotide sequence
cctaggccgacaaaagagga

SEQ ID NO: 20052 - DNA, 20 bp, Artificial sequence
  synthetic polynucleotide sequence
cagggcaacataacgcctca

SEQ ID NO: 20053 - DNA, 18 bp, Artificial sequence
  synthetic polynucleotide sequence
gaggaccacacctgggca

SEQ ID NO: 20054 - DNA, 18 bp, Artificial sequence
  synthetic polynucleotide sequence
ccactccccatcaacgca

SEQ ID NO: 20055 - DNA, 21 bp, Artificial sequence
  synthetic polynucleotide sequence
aacggtgccaaagtgcctcca

SEQ ID NO: 20056 - DNA, 21 bp, Artificial sequence
  synthetic polynucleotide sequence
acaggagccaggagtagagca

SEQ ID NO: 20057 - DNA, 21 bp, Artificial sequence
  synthetic polynucleotide sequence
ctctgtgaggagaagctggga

SEQ ID NO: 20058 - DNA, 20 bp, Artificial sequence
  synthetic polynucleotide sequence
tcctgagtcaaccacaggca

SEQ ID NO: 20059 - DNA, 21 bp, Artificial sequence
  synthetic polynucleotide sequence
gagggactggagagagagtga

SEQ ID NO: 20060 - DNA, 20 bp, Artificial sequence
  synthetic polynucleotide sequence
tctcattgccagggccgtca

SEQ ID NO: 20061 - DNA, 22 bp, Artificial sequence
  synthetic polynucleotide sequence
aaaataatgcggacgctaccga

SEQ ID NO: 20062 - DNA, 20 bp, Artificial sequence
  synthetic polynucleotide sequence
tgaccggactcctcggggca

SEQ ID NO: 20063 - DNA, 21 bp, Artificial sequence
  synthetic polynucleotide sequence
tggtcgagatggtctccggga

SEQ ID NO: 20064 - DNA, 22 bp, Artificial sequence
  synthetic polynucleotide sequence
tgaaaagccagaggtccaacca

SEQ ID NO: 20065 - DNA, 18 bp, Artificial sequence
  synthetic polynucleotide sequence
acgcgacgaggacgggga

SEQ ID NO: 20066 - DNA, 21 bp, Artificial sequence
  synthetic polynucleotide sequence
tagtcatctccaaccggctca

SEQ ID NO: 20067 - DNA, 21 bp, Artificial sequence
  synthetic polynucleotide sequence
ccagtgaagcatgagcccgta

SEQ ID NO: 20068 - DNA, 20 bp, Artificial sequence
  synthetic polynucleotide sequence
gttctccaagtggggctgga

SEQ ID NO: 20069 - DNA, 23 bp, Artificial sequence
  synthetic polynucleotide sequence
ctaaatgacacctgaagcgcgga

SEQ ID NO: 20070 - DNA, 20 bp, Artificial sequence
  synthetic polynucleotide sequence
gccaggatggctgcagcgca

SEQ ID NO: 20071 - DNA, 21 bp, Artificial sequence
  synthetic polynucleotide sequence
tcttcagacgcctctgcagca

SEQ ID NO: 20072 - DNA, 22 bp, Artificial sequence
  synthetic polynucleotide sequence
aatgaaaaggctgcgtctccga

SEQ ID NO: 20073 - DNA, 22 bp, Artificial sequence
  synthetic polynucleotide sequence
aaagcctggtggaatgaaggca

SEQ ID NO: 20074 - DNA, 20 bp, Artificial sequence
  synthetic polynucleotide sequence
tagccacataagggtcagca

SEQ ID NO: 20075 - DNA, 20 bp, Artificial sequence
  synthetic polynucleotide sequence
cctgcggaagacagcctgca

SEQ ID NO: 20076 - DNA, 20 bp, Artificial sequence
  synthetic polynucleotide sequence
cgctggccagcaggcacaca

SEQ ID NO: 20077 - DNA, 21 bp, Artificial sequence
  synthetic polynucleotide sequence
gacaagtccatgtgcagccaa

SEQ ID NO: 20078 - DNA, 20 bp, Artificial sequence
  synthetic polynucleotide sequence
gggtaccagcccagcagaga

SEQ ID NO: 20079 - DNA, 22 bp, Artificial sequence
  synthetic polynucleotide sequence
tgtacctaacactggtacggca

SEQ ID NO: 20080 - DNA, 18 bp, Artificial sequence
  synthetic polynucleotide sequence
gtcaggccctcaatggca

SEQ ID NO: 20081 - DNA, 21 bp, Artificial sequence
  synthetic polynucleotide sequence
ggcctctactcacgctcacga

SEQ ID NO: 20082 - DNA, 19 bp, Artificial sequence
  synthetic polynucleotide sequence
ggtgacgatggctccagga

SEQ ID NO: 20083 - DNA, 18 bp, Artificial sequence
  synthetic polynucleotide sequence
ggccgctgggcacagcca

SEQ ID NO: 20084 - DNA, 23 bp, Artificial sequence
  synthetic polynucleotide sequence
caaaatacaggaagagcatggga

SEQ ID NO: 20085 - DNA, 20 bp, Artificial sequence
  synthetic polynucleotide sequence
accgagcccaaccgtactca

SEQ ID NO: 20086 - DNA, 21 bp, Artificial sequence
  synthetic polynucleotide sequence
ttgagacagaggagtaggcga

SEQ ID NO: 20087 - DNA, 22 bp, Artificial sequence
  synthetic polynucleotide sequence
gctagccctggaagattcggaa

SEQ ID NO: 20088 - DNA, 19 bp, Artificial sequence
  synthetic polynucleotide sequence
ttccccagtgctggcagca

SEQ ID NO: 20089 - DNA, 22 bp, Artificial sequence
  synthetic polynucleotide sequence
aagatgccatgagagctgctga

SEQ ID NO: 20090 - DNA, 18 bp, Artificial sequence
  synthetic polynucleotide sequence
ggccggccacgcttacca

SEQ ID NO: 20091 - DNA, 21 bp, Artificial sequence
  synthetic polynucleotide sequence
ggaccgtgtcaggctaccaga

SEQ ID NO: 20092 - DNA, 20 bp, Artificial sequence
  synthetic polynucleotide sequence
aggaacgggcaagtcctgca

SEQ ID NO: 20093 - DNA, 23 bp, Artificial sequence
  synthetic polynucleotide sequence
cataacagaagtgagatggccca

SEQ ID NO: 20094 - DNA, 21 bp, Artificial sequence
  synthetic polynucleotide sequence
atgctgagatctgggcaggca

SEQ ID NO: 20095 - DNA, 18 bp, Artificial sequence
  synthetic polynucleotide sequence
cagtgcgcgcggctctca

SEQ ID NO: 20096 - DNA, 21 bp, Artificial sequence
  synthetic polynucleotide sequence
cctcctggcaattcgcaacca

SEQ ID NO: 20097 - DNA, 19 bp, Artificial sequence
  synthetic polynucleotide sequence
gggcttgcacctcaaacca

SEQ ID NO: 20098 - DNA, 19 bp, Artificial sequence
  synthetic polynucleotide sequence
ctcagacacgctgtccaca

SEQ ID NO: 20099 - DNA, 20 bp, Artificial sequence
  synthetic polynucleotide sequence
ccagacgacaagccagacga

SEQ ID NO: 20100 - DNA, 21 bp, Artificial sequence
  synthetic polynucleotide sequence
cggaggatgaactcgactgca

SEQ ID NO: 20101 - DNA, 19 bp, Artificial sequence
  synthetic polynucleotide sequence
gcgttcagggtggcagcga

SEQ ID NO: 20102 - DNA, 21 bp, Artificial sequence
  synthetic polynucleotide sequence
gattaaacctgcacgcgccga

SEQ ID NO: 20103 - DNA, 19 bp, Artificial sequence
  synthetic polynucleotide sequence
tgcaccgagatgacagaga

SEQ ID NO: 20104 - DNA, 21 bp, Artificial sequence
  synthetic polynucleotide sequence
tgcacatggttggcacggcca

SEQ ID NO: 20105 - DNA, 21 bp, Artificial sequence
  synthetic polynucleotide sequence
acgagtggaagagctcgggga

SEQ ID NO: 20106 - DNA, 20 bp, Artificial sequence
  synthetic polynucleotide sequence
ctaatgctgcagaggcccga

SEQ ID NO: 20107 - DNA, 20 bp, Artificial sequence
  synthetic polynucleotide sequence
tgaccagggatcctccacga

SEQ ID NO: 20108 - DNA, 20 bp, Artificial sequence
  synthetic polynucleotide sequence
gatctgcggctgacccccta

SEQ ID NO: 20109 - DNA, 22 bp, Artificial sequence
  synthetic polynucleotide sequence
aggtgcctggacaaagcttcca

SEQ ID NO: 20110 - DNA, 21 bp, Artificial sequence
  synthetic polynucleotide sequence
ccaagggctggaaaacgggga

SEQ ID NO: 20111 - DNA, 19 bp, Artificial sequence
  synthetic polynucleotide sequence
cgacccaccctctcaggga

SEQ ID NO: 20112 - DNA, 21 bp, Artificial sequence
  synthetic polynucleotide sequence
acaggtactccaggaagacca

SEQ ID NO: 20113 - DNA, 19 bp, Artificial sequence
  synthetic polynucleotide sequence
cagagcctggggtcctgga

SEQ ID NO: 20114 - DNA, 19 bp, Artificial sequence
  synthetic polynucleotide sequence
ctgagggtgggtggaggga

SEQ ID NO: 20115 - DNA, 21 bp, Artificial sequence
  synthetic polynucleotide sequence
cctattcccggagctacagga

SEQ ID NO: 20116 - DNA, 18 bp, Artificial sequence
  synthetic polynucleotide sequence
tggaccgcggggtgctga

SEQ ID NO: 20117 - DNA, 20 bp, Artificial sequence
  synthetic polynucleotide sequence
gacccggagctgatgcagaa

SEQ ID NO: 20118 - DNA, 20 bp, Artificial sequence
  synthetic polynucleotide sequence
ggaagaaggcgcaaccggca

SEQ ID NO: 20119 - DNA, 22 bp, Artificial sequence
  synthetic polynucleotide sequence
acgagagaaagctgcagcagga

SEQ ID NO: 20120 - DNA, 20 bp, Artificial sequence
  synthetic polynucleotide sequence
ggactccaggagcgttgcca

SEQ ID NO: 20121 - DNA, 18 bp, Artificial sequence
  synthetic polynucleotide sequence
acccctcccacctggaga

SEQ ID NO: 20122 - DNA, 18 bp, Artificial sequence
  synthetic polynucleotide sequence
cgaacgggtgctgctcga

SEQ ID NO: 20123 - DNA, 21 bp, Artificial sequence
  synthetic polynucleotide sequence
gcatcttccacagccagggca

SEQ ID NO: 20124 - DNA, 19 bp, Artificial sequence
  synthetic polynucleotide sequence
ctgggggaggttggaggga

SEQ ID NO: 20125 - DNA, 22 bp, Artificial sequence
  synthetic polynucleotide sequence
acaagcgtgacaaagacgagca

SEQ ID NO: 20126 - DNA, 21 bp, Artificial sequence
  synthetic polynucleotide sequence
ttggaggtgagtgtgaaggca

SEQ ID NO: 20127 - DNA, 20 bp, Artificial sequence
  synthetic polynucleotide sequence
gagagggacagcctggggaa

SEQ ID NO: 20128 - DNA, 20 bp, Artificial sequence
  synthetic polynucleotide sequence
cctcgagccaagtccctgga

SEQ ID NO: 20129 - DNA, 18 bp, Artificial sequence
  synthetic polynucleotide sequence
gaggaccgcctgggggaa

SEQ ID NO: 20130 - DNA, 20 bp, Artificial sequence
  synthetic polynucleotide sequence
agaggcctgtggcatcggga

SEQ ID NO: 20131 - DNA, 21 bp, Artificial sequence
  synthetic polynucleotide sequence
gacacatcgcccaggaagcaa

SEQ ID NO: 20132 - DNA, 19 bp, Artificial sequence
  synthetic polynucleotide sequence
tccctcatcagtcgggcca

SEQ ID NO: 20133 - DNA, 20 bp, Artificial sequence
  synthetic polynucleotide sequence
ggctccacctgactagagga

SEQ ID NO: 20134 - DNA, 23 bp, Artificial sequence
  synthetic polynucleotide sequence
gctgccaggcagaactatgtgga

SEQ ID NO: 20135 - DNA, 22 bp, Artificial sequence
  synthetic polynucleotide sequence
agatgagtgagcaggaagagga

SEQ ID NO: 20136 - DNA, 21 bp, Artificial sequence
  synthetic polynucleotide sequence
tctagccccgtcttcaggaca

SEQ ID NO: 20137 - DNA, 20 bp, Artificial sequence
  synthetic polynucleotide sequence
ggccccacactgcagaagga

SEQ ID NO: 20138 - DNA, 21 bp, Artificial sequence
  synthetic polynucleotide sequence
atcaaggctgctggaggtgga

SEQ ID NO: 20139 - DNA, 21 bp, Artificial sequence
  synthetic polynucleotide sequence
acaagcagcccaccttactga

SEQ ID NO: 20140 - DNA, 21 bp, Artificial sequence
  synthetic polynucleotide sequence
tcctccctcaaactggaggca

SEQ ID NO: 20141 - DNA, 20 bp, Artificial sequence
  synthetic polynucleotide sequence
gggcctggagaaacgccaca

SEQ ID NO: 20142 - DNA, 18 bp, Artificial sequence
  synthetic polynucleotide sequence
ctgagggtcggaggggga

SEQ ID NO: 20143 - DNA, 22 bp, Artificial sequence
  synthetic polynucleotide sequence
gcaagatgaggagttggcacca

SEQ ID NO: 20144 - DNA, 21 bp, Artificial sequence
  synthetic polynucleotide sequence
taagctccttgacgcaagaca

SEQ ID NO: 20145 - DNA, 20 bp, Artificial sequence
  synthetic polynucleotide sequence
tccaccaacctgaccctgca

SEQ ID NO: 20146 - DNA, 19 bp, Artificial sequence
  synthetic polynucleotide sequence
gccagcaccaaggcctgca

SEQ ID NO: 20147 - DNA, 20 bp, Artificial sequence
  synthetic polynucleotide sequence
ctgggagaggtggagagcca

SEQ ID NO: 20148 - DNA, 23 bp, Artificial sequence
  synthetic polynucleotide sequence
caataaggtgacagctgctcaca

SEQ ID NO: 20149 - DNA, 21 bp, Artificial sequence
  synthetic polynucleotide sequence
gcccagccagagttaccgcta

SEQ ID NO: 20150 - DNA, 21 bp, Artificial sequence
  synthetic polynucleotide sequence
tgttcaggggtctcatgcgca

SEQ ID NO: 20151 - DNA, 21 bp, Artificial sequence
  synthetic polynucleotide sequence
taggacaggcagattagctga

SEQ ID NO: 20152 - DNA, 19 bp, Artificial sequence
  synthetic polynucleotide sequence
tacaccagaatcaaccgca

SEQ ID NO: 20153 - DNA, 21 bp, Artificial sequence
  synthetic polynucleotide sequence
agccgcaaggacaagactgga

SEQ ID NO: 20154 - DNA, 21 bp, Artificial sequence
  synthetic polynucleotide sequence
tgccaactgcccagtgggtga

SEQ ID NO: 20155 - DNA, 21 bp, Artificial sequence
  synthetic polynucleotide sequence
catgggggtgatgaagacaga

SEQ ID NO: 20156 - DNA, 19 bp, Artificial sequence
  synthetic polynucleotide sequence
ggggcgtcttccaggagca

SEQ ID NO: 20157 - DNA, 20 bp, Artificial sequence
  synthetic polynucleotide sequence
taaatgtcagcgctgggaga

SEQ ID NO: 20158 - DNA, 18 bp, Artificial sequence
  synthetic polynucleotide sequence
tctcagctgaggcaggca

SEQ ID NO: 20159 - DNA, 22 bp, Artificial sequence
  synthetic polynucleotide sequence
aatcagatgatgagggccctga

SEQ ID NO: 20160 - DNA, 21 bp, Artificial sequence
  synthetic polynucleotide sequence
agtggcagcctccatagctga

SEQ ID NO: 20161 - DNA, 22 bp, Artificial sequence
  synthetic polynucleotide sequence
ccatgtcagcaacaaggtcaca

SEQ ID NO: 20162 - DNA, 20 bp, Artificial sequence
  synthetic polynucleotide sequence
cagctgcagcgtcatgagca

SEQ ID NO: 20163 - DNA, 21 bp, Artificial sequence
  synthetic polynucleotide sequence
aacacccctaccacacacaca

SEQ ID NO: 20164 - DNA, 19 bp, Artificial sequence
  synthetic polynucleotide sequence
ggttggcaccgtgggagga

SEQ ID NO: 20165 - DNA, 21 bp, Artificial sequence
  synthetic polynucleotide sequence
acttccaggcccccaatgtga

SEQ ID NO: 20166 - DNA, 20 bp, Artificial sequence
  synthetic polynucleotide sequence
attgacctggaccgccccta

SEQ ID NO: 20167 - DNA, 21 bp, Artificial sequence
  synthetic polynucleotide sequence
agatgtggcaggtggtggaca

SEQ ID NO: 20168 - DNA, 22 bp, Artificial sequence
  synthetic polynucleotide sequence
gaaaaccatgacactggccaga

SEQ ID NO: 20169 - DNA, 18 bp, Artificial sequence
  synthetic polynucleotide sequence
gcagccttcccgaagcca

SEQ ID NO: 20170 - DNA, 18 bp, Artificial sequence
  synthetic polynucleotide sequence
ggccaacaggagaggcca

SEQ ID NO: 20171 - DNA, 20 bp, Artificial sequence
  synthetic polynucleotide sequence
ccctcatggctgacagccca

SEQ ID NO: 20172 - DNA, 19 bp, Artificial sequence
  synthetic polynucleotide sequence
tctgaccagagctgtcgca

SEQ ID NO: 20173 - DNA, 21 bp, Artificial sequence
  synthetic polynucleotide sequence
tgacaaggttcccgatgagca

SEQ ID NO: 20174 - DNA, 18 bp, Artificial sequence
  synthetic polynucleotide sequence
cggcagggggggatcaga

SEQ ID NO: 20175 - DNA, 20 bp, Artificial sequence
  synthetic polynucleotide sequence
gaacctgcctgggactcgga

SEQ ID NO: 20176 - DNA, 20 bp, Artificial sequence
  synthetic polynucleotide sequence
gtctggcagggagtaggcca

SEQ ID NO: 20177 - DNA, 20 bp, Artificial sequence
  synthetic polynucleotide sequence
cctactgcagctgccgagga

SEQ ID NO: 20178 - DNA, 20 bp, Artificial sequence
  synthetic polynucleotide sequence
acagcaactcagcctccgga

SEQ ID NO: 20179 - DNA, 21 bp, Artificial sequence
  synthetic polynucleotide sequence
acctgacctactcctcccaga

SEQ ID NO: 20180 - DNA, 21 bp, Artificial sequence
  synthetic polynucleotide sequence
gaaacgtgaaggagcaggcca

SEQ ID NO: 20181 - DNA, 20 bp, Artificial sequence
  synthetic polynucleotide sequence
cacagccacccacccagcaa

SEQ ID NO: 20182 - DNA, 20 bp, Artificial sequence
  synthetic polynucleotide sequence
tgaccagtcgagacagggga

SEQ ID NO: 20183 - DNA, 21 bp, Artificial sequence
  synthetic polynucleotide sequence
gaaaccccctagtgcatgaga

SEQ ID NO: 20184 - DNA, 18 bp, Artificial sequence
  synthetic polynucleotide sequence
gctgaggctggagacgaa

SEQ ID NO: 20185 - DNA, 22 bp, Artificial sequence
  synthetic polynucleotide sequence
ccaactccagagcgacaacaga

SEQ ID NO: 20186 - DNA, 21 bp, Artificial sequence
  synthetic polynucleotide sequence
gtagaggtcacccgaatggca

SEQ ID NO: 20187 - DNA, 20 bp, Artificial sequence
  synthetic polynucleotide sequence
ggaccacgctgggtatccaa

SEQ ID NO: 20188 - DNA, 20 bp, Artificial sequence
  synthetic polynucleotide sequence
agccctctctcagaagcgga

SEQ ID NO: 20189 - DNA, 20 bp, Artificial sequence
  synthetic polynucleotide sequence
gagatgcagcctatccacga

SEQ ID NO: 20190 - DNA, 20 bp, Artificial sequence
  synthetic polynucleotide sequence
caggagctccagcaactcca

SEQ ID NO: 20191 - DNA, 18 bp, Artificial sequence
  synthetic polynucleotide sequence
ggcggacctgatgcagga

SEQ ID NO: 20192 - DNA, 18 bp, Artificial sequence
  synthetic polynucleotide sequence
gggagcacagtggcagga

SEQ ID NO: 20193 - DNA, 21 bp, Artificial sequence
  synthetic polynucleotide sequence
agggcacagccatggctgtca

SEQ ID NO: 20194 - DNA, 21 bp, Artificial sequence
  synthetic polynucleotide sequence
cgtctcgggcttgaagcagga

SEQ ID NO: 20195 - DNA, 20 bp, Artificial sequence
  synthetic polynucleotide sequence
gatgacgacaaaccacagca

SEQ ID NO: 20196 - DNA, 18 bp, Artificial sequence
  synthetic polynucleotide sequence
actgcagcaggcagagga

SEQ ID NO: 20197 - DNA, 21 bp, Artificial sequence
  synthetic polynucleotide sequence
gcacaacagttggcccaggaa

SEQ ID NO: 20198 - DNA, 19 bp, Artificial sequence
  synthetic polynucleotide sequence
ttgctgcgcagggttcgga

SEQ ID NO: 20199 - DNA, 21 bp, Artificial sequence
  synthetic polynucleotide sequence
tccatccacagccctacccca

SEQ ID NO: 20200 - DNA, 21 bp, Artificial sequence
  synthetic polynucleotide sequence
gtctccttgaagcctggcaca

SEQ ID NO: 20201 - DNA, 22 bp, Artificial sequence
  synthetic polynucleotide sequence
caaggcgaaagagacgctcaga

SEQ ID NO: 20202 - DNA, 21 bp, Artificial sequence
  synthetic polynucleotide sequence
cttccaccaaggtacaccgga

SEQ ID NO: 20203 - DNA, 19 bp, Artificial sequence
  synthetic polynucleotide sequence
catgggcacagagaaggga

SEQ ID NO: 20204 - DNA, 18 bp, Artificial sequence
  synthetic polynucleotide sequence
ccggggacgccgcaggaa

SEQ ID NO: 20205 - DNA, 22 bp, Artificial sequence
  synthetic polynucleotide sequence
agaagaagacgagcagcagaca

SEQ ID NO: 20206 - DNA, 21 bp, Artificial sequence
  synthetic polynucleotide sequence
tcagaaaggcagacagggcca

SEQ ID NO: 20207 - DNA, 21 bp, Artificial sequence
  synthetic polynucleotide sequence
cccgttacacaccccaggcaa

SEQ ID NO: 20208 - DNA, 19 bp, Artificial sequence
  synthetic polynucleotide sequence
cagcctgggagggttggca

SEQ ID NO: 20209 - DNA, 21 bp, Artificial sequence
  synthetic polynucleotide sequence
aagagggccgaagtccaggaa

SEQ ID NO: 20210 - DNA, 19 bp, Artificial sequence
  synthetic polynucleotide sequence
ttcatgacgctgctgagga

SEQ ID NO: 20211 - DNA, 18 bp, Artificial sequence
  synthetic polynucleotide sequence
tgcgcctggagcgggaga

SEQ ID NO: 20212 - DNA, 20 bp, Artificial sequence
  synthetic polynucleotide sequence
ggtgtggactgcctggcaga

SEQ ID NO: 20213 - DNA, 22 bp, Artificial sequence
  synthetic polynucleotide sequence
aaagggatgtccaggaaggtca

SEQ ID NO: 20214 - DNA, 22 bp, Artificial sequence
  synthetic polynucleotide sequence
agattcaggtaagcctctgcca

SEQ ID NO: 20215 - DNA, 19 bp, Artificial sequence
  synthetic polynucleotide sequence
cgcctgagacccaaccgca

SEQ ID NO: 20216 - DNA, 18 bp, Artificial sequence
  synthetic polynucleotide sequence
gccaccgccgcagtagga

SEQ ID NO: 20217 - DNA, 23 bp, Artificial sequence
  synthetic polynucleotide sequence
taaaaccagccaagtttgggaca

SEQ ID NO: 20218 - DNA, 20 bp, Artificial sequence
  synthetic polynucleotide sequence
ctcgccagcggcgtctgcaa

SEQ ID NO: 20219 - DNA, 23 bp, Artificial sequence
  synthetic polynucleotide sequence
cttaatgagcaacagcaacagca

SEQ ID NO: 20220 - DNA, 20 bp, Artificial sequence
  synthetic polynucleotide sequence
caatgggatgatcaggcaga

SEQ ID NO: 20221 - DNA, 20 bp, Artificial sequence
  synthetic polynucleotide sequence
ctgccacgtgctgatgccga

SEQ ID NO: 20222 - DNA, 21 bp, Artificial sequence
  synthetic polynucleotide sequence
gatggtgctccagtgagagga

SEQ ID NO: 20223 - DNA, 19 bp, Artificial sequence
  synthetic polynucleotide sequence
ccacagagccctgtgagga

SEQ ID NO: 20224 - DNA, 20 bp, Artificial sequence
  synthetic polynucleotide sequence
accattacaccgaagtcgca

SEQ ID NO: 20225 - DNA, 18 bp, Artificial sequence
  synthetic polynucleotide sequence
gccggagaggaccagcga

SEQ ID NO: 20226 - DNA, 20 bp, Artificial sequence
  synthetic polynucleotide sequence
actggtcctgtacacggaga

SEQ ID NO: 20227 - DNA, 19 bp, Artificial sequence
  synthetic polynucleotide sequence
cccatcaacccggcccaga

SEQ ID NO: 20228 - DNA, 20 bp, Artificial sequence
  synthetic polynucleotide sequence
atggtggtcagtggcacgga

SEQ ID NO: 20229 - DNA, 20 bp, Artificial sequence
  synthetic polynucleotide sequence
ctggagagcaagccactcca

SEQ ID NO: 20230 - DNA, 20 bp, Artificial sequence
  synthetic polynucleotide sequence
ggaagggctcacgggctgca

SEQ ID NO: 20231 - DNA, 20 bp, Artificial sequence
  synthetic polynucleotide sequence
gaccctccgctcccatcaca

SEQ ID NO: 20232 - DNA, 20 bp, Artificial sequence
  synthetic polynucleotide sequence
catcggttcccagtcgccga

SEQ ID NO: 20233 - DNA, 21 bp, Artificial sequence
  synthetic polynucleotide sequence
ccagacccagatccccagaga

SEQ ID NO: 20234 - DNA, 21 bp, Artificial sequence
  synthetic polynucleotide sequence
gtctcatcgaagtccacgcca

SEQ ID NO: 20235 - DNA, 20 bp, Artificial sequence
  synthetic polynucleotide sequence
ggaatcccagaggctgccca

SEQ ID NO: 20236 - DNA, 20 bp, Artificial sequence
  synthetic polynucleotide sequence
gttccgggcagcttgggaga

SEQ ID NO: 20237 - DNA, 22 bp, Artificial sequence
  synthetic polynucleotide sequence
atagagaagccacccttcctca

SEQ ID NO: 20238 - DNA, 20 bp, Artificial sequence
  synthetic polynucleotide sequence
cacatcagcgcccctggtga

SEQ ID NO: 20239 - DNA, 22 bp, Artificial sequence
  synthetic polynucleotide sequence
gaatacgctgccatcaactcca

SEQ ID NO: 20240 - DNA, 20 bp, Artificial sequence
  synthetic polynucleotide sequence
ctgccggttggactccagca

SEQ ID NO: 20241 - DNA, 19 bp, Artificial sequence
  synthetic polynucleotide sequence
tcatccacatccagcgcga

SEQ ID NO: 20242 - DNA, 21 bp, Artificial sequence
  synthetic polynucleotide sequence
ggaggcggccatgatcatgca

SEQ ID NO: 20243 - DNA, 20 bp, Artificial sequence
  synthetic polynucleotide sequence
gaaccagcagctgccgcgga

SEQ ID NO: 20244 - DNA, 20 bp, Artificial sequence
  synthetic polynucleotide sequence
agacagtagtggcggcccga

SEQ ID NO: 20245 - DNA, 18 bp, Artificial sequence
  synthetic polynucleotide sequence
gaagcgcagggagaagga

SEQ ID NO: 20246 - DNA, 18 bp, Artificial sequence
  synthetic polynucleotide sequence
tcacaccaccgatggcga

SEQ ID NO: 20247 - DNA, 22 bp, Artificial sequence
  synthetic polynucleotide sequence
aagcgcaaaatcgacgcaggga

SEQ ID NO: 20248 - DNA, 20 bp, Artificial sequence
  synthetic polynucleotide sequence
tctccagaccgtggtcctca

SEQ ID NO: 20249 - DNA, 20 bp, Artificial sequence
  synthetic polynucleotide sequence
gagccagtgggacgaaacca

SEQ ID NO: 20250 - DNA, 21 bp, Artificial sequence
  synthetic polynucleotide sequence
caggatgagccgaggattcga

SEQ ID NO: 20251 - DNA, 18 bp, Artificial sequence
  synthetic polynucleotide sequence
cgaccgagcaggacccca

SEQ ID NO: 20252 - DNA, 18 bp, Artificial sequence
  synthetic polynucleotide sequence
ggggccaccggcatccta

SEQ ID NO: 20253 - DNA, 21 bp, Artificial sequence
  synthetic polynucleotide sequence
ggacccgcacagaaacctgga

SEQ ID NO: 20254 - DNA, 20 bp, Artificial sequence
  synthetic polynucleotide sequence
cagtgttgcggaggccagga

SEQ ID NO: 20255 - DNA, 20 bp, Artificial sequence
  synthetic polynucleotide sequence
acctgggaacctgccagaca

SEQ ID NO: 20256 - DNA, 23 bp, Artificial sequence
  synthetic polynucleotide sequence
taaaagacatccatggaagggca

SEQ ID NO: 20257 - DNA, 18 bp, Artificial sequence
  synthetic polynucleotide sequence
gcgcgtggaggggtggaa

SEQ ID NO: 20258 - DNA, 20 bp, Artificial sequence
  synthetic polynucleotide sequence
cgcacagggaccagtaccca

SEQ ID NO: 20259 - DNA, 20 bp, Artificial sequence
  synthetic polynucleotide sequence
cggtgtcaacgctgcaggga

SEQ ID NO: 20260 - DNA, 20 bp, Artificial sequence
  synthetic polynucleotide sequence
cacaggcaccggggacagca

SEQ ID NO: 20261 - DNA, 20 bp, Artificial sequence
  synthetic polynucleotide sequence
ggcggggtctagcaagagca

SEQ ID NO: 20262 - DNA, 20 bp, Artificial sequence
  synthetic polynucleotide sequence
gctggagatggcggtgggca

SEQ ID NO: 20263 - DNA, 22 bp, Artificial sequence
  synthetic polynucleotide sequence
cgaagggatgaggatgcagaca

SEQ ID NO: 20264 - DNA, 20 bp, Artificial sequence
  synthetic polynucleotide sequence
agcatcgatgcccaggtcca

SEQ ID NO: 20265 - DNA, 22 bp, Artificial sequence
  synthetic polynucleotide sequence
gtcagatagccagtgccaagca

SEQ ID NO: 20266 - DNA, 23 bp, Artificial sequence
  synthetic polynucleotide sequence
gcagtagggagggtacacaagga

SEQ ID NO: 20267 - DNA, 22 bp, Artificial sequence
  synthetic polynucleotide sequence
gttccagacctcagaagcacca

SEQ ID NO: 20268 - DNA, 20 bp, Artificial sequence
  synthetic polynucleotide sequence
tacagcgctgacatactcca

SEQ ID NO: 20269 - DNA, 18 bp, Artificial sequence
  synthetic polynucleotide sequence
ttggtgaggccaacccaa

SEQ ID NO: 20270 - DNA, 21 bp, Artificial sequence
  synthetic polynucleotide sequence
atgagtcagagagccagggta

SEQ ID NO: 20271 - DNA, 18 bp, Artificial sequence
  synthetic polynucleotide sequence
gcgacaccatcactcgca

SEQ ID NO: 20272 - DNA, 20 bp, Artificial sequence
  synthetic polynucleotide sequence
tggctcaggagtctcaggga

SEQ ID NO: 20273 - DNA, 20 bp, Artificial sequence
  synthetic polynucleotide sequence
tactgcacacacatggacga

SEQ ID NO: 20274 - DNA, 18 bp, Artificial sequence
  synthetic polynucleotide sequence
gaatgccagccagggcca

SEQ ID NO: 20275 - DNA, 19 bp, Artificial sequence
  synthetic polynucleotide sequence
gaccacggctccgagcaca

SEQ ID NO: 20276 - DNA, 23 bp, Artificial sequence
  synthetic polynucleotide sequence
taaaaacactcccaagacagcca

SEQ ID NO: 20277 - DNA, 18 bp, Artificial sequence
  synthetic polynucleotide sequence
tgcacaacaatggccaca

SEQ ID NO: 20278 - DNA, 18 bp, Artificial sequence
  synthetic polynucleotide sequence
tgcaggtggagctgggca

SEQ ID NO: 20279 - DNA, 18 bp, Artificial sequence
  synthetic polynucleotide sequence
caagggaggacccctgga

SEQ ID NO: 20280 - DNA, 20 bp, Artificial sequence
  synthetic polynucleotide sequence
tacctagaacggccagtcca

SEQ ID NO: 20281 - DNA, 21 bp, Artificial sequence
  synthetic polynucleotide sequence
agcacaccgtggatggagtca

SEQ ID NO: 20282 - DNA, 20 bp, Artificial sequence
  synthetic polynucleotide sequence
taggtccagtagtcccggca

SEQ ID NO: 20283 - DNA, 22 bp, Artificial sequence
  synthetic polynucleotide sequence
agcactacgatggcagagagca

SEQ ID NO: 20284 - DNA, 18 bp, Artificial sequence
  synthetic polynucleotide sequence
gctgaatgggctcccgga

SEQ ID NO: 20285 - DNA, 20 bp, Artificial sequence
  synthetic polynucleotide sequence
gctgcagaggctggtggaca

SEQ ID NO: 20286 - DNA, 22 bp, Artificial sequence
  synthetic polynucleotide sequence
cgtaggtccagtaatcccagca

SEQ ID NO: 20287 - DNA, 21 bp, Artificial sequence
  synthetic polynucleotide sequence
cctgatgcctacctgcccaga

SEQ ID NO: 20288 - DNA, 18 bp, Artificial sequence
  synthetic polynucleotide sequence
gtggctgaagggggcgga

SEQ ID NO: 20289 - DNA, 22 bp, Artificial sequence
  synthetic polynucleotide sequence
ttgaagcctgacctagccagaa

SEQ ID NO: 20290 - DNA, 20 bp, Artificial sequence
  synthetic polynucleotide sequence
ggagcagcgtgttccagaca

SEQ ID NO: 20291 - DNA, 21 bp, Artificial sequence
  synthetic polynucleotide sequence
acatggtccggttcaagggca

SEQ ID NO: 20292 - DNA, 20 bp, Artificial sequence
  synthetic polynucleotide sequence
actgagtgggggagtcgtca

SEQ ID NO: 20293 - DNA, 20 bp, Artificial sequence
  synthetic polynucleotide sequence
tggagtggggctacgaggaa

SEQ ID NO: 20294 - DNA, 22 bp, Artificial sequence
  synthetic polynucleotide sequence
acataatttggggagaggcgga

SEQ ID NO: 20295 - DNA, 18 bp, Artificial sequence
  synthetic polynucleotide sequence
gaacttccgagcgacgca

SEQ ID NO: 20296 - DNA, 18 bp, Artificial sequence
  synthetic polynucleotide sequence
accagcagccaggcagga

SEQ ID NO: 20297 - DNA, 19 bp, Artificial sequence
  synthetic polynucleotide sequence
ctgctcccgaggcaccaga

SEQ ID NO: 20298 - DNA, 19 bp, Artificial sequence
  synthetic polynucleotide sequence
tctggtggaggaacagcca

SEQ ID NO: 20299 - DNA, 21 bp, Artificial sequence
  synthetic polynucleotide sequence
ctcacaaatctccagcagaca

SEQ ID NO: 20300 - DNA, 19 bp, Artificial sequence
  synthetic polynucleotide sequence
cagggtgctaaggagccca

SEQ ID NO: 20301 - DNA, 22 bp, Artificial sequence
  synthetic polynucleotide sequence
agaagacagataggcactcgga

SEQ ID NO: 20302 - DNA, 21 bp, Artificial sequence
  synthetic polynucleotide sequence
ataatcccacaacgtaaggca

SEQ ID NO: 20303 - DNA, 21 bp, Artificial sequence
  synthetic polynucleotide sequence
cctgagatcaccgtcacgcca

SEQ ID NO: 20304 - DNA, 19 bp, Artificial sequence
  synthetic polynucleotide sequence
tcctcacgttggcagcaga

SEQ ID NO: 20305 - DNA, 18 bp, Artificial sequence
  synthetic polynucleotide sequence
gaagcttgcgcaggagga

SEQ ID NO: 20306 - DNA, 19 bp, Artificial sequence
  synthetic polynucleotide sequence
tggctgctaacagcacaca

SEQ ID NO: 20307 - DNA, 19 bp, Artificial sequence
  synthetic polynucleotide sequence
tgcgtcgtacatgaccaca

SEQ ID NO: 20308 - DNA, 19 bp, Artificial sequence
  synthetic polynucleotide sequence
ccaggctgcactcctccga

SEQ ID NO: 20309 - DNA, 19 bp, Artificial sequence
  synthetic polynucleotide sequence
ggctacatgcccaccgaga

SEQ ID NO: 20310 - DNA, 18 bp, Artificial sequence
  synthetic polynucleotide sequence
gccccattagctccacga

SEQ ID NO: 20311 - DNA, 18 bp, Artificial sequence
  synthetic polynucleotide sequence
catgggcggccgtgtgga

SEQ ID NO: 20312 - DNA, 21 bp, Artificial sequence
  synthetic polynucleotide sequence
tgtcaaactctcggaaggcga

SEQ ID NO: 20313 - DNA, 21 bp, Artificial sequence
  synthetic polynucleotide sequence
acacgaatggagatggggaga

SEQ ID NO: 20314 - DNA, 21 bp, Artificial sequence
  synthetic polynucleotide sequence
cattaacatcagcctcccgga

SEQ ID NO: 20315 - DNA, 21 bp, Artificial sequence
  synthetic polynucleotide sequence
agagaagttccatggcaccga

SEQ ID NO: 20316 - DNA, 19 bp, Artificial sequence
  synthetic polynucleotide sequence
tcatggacaggtgctcgca

SEQ ID NO: 20317 - DNA, 21 bp, Artificial sequence
  synthetic polynucleotide sequence
aagaaactaccgagggagcca

SEQ ID NO: 20318 - DNA, 21 bp, Artificial sequence
  synthetic polynucleotide sequence
gatgcagggacaacgaagtca

SEQ ID NO: 20319 - DNA, 21 bp, Artificial sequence
  synthetic polynucleotide sequence
ggcactgagcaaacggaagca

SEQ ID NO: 20320 - DNA, 20 bp, Artificial sequence
  synthetic polynucleotide sequence
ggtcagctgggacgtaggca

SEQ ID NO: 20321 - DNA, 22 bp, Artificial sequence
  synthetic polynucleotide sequence
tgcatcaccatccaccctctga

SEQ ID NO: 20322 - DNA, 20 bp, Artificial sequence
  synthetic polynucleotide sequence
gtccgtacagcacccccgta

SEQ ID NO: 20323 - DNA, 20 bp, Artificial sequence
  synthetic polynucleotide sequence
accatgagcccacaggagga

SEQ ID NO: 20324 - DNA, 20 bp, Artificial sequence
  synthetic polynucleotide sequence
agtctgagggggggtatcca

SEQ ID NO: 20325 - DNA, 18 bp, Artificial sequence
  synthetic polynucleotide sequence
tggcatcgacgtggagga

SEQ ID NO: 20326 - DNA, 19 bp, Artificial sequence
  synthetic polynucleotide sequence
ggtggcactccggaagaga

SEQ ID NO: 20327 - DNA, 18 bp, Artificial sequence
  synthetic polynucleotide sequence
aacgccctgctgcagaga

SEQ ID NO: 20328 - DNA, 20 bp, Artificial sequence
  synthetic polynucleotide sequence
cagaggcctcactgtccaga

SEQ ID NO: 20329 - DNA, 18 bp, Artificial sequence
  synthetic polynucleotide sequence
ggccatcaacagggccaa

SEQ ID NO: 20330 - DNA, 18 bp, Artificial sequence
  synthetic polynucleotide sequence
tgaagagctggaccccga

SEQ ID NO: 20331 - DNA, 20 bp, Artificial sequence
  synthetic polynucleotide sequence
caagcagaggagtgcggaca

SEQ ID NO: 20332 - DNA, 18 bp, Artificial sequence
  synthetic polynucleotide sequence
ggtcacaggcatcagcga

SEQ ID NO: 20333 - DNA, 20 bp, Artificial sequence
  synthetic polynucleotide sequence
cctgattcgacacgcgggca

SEQ ID NO: 20334 - DNA, 21 bp, Artificial sequence
  synthetic polynucleotide sequence
gaagactcggtcaggcaagca

SEQ ID NO: 20335 - DNA, 19 bp, Artificial sequence
  synthetic polynucleotide sequence
tctcagcccaagggaacca

SEQ ID NO: 20336 - DNA, 20 bp, Artificial sequence
  synthetic polynucleotide sequence
aaaggactgagcacggggga

SEQ ID NO: 20337 - DNA, 18 bp, Artificial sequence
  synthetic polynucleotide sequence
acgagggcaacctgagca

SEQ ID NO: 20338 - DNA, 19 bp, Artificial sequence
  synthetic polynucleotide sequence
gcggaacctggactgagga

SEQ ID NO: 20339 - DNA, 20 bp, Artificial sequence
  synthetic polynucleotide sequence
aagcacctggaggagagcaa

SEQ ID NO: 20340 - DNA, 18 bp, Artificial sequence
  synthetic polynucleotide sequence
gcgagagcatcctggaca

SEQ ID NO: 20341 - DNA, 20 bp, Artificial sequence
  synthetic polynucleotide sequence
cctggccgcaaagacagcaa

SEQ ID NO: 20342 - DNA, 21 bp, Artificial sequence
  synthetic polynucleotide sequence
agttctctggatccggcgaga

SEQ ID NO: 20343 - DNA, 18 bp, Artificial sequence
  synthetic polynucleotide sequence
tggccattgccgtggaca

SEQ ID NO: 20344 - DNA, 18 bp, Artificial sequence
  synthetic polynucleotide sequence
gctccagcttcttggcca

SEQ ID NO: 20345 - DNA, 18 bp, Artificial sequence
  synthetic polynucleotide sequence
gcaggacatcgctcagca

SEQ ID NO: 20346 - DNA, 18 bp, Artificial sequence
  synthetic polynucleotide sequence
agggaggccgtgaagtca

SEQ ID NO: 20347 - DNA, 19 bp, Artificial sequence
  synthetic polynucleotide sequence
gctagtgcagagaccgcga

SEQ ID NO: 20348 - DNA, 18 bp, Artificial sequence
  synthetic polynucleotide sequence
gagcagcagttgcaggga

SEQ ID NO: 20349 - DNA, 21 bp, Artificial sequence
  synthetic polynucleotide sequence
gaagatcagaaggcgcccaga

SEQ ID NO: 20350 - DNA, 22 bp, Artificial sequence
  synthetic polynucleotide sequence
aaaagcagagggagcagaagga

SEQ ID NO: 20351 - DNA, 18 bp, Artificial sequence
  synthetic polynucleotide sequence
tgacccagctgctcagca

SEQ ID NO: 20352 - DNA, 19 bp, Artificial sequence
  synthetic polynucleotide sequence
gtaccaggagccccagaca

SEQ ID NO: 20353 - DNA, 18 bp, Artificial sequence
  synthetic polynucleotide sequence
aggagtgagcggccgaga

SEQ ID NO: 20354 - DNA, 18 bp, Artificial sequence
  synthetic polynucleotide sequence
ccacacccaggtggcaca

SEQ ID NO: 20355 - DNA, 21 bp, Artificial sequence
  synthetic polynucleotide sequence
ccgccgcacagtcatatggaa

SEQ ID NO: 20356 - DNA, 20 bp, Artificial sequence
  synthetic polynucleotide sequence
agtctgccgaaccctggcga

SEQ ID NO: 20357 - DNA, 18 bp, Artificial sequence
  synthetic polynucleotide sequence
ctgatgaggccagcgaga

SEQ ID NO: 20358 - DNA, 20 bp, Artificial sequence
  synthetic polynucleotide sequence
atgcccgttagcactaggca

SEQ ID NO: 20359 - DNA, 22 bp, Artificial sequence
  synthetic polynucleotide sequence
gacattccgagcaactcccaca

SEQ ID NO: 20360 - DNA, 20 bp, Artificial sequence
  synthetic polynucleotide sequence
tgacggccccactaacacca

SEQ ID NO: 20361 - DNA, 20 bp, Artificial sequence
  synthetic polynucleotide sequence
gaggacaccgtctggatcga

SEQ ID NO: 20362 - DNA, 18 bp, Artificial sequence
  synthetic polynucleotide sequence
tccggggcattcgaggca

SEQ ID NO: 20363 - DNA, 20 bp, Artificial sequence
  synthetic polynucleotide sequence
atcacccgcatccccagcta

SEQ ID NO: 20364 - DNA, 21 bp, Artificial sequence
  synthetic polynucleotide sequence
tgttgaagcccttgatgccca

SEQ ID NO: 20365 - DNA, 21 bp, Artificial sequence
  synthetic polynucleotide sequence
agacctgtcccccatcagcaa

SEQ ID NO: 20366 - DNA, 20 bp, Artificial sequence
  synthetic polynucleotide sequence
ggagttgaggagggtcccca

SEQ ID NO: 20367 - DNA, 20 bp, Artificial sequence
  synthetic polynucleotide sequence
tatgccaggatgccgagcta

SEQ ID NO: 20368 - DNA, 21 bp, Artificial sequence
  synthetic polynucleotide sequence
tgtacatggacagctccccca

SEQ ID NO: 20369 - DNA, 22 bp, Artificial sequence
  synthetic polynucleotide sequence
atgcccatgaacacccagctga

SEQ ID NO: 20370 - DNA, 22 bp, Artificial sequence
  synthetic polynucleotide sequence
aagatgccagagacaaaggcca

SEQ ID NO: 20371 - DNA, 18 bp, Artificial sequence
  synthetic polynucleotide sequence
gctgtccgtgggcaccga

SEQ ID NO: 20372 - DNA, 19 bp, Artificial sequence
  synthetic polynucleotide sequence
gccacagccgcttggtgca

SEQ ID NO: 20373 - DNA, 19 bp, Artificial sequence
  synthetic polynucleotide sequence
gccagttcctgcagcccga

SEQ ID NO: 20374 - DNA, 21 bp, Artificial sequence
  synthetic polynucleotide sequence
agggcgaggtggagatgtgca

SEQ ID NO: 20375 - DNA, 20 bp, Artificial sequence
  synthetic polynucleotide sequence
gaagcgggacgaggagaaga

SEQ ID NO: 20376 - DNA, 22 bp, Artificial sequence
  synthetic polynucleotide sequence
atgtagatgttgacggccagca

SEQ ID NO: 20377 - DNA, 21 bp, Artificial sequence
  synthetic polynucleotide sequence
cgacaagtaccggccacgcaa

SEQ ID NO: 20378 - DNA, 20 bp, Artificial sequence
  synthetic polynucleotide sequence
aggaagtactcgggcgtgga

SEQ ID NO: 20379 - DNA, 20 bp, Artificial sequence
  synthetic polynucleotide sequence
tagaagcccagtcaacacca

SEQ ID NO: 20380 - DNA, 21 bp, Artificial sequence
  synthetic polynucleotide sequence
agttcagattccaccgccgga

SEQ ID NO: 20381 - DNA, 20 bp, Artificial sequence
  synthetic polynucleotide sequence
gtggcctacacggatggaga

SEQ ID NO: 20382 - DNA, 18 bp, Artificial sequence
  synthetic polynucleotide sequence
ccacaccatcagaggcca

SEQ ID NO: 20383 - DNA, 18 bp, Artificial sequence
  synthetic polynucleotide sequence
agccatcgggaagcccca

SEQ ID NO: 20384 - DNA, 18 bp, Artificial sequence
  synthetic polynucleotide sequence
atgaacaggttgggccca

SEQ ID NO: 20385 - DNA, 18 bp, Artificial sequence
  synthetic polynucleotide sequence
ccagaatggccctgacca

SEQ ID NO: 20386 - DNA, 21 bp, Artificial sequence
  synthetic polynucleotide sequence
ttgccagatatcgaccaagca

SEQ ID NO: 20387 - DNA, 18 bp, Artificial sequence
  synthetic polynucleotide sequence
ggcacctacggctgcaca

SEQ ID NO: 20388 - DNA, 20 bp, Artificial sequence
  synthetic polynucleotide sequence
gagcatgatgagcagcagga

SEQ ID NO: 20389 - DNA, 20 bp, Artificial sequence
  synthetic polynucleotide sequence
tgtggtgagggagggagaca

SEQ ID NO: 20390 - DNA, 19 bp, Artificial sequence
  synthetic polynucleotide sequence
gcggataccagacccggca

SEQ ID NO: 20391 - DNA, 21 bp, Artificial sequence
  synthetic polynucleotide sequence
tcttggaaggagtgctggcaa

SEQ ID NO: 20392 - DNA, 20 bp, Artificial sequence
  synthetic polynucleotide sequence
cggtccgtcaaccaggtgca

SEQ ID NO: 20393 - DNA, 20 bp, Artificial sequence
  synthetic polynucleotide sequence
tgtgccctggatggaggaca

SEQ ID NO: 20394 - DNA, 22 bp, Artificial sequence
  synthetic polynucleotide sequence
acaacacgccttccaacactga

SEQ ID NO: 20395 - DNA, 21 bp, Artificial sequence
  synthetic polynucleotide sequence
tcaaccctagccaacctccaa

SEQ ID NO: 20396 - DNA, 20 bp, Artificial sequence
  synthetic polynucleotide sequence
gctcccagtcaggcatctca

SEQ ID NO: 20397 - DNA, 20 bp, Artificial sequence
  synthetic polynucleotide sequence
atgatcaggacggcaatgga

SEQ ID NO: 20398 - DNA, 20 bp, Artificial sequence
  synthetic polynucleotide sequence
ccctccatccgacaaagcca

SEQ ID NO: 20399 - DNA, 21 bp, Artificial sequence
  synthetic polynucleotide sequence
caagctccaggaatacaccca

SEQ ID NO: 20400 - DNA, 18 bp, Artificial sequence
  synthetic polynucleotide sequence
gacaggcaggagtcggga

SEQ ID NO: 20401 - DNA, 20 bp, Artificial sequence
  synthetic polynucleotide sequence
ctgggcacatacacgcagga

SEQ ID NO: 20402 - DNA, 21 bp, Artificial sequence
  synthetic polynucleotide sequence
ggcatgctaacatgagggcga

SEQ ID NO: 20403 - DNA, 18 bp, Artificial sequence
  synthetic polynucleotide sequence
cctggagagcagcccaga

SEQ ID NO: 20404 - DNA, 20 bp, Artificial sequence
  synthetic polynucleotide sequence
ctgcacatagtcctgcacca

SEQ ID NO: 20405 - DNA, 19 bp, Artificial sequence
  synthetic polynucleotide sequence
gcccggcagctctgacaga

SEQ ID NO: 20406 - DNA, 21 bp, Artificial sequence
  synthetic polynucleotide sequence
tcagcctccgagtcagagcta

SEQ ID NO: 20407 - DNA, 21 bp, Artificial sequence
  synthetic polynucleotide sequence
gacatgcaggctgagctccaa

SEQ ID NO: 20408 - DNA, 20 bp, Artificial sequence
  synthetic polynucleotide sequence
acagctgggcctgaagctga

SEQ ID NO: 20409 - DNA, 21 bp, Artificial sequence
  synthetic polynucleotide sequence
ctggctgagtgtggaaaccca

SEQ ID NO: 20410 - DNA, 19 bp, Artificial sequence
  synthetic polynucleotide sequence
ttggtcacaagcacccgga

SEQ ID NO: 20411 - DNA, 22 bp, Artificial sequence
  synthetic polynucleotide sequence
aagagcctaagttgccaaagga

SEQ ID NO: 20412 - DNA, 20 bp, Artificial sequence
  synthetic polynucleotide sequence
atgccttcacagagcatcca

SEQ ID NO: 20413 - DNA, 18 bp, Artificial sequence
  synthetic polynucleotide sequence
gcgtgaggaaagacgcca

SEQ ID NO: 20414 - DNA, 18 bp, Artificial sequence
  synthetic polynucleotide sequence
ctgcttgggagcgacaga

SEQ ID NO: 20415 - DNA, 21 bp, Artificial sequence
  synthetic polynucleotide sequence
atgacctggagctgggtcaca

SEQ ID NO: 20416 - DNA, 19 bp, Artificial sequence
  synthetic polynucleotide sequence
tgatccgtgatgccacgca

SEQ ID NO: 20417 - DNA, 19 bp, Artificial sequence
  synthetic polynucleotide sequence
ctcgggtgctcgctgccaa

SEQ ID NO: 20418 - DNA, 20 bp, Artificial sequence
  synthetic polynucleotide sequence
caggcggctgtagagtggga

SEQ ID NO: 20419 - DNA, 21 bp, Artificial sequence
  synthetic polynucleotide sequence
caactacgtggacctggagca

SEQ ID NO: 20420 - DNA, 19 bp, Artificial sequence
  synthetic polynucleotide sequence
gcctgcagctcactccgca

SEQ ID NO: 20421 - DNA, 19 bp, Artificial sequence
  synthetic polynucleotide sequence
gtcactgggtcagaaccca

SEQ ID NO: 20422 - DNA, 18 bp, Artificial sequence
  synthetic polynucleotide sequence
ctcggaatgcctcacgga

SEQ ID NO: 20423 - DNA, 19 bp, Artificial sequence
  synthetic polynucleotide sequence
ctgaagcagagctgcagga

SEQ ID NO: 20424 - DNA, 20 bp, Artificial sequence
  synthetic polynucleotide sequence
ctggccatcatggtcaggaa

SEQ ID NO: 20425 - DNA, 20 bp, Artificial sequence
  synthetic polynucleotide sequence
cttccccgagttcctgggca

SEQ ID NO: 20426 - DNA, 18 bp, Artificial sequence
  synthetic polynucleotide sequence
ctcggcggcgctgacgaa

SEQ ID NO: 20427 - DNA, 22 bp, Artificial sequence
  synthetic polynucleotide sequence
tagacggaaatggagagctgga

SEQ ID NO: 20428 - DNA, 21 bp, Artificial sequence
  synthetic polynucleotide sequence
gcttctcccccagactcgtga

SEQ ID NO: 20429 - DNA, 20 bp, Artificial sequence
  synthetic polynucleotide sequence
atctccgaggttgacagcga

SEQ ID NO: 20430 - DNA, 18 bp, Artificial sequence
  synthetic polynucleotide sequence
cgcggaaggcgacctgca

SEQ ID NO: 20431 - DNA, 21 bp, Artificial sequence
  synthetic polynucleotide sequence
cgtgctaatgaacgcagggga

SEQ ID NO: 20432 - DNA, 20 bp, Artificial sequence
  synthetic polynucleotide sequence
ctcccccgtcatcatggcca

SEQ ID NO: 20433 - DNA, 18 bp, Artificial sequence
  synthetic polynucleotide sequence
gcgaggtggagctggcca

SEQ ID NO: 20434 - DNA, 22 bp, Artificial sequence
  synthetic polynucleotide sequence
ccatcgcgaccttctgaagaca

SEQ ID NO: 20435 - DNA, 20 bp, Artificial sequence
  synthetic polynucleotide sequence
aaaccactcagaatggccga

SEQ ID NO: 20436 - DNA, 19 bp, Artificial sequence
  synthetic polynucleotide sequence
taatgtagccccctccaca

SEQ ID NO: 20437 - DNA, 22 bp, Artificial sequence
  synthetic polynucleotide sequence
agaatgggtaaagacagagcga

SEQ ID NO: 20438 - DNA, 22 bp, Artificial sequence
  synthetic polynucleotide sequence
catagtctgagggaaggatcca

SEQ ID NO: 20439 - DNA, 20 bp, Artificial sequence
  synthetic polynucleotide sequence
ctgaactgcagccacccaga

SEQ ID NO: 20440 - DNA, 18 bp, Artificial sequence
  synthetic polynucleotide sequence
caggaagccgtcggggca

SEQ ID NO: 20441 - DNA, 21 bp, Artificial sequence
  synthetic polynucleotide sequence
aggccttgcagcacccatgga

SEQ ID NO: 20442 - DNA, 19 bp, Artificial sequence
  synthetic polynucleotide sequence
ttcctcatgtgccgcacca

SEQ ID NO: 20443 - DNA, 18 bp, Artificial sequence
  synthetic polynucleotide sequence
agtccgtcagcgcccaga

SEQ ID NO: 20444 - DNA, 18 bp, Artificial sequence
  synthetic polynucleotide sequence
agagcgtggaaggtgcca

SEQ ID NO: 20445 - DNA, 21 bp, Artificial sequence
  synthetic polynucleotide sequence
gagatcaccatcaccgaggca

SEQ ID NO: 20446 - DNA, 20 bp, Artificial sequence
  synthetic polynucleotide sequence
tgctgatgtggagggagcca

SEQ ID NO: 20447 - DNA, 19 bp, Artificial sequence
  synthetic polynucleotide sequence
gcccttaagcacccctgga

SEQ ID NO: 20448 - DNA, 19 bp, Artificial sequence
  synthetic polynucleotide sequence
gccagcatcgtggtgagaa

SEQ ID NO: 20449 - DNA, 21 bp, Artificial sequence
  synthetic polynucleotide sequence
acccctaaagagcaagccaca

SEQ ID NO: 20450 - DNA, 19 bp, Artificial sequence
  synthetic polynucleotide sequence
ccagccagcaccgtgggca

SEQ ID NO: 20451 - DNA, 18 bp, Artificial sequence
  synthetic polynucleotide sequence
gatgccgcctgcatagca

SEQ ID NO: 20452 - DNA, 18 bp, Artificial sequence
  synthetic polynucleotide sequence
cggcggtgccacacacga

SEQ ID NO: 20453 - DNA, 20 bp, Artificial sequence
  synthetic polynucleotide sequence
acgtgattggggaggacgca

SEQ ID NO: 20454 - DNA, 20 bp, Artificial sequence
  synthetic polynucleotide sequence
gccatcccgacggtgccaga

SEQ ID NO: 20455 - DNA, 18 bp, Artificial sequence
  synthetic polynucleotide sequence
gctgagcccctacggcga

SEQ ID NO: 20456 - DNA, 18 bp, Artificial sequence
  synthetic polynucleotide sequence
gttctgcccggcgccgaa

SEQ ID NO: 20457 - DNA, 22 bp, Artificial sequence
  synthetic polynucleotide sequence
ctgccctacagcgaagacaaga

SEQ ID NO: 20458 - DNA, 20 bp, Artificial sequence
  synthetic polynucleotide sequence
ggcctggttgcccgcgaaga

SEQ ID NO: 20459 - DNA, 18 bp, Artificial sequence
  synthetic polynucleotide sequence
cgcagttaagggggcaca

SEQ ID NO: 20460 - DNA, 18 bp, Artificial sequence
  synthetic polynucleotide sequence
ccactgccttgggcacca

SEQ ID NO: 20461 - DNA, 20 bp, Artificial sequence
  synthetic polynucleotide sequence
gtggaggtgacagaggagga

SEQ ID NO: 20462 - DNA, 20 bp, Artificial sequence
  synthetic polynucleotide sequence
ggggctcaaacgggttccca

SEQ ID NO: 20463 - DNA, 18 bp, Artificial sequence
  synthetic polynucleotide sequence
gctggacaagaaccccga

SEQ ID NO: 20464 - DNA, 18 bp, Artificial sequence
  synthetic polynucleotide sequence
cccatgcctcgtgaccca

SEQ ID NO: 20465 - DNA, 19 bp, Artificial sequence
  synthetic polynucleotide sequence
ccggcagttggctgcacca

SEQ ID NO: 20466 - DNA, 21 bp, Artificial sequence
  synthetic polynucleotide sequence
catgtcgcaggcaatcatcca

SEQ ID NO: 20467 - DNA, 20 bp, Artificial sequence
  synthetic polynucleotide sequence
cctgagggaggctcctgaca

SEQ ID NO: 20468 - DNA, 21 bp, Artificial sequence
  synthetic polynucleotide sequence
cgaccttcacacaccagagca

SEQ ID NO: 20469 - DNA, 21 bp, Artificial sequence
  synthetic polynucleotide sequence
cggaacagcgcatcaaccgga

SEQ ID NO: 20470 - DNA, 21 bp, Artificial sequence
  synthetic polynucleotide sequence
ccctttacctcggccacacca

SEQ ID NO: 20471 - DNA, 18 bp, Artificial sequence
  synthetic polynucleotide sequence
tgaccctcaaccaggcca

SEQ ID NO: 20472 - DNA, 18 bp, Artificial sequence
  synthetic polynucleotide sequence
aatcacccagcagggcaa

SEQ ID NO: 20473 - DNA, 21 bp, Artificial sequence
  synthetic polynucleotide sequence
ggagtacctgcggaggaagca

SEQ ID NO: 20474 - DNA, 19 bp, Artificial sequence
  synthetic polynucleotide sequence
tatcaggggtggaggagca

SEQ ID NO: 20475 - DNA, 20 bp, Artificial sequence
  synthetic polynucleotide sequence
caagtctcagccaggcagca

SEQ ID NO: 20476 - DNA, 18 bp, Artificial sequence
  synthetic polynucleotide sequence
tgtgcccaagcaaccaca

SEQ ID NO: 20477 - DNA, 19 bp, Artificial sequence
  synthetic polynucleotide sequence
ctcggggtgaagaggccca

SEQ ID NO: 20478 - DNA, 19 bp, Artificial sequence
  synthetic polynucleotide sequence
gcactgacgctggggagga

SEQ ID NO: 20479 - DNA, 20 bp, Artificial sequence
  synthetic polynucleotide sequence
gaatgcggccagcccatgga

SEQ ID NO: 20480 - DNA, 20 bp, Artificial sequence
  synthetic polynucleotide sequence
ctgaggactccatgggcaca

SEQ ID NO: 20481 - DNA, 19 bp, Artificial sequence
  synthetic polynucleotide sequence
ccctcctccagcccagaca

SEQ ID NO: 20482 - DNA, 19 bp, Artificial sequence
  synthetic polynucleotide sequence
gtgggagggcaggaaggga

SEQ ID NO: 20483 - DNA, 21 bp, Artificial sequence
  synthetic polynucleotide sequence
tgtgcagaggaaggaaccaga

SEQ ID NO: 20484 - DNA, 19 bp, Artificial sequence
  synthetic polynucleotide sequence
tcacagccgtaaccactga

SEQ ID NO: 20485 - DNA, 19 bp, Artificial sequence
  synthetic polynucleotide sequence
gggccacctgcactgccaa

SEQ ID NO: 20486 - DNA, 19 bp, Artificial sequence
  synthetic polynucleotide sequence
tgggaagagaagtcggcca

SEQ ID NO: 20487 - DNA, 18 bp, Artificial sequence
  synthetic polynucleotide sequence
ccaacaccgacgaccaga

SEQ ID NO: 20488 - DNA, 18 bp, Artificial sequence
  synthetic polynucleotide sequence
cgtccagcgtgaaggcca

SEQ ID NO: 20489 - DNA, 20 bp, Artificial sequence
  synthetic polynucleotide sequence
gagaagaaccgaggcagcaa

SEQ ID NO: 20490 - DNA, 18 bp, Artificial sequence
  synthetic polynucleotide sequence
taagggccaggcttggga

SEQ ID NO: 20491 - DNA, 18 bp, Artificial sequence
  synthetic polynucleotide sequence
cggccgtcagcgaaagca

SEQ ID NO: 20492 - DNA, 18 bp, Artificial sequence
  synthetic polynucleotide sequence
cccaatccacatgacgca

SEQ ID NO: 20493 - DNA, 18 bp, Artificial sequence
  synthetic polynucleotide sequence
ggaaggggcgaaaagcga

SEQ ID NO: 20494 - DNA, 18 bp, Artificial sequence
  synthetic polynucleotide sequence
ggcgtactgcatgcgcga

SEQ ID NO: 20495 - DNA, 17 bp, Artificial sequence
  synthetic polynucleotide sequence
ggacaagtcgggcagca

SEQ ID NO: 20496 - DNA, 18 bp, Artificial sequence
  synthetic polynucleotide sequence
tagccgcaccaggcagca

SEQ ID NO: 20497 - DNA, 20 bp, Artificial sequence
  synthetic polynucleotide sequence
ccacatcgctacgcccagga

SEQ ID NO: 20498 - DNA, 21 bp, Artificial sequence
  synthetic polynucleotide sequence
cctcttggaggaactggccca

SEQ ID NO: 20499 - DNA, 21 bp, Artificial sequence
  synthetic polynucleotide sequence
aggaccacggcttctcagaga

SEQ ID NO: 20500 - DNA, 21 bp, Artificial sequence
  synthetic polynucleotide sequence
acccgaagcaggaagtcagca

SEQ ID NO: 20501 - DNA, 21 bp, Artificial sequence
  synthetic polynucleotide sequence
aggctggcactgaatgcagca

SEQ ID NO: 20502 - DNA, 20 bp, Artificial sequence
  synthetic polynucleotide sequence
acaggacacgaaccgctcga

SEQ ID NO: 20503 - DNA, 21 bp, Artificial sequence
  synthetic polynucleotide sequence
tcagggccttctcaaccagga

SEQ ID NO: 20504 - DNA, 20 bp, Artificial sequence
  synthetic polynucleotide sequence
ccacaagtccgagctcagga

SEQ ID NO: 20505 - DNA, 20 bp, Artificial sequence
  synthetic polynucleotide sequence
ggcagttgctgcaggacaca

SEQ ID NO: 20506 - DNA, 20 bp, Artificial sequence
  synthetic polynucleotide sequence
ctggagcagggacaccagca

SEQ ID NO: 20507 - DNA, 19 bp, Artificial sequence
  synthetic polynucleotide sequence
tctggatggagtacggcga

SEQ ID NO: 20508 - DNA, 21 bp, Artificial sequence
  synthetic polynucleotide sequence
ccaggatgcacaggtccagca

SEQ ID NO: 20509 - DNA, 20 bp, Artificial sequence
  synthetic polynucleotide sequence
atgccctgtcaactccacca

SEQ ID NO: 20510 - DNA, 18 bp, Artificial sequence
  synthetic polynucleotide sequence
gcgtttccagccgaacca

SEQ ID NO: 20511 - DNA, 18 bp, Artificial sequence
  synthetic polynucleotide sequence
ccatgcggtacgcagaca

SEQ ID NO: 20512 - DNA, 18 bp, Artificial sequence
  synthetic polynucleotide sequence
catggtgagctgcagcca

SEQ ID NO: 20513 - DNA, 18 bp, Artificial sequence
  synthetic polynucleotide sequence
cccacaaccttcgagcca

SEQ ID NO: 20514 - DNA, 18 bp, Artificial sequence
  synthetic polynucleotide sequence
ggggagtccttgaggcca

SEQ ID NO: 20515 - DNA, 20 bp, Artificial sequence
  synthetic polynucleotide sequence
cagcatggtcgcaccagcga

SEQ ID NO: 20516 - DNA, 20 bp, Artificial sequence
  synthetic polynucleotide sequence
ccacgagccaggttccagca

SEQ ID NO: 20517 - DNA, 20 bp, Artificial sequence
  synthetic polynucleotide sequence
agctacgaggaccaaggcaa

SEQ ID NO: 20518 - DNA, 18 bp, Artificial sequence
  synthetic polynucleotide sequence
aagccatggggaccagga

SEQ ID NO: 20519 - DNA, 22 bp, Artificial sequence
  synthetic polynucleotide sequence
gatgcaccagagtggaatcaca

SEQ ID NO: 20520 - DNA, 20 bp, Artificial sequence
  synthetic polynucleotide sequence
ccgagagaactgcctcacga

SEQ ID NO: 20521 - DNA, 20 bp, Artificial sequence
  synthetic polynucleotide sequence
tgctgacaagtccggcacca

SEQ ID NO: 20522 - DNA, 21 bp, Artificial sequence
  synthetic polynucleotide sequence
catccgcatacctgagcacaa

SEQ ID NO: 20523 - DNA, 21 bp, Artificial sequence
  synthetic polynucleotide sequence
aaacagttcgacactgaccga

SEQ ID NO: 20524 - DNA, 18 bp, Artificial sequence
  synthetic polynucleotide sequence
cacggaacatggcgtcca

SEQ ID NO: 20525 - DNA, 19 bp, Artificial sequence
  synthetic polynucleotide sequence
cgcctcccactcagcagca

SEQ ID NO: 20526 - DNA, 22 bp, Artificial sequence
  synthetic polynucleotide sequence
ttcatcagatcagtggcaccca

SEQ ID NO: 20527 - DNA, 22 bp, Artificial sequence
  synthetic polynucleotide sequence
aagtgactggtaaccaccagca

SEQ ID NO: 20528 - DNA, 20 bp, Artificial sequence
  synthetic polynucleotide sequence
aagcctctagcaccacggga

SEQ ID NO: 20529 - DNA, 22 bp, Artificial sequence
  synthetic polynucleotide sequence
aacaccaccaagtcatggacca

SEQ ID NO: 20530 - DNA, 21 bp, Artificial sequence
  synthetic polynucleotide sequence
tgttcaacttcctgggcagca

SEQ ID NO: 20531 - DNA, 20 bp, Artificial sequence
  synthetic polynucleotide sequence
agaaggacgggcaggtcaca

SEQ ID NO: 20532 - DNA, 21 bp, Artificial sequence
  synthetic polynucleotide sequence
cactggtcatcatggccacga

SEQ ID NO: 20533 - DNA, 21 bp, Artificial sequence
  synthetic polynucleotide sequence
agccacacactgaaggctgaa

SEQ ID NO: 20534 - DNA, 20 bp, Artificial sequence
  synthetic polynucleotide sequence
gccagcagtagctcagtcca

SEQ ID NO: 20535 - DNA, 22 bp, Artificial sequence
  synthetic polynucleotide sequence
gaatggggaatggagtgaggaa

SEQ ID NO: 20536 - DNA, 21 bp, Artificial sequence
  synthetic polynucleotide sequence
atggatgcgctcacacctgca

SEQ ID NO: 20537 - DNA, 21 bp, Artificial sequence
  synthetic polynucleotide sequence
catcacaccacctacagccca

SEQ ID NO: 20538 - DNA, 18 bp, Artificial sequence
  synthetic polynucleotide sequence
ctggaagctgccggcgca

SEQ ID NO: 20539 - DNA, 19 bp, Artificial sequence
  synthetic polynucleotide sequence
tacccgaatggagtctgca

SEQ ID NO: 20540 - DNA, 21 bp, Artificial sequence
  synthetic polynucleotide sequence
cattctgacctccaacgacca

SEQ ID NO: 20541 - DNA, 20 bp, Artificial sequence
  synthetic polynucleotide sequence
ctgagcaggaaggacaagga

SEQ ID NO: 20542 - DNA, 21 bp, Artificial sequence
  synthetic polynucleotide sequence
tgttggtggcctgcacactca

SEQ ID NO: 20543 - DNA, 22 bp, Artificial sequence
  synthetic polynucleotide sequence
tccacgtggtagaagtgcagga

SEQ ID NO: 20544 - DNA, 20 bp, Artificial sequence
  synthetic polynucleotide sequence
tctggtaaggctgcctccga

SEQ ID NO: 20545 - DNA, 18 bp, Artificial sequence
  synthetic polynucleotide sequence
ccgccaggatggaaccaa

SEQ ID NO: 20546 - DNA, 18 bp, Artificial sequence
  synthetic polynucleotide sequence
tagggcctcgtggaagga

SEQ ID NO: 20547 - DNA, 20 bp, Artificial sequence
  synthetic polynucleotide sequence
cggaacaccctgcagccaga

SEQ ID NO: 20548 - DNA, 21 bp, Artificial sequence
  synthetic polynucleotide sequence
cggacctgctgacgaactgaa

SEQ ID NO: 20549 - DNA, 20 bp, Artificial sequence
  synthetic polynucleotide sequence
atcagcgtcatcggcgggaa

SEQ ID NO: 20550 - DNA, 19 bp, Artificial sequence
  synthetic polynucleotide sequence
tgaccttcacagacaggca

SEQ ID NO: 20551 - DNA, 21 bp, Artificial sequence
  synthetic polynucleotide sequence
acaagggtgctgaaccaggaa

SEQ ID NO: 20552 - DNA, 21 bp, Artificial sequence
  synthetic polynucleotide sequence
tcggacctgctgagagtccca

SEQ ID NO: 20553 - DNA, 20 bp, Artificial sequence
  synthetic polynucleotide sequence
ttcggaaaggggctccagca

SEQ ID NO: 20554 - DNA, 20 bp, Artificial sequence
  synthetic polynucleotide sequence
gagtcccagcgtccctgcca

SEQ ID NO: 20555 - DNA, 20 bp, Artificial sequence
  synthetic polynucleotide sequence
tgagcagcaggtggacagga

SEQ ID NO: 20556 - DNA, 20 bp, Artificial sequence
  synthetic polynucleotide sequence
gtggctcaggaggtcacaga

SEQ ID NO: 20557 - DNA, 20 bp, Artificial sequence
  synthetic polynucleotide sequence
aatccgatcagtccaaccca

SEQ ID NO: 20558 - DNA, 21 bp, Artificial sequence
  synthetic polynucleotide sequence
tgagaaggcttagactgggga

SEQ ID NO: 20559 - DNA, 21 bp, Artificial sequence
  synthetic polynucleotide sequence
cgagacgggacagtggatcca

SEQ ID NO: 20560 - DNA, 20 bp, Artificial sequence
  synthetic polynucleotide sequence
tcacacaggcctcagcctga

SEQ ID NO: 20561 - DNA, 17 bp, Artificial sequence
  synthetic polynucleotide sequence
catcgacccctcacgca

SEQ ID NO: 20562 - DNA, 19 bp, Artificial sequence
  synthetic polynucleotide sequence
atgtccaggagcacaccca

SEQ ID NO: 20563 - DNA, 21 bp, Artificial sequence
  synthetic polynucleotide sequence
atagagttcctacagacccca

SEQ ID NO: 20564 - DNA, 22 bp, Artificial sequence
  synthetic polynucleotide sequence
aggtgacaaagtgaggcaggga

SEQ ID NO: 20565 - DNA, 20 bp, Artificial sequence
  synthetic polynucleotide sequence
agggccccgtctacaaagga

SEQ ID NO: 20566 - DNA, 20 bp, Artificial sequence
  synthetic polynucleotide sequence
cttgggtgggatggagcaca

SEQ ID NO: 20567 - DNA, 20 bp, Artificial sequence
  synthetic polynucleotide sequence
gagagctacctccacgccaa

SEQ ID NO: 20568 - DNA, 20 bp, Artificial sequence
  synthetic polynucleotide sequence
gacagacttggccatcagga

SEQ ID NO: 20569 - DNA, 21 bp, Artificial sequence
  synthetic polynucleotide sequence
cccaaacccagtctggcagca

SEQ ID NO: 20570 - DNA, 21 bp, Artificial sequence
  synthetic polynucleotide sequence
aggacaggtggaagaagggca

SEQ ID NO: 20571 - DNA, 20 bp, Artificial sequence
  synthetic polynucleotide sequence
tgtcccccgtacactgcgaa

SEQ ID NO: 20572 - DNA, 20 bp, Artificial sequence
  synthetic polynucleotide sequence
ccccaccaagctcctcacca

SEQ ID NO: 20573 - DNA, 21 bp, Artificial sequence
  synthetic polynucleotide sequence
gtcaggagaatgggatggcca

SEQ ID NO: 20574 - DNA, 20 bp, Artificial sequence
  synthetic polynucleotide sequence
ctggccgcacggtcctcaga

SEQ ID NO: 20575 - DNA, 20 bp, Artificial sequence
  synthetic polynucleotide sequence
agcgaggaggtggaagtgca

SEQ ID NO: 20576 - DNA, 21 bp, Artificial sequence
  synthetic polynucleotide sequence
tactggtgccgtagtagcgga

SEQ ID NO: 20577 - DNA, 20 bp, Artificial sequence
  synthetic polynucleotide sequence
ctggtagaggatgcgccaca

SEQ ID NO: 20578 - DNA, 18 bp, Artificial sequence
  synthetic polynucleotide sequence
gggccattgtcggagaca

SEQ ID NO: 20579 - DNA, 18 bp, Artificial sequence
  synthetic polynucleotide sequence
gaagcgctctcccaacga

SEQ ID NO: 20580 - DNA, 18 bp, Artificial sequence
  synthetic polynucleotide sequence
catggtgggggaaccgga

SEQ ID NO: 20581 - DNA, 21 bp, Artificial sequence
  synthetic polynucleotide sequence
acgtgcctacatgaaggggca

SEQ ID NO: 20582 - DNA, 19 bp, Artificial sequence
  synthetic polynucleotide sequence
ccgtggtgtgcaaggccca

SEQ ID NO: 20583 - DNA, 21 bp, Artificial sequence
  synthetic polynucleotide sequence
gagctgatcgaagcgctgcaa

SEQ ID NO: 20584 - DNA, 20 bp, Artificial sequence
  synthetic polynucleotide sequence
cacactgctcaccggcgtca

SEQ ID NO: 20585 - DNA, 20 bp, Artificial sequence
  synthetic polynucleotide sequence
tggcagatctggacagtgga

SEQ ID NO: 20586 - DNA, 19 bp, Artificial sequence
  synthetic polynucleotide sequence
tgaaacagggtgcagtgca

SEQ ID NO: 20587 - DNA, 18 bp, Artificial sequence
  synthetic polynucleotide sequence
gggcctgaccgtccggaa

SEQ ID NO: 20588 - DNA, 20 bp, Artificial sequence
  synthetic polynucleotide sequence
gctagctgcgcatccgcgga

SEQ ID NO: 20589 - DNA, 21 bp, Artificial sequence
  synthetic polynucleotide sequence
gcggcaaagacctgtgccaga

SEQ ID NO: 20590 - DNA, 20 bp, Artificial sequence
  synthetic polynucleotide sequence
gtgggggatagaggcctgga

SEQ ID NO: 20591 - DNA, 21 bp, Artificial sequence
  synthetic polynucleotide sequence
gtgatgcagggatgcctggaa

SEQ ID NO: 20592 - DNA, 21 bp, Artificial sequence
  synthetic polynucleotide sequence
taaacgctgaagaggactgga

SEQ ID NO: 20593 - DNA, 18 bp, Artificial sequence
  synthetic polynucleotide sequence
tggaaaggctggatgcaa

SEQ ID NO: 20594 - DNA, 20 bp, Artificial sequence
  synthetic polynucleotide sequence
atgcagcaaccagaactcga

SEQ ID NO: 20595 - DNA, 21 bp, Artificial sequence
  synthetic polynucleotide sequence
gtacttggagtacggcagcca

SEQ ID NO: 20596 - DNA, 21 bp, Artificial sequence
  synthetic polynucleotide sequence
ccttcagtgcctgaggctcca

SEQ ID NO: 20597 - DNA, 20 bp, Artificial sequence
  synthetic polynucleotide sequence
ctgcaggcggtggaggagaa

SEQ ID NO: 20598 - DNA, 21 bp, Artificial sequence
  synthetic polynucleotide sequence
ggtcgtcgaacatgctgccga

SEQ ID NO: 20599 - DNA, 19 bp, Artificial sequence
  synthetic polynucleotide sequence
gtgccgggagagagagcca

SEQ ID NO: 20600 - DNA, 21 bp, Artificial sequence
  synthetic polynucleotide sequence
ggaaggctagaagctggagga

SEQ ID NO: 20601 - DNA, 18 bp, Artificial sequence
  synthetic polynucleotide sequence
cacaccgcccagagcaca

SEQ ID NO: 20602 - DNA, 18 bp, Artificial sequence
  synthetic polynucleotide sequence
caccacggcaggcctgga

SEQ ID NO: 20603 - DNA, 18 bp, Artificial sequence
  synthetic polynucleotide sequence
accctgagcaggcaccca

SEQ ID NO: 20604 - DNA, 18 bp, Artificial sequence
  synthetic polynucleotide sequence
cctgggacagtggccaga

SEQ ID NO: 20605 - DNA, 21 bp, Artificial sequence
  synthetic polynucleotide sequence
atcatcatgcaagcctgccga

SEQ ID NO: 20606 - DNA, 20 bp, Artificial sequence
  synthetic polynucleotide sequence
taccttgcaagagccgacca

SEQ ID NO: 20607 - DNA, 21 bp, Artificial sequence
  synthetic polynucleotide sequence
acagcccacaaaccatcccaa

SEQ ID NO: 20608 - DNA, 21 bp, Artificial sequence
  synthetic polynucleotide sequence
acacatccaccagggtctgga

SEQ ID NO: 20609 - DNA, 21 bp, Artificial sequence
  synthetic polynucleotide sequence
gatggaaagaaccacgcagga

SEQ ID NO: 20610 - DNA, 20 bp, Artificial sequence
  synthetic polynucleotide sequence
ttgaggcaggcatagccgca

SEQ ID NO: 20611 - DNA, 20 bp, Artificial sequence
  synthetic polynucleotide sequence
aaaataccagtggaggccga

SEQ ID NO: 20612 - DNA, 20 bp, Artificial sequence
  synthetic polynucleotide sequence
caaagcgactggatgaacca

SEQ ID NO: 20613 - DNA, 20 bp, Artificial sequence
  synthetic polynucleotide sequence
aagacccacgtggagaagga

SEQ ID NO: 20614 - DNA, 19 bp, Artificial sequence
  synthetic polynucleotide sequence
cctctaggtggcagcacca

SEQ ID NO: 20615 - DNA, 21 bp, Artificial sequence
  synthetic polynucleotide sequence
gcctgcaaggaatggggctca

SEQ ID NO: 20616 - DNA, 21 bp, Artificial sequence
  synthetic polynucleotide sequence
gtctggcagcaaatgccctca

SEQ ID NO: 20617 - DNA, 21 bp, Artificial sequence
  synthetic polynucleotide sequence
ctgctggagctgacttcctca

SEQ ID NO: 20618 - DNA, 20 bp, Artificial sequence
  synthetic polynucleotide sequence
gcattgaggcaaaacaggga

SEQ ID NO: 20619 - DNA, 19 bp, Artificial sequence
  synthetic polynucleotide sequence
gcgttcgaaacggaacaga

SEQ ID NO: 20620 - DNA, 20 bp, Artificial sequence
  synthetic polynucleotide sequence
gcttaagaggatgcaggcga

SEQ ID NO: 20621 - DNA, 18 bp, Artificial sequence
  synthetic polynucleotide sequence
ccccacgatgactgcaca

SEQ ID NO: 20622 - DNA, 22 bp, Artificial sequence
  synthetic polynucleotide sequence
atacagcagatgaagcagtcca

SEQ ID NO: 20623 - DNA, 23 bp, Artificial sequence
  synthetic polynucleotide sequence
gaagaggatgcatctgagcaaga

SEQ ID NO: 20624 - DNA, 21 bp, Artificial sequence
  synthetic polynucleotide sequence
tcggcttgtccaggaagaaga

SEQ ID NO: 20625 - DNA, 18 bp, Artificial sequence
  synthetic polynucleotide sequence
tcgaccagctggacgcca

SEQ ID NO: 20626 - DNA, 21 bp, Artificial sequence
  synthetic polynucleotide sequence
cagggtctcaacgtaccagga

SEQ ID NO: 20627 - DNA, 21 bp, Artificial sequence
  synthetic polynucleotide sequence
acaggagatcaaccctgagga

SEQ ID NO: 20628 - DNA, 18 bp, Artificial sequence
  synthetic polynucleotide sequence
accagcagggggaagtca

SEQ ID NO: 20629 - DNA, 19 bp, Artificial sequence
  synthetic polynucleotide sequence
gacaaccccgatctgagca

SEQ ID NO: 20630 - DNA, 20 bp, Artificial sequence
  synthetic polynucleotide sequence
ctgtgacattcaccacccca

SEQ ID NO: 20631 - DNA, 18 bp, Artificial sequence
  synthetic polynucleotide sequence
caccagcttccaccgcaa

SEQ ID NO: 20632 - DNA, 18 bp, Artificial sequence
  synthetic polynucleotide sequence
agccgatcaggaagccca

SEQ ID NO: 20633 - DNA, 21 bp, Artificial sequence
  synthetic polynucleotide sequence
ccatcagcgcatttcacggca

SEQ ID NO: 20634 - DNA, 21 bp, Artificial sequence
  synthetic polynucleotide sequence
tctccatgcacagcgtgtcca

SEQ ID NO: 20635 - DNA, 20 bp, Artificial sequence
  synthetic polynucleotide sequence
taaggaacagcttccaccca

SEQ ID NO: 20636 - DNA, 22 bp, Artificial sequence
  synthetic polynucleotide sequence
ggaaaccacttcagagatggca

SEQ ID NO: 20637 - DNA, 21 bp, Artificial sequence
  synthetic polynucleotide sequence
gcagtcctgaacccagctcca

SEQ ID NO: 20638 - DNA, 22 bp, Artificial sequence
  synthetic polynucleotide sequence
caatctgtgccacgatgccaca

SEQ ID NO: 20639 - DNA, 19 bp, Artificial sequence
  synthetic polynucleotide sequence
ggggatgactgcggccaca

SEQ ID NO: 20640 - DNA, 21 bp, Artificial sequence
  synthetic polynucleotide sequence
gctctgagatctgggccacga

SEQ ID NO: 20641 - DNA, 21 bp, Artificial sequence
  synthetic polynucleotide sequence
ggacagagggaggagcagcaa

SEQ ID NO: 20642 - DNA, 20 bp, Artificial sequence
  synthetic polynucleotide sequence
tgacgctgggatctgaggca

SEQ ID NO: 20643 - DNA, 19 bp, Artificial sequence
  synthetic polynucleotide sequence
tcactgaggtccaccctga

SEQ ID NO: 20644 - DNA, 20 bp, Artificial sequence
  synthetic polynucleotide sequence
caagtgagatccggactgca

SEQ ID NO: 20645 - DNA, 20 bp, Artificial sequence
  synthetic polynucleotide sequence
gcccacgcgctcatctccga

SEQ ID NO: 20646 - DNA, 20 bp, Artificial sequence
  synthetic polynucleotide sequence
gacggacgccacgggtcgaa

SEQ ID NO: 20647 - DNA, 21 bp, Artificial sequence
  synthetic polynucleotide sequence
ttcctgaccagcgtccaggaa

SEQ ID NO: 20648 - DNA, 20 bp, Artificial sequence
  synthetic polynucleotide sequence
gaggaccgcggagaagagga

SEQ ID NO: 20649 - DNA, 25 bp, Artificial sequence
  synthetic polynucleotide sequence
caagaggagctagtcaacaaaggga

SEQ ID NO: 20650 - DNA, 20 bp, Artificial sequence
  synthetic polynucleotide sequence
gtggaggagacacaggagga

SEQ ID NO: 20651 - DNA, 22 bp, Artificial sequence
  synthetic polynucleotide sequence
accttgagccacactgacccaa

SEQ ID NO: 20652 - DNA, 20 bp, Artificial sequence
  synthetic polynucleotide sequence
ctggggcaagtcttccagca

SEQ ID NO: 20653 - DNA, 21 bp, Artificial sequence
  synthetic polynucleotide sequence
caaccaggagcaggagtcaga

SEQ ID NO: 20654 - DNA, 19 bp, Artificial sequence
  synthetic polynucleotide sequence
ttccatgctaacgagcgca

SEQ ID NO: 20655 - DNA, 19 bp, Artificial sequence
  synthetic polynucleotide sequence
gcctctgtgagcaccctga

SEQ ID NO: 20656 - DNA, 18 bp, Artificial sequence
  synthetic polynucleotide sequence
tgaaaggtgttgccgcca

SEQ ID NO: 20657 - DNA, 20 bp, Artificial sequence
  synthetic polynucleotide sequence
gtgagctgccacgaccccaa

SEQ ID NO: 20658 - DNA, 21 bp, Artificial sequence
  synthetic polynucleotide sequence
agtaggatgacgactccagca

SEQ ID NO: 20659 - DNA, 20 bp, Artificial sequence
  synthetic polynucleotide sequence
tagaggagtggacacgagca

SEQ ID NO: 20660 - DNA, 18 bp, Artificial sequence
  synthetic polynucleotide sequence
acaggaggcagaaggcga

SEQ ID NO: 20661 - DNA, 18 bp, Artificial sequence
  synthetic polynucleotide sequence
gcatcccgatggcactca

SEQ ID NO: 20662 - DNA, 21 bp, Artificial sequence
  synthetic polynucleotide sequence
gtcacagacggtgtggacgta

SEQ ID NO: 20663 - DNA, 18 bp, Artificial sequence
  synthetic polynucleotide sequence
ccaggaccgggatcccca

SEQ ID NO: 20664 - DNA, 20 bp, Artificial sequence
  synthetic polynucleotide sequence
gaaggcagaaccattaggca

SEQ ID NO: 20665 - DNA, 18 bp, Artificial sequence
  synthetic polynucleotide sequence
acggcgtgtggaaggtga

SEQ ID NO: 20666 - DNA, 19 bp, Artificial sequence
  synthetic polynucleotide sequence
cagaaggagatgcaggcga

SEQ ID NO: 20667 - DNA, 20 bp, Artificial sequence
  synthetic polynucleotide sequence
cgggcgccactgacttcgca

SEQ ID NO: 20668 - DNA, 20 bp, Artificial sequence
  synthetic polynucleotide sequence
caggcgggtgaggaactgca

SEQ ID NO: 20669 - DNA, 21 bp, Artificial sequence
  synthetic polynucleotide sequence
agagagagcacgaatggagca

SEQ ID NO: 20670 - DNA, 20 bp, Artificial sequence
  synthetic polynucleotide sequence
atcgcgcgatattgcagcca

SEQ ID NO: 20671 - DNA, 19 bp, Artificial sequence
  synthetic polynucleotide sequence
caggaggactccagcgaga

SEQ ID NO: 20672 - DNA, 18 bp, Artificial sequence
  synthetic polynucleotide sequence
tggcagcacccacaggca

SEQ ID NO: 20673 - DNA, 22 bp, Artificial sequence
  synthetic polynucleotide sequence
agaaagagaagcaggcaaggta

SEQ ID NO: 20674 - DNA, 19 bp, Artificial sequence
  synthetic polynucleotide sequence
ctccagacagcccatacca

SEQ ID NO: 20675 - DNA, 18 bp, Artificial sequence
  synthetic polynucleotide sequence
ggcgccatctatcaccga

SEQ ID NO: 20676 - DNA, 20 bp, Artificial sequence
  synthetic polynucleotide sequence
catccagagacaaccagcca

SEQ ID NO: 20677 - DNA, 19 bp, Artificial sequence
  synthetic polynucleotide sequence
gtgccattaccacctgcca

SEQ ID NO: 20678 - DNA, 19 bp, Artificial sequence
  synthetic polynucleotide sequence
gatggagggagggcatcaa

SEQ ID NO: 20679 - DNA, 21 bp, Artificial sequence
  synthetic polynucleotide sequence
cgtgtcagaggagcagctgca

SEQ ID NO: 20680 - DNA, 20 bp, Artificial sequence
  synthetic polynucleotide sequence
caggtgcccgcacggctcaa

SEQ ID NO: 20681 - DNA, 21 bp, Artificial sequence
  synthetic polynucleotide sequence
caaggaactctgagccctcca

SEQ ID NO: 20682 - DNA, 20 bp, Artificial sequence
  synthetic polynucleotide sequence
ttgagaaggcggaccctgca

SEQ ID NO: 20683 - DNA, 18 bp, Artificial sequence
  synthetic polynucleotide sequence
caggagcaccaaccacga

SEQ ID NO: 20684 - DNA, 18 bp, Artificial sequence
  synthetic polynucleotide sequence
ccggccacccgtttagca

SEQ ID NO: 20685 - DNA, 22 bp, Artificial sequence
  synthetic polynucleotide sequence
atgcagaatggctacccagtga

SEQ ID NO: 20686 - DNA, 18 bp, Artificial sequence
  synthetic polynucleotide sequence
atgagcagcagcacgcca

SEQ ID NO: 20687 - DNA, 18 bp, Artificial sequence
  synthetic polynucleotide sequence
tcgtgaagctgccacgaa

SEQ ID NO: 20688 - DNA, 19 bp, Artificial sequence
  synthetic polynucleotide sequence
ggggaacaccagaaagcca

SEQ ID NO: 20689 - DNA, 18 bp, Artificial sequence
  synthetic polynucleotide sequence
cgcatacggggtgacgaa

SEQ ID NO: 20690 - DNA, 18 bp, Artificial sequence
  synthetic polynucleotide sequence
ggcagcaggcattcagga

SEQ ID NO: 20691 - DNA, 24 bp, Artificial sequence
  synthetic polynucleotide sequence
cagtgagacactcacagaaggaga

SEQ ID NO: 20692 - DNA, 18 bp, Artificial sequence
  synthetic polynucleotide sequence
cccaacttggacacccca

SEQ ID NO: 20693 - DNA, 18 bp, Artificial sequence
  synthetic polynucleotide sequence
cggtgacctcggcggaga

SEQ ID NO: 20694 - DNA, 19 bp, Artificial sequence
  synthetic polynucleotide sequence
caggtcagcatggaaccca

SEQ ID NO: 20695 - DNA, 19 bp, Artificial sequence
  synthetic polynucleotide sequence
gggagaagggcttcgacca

SEQ ID NO: 20696 - DNA, 18 bp, Artificial sequence
  synthetic polynucleotide sequence
gcaccttcccggcaagca

SEQ ID NO: 20697 - DNA, 20 bp, Artificial sequence
  synthetic polynucleotide sequence
ccaggaaggggcggggagaa

SEQ ID NO: 20698 - DNA, 20 bp, Artificial sequence
  synthetic polynucleotide sequence
cacgcaaactgctcccgcca

SEQ ID NO: 20699 - DNA, 20 bp, Artificial sequence
  synthetic polynucleotide sequence
gaggaggatcctgcggagga

SEQ ID NO: 20700 - DNA, 20 bp, Artificial sequence
  synthetic polynucleotide sequence
atcttggcgccgaggccaga

SEQ ID NO: 20701 - DNA, 20 bp, Artificial sequence
  synthetic polynucleotide sequence
gggatcagctagcgtcgcga

SEQ ID NO: 20702 - DNA, 20 bp, Artificial sequence
  synthetic polynucleotide sequence
cctcagctgaaccgctggga

SEQ ID NO: 20703 - DNA, 21 bp, Artificial sequence
  synthetic polynucleotide sequence
gggaggcaagcgcaaagctga

SEQ ID NO: 20704 - DNA, 20 bp, Artificial sequence
  synthetic polynucleotide sequence
gctccggctccaaacctcga

SEQ ID NO: 20705 - DNA, 21 bp, Artificial sequence
  synthetic polynucleotide sequence
ggccaaggaagctcactgcca

SEQ ID NO: 20706 - DNA, 21 bp, Artificial sequence
  synthetic polynucleotide sequence
ggaagaggaggatgacgtgga

SEQ ID NO: 20707 - DNA, 21 bp, Artificial sequence
  synthetic polynucleotide sequence
tgccacagacagcagtggaga

SEQ ID NO: 20708 - DNA, 21 bp, Artificial sequence
  synthetic polynucleotide sequence
ttgagcttcatcttctggaca

SEQ ID NO: 20709 - DNA, 19 bp, Artificial sequence
  synthetic polynucleotide sequence
ccaggtgaagcccgagaca

SEQ ID NO: 20710 - DNA, 18 bp, Artificial sequence
  synthetic polynucleotide sequence
tgaggcagttcgcggtga

SEQ ID NO: 20711 - DNA, 21 bp, Artificial sequence
  synthetic polynucleotide sequence
cgtggttaagggacaagtgga

SEQ ID NO: 20712 - DNA, 21 bp, Artificial sequence
  synthetic polynucleotide sequence
aattagctcagggcaatccaa

SEQ ID NO: 20713 - DNA, 18 bp, Artificial sequence
  synthetic polynucleotide sequence
cccctcgcctacaccaca

SEQ ID NO: 20714 - DNA, 18 bp, Artificial sequence
  synthetic polynucleotide sequence
agcctcgggctcggagga

SEQ ID NO: 20715 - DNA, 19 bp, Artificial sequence
  synthetic polynucleotide sequence
cccaacctggagagccaca

SEQ ID NO: 20716 - DNA, 18 bp, Artificial sequence
  synthetic polynucleotide sequence
agcgcaggtgtccaggga

SEQ ID NO: 20717 - DNA, 20 bp, Artificial sequence
  synthetic polynucleotide sequence
ccctagctcagctgaggcca

SEQ ID NO: 20718 - DNA, 18 bp, Artificial sequence
  synthetic polynucleotide sequence
ccacagggatcctggcga

SEQ ID NO: 20719 - DNA, 23 bp, Artificial sequence
  synthetic polynucleotide sequence
ctcgcaaacacacatgtcccaga

SEQ ID NO: 20720 - DNA, 22 bp, Artificial sequence
  synthetic polynucleotide sequence
gctcatccatgaccccaacaca

SEQ ID NO: 20721 - DNA, 20 bp, Artificial sequence
  synthetic polynucleotide sequence
gagcacctgcgtgccctaca

SEQ ID NO: 20722 - DNA, 20 bp, Artificial sequence
  synthetic polynucleotide sequence
cgcgagatgtgatcggccca

SEQ ID NO: 20723 - DNA, 20 bp, Artificial sequence
  synthetic polynucleotide sequence
acacaggttgctgggcccaa

SEQ ID NO: 20724 - DNA, 21 bp, Artificial sequence
  synthetic polynucleotide sequence
gctcttggtcaaacgccagca

SEQ ID NO: 20725 - DNA, 18 bp, Artificial sequence
  synthetic polynucleotide sequence
ggatctgaagccccagca

SEQ ID NO: 20726 - DNA, 20 bp, Artificial sequence
  synthetic polynucleotide sequence
ctgtgactctgtaggggcca

SEQ ID NO: 20727 - DNA, 18 bp, Artificial sequence
  synthetic polynucleotide sequence
gaagccggcagtgagcaa

SEQ ID NO: 20728 - DNA, 18 bp, Artificial sequence
  synthetic polynucleotide sequence
ccgagggggtagtcagca

SEQ ID NO: 20729 - DNA, 21 bp, Artificial sequence
  synthetic polynucleotide sequence
ggatgacatcagagcactgca

SEQ ID NO: 20730 - DNA, 22 bp, Artificial sequence
  synthetic polynucleotide sequence
aacactgacgttcccaagagga

SEQ ID NO: 20731 - DNA, 20 bp, Artificial sequence
  synthetic polynucleotide sequence
cgccctgaggagacccacaa

SEQ ID NO: 20732 - DNA, 21 bp, Artificial sequence
  synthetic polynucleotide sequence
tcctcgggagagggtttccca

SEQ ID NO: 20733 - DNA, 19 bp, Artificial sequence
  synthetic polynucleotide sequence
ggggcgaggcttctgagga

SEQ ID NO: 20734 - DNA, 22 bp, Artificial sequence
  synthetic polynucleotide sequence
gcaagcagacagtctaagggga

SEQ ID NO: 20735 - DNA, 19 bp, Artificial sequence
  synthetic polynucleotide sequence
caggggcaccaggaagaga

SEQ ID NO: 20736 - DNA, 18 bp, Artificial sequence
  synthetic polynucleotide sequence
tgcggatgtcagccagca

SEQ ID NO: 20737 - DNA, 19 bp, Artificial sequence
  synthetic polynucleotide sequence
cgaggcccacaaccaggca

SEQ ID NO: 20738 - DNA, 20 bp, Artificial sequence
  synthetic polynucleotide sequence
cctgcggagcctggactgca

SEQ ID NO: 20739 - DNA, 17 bp, Artificial sequence
  synthetic polynucleotide sequence
gcctcaccccccaggga

SEQ ID NO: 20740 - DNA, 18 bp, Artificial sequence
  synthetic polynucleotide sequence
agtccgaccaccaccgca

SEQ ID NO: 20741 - DNA, 22 bp, Artificial sequence
  synthetic polynucleotide sequence
aagttacgggcagtggaacaga

SEQ ID NO: 20742 - DNA, 22 bp, Artificial sequence
  synthetic polynucleotide sequence
atagtgtgacagttccagggca

SEQ ID NO: 20743 - DNA, 20 bp, Artificial sequence
  synthetic polynucleotide sequence
cgacaagctgcagtgccaca

SEQ ID NO: 20744 - DNA, 20 bp, Artificial sequence
  synthetic polynucleotide sequence
gccgtccacctcatgcccga

SEQ ID NO: 20745 - DNA, 21 bp, Artificial sequence
  synthetic polynucleotide sequence
agatcctgggcaccttccaga

SEQ ID NO: 20746 - DNA, 21 bp, Artificial sequence
  synthetic polynucleotide sequence
ccacaatgagcagctcggcga

SEQ ID NO: 20747 - DNA, 18 bp, Artificial sequence
  synthetic polynucleotide sequence
cccagggaacgcagccca

SEQ ID NO: 20748 - DNA, 18 bp, Artificial sequence
  synthetic polynucleotide sequence
cggtgtacagcgccccca

SEQ ID NO: 20749 - DNA, 22 bp, Artificial sequence
  synthetic polynucleotide sequence
agatgcggcatcttcaacgaga

SEQ ID NO: 20750 - DNA, 22 bp, Artificial sequence
  synthetic polynucleotide sequence
caaatccgaagccaaaggccta

SEQ ID NO: 20751 - DNA, 20 bp, Artificial sequence
  synthetic polynucleotide sequence
tctggggagcccctggcaca

SEQ ID NO: 20752 - DNA, 21 bp, Artificial sequence
  synthetic polynucleotide sequence
acagtaacagagctgccacca

SEQ ID NO: 20753 - DNA, 20 bp, Artificial sequence
  synthetic polynucleotide sequence
gacatgaaccgccggaggga

SEQ ID NO: 20754 - DNA, 22 bp, Artificial sequence
  synthetic polynucleotide sequence
atcaacatcgtgaagggcctca

SEQ ID NO: 20755 - DNA, 20 bp, Artificial sequence
  synthetic polynucleotide sequence
taccccatgagcagggagga

SEQ ID NO: 20756 - DNA, 21 bp, Artificial sequence
  synthetic polynucleotide sequence
ccgccaaaagtgacgtggcca

SEQ ID NO: 20757 - DNA, 22 bp, Artificial sequence
  synthetic polynucleotide sequence
cacactcacataggcaggtaca

SEQ ID NO: 20758 - DNA, 25 bp, Artificial sequence
  synthetic polynucleotide sequence
gaaagcacagctgagtgatccaaga

SEQ ID NO: 20759 - DNA, 20 bp, Artificial sequence
  synthetic polynucleotide sequence
gagtccaaaagggcccggca

SEQ ID NO: 20760 - DNA, 19 bp, Artificial sequence
  synthetic polynucleotide sequence
tggtgtagagggagcggca

SEQ ID NO: 20761 - DNA, 21 bp, Artificial sequence
  synthetic polynucleotide sequence
atacaggagagagccaagcta

SEQ ID NO: 20762 - DNA, 21 bp, Artificial sequence
  synthetic polynucleotide sequence
ctgtgctagtagctgtctcca

SEQ ID NO: 20763 - DNA, 21 bp, Artificial sequence
  synthetic polynucleotide sequence
caaaccggttgcagtggagga

SEQ ID NO: 20764 - DNA, 21 bp, Artificial sequence
  synthetic polynucleotide sequence
aggtcccagtcaggcttccga

SEQ ID NO: 20765 - DNA, 20 bp, Artificial sequence
  synthetic polynucleotide sequence
cacccagccccaatccacca

SEQ ID NO: 20766 - DNA, 20 bp, Artificial sequence
  synthetic polynucleotide sequence
caggaaaagggggtagggga

SEQ ID NO: 20767 - DNA, 20 bp, Artificial sequence
  synthetic polynucleotide sequence
ggagcagggtgcagtctcca

SEQ ID NO: 20768 - DNA, 20 bp, Artificial sequence
  synthetic polynucleotide sequence
gcgtctgcaactcgcgggaa

SEQ ID NO: 20769 - DNA, 21 bp, Artificial sequence
  synthetic polynucleotide sequence
ccgagaccatcagctcaggga

SEQ ID NO: 20770 - DNA, 18 bp, Artificial sequence
  synthetic polynucleotide sequence
cgatggtgcgcgcctcca

SEQ ID NO: 20771 - DNA, 22 bp, Artificial sequence
  synthetic polynucleotide sequence
aacagcagaagatggctcagga

SEQ ID NO: 20772 - DNA, 19 bp, Artificial sequence
  synthetic polynucleotide sequence
ttccgagtggatgctgcca

SEQ ID NO: 20773 - DNA, 18 bp, Artificial sequence
  synthetic polynucleotide sequence
cagcagccaacaccacca

SEQ ID NO: 20774 - DNA, 19 bp, Artificial sequence
  synthetic polynucleotide sequence
cagtggatggagcagcaca

SEQ ID NO: 20775 - DNA, 20 bp, Artificial sequence
  synthetic polynucleotide sequence
cgtcgccgctgacctagaga

SEQ ID NO: 20776 - DNA, 22 bp, Artificial sequence
  synthetic polynucleotide sequence
atagagccacatgagtctgcca

SEQ ID NO: 20777 - DNA, 20 bp, Artificial sequence
  synthetic polynucleotide sequence
agagcagctcccaggaccaa

SEQ ID NO: 20778 - DNA, 20 bp, Artificial sequence
  synthetic polynucleotide sequence
gattccacgggcacatcgga

SEQ ID NO: 20779 - DNA, 21 bp, Artificial sequence
  synthetic polynucleotide sequence
agaaactcaagcggaccgaga

SEQ ID NO: 20780 - DNA, 18 bp, Artificial sequence
  synthetic polynucleotide sequence
ttgggggtgtcggccgca

SEQ ID NO: 20781 - DNA, 18 bp, Artificial sequence
  synthetic polynucleotide sequence
agatgggcccttccccca

SEQ ID NO: 20782 - DNA, 20 bp, Artificial sequence
  synthetic polynucleotide sequence
gaaactgataccccagcgga

SEQ ID NO: 20783 - DNA, 20 bp, Artificial sequence
  synthetic polynucleotide sequence
gcagacaggctggagcagga

SEQ ID NO: 20784 - DNA, 19 bp, Artificial sequence
  synthetic polynucleotide sequence
gacacaccaccggggctca

SEQ ID NO: 20785 - DNA, 21 bp, Artificial sequence
  synthetic polynucleotide sequence
gagcagctacagtggatgcca

SEQ ID NO: 20786 - DNA, 20 bp, Artificial sequence
  synthetic polynucleotide sequence
ctagctgccttagggaccaa

SEQ ID NO: 20787 - DNA, 21 bp, Artificial sequence
  synthetic polynucleotide sequence
gagactatcccctcagccaca

SEQ ID NO: 20788 - DNA, 20 bp, Artificial sequence
  synthetic polynucleotide sequence
ctccttggtggcagcaggga

SEQ ID NO: 20789 - DNA, 20 bp, Artificial sequence
  synthetic polynucleotide sequence
cggacctgggactgcagaga

SEQ ID NO: 20790 - DNA, 18 bp, Artificial sequence
  synthetic polynucleotide sequence
cgtgtcctagggcgggca

SEQ ID NO: 20791 - DNA, 21 bp, Artificial sequence
  synthetic polynucleotide sequence
gtgggcggcattcaaagagca

SEQ ID NO: 20792 - DNA, 20 bp, Artificial sequence
  synthetic polynucleotide sequence
gaactggaggctccctccga

SEQ ID NO: 20793 - DNA, 20 bp, Artificial sequence
  synthetic polynucleotide sequence
gtcccctgatctccgccaga

SEQ ID NO: 20794 - DNA, 20 bp, Artificial sequence
  synthetic polynucleotide sequence
attgaggcagctgctgggca

SEQ ID NO: 20795 - DNA, 22 bp, Artificial sequence
  synthetic polynucleotide sequence
gaaagagcagaccagatccaga

SEQ ID NO: 20796 - DNA, 21 bp, Artificial sequence
  synthetic polynucleotide sequence
caacgcaaggtgactctagga

SEQ ID NO: 20797 - DNA, 20 bp, Artificial sequence
  synthetic polynucleotide sequence
gagagtgagctgtggagcca

SEQ ID NO: 20798 - DNA, 23 bp, Artificial sequence
  synthetic polynucleotide sequence
gtggcaacaagacagactaggga

SEQ ID NO: 20799 - DNA, 21 bp, Artificial sequence
  synthetic polynucleotide sequence
aagaaatgcacgccttggcca

SEQ ID NO: 20800 - DNA, 19 bp, Artificial sequence
  synthetic polynucleotide sequence
tggcaaaggaagagtggca

SEQ ID NO: 20801 - DNA, 20 bp, Artificial sequence
  synthetic polynucleotide sequence
atgtacccctgacggcgaga

SEQ ID NO: 20802 - DNA, 22 bp, Artificial sequence
  synthetic polynucleotide sequence
tcaaagggcatagcctcaggga

SEQ ID NO: 20803 - DNA, 19 bp, Artificial sequence
  synthetic polynucleotide sequence
ggccagggtaaatccagca

SEQ ID NO: 20804 - DNA, 19 bp, Artificial sequence
  synthetic polynucleotide sequence
gactgcggagtagctggga

SEQ ID NO: 20805 - DNA, 20 bp, Artificial sequence
  synthetic polynucleotide sequence
acgagcccaaatccaggaga

SEQ ID NO: 20806 - DNA, 20 bp, Artificial sequence
  synthetic polynucleotide sequence
tccgcctgtgtgcagaagca

SEQ ID NO: 20807 - DNA, 20 bp, Artificial sequence
  synthetic polynucleotide sequence
cattgctgaccatcaggcca

SEQ ID NO: 20808 - DNA, 20 bp, Artificial sequence
  synthetic polynucleotide sequence
actggcatgggctgcatcca

SEQ ID NO: 20809 - DNA, 20 bp, Artificial sequence
  synthetic polynucleotide sequence
tagagggaaggctgcccgaa

SEQ ID NO: 20810 - DNA, 21 bp, Artificial sequence
  synthetic polynucleotide sequence
tcttgagtgatgcgcgggtca

SEQ ID NO: 20811 - DNA, 20 bp, Artificial sequence
  synthetic polynucleotide sequence
cttcgggcccacatggcaga

SEQ ID NO: 20812 - DNA, 20 bp, Artificial sequence
  synthetic polynucleotide sequence
ctcagtgctgccccatccca

SEQ ID NO: 20813 - DNA, 20 bp, Artificial sequence
  synthetic polynucleotide sequence
gcagctggaaggcgctccca

SEQ ID NO: 20814 - DNA, 20 bp, Artificial sequence
  synthetic polynucleotide sequence
ccacctcacagcctggtaca

SEQ ID NO: 20815 - DNA, 22 bp, Artificial sequence
  synthetic polynucleotide sequence
acatcccagaaaaccctccaga

SEQ ID NO: 20816 - DNA, 18 bp, Artificial sequence
  synthetic polynucleotide sequence
gtggggacgggccaagca

SEQ ID NO: 20817 - DNA, 21 bp, Artificial sequence
  synthetic polynucleotide sequence
ccagcagcgtggaatcccaga

SEQ ID NO: 20818 - DNA, 21 bp, Artificial sequence
  synthetic polynucleotide sequence
tgcgggatcagcttgaggcca

SEQ ID NO: 20819 - DNA, 20 bp, Artificial sequence
  synthetic polynucleotide sequence
cacgccttctccagccagca

SEQ ID NO: 20820 - DNA, 22 bp, Artificial sequence
  synthetic polynucleotide sequence
cctatcctctaaggctcccaga

SEQ ID NO: 20821 - DNA, 22 bp, Artificial sequence
  synthetic polynucleotide sequence
aaacgcaggtgaaatgccgcaa

SEQ ID NO: 20822 - DNA, 21 bp, Artificial sequence
  synthetic polynucleotide sequence
aggtcatccttccagcagcca

SEQ ID NO: 20823 - DNA, 22 bp, Artificial sequence
  synthetic polynucleotide sequence
gtgaacagctccagcaagccaa

SEQ ID NO: 20824 - DNA, 20 bp, Artificial sequence
  synthetic polynucleotide sequence
gacactgagctctccgcgga

SEQ ID NO: 20825 - DNA, 20 bp, Artificial sequence
  synthetic polynucleotide sequence
ctccacgaagtctggcccca

SEQ ID NO: 20826 - DNA, 20 bp, Artificial sequence
  synthetic polynucleotide sequence
gtggggggagaagagccgga

SEQ ID NO: 20827 - DNA, 21 bp, Artificial sequence
  synthetic polynucleotide sequence
ggaggtccctggagaaggaga

SEQ ID NO: 20828 - DNA, 21 bp, Artificial sequence
  synthetic polynucleotide sequence
agtaggcatagacgagcgtca

SEQ ID NO: 20829 - DNA, 23 bp, Artificial sequence
  synthetic polynucleotide sequence
taaaacgcattctgacacccaca

SEQ ID NO: 20830 - DNA, 21 bp, Artificial sequence
  synthetic polynucleotide sequence
acttgaggcggtatgggcaca

SEQ ID NO: 20831 - DNA, 19 bp, Artificial sequence
  synthetic polynucleotide sequence
ggactggcttggcacgcga

SEQ ID NO: 20832 - DNA, 21 bp, Artificial sequence
  synthetic polynucleotide sequence
caaggatggcacagttgccca

SEQ ID NO: 20833 - DNA, 20 bp, Artificial sequence
  synthetic polynucleotide sequence
cagggaggtggtgtcgcaga

SEQ ID NO: 20834 - DNA, 22 bp, Artificial sequence
  synthetic polynucleotide sequence
atctttgaggcaggcacaggta

SEQ ID NO: 20835 - DNA, 21 bp, Artificial sequence
  synthetic polynucleotide sequence
ccgcatggcagccaaagacaa

SEQ ID NO: 20836 - DNA, 19 bp, Artificial sequence
  synthetic polynucleotide sequence
tcctacttgccgcagacca

SEQ ID NO: 20837 - DNA, 22 bp, Artificial sequence
  synthetic polynucleotide sequence
gaaagacagagcaccttgagga

SEQ ID NO: 20838 - DNA, 19 bp, Artificial sequence
  synthetic polynucleotide sequence
ggcgtctgggcagcagcca

SEQ ID NO: 20839 - DNA, 18 bp, Artificial sequence
  synthetic polynucleotide sequence
agcaaccgcgtggtacga

SEQ ID NO: 20840 - DNA, 19 bp, Artificial sequence
  synthetic polynucleotide sequence
cgtccaaaccgtaccagca

SEQ ID NO: 20841 - DNA, 22 bp, Artificial sequence
  synthetic polynucleotide sequence
tccaggagaggaaggacaccaa

SEQ ID NO: 20842 - DNA, 21 bp, Artificial sequence
  synthetic polynucleotide sequence
aagtaatctgacggcggggca

SEQ ID NO: 20843 - DNA, 21 bp, Artificial sequence
  synthetic polynucleotide sequence
cctcatgcacacctcaagcga

SEQ ID NO: 20844 - DNA, 21 bp, Artificial sequence
  synthetic polynucleotide sequence
ttcaagactccctcgtagcca

SEQ ID NO: 20845 - DNA, 22 bp, Artificial sequence
  synthetic polynucleotide sequence
aaaggctctcagagagaaggca

SEQ ID NO: 20846 - DNA, 19 bp, Artificial sequence
  synthetic polynucleotide sequence
ggcacagctgtgacgtcga

SEQ ID NO: 20847 - DNA, 19 bp, Artificial sequence
  synthetic polynucleotide sequence
tcagcctagccaccctgga

SEQ ID NO: 20848 - DNA, 21 bp, Artificial sequence
  synthetic polynucleotide sequence
atctcctgatccacaggggca

SEQ ID NO: 20849 - DNA, 21 bp, Artificial sequence
  synthetic polynucleotide sequence
cctttgaccagtgcgccgaga

SEQ ID NO: 20850 - DNA, 20 bp, Artificial sequence
  synthetic polynucleotide sequence
ctccatcaccagccaacaca

SEQ ID NO: 20851 - DNA, 20 bp, Artificial sequence
  synthetic polynucleotide sequence
cagccaccactcaaccgcaa

SEQ ID NO: 20852 - DNA, 20 bp, Artificial sequence
  synthetic polynucleotide sequence
ttctgtcgaggggaaagaca

SEQ ID NO: 20853 - DNA, 20 bp, Artificial sequence
  synthetic polynucleotide sequence
cggctaagggaggaggagga

SEQ ID NO: 20854 - DNA, 20 bp, Artificial sequence
  synthetic polynucleotide sequence
gtccagcagcaggtcctcca

SEQ ID NO: 20855 - DNA, 21 bp, Artificial sequence
  synthetic polynucleotide sequence
caacatgaccaagggccagga

SEQ ID NO: 20856 - DNA, 22 bp, Artificial sequence
  synthetic polynucleotide sequence
aaatcgagggtgttggagagca

SEQ ID NO: 20857 - DNA, 20 bp, Artificial sequence
  synthetic polynucleotide sequence
cccaaccagggcatggagca

SEQ ID NO: 20858 - DNA, 20 bp, Artificial sequence
  synthetic polynucleotide sequence
aggagggggagggcacacaa

SEQ ID NO: 20859 - DNA, 19 bp, Artificial sequence
  synthetic polynucleotide sequence
ttccagcggtcccaggaga

SEQ ID NO: 20860 - DNA, 18 bp, Artificial sequence
  synthetic polynucleotide sequence
tgactcccctgcgcgcca

SEQ ID NO: 20861 - DNA, 22 bp, Artificial sequence
  synthetic polynucleotide sequence
caaagaagtcagcagcatggga

SEQ ID NO: 20862 - DNA, 21 bp, Artificial sequence
  synthetic polynucleotide sequence
tccacagctactgaggaccca

SEQ ID NO: 20863 - DNA, 21 bp, Artificial sequence
  synthetic polynucleotide sequence
aacagcagagtgtgagcccga

SEQ ID NO: 20864 - DNA, 20 bp, Artificial sequence
  synthetic polynucleotide sequence
gtctcctccagtcccaggga

SEQ ID NO: 20865 - DNA, 21 bp, Artificial sequence
  synthetic polynucleotide sequence
gtgtacgtggtgaaccccaca

SEQ ID NO: 20866 - DNA, 21 bp, Artificial sequence
  synthetic polynucleotide sequence
cgtccactttgaggcgcagga

SEQ ID NO: 20867 - DNA, 21 bp, Artificial sequence
  synthetic polynucleotide sequence
ggatgaagaccccggagccaa

SEQ ID NO: 20868 - DNA, 20 bp, Artificial sequence
  synthetic polynucleotide sequence
cgcgtggcagaagaggtcca

SEQ ID NO: 20869 - DNA, 21 bp, Artificial sequence
  synthetic polynucleotide sequence
tagttccagcccagctagtga

SEQ ID NO: 20870 - DNA, 18 bp, Artificial sequence
  synthetic polynucleotide sequence
gggaccctgtgccggaga

SEQ ID NO: 20871 - DNA, 20 bp, Artificial sequence
  synthetic polynucleotide sequence
gctcagtgggcagcagagca

SEQ ID NO: 20872 - DNA, 20 bp, Artificial sequence
  synthetic polynucleotide sequence
ctgccttcagtcccagggga

SEQ ID NO: 20873 - DNA, 20 bp, Artificial sequence
  synthetic polynucleotide sequence
gaagctgagcggagtcccca

SEQ ID NO: 20874 - DNA, 21 bp, Artificial sequence
  synthetic polynucleotide sequence
catcagagaccacaggtggga

SEQ ID NO: 20875 - DNA, 20 bp, Artificial sequence
  synthetic polynucleotide sequence
cacccagcgcatcctggaga

SEQ ID NO: 20876 - DNA, 20 bp, Artificial sequence
  synthetic polynucleotide sequence
gtccggtccagcttcccaga

SEQ ID NO: 20877 - DNA, 21 bp, Artificial sequence
  synthetic polynucleotide sequence
tcctccacacagggcctcaga

SEQ ID NO: 20878 - DNA, 19 bp, Artificial sequence
  synthetic polynucleotide sequence
tggggtgctgcactggaca

SEQ ID NO: 20879 - DNA, 21 bp, Artificial sequence
  synthetic polynucleotide sequence
gatcaagcatggctggcctga

SEQ ID NO: 20880 - DNA, 21 bp, Artificial sequence
  synthetic polynucleotide sequence
ttggccttcacaaggtgggca

SEQ ID NO: 20881 - DNA, 18 bp, Artificial sequence
  synthetic polynucleotide sequence
aaacggagctgcggagga

SEQ ID NO: 20882 - DNA, 18 bp, Artificial sequence
  synthetic polynucleotide sequence
ccccttccgcaacccgca

SEQ ID NO: 20883 - DNA, 21 bp, Artificial sequence
  synthetic polynucleotide sequence
ggatgtgtgtggggaggagga

SEQ ID NO: 20884 - DNA, 22 bp, Artificial sequence
  synthetic polynucleotide sequence
agattgctaagcagctggtcca

SEQ ID NO: 20885 - DNA, 18 bp, Artificial sequence
  synthetic polynucleotide sequence
ctgttcgcaagggcagca

SEQ ID NO: 20886 - DNA, 21 bp, Artificial sequence
  synthetic polynucleotide sequence
accgaggagcacatgagccta

SEQ ID NO: 20887 - DNA, 22 bp, Artificial sequence
  synthetic polynucleotide sequence
atgaacgagggcagaacttgga

SEQ ID NO: 20888 - DNA, 21 bp, Artificial sequence
  synthetic polynucleotide sequence
ctgccgtgagtgaagagcaca

SEQ ID NO: 20889 - DNA, 20 bp, Artificial sequence
  synthetic polynucleotide sequence
cttgagcccccagaaggaga

SEQ ID NO: 20890 - DNA, 20 bp, Artificial sequence
  synthetic polynucleotide sequence
gactccccagcacacaggga

SEQ ID NO: 20891 - DNA, 18 bp, Artificial sequence
  synthetic polynucleotide sequence
cgacggtgacggggagga

SEQ ID NO: 20892 - DNA, 21 bp, Artificial sequence
  synthetic polynucleotide sequence
tggcgcacccctgtaactcca

SEQ ID NO: 20893 - DNA, 20 bp, Artificial sequence
  synthetic polynucleotide sequence
aagaggctgcactgccagca

SEQ ID NO: 20894 - DNA, 19 bp, Artificial sequence
  synthetic polynucleotide sequence
tatggcctgggacgctgga

SEQ ID NO: 20895 - DNA, 22 bp, Artificial sequence
  synthetic polynucleotide sequence
aatgaactgggaccagcaagca

SEQ ID NO: 20896 - DNA, 19 bp, Artificial sequence
  synthetic polynucleotide sequence
tgcagagtcagtgccctga

SEQ ID NO: 20897 - DNA, 22 bp, Artificial sequence
  synthetic polynucleotide sequence
gtcaacgagctcatcaccaaca

SEQ ID NO: 20898 - DNA, 20 bp, Artificial sequence
  synthetic polynucleotide sequence
ctcggagaccatccgctcca

SEQ ID NO: 20899 - DNA, 21 bp, Artificial sequence
  synthetic polynucleotide sequence
catccagaacaccgcagccaa

SEQ ID NO: 20900 - DNA, 20 bp, Artificial sequence
  synthetic polynucleotide sequence
tgtcctccagtgccacctca

SEQ ID NO: 20901 - DNA, 20 bp, Artificial sequence
  synthetic polynucleotide sequence
ctggcgaaggcgatggcgga

SEQ ID NO: 20902 - DNA, 20 bp, Artificial sequence
  synthetic polynucleotide sequence
ctcctcctgcaggataccca

SEQ ID NO: 20903 - DNA, 22 bp, Artificial sequence
  synthetic polynucleotide sequence
agcagataagaaccgtgcccga

SEQ ID NO: 20904 - DNA, 21 bp, Artificial sequence
  synthetic polynucleotide sequence
gcctcaatgcagcctcctcca

SEQ ID NO: 20905 - DNA, 21 bp, Artificial sequence
  synthetic polynucleotide sequence
agagacgacgcattcaggaga

SEQ ID NO: 20906 - DNA, 21 bp, Artificial sequence
  synthetic polynucleotide sequence
tctgcataagcacgggttgca

SEQ ID NO: 20907 - DNA, 21 bp, Artificial sequence
  synthetic polynucleotide sequence
ggcactgtcagacacggagca

SEQ ID NO: 20908 - DNA, 23 bp, Artificial sequence
  synthetic polynucleotide sequence
gaatagcatgtagagcacaggca

SEQ ID NO: 20909 - DNA, 20 bp, Artificial sequence
  synthetic polynucleotide sequence
atcaggaaaggcatccaaca

SEQ ID NO: 20910 - DNA, 19 bp, Artificial sequence
  synthetic polynucleotide sequence
ccacatctgcctagcagca

SEQ ID NO: 20911 - DNA, 20 bp, Artificial sequence
  synthetic polynucleotide sequence
ggcccgatcccagcaggaca

SEQ ID NO: 20912 - DNA, 20 bp, Artificial sequence
  synthetic polynucleotide sequence
tcatcacagcggcgctgcca

SEQ ID NO: 20913 - DNA, 21 bp, Artificial sequence
  synthetic polynucleotide sequence
gagttcgccgagttccaggaa

SEQ ID NO: 20914 - DNA, 21 bp, Artificial sequence
  synthetic polynucleotide sequence
ctctactggcatgagctgcca

SEQ ID NO: 20915 - DNA, 22 bp, Artificial sequence
  synthetic polynucleotide sequence
agaaggctcaaacgtcactgga

SEQ ID NO: 20916 - DNA, 20 bp, Artificial sequence
  synthetic polynucleotide sequence
cttcaagcaacggctggtga

SEQ ID NO: 20917 - DNA, 20 bp, Artificial sequence
  synthetic polynucleotide sequence
ctgtcgacagctctccgaga

SEQ ID NO: 20918 - DNA, 20 bp, Artificial sequence
  synthetic polynucleotide sequence
gtgtaagggatcgggctgga

SEQ ID NO: 20919 - DNA, 21 bp, Artificial sequence
  synthetic polynucleotide sequence
agagccggatcaacataccca

SEQ ID NO: 20920 - DNA, 22 bp, Artificial sequence
  synthetic polynucleotide sequence
gtagtcaggaggcaggaacaca

SEQ ID NO: 20921 - DNA, 19 bp, Artificial sequence
  synthetic polynucleotide sequence
ccttgactggccgagggga

SEQ ID NO: 20922 - DNA, 19 bp, Artificial sequence
  synthetic polynucleotide sequence
cggtgaccccctctggaga

SEQ ID NO: 20923 - DNA, 21 bp, Artificial sequence
  synthetic polynucleotide sequence
cctgtctgggcgaaagtggca

SEQ ID NO: 20924 - DNA, 21 bp, Artificial sequence
  synthetic polynucleotide sequence
tgcacccagatttgaggcgga

SEQ ID NO: 20925 - DNA, 20 bp, Artificial sequence
  synthetic polynucleotide sequence
cagaggctgagatcccgcca

SEQ ID NO: 20926 - DNA, 19 bp, Artificial sequence
  synthetic polynucleotide sequence
ctgaaggggtcagccccca

SEQ ID NO: 20927 - DNA, 21 bp, Artificial sequence
  synthetic polynucleotide sequence
tgagaccctgcaggtgaagga

SEQ ID NO: 20928 - DNA, 18 bp, Artificial sequence
  synthetic polynucleotide sequence
gatgctgcccgggcctga

SEQ ID NO: 20929 - DNA, 22 bp, Artificial sequence
  synthetic polynucleotide sequence
aacccaggaccctcagtaccaa

SEQ ID NO: 20930 - DNA, 20 bp, Artificial sequence
  synthetic polynucleotide sequence
ctggagaaggccctgtctca

SEQ ID NO: 20931 - DNA, 21 bp, Artificial sequence
  synthetic polynucleotide sequence
ttgccaggatcttcagaggga

SEQ ID NO: 20932 - DNA, 21 bp, Artificial sequence
  synthetic polynucleotide sequence
tctcctggatgacactgcgca

SEQ ID NO: 20933 - DNA, 18 bp, Artificial sequence
  synthetic polynucleotide sequence
tgaggccctggagaagga

SEQ ID NO: 20934 - DNA, 18 bp, Artificial sequence
  synthetic polynucleotide sequence
cagagggaaggcaggcga

SEQ ID NO: 20935 - DNA, 21 bp, Artificial sequence
  synthetic polynucleotide sequence
gcagctcagctagaagaagca

SEQ ID NO: 20936 - DNA, 21 bp, Artificial sequence
  synthetic polynucleotide sequence
caacatgactttcacggagga

SEQ ID NO: 20937 - DNA, 21 bp, Artificial sequence
  synthetic polynucleotide sequence
ggggagaaagccctgtgggaa

SEQ ID NO: 20938 - DNA, 21 bp, Artificial sequence
  synthetic polynucleotide sequence
tgctctccggcaatgtggcca

SEQ ID NO: 20939 - DNA, 22 bp, Artificial sequence
  synthetic polynucleotide sequence
agaactacaaggaagggccaga

SEQ ID NO: 20940 - DNA, 20 bp, Artificial sequence
  synthetic polynucleotide sequence
tatggcacggaacttcagca

SEQ ID NO: 20941 - DNA, 20 bp, Artificial sequence
  synthetic polynucleotide sequence
ctcggacgcggagctctgga

SEQ ID NO: 20942 - DNA, 18 bp, Artificial sequence
  synthetic polynucleotide sequence
taccagggcccggcagga

SEQ ID NO: 20943 - DNA, 21 bp, Artificial sequence
  synthetic polynucleotide sequence
agtgaaggacagctggaggaa

SEQ ID NO: 20944 - DNA, 20 bp, Artificial sequence
  synthetic polynucleotide sequence
gaccaaggaccggggtctga

SEQ ID NO: 20945 - DNA, 21 bp, Artificial sequence
  synthetic polynucleotide sequence
gcagaggcctctaatgcagga

SEQ ID NO: 20946 - DNA, 20 bp, Artificial sequence
  synthetic polynucleotide sequence
gagggacttgaggtgccgca

SEQ ID NO: 20947 - DNA, 20 bp, Artificial sequence
  synthetic polynucleotide sequence
tcccagggaccaagaagcca

SEQ ID NO: 20948 - DNA, 20 bp, Artificial sequence
  synthetic polynucleotide sequence
ctgcttcagtgcgggcagga

SEQ ID NO: 20949 - DNA, 21 bp, Artificial sequence
  synthetic polynucleotide sequence
cctcttccaggaacgggaaca

SEQ ID NO: 20950 - DNA, 22 bp, Artificial sequence
  synthetic polynucleotide sequence
gcatctgttcccacaagagcca

SEQ ID NO: 20951 - DNA, 19 bp, Artificial sequence
  synthetic polynucleotide sequence
gccatcgggaggaccagca

SEQ ID NO: 20952 - DNA, 19 bp, Artificial sequence
  synthetic polynucleotide sequence
ctctgggtgctgcgggaga

SEQ ID NO: 20953 - DNA, 20 bp, Artificial sequence
  synthetic polynucleotide sequence
gggccccaggtatccaggaa

SEQ ID NO: 20954 - DNA, 19 bp, Artificial sequence
  synthetic polynucleotide sequence
gcaaccggggagtgtgcca

SEQ ID NO: 20955 - DNA, 20 bp, Artificial sequence
  synthetic polynucleotide sequence
gaggacccaaggagagcaca

SEQ ID NO: 20956 - DNA, 18 bp, Artificial sequence
  synthetic polynucleotide sequence
tgagggaggttggggcaa

SEQ ID NO: 20957 - DNA, 22 bp, Artificial sequence
  synthetic polynucleotide sequence
acgacagtgagatgaagcccca

SEQ ID NO: 20958 - DNA, 21 bp, Artificial sequence
  synthetic polynucleotide sequence
tgtctgaagagagcctcctga

SEQ ID NO: 20959 - DNA, 23 bp, Artificial sequence
  synthetic polynucleotide sequence
acattatatgatggcacaaggca

SEQ ID NO: 20960 - DNA, 18 bp, Artificial sequence
  synthetic polynucleotide sequence
ccacaagcctggcaggaa

SEQ ID NO: 20961 - DNA, 21 bp, Artificial sequence
  synthetic polynucleotide sequence
caggcacagagtttggggaca

SEQ ID NO: 20962 - DNA, 20 bp, Artificial sequence
  synthetic polynucleotide sequence
cttcactcccagggggccca

SEQ ID NO: 20963 - DNA, 22 bp, Artificial sequence
  synthetic polynucleotide sequence
taacatccactcaggtgccaca

SEQ ID NO: 20964 - DNA, 22 bp, Artificial sequence
  synthetic polynucleotide sequence
tccattattccagacgcggcca

SEQ ID NO: 20965 - DNA, 21 bp, Artificial sequence
  synthetic polynucleotide sequence
ggagcccggaacacttccaga

SEQ ID NO: 20966 - DNA, 20 bp, Artificial sequence
  synthetic polynucleotide sequence
gatgctctaggctcccccca

SEQ ID NO: 20967 - DNA, 18 bp, Artificial sequence
  synthetic polynucleotide sequence
tcggcagctgcagggcca

SEQ ID NO: 20968 - DNA, 18 bp, Artificial sequence
  synthetic polynucleotide sequence
gctggcgctccgagtcca

SEQ ID NO: 20969 - DNA, 21 bp, Artificial sequence
  synthetic polynucleotide sequence
acagctgtgaggaggacctga

SEQ ID NO: 20970 - DNA, 20 bp, Artificial sequence
  synthetic polynucleotide sequence
cccagacaggtgctgccgta

SEQ ID NO: 20971 - DNA, 19 bp, Artificial sequence
  synthetic polynucleotide sequence
cggggcgagtgtggaagga

SEQ ID NO: 20972 - DNA, 19 bp, Artificial sequence
  synthetic polynucleotide sequence
ctcctccaggtgacgggca

SEQ ID NO: 20973 - DNA, 20 bp, Artificial sequence
  synthetic polynucleotide sequence
agattcagcaccctccccca

SEQ ID NO: 20974 - DNA, 20 bp, Artificial sequence
  synthetic polynucleotide sequence
cttgtcagggacctcaagca

SEQ ID NO: 20975 - DNA, 18 bp, Artificial sequence
  synthetic polynucleotide sequence
ggccacaaagccacagca

SEQ ID NO: 20976 - DNA, 20 bp, Artificial sequence
  synthetic polynucleotide sequence
cttcacttccaggggaacca

SEQ ID NO: 20977 - DNA, 20 bp, Artificial sequence
  synthetic polynucleotide sequence
gctgaaggaggctggcagga

SEQ ID NO: 20978 - DNA, 19 bp, Artificial sequence
  synthetic polynucleotide sequence
cccaggccacagtccccca

SEQ ID NO: 20979 - DNA, 20 bp, Artificial sequence
  synthetic polynucleotide sequence
gctgccaggaccaagcccaa

SEQ ID NO: 20980 - DNA, 21 bp, Artificial sequence
  synthetic polynucleotide sequence
aggtggggagccaaatcggga

SEQ ID NO: 20981 - DNA, 22 bp, Artificial sequence
  synthetic polynucleotide sequence
aacatcaagctgagggaggaga

SEQ ID NO: 20982 - DNA, 20 bp, Artificial sequence
  synthetic polynucleotide sequence
agtgagggcctcacaccgga

SEQ ID NO: 20983 - DNA, 21 bp, Artificial sequence
  synthetic polynucleotide sequence
ccaagaccaccaagccccaga

SEQ ID NO: 20984 - DNA, 19 bp, Artificial sequence
  synthetic polynucleotide sequence
caggtgagtggtccgggga

SEQ ID NO: 20985 - DNA, 18 bp, Artificial sequence
  synthetic polynucleotide sequence
aggaaacaggcgccggaa

SEQ ID NO: 20986 - DNA, 18 bp, Artificial sequence
  synthetic polynucleotide sequence
acccacagttcgcgagca

SEQ ID NO: 20987 - DNA, 22 bp, Artificial sequence
  synthetic polynucleotide sequence
agattgtactggaccgtgacca

SEQ ID NO: 20988 - DNA, 19 bp, Artificial sequence
  synthetic polynucleotide sequence
tggctccaggatcctcaga

SEQ ID NO: 20989 - DNA, 18 bp, Artificial sequence
  synthetic polynucleotide sequence
ggctagggagtccgccga

SEQ ID NO: 20990 - DNA, 20 bp, Artificial sequence
  synthetic polynucleotide sequence
gatccgatgtgccaccccga

SEQ ID NO: 20991 - DNA, 20 bp, Artificial sequence
  synthetic polynucleotide sequence
gaagtccctagccgtgccga

SEQ ID NO: 20992 - DNA, 22 bp, Artificial sequence
  synthetic polynucleotide sequence
acgtaaaaactggtcccgggca

SEQ ID NO: 20993 - DNA, 21 bp, Artificial sequence
  synthetic polynucleotide sequence
ctggtcgtggtgaagaaggca

SEQ ID NO: 20994 - DNA, 18 bp, Artificial sequence
  synthetic polynucleotide sequence
ctcagggaggacgcgcca

SEQ ID NO: 20995 - DNA, 21 bp, Artificial sequence
  synthetic polynucleotide sequence
caagacgaagcaagcccgaga

SEQ ID NO: 20996 - DNA, 19 bp, Artificial sequence
  synthetic polynucleotide sequence
ggattccaggcgccggtga

SEQ ID NO: 20997 - DNA, 22 bp, Artificial sequence
  synthetic polynucleotide sequence
gtgaacccgacttgacagagca

SEQ ID NO: 20998 - DNA, 20 bp, Artificial sequence
  synthetic polynucleotide sequence
ggccagatgctcctcacgga

SEQ ID NO: 20999 - DNA, 22 bp, Artificial sequence
  synthetic polynucleotide sequence
tctagcattcagtcccaaccca

SEQ ID NO: 21000 - DNA, 21 bp, Artificial sequence
  synthetic polynucleotide sequence
gcatcacacacctcctggtca

SEQ ID NO: 21001 - DNA, 19 bp, Artificial sequence
  synthetic polynucleotide sequence
cccacgccacccctaccca

SEQ ID NO: 21002 - DNA, 19 bp, Artificial sequence
  synthetic polynucleotide sequence
gcccccggcccagctcaga

SEQ ID NO: 21003 - DNA, 20 bp, Artificial sequence
  synthetic polynucleotide sequence
tacgccagattcagcgcaga

SEQ ID NO: 21004 - DNA, 19 bp, Artificial sequence
  synthetic polynucleotide sequence
tcctgctgcaaggtggcca

SEQ ID NO: 21005 - DNA, 19 bp, Artificial sequence
  synthetic polynucleotide sequence
ttgacaccagcactgggga

SEQ ID NO: 21006 - DNA, 20 bp, Artificial sequence
  synthetic polynucleotide sequence
ccggtggctgtgcacgcaga

SEQ ID NO: 21007 - DNA, 20 bp, Artificial sequence
  synthetic polynucleotide sequence
tacatccagcaggcccggaa

SEQ ID NO: 21008 - DNA, 20 bp, Artificial sequence
  synthetic polynucleotide sequence
ctcggcactgcgacggccaa

SEQ ID NO: 21009 - DNA, 20 bp, Artificial sequence
  synthetic polynucleotide sequence
aacgcctggcgggcctacga

SEQ ID NO: 21010 - DNA, 21 bp, Artificial sequence
  synthetic polynucleotide sequence
gatgatggggttgacgcagga

SEQ ID NO: 21011 - DNA, 19 bp, Artificial sequence
  synthetic polynucleotide sequence
ccaggggctgttcaccaga

SEQ ID NO: 21012 - DNA, 18 bp, Artificial sequence
  synthetic polynucleotide sequence
ccacgcgcttcttagcca

SEQ ID NO: 21013 - DNA, 20 bp, Artificial sequence
  synthetic polynucleotide sequence
gctgaggcactgcccgtcaa

SEQ ID NO: 21014 - DNA, 22 bp, Artificial sequence
  synthetic polynucleotide sequence
agcaaaagcagggcagaaggaa

SEQ ID NO: 21015 - DNA, 19 bp, Artificial sequence
  synthetic polynucleotide sequence
cagctgccttcagccccca

SEQ ID NO: 21016 - DNA, 20 bp, Artificial sequence
  synthetic polynucleotide sequence
cttcttggggtcggcacaga

SEQ ID NO: 21017 - DNA, 20 bp, Artificial sequence
  synthetic polynucleotide sequence
cagatgcactcaacgtccca

SEQ ID NO: 21018 - DNA, 20 bp, Artificial sequence
  synthetic polynucleotide sequence
atgacagccttctggggaca

SEQ ID NO: 21019 - DNA, 21 bp, Artificial sequence
  synthetic polynucleotide sequence
tacctacaagatcccgcgtca

SEQ ID NO: 21020 - DNA, 21 bp, Artificial sequence
  synthetic polynucleotide sequence
actggggttggtacagacgga

SEQ ID NO: 21021 - DNA, 21 bp, Artificial sequence
  synthetic polynucleotide sequence
ggatcccaggcccagttcaca

SEQ ID NO: 21022 - DNA, 21 bp, Artificial sequence
  synthetic polynucleotide sequence
caatcctgaactcccggacca

SEQ ID NO: 21023 - DNA, 21 bp, Artificial sequence
  synthetic polynucleotide sequence
ccccaatgacgactgggtcca

SEQ ID NO: 21024 - DNA, 21 bp, Artificial sequence
  synthetic polynucleotide sequence
ttgaggagctggggttgacca

SEQ ID NO: 21025 - DNA, 19 bp, Artificial sequence
  synthetic polynucleotide sequence
ggaccaatgtgggccggga

SEQ ID NO: 21026 - DNA, 22 bp, Artificial sequence
  synthetic polynucleotide sequence
caaaaacgatggcatccctgga

SEQ ID NO: 21027 - DNA, 19 bp, Artificial sequence
  synthetic polynucleotide sequence
tgtgagtttccaagcccca

SEQ ID NO: 21028 - DNA, 18 bp, Artificial sequence
  synthetic polynucleotide sequence
cacaggagcagagggcca

SEQ ID NO: 21029 - DNA, 20 bp, Artificial sequence
  synthetic polynucleotide sequence
ccaactctgagtggcaccaa

SEQ ID NO: 21030 - DNA, 22 bp, Artificial sequence
  synthetic polynucleotide sequence
gtggtgaacactacagcaggca

SEQ ID NO: 21031 - DNA, 18 bp, Artificial sequence
  synthetic polynucleotide sequence
agggctcgctcagccaga

SEQ ID NO: 21032 - DNA, 20 bp, Artificial sequence
  synthetic polynucleotide sequence
ctgcttggggtcagcacaga

SEQ ID NO: 21033 - DNA, 21 bp, Artificial sequence
  synthetic polynucleotide sequence
gcgaatcagaagcagcaagca

SEQ ID NO: 21034 - DNA, 19 bp, Artificial sequence
  synthetic polynucleotide sequence
ggatttgcgcacacagaca

SEQ ID NO: 21035 - DNA, 19 bp, Artificial sequence
  synthetic polynucleotide sequence
caaaggaagattcccgcca

SEQ ID NO: 21036 - DNA, 19 bp, Artificial sequence
  synthetic polynucleotide sequence
gctgggatggagcagccta

SEQ ID NO: 21037 - DNA, 18 bp, Artificial sequence
  synthetic polynucleotide sequence
gcgccaacatggaagaca

SEQ ID NO: 21038 - DNA, 19 bp, Artificial sequence
  synthetic polynucleotide sequence
ggttagcaacaccacgcca

SEQ ID NO: 21039 - DNA, 20 bp, Artificial sequence
  synthetic polynucleotide sequence
catctcctacaccccacgaa

SEQ ID NO: 21040 - DNA, 18 bp, Artificial sequence
  synthetic polynucleotide sequence
gatgacacccggcttgga

SEQ ID NO: 21041 - DNA, 17 bp, Artificial sequence
  synthetic polynucleotide sequence
ggcaggcctgatgacca

SEQ ID NO: 21042 - DNA, 20 bp, Artificial sequence
  synthetic polynucleotide sequence
aagaacatgcagcagggaga

SEQ ID NO: 21043 - DNA, 18 bp, Artificial sequence
  synthetic polynucleotide sequence
cccgctgtccacacccaa

SEQ ID NO: 21044 - DNA, 18 bp, Artificial sequence
  synthetic polynucleotide sequence
cgcagcaggcagattgca

SEQ ID NO: 21045 - DNA, 19 bp, Artificial sequence
  synthetic polynucleotide sequence
ccaccttggaactgccaca

SEQ ID NO: 21046 - DNA, 18 bp, Artificial sequence
  synthetic polynucleotide sequence
gcttcgcacccaggtcca

SEQ ID NO: 21047 - DNA, 22 bp, Artificial sequence
  synthetic polynucleotide sequence
tctaccgaaagccactctcaga

SEQ ID NO: 21048 - DNA, 21 bp, Artificial sequence
  synthetic polynucleotide sequence
tgcgttgagccaggtgaagca

SEQ ID NO: 21049 - DNA, 18 bp, Artificial sequence
  synthetic polynucleotide sequence
ctccagctgttgcacgga

SEQ ID NO: 21050 - DNA, 21 bp, Artificial sequence
  synthetic polynucleotide sequence
atgaaggatgacagcagccaa

SEQ ID NO: 21051 - DNA, 18 bp, Artificial sequence
  synthetic polynucleotide sequence
ctcccggcagattccaca

SEQ ID NO: 21052 - DNA, 18 bp, Artificial sequence
  synthetic polynucleotide sequence
gacaccgggcttggagca

SEQ ID NO: 21053 - DNA, 22 bp, Artificial sequence
  synthetic polynucleotide sequence
acctcccgacagattccacaga

SEQ ID NO: 21054 - DNA, 21 bp, Artificial sequence
  synthetic polynucleotide sequence
cactcagctccaggtcactga

SEQ ID NO: 21055 - DNA, 20 bp, Artificial sequence
  synthetic polynucleotide sequence
tccagcgctctcagcaccaa

SEQ ID NO: 21056 - DNA, 21 bp, Artificial sequence
  synthetic polynucleotide sequence
tggacccaggattcactggga

SEQ ID NO: 21057 - DNA, 18 bp, Artificial sequence
  synthetic polynucleotide sequence
ccgtgcccacatcaagga

SEQ ID NO: 21058 - DNA, 19 bp, Artificial sequence
  synthetic polynucleotide sequence
tgatgtactcccgaaccca

SEQ ID NO: 21059 - DNA, 21 bp, Artificial sequence
  synthetic polynucleotide sequence
cagaggctggagagctacaca

SEQ ID NO: 21060 - DNA, 21 bp, Artificial sequence
  synthetic polynucleotide sequence
gatgcttcatggaatccctga

SEQ ID NO: 21061 - DNA, 19 bp, Artificial sequence
  synthetic polynucleotide sequence
agaccattggcgtgaagga

SEQ ID NO: 21062 - DNA, 18 bp, Artificial sequence
  synthetic polynucleotide sequence
cgagatcatgcggtccca

SEQ ID NO: 21063 - DNA, 20 bp, Artificial sequence
  synthetic polynucleotide sequence
aacccgctcgacccgcagga

SEQ ID NO: 21064 - DNA, 21 bp, Artificial sequence
  synthetic polynucleotide sequence
gacctgacagatgagtgcgca

SEQ ID NO: 21065 - DNA, 19 bp, Artificial sequence
  synthetic polynucleotide sequence
ggcacagacccaaagcaca

SEQ ID NO: 21066 - DNA, 18 bp, Artificial sequence
  synthetic polynucleotide sequence
cttccccaacctccacca

SEQ ID NO: 21067 - DNA, 19 bp, Artificial sequence
  synthetic polynucleotide sequence
gaagacgagacgggttgca

SEQ ID NO: 21068 - DNA, 20 bp, Artificial sequence
  synthetic polynucleotide sequence
ccacatgaatggtgaacgca

SEQ ID NO: 21069 - DNA, 18 bp, Artificial sequence
  synthetic polynucleotide sequence
ctgcctctccaagcccaa

SEQ ID NO: 21070 - DNA, 19 bp, Artificial sequence
  synthetic polynucleotide sequence
ccagtgacttcccgaccca

SEQ ID NO: 21071 - DNA, 20 bp, Artificial sequence
  synthetic polynucleotide sequence
tccgcacagaactcagtcca

SEQ ID NO: 21072 - DNA, 18 bp, Artificial sequence
  synthetic polynucleotide sequence
gaaggccagcgctcggga

SEQ ID NO: 21073 - DNA, 19 bp, Artificial sequence
  synthetic polynucleotide sequence
tgcagtccataaacccaca

SEQ ID NO: 21074 - DNA, 20 bp, Artificial sequence
  synthetic polynucleotide sequence
atccataatgccaacgcaca

SEQ ID NO: 21075 - DNA, 22 bp, Artificial sequence
  synthetic polynucleotide sequence
agatgaccctgcaggaatacca

SEQ ID NO: 21076 - DNA, 21 bp, Artificial sequence
  synthetic polynucleotide sequence
atgctccaggaagggaaccca

SEQ ID NO: 21077 - DNA, 20 bp, Artificial sequence
  synthetic polynucleotide sequence
ggacatgggccaagaagaca

SEQ ID NO: 21078 - DNA, 20 bp, Artificial sequence
  synthetic polynucleotide sequence
ctgctgtacaacacaggcta

SEQ ID NO: 21079 - DNA, 18 bp, Artificial sequence
  synthetic polynucleotide sequence
tccgcaaacacgcgcaga

SEQ ID NO: 21080 - DNA, 21 bp, Artificial sequence
  synthetic polynucleotide sequence
gtgtgaggcggtagtaggaca

SEQ ID NO: 21081 - DNA, 18 bp, Artificial sequence
  synthetic polynucleotide sequence
caccgtcgatgatcgcaa

SEQ ID NO: 21082 - DNA, 18 bp, Artificial sequence
  synthetic polynucleotide sequence
ttgaggagcaccgcctca

SEQ ID NO: 21083 - DNA, 18 bp, Artificial sequence
  synthetic polynucleotide sequence
acgcccctgaccatcgaa

SEQ ID NO: 21084 - DNA, 19 bp, Artificial sequence
  synthetic polynucleotide sequence
cagagagagccggtgcaga

SEQ ID NO: 21085 - DNA, 20 bp, Artificial sequence
  synthetic polynucleotide sequence
tccctgatccccacacctga

SEQ ID NO: 21086 - DNA, 20 bp, Artificial sequence
  synthetic polynucleotide sequence
tgcccagctcagtacaggca

SEQ ID NO: 21087 - DNA, 21 bp, Artificial sequence
  synthetic polynucleotide sequence
aatccaggccaagaagaggaa

SEQ ID NO: 21088 - DNA, 21 bp, Artificial sequence
  synthetic polynucleotide sequence
atgcaaggactgatcccccca

SEQ ID NO: 21089 - DNA, 20 bp, Artificial sequence
  synthetic polynucleotide sequence
gtggagctgagaacccagca

SEQ ID NO: 21090 - DNA, 18 bp, Artificial sequence
  synthetic polynucleotide sequence
atccggtgaggtcccaca

SEQ ID NO: 21091 - DNA, 22 bp, Artificial sequence
  synthetic polynucleotide sequence
tgcacacgataatggcctcaga

SEQ ID NO: 21092 - DNA, 21 bp, Artificial sequence
  synthetic polynucleotide sequence
aaagcagctcagtccaacaca

SEQ ID NO: 21093 - DNA, 21 bp, Artificial sequence
  synthetic polynucleotide sequence
gcacagcccagaacctccaca

SEQ ID NO: 21094 - DNA, 20 bp, Artificial sequence
  synthetic polynucleotide sequence
actgggaggagagctgctga

SEQ ID NO: 21095 - DNA, 20 bp, Artificial sequence
  synthetic polynucleotide sequence
ctcttggacaggagaaggca

SEQ ID NO: 21096 - DNA, 21 bp, Artificial sequence
  synthetic polynucleotide sequence
aagtcgatgaggaagccctca

SEQ ID NO: 21097 - DNA, 19 bp, Artificial sequence
  synthetic polynucleotide sequence
tggcagtccttaccaagca

SEQ ID NO: 21098 - DNA, 22 bp, Artificial sequence
  synthetic polynucleotide sequence
aaacggaattcagaggcaggga

SEQ ID NO: 21099 - DNA, 21 bp, Artificial sequence
  synthetic polynucleotide sequence
ctatattgggacgccgctgga

SEQ ID NO: 21100 - DNA, 21 bp, Artificial sequence
  synthetic polynucleotide sequence
gtgtggagcccttgaactgca

SEQ ID NO: 21101 - DNA, 22 bp, Artificial sequence
  synthetic polynucleotide sequence
agtatcgccatcctacgtcaga

SEQ ID NO: 21102 - DNA, 21 bp, Artificial sequence
  synthetic polynucleotide sequence
acatcccaacaccagtctgca

SEQ ID NO: 21103 - DNA, 18 bp, Artificial sequence
  synthetic polynucleotide sequence
tcggccagccagcgacca

SEQ ID NO: 21104 - DNA, 21 bp, Artificial sequence
  synthetic polynucleotide sequence
ggatgagcctgtactccccga

SEQ ID NO: 21105 - DNA, 18 bp, Artificial sequence
  synthetic polynucleotide sequence
ccgggatgtccaccacca

SEQ ID NO: 21106 - DNA, 18 bp, Artificial sequence
  synthetic polynucleotide sequence
tggtagggcaggtgtgca

SEQ ID NO: 21107 - DNA, 21 bp, Artificial sequence
  synthetic polynucleotide sequence
atccatgcaggatgggctcga

SEQ ID NO: 21108 - DNA, 20 bp, Artificial sequence
  synthetic polynucleotide sequence
tgccatcgccacctgcggca

SEQ ID NO: 21109 - DNA, 18 bp, Artificial sequence
  synthetic polynucleotide sequence
ccgtgaacggcttgccaa

SEQ ID NO: 21110 - DNA, 18 bp, Artificial sequence
  synthetic polynucleotide sequence
cgctgatcgggatgggga

SEQ ID NO: 21111 - DNA, 19 bp, Artificial sequence
  synthetic polynucleotide sequence
cgaagctctggaagcgcaa

SEQ ID NO: 21112 - DNA, 20 bp, Artificial sequence
  synthetic polynucleotide sequence
gtctcccagtcgcaagtcca

SEQ ID NO: 21113 - DNA, 21 bp, Artificial sequence
  synthetic polynucleotide sequence
cctgggcatagctcagacaca

SEQ ID NO: 21114 - DNA, 18 bp, Artificial sequence
  synthetic polynucleotide sequence
ggctgaacaccctgggca

SEQ ID NO: 21115 - DNA, 21 bp, Artificial sequence
  synthetic polynucleotide sequence
actcgcatagtggcagcagca

SEQ ID NO: 21116 - DNA, 22 bp, Artificial sequence
  synthetic polynucleotide sequence
ttgaagagctggagctagagga

SEQ ID NO: 21117 - DNA, 21 bp, Artificial sequence
  synthetic polynucleotide sequence
acaacccagagcagaagcaga

SEQ ID NO: 21118 - DNA, 19 bp, Artificial sequence
  synthetic polynucleotide sequence
gccagcaggatcgccccta

SEQ ID NO: 21119 - DNA, 20 bp, Artificial sequence
  synthetic polynucleotide sequence
ctgccagatcctcaaggaca

SEQ ID NO: 21120 - DNA, 22 bp, Artificial sequence
  synthetic polynucleotide sequence
atctgctaaggagcgaaggtca

SEQ ID NO: 21121 - DNA, 22 bp, Artificial sequence
  synthetic polynucleotide sequence
agaagaaggcaatgacagcgga

SEQ ID NO: 21122 - DNA, 21 bp, Artificial sequence
  synthetic polynucleotide sequence
gtgagtccgcttgagacagca

SEQ ID NO: 21123 - DNA, 22 bp, Artificial sequence
  synthetic polynucleotide sequence
tagagcaaggagaaagcagcca

SEQ ID NO: 21124 - DNA, 21 bp, Artificial sequence
  synthetic polynucleotide sequence
ggctgctagaggaagagccca

SEQ ID NO: 21125 - DNA, 18 bp, Artificial sequence
  synthetic polynucleotide sequence
ggtgatcgcctacacgca

SEQ ID NO: 21126 - DNA, 18 bp, Artificial sequence
  synthetic polynucleotide sequence
ccacggagaggaagggga

SEQ ID NO: 21127 - DNA, 18 bp, Artificial sequence
  synthetic polynucleotide sequence
tctactggctgcgcgcga

SEQ ID NO: 21128 - DNA, 19 bp, Artificial sequence
  synthetic polynucleotide sequence
gcccaggaaggcgtagaga

SEQ ID NO: 21129 - DNA, 19 bp, Artificial sequence
  synthetic polynucleotide sequence
taccaacgagagcggtgaa

SEQ ID NO: 21130 - DNA, 20 bp, Artificial sequence
  synthetic polynucleotide sequence
taagatgaggacgaccagca

SEQ ID NO: 21131 - DNA, 18 bp, Artificial sequence
  synthetic polynucleotide sequence
gctgcatgaacccggtga

SEQ ID NO: 21132 - DNA, 18 bp, Artificial sequence
  synthetic polynucleotide sequence
gcccaggtgcatgagcaa

SEQ ID NO: 21133 - DNA, 22 bp, Artificial sequence
  synthetic polynucleotide sequence
tgatcatcaggaccttgcagca

SEQ ID NO: 21134 - DNA, 21 bp, Artificial sequence
  synthetic polynucleotide sequence
gctccaccagggtctctagga

SEQ ID NO: 21135 - DNA, 20 bp, Artificial sequence
  synthetic polynucleotide sequence
gtttgcgtctctcccaggaa

SEQ ID NO: 21136 - DNA, 18 bp, Artificial sequence
  synthetic polynucleotide sequence
ccatgacaagcagcggca

SEQ ID NO: 21137 - DNA, 21 bp, Artificial sequence
  synthetic polynucleotide sequence
gcatggaccggtacatcgcca

SEQ ID NO: 21138 - DNA, 21 bp, Artificial sequence
  synthetic polynucleotide sequence
gatgatgactgacagccccca

SEQ ID NO: 21139 - DNA, 18 bp, Artificial sequence
  synthetic polynucleotide sequence
ggcccagacggtggccaa

SEQ ID NO: 21140 - DNA, 18 bp, Artificial sequence
  synthetic polynucleotide sequence
tgcggaacttgacgccga

SEQ ID NO: 21141 - DNA, 22 bp, Artificial sequence
  synthetic polynucleotide sequence
agaagctgaggagcatcacaga

SEQ ID NO: 21142 - DNA, 21 bp, Artificial sequence
  synthetic polynucleotide sequence
tcccaaacacccactggtcca

SEQ ID NO: 21143 - DNA, 22 bp, Artificial sequence
  synthetic polynucleotide sequence
ttcacaccctgatacaagccaa

SEQ ID NO: 21144 - DNA, 21 bp, Artificial sequence
  synthetic polynucleotide sequence
atagagaacagggttcaggca

SEQ ID NO: 21145 - DNA, 22 bp, Artificial sequence
  synthetic polynucleotide sequence
taaggttcagggagcagaggta

SEQ ID NO: 21146 - DNA, 20 bp, Artificial sequence
  synthetic polynucleotide sequence
tacaggagagggttgatgca

SEQ ID NO: 21147 - DNA, 18 bp, Artificial sequence
  synthetic polynucleotide sequence
gatgacctgggccgggga

SEQ ID NO: 21148 - DNA, 18 bp, Artificial sequence
  synthetic polynucleotide sequence
ggcctcgctcctcccaga

SEQ ID NO: 21149 - DNA, 21 bp, Artificial sequence
  synthetic polynucleotide sequence
ctgagcctcgacagcaaccaa

SEQ ID NO: 21150 - DNA, 20 bp, Artificial sequence
  synthetic polynucleotide sequence
ctccccagccataaagagca

SEQ ID NO: 21151 - DNA, 21 bp, Artificial sequence
  synthetic polynucleotide sequence
gatgtaacagaacgggcagga

SEQ ID NO: 21152 - DNA, 22 bp, Artificial sequence
  synthetic polynucleotide sequence
aagttgtcacagtgggatgcca

SEQ ID NO: 21153 - DNA, 20 bp, Artificial sequence
  synthetic polynucleotide sequence
gagcattaccacctcagcca

SEQ ID NO: 21154 - DNA, 18 bp, Artificial sequence
  synthetic polynucleotide sequence
cctgaaccatgtgccgaa

SEQ ID NO: 21155 - DNA, 19 bp, Artificial sequence
  synthetic polynucleotide sequence
tgcaggtgtggaacgccta

SEQ ID NO: 21156 - DNA, 18 bp, Artificial sequence
  synthetic polynucleotide sequence
gttgagtggcaccacgca

SEQ ID NO: 21157 - DNA, 18 bp, Artificial sequence
  synthetic polynucleotide sequence
ggcccatgccttgacaga

SEQ ID NO: 21158 - DNA, 18 bp, Artificial sequence
  synthetic polynucleotide sequence
gtgcttggcccgaaggga

SEQ ID NO: 21159 - DNA, 22 bp, Artificial sequence
  synthetic polynucleotide sequence
gaaaatgccggcctgaatccca

SEQ ID NO: 21160 - DNA, 21 bp, Artificial sequence
  synthetic polynucleotide sequence
gctggacaaccagttcctcca

SEQ ID NO: 21161 - DNA, 19 bp, Artificial sequence
  synthetic polynucleotide sequence
gcactggaggtcatcccca

SEQ ID NO: 21162 - DNA, 20 bp, Artificial sequence
  synthetic polynucleotide sequence
aacagtcgatgccaagagca

SEQ ID NO: 21163 - DNA, 20 bp, Artificial sequence
  synthetic polynucleotide sequence
cctgaacacaggtgagccaa

SEQ ID NO: 21164 - DNA, 19 bp, Artificial sequence
  synthetic polynucleotide sequence
tggtggcaatcacagtgca

SEQ ID NO: 21165 - DNA, 21 bp, Artificial sequence
  synthetic polynucleotide sequence
gtcaatatatgcgccgcccga

SEQ ID NO: 21166 - DNA, 21 bp, Artificial sequence
  synthetic polynucleotide sequence
tcatcgagcagcacattgcca

SEQ ID NO: 21167 - DNA, 18 bp, Artificial sequence
  synthetic polynucleotide sequence
caagctgcgggctcggca

SEQ ID NO: 21168 - DNA, 18 bp, Artificial sequence
  synthetic polynucleotide sequence
atcaggcacgcagcctca

SEQ ID NO: 21169 - DNA, 19 bp, Artificial sequence
  synthetic polynucleotide sequence
tgtgacaaacgatgcagca

SEQ ID NO: 21170 - DNA, 22 bp, Artificial sequence
  synthetic polynucleotide sequence
agctaattccaggagagctcca

SEQ ID NO: 21171 - DNA, 20 bp, Artificial sequence
  synthetic polynucleotide sequence
gaccctcacactggcggaca

SEQ ID NO: 21172 - DNA, 21 bp, Artificial sequence
  synthetic polynucleotide sequence
ctgagaaccacagtgagggca

SEQ ID NO: 21173 - DNA, 20 bp, Artificial sequence
  synthetic polynucleotide sequence
cgacgcctctgtccacccaa

SEQ ID NO: 21174 - DNA, 20 bp, Artificial sequence
  synthetic polynucleotide sequence
gggtgcacggaagtgagcga

SEQ ID NO: 21175 - DNA, 20 bp, Artificial sequence
  synthetic polynucleotide sequence
taccggacccttgaacctca

SEQ ID NO: 21176 - DNA, 19 bp, Artificial sequence
  synthetic polynucleotide sequence
tcacagatgtcagaggcca

SEQ ID NO: 21177 - DNA, 20 bp, Artificial sequence
  synthetic polynucleotide sequence
tgatgagccgtcagccgcaa

SEQ ID NO: 21178 - DNA, 20 bp, Artificial sequence
  synthetic polynucleotide sequence
gctggaactgccacgtcaca

SEQ ID NO: 21179 - DNA, 19 bp, Artificial sequence
  synthetic polynucleotide sequence
gctccaagccttccaacca

SEQ ID NO: 21180 - DNA, 18 bp, Artificial sequence
  synthetic polynucleotide sequence
ccccatcctcactgggaa

SEQ ID NO: 21181 - DNA, 18 bp, Artificial sequence
  synthetic polynucleotide sequence
cgctgcgcaacacaggaa

SEQ ID NO: 21182 - DNA, 18 bp, Artificial sequence
  synthetic polynucleotide sequence
gttcagggcgctggacca

SEQ ID NO: 21183 - DNA, 20 bp, Artificial sequence
  synthetic polynucleotide sequence
ctggcgagacagtgagtgga

SEQ ID NO: 21184 - DNA, 18 bp, Artificial sequence
  synthetic polynucleotide sequence
caccaccgtcttgcagca

SEQ ID NO: 21185 - DNA, 21 bp, Artificial sequence
  synthetic polynucleotide sequence
gggaactacacagtgacggga

SEQ ID NO: 21186 - DNA, 18 bp, Artificial sequence
  synthetic polynucleotide sequence
gggccacaaggctggtga

SEQ ID NO: 21187 - DNA, 20 bp, Artificial sequence
  synthetic polynucleotide sequence
atgggagaagagactggcca

SEQ ID NO: 21188 - DNA, 18 bp, Artificial sequence
  synthetic polynucleotide sequence
ggtccagtcccctgacca

SEQ ID NO: 21189 - DNA, 20 bp, Artificial sequence
  synthetic polynucleotide sequence
ctatgggactgtcacgccaa

SEQ ID NO: 21190 - DNA, 21 bp, Artificial sequence
  synthetic polynucleotide sequence
agaaccaggagaaggagccca

SEQ ID NO: 21191 - DNA, 18 bp, Artificial sequence
  synthetic polynucleotide sequence
agcacccgaacgtgacga

SEQ ID NO: 21192 - DNA, 18 bp, Artificial sequence
  synthetic polynucleotide sequence
ggtgaccagcgggaggga

SEQ ID NO: 21193 - DNA, 19 bp, Artificial sequence
  synthetic polynucleotide sequence
ccagtccctgaggcccaca

SEQ ID NO: 21194 - DNA, 21 bp, Artificial sequence
  synthetic polynucleotide sequence
gccttgaggaagtgcagcaca

SEQ ID NO: 21195 - DNA, 19 bp, Artificial sequence
  synthetic polynucleotide sequence
ccccgaatgacctgcccca

SEQ ID NO: 21196 - DNA, 20 bp, Artificial sequence
  synthetic polynucleotide sequence
tgagagactccaggccctca

SEQ ID NO: 21197 - DNA, 20 bp, Artificial sequence
  synthetic polynucleotide sequence
taagccacaacagcctgaca

SEQ ID NO: 21198 - DNA, 18 bp, Artificial sequence
  synthetic polynucleotide sequence
agggaggagacggggtga

SEQ ID NO: 21199 - DNA, 18 bp, Artificial sequence
  synthetic polynucleotide sequence
accgtggcaacctgacca

SEQ ID NO: 21200 - DNA, 19 bp, Artificial sequence
  synthetic polynucleotide sequence
ccacaagggaacacaggca

SEQ ID NO: 21201 - DNA, 18 bp, Artificial sequence
  synthetic polynucleotide sequence
gcggcaagtgaagcccga

SEQ ID NO: 21202 - DNA, 18 bp, Artificial sequence
  synthetic polynucleotide sequence
tcccatcagcactgggca

SEQ ID NO: 21203 - DNA, 20 bp, Artificial sequence
  synthetic polynucleotide sequence
ttgagatccagggcatagca

SEQ ID NO: 21204 - DNA, 20 bp, Artificial sequence
  synthetic polynucleotide sequence
gggaaggcacacatgaagca

SEQ ID NO: 21205 - DNA, 19 bp, Artificial sequence
  synthetic polynucleotide sequence
gaacaggagcaactgggca

SEQ ID NO: 21206 - DNA, 20 bp, Artificial sequence
  synthetic polynucleotide sequence
tcactcgacaagacaggcca

SEQ ID NO: 21207 - DNA, 18 bp, Artificial sequence
  synthetic polynucleotide sequence
gcactcagccaggggaca

SEQ ID NO: 21208 - DNA, 18 bp, Artificial sequence
  synthetic polynucleotide sequence
ggaacagcaagcacgcca

SEQ ID NO: 21209 - DNA, 20 bp, Artificial sequence
  synthetic polynucleotide sequence
gggaagtcagcagagggaga

SEQ ID NO: 21210 - DNA, 20 bp, Artificial sequence
  synthetic polynucleotide sequence
gaggaggaacaggagcagca

SEQ ID NO: 21211 - DNA, 21 bp, Artificial sequence
  synthetic polynucleotide sequence
cagcagggaacaaagtcagca

SEQ ID NO: 21212 - DNA, 20 bp, Artificial sequence
  synthetic polynucleotide sequence
gaaaacgagcagtgccacaa

SEQ ID NO: 21213 - DNA, 21 bp, Artificial sequence
  synthetic polynucleotide sequence
tgtctcacccaaatgggacca

SEQ ID NO: 21214 - DNA, 21 bp, Artificial sequence
  synthetic polynucleotide sequence
taaagtcggtcacagtcccca

SEQ ID NO: 21215 - DNA, 20 bp, Artificial sequence
  synthetic polynucleotide sequence
gaggccagccttcctgcaca

SEQ ID NO: 21216 - DNA, 21 bp, Artificial sequence
  synthetic polynucleotide sequence
tcatgagtgatggccacggta

SEQ ID NO: 21217 - DNA, 18 bp, Artificial sequence
  synthetic polynucleotide sequence
ggaagccagctgcccaga

SEQ ID NO: 21218 - DNA, 20 bp, Artificial sequence
  synthetic polynucleotide sequence
atgggagacatggcaggtca

SEQ ID NO: 21219 - DNA, 21 bp, Artificial sequence
  synthetic polynucleotide sequence
gacctcagagagtgagcagga

SEQ ID NO: 21220 - DNA, 21 bp, Artificial sequence
  synthetic polynucleotide sequence
gaatggcgtgtcatccaccca

SEQ ID NO: 21221 - DNA, 18 bp, Artificial sequence
  synthetic polynucleotide sequence
ccagcggaactggcacga

SEQ ID NO: 21222 - DNA, 20 bp, Artificial sequence
  synthetic polynucleotide sequence
caacagaggtgagccgtcca

SEQ ID NO: 21223 - DNA, 18 bp, Artificial sequence
  synthetic polynucleotide sequence
ctgtgagagcgacgccaa

SEQ ID NO: 21224 - DNA, 18 bp, Artificial sequence
  synthetic polynucleotide sequence
gagggtgctgagaggcga

SEQ ID NO: 21225 - DNA, 18 bp, Artificial sequence
  synthetic polynucleotide sequence
gatcgggacccagcagga

SEQ ID NO: 21226 - DNA, 23 bp, Artificial sequence
  synthetic polynucleotide sequence
gagagcaggaatagtagccaaca

SEQ ID NO: 21227 - DNA, 17 bp, Artificial sequence
  synthetic polynucleotide sequence
gggacatgggcagagca

SEQ ID NO: 21228 - DNA, 18 bp, Artificial sequence
  synthetic polynucleotide sequence
ggccaacccagagttgga

SEQ ID NO: 21229 - DNA, 21 bp, Artificial sequence
  synthetic polynucleotide sequence
ccaggaagtctggatccagga

SEQ ID NO: 21230 - DNA, 21 bp, Artificial sequence
  synthetic polynucleotide sequence
tctttgcggctcaatcgagca

SEQ ID NO: 21231 - DNA, 21 bp, Artificial sequence
  synthetic polynucleotide sequence
gaagttcagcaggagcgcaga

SEQ ID NO: 21232 - DNA, 20 bp, Artificial sequence
  synthetic polynucleotide sequence
ccatctcagggtcccggcca

SEQ ID NO: 21233 - DNA, 18 bp, Artificial sequence
  synthetic polynucleotide sequence
ttgccgagcacagccaga

SEQ ID NO: 21234 - DNA, 18 bp, Artificial sequence
  synthetic polynucleotide sequence
cccagcatggatgaccca

SEQ ID NO: 21235 - DNA, 18 bp, Artificial sequence
  synthetic polynucleotide sequence
acccactggccaccccaa

SEQ ID NO: 21236 - DNA, 18 bp, Artificial sequence
  synthetic polynucleotide sequence
ggctctgcaggctccaca

SEQ ID NO: 21237 - DNA, 21 bp, Artificial sequence
  synthetic polynucleotide sequence
gtggtgccgactacaagcgaa

SEQ ID NO: 21238 - DNA, 20 bp, Artificial sequence
  synthetic polynucleotide sequence
gggtagccctcagcctgaca

SEQ ID NO: 21239 - DNA, 18 bp, Artificial sequence
  synthetic polynucleotide sequence
gcagatggccaacgagca

SEQ ID NO: 21240 - DNA, 20 bp, Artificial sequence
  synthetic polynucleotide sequence
gagacagacagacagcccca

SEQ ID NO: 21241 - DNA, 17 bp, Artificial sequence
  synthetic polynucleotide sequence
ggtgaagcagtcgccca

SEQ ID NO: 21242 - DNA, 22 bp, Artificial sequence
  synthetic polynucleotide sequence
tacaacacagacttccacagca

SEQ ID NO: 21243 - DNA, 20 bp, Artificial sequence
  synthetic polynucleotide sequence
ctggtggagtggaaccctga

SEQ ID NO: 21244 - DNA, 22 bp, Artificial sequence
  synthetic polynucleotide sequence
aggtataggtgaagtaggccca

SEQ ID NO: 21245 - DNA, 21 bp, Artificial sequence
  synthetic polynucleotide sequence
aacccctacccagagaggaga

SEQ ID NO: 21246 - DNA, 18 bp, Artificial sequence
  synthetic polynucleotide sequence
gcgctggtgaagggccca

SEQ ID NO: 21247 - DNA, 18 bp, Artificial sequence
  synthetic polynucleotide sequence
gccagcaccaccaaggga

SEQ ID NO: 21248 - DNA, 18 bp, Artificial sequence
  synthetic polynucleotide sequence
tcccgaggcctctgagca

SEQ ID NO: 21249 - DNA, 21 bp, Artificial sequence
  synthetic polynucleotide sequence
ggatacaccgtggctccgaga

SEQ ID NO: 21250 - DNA, 19 bp, Artificial sequence
  synthetic polynucleotide sequence
ttctggtcacgctgggcca

SEQ ID NO: 21251 - DNA, 20 bp, Artificial sequence
  synthetic polynucleotide sequence
cgaaacctcagcaccgggga

SEQ ID NO: 21252 - DNA, 21 bp, Artificial sequence
  synthetic polynucleotide sequence
tcacccagaagacagcaccca

SEQ ID NO: 21253 - DNA, 22 bp, Artificial sequence
  synthetic polynucleotide sequence
gcaagctcacctaccaacagca

SEQ ID NO: 21254 - DNA, 21 bp, Artificial sequence
  synthetic polynucleotide sequence
cctctgagaccccttcaacca

SEQ ID NO: 21255 - DNA, 23 bp, Artificial sequence
  synthetic polynucleotide sequence
caaatggatcagagcaggaggta

SEQ ID NO: 21256 - DNA, 21 bp, Artificial sequence
  synthetic polynucleotide sequence
aggtctctcagtcccacacca

SEQ ID NO: 21257 - DNA, 18 bp, Artificial sequence
  synthetic polynucleotide sequence
agcagaaagcagccggga

SEQ ID NO: 21258 - DNA, 18 bp, Artificial sequence
  synthetic polynucleotide sequence
ccttcggcaaggaagcca

SEQ ID NO: 21259 - DNA, 20 bp, Artificial sequence
  synthetic polynucleotide sequence
caccagtccagctctcagca

SEQ ID NO: 21260 - DNA, 18 bp, Artificial sequence
  synthetic polynucleotide sequence
aggcctgcggctgacaga

SEQ ID NO: 21261 - DNA, 20 bp, Artificial sequence
  synthetic polynucleotide sequence
ctgcacatcaagacaggtga

SEQ ID NO: 21262 - DNA, 20 bp, Artificial sequence
  synthetic polynucleotide sequence
taccgtgctagcaatcacca

SEQ ID NO: 21263 - DNA, 19 bp, Artificial sequence
  synthetic polynucleotide sequence
gaccagtctggaagcccaa

SEQ ID NO: 21264 - DNA, 18 bp, Artificial sequence
  synthetic polynucleotide sequence
tggccaccagtaacccca

SEQ ID NO: 21265 - DNA, 18 bp, Artificial sequence
  synthetic polynucleotide sequence
agacgccaggaggaggga

SEQ ID NO: 21266 - DNA, 18 bp, Artificial sequence
  synthetic polynucleotide sequence
gctcacaggcccaggaca

SEQ ID NO: 21267 - DNA, 18 bp, Artificial sequence
  synthetic polynucleotide sequence
gacctccagctgtgcgga

SEQ ID NO: 21268 - DNA, 19 bp, Artificial sequence
  synthetic polynucleotide sequence
gttctgttggccaagacca

SEQ ID NO: 21269 - DNA, 18 bp, Artificial sequence
  synthetic polynucleotide sequence
aacccaggacgctgagga

SEQ ID NO: 21270 - DNA, 18 bp, Artificial sequence
  synthetic polynucleotide sequence
gcagctgccacagccaga

SEQ ID NO: 21271 - DNA, 18 bp, Artificial sequence
  synthetic polynucleotide sequence
cttgtcggcgaccaacga

SEQ ID NO: 21272 - DNA, 18 bp, Artificial sequence
  synthetic polynucleotide sequence
tgtggctctctgcaggga

SEQ ID NO: 21273 - DNA, 18 bp, Artificial sequence
  synthetic polynucleotide sequence
cacaggtccagcgggaca

SEQ ID NO: 21274 - DNA, 20 bp, Artificial sequence
  synthetic polynucleotide sequence
tgagcatcacatggaccaca

SEQ ID NO: 21275 - DNA, 18 bp, Artificial sequence
  synthetic polynucleotide sequence
tggacctgggaaaacgca

SEQ ID NO: 21276 - DNA, 19 bp, Artificial sequence
  synthetic polynucleotide sequence
ctggatccagctccacaca

SEQ ID NO: 21277 - DNA, 20 bp, Artificial sequence
  synthetic polynucleotide sequence
ccaagcctgtgacacgagga

SEQ ID NO: 21278 - DNA, 19 bp, Artificial sequence
  synthetic polynucleotide sequence
gcgtctctgattcaggcca

SEQ ID NO: 21279 - DNA, 18 bp, Artificial sequence
  synthetic polynucleotide sequence
cagcctgaagccagggca

SEQ ID NO: 21280 - DNA, 17 bp, Artificial sequence
  synthetic polynucleotide sequence
ggagcctcctccccaga

SEQ ID NO: 21281 - DNA, 18 bp, Artificial sequence
  synthetic polynucleotide sequence
ccaaggaccctcgaggga

SEQ ID NO: 21282 - DNA, 20 bp, Artificial sequence
  synthetic polynucleotide sequence
ctgaagctctcgactggcga

SEQ ID NO: 21283 - DNA, 20 bp, Artificial sequence
  synthetic polynucleotide sequence
ctgctgagtgactcgggaca

SEQ ID NO: 21284 - DNA, 18 bp, Artificial sequence
  synthetic polynucleotide sequence
gccggcacctgacacaga

SEQ ID NO: 21285 - DNA, 19 bp, Artificial sequence
  synthetic polynucleotide sequence
tggacaagctgtgagacca

SEQ ID NO: 21286 - DNA, 19 bp, Artificial sequence
  synthetic polynucleotide sequence
cagcaccaagaggatggca

SEQ ID NO: 21287 - DNA, 21 bp, Artificial sequence
  synthetic polynucleotide sequence
tcagagctgcaaatacccaca

SEQ ID NO: 21288 - DNA, 19 bp, Artificial sequence
  synthetic polynucleotide sequence
gccaaaggacgtgaagcca

SEQ ID NO: 21289 - DNA, 20 bp, Artificial sequence
  synthetic polynucleotide sequence
tcagtcacagacctgcccaa

SEQ ID NO: 21290 - DNA, 18 bp, Artificial sequence
  synthetic polynucleotide sequence
tggacatagcgggtgcca

SEQ ID NO: 21291 - DNA, 18 bp, Artificial sequence
  synthetic polynucleotide sequence
ggagcggtaagcccccaa

SEQ ID NO: 21292 - DNA, 18 bp, Artificial sequence
  synthetic polynucleotide sequence
tggagcagcacgactcca

SEQ ID NO: 21293 - DNA, 21 bp, Artificial sequence
  synthetic polynucleotide sequence
tgctgcggatcagctcagcta

SEQ ID NO: 21294 - DNA, 22 bp, Artificial sequence
  synthetic polynucleotide sequence
taaagtcagtggggacagtgga

SEQ ID NO: 21295 - DNA, 23 bp, Artificial sequence
  synthetic polynucleotide sequence
gaaagaggacaacagcacctaca

SEQ ID NO: 21296 - DNA, 21 bp, Artificial sequence
  synthetic polynucleotide sequence
acagactcgccaggtatcaca

SEQ ID NO: 21297 - DNA, 20 bp, Artificial sequence
  synthetic polynucleotide sequence
cagcagcatctgtgaaggca

SEQ ID NO: 21298 - DNA, 20 bp, Artificial sequence
  synthetic polynucleotide sequence
gcgtccagcactcgatagga

SEQ ID NO: 21299 - DNA, 20 bp, Artificial sequence
  synthetic polynucleotide sequence
ggacaaaacgacaccagcca

SEQ ID NO: 21300 - DNA, 22 bp, Artificial sequence
  synthetic polynucleotide sequence
caactgaagcagaagaggtgga

SEQ ID NO: 21301 - DNA, 18 bp, Artificial sequence
  synthetic polynucleotide sequence
agcgtgggactccatcca

SEQ ID NO: 21302 - DNA, 18 bp, Artificial sequence
  synthetic polynucleotide sequence
tcgcatagcaaccctcca

SEQ ID NO: 21303 - DNA, 19 bp, Artificial sequence
  synthetic polynucleotide sequence
catgccctaatccgggaga

SEQ ID NO: 21304 - DNA, 20 bp, Artificial sequence
  synthetic polynucleotide sequence
acgggtcactccactggaca

SEQ ID NO: 21305 - DNA, 18 bp, Artificial sequence
  synthetic polynucleotide sequence
cagaggccggcccgacga

SEQ ID NO: 21306 - DNA, 20 bp, Artificial sequence
  synthetic polynucleotide sequence
gcagtgcagcaggcagacca

SEQ ID NO: 21307 - DNA, 18 bp, Artificial sequence
  synthetic polynucleotide sequence
acaacccgcttgagggaa

SEQ ID NO: 21308 - DNA, 21 bp, Artificial sequence
  synthetic polynucleotide sequence
agaaatggagtcaccagcaga

SEQ ID NO: 21309 - DNA, 19 bp, Artificial sequence
  synthetic polynucleotide sequence
ccctccttcagagaccgga

SEQ ID NO: 21310 - DNA, 18 bp, Artificial sequence
  synthetic polynucleotide sequence
ctggcactgctccaggga

SEQ ID NO: 21311 - DNA, 19 bp, Artificial sequence
  synthetic polynucleotide sequence
gccacccttggaggaagga

SEQ ID NO: 21312 - DNA, 19 bp, Artificial sequence
  synthetic polynucleotide sequence
gggtgatactgagggccca

SEQ ID NO: 21313 - DNA, 19 bp, Artificial sequence
  synthetic polynucleotide sequence
tcaacgagaaggcgatcca

SEQ ID NO: 21314 - DNA, 19 bp, Artificial sequence
  synthetic polynucleotide sequence
gctgctgcagctaccacca

SEQ ID NO: 21315 - DNA, 18 bp, Artificial sequence
  synthetic polynucleotide sequence
cttcccccacgcagcaca

SEQ ID NO: 21316 - DNA, 18 bp, Artificial sequence
  synthetic polynucleotide sequence
accagggcgaggaggcca

SEQ ID NO: 21317 - DNA, 19 bp, Artificial sequence
  synthetic polynucleotide sequence
caatgccatcagacagcca

SEQ ID NO: 21318 - DNA, 22 bp, Artificial sequence
  synthetic polynucleotide sequence
aatgacagcaagagtagcacca

SEQ ID NO: 21319 - DNA, 19 bp, Artificial sequence
  synthetic polynucleotide sequence
tctcagggtcccaggacaa

SEQ ID NO: 21320 - DNA, 19 bp, Artificial sequence
  synthetic polynucleotide sequence
tcctctgtcaccaggacca

SEQ ID NO: 21321 - DNA, 20 bp, Artificial sequence
  synthetic polynucleotide sequence
gcatggaccagagctggaca

SEQ ID NO: 21322 - DNA, 18 bp, Artificial sequence
  synthetic polynucleotide sequence
agcagattcccacggcca

SEQ ID NO: 21323 - DNA, 18 bp, Artificial sequence
  synthetic polynucleotide sequence
gcagctccagcagacgaa

SEQ ID NO: 21324 - DNA, 18 bp, Artificial sequence
  synthetic polynucleotide sequence
cttcctgactctgcgcca

SEQ ID NO: 21325 - DNA, 18 bp, Artificial sequence
  synthetic polynucleotide sequence
ccccggagagcaagtgca

SEQ ID NO: 21326 - DNA, 18 bp, Artificial sequence
  synthetic polynucleotide sequence
cctggccagcgaggagca

SEQ ID NO: 21327 - DNA, 20 bp, Artificial sequence
  synthetic polynucleotide sequence
ggcaacgagtcataccagca

SEQ ID NO: 21328 - DNA, 18 bp, Artificial sequence
  synthetic polynucleotide sequence
ccgcgcagaacaggagga

SEQ ID NO: 21329 - DNA, 18 bp, Artificial sequence
  synthetic polynucleotide sequence
ggacgagaatccccagca

SEQ ID NO: 21330 - DNA, 18 bp, Artificial sequence
  synthetic polynucleotide sequence
atggtgagggtggcgaga

SEQ ID NO: 21331 - DNA, 18 bp, Artificial sequence
  synthetic polynucleotide sequence
agctggcacaaactcgca

SEQ ID NO: 21332 - DNA, 18 bp, Artificial sequence
  synthetic polynucleotide sequence
cgcagagccaggatcaca

SEQ ID NO: 21333 - DNA, 18 bp, Artificial sequence
  synthetic polynucleotide sequence
tgcaggagaacctgggca

SEQ ID NO: 21334 - DNA, 18 bp, Artificial sequence
  synthetic polynucleotide sequence
ggaatggacgtgccggca

SEQ ID NO: 21335 - DNA, 19 bp, Artificial sequence
  synthetic polynucleotide sequence
cccccaatgaaaggcccta

SEQ ID NO: 21336 - DNA, 18 bp, Artificial sequence
  synthetic polynucleotide sequence
gtgcagggcatcctgtca

SEQ ID NO: 21337 - DNA, 19 bp, Artificial sequence
  synthetic polynucleotide sequence
tacacgtgtacagcccaga

SEQ ID NO: 21338 - DNA, 20 bp, Artificial sequence
  synthetic polynucleotide sequence
gaacatagccagcacgctca

SEQ ID NO: 21339 - DNA, 18 bp, Artificial sequence
  synthetic polynucleotide sequence
gaagaagcggcctcgcaa

SEQ ID NO: 21340 - DNA, 19 bp, Artificial sequence
  synthetic polynucleotide sequence
cacgctgggcttcatcaga

SEQ ID NO: 21341 - DNA, 19 bp, Artificial sequence
  synthetic polynucleotide sequence
gccgagagaacgagggcta

SEQ ID NO: 21342 - DNA, 18 bp, Artificial sequence
  synthetic polynucleotide sequence
ctggcaggaagaccggca

SEQ ID NO: 21343 - DNA, 20 bp, Artificial sequence
  synthetic polynucleotide sequence
gctgaccttcgggaagggaa

SEQ ID NO: 21344 - DNA, 20 bp, Artificial sequence
  synthetic polynucleotide sequence
tggcctgggtaaccggcaca

SEQ ID NO: 21345 - DNA, 20 bp, Artificial sequence
  synthetic polynucleotide sequence
gaaacgctgaaagccatcca

SEQ ID NO: 21346 - DNA, 19 bp, Artificial sequence
  synthetic polynucleotide sequence
tgatggcatcaggacagga

SEQ ID NO: 21347 - DNA, 18 bp, Artificial sequence
  synthetic polynucleotide sequence
ccagcatccatcacgcca

SEQ ID NO: 21348 - DNA, 20 bp, Artificial sequence
  synthetic polynucleotide sequence
caggagtaggatggccacca

SEQ ID NO: 21349 - DNA, 18 bp, Artificial sequence
  synthetic polynucleotide sequence
accagcacagccagagca

SEQ ID NO: 21350 - DNA, 20 bp, Artificial sequence
  synthetic polynucleotide sequence
gctgctacaatcactggcca

SEQ ID NO: 21351 - DNA, 18 bp, Artificial sequence
  synthetic polynucleotide sequence
agaaggggaagaggccga

SEQ ID NO: 21352 - DNA, 18 bp, Artificial sequence
  synthetic polynucleotide sequence
ctccagccacggcgacca

SEQ ID NO: 21353 - DNA, 21 bp, Artificial sequence
  synthetic polynucleotide sequence
ccggtacggcagcaatgacga

SEQ ID NO: 21354 - DNA, 21 bp, Artificial sequence
  synthetic polynucleotide sequence
gagatgtagctggagacggca

SEQ ID NO: 21355 - DNA, 20 bp, Artificial sequence
  synthetic polynucleotide sequence
ctatcgccagtgacatgcaa

SEQ ID NO: 21356 - DNA, 18 bp, Artificial sequence
  synthetic polynucleotide sequence
ggtcatgtacacgggcca

SEQ ID NO: 21357 - DNA, 18 bp, Artificial sequence
  synthetic polynucleotide sequence
gcagcatgaccggtcaga

SEQ ID NO: 21358 - DNA, 20 bp, Artificial sequence
  synthetic polynucleotide sequence
gagctccatccagaggctga

SEQ ID NO: 21359 - DNA, 19 bp, Artificial sequence
  synthetic polynucleotide sequence
tctggcagacacaaggcca

SEQ ID NO: 21360 - DNA, 21 bp, Artificial sequence
  synthetic polynucleotide sequence
ttcagcaaagtcccctggcca

SEQ ID NO: 21361 - DNA, 20 bp, Artificial sequence
  synthetic polynucleotide sequence
tagggggaaggtgtggctca

SEQ ID NO: 21362 - DNA, 20 bp, Artificial sequence
  synthetic polynucleotide sequence
cttgggtagccggtaactca

SEQ ID NO: 21363 - DNA, 18 bp, Artificial sequence
  synthetic polynucleotide sequence
agacgctggcttcgagca

SEQ ID NO: 21364 - DNA, 21 bp, Artificial sequence
  synthetic polynucleotide sequence
gtccctgttcttccaagacca

SEQ ID NO: 21365 - DNA, 20 bp, Artificial sequence
  synthetic polynucleotide sequence
cagcacccctactgatgcca

SEQ ID NO: 21366 - DNA, 18 bp, Artificial sequence
  synthetic polynucleotide sequence
cagatcctgacccacgca

SEQ ID NO: 21367 - DNA, 21 bp, Artificial sequence
  synthetic polynucleotide sequence
agagtgagcacgaccaagcga

SEQ ID NO: 21368 - DNA, 21 bp, Artificial sequence
  synthetic polynucleotide sequence
tcttccggtgcaatgctcaga

SEQ ID NO: 21369 - DNA, 20 bp, Artificial sequence
  synthetic polynucleotide sequence
aaggagctcatctcaggcca

SEQ ID NO: 21370 - DNA, 18 bp, Artificial sequence
  synthetic polynucleotide sequence
gatgccactgtggcccca

SEQ ID NO: 21371 - DNA, 20 bp, Artificial sequence
  synthetic polynucleotide sequence
gttggggctctgagctggaa

SEQ ID NO: 21372 - DNA, 19 bp, Artificial sequence
  synthetic polynucleotide sequence
cacctggatcgtggggcca

SEQ ID NO: 21373 - DNA, 19 bp, Artificial sequence
  synthetic polynucleotide sequence
tgagagtggagctcagcaa

SEQ ID NO: 21374 - DNA, 18 bp, Artificial sequence
  synthetic polynucleotide sequence
accaggctccccaatgca

SEQ ID NO: 21375 - DNA, 19 bp, Artificial sequence
  synthetic polynucleotide sequence
gaatacgagggaggccaca

SEQ ID NO: 21376 - DNA, 20 bp, Artificial sequence
  synthetic polynucleotide sequence
ctctctcacataccggcaca

SEQ ID NO: 21377 - DNA, 20 bp, Artificial sequence
  synthetic polynucleotide sequence
ctggacagtgaccaccgaga

SEQ ID NO: 21378 - DNA, 18 bp, Artificial sequence
  synthetic polynucleotide sequence
tgcccgtcaatagggcca

SEQ ID NO: 21379 - DNA, 21 bp, Artificial sequence
  synthetic polynucleotide sequence
gctgtctgcgtgaagaggaca

SEQ ID NO: 21380 - DNA, 18 bp, Artificial sequence
  synthetic polynucleotide sequence
ggcttcgacacctcagca

SEQ ID NO: 21381 - DNA, 22 bp, Artificial sequence
  synthetic polynucleotide sequence
gaaaccaacacgcctagagcta

SEQ ID NO: 21382 - DNA, 21 bp, Artificial sequence
  synthetic polynucleotide sequence
ttgggatcactgctaagccca

SEQ ID NO: 21383 - DNA, 18 bp, Artificial sequence
  synthetic polynucleotide sequence
gttgccagaatcggccaa

SEQ ID NO: 21384 - DNA, 21 bp, Artificial sequence
  synthetic polynucleotide sequence
gtcgtgaacttcttcgaggca

SEQ ID NO: 21385 - DNA, 18 bp, Artificial sequence
  synthetic polynucleotide sequence
gcgtgaaggtgcccacca

SEQ ID NO: 21386 - DNA, 18 bp, Artificial sequence
  synthetic polynucleotide sequence
ctcatcgtccccgaagca

SEQ ID NO: 21387 - DNA, 18 bp, Artificial sequence
  synthetic polynucleotide sequence
gcaggacgccatcagcaa

SEQ ID NO: 21388 - DNA, 20 bp, Artificial sequence
  synthetic polynucleotide sequence
cttagagttggggacccaga

SEQ ID NO: 21389 - DNA, 21 bp, Artificial sequence
  synthetic polynucleotide sequence
tgaggctgaggaagagagtga

SEQ ID NO: 21390 - DNA, 19 bp, Artificial sequence
  synthetic polynucleotide sequence
tccatttgcacgccacaga

SEQ ID NO: 21391 - DNA, 21 bp, Artificial sequence
  synthetic polynucleotide sequence
cggactcggacagtgagagca

SEQ ID NO: 21392 - DNA, 20 bp, Artificial sequence
  synthetic polynucleotide sequence
ccttaactgccacctccgga

SEQ ID NO: 21393 - DNA, 22 bp, Artificial sequence
  synthetic polynucleotide sequence
cagaagcctatcactccagaga

SEQ ID NO: 21394 - DNA, 22 bp, Artificial sequence
  synthetic polynucleotide sequence
tgtaagtgcagaacactccaca

SEQ ID NO: 21395 - DNA, 18 bp, Artificial sequence
  synthetic polynucleotide sequence
tcagcaaggtcatccgca

SEQ ID NO: 21396 - DNA, 18 bp, Artificial sequence
  synthetic polynucleotide sequence
agagccctctgacgggga

SEQ ID NO: 21397 - DNA, 20 bp, Artificial sequence
  synthetic polynucleotide sequence
gaccatcggcctgcggagga

SEQ ID NO: 21398 - DNA, 20 bp, Artificial sequence
  synthetic polynucleotide sequence
acgttgagaaccgctcccga

SEQ ID NO: 21399 - DNA, 18 bp, Artificial sequence
  synthetic polynucleotide sequence
tgccatcctcgaccagga

SEQ ID NO: 21400 - DNA, 18 bp, Artificial sequence
  synthetic polynucleotide sequence
cacacagcacgaccagca

SEQ ID NO: 21401 - DNA, 18 bp, Artificial sequence
  synthetic polynucleotide sequence
ccgctcggaaaagccgca

SEQ ID NO: 21402 - DNA, 18 bp, Artificial sequence
  synthetic polynucleotide sequence
ctgaggagtgagggccca

SEQ ID NO: 21403 - DNA, 19 bp, Artificial sequence
  synthetic polynucleotide sequence
gagggagggagtgtggaca

SEQ ID NO: 21404 - DNA, 18 bp, Artificial sequence
  synthetic polynucleotide sequence
tggaaggccccaggtcca

SEQ ID NO: 21405 - DNA, 20 bp, Artificial sequence
  synthetic polynucleotide sequence
gaccatcccaccccatgcga

SEQ ID NO: 21406 - DNA, 21 bp, Artificial sequence
  synthetic polynucleotide sequence
tcatccaaaagtgagggccca

SEQ ID NO: 21407 - DNA, 21 bp, Artificial sequence
  synthetic polynucleotide sequence
acacagaaccaaccacagcca

SEQ ID NO: 21408 - DNA, 20 bp, Artificial sequence
  synthetic polynucleotide sequence
gagcaccaacagggcaccga

SEQ ID NO: 21409 - DNA, 20 bp, Artificial sequence
  synthetic polynucleotide sequence
gtagagaaaccccagccgaa

SEQ ID NO: 21410 - DNA, 18 bp, Artificial sequence
  synthetic polynucleotide sequence
gtccatctccggccccca

SEQ ID NO: 21411 - DNA, 18 bp, Artificial sequence
  synthetic polynucleotide sequence
gtggatacgaaggcggga

SEQ ID NO: 21412 - DNA, 21 bp, Artificial sequence
  synthetic polynucleotide sequence
ccagctgaaggaaatgcagga

SEQ ID NO: 21413 - DNA, 18 bp, Artificial sequence
  synthetic polynucleotide sequence
agaagcagctgcgagcca

SEQ ID NO: 21414 - DNA, 19 bp, Artificial sequence
  synthetic polynucleotide sequence
gccggcctagagaacagca

SEQ ID NO: 21415 - DNA, 19 bp, Artificial sequence
  synthetic polynucleotide sequence
ccgaggatggaatggcaga

SEQ ID NO: 21416 - DNA, 18 bp, Artificial sequence
  synthetic polynucleotide sequence
taggggcaggaaggccca

SEQ ID NO: 21417 - DNA, 20 bp, Artificial sequence
  synthetic polynucleotide sequence
aacaggatgaccttgagcca

SEQ ID NO: 21418 - DNA, 21 bp, Artificial sequence
  synthetic polynucleotide sequence
tcaactgcctgatcaagagca

SEQ ID NO: 21419 - DNA, 20 bp, Artificial sequence
  synthetic polynucleotide sequence
ctagggcaggtacaccagga

SEQ ID NO: 21420 - DNA, 20 bp, Artificial sequence
  synthetic polynucleotide sequence
cacctgcagaccacatgtca

SEQ ID NO: 21421 - DNA, 18 bp, Artificial sequence
  synthetic polynucleotide sequence
gaagcgtcaacatcggca

SEQ ID NO: 21422 - DNA, 18 bp, Artificial sequence
  synthetic polynucleotide sequence
tgaccctccaaacgggca

SEQ ID NO: 21423 - DNA, 21 bp, Artificial sequence
  synthetic polynucleotide sequence
ggagaggacttaagcccggaa

SEQ ID NO: 21424 - DNA, 21 bp, Artificial sequence
  synthetic polynucleotide sequence
agtgcctgaaagggtctcaga

SEQ ID NO: 21425 - DNA, 20 bp, Artificial sequence
  synthetic polynucleotide sequence
atgaagaccagcagtggaga

SEQ ID NO: 21426 - DNA, 20 bp, Artificial sequence
  synthetic polynucleotide sequence
taactgggtacccagaggca

SEQ ID NO: 21427 - DNA, 23 bp, Artificial sequence
  synthetic polynucleotide sequence
ctaaaaaccccagctgcatggaa

SEQ ID NO: 21428 - DNA, 18 bp, Artificial sequence
  synthetic polynucleotide sequence
cgtggtccagctcgccca

SEQ ID NO: 21429 - DNA, 21 bp, Artificial sequence
  synthetic polynucleotide sequence
ggggcagaagacttgtccgga

SEQ ID NO: 21430 - DNA, 19 bp, Artificial sequence
  synthetic polynucleotide sequence
ttctcgggtggtggggaga

SEQ ID NO: 21431 - DNA, 20 bp, Artificial sequence
  synthetic polynucleotide sequence
tatggtgaagaggtcaggga

SEQ ID NO: 21432 - DNA, 21 bp, Artificial sequence
  synthetic polynucleotide sequence
tacacaaggaccccagtcgca

SEQ ID NO: 21433 - DNA, 21 bp, Artificial sequence
  synthetic polynucleotide sequence
ggcgtatgaacccaacccgga

SEQ ID NO: 21434 - DNA, 21 bp, Artificial sequence
  synthetic polynucleotide sequence
tgatggcacgtgttacccaga

SEQ ID NO: 21435 - DNA, 18 bp, Artificial sequence
  synthetic polynucleotide sequence
ctccaggcctgacaccca

SEQ ID NO: 21436 - DNA, 20 bp, Artificial sequence
  synthetic polynucleotide sequence
ctctgcaagtcactggccaa

SEQ ID NO: 21437 - DNA, 20 bp, Artificial sequence
  synthetic polynucleotide sequence
ctctaactgcagccccacga

SEQ ID NO: 21438 - DNA, 18 bp, Artificial sequence
  synthetic polynucleotide sequence
atgatgagcccgagggca

SEQ ID NO: 21439 - DNA, 18 bp, Artificial sequence
  synthetic polynucleotide sequence
ccgtgacctcaagccaca

SEQ ID NO: 21440 - DNA, 18 bp, Artificial sequence
  synthetic polynucleotide sequence
tcgccctcagtggaccca

SEQ ID NO: 21441 - DNA, 18 bp, Artificial sequence
  synthetic polynucleotide sequence
gatgcccccaatacccca

SEQ ID NO: 21442 - DNA, 18 bp, Artificial sequence
  synthetic polynucleotide sequence
ccagcacatccacggtga

SEQ ID NO: 21443 - DNA, 20 bp, Artificial sequence
  synthetic polynucleotide sequence
cagcacaggcacactgacca

SEQ ID NO: 21444 - DNA, 18 bp, Artificial sequence
  synthetic polynucleotide sequence
tgcagaggaggatggcga

SEQ ID NO: 21445 - DNA, 18 bp, Artificial sequence
  synthetic polynucleotide sequence
gcggggattgaaacccga

SEQ ID NO: 21446 - DNA, 20 bp, Artificial sequence
  synthetic polynucleotide sequence
caatcaacgccccagtgcta

SEQ ID NO: 21447 - DNA, 22 bp, Artificial sequence
  synthetic polynucleotide sequence
cagggaaaccacccatgacgaa

SEQ ID NO: 21448 - DNA, 20 bp, Artificial sequence
  synthetic polynucleotide sequence
tgagggcaggctgaagcgca

SEQ ID NO: 21449 - DNA, 20 bp, Artificial sequence
  synthetic polynucleotide sequence
cttcggaccagcctagcaga

SEQ ID NO: 21450 - DNA, 18 bp, Artificial sequence
  synthetic polynucleotide sequence
tgggtctggatccggcca

SEQ ID NO: 21451 - DNA, 18 bp, Artificial sequence
  synthetic polynucleotide sequence
cctggattgggagccaga

SEQ ID NO: 21452 - DNA, 18 bp, Artificial sequence
  synthetic polynucleotide sequence
cccaccagcttcgccaca

SEQ ID NO: 21453 - DNA, 21 bp, Artificial sequence
  synthetic polynucleotide sequence
actgtctaccaggcacacaga

SEQ ID NO: 21454 - DNA, 19 bp, Artificial sequence
  synthetic polynucleotide sequence
gcccacagtgggtatccca

SEQ ID NO: 21455 - DNA, 20 bp, Artificial sequence
  synthetic polynucleotide sequence
atcatccaccctggaaagca

SEQ ID NO: 21456 - DNA, 20 bp, Artificial sequence
  synthetic polynucleotide sequence
ccagcgagctgatagaccca

SEQ ID NO: 21457 - DNA, 20 bp, Artificial sequence
  synthetic polynucleotide sequence
cacaagcgctgagatcagga

SEQ ID NO: 21458 - DNA, 21 bp, Artificial sequence
  synthetic polynucleotide sequence
aaaagcgtaggtctggaggga

SEQ ID NO: 21459 - DNA, 18 bp, Artificial sequence
  synthetic polynucleotide sequence
cttgagccagctgcagca

SEQ ID NO: 21460 - DNA, 18 bp, Artificial sequence
  synthetic polynucleotide sequence
gctgcagatcggaccgga

SEQ ID NO: 21461 - DNA, 19 bp, Artificial sequence
  synthetic polynucleotide sequence
ccatgtggaacccccggga

SEQ ID NO: 21462 - DNA, 20 bp, Artificial sequence
  synthetic polynucleotide sequence
cactgcgcacgtctgaggca

SEQ ID NO: 21463 - DNA, 19 bp, Artificial sequence
  synthetic polynucleotide sequence
ggcacgctcaccatccgca

SEQ ID NO: 21464 - DNA, 22 bp, Artificial sequence
  synthetic polynucleotide sequence
acaaccaggatgagaacgcaga

SEQ ID NO: 21465 - DNA, 20 bp, Artificial sequence
  synthetic polynucleotide sequence
gtggcatccccacgtggaca

SEQ ID NO: 21466 - DNA, 25 bp, Artificial sequence
  synthetic polynucleotide sequence
tgggaagccagtgaaatggagagaa

SEQ ID NO: 21467 - DNA, 19 bp, Artificial sequence
  synthetic polynucleotide sequence
cagcacccctggatcgcga

SEQ ID NO: 21468 - DNA, 22 bp, Artificial sequence
  synthetic polynucleotide sequence
cagcaaccagaagaggtaccca

SEQ ID NO: 21469 - DNA, 21 bp, Artificial sequence
  synthetic polynucleotide sequence
atggcaagccctttgagccaa

SEQ ID NO: 21470 - DNA, 20 bp, Artificial sequence
  synthetic polynucleotide sequence
gaggtaggtagccggggtca

SEQ ID NO: 21471 - DNA, 18 bp, Artificial sequence
  synthetic polynucleotide sequence
tgacggtgatcagggcca

SEQ ID NO: 21472 - DNA, 18 bp, Artificial sequence
  synthetic polynucleotide sequence
gcagcaccagcaggagga

SEQ ID NO: 21473 - DNA, 20 bp, Artificial sequence
  synthetic polynucleotide sequence
ggttggagtggcaggaacga

SEQ ID NO: 21474 - DNA, 20 bp, Artificial sequence
  synthetic polynucleotide sequence
gagaaacctgctgggccaga

SEQ ID NO: 21475 - DNA, 19 bp, Artificial sequence
  synthetic polynucleotide sequence
gctccgagtccatagccga

SEQ ID NO: 21476 - DNA, 19 bp, Artificial sequence
  synthetic polynucleotide sequence
gagccgtacagctcagcca

SEQ ID NO: 21477 - DNA, 18 bp, Artificial sequence
  synthetic polynucleotide sequence
ctccaacagctcgcgaca

SEQ ID NO: 21478 - DNA, 20 bp, Artificial sequence
  synthetic polynucleotide sequence
gtggtcactgactccagcga

SEQ ID NO: 21479 - DNA, 21 bp, Artificial sequence
  synthetic polynucleotide sequence
ctccctcacttagcagcacca

SEQ ID NO: 21480 - DNA, 21 bp, Artificial sequence
  synthetic polynucleotide sequence
gctcctgtactgaggccagca

SEQ ID NO: 21481 - DNA, 20 bp, Artificial sequence
  synthetic polynucleotide sequence
gtggactgggagacaagcaa

SEQ ID NO: 21482 - DNA, 18 bp, Artificial sequence
  synthetic polynucleotide sequence
tcatcagcgtcggtcgca

SEQ ID NO: 21483 - DNA, 18 bp, Artificial sequence
  synthetic polynucleotide sequence
gacgcagacccaagtgca

SEQ ID NO: 21484 - DNA, 20 bp, Artificial sequence
  synthetic polynucleotide sequence
ggcccccagtcactgaggta

SEQ ID NO: 21485 - DNA, 20 bp, Artificial sequence
  synthetic polynucleotide sequence
cgaggatgcagaggaaccca

SEQ ID NO: 21486 - DNA, 18 bp, Artificial sequence
  synthetic polynucleotide sequence
gggcatccagggagcgga

SEQ ID NO: 21487 - DNA, 18 bp, Artificial sequence
  synthetic polynucleotide sequence
tcaggactcgctgacgca

SEQ ID NO: 21488 - DNA, 18 bp, Artificial sequence
  synthetic polynucleotide sequence
gcacacacacgaaggcca

SEQ ID NO: 21489 - DNA, 18 bp, Artificial sequence
  synthetic polynucleotide sequence
gagtccagccaccaggga

SEQ ID NO: 21490 - DNA, 18 bp, Artificial sequence
  synthetic polynucleotide sequence
accagcatcctcagccca

SEQ ID NO: 21491 - DNA, 21 bp, Artificial sequence
  synthetic polynucleotide sequence
catgctcgtgacagacacaga

SEQ ID NO: 21492 - DNA, 20 bp, Artificial sequence
  synthetic polynucleotide sequence
aggagcctgccaagaagcca

SEQ ID NO: 21493 - DNA, 18 bp, Artificial sequence
  synthetic polynucleotide sequence
cctcccaccaaccaacca

SEQ ID NO: 21494 - DNA, 18 bp, Artificial sequence
  synthetic polynucleotide sequence
acaaggacggcgaggcca

SEQ ID NO: 21495 - DNA, 20 bp, Artificial sequence
  synthetic polynucleotide sequence
gtgcagacggtgtgtcccca

SEQ ID NO: 21496 - DNA, 22 bp, Artificial sequence
  synthetic polynucleotide sequence
ccagatcacatcccatgaagca

SEQ ID NO: 21497 - DNA, 20 bp, Artificial sequence
  synthetic polynucleotide sequence
cctgctgtaccctggagcca

SEQ ID NO: 21498 - DNA, 21 bp, Artificial sequence
  synthetic polynucleotide sequence
cggaacagtcccacagagcca

SEQ ID NO: 21499 - DNA, 22 bp, Artificial sequence
  synthetic polynucleotide sequence
actacaggtcaagtggtagcca

SEQ ID NO: 21500 - DNA, 22 bp, Artificial sequence
  synthetic polynucleotide sequence
tccatgtactgaccaggaggga

SEQ ID NO: 21501 - DNA, 21 bp, Artificial sequence
  synthetic polynucleotide sequence
gcacttccgagatccaccaga

SEQ ID NO: 21502 - DNA, 20 bp, Artificial sequence
  synthetic polynucleotide sequence
ccggaggctgtactggccga

SEQ ID NO: 21503 - DNA, 20 bp, Artificial sequence
  synthetic polynucleotide sequence
cgtggagcacgacctcaaga

SEQ ID NO: 21504 - DNA, 20 bp, Artificial sequence
  synthetic polynucleotide sequence
gcggtaccactgggtcacca

SEQ ID NO: 21505 - DNA, 20 bp, Artificial sequence
  synthetic polynucleotide sequence
tccaacctgctgctgagcca

SEQ ID NO: 21506 - DNA, 20 bp, Artificial sequence
  synthetic polynucleotide sequence
ctgacttcccggggaacaga

SEQ ID NO: 21507 - DNA, 20 bp, Artificial sequence
  synthetic polynucleotide sequence
gtccagcagttaccagggca

SEQ ID NO: 21508 - DNA, 18 bp, Artificial sequence
  synthetic polynucleotide sequence
ggaatggttgcccgacca

SEQ ID NO: 21509 - DNA, 20 bp, Artificial sequence
  synthetic polynucleotide sequence
cccctgagctaccaggagga

SEQ ID NO: 21510 - DNA, 18 bp, Artificial sequence
  synthetic polynucleotide sequence
tcaccatagcgaggccca

SEQ ID NO: 21511 - DNA, 22 bp, Artificial sequence
  synthetic polynucleotide sequence
aaaatccgtccctagccacaca

SEQ ID NO: 21512 - DNA, 22 bp, Artificial sequence
  synthetic polynucleotide sequence
caaagatgcaacctactcccca

SEQ ID NO: 21513 - DNA, 21 bp, Artificial sequence
  synthetic polynucleotide sequence
tcagtcacctgggagagctca

SEQ ID NO: 21514 - DNA, 19 bp, Artificial sequence
  synthetic polynucleotide sequence
ggactcccagcacctccca

SEQ ID NO: 21515 - DNA, 21 bp, Artificial sequence
  synthetic polynucleotide sequence
tcaacgagaggggagagctca

SEQ ID NO: 21516 - DNA, 18 bp, Artificial sequence
  synthetic polynucleotide sequence
tccaccgtggagcccgga

SEQ ID NO: 21517 - DNA, 21 bp, Artificial sequence
  synthetic polynucleotide sequence
cgagccaagtcagttcccaca

SEQ ID NO: 21518 - DNA, 23 bp, Artificial sequence
  synthetic polynucleotide sequence
gaaaatgcaaccaacaccccaca

SEQ ID NO: 21519 - DNA, 21 bp, Artificial sequence
  synthetic polynucleotide sequence
ccacagagtactccaccccca

SEQ ID NO: 21520 - DNA, 18 bp, Artificial sequence
  synthetic polynucleotide sequence
gcgggaggtagcagggga

SEQ ID NO: 21521 - DNA, 21 bp, Artificial sequence
  synthetic polynucleotide sequence
tcaggcgcaaactcaggtgga

SEQ ID NO: 21522 - DNA, 18 bp, Artificial sequence
  synthetic polynucleotide sequence
ccggtgggcctggtgaga

SEQ ID NO: 21523 - DNA, 19 bp, Artificial sequence
  synthetic polynucleotide sequence
cggagagggcacgtacgga

SEQ ID NO: 21524 - DNA, 20 bp, Artificial sequence
  synthetic polynucleotide sequence
ggatggcagtactgggcaca

SEQ ID NO: 21525 - DNA, 22 bp, Artificial sequence
  synthetic polynucleotide sequence
attgaagagctggggaaggaga

SEQ ID NO: 21526 - DNA, 19 bp, Artificial sequence
  synthetic polynucleotide sequence
ttctgccaagcactcccga

SEQ ID NO: 21527 - DNA, 20 bp, Artificial sequence
  synthetic polynucleotide sequence
catgggctacgtgcaggcga

SEQ ID NO: 21528 - DNA, 21 bp, Artificial sequence
  synthetic polynucleotide sequence
tgccagcataggtaggccgga

SEQ ID NO: 21529 - DNA, 21 bp, Artificial sequence
  synthetic polynucleotide sequence
aactcctgcagtatgacccca

SEQ ID NO: 21530 - DNA, 21 bp, Artificial sequence
  synthetic polynucleotide sequence
tggcggaatcgctgcagcaca

SEQ ID NO: 21531 - DNA, 18 bp, Artificial sequence
  synthetic polynucleotide sequence
agccgaccagttgggcaa

SEQ ID NO: 21532 - DNA, 21 bp, Artificial sequence
  synthetic polynucleotide sequence
ctccatctcaggtaccaccga

SEQ ID NO: 21533 - DNA, 18 bp, Artificial sequence
  synthetic polynucleotide sequence
ggggaaggcacctacgga

SEQ ID NO: 21534 - DNA, 18 bp, Artificial sequence
  synthetic polynucleotide sequence
agggcggaactcggcaca

SEQ ID NO: 21535 - DNA, 19 bp, Artificial sequence
  synthetic polynucleotide sequence
ggtgctaccgcctgaagca

SEQ ID NO: 21536 - DNA, 20 bp, Artificial sequence
  synthetic polynucleotide sequence
gaggtacaggcatgtcagca

SEQ ID NO: 21537 - DNA, 21 bp, Artificial sequence
  synthetic polynucleotide sequence
ggcaacgagatctcctaccca

SEQ ID NO: 21538 - DNA, 19 bp, Artificial sequence
  synthetic polynucleotide sequence
cgcagcatctgcgggctga

SEQ ID NO: 21539 - DNA, 19 bp, Artificial sequence
  synthetic polynucleotide sequence
ttgtggtgagacggaggaa

SEQ ID NO: 21540 - DNA, 21 bp, Artificial sequence
  synthetic polynucleotide sequence
tgagcccttccactagcacca

SEQ ID NO: 21541 - DNA, 19 bp, Artificial sequence
  synthetic polynucleotide sequence
ctaccaggacagcccagga

SEQ ID NO: 21542 - DNA, 19 bp, Artificial sequence
  synthetic polynucleotide sequence
caaggtcatcaggtgggca

SEQ ID NO: 21543 - DNA, 21 bp, Artificial sequence
  synthetic polynucleotide sequence
tagaggcagtgtctgagggga

SEQ ID NO: 21544 - DNA, 22 bp, Artificial sequence
  synthetic polynucleotide sequence
aagcaacagcatcgtctcccca

SEQ ID NO: 21545 - DNA, 18 bp, Artificial sequence
  synthetic polynucleotide sequence
ggtgaccagcagcggaca

SEQ ID NO: 21546 - DNA, 21 bp, Artificial sequence
  synthetic polynucleotide sequence
aaatatgcagccaacactcca

SEQ ID NO: 21547 - DNA, 19 bp, Artificial sequence
  synthetic polynucleotide sequence
tcagtgcagcaggagacga

SEQ ID NO: 21548 - DNA, 20 bp, Artificial sequence
  synthetic polynucleotide sequence
gtggccgtaattcgagcaca

SEQ ID NO: 21549 - DNA, 22 bp, Artificial sequence
  synthetic polynucleotide sequence
agcagcagcagggcaataacca

SEQ ID NO: 21550 - DNA, 22 bp, Artificial sequence
  synthetic polynucleotide sequence
acctgaggtagtggtaggagga

SEQ ID NO: 21551 - DNA, 18 bp, Artificial sequence
  synthetic polynucleotide sequence
caagggccagaagcggaa

SEQ ID NO: 21552 - DNA, 18 bp, Artificial sequence
  synthetic polynucleotide sequence
gcatggggtcggaccaga

SEQ ID NO: 21553 - DNA, 18 bp, Artificial sequence
  synthetic polynucleotide sequence
ggcaccaatctccccaca

SEQ ID NO: 21554 - DNA, 21 bp, Artificial sequence
  synthetic polynucleotide sequence
aaagcgtagactctggggtga

SEQ ID NO: 21555 - DNA, 22 bp, Artificial sequence
  synthetic polynucleotide sequence
atctcattcctaggcaccagca

SEQ ID NO: 21556 - DNA, 20 bp, Artificial sequence
  synthetic polynucleotide sequence
tctgccctttaggagcccca

SEQ ID NO: 21557 - DNA, 21 bp, Artificial sequence
  synthetic polynucleotide sequence
ccgatggtacagagctccaga

SEQ ID NO: 21558 - DNA, 21 bp, Artificial sequence
  synthetic polynucleotide sequence
caggaaataggggttccccca

SEQ ID NO: 21559 - DNA, 22 bp, Artificial sequence
  synthetic polynucleotide sequence
agatggccactggaaatcccta

SEQ ID NO: 21560 - DNA, 22 bp, Artificial sequence
  synthetic polynucleotide sequence
ttgaggaagaactaccccagca

SEQ ID NO: 21561 - DNA, 20 bp, Artificial sequence
  synthetic polynucleotide sequence
ccaggagatgcctacaccga

SEQ ID NO: 21562 - DNA, 25 bp, Artificial sequence
  synthetic polynucleotide sequence
caggagctctgcaaaaacacaacca

SEQ ID NO: 21563 - DNA, 21 bp, Artificial sequence
  synthetic polynucleotide sequence
agacaccattctggaccccaa

SEQ ID NO: 21564 - DNA, 20 bp, Artificial sequence
  synthetic polynucleotide sequence
ctcggtttgggacgcacgga

SEQ ID NO: 21565 - DNA, 21 bp, Artificial sequence
  synthetic polynucleotide sequence
gggatgagttgggaggaggca

SEQ ID NO: 21566 - DNA, 20 bp, Artificial sequence
  synthetic polynucleotide sequence
gagcgaggcacaagggtaca

SEQ ID NO: 21567 - DNA, 18 bp, Artificial sequence
  synthetic polynucleotide sequence
gcgacctgcaaccgacga

SEQ ID NO: 21568 - DNA, 18 bp, Artificial sequence
  synthetic polynucleotide sequence
agaaccggcatttgggga

SEQ ID NO: 21569 - DNA, 18 bp, Artificial sequence
  synthetic polynucleotide sequence
tgagaagtcgtcgggcga

SEQ ID NO: 21570 - DNA, 18 bp, Artificial sequence
  synthetic polynucleotide sequence
cggggtctgctccaccga

SEQ ID NO: 21571 - DNA, 20 bp, Artificial sequence
  synthetic polynucleotide sequence
cccgtggacctggctgagga

SEQ ID NO: 21572 - DNA, 20 bp, Artificial sequence
  synthetic polynucleotide sequence
ctgagggaccttccgcggca

SEQ ID NO: 21573 - DNA, 20 bp, Artificial sequence
  synthetic polynucleotide sequence
gctgcctccgctagcacgga

SEQ ID NO: 21574 - DNA, 20 bp, Artificial sequence
  synthetic polynucleotide sequence
aggaagacgtggttcgccca

SEQ ID NO: 21575 - DNA, 21 bp, Artificial sequence
  synthetic polynucleotide sequence
caatggaaggcccgcatggaa

SEQ ID NO: 21576 - DNA, 22 bp, Artificial sequence
  synthetic polynucleotide sequence
gtaactgcagcctaggaagaga

SEQ ID NO: 21577 - DNA, 21 bp, Artificial sequence
  synthetic polynucleotide sequence
ggatgtgcaagcgacgacaga

SEQ ID NO: 21578 - DNA, 22 bp, Artificial sequence
  synthetic polynucleotide sequence
gcaaaggccagcatcctgtgca

SEQ ID NO: 21579 - DNA, 18 bp, Artificial sequence
  synthetic polynucleotide sequence
catgatgcggccagagca

SEQ ID NO: 21580 - DNA, 20 bp, Artificial sequence
  synthetic polynucleotide sequence
gtgcttcaccaggaactcca

SEQ ID NO: 21581 - DNA, 18 bp, Artificial sequence
  synthetic polynucleotide sequence
cggggcacttccaatcca

SEQ ID NO: 21582 - DNA, 18 bp, Artificial sequence
  synthetic polynucleotide sequence
ctgcagtgccagctccaa

SEQ ID NO: 21583 - DNA, 19 bp, Artificial sequence
  synthetic polynucleotide sequence
ccaatcgcagatggaggga

SEQ ID NO: 21584 - DNA, 20 bp, Artificial sequence
  synthetic polynucleotide sequence
ctcccaagtcctccatagca

SEQ ID NO: 21585 - DNA, 21 bp, Artificial sequence
  synthetic polynucleotide sequence
gacgcagccacaaagatccta

SEQ ID NO: 21586 - DNA, 20 bp, Artificial sequence
  synthetic polynucleotide sequence
gtcaactgatgccaagtcca

SEQ ID NO: 21587 - DNA, 22 bp, Artificial sequence
  synthetic polynucleotide sequence
tagagaacatcagccatacgga

SEQ ID NO: 21588 - DNA, 18 bp, Artificial sequence
  synthetic polynucleotide sequence
gttctccagcgagcccga

SEQ ID NO: 21589 - DNA, 18 bp, Artificial sequence
  synthetic polynucleotide sequence
cggttcgagtcccaggaa

SEQ ID NO: 21590 - DNA, 18 bp, Artificial sequence
  synthetic polynucleotide sequence
gatgcccacgggtggaga

SEQ ID NO: 21591 - DNA, 19 bp, Artificial sequence
  synthetic polynucleotide sequence
ccccccaacacccagtcga

SEQ ID NO: 21592 - DNA, 20 bp, Artificial sequence
  synthetic polynucleotide sequence
acacacaccagcctgctgca

SEQ ID NO: 21593 - DNA, 21 bp, Artificial sequence
  synthetic polynucleotide sequence
aagacctggaggccattggaa

SEQ ID NO: 21594 - DNA, 23 bp, Artificial sequence
  synthetic polynucleotide sequence
aaaaatccaggtcttccagccaa

SEQ ID NO: 21595 - DNA, 18 bp, Artificial sequence
  synthetic polynucleotide sequence
ctgcatcaggagggccaa

SEQ ID NO: 21596 - DNA, 18 bp, Artificial sequence
  synthetic polynucleotide sequence
agttcccagccgctggca

SEQ ID NO: 21597 - DNA, 20 bp, Artificial sequence
  synthetic polynucleotide sequence
ctgggggagaggagtgtgga

SEQ ID NO: 21598 - DNA, 20 bp, Artificial sequence
  synthetic polynucleotide sequence
tgccactacagagctgggga

SEQ ID NO: 21599 - DNA, 21 bp, Artificial sequence
  synthetic polynucleotide sequence
ccaagtgctacagctcaggga

SEQ ID NO: 21600 - DNA, 20 bp, Artificial sequence
  synthetic polynucleotide sequence
catgggctggacagcggcca

SEQ ID NO: 21601 - DNA, 21 bp, Artificial sequence
  synthetic polynucleotide sequence
caaggaccagaccaacgagga

SEQ ID NO: 21602 - DNA, 20 bp, Artificial sequence
  synthetic polynucleotide sequence
cctggatgcccagctgtgga

SEQ ID NO: 21603 - DNA, 19 bp, Artificial sequence
  synthetic polynucleotide sequence
cacagccccagccagcaga

SEQ ID NO: 21604 - DNA, 21 bp, Artificial sequence
  synthetic polynucleotide sequence
tctctccagcgaggtacagga

SEQ ID NO: 21605 - DNA, 20 bp, Artificial sequence
  synthetic polynucleotide sequence
accctgggcatcaaggcaga

SEQ ID NO: 21606 - DNA, 22 bp, Artificial sequence
  synthetic polynucleotide sequence
ccaataccgaataagcgcccca

SEQ ID NO: 21607 - DNA, 21 bp, Artificial sequence
  synthetic polynucleotide sequence
tctgcccagtggaataccgaa

SEQ ID NO: 21608 - DNA, 22 bp, Artificial sequence
  synthetic polynucleotide sequence
aaagaagcctccaaatgggcca

SEQ ID NO: 21609 - DNA, 20 bp, Artificial sequence
  synthetic polynucleotide sequence
gtggactgtgagccctcgga

SEQ ID NO: 21610 - DNA, 20 bp, Artificial sequence
  synthetic polynucleotide sequence
ctggcagtcaaagcgatcca

SEQ ID NO: 21611 - DNA, 21 bp, Artificial sequence
  synthetic polynucleotide sequence
agcagcagctccagttcccaa

SEQ ID NO: 21612 - DNA, 21 bp, Artificial sequence
  synthetic polynucleotide sequence
gcccccagtcagtgtcaagga

SEQ ID NO: 21613 - DNA, 20 bp, Artificial sequence
  synthetic polynucleotide sequence
ctgaagggggtgtcccagga

SEQ ID NO: 21614 - DNA, 20 bp, Artificial sequence
  synthetic polynucleotide sequence
acaggccacctccatgctga

SEQ ID NO: 21615 - DNA, 20 bp, Artificial sequence
  synthetic polynucleotide sequence
ctggggccaggttaaccaca

SEQ ID NO: 21616 - DNA, 21 bp, Artificial sequence
  synthetic polynucleotide sequence
cagttgactgcagggatggga

SEQ ID NO: 21617 - DNA, 21 bp, Artificial sequence
  synthetic polynucleotide sequence
gtggtctacaccgaccaccaa

SEQ ID NO: 21618 - DNA, 20 bp, Artificial sequence
  synthetic polynucleotide sequence
ctgccgttcagtgagcccca

SEQ ID NO: 21619 - DNA, 20 bp, Artificial sequence
  synthetic polynucleotide sequence
tgaagaagggggtgggggga

SEQ ID NO: 21620 - DNA, 23 bp, Artificial sequence
  synthetic polynucleotide sequence
cttggatgttacacagaccaaca

SEQ ID NO: 21621 - DNA, 21 bp, Artificial sequence
  synthetic polynucleotide sequence
ctgctcgaccgactacagcaa

SEQ ID NO: 21622 - DNA, 18 bp, Artificial sequence
  synthetic polynucleotide sequence
cggctcctgctgggggaa

SEQ ID NO: 21623 - DNA, 18 bp, Artificial sequence
  synthetic polynucleotide sequence
aagggaggcatgcgccaa

SEQ ID NO: 21624 - DNA, 22 bp, Artificial sequence
  synthetic polynucleotide sequence
acgagggccttacattcttcca

SEQ ID NO: 21625 - DNA, 25 bp, Artificial sequence
  synthetic polynucleotide sequence
gaaagtgccagcacatacagagaca

SEQ ID NO: 21626 - DNA, 25 bp, Artificial sequence
  synthetic polynucleotide sequence
gcagcaaaagacacttccagctgca

SEQ ID NO: 21627 - DNA, 25 bp, Artificial sequence
  synthetic polynucleotide sequence
acagaacaagactcagatgcaccca

SEQ ID NO: 21628 - DNA, 23 bp, Artificial sequence
  synthetic polynucleotide sequence
ctgaacctgtggccatagaagca

SEQ ID NO: 21629 - DNA, 18 bp, Artificial sequence
  synthetic polynucleotide sequence
gcaggaggcgtgtggcaa

SEQ ID NO: 21630 - DNA, 18 bp, Artificial sequence
  synthetic polynucleotide sequence
gcgcacgagggctttgga

SEQ ID NO: 21631 - DNA, 18 bp, Artificial sequence
  synthetic polynucleotide sequence
tccagacgccctacgcca

SEQ ID NO: 21632 - DNA, 18 bp, Artificial sequence
  synthetic polynucleotide sequence
gctgaacgtggtgggcca

SEQ ID NO: 21633 - DNA, 18 bp, Artificial sequence
  synthetic polynucleotide sequence
gcaacaccaccctcagca

SEQ ID NO: 21634 - DNA, 20 bp, Artificial sequence
  synthetic polynucleotide sequence
caaccagggccactactcca

SEQ ID NO: 21635 - DNA, 20 bp, Artificial sequence
  synthetic polynucleotide sequence
gtgtccaggtcctgcccaga

SEQ ID NO: 21636 - DNA, 21 bp, Artificial sequence
  synthetic polynucleotide sequence
agcttgaccacgactgaggca

SEQ ID NO: 21637 - DNA, 18 bp, Artificial sequence
  synthetic polynucleotide sequence
gctgagatcggctcccaa

SEQ ID NO: 21638 - DNA, 18 bp, Artificial sequence
  synthetic polynucleotide sequence
tgcatcggtaacggccca

SEQ ID NO: 21639 - DNA, 18 bp, Artificial sequence
  synthetic polynucleotide sequence
gcacatggatggcgacca

SEQ ID NO: 21640 - DNA, 20 bp, Artificial sequence
  synthetic polynucleotide sequence
gggacaccaggaggactgga

SEQ ID NO: 21641 - DNA, 22 bp, Artificial sequence
  synthetic polynucleotide sequence
tgcaaccaccagaccttccaga

SEQ ID NO: 21642 - DNA, 20 bp, Artificial sequence
  synthetic polynucleotide sequence
gaccaatctgagtgggggca

SEQ ID NO: 21643 - DNA, 18 bp, Artificial sequence
  synthetic polynucleotide sequence
ccccatcaggcaggagga

SEQ ID NO: 21644 - DNA, 20 bp, Artificial sequence
  synthetic polynucleotide sequence
cagccaccagaagactccca

SEQ ID NO: 21645 - DNA, 21 bp, Artificial sequence
  synthetic polynucleotide sequence
cctctccccacagagaatgca

SEQ ID NO: 21646 - DNA, 20 bp, Artificial sequence
  synthetic polynucleotide sequence
cttcccctctgcgacactga

SEQ ID NO: 21647 - DNA, 21 bp, Artificial sequence
  synthetic polynucleotide sequence
ggccagctccacgtacaccaa

SEQ ID NO: 21648 - DNA, 18 bp, Artificial sequence
  synthetic polynucleotide sequence
gctgggtagaggggccga

SEQ ID NO: 21649 - DNA, 18 bp, Artificial sequence
  synthetic polynucleotide sequence
gcaaaccgcagtgaccca

SEQ ID NO: 21650 - DNA, 18 bp, Artificial sequence
  synthetic polynucleotide sequence
agaggccgagtggcagga

SEQ ID NO: 21651 - DNA, 20 bp, Artificial sequence
  synthetic polynucleotide sequence
ctggcctcaataggaccaca

SEQ ID NO: 21652 - DNA, 18 bp, Artificial sequence
  synthetic polynucleotide sequence
gagccaccctggccagca

SEQ ID NO: 21653 - DNA, 18 bp, Artificial sequence
  synthetic polynucleotide sequence
agccacccaagccctcca

SEQ ID NO: 21654 - DNA, 18 bp, Artificial sequence
  synthetic polynucleotide sequence
gagagcagcagcctggga

SEQ ID NO: 21655 - DNA, 18 bp, Artificial sequence
  synthetic polynucleotide sequence
gcccagatgcccccacca

SEQ ID NO: 21656 - DNA, 18 bp, Artificial sequence
  synthetic polynucleotide sequence
ggtggattagaggccgca

SEQ ID NO: 21657 - DNA, 20 bp, Artificial sequence
  synthetic polynucleotide sequence
gaaggtgctggagctgacca

SEQ ID NO: 21658 - DNA, 18 bp, Artificial sequence
  synthetic polynucleotide sequence
tgcccatggccttgacca

SEQ ID NO: 21659 - DNA, 20 bp, Artificial sequence
  synthetic polynucleotide sequence
aaggcggagccgggcttcga

SEQ ID NO: 21660 - DNA, 20 bp, Artificial sequence
  synthetic polynucleotide sequence
gtagccgaggtaagcgcgca

SEQ ID NO: 21661 - DNA, 20 bp, Artificial sequence
  synthetic polynucleotide sequence
caaccaggagatgcagcaga

SEQ ID NO: 21662 - DNA, 18 bp, Artificial sequence
  synthetic polynucleotide sequence
cggccaggtcccgcgtga

SEQ ID NO: 21663 - DNA, 21 bp, Artificial sequence
  synthetic polynucleotide sequence
gcattctggagacgcagcaga

SEQ ID NO: 21664 - DNA, 20 bp, Artificial sequence
  synthetic polynucleotide sequence
cgcctcaggaatctggcgga

SEQ ID NO: 21665 - DNA, 21 bp, Artificial sequence
  synthetic polynucleotide sequence
tgttatccatacccaggcaca

SEQ ID NO: 21666 - DNA, 19 bp, Artificial sequence
  synthetic polynucleotide sequence
gcgttgccgatactcgtca

SEQ ID NO: 21667 - DNA, 19 bp, Artificial sequence
  synthetic polynucleotide sequence
tcccagactggtgatgaca

SEQ ID NO: 21668 - DNA, 20 bp, Artificial sequence
  synthetic polynucleotide sequence
ccttcacccggcgcaacaca

SEQ ID NO: 21669 - DNA, 22 bp, Artificial sequence
  synthetic polynucleotide sequence
gagctcaccacaagaaagggaa

SEQ ID NO: 21670 - DNA, 20 bp, Artificial sequence
  synthetic polynucleotide sequence
tgctatccgagggccaggga

SEQ ID NO: 21671 - DNA, 23 bp, Artificial sequence
  synthetic polynucleotide sequence
cagaaaaggatcctgggctcaga

SEQ ID NO: 21672 - DNA, 22 bp, Artificial sequence
  synthetic polynucleotide sequence
tttggggactaacagagaggaa

SEQ ID NO: 21673 - DNA, 20 bp, Artificial sequence
  synthetic polynucleotide sequence
aaacagcggctacctggaga

SEQ ID NO: 21674 - DNA, 18 bp, Artificial sequence
  synthetic polynucleotide sequence
tgagggtccagtagcgca

SEQ ID NO: 21675 - DNA, 20 bp, Artificial sequence
  synthetic polynucleotide sequence
gactctgggggccccctcca

SEQ ID NO: 21676 - DNA, 20 bp, Artificial sequence
  synthetic polynucleotide sequence
acagccccggctggacacaa

SEQ ID NO: 21677 - DNA, 19 bp, Artificial sequence
  synthetic polynucleotide sequence
ccggcaccattctacccaa

SEQ ID NO: 21678 - DNA, 18 bp, Artificial sequence
  synthetic polynucleotide sequence
acgccatcacccccagca

SEQ ID NO: 21679 - DNA, 18 bp, Artificial sequence
  synthetic polynucleotide sequence
aggtccacggtgtgacca

SEQ ID NO: 21680 - DNA, 18 bp, Artificial sequence
  synthetic polynucleotide sequence
ccagtcgatgaaggcgga

SEQ ID NO: 21681 - DNA, 20 bp, Artificial sequence
  synthetic polynucleotide sequence
ctcccagacaagctgcagga

SEQ ID NO: 21682 - DNA, 20 bp, Artificial sequence
  synthetic polynucleotide sequence
ggggtcctccagagtcacca

SEQ ID NO: 21683 - DNA, 21 bp, Artificial sequence
  synthetic polynucleotide sequence
gctccccactctgtacaacca

SEQ ID NO: 21684 - DNA, 21 bp, Artificial sequence
  synthetic polynucleotide sequence
tgcagcaggtcctgatcacca

SEQ ID NO: 21685 - DNA, 18 bp, Artificial sequence
  synthetic polynucleotide sequence
cgccacaggcttgacgaa

SEQ ID NO: 21686 - DNA, 20 bp, Artificial sequence
  synthetic polynucleotide sequence
ctggctgtacagagtgggca

SEQ ID NO: 21687 - DNA, 20 bp, Artificial sequence
  synthetic polynucleotide sequence
ggccacgtcatctcagccaa

SEQ ID NO: 21688 - DNA, 21 bp, Artificial sequence
  synthetic polynucleotide sequence
ttcatgccgatctggaagcca

SEQ ID NO: 21689 - DNA, 19 bp, Artificial sequence
  synthetic polynucleotide sequence
cacccctacccagcacaga

SEQ ID NO: 21690 - DNA, 18 bp, Artificial sequence
  synthetic polynucleotide sequence
attggaggcggctgagga

SEQ ID NO: 21691 - DNA, 20 bp, Artificial sequence
  synthetic polynucleotide sequence
atgcagcagatggtgggcca

SEQ ID NO: 21692 - DNA, 20 bp, Artificial sequence
  synthetic polynucleotide sequence
caggagcgatgggtgtggca

SEQ ID NO: 21693 - DNA, 21 bp, Artificial sequence
  synthetic polynucleotide sequence
gcctatgccccagtgagcaca

SEQ ID NO: 21694 - DNA, 22 bp, Artificial sequence
  synthetic polynucleotide sequence
gcatcaccaaactcctgaggca

SEQ ID NO: 21695 - DNA, 20 bp, Artificial sequence
  synthetic polynucleotide sequence
ctgtccaggaaccggacaca

SEQ ID NO: 21696 - DNA, 18 bp, Artificial sequence
  synthetic polynucleotide sequence
tcaggaggacgaaggcca

SEQ ID NO: 21697 - DNA, 18 bp, Artificial sequence
  synthetic polynucleotide sequence
tgagcggctacagcggaa

SEQ ID NO: 21698 - DNA, 18 bp, Artificial sequence
  synthetic polynucleotide sequence
tgtgtggcagacagccca

SEQ ID NO: 21699 - DNA, 21 bp, Artificial sequence
  synthetic polynucleotide sequence
gcagcctttcacagccagcca

SEQ ID NO: 21700 - DNA, 21 bp, Artificial sequence
  synthetic polynucleotide sequence
aggggacgtagaacaggggca

SEQ ID NO: 21701 - DNA, 20 bp, Artificial sequence
  synthetic polynucleotide sequence
gatacgtctccagaggccca

SEQ ID NO: 21702 - DNA, 18 bp, Artificial sequence
  synthetic polynucleotide sequence
tcaccacagggatgggca

SEQ ID NO: 21703 - DNA, 18 bp, Artificial sequence
  synthetic polynucleotide sequence
ccctgacgtctgacccca

SEQ ID NO: 21704 - DNA, 18 bp, Artificial sequence
  synthetic polynucleotide sequence
ccttggccctggcacaca

SEQ ID NO: 21705 - DNA, 20 bp, Artificial sequence
  synthetic polynucleotide sequence
caacctgaagccagccccca

SEQ ID NO: 21706 - DNA, 18 bp, Artificial sequence
  synthetic polynucleotide sequence
ccacacccccagccacca

SEQ ID NO: 21707 - DNA, 21 bp, Artificial sequence
  synthetic polynucleotide sequence
gcgcttcctcccatcaacaca

SEQ ID NO: 21708 - DNA, 21 bp, Artificial sequence
  synthetic polynucleotide sequence
gtgaggagataggcgtcctca

SEQ ID NO: 21709 - DNA, 22 bp, Artificial sequence
  synthetic polynucleotide sequence
aagaggacgatgaggaagagga

SEQ ID NO: 21710 - DNA, 21 bp, Artificial sequence
  synthetic polynucleotide sequence
gcacgcggtcatcaatgggga

SEQ ID NO: 21711 - DNA, 22 bp, Artificial sequence
  synthetic polynucleotide sequence
aagcgggtgagaagctcagtca

SEQ ID NO: 21712 - DNA, 18 bp, Artificial sequence
  synthetic polynucleotide sequence
gcggcgctcaaggtcgca

SEQ ID NO: 21713 - DNA, 22 bp, Artificial sequence
  synthetic polynucleotide sequence
caaacagatcagttcaggccca

SEQ ID NO: 21714 - DNA, 21 bp, Artificial sequence
  synthetic polynucleotide sequence
aacagaaggtgagccaacgga

SEQ ID NO: 21715 - DNA, 20 bp, Artificial sequence
  synthetic polynucleotide sequence
aagggagaaaagagcaggca

SEQ ID NO: 21716 - DNA, 18 bp, Artificial sequence
  synthetic polynucleotide sequence
ttgagccgcacacctgca

SEQ ID NO: 21717 - DNA, 19 bp, Artificial sequence
  synthetic polynucleotide sequence
tgctgacatcccgacagga

SEQ ID NO: 21718 - DNA, 18 bp, Artificial sequence
  synthetic polynucleotide sequence
gccgagactcagtgggga

SEQ ID NO: 21719 - DNA, 21 bp, Artificial sequence
  synthetic polynucleotide sequence
ccagatgcaagacgccgacga

SEQ ID NO: 21720 - DNA, 20 bp, Artificial sequence
  synthetic polynucleotide sequence
tgctctcagcctgaggagca

SEQ ID NO: 21721 - DNA, 21 bp, Artificial sequence
  synthetic polynucleotide sequence
tcctcagcctggataccagca

SEQ ID NO: 21722 - DNA, 21 bp, Artificial sequence
  synthetic polynucleotide sequence
gggtttggacgtccacaggca

SEQ ID NO: 21723 - DNA, 18 bp, Artificial sequence
  synthetic polynucleotide sequence
gggcatcagcagcagaga

SEQ ID NO: 21724 - DNA, 20 bp, Artificial sequence
  synthetic polynucleotide sequence
atgaggatctcgagggctca

SEQ ID NO: 21725 - DNA, 22 bp, Artificial sequence
  synthetic polynucleotide sequence
aaagggaacaacggtggttgga

SEQ ID NO: 21726 - DNA, 22 bp, Artificial sequence
  synthetic polynucleotide sequence
agaaactcgcccaaggtactca

SEQ ID NO: 21727 - DNA, 22 bp, Artificial sequence
  synthetic polynucleotide sequence
aaggaacacaaagggacccgga

SEQ ID NO: 21728 - DNA, 23 bp, Artificial sequence
  synthetic polynucleotide sequence
caaatacacagcagaaccagcca

SEQ ID NO: 21729 - DNA, 19 bp, Artificial sequence
  synthetic polynucleotide sequence
gaaggctttagggccacca

SEQ ID NO: 21730 - DNA, 18 bp, Artificial sequence
  synthetic polynucleotide sequence
ggagtcagcacgaagcca

SEQ ID NO: 21731 - DNA, 20 bp, Artificial sequence
  synthetic polynucleotide sequence
gtgtgaggaaaagcgtgcaa

SEQ ID NO: 21732 - DNA, 19 bp, Artificial sequence
  synthetic polynucleotide sequence
cccaggcaattcgaatcca

SEQ ID NO: 21733 - DNA, 22 bp, Artificial sequence
  synthetic polynucleotide sequence
gctagagacccaagtgagcaga

SEQ ID NO: 21734 - DNA, 18 bp, Artificial sequence
  synthetic polynucleotide sequence
gccgcaccacagccctca

SEQ ID NO: 21735 - DNA, 18 bp, Artificial sequence
  synthetic polynucleotide sequence
tggggatccgcagcgcca

SEQ ID NO: 21736 - DNA, 20 bp, Artificial sequence
  synthetic polynucleotide sequence
ccagggttcggaagctgaga

SEQ ID NO: 21737 - DNA, 22 bp, Artificial sequence
  synthetic polynucleotide sequence
gaaagggcacgagacaaagcta

SEQ ID NO: 21738 - DNA, 20 bp, Artificial sequence
  synthetic polynucleotide sequence
cttccacctcacttgccaga

SEQ ID NO: 21739 - DNA, 21 bp, Artificial sequence
  synthetic polynucleotide sequence
gaggtgacagaagcagaggga

SEQ ID NO: 21740 - DNA, 20 bp, Artificial sequence
  synthetic polynucleotide sequence
agagactcaggggtgctgga

SEQ ID NO: 21741 - DNA, 20 bp, Artificial sequence
  synthetic polynucleotide sequence
tcacaggtctgagggcgcaa

SEQ ID NO: 21742 - DNA, 22 bp, Artificial sequence
  synthetic polynucleotide sequence
tcattttcacccagcctgccaa

SEQ ID NO: 21743 - DNA, 21 bp, Artificial sequence
  synthetic polynucleotide sequence
tcctgaagggagctgagcaca

SEQ ID NO: 21744 - DNA, 20 bp, Artificial sequence
  synthetic polynucleotide sequence
ctcagtgaccatactccgca

SEQ ID NO: 21745 - DNA, 20 bp, Artificial sequence
  synthetic polynucleotide sequence
agtctcccagaggaagcaga

SEQ ID NO: 21746 - DNA, 19 bp, Artificial sequence
  synthetic polynucleotide sequence
ctttgctgcggccagtaca

SEQ ID NO: 21747 - DNA, 20 bp, Artificial sequence
  synthetic polynucleotide sequence
tgggaaaggcctggccagca

SEQ ID NO: 21748 - DNA, 20 bp, Artificial sequence
  synthetic polynucleotide sequence
aggaatgtgggcaggaggca

SEQ ID NO: 21749 - DNA, 21 bp, Artificial sequence
  synthetic polynucleotide sequence
ttcagccctggagaagaggca

SEQ ID NO: 21750 - DNA, 18 bp, Artificial sequence
  synthetic polynucleotide sequence
aggggcctgatgcggcca

SEQ ID NO: 21751 - DNA, 21 bp, Artificial sequence
  synthetic polynucleotide sequence
tgcagaaaggcggctccagga

SEQ ID NO: 21752 - DNA, 20 bp, Artificial sequence
  synthetic polynucleotide sequence
tctctgcacatcgcacctga

SEQ ID NO: 21753 - DNA, 20 bp, Artificial sequence
  synthetic polynucleotide sequence
acaagcagcagtggggacga

SEQ ID NO: 21754 - DNA, 19 bp, Artificial sequence
  synthetic polynucleotide sequence
tttcctcagcggcaaggta

SEQ ID NO: 21755 - DNA, 22 bp, Artificial sequence
  synthetic polynucleotide sequence
aacgagatgtgcaccagaggga

SEQ ID NO: 21756 - DNA, 21 bp, Artificial sequence
  synthetic polynucleotide sequence
aacttctccagctgaccacga

SEQ ID NO: 21757 - DNA, 20 bp, Artificial sequence
  synthetic polynucleotide sequence
tgctcggagctgaagggcca

SEQ ID NO: 21758 - DNA, 19 bp, Artificial sequence
  synthetic polynucleotide sequence
ctcgttcaccgcctgcgca

SEQ ID NO: 21759 - DNA, 21 bp, Artificial sequence
  synthetic polynucleotide sequence
ttcacaggatgaggaggctca

SEQ ID NO: 21760 - DNA, 19 bp, Artificial sequence
  synthetic polynucleotide sequence
gcatcaagctggcgccgga

SEQ ID NO: 21761 - DNA, 20 bp, Artificial sequence
  synthetic polynucleotide sequence
atggccgagctctctaagga

SEQ ID NO: 21762 - DNA, 18 bp, Artificial sequence
  synthetic polynucleotide sequence
gcatggtgtccagcagca

SEQ ID NO: 21763 - DNA, 19 bp, Artificial sequence
  synthetic polynucleotide sequence
tccaggtggaacaggctca

SEQ ID NO: 21764 - DNA, 20 bp, Artificial sequence
  synthetic polynucleotide sequence
gctgtccagggttccaggga

SEQ ID NO: 21765 - DNA, 20 bp, Artificial sequence
  synthetic polynucleotide sequence
ccaaccggaggtggctggaa

SEQ ID NO: 21766 - DNA, 20 bp, Artificial sequence
  synthetic polynucleotide sequence
ctcatcaaggcccagctgca

SEQ ID NO: 21767 - DNA, 18 bp, Artificial sequence
  synthetic polynucleotide sequence
agcagcagagcctcccga

SEQ ID NO: 21768 - DNA, 20 bp, Artificial sequence
  synthetic polynucleotide sequence
aaagacggatgacagcagca

SEQ ID NO: 21769 - DNA, 20 bp, Artificial sequence
  synthetic polynucleotide sequence
ctagcccaggagatccacga

SEQ ID NO: 21770 - DNA, 19 bp, Artificial sequence
  synthetic polynucleotide sequence
tctggtcaaagtcccgaga

SEQ ID NO: 21771 - DNA, 21 bp, Artificial sequence
  synthetic polynucleotide sequence
agattgcaccagagctgctga

SEQ ID NO: 21772 - DNA, 19 bp, Artificial sequence
  synthetic polynucleotide sequence
ctgccagactctgccccga

SEQ ID NO: 21773 - DNA, 18 bp, Artificial sequence
  synthetic polynucleotide sequence
cgcatgccactgtgccaa

SEQ ID NO: 21774 - DNA, 19 bp, Artificial sequence
  synthetic polynucleotide sequence
cctgctagccgagtgacca

SEQ ID NO: 21775 - DNA, 18 bp, Artificial sequence
  synthetic polynucleotide sequence
tggagcgagaacggagga

SEQ ID NO: 21776 - DNA, 18 bp, Artificial sequence
  synthetic polynucleotide sequence
gctgagcttgcagcagga

SEQ ID NO: 21777 - DNA, 21 bp, Artificial sequence
  synthetic polynucleotide sequence
tgcagaagatggaggcctaca

SEQ ID NO: 21778 - DNA, 20 bp, Artificial sequence
  synthetic polynucleotide sequence
gtgccaagggtaaagctcca

SEQ ID NO: 21779 - DNA, 21 bp, Artificial sequence
  synthetic polynucleotide sequence
aagccaccttcagatcccaca

SEQ ID NO: 21780 - DNA, 21 bp, Artificial sequence
  synthetic polynucleotide sequence
ggtgtcaacctgctcgggaga

SEQ ID NO: 21781 - DNA, 20 bp, Artificial sequence
  synthetic polynucleotide sequence
aaactgggcacgctggcaga

SEQ ID NO: 21782 - DNA, 21 bp, Artificial sequence
  synthetic polynucleotide sequence
aggaggacttcagatgggcca

SEQ ID NO: 21783 - DNA, 21 bp, Artificial sequence
  synthetic polynucleotide sequence
gccaaggaactgaacatgcca

SEQ ID NO: 21784 - DNA, 20 bp, Artificial sequence
  synthetic polynucleotide sequence
cacggagacgcaggagtgaa

SEQ ID NO: 21785 - DNA, 21 bp, Artificial sequence
  synthetic polynucleotide sequence
gaggcacattgggaaccctga

SEQ ID NO: 21786 - DNA, 21 bp, Artificial sequence
  synthetic polynucleotide sequence
cattcatggcacagtctggca

SEQ ID NO: 21787 - DNA, 21 bp, Artificial sequence
  synthetic polynucleotide sequence
agcaggggagttctgaagaga

SEQ ID NO: 21788 - DNA, 21 bp, Artificial sequence
  synthetic polynucleotide sequence
gggcagcacaagcaactgaca

SEQ ID NO: 21789 - DNA, 22 bp, Artificial sequence
  synthetic polynucleotide sequence
tcgaccgtcaacatgtgcagca

SEQ ID NO: 21790 - DNA, 21 bp, Artificial sequence
  synthetic polynucleotide sequence
tcattgagtgcagcagtggga

SEQ ID NO: 21791 - DNA, 18 bp, Artificial sequence
  synthetic polynucleotide sequence
ccatgccgtggtagccaa

SEQ ID NO: 21792 - DNA, 20 bp, Artificial sequence
  synthetic polynucleotide sequence
taataccgttggaggaggga

SEQ ID NO: 21793 - DNA, 21 bp, Artificial sequence
  synthetic polynucleotide sequence
gaggcaacatcgtgacccaca

SEQ ID NO: 21794 - DNA, 20 bp, Artificial sequence
  synthetic polynucleotide sequence
ctagaaggcttggggagaca

SEQ ID NO: 21795 - DNA, 20 bp, Artificial sequence
  synthetic polynucleotide sequence
cagcccttgcagctccacca

SEQ ID NO: 21796 - DNA, 20 bp, Artificial sequence
  synthetic polynucleotide sequence
gggcatccaagcgctctaga

SEQ ID NO: 21797 - DNA, 20 bp, Artificial sequence
  synthetic polynucleotide sequence
agggagaagaggaccagcca

SEQ ID NO: 21798 - DNA, 20 bp, Artificial sequence
  synthetic polynucleotide sequence
aagggaaggaagctggccca

SEQ ID NO: 21799 - DNA, 18 bp, Artificial sequence
  synthetic polynucleotide sequence
ctgcacagcaacgaggca

SEQ ID NO: 21800 - DNA, 18 bp, Artificial sequence
  synthetic polynucleotide sequence
aaggcggctttgcaggga

SEQ ID NO: 21801 - DNA, 21 bp, Artificial sequence
  synthetic polynucleotide sequence
cgaccctcacacaactcacga

SEQ ID NO: 21802 - DNA, 21 bp, Artificial sequence
  synthetic polynucleotide sequence
ctacagagaaaggccagcaga

SEQ ID NO: 21803 - DNA, 21 bp, Artificial sequence
  synthetic polynucleotide sequence
ctactccagagggcttaggaa

SEQ ID NO: 21804 - DNA, 19 bp, Artificial sequence
  synthetic polynucleotide sequence
tccagttccagaagtcgca

SEQ ID NO: 21805 - DNA, 21 bp, Artificial sequence
  synthetic polynucleotide sequence
agtggaacaacttgctcgaga

SEQ ID NO: 21806 - DNA, 19 bp, Artificial sequence
  synthetic polynucleotide sequence
gtagcctgcatctcagcca

SEQ ID NO: 21807 - DNA, 20 bp, Artificial sequence
  synthetic polynucleotide sequence
gagagaggaggcccagcgaa

SEQ ID NO: 21808 - DNA, 20 bp, Artificial sequence
  synthetic polynucleotide sequence
ctggtgcagctcaagtgcca

SEQ ID NO: 21809 - DNA, 20 bp, Artificial sequence
  synthetic polynucleotide sequence
cacagtaggggggagcagga

SEQ ID NO: 21810 - DNA, 20 bp, Artificial sequence
  synthetic polynucleotide sequence
atacagtgccaccctggcca

SEQ ID NO: 21811 - DNA, 22 bp, Artificial sequence
  synthetic polynucleotide sequence
gaatccgagaacttctccagga

SEQ ID NO: 21812 - DNA, 21 bp, Artificial sequence
  synthetic polynucleotide sequence
agcagacatcgcagccgtcca

SEQ ID NO: 21813 - DNA, 21 bp, Artificial sequence
  synthetic polynucleotide sequence
tgaggagacactgtctcagca

SEQ ID NO: 21814 - DNA, 22 bp, Artificial sequence
  synthetic polynucleotide sequence
aactggagatggagagagcgaa

SEQ ID NO: 21815 - DNA, 20 bp, Artificial sequence
  synthetic polynucleotide sequence
gtcaggacagggactacaga

SEQ ID NO: 21816 - DNA, 19 bp, Artificial sequence
  synthetic polynucleotide sequence
tagcccttccacacagcca

SEQ ID NO: 21817 - DNA, 21 bp, Artificial sequence
  synthetic polynucleotide sequence
atgtggagattctcacccgga

SEQ ID NO: 21818 - DNA, 20 bp, Artificial sequence
  synthetic polynucleotide sequence
gctcaagcagggaccgtcca

SEQ ID NO: 21819 - DNA, 19 bp, Artificial sequence
  synthetic polynucleotide sequence
cctgccaagttcaccacga

SEQ ID NO: 21820 - DNA, 20 bp, Artificial sequence
  synthetic polynucleotide sequence
ctgggagccagcatgtagga

SEQ ID NO: 21821 - DNA, 18 bp, Artificial sequence
  synthetic polynucleotide sequence
ccagcaccccaacgagca

SEQ ID NO: 21822 - DNA, 19 bp, Artificial sequence
  synthetic polynucleotide sequence
ggcatagtgggtaggggca

SEQ ID NO: 21823 - DNA, 21 bp, Artificial sequence
  synthetic polynucleotide sequence
catggaggatgaggacagcga

SEQ ID NO: 21824 - DNA, 19 bp, Artificial sequence
  synthetic polynucleotide sequence
ccccgtcgcagttccagga

SEQ ID NO: 21825 - DNA, 20 bp, Artificial sequence
  synthetic polynucleotide sequence
agggcacagggatctcccaa

SEQ ID NO: 21826 - DNA, 22 bp, Artificial sequence
  synthetic polynucleotide sequence
taggtgccactgaacacaggca

SEQ ID NO: 21827 - DNA, 21 bp, Artificial sequence
  synthetic polynucleotide sequence
tgtatgccaccagtcactgca

SEQ ID NO: 21828 - DNA, 22 bp, Artificial sequence
  synthetic polynucleotide sequence
gcaaacgccacgatgtacagga

SEQ ID NO: 21829 - DNA, 19 bp, Artificial sequence
  synthetic polynucleotide sequence
gaccggcccagtctcctca

SEQ ID NO: 21830 - DNA, 19 bp, Artificial sequence
  synthetic polynucleotide sequence
tcgcttgacatcagaggca

SEQ ID NO: 21831 - DNA, 18 bp, Artificial sequence
  synthetic polynucleotide sequence
gcccctgctgccatccca

SEQ ID NO: 21832 - DNA, 21 bp, Artificial sequence
  synthetic polynucleotide sequence
actccagccaaatgtcagcca

SEQ ID NO: 21833 - DNA, 20 bp, Artificial sequence
  synthetic polynucleotide sequence
cagtgccaacctgctgcgca

SEQ ID NO: 21834 - DNA, 22 bp, Artificial sequence
  synthetic polynucleotide sequence
aggatctgggtgggaaagagga

SEQ ID NO: 21835 - DNA, 20 bp, Artificial sequence
  synthetic polynucleotide sequence
cgccatcggaggaatcagga

SEQ ID NO: 21836 - DNA, 20 bp, Artificial sequence
  synthetic polynucleotide sequence
gttatgccagcactgtcgga

SEQ ID NO: 21837 - DNA, 21 bp, Artificial sequence
  synthetic polynucleotide sequence
tacccctatcagccactcaca

SEQ ID NO: 21838 - DNA, 20 bp, Artificial sequence
  synthetic polynucleotide sequence
tggcagcctccagaagagca

SEQ ID NO: 21839 - DNA, 20 bp, Artificial sequence
  synthetic polynucleotide sequence
gaacccaggctctgtgacca

SEQ ID NO: 21840 - DNA, 18 bp, Artificial sequence
  synthetic polynucleotide sequence
gaagtgagggccacgcca

SEQ ID NO: 21841 - DNA, 18 bp, Artificial sequence
  synthetic polynucleotide sequence
gaacatcaggccaccgca

SEQ ID NO: 21842 - DNA, 18 bp, Artificial sequence
  synthetic polynucleotide sequence
tgtggcagaccctcgcca

SEQ ID NO: 21843 - DNA, 18 bp, Artificial sequence
  synthetic polynucleotide sequence
ctcggacgcacaagccaa

SEQ ID NO: 21844 - DNA, 18 bp, Artificial sequence
  synthetic polynucleotide sequence
tcagccttcacccaggca

SEQ ID NO: 21845 - DNA, 18 bp, Artificial sequence
  synthetic polynucleotide sequence
tggctggatgcaaccaca

SEQ ID NO: 21846 - DNA, 20 bp, Artificial sequence
  synthetic polynucleotide sequence
gatcaccacaccatccacca

SEQ ID NO: 21847 - DNA, 20 bp, Artificial sequence
  synthetic polynucleotide sequence
atcccttacctggaggccca

SEQ ID NO: 21848 - DNA, 20 bp, Artificial sequence
  synthetic polynucleotide sequence
tgtcctcaggcacctcagca

SEQ ID NO: 21849 - DNA, 21 bp, Artificial sequence
  synthetic polynucleotide sequence
tgatgacgatgagaccgggaa

SEQ ID NO: 21850 - DNA, 18 bp, Artificial sequence
  synthetic polynucleotide sequence
tcgccgtccccatcccga

SEQ ID NO: 21851 - DNA, 19 bp, Artificial sequence
  synthetic polynucleotide sequence
ctgatgaggagctgcagga

SEQ ID NO: 21852 - DNA, 18 bp, Artificial sequence
  synthetic polynucleotide sequence
ttcacaccatggcaggca

SEQ ID NO: 21853 - DNA, 19 bp, Artificial sequence
  synthetic polynucleotide sequence
ggggcttcaacaccaacca

SEQ ID NO: 21854 - DNA, 18 bp, Artificial sequence
  synthetic polynucleotide sequence
ggcaggagatcttgggca

SEQ ID NO: 21855 - DNA, 20 bp, Artificial sequence
  synthetic polynucleotide sequence
ggcgaccaaagaggaggcca

SEQ ID NO: 21856 - DNA, 20 bp, Artificial sequence
  synthetic polynucleotide sequence
atggcctgcacggagctgca

SEQ ID NO: 21857 - DNA, 22 bp, Artificial sequence
  synthetic polynucleotide sequence
aactggtctcccactaagccaa

SEQ ID NO: 21858 - DNA, 21 bp, Artificial sequence
  synthetic polynucleotide sequence
ttgtacgggaggtcagggtca

SEQ ID NO: 21859 - DNA, 20 bp, Artificial sequence
  synthetic polynucleotide sequence
cggtaccagcggaagtggga

SEQ ID NO: 21860 - DNA, 20 bp, Artificial sequence
  synthetic polynucleotide sequence
cgtgcgcttgaggaaggcca

SEQ ID NO: 21861 - DNA, 21 bp, Artificial sequence
  synthetic polynucleotide sequence
tctacctggaggaggagctca

SEQ ID NO: 21862 - DNA, 20 bp, Artificial sequence
  synthetic polynucleotide sequence
tacacaggctcaggtcccca

SEQ ID NO: 21863 - DNA, 23 bp, Artificial sequence
  synthetic polynucleotide sequence
caaaaaggtacggaatggccaca

SEQ ID NO: 21864 - DNA, 20 bp, Artificial sequence
  synthetic polynucleotide sequence
tacttgcccgaaagcgacga

SEQ ID NO: 21865 - DNA, 22 bp, Artificial sequence
  synthetic polynucleotide sequence
aagaacatcaccgggtcctaga

SEQ ID NO: 21866 - DNA, 20 bp, Artificial sequence
  synthetic polynucleotide sequence
ggccagagcggagtaacaca

SEQ ID NO: 21867 - DNA, 20 bp, Artificial sequence
  synthetic polynucleotide sequence
agagtcccgccacgggtcca

SEQ ID NO: 21868 - DNA, 21 bp, Artificial sequence
  synthetic polynucleotide sequence
aggagagaaccagggactgga

SEQ ID NO: 21869 - DNA, 19 bp, Artificial sequence
  synthetic polynucleotide sequence
ttgcacacccaccctcaga

SEQ ID NO: 21870 - DNA, 21 bp, Artificial sequence
  synthetic polynucleotide sequence
ctcgcatgctctaagccagga

SEQ ID NO: 21871 - DNA, 21 bp, Artificial sequence
  synthetic polynucleotide sequence
cagggagaagcaggttggaga

SEQ ID NO: 21872 - DNA, 22 bp, Artificial sequence
  synthetic polynucleotide sequence
gaaagcccaagactgcagagga

SEQ ID NO: 21873 - DNA, 22 bp, Artificial sequence
  synthetic polynucleotide sequence
agctagcagcagagatgggaga

SEQ ID NO: 21874 - DNA, 19 bp, Artificial sequence
  synthetic polynucleotide sequence
gggagagggggttgacgga

SEQ ID NO: 21875 - DNA, 21 bp, Artificial sequence
  synthetic polynucleotide sequence
agagagtggcgcagaaaggaa

SEQ ID NO: 21876 - DNA, 21 bp, Artificial sequence
  synthetic polynucleotide sequence
gagcccgaagaatcctctcga

SEQ ID NO: 21877 - DNA, 20 bp, Artificial sequence
  synthetic polynucleotide sequence
tgtatgggctgccgcaccaa

SEQ ID NO: 21878 - DNA, 21 bp, Artificial sequence
  synthetic polynucleotide sequence
aggtggggatgggttggcaga

SEQ ID NO: 21879 - DNA, 20 bp, Artificial sequence
  synthetic polynucleotide sequence
ccacagaggttccctcgcca

SEQ ID NO: 21880 - DNA, 20 bp, Artificial sequence
  synthetic polynucleotide sequence
gaacttcacctcagccggga

SEQ ID NO: 21881 - DNA, 21 bp, Artificial sequence
  synthetic polynucleotide sequence
aggaggccctgaaggaacaca

SEQ ID NO: 21882 - DNA, 20 bp, Artificial sequence
  synthetic polynucleotide sequence
ctgagacgcacaaggtccca

SEQ ID NO: 21883 - DNA, 19 bp, Artificial sequence
  synthetic polynucleotide sequence
tgaagcaggtgtagcagca

SEQ ID NO: 21884 - DNA, 21 bp, Artificial sequence
  synthetic polynucleotide sequence
cggtggaagcttactggggca

SEQ ID NO: 21885 - DNA, 22 bp, Artificial sequence
  synthetic polynucleotide sequence
cagatcaatccgacacagcaga

SEQ ID NO: 21886 - DNA, 22 bp, Artificial sequence
  synthetic polynucleotide sequence
ccaagtgaatgcaacgcctgaa

SEQ ID NO: 21887 - DNA, 21 bp, Artificial sequence
  synthetic polynucleotide sequence
acaccaccacgagcctagaga

SEQ ID NO: 21888 - DNA, 19 bp, Artificial sequence
  synthetic polynucleotide sequence
tttggcatcgggggagaca

SEQ ID NO: 21889 - DNA, 21 bp, Artificial sequence
  synthetic polynucleotide sequence
agacaacaagccctggagaca

SEQ ID NO: 21890 - DNA, 22 bp, Artificial sequence
  synthetic polynucleotide sequence
atcattgcgccgaacaagctga

SEQ ID NO: 21891 - DNA, 18 bp, Artificial sequence
  synthetic polynucleotide sequence
ccgtccacttccgcccca

SEQ ID NO: 21892 - DNA, 18 bp, Artificial sequence
  synthetic polynucleotide sequence
cgggggtgagatggggca

SEQ ID NO: 21893 - DNA, 20 bp, Artificial sequence
  synthetic polynucleotide sequence
cagcccgcaagctccatgga

SEQ ID NO: 21894 - DNA, 20 bp, Artificial sequence
  synthetic polynucleotide sequence
tcagccacctcaatgcccca

SEQ ID NO: 21895 - DNA, 20 bp, Artificial sequence
  synthetic polynucleotide sequence
gactggtctgcagcacagca

SEQ ID NO: 21896 - DNA, 19 bp, Artificial sequence
  synthetic polynucleotide sequence
gcctcggccacctgtacca

SEQ ID NO: 21897 - DNA, 20 bp, Artificial sequence
  synthetic polynucleotide sequence
gagctcacagaggctgagga

SEQ ID NO: 21898 - DNA, 18 bp, Artificial sequence
  synthetic polynucleotide sequence
tcaggcagaccagagcca

SEQ ID NO: 21899 - DNA, 22 bp, Artificial sequence
  synthetic polynucleotide sequence
attcagaacacagcagcggaga

SEQ ID NO: 21900 - DNA, 21 bp, Artificial sequence
  synthetic polynucleotide sequence
tcctcgatgtccagggtggga

SEQ ID NO: 21901 - DNA, 20 bp, Artificial sequence
  synthetic polynucleotide sequence
cccgtcaatcaagcaggcca

SEQ ID NO: 21902 - DNA, 22 bp, Artificial sequence
  synthetic polynucleotide sequence
ccgagtgaggaagtgtccagga

SEQ ID NO: 21903 - DNA, 21 bp, Artificial sequence
  synthetic polynucleotide sequence
gccttcagtagcacccgggaa

SEQ ID NO: 21904 - DNA, 19 bp, Artificial sequence
  synthetic polynucleotide sequence
ttgggggatgatcagccga

SEQ ID NO: 21905 - DNA, 20 bp, Artificial sequence
  synthetic polynucleotide sequence
atcagcggcgcaaggaggaa

SEQ ID NO: 21906 - DNA, 19 bp, Artificial sequence
  synthetic polynucleotide sequence
cccacctcaaggctgcgga

SEQ ID NO: 21907 - DNA, 21 bp, Artificial sequence
  synthetic polynucleotide sequence
gagtccctatgctgaccccaa

SEQ ID NO: 21908 - DNA, 21 bp, Artificial sequence
  synthetic polynucleotide sequence
gcagacatccactactcccca

SEQ ID NO: 21909 - DNA, 18 bp, Artificial sequence
  synthetic polynucleotide sequence
cccacgctcacgggccga

SEQ ID NO: 21910 - DNA, 18 bp, Artificial sequence
  synthetic polynucleotide sequence
aagtcccggccttccgca

SEQ ID NO: 21911 - DNA, 19 bp, Artificial sequence
  synthetic polynucleotide sequence
gggacagctgcaagggtga

SEQ ID NO: 21912 - DNA, 18 bp, Artificial sequence
  synthetic polynucleotide sequence
ctgtcgatccaggccgca

SEQ ID NO: 21913 - DNA, 20 bp, Artificial sequence
  synthetic polynucleotide sequence
cagagcattccagccaggaa

SEQ ID NO: 21914 - DNA, 18 bp, Artificial sequence
  synthetic polynucleotide sequence
attgaggaagctggccca

SEQ ID NO: 21915 - DNA, 18 bp, Artificial sequence
  synthetic polynucleotide sequence
aggcgggtgagcaagtga

SEQ ID NO: 21916 - DNA, 18 bp, Artificial sequence
  synthetic polynucleotide sequence
gggcggattcacacagga

SEQ ID NO: 21917 - DNA, 21 bp, Artificial sequence
  synthetic polynucleotide sequence
aaggatggtcaccaacaccaa

SEQ ID NO: 21918 - DNA, 18 bp, Artificial sequence
  synthetic polynucleotide sequence
gggcggattcacacagga

SEQ ID NO: 21919 - DNA, 22 bp, Artificial sequence
  synthetic polynucleotide sequence
cataacgtgcgcagaagaagga

SEQ ID NO: 21920 - DNA, 22 bp, Artificial sequence
  synthetic polynucleotide sequence
tgcatttgggaggagtggacca

SEQ ID NO: 21921 - DNA, 20 bp, Artificial sequence
  synthetic polynucleotide sequence
ggtggtcaccagcagtacca

SEQ ID NO: 21922 - DNA, 22 bp, Artificial sequence
  synthetic polynucleotide sequence
ggatgcatctgggagtaggaga

SEQ ID NO: 21923 - DNA, 19 bp, Artificial sequence
  synthetic polynucleotide sequence
ttccagcagctgcaggaca

SEQ ID NO: 21924 - DNA, 21 bp, Artificial sequence
  synthetic polynucleotide sequence
gcatgggaccgttggtgacca

SEQ ID NO: 21925 - DNA, 21 bp, Artificial sequence
  synthetic polynucleotide sequence
aaggatggtcaccaacaccga

SEQ ID NO: 21926 - DNA, 22 bp, Artificial sequence
  synthetic polynucleotide sequence
agctgcatatgggaggagtgga

SEQ ID NO: 21927 - DNA, 20 bp, Artificial sequence
  synthetic polynucleotide sequence
gtagactggatacaccccga

SEQ ID NO: 21928 - DNA, 19 bp, Artificial sequence
  synthetic polynucleotide sequence
gatggaacgaggcagctca

SEQ ID NO: 21929 - DNA, 18 bp, Artificial sequence
  synthetic polynucleotide sequence
gggccagactgtcgacga

SEQ ID NO: 21930 - DNA, 19 bp, Artificial sequence
  synthetic polynucleotide sequence
catagagggcatagcggca

SEQ ID NO: 21931 - DNA, 21 bp, Artificial sequence
  synthetic polynucleotide sequence
actgtagaggacccctacaca

SEQ ID NO: 21932 - DNA, 20 bp, Artificial sequence
  synthetic polynucleotide sequence
ggtgcactttcaggagccca

SEQ ID NO: 21933 - DNA, 18 bp, Artificial sequence
  synthetic polynucleotide sequence
aagcgagggctgtgcaca

SEQ ID NO: 21934 - DNA, 19 bp, Artificial sequence
  synthetic polynucleotide sequence
ggcactgcaggtacaggga

SEQ ID NO: 21935 - DNA, 18 bp, Artificial sequence
  synthetic polynucleotide sequence
gatcacagagggagcgca

SEQ ID NO: 21936 - DNA, 19 bp, Artificial sequence
  synthetic polynucleotide sequence
gcaaggctgacagagccca

SEQ ID NO: 21937 - DNA, 18 bp, Artificial sequence
  synthetic polynucleotide sequence
gccttctgggaggaggga

SEQ ID NO: 21938 - DNA, 20 bp, Artificial sequence
  synthetic polynucleotide sequence
ctgctccagtggatccagca

SEQ ID NO: 21939 - DNA, 18 bp, Artificial sequence
  synthetic polynucleotide sequence
gatgtgcaggattgccca

SEQ ID NO: 21940 - DNA, 21 bp, Artificial sequence
  synthetic polynucleotide sequence
ttggaccttagtggagtggga

SEQ ID NO: 21941 - DNA, 20 bp, Artificial sequence
  synthetic polynucleotide sequence
ctcaaaggcccctcccccca

SEQ ID NO: 21942 - DNA, 20 bp, Artificial sequence
  synthetic polynucleotide sequence
gggaggatcggggtgtccga

SEQ ID NO: 21943 - DNA, 22 bp, Artificial sequence
  synthetic polynucleotide sequence
ttcagtgcaacagtactgcgca

SEQ ID NO: 21944 - DNA, 20 bp, Artificial sequence
  synthetic polynucleotide sequence
aagcacggactgctgggtga

SEQ ID NO: 21945 - DNA, 21 bp, Artificial sequence
  synthetic polynucleotide sequence
gatcggggaggactctaagca

SEQ ID NO: 21946 - DNA, 21 bp, Artificial sequence
  synthetic polynucleotide sequence
aagtcggctcagtcctccaga

SEQ ID NO: 21947 - DNA, 19 bp, Artificial sequence
  synthetic polynucleotide sequence
ggatcgcggagctggagga

SEQ ID NO: 21948 - DNA, 22 bp, Artificial sequence
  synthetic polynucleotide sequence
tcatcatccacctgcatcacca

SEQ ID NO: 21949 - DNA, 18 bp, Artificial sequence
  synthetic polynucleotide sequence
gcatctgagccgggagca

SEQ ID NO: 21950 - DNA, 19 bp, Artificial sequence
  synthetic polynucleotide sequence
ccgggttggtggtaggaga

SEQ ID NO: 21951 - DNA, 21 bp, Artificial sequence
  synthetic polynucleotide sequence
atcggaagagaacagcaagga

SEQ ID NO: 21952 - DNA, 20 bp, Artificial sequence
  synthetic polynucleotide sequence
ctgaacaaactgcctgcaca

SEQ ID NO: 21953 - DNA, 18 bp, Artificial sequence
  synthetic polynucleotide sequence
gccctcctgccccacgaa

SEQ ID NO: 21954 - DNA, 18 bp, Artificial sequence
  synthetic polynucleotide sequence
tgcggtacagccagggca

SEQ ID NO: 21955 - DNA, 21 bp, Artificial sequence
  synthetic polynucleotide sequence
caagatgctcctgaccaacca

SEQ ID NO: 21956 - DNA, 20 bp, Artificial sequence
  synthetic polynucleotide sequence
catgaagtctgccagacgca

SEQ ID NO: 21957 - DNA, 23 bp, Artificial sequence
  synthetic polynucleotide sequence
aaaaaggaggctacagaaccaca

SEQ ID NO: 21958 - DNA, 19 bp, Artificial sequence
  synthetic polynucleotide sequence
tccacttggaccagctgca

SEQ ID NO: 21959 - DNA, 19 bp, Artificial sequence
  synthetic polynucleotide sequence
cccttcgacagcctggaga

SEQ ID NO: 21960 - DNA, 19 bp, Artificial sequence
  synthetic polynucleotide sequence
gaacttggcaggtgaggca

SEQ ID NO: 21961 - DNA, 20 bp, Artificial sequence
  synthetic polynucleotide sequence
aagctgcacctggacaggaa

SEQ ID NO: 21962 - DNA, 18 bp, Artificial sequence
  synthetic polynucleotide sequence
gaagaggtgctgcagcga

SEQ ID NO: 21963 - DNA, 19 bp, Artificial sequence
  synthetic polynucleotide sequence
gcttccaggcagacacgga

SEQ ID NO: 21964 - DNA, 18 bp, Artificial sequence
  synthetic polynucleotide sequence
tccggaagcggctccaca

SEQ ID NO: 21965 - DNA, 21 bp, Artificial sequence
  synthetic polynucleotide sequence
agcaagacaacaccccggaga

SEQ ID NO: 21966 - DNA, 19 bp, Artificial sequence
  synthetic polynucleotide sequence
ctctgggggactgccctga

SEQ ID NO: 21967 - DNA, 18 bp, Artificial sequence
  synthetic polynucleotide sequence
tcccaaaccccagaagca

SEQ ID NO: 21968 - DNA, 18 bp, Artificial sequence
  synthetic polynucleotide sequence
tggagatgcagctgggga

SEQ ID NO: 21969 - DNA, 19 bp, Artificial sequence
  synthetic polynucleotide sequence
gctacaacccccagccaga

SEQ ID NO: 21970 - DNA, 18 bp, Artificial sequence
  synthetic polynucleotide sequence
tctcagtaggcggcagca

SEQ ID NO: 21971 - DNA, 20 bp, Artificial sequence
  synthetic polynucleotide sequence
ctagctaaccgcgtcgggga

SEQ ID NO: 21972 - DNA, 21 bp, Artificial sequence
  synthetic polynucleotide sequence
cacaatcgaggaagccctgga

SEQ ID NO: 21973 - DNA, 19 bp, Artificial sequence
  synthetic polynucleotide sequence
gcgcctacgagatcaggca

SEQ ID NO: 21974 - DNA, 21 bp, Artificial sequence
  synthetic polynucleotide sequence
cagggagctcagaccatggta

SEQ ID NO: 21975 - DNA, 22 bp, Artificial sequence
  synthetic polynucleotide sequence
agctgctgaagaggtggaagca

SEQ ID NO: 21976 - DNA, 18 bp, Artificial sequence
  synthetic polynucleotide sequence
ctgggtggccagagcgga

SEQ ID NO: 21977 - DNA, 20 bp, Artificial sequence
  synthetic polynucleotide sequence
agcggtccctgtggagaaca

SEQ ID NO: 21978 - DNA, 21 bp, Artificial sequence
  synthetic polynucleotide sequence
gcattcctgcatggcccggaa

SEQ ID NO: 21979 - DNA, 21 bp, Artificial sequence
  synthetic polynucleotide sequence
agtgcacatcctcccacccaa

SEQ ID NO: 21980 - DNA, 21 bp, Artificial sequence
  synthetic polynucleotide sequence
tgctctgcacagttgcccaca

SEQ ID NO: 21981 - DNA, 21 bp, Artificial sequence
  synthetic polynucleotide sequence
cagagctaagacgccgtgaca

SEQ ID NO: 21982 - DNA, 21 bp, Artificial sequence
  synthetic polynucleotide sequence
agtggagaatctgggcctgca

SEQ ID NO: 21983 - DNA, 22 bp, Artificial sequence
  synthetic polynucleotide sequence
cggtaacacagaggctgagaga

SEQ ID NO: 21984 - DNA, 20 bp, Artificial sequence
  synthetic polynucleotide sequence
ccagacatctggtggaagca

SEQ ID NO: 21985 - DNA, 21 bp, Artificial sequence
  synthetic polynucleotide sequence
gtagccctgaagaagcagcca

SEQ ID NO: 21986 - DNA, 21 bp, Artificial sequence
  synthetic polynucleotide sequence
gagtggagagcggtactacca

SEQ ID NO: 21987 - DNA, 18 bp, Artificial sequence
  synthetic polynucleotide sequence
agcgatccgctgagccaa

SEQ ID NO: 21988 - DNA, 21 bp, Artificial sequence
  synthetic polynucleotide sequence
ccagacaggacattggaacga

SEQ ID NO: 21989 - DNA, 18 bp, Artificial sequence
  synthetic polynucleotide sequence
tccaccatggggaagcga

SEQ ID NO: 21990 - DNA, 18 bp, Artificial sequence
  synthetic polynucleotide sequence
cttccggaacggtgggca

SEQ ID NO: 21991 - DNA, 18 bp, Artificial sequence
  synthetic polynucleotide sequence
gggaggaagggacgagga

SEQ ID NO: 21992 - DNA, 21 bp, Artificial sequence
  synthetic polynucleotide sequence
acacaggaggtaactgagcca

SEQ ID NO: 21993 - DNA, 18 bp, Artificial sequence
  synthetic polynucleotide sequence
ggcctccagaaacgccaa

SEQ ID NO: 21994 - DNA, 18 bp, Artificial sequence
  synthetic polynucleotide sequence
ccaggagaagcgcaacca

SEQ ID NO: 21995 - DNA, 18 bp, Artificial sequence
  synthetic polynucleotide sequence
gggcttcaatgcccgaca

SEQ ID NO: 21996 - DNA, 18 bp, Artificial sequence
  synthetic polynucleotide sequence
ctcgaaggtcccgcacca

SEQ ID NO: 21997 - DNA, 20 bp, Artificial sequence
  synthetic polynucleotide sequence
agcacgtgggagctagagga

SEQ ID NO: 21998 - DNA, 18 bp, Artificial sequence
  synthetic polynucleotide sequence
ccagctggtactcccgga

SEQ ID NO: 21999 - DNA, 19 bp, Artificial sequence
  synthetic polynucleotide sequence
gggagcgagcagaagagga

SEQ ID NO: 22000 - DNA, 19 bp, Artificial sequence
  synthetic polynucleotide sequence
cagctggagcgactggaga

SEQ ID NO: 22001 - DNA, 19 bp, Artificial sequence
  synthetic polynucleotide sequence
cctctgagtggcccaagga

SEQ ID NO: 22002 - DNA, 20 bp, Artificial sequence
  synthetic polynucleotide sequence
tggggactggagagtcacca

SEQ ID NO: 22003 - DNA, 18 bp, Artificial sequence
  synthetic polynucleotide sequence
gcgtcgcgtcactgagca

SEQ ID NO: 22004 - DNA, 19 bp, Artificial sequence
  synthetic polynucleotide sequence
caatacgaggctgccagca

SEQ ID NO: 22005 - DNA, 21 bp, Artificial sequence
  synthetic polynucleotide sequence
gtgcacctgtaagatgggcca

SEQ ID NO: 22006 - DNA, 21 bp, Artificial sequence
  synthetic polynucleotide sequence
cgttcaggttgccgctgacca

SEQ ID NO: 22007 - DNA, 20 bp, Artificial sequence
  synthetic polynucleotide sequence
atgggaccaacccagtgaca

SEQ ID NO: 22008 - DNA, 21 bp, Artificial sequence
  synthetic polynucleotide sequence
agactctgacacaccacctga

SEQ ID NO: 22009 - DNA, 20 bp, Artificial sequence
  synthetic polynucleotide sequence
cagcaagagaggcagaccca

SEQ ID NO: 22010 - DNA, 21 bp, Artificial sequence
  synthetic polynucleotide sequence
catgaaggtactgcacagcca

SEQ ID NO: 22011 - DNA, 19 bp, Artificial sequence
  synthetic polynucleotide sequence
cccacgacaggcccaggaa

SEQ ID NO: 22012 - DNA, 22 bp, Artificial sequence
  synthetic polynucleotide sequence
acgagcctgaagacttggagga

SEQ ID NO: 22013 - DNA, 18 bp, Artificial sequence
  synthetic polynucleotide sequence
ccctctgcaaggaagcca

SEQ ID NO: 22014 - DNA, 19 bp, Artificial sequence
  synthetic polynucleotide sequence
ccccagtacaggtggcaga

SEQ ID NO: 22015 - DNA, 21 bp, Artificial sequence
  synthetic polynucleotide sequence
aggaggaggacaaccgggaca

SEQ ID NO: 22016 - DNA, 19 bp, Artificial sequence
  synthetic polynucleotide sequence
caaggctgtcctcccggga

SEQ ID NO: 22017 - DNA, 18 bp, Artificial sequence
  synthetic polynucleotide sequence
agggaagtggcagcagca

SEQ ID NO: 22018 - DNA, 19 bp, Artificial sequence
  synthetic polynucleotide sequence
tccactggagagggtcgta

SEQ ID NO: 22019 - DNA, 18 bp, Artificial sequence
  synthetic polynucleotide sequence
gtcatgggcatccccaca

SEQ ID NO: 22020 - DNA, 21 bp, Artificial sequence
  synthetic polynucleotide sequence
ataataggccaggaagcctga

SEQ ID NO: 22021 - DNA, 18 bp, Artificial sequence
  synthetic polynucleotide sequence
tcccagtggcagcgggaa

SEQ ID NO: 22022 - DNA, 20 bp, Artificial sequence
  synthetic polynucleotide sequence
tacgtgactccattcacgca

SEQ ID NO: 22023 - DNA, 19 bp, Artificial sequence
  synthetic polynucleotide sequence
cagggaaggtggccccaga

SEQ ID NO: 22024 - DNA, 21 bp, Artificial sequence
  synthetic polynucleotide sequence
gcaacccagtgtgcaacagca

SEQ ID NO: 22025 - DNA, 21 bp, Artificial sequence
  synthetic polynucleotide sequence
gctgctcaagtactcgccgga

SEQ ID NO: 22026 - DNA, 22 bp, Artificial sequence
  synthetic polynucleotide sequence
aaaggcagccacaaagtagcca

SEQ ID NO: 22027 - DNA, 21 bp, Artificial sequence
  synthetic polynucleotide sequence
ggggccaggtacatccagaca

SEQ ID NO: 22028 - DNA, 18 bp, Artificial sequence
  synthetic polynucleotide sequence
tagagaccccaacgccca

SEQ ID NO: 22029 - DNA, 20 bp, Artificial sequence
  synthetic polynucleotide sequence
cagccctctgaacctgagca

SEQ ID NO: 22030 - DNA, 20 bp, Artificial sequence
  synthetic polynucleotide sequence
gaggattgggatagagccca

SEQ ID NO: 22031 - DNA, 18 bp, Artificial sequence
  synthetic polynucleotide sequence
ttcaaggggctgaggcca

SEQ ID NO: 22032 - DNA, 18 bp, Artificial sequence
  synthetic polynucleotide sequence
ccagtcggccttggggaa

SEQ ID NO: 22033 - DNA, 21 bp, Artificial sequence
  synthetic polynucleotide sequence
ctagagtctaccccatcgcca

SEQ ID NO: 22034 - DNA, 21 bp, Artificial sequence
  synthetic polynucleotide sequence
tgtactcgaagtccaccagca

SEQ ID NO: 22035 - DNA, 18 bp, Artificial sequence
  synthetic polynucleotide sequence
aagccacagggagcccca

SEQ ID NO: 22036 - DNA, 18 bp, Artificial sequence
  synthetic polynucleotide sequence
gactgagggtcaggccca

SEQ ID NO: 22037 - DNA, 22 bp, Artificial sequence
  synthetic polynucleotide sequence
agattcctcgggaatcagcaga

SEQ ID NO: 22038 - DNA, 21 bp, Artificial sequence
  synthetic polynucleotide sequence
gatttggaggtggagggcaga

SEQ ID NO: 22039 - DNA, 18 bp, Artificial sequence
  synthetic polynucleotide sequence
cgcaggagcaggtggaca

SEQ ID NO: 22040 - DNA, 18 bp, Artificial sequence
  synthetic polynucleotide sequence
cggccaacctccgtgaca

SEQ ID NO: 22041 - DNA, 21 bp, Artificial sequence
  synthetic polynucleotide sequence
cactccccagaaccaagtgga

SEQ ID NO: 22042 - DNA, 21 bp, Artificial sequence
  synthetic polynucleotide sequence
agttcatcctgctccgccgaa

SEQ ID NO: 22043 - DNA, 21 bp, Artificial sequence
  synthetic polynucleotide sequence
tgaagttgccccagatccaga

SEQ ID NO: 22044 - DNA, 19 bp, Artificial sequence
  synthetic polynucleotide sequence
tttttcccaccagcagcca

SEQ ID NO: 22045 - DNA, 21 bp, Artificial sequence
  synthetic polynucleotide sequence
tgacgaagaagaaagccagga

SEQ ID NO: 22046 - DNA, 21 bp, Artificial sequence
  synthetic polynucleotide sequence
gcagatggtaagcttcgagca

SEQ ID NO: 22047 - DNA, 22 bp, Artificial sequence
  synthetic polynucleotide sequence
attccagagattcaggccacca

SEQ ID NO: 22048 - DNA, 19 bp, Artificial sequence
  synthetic polynucleotide sequence
ggcagccatcgctcctgga

SEQ ID NO: 22049 - DNA, 19 bp, Artificial sequence
  synthetic polynucleotide sequence
ggcacaaactgacgggaca

SEQ ID NO: 22050 - DNA, 19 bp, Artificial sequence
  synthetic polynucleotide sequence
ggcagcaagctccatggta

SEQ ID NO: 22051 - DNA, 21 bp, Artificial sequence
  synthetic polynucleotide sequence
cgccaagaagcacggcaccaa

SEQ ID NO: 22052 - DNA, 18 bp, Artificial sequence
  synthetic polynucleotide sequence
cagggcctcccgctggaa

SEQ ID NO: 22053 - DNA, 21 bp, Artificial sequence
  synthetic polynucleotide sequence
gcaacaggatatcgcccaaga

SEQ ID NO: 22054 - DNA, 20 bp, Artificial sequence
  synthetic polynucleotide sequence
cgggatcgacgtgcagtgga

SEQ ID NO: 22055 - DNA, 21 bp, Artificial sequence
  synthetic polynucleotide sequence
cagcgggacaatcttgcccaa

SEQ ID NO: 22056 - DNA, 20 bp, Artificial sequence
  synthetic polynucleotide sequence
ctggggtgccataactgcga

SEQ ID NO: 22057 - DNA, 21 bp, Artificial sequence
  synthetic polynucleotide sequence
tagacgagctcctggcaggaa

SEQ ID NO: 22058 - DNA, 19 bp, Artificial sequence
  synthetic polynucleotide sequence
tctcaggaaggggctcgga

SEQ ID NO: 22059 - DNA, 21 bp, Artificial sequence
  synthetic polynucleotide sequence
agagctctgtgacacccagga

SEQ ID NO: 22060 - DNA, 20 bp, Artificial sequence
  synthetic polynucleotide sequence
attgcgggggttgtcaggca

SEQ ID NO: 22061 - DNA, 21 bp, Artificial sequence
  synthetic polynucleotide sequence
tcagggagtgaaatgtgcaga

SEQ ID NO: 22062 - DNA, 20 bp, Artificial sequence
  synthetic polynucleotide sequence
tcacgagcgtcgtaaggtca

SEQ ID NO: 22063 - DNA, 21 bp, Artificial sequence
  synthetic polynucleotide sequence
ctgccctcacacacaacgaca

SEQ ID NO: 22064 - DNA, 21 bp, Artificial sequence
  synthetic polynucleotide sequence
atccacagtctgagcaccgga

SEQ ID NO: 22065 - DNA, 20 bp, Artificial sequence
  synthetic polynucleotide sequence
tgagggaggagtcctcctca

SEQ ID NO: 22066 - DNA, 21 bp, Artificial sequence
  synthetic polynucleotide sequence
tggtagagatctgggcaggca

SEQ ID NO: 22067 - DNA, 21 bp, Artificial sequence
  synthetic polynucleotide sequence
ctggcatcagactggaggtga

SEQ ID NO: 22068 - DNA, 19 bp, Artificial sequence
  synthetic polynucleotide sequence
tcaaggcttgcccactgca

SEQ ID NO: 22069 - DNA, 21 bp, Artificial sequence
  synthetic polynucleotide sequence
gcctctacagccggttcacca

SEQ ID NO: 22070 - DNA, 21 bp, Artificial sequence
  synthetic polynucleotide sequence
cattgatgatccggtccccca

SEQ ID NO: 22071 - DNA, 20 bp, Artificial sequence
  synthetic polynucleotide sequence
gatgggagccagcgagtgga

SEQ ID NO: 22072 - DNA, 21 bp, Artificial sequence
  synthetic polynucleotide sequence
ctgtcacctgtaccccaacca

SEQ ID NO: 22073 - DNA, 18 bp, Artificial sequence
  synthetic polynucleotide sequence
agtgtgcagacagccgca

SEQ ID NO: 22074 - DNA, 18 bp, Artificial sequence
  synthetic polynucleotide sequence
ggaagtcaggcgtgagca

SEQ ID NO: 22075 - DNA, 20 bp, Artificial sequence
  synthetic polynucleotide sequence
caggccaggaagaggaggaa

SEQ ID NO: 22076 - DNA, 18 bp, Artificial sequence
  synthetic polynucleotide sequence
tgcagtctcgcagggaga

SEQ ID NO: 22077 - DNA, 21 bp, Artificial sequence
  synthetic polynucleotide sequence
gatccactatagcaggcacca

SEQ ID NO: 22078 - DNA, 22 bp, Artificial sequence
  synthetic polynucleotide sequence
aagacctggccccaaaaagaca

SEQ ID NO: 22079 - DNA, 20 bp, Artificial sequence
  synthetic polynucleotide sequence
aaagacaagggcggggagca

SEQ ID NO: 22080 - DNA, 19 bp, Artificial sequence
  synthetic polynucleotide sequence
gtggccttggccgtgagca

SEQ ID NO: 22081 - DNA, 18 bp, Artificial sequence
  synthetic polynucleotide sequence
ggcacctggcaaaaggca

SEQ ID NO: 22082 - DNA, 18 bp, Artificial sequence
  synthetic polynucleotide sequence
gggagaccaggcaccaca

SEQ ID NO: 22083 - DNA, 19 bp, Artificial sequence
  synthetic polynucleotide sequence
gccgggtatgcagaggaga

SEQ ID NO: 22084 - DNA, 18 bp, Artificial sequence
  synthetic polynucleotide sequence
aagcgggacagacctcca

SEQ ID NO: 22085 - DNA, 20 bp, Artificial sequence
  synthetic polynucleotide sequence
ccaagggagcaggcagcaca

SEQ ID NO: 22086 - DNA, 20 bp, Artificial sequence
  synthetic polynucleotide sequence
acggaaggccgggtgccaca

SEQ ID NO: 22087 - DNA, 18 bp, Artificial sequence
  synthetic polynucleotide sequence
ctgccaggacgaaagcga

SEQ ID NO: 22088 - DNA, 18 bp, Artificial sequence
  synthetic polynucleotide sequence
ccgacatcaggatgccga

SEQ ID NO: 22089 - DNA, 18 bp, Artificial sequence
  synthetic polynucleotide sequence
gcagctggccaagcggaa

SEQ ID NO: 22090 - DNA, 20 bp, Artificial sequence
  synthetic polynucleotide sequence
gtagcacagccagtagccca

SEQ ID NO: 22091 - DNA, 18 bp, Artificial sequence
  synthetic polynucleotide sequence
ccagtcaagcggaccaca

SEQ ID NO: 22092 - DNA, 20 bp, Artificial sequence
  synthetic polynucleotide sequence
aggctgcaatagccgtacca

SEQ ID NO: 22093 - DNA, 19 bp, Artificial sequence
  synthetic polynucleotide sequence
gctccgagcagatggacca

SEQ ID NO: 22094 - DNA, 18 bp, Artificial sequence
  synthetic polynucleotide sequence
gacccggaagcttgagca

SEQ ID NO: 22095 - DNA, 18 bp, Artificial sequence
  synthetic polynucleotide sequence
cagcatcgctcgcaacca

SEQ ID NO: 22096 - DNA, 18 bp, Artificial sequence
  synthetic polynucleotide sequence
accacaccgtgtcaggga

SEQ ID NO: 22097 - DNA, 18 bp, Artificial sequence
  synthetic polynucleotide sequence
ggccaagcgtactccgaa

SEQ ID NO: 22098 - DNA, 20 bp, Artificial sequence
  synthetic polynucleotide sequence
cagggatgtagaaggcagca

SEQ ID NO: 22099 - DNA, 22 bp, Artificial sequence
  synthetic polynucleotide sequence
agagaagggcaggagaggaaga

SEQ ID NO: 22100 - DNA, 23 bp, Artificial sequence
  synthetic polynucleotide sequence
gagacagcagaactaaagggaga

SEQ ID NO: 22101 - DNA, 18 bp, Artificial sequence
  synthetic polynucleotide sequence
tgcaccacgtagccacca

SEQ ID NO: 22102 - DNA, 18 bp, Artificial sequence
  synthetic polynucleotide sequence
tgaccagggccatggaga

SEQ ID NO: 22103 - DNA, 19 bp, Artificial sequence
  synthetic polynucleotide sequence
ggaggaggacagatgggca

SEQ ID NO: 22104 - DNA, 18 bp, Artificial sequence
  synthetic polynucleotide sequence
cagcatcctcagaccgca

SEQ ID NO: 22105 - DNA, 18 bp, Artificial sequence
  synthetic polynucleotide sequence
acccctgccaggacggga

SEQ ID NO: 22106 - DNA, 21 bp, Artificial sequence
  synthetic polynucleotide sequence
acaaagcagagagggacagca

SEQ ID NO: 22107 - DNA, 21 bp, Artificial sequence
  synthetic polynucleotide sequence
gcagaccacctgaaggccgaa

SEQ ID NO: 22108 - DNA, 21 bp, Artificial sequence
  synthetic polynucleotide sequence
gcaggcagacgatgatgaaca

SEQ ID NO: 22109 - DNA, 20 bp, Artificial sequence
  synthetic polynucleotide sequence
gcacagggggagaagtgaga

SEQ ID NO: 22110 - DNA, 25 bp, Artificial sequence
  synthetic polynucleotide sequence
agaagccaaacacacagacacgaga

SEQ ID NO: 22111 - DNA, 18 bp, Artificial sequence
  synthetic polynucleotide sequence
ctgccaggacgaaagcga

SEQ ID NO: 22112 - DNA, 18 bp, Artificial sequence
  synthetic polynucleotide sequence
tggacacggcctccacga

SEQ ID NO: 22113 - DNA, 21 bp, Artificial sequence
  synthetic polynucleotide sequence
acatagccacgatggccctga

SEQ ID NO: 22114 - DNA, 19 bp, Artificial sequence
  synthetic polynucleotide sequence
ggatgaccaccctggccca

SEQ ID NO: 22115 - DNA, 18 bp, Artificial sequence
  synthetic polynucleotide sequence
cgatgcgctgaaggagga

SEQ ID NO: 22116 - DNA, 18 bp, Artificial sequence
  synthetic polynucleotide sequence
ggtacgtggcgtccagga

SEQ ID NO: 22117 - DNA, 20 bp, Artificial sequence
  synthetic polynucleotide sequence
ggactggaagtacgtcgcca

SEQ ID NO: 22118 - DNA, 20 bp, Artificial sequence
  synthetic polynucleotide sequence
ctggaagagaggctgcagga

SEQ ID NO: 22119 - DNA, 20 bp, Artificial sequence
  synthetic polynucleotide sequence
cgaccgacagaactgctcca

SEQ ID NO: 22120 - DNA, 22 bp, Artificial sequence
  synthetic polynucleotide sequence
aataaaggcaggcgtctcagga

SEQ ID NO: 22121 - DNA, 21 bp, Artificial sequence
  synthetic polynucleotide sequence
gactgcggcgagaagatgaca

SEQ ID NO: 22122 - DNA, 20 bp, Artificial sequence
  synthetic polynucleotide sequence
gccgatgagaggcacatcga

SEQ ID NO: 22123 - DNA, 18 bp, Artificial sequence
  synthetic polynucleotide sequence
catgtcccgcccagcaga

SEQ ID NO: 22124 - DNA, 18 bp, Artificial sequence
  synthetic polynucleotide sequence
catgaggtcactgcggga

SEQ ID NO: 22125 - DNA, 21 bp, Artificial sequence
  synthetic polynucleotide sequence
tgctcaacgtgtcccagcgga

SEQ ID NO: 22126 - DNA, 21 bp, Artificial sequence
  synthetic polynucleotide sequence
gcctctgcccctcaaacacga

SEQ ID NO: 22127 - DNA, 21 bp, Artificial sequence
  synthetic polynucleotide sequence
gtggccaagaaggtgcctgaa

SEQ ID NO: 22128 - DNA, 22 bp, Artificial sequence
  synthetic polynucleotide sequence
ggagacattgagcacaaccaca

SEQ ID NO: 22129 - DNA, 18 bp, Artificial sequence
  synthetic polynucleotide sequence
tgggcatcccgctggaca

SEQ ID NO: 22130 - DNA, 20 bp, Artificial sequence
  synthetic polynucleotide sequence
gatgtcgtaggagaggcgga

SEQ ID NO: 22131 - DNA, 18 bp, Artificial sequence
  synthetic polynucleotide sequence
cgactatccctccgggca

SEQ ID NO: 22132 - DNA, 18 bp, Artificial sequence
  synthetic polynucleotide sequence
gggcatacaggcgtcgga

SEQ ID NO: 22133 - DNA, 18 bp, Artificial sequence
  synthetic polynucleotide sequence
tccgggagcccttcgaga

SEQ ID NO: 22134 - DNA, 20 bp, Artificial sequence
  synthetic polynucleotide sequence
gtaccgcttgtggaaggaga

SEQ ID NO: 22135 - DNA, 18 bp, Artificial sequence
  synthetic polynucleotide sequence
actccaggtggaccggca

SEQ ID NO: 22136 - DNA, 18 bp, Artificial sequence
  synthetic polynucleotide sequence
ccagggggatcttggcga

SEQ ID NO: 22137 - DNA, 18 bp, Artificial sequence
  synthetic polynucleotide sequence
ctacgacgtcgtgggcaa

SEQ ID NO: 22138 - DNA, 18 bp, Artificial sequence
  synthetic polynucleotide sequence
aggggctgatgtcccgga

SEQ ID NO: 22139 - DNA, 19 bp, Artificial sequence
  synthetic polynucleotide sequence
ggcaccacctcacgtccga

SEQ ID NO: 22140 - DNA, 21 bp, Artificial sequence
  synthetic polynucleotide sequence
cagtgggtaggcaaagaggga

SEQ ID NO: 22141 - DNA, 20 bp, Artificial sequence
  synthetic polynucleotide sequence
agtgcctccacgatgtggga

SEQ ID NO: 22142 - DNA, 22 bp, Artificial sequence
  synthetic polynucleotide sequence
gcatttggctgaaaggcgtgga

SEQ ID NO: 22143 - DNA, 21 bp, Artificial sequence
  synthetic polynucleotide sequence
accccgtcaagacactacgga

SEQ ID NO: 22144 - DNA, 18 bp, Artificial sequence
  synthetic polynucleotide sequence
cttggaggaggagcccga

SEQ ID NO: 22145 - DNA, 18 bp, Artificial sequence
  synthetic polynucleotide sequence
ccgcgacgtgctcaagca

SEQ ID NO: 22146 - DNA, 20 bp, Artificial sequence
  synthetic polynucleotide sequence
cttgacgaagggcgtacaga

SEQ ID NO: 22147 - DNA, 20 bp, Artificial sequence
  synthetic polynucleotide sequence
tgtggcccagacttcccgaa

SEQ ID NO: 22148 - DNA, 21 bp, Artificial sequence
  synthetic polynucleotide sequence
tgtggaaagcgtggtcaccca

SEQ ID NO: 22149 - DNA, 19 bp, Artificial sequence
  synthetic polynucleotide sequence
gcctgaccctcacgccaca

SEQ ID NO: 22150 - DNA, 19 bp, Artificial sequence
  synthetic polynucleotide sequence
tgcgcgcattcctagacga

SEQ ID NO: 22151 - DNA, 18 bp, Artificial sequence
  synthetic polynucleotide sequence
cgtccaggaatgcgctca

SEQ ID NO: 22152 - DNA, 18 bp, Artificial sequence
  synthetic polynucleotide sequence
tcaggcctcgtggcagca

SEQ ID NO: 22153 - DNA, 20 bp, Artificial sequence
  synthetic polynucleotide sequence
ccggtggtggtcatcaagga

SEQ ID NO: 22154 - DNA, 18 bp, Artificial sequence
  synthetic polynucleotide sequence
ggatgctctcgcgcagca

SEQ ID NO: 22155 - DNA, 18 bp, Artificial sequence
  synthetic polynucleotide sequence
catggaggacgatgccaa

SEQ ID NO: 22156 - DNA, 19 bp, Artificial sequence
  synthetic polynucleotide sequence
gcgaagtactggtgggcga

SEQ ID NO: 22157 - DNA, 22 bp, Artificial sequence
  synthetic polynucleotide sequence
tacagggagagtggagaagaga

SEQ ID NO: 22158 - DNA, 20 bp, Artificial sequence
  synthetic polynucleotide sequence
gattctgggtacaggccgca

SEQ ID NO: 22159 - DNA, 22 bp, Artificial sequence
  synthetic polynucleotide sequence
tgaagacgtttaggagccagga

SEQ ID NO: 22160 - DNA, 22 bp, Artificial sequence
  synthetic polynucleotide sequence
tcgatgctttggaccccaagca

SEQ ID NO: 22161 - DNA, 18 bp, Artificial sequence
  synthetic polynucleotide sequence
caggaggatggtgccaca

SEQ ID NO: 22162 - DNA, 21 bp, Artificial sequence
  synthetic polynucleotide sequence
cagacacactgagtcccacca

SEQ ID NO: 22163 - DNA, 19 bp, Artificial sequence
  synthetic polynucleotide sequence
ctggggggcattggggaga

SEQ ID NO: 22164 - DNA, 20 bp, Artificial sequence
  synthetic polynucleotide sequence
ctgtgctcctgacgaccaca

SEQ ID NO: 22165 - DNA, 18 bp, Artificial sequence
  synthetic polynucleotide sequence
tcgaggctcgctacagca

SEQ ID NO: 22166 - DNA, 20 bp, Artificial sequence
  synthetic polynucleotide sequence
cacagtcctgatccccagga

SEQ ID NO: 22167 - DNA, 20 bp, Artificial sequence
  synthetic polynucleotide sequence
tccagagaggcttgcccaga

SEQ ID NO: 22168 - DNA, 20 bp, Artificial sequence
  synthetic polynucleotide sequence
ggctcgtccacctcggagca

SEQ ID NO: 22169 - DNA, 20 bp, Artificial sequence
  synthetic polynucleotide sequence
caggaccgtgtgctcaagga

SEQ ID NO: 22170 - DNA, 18 bp, Artificial sequence
  synthetic polynucleotide sequence
cctacaagggaccgggca

SEQ ID NO: 22171 - DNA, 19 bp, Artificial sequence
  synthetic polynucleotide sequence
cagtgtgcagtaagcggga

SEQ ID NO: 22172 - DNA, 20 bp, Artificial sequence
  synthetic polynucleotide sequence
gccgcataacagacacagca

SEQ ID NO: 22173 - DNA, 21 bp, Artificial sequence
  synthetic polynucleotide sequence
caggaagcaccactctgcaca

SEQ ID NO: 22174 - DNA, 22 bp, Artificial sequence
  synthetic polynucleotide sequence
gaaagagtcagggctgaacaca

SEQ ID NO: 22175 - DNA, 20 bp, Artificial sequence
  synthetic polynucleotide sequence
ggagtgcaacccttcaccca

SEQ ID NO: 22176 - DNA, 21 bp, Artificial sequence
  synthetic polynucleotide sequence
tagcaacgaggaccctctcca

SEQ ID NO: 22177 - DNA, 19 bp, Artificial sequence
  synthetic polynucleotide sequence
gggagagggcgaggacaca

SEQ ID NO: 22178 - DNA, 22 bp, Artificial sequence
  synthetic polynucleotide sequence
aaaggagctggcaaagtctgga

SEQ ID NO: 22179 - DNA, 21 bp, Artificial sequence
  synthetic polynucleotide sequence
gtcagagctggatgaggagga

SEQ ID NO: 22180 - DNA, 21 bp, Artificial sequence
  synthetic polynucleotide sequence
aggaagtcaggggccttggca

SEQ ID NO: 22181 - DNA, 20 bp, Artificial sequence
  synthetic polynucleotide sequence
ctggagcagacggtgaccaa

SEQ ID NO: 22182 - DNA, 18 bp, Artificial sequence
  synthetic polynucleotide sequence
tccagggacagccgccca

SEQ ID NO: 22183 - DNA, 19 bp, Artificial sequence
  synthetic polynucleotide sequence
caggcctgcccaagcctga

SEQ ID NO: 22184 - DNA, 20 bp, Artificial sequence
  synthetic polynucleotide sequence
gtccagatccgactcactca

SEQ ID NO: 22185 - DNA, 19 bp, Artificial sequence
  synthetic polynucleotide sequence
ggggcagaacggctacaca

SEQ ID NO: 22186 - DNA, 20 bp, Artificial sequence
  synthetic polynucleotide sequence
cagagtacgatgcagggcca

SEQ ID NO: 22187 - DNA, 18 bp, Artificial sequence
  synthetic polynucleotide sequence
cgccgaagaggtcgggaa

SEQ ID NO: 22188 - DNA, 20 bp, Artificial sequence
  synthetic polynucleotide sequence
gtgcaccggatgtcgtagga

SEQ ID NO: 22189 - DNA, 20 bp, Artificial sequence
  synthetic polynucleotide sequence
accctggtgctagaggagga

SEQ ID NO: 22190 - DNA, 20 bp, Artificial sequence
  synthetic polynucleotide sequence
tagggctccagctctgacca

SEQ ID NO: 22191 - DNA, 22 bp, Artificial sequence
  synthetic polynucleotide sequence
tgtacaagctgaacccacagga

SEQ ID NO: 22192 - DNA, 20 bp, Artificial sequence
  synthetic polynucleotide sequence
tgcatgctgaagagggccca

SEQ ID NO: 22193 - DNA, 19 bp, Artificial sequence
  synthetic polynucleotide sequence
ggcagcacgtggtacagga

SEQ ID NO: 22194 - DNA, 20 bp, Artificial sequence
  synthetic polynucleotide sequence
gacacagctgagtcccacga

SEQ ID NO: 22195 - DNA, 18 bp, Artificial sequence
  synthetic polynucleotide sequence
tggtgggcaacctggaga

SEQ ID NO: 22196 - DNA, 19 bp, Artificial sequence
  synthetic polynucleotide sequence
caggccctagggttggaca

SEQ ID NO: 22197 - DNA, 20 bp, Artificial sequence
  synthetic polynucleotide sequence
ctgtcactgaccagagccca

SEQ ID NO: 22198 - DNA, 20 bp, Artificial sequence
  synthetic polynucleotide sequence
ctggagaagccgtcagagga

SEQ ID NO: 22199 - DNA, 20 bp, Artificial sequence
  synthetic polynucleotide sequence
atggggaggagagtaaacga

SEQ ID NO: 22200 - DNA, 22 bp, Artificial sequence
  synthetic polynucleotide sequence
atggacaggtagctcagggtga

SEQ ID NO: 22201 - DNA, 21 bp, Artificial sequence
  synthetic polynucleotide sequence
tcagccggtatccagcagtca

SEQ ID NO: 22202 - DNA, 21 bp, Artificial sequence
  synthetic polynucleotide sequence
gcggacagtggtgaaagggga

SEQ ID NO: 22203 - DNA, 20 bp, Artificial sequence
  synthetic polynucleotide sequence
cagaaaggagccccacgaga

SEQ ID NO: 22204 - DNA, 20 bp, Artificial sequence
  synthetic polynucleotide sequence
agctccgaggggtgcatcga

SEQ ID NO: 22205 - DNA, 22 bp, Artificial sequence
  synthetic polynucleotide sequence
aagtctgtagatggacggcaga

SEQ ID NO: 22206 - DNA, 18 bp, Artificial sequence
  synthetic polynucleotide sequence
tcctcggcccccacggaa

SEQ ID NO: 22207 - DNA, 21 bp, Artificial sequence
  synthetic polynucleotide sequence
acttccagttccagcgtacga

SEQ ID NO: 22208 - DNA, 21 bp, Artificial sequence
  synthetic polynucleotide sequence
gagccccatcacagaatggga

SEQ ID NO: 22209 - DNA, 22 bp, Artificial sequence
  synthetic polynucleotide sequence
tgcatatctgaagcggctccca

SEQ ID NO: 22210 - DNA, 22 bp, Artificial sequence
  synthetic polynucleotide sequence
tggacgaactgcaaggtagcca

SEQ ID NO: 22211 - DNA, 19 bp, Artificial sequence
  synthetic polynucleotide sequence
gtggccctgaagaccccca

SEQ ID NO: 22212 - DNA, 21 bp, Artificial sequence
  synthetic polynucleotide sequence
agtgcgttggaagaagtggga

SEQ ID NO: 22213 - DNA, 18 bp, Artificial sequence
  synthetic polynucleotide sequence
gccccaccaatgtacgca

SEQ ID NO: 22214 - DNA, 20 bp, Artificial sequence
  synthetic polynucleotide sequence
cgggtatcagcagtgcagga

SEQ ID NO: 22215 - DNA, 18 bp, Artificial sequence
  synthetic polynucleotide sequence
ggatgaaggtgcccagga

SEQ ID NO: 22216 - DNA, 18 bp, Artificial sequence
  synthetic polynucleotide sequence
gcgagttcggaagcacca

SEQ ID NO: 22217 - DNA, 21 bp, Artificial sequence
  synthetic polynucleotide sequence
aggacccctgcaaaactggga

SEQ ID NO: 22218 - DNA, 20 bp, Artificial sequence
  synthetic polynucleotide sequence
cctcatccactgggtccgaa

SEQ ID NO: 22219 - DNA, 18 bp, Artificial sequence
  synthetic polynucleotide sequence
ccggggactgtgaacgga

SEQ ID NO: 22220 - DNA, 18 bp, Artificial sequence
  synthetic polynucleotide sequence
gggacccatgaactggga

SEQ ID NO: 22221 - DNA, 20 bp, Artificial sequence
  synthetic polynucleotide sequence
tgggcctcccacctcaagga

SEQ ID NO: 22222 - DNA, 20 bp, Artificial sequence
  synthetic polynucleotide sequence
tttggaggccagacagggca

SEQ ID NO: 22223 - DNA, 20 bp, Artificial sequence
  synthetic polynucleotide sequence
tcggagacctacagccccaa

SEQ ID NO: 22224 - DNA, 19 bp, Artificial sequence
  synthetic polynucleotide sequence
tctcaaagtggcccaggga

SEQ ID NO: 22225 - DNA, 20 bp, Artificial sequence
  synthetic polynucleotide sequence
acaatccggaaagggcctca

SEQ ID NO: 22226 - DNA, 21 bp, Artificial sequence
  synthetic polynucleotide sequence
acaatgaagcaggcctggcta

SEQ ID NO: 22227 - DNA, 21 bp, Artificial sequence
  synthetic polynucleotide sequence
atcagtggaagagctggccaa

SEQ ID NO: 22228 - DNA, 21 bp, Artificial sequence
  synthetic polynucleotide sequence
tcttgcacttccggcatccca

SEQ ID NO: 22229 - DNA, 20 bp, Artificial sequence
  synthetic polynucleotide sequence
ctcagtcaggaccaagccca

SEQ ID NO: 22230 - DNA, 20 bp, Artificial sequence
  synthetic polynucleotide sequence
gtccacagcagtcctgagca

SEQ ID NO: 22231 - DNA, 20 bp, Artificial sequence
  synthetic polynucleotide sequence
caagggaccagctgaggaca

SEQ ID NO: 22232 - DNA, 18 bp, Artificial sequence
  synthetic polynucleotide sequence
ggaattctcggcggacca

SEQ ID NO: 22233 - DNA, 18 bp, Artificial sequence
  synthetic polynucleotide sequence
gcacaggcggtgtggaca

SEQ ID NO: 22234 - DNA, 18 bp, Artificial sequence
  synthetic polynucleotide sequence
tcactccgtccaccacca

SEQ ID NO: 22235 - DNA, 20 bp, Artificial sequence
  synthetic polynucleotide sequence
aagctggcgcacctgagcaa

SEQ ID NO: 22236 - DNA, 21 bp, Artificial sequence
  synthetic polynucleotide sequence
tcaaatactgagcccacggca

SEQ ID NO: 22237 - DNA, 21 bp, Artificial sequence
  synthetic polynucleotide sequence
caaaagcgtggtactggagga

SEQ ID NO: 22238 - DNA, 20 bp, Artificial sequence
  synthetic polynucleotide sequence
atcgatgaccagttgcacca

SEQ ID NO: 22239 - DNA, 19 bp, Artificial sequence
  synthetic polynucleotide sequence
cactcgagcagagcgacga

SEQ ID NO: 22240 - DNA, 18 bp, Artificial sequence
  synthetic polynucleotide sequence
tgcagtcagcaacgggga

SEQ ID NO: 22241 - DNA, 20 bp, Artificial sequence
  synthetic polynucleotide sequence
taggatcccaaagctcagca

SEQ ID NO: 22242 - DNA, 18 bp, Artificial sequence
  synthetic polynucleotide sequence
gcggcagtgtccacacca

SEQ ID NO: 22243 - DNA, 20 bp, Artificial sequence
  synthetic polynucleotide sequence
aagctggtccctaaaaccca

SEQ ID NO: 22244 - DNA, 20 bp, Artificial sequence
  synthetic polynucleotide sequence
gccggaacagcaagatgtga

SEQ ID NO: 22245 - DNA, 22 bp, Artificial sequence
  synthetic polynucleotide sequence
acgaacactacgagtaccggca

SEQ ID NO: 22246 - DNA, 21 bp, Artificial sequence
  synthetic polynucleotide sequence
ttggacaccaagtctcctcca

SEQ ID NO: 22247 - DNA, 22 bp, Artificial sequence
  synthetic polynucleotide sequence
gaagaagcctgtgaggaggaga

SEQ ID NO: 22248 - DNA, 20 bp, Artificial sequence
  synthetic polynucleotide sequence
gataatggggaatgccacca

SEQ ID NO: 22249 - DNA, 22 bp, Artificial sequence
  synthetic polynucleotide sequence
ccaagagcaggaggtgatgcta

SEQ ID NO: 22250 - DNA, 19 bp, Artificial sequence
  synthetic polynucleotide sequence
ctcgagagcgtggagagga

SEQ ID NO: 22251 - DNA, 22 bp, Artificial sequence
  synthetic polynucleotide sequence
aacgccgagagaaggagagaga

SEQ ID NO: 22252 - DNA, 18 bp, Artificial sequence
  synthetic polynucleotide sequence
ggggcttcgggatcggga

SEQ ID NO: 22253 - DNA, 20 bp, Artificial sequence
  synthetic polynucleotide sequence
ctgtgacaatcaaagggcga

SEQ ID NO: 22254 - DNA, 19 bp, Artificial sequence
  synthetic polynucleotide sequence
catgaccacacgacgacca

SEQ ID NO: 22255 - DNA, 18 bp, Artificial sequence
  synthetic polynucleotide sequence
gcaccgtgggaaaggaca

SEQ ID NO: 22256 - DNA, 18 bp, Artificial sequence
  synthetic polynucleotide sequence
agcattggacgcacggga

SEQ ID NO: 22257 - DNA, 18 bp, Artificial sequence
  synthetic polynucleotide sequence
cataagcaccccagccca

SEQ ID NO: 22258 - DNA, 18 bp, Artificial sequence
  synthetic polynucleotide sequence
ggccagctggaactccca

SEQ ID NO: 22259 - DNA, 21 bp, Artificial sequence
  synthetic polynucleotide sequence
ggctgggtagtgaacggggaa

SEQ ID NO: 22260 - DNA, 22 bp, Artificial sequence
  synthetic polynucleotide sequence
ataccacaaatgcacctccgga

SEQ ID NO: 22261 - DNA, 20 bp, Artificial sequence
  synthetic polynucleotide sequence
ctggattgaccccacagaca

SEQ ID NO: 22262 - DNA, 22 bp, Artificial sequence
  synthetic polynucleotide sequence
atcagcacatgacaagtcagga

SEQ ID NO: 22263 - DNA, 18 bp, Artificial sequence
  synthetic polynucleotide sequence
tcaaccgtcaggctgcca

SEQ ID NO: 22264 - DNA, 18 bp, Artificial sequence
  synthetic polynucleotide sequence
ccttggccgagcgccaca

SEQ ID NO: 22265 - DNA, 21 bp, Artificial sequence
  synthetic polynucleotide sequence
tgattgctgcctccccagaga

SEQ ID NO: 22266 - DNA, 20 bp, Artificial sequence
  synthetic polynucleotide sequence
gccctgcaagatgtcggcca

SEQ ID NO: 22267 - DNA, 18 bp, Artificial sequence
  synthetic polynucleotide sequence
ggcactgcacaggaccaa

SEQ ID NO: 22268 - DNA, 18 bp, Artificial sequence
  synthetic polynucleotide sequence
cccccaacaatgccacca

SEQ ID NO: 22269 - DNA, 18 bp, Artificial sequence
  synthetic polynucleotide sequence
ctgatcgtccagcaggca

SEQ ID NO: 22270 - DNA, 18 bp, Artificial sequence
  synthetic polynucleotide sequence
gcaagctgctccaccgca

SEQ ID NO: 22271 - DNA, 18 bp, Artificial sequence
  synthetic polynucleotide sequence
gaacgccagacagaggca

SEQ ID NO: 22272 - DNA, 18 bp, Artificial sequence
  synthetic polynucleotide sequence
acgggctgaggttcagga

SEQ ID NO: 22273 - DNA, 19 bp, Artificial sequence
  synthetic polynucleotide sequence
ggaagcgaaagaccaccca

SEQ ID NO: 22274 - DNA, 18 bp, Artificial sequence
  synthetic polynucleotide sequence
cagccggtctgtcaggca

SEQ ID NO: 22275 - DNA, 20 bp, Artificial sequence
  synthetic polynucleotide sequence
tgaaagccagtcgagcgcca

SEQ ID NO: 22276 - DNA, 20 bp, Artificial sequence
  synthetic polynucleotide sequence
ggcgagacggtgaaaggcga

SEQ ID NO: 22277 - DNA, 21 bp, Artificial sequence
  synthetic polynucleotide sequence
acactcactcactgccaggga

SEQ ID NO: 22278 - DNA, 21 bp, Artificial sequence
  synthetic polynucleotide sequence
tgtcatcggcatgctccacca

SEQ ID NO: 22279 - DNA, 18 bp, Artificial sequence
  synthetic polynucleotide sequence
ccacactggccaaggaca

SEQ ID NO: 22280 - DNA, 20 bp, Artificial sequence
  synthetic polynucleotide sequence
ctgcacgatgcctaccagga

SEQ ID NO: 22281 - DNA, 20 bp, Artificial sequence
  synthetic polynucleotide sequence
gggcagagctgagtgtgaga

SEQ ID NO: 22282 - DNA, 20 bp, Artificial sequence
  synthetic polynucleotide sequence
caggagcctctcactgggaa

SEQ ID NO: 22283 - DNA, 18 bp, Artificial sequence
  synthetic polynucleotide sequence
cctgcgtgtcgcagagca

SEQ ID NO: 22284 - DNA, 18 bp, Artificial sequence
  synthetic polynucleotide sequence
atgccaacggtggccaca

SEQ ID NO: 22285 - DNA, 21 bp, Artificial sequence
  synthetic polynucleotide sequence
tgtggatgaactgcgcaggta

SEQ ID NO: 22286 - DNA, 21 bp, Artificial sequence
  synthetic polynucleotide sequence
agtcattgagcacagccctga

SEQ ID NO: 22287 - DNA, 18 bp, Artificial sequence
  synthetic polynucleotide sequence
cccaccgtgagaccacca

SEQ ID NO: 22288 - DNA, 18 bp, Artificial sequence
  synthetic polynucleotide sequence
ggatgacacagccaccca

SEQ ID NO: 22289 - DNA, 21 bp, Artificial sequence
  synthetic polynucleotide sequence
ccggtatgacgggagcagtga

SEQ ID NO: 22290 - DNA, 20 bp, Artificial sequence
  synthetic polynucleotide sequence
attgaccagacacttggcca

SEQ ID NO: 22291 - DNA, 20 bp, Artificial sequence
  synthetic polynucleotide sequence
ctacaacccgctgctgccca

SEQ ID NO: 22292 - DNA, 20 bp, Artificial sequence
  synthetic polynucleotide sequence
acaggcaaagcagggtgcca

SEQ ID NO: 22293 - DNA, 18 bp, Artificial sequence
  synthetic polynucleotide sequence
ccccggaaccaagtacga

SEQ ID NO: 22294 - DNA, 18 bp, Artificial sequence
  synthetic polynucleotide sequence
gtcctcgtcagagccgca

SEQ ID NO: 22295 - DNA, 18 bp, Artificial sequence
  synthetic polynucleotide sequence
ctcccgcctgccctggaa

SEQ ID NO: 22296 - DNA, 22 bp, Artificial sequence
  synthetic polynucleotide sequence
atcagaacgaagatgcccgtca

SEQ ID NO: 22297 - DNA, 18 bp, Artificial sequence
  synthetic polynucleotide sequence
ccctgaaatgcatccgca

SEQ ID NO: 22298 - DNA, 18 bp, Artificial sequence
  synthetic polynucleotide sequence
cccacgaacagagccgca

SEQ ID NO: 22299 - DNA, 18 bp, Artificial sequence
  synthetic polynucleotide sequence
caccctggtgacccagga

SEQ ID NO: 22300 - DNA, 18 bp, Artificial sequence
  synthetic polynucleotide sequence
ctccgggcatgtgcagca

SEQ ID NO: 22301 - DNA, 19 bp, Artificial sequence
  synthetic polynucleotide sequence
gcctgcccgctgacatcca

SEQ ID NO: 22302 - DNA, 20 bp, Artificial sequence
  synthetic polynucleotide sequence
gactccacctgctaccgcca

SEQ ID NO: 22303 - DNA, 21 bp, Artificial sequence
  synthetic polynucleotide sequence
gtacgtggtacagcactggga

SEQ ID NO: 22304 - DNA, 21 bp, Artificial sequence
  synthetic polynucleotide sequence
ctgtggaagtgcagatcccca

SEQ ID NO: 22305 - DNA, 19 bp, Artificial sequence
  synthetic polynucleotide sequence
ctgggcctcgggagtcaca

SEQ ID NO: 22306 - DNA, 21 bp, Artificial sequence
  synthetic polynucleotide sequence
agtggagcagacaccctccta

SEQ ID NO: 22307 - DNA, 22 bp, Artificial sequence
  synthetic polynucleotide sequence
tgaaagtcgagggcatgcaaga

SEQ ID NO: 22308 - DNA, 23 bp, Artificial sequence
  synthetic polynucleotide sequence
cgtccaaagggtggaatagtaca

SEQ ID NO: 22309 - DNA, 21 bp, Artificial sequence
  synthetic polynucleotide sequence
tggaccatgggactctggcaa

SEQ ID NO: 22310 - DNA, 19 bp, Artificial sequence
  synthetic polynucleotide sequence
tctcaaacagtccaggcca

SEQ ID NO: 22311 - DNA, 20 bp, Artificial sequence
  synthetic polynucleotide sequence
ggaggcatccgcttcagcca

SEQ ID NO: 22312 - DNA, 21 bp, Artificial sequence
  synthetic polynucleotide sequence
gcacctccaaactcccaccga

SEQ ID NO: 22313 - DNA, 19 bp, Artificial sequence
  synthetic polynucleotide sequence
gccaaggccaagatcacca

SEQ ID NO: 22314 - DNA, 18 bp, Artificial sequence
  synthetic polynucleotide sequence
tctgcgcctcgggcacca

SEQ ID NO: 22315 - DNA, 22 bp, Artificial sequence
  synthetic polynucleotide sequence
cttcaagccagatgtgcaggaa

SEQ ID NO: 22316 - DNA, 23 bp, Artificial sequence
  synthetic polynucleotide sequence
cagttaacagcatcggcaagaca

SEQ ID NO: 22317 - DNA, 18 bp, Artificial sequence
  synthetic polynucleotide sequence
tggaggatgaaagcgcca

SEQ ID NO: 22318 - DNA, 18 bp, Artificial sequence
  synthetic polynucleotide sequence
tgtgggccgtccaggaca

SEQ ID NO: 22319 - DNA, 18 bp, Artificial sequence
  synthetic polynucleotide sequence
cgtgtggccctcacggga

SEQ ID NO: 22320 - DNA, 18 bp, Artificial sequence
  synthetic polynucleotide sequence
tgtacagcgctgcgccca

SEQ ID NO: 22321 - DNA, 21 bp, Artificial sequence
  synthetic polynucleotide sequence
cacctgtgtggaggagaagga

SEQ ID NO: 22322 - DNA, 20 bp, Artificial sequence
  synthetic polynucleotide sequence
atgatggcatgcgccgtcca

SEQ ID NO: 22323 - DNA, 18 bp, Artificial sequence
  synthetic polynucleotide sequence
tagccatgggtggaggca

SEQ ID NO: 22324 - DNA, 20 bp, Artificial sequence
  synthetic polynucleotide sequence
taagagcggggtacacggta

SEQ ID NO: 22325 - DNA, 19 bp, Artificial sequence
  synthetic polynucleotide sequence
caggcagccagaggactga

SEQ ID NO: 22326 - DNA, 18 bp, Artificial sequence
  synthetic polynucleotide sequence
gcaccaccatgcccgtga

SEQ ID NO: 22327 - DNA, 18 bp, Artificial sequence
  synthetic polynucleotide sequence
gcacgccatcatccagga

SEQ ID NO: 22328 - DNA, 18 bp, Artificial sequence
  synthetic polynucleotide sequence
atggagtagcccagccga

SEQ ID NO: 22329 - DNA, 18 bp, Artificial sequence
  synthetic polynucleotide sequence
ccaccattgccacgggca

SEQ ID NO: 22330 - DNA, 21 bp, Artificial sequence
  synthetic polynucleotide sequence
agatgaagagagcagaagcca

SEQ ID NO: 22331 - DNA, 21 bp, Artificial sequence
  synthetic polynucleotide sequence
ccgtgaagaatgcgtggaaga

SEQ ID NO: 22332 - DNA, 22 bp, Artificial sequence
  synthetic polynucleotide sequence
tcatgtctgccagcagaaagca

SEQ ID NO: 22333 - DNA, 21 bp, Artificial sequence
  synthetic polynucleotide sequence
tgaccctgaaggagcctggaa

SEQ ID NO: 22334 - DNA, 20 bp, Artificial sequence
  synthetic polynucleotide sequence
acagtcctcgcctccaccca

SEQ ID NO: 22335 - DNA, 18 bp, Artificial sequence
  synthetic polynucleotide sequence
cgtggtcgagctgaccca

SEQ ID NO: 22336 - DNA, 18 bp, Artificial sequence
  synthetic polynucleotide sequence
agcttcgaagtcgcgcga

SEQ ID NO: 22337 - DNA, 21 bp, Artificial sequence
  synthetic polynucleotide sequence
aacctctccaccacactgcaa

SEQ ID NO: 22338 - DNA, 21 bp, Artificial sequence
  synthetic polynucleotide sequence
gctggcattctgagcagcaca

SEQ ID NO: 22339 - DNA, 21 bp, Artificial sequence
  synthetic polynucleotide sequence
gtgacctacgcgacactcaca

SEQ ID NO: 22340 - DNA, 21 bp, Artificial sequence
  synthetic polynucleotide sequence
atccccaatgtcaccagccca

SEQ ID NO: 22341 - DNA, 21 bp, Artificial sequence
  synthetic polynucleotide sequence
gagaagctgggagagacacca

SEQ ID NO: 22342 - DNA, 21 bp, Artificial sequence
  synthetic polynucleotide sequence
gaggagtcgaaagcctgagga

SEQ ID NO: 22343 - DNA, 19 bp, Artificial sequence
  synthetic polynucleotide sequence
cctccacctccactcagca

SEQ ID NO: 22344 - DNA, 18 bp, Artificial sequence
  synthetic polynucleotide sequence
cgagctggtgcctccaga

SEQ ID NO: 22345 - DNA, 21 bp, Artificial sequence
  synthetic polynucleotide sequence
cccaagcaccaagtcatggga

SEQ ID NO: 22346 - DNA, 20 bp, Artificial sequence
  synthetic polynucleotide sequence
agccatgggccttggccaca

SEQ ID NO: 22347 - DNA, 18 bp, Artificial sequence
  synthetic polynucleotide sequence
ccccggaggcaactggga

SEQ ID NO: 22348 - DNA, 18 bp, Artificial sequence
  synthetic polynucleotide sequence
gccagggggacagtggca

SEQ ID NO: 22349 - DNA, 20 bp, Artificial sequence
  synthetic polynucleotide sequence
atcagtccagccctgccaga

SEQ ID NO: 22350 - DNA, 20 bp, Artificial sequence
  synthetic polynucleotide sequence
atggaggccagcttggcgga

SEQ ID NO: 22351 - DNA, 20 bp, Artificial sequence
  synthetic polynucleotide sequence
gccacaactcggcatccaga

SEQ ID NO: 22352 - DNA, 20 bp, Artificial sequence
  synthetic polynucleotide sequence
ggctgccagccctatcagca

SEQ ID NO: 22353 - DNA, 21 bp, Artificial sequence
  synthetic polynucleotide sequence
gcccctgtgacacaaactgga

SEQ ID NO: 22354 - DNA, 19 bp, Artificial sequence
  synthetic polynucleotide sequence
ggcgagataatccgaccca

SEQ ID NO: 22355 - DNA, 20 bp, Artificial sequence
  synthetic polynucleotide sequence
ctgcgggatggcagagctga

SEQ ID NO: 22356 - DNA, 20 bp, Artificial sequence
  synthetic polynucleotide sequence
actccaagccagtcccctga

SEQ ID NO: 22357 - DNA, 22 bp, Artificial sequence
  synthetic polynucleotide sequence
tggattggactgaagatggcaa

SEQ ID NO: 22358 - DNA, 22 bp, Artificial sequence
  synthetic polynucleotide sequence
gtaacatctagctgttgctgca

SEQ ID NO: 22359 - DNA, 19 bp, Artificial sequence
  synthetic polynucleotide sequence
gcatgcccagaaagctgga

SEQ ID NO: 22360 - DNA, 21 bp, Artificial sequence
  synthetic polynucleotide sequence
tcaacctgagcaagatcagca

SEQ ID NO: 22361 - DNA, 19 bp, Artificial sequence
  synthetic polynucleotide sequence
tccactgggtcaacgggga

SEQ ID NO: 22362 - DNA, 18 bp, Artificial sequence
  synthetic polynucleotide sequence
acacccagggccgggtca

SEQ ID NO: 22363 - DNA, 20 bp, Artificial sequence
  synthetic polynucleotide sequence
aggagcctgccaggtgtcaa

SEQ ID NO: 22364 - DNA, 20 bp, Artificial sequence
  synthetic polynucleotide sequence
gcacggtcccagttgaggaa

SEQ ID NO: 22365 - DNA, 18 bp, Artificial sequence
  synthetic polynucleotide sequence
gatcaccgcgcaacccga

SEQ ID NO: 22366 - DNA, 20 bp, Artificial sequence
  synthetic polynucleotide sequence
gaactggcagatgtagggca

SEQ ID NO: 22367 - DNA, 21 bp, Artificial sequence
  synthetic polynucleotide sequence
tcagatccagaaggtcagcga

SEQ ID NO: 22368 - DNA, 20 bp, Artificial sequence
  synthetic polynucleotide sequence
caacgcagcgctcattggga

SEQ ID NO: 22369 - DNA, 20 bp, Artificial sequence
  synthetic polynucleotide sequence
ctgctgcccaaccccttgga

SEQ ID NO: 22370 - DNA, 20 bp, Artificial sequence
  synthetic polynucleotide sequence
caccaccagatcagccccca

SEQ ID NO: 22371 - DNA, 21 bp, Artificial sequence
  synthetic polynucleotide sequence
cagcacggaagctgagcagaa

SEQ ID NO: 22372 - DNA, 20 bp, Artificial sequence
  synthetic polynucleotide sequence
gtctggtccacccaacgcca

SEQ ID NO: 22373 - DNA, 23 bp, Artificial sequence
  synthetic polynucleotide sequence
aaacacaatgcacagagagagga

SEQ ID NO: 22374 - DNA, 23 bp, Artificial sequence
  synthetic polynucleotide sequence
aagatgcgaaatgtcacaacaca

SEQ ID NO: 22375 - DNA, 21 bp, Artificial sequence
  synthetic polynucleotide sequence
gatggtcctgcaaggctggaa

SEQ ID NO: 22376 - DNA, 19 bp, Artificial sequence
  synthetic polynucleotide sequence
ccagatgggctccctggga

SEQ ID NO: 22377 - DNA, 21 bp, Artificial sequence
  synthetic polynucleotide sequence
aggatcactgcgcagatgcca

SEQ ID NO: 22378 - DNA, 20 bp, Artificial sequence
  synthetic polynucleotide sequence
gtagccctgaaccttgccca

SEQ ID NO: 22379 - DNA, 21 bp, Artificial sequence
  synthetic polynucleotide sequence
cactgtcccaaggactggaca

SEQ ID NO: 22380 - DNA, 18 bp, Artificial sequence
  synthetic polynucleotide sequence
cgacgagctgggccctca

SEQ ID NO: 22381 - DNA, 21 bp, Artificial sequence
  synthetic polynucleotide sequence
tcaacacgccagagaaactga

SEQ ID NO: 22382 - DNA, 18 bp, Artificial sequence
  synthetic polynucleotide sequence
taggccaatggtcgcaca

SEQ ID NO: 22383 - DNA, 20 bp, Artificial sequence
  synthetic polynucleotide sequence
caaaggtgccagcctgggga

SEQ ID NO: 22384 - DNA, 19 bp, Artificial sequence
  synthetic polynucleotide sequence
tgtgggtctgaaagcccca

SEQ ID NO: 22385 - DNA, 21 bp, Artificial sequence
  synthetic polynucleotide sequence
acagctacccaagaaaaccca

SEQ ID NO: 22386 - DNA, 20 bp, Artificial sequence
  synthetic polynucleotide sequence
atatgagggcacactacaca

SEQ ID NO: 22387 - DNA, 21 bp, Artificial sequence
  synthetic polynucleotide sequence
gggatagcccagcaccagaca

SEQ ID NO: 22388 - DNA, 21 bp, Artificial sequence
  synthetic polynucleotide sequence
cctgcaacaacttgacgccca

SEQ ID NO: 22389 - DNA, 21 bp, Artificial sequence
  synthetic polynucleotide sequence
ccacttggggagcagaaggaa

SEQ ID NO: 22390 - DNA, 22 bp, Artificial sequence
  synthetic polynucleotide sequence
gaaacgcgagttctaacgggga

SEQ ID NO: 22391 - DNA, 22 bp, Artificial sequence
  synthetic polynucleotide sequence
atgactggaatgaagacacgga

SEQ ID NO: 22392 - DNA, 18 bp, Artificial sequence
  synthetic polynucleotide sequence
tcaccacacccaatccga

SEQ ID NO: 22393 - DNA, 22 bp, Artificial sequence
  synthetic polynucleotide sequence
tgcagctctaaccctggaagga

SEQ ID NO: 22394 - DNA, 22 bp, Artificial sequence
  synthetic polynucleotide sequence
caatctgagctaaagccaggca

SEQ ID NO: 22395 - DNA, 22 bp, Artificial sequence
  synthetic polynucleotide sequence
aggacttagccccaggtaccaa

SEQ ID NO: 22396 - DNA, 21 bp, Artificial sequence
  synthetic polynucleotide sequence
gcaaagaggttacagcccaca

SEQ ID NO: 22397 - DNA, 20 bp, Artificial sequence
  synthetic polynucleotide sequence
caagacagacacgctgcaga

SEQ ID NO: 22398 - DNA, 18 bp, Artificial sequence
  synthetic polynucleotide sequence
agctgtccagcctggcga

SEQ ID NO: 22399 - DNA, 21 bp, Artificial sequence
  synthetic polynucleotide sequence
gccgctgaatgggctgaagga

SEQ ID NO: 22400 - DNA, 22 bp, Artificial sequence
  synthetic polynucleotide sequence
gaatcatgaagagcctctggga

SEQ ID NO: 22401 - DNA, 23 bp, Artificial sequence
  synthetic polynucleotide sequence
caaaacaccgggaatccaacaca

SEQ ID NO: 22402 - DNA, 19 bp, Artificial sequence
  synthetic polynucleotide sequence
ccaggaacttgcgccggga

SEQ ID NO: 22403 - DNA, 20 bp, Artificial sequence
  synthetic polynucleotide sequence
gaggcccagctcagcaacca

SEQ ID NO: 22404 - DNA, 21 bp, Artificial sequence
  synthetic polynucleotide sequence
gagacgctgagaaaacgggca

SEQ ID NO: 22405 - DNA, 22 bp, Artificial sequence
  synthetic polynucleotide sequence
ccatgcctatgagcatgcccaa

SEQ ID NO: 22406 - DNA, 20 bp, Artificial sequence
  synthetic polynucleotide sequence
tgcctgtcaagcccatccca

SEQ ID NO: 22407 - DNA, 18 bp, Artificial sequence
  synthetic polynucleotide sequence
cagccaaagccaaggcca

SEQ ID NO: 22408 - DNA, 18 bp, Artificial sequence
  synthetic polynucleotide sequence
cctggcgtaacgggagga

SEQ ID NO: 22409 - DNA, 20 bp, Artificial sequence
  synthetic polynucleotide sequence
aaggagaagcggcgcctgga

SEQ ID NO: 22410 - DNA, 19 bp, Artificial sequence
  synthetic polynucleotide sequence
ctccgctccttccgcagca

SEQ ID NO: 22411 - DNA, 20 bp, Artificial sequence
  synthetic polynucleotide sequence
ggggacagcgttggagccaa

SEQ ID NO: 22412 - DNA, 19 bp, Artificial sequence
  synthetic polynucleotide sequence
gccctcagcatccagggga

SEQ ID NO: 22413 - DNA, 22 bp, Artificial sequence
  synthetic polynucleotide sequence
tgatcatgtcactggcaaggca

SEQ ID NO: 22414 - DNA, 21 bp, Artificial sequence
  synthetic polynucleotide sequence
atccagttcaatgccagccca

SEQ ID NO: 22415 - DNA, 22 bp, Artificial sequence
  synthetic polynucleotide sequence
tagaggatgatgaggagggtca

SEQ ID NO: 22416 - DNA, 20 bp, Artificial sequence
  synthetic polynucleotide sequence
tctgagcgagcagcttcaca

SEQ ID NO: 22417 - DNA, 21 bp, Artificial sequence
  synthetic polynucleotide sequence
acaactacctgccctacccca

SEQ ID NO: 22418 - DNA, 21 bp, Artificial sequence
  synthetic polynucleotide sequence
tgccaaagtctaccacccgca

SEQ ID NO: 22419 - DNA, 21 bp, Artificial sequence
  synthetic polynucleotide sequence
accatgagcaccacaccacca

SEQ ID NO: 22420 - DNA, 21 bp, Artificial sequence
  synthetic polynucleotide sequence
gaagagtgtgaagccccggta

SEQ ID NO: 22421 - DNA, 21 bp, Artificial sequence
  synthetic polynucleotide sequence
gtaggccgttaccgtgaagca

SEQ ID NO: 22422 - DNA, 21 bp, Artificial sequence
  synthetic polynucleotide sequence
actggcagatctgatacgcca

SEQ ID NO: 22423 - DNA, 18 bp, Artificial sequence
  synthetic polynucleotide sequence
tgcatgacaggcccacca

SEQ ID NO: 22424 - DNA, 18 bp, Artificial sequence
  synthetic polynucleotide sequence
gagctcccaggtgaggca

SEQ ID NO: 22425 - DNA, 23 bp, Artificial sequence
  synthetic polynucleotide sequence
gtacagcccatgaggaagatcca

SEQ ID NO: 22426 - DNA, 23 bp, Artificial sequence
  synthetic polynucleotide sequence
cataaaccaccgactccaggaga

SEQ ID NO: 22427 - DNA, 21 bp, Artificial sequence
  synthetic polynucleotide sequence
ccatgtcactggggagccaca

SEQ ID NO: 22428 - DNA, 22 bp, Artificial sequence
  synthetic polynucleotide sequence
acatccagttgtgggaagagca

SEQ ID NO: 22429 - DNA, 21 bp, Artificial sequence
  synthetic polynucleotide sequence
aggcaacgaagctgggaagga

SEQ ID NO: 22430 - DNA, 21 bp, Artificial sequence
  synthetic polynucleotide sequence
ttcggattagcagccacacca

SEQ ID NO: 22431 - DNA, 20 bp, Artificial sequence
  synthetic polynucleotide sequence
gcaggtctgggagtagggaa

SEQ ID NO: 22432 - DNA, 21 bp, Artificial sequence
  synthetic polynucleotide sequence
atgccaggaagaaactcccca

SEQ ID NO: 22433 - DNA, 20 bp, Artificial sequence
  synthetic polynucleotide sequence
caggaggtagacacggcaca

SEQ ID NO: 22434 - DNA, 21 bp, Artificial sequence
  synthetic polynucleotide sequence
ataactgggataggtgagcca

SEQ ID NO: 22435 - DNA, 19 bp, Artificial sequence
  synthetic polynucleotide sequence
ctgctcctggtggcaccca

SEQ ID NO: 22436 - DNA, 20 bp, Artificial sequence
  synthetic polynucleotide sequence
ctggtgcaggacgagggcca

SEQ ID NO: 22437 - DNA, 18 bp, Artificial sequence
  synthetic polynucleotide sequence
gggacggcctggtcagca

SEQ ID NO: 22438 - DNA, 19 bp, Artificial sequence
  synthetic polynucleotide sequence
gaagttccagtccaccgga

SEQ ID NO: 22439 - DNA, 21 bp, Artificial sequence
  synthetic polynucleotide sequence
ctggagaccacctttccccaa

SEQ ID NO: 22440 - DNA, 22 bp, Artificial sequence
  synthetic polynucleotide sequence
gtggaacaatctcggaccaaga

SEQ ID NO: 22441 - DNA, 19 bp, Artificial sequence
  synthetic polynucleotide sequence
ggcagcagccagacactga

SEQ ID NO: 22442 - DNA, 18 bp, Artificial sequence
  synthetic polynucleotide sequence
caagacaggcggctctca

SEQ ID NO: 22443 - DNA, 18 bp, Artificial sequence
  synthetic polynucleotide sequence
ctgacccagccaccgcaa

SEQ ID NO: 22444 - DNA, 18 bp, Artificial sequence
  synthetic polynucleotide sequence
gggtcgggcaagctgtca

SEQ ID NO: 22445 - DNA, 18 bp, Artificial sequence
  synthetic polynucleotide sequence
aagttggggcacccacca

SEQ ID NO: 22446 - DNA, 18 bp, Artificial sequence
  synthetic polynucleotide sequence
tctcgcccaggagtgaca

SEQ ID NO: 22447 - DNA, 20 bp, Artificial sequence
  synthetic polynucleotide sequence
cacggtggaggactcagaca

SEQ ID NO: 22448 - DNA, 20 bp, Artificial sequence
  synthetic polynucleotide sequence
gtcgatgatctccagacgca

SEQ ID NO: 22449 - DNA, 22 bp, Artificial sequence
  synthetic polynucleotide sequence
acatctacgccaagcacaccaa

SEQ ID NO: 22450 - DNA, 18 bp, Artificial sequence
  synthetic polynucleotide sequence
cgtcctggggagggtgga

SEQ ID NO: 22451 - DNA, 18 bp, Artificial sequence
  synthetic polynucleotide sequence
ggccagcgagaacagcga

SEQ ID NO: 22452 - DNA, 18 bp, Artificial sequence
  synthetic polynucleotide sequence
gcgtcatggcagatgcca

SEQ ID NO: 22453 - DNA, 21 bp, Artificial sequence
  synthetic polynucleotide sequence
ctgccaacgtgctccagacaa

SEQ ID NO: 22454 - DNA, 20 bp, Artificial sequence
  synthetic polynucleotide sequence
caagtcaggttccgcaggca

SEQ ID NO: 22455 - DNA, 21 bp, Artificial sequence
  synthetic polynucleotide sequence
agaccaagggagctaccaaca

SEQ ID NO: 22456 - DNA, 20 bp, Artificial sequence
  synthetic polynucleotide sequence
ccccaagggagcagtgacca

SEQ ID NO: 22457 - DNA, 21 bp, Artificial sequence
  synthetic polynucleotide sequence
gcagtcagatgaggagcagga

SEQ ID NO: 22458 - DNA, 21 bp, Artificial sequence
  synthetic polynucleotide sequence
tgaaggccaggaactcgaaga

SEQ ID NO: 22459 - DNA, 18 bp, Artificial sequence
  synthetic polynucleotide sequence
cctcttcatgctgcccca

SEQ ID NO: 22460 - DNA, 19 bp, Artificial sequence
  synthetic polynucleotide sequence
ctcctcgtaggactcccca

SEQ ID NO: 22461 - DNA, 21 bp, Artificial sequence
  synthetic polynucleotide sequence
ggaaaaggcagaagggctgca

SEQ ID NO: 22462 - DNA, 21 bp, Artificial sequence
  synthetic polynucleotide sequence
ctctggcttccacatgacgca

SEQ ID NO: 22463 - DNA, 22 bp, Artificial sequence
  synthetic polynucleotide sequence
atcccagtgagcatccacgtca

SEQ ID NO: 22464 - DNA, 22 bp, Artificial sequence
  synthetic polynucleotide sequence
tcatgacaagacagccacagga

SEQ ID NO: 22465 - DNA, 20 bp, Artificial sequence
  synthetic polynucleotide sequence
cctgacggaacgaatcgcca

SEQ ID NO: 22466 - DNA, 19 bp, Artificial sequence
  synthetic polynucleotide sequence
ccgaagcgctggccacgca

SEQ ID NO: 22467 - DNA, 21 bp, Artificial sequence
  synthetic polynucleotide sequence
agtcacggacttgcagaacca

SEQ ID NO: 22468 - DNA, 20 bp, Artificial sequence
  synthetic polynucleotide sequence
gatgcaccgagcccgttcca

SEQ ID NO: 22469 - DNA, 20 bp, Artificial sequence
  synthetic polynucleotide sequence
caggtggaggaaggagcgaa

SEQ ID NO: 22470 - DNA, 18 bp, Artificial sequence
  synthetic polynucleotide sequence
accatagggcgactggca

SEQ ID NO: 22471 - DNA, 18 bp, Artificial sequence
  synthetic polynucleotide sequence
gcagctctgaactgggca

SEQ ID NO: 22472 - DNA, 18 bp, Artificial sequence
  synthetic polynucleotide sequence
gccagttccgatagcgca

SEQ ID NO: 22473 - DNA, 20 bp, Artificial sequence
  synthetic polynucleotide sequence
ccaacgacacctggatgcca

SEQ ID NO: 22474 - DNA, 20 bp, Artificial sequence
  synthetic polynucleotide sequence
acgccagttgcggtagcgga

SEQ ID NO: 22475 - DNA, 19 bp, Artificial sequence
  synthetic polynucleotide sequence
gctggacacagcctagcca

SEQ ID NO: 22476 - DNA, 18 bp, Artificial sequence
  synthetic polynucleotide sequence
ccaggacgaccatgagca

SEQ ID NO: 22477 - DNA, 18 bp, Artificial sequence
  synthetic polynucleotide sequence
gtcgtccccaggcactga

SEQ ID NO: 22478 - DNA, 19 bp, Artificial sequence
  synthetic polynucleotide sequence
gagatgaggactgagcgca

SEQ ID NO: 22479 - DNA, 20 bp, Artificial sequence
  synthetic polynucleotide sequence
tggaaccagcgccagagtga

SEQ ID NO: 22480 - DNA, 22 bp, Artificial sequence
  synthetic polynucleotide sequence
ttgaagtcacatagctgggcca

SEQ ID NO: 22481 - DNA, 21 bp, Artificial sequence
  synthetic polynucleotide sequence
tagaaactgcatggaggcaca

SEQ ID NO: 22482 - DNA, 18 bp, Artificial sequence
  synthetic polynucleotide sequence
tggggagggacggcaaca

SEQ ID NO: 22483 - DNA, 19 bp, Artificial sequence
  synthetic polynucleotide sequence
ccgctgttacgaggaggga

SEQ ID NO: 22484 - DNA, 18 bp, Artificial sequence
  synthetic polynucleotide sequence
acagctgtgcgaagcgga

SEQ ID NO: 22485 - DNA, 19 bp, Artificial sequence
  synthetic polynucleotide sequence
tcatacgagaaggcgacga

SEQ ID NO: 22486 - DNA, 20 bp, Artificial sequence
  synthetic polynucleotide sequence
caaggaggaggtgttgagca

SEQ ID NO: 22487 - DNA, 20 bp, Artificial sequence
  synthetic polynucleotide sequence
gaacagaagccattgccaga

SEQ ID NO: 22488 - DNA, 19 bp, Artificial sequence
  synthetic polynucleotide sequence
agcttcatcagaggccaca

SEQ ID NO: 22489 - DNA, 18 bp, Artificial sequence
  synthetic polynucleotide sequence
ggtgttcggggaagacca

SEQ ID NO: 22490 - DNA, 18 bp, Artificial sequence
  synthetic polynucleotide sequence
cgttctccaggaagcgca

SEQ ID NO: 22491 - DNA, 22 bp, Artificial sequence
  synthetic polynucleotide sequence
aagaagaaaggctatgccggga

SEQ ID NO: 22492 - DNA, 20 bp, Artificial sequence
  synthetic polynucleotide sequence
gaggaccagctaggttggca

SEQ ID NO: 22493 - DNA, 22 bp, Artificial sequence
  synthetic polynucleotide sequence
atgatcatcaccaggcctgaca

SEQ ID NO: 22494 - DNA, 21 bp, Artificial sequence
  synthetic polynucleotide sequence
tgagccaggagtctaaaggca

SEQ ID NO: 22495 - DNA, 22 bp, Artificial sequence
  synthetic polynucleotide sequence
atctggaccactatggcaggaa

SEQ ID NO: 22496 - DNA, 21 bp, Artificial sequence
  synthetic polynucleotide sequence
ttcctccaaatcgcgctggga

SEQ ID NO: 22497 - DNA, 22 bp, Artificial sequence
  synthetic polynucleotide sequence
tctagcagctgatatccccaga

SEQ ID NO: 22498 - DNA, 19 bp, Artificial sequence
  synthetic polynucleotide sequence
tgcagccactccatcctca

SEQ ID NO: 22499 - DNA, 20 bp, Artificial sequence
  synthetic polynucleotide sequence
cgggctcagacactctgcaa

SEQ ID NO: 22500 - DNA, 19 bp, Artificial sequence
  synthetic polynucleotide sequence
tcctgggattgcccacaca

SEQ ID NO: 22501 - DNA, 19 bp, Artificial sequence
  synthetic polynucleotide sequence
cagggccgaggtgtggaga

SEQ ID NO: 22502 - DNA, 20 bp, Artificial sequence
  synthetic polynucleotide sequence
gacccagccaatgagcggga

SEQ ID NO: 22503 - DNA, 21 bp, Artificial sequence
  synthetic polynucleotide sequence
tggcagttgcccaataccaga

SEQ ID NO: 22504 - DNA, 18 bp, Artificial sequence
  synthetic polynucleotide sequence
caccccagcagaatccca

SEQ ID NO: 22505 - DNA, 19 bp, Artificial sequence
  synthetic polynucleotide sequence
cccaagcccctcccctcca

SEQ ID NO: 22506 - DNA, 18 bp, Artificial sequence
  synthetic polynucleotide sequence
gccatctcggcgggccga

SEQ ID NO: 22507 - DNA, 19 bp, Artificial sequence
  synthetic polynucleotide sequence
ggaccaagagcagggagca

SEQ ID NO: 22508 - DNA, 19 bp, Artificial sequence
  synthetic polynucleotide sequence
ctaaacgccctgcccaaca

SEQ ID NO: 22509 - DNA, 18 bp, Artificial sequence
  synthetic polynucleotide sequence
ggatccgtgccagaagca

SEQ ID NO: 22510 - DNA, 21 bp, Artificial sequence
  synthetic polynucleotide sequence
actgagcacaacacttacgca

SEQ ID NO: 22511 - DNA, 20 bp, Artificial sequence
  synthetic polynucleotide sequence
gtaaccagtgcctgcgccga

SEQ ID NO: 22512 - DNA, 21 bp, Artificial sequence
  synthetic polynucleotide sequence
tcttcatggagctcagggcca

SEQ ID NO: 22513 - DNA, 18 bp, Artificial sequence
  synthetic polynucleotide sequence
acagctgcatgaacccca

SEQ ID NO: 22514 - DNA, 19 bp, Artificial sequence
  synthetic polynucleotide sequence
tagagcattgaccaggcga

SEQ ID NO: 22515 - DNA, 20 bp, Artificial sequence
  synthetic polynucleotide sequence
cgaggaaatggatcagacaa

SEQ ID NO: 22516 - DNA, 23 bp, Artificial sequence
  synthetic polynucleotide sequence
cgaaagatacatctgccttccca

SEQ ID NO: 22517 - DNA, 21 bp, Artificial sequence
  synthetic polynucleotide sequence
gaagaccagggaagaagcaga

SEQ ID NO: 22518 - DNA, 18 bp, Artificial sequence
  synthetic polynucleotide sequence
aggggctggcatcaacca

SEQ ID NO: 22519 - DNA, 21 bp, Artificial sequence
  synthetic polynucleotide sequence
cagcattcagaggagacggca

SEQ ID NO: 22520 - DNA, 21 bp, Artificial sequence
  synthetic polynucleotide sequence
tccccggagttcctacaccca

SEQ ID NO: 22521 - DNA, 20 bp, Artificial sequence
  synthetic polynucleotide sequence
gctcttggggcacgctgaga

SEQ ID NO: 22522 - DNA, 23 bp, Artificial sequence
  synthetic polynucleotide sequence
taaaagcaaaaactccagccgca

SEQ ID NO: 22523 - DNA, 20 bp, Artificial sequence
  synthetic polynucleotide sequence
ctcacagcgcctctgctgga

SEQ ID NO: 22524 - DNA, 20 bp, Artificial sequence
  synthetic polynucleotide sequence
aacaccccagcggctttgga

SEQ ID NO: 22525 - DNA, 18 bp, Artificial sequence
  synthetic polynucleotide sequence
gcgactgcggcatatgca

SEQ ID NO: 22526 - DNA, 18 bp, Artificial sequence
  synthetic polynucleotide sequence
cgctggatctcagggcga

SEQ ID NO: 22527 - DNA, 20 bp, Artificial sequence
  synthetic polynucleotide sequence
cagggcttcgcggtggacaa

SEQ ID NO: 22528 - DNA, 20 bp, Artificial sequence
  synthetic polynucleotide sequence
gagatggaggccgtgaagca

SEQ ID NO: 22529 - DNA, 19 bp, Artificial sequence
  synthetic polynucleotide sequence
ggagcggtgtacagcccca

SEQ ID NO: 22530 - DNA, 22 bp, Artificial sequence
  synthetic polynucleotide sequence
agcagagacagcaacagctgca

SEQ ID NO: 22531 - DNA, 21 bp, Artificial sequence
  synthetic polynucleotide sequence
gccctgctgaaagtggcgcaa

SEQ ID NO: 22532 - DNA, 22 bp, Artificial sequence
  synthetic polynucleotide sequence
aaccaaagatcgacaggggcca

SEQ ID NO: 22533 - DNA, 20 bp, Artificial sequence
  synthetic polynucleotide sequence
cgccagctccttcgcagaga

SEQ ID NO: 22534 - DNA, 22 bp, Artificial sequence
  synthetic polynucleotide sequence
atgaggaagaagacggtgagga

SEQ ID NO: 22535 - DNA, 18 bp, Artificial sequence
  synthetic polynucleotide sequence
gcagactccattgcccca

SEQ ID NO: 22536 - DNA, 18 bp, Artificial sequence
  synthetic polynucleotide sequence
tgggagtcatgcacacga

SEQ ID NO: 22537 - DNA, 18 bp, Artificial sequence
  synthetic polynucleotide sequence
cccctgaggacctgcgca

SEQ ID NO: 22538 - DNA, 20 bp, Artificial sequence
  synthetic polynucleotide sequence
aagcagggcccccttaagga

SEQ ID NO: 22539 - DNA, 20 bp, Artificial sequence
  synthetic polynucleotide sequence
gacgtcagagtggctaccca

SEQ ID NO: 22540 - DNA, 19 bp, Artificial sequence
  synthetic polynucleotide sequence
tcttcctccgggaaggaca

SEQ ID NO: 22541 - DNA, 21 bp, Artificial sequence
  synthetic polynucleotide sequence
ctgctcactggaagcacccta

SEQ ID NO: 22542 - DNA, 21 bp, Artificial sequence
  synthetic polynucleotide sequence
agttctgagcttaggccagga

SEQ ID NO: 22543 - DNA, 21 bp, Artificial sequence
  synthetic polynucleotide sequence
cccaagagagagcgagagcaa

SEQ ID NO: 22544 - DNA, 18 bp, Artificial sequence
  synthetic polynucleotide sequence
gcatggtcgcagtcacga

SEQ ID NO: 22545 - DNA, 20 bp, Artificial sequence
  synthetic polynucleotide sequence
cacccagtatctcgcagcaa

SEQ ID NO: 22546 - DNA, 19 bp, Artificial sequence
  synthetic polynucleotide sequence
cccagcggaattagcacca

SEQ ID NO: 22547 - DNA, 20 bp, Artificial sequence
  synthetic polynucleotide sequence
gagccagacttgaccaggga

SEQ ID NO: 22548 - DNA, 18 bp, Artificial sequence
  synthetic polynucleotide sequence
ctgaccccacaggcagca

SEQ ID NO: 22549 - DNA, 21 bp, Artificial sequence
  synthetic polynucleotide sequence
tggagcaggcggaagatctca

SEQ ID NO: 22550 - DNA, 19 bp, Artificial sequence
  synthetic polynucleotide sequence
taaccagttccaggcacca

SEQ ID NO: 22551 - DNA, 19 bp, Artificial sequence
  synthetic polynucleotide sequence
cctgccgcatctccgacga

SEQ ID NO: 22552 - DNA, 18 bp, Artificial sequence
  synthetic polynucleotide sequence
cagagggcgcagggcaga

SEQ ID NO: 22553 - DNA, 21 bp, Artificial sequence
  synthetic polynucleotide sequence
ctgcaaaccaggtttgcccga

SEQ ID NO: 22554 - DNA, 19 bp, Artificial sequence
  synthetic polynucleotide sequence
ttccgctccaggtccctca

SEQ ID NO: 22555 - DNA, 21 bp, Artificial sequence
  synthetic polynucleotide sequence
caactacatccacaccctgca

SEQ ID NO: 22556 - DNA, 20 bp, Artificial sequence
  synthetic polynucleotide sequence
cagcaggcggttgaagcgca

SEQ ID NO: 22557 - DNA, 20 bp, Artificial sequence
  synthetic polynucleotide sequence
gctgaaggctgagatcgcca

SEQ ID NO: 22558 - DNA, 20 bp, Artificial sequence
  synthetic polynucleotide sequence
gggtcgcagcttcagcacca

SEQ ID NO: 22559 - DNA, 20 bp, Artificial sequence
  synthetic polynucleotide sequence
ctgagctggagtccagcgca

SEQ ID NO: 22560 - DNA, 21 bp, Artificial sequence
  synthetic polynucleotide sequence
tcctcaggctcaccctcgtca

SEQ ID NO: 22561 - DNA, 18 bp, Artificial sequence
  synthetic polynucleotide sequence
ggcgcatgctgagaagca

SEQ ID NO: 22562 - DNA, 19 bp, Artificial sequence
  synthetic polynucleotide sequence
tcctgtcatagcgagggca

SEQ ID NO: 22563 - DNA, 21 bp, Artificial sequence
  synthetic polynucleotide sequence
gaagccactggacagacctga

SEQ ID NO: 22564 - DNA, 20 bp, Artificial sequence
  synthetic polynucleotide sequence
ctccgccctcagcagaagga

SEQ ID NO: 22565 - DNA, 20 bp, Artificial sequence
  synthetic polynucleotide sequence
ctcccagagtacctcatcca

SEQ ID NO: 22566 - DNA, 21 bp, Artificial sequence
  synthetic polynucleotide sequence
gggtcatagagtcctgggcca

SEQ ID NO: 22567 - DNA, 20 bp, Artificial sequence
  synthetic polynucleotide sequence
aggaagctggtggtcccaga

SEQ ID NO: 22568 - DNA, 21 bp, Artificial sequence
  synthetic polynucleotide sequence
ggtggtagaagaggaggggga

SEQ ID NO: 22569 - DNA, 22 bp, Artificial sequence
  synthetic polynucleotide sequence
atgcgagggaacggttgaggaa

SEQ ID NO: 22570 - DNA, 21 bp, Artificial sequence
  synthetic polynucleotide sequence
cgtgagccactcttgcgcaca

SEQ ID NO: 22571 - DNA, 19 bp, Artificial sequence
  synthetic polynucleotide sequence
ggagaccaaatgcaagcca

SEQ ID NO: 22572 - DNA, 21 bp, Artificial sequence
  synthetic polynucleotide sequence
gctggcaaacagagctaagga

SEQ ID NO: 22573 - DNA, 20 bp, Artificial sequence
  synthetic polynucleotide sequence
agtggcacaggctgaaggca

SEQ ID NO: 22574 - DNA, 20 bp, Artificial sequence
  synthetic polynucleotide sequence
ctctctgaggtcagggggca

SEQ ID NO: 22575 - DNA, 20 bp, Artificial sequence
  synthetic polynucleotide sequence
cagactctgcccctggagga

SEQ ID NO: 22576 - DNA, 21 bp, Artificial sequence
  synthetic polynucleotide sequence
tcagctaaggggtatggccca

SEQ ID NO: 22577 - DNA, 19 bp, Artificial sequence
  synthetic polynucleotide sequence
ctccacagcagcgccacga

SEQ ID NO: 22578 - DNA, 21 bp, Artificial sequence
  synthetic polynucleotide sequence
tgaggcgcgtaaaccagctga

SEQ ID NO: 22579 - DNA, 21 bp, Artificial sequence
  synthetic polynucleotide sequence
cgaccctagactggatcacga

SEQ ID NO: 22580 - DNA, 21 bp, Artificial sequence
  synthetic polynucleotide sequence
catgatgactctgcaggccga

SEQ ID NO: 22581 - DNA, 21 bp, Artificial sequence
  synthetic polynucleotide sequence
caccaacaaaggagccagcca

SEQ ID NO: 22582 - DNA, 18 bp, Artificial sequence
  synthetic polynucleotide sequence
cgtcatgccccgctgcga

SEQ ID NO: 22583 - DNA, 20 bp, Artificial sequence
  synthetic polynucleotide sequence
ctcgaccatcagcctccaga

SEQ ID NO: 22584 - DNA, 18 bp, Artificial sequence
  synthetic polynucleotide sequence
cgccctgcgtgtagccca

SEQ ID NO: 22585 - DNA, 20 bp, Artificial sequence
  synthetic polynucleotide sequence
aggcagggatgttagcacca

SEQ ID NO: 22586 - DNA, 18 bp, Artificial sequence
  synthetic polynucleotide sequence
acttgccgcccaagccca

SEQ ID NO: 22587 - DNA, 21 bp, Artificial sequence
  synthetic polynucleotide sequence
ctcagtccacatcctcagcga

SEQ ID NO: 22588 - DNA, 20 bp, Artificial sequence
  synthetic polynucleotide sequence
aaggcctccatgtcagggga

SEQ ID NO: 22589 - DNA, 21 bp, Artificial sequence
  synthetic polynucleotide sequence
ggtcaccgatccctacaacga

SEQ ID NO: 22590 - DNA, 21 bp, Artificial sequence
  synthetic polynucleotide sequence
ttcgccggtgatcatgaagca

SEQ ID NO: 22591 - DNA, 20 bp, Artificial sequence
  synthetic polynucleotide sequence
cctgagaacaccgacctgca

SEQ ID NO: 22592 - DNA, 20 bp, Artificial sequence
  synthetic polynucleotide sequence
agggctgccttccaccggga

SEQ ID NO: 22593 - DNA, 20 bp, Artificial sequence
  synthetic polynucleotide sequence
cactcggcagcagtaccaga

SEQ ID NO: 22594 - DNA, 18 bp, Artificial sequence
  synthetic polynucleotide sequence
tctcgtccaccacaggca

SEQ ID NO: 22595 - DNA, 18 bp, Artificial sequence
  synthetic polynucleotide sequence
gcccagcccatgaagcaa

SEQ ID NO: 22596 - DNA, 18 bp, Artificial sequence
  synthetic polynucleotide sequence
cgcagcagaaggtcagca

SEQ ID NO: 22597 - DNA, 18 bp, Artificial sequence
  synthetic polynucleotide sequence
cccctcagtgctacccca

SEQ ID NO: 22598 - DNA, 18 bp, Artificial sequence
  synthetic polynucleotide sequence
ttgaagccgcctggtgga

SEQ ID NO: 22599 - DNA, 21 bp, Artificial sequence
  synthetic polynucleotide sequence
caccccagccaaacttcctga

SEQ ID NO: 22600 - DNA, 21 bp, Artificial sequence
  synthetic polynucleotide sequence
gacgcaccaaccgattctgca

SEQ ID NO: 22601 - DNA, 21 bp, Artificial sequence
  synthetic polynucleotide sequence
cagcagagacagacccaggaa

SEQ ID NO: 22602 - DNA, 22 bp, Artificial sequence
  synthetic polynucleotide sequence
aaggtgaagatgcccagggtga

SEQ ID NO: 22603 - DNA, 18 bp, Artificial sequence
  synthetic polynucleotide sequence
aacgctgcacctgaccga

SEQ ID NO: 22604 - DNA, 19 bp, Artificial sequence
  synthetic polynucleotide sequence
gagtcagaggggtgaggca

SEQ ID NO: 22605 - DNA, 20 bp, Artificial sequence
  synthetic polynucleotide sequence
gaaccacacagcaaacccca

SEQ ID NO: 22606 - DNA, 18 bp, Artificial sequence
  synthetic polynucleotide sequence
tgtgagggcctgaaggga

SEQ ID NO: 22607 - DNA, 21 bp, Artificial sequence
  synthetic polynucleotide sequence
ctcagctgaacaccttaggca

SEQ ID NO: 22608 - DNA, 22 bp, Artificial sequence
  synthetic polynucleotide sequence
aggaaaggcagtaagagctcca

SEQ ID NO: 22609 - DNA, 22 bp, Artificial sequence
  synthetic polynucleotide sequence
atctcgcagttcatccagagca

SEQ ID NO: 22610 - DNA, 22 bp, Artificial sequence
  synthetic polynucleotide sequence
catatagctgccgggtagcgta

SEQ ID NO: 22611 - DNA, 22 bp, Artificial sequence
  synthetic polynucleotide sequence
gcaaggagaataccctccagga

SEQ ID NO: 22612 - DNA, 21 bp, Artificial sequence
  synthetic polynucleotide sequence
ccttcacagaggaccactcca

SEQ ID NO: 22613 - DNA, 20 bp, Artificial sequence
  synthetic polynucleotide sequence
accaggcaggctcagactca

SEQ ID NO: 22614 - DNA, 21 bp, Artificial sequence
  synthetic polynucleotide sequence
tgggcagagtccacatcctca

SEQ ID NO: 22615 - DNA, 21 bp, Artificial sequence
  synthetic polynucleotide sequence
ttgccacattcatcctccaga

SEQ ID NO: 22616 - DNA, 18 bp, Artificial sequence
  synthetic polynucleotide sequence
tgcttcagcagacgggca

SEQ ID NO: 22617 - DNA, 18 bp, Artificial sequence
  synthetic polynucleotide sequence
aggccttcacgctgacca

SEQ ID NO: 22618 - DNA, 18 bp, Artificial sequence
  synthetic polynucleotide sequence
cgtcagctgcacagccga

SEQ ID NO: 22619 - DNA, 21 bp, Artificial sequence
  synthetic polynucleotide sequence
gcctcactgactcctccacca

SEQ ID NO: 22620 - DNA, 20 bp, Artificial sequence
  synthetic polynucleotide sequence
caggcatggcaggttgggga

SEQ ID NO: 22621 - DNA, 21 bp, Artificial sequence
  synthetic polynucleotide sequence
acttatcgcccaggagacaca

SEQ ID NO: 22622 - DNA, 21 bp, Artificial sequence
  synthetic polynucleotide sequence
cagcagaacggcactcctaga

SEQ ID NO: 22623 - DNA, 21 bp, Artificial sequence
  synthetic polynucleotide sequence
gatatgtgaccggatgaagga

SEQ ID NO: 22624 - DNA, 21 bp, Artificial sequence
  synthetic polynucleotide sequence
ccggcccactacacgtacgta

SEQ ID NO: 22625 - DNA, 20 bp, Artificial sequence
  synthetic polynucleotide sequence
tagcctgcacaaggagagga

SEQ ID NO: 22626 - DNA, 21 bp, Artificial sequence
  synthetic polynucleotide sequence
tcaaactcttccaccagcaca

SEQ ID NO: 22627 - DNA, 22 bp, Artificial sequence
  synthetic polynucleotide sequence
ggatgttgaaggaggaggacga

SEQ ID NO: 22628 - DNA, 18 bp, Artificial sequence
  synthetic polynucleotide sequence
gcacctgccccagctcca

SEQ ID NO: 22629 - DNA, 20 bp, Artificial sequence
  synthetic polynucleotide sequence
ctctggaaggctcacagcca

SEQ ID NO: 22630 - DNA, 18 bp, Artificial sequence
  synthetic polynucleotide sequence
tgcaagcagagggcccca

SEQ ID NO: 22631 - DNA, 20 bp, Artificial sequence
  synthetic polynucleotide sequence
tacgctcagtgaccaggtca

SEQ ID NO: 22632 - DNA, 18 bp, Artificial sequence
  synthetic polynucleotide sequence
caggcagtgatgggcaga

SEQ ID NO: 22633 - DNA, 18 bp, Artificial sequence
  synthetic polynucleotide sequence
aacggcaacccatccaga

SEQ ID NO: 22634 - DNA, 18 bp, Artificial sequence
  synthetic polynucleotide sequence
ggggcttccccactggca

SEQ ID NO: 22635 - DNA, 18 bp, Artificial sequence
  synthetic polynucleotide sequence
tggagcccctggggagca

SEQ ID NO: 22636 - DNA, 20 bp, Artificial sequence
  synthetic polynucleotide sequence
ctcggaggactgggtgtgga

SEQ ID NO: 22637 - DNA, 21 bp, Artificial sequence
  synthetic polynucleotide sequence
cccagtcagctgcaaggggaa

SEQ ID NO: 22638 - DNA, 20 bp, Artificial sequence
  synthetic polynucleotide sequence
tcccactccgtgagtcagga

SEQ ID NO: 22639 - DNA, 21 bp, Artificial sequence
  synthetic polynucleotide sequence
aggcagagcgactccaagaga

SEQ ID NO: 22640 - DNA, 22 bp, Artificial sequence
  synthetic polynucleotide sequence
aaaggcagcgacttggagaaga

SEQ ID NO: 22641 - DNA, 18 bp, Artificial sequence
  synthetic polynucleotide sequence
agaccacgaccagcacca

SEQ ID NO: 22642 - DNA, 18 bp, Artificial sequence
  synthetic polynucleotide sequence
tgatggggacgctgacca

SEQ ID NO: 22643 - DNA, 21 bp, Artificial sequence
  synthetic polynucleotide sequence
tgggtgggtgaagaagggtca

SEQ ID NO: 22644 - DNA, 18 bp, Artificial sequence
  synthetic polynucleotide sequence
gcagctgcgtccgggtca

SEQ ID NO: 22645 - DNA, 18 bp, Artificial sequence
  synthetic polynucleotide sequence
ccgcgtggtagcaaccaa

SEQ ID NO: 22646 - DNA, 20 bp, Artificial sequence
  synthetic polynucleotide sequence
ctacatctgaaggagccaca

SEQ ID NO: 22647 - DNA, 19 bp, Artificial sequence
  synthetic polynucleotide sequence
ctcaggactcagcggagga

SEQ ID NO: 22648 - DNA, 20 bp, Artificial sequence
  synthetic polynucleotide sequence
gaaggacagcaggtagccga

SEQ ID NO: 22649 - DNA, 20 bp, Artificial sequence
  synthetic polynucleotide sequence
ggagacagggcacctctaca

SEQ ID NO: 22650 - DNA, 21 bp, Artificial sequence
  synthetic polynucleotide sequence
caccatcagaacgtagcacca

SEQ ID NO: 22651 - DNA, 18 bp, Artificial sequence
  synthetic polynucleotide sequence
gaggagatggcagcagca

SEQ ID NO: 22652 - DNA, 18 bp, Artificial sequence
  synthetic polynucleotide sequence
ttcgaagtggaagcccca

SEQ ID NO: 22653 - DNA, 21 bp, Artificial sequence
  synthetic polynucleotide sequence
cagttccgaagacagcaccca

SEQ ID NO: 22654 - DNA, 22 bp, Artificial sequence
  synthetic polynucleotide sequence
aatatagccgaagccttcccca

SEQ ID NO: 22655 - DNA, 21 bp, Artificial sequence
  synthetic polynucleotide sequence
atgaacctcaactggccccaa

SEQ ID NO: 22656 - DNA, 23 bp, Artificial sequence
  synthetic polynucleotide sequence
gtataagacctcatagcccagca

SEQ ID NO: 22657 - DNA, 17 bp, Artificial sequence
  synthetic polynucleotide sequence
tgagccggccagtgcca

SEQ ID NO: 22658 - DNA, 17 bp, Artificial sequence
  synthetic polynucleotide sequence
cgggcacaggccgacca

SEQ ID NO: 22659 - DNA, 20 bp, Artificial sequence
  synthetic polynucleotide sequence
cgcctggagctctacagcca

SEQ ID NO: 22660 - DNA, 18 bp, Artificial sequence
  synthetic polynucleotide sequence
gctggtgcaatggcccga

SEQ ID NO: 22661 - DNA, 20 bp, Artificial sequence
  synthetic polynucleotide sequence
ggtgcacacaagcaggtgca

SEQ ID NO: 22662 - DNA, 20 bp, Artificial sequence
  synthetic polynucleotide sequence
ggagaaagggacctcccaga

SEQ ID NO: 22663 - DNA, 21 bp, Artificial sequence
  synthetic polynucleotide sequence
cacccacccacttcaacgaca

SEQ ID NO: 22664 - DNA, 19 bp, Artificial sequence
  synthetic polynucleotide sequence
tccacccacgaagagctga

SEQ ID NO: 22665 - DNA, 22 bp, Artificial sequence
  synthetic polynucleotide sequence
gatgagcgggaaccactcacaa

SEQ ID NO: 22666 - DNA, 21 bp, Artificial sequence
  synthetic polynucleotide sequence
ggaaccgggtcatgatgccga

SEQ ID NO: 22667 - DNA, 20 bp, Artificial sequence
  synthetic polynucleotide sequence
aaagcggcagacagagggca

SEQ ID NO: 22668 - DNA, 22 bp, Artificial sequence
  synthetic polynucleotide sequence
ggaagactccagctgagacaga

SEQ ID NO: 22669 - DNA, 21 bp, Artificial sequence
  synthetic polynucleotide sequence
gtattccaccgcctgtccaca

SEQ ID NO: 22670 - DNA, 20 bp, Artificial sequence
  synthetic polynucleotide sequence
ccgagcctggtagagtcgca

SEQ ID NO: 22671 - DNA, 21 bp, Artificial sequence
  synthetic polynucleotide sequence
agccatcccgaggcacaggaa

SEQ ID NO: 22672 - DNA, 21 bp, Artificial sequence
  synthetic polynucleotide sequence
tcgtcaaggtgccacctctga

SEQ ID NO: 22673 - DNA, 19 bp, Artificial sequence
  synthetic polynucleotide sequence
gagaggccccgttcgctca

SEQ ID NO: 22674 - DNA, 19 bp, Artificial sequence
  synthetic polynucleotide sequence
ccgatgcctaggccggtca

SEQ ID NO: 22675 - DNA, 22 bp, Artificial sequence
  synthetic polynucleotide sequence
agaaagacgatgaggaggagga

SEQ ID NO: 22676 - DNA, 19 bp, Artificial sequence
  synthetic polynucleotide sequence
gtggctggcattgccgcca

SEQ ID NO: 22677 - DNA, 20 bp, Artificial sequence
  synthetic polynucleotide sequence
agctgatgctaggccccaga

SEQ ID NO: 22678 - DNA, 20 bp, Artificial sequence
  synthetic polynucleotide sequence
gtagagcgggccagactgaa

SEQ ID NO: 22679 - DNA, 18 bp, Artificial sequence
  synthetic polynucleotide sequence
cttgagccagcggggcga

SEQ ID NO: 22680 - DNA, 19 bp, Artificial sequence
  synthetic polynucleotide sequence
gaagctctctgcccgccca

SEQ ID NO: 22681 - DNA, 20 bp, Artificial sequence
  synthetic polynucleotide sequence
taccacgagaaggacccgga

SEQ ID NO: 22682 - DNA, 20 bp, Artificial sequence
  synthetic polynucleotide sequence
tccaggcttctcacacgcca

SEQ ID NO: 22683 - DNA, 18 bp, Artificial sequence
  synthetic polynucleotide sequence
agctggcccgagaggaga

SEQ ID NO: 22684 - DNA, 18 bp, Artificial sequence
  synthetic polynucleotide sequence
gccagccggcttcaagca

SEQ ID NO: 22685 - DNA, 21 bp, Artificial sequence
  synthetic polynucleotide sequence
gccattgccaagcgcatagga

SEQ ID NO: 22686 - DNA, 20 bp, Artificial sequence
  synthetic polynucleotide sequence
agtgacaggtggtgcagcca

SEQ ID NO: 22687 - DNA, 20 bp, Artificial sequence
  synthetic polynucleotide sequence
gtgccccacgaccatactca

SEQ ID NO: 22688 - DNA, 21 bp, Artificial sequence
  synthetic polynucleotide sequence
tgttggctggaggttggacca

SEQ ID NO: 22689 - DNA, 18 bp, Artificial sequence
  synthetic polynucleotide sequence
gatgtccaaggccctgca

SEQ ID NO: 22690 - DNA, 18 bp, Artificial sequence
  synthetic polynucleotide sequence
ccagaggtgcccaagcca

SEQ ID NO: 22691 - DNA, 20 bp, Artificial sequence
  synthetic polynucleotide sequence
ctgacagccaagggtgacga

SEQ ID NO: 22692 - DNA, 18 bp, Artificial sequence
  synthetic polynucleotide sequence
gttcgctgcaccaggcga

SEQ ID NO: 22693 - DNA, 20 bp, Artificial sequence
  synthetic polynucleotide sequence
ctggacaagcttcaggagca

SEQ ID NO: 22694 - DNA, 18 bp, Artificial sequence
  synthetic polynucleotide sequence
ggagggcacacaggctga

SEQ ID NO: 22695 - DNA, 22 bp, Artificial sequence
  synthetic polynucleotide sequence
caatcctagaccacagaccaca

SEQ ID NO: 22696 - DNA, 21 bp, Artificial sequence
  synthetic polynucleotide sequence
ctctgacgctccaagtaagga

SEQ ID NO: 22697 - DNA, 21 bp, Artificial sequence
  synthetic polynucleotide sequence
cagcacagccatcaagccaca

SEQ ID NO: 22698 - DNA, 21 bp, Artificial sequence
  synthetic polynucleotide sequence
actttctccaactcgacggca

SEQ ID NO: 22699 - DNA, 19 bp, Artificial sequence
  synthetic polynucleotide sequence
tcactgacagacgtctgga

SEQ ID NO: 22700 - DNA, 21 bp, Artificial sequence
  synthetic polynucleotide sequence
tctggggctgacagataacga

SEQ ID NO: 22701 - DNA, 18 bp, Artificial sequence
  synthetic polynucleotide sequence
taaccagcaggcccacca

SEQ ID NO: 22702 - DNA, 19 bp, Artificial sequence
  synthetic polynucleotide sequence
gtgagactaaaggcgggca

SEQ ID NO: 22703 - DNA, 20 bp, Artificial sequence
  synthetic polynucleotide sequence
gaagtgcgccagtccatgca

SEQ ID NO: 22704 - DNA, 20 bp, Artificial sequence
  synthetic polynucleotide sequence
gaagacgtccatgcgccgca

SEQ ID NO: 22705 - DNA, 20 bp, Artificial sequence
  synthetic polynucleotide sequence
gtgcagagtcagacgaccaa

SEQ ID NO: 22706 - DNA, 18 bp, Artificial sequence
  synthetic polynucleotide sequence
tgagccagaacgcctcca

SEQ ID NO: 22707 - DNA, 18 bp, Artificial sequence
  synthetic polynucleotide sequence
atggagaggctggcccaa

SEQ ID NO: 22708 - DNA, 18 bp, Artificial sequence
  synthetic polynucleotide sequence
gctatgccagctgggcca

SEQ ID NO: 22709 - DNA, 18 bp, Artificial sequence
  synthetic polynucleotide sequence
gcaggccaagatggacca

SEQ ID NO: 22710 - DNA, 20 bp, Artificial sequence
  synthetic polynucleotide sequence
gaccaggtggacctaaggga

SEQ ID NO: 22711 - DNA, 18 bp, Artificial sequence
  synthetic polynucleotide sequence
ggctgccagacacagcaa

SEQ ID NO: 22712 - DNA, 18 bp, Artificial sequence
  synthetic polynucleotide sequence
tgaagcagacaggcccca

SEQ ID NO: 22713 - DNA, 20 bp, Artificial sequence
  synthetic polynucleotide sequence
cagaagcccctacagagcca

SEQ ID NO: 22714 - DNA, 18 bp, Artificial sequence
  synthetic polynucleotide sequence
gtccccaatgctccagga

SEQ ID NO: 22715 - DNA, 20 bp, Artificial sequence
  synthetic polynucleotide sequence
ggctctccaggagatccgga

SEQ ID NO: 22716 - DNA, 20 bp, Artificial sequence
  synthetic polynucleotide sequence
tggagggcctggcagtccaa

SEQ ID NO: 22717 - DNA, 18 bp, Artificial sequence
  synthetic polynucleotide sequence
ccaggcgttggaacccaa

SEQ ID NO: 22718 - DNA, 18 bp, Artificial sequence
  synthetic polynucleotide sequence
ccaggctggccagaagga

SEQ ID NO: 22719 - DNA, 19 bp, Artificial sequence
  synthetic polynucleotide sequence
cggcaggagcagaagcaga

SEQ ID NO: 22720 - DNA, 20 bp, Artificial sequence
  synthetic polynucleotide sequence
tcctggaggacctctcagca

SEQ ID NO: 22721 - DNA, 18 bp, Artificial sequence
  synthetic polynucleotide sequence
tgcaggacagaagggcca

SEQ ID NO: 22722 - DNA, 18 bp, Artificial sequence
  synthetic polynucleotide sequence
acaggccccatggaacca

SEQ ID NO: 22723 - DNA, 18 bp, Artificial sequence
  synthetic polynucleotide sequence
ctcagagctggcaagcca

SEQ ID NO: 22724 - DNA, 18 bp, Artificial sequence
  synthetic polynucleotide sequence
tcatcccgctgcagcaca

SEQ ID NO: 22725 - DNA, 19 bp, Artificial sequence
  synthetic polynucleotide sequence
ggcatggctcggaccccaa

SEQ ID NO: 22726 - DNA, 19 bp, Artificial sequence
  synthetic polynucleotide sequence
gtgatggcagctcgcggca

SEQ ID NO: 22727 - DNA, 20 bp, Artificial sequence
  synthetic polynucleotide sequence
aaggaccctcaggaaagcca

SEQ ID NO: 22728 - DNA, 19 bp, Artificial sequence
  synthetic polynucleotide sequence
ggtggacccataggaccga

SEQ ID NO: 22729 - DNA, 20 bp, Artificial sequence
  synthetic polynucleotide sequence
ccccctacctccagagcaca

SEQ ID NO: 22730 - DNA, 18 bp, Artificial sequence
  synthetic polynucleotide sequence
gcatccagcagaacccca

SEQ ID NO: 22731 - DNA, 21 bp, Artificial sequence
  synthetic polynucleotide sequence
gcaacagggaattcaaggcca

SEQ ID NO: 22732 - DNA, 18 bp, Artificial sequence
  synthetic polynucleotide sequence
taggacctgcgggcccca

SEQ ID NO: 22733 - DNA, 18 bp, Artificial sequence
  synthetic polynucleotide sequence
ggcaaagcaggagagcca

SEQ ID NO: 22734 - DNA, 18 bp, Artificial sequence
  synthetic polynucleotide sequence
cctgaccaggaagcccca

SEQ ID NO: 22735 - DNA, 19 bp, Artificial sequence
  synthetic polynucleotide sequence
gggtgcgtcgggtgagaga

SEQ ID NO: 22736 - DNA, 19 bp, Artificial sequence
  synthetic polynucleotide sequence
ctctccacgctcgctccga

SEQ ID NO: 22737 - DNA, 20 bp, Artificial sequence
  synthetic polynucleotide sequence
gtggtcctaagggtgccaga

SEQ ID NO: 22738 - DNA, 18 bp, Artificial sequence
  synthetic polynucleotide sequence
ggttcacctcgaggccca

SEQ ID NO: 22739 - DNA, 19 bp, Artificial sequence
  synthetic polynucleotide sequence
gggagacatgggggaccca

SEQ ID NO: 22740 - DNA, 20 bp, Artificial sequence
  synthetic polynucleotide sequence
gtggacccggcattccagaa

SEQ ID NO: 22741 - DNA, 20 bp, Artificial sequence
  synthetic polynucleotide sequence
ggtccagcgcgtgtaccaga

SEQ ID NO: 22742 - DNA, 20 bp, Artificial sequence
  synthetic polynucleotide sequence
accgtcaccgtgcggtagga

SEQ ID NO: 22743 - DNA, 18 bp, Artificial sequence
  synthetic polynucleotide sequence
gggcctggaatggacaga

SEQ ID NO: 22744 - DNA, 19 bp, Artificial sequence
  synthetic polynucleotide sequence
cctgatgaggcaggaggga

SEQ ID NO: 22745 - DNA, 25 bp, Artificial sequence
  synthetic polynucleotide sequence
gatgtcaggggaagaactcagtgaa

SEQ ID NO: 22746 - DNA, 20 bp, Artificial sequence
  synthetic polynucleotide sequence
atccacaggggtgctgagca

SEQ ID NO: 22747 - DNA, 18 bp, Artificial sequence
  synthetic polynucleotide sequence
ggacgaagcagctggcaa

SEQ ID NO: 22748 - DNA, 18 bp, Artificial sequence
  synthetic polynucleotide sequence
cagccatccttcagggca

SEQ ID NO: 22749 - DNA, 18 bp, Artificial sequence
  synthetic polynucleotide sequence
gcctgcgcaagttcagca

SEQ ID NO: 22750 - DNA, 20 bp, Artificial sequence
  synthetic polynucleotide sequence
gagtagccgatccacagcga

SEQ ID NO: 22751 - DNA, 20 bp, Artificial sequence
  synthetic polynucleotide sequence
ctgtacttcgagggccagga

SEQ ID NO: 22752 - DNA, 19 bp, Artificial sequence
  synthetic polynucleotide sequence
gcgcagtggtagagagcca

SEQ ID NO: 22753 - DNA, 20 bp, Artificial sequence
  synthetic polynucleotide sequence
caggagacatgggaccacca

SEQ ID NO: 22754 - DNA, 20 bp, Artificial sequence
  synthetic polynucleotide sequence
cagggtctccacgtacacca

SEQ ID NO: 22755 - DNA, 21 bp, Artificial sequence
  synthetic polynucleotide sequence
agtatggctgcagaggatcca

SEQ ID NO: 22756 - DNA, 22 bp, Artificial sequence
  synthetic polynucleotide sequence
accattgagccatgtcgacgca

SEQ ID NO: 22757 - DNA, 22 bp, Artificial sequence
  synthetic polynucleotide sequence
cactatgcccagagaaacgaca

SEQ ID NO: 22758 - DNA, 20 bp, Artificial sequence
  synthetic polynucleotide sequence
ataccgcacagcggctgaca

SEQ ID NO: 22759 - DNA, 18 bp, Artificial sequence
  synthetic polynucleotide sequence
ggtccaaagggcgaacca

SEQ ID NO: 22760 - DNA, 20 bp, Artificial sequence
  synthetic polynucleotide sequence
gtagacctggtctcccagga

SEQ ID NO: 22761 - DNA, 18 bp, Artificial sequence
  synthetic polynucleotide sequence
gaatgcctggccagagca

SEQ ID NO: 22762 - DNA, 20 bp, Artificial sequence
  synthetic polynucleotide sequence
taagctgtaccccacccaca

SEQ ID NO: 22763 - DNA, 19 bp, Artificial sequence
  synthetic polynucleotide sequence
cggccctactggtgaacca

SEQ ID NO: 22764 - DNA, 18 bp, Artificial sequence
  synthetic polynucleotide sequence
gggatccctcgaaggcca

SEQ ID NO: 22765 - DNA, 20 bp, Artificial sequence
  synthetic polynucleotide sequence
ctgggcaacgtggagagaga

SEQ ID NO: 22766 - DNA, 20 bp, Artificial sequence
  synthetic polynucleotide sequence
cagggtctccacgatcacca

SEQ ID NO: 22767 - DNA, 18 bp, Artificial sequence
  synthetic polynucleotide sequence
agggggaaaagggccaca

SEQ ID NO: 22768 - DNA, 18 bp, Artificial sequence
  synthetic polynucleotide sequence
ccaatgggaccaggggga

SEQ ID NO: 22769 - DNA, 18 bp, Artificial sequence
  synthetic polynucleotide sequence
ccaggtgaatgagcccca

SEQ ID NO: 22770 - DNA, 18 bp, Artificial sequence
  synthetic polynucleotide sequence
ggtggaagacaccgcgga

SEQ ID NO: 22771 - DNA, 20 bp, Artificial sequence
  synthetic polynucleotide sequence
gtggtgcagtacagccacga

SEQ ID NO: 22772 - DNA, 18 bp, Artificial sequence
  synthetic polynucleotide sequence
gcccgtccgtgatgacca

SEQ ID NO: 22773 - DNA, 18 bp, Artificial sequence
  synthetic polynucleotide sequence
acagcgctgagaccacca

SEQ ID NO: 22774 - DNA, 18 bp, Artificial sequence
  synthetic polynucleotide sequence
caactgccactctggcga

SEQ ID NO: 22775 - DNA, 21 bp, Artificial sequence
  synthetic polynucleotide sequence
gaagaagcagctcctccagca

SEQ ID NO: 22776 - DNA, 21 bp, Artificial sequence
  synthetic polynucleotide sequence
gcttgaacacgttgcgggtca

SEQ ID NO: 22777 - DNA, 18 bp, Artificial sequence
  synthetic polynucleotide sequence
gaatgcccagtgcaccca

SEQ ID NO: 22778 - DNA, 18 bp, Artificial sequence
  synthetic polynucleotide sequence
aggcgtctgagaagcgca

SEQ ID NO: 22779 - DNA, 18 bp, Artificial sequence
  synthetic polynucleotide sequence
tcgaggcgagaagggaga

SEQ ID NO: 22780 - DNA, 18 bp, Artificial sequence
  synthetic polynucleotide sequence
tgagagacgcggagcaca

SEQ ID NO: 22781 - DNA, 18 bp, Artificial sequence
  synthetic polynucleotide sequence
ggaccaataggtgcccca

SEQ ID NO: 22782 - DNA, 20 bp, Artificial sequence
  synthetic polynucleotide sequence
caggaggccctacttcacca

SEQ ID NO: 22783 - DNA, 21 bp, Artificial sequence
  synthetic polynucleotide sequence
tgtgcacgtcaagggcaccaa

SEQ ID NO: 22784 - DNA, 20 bp, Artificial sequence
  synthetic polynucleotide sequence
cccaccagatgcctggtcca

SEQ ID NO: 22785 - DNA, 21 bp, Artificial sequence
  synthetic polynucleotide sequence
gagcaccgacagatcagcaca

SEQ ID NO: 22786 - DNA, 21 bp, Artificial sequence
  synthetic polynucleotide sequence
aggaagcccagtggcacctga

SEQ ID NO: 22787 - DNA, 18 bp, Artificial sequence
  synthetic polynucleotide sequence
cgtgggtcagatcggcaa

SEQ ID NO: 22788 - DNA, 18 bp, Artificial sequence
  synthetic polynucleotide sequence
ggccgaagctccaaggca

SEQ ID NO: 22789 - DNA, 20 bp, Artificial sequence
  synthetic polynucleotide sequence
agcgagcagcgcatcaggga

SEQ ID NO: 22790 - DNA, 19 bp, Artificial sequence
  synthetic polynucleotide sequence
gaccgggccgaccaatgga

SEQ ID NO: 22791 - DNA, 21 bp, Artificial sequence
  synthetic polynucleotide sequence
tggctaccccccagaagacca

SEQ ID NO: 22792 - DNA, 20 bp, Artificial sequence
  synthetic polynucleotide sequence
tctgcctcacacgatgcgca

SEQ ID NO: 22793 - DNA, 20 bp, Artificial sequence
  synthetic polynucleotide sequence
aggatgaagctgccaacaca

SEQ ID NO: 22794 - DNA, 21 bp, Artificial sequence
  synthetic polynucleotide sequence
tccacacagtcctcatgacca

SEQ ID NO: 22795 - DNA, 20 bp, Artificial sequence
  synthetic polynucleotide sequence
gtactctgaccactccccca

SEQ ID NO: 22796 - DNA, 18 bp, Artificial sequence
  synthetic polynucleotide sequence
ggccaccatctccacgca

SEQ ID NO: 22797 - DNA, 22 bp, Artificial sequence
  synthetic polynucleotide sequence
agatggtagggagagagagcca

SEQ ID NO: 22798 - DNA, 18 bp, Artificial sequence
  synthetic polynucleotide sequence
cccatggccatgacccca

SEQ ID NO: 22799 - DNA, 18 bp, Artificial sequence
  synthetic polynucleotide sequence
gcggatgcaggtggagca

SEQ ID NO: 22800 - DNA, 18 bp, Artificial sequence
  synthetic polynucleotide sequence
cgaacatgacgggcagga

SEQ ID NO: 22801 - DNA, 22 bp, Artificial sequence
  synthetic polynucleotide sequence
atctctctggaaggagcacaga

SEQ ID NO: 22802 - DNA, 21 bp, Artificial sequence
  synthetic polynucleotide sequence
gatgagcaagggttctgcaga

SEQ ID NO: 22803 - DNA, 20 bp, Artificial sequence
  synthetic polynucleotide sequence
cactgcagaccagcacggca

SEQ ID NO: 22804 - DNA, 20 bp, Artificial sequence
  synthetic polynucleotide sequence
gtaggcacggtgacagcgga

SEQ ID NO: 22805 - DNA, 19 bp, Artificial sequence
  synthetic polynucleotide sequence
cagaggtgccacccgagga

SEQ ID NO: 22806 - DNA, 23 bp, Artificial sequence
  synthetic polynucleotide sequence
gaaatgacagcagcttggtcaga

SEQ ID NO: 22807 - DNA, 21 bp, Artificial sequence
  synthetic polynucleotide sequence
ccagcagctttgcagcagcaa

SEQ ID NO: 22808 - DNA, 20 bp, Artificial sequence
  synthetic polynucleotide sequence
tgcttgagcagagtgagcca

SEQ ID NO: 22809 - DNA, 19 bp, Artificial sequence
  synthetic polynucleotide sequence
gtcgccgagtttgggcgga

SEQ ID NO: 22810 - DNA, 20 bp, Artificial sequence
  synthetic polynucleotide sequence
cttccacaccatgctggaca

SEQ ID NO: 22811 - DNA, 19 bp, Artificial sequence
  synthetic polynucleotide sequence
ctccgggcggcattccaga

SEQ ID NO: 22812 - DNA, 21 bp, Artificial sequence
  synthetic polynucleotide sequence
agttgcagctgctgcatgaca

SEQ ID NO: 22813 - DNA, 21 bp, Artificial sequence
  synthetic polynucleotide sequence
agaaatcagcacgctggccaa

SEQ ID NO: 22814 - DNA, 21 bp, Artificial sequence
  synthetic polynucleotide sequence
cgtcagccgtgagcttcagga

SEQ ID NO: 22815 - DNA, 21 bp, Artificial sequence
  synthetic polynucleotide sequence
ggtggcgggtggatgtagcaa

SEQ ID NO: 22816 - DNA, 18 bp, Artificial sequence
  synthetic polynucleotide sequence
gggccacgctgtaccgca

SEQ ID NO: 22817 - DNA, 22 bp, Artificial sequence
  synthetic polynucleotide sequence
agaagagtctcacagccaagca

SEQ ID NO: 22818 - DNA, 20 bp, Artificial sequence
  synthetic polynucleotide sequence
cccatcgagcaagggtggga

SEQ ID NO: 22819 - DNA, 22 bp, Artificial sequence
  synthetic polynucleotide sequence
atgagtagagaggagctgcaga

SEQ ID NO: 22820 - DNA, 21 bp, Artificial sequence
  synthetic polynucleotide sequence
cacaaggtttctgaacacgca

SEQ ID NO: 22821 - DNA, 19 bp, Artificial sequence
  synthetic polynucleotide sequence
cccacctgcctgctccaga

SEQ ID NO: 22822 - DNA, 18 bp, Artificial sequence
  synthetic polynucleotide sequence
ggtctcggatgcggccca

SEQ ID NO: 22823 - DNA, 18 bp, Artificial sequence
  synthetic polynucleotide sequence
tgatgcctgcgacgacga

SEQ ID NO: 22824 - DNA, 18 bp, Artificial sequence
  synthetic polynucleotide sequence
cagcgttctccggacaca

SEQ ID NO: 22825 - DNA, 18 bp, Artificial sequence
  synthetic polynucleotide sequence
accggtacctgccggaca

SEQ ID NO: 22826 - DNA, 20 bp, Artificial sequence
  synthetic polynucleotide sequence
gtgctaggaagtctggcgca

SEQ ID NO: 22827 - DNA, 20 bp, Artificial sequence
  synthetic polynucleotide sequence
gccttggagaccctggacga

SEQ ID NO: 22828 - DNA, 18 bp, Artificial sequence
  synthetic polynucleotide sequence
ggatgcctccgggtcgca

SEQ ID NO: 22829 - DNA, 18 bp, Artificial sequence
  synthetic polynucleotide sequence
cccagcagctcatcacca

SEQ ID NO: 22830 - DNA, 18 bp, Artificial sequence
  synthetic polynucleotide sequence
tgagggctgtacgcagca

SEQ ID NO: 22831 - DNA, 19 bp, Artificial sequence
  synthetic polynucleotide sequence
ggcagcagatcccctagca

SEQ ID NO: 22832 - DNA, 19 bp, Artificial sequence
  synthetic polynucleotide sequence
tgcgaagtcatgaggagca

SEQ ID NO: 22833 - DNA, 22 bp, Artificial sequence
  synthetic polynucleotide sequence
caatacccacttgtcacgccaa

SEQ ID NO: 22834 - DNA, 22 bp, Artificial sequence
  synthetic polynucleotide sequence
agtaggagaagcaggtttccca

SEQ ID NO: 22835 - DNA, 18 bp, Artificial sequence
  synthetic polynucleotide sequence
ctgacaagtgctcgccca

SEQ ID NO: 22836 - DNA, 20 bp, Artificial sequence
  synthetic polynucleotide sequence
caggacgatgaggttgacca

SEQ ID NO: 22837 - DNA, 22 bp, Artificial sequence
  synthetic polynucleotide sequence
agaaagtacccccatcacagca

SEQ ID NO: 22838 - DNA, 20 bp, Artificial sequence
  synthetic polynucleotide sequence
aggacttgaagaggggccca

SEQ ID NO: 22839 - DNA, 21 bp, Artificial sequence
  synthetic polynucleotide sequence
catgaagcaggccattgtgga

SEQ ID NO: 22840 - DNA, 22 bp, Artificial sequence
  synthetic polynucleotide sequence
ctaaggtgatacaggactccca

SEQ ID NO: 22841 - DNA, 21 bp, Artificial sequence
  synthetic polynucleotide sequence
atgctgacgacatccaggaga

SEQ ID NO: 22842 - DNA, 21 bp, Artificial sequence
  synthetic polynucleotide sequence
tagggtatcagtggaggcgga

SEQ ID NO: 22843 - DNA, 21 bp, Artificial sequence
  synthetic polynucleotide sequence
acatcagtcgtgccagactga

SEQ ID NO: 22844 - DNA, 22 bp, Artificial sequence
  synthetic polynucleotide sequence
aatcagtggatgagggatggca

SEQ ID NO: 22845 - DNA, 22 bp, Artificial sequence
  synthetic polynucleotide sequence
aacaacccctcagaactccgaa

SEQ ID NO: 22846 - DNA, 21 bp, Artificial sequence
  synthetic polynucleotide sequence
acaactgcacacgacttgcca

SEQ ID NO: 22847 - DNA, 21 bp, Artificial sequence
  synthetic polynucleotide sequence
cgtgcgacaggatttggccca

SEQ ID NO: 22848 - DNA, 21 bp, Artificial sequence
  synthetic polynucleotide sequence
atcagtcagcaactgccgcga

SEQ ID NO: 22849 - DNA, 18 bp, Artificial sequence
  synthetic polynucleotide sequence
tcgggaggcaacttggaa

SEQ ID NO: 22850 - DNA, 20 bp, Artificial sequence
  synthetic polynucleotide sequence
catatgcagcagcctgagca

SEQ ID NO: 22851 - DNA, 18 bp, Artificial sequence
  synthetic polynucleotide sequence
ggcctctgaagcgggaga

SEQ ID NO: 22852 - DNA, 18 bp, Artificial sequence
  synthetic polynucleotide sequence
ggtaggccatgagcccca

SEQ ID NO: 22853 - DNA, 19 bp, Artificial sequence
  synthetic polynucleotide sequence
gcatcgggcgggacatcca

SEQ ID NO: 22854 - DNA, 20 bp, Artificial sequence
  synthetic polynucleotide sequence
ctcctcaatgcctgacagca

SEQ ID NO: 22855 - DNA, 21 bp, Artificial sequence
  synthetic polynucleotide sequence
tcagcagcaggtagaagcaga

SEQ ID NO: 22856 - DNA, 18 bp, Artificial sequence
  synthetic polynucleotide sequence
tgctcagcgtgaggggga

SEQ ID NO: 22857 - DNA, 22 bp, Artificial sequence
  synthetic polynucleotide sequence
ggatggcaagctgattccacca

SEQ ID NO: 22858 - DNA, 21 bp, Artificial sequence
  synthetic polynucleotide sequence
ggtattgggggaactggagca

SEQ ID NO: 22859 - DNA, 21 bp, Artificial sequence
  synthetic polynucleotide sequence
ggcgagaggtcagcgaagaca

SEQ ID NO: 22860 - DNA, 21 bp, Artificial sequence
  synthetic polynucleotide sequence
ttcttctccaccagcaacgga

SEQ ID NO: 22861 - DNA, 21 bp, Artificial sequence
  synthetic polynucleotide sequence
gacccatcggactgacagtga

SEQ ID NO: 22862 - DNA, 21 bp, Artificial sequence
  synthetic polynucleotide sequence
ctctctaggatcacccctcca

SEQ ID NO: 22863 - DNA, 20 bp, Artificial sequence
  synthetic polynucleotide sequence
cccctccatgaaggagcaga

SEQ ID NO: 22864 - DNA, 22 bp, Artificial sequence
  synthetic polynucleotide sequence
tcattctcgtaggatgagccca

SEQ ID NO: 22865 - DNA, 22 bp, Artificial sequence
  synthetic polynucleotide sequence
tcatggggtactcaatgcagga

SEQ ID NO: 22866 - DNA, 22 bp, Artificial sequence
  synthetic polynucleotide sequence
gaataccagggctgaatcgcca

SEQ ID NO: 22867 - DNA, 22 bp, Artificial sequence
  synthetic polynucleotide sequence
atgtagtatcgggagtggagga

SEQ ID NO: 22868 - DNA, 21 bp, Artificial sequence
  synthetic polynucleotide sequence
tagccaggaagacctgggcta

SEQ ID NO: 22869 - DNA, 20 bp, Artificial sequence
  synthetic polynucleotide sequence
ggggacagctaaccctggca

SEQ ID NO: 22870 - DNA, 22 bp, Artificial sequence
  synthetic polynucleotide sequence
accatccaagtaacgctcccca

SEQ ID NO: 22871 - DNA, 20 bp, Artificial sequence
  synthetic polynucleotide sequence
ctggctcacaaatggtggga

SEQ ID NO: 22872 - DNA, 18 bp, Artificial sequence
  synthetic polynucleotide sequence
ccaccacagccaacgtca

SEQ ID NO: 22873 - DNA, 19 bp, Artificial sequence
  synthetic polynucleotide sequence
cacccacccgcttcgtgga

SEQ ID NO: 22874 - DNA, 20 bp, Artificial sequence
  synthetic polynucleotide sequence
catgggcaggccagtctgga

SEQ ID NO: 22875 - DNA, 20 bp, Artificial sequence
  synthetic polynucleotide sequence
caggcactccaggaagctca

SEQ ID NO: 22876 - DNA, 20 bp, Artificial sequence
  synthetic polynucleotide sequence
caggacagggatgacctgga

SEQ ID NO: 22877 - DNA, 18 bp, Artificial sequence
  synthetic polynucleotide sequence
gtggatgccaaaagccga

SEQ ID NO: 22878 - DNA, 18 bp, Artificial sequence
  synthetic polynucleotide sequence
ccctgtcctgcaagcgga

SEQ ID NO: 22879 - DNA, 21 bp, Artificial sequence
  synthetic polynucleotide sequence
gcgtcgggccagtcattcaga

SEQ ID NO: 22880 - DNA, 19 bp, Artificial sequence
  synthetic polynucleotide sequence
cacggtgcaggccatggca

SEQ ID NO: 22881 - DNA, 18 bp, Artificial sequence
  synthetic polynucleotide sequence
ggtcatggaagacgccca

SEQ ID NO: 22882 - DNA, 18 bp, Artificial sequence
  synthetic polynucleotide sequence
cgagacggtgcctcagca

SEQ ID NO: 22883 - DNA, 21 bp, Artificial sequence
  synthetic polynucleotide sequence
tgtcctgcagaagtccaggga

SEQ ID NO: 22884 - DNA, 18 bp, Artificial sequence
  synthetic polynucleotide sequence
ctcctcgggtgggggaca

SEQ ID NO: 22885 - DNA, 20 bp, Artificial sequence
  synthetic polynucleotide sequence
gccagcatgttcgggaagga

SEQ ID NO: 22886 - DNA, 20 bp, Artificial sequence
  synthetic polynucleotide sequence
cgcctggcccaactgtacca

SEQ ID NO: 22887 - DNA, 18 bp, Artificial sequence
  synthetic polynucleotide sequence
ccccgctacagtcgagca

SEQ ID NO: 22888 - DNA, 18 bp, Artificial sequence
  synthetic polynucleotide sequence
ctccgggttgggcaagca

SEQ ID NO: 22889 - DNA, 22 bp, Artificial sequence
  synthetic polynucleotide sequence
aagactggacgtgtggacaaga

SEQ ID NO: 22890 - DNA, 20 bp, Artificial sequence
  synthetic polynucleotide sequence
agtcctcggagccactggca

SEQ ID NO: 22891 - DNA, 22 bp, Artificial sequence
  synthetic polynucleotide sequence
tgaacacgttcaccagcaagga

SEQ ID NO: 22892 - DNA, 18 bp, Artificial sequence
  synthetic polynucleotide sequence
atcccgcccgctcaccca

SEQ ID NO: 22893 - DNA, 21 bp, Artificial sequence
  synthetic polynucleotide sequence
ggacatagactggtgcccaca

SEQ ID NO: 22894 - DNA, 21 bp, Artificial sequence
  synthetic polynucleotide sequence
caccacaggttcagtcaggga

SEQ ID NO: 22895 - DNA, 21 bp, Artificial sequence
  synthetic polynucleotide sequence
cagaacacaggctggaggaga

SEQ ID NO: 22896 - DNA, 20 bp, Artificial sequence
  synthetic polynucleotide sequence
ctgggtcaacagctcccgga

SEQ ID NO: 22897 - DNA, 21 bp, Artificial sequence
  synthetic polynucleotide sequence
atgaagcggctcctcacgaca

SEQ ID NO: 22898 - DNA, 21 bp, Artificial sequence
  synthetic polynucleotide sequence
tagaaggggaacaggaggcca

SEQ ID NO: 22899 - DNA, 19 bp, Artificial sequence
  synthetic polynucleotide sequence
tacgatcccgactccagca

SEQ ID NO: 22900 - DNA, 21 bp, Artificial sequence
  synthetic polynucleotide sequence
gtagcttgtagaaccgggcga

SEQ ID NO: 22901 - DNA, 21 bp, Artificial sequence
  synthetic polynucleotide sequence
tgcccagctacgacccagaca

SEQ ID NO: 22902 - DNA, 21 bp, Artificial sequence
  synthetic polynucleotide sequence
actccgtcttaggcaggagga

SEQ ID NO: 22903 - DNA, 21 bp, Artificial sequence
  synthetic polynucleotide sequence
gagcatatgcaggaagcggca

SEQ ID NO: 22904 - DNA, 18 bp, Artificial sequence
  synthetic polynucleotide sequence
cccggcactggcctggga

SEQ ID NO: 22905 - DNA, 22 bp, Artificial sequence
  synthetic polynucleotide sequence
agtaccagcacttcatccagca

SEQ ID NO: 22906 - DNA, 22 bp, Artificial sequence
  synthetic polynucleotide sequence
acgttctcaccgatccacgtga

SEQ ID NO: 22907 - DNA, 18 bp, Artificial sequence
  synthetic polynucleotide sequence
ccacatggaccttcccca

SEQ ID NO: 22908 - DNA, 18 bp, Artificial sequence
  synthetic polynucleotide sequence
ggtgccacaggctgcaga

SEQ ID NO: 22909 - DNA, 18 bp, Artificial sequence
  synthetic polynucleotide sequence
ccgctgtcgccgtgggca

SEQ ID NO: 22910 - DNA, 20 bp, Artificial sequence
  synthetic polynucleotide sequence
gtctgaggcatgacctgcaa

SEQ ID NO: 22911 - DNA, 21 bp, Artificial sequence
  synthetic polynucleotide sequence
ctggcaagcagctagctgaca

SEQ ID NO: 22912 - DNA, 18 bp, Artificial sequence
  synthetic polynucleotide sequence
ggccctgcgccactggaa

SEQ ID NO: 22913 - DNA, 18 bp, Artificial sequence
  synthetic polynucleotide sequence
agccgtggcatgaaagga

SEQ ID NO: 22914 - DNA, 18 bp, Artificial sequence
  synthetic polynucleotide sequence
gcaacttgtgcggaggga

SEQ ID NO: 22915 - DNA, 20 bp, Artificial sequence
  synthetic polynucleotide sequence
tctcggctatggagtcccca

SEQ ID NO: 22916 - DNA, 19 bp, Artificial sequence
  synthetic polynucleotide sequence
tccttggaggaggtcagga

SEQ ID NO: 22917 - DNA, 18 bp, Artificial sequence
  synthetic polynucleotide sequence
gaccaagaaggcgcgcga

SEQ ID NO: 22918 - DNA, 20 bp, Artificial sequence
  synthetic polynucleotide sequence
attcacacagcagaccacca

SEQ ID NO: 22919 - DNA, 21 bp, Artificial sequence
  synthetic polynucleotide sequence
actgccaccctttcaaagcca

SEQ ID NO: 22920 - DNA, 22 bp, Artificial sequence
  synthetic polynucleotide sequence
atgacgccaacagagataggca

SEQ ID NO: 22921 - DNA, 19 bp, Artificial sequence
  synthetic polynucleotide sequence
ggagacaggcagggacaca

SEQ ID NO: 22922 - DNA, 18 bp, Artificial sequence
  synthetic polynucleotide sequence
gccagaactccaccccca

SEQ ID NO: 22923 - DNA, 20 bp, Artificial sequence
  synthetic polynucleotide sequence
ggtgagcccgaggagaggaa

SEQ ID NO: 22924 - DNA, 23 bp, Artificial sequence
  synthetic polynucleotide sequence
aaaaatgtccaaagccagccaca

SEQ ID NO: 22925 - DNA, 19 bp, Artificial sequence
  synthetic polynucleotide sequence
ctagttggcaagcgagcaa

SEQ ID NO: 22926 - DNA, 20 bp, Artificial sequence
  synthetic polynucleotide sequence
tggcagacaggtgcttgaca

SEQ ID NO: 22927 - DNA, 21 bp, Artificial sequence
  synthetic polynucleotide sequence
ccagaagagcccttctgcaca

SEQ ID NO: 22928 - DNA, 20 bp, Artificial sequence
  synthetic polynucleotide sequence
ctggagccggtacaaggcca

SEQ ID NO: 22929 - DNA, 18 bp, Artificial sequence
  synthetic polynucleotide sequence
gcgctgtggccgcaacca

SEQ ID NO: 22930 - DNA, 19 bp, Artificial sequence
  synthetic polynucleotide sequence
gtgacccatgggaatagca

SEQ ID NO: 22931 - DNA, 18 bp, Artificial sequence
  synthetic polynucleotide sequence
ttggctgcacaaaggcga

SEQ ID NO: 22932 - DNA, 18 bp, Artificial sequence
  synthetic polynucleotide sequence
ccagctgctggggcacca

SEQ ID NO: 22933 - DNA, 18 bp, Artificial sequence
  synthetic polynucleotide sequence
ccggggtggcagtcagca

SEQ ID NO: 22934 - DNA, 18 bp, Artificial sequence
  synthetic polynucleotide sequence
ggagatgggggtaggcga

SEQ ID NO: 22935 - DNA, 18 bp, Artificial sequence
  synthetic polynucleotide sequence
gccagcgctgccaaagga

SEQ ID NO: 22936 - DNA, 18 bp, Artificial sequence
  synthetic polynucleotide sequence
tgaaggtgcagagggcca

SEQ ID NO: 22937 - DNA, 21 bp, Artificial sequence
  synthetic polynucleotide sequence
ctgctggcagaactacctgga

SEQ ID NO: 22938 - DNA, 21 bp, Artificial sequence
  synthetic polynucleotide sequence
ctggtacacacgctggtacca

SEQ ID NO: 22939 - DNA, 21 bp, Artificial sequence
  synthetic polynucleotide sequence
ccagccagaaccagatccgta

SEQ ID NO: 22940 - DNA, 20 bp, Artificial sequence
  synthetic polynucleotide sequence
ccagctctccacccagctga

SEQ ID NO: 22941 - DNA, 21 bp, Artificial sequence
  synthetic polynucleotide sequence
aagttttgccaaaacctcgga

SEQ ID NO: 22942 - DNA, 19 bp, Artificial sequence
  synthetic polynucleotide sequence
tctttgatcagccacacga

SEQ ID NO: 22943 - DNA, 18 bp, Artificial sequence
  synthetic polynucleotide sequence
agaaccgagtgcgcgaga

SEQ ID NO: 22944 - DNA, 18 bp, Artificial sequence
  synthetic polynucleotide sequence
cctggggaaggaggccca

SEQ ID NO: 22945 - DNA, 20 bp, Artificial sequence
  synthetic polynucleotide sequence
tcgtcagattgggcagagga

SEQ ID NO: 22946 - DNA, 18 bp, Artificial sequence
  synthetic polynucleotide sequence
agggcatcagctacccca

SEQ ID NO: 22947 - DNA, 21 bp, Artificial sequence
  synthetic polynucleotide sequence
acgcagaagttggcaggagca

SEQ ID NO: 22948 - DNA, 21 bp, Artificial sequence
  synthetic polynucleotide sequence
ccatggtggtccggtaaagca

SEQ ID NO: 22949 - DNA, 21 bp, Artificial sequence
  synthetic polynucleotide sequence
tggcaaggcagagccaccaga

SEQ ID NO: 22950 - DNA, 21 bp, Artificial sequence
  synthetic polynucleotide sequence
gccaacaggggacaggttcca

SEQ ID NO: 22951 - DNA, 18 bp, Artificial sequence
  synthetic polynucleotide sequence
gccgcgcgccaagatcca

SEQ ID NO: 22952 - DNA, 22 bp, Artificial sequence
  synthetic polynucleotide sequence
taggtctccaggtgtgacagga

SEQ ID NO: 22953 - DNA, 20 bp, Artificial sequence
  synthetic polynucleotide sequence
gtgctaggcaacctgaagca

SEQ ID NO: 22954 - DNA, 22 bp, Artificial sequence
  synthetic polynucleotide sequence
gttgcatcaactcaactaggca

SEQ ID NO: 22955 - DNA, 18 bp, Artificial sequence
  synthetic polynucleotide sequence
cgccggaaatgaggccga

SEQ ID NO: 22956 - DNA, 18 bp, Artificial sequence
  synthetic polynucleotide sequence
ggccacatgtggagcgta

SEQ ID NO: 22957 - DNA, 18 bp, Artificial sequence
  synthetic polynucleotide sequence
ggacctacagccagggca

SEQ ID NO: 22958 - DNA, 18 bp, Artificial sequence
  synthetic polynucleotide sequence
tgatggtcagaagcgcca

SEQ ID NO: 22959 - DNA, 19 bp, Artificial sequence
  synthetic polynucleotide sequence
caagccagtggaggaagca

SEQ ID NO: 22960 - DNA, 18 bp, Artificial sequence
  synthetic polynucleotide sequence
cctcggctgtgggcagga

SEQ ID NO: 22961 - DNA, 20 bp, Artificial sequence
  synthetic polynucleotide sequence
ctgccacctaaccatgagga

SEQ ID NO: 22962 - DNA, 18 bp, Artificial sequence
  synthetic polynucleotide sequence
gcccaggtcataagccca

SEQ ID NO: 22963 - DNA, 21 bp, Artificial sequence
  synthetic polynucleotide sequence
actgggcctatgacagtggca

SEQ ID NO: 22964 - DNA, 21 bp, Artificial sequence
  synthetic polynucleotide sequence
ccatgatggtccgaagcgcca

SEQ ID NO: 22965 - DNA, 18 bp, Artificial sequence
  synthetic polynucleotide sequence
ctgggcagacgatcacga

SEQ ID NO: 22966 - DNA, 21 bp, Artificial sequence
  synthetic polynucleotide sequence
catcgacgttaaacacaggca

SEQ ID NO: 22967 - DNA, 21 bp, Artificial sequence
  synthetic polynucleotide sequence
agctgagggttcccgaggaga

SEQ ID NO: 22968 - DNA, 20 bp, Artificial sequence
  synthetic polynucleotide sequence
atgcagccacctggtgcaca

SEQ ID NO: 22969 - DNA, 18 bp, Artificial sequence
  synthetic polynucleotide sequence
ctcactgcacggcaccaa

SEQ ID NO: 22970 - DNA, 18 bp, Artificial sequence
  synthetic polynucleotide sequence
cctcgcaggtagcccgga

SEQ ID NO: 22971 - DNA, 18 bp, Artificial sequence
  synthetic polynucleotide sequence
gaggtggggacgattgga

SEQ ID NO: 22972 - DNA, 18 bp, Artificial sequence
  synthetic polynucleotide sequence
tgtaacgctccggcagca

SEQ ID NO: 22973 - DNA, 18 bp, Artificial sequence
  synthetic polynucleotide sequence
cctgggcagcatgaagga

SEQ ID NO: 22974 - DNA, 18 bp, Artificial sequence
  synthetic polynucleotide sequence
ctgcccacaaggaaggga

SEQ ID NO: 22975 - DNA, 19 bp, Artificial sequence
  synthetic polynucleotide sequence
gaggagaccttgtggccaa

SEQ ID NO: 22976 - DNA, 18 bp, Artificial sequence
  synthetic polynucleotide sequence
agagtatgcccgggccaa

SEQ ID NO: 22977 - DNA, 18 bp, Artificial sequence
  synthetic polynucleotide sequence
ggcttgaccccagcagga

SEQ ID NO: 22978 - DNA, 18 bp, Artificial sequence
  synthetic polynucleotide sequence
caatcccggcatacacca

SEQ ID NO: 22979 - DNA, 18 bp, Artificial sequence
  synthetic polynucleotide sequence
gatgaatgccagggcgca

SEQ ID NO: 22980 - DNA, 20 bp, Artificial sequence
  synthetic polynucleotide sequence
tatggaactcacgtccagca

SEQ ID NO: 22981 - DNA, 18 bp, Artificial sequence
  synthetic polynucleotide sequence
cacacgctgtggtgggaa

SEQ ID NO: 22982 - DNA, 18 bp, Artificial sequence
  synthetic polynucleotide sequence
cggaacgggacgtgacga

SEQ ID NO: 22983 - DNA, 22 bp, Artificial sequence
  synthetic polynucleotide sequence
gaatggggaaagagtggaacga

SEQ ID NO: 22984 - DNA, 22 bp, Artificial sequence
  synthetic polynucleotide sequence
ccaatccacaatcagagggcca

SEQ ID NO: 22985 - DNA, 21 bp, Artificial sequence
  synthetic polynucleotide sequence
gcatccgagacaagtacggca

SEQ ID NO: 22986 - DNA, 18 bp, Artificial sequence
  synthetic polynucleotide sequence
ctccacctcgtccccgca

SEQ ID NO: 22987 - DNA, 21 bp, Artificial sequence
  synthetic polynucleotide sequence
ggagaaagcagccctggagca

SEQ ID NO: 22988 - DNA, 19 bp, Artificial sequence
  synthetic polynucleotide sequence
ttgagcaccgtgtccagga

SEQ ID NO: 22989 - DNA, 20 bp, Artificial sequence
  synthetic polynucleotide sequence
atggcaggtggagacgtgga

SEQ ID NO: 22990 - DNA, 21 bp, Artificial sequence
  synthetic polynucleotide sequence
agtgagcccaggttcaagcca

SEQ ID NO: 22991 - DNA, 20 bp, Artificial sequence
  synthetic polynucleotide sequence
gaagccgtcaaaaagcctga

SEQ ID NO: 22992 - DNA, 21 bp, Artificial sequence
  synthetic polynucleotide sequence
catggaggtttgcagagagga

SEQ ID NO: 22993 - DNA, 20 bp, Artificial sequence
  synthetic polynucleotide sequence
gaccaccctggaatccacga

SEQ ID NO: 22994 - DNA, 20 bp, Artificial sequence
  synthetic polynucleotide sequence
tccggaactcctcgcacaga

SEQ ID NO: 22995 - DNA, 18 bp, Artificial sequence
  synthetic polynucleotide sequence
ccggacgaaagcaaggca

SEQ ID NO: 22996 - DNA, 18 bp, Artificial sequence
  synthetic polynucleotide sequence
gagctggacgttcagcca

SEQ ID NO: 22997 - DNA, 18 bp, Artificial sequence
  synthetic polynucleotide sequence
aggctgcacatcagggga

SEQ ID NO: 22998 - DNA, 20 bp, Artificial sequence
  synthetic polynucleotide sequence
caaagtcagcaccacccaca

SEQ ID NO: 22999 - DNA, 18 bp, Artificial sequence
  synthetic polynucleotide sequence
cacaacagcggacggcca

SEQ ID NO: 23000 - DNA, 18 bp, Artificial sequence
  synthetic polynucleotide sequence
ggaactccatggcagcga

SEQ ID NO: 23001 - DNA, 22 bp, Artificial sequence
  synthetic polynucleotide sequence
ataatgggaggatgtcagctga

SEQ ID NO: 23002 - DNA, 21 bp, Artificial sequence
  synthetic polynucleotide sequence
tgaggaggtatctgagcgcca

SEQ ID NO: 23003 - DNA, 20 bp, Artificial sequence
  synthetic polynucleotide sequence
tatcacagacatggccgaca

SEQ ID NO: 23004 - DNA, 22 bp, Artificial sequence
  synthetic polynucleotide sequence
agaatcccatcatcaccgtcca

SEQ ID NO: 23005 - DNA, 20 bp, Artificial sequence
  synthetic polynucleotide sequence
cgcagcctgcgcactgtgca

SEQ ID NO: 23006 - DNA, 20 bp, Artificial sequence
  synthetic polynucleotide sequence
agcagcaccgagtactggga

SEQ ID NO: 23007 - DNA, 21 bp, Artificial sequence
  synthetic polynucleotide sequence
tcgttgcctgccccagatcca

SEQ ID NO: 23008 - DNA, 21 bp, Artificial sequence
  synthetic polynucleotide sequence
agtcagcattgcccacgccta

SEQ ID NO: 23009 - DNA, 21 bp, Artificial sequence
  synthetic polynucleotide sequence
gcaacgccgacttcaccgaca

SEQ ID NO: 23010 - DNA, 20 bp, Artificial sequence
  synthetic polynucleotide sequence
ctccaccacctgcttcggga

SEQ ID NO: 23011 - DNA, 21 bp, Artificial sequence
  synthetic polynucleotide sequence
tgctcagcccacttccctcca

SEQ ID NO: 23012 - DNA, 20 bp, Artificial sequence
  synthetic polynucleotide sequence
aagcctccatgaccccctca

SEQ ID NO: 23013 - DNA, 20 bp, Artificial sequence
  synthetic polynucleotide sequence
ggacttcactgggagggcca

SEQ ID NO: 23014 - DNA, 20 bp, Artificial sequence
  synthetic polynucleotide sequence
tctgcaggcaaggaggcgga

SEQ ID NO: 23015 - DNA, 19 bp, Artificial sequence
  synthetic polynucleotide sequence
gaagctcagatccagccca

SEQ ID NO: 23016 - DNA, 18 bp, Artificial sequence
  synthetic polynucleotide sequence
cccagcagcatagtggca

SEQ ID NO: 23017 - DNA, 19 bp, Artificial sequence
  synthetic polynucleotide sequence
gtgaccagcatggtccaga

SEQ ID NO: 23018 - DNA, 20 bp, Artificial sequence
  synthetic polynucleotide sequence
aaggaactacagccctggca

SEQ ID NO: 23019 - DNA, 18 bp, Artificial sequence
  synthetic polynucleotide sequence
cagggccatcatggagga

SEQ ID NO: 23020 - DNA, 18 bp, Artificial sequence
  synthetic polynucleotide sequence
ctggctccaggcactcca

SEQ ID NO: 23021 - DNA, 19 bp, Artificial sequence
  synthetic polynucleotide sequence
gctgaaggtggctcaggca

SEQ ID NO: 23022 - DNA, 20 bp, Artificial sequence
  synthetic polynucleotide sequence
taggaaggcctcaacaagca

SEQ ID NO: 23023 - DNA, 20 bp, Artificial sequence
  synthetic polynucleotide sequence
accaccatgctgccacacca

SEQ ID NO: 23024 - DNA, 19 bp, Artificial sequence
  synthetic polynucleotide sequence
gcggttgagcagctcccca

SEQ ID NO: 23025 - DNA, 21 bp, Artificial sequence
  synthetic polynucleotide sequence
tgaaggacgctctgatgggga

SEQ ID NO: 23026 - DNA, 21 bp, Artificial sequence
  synthetic polynucleotide sequence
tctttcccaccaaaggcgcga

SEQ ID NO: 23027 - DNA, 20 bp, Artificial sequence
  synthetic polynucleotide sequence
agcgtcacagtggacgggaa

SEQ ID NO: 23028 - DNA, 20 bp, Artificial sequence
  synthetic polynucleotide sequence
tctctgtgcagccagctcca

SEQ ID NO: 23029 - DNA, 20 bp, Artificial sequence
  synthetic polynucleotide sequence
gagatcgcggtggagcagca

SEQ ID NO: 23030 - DNA, 20 bp, Artificial sequence
  synthetic polynucleotide sequence
ttgcataggccacgcagcca

SEQ ID NO: 23031 - DNA, 21 bp, Artificial sequence
  synthetic polynucleotide sequence
ccagctccgcatgtgaaccca

SEQ ID NO: 23032 - DNA, 21 bp, Artificial sequence
  synthetic polynucleotide sequence
tcatatggtggaggtcgccca

SEQ ID NO: 23033 - DNA, 21 bp, Artificial sequence
  synthetic polynucleotide sequence
ctctgccccctataaccacca

SEQ ID NO: 23034 - DNA, 21 bp, Artificial sequence
  synthetic polynucleotide sequence
ctcatcattggcaacccggga

SEQ ID NO: 23035 - DNA, 19 bp, Artificial sequence
  synthetic polynucleotide sequence
gcccagacggtggaacaga

SEQ ID NO: 23036 - DNA, 21 bp, Artificial sequence
  synthetic polynucleotide sequence
taaaggcagaagaggtgacga

SEQ ID NO: 23037 - DNA, 20 bp, Artificial sequence
  synthetic polynucleotide sequence
cctgtaccagcgagtccaca

SEQ ID NO: 23038 - DNA, 20 bp, Artificial sequence
  synthetic polynucleotide sequence
gagacgccagggttccgaga

SEQ ID NO: 23039 - DNA, 21 bp, Artificial sequence
  synthetic polynucleotide sequence
gggcagcacattgaggacgca

SEQ ID NO: 23040 - DNA, 19 bp, Artificial sequence
  synthetic polynucleotide sequence
cccagtctggcgggagaga

SEQ ID NO: 23041 - DNA, 18 bp, Artificial sequence
  synthetic polynucleotide sequence
ccatggccagctgaccaa

SEQ ID NO: 23042 - DNA, 20 bp, Artificial sequence
  synthetic polynucleotide sequence
gtccaggtagagctcaggca

SEQ ID NO: 23043 - DNA, 20 bp, Artificial sequence
  synthetic polynucleotide sequence
gtggcccacgagctgagcaa

SEQ ID NO: 23044 - DNA, 18 bp, Artificial sequence
  synthetic polynucleotide sequence
cctcggggctggtacgca

SEQ ID NO: 23045 - DNA, 19 bp, Artificial sequence
  synthetic polynucleotide sequence
gggcatggactggaaagga

SEQ ID NO: 23046 - DNA, 18 bp, Artificial sequence
  synthetic polynucleotide sequence
gccggatgtaaccagcca

SEQ ID NO: 23047 - DNA, 19 bp, Artificial sequence
  synthetic polynucleotide sequence
gcaggagtggtgagggaca

SEQ ID NO: 23048 - DNA, 18 bp, Artificial sequence
  synthetic polynucleotide sequence
cggcactggcagtcacca

SEQ ID NO: 23049 - DNA, 18 bp, Artificial sequence
  synthetic polynucleotide sequence
gctgccgagaccagagca

SEQ ID NO: 23050 - DNA, 21 bp, Artificial sequence
  synthetic polynucleotide sequence
ggcataggagtaggccagcca

SEQ ID NO: 23051 - DNA, 18 bp, Artificial sequence
  synthetic polynucleotide sequence
acagcttcacgggaggca

SEQ ID NO: 23052 - DNA, 18 bp, Artificial sequence
  synthetic polynucleotide sequence
ggtgcaccgtctccacga

SEQ ID NO: 23053 - DNA, 18 bp, Artificial sequence
  synthetic polynucleotide sequence
atgtgacccccacccaga

SEQ ID NO: 23054 - DNA, 18 bp, Artificial sequence
  synthetic polynucleotide sequence
agttcacagcgaggggca

SEQ ID NO: 23055 - DNA, 18 bp, Artificial sequence
  synthetic polynucleotide sequence
cccacccagacagaggga

SEQ ID NO: 23056 - DNA, 18 bp, Artificial sequence
  synthetic polynucleotide sequence
agttcacagcgaggggca

SEQ ID NO: 23057 - DNA, 19 bp, Artificial sequence
  synthetic polynucleotide sequence
ccctgggccagaaagagga

SEQ ID NO: 23058 - DNA, 20 bp, Artificial sequence
  synthetic polynucleotide sequence
catgtgagcactggacagca

SEQ ID NO: 23059 - DNA, 18 bp, Artificial sequence
  synthetic polynucleotide sequence
acggacgcaagtgcagga

SEQ ID NO: 23060 - DNA, 18 bp, Artificial sequence
  synthetic polynucleotide sequence
ggccagctcacgggtcca

SEQ ID NO: 23061 - DNA, 19 bp, Artificial sequence
  synthetic polynucleotide sequence
cccaagacctcgtggacca

SEQ ID NO: 23062 - DNA, 20 bp, Artificial sequence
  synthetic polynucleotide sequence
gacgtagaccctggtgcaca

SEQ ID NO: 23063 - DNA, 21 bp, Artificial sequence
  synthetic polynucleotide sequence
agcagctcacccagaagcaga

SEQ ID NO: 23064 - DNA, 20 bp, Artificial sequence
  synthetic polynucleotide sequence
ctcccaggaagtccgctcca

SEQ ID NO: 23065 - DNA, 21 bp, Artificial sequence
  synthetic polynucleotide sequence
catcaccaagcacgacctgca

SEQ ID NO: 23066 - DNA, 20 bp, Artificial sequence
  synthetic polynucleotide sequence
gaactccctggcggtgagga

SEQ ID NO: 23067 - DNA, 21 bp, Artificial sequence
  synthetic polynucleotide sequence
ggatcccctcgcacatcctca

SEQ ID NO: 23068 - DNA, 18 bp, Artificial sequence
  synthetic polynucleotide sequence
ggcctccaccacctgcga

SEQ ID NO: 23069 - DNA, 20 bp, Artificial sequence
  synthetic polynucleotide sequence
tccccagagaagagccggaa

SEQ ID NO: 23070 - DNA, 20 bp, Artificial sequence
  synthetic polynucleotide sequence
gggccaggtcattgaaccga

SEQ ID NO: 23071 - DNA, 18 bp, Artificial sequence
  synthetic polynucleotide sequence
tggacacctcctacgcca

SEQ ID NO: 23072 - DNA, 20 bp, Artificial sequence
  synthetic polynucleotide sequence
ctgttgtaggccgacaggga

SEQ ID NO: 23073 - DNA, 21 bp, Artificial sequence
  synthetic polynucleotide sequence
catgggactgggaagtcagca

SEQ ID NO: 23074 - DNA, 22 bp, Artificial sequence
  synthetic polynucleotide sequence
cccacctcctacaggataagga

SEQ ID NO: 23075 - DNA, 21 bp, Artificial sequence
  synthetic polynucleotide sequence
gtccagaagccatcactgcta

SEQ ID NO: 23076 - DNA, 18 bp, Artificial sequence
  synthetic polynucleotide sequence
cccgaagcttccgcacca

SEQ ID NO: 23077 - DNA, 21 bp, Artificial sequence
  synthetic polynucleotide sequence
caccagtctgccgacatcaca

SEQ ID NO: 23078 - DNA, 22 bp, Artificial sequence
  synthetic polynucleotide sequence
aatgtctgtccgggaatcagga

SEQ ID NO: 23079 - DNA, 21 bp, Artificial sequence
  synthetic polynucleotide sequence
tgctgaaccaccggcctgtga

SEQ ID NO: 23080 - DNA, 20 bp, Artificial sequence
  synthetic polynucleotide sequence
cctctggctctgcaggcaga

SEQ ID NO: 23081 - DNA, 20 bp, Artificial sequence
  synthetic polynucleotide sequence
gctgctgcttcccaaggaga

SEQ ID NO: 23082 - DNA, 20 bp, Artificial sequence
  synthetic polynucleotide sequence
cagccggagcagcatcctga

SEQ ID NO: 23083 - DNA, 19 bp, Artificial sequence
  synthetic polynucleotide sequence
ccagcagagtggagatgca

SEQ ID NO: 23084 - DNA, 21 bp, Artificial sequence
  synthetic polynucleotide sequence
tagagttacggtgggagcaga

SEQ ID NO: 23085 - DNA, 20 bp, Artificial sequence
  synthetic polynucleotide sequence
ctcctctgacacaaggggga

SEQ ID NO: 23086 - DNA, 21 bp, Artificial sequence
  synthetic polynucleotide sequence
gtacacagtctgagccgtcca

SEQ ID NO: 23087 - DNA, 20 bp, Artificial sequence
  synthetic polynucleotide sequence
gttctcctccggctcccaga

SEQ ID NO: 23088 - DNA, 20 bp, Artificial sequence
  synthetic polynucleotide sequence
cccataagcctgccccgtca

SEQ ID NO: 23089 - DNA, 18 bp, Artificial sequence
  synthetic polynucleotide sequence
acccacagcccctccaga

SEQ ID NO: 23090 - DNA, 19 bp, Artificial sequence
  synthetic polynucleotide sequence
ggggatgggatagccctca

SEQ ID NO: 23091 - DNA, 21 bp, Artificial sequence
  synthetic polynucleotide sequence
gtacgaggagcgagtgctgaa

SEQ ID NO: 23092 - DNA, 20 bp, Artificial sequence
  synthetic polynucleotide sequence
acatccgagtctccaggcca

SEQ ID NO: 23093 - DNA, 19 bp, Artificial sequence
  synthetic polynucleotide sequence
tggtagctcagctccgcca

SEQ ID NO: 23094 - DNA, 21 bp, Artificial sequence
  synthetic polynucleotide sequence
aagctgggcaggatgatgaga

SEQ ID NO: 23095 - DNA, 18 bp, Artificial sequence
  synthetic polynucleotide sequence
ccagcttgctcccagcaa

SEQ ID NO: 23096 - DNA, 18 bp, Artificial sequence
  synthetic polynucleotide sequence
taccacctcgctgaccga

SEQ ID NO: 23097 - DNA, 18 bp, Artificial sequence
  synthetic polynucleotide sequence
cagatcagcagcccccaa

SEQ ID NO: 23098 - DNA, 20 bp, Artificial sequence
  synthetic polynucleotide sequence
caccggtgctagaaggagga

SEQ ID NO: 23099 - DNA, 18 bp, Artificial sequence
  synthetic polynucleotide sequence
caggagcagggaagagca

SEQ ID NO: 23100 - DNA, 20 bp, Artificial sequence
  synthetic polynucleotide sequence
ccagcacaatagccgaggca

SEQ ID NO: 23101 - DNA, 22 bp, Artificial sequence
  synthetic polynucleotide sequence
gtggtgcagtggcaaagagaca

SEQ ID NO: 23102 - DNA, 21 bp, Artificial sequence
  synthetic polynucleotide sequence
tctcctgctgcaagtgaccca

SEQ ID NO: 23103 - DNA, 20 bp, Artificial sequence
  synthetic polynucleotide sequence
tgatggggctggagagtcga

SEQ ID NO: 23104 - DNA, 18 bp, Artificial sequence
  synthetic polynucleotide sequence
gcagtcccacgccgctca

SEQ ID NO: 23105 - DNA, 18 bp, Artificial sequence
  synthetic polynucleotide sequence
caccatctccacgctgga

SEQ ID NO: 23106 - DNA, 18 bp, Artificial sequence
  synthetic polynucleotide sequence
gcaggttgctcacggaga

SEQ ID NO: 23107 - DNA, 18 bp, Artificial sequence
  synthetic polynucleotide sequence
gctggctgctaagggcga

SEQ ID NO: 23108 - DNA, 19 bp, Artificial sequence
  synthetic polynucleotide sequence
gatgaagccctccagcaca

SEQ ID NO: 23109 - DNA, 20 bp, Artificial sequence
  synthetic polynucleotide sequence
atctgcacagcctgtgacga

SEQ ID NO: 23110 - DNA, 18 bp, Artificial sequence
  synthetic polynucleotide sequence
gccgcacactcgtccaca

SEQ ID NO: 23111 - DNA, 20 bp, Artificial sequence
  synthetic polynucleotide sequence
gaagcaacacgcaaacgaga

SEQ ID NO: 23112 - DNA, 18 bp, Artificial sequence
  synthetic polynucleotide sequence
tcaagcacagccacacga

SEQ ID NO: 23113 - DNA, 25 bp, Artificial sequence
  synthetic polynucleotide sequence
cacagcaacaggaaactcatggaga

SEQ ID NO: 23114 - DNA, 21 bp, Artificial sequence
  synthetic polynucleotide sequence
agagcagcgctatggtacaga

SEQ ID NO: 23115 - DNA, 21 bp, Artificial sequence
  synthetic polynucleotide sequence
cctggtagttccacaccagca

SEQ ID NO: 23116 - DNA, 18 bp, Artificial sequence
  synthetic polynucleotide sequence
ctcgcaacctgctgagga

SEQ ID NO: 23117 - DNA, 20 bp, Artificial sequence
  synthetic polynucleotide sequence
gtccgcatcctcatgaccaa

SEQ ID NO: 23118 - DNA, 21 bp, Artificial sequence
  synthetic polynucleotide sequence
gtagatgaagacgacccggga

SEQ ID NO: 23119 - DNA, 20 bp, Artificial sequence
  synthetic polynucleotide sequence
ccaaaggccaaggctctgga

SEQ ID NO: 23120 - DNA, 20 bp, Artificial sequence
  synthetic polynucleotide sequence
tgcagggacacagggacgga

SEQ ID NO: 23121 - DNA, 20 bp, Artificial sequence
  synthetic polynucleotide sequence
cagaacccctcacgcaccca

SEQ ID NO: 23122 - DNA, 21 bp, Artificial sequence
  synthetic polynucleotide sequence
cagaagggcaggactcagaga

SEQ ID NO: 23123 - DNA, 20 bp, Artificial sequence
  synthetic polynucleotide sequence
gccctgcctgaagtgcgaga

SEQ ID NO: 23124 - DNA, 21 bp, Artificial sequence
  synthetic polynucleotide sequence
cgcccaaagcctttaggccca

SEQ ID NO: 23125 - DNA, 18 bp, Artificial sequence
  synthetic polynucleotide sequence
gagcgctgcgggaagaca

SEQ ID NO: 23126 - DNA, 19 bp, Artificial sequence
  synthetic polynucleotide sequence
cccttgggtccgaagagga

SEQ ID NO: 23127 - DNA, 19 bp, Artificial sequence
  synthetic polynucleotide sequence
tggcaccgaccgtgtctga

SEQ ID NO: 23128 - DNA, 20 bp, Artificial sequence
  synthetic polynucleotide sequence
caggtagccgtagcagggga

SEQ ID NO: 23129 - DNA, 19 bp, Artificial sequence
  synthetic polynucleotide sequence
gcacacagccacaaagcca

SEQ ID NO: 23130 - DNA, 18 bp, Artificial sequence
  synthetic polynucleotide sequence
gccacactcctggaggca

SEQ ID NO: 23131 - DNA, 21 bp, Artificial sequence
  synthetic polynucleotide sequence
cgccaacaaggatcacctcga

SEQ ID NO: 23132 - DNA, 18 bp, Artificial sequence
  synthetic polynucleotide sequence
ggcaggcttcacatggga

SEQ ID NO: 23133 - DNA, 18 bp, Artificial sequence
  synthetic polynucleotide sequence
ggtgggcaaacaagtgca

SEQ ID NO: 23134 - DNA, 22 bp, Artificial sequence
  synthetic polynucleotide sequence
cagtaggcaattccacagccta

SEQ ID NO: 23135 - DNA, 19 bp, Artificial sequence
  synthetic polynucleotide sequence
gccaaagactcccaacgca

SEQ ID NO: 23136 - DNA, 20 bp, Artificial sequence
  synthetic polynucleotide sequence
tagcccaattaccagcagga

SEQ ID NO: 23137 - DNA, 21 bp, Artificial sequence
  synthetic polynucleotide sequence
catgacacccatgtccggaca

SEQ ID NO: 23138 - DNA, 21 bp, Artificial sequence
  synthetic polynucleotide sequence
ctatccaaacagccagcagga

SEQ ID NO: 23139 - DNA, 18 bp, Artificial sequence
  synthetic polynucleotide sequence
cgtgcagtccctcagcaa

SEQ ID NO: 23140 - DNA, 18 bp, Artificial sequence
  synthetic polynucleotide sequence
aacgggcacagctgagca

SEQ ID NO: 23141 - DNA, 18 bp, Artificial sequence
  synthetic polynucleotide sequence
gcgaaggcaagagaggga

SEQ ID NO: 23142 - DNA, 18 bp, Artificial sequence
  synthetic polynucleotide sequence
ggttgggcatagggccca

SEQ ID NO: 23143 - DNA, 19 bp, Artificial sequence
  synthetic polynucleotide sequence
ccacacggaaagcatggaa

SEQ ID NO: 23144 - DNA, 17 bp, Artificial sequence
  synthetic polynucleotide sequence
ccccaggagaaccggaa

SEQ ID NO: 23145 - DNA, 20 bp, Artificial sequence
  synthetic polynucleotide sequence
ccgctaccgagtggaggaca

SEQ ID NO: 23146 - DNA, 18 bp, Artificial sequence
  synthetic polynucleotide sequence
tgcagcgcacttgcacga

SEQ ID NO: 23147 - DNA, 21 bp, Artificial sequence
  synthetic polynucleotide sequence
caccaacgcctcccaaaccaa

SEQ ID NO: 23148 - DNA, 21 bp, Artificial sequence
  synthetic polynucleotide sequence
gtatctcaaagagcccgggga

SEQ ID NO: 23149 - DNA, 22 bp, Artificial sequence
  synthetic polynucleotide sequence
gatatgactctctgcagcggga

SEQ ID NO: 23150 - DNA, 21 bp, Artificial sequence
  synthetic polynucleotide sequence
tcaaacgtgacagtggaccca

SEQ ID NO: 23151 - DNA, 22 bp, Artificial sequence
  synthetic polynucleotide sequence
ccaacaccacgaacacttgcca

SEQ ID NO: 23152 - DNA, 21 bp, Artificial sequence
  synthetic polynucleotide sequence
acctgaacagtcttccggcca

SEQ ID NO: 23153 - DNA, 20 bp, Artificial sequence
  synthetic polynucleotide sequence
cacctgtaccagcgcgtcaa

SEQ ID NO: 23154 - DNA, 20 bp, Artificial sequence
  synthetic polynucleotide sequence
ctgaaggagcgggagttgca

SEQ ID NO: 23155 - DNA, 18 bp, Artificial sequence
  synthetic polynucleotide sequence
tgaggagcaagcctggca

SEQ ID NO: 23156 - DNA, 18 bp, Artificial sequence
  synthetic polynucleotide sequence
catcagggtgcacgagga

SEQ ID NO: 23157 - DNA, 21 bp, Artificial sequence
  synthetic polynucleotide sequence
ggaggggctagagaacaggga

SEQ ID NO: 23158 - DNA, 20 bp, Artificial sequence
  synthetic polynucleotide sequence
tcacacagcgccttgggtga

SEQ ID NO: 23159 - DNA, 18 bp, Artificial sequence
  synthetic polynucleotide sequence
tcaacagcacccgggaca

SEQ ID NO: 23160 - DNA, 20 bp, Artificial sequence
  synthetic polynucleotide sequence
ctgcagttccaggtcagcca

SEQ ID NO: 23161 - DNA, 20 bp, Artificial sequence
  synthetic polynucleotide sequence
gagacagctcgctctcggca

SEQ ID NO: 23162 - DNA, 20 bp, Artificial sequence
  synthetic polynucleotide sequence
ttcggaggcccccacatgca

SEQ ID NO: 23163 - DNA, 18 bp, Artificial sequence
  synthetic polynucleotide sequence
catcttggggcaggagca

SEQ ID NO: 23164 - DNA, 18 bp, Artificial sequence
  synthetic polynucleotide sequence
ggactgaagggcccgcca

SEQ ID NO: 23165 - DNA, 20 bp, Artificial sequence
  synthetic polynucleotide sequence
cacttcaggacccagcccca

SEQ ID NO: 23166 - DNA, 20 bp, Artificial sequence
  synthetic polynucleotide sequence
tcgagggcacacgaatggga

SEQ ID NO: 23167 - DNA, 21 bp, Artificial sequence
  synthetic polynucleotide sequence
gtgcctaacgtaaccctgcaa

SEQ ID NO: 23168 - DNA, 23 bp, Artificial sequence
  synthetic polynucleotide sequence
tcatggtggagcacatgagtaca

SEQ ID NO: 23169 - DNA, 18 bp, Artificial sequence
  synthetic polynucleotide sequence
gcgagggttccagggaga

SEQ ID NO: 23170 - DNA, 21 bp, Artificial sequence
  synthetic polynucleotide sequence
gagcagatagctgactgcaca

SEQ ID NO: 23171 - DNA, 19 bp, Artificial sequence
  synthetic polynucleotide sequence
gcttcgactccgacagcca

SEQ ID NO: 23172 - DNA, 18 bp, Artificial sequence
  synthetic polynucleotide sequence
ctgggtcggccagaacca

SEQ ID NO: 23173 - DNA, 22 bp, Artificial sequence
  synthetic polynucleotide sequence
tcaaccaccagaacttgaccca

SEQ ID NO: 23174 - DNA, 20 bp, Artificial sequence
  synthetic polynucleotide sequence
ggcacaggggtcactcagca

SEQ ID NO: 23175 - DNA, 20 bp, Artificial sequence
  synthetic polynucleotide sequence
atcccagctgctatgaccca

SEQ ID NO: 23176 - DNA, 18 bp, Artificial sequence
  synthetic polynucleotide sequence
gtgagagggctgacggga

SEQ ID NO: 23177 - DNA, 19 bp, Artificial sequence
  synthetic polynucleotide sequence
tcagcggcctagaccccta

SEQ ID NO: 23178 - DNA, 20 bp, Artificial sequence
  synthetic polynucleotide sequence
cctgatagggaggtggggga

SEQ ID NO: 23179 - DNA, 23 bp, Artificial sequence
  synthetic polynucleotide sequence
aaatatcccaggttgtagcagca

SEQ ID NO: 23180 - DNA, 22 bp, Artificial sequence
  synthetic polynucleotide sequence
acgtttcccaccactgagacca

SEQ ID NO: 23181 - DNA, 18 bp, Artificial sequence
  synthetic polynucleotide sequence
tcagcgtgaacgcaggca

SEQ ID NO: 23182 - DNA, 18 bp, Artificial sequence
  synthetic polynucleotide sequence
ggccgtgggtagtccaca

SEQ ID NO: 23183 - DNA, 19 bp, Artificial sequence
  synthetic polynucleotide sequence
gctaccgcctgccgtccaa

SEQ ID NO: 23184 - DNA, 18 bp, Artificial sequence
  synthetic polynucleotide sequence
cggcgtgggtggcatcca

SEQ ID NO: 23185 - DNA, 18 bp, Artificial sequence
  synthetic polynucleotide sequence
ccatccaccacccctgga

SEQ ID NO: 23186 - DNA, 18 bp, Artificial sequence
  synthetic polynucleotide sequence
ccaggcgcatctctgaga

SEQ ID NO: 23187 - DNA, 20 bp, Artificial sequence
  synthetic polynucleotide sequence
ggtggaaagtggcgcctgga

SEQ ID NO: 23188 - DNA, 21 bp, Artificial sequence
  synthetic polynucleotide sequence
gcattactcccactccaggca

SEQ ID NO: 23189 - DNA, 20 bp, Artificial sequence
  synthetic polynucleotide sequence
cagtgaacaggggtgcggca

SEQ ID NO: 23190 - DNA, 20 bp, Artificial sequence
  synthetic polynucleotide sequence
cagggggaggcagaaggaga

SEQ ID NO: 23191 - DNA, 18 bp, Artificial sequence
  synthetic polynucleotide sequence
atccagggggacgacgca

SEQ ID NO: 23192 - DNA, 18 bp, Artificial sequence
  synthetic polynucleotide sequence
tgtcacgcaggcgacgca

SEQ ID NO: 23193 - DNA, 21 bp, Artificial sequence
  synthetic polynucleotide sequence
tgaggcccatcaaagtggaca

SEQ ID NO: 23194 - DNA, 20 bp, Artificial sequence
  synthetic polynucleotide sequence
aacccacgtgccactctgca

SEQ ID NO: 23195 - DNA, 22 bp, Artificial sequence
  synthetic polynucleotide sequence
atagtggatgatgacgtgccca

SEQ ID NO: 23196 - DNA, 18 bp, Artificial sequence
  synthetic polynucleotide sequence
cccacggtagccggggaa

SEQ ID NO: 23197 - DNA, 20 bp, Artificial sequence
  synthetic polynucleotide sequence
cttcctgcggttgcccagca

SEQ ID NO: 23198 - DNA, 19 bp, Artificial sequence
  synthetic polynucleotide sequence
tccctcacaatgctccaga

SEQ ID NO: 23199 - DNA, 20 bp, Artificial sequence
  synthetic polynucleotide sequence
gaggcctggggactacagaa

SEQ ID NO: 23200 - DNA, 20 bp, Artificial sequence
  synthetic polynucleotide sequence
gacccgtctcaaagagccga

SEQ ID NO: 23201 - DNA, 21 bp, Artificial sequence
  synthetic polynucleotide sequence
ccctcaatgtgctggagggca

SEQ ID NO: 23202 - DNA, 19 bp, Artificial sequence
  synthetic polynucleotide sequence
tggcatttggagcccccca

SEQ ID NO: 23203 - DNA, 21 bp, Artificial sequence
  synthetic polynucleotide sequence
ggtcctctacgagctgcccaa

SEQ ID NO: 23204 - DNA, 22 bp, Artificial sequence
  synthetic polynucleotide sequence
tacaaatccaccactctccgca

SEQ ID NO: 23205 - DNA, 19 bp, Artificial sequence
  synthetic polynucleotide sequence
tcacagggcagaagctgga

SEQ ID NO: 23206 - DNA, 18 bp, Artificial sequence
  synthetic polynucleotide sequence
caggccgacaggagccca

SEQ ID NO: 23207 - DNA, 19 bp, Artificial sequence
  synthetic polynucleotide sequence
ggcctcaacgaccgcctca

SEQ ID NO: 23208 - DNA, 22 bp, Artificial sequence
  synthetic polynucleotide sequence
aaaatccagacaccctccagca

SEQ ID NO: 23209 - DNA, 21 bp, Artificial sequence
  synthetic polynucleotide sequence
tcatgtcagaagggttgggca

SEQ ID NO: 23210 - DNA, 22 bp, Artificial sequence
  synthetic polynucleotide sequence
tcatcagggaccttcatgcaca

SEQ ID NO: 23211 - DNA, 21 bp, Artificial sequence
  synthetic polynucleotide sequence
agaggatgcactgaccaccaa

SEQ ID NO: 23212 - DNA, 22 bp, Artificial sequence
  synthetic polynucleotide sequence
acatttccatccatgaccgcca

SEQ ID NO: 23213 - DNA, 18 bp, Artificial sequence
  synthetic polynucleotide sequence
aaggagctgccatcggca

SEQ ID NO: 23214 - DNA, 18 bp, Artificial sequence
  synthetic polynucleotide sequence
cacttgccccatgaacca

SEQ ID NO: 23215 - DNA, 20 bp, Artificial sequence
  synthetic polynucleotide sequence
acctcccatagcccgagtga

SEQ ID NO: 23216 - DNA, 21 bp, Artificial sequence
  synthetic polynucleotide sequence
acccagtggcctccaacacca

SEQ ID NO: 23217 - DNA, 18 bp, Artificial sequence
  synthetic polynucleotide sequence
gcagcggtattggggcca

SEQ ID NO: 23218 - DNA, 20 bp, Artificial sequence
  synthetic polynucleotide sequence
aaggacaggtaagggtcgga

SEQ ID NO: 23219 - DNA, 18 bp, Artificial sequence
  synthetic polynucleotide sequence
ggagcgcatggtgaagga

SEQ ID NO: 23220 - DNA, 18 bp, Artificial sequence
  synthetic polynucleotide sequence
tggccacaaccacacgga

SEQ ID NO: 23221 - DNA, 19 bp, Artificial sequence
  synthetic polynucleotide sequence
ggccaacactatccagcca

SEQ ID NO: 23222 - DNA, 19 bp, Artificial sequence
  synthetic polynucleotide sequence
cccaaggaagcactggaga

SEQ ID NO: 23223 - DNA, 21 bp, Artificial sequence
  synthetic polynucleotide sequence
tgtgtctgacatcgaggggga

SEQ ID NO: 23224 - DNA, 18 bp, Artificial sequence
  synthetic polynucleotide sequence
gtgtggggggccagctga

SEQ ID NO: 23225 - DNA, 20 bp, Artificial sequence
  synthetic polynucleotide sequence
tagaacgcggttcaaacaca

SEQ ID NO: 23226 - DNA, 20 bp, Artificial sequence
  synthetic polynucleotide sequence
gtcaactgattcaggaggca

SEQ ID NO: 23227 - DNA, 18 bp, Artificial sequence
  synthetic polynucleotide sequence
ggagcaccagggatcgga

SEQ ID NO: 23228 - DNA, 20 bp, Artificial sequence
  synthetic polynucleotide sequence
ccagcaagaccaggatgaca

SEQ ID NO: 23229 - DNA, 20 bp, Artificial sequence
  synthetic polynucleotide sequence
gaaacccaggaggctggaga

SEQ ID NO: 23230 - DNA, 18 bp, Artificial sequence
  synthetic polynucleotide sequence
catcccagacctgcagca

SEQ ID NO: 23231 - DNA, 19 bp, Artificial sequence
  synthetic polynucleotide sequence
gagccgacctgcctacaga

SEQ ID NO: 23232 - DNA, 18 bp, Artificial sequence
  synthetic polynucleotide sequence
ttccggggttggagggca

SEQ ID NO: 23233 - DNA, 20 bp, Artificial sequence
  synthetic polynucleotide sequence
gagctcctggagtgaagcca

SEQ ID NO: 23234 - DNA, 18 bp, Artificial sequence
  synthetic polynucleotide sequence
gccgaggacgatgccaca

SEQ ID NO: 23235 - DNA, 18 bp, Artificial sequence
  synthetic polynucleotide sequence
tccagaacgcccacagca

SEQ ID NO: 23236 - DNA, 18 bp, Artificial sequence
  synthetic polynucleotide sequence
cacagaagcggagggcca

SEQ ID NO: 23237 - DNA, 20 bp, Artificial sequence
  synthetic polynucleotide sequence
cccaccttggacacactgca

SEQ ID NO: 23238 - DNA, 18 bp, Artificial sequence
  synthetic polynucleotide sequence
cgcggtacgacacctcca

SEQ ID NO: 23239 - DNA, 18 bp, Artificial sequence
  synthetic polynucleotide sequence
cacgccacccatcaccaa

SEQ ID NO: 23240 - DNA, 18 bp, Artificial sequence
  synthetic polynucleotide sequence
accagagtggggaggcca

SEQ ID NO: 23241 - DNA, 18 bp, Artificial sequence
  synthetic polynucleotide sequence
gactggccttacccgcca

SEQ ID NO: 23242 - DNA, 19 bp, Artificial sequence
  synthetic polynucleotide sequence
ggccgtgtaaggacggtga

SEQ ID NO: 23243 - DNA, 21 bp, Artificial sequence
  synthetic polynucleotide sequence
tgagaagatgcggtcactgca

SEQ ID NO: 23244 - DNA, 20 bp, Artificial sequence
  synthetic polynucleotide sequence
cttcaggatggcgagtgaga

SEQ ID NO: 23245 - DNA, 20 bp, Artificial sequence
  synthetic polynucleotide sequence
tgggcagatcctcaagcaga

SEQ ID NO: 23246 - DNA, 21 bp, Artificial sequence
  synthetic polynucleotide sequence
gaagcagtagagcagcccgta

SEQ ID NO: 23247 - DNA, 19 bp, Artificial sequence
  synthetic polynucleotide sequence
tgaccacgctatgctccaa

SEQ ID NO: 23248 - DNA, 18 bp, Artificial sequence
  synthetic polynucleotide sequence
gctccagccacgactcga

SEQ ID NO: 23249 - DNA, 18 bp, Artificial sequence
  synthetic polynucleotide sequence
cgtggccaaggtcagcga

SEQ ID NO: 23250 - DNA, 18 bp, Artificial sequence
  synthetic polynucleotide sequence
ccttctccacccgaggga

SEQ ID NO: 23251 - DNA, 20 bp, Artificial sequence
  synthetic polynucleotide sequence
cggcacacgcggatgtgaga

SEQ ID NO: 23252 - DNA, 20 bp, Artificial sequence
  synthetic polynucleotide sequence
gtgctcagatccccctgcga

SEQ ID NO: 23253 - DNA, 20 bp, Artificial sequence
  synthetic polynucleotide sequence
aagttctccccagccacaca

SEQ ID NO: 23254 - DNA, 19 bp, Artificial sequence
  synthetic polynucleotide sequence
gccctccaggaagaagcca

SEQ ID NO: 23255 - DNA, 18 bp, Artificial sequence
  synthetic polynucleotide sequence
cgcaaaggggaaagccga

SEQ ID NO: 23256 - DNA, 18 bp, Artificial sequence
  synthetic polynucleotide sequence
gcggccacatttagcgca

SEQ ID NO: 23257 - DNA, 20 bp, Artificial sequence
  synthetic polynucleotide sequence
ctttccagcagctcaaccaa

SEQ ID NO: 23258 - DNA, 21 bp, Artificial sequence
  synthetic polynucleotide sequence
catgagcagtgggattggaga

SEQ ID NO: 23259 - DNA, 19 bp, Artificial sequence
  synthetic polynucleotide sequence
cagcaggtccctcagccta

SEQ ID NO: 23260 - DNA, 19 bp, Artificial sequence
  synthetic polynucleotide sequence
ctctgagggtagggcacca

SEQ ID NO: 23261 - DNA, 21 bp, Artificial sequence
  synthetic polynucleotide sequence
gtagttaggccacatgcccaa

SEQ ID NO: 23262 - DNA, 20 bp, Artificial sequence
  synthetic polynucleotide sequence
ggtttgggcgacgtaccaca

SEQ ID NO: 23263 - DNA, 19 bp, Artificial sequence
  synthetic polynucleotide sequence
tctgggacctagcctcgaa

SEQ ID NO: 23264 - DNA, 20 bp, Artificial sequence
  synthetic polynucleotide sequence
acagtgacgcccaataccca

SEQ ID NO: 23265 - DNA, 21 bp, Artificial sequence
  synthetic polynucleotide sequence
ggacgtagcagtgaagctgga

SEQ ID NO: 23266 - DNA, 20 bp, Artificial sequence
  synthetic polynucleotide sequence
gctgggtcccagaaggtcca

SEQ ID NO: 23267 - DNA, 20 bp, Artificial sequence
  synthetic polynucleotide sequence
gtctccggcatggagagaga

SEQ ID NO: 23268 - DNA, 19 bp, Artificial sequence
  synthetic polynucleotide sequence
gtgaggtggacatgcgaga

SEQ ID NO: 23269 - DNA, 21 bp, Artificial sequence
  synthetic polynucleotide sequence
gcggtttgacgacaagcccga

SEQ ID NO: 23270 - DNA, 18 bp, Artificial sequence
  synthetic polynucleotide sequence
acccccgtagctgcccca

SEQ ID NO: 23271 - DNA, 22 bp, Artificial sequence
  synthetic polynucleotide sequence
gcaaggactcaaggctgacaca

SEQ ID NO: 23272 - DNA, 22 bp, Artificial sequence
  synthetic polynucleotide sequence
tcaaagaagtccagtcgcctga

SEQ ID NO: 23273 - DNA, 21 bp, Artificial sequence
  synthetic polynucleotide sequence
ccagccgcacagcaaaaacca

SEQ ID NO: 23274 - DNA, 19 bp, Artificial sequence
  synthetic polynucleotide sequence
ggccacctccacctctgca

SEQ ID NO: 23275 - DNA, 21 bp, Artificial sequence
  synthetic polynucleotide sequence
atacaaaacgggctacaccaa

SEQ ID NO: 23276 - DNA, 19 bp, Artificial sequence
  synthetic polynucleotide sequence
ctgaactgcacccactgga

SEQ ID NO: 23277 - DNA, 19 bp, Artificial sequence
  synthetic polynucleotide sequence
gtgaaggaccaggctcgaa

SEQ ID NO: 23278 - DNA, 18 bp, Artificial sequence
  synthetic polynucleotide sequence
atcccaagggggttggca

SEQ ID NO: 23279 - DNA, 20 bp, Artificial sequence
  synthetic polynucleotide sequence
ggaccagagctcctcgtgga

SEQ ID NO: 23280 - DNA, 21 bp, Artificial sequence
  synthetic polynucleotide sequence
ccagaaccttggcaatgcgaa

SEQ ID NO: 23281 - DNA, 22 bp, Artificial sequence
  synthetic polynucleotide sequence
tgcacagagatgtcaagcccca

SEQ ID NO: 23282 - DNA, 22 bp, Artificial sequence
  synthetic polynucleotide sequence
aagtatcgggaagcaactcgga

SEQ ID NO: 23283 - DNA, 21 bp, Artificial sequence
  synthetic polynucleotide sequence
cagacatcccaggtgaagcca

SEQ ID NO: 23284 - DNA, 20 bp, Artificial sequence
  synthetic polynucleotide sequence
cagtgccgaagtaggcgcca

SEQ ID NO: 23285 - DNA, 20 bp, Artificial sequence
  synthetic polynucleotide sequence
agtacgaggtccagcgggca

SEQ ID NO: 23286 - DNA, 20 bp, Artificial sequence
  synthetic polynucleotide sequence
cgaaggccagccgccctgaa

SEQ ID NO: 23287 - DNA, 21 bp, Artificial sequence
  synthetic polynucleotide sequence
ctgcgagtccatcatcaccga

SEQ ID NO: 23288 - DNA, 20 bp, Artificial sequence
  synthetic polynucleotide sequence
gagctcagatggggtccgga

SEQ ID NO: 23289 - DNA, 20 bp, Artificial sequence
  synthetic polynucleotide sequence
gctccgtgcagaagaggaga

SEQ ID NO: 23290 - DNA, 19 bp, Artificial sequence
  synthetic polynucleotide sequence
gacaggagcttgcaaccga

SEQ ID NO: 23291 - DNA, 20 bp, Artificial sequence
  synthetic polynucleotide sequence
gcctggacaacatcgaggca

SEQ ID NO: 23292 - DNA, 20 bp, Artificial sequence
  synthetic polynucleotide sequence
tcggcggctggctcggagaa

SEQ ID NO: 23293 - DNA, 20 bp, Artificial sequence
  synthetic polynucleotide sequence
cacctgcagagtgcagagga

SEQ ID NO: 23294 - DNA, 18 bp, Artificial sequence
  synthetic polynucleotide sequence
ggcacagctcttcgggga

SEQ ID NO: 23295 - DNA, 22 bp, Artificial sequence
  synthetic polynucleotide sequence
atacttgaaaggcccctcccaa

SEQ ID NO: 23296 - DNA, 21 bp, Artificial sequence
  synthetic polynucleotide sequence
gactgtctcaaccacgggtga

SEQ ID NO: 23297 - DNA, 20 bp, Artificial sequence
  synthetic polynucleotide sequence
gaggttcagtgcgaaggcaa

SEQ ID NO: 23298 - DNA, 19 bp, Artificial sequence
  synthetic polynucleotide sequence
tgccgtagcaggacttgca

SEQ ID NO: 23299 - DNA, 18 bp, Artificial sequence
  synthetic polynucleotide sequence
ccacgcagaagaggtgca

SEQ ID NO: 23300 - DNA, 18 bp, Artificial sequence
  synthetic polynucleotide sequence
gccctggccataaccgta

SEQ ID NO: 23301 - DNA, 18 bp, Artificial sequence
  synthetic polynucleotide sequence
cagtccccaaagccggca

SEQ ID NO: 23302 - DNA, 18 bp, Artificial sequence
  synthetic polynucleotide sequence
cacagatggcacagcgga

SEQ ID NO: 23303 - DNA, 22 bp, Artificial sequence
  synthetic polynucleotide sequence
gataggataatcccgggtggca

SEQ ID NO: 23304 - DNA, 21 bp, Artificial sequence
  synthetic polynucleotide sequence
gctcttagtacccgcagcgga

SEQ ID NO: 23305 - DNA, 21 bp, Artificial sequence
  synthetic polynucleotide sequence
cctcccctaccaagcaaggaa

SEQ ID NO: 23306 - DNA, 21 bp, Artificial sequence
  synthetic polynucleotide sequence
taaggactcggaagatcctga

SEQ ID NO: 23307 - DNA, 21 bp, Artificial sequence
  synthetic polynucleotide sequence
tgggccgaaccatatgtacca

SEQ ID NO: 23308 - DNA, 19 bp, Artificial sequence
  synthetic polynucleotide sequence
tgacacctggaattcacca

SEQ ID NO: 23309 - DNA, 18 bp, Artificial sequence
  synthetic polynucleotide sequence
acgtggagctgggccgaa

SEQ ID NO: 23310 - DNA, 18 bp, Artificial sequence
  synthetic polynucleotide sequence
ctggtcatggaaggggca

SEQ ID NO: 23311 - DNA, 21 bp, Artificial sequence
  synthetic polynucleotide sequence
cgagtacaacaaggccaccga

SEQ ID NO: 23312 - DNA, 20 bp, Artificial sequence
  synthetic polynucleotide sequence
ggtacatatggtgcggccca

SEQ ID NO: 23313 - DNA, 21 bp, Artificial sequence
  synthetic polynucleotide sequence
gcatccatgccacagacctca

SEQ ID NO: 23314 - DNA, 20 bp, Artificial sequence
  synthetic polynucleotide sequence
gtaggcagccatcacctgca

SEQ ID NO: 23315 - DNA, 18 bp, Artificial sequence
  synthetic polynucleotide sequence
gcacatcatcaaggcgca

SEQ ID NO: 23316 - DNA, 19 bp, Artificial sequence
  synthetic polynucleotide sequence
gggcaagtggtgaggtcga

SEQ ID NO: 23317 - DNA, 22 bp, Artificial sequence
  synthetic polynucleotide sequence
accaaccacaccttgaagcaga

SEQ ID NO: 23318 - DNA, 19 bp, Artificial sequence
  synthetic polynucleotide sequence
cggagaacaggcacctcga

SEQ ID NO: 23319 - DNA, 20 bp, Artificial sequence
  synthetic polynucleotide sequence
tgcccgcagcgattgcagaa

SEQ ID NO: 23320 - DNA, 25 bp, Artificial sequence
  synthetic polynucleotide sequence
gaagtgctcctaccaaaaagctgca

SEQ ID NO: 23321 - DNA, 21 bp, Artificial sequence
  synthetic polynucleotide sequence
aggaaggctatgccctgggca

SEQ ID NO: 23322 - DNA, 21 bp, Artificial sequence
  synthetic polynucleotide sequence
acgcgcaacagcctgtaggca

SEQ ID NO: 23323 - DNA, 19 bp, Artificial sequence
  synthetic polynucleotide sequence
gcctacagactggggcaca

SEQ ID NO: 23324 - DNA, 19 bp, Artificial sequence
  synthetic polynucleotide sequence
ctccccagcagtagctcca

SEQ ID NO: 23325 - DNA, 20 bp, Artificial sequence
  synthetic polynucleotide sequence
cttcccggacaaaatgagga

SEQ ID NO: 23326 - DNA, 22 bp, Artificial sequence
  synthetic polynucleotide sequence
gtagccagttgaaggaatcaga

SEQ ID NO: 23327 - DNA, 18 bp, Artificial sequence
  synthetic polynucleotide sequence
acatcgccgaccaggtga

SEQ ID NO: 23328 - DNA, 18 bp, Artificial sequence
  synthetic polynucleotide sequence
cctcgtcgccgacgtgca

SEQ ID NO: 23329 - DNA, 21 bp, Artificial sequence
  synthetic polynucleotide sequence
acacagagaggatgttggcca

SEQ ID NO: 23330 - DNA, 21 bp, Artificial sequence
  synthetic polynucleotide sequence
tgttgggtggaaagcaaggca

SEQ ID NO: 23331 - DNA, 18 bp, Artificial sequence
  synthetic polynucleotide sequence
atgatccacggggaggca

SEQ ID NO: 23332 - DNA, 18 bp, Artificial sequence
  synthetic polynucleotide sequence
ggctctcatggccaggga

SEQ ID NO: 23333 - DNA, 21 bp, Artificial sequence
  synthetic polynucleotide sequence
caaatgacccacgtggaggga

SEQ ID NO: 23334 - DNA, 20 bp, Artificial sequence
  synthetic polynucleotide sequence
ggccacgagtgtcatgacca

SEQ ID NO: 23335 - DNA, 19 bp, Artificial sequence
  synthetic polynucleotide sequence
ccacggagcaggcagctga

SEQ ID NO: 23336 - DNA, 21 bp, Artificial sequence
  synthetic polynucleotide sequence
agaatctgccagaactgggga

SEQ ID NO: 23337 - DNA, 21 bp, Artificial sequence
  synthetic polynucleotide sequence
ttcctgccccctgcaaagcaa

SEQ ID NO: 23338 - DNA, 20 bp, Artificial sequence
  synthetic polynucleotide sequence
gcccacatgctcggcctcca

SEQ ID NO: 23339 - DNA, 20 bp, Artificial sequence
  synthetic polynucleotide sequence
ctctgccatgtccaaagcaa

SEQ ID NO: 23340 - DNA, 20 bp, Artificial sequence
  synthetic polynucleotide sequence
ctcccacaggtgcattgcta

SEQ ID NO: 23341 - DNA, 21 bp, Artificial sequence
  synthetic polynucleotide sequence
gccgcagatgagaaaccccca

SEQ ID NO: 23342 - DNA, 19 bp, Artificial sequence
  synthetic polynucleotide sequence
gtgacttcctcgggggcca

SEQ ID NO: 23343 - DNA, 22 bp, Artificial sequence
  synthetic polynucleotide sequence
caaggtgacacccagttgacaa

SEQ ID NO: 23344 - DNA, 20 bp, Artificial sequence
  synthetic polynucleotide sequence
tagaggcacgttgccagtca

SEQ ID NO: 23345 - DNA, 21 bp, Artificial sequence
  synthetic polynucleotide sequence
gcctacagccacacccacaga

SEQ ID NO: 23346 - DNA, 21 bp, Artificial sequence
  synthetic polynucleotide sequence
tcaagtagagagtcagcccca

SEQ ID NO: 23347 - DNA, 23 bp, Artificial sequence
  synthetic polynucleotide sequence
gctttcagagaaacactggcgaa

SEQ ID NO: 23348 - DNA, 22 bp, Artificial sequence
  synthetic polynucleotide sequence
agagaggtcgtagactgcaaga

SEQ ID NO: 23349 - DNA, 20 bp, Artificial sequence
  synthetic polynucleotide sequence
tcagcctccctcagggcaga

SEQ ID NO: 23350 - DNA, 22 bp, Artificial sequence
  synthetic polynucleotide sequence
gacaaacaatcaggcccccaca

SEQ ID NO: 23351 - DNA, 20 bp, Artificial sequence
  synthetic polynucleotide sequence
gcagaccaccgccaactgca

SEQ ID NO: 23352 - DNA, 21 bp, Artificial sequence
  synthetic polynucleotide sequence
gctgagccaaaaacacgggca

SEQ ID NO: 23353 - DNA, 21 bp, Artificial sequence
  synthetic polynucleotide sequence
accaggggcggttctgaagga

SEQ ID NO: 23354 - DNA, 22 bp, Artificial sequence
  synthetic polynucleotide sequence
atcaacagggaaagctgctgga

SEQ ID NO: 23355 - DNA, 19 bp, Artificial sequence
  synthetic polynucleotide sequence
gctccagaggcccagggaa

SEQ ID NO: 23356 - DNA, 19 bp, Artificial sequence
  synthetic polynucleotide sequence
gggcccagcgtcagaagga

SEQ ID NO: 23357 - DNA, 21 bp, Artificial sequence
  synthetic polynucleotide sequence
tctggatcagcagaacccaga

SEQ ID NO: 23358 - DNA, 21 bp, Artificial sequence
  synthetic polynucleotide sequence
ctgactggagcaagaggtgga

SEQ ID NO: 23359 - DNA, 21 bp, Artificial sequence
  synthetic polynucleotide sequence
tctggaccagcagaacccaga

SEQ ID NO: 23360 - DNA, 22 bp, Artificial sequence
  synthetic polynucleotide sequence
caatggaccgctgattggagca

SEQ ID NO: 23361 - DNA, 21 bp, Artificial sequence
  synthetic polynucleotide sequence
tctggaccagcagaactcaga

SEQ ID NO: 23362 - DNA, 19 bp, Artificial sequence
  synthetic polynucleotide sequence
tggagcaagaggtggagga

SEQ ID NO: 23363 - DNA, 21 bp, Artificial sequence
  synthetic polynucleotide sequence
tctggaccagcagaacccaga

SEQ ID NO: 23364 - DNA, 21 bp, Artificial sequence
  synthetic polynucleotide sequence
ctgactggagcaagaggtgga

SEQ ID NO: 23365 - DNA, 18 bp, Artificial sequence
  synthetic polynucleotide sequence
gggagatccgcagagcca

SEQ ID NO: 23366 - DNA, 19 bp, Artificial sequence
  synthetic polynucleotide sequence
ccttccacagcagctggga

SEQ ID NO: 23367 - DNA, 18 bp, Artificial sequence
  synthetic polynucleotide sequence
ggcaggatacgaggggca

SEQ ID NO: 23368 - DNA, 21 bp, Artificial sequence
  synthetic polynucleotide sequence
ctgtaccaggcagtgtgagga

SEQ ID NO: 23369 - DNA, 18 bp, Artificial sequence
  synthetic polynucleotide sequence
tgacgctgcaggacgtca

SEQ ID NO: 23370 - DNA, 18 bp, Artificial sequence
  synthetic polynucleotide sequence
acatgccaatgccccgta

SEQ ID NO: 23371 - DNA, 19 bp, Artificial sequence
  synthetic polynucleotide sequence
cctggccccgctacaccaa

SEQ ID NO: 23372 - DNA, 20 bp, Artificial sequence
  synthetic polynucleotide sequence
agcaggtcggtcagtgagga

SEQ ID NO: 23373 - DNA, 18 bp, Artificial sequence
  synthetic polynucleotide sequence
agtgcccagactgcgaca

SEQ ID NO: 23374 - DNA, 20 bp, Artificial sequence
  synthetic polynucleotide sequence
tacactggcgtaatcgcaca

SEQ ID NO: 23375 - DNA, 22 bp, Artificial sequence
  synthetic polynucleotide sequence
aacacggcgaaaatgtccccaa

SEQ ID NO: 23376 - DNA, 21 bp, Artificial sequence
  synthetic polynucleotide sequence
agctctgcagcgctgtaagca

SEQ ID NO: 23377 - DNA, 21 bp, Artificial sequence
  synthetic polynucleotide sequence
ggagccatccagacaatgcca

SEQ ID NO: 23378 - DNA, 22 bp, Artificial sequence
  synthetic polynucleotide sequence
cgaacatcagcggtgaacctga

SEQ ID NO: 23379 - DNA, 21 bp, Artificial sequence
  synthetic polynucleotide sequence
ttggagaaggcagcgacgaca

SEQ ID NO: 23380 - DNA, 18 bp, Artificial sequence
  synthetic polynucleotide sequence
tggacgcaggtgccccga

SEQ ID NO: 23381 - DNA, 21 bp, Artificial sequence
  synthetic polynucleotide sequence
ccgggggaactacgtgaagga

SEQ ID NO: 23382 - DNA, 21 bp, Artificial sequence
  synthetic polynucleotide sequence
actgagtacacgtcgtccaca

SEQ ID NO: 23383 - DNA, 21 bp, Artificial sequence
  synthetic polynucleotide sequence
gattgaggggaccactcacca

SEQ ID NO: 23384 - DNA, 20 bp, Artificial sequence
  synthetic polynucleotide sequence
cttggccaggctggcagtga

SEQ ID NO: 23385 - DNA, 19 bp, Artificial sequence
  synthetic polynucleotide sequence
tcctccagaggatggggca

SEQ ID NO: 23386 - DNA, 22 bp, Artificial sequence
  synthetic polynucleotide sequence
ggaagatgtatgaggcagggga

SEQ ID NO: 23387 - DNA, 21 bp, Artificial sequence
  synthetic polynucleotide sequence
atcccaccccttacagcacca

SEQ ID NO: 23388 - DNA, 20 bp, Artificial sequence
  synthetic polynucleotide sequence
cttctgtcagtggcgggaca

SEQ ID NO: 23389 - DNA, 18 bp, Artificial sequence
  synthetic polynucleotide sequence
tccccacttggaggccaa

SEQ ID NO: 23390 - DNA, 18 bp, Artificial sequence
  synthetic polynucleotide sequence
agaagctgggcagcccga

SEQ ID NO: 23391 - DNA, 21 bp, Artificial sequence
  synthetic polynucleotide sequence
acacgtttggcccagacccaa

SEQ ID NO: 23392 - DNA, 21 bp, Artificial sequence
  synthetic polynucleotide sequence
cattggtaacccgggtggaga

SEQ ID NO: 23393 - DNA, 18 bp, Artificial sequence
  synthetic polynucleotide sequence
gccgagagcttgggagga

SEQ ID NO: 23394 - DNA, 21 bp, Artificial sequence
  synthetic polynucleotide sequence
ctcatcctctaagcccacaga

SEQ ID NO: 23395 - DNA, 21 bp, Artificial sequence
  synthetic polynucleotide sequence
ttggaccaaggaagccctgaa

SEQ ID NO: 23396 - DNA, 22 bp, Artificial sequence
  synthetic polynucleotide sequence
ccaacccagatagcaacatcca

SEQ ID NO: 23397 - DNA, 20 bp, Artificial sequence
  synthetic polynucleotide sequence
gacttcacggtgcgcgagga

SEQ ID NO: 23398 - DNA, 22 bp, Artificial sequence
  synthetic polynucleotide sequence
catagagcagcaaaggacagca

SEQ ID NO: 23399 - DNA, 20 bp, Artificial sequence
  synthetic polynucleotide sequence
gctgaacctggctaccagga

SEQ ID NO: 23400 - DNA, 17 bp, Artificial sequence
  synthetic polynucleotide sequence
gctgtcagcctgccgaa

SEQ ID NO: 23401 - DNA, 21 bp, Artificial sequence
  synthetic polynucleotide sequence
aggtcaaggccgaggtgcaga

SEQ ID NO: 23402 - DNA, 21 bp, Artificial sequence
  synthetic polynucleotide sequence
ttcactgtctgcaccacagca

SEQ ID NO: 23403 - DNA, 18 bp, Artificial sequence
  synthetic polynucleotide sequence
atgggacgacagcggcaa

SEQ ID NO: 23404 - DNA, 21 bp, Artificial sequence
  synthetic polynucleotide sequence
aatcaggacactgatcagcca

SEQ ID NO: 23405 - DNA, 19 bp, Artificial sequence
  synthetic polynucleotide sequence
ccagaacctcaggcagcaa

SEQ ID NO: 23406 - DNA, 19 bp, Artificial sequence
  synthetic polynucleotide sequence
catgaagaatccgccagca

SEQ ID NO: 23407 - DNA, 20 bp, Artificial sequence
  synthetic polynucleotide sequence
tagaggagaggggccactga

SEQ ID NO: 23408 - DNA, 21 bp, Artificial sequence
  synthetic polynucleotide sequence
tggagctggtggcatagagga

SEQ ID NO: 23409 - DNA, 18 bp, Artificial sequence
  synthetic polynucleotide sequence
cgggatgttcacaaccga

SEQ ID NO: 23410 - DNA, 18 bp, Artificial sequence
  synthetic polynucleotide sequence
tcacagaggacccctgca

SEQ ID NO: 23411 - DNA, 21 bp, Artificial sequence
  synthetic polynucleotide sequence
ctcatgctgcggaagatggga

SEQ ID NO: 23412 - DNA, 20 bp, Artificial sequence
  synthetic polynucleotide sequence
tctgcaccctggtcgatgga

SEQ ID NO: 23413 - DNA, 20 bp, Artificial sequence
  synthetic polynucleotide sequence
tgcaatgcaggtggcggaca

SEQ ID NO: 23414 - DNA, 20 bp, Artificial sequence
  synthetic polynucleotide sequence
atccaggcgccggaggtaga

SEQ ID NO: 23415 - DNA, 17 bp, Artificial sequence
  synthetic polynucleotide sequence
gcggaagctcaagggca

SEQ ID NO: 23416 - DNA, 18 bp, Artificial sequence
  synthetic polynucleotide sequence
acaagggcaggcacacca

SEQ ID NO: 23417 - DNA, 19 bp, Artificial sequence
  synthetic polynucleotide sequence
cccacaggagcccagcaga

SEQ ID NO: 23418 - DNA, 20 bp, Artificial sequence
  synthetic polynucleotide sequence
gccggtggacttgagaccca

SEQ ID NO: 23419 - DNA, 20 bp, Artificial sequence
  synthetic polynucleotide sequence
gagggctggagcattggcaa

SEQ ID NO: 23420 - DNA, 21 bp, Artificial sequence
  synthetic polynucleotide sequence
gtctccgaagatcagcgtcca

SEQ ID NO: 23421 - DNA, 18 bp, Artificial sequence
  synthetic polynucleotide sequence
cccgtgcgctaccacgaa

SEQ ID NO: 23422 - DNA, 21 bp, Artificial sequence
  synthetic polynucleotide sequence
tgccaactgcatccctaagca

SEQ ID NO: 23423 - DNA, 20 bp, Artificial sequence
  synthetic polynucleotide sequence
caagccaaggtgccggtgga

SEQ ID NO: 23424 - DNA, 21 bp, Artificial sequence
  synthetic polynucleotide sequence
gagacaggcctaaacccctca

SEQ ID NO: 23425 - DNA, 21 bp, Artificial sequence
  synthetic polynucleotide sequence
tcagggagaagccactcagga

SEQ ID NO: 23426 - DNA, 19 bp, Artificial sequence
  synthetic polynucleotide sequence
ttccagagccttggccaga

SEQ ID NO: 23427 - DNA, 21 bp, Artificial sequence
  synthetic polynucleotide sequence
gcaggaggatcaccgacgtga

SEQ ID NO: 23428 - DNA, 19 bp, Artificial sequence
  synthetic polynucleotide sequence
caccagggtccaggctcca

SEQ ID NO: 23429 - DNA, 21 bp, Artificial sequence
  synthetic polynucleotide sequence
gcaggaggatcaccgacgtga

SEQ ID NO: 23430 - DNA, 20 bp, Artificial sequence
  synthetic polynucleotide sequence
acaatgcccaccagggtcca

SEQ ID NO: 23431 - DNA, 18 bp, Artificial sequence
  synthetic polynucleotide sequence
cctcagtggcgtgggcaa

SEQ ID NO: 23432 - DNA, 18 bp, Artificial sequence
  synthetic polynucleotide sequence
acctgcgccacctgcaca

SEQ ID NO: 23433 - DNA, 20 bp, Artificial sequence
  synthetic polynucleotide sequence
tccctcaaccagaagatgga

SEQ ID NO: 23434 - DNA, 20 bp, Artificial sequence
  synthetic polynucleotide sequence
gggagaacatggtgaaggca

SEQ ID NO: 23435 - DNA, 19 bp, Artificial sequence
  synthetic polynucleotide sequence
cggatctgcatccacacca

SEQ ID NO: 23436 - DNA, 21 bp, Artificial sequence
  synthetic polynucleotide sequence
caagcttcagcaggatagcca

SEQ ID NO: 23437 - DNA, 23 bp, Artificial sequence
  synthetic polynucleotide sequence
tctaccaccacactggtctaaga

SEQ ID NO: 23438 - DNA, 18 bp, Artificial sequence
  synthetic polynucleotide sequence
cggatccggaagtagcca

SEQ ID NO: 23439 - DNA, 20 bp, Artificial sequence
  synthetic polynucleotide sequence
gtgaggccattgtggacaca

SEQ ID NO: 23440 - DNA, 18 bp, Artificial sequence
  synthetic polynucleotide sequence
cgccctgaatcagcggca

SEQ ID NO: 23441 - DNA, 18 bp, Artificial sequence
  synthetic polynucleotide sequence
aaccgtggttggccagca

SEQ ID NO: 23442 - DNA, 18 bp, Artificial sequence
  synthetic polynucleotide sequence
acatcggcaagtccacca

SEQ ID NO: 23443 - DNA, 18 bp, Artificial sequence
  synthetic polynucleotide sequence
gcctggctggccaagaga

SEQ ID NO: 23444 - DNA, 18 bp, Artificial sequence
  synthetic polynucleotide sequence
cccacaagcaacaccgca

SEQ ID NO: 23445 - DNA, 18 bp, Artificial sequence
  synthetic polynucleotide sequence
gcaggggagatcatcgga

SEQ ID NO: 23446 - DNA, 18 bp, Artificial sequence
  synthetic polynucleotide sequence
cgcaccaggaaccctcca

SEQ ID NO: 23447 - DNA, 21 bp, Artificial sequence
  synthetic polynucleotide sequence
accttccgtggactggcggaa

SEQ ID NO: 23448 - DNA, 20 bp, Artificial sequence
  synthetic polynucleotide sequence
gatggcgatcgcagactcca

SEQ ID NO: 23449 - DNA, 18 bp, Artificial sequence
  synthetic polynucleotide sequence
aacccaacaggcaaggca

SEQ ID NO: 23450 - DNA, 18 bp, Artificial sequence
  synthetic polynucleotide sequence
ggcttgcatcaatggcca

SEQ ID NO: 23451 - DNA, 20 bp, Artificial sequence
  synthetic polynucleotide sequence
taagcaggagaaggccctga

SEQ ID NO: 23452 - DNA, 20 bp, Artificial sequence
  synthetic polynucleotide sequence
aaatccgtagccaaccacca

SEQ ID NO: 23453 - DNA, 19 bp, Artificial sequence
  synthetic polynucleotide sequence
ttgactggagggacaagca

SEQ ID NO: 23454 - DNA, 18 bp, Artificial sequence
  synthetic polynucleotide sequence
ctgcccccaccacgctga

SEQ ID NO: 23455 - DNA, 19 bp, Artificial sequence
  synthetic polynucleotide sequence
gaaaggctacgtgacgcca

SEQ ID NO: 23456 - DNA, 18 bp, Artificial sequence
  synthetic polynucleotide sequence
cgcgaacagtccaccaga

SEQ ID NO: 23457 - DNA, 18 bp, Artificial sequence
  synthetic polynucleotide sequence
catggcagcggcaggcaa

SEQ ID NO: 23458 - DNA, 18 bp, Artificial sequence
  synthetic polynucleotide sequence
tgaacgcgtcccagacga

SEQ ID NO: 23459 - DNA, 19 bp, Artificial sequence
  synthetic polynucleotide sequence
ccgtgcagaacgtcatcga

SEQ ID NO: 23460 - DNA, 18 bp, Artificial sequence
  synthetic polynucleotide sequence
tgcaggtctcgtcaggga

SEQ ID NO: 23461 - DNA, 18 bp, Artificial sequence
  synthetic polynucleotide sequence
ggagcaagccagagccaa

SEQ ID NO: 23462 - DNA, 18 bp, Artificial sequence
  synthetic polynucleotide sequence
gccttgaaggaagccgca

SEQ ID NO: 23463 - DNA, 20 bp, Artificial sequence
  synthetic polynucleotide sequence
atggcgagcccatgcaagga

SEQ ID NO: 23464 - DNA, 21 bp, Artificial sequence
  synthetic polynucleotide sequence
gcatgcccaggaactacagga

SEQ ID NO: 23465 - DNA, 18 bp, Artificial sequence
  synthetic polynucleotide sequence
ctccagtcccaatgccca

SEQ ID NO: 23466 - DNA, 20 bp, Artificial sequence
  synthetic polynucleotide sequence
atggagggctctgtaggcca

SEQ ID NO: 23467 - DNA, 20 bp, Artificial sequence
  synthetic polynucleotide sequence
cccacccatcccctctcgaa

SEQ ID NO: 23468 - DNA, 21 bp, Artificial sequence
  synthetic polynucleotide sequence
gtcaccgacaggctcacacaa

SEQ ID NO: 23469 - DNA, 21 bp, Artificial sequence
  synthetic polynucleotide sequence
tgcagacccagttcccctcca

SEQ ID NO: 23470 - DNA, 19 bp, Artificial sequence
  synthetic polynucleotide sequence
cgggtctcagtcaggggga

SEQ ID NO: 23471 - DNA, 18 bp, Artificial sequence
  synthetic polynucleotide sequence
tggacgcggagcagcgca

SEQ ID NO: 23472 - DNA, 20 bp, Artificial sequence
  synthetic polynucleotide sequence
gtcgaactgcccgcgctcga

SEQ ID NO: 23473 - DNA, 20 bp, Artificial sequence
  synthetic polynucleotide sequence
ctagcttcccaaggtcacca

SEQ ID NO: 23474 - DNA, 22 bp, Artificial sequence
  synthetic polynucleotide sequence
ccatagacctgagcagtaacca

SEQ ID NO: 23475 - DNA, 21 bp, Artificial sequence
  synthetic polynucleotide sequence
ctagcatgtccctggagcaga

SEQ ID NO: 23476 - DNA, 20 bp, Artificial sequence
  synthetic polynucleotide sequence
tctccaggccttcaagtcca

SEQ ID NO: 23477 - DNA, 18 bp, Artificial sequence
  synthetic polynucleotide sequence
gcttcaggactcaccgca

SEQ ID NO: 23478 - DNA, 18 bp, Artificial sequence
  synthetic polynucleotide sequence
actggcacagccgaagca

SEQ ID NO: 23479 - DNA, 19 bp, Artificial sequence
  synthetic polynucleotide sequence
ccaagcctgggagtggaga

SEQ ID NO: 23480 - DNA, 22 bp, Artificial sequence
  synthetic polynucleotide sequence
aatcgatctctctccagagcga

SEQ ID NO: 23481 - DNA, 21 bp, Artificial sequence
  synthetic polynucleotide sequence
atcagaagattcaccggccca

SEQ ID NO: 23482 - DNA, 18 bp, Artificial sequence
  synthetic polynucleotide sequence
cggcctcagggttccgca

SEQ ID NO: 23483 - DNA, 20 bp, Artificial sequence
  synthetic polynucleotide sequence
aacatcgaggaagaccgcaa

SEQ ID NO: 23484 - DNA, 20 bp, Artificial sequence
  synthetic polynucleotide sequence
tgaacctggaggacagctga

SEQ ID NO: 23485 - DNA, 20 bp, Artificial sequence
  synthetic polynucleotide sequence
taccagcaagctacatcgga

SEQ ID NO: 23486 - DNA, 22 bp, Artificial sequence
  synthetic polynucleotide sequence
aaggagcctgagtaagaggcca

SEQ ID NO: 23487 - DNA, 20 bp, Artificial sequence
  synthetic polynucleotide sequence
tagccaaacacagtggtcga

SEQ ID NO: 23488 - DNA, 21 bp, Artificial sequence
  synthetic polynucleotide sequence
acttgtgcacctccaacacca

SEQ ID NO: 23489 - DNA, 18 bp, Artificial sequence
  synthetic polynucleotide sequence
acgaggagctggagcgga

SEQ ID NO: 23490 - DNA, 19 bp, Artificial sequence
  synthetic polynucleotide sequence
ttcagcatcgactgaggca

SEQ ID NO: 23491 - DNA, 21 bp, Artificial sequence
  synthetic polynucleotide sequence
gatcagaccacccagaagtca

SEQ ID NO: 23492 - DNA, 22 bp, Artificial sequence
  synthetic polynucleotide sequence
aagaacctgaactccacctcga

SEQ ID NO: 23493 - DNA, 21 bp, Artificial sequence
  synthetic polynucleotide sequence
aacctcaagtcaactcaccca

SEQ ID NO: 23494 - DNA, 20 bp, Artificial sequence
  synthetic polynucleotide sequence
tagtgagctgcaaacgtcca

SEQ ID NO: 23495 - DNA, 20 bp, Artificial sequence
  synthetic polynucleotide sequence
gtgccacgctactgtgagca

SEQ ID NO: 23496 - DNA, 18 bp, Artificial sequence
  synthetic polynucleotide sequence
ttcagcaaggctcccgca

SEQ ID NO: 23497 - DNA, 21 bp, Artificial sequence
  synthetic polynucleotide sequence
agagcgaaacctccaagccca

SEQ ID NO: 23498 - DNA, 20 bp, Artificial sequence
  synthetic polynucleotide sequence
cgtctcctgcacctgacgca

SEQ ID NO: 23499 - DNA, 22 bp, Artificial sequence
  synthetic polynucleotide sequence
atgagtggaaagggaagatcga

SEQ ID NO: 23500 - DNA, 20 bp, Artificial sequence
  synthetic polynucleotide sequence
cgtaagggtgcacagaacga

SEQ ID NO: 23501 - DNA, 21 bp, Artificial sequence
  synthetic polynucleotide sequence
atccaatggcagctctggaga

SEQ ID NO: 23502 - DNA, 20 bp, Artificial sequence
  synthetic polynucleotide sequence
ctgtagcacctgaaccctca

SEQ ID NO: 23503 - DNA, 19 bp, Artificial sequence
  synthetic polynucleotide sequence
gcgagagcatggagaggga

SEQ ID NO: 23504 - DNA, 18 bp, Artificial sequence
  synthetic polynucleotide sequence
cacaagtcaccagccgca

SEQ ID NO: 23505 - DNA, 20 bp, Artificial sequence
  synthetic polynucleotide sequence
ccctcgcagcagaccatcga

SEQ ID NO: 23506 - DNA, 20 bp, Artificial sequence
  synthetic polynucleotide sequence
caccaacatctcccggcgca

SEQ ID NO: 23507 - DNA, 21 bp, Artificial sequence
  synthetic polynucleotide sequence
ccccaattacccaaagccgca

SEQ ID NO: 23508 - DNA, 20 bp, Artificial sequence
  synthetic polynucleotide sequence
aggtgggagtcacacggcca

SEQ ID NO: 23509 - DNA, 21 bp, Artificial sequence
  synthetic polynucleotide sequence
agaggtggaaggggaaaagga

SEQ ID NO: 23510 - DNA, 20 bp, Artificial sequence
  synthetic polynucleotide sequence
tacgaacctcttcaggggca

SEQ ID NO: 23511 - DNA, 22 bp, Artificial sequence
  synthetic polynucleotide sequence
aacagggaccgagaaaaacgca

SEQ ID NO: 23512 - DNA, 23 bp, Artificial sequence
  synthetic polynucleotide sequence
gaatatatgctccaccagtgcga

SEQ ID NO: 23513 - DNA, 20 bp, Artificial sequence
  synthetic polynucleotide sequence
cagcgggagctgcgagaaga

SEQ ID NO: 23514 - DNA, 20 bp, Artificial sequence
  synthetic polynucleotide sequence
cacggttcaccatcccacca

SEQ ID NO: 23515 - DNA, 21 bp, Artificial sequence
  synthetic polynucleotide sequence
ggagcctcccacgaatgggaa

SEQ ID NO: 23516 - DNA, 20 bp, Artificial sequence
  synthetic polynucleotide sequence
ctccaccactccctgtgcca

SEQ ID NO: 23517 - DNA, 21 bp, Artificial sequence
  synthetic polynucleotide sequence
taccttgccctggccaaagga

SEQ ID NO: 23518 - DNA, 21 bp, Artificial sequence
  synthetic polynucleotide sequence
gtagagcagctgattgggaca

SEQ ID NO: 23519 - DNA, 21 bp, Artificial sequence
  synthetic polynucleotide sequence
gctctgatgggagaggagaca

SEQ ID NO: 23520 - DNA, 20 bp, Artificial sequence
  synthetic polynucleotide sequence
actcacgctctggactgcca

SEQ ID NO: 23521 - DNA, 21 bp, Artificial sequence
  synthetic polynucleotide sequence
ctcagggacaaaccctgggaa

SEQ ID NO: 23522 - DNA, 21 bp, Artificial sequence
  synthetic polynucleotide sequence
tagcgtagacacctcctggga

SEQ ID NO: 23523 - DNA, 19 bp, Artificial sequence
  synthetic polynucleotide sequence
tcacctaccagagcctcca

SEQ ID NO: 23524 - DNA, 20 bp, Artificial sequence
  synthetic polynucleotide sequence
cgggcaccaggacatatgaa

SEQ ID NO: 23525 - DNA, 20 bp, Artificial sequence
  synthetic polynucleotide sequence
caactccatgaacaaccgga

SEQ ID NO: 23526 - DNA, 18 bp, Artificial sequence
  synthetic polynucleotide sequence
attgcggagcacgggcca

SEQ ID NO: 23527 - DNA, 19 bp, Artificial sequence
  synthetic polynucleotide sequence
ccaaagagccgtacgtcca

SEQ ID NO: 23528 - DNA, 20 bp, Artificial sequence
  synthetic polynucleotide sequence
gtgggagagtcggactctga

SEQ ID NO: 23529 - DNA, 20 bp, Artificial sequence
  synthetic polynucleotide sequence
tctgagcctacagcagagga

SEQ ID NO: 23530 - DNA, 22 bp, Artificial sequence
  synthetic polynucleotide sequence
gagaggtactccttgaatgcca

SEQ ID NO: 23531 - DNA, 21 bp, Artificial sequence
  synthetic polynucleotide sequence
cccgtcagcctgagctacaga

SEQ ID NO: 23532 - DNA, 20 bp, Artificial sequence
  synthetic polynucleotide sequence
gggctacaatctgaagggca

SEQ ID NO: 23533 - DNA, 20 bp, Artificial sequence
  synthetic polynucleotide sequence
ggaccctcaagctgaatgga

SEQ ID NO: 23534 - DNA, 21 bp, Artificial sequence
  synthetic polynucleotide sequence
cagagcagggataagggaaga

SEQ ID NO: 23535 - DNA, 20 bp, Artificial sequence
  synthetic polynucleotide sequence
atgaagccaaagtacccgca

SEQ ID NO: 23536 - DNA, 20 bp, Artificial sequence
  synthetic polynucleotide sequence
ctgacctcggtacctggaca

SEQ ID NO: 23537 - DNA, 19 bp, Artificial sequence
  synthetic polynucleotide sequence
ggacccatgggttcaggaa

SEQ ID NO: 23538 - DNA, 21 bp, Artificial sequence
  synthetic polynucleotide sequence
ctgagtggactgcaaggtgga

SEQ ID NO: 23539 - DNA, 20 bp, Artificial sequence
  synthetic polynucleotide sequence
aagacaccaaaggcaccaca

SEQ ID NO: 23540 - DNA, 19 bp, Artificial sequence
  synthetic polynucleotide sequence
ggaagagtgggcgctcaga

SEQ ID NO: 23541 - DNA, 18 bp, Artificial sequence
  synthetic polynucleotide sequence
gctgagccccatggccca

SEQ ID NO: 23542 - DNA, 18 bp, Artificial sequence
  synthetic polynucleotide sequence
gcaagcactggcagcgca

SEQ ID NO: 23543 - DNA, 18 bp, Artificial sequence
  synthetic polynucleotide sequence
agccagggcccatcgcca

SEQ ID NO: 23544 - DNA, 21 bp, Artificial sequence
  synthetic polynucleotide sequence
ccttggagcactgtgggccta

SEQ ID NO: 23545 - DNA, 20 bp, Artificial sequence
  synthetic polynucleotide sequence
acgctgagagtaaaccccaa

SEQ ID NO: 23546 - DNA, 18 bp, Artificial sequence
  synthetic polynucleotide sequence
ggcttccgggtccagaca

SEQ ID NO: 23547 - DNA, 20 bp, Artificial sequence
  synthetic polynucleotide sequence
ccacactgcgccaacacaga

SEQ ID NO: 23548 - DNA, 20 bp, Artificial sequence
  synthetic polynucleotide sequence
tccacaaccctctgcaccca

SEQ ID NO: 23549 - DNA, 18 bp, Artificial sequence
  synthetic polynucleotide sequence
tcagcaccaaccaaggga

SEQ ID NO: 23550 - DNA, 18 bp, Artificial sequence
  synthetic polynucleotide sequence
aggaagggcttggggcaa

SEQ ID NO: 23551 - DNA, 20 bp, Artificial sequence
  synthetic polynucleotide sequence
atctacgccttcattggcca

SEQ ID NO: 23552 - DNA, 19 bp, Artificial sequence
  synthetic polynucleotide sequence
gtgccctgaagaagagcca

SEQ ID NO: 23553 - DNA, 20 bp, Artificial sequence
  synthetic polynucleotide sequence
gccaacgtcagtgaggcaga

SEQ ID NO: 23554 - DNA, 21 bp, Artificial sequence
  synthetic polynucleotide sequence
acaggatgacaataccaggca

SEQ ID NO: 23555 - DNA, 20 bp, Artificial sequence
  synthetic polynucleotide sequence
gagaaccaagcagaaacgca

SEQ ID NO: 23556 - DNA, 21 bp, Artificial sequence
  synthetic polynucleotide sequence
gatgtggtagggtgaccagca

SEQ ID NO: 23557 - DNA, 21 bp, Artificial sequence
  synthetic polynucleotide sequence
cagaggccatcgcatacctga

SEQ ID NO: 23558 - DNA, 21 bp, Artificial sequence
  synthetic polynucleotide sequence
gtgagaccccaaggtaaggga

SEQ ID NO: 23559 - DNA, 20 bp, Artificial sequence
  synthetic polynucleotide sequence
gattgcagggggccaggtga

SEQ ID NO: 23560 - DNA, 20 bp, Artificial sequence
  synthetic polynucleotide sequence
ggggaaagtcactgggctga

SEQ ID NO: 23561 - DNA, 19 bp, Artificial sequence
  synthetic polynucleotide sequence
tgggccccaaacttatcga

SEQ ID NO: 23562 - DNA, 22 bp, Artificial sequence
  synthetic polynucleotide sequence
atcagaaaagtcctggtcccca

SEQ ID NO: 23563 - DNA, 20 bp, Artificial sequence
  synthetic polynucleotide sequence
aatctggcgccctgtggaga

SEQ ID NO: 23564 - DNA, 18 bp, Artificial sequence
  synthetic polynucleotide sequence
gcaccaggtccggcgtga

SEQ ID NO: 23565 - DNA, 18 bp, Artificial sequence
  synthetic polynucleotide sequence
ctgggtgaaggcgggcca

SEQ ID NO: 23566 - DNA, 18 bp, Artificial sequence
  synthetic polynucleotide sequence
cggccggcagtttcccca

SEQ ID NO: 23567 - DNA, 21 bp, Artificial sequence
  synthetic polynucleotide sequence
gcagccagcggaactgtacca

SEQ ID NO: 23568 - DNA, 21 bp, Artificial sequence
  synthetic polynucleotide sequence
aaggcctgaatctgagcagga

SEQ ID NO: 23569 - DNA, 19 bp, Artificial sequence
  synthetic polynucleotide sequence
ggaagatggccggggggaa

SEQ ID NO: 23570 - DNA, 19 bp, Artificial sequence
  synthetic polynucleotide sequence
gacatcccctgtggccgca

SEQ ID NO: 23571 - DNA, 22 bp, Artificial sequence
  synthetic polynucleotide sequence
gaattcagcagtagcgacccca

SEQ ID NO: 23572 - DNA, 19 bp, Artificial sequence
  synthetic polynucleotide sequence
gcatggcgtctgggcacga

SEQ ID NO: 23573 - DNA, 22 bp, Artificial sequence
  synthetic polynucleotide sequence
ttgatgctgccaaacatgccca

SEQ ID NO: 23574 - DNA, 20 bp, Artificial sequence
  synthetic polynucleotide sequence
ggtagaagagcggcagtcca

SEQ ID NO: 23575 - DNA, 18 bp, Artificial sequence
  synthetic polynucleotide sequence
cgggaggggtgatccgaa

SEQ ID NO: 23576 - DNA, 18 bp, Artificial sequence
  synthetic polynucleotide sequence
tacaggcaccacctccga

SEQ ID NO: 23577 - DNA, 21 bp, Artificial sequence
  synthetic polynucleotide sequence
actgaaccaaaaacgggccca

SEQ ID NO: 23578 - DNA, 21 bp, Artificial sequence
  synthetic polynucleotide sequence
atggagaatcaccagctgcca

SEQ ID NO: 23579 - DNA, 21 bp, Artificial sequence
  synthetic polynucleotide sequence
atgccctggagaggagacgaa

SEQ ID NO: 23580 - DNA, 21 bp, Artificial sequence
  synthetic polynucleotide sequence
ctaaaggtcggagacttgcga

SEQ ID NO: 23581 - DNA, 20 bp, Artificial sequence
  synthetic polynucleotide sequence
cagtgagtctaggcagggca

SEQ ID NO: 23582 - DNA, 22 bp, Artificial sequence
  synthetic polynucleotide sequence
tacgaaaggacctggaagagga

SEQ ID NO: 23583 - DNA, 19 bp, Artificial sequence
  synthetic polynucleotide sequence
tccaactcctcctccccga

SEQ ID NO: 23584 - DNA, 20 bp, Artificial sequence
  synthetic polynucleotide sequence
gagggacagggctcagagca

SEQ ID NO: 23585 - DNA, 19 bp, Artificial sequence
  synthetic polynucleotide sequence
ctcgtcctcctcaggggga

SEQ ID NO: 23586 - DNA, 20 bp, Artificial sequence
  synthetic polynucleotide sequence
tgcaactgctgcagacgcca

SEQ ID NO: 23587 - DNA, 20 bp, Artificial sequence
  synthetic polynucleotide sequence
caactgcgagcagtgcagca

SEQ ID NO: 23588 - DNA, 20 bp, Artificial sequence
  synthetic polynucleotide sequence
ccttctccagagcagcggaa

SEQ ID NO: 23589 - DNA, 18 bp, Artificial sequence
  synthetic polynucleotide sequence
tcctgccctgggcgtcca

SEQ ID NO: 23590 - DNA, 21 bp, Artificial sequence
  synthetic polynucleotide sequence
ctgttggcaaagaccgcctca

SEQ ID NO: 23591 - DNA, 20 bp, Artificial sequence
  synthetic polynucleotide sequence
ccgggcagccagggtctcaa

SEQ ID NO: 23592 - DNA, 20 bp, Artificial sequence
  synthetic polynucleotide sequence
gcatgatcaccagggctgga

SEQ ID NO: 23593 - DNA, 18 bp, Artificial sequence
  synthetic polynucleotide sequence
aggccgagcacgctgcca

SEQ ID NO: 23594 - DNA, 18 bp, Artificial sequence
  synthetic polynucleotide sequence
ccccaccccacctgagca

SEQ ID NO: 23595 - DNA, 21 bp, Artificial sequence
  synthetic polynucleotide sequence
gggagctccatccagatgaca

SEQ ID NO: 23596 - DNA, 18 bp, Artificial sequence
  synthetic polynucleotide sequence
acatcaaggcgacggcca

SEQ ID NO: 23597 - DNA, 18 bp, Artificial sequence
  synthetic polynucleotide sequence
ggaggtggcaaagcgcaa

SEQ ID NO: 23598 - DNA, 20 bp, Artificial sequence
  synthetic polynucleotide sequence
aggaagcgggtgacatcgta

SEQ ID NO: 23599 - DNA, 20 bp, Artificial sequence
  synthetic polynucleotide sequence
ctgaccggctgcctgaggta

SEQ ID NO: 23600 - DNA, 20 bp, Artificial sequence
  synthetic polynucleotide sequence
ctccagaacccccacctcca

SEQ ID NO: 23601 - DNA, 18 bp, Artificial sequence
  synthetic polynucleotide sequence
cggagtggagctcagcca

SEQ ID NO: 23602 - DNA, 18 bp, Artificial sequence
  synthetic polynucleotide sequence
agcttcctggggacgcca

SEQ ID NO: 23603 - DNA, 19 bp, Artificial sequence
  synthetic polynucleotide sequence
gggacaggaatcaccccaa

SEQ ID NO: 23604 - DNA, 18 bp, Artificial sequence
  synthetic polynucleotide sequence
catcccctggagcgggca

SEQ ID NO: 23605 - DNA, 20 bp, Artificial sequence
  synthetic polynucleotide sequence
gccaaccagacagaggagga

SEQ ID NO: 23606 - DNA, 21 bp, Artificial sequence
  synthetic polynucleotide sequence
gtcggcagtaacgaagcctga

SEQ ID NO: 23607 - DNA, 19 bp, Artificial sequence
  synthetic polynucleotide sequence
gcgacctgagctggaggaa

SEQ ID NO: 23608 - DNA, 18 bp, Artificial sequence
  synthetic polynucleotide sequence
gtggaaggtggtcccgga

SEQ ID NO: 23609 - DNA, 21 bp, Artificial sequence
  synthetic polynucleotide sequence
aatgagagcagcaggatcaga

SEQ ID NO: 23610 - DNA, 18 bp, Artificial sequence
  synthetic polynucleotide sequence
cattctgccaaccaggca

SEQ ID NO: 23611 - DNA, 20 bp, Artificial sequence
  synthetic polynucleotide sequence
tggcgaggacctttcggaga

SEQ ID NO: 23612 - DNA, 21 bp, Artificial sequence
  synthetic polynucleotide sequence
tgatgctctgcaggataggca

SEQ ID NO: 23613 - DNA, 20 bp, Artificial sequence
  synthetic polynucleotide sequence
atcaagcagccgcccagcaa

SEQ ID NO: 23614 - DNA, 18 bp, Artificial sequence
  synthetic polynucleotide sequence
cctcgtcggtcaccggga

SEQ ID NO: 23615 - DNA, 17 bp, Artificial sequence
  synthetic polynucleotide sequence
ggacggcccaactggga

SEQ ID NO: 23616 - DNA, 18 bp, Artificial sequence
  synthetic polynucleotide sequence
cactccccgagggccaga

SEQ ID NO: 23617 - DNA, 21 bp, Artificial sequence
  synthetic polynucleotide sequence
cgtggacctggaaatgcagca

SEQ ID NO: 23618 - DNA, 20 bp, Artificial sequence
  synthetic polynucleotide sequence
aagcggagcccatggaagca

SEQ ID NO: 23619 - DNA, 18 bp, Artificial sequence
  synthetic polynucleotide sequence
ccagagcacgaccatcga

SEQ ID NO: 23620 - DNA, 20 bp, Artificial sequence
  synthetic polynucleotide sequence
tatggtgtagaccaggggca

SEQ ID NO: 23621 - DNA, 21 bp, Artificial sequence
  synthetic polynucleotide sequence
ggcacagatgagtaactgcca

SEQ ID NO: 23622 - DNA, 17 bp, Artificial sequence
  synthetic polynucleotide sequence
gagcagcgatcacgcca

SEQ ID NO: 23623 - DNA, 20 bp, Artificial sequence
  synthetic polynucleotide sequence
gccatcgcaagagaggggga

SEQ ID NO: 23624 - DNA, 20 bp, Artificial sequence
  synthetic polynucleotide sequence
gcgccagatggggtcatcca

SEQ ID NO: 23625 - DNA, 18 bp, Artificial sequence
  synthetic polynucleotide sequence
cctgcggaagatggcaga

SEQ ID NO: 23626 - DNA, 20 bp, Artificial sequence
  synthetic polynucleotide sequence
gttgacaatgtcagccagca

SEQ ID NO: 23627 - DNA, 18 bp, Artificial sequence
  synthetic polynucleotide sequence
ccttgtggggaaagccca

SEQ ID NO: 23628 - DNA, 20 bp, Artificial sequence
  synthetic polynucleotide sequence
caggtgggaagtcactggca

SEQ ID NO: 23629 - DNA, 18 bp, Artificial sequence
  synthetic polynucleotide sequence
ctcggagcgtaaccccaa

SEQ ID NO: 23630 - DNA, 18 bp, Artificial sequence
  synthetic polynucleotide sequence
ggcccttgagcagcagga

SEQ ID NO: 23631 - DNA, 25 bp, Artificial sequence
  synthetic polynucleotide sequence
ggaaggactggaatcaaagagagga

SEQ ID NO: 23632 - DNA, 21 bp, Artificial sequence
  synthetic polynucleotide sequence
gagaaggctcacaagcaggga

SEQ ID NO: 23633 - DNA, 21 bp, Artificial sequence
  synthetic polynucleotide sequence
aacggccaggaaccaaaagga

SEQ ID NO: 23634 - DNA, 22 bp, Artificial sequence
  synthetic polynucleotide sequence
agaatccacctcgacagtacga

SEQ ID NO: 23635 - DNA, 20 bp, Artificial sequence
  synthetic polynucleotide sequence
cactgcacccgtccaagaga

SEQ ID NO: 23636 - DNA, 22 bp, Artificial sequence
  synthetic polynucleotide sequence
atccgtacagcctgcacactca

SEQ ID NO: 23637 - DNA, 21 bp, Artificial sequence
  synthetic polynucleotide sequence
agacactggtgcaagtggcca

SEQ ID NO: 23638 - DNA, 19 bp, Artificial sequence
  synthetic polynucleotide sequence
cgtcccagacactgccgca

SEQ ID NO: 23639 - DNA, 21 bp, Artificial sequence
  synthetic polynucleotide sequence
tcggaaccccaacgtgcagca

SEQ ID NO: 23640 - DNA, 20 bp, Artificial sequence
  synthetic polynucleotide sequence
ctccttgagggccgcacgca

SEQ ID NO: 23641 - DNA, 20 bp, Artificial sequence
  synthetic polynucleotide sequence
gagcgagtggtgagctcaga

SEQ ID NO: 23642 - DNA, 20 bp, Artificial sequence
  synthetic polynucleotide sequence
gcctcgggaacaaggcggca

SEQ ID NO: 23643 - DNA, 18 bp, Artificial sequence
  synthetic polynucleotide sequence
gaatccagcggggaccca

SEQ ID NO: 23644 - DNA, 18 bp, Artificial sequence
  synthetic polynucleotide sequence
ggggatgccttccaggga

SEQ ID NO: 23645 - DNA, 22 bp, Artificial sequence
  synthetic polynucleotide sequence
tgcatgggaattggacccctca

SEQ ID NO: 23646 - DNA, 21 bp, Artificial sequence
  synthetic polynucleotide sequence
ctccagagatccagactcgca

SEQ ID NO: 23647 - DNA, 20 bp, Artificial sequence
  synthetic polynucleotide sequence
atcctggagaccttccgaca

SEQ ID NO: 23648 - DNA, 18 bp, Artificial sequence
  synthetic polynucleotide sequence
cacaacgccccttgggga

SEQ ID NO: 23649 - DNA, 19 bp, Artificial sequence
  synthetic polynucleotide sequence
cctaaccctgccctgcaga

SEQ ID NO: 23650 - DNA, 18 bp, Artificial sequence
  synthetic polynucleotide sequence
cccgtgatgtcccggaca

SEQ ID NO: 23651 - DNA, 20 bp, Artificial sequence
  synthetic polynucleotide sequence
cagactcgagtgcaggcaga

SEQ ID NO: 23652 - DNA, 18 bp, Artificial sequence
  synthetic polynucleotide sequence
aggccaggacatagggca

SEQ ID NO: 23653 - DNA, 18 bp, Artificial sequence
  synthetic polynucleotide sequence
cgtgcccctcagccagca

SEQ ID NO: 23654 - DNA, 21 bp, Artificial sequence
  synthetic polynucleotide sequence
gactccagttgcatgagggca

SEQ ID NO: 23655 - DNA, 20 bp, Artificial sequence
  synthetic polynucleotide sequence
caggaggagctagaccacga

SEQ ID NO: 23656 - DNA, 18 bp, Artificial sequence
  synthetic polynucleotide sequence
ggggcaaggctaagggca

SEQ ID NO: 23657 - DNA, 20 bp, Artificial sequence
  synthetic polynucleotide sequence
attcacgcgcgcatcgagca

SEQ ID NO: 23658 - DNA, 21 bp, Artificial sequence
  synthetic polynucleotide sequence
cccacgagtgctcgatcaaca

SEQ ID NO: 23659 - DNA, 18 bp, Artificial sequence
  synthetic polynucleotide sequence
cgggacacccatgacaca

SEQ ID NO: 23660 - DNA, 18 bp, Artificial sequence
  synthetic polynucleotide sequence
agcggctggtgctagcca

SEQ ID NO: 23661 - DNA, 18 bp, Artificial sequence
  synthetic polynucleotide sequence
agcctgctacccccagga

SEQ ID NO: 23662 - DNA, 18 bp, Artificial sequence
  synthetic polynucleotide sequence
ggatcagccttgcgagga

SEQ ID NO: 23663 - DNA, 19 bp, Artificial sequence
  synthetic polynucleotide sequence
ccccgaagtccagacagca

SEQ ID NO: 23664 - DNA, 18 bp, Artificial sequence
  synthetic polynucleotide sequence
tgaccaccgccttcagca

SEQ ID NO: 23665 - DNA, 21 bp, Artificial sequence
  synthetic polynucleotide sequence
aactgcagctgatgtccccaa

SEQ ID NO: 23666 - DNA, 20 bp, Artificial sequence
  synthetic polynucleotide sequence
tcggaatcagatacccgcca

SEQ ID NO: 23667 - DNA, 20 bp, Artificial sequence
  synthetic polynucleotide sequence
gtgggggaaggaaggggaga

SEQ ID NO: 23668 - DNA, 22 bp, Artificial sequence
  synthetic polynucleotide sequence
ctcatcacagctctgaaggaca

SEQ ID NO: 23669 - DNA, 20 bp, Artificial sequence
  synthetic polynucleotide sequence
ggcaggatggcggaaaggaa

SEQ ID NO: 23670 - DNA, 20 bp, Artificial sequence
  synthetic polynucleotide sequence
ctcatcccagctcggaagca

SEQ ID NO: 23671 - DNA, 21 bp, Artificial sequence
  synthetic polynucleotide sequence
agtgatcggcaagaaccggca

SEQ ID NO: 23672 - DNA, 21 bp, Artificial sequence
  synthetic polynucleotide sequence
tgcgggccaaactcatgggga

SEQ ID NO: 23673 - DNA, 18 bp, Artificial sequence
  synthetic polynucleotide sequence
cccacatcgccctccaga

SEQ ID NO: 23674 - DNA, 18 bp, Artificial sequence
  synthetic polynucleotide sequence
gggtgacaatgtggggca

SEQ ID NO: 23675 - DNA, 21 bp, Artificial sequence
  synthetic polynucleotide sequence
gcccctgtatgcaggacagga

SEQ ID NO: 23676 - DNA, 18 bp, Artificial sequence
  synthetic polynucleotide sequence
ggggcaggttggtgggga

SEQ ID NO: 23677 - DNA, 20 bp, Artificial sequence
  synthetic polynucleotide sequence
ggccacatgccctacacaga

SEQ ID NO: 23678 - DNA, 20 bp, Artificial sequence
  synthetic polynucleotide sequence
taacgtcacaggtcactgca

SEQ ID NO: 23679 - DNA, 18 bp, Artificial sequence
  synthetic polynucleotide sequence
gacacaggagcccctgca

SEQ ID NO: 23680 - DNA, 18 bp, Artificial sequence
  synthetic polynucleotide sequence
ccggtggggacaaggtca

SEQ ID NO: 23681 - DNA, 18 bp, Artificial sequence
  synthetic polynucleotide sequence
tggtgaccacctcgacca

SEQ ID NO: 23682 - DNA, 18 bp, Artificial sequence
  synthetic polynucleotide sequence
tgtgagcctggtcaccca

SEQ ID NO: 23683 - DNA, 18 bp, Artificial sequence
  synthetic polynucleotide sequence
tcagcaggccgccgtgca

SEQ ID NO: 23684 - DNA, 19 bp, Artificial sequence
  synthetic polynucleotide sequence
gcggccacggagaagctga

SEQ ID NO: 23685 - DNA, 18 bp, Artificial sequence
  synthetic polynucleotide sequence
tgattgggccaagccgaa

SEQ ID NO: 23686 - DNA, 18 bp, Artificial sequence
  synthetic polynucleotide sequence
gcaggttggagggcacga

SEQ ID NO: 23687 - DNA, 21 bp, Artificial sequence
  synthetic polynucleotide sequence
ccaggagttcaaccccgagca

SEQ ID NO: 23688 - DNA, 20 bp, Artificial sequence
  synthetic polynucleotide sequence
gccagcgactctcccaggca

SEQ ID NO: 23689 - DNA, 20 bp, Artificial sequence
  synthetic polynucleotide sequence
gaggtgcagagaatgggcaa

SEQ ID NO: 23690 - DNA, 18 bp, Artificial sequence
  synthetic polynucleotide sequence
gcaggtggtacccagcca

SEQ ID NO: 23691 - DNA, 20 bp, Artificial sequence
  synthetic polynucleotide sequence
ggcatgacattgcagcccca

SEQ ID NO: 23692 - DNA, 21 bp, Artificial sequence
  synthetic polynucleotide sequence
ttcccgaaaacatcccaggca

SEQ ID NO: 23693 - DNA, 22 bp, Artificial sequence
  synthetic polynucleotide sequence
ccaacatcttcaagcacccaga

SEQ ID NO: 23694 - DNA, 21 bp, Artificial sequence
  synthetic polynucleotide sequence
gcagacacgcttccctaagga

SEQ ID NO: 23695 - DNA, 20 bp, Artificial sequence
  synthetic polynucleotide sequence
ctgctgccatgggaccagga

SEQ ID NO: 23696 - DNA, 20 bp, Artificial sequence
  synthetic polynucleotide sequence
cactgggggaaatcctggca

SEQ ID NO: 23697 - DNA, 18 bp, Artificial sequence
  synthetic polynucleotide sequence
acacagtggcagacccca

SEQ ID NO: 23698 - DNA, 18 bp, Artificial sequence
  synthetic polynucleotide sequence
caggcgctccccaacaca

SEQ ID NO: 23699 - DNA, 21 bp, Artificial sequence
  synthetic polynucleotide sequence
catggcatttggaagcgggaa

SEQ ID NO: 23700 - DNA, 18 bp, Artificial sequence
  synthetic polynucleotide sequence
gctgggggacacccacca

SEQ ID NO: 23701 - DNA, 19 bp, Artificial sequence
  synthetic polynucleotide sequence
cccaataaggcaccaccca

SEQ ID NO: 23702 - DNA, 22 bp, Artificial sequence
  synthetic polynucleotide sequence
ggaacttctcaggctctgtcca

SEQ ID NO: 23703 - DNA, 22 bp, Artificial sequence
  synthetic polynucleotide sequence
gcctatgacacaactagcacca

SEQ ID NO: 23704 - DNA, 20 bp, Artificial sequence
  synthetic polynucleotide sequence
ccagggcatcgtaggtgaca

SEQ ID NO: 23705 - DNA, 20 bp, Artificial sequence
  synthetic polynucleotide sequence
tgggaattccagggcccaca

SEQ ID NO: 23706 - DNA, 21 bp, Artificial sequence
  synthetic polynucleotide sequence
ggatctgtgatggccagcaca

SEQ ID NO: 23707 - DNA, 21 bp, Artificial sequence
  synthetic polynucleotide sequence
tctccaacattcaccagcgga

SEQ ID NO: 23708 - DNA, 21 bp, Artificial sequence
  synthetic polynucleotide sequence
acatccatgctgtaggcccca

SEQ ID NO: 23709 - DNA, 18 bp, Artificial sequence
  synthetic polynucleotide sequence
aggaggttcctgccgaca

SEQ ID NO: 23710 - DNA, 19 bp, Artificial sequence
  synthetic polynucleotide sequence
ggcagaggtctcgtgacca

SEQ ID NO: 23711 - DNA, 18 bp, Artificial sequence
  synthetic polynucleotide sequence
agtgtggcccaacccaga

SEQ ID NO: 23712 - DNA, 18 bp, Artificial sequence
  synthetic polynucleotide sequence
tggtgggatcaggcagca

SEQ ID NO: 23713 - DNA, 20 bp, Artificial sequence
  synthetic polynucleotide sequence
ctggaaccacctggaccaga

SEQ ID NO: 23714 - DNA, 18 bp, Artificial sequence
  synthetic polynucleotide sequence
tcagggaaggtgacggga

SEQ ID NO: 23715 - DNA, 18 bp, Artificial sequence
  synthetic polynucleotide sequence
gagaggaggtccgcgaga

SEQ ID NO: 23716 - DNA, 18 bp, Artificial sequence
  synthetic polynucleotide sequence
gcaggtagagaccggcca

SEQ ID NO: 23717 - DNA, 20 bp, Artificial sequence
  synthetic polynucleotide sequence
gctgctgtcgcacccaagga

SEQ ID NO: 23718 - DNA, 20 bp, Artificial sequence
  synthetic polynucleotide sequence
aggcaggcgtcaacatccga

SEQ ID NO: 23719 - DNA, 21 bp, Artificial sequence
  synthetic polynucleotide sequence
ccttccgctttgacccagaga

SEQ ID NO: 23720 - DNA, 19 bp, Artificial sequence
  synthetic polynucleotide sequence
ttcatctccgccatggcga

SEQ ID NO: 23721 - DNA, 18 bp, Artificial sequence
  synthetic polynucleotide sequence
cccagctgtgtggccgga

SEQ ID NO: 23722 - DNA, 18 bp, Artificial sequence
  synthetic polynucleotide sequence
tcctgggccctgccgaga

SEQ ID NO: 23723 - DNA, 18 bp, Artificial sequence
  synthetic polynucleotide sequence
cccggacaacccacagca

SEQ ID NO: 23724 - DNA, 18 bp, Artificial sequence
  synthetic polynucleotide sequence
gtgccacaaccacgcgca

SEQ ID NO: 23725 - DNA, 18 bp, Artificial sequence
  synthetic polynucleotide sequence
cgttcgcgatggcggaga

SEQ ID NO: 23726 - DNA, 18 bp, Artificial sequence
  synthetic polynucleotide sequence
cggtgtggtcaggcagga

SEQ ID NO: 23727 - DNA, 21 bp, Artificial sequence
  synthetic polynucleotide sequence
tgaccatgtgcctgaaggaga

SEQ ID NO: 23728 - DNA, 20 bp, Artificial sequence
  synthetic polynucleotide sequence
ggtcgaagcggaaggggtca

SEQ ID NO: 23729 - DNA, 20 bp, Artificial sequence
  synthetic polynucleotide sequence
atgcacaagggcgccatcca

SEQ ID NO: 23730 - DNA, 22 bp, Artificial sequence
  synthetic polynucleotide sequence
aaaagtgcctcaggatgcacga

SEQ ID NO: 23731 - DNA, 18 bp, Artificial sequence
  synthetic polynucleotide sequence
gggaggaggtcaggggca

SEQ ID NO: 23732 - DNA, 18 bp, Artificial sequence
  synthetic polynucleotide sequence
atggacgggactgcagga

SEQ ID NO: 23733 - DNA, 21 bp, Artificial sequence
  synthetic polynucleotide sequence
tgagccagatgccttacacca

SEQ ID NO: 23734 - DNA, 20 bp, Artificial sequence
  synthetic polynucleotide sequence
ctgcaggtaaggagcgtcca

SEQ ID NO: 23735 - DNA, 21 bp, Artificial sequence
  synthetic polynucleotide sequence
gcagggcagcatacatcctca

SEQ ID NO: 23736 - DNA, 21 bp, Artificial sequence
  synthetic polynucleotide sequence
gtataccctgccacagtctga

SEQ ID NO: 23737 - DNA, 21 bp, Artificial sequence
  synthetic polynucleotide sequence
gcagaactgaatgacctgcca

SEQ ID NO: 23738 - DNA, 20 bp, Artificial sequence
  synthetic polynucleotide sequence
ggaaccgtcctcaaggtgca

SEQ ID NO: 23739 - DNA, 22 bp, Artificial sequence
  synthetic polynucleotide sequence
ccaagatgcaaggatggtcaga

SEQ ID NO: 23740 - DNA, 18 bp, Artificial sequence
  synthetic polynucleotide sequence
gtttgccacagaggccca

SEQ ID NO: 23741 - DNA, 18 bp, Artificial sequence
  synthetic polynucleotide sequence
acatccaccctgagccca

SEQ ID NO: 23742 - DNA, 20 bp, Artificial sequence
  synthetic polynucleotide sequence
aaagaacctcccagggcaga

SEQ ID NO: 23743 - DNA, 18 bp, Artificial sequence
  synthetic polynucleotide sequence
cggccttgtggacagcca

SEQ ID NO: 23744 - DNA, 18 bp, Artificial sequence
  synthetic polynucleotide sequence
gcatcggccgtccacgca

SEQ ID NO: 23745 - DNA, 20 bp, Artificial sequence
  synthetic polynucleotide sequence
gagcagagcacagagggcca

SEQ ID NO: 23746 - DNA, 18 bp, Artificial sequence
  synthetic polynucleotide sequence
cccgctcgatgctcgcca

SEQ ID NO: 23747 - DNA, 18 bp, Artificial sequence
  synthetic polynucleotide sequence
ctgccacatgccatgaca

SEQ ID NO: 23748 - DNA, 20 bp, Artificial sequence
  synthetic polynucleotide sequence
atagaccacacggagaggca

SEQ ID NO: 23749 - DNA, 21 bp, Artificial sequence
  synthetic polynucleotide sequence
gagcagaacggcagtgtcaca

SEQ ID NO: 23750 - DNA, 21 bp, Artificial sequence
  synthetic polynucleotide sequence
ccttcctgtgagaaacccgca

SEQ ID NO: 23751 - DNA, 20 bp, Artificial sequence
  synthetic polynucleotide sequence
cacctcttgcagccgaccga

SEQ ID NO: 23752 - DNA, 19 bp, Artificial sequence
  synthetic polynucleotide sequence
ggagggccagcgtaggtca

SEQ ID NO: 23753 - DNA, 20 bp, Artificial sequence
  synthetic polynucleotide sequence
gtccaacggccccataccca

SEQ ID NO: 23754 - DNA, 19 bp, Artificial sequence
  synthetic polynucleotide sequence
cctgaggtccaccctgcca

SEQ ID NO: 23755 - DNA, 20 bp, Artificial sequence
  synthetic polynucleotide sequence
gcctgcaagaccgaggctga

SEQ ID NO: 23756 - DNA, 20 bp, Artificial sequence
  synthetic polynucleotide sequence
gtagaaagggtccctgctga

SEQ ID NO: 23757 - DNA, 18 bp, Artificial sequence
  synthetic polynucleotide sequence
ccccaacaacaaggggca

SEQ ID NO: 23758 - DNA, 20 bp, Artificial sequence
  synthetic polynucleotide sequence
agaaggggtccacactcaca

SEQ ID NO: 23759 - DNA, 21 bp, Artificial sequence
  synthetic polynucleotide sequence
ccctgaggagctgctgaggaa

SEQ ID NO: 23760 - DNA, 21 bp, Artificial sequence
  synthetic polynucleotide sequence
aggtcttcacacgccctccca

SEQ ID NO: 23761 - DNA, 18 bp, Artificial sequence
  synthetic polynucleotide sequence
accgcatctcagccacca

SEQ ID NO: 23762 - DNA, 18 bp, Artificial sequence
  synthetic polynucleotide sequence
agaaggggacacgggtga

SEQ ID NO: 23763 - DNA, 21 bp, Artificial sequence
  synthetic polynucleotide sequence
cagtcggcagacgagtacaga

SEQ ID NO: 23764 - DNA, 19 bp, Artificial sequence
  synthetic polynucleotide sequence
cccacaagggagacatgga

SEQ ID NO: 23765 - DNA, 19 bp, Artificial sequence
  synthetic polynucleotide sequence
tgaaggacaaagcacggaa

SEQ ID NO: 23766 - DNA, 20 bp, Artificial sequence
  synthetic polynucleotide sequence
caggaccgtagtcactggga

SEQ ID NO: 23767 - DNA, 20 bp, Artificial sequence
  synthetic polynucleotide sequence
gagacacgctccagaaggga

SEQ ID NO: 23768 - DNA, 25 bp, Artificial sequence
  synthetic polynucleotide sequence
cacacccacctaaaatacgagcaga

SEQ ID NO: 23769 - DNA, 18 bp, Artificial sequence
  synthetic polynucleotide sequence
tcagcacctgcaagggga

SEQ ID NO: 23770 - DNA, 18 bp, Artificial sequence
  synthetic polynucleotide sequence
atcggtcaccaggccgga

SEQ ID NO: 23771 - DNA, 18 bp, Artificial sequence
  synthetic polynucleotide sequence
caagcagcaggtggcgga

SEQ ID NO: 23772 - DNA, 20 bp, Artificial sequence
  synthetic polynucleotide sequence
aggaaggagagatccaggca

SEQ ID NO: 23773 - DNA, 21 bp, Artificial sequence
  synthetic polynucleotide sequence
aggaggtgggcaacctcagga

SEQ ID NO: 23774 - DNA, 22 bp, Artificial sequence
  synthetic polynucleotide sequence
gaagtcgctcatgacagggaca

SEQ ID NO: 23775 - DNA, 21 bp, Artificial sequence
  synthetic polynucleotide sequence
ggtggcacaggatacagacga

SEQ ID NO: 23776 - DNA, 20 bp, Artificial sequence
  synthetic polynucleotide sequence
gtaggatcactggcatggga

SEQ ID NO: 23777 - DNA, 18 bp, Artificial sequence
  synthetic polynucleotide sequence
ctccctcaggcaggacca

SEQ ID NO: 23778 - DNA, 18 bp, Artificial sequence
  synthetic polynucleotide sequence
caagcattgggtgccaca

SEQ ID NO: 23779 - DNA, 20 bp, Artificial sequence
  synthetic polynucleotide sequence
cggcagcaggaggacaagga

SEQ ID NO: 23780 - DNA, 20 bp, Artificial sequence
  synthetic polynucleotide sequence
ggagtccacagccgcttgca

SEQ ID NO: 23781 - DNA, 21 bp, Artificial sequence
  synthetic polynucleotide sequence
agatgaaccacctcagcacca

SEQ ID NO: 23782 - DNA, 21 bp, Artificial sequence
  synthetic polynucleotide sequence
gcaggtgaggggctatcagga

SEQ ID NO: 23783 - DNA, 18 bp, Artificial sequence
  synthetic polynucleotide sequence
tggctgctgcagcacaga

SEQ ID NO: 23784 - DNA, 18 bp, Artificial sequence
  synthetic polynucleotide sequence
gaggtctggctcccagga

SEQ ID NO: 23785 - DNA, 21 bp, Artificial sequence
  synthetic polynucleotide sequence
cagtgaggacgagcagagcaa

SEQ ID NO: 23786 - DNA, 21 bp, Artificial sequence
  synthetic polynucleotide sequence
agtctggacaaactgggacca

SEQ ID NO: 23787 - DNA, 21 bp, Artificial sequence
  synthetic polynucleotide sequence
cctccgtctgcagtgaccaca

SEQ ID NO: 23788 - DNA, 18 bp, Artificial sequence
  synthetic polynucleotide sequence
ggggtctccacgctggca

SEQ ID NO: 23789 - DNA, 20 bp, Artificial sequence
  synthetic polynucleotide sequence
ccctgggaagggaaggagca

SEQ ID NO: 23790 - DNA, 20 bp, Artificial sequence
  synthetic polynucleotide sequence
agggagtgggggtcatgaga

SEQ ID NO: 23791 - DNA, 23 bp, Artificial sequence
  synthetic polynucleotide sequence
gaacaaagcggatttccaaggca

SEQ ID NO: 23792 - DNA, 21 bp, Artificial sequence
  synthetic polynucleotide sequence
aggatggtgctggcaaagaga

SEQ ID NO: 23793 - DNA, 19 bp, Artificial sequence
  synthetic polynucleotide sequence
ggctgctccctgaaccaga

SEQ ID NO: 23794 - DNA, 18 bp, Artificial sequence
  synthetic polynucleotide sequence
catggatctgcctccgga

SEQ ID NO: 23795 - DNA, 20 bp, Artificial sequence
  synthetic polynucleotide sequence
cgtgcccagttcgagcccaa

SEQ ID NO: 23796 - DNA, 20 bp, Artificial sequence
  synthetic polynucleotide sequence
gaggagctgagcgggaagga

SEQ ID NO: 23797 - DNA, 18 bp, Artificial sequence
  synthetic polynucleotide sequence
ccgaccacatgccagaca

SEQ ID NO: 23798 - DNA, 18 bp, Artificial sequence
  synthetic polynucleotide sequence
tgctggacaggagacgca

SEQ ID NO: 23799 - DNA, 21 bp, Artificial sequence
  synthetic polynucleotide sequence
ctacgagttccggcataccca

SEQ ID NO: 23800 - DNA, 22 bp, Artificial sequence
  synthetic polynucleotide sequence
aacttgatggtggccacagaga

SEQ ID NO: 23801 - DNA, 18 bp, Artificial sequence
  synthetic polynucleotide sequence
ctacatccctggctcgga

SEQ ID NO: 23802 - DNA, 20 bp, Artificial sequence
  synthetic polynucleotide sequence
gtgacacccctcgatcagca

SEQ ID NO: 23803 - DNA, 21 bp, Artificial sequence
  synthetic polynucleotide sequence
atcatcccagggacccagaca

SEQ ID NO: 23804 - DNA, 20 bp, Artificial sequence
  synthetic polynucleotide sequence
agtctgcagcagccttccca

SEQ ID NO: 23805 - DNA, 25 bp, Artificial sequence
  synthetic polynucleotide sequence
agaccagtcatgcaaccacaaggaa

SEQ ID NO: 23806 - DNA, 22 bp, Artificial sequence
  synthetic polynucleotide sequence
gtccgtcagagtccagtgaaga

SEQ ID NO: 23807 - DNA, 22 bp, Artificial sequence
  synthetic polynucleotide sequence
gaaagacaaggatgaccaggaa

SEQ ID NO: 23808 - DNA, 18 bp, Artificial sequence
  synthetic polynucleotide sequence
gggcgatgaccccagaga

SEQ ID NO: 23809 - DNA, 21 bp, Artificial sequence
  synthetic polynucleotide sequence
gagaagtggttgaacagggca

SEQ ID NO: 23810 - DNA, 20 bp, Artificial sequence
  synthetic polynucleotide sequence
tccatccacggccactagga

SEQ ID NO: 23811 - DNA, 19 bp, Artificial sequence
  synthetic polynucleotide sequence
gggctgatgaggaggacga

SEQ ID NO: 23812 - DNA, 18 bp, Artificial sequence
  synthetic polynucleotide sequence
cattcacccacaggcgga

SEQ ID NO: 23813 - DNA, 18 bp, Artificial sequence
  synthetic polynucleotide sequence
ccggtggacaaccagcaa

SEQ ID NO: 23814 - DNA, 18 bp, Artificial sequence
  synthetic polynucleotide sequence
tcatcagcgagcgggtga

SEQ ID NO: 23815 - DNA, 21 bp, Artificial sequence
  synthetic polynucleotide sequence
atcccaagcggagaatgacca

SEQ ID NO: 23816 - DNA, 21 bp, Artificial sequence
  synthetic polynucleotide sequence
cctcctccagcaccttggaga

SEQ ID NO: 23817 - DNA, 18 bp, Artificial sequence
  synthetic polynucleotide sequence
aacagtgcacatggcgca

SEQ ID NO: 23818 - DNA, 17 bp, Artificial sequence
  synthetic polynucleotide sequence
cgaggcagctggccaga

SEQ ID NO: 23819 - DNA, 20 bp, Artificial sequence
  synthetic polynucleotide sequence
atctctgtgcaaagaccgga

SEQ ID NO: 23820 - DNA, 18 bp, Artificial sequence
  synthetic polynucleotide sequence
tgaacgaccgagatcgga

SEQ ID NO: 23821 - DNA, 18 bp, Artificial sequence
  synthetic polynucleotide sequence
tgtggcggtgggagacca

SEQ ID NO: 23822 - DNA, 18 bp, Artificial sequence
  synthetic polynucleotide sequence
catccagctgcaggggca

SEQ ID NO: 23823 - DNA, 21 bp, Artificial sequence
  synthetic polynucleotide sequence
gtaccatccagggaacctgga

SEQ ID NO: 23824 - DNA, 22 bp, Artificial sequence
  synthetic polynucleotide sequence
cgataacatcgggcaacctgaa

SEQ ID NO: 23825 - DNA, 20 bp, Artificial sequence
  synthetic polynucleotide sequence
gtggcgactggaagtatgga

SEQ ID NO: 23826 - DNA, 20 bp, Artificial sequence
  synthetic polynucleotide sequence
cttccagtatcagcgtccca

SEQ ID NO: 23827 - DNA, 18 bp, Artificial sequence
  synthetic polynucleotide sequence
gagctcggctccaaggca

SEQ ID NO: 23828 - DNA, 18 bp, Artificial sequence
  synthetic polynucleotide sequence
tctggaggcagaagggca

SEQ ID NO: 23829 - DNA, 18 bp, Artificial sequence
  synthetic polynucleotide sequence
ctcaggctgccccggaca

SEQ ID NO: 23830 - DNA, 20 bp, Artificial sequence
  synthetic polynucleotide sequence
agaagccctgtccgaagcca

SEQ ID NO: 23831 - DNA, 18 bp, Artificial sequence
  synthetic polynucleotide sequence
cacccaggggctgccaca

SEQ ID NO: 23832 - DNA, 18 bp, Artificial sequence
  synthetic polynucleotide sequence
accagcactgtggagcca

SEQ ID NO: 23833 - DNA, 21 bp, Artificial sequence
  synthetic polynucleotide sequence
atatgcagcccacaaccacga

SEQ ID NO: 23834 - DNA, 20 bp, Artificial sequence
  synthetic polynucleotide sequence
ctttgctccccaacaggcca

SEQ ID NO: 23835 - DNA, 21 bp, Artificial sequence
  synthetic polynucleotide sequence
ccggagccatgaggatccaca

SEQ ID NO: 23836 - DNA, 20 bp, Artificial sequence
  synthetic polynucleotide sequence
cttcaactcgccctcccaga

SEQ ID NO: 23837 - DNA, 19 bp, Artificial sequence
  synthetic polynucleotide sequence
cagagtgcccagcaccgga

SEQ ID NO: 23838 - DNA, 20 bp, Artificial sequence
  synthetic polynucleotide sequence
gaggccagcctggaaaggga

SEQ ID NO: 23839 - DNA, 21 bp, Artificial sequence
  synthetic polynucleotide sequence
ctacgtgcactactaccccca

SEQ ID NO: 23840 - DNA, 18 bp, Artificial sequence
  synthetic polynucleotide sequence
cctgagggcaggtgcaga

SEQ ID NO: 23841 - DNA, 21 bp, Artificial sequence
  synthetic polynucleotide sequence
gtttgagaaagctgcagagga

SEQ ID NO: 23842 - DNA, 20 bp, Artificial sequence
  synthetic polynucleotide sequence
gtggccatagatgaacagca

SEQ ID NO: 23843 - DNA, 20 bp, Artificial sequence
  synthetic polynucleotide sequence
cactgccactgctgacacca

SEQ ID NO: 23844 - DNA, 20 bp, Artificial sequence
  synthetic polynucleotide sequence
aagttgagaagggtggcaca

SEQ ID NO: 23845 - DNA, 21 bp, Artificial sequence
  synthetic polynucleotide sequence
acttcgacctcctggacctca

SEQ ID NO: 23846 - DNA, 19 bp, Artificial sequence
  synthetic polynucleotide sequence
ggtgcagacctgctgggga

SEQ ID NO: 23847 - DNA, 21 bp, Artificial sequence
  synthetic polynucleotide sequence
ctgcatctcgagtcgcagaga

SEQ ID NO: 23848 - DNA, 19 bp, Artificial sequence
  synthetic polynucleotide sequence
ctggggggttggtggagga

SEQ ID NO: 23849 - DNA, 19 bp, Artificial sequence
  synthetic polynucleotide sequence
gcagccgacgacacagaga

SEQ ID NO: 23850 - DNA, 20 bp, Artificial sequence
  synthetic polynucleotide sequence
ctccacgtagttggcaggga

SEQ ID NO: 23851 - DNA, 20 bp, Artificial sequence
  synthetic polynucleotide sequence
aagaacaacgaggcagccaa

SEQ ID NO: 23852 - DNA, 18 bp, Artificial sequence
  synthetic polynucleotide sequence
gctcctggcgcacggcca

SEQ ID NO: 23853 - DNA, 18 bp, Artificial sequence
  synthetic polynucleotide sequence
aggcggatctacgctgca

SEQ ID NO: 23854 - DNA, 18 bp, Artificial sequence
  synthetic polynucleotide sequence
ggtgccacccagccacca

SEQ ID NO: 23855 - DNA, 18 bp, Artificial sequence
  synthetic polynucleotide sequence
gcctatgtggggaagcca

SEQ ID NO: 23856 - DNA, 18 bp, Artificial sequence
  synthetic polynucleotide sequence
tccattgccagacggcga

SEQ ID NO: 23857 - DNA, 21 bp, Artificial sequence
  synthetic polynucleotide sequence
ccatcatgagggagagaccca

SEQ ID NO: 23858 - DNA, 20 bp, Artificial sequence
  synthetic polynucleotide sequence
caaaccctggtctaggccca

SEQ ID NO: 23859 - DNA, 21 bp, Artificial sequence
  synthetic polynucleotide sequence
ctgtgcattctcagcacggga

SEQ ID NO: 23860 - DNA, 21 bp, Artificial sequence
  synthetic polynucleotide sequence
gatgtcagcagcaaggaccca

SEQ ID NO: 23861 - DNA, 18 bp, Artificial sequence
  synthetic polynucleotide sequence
gcttgcccaaagaagcca

SEQ ID NO: 23862 - DNA, 20 bp, Artificial sequence
  synthetic polynucleotide sequence
gaaacccgtccactaaggca

SEQ ID NO: 23863 - DNA, 18 bp, Artificial sequence
  synthetic polynucleotide sequence
cagttcgtgggacgggaa

SEQ ID NO: 23864 - DNA, 18 bp, Artificial sequence
  synthetic polynucleotide sequence
gattggggcactggggca

SEQ ID NO: 23865 - DNA, 21 bp, Artificial sequence
  synthetic polynucleotide sequence
cactggaggagacaaccccaa

SEQ ID NO: 23866 - DNA, 21 bp, Artificial sequence
  synthetic polynucleotide sequence
tgcatacacagggacccgtga

SEQ ID NO: 23867 - DNA, 22 bp, Artificial sequence
  synthetic polynucleotide sequence
tcatcaaccccagtaaccgcaa

SEQ ID NO: 23868 - DNA, 19 bp, Artificial sequence
  synthetic polynucleotide sequence
ctgctggtcctggcgcaga

SEQ ID NO: 23869 - DNA, 19 bp, Artificial sequence
  synthetic polynucleotide sequence
tcagcggcaagaaccagga

SEQ ID NO: 23870 - DNA, 20 bp, Artificial sequence
  synthetic polynucleotide sequence
cctgtgccaccctctcgaga

SEQ ID NO: 23871 - DNA, 22 bp, Artificial sequence
  synthetic polynucleotide sequence
aggtgaagatgctgagccggaa

SEQ ID NO: 23872 - DNA, 22 bp, Artificial sequence
  synthetic polynucleotide sequence
attgactccatcacggtgacca

SEQ ID NO: 23873 - DNA, 21 bp, Artificial sequence
  synthetic polynucleotide sequence
ggaggatgagttggaggacga

SEQ ID NO: 23874 - DNA, 22 bp, Artificial sequence
  synthetic polynucleotide sequence
aagaacagaactgatggcccca

SEQ ID NO: 23875 - DNA, 21 bp, Artificial sequence
  synthetic polynucleotide sequence
ggatccaagcacaccagtcca

SEQ ID NO: 23876 - DNA, 20 bp, Artificial sequence
  synthetic polynucleotide sequence
ctctagagagccggctggga

SEQ ID NO: 23877 - DNA, 20 bp, Artificial sequence
  synthetic polynucleotide sequence
gggcgctggtgtgccaggaa

SEQ ID NO: 23878 - DNA, 20 bp, Artificial sequence
  synthetic polynucleotide sequence
cactgctgacacagcgccga

SEQ ID NO: 23879 - DNA, 21 bp, Artificial sequence
  synthetic polynucleotide sequence
ggccaggactgctacacgaga

SEQ ID NO: 23880 - DNA, 18 bp, Artificial sequence
  synthetic polynucleotide sequence
gccgcgacgagaaggcca

SEQ ID NO: 23881 - DNA, 18 bp, Artificial sequence
  synthetic polynucleotide sequence
ggtggcagtgggccagga

SEQ ID NO: 23882 - DNA, 19 bp, Artificial sequence
  synthetic polynucleotide sequence
gcgaaggccacgctgggaa

SEQ ID NO: 23883 - DNA, 18 bp, Artificial sequence
  synthetic polynucleotide sequence
cccgtgcatgtgaacgaa

SEQ ID NO: 23884 - DNA, 18 bp, Artificial sequence
  synthetic polynucleotide sequence
gcaggtggccatgacgga

SEQ ID NO: 23885 - DNA, 22 bp, Artificial sequence
  synthetic polynucleotide sequence
aacctgtccctccaaagtgcca

SEQ ID NO: 23886 - DNA, 20 bp, Artificial sequence
  synthetic polynucleotide sequence
tgaaacacaggcaggcggga

SEQ ID NO: 23887 - DNA, 21 bp, Artificial sequence
  synthetic polynucleotide sequence
gccatcgcaactccaggacaa

SEQ ID NO: 23888 - DNA, 22 bp, Artificial sequence
  synthetic polynucleotide sequence
caaatgctcagcagtgtgccga

SEQ ID NO: 23889 - DNA, 19 bp, Artificial sequence
  synthetic polynucleotide sequence
ccctgcacacctgtcgcca

SEQ ID NO: 23890 - DNA, 19 bp, Artificial sequence
  synthetic polynucleotide sequence
tcagctgtgtaggccagga

SEQ ID NO: 23891 - DNA, 19 bp, Artificial sequence
  synthetic polynucleotide sequence
ttgcagtgggtggacgaga

SEQ ID NO: 23892 - DNA, 20 bp, Artificial sequence
  synthetic polynucleotide sequence
tgggccccatcactgtgaga

SEQ ID NO: 23893 - DNA, 21 bp, Artificial sequence
  synthetic polynucleotide sequence
gaccagtggcctagatcagca

SEQ ID NO: 23894 - DNA, 21 bp, Artificial sequence
  synthetic polynucleotide sequence
aggtgacgcacgaagaaccga

SEQ ID NO: 23895 - DNA, 25 bp, Artificial sequence
  synthetic polynucleotide sequence
aacgagatgaagacagcttgcacca

SEQ ID NO: 23896 - DNA, 20 bp, Artificial sequence
  synthetic polynucleotide sequence
cgtgacgcaggaggaaccaa

SEQ ID NO: 23897 - DNA, 21 bp, Artificial sequence
  synthetic polynucleotide sequence
gtgtcaccaaacgccaggtca

SEQ ID NO: 23898 - DNA, 22 bp, Artificial sequence
  synthetic polynucleotide sequence
taaggcagaaggtagtgggtga

SEQ ID NO: 23899 - DNA, 21 bp, Artificial sequence
  synthetic polynucleotide sequence
agtctcaccgggaaactcaca

SEQ ID NO: 23900 - DNA, 20 bp, Artificial sequence
  synthetic polynucleotide sequence
gtgcgaagaccaggccctga

SEQ ID NO: 23901 - DNA, 20 bp, Artificial sequence
  synthetic polynucleotide sequence
gttccctgtcagacaagcga

SEQ ID NO: 23902 - DNA, 20 bp, Artificial sequence
  synthetic polynucleotide sequence
ctcccccaaatcgatctcca

SEQ ID NO: 23903 - DNA, 18 bp, Artificial sequence
  synthetic polynucleotide sequence
atgtcagggcaccccaca

SEQ ID NO: 23904 - DNA, 18 bp, Artificial sequence
  synthetic polynucleotide sequence
ggcctgggctgaggagca

SEQ ID NO: 23905 - DNA, 20 bp, Artificial sequence
  synthetic polynucleotide sequence
gacctcacaccagtcagcca

SEQ ID NO: 23906 - DNA, 18 bp, Artificial sequence
  synthetic polynucleotide sequence
gggatggcgctcacgaca

SEQ ID NO: 23907 - DNA, 21 bp, Artificial sequence
  synthetic polynucleotide sequence
aggatcggggaacccttgcca

SEQ ID NO: 23908 - DNA, 20 bp, Artificial sequence
  synthetic polynucleotide sequence
gttttccgagtccccccaca

SEQ ID NO: 23909 - DNA, 21 bp, Artificial sequence
  synthetic polynucleotide sequence
tctcagtttggccccaacaga

SEQ ID NO: 23910 - DNA, 21 bp, Artificial sequence
  synthetic polynucleotide sequence
ctcagttgacccactggagca

SEQ ID NO: 23911 - DNA, 21 bp, Artificial sequence
  synthetic polynucleotide sequence
agtcgatcagaggccagcaga

SEQ ID NO: 23912 - DNA, 21 bp, Artificial sequence
  synthetic polynucleotide sequence
tcctcgacttgctcaggggca

SEQ ID NO: 23913 - DNA, 20 bp, Artificial sequence
  synthetic polynucleotide sequence
cacagggcccaggtaaccca

SEQ ID NO: 23914 - DNA, 21 bp, Artificial sequence
  synthetic polynucleotide sequence
atgggaatgagagtgtgggga

SEQ ID NO: 23915 - DNA, 21 bp, Artificial sequence
  synthetic polynucleotide sequence
ccctctaggaggcgttcggaa

SEQ ID NO: 23916 - DNA, 21 bp, Artificial sequence
  synthetic polynucleotide sequence
acctcactgggcacccttgga

SEQ ID NO: 23917 - DNA, 21 bp, Artificial sequence
  synthetic polynucleotide sequence
gcagccacacaccagaaggca

SEQ ID NO: 23918 - DNA, 19 bp, Artificial sequence
  synthetic polynucleotide sequence
ttggaggctgctctggcaa

SEQ ID NO: 23919 - DNA, 18 bp, Artificial sequence
  synthetic polynucleotide sequence
gtccatgcaggaggcaca

SEQ ID NO: 23920 - DNA, 19 bp, Artificial sequence
  synthetic polynucleotide sequence
cagggtcagggtcagcaca

SEQ ID NO: 23921 - DNA, 21 bp, Artificial sequence
  synthetic polynucleotide sequence
accacccagcgttcctcagga

SEQ ID NO: 23922 - DNA, 20 bp, Artificial sequence
  synthetic polynucleotide sequence
gctggcgatggagtaccgga

SEQ ID NO: 23923 - DNA, 19 bp, Artificial sequence
  synthetic polynucleotide sequence
tcaagccactccagagaca

SEQ ID NO: 23924 - DNA, 21 bp, Artificial sequence
  synthetic polynucleotide sequence
cagtgtcctatgcaggagcca

SEQ ID NO: 23925 - DNA, 21 bp, Artificial sequence
  synthetic polynucleotide sequence
aaggtggacatctgggcagca

SEQ ID NO: 23926 - DNA, 21 bp, Artificial sequence
  synthetic polynucleotide sequence
aaggaaagtccacctgcccca

SEQ ID NO: 23927 - DNA, 23 bp, Artificial sequence
  synthetic polynucleotide sequence
gataacatcacggactctgccaa

SEQ ID NO: 23928 - DNA, 21 bp, Artificial sequence
  synthetic polynucleotide sequence
ggaggcatcatctgacaccca

SEQ ID NO: 23929 - DNA, 21 bp, Artificial sequence
  synthetic polynucleotide sequence
caagagcattgtccaccggga

SEQ ID NO: 23930 - DNA, 18 bp, Artificial sequence
  synthetic polynucleotide sequence
gggctgcggaatggggga

SEQ ID NO: 23931 - DNA, 22 bp, Artificial sequence
  synthetic polynucleotide sequence
aaaagccaacacgtgtccccaa

SEQ ID NO: 23932 - DNA, 21 bp, Artificial sequence
  synthetic polynucleotide sequence
tgtttcagagcgtggtggaga

SEQ ID NO: 23933 - DNA, 20 bp, Artificial sequence
  synthetic polynucleotide sequence
catacgcccatcgcagtgga

SEQ ID NO: 23934 - DNA, 20 bp, Artificial sequence
  synthetic polynucleotide sequence
ccaggtgctagacaggccca

SEQ ID NO: 23935 - DNA, 23 bp, Artificial sequence
  synthetic polynucleotide sequence
aaaaactgagacaaaccccagga

SEQ ID NO: 23936 - DNA, 21 bp, Artificial sequence
  synthetic polynucleotide sequence
gcaggtgaagtacagagccca

SEQ ID NO: 23937 - DNA, 18 bp, Artificial sequence
  synthetic polynucleotide sequence
caggttgaccccacagca

SEQ ID NO: 23938 - DNA, 22 bp, Artificial sequence
  synthetic polynucleotide sequence
ggataacaccttaggctgcaca

SEQ ID NO: 23939 - DNA, 21 bp, Artificial sequence
  synthetic polynucleotide sequence
ccatggtgttcgcacaaccca

SEQ ID NO: 23940 - DNA, 21 bp, Artificial sequence
  synthetic polynucleotide sequence
ggctctgtatgggcaggagga

SEQ ID NO: 23941 - DNA, 22 bp, Artificial sequence
  synthetic polynucleotide sequence
accagtgggtaaagcacaggca

SEQ ID NO: 23942 - DNA, 22 bp, Artificial sequence
  synthetic polynucleotide sequence
ttcactggagctaggcaagtca

SEQ ID NO: 23943 - DNA, 18 bp, Artificial sequence
  synthetic polynucleotide sequence
ccggatgaagggagacca

SEQ ID NO: 23944 - DNA, 20 bp, Artificial sequence
  synthetic polynucleotide sequence
gtgcctagggtcacactcca

SEQ ID NO: 23945 - DNA, 20 bp, Artificial sequence
  synthetic polynucleotide sequence
gtctgcacgccccgcgaaga

SEQ ID NO: 23946 - DNA, 20 bp, Artificial sequence
  synthetic polynucleotide sequence
acggtgcggaagagcgagca

SEQ ID NO: 23947 - DNA, 19 bp, Artificial sequence
  synthetic polynucleotide sequence
ccctgagccccacagacca

SEQ ID NO: 23948 - DNA, 21 bp, Artificial sequence
  synthetic polynucleotide sequence
ggtgggtgggaaggatcagga

SEQ ID NO: 23949 - DNA, 21 bp, Artificial sequence
  synthetic polynucleotide sequence
acagcaaaggggaagtcctga

SEQ ID NO: 23950 - DNA, 20 bp, Artificial sequence
  synthetic polynucleotide sequence
gccagtgccaagcaggacga

SEQ ID NO: 23951 - DNA, 21 bp, Artificial sequence
  synthetic polynucleotide sequence
acgtgtgccatgcggagctga

SEQ ID NO: 23952 - DNA, 20 bp, Artificial sequence
  synthetic polynucleotide sequence
taaacaggagcctcgcagca

SEQ ID NO: 23953 - DNA, 18 bp, Artificial sequence
  synthetic polynucleotide sequence
gcgaatgccagggacaga

SEQ ID NO: 23954 - DNA, 20 bp, Artificial sequence
  synthetic polynucleotide sequence
aagccagttcctccagagca

SEQ ID NO: 23955 - DNA, 21 bp, Artificial sequence
  synthetic polynucleotide sequence
tcaagctgccaaagtcgcaga

SEQ ID NO: 23956 - DNA, 20 bp, Artificial sequence
  synthetic polynucleotide sequence
actctgtagccgagcctcca

SEQ ID NO: 23957 - DNA, 22 bp, Artificial sequence
  synthetic polynucleotide sequence
tccacattcagcagcaggacca

SEQ ID NO: 23958 - DNA, 21 bp, Artificial sequence
  synthetic polynucleotide sequence
gtagctcatcccactgcacga

SEQ ID NO: 23959 - DNA, 18 bp, Artificial sequence
  synthetic polynucleotide sequence
acccagccaagaccacca

SEQ ID NO: 23960 - DNA, 18 bp, Artificial sequence
  synthetic polynucleotide sequence
ggttcctgccaaccgcca

SEQ ID NO: 23961 - DNA, 21 bp, Artificial sequence
  synthetic polynucleotide sequence
cggaagccgggccaatagtga

SEQ ID NO: 23962 - DNA, 19 bp, Artificial sequence
  synthetic polynucleotide sequence
taggttgcaacaagcccca

SEQ ID NO: 23963 - DNA, 18 bp, Artificial sequence
  synthetic polynucleotide sequence
tcccccagggaacgggca

SEQ ID NO: 23964 - DNA, 19 bp, Artificial sequence
  synthetic polynucleotide sequence
gagagcactgctagcggca

SEQ ID NO: 23965 - DNA, 21 bp, Artificial sequence
  synthetic polynucleotide sequence
cagagcagcaacacagtgcga

SEQ ID NO: 23966 - DNA, 21 bp, Artificial sequence
  synthetic polynucleotide sequence
agttccagtaggcaatggcca

SEQ ID NO: 23967 - DNA, 20 bp, Artificial sequence
  synthetic polynucleotide sequence
cgctaagaacccagggcaga

SEQ ID NO: 23968 - DNA, 22 bp, Artificial sequence
  synthetic polynucleotide sequence
caaagtccagcaggaggttcca

SEQ ID NO: 23969 - DNA, 20 bp, Artificial sequence
  synthetic polynucleotide sequence
agcggtcactgcatcgggaa

SEQ ID NO: 23970 - DNA, 21 bp, Artificial sequence
  synthetic polynucleotide sequence
tagttgctgaggtcagggcca

SEQ ID NO: 23971 - DNA, 18 bp, Artificial sequence
  synthetic polynucleotide sequence
cggatgccgccgctgtca

SEQ ID NO: 23972 - DNA, 22 bp, Artificial sequence
  synthetic polynucleotide sequence
tgaagaactgcaagaccgcaga

SEQ ID NO: 23973 - DNA, 20 bp, Artificial sequence
  synthetic polynucleotide sequence
tgcttgggaggacatggcca

SEQ ID NO: 23974 - DNA, 22 bp, Artificial sequence
  synthetic polynucleotide sequence
aagaagaacaggccaagcacca

SEQ ID NO: 23975 - DNA, 19 bp, Artificial sequence
  synthetic polynucleotide sequence
gccagctctctacccccaa

SEQ ID NO: 23976 - DNA, 20 bp, Artificial sequence
  synthetic polynucleotide sequence
gtcatccaaggacagaggca

SEQ ID NO: 23977 - DNA, 18 bp, Artificial sequence
  synthetic polynucleotide sequence
ccaagggtgccctggaca

SEQ ID NO: 23978 - DNA, 18 bp, Artificial sequence
  synthetic polynucleotide sequence
cctggcccatggacgtca

SEQ ID NO: 23979 - DNA, 21 bp, Artificial sequence
  synthetic polynucleotide sequence
gtgtgcaaagcctcgaaccga

SEQ ID NO: 23980 - DNA, 20 bp, Artificial sequence
  synthetic polynucleotide sequence
ctgatgcaggtagcgcagga

SEQ ID NO: 23981 - DNA, 21 bp, Artificial sequence
  synthetic polynucleotide sequence
accaccgctacgacaaactca

SEQ ID NO: 23982 - DNA, 18 bp, Artificial sequence
  synthetic polynucleotide sequence
ccggggttcggtgcagca

SEQ ID NO: 23983 - DNA, 18 bp, Artificial sequence
  synthetic polynucleotide sequence
caaaaggctgtccgggca

SEQ ID NO: 23984 - DNA, 18 bp, Artificial sequence
  synthetic polynucleotide sequence
ggcacaccaggcaaccca

SEQ ID NO: 23985 - DNA, 18 bp, Artificial sequence
  synthetic polynucleotide sequence
aggatagcgctgccacca

SEQ ID NO: 23986 - DNA, 19 bp, Artificial sequence
  synthetic polynucleotide sequence
ggggtggaagtctcaccca

SEQ ID NO: 23987 - DNA, 18 bp, Artificial sequence
  synthetic polynucleotide sequence
tgtgggccgatacccaga

SEQ ID NO: 23988 - DNA, 18 bp, Artificial sequence
  synthetic polynucleotide sequence
aacccattgcagaggcca

SEQ ID NO: 23989 - DNA, 18 bp, Artificial sequence
  synthetic polynucleotide sequence
ttgccaccctggggacca

SEQ ID NO: 23990 - DNA, 18 bp, Artificial sequence
  synthetic polynucleotide sequence
gtgccggaactcagggca

SEQ ID NO: 23991 - DNA, 21 bp, Artificial sequence
  synthetic polynucleotide sequence
aggggccagcagatgcaggaa

SEQ ID NO: 23992 - DNA, 21 bp, Artificial sequence
  synthetic polynucleotide sequence
catccacactgtgccagtcca

SEQ ID NO: 23993 - DNA, 19 bp, Artificial sequence
  synthetic polynucleotide sequence
cgctgcggatggcctggaa

SEQ ID NO: 23994 - DNA, 21 bp, Artificial sequence
  synthetic polynucleotide sequence
cctccattcagcatccccaca

SEQ ID NO: 23995 - DNA, 21 bp, Artificial sequence
  synthetic polynucleotide sequence
cgatagaagaggcccccgaga

SEQ ID NO: 23996 - DNA, 18 bp, Artificial sequence
  synthetic polynucleotide sequence
ggtcatctgggcgcccga

SEQ ID NO: 23997 - DNA, 21 bp, Artificial sequence
  synthetic polynucleotide sequence
ttgaggaacagcccatggaca

SEQ ID NO: 23998 - DNA, 21 bp, Artificial sequence
  synthetic polynucleotide sequence
ctcttccagccccatatgcca

SEQ ID NO: 23999 - DNA, 19 bp, Artificial sequence
  synthetic polynucleotide sequence
gcacctcagctgcacccta

SEQ ID NO: 24000 - DNA, 20 bp, Artificial sequence
  synthetic polynucleotide sequence
caggtgaccaagcacttcga

SEQ ID NO: 24001 - DNA, 20 bp, Artificial sequence
  synthetic polynucleotide sequence
gaggagccagaaccagcaga

SEQ ID NO: 24002 - DNA, 19 bp, Artificial sequence
  synthetic polynucleotide sequence
ctgagccagggagctctga

SEQ ID NO: 24003 - DNA, 18 bp, Artificial sequence
  synthetic polynucleotide sequence
agctggcactcgacccca

SEQ ID NO: 24004 - DNA, 19 bp, Artificial sequence
  synthetic polynucleotide sequence
ggaagggagagttggcgga

SEQ ID NO: 24005 - DNA, 20 bp, Artificial sequence
  synthetic polynucleotide sequence
atcacccagagagcctgcta

SEQ ID NO: 24006 - DNA, 19 bp, Artificial sequence
  synthetic polynucleotide sequence
cgcagggctccgttgagga

SEQ ID NO: 24007 - DNA, 20 bp, Artificial sequence
  synthetic polynucleotide sequence
aatgagaggaccctgcccga

SEQ ID NO: 24008 - DNA, 20 bp, Artificial sequence
  synthetic polynucleotide sequence
tctgatgtccctcaccccga

SEQ ID NO: 24009 - DNA, 21 bp, Artificial sequence
  synthetic polynucleotide sequence
tccttgcgcgagatggacaga

SEQ ID NO: 24010 - DNA, 21 bp, Artificial sequence
  synthetic polynucleotide sequence
gggcatggacacactcgctca

SEQ ID NO: 24011 - DNA, 20 bp, Artificial sequence
  synthetic polynucleotide sequence
aaccggctaggctacacaca

SEQ ID NO: 24012 - DNA, 21 bp, Artificial sequence
  synthetic polynucleotide sequence
ggcgtagtaggggtaggccga

SEQ ID NO: 24013 - DNA, 18 bp, Artificial sequence
  synthetic polynucleotide sequence
tgggcagctcaccgacga

SEQ ID NO: 24014 - DNA, 18 bp, Artificial sequence
  synthetic polynucleotide sequence
tcctctgccaggaaccga

SEQ ID NO: 24015 - DNA, 18 bp, Artificial sequence
  synthetic polynucleotide sequence
cgagatctggccacacga

SEQ ID NO: 24016 - DNA, 18 bp, Artificial sequence
  synthetic polynucleotide sequence
cccaagacatccagcgga

SEQ ID NO: 24017 - DNA, 21 bp, Artificial sequence
  synthetic polynucleotide sequence
tgtgattgacgaccggggcaa

SEQ ID NO: 24018 - DNA, 20 bp, Artificial sequence
  synthetic polynucleotide sequence
ggcttgggcaagctcggcga

SEQ ID NO: 24019 - DNA, 18 bp, Artificial sequence
  synthetic polynucleotide sequence
aggacaaccgcagccaca

SEQ ID NO: 24020 - DNA, 18 bp, Artificial sequence
  synthetic polynucleotide sequence
gccaggactccaagggga

SEQ ID NO: 24021 - DNA, 19 bp, Artificial sequence
  synthetic polynucleotide sequence
cgcggggctggagaaacga

SEQ ID NO: 24022 - DNA, 20 bp, Artificial sequence
  synthetic polynucleotide sequence
gagatggacagctgcgcgca

SEQ ID NO: 24023 - DNA, 19 bp, Artificial sequence
  synthetic polynucleotide sequence
ttctccccaatgctccgaa

SEQ ID NO: 24024 - DNA, 19 bp, Artificial sequence
  synthetic polynucleotide sequence
gagctgatcccgggctgca

SEQ ID NO: 24025 - DNA, 20 bp, Artificial sequence
  synthetic polynucleotide sequence
gtcctgaggatgccaacaca

SEQ ID NO: 24026 - DNA, 20 bp, Artificial sequence
  synthetic polynucleotide sequence
ctgaagaagctgctgcacca

SEQ ID NO: 24027 - DNA, 19 bp, Artificial sequence
  synthetic polynucleotide sequence
gggaaggctctggtggaga

SEQ ID NO: 24028 - DNA, 18 bp, Artificial sequence
  synthetic polynucleotide sequence
atcgctggtccaggagca

SEQ ID NO: 24029 - DNA, 18 bp, Artificial sequence
  synthetic polynucleotide sequence
ggagcacaagcaggccaa

SEQ ID NO: 24030 - DNA, 20 bp, Artificial sequence
  synthetic polynucleotide sequence
tagctccataagtgccagca

SEQ ID NO: 24031 - DNA, 20 bp, Artificial sequence
  synthetic polynucleotide sequence
ataagtcagcccaggaagca

SEQ ID NO: 24032 - DNA, 20 bp, Artificial sequence
  synthetic polynucleotide sequence
cagatcaacgaagggaggca

SEQ ID NO: 24033 - DNA, 18 bp, Artificial sequence
  synthetic polynucleotide sequence
acgtgtgtgcccgcggca

SEQ ID NO: 24034 - DNA, 19 bp, Artificial sequence
  synthetic polynucleotide sequence
gccaggcccctcttgccaa

SEQ ID NO: 24035 - DNA, 21 bp, Artificial sequence
  synthetic polynucleotide sequence
acctctacggggccatcacca

SEQ ID NO: 24036 - DNA, 19 bp, Artificial sequence
  synthetic polynucleotide sequence
gccctctcggaagcgctca

SEQ ID NO: 24037 - DNA, 18 bp, Artificial sequence
  synthetic polynucleotide sequence
ctgggctgtgacaggcaa

SEQ ID NO: 24038 - DNA, 20 bp, Artificial sequence
  synthetic polynucleotide sequence
gaatctgggggagtgacaca

SEQ ID NO: 24039 - DNA, 18 bp, Artificial sequence
  synthetic polynucleotide sequence
tgccacgtccgtagacca

SEQ ID NO: 24040 - DNA, 18 bp, Artificial sequence
  synthetic polynucleotide sequence
ggccacagagagctgcca

SEQ ID NO: 24041 - DNA, 21 bp, Artificial sequence
  synthetic polynucleotide sequence
tgttggccaaatccctggaga

SEQ ID NO: 24042 - DNA, 22 bp, Artificial sequence
  synthetic polynucleotide sequence
atgtcaataccacgaccagcca

SEQ ID NO: 24043 - DNA, 21 bp, Artificial sequence
  synthetic polynucleotide sequence
atggatgtggtcaaggagcga

SEQ ID NO: 24044 - DNA, 20 bp, Artificial sequence
  synthetic polynucleotide sequence
ccagctcaatctccagggca

SEQ ID NO: 24045 - DNA, 22 bp, Artificial sequence
  synthetic polynucleotide sequence
cacactgaacaacatccggcaa

SEQ ID NO: 24046 - DNA, 22 bp, Artificial sequence
  synthetic polynucleotide sequence
cagaagatgatggcctgaccaa

SEQ ID NO: 24047 - DNA, 20 bp, Artificial sequence
  synthetic polynucleotide sequence
gtgctagtgcccacccgaga

SEQ ID NO: 24048 - DNA, 20 bp, Artificial sequence
  synthetic polynucleotide sequence
cttcacatccaagccgccca

SEQ ID NO: 24049 - DNA, 20 bp, Artificial sequence
  synthetic polynucleotide sequence
aaggactggtccctcaggaa

SEQ ID NO: 24050 - DNA, 19 bp, Artificial sequence
  synthetic polynucleotide sequence
gacaaccagctccacacca

SEQ ID NO: 24051 - DNA, 21 bp, Artificial sequence
  synthetic polynucleotide sequence
ggactcggacacctacctgca

SEQ ID NO: 24052 - DNA, 21 bp, Artificial sequence
  synthetic polynucleotide sequence
tcaaaccggtcctggacgtca

SEQ ID NO: 24053 - DNA, 19 bp, Artificial sequence
  synthetic polynucleotide sequence
cctgcatcgggtggccaga

SEQ ID NO: 24054 - DNA, 22 bp, Artificial sequence
  synthetic polynucleotide sequence
ttgacctcaaagcgatcctgca

SEQ ID NO: 24055 - DNA, 21 bp, Artificial sequence
  synthetic polynucleotide sequence
tagcagcaagaggactggaca

SEQ ID NO: 24056 - DNA, 18 bp, Artificial sequence
  synthetic polynucleotide sequence
aatgaggttgccaggcca

SEQ ID NO: 24057 - DNA, 21 bp, Artificial sequence
  synthetic polynucleotide sequence
tggtgccagagactatcgaca

SEQ ID NO: 24058 - DNA, 20 bp, Artificial sequence
  synthetic polynucleotide sequence
tgccgtaaccacctccacca

SEQ ID NO: 24059 - DNA, 20 bp, Artificial sequence
  synthetic polynucleotide sequence
aacagagagagcgggagcaa

SEQ ID NO: 24060 - DNA, 18 bp, Artificial sequence
  synthetic polynucleotide sequence
caacgaccagtacgccca

SEQ ID NO: 24061 - DNA, 18 bp, Artificial sequence
  synthetic polynucleotide sequence
gctcgggaaacacaggca

SEQ ID NO: 24062 - DNA, 18 bp, Artificial sequence
  synthetic polynucleotide sequence
aatgcagcacctgcagca

SEQ ID NO: 24063 - DNA, 21 bp, Artificial sequence
  synthetic polynucleotide sequence
tgagagcaagatggagcccaa

SEQ ID NO: 24064 - DNA, 21 bp, Artificial sequence
  synthetic polynucleotide sequence
cgtttaggcggctctgggaca

SEQ ID NO: 24065 - DNA, 18 bp, Artificial sequence
  synthetic polynucleotide sequence
gtggtcgctggagaggca

SEQ ID NO: 24066 - DNA, 18 bp, Artificial sequence
  synthetic polynucleotide sequence
ttgacccaccacgaccga

SEQ ID NO: 24067 - DNA, 21 bp, Artificial sequence
  synthetic polynucleotide sequence
ggcggactggaagagcaggaa

SEQ ID NO: 24068 - DNA, 22 bp, Artificial sequence
  synthetic polynucleotide sequence
gaatcccttaccagagaaccca

SEQ ID NO: 24069 - DNA, 19 bp, Artificial sequence
  synthetic polynucleotide sequence
cactgctggagaccccgca

SEQ ID NO: 24070 - DNA, 22 bp, Artificial sequence
  synthetic polynucleotide sequence
tgcactccaatagaggacccca

SEQ ID NO: 24071 - DNA, 21 bp, Artificial sequence
  synthetic polynucleotide sequence
agaaccggcgcttcaaggaga

SEQ ID NO: 24072 - DNA, 19 bp, Artificial sequence
  synthetic polynucleotide sequence
ggactgggcctgagtggga

SEQ ID NO: 24073 - DNA, 19 bp, Artificial sequence
  synthetic polynucleotide sequence
tggagtggcacagactgga

SEQ ID NO: 24074 - DNA, 20 bp, Artificial sequence
  synthetic polynucleotide sequence
ccgagttggtgccagcacca

SEQ ID NO: 24075 - DNA, 18 bp, Artificial sequence
  synthetic polynucleotide sequence
catctgcagagtggccga

SEQ ID NO: 24076 - DNA, 20 bp, Artificial sequence
  synthetic polynucleotide sequence
cactgtgggcaagttgcaga

SEQ ID NO: 24077 - DNA, 19 bp, Artificial sequence
  synthetic polynucleotide sequence
gggacggggattcggggaa

SEQ ID NO: 24078 - DNA, 21 bp, Artificial sequence
  synthetic polynucleotide sequence
cacccccaaaagcttgcacca

SEQ ID NO: 24079 - DNA, 21 bp, Artificial sequence
  synthetic polynucleotide sequence
cccccggaatcgacctagcaa

SEQ ID NO: 24080 - DNA, 21 bp, Artificial sequence
  synthetic polynucleotide sequence
ccttgtgggatgtgcaggcca

SEQ ID NO: 24081 - DNA, 21 bp, Artificial sequence
  synthetic polynucleotide sequence
ttgcacaaaccggaacaggga

SEQ ID NO: 24082 - DNA, 21 bp, Artificial sequence
  synthetic polynucleotide sequence
aggactagcatcccaggccca

SEQ ID NO: 24083 - DNA, 19 bp, Artificial sequence
  synthetic polynucleotide sequence
ccaagaggcggagggagga

SEQ ID NO: 24084 - DNA, 21 bp, Artificial sequence
  synthetic polynucleotide sequence
catcccccatcaagtccagga

SEQ ID NO: 24085 - DNA, 20 bp, Artificial sequence
  synthetic polynucleotide sequence
tgatgtgatggcccggggaa

SEQ ID NO: 24086 - DNA, 21 bp, Artificial sequence
  synthetic polynucleotide sequence
actcttccatgggcaggagga

SEQ ID NO: 24087 - DNA, 21 bp, Artificial sequence
  synthetic polynucleotide sequence
gctatcgctgcagggatgcca

SEQ ID NO: 24088 - DNA, 22 bp, Artificial sequence
  synthetic polynucleotide sequence
aggtagtcaggaacatggccca

SEQ ID NO: 24089 - DNA, 19 bp, Artificial sequence
  synthetic polynucleotide sequence
tggaggatcttcaggccca

SEQ ID NO: 24090 - DNA, 20 bp, Artificial sequence
  synthetic polynucleotide sequence
atcactgacgcatcaagaga

SEQ ID NO: 24091 - DNA, 21 bp, Artificial sequence
  synthetic polynucleotide sequence
agtgcagatactggctcagga

SEQ ID NO: 24092 - DNA, 19 bp, Artificial sequence
  synthetic polynucleotide sequence
tttcatgcgtggcaggcca

SEQ ID NO: 24093 - DNA, 20 bp, Artificial sequence
  synthetic polynucleotide sequence
cactcagcagcaagcacaga

SEQ ID NO: 24094 - DNA, 19 bp, Artificial sequence
  synthetic polynucleotide sequence
tgtggaggtcacatccgaa

SEQ ID NO: 24095 - DNA, 18 bp, Artificial sequence
  synthetic polynucleotide sequence
cgacacatggcagcgaga

SEQ ID NO: 24096 - DNA, 19 bp, Artificial sequence
  synthetic polynucleotide sequence
gtgggtgcaacgtacacga

SEQ ID NO: 24097 - DNA, 21 bp, Artificial sequence
  synthetic polynucleotide sequence
gaaagtgctgagggagagcga

SEQ ID NO: 24098 - DNA, 20 bp, Artificial sequence
  synthetic polynucleotide sequence
agagttctgccggcaggcaa

SEQ ID NO: 24099 - DNA, 18 bp, Artificial sequence
  synthetic polynucleotide sequence
actcccaccaaagcggca

SEQ ID NO: 24100 - DNA, 20 bp, Artificial sequence
  synthetic polynucleotide sequence
gttgagcaaggagttgacca

SEQ ID NO: 24101 - DNA, 23 bp, Artificial sequence
  synthetic polynucleotide sequence
ggtctgtaaagtggcaagcagga

SEQ ID NO: 24102 - DNA, 20 bp, Artificial sequence
  synthetic polynucleotide sequence
gccttgggcctggcaagaga

SEQ ID NO: 24103 - DNA, 18 bp, Artificial sequence
  synthetic polynucleotide sequence
ggcacagccttcgtgaca

SEQ ID NO: 24104 - DNA, 23 bp, Artificial sequence
  synthetic polynucleotide sequence
caaaacctgaaccagtctcagca

SEQ ID NO: 24105 - DNA, 18 bp, Artificial sequence
  synthetic polynucleotide sequence
ctgccagcccgctgcaga

SEQ ID NO: 24106 - DNA, 19 bp, Artificial sequence
  synthetic polynucleotide sequence
cgtcaaccatgccccgcca

SEQ ID NO: 24107 - DNA, 20 bp, Artificial sequence
  synthetic polynucleotide sequence
caggacccacttgagcgcca

SEQ ID NO: 24108 - DNA, 20 bp, Artificial sequence
  synthetic polynucleotide sequence
gtcacgccagaatgcatcga

SEQ ID NO: 24109 - DNA, 20 bp, Artificial sequence
  synthetic polynucleotide sequence
catgggccagccttggagca

SEQ ID NO: 24110 - DNA, 20 bp, Artificial sequence
  synthetic polynucleotide sequence
gcccaggtcccttgagcgca

SEQ ID NO: 24111 - DNA, 18 bp, Artificial sequence
  synthetic polynucleotide sequence
gcgcagcaggagaaggaa

SEQ ID NO: 24112 - DNA, 18 bp, Artificial sequence
  synthetic polynucleotide sequence
gagctgctggtgaccgga

SEQ ID NO: 24113 - DNA, 18 bp, Artificial sequence
  synthetic polynucleotide sequence
gctctgcagagagggcga

SEQ ID NO: 24114 - DNA, 18 bp, Artificial sequence
  synthetic polynucleotide sequence
ccgggcacacttgggaca

SEQ ID NO: 24115 - DNA, 20 bp, Artificial sequence
  synthetic polynucleotide sequence
gcccaggctgagccactcca

SEQ ID NO: 24116 - DNA, 22 bp, Artificial sequence
  synthetic polynucleotide sequence
agggaaacaaccacttctggga

SEQ ID NO: 24117 - DNA, 19 bp, Artificial sequence
  synthetic polynucleotide sequence
gggccagaagaccaggaca

SEQ ID NO: 24118 - DNA, 19 bp, Artificial sequence
  synthetic polynucleotide sequence
gaggcagttcccaacacga

SEQ ID NO: 24119 - DNA, 20 bp, Artificial sequence
  synthetic polynucleotide sequence
caggcaagagccacctgcta

SEQ ID NO: 24120 - DNA, 20 bp, Artificial sequence
  synthetic polynucleotide sequence
ctgatttcacacaccccgga

SEQ ID NO: 24121 - DNA, 21 bp, Artificial sequence
  synthetic polynucleotide sequence
gccaaggctgagccactccaa

SEQ ID NO: 24122 - DNA, 22 bp, Artificial sequence
  synthetic polynucleotide sequence
atcctctgcaaaggagacggca

SEQ ID NO: 24123 - DNA, 18 bp, Artificial sequence
  synthetic polynucleotide sequence
cagcctccaaaggagcca

SEQ ID NO: 24124 - DNA, 21 bp, Artificial sequence
  synthetic polynucleotide sequence
cgggcaggcagaatagagaca

SEQ ID NO: 24125 - DNA, 22 bp, Artificial sequence
  synthetic polynucleotide sequence
tgaagcctagcagctatgagga

SEQ ID NO: 24126 - DNA, 20 bp, Artificial sequence
  synthetic polynucleotide sequence
aggcagctgagcacagcaca

SEQ ID NO: 24127 - DNA, 19 bp, Artificial sequence
  synthetic polynucleotide sequence
ggaagaaatgtcgcagcca

SEQ ID NO: 24128 - DNA, 20 bp, Artificial sequence
  synthetic polynucleotide sequence
agcgactctagggaccagca

SEQ ID NO: 24129 - DNA, 19 bp, Artificial sequence
  synthetic polynucleotide sequence
ggaagaaatgtcgcagcca

SEQ ID NO: 24130 - DNA, 19 bp, Artificial sequence
  synthetic polynucleotide sequence
gcgactctagggaccagca

SEQ ID NO: 24131 - DNA, 25 bp, Artificial sequence
  synthetic polynucleotide sequence
tcacaagctccaagaagagagacca

SEQ ID NO: 24132 - DNA, 25 bp, Artificial sequence
  synthetic polynucleotide sequence
atagagacacacacgccttgaagga

SEQ ID NO: 24133 - DNA, 22 bp, Artificial sequence
  synthetic polynucleotide sequence
atgtacagcgattggaggtcga

SEQ ID NO: 24134 - DNA, 19 bp, Artificial sequence
  synthetic polynucleotide sequence
ttgggtccgtagggtcaca

SEQ ID NO: 24135 - DNA, 20 bp, Artificial sequence
  synthetic polynucleotide sequence
ccggaatgcaacagctggga

SEQ ID NO: 24136 - DNA, 21 bp, Artificial sequence
  synthetic polynucleotide sequence
gtattcccataccgcacagca

SEQ ID NO: 24137 - DNA, 20 bp, Artificial sequence
  synthetic polynucleotide sequence
cacaatggcaagagccgaga

SEQ ID NO: 24138 - DNA, 22 bp, Artificial sequence
  synthetic polynucleotide sequence
tcacagaaagtttcaggcagca

SEQ ID NO: 24139 - DNA, 21 bp, Artificial sequence
  synthetic polynucleotide sequence
cagatcagggcactgcaggaa

SEQ ID NO: 24140 - DNA, 21 bp, Artificial sequence
  synthetic polynucleotide sequence
ggtgtgggagatgtcgcagga

SEQ ID NO: 24141 - DNA, 19 bp, Artificial sequence
  synthetic polynucleotide sequence
caaacgccacatccttcga

SEQ ID NO: 24142 - DNA, 18 bp, Artificial sequence
  synthetic polynucleotide sequence
ggactggaggcagcagga

SEQ ID NO: 24143 - DNA, 20 bp, Artificial sequence
  synthetic polynucleotide sequence
gcaagtcaggcaggtgcaga

SEQ ID NO: 24144 - DNA, 22 bp, Artificial sequence
  synthetic polynucleotide sequence
catacttgggatccacacagca

SEQ ID NO: 24145 - DNA, 20 bp, Artificial sequence
  synthetic polynucleotide sequence
tgactccaggtggcacccaa

SEQ ID NO: 24146 - DNA, 20 bp, Artificial sequence
  synthetic polynucleotide sequence
cttgggcttcacgcagcaca

SEQ ID NO: 24147 - DNA, 19 bp, Artificial sequence
  synthetic polynucleotide sequence
gggtcaaggggcctgccaa

SEQ ID NO: 24148 - DNA, 20 bp, Artificial sequence
  synthetic polynucleotide sequence
catgcttggggaccggtgga

SEQ ID NO: 24149 - DNA, 22 bp, Artificial sequence
  synthetic polynucleotide sequence
aaaccatgacacctgagaccaa

SEQ ID NO: 24150 - DNA, 19 bp, Artificial sequence
  synthetic polynucleotide sequence
gtctgagaaggtggtggca

SEQ ID NO: 24151 - DNA, 22 bp, Artificial sequence
  synthetic polynucleotide sequence
caatgtgcggcaaacaaaggga

SEQ ID NO: 24152 - DNA, 19 bp, Artificial sequence
  synthetic polynucleotide sequence
cgggggtaggagccatcga

SEQ ID NO: 24153 - DNA, 23 bp, Artificial sequence
  synthetic polynucleotide sequence
gcaggaagaaatgcaaggtagga

SEQ ID NO: 24154 - DNA, 18 bp, Artificial sequence
  synthetic polynucleotide sequence
tggagaccagcgagacaa

SEQ ID NO: 24155 - DNA, 21 bp, Artificial sequence
  synthetic polynucleotide sequence
gcactatgaccccaggacaga

SEQ ID NO: 24156 - DNA, 20 bp, Artificial sequence
  synthetic polynucleotide sequence
gtggtggcgaggcagtggca

SEQ ID NO: 24157 - DNA, 21 bp, Artificial sequence
  synthetic polynucleotide sequence
tgaaaggggtgtgcagagaca

SEQ ID NO: 24158 - DNA, 22 bp, Artificial sequence
  synthetic polynucleotide sequence
gatagggctcaagtatccacca

SEQ ID NO: 24159 - DNA, 22 bp, Artificial sequence
  synthetic polynucleotide sequence
atgtgtgagtaacaccccagga

SEQ ID NO: 24160 - DNA, 20 bp, Artificial sequence
  synthetic polynucleotide sequence
cggcaggaaggagtagctga

SEQ ID NO: 24161 - DNA, 19 bp, Artificial sequence
  synthetic polynucleotide sequence
ttgggatccagtgctggca

SEQ ID NO: 24162 - DNA, 20 bp, Artificial sequence
  synthetic polynucleotide sequence
tgacacagcactccagctga

SEQ ID NO: 24163 - DNA, 20 bp, Artificial sequence
  synthetic polynucleotide sequence
tcgcacctgcactagccaga

SEQ ID NO: 24164 - DNA, 21 bp, Artificial sequence
  synthetic polynucleotide sequence
attgtggcagaacgcaatcca

SEQ ID NO: 24165 - DNA, 20 bp, Artificial sequence
  synthetic polynucleotide sequence
ctgccttaagagtggagcca

SEQ ID NO: 24166 - DNA, 19 bp, Artificial sequence
  synthetic polynucleotide sequence
ttgttccagggagaccaca

SEQ ID NO: 24167 - DNA, 21 bp, Artificial sequence
  synthetic polynucleotide sequence
cctgccttaagagtggagcca

SEQ ID NO: 24168 - DNA, 20 bp, Artificial sequence
  synthetic polynucleotide sequence
cagggagaccacaggtgcca

SEQ ID NO: 24169 - DNA, 22 bp, Artificial sequence
  synthetic polynucleotide sequence
agatcctggcaaagtatccaga

SEQ ID NO: 24170 - DNA, 18 bp, Artificial sequence
  synthetic polynucleotide sequence
aaggcagcattgtgggca

SEQ ID NO: 24171 - DNA, 21 bp, Artificial sequence
  synthetic polynucleotide sequence
tggagcaccacgacttcccca

SEQ ID NO: 24172 - DNA, 21 bp, Artificial sequence
  synthetic polynucleotide sequence
atcccagagcaccttcaccca

SEQ ID NO: 24173 - DNA, 19 bp, Artificial sequence
  synthetic polynucleotide sequence
gcacaaggaaaggggcaga

SEQ ID NO: 24174 - DNA, 21 bp, Artificial sequence
  synthetic polynucleotide sequence
gaaagccactgaactgaccca

SEQ ID NO: 24175 - DNA, 18 bp, Artificial sequence
  synthetic polynucleotide sequence
gcgcccacctcgtccaca

SEQ ID NO: 24176 - DNA, 19 bp, Artificial sequence
  synthetic polynucleotide sequence
cgtcgggaacttggccgca

SEQ ID NO: 24177 - DNA, 22 bp, Artificial sequence
  synthetic polynucleotide sequence
taaccacccagtaccaaaggca

SEQ ID NO: 24178 - DNA, 22 bp, Artificial sequence
  synthetic polynucleotide sequence
agaagagcagctgatccatgga

SEQ ID NO: 24179 - DNA, 20 bp, Artificial sequence
  synthetic polynucleotide sequence
cagcctgagaccgagccaga

SEQ ID NO: 24180 - DNA, 21 bp, Artificial sequence
  synthetic polynucleotide sequence
tgttgaggactgggatggaga

SEQ ID NO: 24181 - DNA, 19 bp, Artificial sequence
  synthetic polynucleotide sequence
gggcgagcgtgaggagaga

SEQ ID NO: 24182 - DNA, 20 bp, Artificial sequence
  synthetic polynucleotide sequence
gctcctggatgaagccccga

SEQ ID NO: 24183 - DNA, 21 bp, Artificial sequence
  synthetic polynucleotide sequence
gtatccgttcacctggcagca

SEQ ID NO: 24184 - DNA, 21 bp, Artificial sequence
  synthetic polynucleotide sequence
ctggagctgtggtaaggagca

SEQ ID NO: 24185 - DNA, 20 bp, Artificial sequence
  synthetic polynucleotide sequence
ctgccaccgaagcttcagga

SEQ ID NO: 24186 - DNA, 21 bp, Artificial sequence
  synthetic polynucleotide sequence
gaactgcacaaaggggcctga

SEQ ID NO: 24187 - DNA, 19 bp, Artificial sequence
  synthetic polynucleotide sequence
gcctgaaggacctggccca

SEQ ID NO: 24188 - DNA, 20 bp, Artificial sequence
  synthetic polynucleotide sequence
ggtgtccatgtgcgccacca

SEQ ID NO: 24189 - DNA, 20 bp, Artificial sequence
  synthetic polynucleotide sequence
ctggccccttggataaggaa

SEQ ID NO: 24190 - DNA, 18 bp, Artificial sequence
  synthetic polynucleotide sequence
gggacttggaaggtgcca

SEQ ID NO: 24191 - DNA, 20 bp, Artificial sequence
  synthetic polynucleotide sequence
tggatccactgcctccgaga

SEQ ID NO: 24192 - DNA, 20 bp, Artificial sequence
  synthetic polynucleotide sequence
agtcatcaggtgcccagcca

SEQ ID NO: 24193 - DNA, 21 bp, Artificial sequence
  synthetic polynucleotide sequence
gtgttggaggcccattgcaga

SEQ ID NO: 24194 - DNA, 21 bp, Artificial sequence
  synthetic polynucleotide sequence
ctagaggactcaagtagggca

SEQ ID NO: 24195 - DNA, 18 bp, Artificial sequence
  synthetic polynucleotide sequence
ccggaacatcggcaagga

SEQ ID NO: 24196 - DNA, 18 bp, Artificial sequence
  synthetic polynucleotide sequence
tgatggggcagtcagcca

SEQ ID NO: 24197 - DNA, 18 bp, Artificial sequence
  synthetic polynucleotide sequence
gcaggtcaagcaggggaa

SEQ ID NO: 24198 - DNA, 18 bp, Artificial sequence
  synthetic polynucleotide sequence
agaccctgagcgttggca

SEQ ID NO: 24199 - DNA, 18 bp, Artificial sequence
  synthetic polynucleotide sequence
cgacctggagctgggcca

SEQ ID NO: 24200 - DNA, 21 bp, Artificial sequence
  synthetic polynucleotide sequence
atccaggagacaatgcagcga

SEQ ID NO: 24201 - DNA, 19 bp, Artificial sequence
  synthetic polynucleotide sequence
cggcagcggcacaaggaga

SEQ ID NO: 24202 - DNA, 20 bp, Artificial sequence
  synthetic polynucleotide sequence
ggagccgatgaccgtctcga

SEQ ID NO: 24203 - DNA, 19 bp, Artificial sequence
  synthetic polynucleotide sequence
gtcaaggaacagcagggga

SEQ ID NO: 24204 - DNA, 20 bp, Artificial sequence
  synthetic polynucleotide sequence
tcaaaagttgcaaggccaca

SEQ ID NO: 24205 - DNA, 23 bp, Artificial sequence
  synthetic polynucleotide sequence
ctagcaaattggccaagaagcaa

SEQ ID NO: 24206 - DNA, 21 bp, Artificial sequence
  synthetic polynucleotide sequence
atgaggttgcagcaagcccaa

SEQ ID NO: 24207 - DNA, 22 bp, Artificial sequence
  synthetic polynucleotide sequence
tggaatgatctcccaccaggca

SEQ ID NO: 24208 - DNA, 20 bp, Artificial sequence
  synthetic polynucleotide sequence
ggcaagctggcacctctcca

SEQ ID NO: 24209 - DNA, 21 bp, Artificial sequence
  synthetic polynucleotide sequence
gaacgggccaagttccaggaa

SEQ ID NO: 24210 - DNA, 22 bp, Artificial sequence
  synthetic polynucleotide sequence
cgacagcatcagaaccagtgaa

SEQ ID NO: 24211 - DNA, 20 bp, Artificial sequence
  synthetic polynucleotide sequence
cagacgaggacgagtggcaa

SEQ ID NO: 24212 - DNA, 18 bp, Artificial sequence
  synthetic polynucleotide sequence
atcatgcgatccgagcga

SEQ ID NO: 24213 - DNA, 20 bp, Artificial sequence
  synthetic polynucleotide sequence
aagcctgccaactcccctca

SEQ ID NO: 24214 - DNA, 19 bp, Artificial sequence
  synthetic polynucleotide sequence
tgctgccgagagccactca

SEQ ID NO: 24215 - DNA, 21 bp, Artificial sequence
  synthetic polynucleotide sequence
ccctgtgctctgcaaccccaa

SEQ ID NO: 24216 - DNA, 20 bp, Artificial sequence
  synthetic polynucleotide sequence
cctcgcaccacaaaacccca

SEQ ID NO: 24217 - DNA, 22 bp, Artificial sequence
  synthetic polynucleotide sequence
gctatagtaatgctgcgggcca

SEQ ID NO: 24218 - DNA, 21 bp, Artificial sequence
  synthetic polynucleotide sequence
aagagagagccaagcaaggga

SEQ ID NO: 24219 - DNA, 21 bp, Artificial sequence
  synthetic polynucleotide sequence
gggcccagctgaacagagaca

SEQ ID NO: 24220 - DNA, 20 bp, Artificial sequence
  synthetic polynucleotide sequence
cctcatgctagcagggggca

SEQ ID NO: 24221 - DNA, 20 bp, Artificial sequence
  synthetic polynucleotide sequence
ttccgaggtcggacagcaga

SEQ ID NO: 24222 - DNA, 20 bp, Artificial sequence
  synthetic polynucleotide sequence
tcccatgagcacccagggca

SEQ ID NO: 24223 - DNA, 20 bp, Artificial sequence
  synthetic polynucleotide sequence
gctgctgctgggcaactcca

SEQ ID NO: 24224 - DNA, 20 bp, Artificial sequence
  synthetic polynucleotide sequence
gaagccaggggtctgcagga

SEQ ID NO: 24225 - DNA, 18 bp, Artificial sequence
  synthetic polynucleotide sequence
tcagacctgacccaggca

SEQ ID NO: 24226 - DNA, 20 bp, Artificial sequence
  synthetic polynucleotide sequence
ctcgcaggtgtaggactgga

SEQ ID NO: 24227 - DNA, 22 bp, Artificial sequence
  synthetic polynucleotide sequence
tcatgctggggaaacaactgga

SEQ ID NO: 24228 - DNA, 21 bp, Artificial sequence
  synthetic polynucleotide sequence
ggttgtaggcctcacctcgga

SEQ ID NO: 24229 - DNA, 20 bp, Artificial sequence
  synthetic polynucleotide sequence
cctcccgaaggagtggctca

SEQ ID NO: 24230 - DNA, 20 bp, Artificial sequence
  synthetic polynucleotide sequence
gtgcttgccacggaagcgga

SEQ ID NO: 24231 - DNA, 21 bp, Artificial sequence
  synthetic polynucleotide sequence
gcggcccaagacttgtggaga

SEQ ID NO: 24232 - DNA, 23 bp, Artificial sequence
  synthetic polynucleotide sequence
caaaagggtgaaaggtgaaggca

SEQ ID NO: 24233 - DNA, 22 bp, Artificial sequence
  synthetic polynucleotide sequence
ctaacagggaacagtcaaggca

SEQ ID NO: 24234 - DNA, 22 bp, Artificial sequence
  synthetic polynucleotide sequence
aaatgtcgaaggtggcaaggga

SEQ ID NO: 24235 - DNA, 21 bp, Artificial sequence
  synthetic polynucleotide sequence
tcgtcttcctgcccgaggaca

SEQ ID NO: 24236 - DNA, 21 bp, Artificial sequence
  synthetic polynucleotide sequence
aagacgtcgagctccgagtca

SEQ ID NO: 24237 - DNA, 18 bp, Artificial sequence
  synthetic polynucleotide sequence
cagcggctgcagcacaca

SEQ ID NO: 24238 - DNA, 18 bp, Artificial sequence
  synthetic polynucleotide sequence
atgtggctcgccagcgca

SEQ ID NO: 24239 - DNA, 20 bp, Artificial sequence
  synthetic polynucleotide sequence
atacagctgtgagagccgga

SEQ ID NO: 24240 - DNA, 18 bp, Artificial sequence
  synthetic polynucleotide sequence
agccgaggacccgcagga

SEQ ID NO: 24241 - DNA, 20 bp, Artificial sequence
  synthetic polynucleotide sequence
tgcctgagccacaacagaca

SEQ ID NO: 24242 - DNA, 20 bp, Artificial sequence
  synthetic polynucleotide sequence
cacccaccctgtaagctgca

SEQ ID NO: 24243 - DNA, 22 bp, Artificial sequence
  synthetic polynucleotide sequence
tctatggaaggcgaggtaacca

SEQ ID NO: 24244 - DNA, 22 bp, Artificial sequence
  synthetic polynucleotide sequence
ggatgctctccatgaccacaca

SEQ ID NO: 24245 - DNA, 18 bp, Artificial sequence
  synthetic polynucleotide sequence
agtggatggtccccacca

SEQ ID NO: 24246 - DNA, 18 bp, Artificial sequence
  synthetic polynucleotide sequence
agccacggcattcaggca

SEQ ID NO: 24247 - DNA, 19 bp, Artificial sequence
  synthetic polynucleotide sequence
cctgtcagccgggacacca

SEQ ID NO: 24248 - DNA, 18 bp, Artificial sequence
  synthetic polynucleotide sequence
ctggacccatcggcccca

SEQ ID NO: 24249 - DNA, 20 bp, Artificial sequence
  synthetic polynucleotide sequence
ggagaccttccctgagggca

SEQ ID NO: 24250 - DNA, 19 bp, Artificial sequence
  synthetic polynucleotide sequence
tgaaaggcaggaagcccca

SEQ ID NO: 24251 - DNA, 20 bp, Artificial sequence
  synthetic polynucleotide sequence
cctgcccctggtgtgaacga

SEQ ID NO: 24252 - DNA, 20 bp, Artificial sequence
  synthetic polynucleotide sequence
gttggccatcttcagaccca

SEQ ID NO: 24253 - DNA, 18 bp, Artificial sequence
  synthetic polynucleotide sequence
cacctgccatggagggga

SEQ ID NO: 24254 - DNA, 19 bp, Artificial sequence
  synthetic polynucleotide sequence
tgccatctgggtccagaca

SEQ ID NO: 24255 - DNA, 20 bp, Artificial sequence
  synthetic polynucleotide sequence
tacgcgggcgccttggagga

SEQ ID NO: 24256 - DNA, 20 bp, Artificial sequence
  synthetic polynucleotide sequence
gtaggacaagcgctgctgga

SEQ ID NO: 24257 - DNA, 20 bp, Artificial sequence
  synthetic polynucleotide sequence
ctgcagatgaacctgctgga

SEQ ID NO: 24258 - DNA, 20 bp, Artificial sequence
  synthetic polynucleotide sequence
tctggtcacactgggcagca

SEQ ID NO: 24259 - DNA, 18 bp, Artificial sequence
  synthetic polynucleotide sequence
gtcacctggtccaggcca

SEQ ID NO: 24260 - DNA, 18 bp, Artificial sequence
  synthetic polynucleotide sequence
ggcttgacgggggacaca

SEQ ID NO: 24261 - DNA, 20 bp, Artificial sequence
  synthetic polynucleotide sequence
aaaccgctggatctgagcaa

SEQ ID NO: 24262 - DNA, 18 bp, Artificial sequence
  synthetic polynucleotide sequence
attgcaccctccagccca

SEQ ID NO: 24263 - DNA, 21 bp, Artificial sequence
  synthetic polynucleotide sequence
agagtggttcccagcagccaa

SEQ ID NO: 24264 - DNA, 22 bp, Artificial sequence
  synthetic polynucleotide sequence
aaaagtgggtgagtaccaggca

SEQ ID NO: 24265 - DNA, 21 bp, Artificial sequence
  synthetic polynucleotide sequence
tagctcagtctcaccgggaca

SEQ ID NO: 24266 - DNA, 21 bp, Artificial sequence
  synthetic polynucleotide sequence
agctccgtctcactgcgcaga

SEQ ID NO: 24267 - DNA, 21 bp, Artificial sequence
  synthetic polynucleotide sequence
cactgcccagcttggaaggta

SEQ ID NO: 24268 - DNA, 21 bp, Artificial sequence
  synthetic polynucleotide sequence
tgagcacagtggaaagaccca

SEQ ID NO: 24269 - DNA, 20 bp, Artificial sequence
  synthetic polynucleotide sequence
gacggtggggaactcagaga

SEQ ID NO: 24270 - DNA, 18 bp, Artificial sequence
  synthetic polynucleotide sequence
ttggcggacacgcagcca

SEQ ID NO: 24271 - DNA, 20 bp, Artificial sequence
  synthetic polynucleotide sequence
tggaatcctgccctgcggaa

SEQ ID NO: 24272 - DNA, 21 bp, Artificial sequence
  synthetic polynucleotide sequence
tggtgactgtagcacgcggga

SEQ ID NO: 24273 - DNA, 22 bp, Artificial sequence
  synthetic polynucleotide sequence
acctgagcaagatccaccagca

SEQ ID NO: 24274 - DNA, 22 bp, Artificial sequence
  synthetic polynucleotide sequence
ggaatacaggaagctgcaccca

SEQ ID NO: 24275 - DNA, 21 bp, Artificial sequence
  synthetic polynucleotide sequence
agccccccaagatcgtgcaga

SEQ ID NO: 24276 - DNA, 19 bp, Artificial sequence
  synthetic polynucleotide sequence
ccccacccgcacgtacaca

SEQ ID NO: 24277 - DNA, 19 bp, Artificial sequence
  synthetic polynucleotide sequence
ggctctccatcgaaggcaa

SEQ ID NO: 24278 - DNA, 18 bp, Artificial sequence
  synthetic polynucleotide sequence
gggtgccagcagcctgga

SEQ ID NO: 24279 - DNA, 20 bp, Artificial sequence
  synthetic polynucleotide sequence
cttctgggagctccaggaca

SEQ ID NO: 24280 - DNA, 19 bp, Artificial sequence
  synthetic polynucleotide sequence
gggtcagcttcaggaggga

SEQ ID NO: 24281 - DNA, 18 bp, Artificial sequence
  synthetic polynucleotide sequence
agcagcgggagctccaca

SEQ ID NO: 24282 - DNA, 18 bp, Artificial sequence
  synthetic polynucleotide sequence
ccagacacagtcgcccca

SEQ ID NO: 24283 - DNA, 21 bp, Artificial sequence
  synthetic polynucleotide sequence
ctagaggtgacagtctacgca

SEQ ID NO: 24284 - DNA, 20 bp, Artificial sequence
  synthetic polynucleotide sequence
gtgcaatcagctcctggaga

SEQ ID NO: 24285 - DNA, 19 bp, Artificial sequence
  synthetic polynucleotide sequence
tttgacaacggggcaggca

SEQ ID NO: 24286 - DNA, 19 bp, Artificial sequence
  synthetic polynucleotide sequence
tcaaggatgtcagccagga

SEQ ID NO: 24287 - DNA, 20 bp, Artificial sequence
  synthetic polynucleotide sequence
gaacctccacaaggagctca

SEQ ID NO: 24288 - DNA, 21 bp, Artificial sequence
  synthetic polynucleotide sequence
agaactgccaccaactatcca

SEQ ID NO: 24289 - DNA, 23 bp, Artificial sequence
  synthetic polynucleotide sequence
gcaggaagaagtacaggatagga

SEQ ID NO: 24290 - DNA, 23 bp, Artificial sequence
  synthetic polynucleotide sequence
gggctaagcagtcagtcaccaca

SEQ ID NO: 24291 - DNA, 18 bp, Artificial sequence
  synthetic polynucleotide sequence
gcactcacccaaggccga

SEQ ID NO: 24292 - DNA, 19 bp, Artificial sequence
  synthetic polynucleotide sequence
gccgtgtacagctgcacca

SEQ ID NO: 24293 - DNA, 20 bp, Artificial sequence
  synthetic polynucleotide sequence
tacatcaacacagcccagga

SEQ ID NO: 24294 - DNA, 18 bp, Artificial sequence
  synthetic polynucleotide sequence
aagaccagggaggcgtca

SEQ ID NO: 24295 - DNA, 22 bp, Artificial sequence
  synthetic polynucleotide sequence
tgcagacagaactgctgaagga

SEQ ID NO: 24296 - DNA, 18 bp, Artificial sequence
  synthetic polynucleotide sequence
tccacatcccgaaggcca

SEQ ID NO: 24297 - DNA, 18 bp, Artificial sequence
  synthetic polynucleotide sequence
atgtggacgatgggcaca

SEQ ID NO: 24298 - DNA, 18 bp, Artificial sequence
  synthetic polynucleotide sequence
gtcagcgcagtgacggca

SEQ ID NO: 24299 - DNA, 22 bp, Artificial sequence
  synthetic polynucleotide sequence
aacagcggcattggcaaagcaa

SEQ ID NO: 24300 - DNA, 19 bp, Artificial sequence
  synthetic polynucleotide sequence
gggatcaggccggtcgtga

SEQ ID NO: 24301 - DNA, 19 bp, Artificial sequence
  synthetic polynucleotide sequence
cgagcccctcagtgggaga

SEQ ID NO: 24302 - DNA, 18 bp, Artificial sequence
  synthetic polynucleotide sequence
gcatcctccccaggccca

SEQ ID NO: 24303 - DNA, 19 bp, Artificial sequence
  synthetic polynucleotide sequence
gtgtgcagcgcaggggtca

SEQ ID NO: 24304 - DNA, 18 bp, Artificial sequence
  synthetic polynucleotide sequence
cagcagcagggctgggga

SEQ ID NO: 24305 - DNA, 20 bp, Artificial sequence
  synthetic polynucleotide sequence
cacatcaacaccctgggcca

SEQ ID NO: 24306 - DNA, 20 bp, Artificial sequence
  synthetic polynucleotide sequence
gcagacagtgccagcacgga

SEQ ID NO: 24307 - DNA, 21 bp, Artificial sequence
  synthetic polynucleotide sequence
gatgctctggatggacaagga

SEQ ID NO: 24308 - DNA, 20 bp, Artificial sequence
  synthetic polynucleotide sequence
aaagacacgatgccagcaca

SEQ ID NO: 24309 - DNA, 18 bp, Artificial sequence
  synthetic polynucleotide sequence
tgaaggccccagccctga

SEQ ID NO: 24310 - DNA, 21 bp, Artificial sequence
  synthetic polynucleotide sequence
ctatggaagacacgatcacca

SEQ ID NO: 24311 - DNA, 20 bp, Artificial sequence
  synthetic polynucleotide sequence
gtcccacaagatgacaacca

SEQ ID NO: 24312 - DNA, 18 bp, Artificial sequence
  synthetic polynucleotide sequence
ggttatccaccaggccca

SEQ ID NO: 24313 - DNA, 20 bp, Artificial sequence
  synthetic polynucleotide sequence
gtcgccatcagcagcatcca

SEQ ID NO: 24314 - DNA, 20 bp, Artificial sequence
  synthetic polynucleotide sequence
tccatctcggcacgcagaca

SEQ ID NO: 24315 - DNA, 19 bp, Artificial sequence
  synthetic polynucleotide sequence
gacctacggcgtgcaccca

SEQ ID NO: 24316 - DNA, 20 bp, Artificial sequence
  synthetic polynucleotide sequence
ctccgggaagaaggtgcgga

SEQ ID NO: 24317 - DNA, 20 bp, Artificial sequence
  synthetic polynucleotide sequence
ctcccactgactggctgaca

SEQ ID NO: 24318 - DNA, 21 bp, Artificial sequence
  synthetic polynucleotide sequence
gatggagtatagccccctcca

SEQ ID NO: 24319 - DNA, 18 bp, Artificial sequence
  synthetic polynucleotide sequence
aagccacgtgaccgccaa

SEQ ID NO: 24320 - DNA, 18 bp, Artificial sequence
  synthetic polynucleotide sequence
ccagacgggtggcccaga

SEQ ID NO: 24321 - DNA, 18 bp, Artificial sequence
  synthetic polynucleotide sequence
ggccaagaaagccgcaga

SEQ ID NO: 24322 - DNA, 19 bp, Artificial sequence
  synthetic polynucleotide sequence
tgtctgcggacatcaggga

SEQ ID NO: 24323 - DNA, 18 bp, Artificial sequence
  synthetic polynucleotide sequence
tccgtgtacgcaaggcca

SEQ ID NO: 24324 - DNA, 18 bp, Artificial sequence
  synthetic polynucleotide sequence
agccacctccagaagcca

SEQ ID NO: 24325 - DNA, 20 bp, Artificial sequence
  synthetic polynucleotide sequence
cttctaccagctgggaagga

SEQ ID NO: 24326 - DNA, 18 bp, Artificial sequence
  synthetic polynucleotide sequence
ggccgtctccacaatgca

SEQ ID NO: 24327 - DNA, 18 bp, Artificial sequence
  synthetic polynucleotide sequence
tgacagcggcagtgacca

SEQ ID NO: 24328 - DNA, 18 bp, Artificial sequence
  synthetic polynucleotide sequence
gtccgtggatgaagcgca

SEQ ID NO: 24329 - DNA, 21 bp, Artificial sequence
  synthetic polynucleotide sequence
gcgggtggcggatgaaatgga

SEQ ID NO: 24330 - DNA, 22 bp, Artificial sequence
  synthetic polynucleotide sequence
atgatgaccccatagctaccca

SEQ ID NO: 24331 - DNA, 19 bp, Artificial sequence
  synthetic polynucleotide sequence
cacggacacccaccagcca

SEQ ID NO: 24332 - DNA, 19 bp, Artificial sequence
  synthetic polynucleotide sequence
gggcagcctcgtacagcca

SEQ ID NO: 24333 - DNA, 18 bp, Artificial sequence
  synthetic polynucleotide sequence
aactgcgacggaagccga

SEQ ID NO: 24334 - DNA, 18 bp, Artificial sequence
  synthetic polynucleotide sequence
aggagggactggagggca

SEQ ID NO: 24335 - DNA, 22 bp, Artificial sequence
  synthetic polynucleotide sequence
gagctgcgactgtaagagaaca

SEQ ID NO: 24336 - DNA, 21 bp, Artificial sequence
  synthetic polynucleotide sequence
tgcattggcgaagaagccgga

SEQ ID NO: 24337 - DNA, 19 bp, Artificial sequence
  synthetic polynucleotide sequence
tggagtccacttggcacga

SEQ ID NO: 24338 - DNA, 20 bp, Artificial sequence
  synthetic polynucleotide sequence
atctgaaaccacgtcgccta

SEQ ID NO: 24339 - DNA, 21 bp, Artificial sequence
  synthetic polynucleotide sequence
gcaagctggcctcataccgga

SEQ ID NO: 24340 - DNA, 20 bp, Artificial sequence
  synthetic polynucleotide sequence
ctgcaaccagggctcgcaga

SEQ ID NO: 24341 - DNA, 21 bp, Artificial sequence
  synthetic polynucleotide sequence
caagctcaagggaatcgggga

SEQ ID NO: 24342 - DNA, 19 bp, Artificial sequence
  synthetic polynucleotide sequence
cagccactccccgtccaca

SEQ ID NO: 24343 - DNA, 21 bp, Artificial sequence
  synthetic polynucleotide sequence
ggcccgacgtgaagtgagaga

SEQ ID NO: 24344 - DNA, 21 bp, Artificial sequence
  synthetic polynucleotide sequence
tcaaggaaacgagcccgtgca

SEQ ID NO: 24345 - DNA, 22 bp, Artificial sequence
  synthetic polynucleotide sequence
tcattgaacctccacacaccga

SEQ ID NO: 24346 - DNA, 21 bp, Artificial sequence
  synthetic polynucleotide sequence
ctggcagcaatggtgagagca

SEQ ID NO: 24347 - DNA, 18 bp, Artificial sequence
  synthetic polynucleotide sequence
acccagagggaccagcaa

SEQ ID NO: 24348 - DNA, 18 bp, Artificial sequence
  synthetic polynucleotide sequence
gcccataacgcaccacca

SEQ ID NO: 24349 - DNA, 18 bp, Artificial sequence
  synthetic polynucleotide sequence
ccggacactgatcgacca

SEQ ID NO: 24350 - DNA, 20 bp, Artificial sequence
  synthetic polynucleotide sequence
caaactccacaagccaccga

SEQ ID NO: 24351 - DNA, 22 bp, Artificial sequence
  synthetic polynucleotide sequence
tagccaagacatgaagtaccca

SEQ ID NO: 24352 - DNA, 18 bp, Artificial sequence
  synthetic polynucleotide sequence
atggctgcccggagacca

SEQ ID NO: 24353 - DNA, 20 bp, Artificial sequence
  synthetic polynucleotide sequence
caggtggaagaggtgcacca

SEQ ID NO: 24354 - DNA, 18 bp, Artificial sequence
  synthetic polynucleotide sequence
gcctcctgctccgactca

SEQ ID NO: 24355 - DNA, 18 bp, Artificial sequence
  synthetic polynucleotide sequence
cccgtcaagccaacagga

SEQ ID NO: 24356 - DNA, 18 bp, Artificial sequence
  synthetic polynucleotide sequence
tggcaggaacagcagcca

SEQ ID NO: 24357 - DNA, 21 bp, Artificial sequence
  synthetic polynucleotide sequence
cgggccgccaatgaagaggaa

SEQ ID NO: 24358 - DNA, 20 bp, Artificial sequence
  synthetic polynucleotide sequence
ataatggctgagctgcagga

SEQ ID NO: 24359 - DNA, 21 bp, Artificial sequence
  synthetic polynucleotide sequence
tcagtactgcctgcgaagaga

SEQ ID NO: 24360 - DNA, 18 bp, Artificial sequence
  synthetic polynucleotide sequence
tgagcattccgggagcca

SEQ ID NO: 24361 - DNA, 18 bp, Artificial sequence
  synthetic polynucleotide sequence
agaaccagccccagccca

SEQ ID NO: 24362 - DNA, 18 bp, Artificial sequence
  synthetic polynucleotide sequence
agtccaggattggggcca

SEQ ID NO: 24363 - DNA, 20 bp, Artificial sequence
  synthetic polynucleotide sequence
ccctccagagggagacacga

SEQ ID NO: 24364 - DNA, 18 bp, Artificial sequence
  synthetic polynucleotide sequence
ggtgcgatcctcccacca

SEQ ID NO: 24365 - DNA, 20 bp, Artificial sequence
  synthetic polynucleotide sequence
ggcccttcaggatgcccaga

SEQ ID NO: 24366 - DNA, 22 bp, Artificial sequence
  synthetic polynucleotide sequence
tggaagacatgtgggagctgca

SEQ ID NO: 24367 - DNA, 21 bp, Artificial sequence
  synthetic polynucleotide sequence
tgaagagcgctggaggactca

SEQ ID NO: 24368 - DNA, 22 bp, Artificial sequence
  synthetic polynucleotide sequence
atgttgccagttccaggtccaa

SEQ ID NO: 24369 - DNA, 21 bp, Artificial sequence
  synthetic polynucleotide sequence
gccacgacaactggataccaa

SEQ ID NO: 24370 - DNA, 18 bp, Artificial sequence
  synthetic polynucleotide sequence
ccgggcagtttggggcca

SEQ ID NO: 24371 - DNA, 18 bp, Artificial sequence
  synthetic polynucleotide sequence
tgagggagccacatgcca

SEQ ID NO: 24372 - DNA, 18 bp, Artificial sequence
  synthetic polynucleotide sequence
gcccagccatctgatgga

SEQ ID NO: 24373 - DNA, 21 bp, Artificial sequence
  synthetic polynucleotide sequence
gatggagtccggggaaagaga

SEQ ID NO: 24374 - DNA, 20 bp, Artificial sequence
  synthetic polynucleotide sequence
tcccagccccacaatcagca

SEQ ID NO: 24375 - DNA, 20 bp, Artificial sequence
  synthetic polynucleotide sequence
caccacaggaggagcaccca

SEQ ID NO: 24376 - DNA, 21 bp, Artificial sequence
  synthetic polynucleotide sequence
gtctgcgaactccagtgacca

SEQ ID NO: 24377 - DNA, 22 bp, Artificial sequence
  synthetic polynucleotide sequence
tgaaacactggagctgagagga

SEQ ID NO: 24378 - DNA, 19 bp, Artificial sequence
  synthetic polynucleotide sequence
tcctgttcagagccgcaca

SEQ ID NO: 24379 - DNA, 19 bp, Artificial sequence
  synthetic polynucleotide sequence
cctcggtcatcagagccca

SEQ ID NO: 24380 - DNA, 18 bp, Artificial sequence
  synthetic polynucleotide sequence
cgatgtccaccacgacca

SEQ ID NO: 24381 - DNA, 18 bp, Artificial sequence
  synthetic polynucleotide sequence
ggaggtggacacgcgcga

SEQ ID NO: 24382 - DNA, 18 bp, Artificial sequence
  synthetic polynucleotide sequence
ggcgcgtctccagcgtca

SEQ ID NO: 24383 - DNA, 20 bp, Artificial sequence
  synthetic polynucleotide sequence
agccgacagtccttggagga

SEQ ID NO: 24384 - DNA, 18 bp, Artificial sequence
  synthetic polynucleotide sequence
tcgcggctggggctctca

SEQ ID NO: 24385 - DNA, 21 bp, Artificial sequence
  synthetic polynucleotide sequence
gtcatgagtacctgccgacca

SEQ ID NO: 24386 - DNA, 21 bp, Artificial sequence
  synthetic polynucleotide sequence
tgactgagtagaccaggacga

SEQ ID NO: 24387 - DNA, 21 bp, Artificial sequence
  synthetic polynucleotide sequence
aggcccacatgcagcctgcaa

SEQ ID NO: 24388 - DNA, 21 bp, Artificial sequence
  synthetic polynucleotide sequence
tctatacacatggggtgggca

SEQ ID NO: 24389 - DNA, 18 bp, Artificial sequence
  synthetic polynucleotide sequence
ccagcgcatgtcagccaa

SEQ ID NO: 24390 - DNA, 20 bp, Artificial sequence
  synthetic polynucleotide sequence
gatgacagtgtagctcccga

SEQ ID NO: 24391 - DNA, 21 bp, Artificial sequence
  synthetic polynucleotide sequence
agcactacctgcgagacgaca

SEQ ID NO: 24392 - DNA, 20 bp, Artificial sequence
  synthetic polynucleotide sequence
gtagtgcggttgcgggcaga

SEQ ID NO: 24393 - DNA, 22 bp, Artificial sequence
  synthetic polynucleotide sequence
ggaagaagctcagcttgcccaa

SEQ ID NO: 24394 - DNA, 21 bp, Artificial sequence
  synthetic polynucleotide sequence
ccaggagagctaggtcccgta

SEQ ID NO: 24395 - DNA, 21 bp, Artificial sequence
  synthetic polynucleotide sequence
gaacaggtccacacgagggaa

SEQ ID NO: 24396 - DNA, 21 bp, Artificial sequence
  synthetic polynucleotide sequence
ccttccaatgctcctcgggaa

SEQ ID NO: 24397 - DNA, 18 bp, Artificial sequence
  synthetic polynucleotide sequence
ggctgcgacctgacccca

SEQ ID NO: 24398 - DNA, 21 bp, Artificial sequence
  synthetic polynucleotide sequence
ggtggctctgcatggaaggga

SEQ ID NO: 24399 - DNA, 21 bp, Artificial sequence
  synthetic polynucleotide sequence
gcactgcccctgagaagacca

SEQ ID NO: 24400 - DNA, 21 bp, Artificial sequence
  synthetic polynucleotide sequence
tgctggcaagagtgtgggcca

SEQ ID NO: 24401 - DNA, 19 bp, Artificial sequence
  synthetic polynucleotide sequence
ctgggcatcatggcgccca

SEQ ID NO: 24402 - DNA, 20 bp, Artificial sequence
  synthetic polynucleotide sequence
gagcacgaggcaggcaccca

SEQ ID NO: 24403 - DNA, 21 bp, Artificial sequence
  synthetic polynucleotide sequence
gtatgcaccagacttcggcta

SEQ ID NO: 24404 - DNA, 18 bp, Artificial sequence
  synthetic polynucleotide sequence
gcagctgctccctgggca

SEQ ID NO: 24405 - DNA, 21 bp, Artificial sequence
  synthetic polynucleotide sequence
tgaggaccatctacgagagca

SEQ ID NO: 24406 - DNA, 18 bp, Artificial sequence
  synthetic polynucleotide sequence
ccagaacgaaccctccga

SEQ ID NO: 24407 - DNA, 18 bp, Artificial sequence
  synthetic polynucleotide sequence
gtgcgcagaggacgagga

SEQ ID NO: 24408 - DNA, 18 bp, Artificial sequence
  synthetic polynucleotide sequence
gggcagcacatagcgtga

SEQ ID NO: 24409 - DNA, 20 bp, Artificial sequence
  synthetic polynucleotide sequence
gcgctgccaccgagatggca

SEQ ID NO: 24410 - DNA, 20 bp, Artificial sequence
  synthetic polynucleotide sequence
agtaccatccagagccggga

SEQ ID NO: 24411 - DNA, 18 bp, Artificial sequence
  synthetic polynucleotide sequence
gatggagccttggaccga

SEQ ID NO: 24412 - DNA, 18 bp, Artificial sequence
  synthetic polynucleotide sequence
ggacctctctgggcagca

SEQ ID NO: 24413 - DNA, 20 bp, Artificial sequence
  synthetic polynucleotide sequence
gtctgctccagaagagggca

SEQ ID NO: 24414 - DNA, 20 bp, Artificial sequence
  synthetic polynucleotide sequence
gacacagtagtccagggcca

SEQ ID NO: 24415 - DNA, 20 bp, Artificial sequence
  synthetic polynucleotide sequence
cagccacctccagatcgaca

SEQ ID NO: 24416 - DNA, 20 bp, Artificial sequence
  synthetic polynucleotide sequence
gttgaatggatgccaccaca

SEQ ID NO: 24417 - DNA, 20 bp, Artificial sequence
  synthetic polynucleotide sequence
gtccctgaaggcacaagaga

SEQ ID NO: 24418 - DNA, 18 bp, Artificial sequence
  synthetic polynucleotide sequence
ttggaggaacagcggcca

SEQ ID NO: 24419 - DNA, 19 bp, Artificial sequence
  synthetic polynucleotide sequence
gcccctcactctggaagca

SEQ ID NO: 24420 - DNA, 21 bp, Artificial sequence
  synthetic polynucleotide sequence
cgaagtggagtagctgaccca

SEQ ID NO: 24421 - DNA, 22 bp, Artificial sequence
  synthetic polynucleotide sequence
gggttggcaaatcagaagagca

SEQ ID NO: 24422 - DNA, 20 bp, Artificial sequence
  synthetic polynucleotide sequence
ctccagcacctggtccaaga

SEQ ID NO: 24423 - DNA, 20 bp, Artificial sequence
  synthetic polynucleotide sequence
gtgggctgctagaagcacga

SEQ ID NO: 24424 - DNA, 18 bp, Artificial sequence
  synthetic polynucleotide sequence
cgagcacaccttccacca

SEQ ID NO: 24425 - DNA, 21 bp, Artificial sequence
  synthetic polynucleotide sequence
gccagatgggatgagatggga

SEQ ID NO: 24426 - DNA, 23 bp, Artificial sequence
  synthetic polynucleotide sequence
cagagatccacagagaccatgca

SEQ ID NO: 24427 - DNA, 19 bp, Artificial sequence
  synthetic polynucleotide sequence
tcgaactagccagaagcga

SEQ ID NO: 24428 - DNA, 18 bp, Artificial sequence
  synthetic polynucleotide sequence
ccctgactgggaagccca

SEQ ID NO: 24429 - DNA, 21 bp, Artificial sequence
  synthetic polynucleotide sequence
ggatggcagactcagggtcaa

SEQ ID NO: 24430 - DNA, 22 bp, Artificial sequence
  synthetic polynucleotide sequence
ctacgcacatacagccgaacga

SEQ ID NO: 24431 - DNA, 18 bp, Artificial sequence
  synthetic polynucleotide sequence
aaggctggtgaccccaca

SEQ ID NO: 24432 - DNA, 18 bp, Artificial sequence
  synthetic polynucleotide sequence
atcatccccgtcctggca

SEQ ID NO: 24433 - DNA, 19 bp, Artificial sequence
  synthetic polynucleotide sequence
gccttcgacagagccacca

SEQ ID NO: 24434 - DNA, 18 bp, Artificial sequence
  synthetic polynucleotide sequence
ctctcgggctggaaccca

SEQ ID NO: 24435 - DNA, 18 bp, Artificial sequence
  synthetic polynucleotide sequence
ggcgcagaagcttgagca

SEQ ID NO: 24436 - DNA, 18 bp, Artificial sequence
  synthetic polynucleotide sequence
ggcaggctggaatccaca

SEQ ID NO: 24437 - DNA, 22 bp, Artificial sequence
  synthetic polynucleotide sequence
gcattcagggctcaggaaacca

SEQ ID NO: 24438 - DNA, 21 bp, Artificial sequence
  synthetic polynucleotide sequence
tctgttgacaccacccctcca

SEQ ID NO: 24439 - DNA, 21 bp, Artificial sequence
  synthetic polynucleotide sequence
ggtgagaactgtacggaccca

SEQ ID NO: 24440 - DNA, 20 bp, Artificial sequence
  synthetic polynucleotide sequence
tcgatggcgggctccagcca

SEQ ID NO: 24441 - DNA, 20 bp, Artificial sequence
  synthetic polynucleotide sequence
cagatggagcgtgaggcgga

SEQ ID NO: 24442 - DNA, 20 bp, Artificial sequence
  synthetic polynucleotide sequence
gaggtcccagaaacccgcca

SEQ ID NO: 24443 - DNA, 19 bp, Artificial sequence
  synthetic polynucleotide sequence
gatgccaacccacgcccca

SEQ ID NO: 24444 - DNA, 20 bp, Artificial sequence
  synthetic polynucleotide sequence
cttctcgggggtctccacca

SEQ ID NO: 24445 - DNA, 19 bp, Artificial sequence
  synthetic polynucleotide sequence
cctgaaagcaggagcagca

SEQ ID NO: 24446 - DNA, 22 bp, Artificial sequence
  synthetic polynucleotide sequence
tcatctgctactccaccagcaa

SEQ ID NO: 24447 - DNA, 18 bp, Artificial sequence
  synthetic polynucleotide sequence
tctcctcaccgagggcca

SEQ ID NO: 24448 - DNA, 18 bp, Artificial sequence
  synthetic polynucleotide sequence
gcgcaggttggacaccca

SEQ ID NO: 24449 - DNA, 18 bp, Artificial sequence
  synthetic polynucleotide sequence
gcagtgccaggacgacca

SEQ ID NO: 24450 - DNA, 20 bp, Artificial sequence
  synthetic polynucleotide sequence
ctcaggacagaggcaggaga

SEQ ID NO: 24451 - DNA, 18 bp, Artificial sequence
  synthetic polynucleotide sequence
gctgcacggatctcgaga

SEQ ID NO: 24452 - DNA, 18 bp, Artificial sequence
  synthetic polynucleotide sequence
tgaagccggagtagccca

SEQ ID NO: 24453 - DNA, 18 bp, Artificial sequence
  synthetic polynucleotide sequence
cgtgtgccaatggaggca

SEQ ID NO: 24454 - DNA, 18 bp, Artificial sequence
  synthetic polynucleotide sequence
gtctgcacccccgacaca

SEQ ID NO: 24455 - DNA, 20 bp, Artificial sequence
  synthetic polynucleotide sequence
gaggtgcggacatccatcga

SEQ ID NO: 24456 - DNA, 22 bp, Artificial sequence
  synthetic polynucleotide sequence
caaagccataagggcagttgca

SEQ ID NO: 24457 - DNA, 18 bp, Artificial sequence
  synthetic polynucleotide sequence
ctgcagcacccataccca

SEQ ID NO: 24458 - DNA, 20 bp, Artificial sequence
  synthetic polynucleotide sequence
ctcagctagtggtggggcaa

SEQ ID NO: 24459 - DNA, 20 bp, Artificial sequence
  synthetic polynucleotide sequence
gtacctagctctgccggaga

SEQ ID NO: 24460 - DNA, 18 bp, Artificial sequence
  synthetic polynucleotide sequence
acgggtggggagccagca

SEQ ID NO: 24461 - DNA, 22 bp, Artificial sequence
  synthetic polynucleotide sequence
ggaagccaaagaaagtccggaa

SEQ ID NO: 24462 - DNA, 20 bp, Artificial sequence
  synthetic polynucleotide sequence
agctcggctcgctccggcaa

SEQ ID NO: 24463 - DNA, 18 bp, Artificial sequence
  synthetic polynucleotide sequence
aggtgccgctggagcaca

SEQ ID NO: 24464 - DNA, 18 bp, Artificial sequence
  synthetic polynucleotide sequence
ggcagctgactgcgggca

SEQ ID NO: 24465 - DNA, 21 bp, Artificial sequence
  synthetic polynucleotide sequence
ccagcgtttccagcacacgca

SEQ ID NO: 24466 - DNA, 18 bp, Artificial sequence
  synthetic polynucleotide sequence
tccccttcctgcccccca

SEQ ID NO: 24467 - DNA, 20 bp, Artificial sequence
  synthetic polynucleotide sequence
tcccagctccagcgacccaa

SEQ ID NO: 24468 - DNA, 18 bp, Artificial sequence
  synthetic polynucleotide sequence
gaggtcggagggtgggca

SEQ ID NO: 24469 - DNA, 22 bp, Artificial sequence
  synthetic polynucleotide sequence
tgaagcagggcagtaatcctca

SEQ ID NO: 24470 - DNA, 21 bp, Artificial sequence
  synthetic polynucleotide sequence
ctgttggggggcatactgaca

SEQ ID NO: 24471 - DNA, 22 bp, Artificial sequence
  synthetic polynucleotide sequence
caagctctgtgggacagaagaa

SEQ ID NO: 24472 - DNA, 20 bp, Artificial sequence
  synthetic polynucleotide sequence
gagctcgtagagcagcacca

SEQ ID NO: 24473 - DNA, 18 bp, Artificial sequence
  synthetic polynucleotide sequence
agtcccagtcaacgccca

SEQ ID NO: 24474 - DNA, 18 bp, Artificial sequence
  synthetic polynucleotide sequence
tcaccagcctcagagcca

SEQ ID NO: 24475 - DNA, 18 bp, Artificial sequence
  synthetic polynucleotide sequence
ctgcctgcacccccagca

SEQ ID NO: 24476 - DNA, 20 bp, Artificial sequence
  synthetic polynucleotide sequence
gggcagcgtatcgagtccca

SEQ ID NO: 24477 - DNA, 23 bp, Artificial sequence
  synthetic polynucleotide sequence
caaaaaacccattgggggacaca

SEQ ID NO: 24478 - DNA, 21 bp, Artificial sequence
  synthetic polynucleotide sequence
gcatccccaattcctccagca

SEQ ID NO: 24479 - DNA, 18 bp, Artificial sequence
  synthetic polynucleotide sequence
gcctggagcaagagcaca

SEQ ID NO: 24480 - DNA, 18 bp, Artificial sequence
  synthetic polynucleotide sequence
catgcagaaggaggccca

SEQ ID NO: 24481 - DNA, 20 bp, Artificial sequence
  synthetic polynucleotide sequence
caggactcctgggtcaccaa

SEQ ID NO: 24482 - DNA, 18 bp, Artificial sequence
  synthetic polynucleotide sequence
ggccccaccataggcaga

SEQ ID NO: 24483 - DNA, 21 bp, Artificial sequence
  synthetic polynucleotide sequence
acaaccagcatgcgtatccca

SEQ ID NO: 24484 - DNA, 19 bp, Artificial sequence
  synthetic polynucleotide sequence
cacccactgcagcaggcca

SEQ ID NO: 24485 - DNA, 18 bp, Artificial sequence
  synthetic polynucleotide sequence
atgaggaccgggtggaca

SEQ ID NO: 24486 - DNA, 18 bp, Artificial sequence
  synthetic polynucleotide sequence
catcactgccacctccca

SEQ ID NO: 24487 - DNA, 19 bp, Artificial sequence
  synthetic polynucleotide sequence
ggggagacactgtcggaca

SEQ ID NO: 24488 - DNA, 18 bp, Artificial sequence
  synthetic polynucleotide sequence
gcacgtgtggctcaagca

SEQ ID NO: 24489 - DNA, 20 bp, Artificial sequence
  synthetic polynucleotide sequence
cagcagagggcatgtggaga

SEQ ID NO: 24490 - DNA, 18 bp, Artificial sequence
  synthetic polynucleotide sequence
gcacataaggtccgggga

SEQ ID NO: 24491 - DNA, 18 bp, Artificial sequence
  synthetic polynucleotide sequence
gcccagtggaaccaccaa

SEQ ID NO: 24492 - DNA, 18 bp, Artificial sequence
  synthetic polynucleotide sequence
gtcgctaatggggccaca

SEQ ID NO: 24493 - DNA, 20 bp, Artificial sequence
  synthetic polynucleotide sequence
acctggtgagcgccgtggaa

SEQ ID NO: 24494 - DNA, 21 bp, Artificial sequence
  synthetic polynucleotide sequence
agatgtgcccattggagggca

SEQ ID NO: 24495 - DNA, 18 bp, Artificial sequence
  synthetic polynucleotide sequence
ggagaacggcgatggcga

SEQ ID NO: 24496 - DNA, 19 bp, Artificial sequence
  synthetic polynucleotide sequence
tgtcagcctctgaaccgga

SEQ ID NO: 24497 - DNA, 20 bp, Artificial sequence
  synthetic polynucleotide sequence
gtaccctggtggctccagca

SEQ ID NO: 24498 - DNA, 20 bp, Artificial sequence
  synthetic polynucleotide sequence
ggtactggctgcgggacaca

SEQ ID NO: 24499 - DNA, 20 bp, Artificial sequence
  synthetic polynucleotide sequence
accagccttgcaacccacca

SEQ ID NO: 24500 - DNA, 21 bp, Artificial sequence
  synthetic polynucleotide sequence
tcaagagggagatgcatccca

SEQ ID NO: 24501 - DNA, 20 bp, Artificial sequence
  synthetic polynucleotide sequence
ctgcagccacaggtccccaa

SEQ ID NO: 24502 - DNA, 21 bp, Artificial sequence
  synthetic polynucleotide sequence
ctcagagtcagcagagcctca

SEQ ID NO: 24503 - DNA, 21 bp, Artificial sequence
  synthetic polynucleotide sequence
acctgcccaggatctcaccca

SEQ ID NO: 24504 - DNA, 21 bp, Artificial sequence
  synthetic polynucleotide sequence
ggcacagaaggggtcacacga

SEQ ID NO: 24505 - DNA, 20 bp, Artificial sequence
  synthetic polynucleotide sequence
gactgttgccacagaggaca

SEQ ID NO: 24506 - DNA, 18 bp, Artificial sequence
  synthetic polynucleotide sequence
agggcgtctggaggctca

SEQ ID NO: 24507 - DNA, 18 bp, Artificial sequence
  synthetic polynucleotide sequence
gaagcccaggcctgcaga

SEQ ID NO: 24508 - DNA, 20 bp, Artificial sequence
  synthetic polynucleotide sequence
ctcttcaggggacatggcaa

SEQ ID NO: 24509 - DNA, 19 bp, Artificial sequence
  synthetic polynucleotide sequence
tcacagacgaggagaccga

SEQ ID NO: 24510 - DNA, 19 bp, Artificial sequence
  synthetic polynucleotide sequence
ccactgtgccactcgggga

SEQ ID NO: 24511 - DNA, 18 bp, Artificial sequence
  synthetic polynucleotide sequence
ccagctcaatggccagga

SEQ ID NO: 24512 - DNA, 18 bp, Artificial sequence
  synthetic polynucleotide sequence
gaatgtgtggccaggcca

SEQ ID NO: 24513 - DNA, 20 bp, Artificial sequence
  synthetic polynucleotide sequence
tcggggggtaggaaaggaca

SEQ ID NO: 24514 - DNA, 21 bp, Artificial sequence
  synthetic polynucleotide sequence
atctgcatgactccagcccca

SEQ ID NO: 24515 - DNA, 21 bp, Artificial sequence
  synthetic polynucleotide sequence
agacaaggttccagcgccaga

SEQ ID NO: 24516 - DNA, 23 bp, Artificial sequence
  synthetic polynucleotide sequence
caatatcagagggactgcatcca

SEQ ID NO: 24517 - DNA, 20 bp, Artificial sequence
  synthetic polynucleotide sequence
ccccccacctgccaaagaga

SEQ ID NO: 24518 - DNA, 19 bp, Artificial sequence
  synthetic polynucleotide sequence
ctgggctgggcaactccga

SEQ ID NO: 24519 - DNA, 18 bp, Artificial sequence
  synthetic polynucleotide sequence
ggccgcagctggagagga

SEQ ID NO: 24520 - DNA, 18 bp, Artificial sequence
  synthetic polynucleotide sequence
caaggggagcctccgcca

SEQ ID NO: 24521 - DNA, 20 bp, Artificial sequence
  synthetic polynucleotide sequence
cggaactccgccccttgaca

SEQ ID NO: 24522 - DNA, 21 bp, Artificial sequence
  synthetic polynucleotide sequence
aacctggagactcagagggca

SEQ ID NO: 24523 - DNA, 18 bp, Artificial sequence
  synthetic polynucleotide sequence
cggcatgacggatccaga

SEQ ID NO: 24524 - DNA, 18 bp, Artificial sequence
  synthetic polynucleotide sequence
actgcagccaggtgacca

SEQ ID NO: 24525 - DNA, 19 bp, Artificial sequence
  synthetic polynucleotide sequence
tgccaacacccaaccgcaa

SEQ ID NO: 24526 - DNA, 21 bp, Artificial sequence
  synthetic polynucleotide sequence
agggcacagatgagggccaca

SEQ ID NO: 24527 - DNA, 21 bp, Artificial sequence
  synthetic polynucleotide sequence
gaaagccttccagcaacggga

SEQ ID NO: 24528 - DNA, 21 bp, Artificial sequence
  synthetic polynucleotide sequence
tagatggtcaggatgcggcga

SEQ ID NO: 24529 - DNA, 21 bp, Artificial sequence
  synthetic polynucleotide sequence
gaaggtgcatacctccacgga

SEQ ID NO: 24530 - DNA, 22 bp, Artificial sequence
  synthetic polynucleotide sequence
caaagatgaccggcatagggca

SEQ ID NO: 24531 - DNA, 22 bp, Artificial sequence
  synthetic polynucleotide sequence
cgaatagccgaagctctgcaga

SEQ ID NO: 24532 - DNA, 21 bp, Artificial sequence
  synthetic polynucleotide sequence
tgcagtcccatcaaggagcca

SEQ ID NO: 24533 - DNA, 22 bp, Artificial sequence
  synthetic polynucleotide sequence
agatggacaaggaggaaaccaa

SEQ ID NO: 24534 - DNA, 19 bp, Artificial sequence
  synthetic polynucleotide sequence
gggaagctggctctggaga

SEQ ID NO: 24535 - DNA, 19 bp, Artificial sequence
  synthetic polynucleotide sequence
catgaccgctcctccgcga

SEQ ID NO: 24536 - DNA, 19 bp, Artificial sequence
  synthetic polynucleotide sequence
ttcagccgcgcttcagcga

SEQ ID NO: 24537 - DNA, 22 bp, Artificial sequence
  synthetic polynucleotide sequence
tacgtggcccagtattccggaa

SEQ ID NO: 24538 - DNA, 22 bp, Artificial sequence
  synthetic polynucleotide sequence
agctcatcaatggcctggacca

SEQ ID NO: 24539 - DNA, 21 bp, Artificial sequence
  synthetic polynucleotide sequence
gaatctccccatcacagccca

SEQ ID NO: 24540 - DNA, 21 bp, Artificial sequence
  synthetic polynucleotide sequence
actgtctagggagggtcagca

SEQ ID NO: 24541 - DNA, 21 bp, Artificial sequence
  synthetic polynucleotide sequence
gaatctgatccacggacgcca

SEQ ID NO: 24542 - DNA, 19 bp, Artificial sequence
  synthetic polynucleotide sequence
gccctggcccatggacaca

SEQ ID NO: 24543 - DNA, 22 bp, Artificial sequence
  synthetic polynucleotide sequence
aaagtgcgtcagaagctgcaca

SEQ ID NO: 24544 - DNA, 22 bp, Artificial sequence
  synthetic polynucleotide sequence
caaaccagtcaatggtgcagca

SEQ ID NO: 24545 - DNA, 20 bp, Artificial sequence
  synthetic polynucleotide sequence
cagttagatcgccagcggga

SEQ ID NO: 24546 - DNA, 20 bp, Artificial sequence
  synthetic polynucleotide sequence
gggactcatggcaaggacca

SEQ ID NO: 24547 - DNA, 18 bp, Artificial sequence
  synthetic polynucleotide sequence
atggagcagcctgggaca

SEQ ID NO: 24548 - DNA, 18 bp, Artificial sequence
  synthetic polynucleotide sequence
gggccactcctctcagga

SEQ ID NO: 24549 - DNA, 20 bp, Artificial sequence
  synthetic polynucleotide sequence
cctgcacaaggccctggaca

SEQ ID NO: 24550 - DNA, 20 bp, Artificial sequence
  synthetic polynucleotide sequence
tctgccaccaccgcatggaa

SEQ ID NO: 24551 - DNA, 20 bp, Artificial sequence
  synthetic polynucleotide sequence
ctggaacccataccacacca

SEQ ID NO: 24552 - DNA, 21 bp, Artificial sequence
  synthetic polynucleotide sequence
agtagaagagtatggcgccca

SEQ ID NO: 24553 - DNA, 21 bp, Artificial sequence
  synthetic polynucleotide sequence
ttaccaccaggatggacggaa

SEQ ID NO: 24554 - DNA, 20 bp, Artificial sequence
  synthetic polynucleotide sequence
gtcctgcacccggaggcaga

SEQ ID NO: 24555 - DNA, 19 bp, Artificial sequence
  synthetic polynucleotide sequence
tttggaggaggaggaagga

SEQ ID NO: 24556 - DNA, 18 bp, Artificial sequence
  synthetic polynucleotide sequence
acctcggcaattgggaca

SEQ ID NO: 24557 - DNA, 20 bp, Artificial sequence
  synthetic polynucleotide sequence
cgaggtgaagggatgccgca

SEQ ID NO: 24558 - DNA, 20 bp, Artificial sequence
  synthetic polynucleotide sequence
gaccacctcctgagcctcga

SEQ ID NO: 24559 - DNA, 22 bp, Artificial sequence
  synthetic polynucleotide sequence
ggatgcctgtgggaaaaaggga

SEQ ID NO: 24560 - DNA, 21 bp, Artificial sequence
  synthetic polynucleotide sequence
gtacccccaagaagagcctga

SEQ ID NO: 24561 - DNA, 18 bp, Artificial sequence
  synthetic polynucleotide sequence
ccaaggaccgctgcgaga

SEQ ID NO: 24562 - DNA, 20 bp, Artificial sequence
  synthetic polynucleotide sequence
tatgacatcaccaggctcca

SEQ ID NO: 24563 - DNA, 22 bp, Artificial sequence
  synthetic polynucleotide sequence
gaaaatctcccacaagcggcta

SEQ ID NO: 24564 - DNA, 19 bp, Artificial sequence
  synthetic polynucleotide sequence
ccacacagagcctcccgga

SEQ ID NO: 24565 - DNA, 19 bp, Artificial sequence
  synthetic polynucleotide sequence
ggaggtggtctgcgacgaa

SEQ ID NO: 24566 - DNA, 18 bp, Artificial sequence
  synthetic polynucleotide sequence
ccatccacgtgaggctca

SEQ ID NO: 24567 - DNA, 21 bp, Artificial sequence
  synthetic polynucleotide sequence
caacccggagaagaggaagca

SEQ ID NO: 24568 - DNA, 22 bp, Artificial sequence
  synthetic polynucleotide sequence
atcagctgcacaaacaccccta

SEQ ID NO: 24569 - DNA, 21 bp, Artificial sequence
  synthetic polynucleotide sequence
ggccccaacatcatcccagca

SEQ ID NO: 24570 - DNA, 18 bp, Artificial sequence
  synthetic polynucleotide sequence
gcatcccctcccctggca

SEQ ID NO: 24571 - DNA, 21 bp, Artificial sequence
  synthetic polynucleotide sequence
ggaacagggatgaggctgaga

SEQ ID NO: 24572 - DNA, 19 bp, Artificial sequence
  synthetic polynucleotide sequence
ccaatagtgcgcgggccga

SEQ ID NO: 24573 - DNA, 20 bp, Artificial sequence
  synthetic polynucleotide sequence
gccgcatcaccacacgcaga

SEQ ID NO: 24574 - DNA, 19 bp, Artificial sequence
  synthetic polynucleotide sequence
ctggacctgagtgccccca

SEQ ID NO: 24575 - DNA, 21 bp, Artificial sequence
  synthetic polynucleotide sequence
agcaggaggtactgatggaca

SEQ ID NO: 24576 - DNA, 18 bp, Artificial sequence
  synthetic polynucleotide sequence
tgaggcgggatggcccca

SEQ ID NO: 24577 - DNA, 21 bp, Artificial sequence
  synthetic polynucleotide sequence
gcaccaagatcaccttcccca

SEQ ID NO: 24578 - DNA, 22 bp, Artificial sequence
  synthetic polynucleotide sequence
gaatgttcacagtgcagccaca

SEQ ID NO: 24579 - DNA, 19 bp, Artificial sequence
  synthetic polynucleotide sequence
ttttggtggaagggaccca

SEQ ID NO: 24580 - DNA, 20 bp, Artificial sequence
  synthetic polynucleotide sequence
atgaagtgaggcccccgtga

SEQ ID NO: 24581 - DNA, 21 bp, Artificial sequence
  synthetic polynucleotide sequence
cgtccaggaagctcctatgga

SEQ ID NO: 24582 - DNA, 22 bp, Artificial sequence
  synthetic polynucleotide sequence
gaagtaaggccttcatgcccca

SEQ ID NO: 24583 - DNA, 18 bp, Artificial sequence
  synthetic polynucleotide sequence
accacagccccttcgaca

SEQ ID NO: 24584 - DNA, 18 bp, Artificial sequence
  synthetic polynucleotide sequence
ccccgctgcagcccagca

SEQ ID NO: 24585 - DNA, 19 bp, Artificial sequence
  synthetic polynucleotide sequence
gtagtcggagggtgcagga

SEQ ID NO: 24586 - DNA, 18 bp, Artificial sequence
  synthetic polynucleotide sequence
gatgccgattttggcaca

SEQ ID NO: 24587 - DNA, 19 bp, Artificial sequence
  synthetic polynucleotide sequence
gagtccagcgacgaggaga

SEQ ID NO: 24588 - DNA, 18 bp, Artificial sequence
  synthetic polynucleotide sequence
ggtactgctgcaacgcca

SEQ ID NO: 24589 - DNA, 21 bp, Artificial sequence
  synthetic polynucleotide sequence
ctggactgatcaacgtgggca

SEQ ID NO: 24590 - DNA, 21 bp, Artificial sequence
  synthetic polynucleotide sequence
tagaccccagattctcaggga

SEQ ID NO: 24591 - DNA, 19 bp, Artificial sequence
  synthetic polynucleotide sequence
cagagggaaagcgccgcca

SEQ ID NO: 24592 - DNA, 20 bp, Artificial sequence
  synthetic polynucleotide sequence
cccgtaccaggcattgacga

SEQ ID NO: 24593 - DNA, 22 bp, Artificial sequence
  synthetic polynucleotide sequence
aaacggagcagaaagaacccaa

SEQ ID NO: 24594 - DNA, 18 bp, Artificial sequence
  synthetic polynucleotide sequence
catccttggaccagcgga

SEQ ID NO: 24595 - DNA, 20 bp, Artificial sequence
  synthetic polynucleotide sequence
atataggctcgcaggcccaa

SEQ ID NO: 24596 - DNA, 20 bp, Artificial sequence
  synthetic polynucleotide sequence
tctcagagcctccaaagcca

SEQ ID NO: 24597 - DNA, 22 bp, Artificial sequence
  synthetic polynucleotide sequence
tgcatcctgctgaggaaggaga

SEQ ID NO: 24598 - DNA, 19 bp, Artificial sequence
  synthetic polynucleotide sequence
cacgctggcatccagccca

SEQ ID NO: 24599 - DNA, 19 bp, Artificial sequence
  synthetic polynucleotide sequence
cgacgtcgaccagcagaga

SEQ ID NO: 24600 - DNA, 18 bp, Artificial sequence
  synthetic polynucleotide sequence
aatgcgtagcgacctgca

SEQ ID NO: 24601 - DNA, 21 bp, Artificial sequence
  synthetic polynucleotide sequence
gcgagagtcaagccctccaga

SEQ ID NO: 24602 - DNA, 22 bp, Artificial sequence
  synthetic polynucleotide sequence
gaattcgacaggatgaggacca

SEQ ID NO: 24603 - DNA, 21 bp, Artificial sequence
  synthetic polynucleotide sequence
cgtgaccagaggttgagagga

SEQ ID NO: 24604 - DNA, 22 bp, Artificial sequence
  synthetic polynucleotide sequence
ttgacggttgcaaactccacca

SEQ ID NO: 24605 - DNA, 21 bp, Artificial sequence
  synthetic polynucleotide sequence
gcaccgacatgagaggacaca

SEQ ID NO: 24606 - DNA, 22 bp, Artificial sequence
  synthetic polynucleotide sequence
tatgggggattagtagccagca

SEQ ID NO: 24607 - DNA, 17 bp, Artificial sequence
  synthetic polynucleotide sequence
cggcctctgagctggga

SEQ ID NO: 24608 - DNA, 20 bp, Artificial sequence
  synthetic polynucleotide sequence
tagccaccactgaaggcaga

SEQ ID NO: 24609 - DNA, 20 bp, Artificial sequence
  synthetic polynucleotide sequence
cgccatcacccacgctctga

SEQ ID NO: 24610 - DNA, 20 bp, Artificial sequence
  synthetic polynucleotide sequence
atctcacatggccaagtcca

SEQ ID NO: 24611 - DNA, 20 bp, Artificial sequence
  synthetic polynucleotide sequence
gatgaggccgaggacgctga

SEQ ID NO: 24612 - DNA, 21 bp, Artificial sequence
  synthetic polynucleotide sequence
agcaaggccaccatttcccga

SEQ ID NO: 24613 - DNA, 22 bp, Artificial sequence
  synthetic polynucleotide sequence
atacagtgccctctgcaacaca

SEQ ID NO: 24614 - DNA, 21 bp, Artificial sequence
  synthetic polynucleotide sequence
acaaactccatgaggcggcca

SEQ ID NO: 24615 - DNA, 22 bp, Artificial sequence
  synthetic polynucleotide sequence
atgtaccagcaggaacagtgga

SEQ ID NO: 24616 - DNA, 21 bp, Artificial sequence
  synthetic polynucleotide sequence
tcttcacaccgctgcaggtca

SEQ ID NO: 24617 - DNA, 19 bp, Artificial sequence
  synthetic polynucleotide sequence
gcttggcccctaaggtgga

SEQ ID NO: 24618 - DNA, 19 bp, Artificial sequence
  synthetic polynucleotide sequence
tggatacggtacttgggca

SEQ ID NO: 24619 - DNA, 22 bp, Artificial sequence
  synthetic polynucleotide sequence
caagcagatgccattcgcagaa

SEQ ID NO: 24620 - DNA, 22 bp, Artificial sequence
  synthetic polynucleotide sequence
gtcagggtgaagaagcacagca

SEQ ID NO: 24621 - DNA, 22 bp, Artificial sequence
  synthetic polynucleotide sequence
catgactcacaacctgaaccga

SEQ ID NO: 24622 - DNA, 20 bp, Artificial sequence
  synthetic polynucleotide sequence
gcctggtcaggatgggaaca

SEQ ID NO: 24623 - DNA, 20 bp, Artificial sequence
  synthetic polynucleotide sequence
atgcagagagccagcaagga

SEQ ID NO: 24624 - DNA, 18 bp, Artificial sequence
  synthetic polynucleotide sequence
ccgcctgagctgaaggga

SEQ ID NO: 24625 - DNA, 20 bp, Artificial sequence
  synthetic polynucleotide sequence
ggcctactcagcgacgagga

SEQ ID NO: 24626 - DNA, 20 bp, Artificial sequence
  synthetic polynucleotide sequence
gagaaccgtcgtgggtccga

SEQ ID NO: 24627 - DNA, 19 bp, Artificial sequence
  synthetic polynucleotide sequence
ggacaccccccaacgcaca

SEQ ID NO: 24628 - DNA, 20 bp, Artificial sequence
  synthetic polynucleotide sequence
gaggaggaggcagtacccca

SEQ ID NO: 24629 - DNA, 20 bp, Artificial sequence
  synthetic polynucleotide sequence
gatcctggctcgagcacaca

SEQ ID NO: 24630 - DNA, 25 bp, Artificial sequence
  synthetic polynucleotide sequence
cagacatacaagacggagatcacca

SEQ ID NO: 24631 - DNA, 22 bp, Artificial sequence
  synthetic polynucleotide sequence
attggccctgaaacaccatcca

SEQ ID NO: 24632 - DNA, 20 bp, Artificial sequence
  synthetic polynucleotide sequence
gtctccaaactgctcggcca

SEQ ID NO: 24633 - DNA, 22 bp, Artificial sequence
  synthetic polynucleotide sequence
ctccaaccctaagagtgggaga

SEQ ID NO: 24634 - DNA, 20 bp, Artificial sequence
  synthetic polynucleotide sequence
gggtcactggaagcactgga

SEQ ID NO: 24635 - DNA, 23 bp, Artificial sequence
  synthetic polynucleotide sequence
aaaaaatgcgcagctggaactga

SEQ ID NO: 24636 - DNA, 21 bp, Artificial sequence
  synthetic polynucleotide sequence
tgaacctcagcactggctcca

SEQ ID NO: 24637 - DNA, 22 bp, Artificial sequence
  synthetic polynucleotide sequence
aaacgggaaagagagtggcaga

SEQ ID NO: 24638 - DNA, 21 bp, Artificial sequence
  synthetic polynucleotide sequence
ggtggtctcaggaaggtccga

SEQ ID NO: 24639 - DNA, 18 bp, Artificial sequence
  synthetic polynucleotide sequence
ccacccgccgcttccaga

SEQ ID NO: 24640 - DNA, 19 bp, Artificial sequence
  synthetic polynucleotide sequence
gccgccaatacgcctccca

SEQ ID NO: 24641 - DNA, 20 bp, Artificial sequence
  synthetic polynucleotide sequence
tggaggcagtaggggacaca

SEQ ID NO: 24642 - DNA, 22 bp, Artificial sequence
  synthetic polynucleotide sequence
caaacaccaggtcttcgaggca

SEQ ID NO: 24643 - DNA, 20 bp, Artificial sequence
  synthetic polynucleotide sequence
atgcgcgtggagaccatgga

SEQ ID NO: 24644 - DNA, 20 bp, Artificial sequence
  synthetic polynucleotide sequence
tcgccgatcaccacgtgcca

SEQ ID NO: 24645 - DNA, 19 bp, Artificial sequence
  synthetic polynucleotide sequence
gtccgggacgagatccgca

SEQ ID NO: 24646 - DNA, 20 bp, Artificial sequence
  synthetic polynucleotide sequence
cttcccctgctcagcctgca

SEQ ID NO: 24647 - DNA, 20 bp, Artificial sequence
  synthetic polynucleotide sequence
cagcgctgacaccacagcta

SEQ ID NO: 24648 - DNA, 18 bp, Artificial sequence
  synthetic polynucleotide sequence
ggaagagccgagtcggga

SEQ ID NO: 24649 - DNA, 18 bp, Artificial sequence
  synthetic polynucleotide sequence
gagctgcggactgagcca

SEQ ID NO: 24650 - DNA, 18 bp, Artificial sequence
  synthetic polynucleotide sequence
cagccgcagtgtgcagca

SEQ ID NO: 24651 - DNA, 18 bp, Artificial sequence
  synthetic polynucleotide sequence
atcaagccgtggcggaga

SEQ ID NO: 24652 - DNA, 20 bp, Artificial sequence
  synthetic polynucleotide sequence
ctcactgctcctcagacgga

SEQ ID NO: 24653 - DNA, 19 bp, Artificial sequence
  synthetic polynucleotide sequence
gcacaccaccccagagaca

SEQ ID NO: 24654 - DNA, 18 bp, Artificial sequence
  synthetic polynucleotide sequence
acgtagctgcagccggca

SEQ ID NO: 24655 - DNA, 19 bp, Artificial sequence
  synthetic polynucleotide sequence
ggcccaagcttcaacagca

SEQ ID NO: 24656 - DNA, 18 bp, Artificial sequence
  synthetic polynucleotide sequence
ctggcagctgggcacaca

SEQ ID NO: 24657 - DNA, 18 bp, Artificial sequence
  synthetic polynucleotide sequence
gctgctccatcccagcca

SEQ ID NO: 24658 - DNA, 18 bp, Artificial sequence
  synthetic polynucleotide sequence
gtggtgaggagcctgcca

SEQ ID NO: 24659 - DNA, 19 bp, Artificial sequence
  synthetic polynucleotide sequence
gtgcccttcagcggcctca

SEQ ID NO: 24660 - DNA, 19 bp, Artificial sequence
  synthetic polynucleotide sequence
ccacaggaggttggcccca

SEQ ID NO: 24661 - DNA, 18 bp, Artificial sequence
  synthetic polynucleotide sequence
caccaacatgccacggca

SEQ ID NO: 24662 - DNA, 18 bp, Artificial sequence
  synthetic polynucleotide sequence
aatgcggctgatgcggca

SEQ ID NO: 24663 - DNA, 21 bp, Artificial sequence
  synthetic polynucleotide sequence
ctgtggaaggtagcgagacga

SEQ ID NO: 24664 - DNA, 22 bp, Artificial sequence
  synthetic polynucleotide sequence
aatatggagtagcccagctcca

SEQ ID NO: 24665 - DNA, 18 bp, Artificial sequence
  synthetic polynucleotide sequence
ggaggcggcgcactacca

SEQ ID NO: 24666 - DNA, 20 bp, Artificial sequence
  synthetic polynucleotide sequence
caggtccgagaaccagccca

SEQ ID NO: 24667 - DNA, 18 bp, Artificial sequence
  synthetic polynucleotide sequence
catcggccagaacgcgga

SEQ ID NO: 24668 - DNA, 18 bp, Artificial sequence
  synthetic polynucleotide sequence
tgaccagctgcaagacca

SEQ ID NO: 24669 - DNA, 20 bp, Artificial sequence
  synthetic polynucleotide sequence
cacaggcaactggagaggaa

SEQ ID NO: 24670 - DNA, 19 bp, Artificial sequence
  synthetic polynucleotide sequence
cgtgcaacaggaactggca

SEQ ID NO: 24671 - DNA, 18 bp, Artificial sequence
  synthetic polynucleotide sequence
ggccttcatccaccacga

SEQ ID NO: 24672 - DNA, 18 bp, Artificial sequence
  synthetic polynucleotide sequence
ggggtacaggcgtggaca

SEQ ID NO: 24673 - DNA, 20 bp, Artificial sequence
  synthetic polynucleotide sequence
atgcagttcatcacgaggga

SEQ ID NO: 24674 - DNA, 19 bp, Artificial sequence
  synthetic polynucleotide sequence
ccccacgtaacccctgcga

SEQ ID NO: 24675 - DNA, 18 bp, Artificial sequence
  synthetic polynucleotide sequence
gctgcccaagttccacca

SEQ ID NO: 24676 - DNA, 18 bp, Artificial sequence
  synthetic polynucleotide sequence
tccagagcctggtgcaca

SEQ ID NO: 24677 - DNA, 18 bp, Artificial sequence
  synthetic polynucleotide sequence
agggaagggcaagcccaa

SEQ ID NO: 24678 - DNA, 18 bp, Artificial sequence
  synthetic polynucleotide sequence
ggtggaatccctccgaca

SEQ ID NO: 24679 - DNA, 21 bp, Artificial sequence
  synthetic polynucleotide sequence
cagctgagaagaggaagccca

SEQ ID NO: 24680 - DNA, 19 bp, Artificial sequence
  synthetic polynucleotide sequence
ctcacacacctccgaggca

SEQ ID NO: 24681 - DNA, 18 bp, Artificial sequence
  synthetic polynucleotide sequence
cccaagcgcctcaagaca

SEQ ID NO: 24682 - DNA, 18 bp, Artificial sequence
  synthetic polynucleotide sequence
aaggaagcgatcccggca

SEQ ID NO: 24683 - DNA, 21 bp, Artificial sequence
  synthetic polynucleotide sequence
tggagatggagccagtcacca

SEQ ID NO: 24684 - DNA, 21 bp, Artificial sequence
  synthetic polynucleotide sequence
ttcttccgaaaccagagccca

SEQ ID NO: 24685 - DNA, 19 bp, Artificial sequence
  synthetic polynucleotide sequence
tcgaggaagccatacccaa

SEQ ID NO: 24686 - DNA, 21 bp, Artificial sequence
  synthetic polynucleotide sequence
tctgacaccgcgtttgaagca

SEQ ID NO: 24687 - DNA, 19 bp, Artificial sequence
  synthetic polynucleotide sequence
gctgcggcgattcgggaca

SEQ ID NO: 24688 - DNA, 21 bp, Artificial sequence
  synthetic polynucleotide sequence
gtgtcacttctgccacgacca

SEQ ID NO: 24689 - DNA, 20 bp, Artificial sequence
  synthetic polynucleotide sequence
ctcaggttgcctagcaggaa

SEQ ID NO: 24690 - DNA, 18 bp, Artificial sequence
  synthetic polynucleotide sequence
acgacgctcgtaggggca

SEQ ID NO: 24691 - DNA, 20 bp, Artificial sequence
  synthetic polynucleotide sequence
agccaacaaagccctgggga

SEQ ID NO: 24692 - DNA, 18 bp, Artificial sequence
  synthetic polynucleotide sequence
tgccccctgttgcccgca

SEQ ID NO: 24693 - DNA, 20 bp, Artificial sequence
  synthetic polynucleotide sequence
tgcaactgtggaagtaggca

SEQ ID NO: 24694 - DNA, 22 bp, Artificial sequence
  synthetic polynucleotide sequence
atcactaccaccacaatcacca

SEQ ID NO: 24695 - DNA, 18 bp, Artificial sequence
  synthetic polynucleotide sequence
gcaggggctgctggagga

SEQ ID NO: 24696 - DNA, 20 bp, Artificial sequence
  synthetic polynucleotide sequence
atggcagccagatgggcgca

SEQ ID NO: 24697 - DNA, 21 bp, Artificial sequence
  synthetic polynucleotide sequence
tgaaccccacatggaacgaga

SEQ ID NO: 24698 - DNA, 19 bp, Artificial sequence
  synthetic polynucleotide sequence
ggcacacgtgtctccccga

SEQ ID NO: 24699 - DNA, 19 bp, Artificial sequence
  synthetic polynucleotide sequence
tcgctggtccagttcagga

SEQ ID NO: 24700 - DNA, 18 bp, Artificial sequence
  synthetic polynucleotide sequence
ctccaaaaggtcgccgca

SEQ ID NO: 24701 - DNA, 19 bp, Artificial sequence
  synthetic polynucleotide sequence
tcccagcagaggtgaagga

SEQ ID NO: 24702 - DNA, 19 bp, Artificial sequence
  synthetic polynucleotide sequence
tgccaggctgtactggaga

SEQ ID NO: 24703 - DNA, 21 bp, Artificial sequence
  synthetic polynucleotide sequence
gaggccagagatttcccgaga

SEQ ID NO: 24704 - DNA, 21 bp, Artificial sequence
  synthetic polynucleotide sequence
agcgcttcaggaagctagcca

SEQ ID NO: 24705 - DNA, 21 bp, Artificial sequence
  synthetic polynucleotide sequence
caagctgacccacctcaagga

SEQ ID NO: 24706 - DNA, 20 bp, Artificial sequence
  synthetic polynucleotide sequence
ccggtcatggaagggtcgca

SEQ ID NO: 24707 - DNA, 20 bp, Artificial sequence
  synthetic polynucleotide sequence
gcccagccatgccgaagcca

SEQ ID NO: 24708 - DNA, 20 bp, Artificial sequence
  synthetic polynucleotide sequence
atcgtgctccagggccggca

SEQ ID NO: 24709 - DNA, 19 bp, Artificial sequence
  synthetic polynucleotide sequence
gcctggacagtgggaagga

SEQ ID NO: 24710 - DNA, 19 bp, Artificial sequence
  synthetic polynucleotide sequence
tggagatgagtcctggcga

SEQ ID NO: 24711 - DNA, 21 bp, Artificial sequence
  synthetic polynucleotide sequence
actgccacccaacttgacgga

SEQ ID NO: 24712 - DNA, 21 bp, Artificial sequence
  synthetic polynucleotide sequence
ttcaactctggcacctgacga

SEQ ID NO: 24713 - DNA, 18 bp, Artificial sequence
  synthetic polynucleotide sequence
gcatcagcaccatccgca

SEQ ID NO: 24714 - DNA, 20 bp, Artificial sequence
  synthetic polynucleotide sequence
caccagggacgagagagaca

SEQ ID NO: 24715 - DNA, 21 bp, Artificial sequence
  synthetic polynucleotide sequence
cttcgcacacagagacgtcaa

SEQ ID NO: 24716 - DNA, 20 bp, Artificial sequence
  synthetic polynucleotide sequence
cccgaacgctgccactgcaa

SEQ ID NO: 24717 - DNA, 21 bp, Artificial sequence
  synthetic polynucleotide sequence
atggatgtcacccggagccaa

SEQ ID NO: 24718 - DNA, 20 bp, Artificial sequence
  synthetic polynucleotide sequence
cccaccaaagatgccaggga

SEQ ID NO: 24719 - DNA, 18 bp, Artificial sequence
  synthetic polynucleotide sequence
agggaagcaccctggaca

SEQ ID NO: 24720 - DNA, 18 bp, Artificial sequence
  synthetic polynucleotide sequence
atcacagcgaaccacgga

SEQ ID NO: 24721 - DNA, 21 bp, Artificial sequence
  synthetic polynucleotide sequence
tcgggtgaaggaggagggcta

SEQ ID NO: 24722 - DNA, 21 bp, Artificial sequence
  synthetic polynucleotide sequence
ttgcagtaccaggttcaggga

SEQ ID NO: 24723 - DNA, 19 bp, Artificial sequence
  synthetic polynucleotide sequence
gccgccttcacccaccaca

SEQ ID NO: 24724 - DNA, 18 bp, Artificial sequence
  synthetic polynucleotide sequence
ggtcaggtcgagggggca

SEQ ID NO: 24725 - DNA, 21 bp, Artificial sequence
  synthetic polynucleotide sequence
tgcgcaagttcggctccgaca

SEQ ID NO: 24726 - DNA, 21 bp, Artificial sequence
  synthetic polynucleotide sequence
acaggaccaaggctgtcctga

SEQ ID NO: 24727 - DNA, 20 bp, Artificial sequence
  synthetic polynucleotide sequence
ctcgtatccctgcacaccca

SEQ ID NO: 24728 - DNA, 19 bp, Artificial sequence
  synthetic polynucleotide sequence
ggctgccccatacccctca

SEQ ID NO: 24729 - DNA, 18 bp, Artificial sequence
  synthetic polynucleotide sequence
ccgcctcgctgagcacca

SEQ ID NO: 24730 - DNA, 21 bp, Artificial sequence
  synthetic polynucleotide sequence
atgaagcttcagagggctgga

SEQ ID NO: 24731 - DNA, 21 bp, Artificial sequence
  synthetic polynucleotide sequence
aggagatacggtcgggactca

SEQ ID NO: 24732 - DNA, 21 bp, Artificial sequence
  synthetic polynucleotide sequence
agctatggccagtgtcgcaga

SEQ ID NO: 24733 - DNA, 20 bp, Artificial sequence
  synthetic polynucleotide sequence
ggatgaccgcagcctgtcca

SEQ ID NO: 24734 - DNA, 20 bp, Artificial sequence
  synthetic polynucleotide sequence
gacgtgctggctgacgacga

SEQ ID NO: 24735 - DNA, 18 bp, Artificial sequence
  synthetic polynucleotide sequence
cccccaccatcgcccgaa

SEQ ID NO: 24736 - DNA, 21 bp, Artificial sequence
  synthetic polynucleotide sequence
agatgggaagagacatgccca

SEQ ID NO: 24737 - DNA, 20 bp, Artificial sequence
  synthetic polynucleotide sequence
agtgggcaccaagtacggga

SEQ ID NO: 24738 - DNA, 21 bp, Artificial sequence
  synthetic polynucleotide sequence
tgtaggagactaggaaggcca

SEQ ID NO: 24739 - DNA, 18 bp, Artificial sequence
  synthetic polynucleotide sequence
tgatgcaaccctgcagca

SEQ ID NO: 24740 - DNA, 18 bp, Artificial sequence
  synthetic polynucleotide sequence
ctgctgctcggaacagga

SEQ ID NO: 24741 - DNA, 18 bp, Artificial sequence
  synthetic polynucleotide sequence
gggcagctgccatcccaa

SEQ ID NO: 24742 - DNA, 20 bp, Artificial sequence
  synthetic polynucleotide sequence
gtcccctgagtgactacgga

SEQ ID NO: 24743 - DNA, 21 bp, Artificial sequence
  synthetic polynucleotide sequence
cgatctcctaggggccacgaa

SEQ ID NO: 24744 - DNA, 19 bp, Artificial sequence
  synthetic polynucleotide sequence
tctgctccacactgccgca

SEQ ID NO: 24745 - DNA, 19 bp, Artificial sequence
  synthetic polynucleotide sequence
ctgtgccctaccaggacca

SEQ ID NO: 24746 - DNA, 18 bp, Artificial sequence
  synthetic polynucleotide sequence
cttcccgccaagccacca

SEQ ID NO: 24747 - DNA, 19 bp, Artificial sequence
  synthetic polynucleotide sequence
gagcctccagctggtgaca

SEQ ID NO: 24748 - DNA, 18 bp, Artificial sequence
  synthetic polynucleotide sequence
tgcccaggatctgcagca

SEQ ID NO: 24749 - DNA, 18 bp, Artificial sequence
  synthetic polynucleotide sequence
gacccagcgcccctagga

SEQ ID NO: 24750 - DNA, 22 bp, Artificial sequence
  synthetic polynucleotide sequence
aggtttcgaatccgccactgga

SEQ ID NO: 24751 - DNA, 22 bp, Artificial sequence
  synthetic polynucleotide sequence
aagccacaggaaacgagagcca

SEQ ID NO: 24752 - DNA, 22 bp, Artificial sequence
  synthetic polynucleotide sequence
aagatcaggccaaggaacacca

SEQ ID NO: 24753 - DNA, 18 bp, Artificial sequence
  synthetic polynucleotide sequence
cctgcaccaacaaggcca

SEQ ID NO: 24754 - DNA, 18 bp, Artificial sequence
  synthetic polynucleotide sequence
gggacccttggaacacca

SEQ ID NO: 24755 - DNA, 18 bp, Artificial sequence
  synthetic polynucleotide sequence
cggatgagcagctgagca

SEQ ID NO: 24756 - DNA, 18 bp, Artificial sequence
  synthetic polynucleotide sequence
actgggaaggtggccaca

SEQ ID NO: 24757 - DNA, 18 bp, Artificial sequence
  synthetic polynucleotide sequence
tcccactcagctgccaga

SEQ ID NO: 24758 - DNA, 18 bp, Artificial sequence
  synthetic polynucleotide sequence
gcaggttgcactgcagca

SEQ ID NO: 24759 - DNA, 18 bp, Artificial sequence
  synthetic polynucleotide sequence
cggcactgtcatccccaa

SEQ ID NO: 24760 - DNA, 18 bp, Artificial sequence
  synthetic polynucleotide sequence
ggttccgcacaggctgca

SEQ ID NO: 24761 - DNA, 21 bp, Artificial sequence
  synthetic polynucleotide sequence
atgatggcggcagtgaagaca

SEQ ID NO: 24762 - DNA, 21 bp, Artificial sequence
  synthetic polynucleotide sequence
gccacgatcgcagtcatcaca

SEQ ID NO: 24763 - DNA, 20 bp, Artificial sequence
  synthetic polynucleotide sequence
ggtccccacccaaccacaga

SEQ ID NO: 24764 - DNA, 20 bp, Artificial sequence
  synthetic polynucleotide sequence
gttcatgttggagcccccca

SEQ ID NO: 24765 - DNA, 20 bp, Artificial sequence
  synthetic polynucleotide sequence
acatccccccgactgtccaa

SEQ ID NO: 24766 - DNA, 18 bp, Artificial sequence
  synthetic polynucleotide sequence
ggcggcccaaagtgccca

SEQ ID NO: 24767 - DNA, 22 bp, Artificial sequence
  synthetic polynucleotide sequence
gaaaccccagacgtgtcactca

SEQ ID NO: 24768 - DNA, 22 bp, Artificial sequence
  synthetic polynucleotide sequence
actaaggaatgaggctgcagga

SEQ ID NO: 24769 - DNA, 22 bp, Artificial sequence
  synthetic polynucleotide sequence
atgacgaggtggaaatcgagga

SEQ ID NO: 24770 - DNA, 20 bp, Artificial sequence
  synthetic polynucleotide sequence
gttggctgaaggggctggga

SEQ ID NO: 24771 - DNA, 21 bp, Artificial sequence
  synthetic polynucleotide sequence
gagtgtaaaccaagcagccca

SEQ ID NO: 24772 - DNA, 20 bp, Artificial sequence
  synthetic polynucleotide sequence
ctccaaccctggctaagcca

SEQ ID NO: 24773 - DNA, 21 bp, Artificial sequence
  synthetic polynucleotide sequence
tgatcagtggtgggaaggaca

SEQ ID NO: 24774 - DNA, 21 bp, Artificial sequence
  synthetic polynucleotide sequence
ggcgatagaggggaagagcca

SEQ ID NO: 24775 - DNA, 20 bp, Artificial sequence
  synthetic polynucleotide sequence
tgcagggtggggtatggaga

SEQ ID NO: 24776 - DNA, 19 bp, Artificial sequence
  synthetic polynucleotide sequence
ccaggaccagtcggctcca

SEQ ID NO: 24777 - DNA, 18 bp, Artificial sequence
  synthetic polynucleotide sequence
tcgcaggtctcggcggga

SEQ ID NO: 24778 - DNA, 19 bp, Artificial sequence
  synthetic polynucleotide sequence
ttcaccagcagccacacga

SEQ ID NO: 24779 - DNA, 21 bp, Artificial sequence
  synthetic polynucleotide sequence
cctactacaccgcctgggtga

SEQ ID NO: 24780 - DNA, 22 bp, Artificial sequence
  synthetic polynucleotide sequence
aacagtcccacaaacaggagca

SEQ ID NO: 24781 - DNA, 20 bp, Artificial sequence
  synthetic polynucleotide sequence
actagcgatcctgggctcca

SEQ ID NO: 24782 - DNA, 18 bp, Artificial sequence
  synthetic polynucleotide sequence
ggcatagcagccggcgga

SEQ ID NO: 24783 - DNA, 25 bp, Artificial sequence
  synthetic polynucleotide sequence
cacgctcagagacagtgaactagca

SEQ ID NO: 24784 - DNA, 21 bp, Artificial sequence
  synthetic polynucleotide sequence
ttctgcacccctagcaacaca

SEQ ID NO: 24785 - DNA, 21 bp, Artificial sequence
  synthetic polynucleotide sequence
accatcgcctccagctacgaa

SEQ ID NO: 24786 - DNA, 21 bp, Artificial sequence
  synthetic polynucleotide sequence
cctccagcaagactctcagga

SEQ ID NO: 24787 - DNA, 19 bp, Artificial sequence
  synthetic polynucleotide sequence
ttgcagtggctcaggagga

SEQ ID NO: 24788 - DNA, 22 bp, Artificial sequence
  synthetic polynucleotide sequence
ccaacccagccagtagtactca

SEQ ID NO: 24789 - DNA, 20 bp, Artificial sequence
  synthetic polynucleotide sequence
aggtctggaaggggaagcca

SEQ ID NO: 24790 - DNA, 20 bp, Artificial sequence
  synthetic polynucleotide sequence
gctaccatgccacatcccca

SEQ ID NO: 24791 - DNA, 18 bp, Artificial sequence
  synthetic polynucleotide sequence
cctgaccttcgccagcaa

SEQ ID NO: 24792 - DNA, 19 bp, Artificial sequence
  synthetic polynucleotide sequence
ccccagaagctggtcagca

SEQ ID NO: 24793 - DNA, 22 bp, Artificial sequence
  synthetic polynucleotide sequence
aaaagatggagggccacaagga

SEQ ID NO: 24794 - DNA, 21 bp, Artificial sequence
  synthetic polynucleotide sequence
ccagtctggatcagcagggca

SEQ ID NO: 24795 - DNA, 20 bp, Artificial sequence
  synthetic polynucleotide sequence
cctgcagttcgtggccgaga

SEQ ID NO: 24796 - DNA, 20 bp, Artificial sequence
  synthetic polynucleotide sequence
cttctccacgtgcagggcca

SEQ ID NO: 24797 - DNA, 21 bp, Artificial sequence
  synthetic polynucleotide sequence
aaggcagtgaccaagagagca

SEQ ID NO: 24798 - DNA, 21 bp, Artificial sequence
  synthetic polynucleotide sequence
tctgccgagagaagtctgcca

SEQ ID NO: 24799 - DNA, 21 bp, Artificial sequence
  synthetic polynucleotide sequence
ggagcagcagtcctcagggaa

SEQ ID NO: 24800 - DNA, 20 bp, Artificial sequence
  synthetic polynucleotide sequence
atgcgtacgaactccgccga

SEQ ID NO: 24801 - DNA, 20 bp, Artificial sequence
  synthetic polynucleotide sequence
gggcgaggacaccagaggca

SEQ ID NO: 24802 - DNA, 22 bp, Artificial sequence
  synthetic polynucleotide sequence
aaactgcaggtgaacccaacca

SEQ ID NO: 24803 - DNA, 20 bp, Artificial sequence
  synthetic polynucleotide sequence
cggcccggacggatctcgaa

SEQ ID NO: 24804 - DNA, 23 bp, Artificial sequence
  synthetic polynucleotide sequence
caaataggagccgtaaaccacga

SEQ ID NO: 24805 - DNA, 22 bp, Artificial sequence
  synthetic polynucleotide sequence
aactccacaaccgccaatacca

SEQ ID NO: 24806 - DNA, 21 bp, Artificial sequence
  synthetic polynucleotide sequence
ctcgatgacccgtgtacacca

SEQ ID NO: 24807 - DNA, 21 bp, Artificial sequence
  synthetic polynucleotide sequence
ctggcatggaatggtaccaga

SEQ ID NO: 24808 - DNA, 18 bp, Artificial sequence
  synthetic polynucleotide sequence
actgccactcccgatcca

SEQ ID NO: 24809 - DNA, 19 bp, Artificial sequence
  synthetic polynucleotide sequence
ttggccagttggtaccgga

SEQ ID NO: 24810 - DNA, 23 bp, Artificial sequence
  synthetic polynucleotide sequence
ataaaagcaagcaggatctccca

SEQ ID NO: 24811 - DNA, 19 bp, Artificial sequence
  synthetic polynucleotide sequence
ctgccaaggggctcctgga

SEQ ID NO: 24812 - DNA, 20 bp, Artificial sequence
  synthetic polynucleotide sequence
cttttcccggagctgcgcca

SEQ ID NO: 24813 - DNA, 19 bp, Artificial sequence
  synthetic polynucleotide sequence
tctggccaggaatgatgga

SEQ ID NO: 24814 - DNA, 21 bp, Artificial sequence
  synthetic polynucleotide sequence
tgcacagcttgactccggcca

SEQ ID NO: 24815 - DNA, 21 bp, Artificial sequence
  synthetic polynucleotide sequence
ccacctgtagagctgcgccaa

SEQ ID NO: 24816 - DNA, 22 bp, Artificial sequence
  synthetic polynucleotide sequence
cataccactagtaaccgctgca

SEQ ID NO: 24817 - DNA, 21 bp, Artificial sequence
  synthetic polynucleotide sequence
gatgctggagggacaaacgca

SEQ ID NO: 24818 - DNA, 21 bp, Artificial sequence
  synthetic polynucleotide sequence
ccaggtaggcacgagttggca

SEQ ID NO: 24819 - DNA, 18 bp, Artificial sequence
  synthetic polynucleotide sequence
ggcacaccttggccagca

SEQ ID NO: 24820 - DNA, 18 bp, Artificial sequence
  synthetic polynucleotide sequence
ccaggcagagcacgagca

SEQ ID NO: 24821 - DNA, 21 bp, Artificial sequence
  synthetic polynucleotide sequence
tgagagccatcaccatagcca

SEQ ID NO: 24822 - DNA, 22 bp, Artificial sequence
  synthetic polynucleotide sequence
ttcaccatagaccaccttccca

SEQ ID NO: 24823 - DNA, 18 bp, Artificial sequence
  synthetic polynucleotide sequence
gattccggagggcaccaa

SEQ ID NO: 24824 - DNA, 18 bp, Artificial sequence
  synthetic polynucleotide sequence
tcggcatcggatcccaca

SEQ ID NO: 24825 - DNA, 18 bp, Artificial sequence
  synthetic polynucleotide sequence
caacctgcacgtgaccca

SEQ ID NO: 24826 - DNA, 18 bp, Artificial sequence
  synthetic polynucleotide sequence
atgccccttgggacggca

SEQ ID NO: 24827 - DNA, 20 bp, Artificial sequence
  synthetic polynucleotide sequence
tcgctcaggccaagcgcaga

SEQ ID NO: 24828 - DNA, 20 bp, Artificial sequence
  synthetic polynucleotide sequence
aaggctgcggccttggccca

SEQ ID NO: 24829 - DNA, 20 bp, Artificial sequence
  synthetic polynucleotide sequence
tgtgggacccagaagccaca

SEQ ID NO: 24830 - DNA, 19 bp, Artificial sequence
  synthetic polynucleotide sequence
ccccggctgatggtgacca

SEQ ID NO: 24831 - DNA, 21 bp, Artificial sequence
  synthetic polynucleotide sequence
ggcagcattgtgccaagccca

SEQ ID NO: 24832 - DNA, 21 bp, Artificial sequence
  synthetic polynucleotide sequence
agtatgaggagagctgggcca

SEQ ID NO: 24833 - DNA, 20 bp, Artificial sequence
  synthetic polynucleotide sequence
cggtggagtagtggaccaga

SEQ ID NO: 24834 - DNA, 19 bp, Artificial sequence
  synthetic polynucleotide sequence
gtgcagcagttcaccacca

SEQ ID NO: 24835 - DNA, 21 bp, Artificial sequence
  synthetic polynucleotide sequence
tgtacacgctcctacagtcca

SEQ ID NO: 24836 - DNA, 20 bp, Artificial sequence
  synthetic polynucleotide sequence
atggggatgacagctgcgca

SEQ ID NO: 24837 - DNA, 18 bp, Artificial sequence
  synthetic polynucleotide sequence
gcccaaaatccatggcaa

SEQ ID NO: 24838 - DNA, 23 bp, Artificial sequence
  synthetic polynucleotide sequence
caaaactgatgagcaagtcagca

SEQ ID NO: 24839 - DNA, 21 bp, Artificial sequence
  synthetic polynucleotide sequence
acaaccacatggatggggaca

SEQ ID NO: 24840 - DNA, 20 bp, Artificial sequence
  synthetic polynucleotide sequence
ctccgagtctgtcccggaca

SEQ ID NO: 24841 - DNA, 21 bp, Artificial sequence
  synthetic polynucleotide sequence
agaaggtccaccatcaggaga

SEQ ID NO: 24842 - DNA, 20 bp, Artificial sequence
  synthetic polynucleotide sequence
ccctgggcaagtcgagtcaa

SEQ ID NO: 24843 - DNA, 21 bp, Artificial sequence
  synthetic polynucleotide sequence
agctggcagagcagacggaga

SEQ ID NO: 24844 - DNA, 20 bp, Artificial sequence
  synthetic polynucleotide sequence
acccatgacgaaggcctcca

SEQ ID NO: 24845 - DNA, 21 bp, Artificial sequence
  synthetic polynucleotide sequence
ccaggagcagggcaaacgcaa

SEQ ID NO: 24846 - DNA, 20 bp, Artificial sequence
  synthetic polynucleotide sequence
ctcctccagctgctccacca

SEQ ID NO: 24847 - DNA, 19 bp, Artificial sequence
  synthetic polynucleotide sequence
cggaggaggacgtggcaga

SEQ ID NO: 24848 - DNA, 21 bp, Artificial sequence
  synthetic polynucleotide sequence
tgatgcacatgtcgggcgtca

SEQ ID NO: 24849 - DNA, 21 bp, Artificial sequence
  synthetic polynucleotide sequence
acgaggctccatctccaagga

SEQ ID NO: 24850 - DNA, 21 bp, Artificial sequence
  synthetic polynucleotide sequence
gcttctccaagggtctggcga

SEQ ID NO: 24851 - DNA, 19 bp, Artificial sequence
  synthetic polynucleotide sequence
cggacctccctcaagacca

SEQ ID NO: 24852 - DNA, 18 bp, Artificial sequence
  synthetic polynucleotide sequence
tgtacaggacaggcggga

SEQ ID NO: 24853 - DNA, 20 bp, Artificial sequence
  synthetic polynucleotide sequence
atgcccgttcactaccagca

SEQ ID NO: 24854 - DNA, 20 bp, Artificial sequence
  synthetic polynucleotide sequence
gaagagggcaggacacagca

SEQ ID NO: 24855 - DNA, 18 bp, Artificial sequence
  synthetic polynucleotide sequence
cccagactccaccgcaga

SEQ ID NO: 24856 - DNA, 18 bp, Artificial sequence
  synthetic polynucleotide sequence
gcgtgatgtgcaccacga

SEQ ID NO: 24857 - DNA, 19 bp, Artificial sequence
  synthetic polynucleotide sequence
ccctgcgtcagtgagacca

SEQ ID NO: 24858 - DNA, 18 bp, Artificial sequence
  synthetic polynucleotide sequence
agaagtggctgcacccca

SEQ ID NO: 24859 - DNA, 22 bp, Artificial sequence
  synthetic polynucleotide sequence
aagaagaaggacaagggaggca

SEQ ID NO: 24860 - DNA, 22 bp, Artificial sequence
  synthetic polynucleotide sequence
actacgtagagtcacatcggca

SEQ ID NO: 24861 - DNA, 20 bp, Artificial sequence
  synthetic polynucleotide sequence
tgtggtcatcagctgcggca

SEQ ID NO: 24862 - DNA, 19 bp, Artificial sequence
  synthetic polynucleotide sequence
ctggcgagtgaccggtgga

SEQ ID NO: 24863 - DNA, 22 bp, Artificial sequence
  synthetic polynucleotide sequence
accaagcccggagtaagaagga

SEQ ID NO: 24864 - DNA, 19 bp, Artificial sequence
  synthetic polynucleotide sequence
gggacaaggcctgggcgta

SEQ ID NO: 24865 - DNA, 22 bp, Artificial sequence
  synthetic polynucleotide sequence
acctgcagcacatcagcaacca

SEQ ID NO: 24866 - DNA, 20 bp, Artificial sequence
  synthetic polynucleotide sequence
gtcctcagaagaaccctgga

SEQ ID NO: 24867 - DNA, 18 bp, Artificial sequence
  synthetic polynucleotide sequence
gtggaattcggcagccca

SEQ ID NO: 24868 - DNA, 20 bp, Artificial sequence
  synthetic polynucleotide sequence
aacaacagcatcacccagga

SEQ ID NO: 24869 - DNA, 22 bp, Artificial sequence
  synthetic polynucleotide sequence
agaagggacagactactccaga

SEQ ID NO: 24870 - DNA, 21 bp, Artificial sequence
  synthetic polynucleotide sequence
cagaacttcgcacactgggga

SEQ ID NO: 24871 - DNA, 22 bp, Artificial sequence
  synthetic polynucleotide sequence
caacacactggcgacttgagaa

SEQ ID NO: 24872 - DNA, 21 bp, Artificial sequence
  synthetic polynucleotide sequence
gtgcaagatcggccaactgca

SEQ ID NO: 24873 - DNA, 20 bp, Artificial sequence
  synthetic polynucleotide sequence
agggagaacatgtacgggga

SEQ ID NO: 24874 - DNA, 19 bp, Artificial sequence
  synthetic polynucleotide sequence
ctcatcaggatcaaccgca

SEQ ID NO: 24875 - DNA, 18 bp, Artificial sequence
  synthetic polynucleotide sequence
gaccgcatgccatcccaa

SEQ ID NO: 24876 - DNA, 18 bp, Artificial sequence
  synthetic polynucleotide sequence
tcactgcagcagcccaca

SEQ ID NO: 24877 - DNA, 19 bp, Artificial sequence
  synthetic polynucleotide sequence
tggaccacagctcagagga

SEQ ID NO: 24878 - DNA, 20 bp, Artificial sequence
  synthetic polynucleotide sequence
cagcagcaagacccccacca

SEQ ID NO: 24879 - DNA, 22 bp, Artificial sequence
  synthetic polynucleotide sequence
catccatgagcacaccctcaga

SEQ ID NO: 24880 - DNA, 20 bp, Artificial sequence
  synthetic polynucleotide sequence
cttgttggcccggtgaggga

SEQ ID NO: 24881 - DNA, 18 bp, Artificial sequence
  synthetic polynucleotide sequence
tggatgcgacgctgcaga

SEQ ID NO: 24882 - DNA, 18 bp, Artificial sequence
  synthetic polynucleotide sequence
ggcacagcgtgggctcca

SEQ ID NO: 24883 - DNA, 19 bp, Artificial sequence
  synthetic polynucleotide sequence
ttactcccagtcccgtgga

SEQ ID NO: 24884 - DNA, 19 bp, Artificial sequence
  synthetic polynucleotide sequence
gcacacccgcacgtctcca

SEQ ID NO: 24885 - DNA, 22 bp, Artificial sequence
  synthetic polynucleotide sequence
acgagagatgatgaaccccgga

SEQ ID NO: 24886 - DNA, 19 bp, Artificial sequence
  synthetic polynucleotide sequence
tgtggggctggcaagtcca

SEQ ID NO: 24887 - DNA, 20 bp, Artificial sequence
  synthetic polynucleotide sequence
gagacagactgaggaggcca

SEQ ID NO: 24888 - DNA, 20 bp, Artificial sequence
  synthetic polynucleotide sequence
tatcagggacagcatccaca

SEQ ID NO: 24889 - DNA, 21 bp, Artificial sequence
  synthetic polynucleotide sequence
tagtctgagtatgcaccccga

SEQ ID NO: 24890 - DNA, 20 bp, Artificial sequence
  synthetic polynucleotide sequence
tgtccctcccaagctgctca

SEQ ID NO: 24891 - DNA, 18 bp, Artificial sequence
  synthetic polynucleotide sequence
ctgcagggaagcacagca

SEQ ID NO: 24892 - DNA, 18 bp, Artificial sequence
  synthetic polynucleotide sequence
cgcaatggcacatcagca

SEQ ID NO: 24893 - DNA, 18 bp, Artificial sequence
  synthetic polynucleotide sequence
gacgatggccaggaagca

SEQ ID NO: 24894 - DNA, 18 bp, Artificial sequence
  synthetic polynucleotide sequence
aacaacccacggagccca

SEQ ID NO: 24895 - DNA, 22 bp, Artificial sequence
  synthetic polynucleotide sequence
tcccccatgacatctcgacaca

SEQ ID NO: 24896 - DNA, 21 bp, Artificial sequence
  synthetic polynucleotide sequence
acaaggtgcaaggtctccaca

SEQ ID NO: 24897 - DNA, 20 bp, Artificial sequence
  synthetic polynucleotide sequence
gcaatcctggcggcgagcaa

SEQ ID NO: 24898 - DNA, 22 bp, Artificial sequence
  synthetic polynucleotide sequence
tcgacactgatagaccggctga

SEQ ID NO: 24899 - DNA, 19 bp, Artificial sequence
  synthetic polynucleotide sequence
gaccaagacatggccacca

SEQ ID NO: 24900 - DNA, 17 bp, Artificial sequence
  synthetic polynucleotide sequence
ccaggaagcgctggcca

SEQ ID NO: 24901 - DNA, 19 bp, Artificial sequence
  synthetic polynucleotide sequence
ctggaatggggacacagga

SEQ ID NO: 24902 - DNA, 20 bp, Artificial sequence
  synthetic polynucleotide sequence
cttcttggacaacagcgaca

SEQ ID NO: 24903 - DNA, 18 bp, Artificial sequence
  synthetic polynucleotide sequence
gcagggccaaaggaagga

SEQ ID NO: 24904 - DNA, 18 bp, Artificial sequence
  synthetic polynucleotide sequence
gcgcagcctgactggaca

SEQ ID NO: 24905 - DNA, 19 bp, Artificial sequence
  synthetic polynucleotide sequence
gcaagctccaaggatgcaa

SEQ ID NO: 24906 - DNA, 21 bp, Artificial sequence
  synthetic polynucleotide sequence
cagggcatccttcaaaggcta

SEQ ID NO: 24907 - DNA, 20 bp, Artificial sequence
  synthetic polynucleotide sequence
atggagcggctacaccggga

SEQ ID NO: 24908 - DNA, 20 bp, Artificial sequence
  synthetic polynucleotide sequence
ctggctgtgcaggaagcgga

SEQ ID NO: 24909 - DNA, 20 bp, Artificial sequence
  synthetic polynucleotide sequence
aagctcgaaaaacagcagca

SEQ ID NO: 24910 - DNA, 18 bp, Artificial sequence
  synthetic polynucleotide sequence
gaggacacgtcgccctca

SEQ ID NO: 24911 - DNA, 21 bp, Artificial sequence
  synthetic polynucleotide sequence
tgggtggaggtccaaagagga

SEQ ID NO: 24912 - DNA, 21 bp, Artificial sequence
  synthetic polynucleotide sequence
ctccaagggtagcttgaggga

SEQ ID NO: 24913 - DNA, 22 bp, Artificial sequence
  synthetic polynucleotide sequence
tcaaccgtccacagagtaccaa

SEQ ID NO: 24914 - DNA, 20 bp, Artificial sequence
  synthetic polynucleotide sequence
gaatggtgctacggcgcaga

SEQ ID NO: 24915 - DNA, 21 bp, Artificial sequence
  synthetic polynucleotide sequence
gcccggtctcccatcaacaga

SEQ ID NO: 24916 - DNA, 21 bp, Artificial sequence
  synthetic polynucleotide sequence
ttggtctccgaagcaggtgga

SEQ ID NO: 24917 - DNA, 18 bp, Artificial sequence
  synthetic polynucleotide sequence
aggcacagcaaaacccca

SEQ ID NO: 24918 - DNA, 20 bp, Artificial sequence
  synthetic polynucleotide sequence
gagaccctccaactggacca

SEQ ID NO: 24919 - DNA, 21 bp, Artificial sequence
  synthetic polynucleotide sequence
catacatcgcccacccatgga

SEQ ID NO: 24920 - DNA, 18 bp, Artificial sequence
  synthetic polynucleotide sequence
cccgactccgctcagcga

SEQ ID NO: 24921 - DNA, 22 bp, Artificial sequence
  synthetic polynucleotide sequence
tgatggacatatcggaccagga

SEQ ID NO: 24922 - DNA, 19 bp, Artificial sequence
  synthetic polynucleotide sequence
tggaggggagtggcatcga

SEQ ID NO: 24923 - DNA, 22 bp, Artificial sequence
  synthetic polynucleotide sequence
gaagtcagcgaaggaaagcaga

SEQ ID NO: 24924 - DNA, 20 bp, Artificial sequence
  synthetic polynucleotide sequence
ctcacagagcagggagcaga

SEQ ID NO: 24925 - DNA, 23 bp, Artificial sequence
  synthetic polynucleotide sequence
cagagtggacagcagagagtcaa

SEQ ID NO: 24926 - DNA, 20 bp, Artificial sequence
  synthetic polynucleotide sequence
cgtggcagccaatcagcaga

SEQ ID NO: 24927 - DNA, 18 bp, Artificial sequence
  synthetic polynucleotide sequence
agtgcccccagatgagga

SEQ ID NO: 24928 - DNA, 20 bp, Artificial sequence
  synthetic polynucleotide sequence
cagtacatggccaggaggca

SEQ ID NO: 24929 - DNA, 19 bp, Artificial sequence
  synthetic polynucleotide sequence
tcggtatcctggcaccaca

SEQ ID NO: 24930 - DNA, 20 bp, Artificial sequence
  synthetic polynucleotide sequence
tgtggtcatggacgtgccga

SEQ ID NO: 24931 - DNA, 20 bp, Artificial sequence
  synthetic polynucleotide sequence
ccaaagcagcttctccgcca

SEQ ID NO: 24932 - DNA, 19 bp, Artificial sequence
  synthetic polynucleotide sequence
tgttgatacaaggggcgca

SEQ ID NO: 24933 - DNA, 20 bp, Artificial sequence
  synthetic polynucleotide sequence
caccacaggcgagtcagaca

SEQ ID NO: 24934 - DNA, 18 bp, Artificial sequence
  synthetic polynucleotide sequence
gggcagccagttcagcca

SEQ ID NO: 24935 - DNA, 21 bp, Artificial sequence
  synthetic polynucleotide sequence
ctcgtcgtggacagatacgca

SEQ ID NO: 24936 - DNA, 21 bp, Artificial sequence
  synthetic polynucleotide sequence
tcctggaaagccccgttctca

SEQ ID NO: 24937 - DNA, 20 bp, Artificial sequence
  synthetic polynucleotide sequence
catccgagaggtggaggaga

SEQ ID NO: 24938 - DNA, 18 bp, Artificial sequence
  synthetic polynucleotide sequence
agtgggtgatggagcgca

SEQ ID NO: 24939 - DNA, 21 bp, Artificial sequence
  synthetic polynucleotide sequence
ggaggagaacgaccaccagga

SEQ ID NO: 24940 - DNA, 19 bp, Artificial sequence
  synthetic polynucleotide sequence
gaagggctcgaagggggga

SEQ ID NO: 24941 - DNA, 21 bp, Artificial sequence
  synthetic polynucleotide sequence
cgggacactacacctcagcca

SEQ ID NO: 24942 - DNA, 20 bp, Artificial sequence
  synthetic polynucleotide sequence
tgatccagaaggcaggccca

SEQ ID NO: 24943 - DNA, 20 bp, Artificial sequence
  synthetic polynucleotide sequence
tggcactgctgaccaccgga

SEQ ID NO: 24944 - DNA, 20 bp, Artificial sequence
  synthetic polynucleotide sequence
tgagtggtgagcgcggagga

SEQ ID NO: 24945 - DNA, 21 bp, Artificial sequence
  synthetic polynucleotide sequence
acctgcccaccttcgacctca

SEQ ID NO: 24946 - DNA, 20 bp, Artificial sequence
  synthetic polynucleotide sequence
gtggatcatcaggtaggcca

SEQ ID NO: 24947 - DNA, 20 bp, Artificial sequence
  synthetic polynucleotide sequence
cgacccctctctgaagccaa

SEQ ID NO: 24948 - DNA, 21 bp, Artificial sequence
  synthetic polynucleotide sequence
aagcaatccgtgacctgggca

SEQ ID NO: 24949 - DNA, 22 bp, Artificial sequence
  synthetic polynucleotide sequence
aacggaggatctcatgaccaca

SEQ ID NO: 24950 - DNA, 20 bp, Artificial sequence
  synthetic polynucleotide sequence
ccgcagaccctccttgagga

SEQ ID NO: 24951 - DNA, 21 bp, Artificial sequence
  synthetic polynucleotide sequence
gtacatcgaggagtgcgtgca

SEQ ID NO: 24952 - DNA, 18 bp, Artificial sequence
  synthetic polynucleotide sequence
gtccaggcgctcggacga

SEQ ID NO: 24953 - DNA, 21 bp, Artificial sequence
  synthetic polynucleotide sequence
gtggcggattactgggacaga

SEQ ID NO: 24954 - DNA, 22 bp, Artificial sequence
  synthetic polynucleotide sequence
aggagtcccgagttcaagagca

SEQ ID NO: 24955 - DNA, 20 bp, Artificial sequence
  synthetic polynucleotide sequence
cagcgcggaatctgggtgca

SEQ ID NO: 24956 - DNA, 20 bp, Artificial sequence
  synthetic polynucleotide sequence
tgcgggaagcgtgatacgca

SEQ ID NO: 24957 - DNA, 21 bp, Artificial sequence
  synthetic polynucleotide sequence
tgacaactccctccagctcca

SEQ ID NO: 24958 - DNA, 21 bp, Artificial sequence
  synthetic polynucleotide sequence
ggaagggcaagatgggggtga

SEQ ID NO: 24959 - DNA, 22 bp, Artificial sequence
  synthetic polynucleotide sequence
gaattccagtgtacccaggtca

SEQ ID NO: 24960 - DNA, 22 bp, Artificial sequence
  synthetic polynucleotide sequence
gaaatgtcgaggagctgagtga

SEQ ID NO: 24961 - DNA, 21 bp, Artificial sequence
  synthetic polynucleotide sequence
cgagacggacctactcagcca

SEQ ID NO: 24962 - DNA, 20 bp, Artificial sequence
  synthetic polynucleotide sequence
tatggccacacttcgactga

SEQ ID NO: 24963 - DNA, 19 bp, Artificial sequence
  synthetic polynucleotide sequence
ggcaagttccaggtggaca

SEQ ID NO: 24964 - DNA, 18 bp, Artificial sequence
  synthetic polynucleotide sequence
cagagcggcttaccccca

SEQ ID NO: 24965 - DNA, 20 bp, Artificial sequence
  synthetic polynucleotide sequence
ctgtcatcaggcccaacgta

SEQ ID NO: 24966 - DNA, 19 bp, Artificial sequence
  synthetic polynucleotide sequence
gacgtcgggaactatgcca

SEQ ID NO: 24967 - DNA, 18 bp, Artificial sequence
  synthetic polynucleotide sequence
ccccttccgcgacgagga

SEQ ID NO: 24968 - DNA, 20 bp, Artificial sequence
  synthetic polynucleotide sequence
gttccctcggaggctgctga

SEQ ID NO: 24969 - DNA, 21 bp, Artificial sequence
  synthetic polynucleotide sequence
tcagacagccagagcaagcga

SEQ ID NO: 24970 - DNA, 19 bp, Artificial sequence
  synthetic polynucleotide sequence
gtagaggtctggggggcca

SEQ ID NO: 24971 - DNA, 21 bp, Artificial sequence
  synthetic polynucleotide sequence
tggagatgaagcagggccgta

SEQ ID NO: 24972 - DNA, 22 bp, Artificial sequence
  synthetic polynucleotide sequence
atagtggatgagctgctcccaa

SEQ ID NO: 24973 - DNA, 21 bp, Artificial sequence
  synthetic polynucleotide sequence
tgtgcaggaccttagctcgga

SEQ ID NO: 24974 - DNA, 20 bp, Artificial sequence
  synthetic polynucleotide sequence
acaattgcagcagccctgga

SEQ ID NO: 24975 - DNA, 18 bp, Artificial sequence
  synthetic polynucleotide sequence
caaaaccagccgctccga

SEQ ID NO: 24976 - DNA, 18 bp, Artificial sequence
  synthetic polynucleotide sequence
aggacggctgtgatgcca

SEQ ID NO: 24977 - DNA, 18 bp, Artificial sequence
  synthetic polynucleotide sequence
gggccgtacgctgctgca

SEQ ID NO: 24978 - DNA, 18 bp, Artificial sequence
  synthetic polynucleotide sequence
gatgatggggcggcgcga

SEQ ID NO: 24979 - DNA, 18 bp, Artificial sequence
  synthetic polynucleotide sequence
gtgcatcccagcagcgga

SEQ ID NO: 24980 - DNA, 18 bp, Artificial sequence
  synthetic polynucleotide sequence
gtgcagggcatcctccca

SEQ ID NO: 24981 - DNA, 20 bp, Artificial sequence
  synthetic polynucleotide sequence
ggagaggctgtgggagtgca

SEQ ID NO: 24982 - DNA, 20 bp, Artificial sequence
  synthetic polynucleotide sequence
ctcgatggagccgggtcgta

SEQ ID NO: 24983 - DNA, 20 bp, Artificial sequence
  synthetic polynucleotide sequence
cacttccagacggctgccga

SEQ ID NO: 24984 - DNA, 20 bp, Artificial sequence
  synthetic polynucleotide sequence
gccagtaccagggtggcgga

SEQ ID NO: 24985 - DNA, 21 bp, Artificial sequence
  synthetic polynucleotide sequence
ggacacctcctcctaccacga

SEQ ID NO: 24986 - DNA, 20 bp, Artificial sequence
  synthetic polynucleotide sequence
gttgtacgtggacctggaga

SEQ ID NO: 24987 - DNA, 20 bp, Artificial sequence
  synthetic polynucleotide sequence
ggaggaaggatgtccctgca

SEQ ID NO: 24988 - DNA, 20 bp, Artificial sequence
  synthetic polynucleotide sequence
tcctgcagacacagtcccga

SEQ ID NO: 24989 - DNA, 18 bp, Artificial sequence
  synthetic polynucleotide sequence
ctcgtccactgccgggaa

SEQ ID NO: 24990 - DNA, 18 bp, Artificial sequence
  synthetic polynucleotide sequence
ctcacgatgctcagggca

SEQ ID NO: 24991 - DNA, 18 bp, Artificial sequence
  synthetic polynucleotide sequence
tgccaaggggaggcagca

SEQ ID NO: 24992 - DNA, 21 bp, Artificial sequence
  synthetic polynucleotide sequence
agactgttgagtgggtaggca

SEQ ID NO: 24993 - DNA, 20 bp, Artificial sequence
  synthetic polynucleotide sequence
aacgagaatacgggcggcga

SEQ ID NO: 24994 - DNA, 20 bp, Artificial sequence
  synthetic polynucleotide sequence
ggtctcgcaatgcagggaga

SEQ ID NO: 24995 - DNA, 18 bp, Artificial sequence
  synthetic polynucleotide sequence
cctggacgtgctcggcaa

SEQ ID NO: 24996 - DNA, 18 bp, Artificial sequence
  synthetic polynucleotide sequence
agctgatggcctcaggga

SEQ ID NO: 24997 - DNA, 18 bp, Artificial sequence
  synthetic polynucleotide sequence
cagcaactcctgccccaa

SEQ ID NO: 24998 - DNA, 18 bp, Artificial sequence
  synthetic polynucleotide sequence
gatggcgatggtggcaga

SEQ ID NO: 24999 - DNA, 20 bp, Artificial sequence
  synthetic polynucleotide sequence
atcctcaatgtcacccccaa

SEQ ID NO: 25000 - DNA, 18 bp, Artificial sequence
  synthetic polynucleotide sequence
ccccgcagttctgggaca

SEQ ID NO: 25001 - DNA, 20 bp, Artificial sequence
  synthetic polynucleotide sequence
cgcgggctacgacctgtaca

SEQ ID NO: 25002 - DNA, 20 bp, Artificial sequence
  synthetic polynucleotide sequence
cagccaagcctgaccgtgga

SEQ ID NO: 25003 - DNA, 20 bp, Artificial sequence
  synthetic polynucleotide sequence
gcaggggcagatgcaaggca

SEQ ID NO: 25004 - DNA, 20 bp, Artificial sequence
  synthetic polynucleotide sequence
cagaaactccgggctcgcca

SEQ ID NO: 25005 - DNA, 21 bp, Artificial sequence
  synthetic polynucleotide sequence
cctgccaatggacccatgaca

SEQ ID NO: 25006 - DNA, 20 bp, Artificial sequence
  synthetic polynucleotide sequence
gggtatgagaggcccctgaa

SEQ ID NO: 25007 - DNA, 19 bp, Artificial sequence
  synthetic polynucleotide sequence
gcccggaagtacgccagca

SEQ ID NO: 25008 - DNA, 21 bp, Artificial sequence
  synthetic polynucleotide sequence
gggtggcgagattgctgcaga

SEQ ID NO: 25009 - DNA, 18 bp, Artificial sequence
  synthetic polynucleotide sequence
caggcctgatccgacaca

SEQ ID NO: 25010 - DNA, 18 bp, Artificial sequence
  synthetic polynucleotide sequence
gaagccccactggagcca

SEQ ID NO: 25011 - DNA, 20 bp, Artificial sequence
  synthetic polynucleotide sequence
gcccgcaagtatgccagcaa

SEQ ID NO: 25012 - DNA, 20 bp, Artificial sequence
  synthetic polynucleotide sequence
gttgccgcagaggtcaccga

SEQ ID NO: 25013 - DNA, 21 bp, Artificial sequence
  synthetic polynucleotide sequence
gtagactgcacagacccccaa

SEQ ID NO: 25014 - DNA, 21 bp, Artificial sequence
  synthetic polynucleotide sequence
tgggaggaatgactgagccca

SEQ ID NO: 25015 - DNA, 21 bp, Artificial sequence
  synthetic polynucleotide sequence
ggcaagagttcgcccagtgga

SEQ ID NO: 25016 - DNA, 19 bp, Artificial sequence
  synthetic polynucleotide sequence
tcacgctccagcttggcca

SEQ ID NO: 25017 - DNA, 21 bp, Artificial sequence
  synthetic polynucleotide sequence
aagatccacctgcaggaggaa

SEQ ID NO: 25018 - DNA, 21 bp, Artificial sequence
  synthetic polynucleotide sequence
gactggaagtacctggcagga

SEQ ID NO: 25019 - DNA, 22 bp, Artificial sequence
  synthetic polynucleotide sequence
acaagaaaagccacctcctcca

SEQ ID NO: 25020 - DNA, 21 bp, Artificial sequence
  synthetic polynucleotide sequence
agaggggaagaaagctctgga

SEQ ID NO: 25021 - DNA, 22 bp, Artificial sequence
  synthetic polynucleotide sequence
tgaacccaggaatccttgcaca

SEQ ID NO: 25022 - DNA, 22 bp, Artificial sequence
  synthetic polynucleotide sequence
caggctaagagacaagccagga

SEQ ID NO: 25023 - DNA, 18 bp, Artificial sequence
  synthetic polynucleotide sequence
tcaggacgttcgccagga

SEQ ID NO: 25024 - DNA, 19 bp, Artificial sequence
  synthetic polynucleotide sequence
gcaccgtgtagtgggacca

SEQ ID NO: 25025 - DNA, 22 bp, Artificial sequence
  synthetic polynucleotide sequence
acatgctctcaactccacagga

SEQ ID NO: 25026 - DNA, 19 bp, Artificial sequence
  synthetic polynucleotide sequence
tcctcactgccaaccacga

SEQ ID NO: 25027 - DNA, 20 bp, Artificial sequence
  synthetic polynucleotide sequence
tgaggggcatcaaggaccaa

SEQ ID NO: 25028 - DNA, 22 bp, Artificial sequence
  synthetic polynucleotide sequence
caaatccaatctccccatgcca

SEQ ID NO: 25029 - DNA, 21 bp, Artificial sequence
  synthetic polynucleotide sequence
atgttgccagcgtgtcaccca

SEQ ID NO: 25030 - DNA, 19 bp, Artificial sequence
  synthetic polynucleotide sequence
gcttccacctccagcccca

SEQ ID NO: 25031 - DNA, 20 bp, Artificial sequence
  synthetic polynucleotide sequence
gtcaaggttccccacagaga

SEQ ID NO: 25032 - DNA, 21 bp, Artificial sequence
  synthetic polynucleotide sequence
tgcacaccaccaacaccggga

SEQ ID NO: 25033 - DNA, 19 bp, Artificial sequence
  synthetic polynucleotide sequence
ggcgctaagaccggacaga

SEQ ID NO: 25034 - DNA, 18 bp, Artificial sequence
  synthetic polynucleotide sequence
gaaggatcagcacccgga

SEQ ID NO: 25035 - DNA, 19 bp, Artificial sequence
  synthetic polynucleotide sequence
tgggaactcggtggaggaa

SEQ ID NO: 25036 - DNA, 19 bp, Artificial sequence
  synthetic polynucleotide sequence
ttccatggtgggccagaga

SEQ ID NO: 25037 - DNA, 21 bp, Artificial sequence
  synthetic polynucleotide sequence
gatgcaacaggactcggtgga

SEQ ID NO: 25038 - DNA, 22 bp, Artificial sequence
  synthetic polynucleotide sequence
taactaccgaagttcctcccca

SEQ ID NO: 25039 - DNA, 19 bp, Artificial sequence
  synthetic polynucleotide sequence
ccgttgactgcgccacgca

SEQ ID NO: 25040 - DNA, 20 bp, Artificial sequence
  synthetic polynucleotide sequence
cggcccacgatacaatgcca

SEQ ID NO: 25041 - DNA, 21 bp, Artificial sequence
  synthetic polynucleotide sequence
gccagaagggagtgcagggaa

SEQ ID NO: 25042 - DNA, 20 bp, Artificial sequence
  synthetic polynucleotide sequence
ctgggggtcgatgtcacgca

SEQ ID NO: 25043 - DNA, 20 bp, Artificial sequence
  synthetic polynucleotide sequence
cacctgacaatgaaagccaa

SEQ ID NO: 25044 - DNA, 18 bp, Artificial sequence
  synthetic polynucleotide sequence
acagccttggccatcgca

SEQ ID NO: 25045 - DNA, 22 bp, Artificial sequence
  synthetic polynucleotide sequence
caaagtgaaccagtggaccaca

SEQ ID NO: 25046 - DNA, 19 bp, Artificial sequence
  synthetic polynucleotide sequence
tctcccatcgcacagtgca

SEQ ID NO: 25047 - DNA, 22 bp, Artificial sequence
  synthetic polynucleotide sequence
ttcaatgctgaggaagcccaca

SEQ ID NO: 25048 - DNA, 20 bp, Artificial sequence
  synthetic polynucleotide sequence
ctggaccactgcacaggtca

SEQ ID NO: 25049 - DNA, 18 bp, Artificial sequence
  synthetic polynucleotide sequence
gctcatcggggacaagca

SEQ ID NO: 25050 - DNA, 18 bp, Artificial sequence
  synthetic polynucleotide sequence
tccatggcctgcacggca

SEQ ID NO: 25051 - DNA, 21 bp, Artificial sequence
  synthetic polynucleotide sequence
ctgtgagatgaacagccccca

SEQ ID NO: 25052 - DNA, 20 bp, Artificial sequence
  synthetic polynucleotide sequence
tcccaggcagtgacgaggca

SEQ ID NO: 25053 - DNA, 18 bp, Artificial sequence
  synthetic polynucleotide sequence
cagcggaggagatccgaa

SEQ ID NO: 25054 - DNA, 18 bp, Artificial sequence
  synthetic polynucleotide sequence
tgcagaatcgagtgggca

SEQ ID NO: 25055 - DNA, 21 bp, Artificial sequence
  synthetic polynucleotide sequence
ggtaaaaagcggggtccccca

SEQ ID NO: 25056 - DNA, 19 bp, Artificial sequence
  synthetic polynucleotide sequence
ggcagaggggtcccagtga

SEQ ID NO: 25057 - DNA, 22 bp, Artificial sequence
  synthetic polynucleotide sequence
caaaagatagccccacgaagca

SEQ ID NO: 25058 - DNA, 18 bp, Artificial sequence
  synthetic polynucleotide sequence
tggacacctccgccccga

SEQ ID NO: 25059 - DNA, 21 bp, Artificial sequence
  synthetic polynucleotide sequence
agccagacatcgagcagggga

SEQ ID NO: 25060 - DNA, 21 bp, Artificial sequence
  synthetic polynucleotide sequence
tgaggctcaggtcatccagga

SEQ ID NO: 25061 - DNA, 20 bp, Artificial sequence
  synthetic polynucleotide sequence
tgtggaaagtgccacccgca

SEQ ID NO: 25062 - DNA, 20 bp, Artificial sequence
  synthetic polynucleotide sequence
taaccggtggcaggtcggga

SEQ ID NO: 25063 - DNA, 20 bp, Artificial sequence
  synthetic polynucleotide sequence
tacagctggcagcagacgaa

SEQ ID NO: 25064 - DNA, 21 bp, Artificial sequence
  synthetic polynucleotide sequence
cgtcacagaaagggtctccca

SEQ ID NO: 25065 - DNA, 20 bp, Artificial sequence
  synthetic polynucleotide sequence
aggaagagagagcaccgcca

SEQ ID NO: 25066 - DNA, 21 bp, Artificial sequence
  synthetic polynucleotide sequence
ccttggccaaacttggcagca

SEQ ID NO: 25067 - DNA, 20 bp, Artificial sequence
  synthetic polynucleotide sequence
gggaagcgaaatcgaggaca

SEQ ID NO: 25068 - DNA, 18 bp, Artificial sequence
  synthetic polynucleotide sequence
atcctccacatccgcaca

SEQ ID NO: 25069 - DNA, 20 bp, Artificial sequence
  synthetic polynucleotide sequence
actgcatggaccctccagca

SEQ ID NO: 25070 - DNA, 21 bp, Artificial sequence
  synthetic polynucleotide sequence
gctgtagagacacacgctgca

SEQ ID NO: 25071 - DNA, 18 bp, Artificial sequence
  synthetic polynucleotide sequence
ccacatgggaaggagcca

SEQ ID NO: 25072 - DNA, 20 bp, Artificial sequence
  synthetic polynucleotide sequence
tggagtctgcacgttggaca

SEQ ID NO: 25073 - DNA, 19 bp, Artificial sequence
  synthetic polynucleotide sequence
cccctcatccctcaccaca

SEQ ID NO: 25074 - DNA, 18 bp, Artificial sequence
  synthetic polynucleotide sequence
cggagaagtcctcccgca

SEQ ID NO: 25075 - DNA, 18 bp, Artificial sequence
  synthetic polynucleotide sequence
cccatccttggaccagga

SEQ ID NO: 25076 - DNA, 19 bp, Artificial sequence
  synthetic polynucleotide sequence
ggtccccaaggtcgtagga

SEQ ID NO: 25077 - DNA, 22 bp, Artificial sequence
  synthetic polynucleotide sequence
atcaccaacgttctggaaggca

SEQ ID NO: 25078 - DNA, 20 bp, Artificial sequence
  synthetic polynucleotide sequence
caggccttgacactgggcca

SEQ ID NO: 25079 - DNA, 18 bp, Artificial sequence
  synthetic polynucleotide sequence
ccatcaaggcagacccca

SEQ ID NO: 25080 - DNA, 18 bp, Artificial sequence
  synthetic polynucleotide sequence
agacgaagcagaggggca

SEQ ID NO: 25081 - DNA, 22 bp, Artificial sequence
  synthetic polynucleotide sequence
ggtacacaactggaggtaccca

SEQ ID NO: 25082 - DNA, 21 bp, Artificial sequence
  synthetic polynucleotide sequence
cactggagtcaaggactggga

SEQ ID NO: 25083 - DNA, 18 bp, Artificial sequence
  synthetic polynucleotide sequence
ggagtccgaaagcggaga

SEQ ID NO: 25084 - DNA, 20 bp, Artificial sequence
  synthetic polynucleotide sequence
tcaaacagctgctgagcaca

SEQ ID NO: 25085 - DNA, 21 bp, Artificial sequence
  synthetic polynucleotide sequence
aactccctgctgcagaagaga

SEQ ID NO: 25086 - DNA, 21 bp, Artificial sequence
  synthetic polynucleotide sequence
aagggacactgaaagacggca

SEQ ID NO: 25087 - DNA, 21 bp, Artificial sequence
  synthetic polynucleotide sequence
ccagagccagccaaatggaca

SEQ ID NO: 25088 - DNA, 19 bp, Artificial sequence
  synthetic polynucleotide sequence
ggtccacctggggtacgga

SEQ ID NO: 25089 - DNA, 22 bp, Artificial sequence
  synthetic polynucleotide sequence
aacgtcaccatggacgaggaga

SEQ ID NO: 25090 - DNA, 18 bp, Artificial sequence
  synthetic polynucleotide sequence
gccctcgctgatggccga

SEQ ID NO: 25091 - DNA, 21 bp, Artificial sequence
  synthetic polynucleotide sequence
gccttcacaccagcagcccta

SEQ ID NO: 25092 - DNA, 21 bp, Artificial sequence
  synthetic polynucleotide sequence
tgtcactgccagactcactca

SEQ ID NO: 25093 - DNA, 18 bp, Artificial sequence
  synthetic polynucleotide sequence
tcaggctgaggtggcaga

SEQ ID NO: 25094 - DNA, 18 bp, Artificial sequence
  synthetic polynucleotide sequence
cacagtgtggaaggcgca

SEQ ID NO: 25095 - DNA, 23 bp, Artificial sequence
  synthetic polynucleotide sequence
gaaaagttgcaacagctccgaca

SEQ ID NO: 25096 - DNA, 21 bp, Artificial sequence
  synthetic polynucleotide sequence
tgtgcatcaacccaggcctga

SEQ ID NO: 25097 - DNA, 19 bp, Artificial sequence
  synthetic polynucleotide sequence
gccctgctggacctggaga

SEQ ID NO: 25098 - DNA, 21 bp, Artificial sequence
  synthetic polynucleotide sequence
caaccaaaggcctcctccaca

SEQ ID NO: 25099 - DNA, 20 bp, Artificial sequence
  synthetic polynucleotide sequence
cagatctggcagaggacgga

SEQ ID NO: 25100 - DNA, 21 bp, Artificial sequence
  synthetic polynucleotide sequence
atcttcatcccaggaagtcca

SEQ ID NO: 25101 - DNA, 19 bp, Artificial sequence
  synthetic polynucleotide sequence
ccactccccagcagaccaa

SEQ ID NO: 25102 - DNA, 18 bp, Artificial sequence
  synthetic polynucleotide sequence
cagctgagccgttgagga

SEQ ID NO: 25103 - DNA, 20 bp, Artificial sequence
  synthetic polynucleotide sequence
cagccagcttggggtcagca

SEQ ID NO: 25104 - DNA, 20 bp, Artificial sequence
  synthetic polynucleotide sequence
taaggagagccggtgggtga

SEQ ID NO: 25105 - DNA, 21 bp, Artificial sequence
  synthetic polynucleotide sequence
cgtcaactccttcagcagcca

SEQ ID NO: 25106 - DNA, 20 bp, Artificial sequence
  synthetic polynucleotide sequence
ctggggagtactgctgggga

SEQ ID NO: 25107 - DNA, 20 bp, Artificial sequence
  synthetic polynucleotide sequence
attcccagacaccccggaga

SEQ ID NO: 25108 - DNA, 21 bp, Artificial sequence
  synthetic polynucleotide sequence
tgctgtacagagcctcggcca

SEQ ID NO: 25109 - DNA, 19 bp, Artificial sequence
  synthetic polynucleotide sequence
cctgctccaaactccacca

SEQ ID NO: 25110 - DNA, 21 bp, Artificial sequence
  synthetic polynucleotide sequence
gtgacattgagcacgtaggga

SEQ ID NO: 25111 - DNA, 22 bp, Artificial sequence
  synthetic polynucleotide sequence
gatatgcaccaacagcctccaa

SEQ ID NO: 25112 - DNA, 22 bp, Artificial sequence
  synthetic polynucleotide sequence
ttgatcaagtagctcgcacgca

SEQ ID NO: 25113 - DNA, 22 bp, Artificial sequence
  synthetic polynucleotide sequence
ggttgggaatgagaacgaggaa

SEQ ID NO: 25114 - DNA, 20 bp, Artificial sequence
  synthetic polynucleotide sequence
aaggtcacagcagtggcgga

SEQ ID NO: 25115 - DNA, 19 bp, Artificial sequence
  synthetic polynucleotide sequence
ccccgcctccatcagctca

SEQ ID NO: 25116 - DNA, 19 bp, Artificial sequence
  synthetic polynucleotide sequence
ttcagacctctccatggca

SEQ ID NO: 25117 - DNA, 22 bp, Artificial sequence
  synthetic polynucleotide sequence
aaagagtatgccaagggagaca

SEQ ID NO: 25118 - DNA, 18 bp, Artificial sequence
  synthetic polynucleotide sequence
aggcgatcaccacccaca

SEQ ID NO: 25119 - DNA, 19 bp, Artificial sequence
  synthetic polynucleotide sequence
gctacgacgcgctggtgca

SEQ ID NO: 25120 - DNA, 22 bp, Artificial sequence
  synthetic polynucleotide sequence
aacaatgccagagacccatcca

SEQ ID NO: 25121 - DNA, 22 bp, Artificial sequence
  synthetic polynucleotide sequence
agatggaccaggaactagcaca

SEQ ID NO: 25122 - DNA, 18 bp, Artificial sequence
  synthetic polynucleotide sequence
tggaagcaggtcctgcca

SEQ ID NO: 25123 - DNA, 18 bp, Artificial sequence
  synthetic polynucleotide sequence
cacacgctcctcacccaa

SEQ ID NO: 25124 - DNA, 18 bp, Artificial sequence
  synthetic polynucleotide sequence
cttgaaggcctccacgga

SEQ ID NO: 25125 - DNA, 18 bp, Artificial sequence
  synthetic polynucleotide sequence
gctggctggggaacgaga

SEQ ID NO: 25126 - DNA, 18 bp, Artificial sequence
  synthetic polynucleotide sequence
aaccggcctccagggaca

SEQ ID NO: 25127 - DNA, 20 bp, Artificial sequence
  synthetic polynucleotide sequence
cctgcgaaaggctgagtgca

SEQ ID NO: 25128 - DNA, 20 bp, Artificial sequence
  synthetic polynucleotide sequence
gaggccgcccatatctgcga

SEQ ID NO: 25129 - DNA, 18 bp, Artificial sequence
  synthetic polynucleotide sequence
accattcggtggccgaga

SEQ ID NO: 25130 - DNA, 18 bp, Artificial sequence
  synthetic polynucleotide sequence
agtcgtggcctggaccga

SEQ ID NO: 25131 - DNA, 21 bp, Artificial sequence
  synthetic polynucleotide sequence
ggacagaggggaaaggcctca

SEQ ID NO: 25132 - DNA, 21 bp, Artificial sequence
  synthetic polynucleotide sequence
tgctcctccacccaatgccca

SEQ ID NO: 25133 - DNA, 21 bp, Artificial sequence
  synthetic polynucleotide sequence
ggactgattgagaccacgcga

SEQ ID NO: 25134 - DNA, 20 bp, Artificial sequence
  synthetic polynucleotide sequence
cagtcgtcggcccgtgaaga

SEQ ID NO: 25135 - DNA, 22 bp, Artificial sequence
  synthetic polynucleotide sequence
gctaggaagatcgcatcgctga

SEQ ID NO: 25136 - DNA, 19 bp, Artificial sequence
  synthetic polynucleotide sequence
cgcagggccaggttgtcca

SEQ ID NO: 25137 - DNA, 18 bp, Artificial sequence
  synthetic polynucleotide sequence
tgccggtgagaaggccca

SEQ ID NO: 25138 - DNA, 19 bp, Artificial sequence
  synthetic polynucleotide sequence
ggctgagatccggtcacca

SEQ ID NO: 25139 - DNA, 21 bp, Artificial sequence
  synthetic polynucleotide sequence
cctggagaacaccatcgggca

SEQ ID NO: 25140 - DNA, 21 bp, Artificial sequence
  synthetic polynucleotide sequence
gaatggccatccactgggcta

SEQ ID NO: 25141 - DNA, 22 bp, Artificial sequence
  synthetic polynucleotide sequence
agatcatgttcaaccggcccaa

SEQ ID NO: 25142 - DNA, 21 bp, Artificial sequence
  synthetic polynucleotide sequence
tcctctactccaccaggggga

SEQ ID NO: 25143 - DNA, 18 bp, Artificial sequence
  synthetic polynucleotide sequence
atggaaggcctgggagga

SEQ ID NO: 25144 - DNA, 18 bp, Artificial sequence
  synthetic polynucleotide sequence
ttggggtaaggagcccga

SEQ ID NO: 25145 - DNA, 20 bp, Artificial sequence
  synthetic polynucleotide sequence
aggaggacccggtaagagga

SEQ ID NO: 25146 - DNA, 21 bp, Artificial sequence
  synthetic polynucleotide sequence
ggtcctgtaggacagagagca

SEQ ID NO: 25147 - DNA, 21 bp, Artificial sequence
  synthetic polynucleotide sequence
atgagcctgagcatgagggaa

SEQ ID NO: 25148 - DNA, 22 bp, Artificial sequence
  synthetic polynucleotide sequence
atgatcaccacaaccaccagga

SEQ ID NO: 25149 - DNA, 18 bp, Artificial sequence
  synthetic polynucleotide sequence
ggaagagacgccggagga

SEQ ID NO: 25150 - DNA, 18 bp, Artificial sequence
  synthetic polynucleotide sequence
ggtcatgagcacccgcca

SEQ ID NO: 25151 - DNA, 19 bp, Artificial sequence
  synthetic polynucleotide sequence
gcagtcagcaaggtggcaa

SEQ ID NO: 25152 - DNA, 20 bp, Artificial sequence
  synthetic polynucleotide sequence
ctggtgcaaggataggtcca

SEQ ID NO: 25153 - DNA, 22 bp, Artificial sequence
  synthetic polynucleotide sequence
aaaccttgcccaagcgaagcaa

SEQ ID NO: 25154 - DNA, 20 bp, Artificial sequence
  synthetic polynucleotide sequence
tgaagtgtggccggagagca

SEQ ID NO: 25155 - DNA, 19 bp, Artificial sequence
  synthetic polynucleotide sequence
ctggccctccacctgctga

SEQ ID NO: 25156 - DNA, 20 bp, Artificial sequence
  synthetic polynucleotide sequence
gatggggctgtcagggtcga

SEQ ID NO: 25157 - DNA, 22 bp, Artificial sequence
  synthetic polynucleotide sequence
atgcacagagctggacctgcaa

SEQ ID NO: 25158 - DNA, 22 bp, Artificial sequence
  synthetic polynucleotide sequence
tcaaagggcacattgagctcca

SEQ ID NO: 25159 - DNA, 18 bp, Artificial sequence
  synthetic polynucleotide sequence
ggggcatgacagacggca

SEQ ID NO: 25160 - DNA, 20 bp, Artificial sequence
  synthetic polynucleotide sequence
cacacaaggactccacagca

SEQ ID NO: 25161 - DNA, 20 bp, Artificial sequence
  synthetic polynucleotide sequence
ccacagagccccaccttgga

SEQ ID NO: 25162 - DNA, 20 bp, Artificial sequence
  synthetic polynucleotide sequence
cttgggccactcctcgtcca

SEQ ID NO: 25163 - DNA, 19 bp, Artificial sequence
  synthetic polynucleotide sequence
cgggcaccagtactcagca

SEQ ID NO: 25164 - DNA, 18 bp, Artificial sequence
  synthetic polynucleotide sequence
cttgcagccaaagggcga

SEQ ID NO: 25165 - DNA, 18 bp, Artificial sequence
  synthetic polynucleotide sequence
gccacatgaagagccgga

SEQ ID NO: 25166 - DNA, 18 bp, Artificial sequence
  synthetic polynucleotide sequence
tgctgcacctcagcacga

SEQ ID NO: 25167 - DNA, 22 bp, Artificial sequence
  synthetic polynucleotide sequence
ccaagtaggacacgcaggtgga

SEQ ID NO: 25168 - DNA, 25 bp, Artificial sequence
  synthetic polynucleotide sequence
atacacacagcctgcaaaggatgca

SEQ ID NO: 25169 - DNA, 19 bp, Artificial sequence
  synthetic polynucleotide sequence
gggcacactcttggcccta

SEQ ID NO: 25170 - DNA, 18 bp, Artificial sequence
  synthetic polynucleotide sequence
tcggaagcgatccatcca

SEQ ID NO: 25171 - DNA, 20 bp, Artificial sequence
  synthetic polynucleotide sequence
cacgataagggtcctgggaa

SEQ ID NO: 25172 - DNA, 18 bp, Artificial sequence
  synthetic polynucleotide sequence
aagcagggaggagccgca

SEQ ID NO: 25173 - DNA, 18 bp, Artificial sequence
  synthetic polynucleotide sequence
ccatgaccaggcaaggga

SEQ ID NO: 25174 - DNA, 18 bp, Artificial sequence
  synthetic polynucleotide sequence
gaagggctgactggggca

SEQ ID NO: 25175 - DNA, 19 bp, Artificial sequence
  synthetic polynucleotide sequence
ccagaggcagtgatgggaa

SEQ ID NO: 25176 - DNA, 18 bp, Artificial sequence
  synthetic polynucleotide sequence
ccaccaatggctccagca

SEQ ID NO: 25177 - DNA, 19 bp, Artificial sequence
  synthetic polynucleotide sequence
cgcggactatgagagcgga

SEQ ID NO: 25178 - DNA, 18 bp, Artificial sequence
  synthetic polynucleotide sequence
ccccggagcttgaggcca

SEQ ID NO: 25179 - DNA, 20 bp, Artificial sequence
  synthetic polynucleotide sequence
aatacaaatgctcaggccca

SEQ ID NO: 25180 - DNA, 22 bp, Artificial sequence
  synthetic polynucleotide sequence
aaagagctcggtgagtagagga

SEQ ID NO: 25181 - DNA, 19 bp, Artificial sequence
  synthetic polynucleotide sequence
cttgccaaggagctccaga

SEQ ID NO: 25182 - DNA, 19 bp, Artificial sequence
  synthetic polynucleotide sequence
tatccatcagggacgagca

SEQ ID NO: 25183 - DNA, 19 bp, Artificial sequence
  synthetic polynucleotide sequence
gctcctggctcgacaagga

SEQ ID NO: 25184 - DNA, 18 bp, Artificial sequence
  synthetic polynucleotide sequence
gtccctggcactggagca

SEQ ID NO: 25185 - DNA, 21 bp, Artificial sequence
  synthetic polynucleotide sequence
cccaaactctggacgtcagca

SEQ ID NO: 25186 - DNA, 18 bp, Artificial sequence
  synthetic polynucleotide sequence
ggagcgagggcgagtcca

SEQ ID NO: 25187 - DNA, 22 bp, Artificial sequence
  synthetic polynucleotide sequence
aagcagcgtcgagaagtggcaa

SEQ ID NO: 25188 - DNA, 21 bp, Artificial sequence
  synthetic polynucleotide sequence
agcagcagaggcatgactgga

SEQ ID NO: 25189 - DNA, 18 bp, Artificial sequence
  synthetic polynucleotide sequence
gccaaggacccatcgaga

SEQ ID NO: 25190 - DNA, 18 bp, Artificial sequence
  synthetic polynucleotide sequence
tgcagcaggtctcccaga

SEQ ID NO: 25191 - DNA, 19 bp, Artificial sequence
  synthetic polynucleotide sequence
ccgaggggctagagaagca

SEQ ID NO: 25192 - DNA, 18 bp, Artificial sequence
  synthetic polynucleotide sequence
tcatggcagcatcggaca

SEQ ID NO: 25193 - DNA, 22 bp, Artificial sequence
  synthetic polynucleotide sequence
aggagctgggcagagaaaacca

SEQ ID NO: 25194 - DNA, 19 bp, Artificial sequence
  synthetic polynucleotide sequence
tccacactgtcggcagtga

SEQ ID NO: 25195 - DNA, 21 bp, Artificial sequence
  synthetic polynucleotide sequence
aggcgtagaagggcacagaga

SEQ ID NO: 25196 - DNA, 20 bp, Artificial sequence
  synthetic polynucleotide sequence
caaatcgcctaaccatcgca

SEQ ID NO: 25197 - DNA, 22 bp, Artificial sequence
  synthetic polynucleotide sequence
gatatggttcctggcaagccca

SEQ ID NO: 25198 - DNA, 20 bp, Artificial sequence
  synthetic polynucleotide sequence
ctttgatgacacccaccgca

SEQ ID NO: 25199 - DNA, 18 bp, Artificial sequence
  synthetic polynucleotide sequence
cggtcatcgactgccaca

SEQ ID NO: 25200 - DNA, 18 bp, Artificial sequence
  synthetic polynucleotide sequence
ccggcaccatctccacga

SEQ ID NO: 25201 - DNA, 20 bp, Artificial sequence
  synthetic polynucleotide sequence
gagaattggcaactgagcca

SEQ ID NO: 25202 - DNA, 18 bp, Artificial sequence
  synthetic polynucleotide sequence
gggcactcacacatgcga

SEQ ID NO: 25203 - DNA, 21 bp, Artificial sequence
  synthetic polynucleotide sequence
atgtgctgaccatcacgcaga

SEQ ID NO: 25204 - DNA, 19 bp, Artificial sequence
  synthetic polynucleotide sequence
cacgatgcctgtccccgca

SEQ ID NO: 25205 - DNA, 20 bp, Artificial sequence
  synthetic polynucleotide sequence
gaggacaaggaggcggcaca

SEQ ID NO: 25206 - DNA, 22 bp, Artificial sequence
  synthetic polynucleotide sequence
tcatcccaaggcttgacatcca

SEQ ID NO: 25207 - DNA, 22 bp, Artificial sequence
  synthetic polynucleotide sequence
caatggtccaagtctaacagga

SEQ ID NO: 25208 - DNA, 21 bp, Artificial sequence
  synthetic polynucleotide sequence
agtgcccatctacttgagtga

SEQ ID NO: 25209 - DNA, 19 bp, Artificial sequence
  synthetic polynucleotide sequence
gcgaggagtgggaccagga

SEQ ID NO: 25210 - DNA, 21 bp, Artificial sequence
  synthetic polynucleotide sequence
cagagtcaaaagctcgcgcca

SEQ ID NO: 25211 - DNA, 20 bp, Artificial sequence
  synthetic polynucleotide sequence
cttgagcagctccgagggaa

SEQ ID NO: 25212 - DNA, 20 bp, Artificial sequence
  synthetic polynucleotide sequence
gagctgatggaccgtcgcga

SEQ ID NO: 25213 - DNA, 19 bp, Artificial sequence
  synthetic polynucleotide sequence
ccgacaagaaggccggcca

SEQ ID NO: 25214 - DNA, 18 bp, Artificial sequence
  synthetic polynucleotide sequence
gcccgctccacaaggcca

SEQ ID NO: 25215 - DNA, 21 bp, Artificial sequence
  synthetic polynucleotide sequence
ggttggcgagctttgcacaga

SEQ ID NO: 25216 - DNA, 19 bp, Artificial sequence
  synthetic polynucleotide sequence
gtgaaggtgtgcgcgggga

SEQ ID NO: 25217 - DNA, 20 bp, Artificial sequence
  synthetic polynucleotide sequence
ccatccccccactgcctgga

SEQ ID NO: 25218 - DNA, 21 bp, Artificial sequence
  synthetic polynucleotide sequence
cccacagcacatactggggaa

SEQ ID NO: 25219 - DNA, 21 bp, Artificial sequence
  synthetic polynucleotide sequence
accctggaggagatggaggaa

SEQ ID NO: 25220 - DNA, 20 bp, Artificial sequence
  synthetic polynucleotide sequence
gtgccgattcccacagcgca

SEQ ID NO: 25221 - DNA, 22 bp, Artificial sequence
  synthetic polynucleotide sequence
tgaaaccctcgacgatctcaga

SEQ ID NO: 25222 - DNA, 21 bp, Artificial sequence
  synthetic polynucleotide sequence
ctaacctggcagcatcacgca

SEQ ID NO: 25223 - DNA, 21 bp, Artificial sequence
  synthetic polynucleotide sequence
ctgcctaccactgtagaggga

SEQ ID NO: 25224 - DNA, 21 bp, Artificial sequence
  synthetic polynucleotide sequence
gatgtggctgaaggtgacgga

SEQ ID NO: 25225 - DNA, 21 bp, Artificial sequence
  synthetic polynucleotide sequence
gcggacgagaaggacagggaa

SEQ ID NO: 25226 - DNA, 21 bp, Artificial sequence
  synthetic polynucleotide sequence
ctctccttccgtaggacagca

SEQ ID NO: 25227 - DNA, 20 bp, Artificial sequence
  synthetic polynucleotide sequence
ccagcatactggcccaggaa

SEQ ID NO: 25228 - DNA, 21 bp, Artificial sequence
  synthetic polynucleotide sequence
gcaatccgggcagcattagca

SEQ ID NO: 25229 - DNA, 21 bp, Artificial sequence
  synthetic polynucleotide sequence
ccatccacaggaagtcatgca

SEQ ID NO: 25230 - DNA, 21 bp, Artificial sequence
  synthetic polynucleotide sequence
catagcaggccacttggacca

SEQ ID NO: 25231 - DNA, 22 bp, Artificial sequence
  synthetic polynucleotide sequence
aaatacccggacttcctgagca

SEQ ID NO: 25232 - DNA, 21 bp, Artificial sequence
  synthetic polynucleotide sequence
tgagtgggcaatgagagggca

SEQ ID NO: 25233 - DNA, 22 bp, Artificial sequence
  synthetic polynucleotide sequence
caactggctgtaggctgaggaa

SEQ ID NO: 25234 - DNA, 20 bp, Artificial sequence
  synthetic polynucleotide sequence
tctctctgcagacagcccaa

SEQ ID NO: 25235 - DNA, 20 bp, Artificial sequence
  synthetic polynucleotide sequence
cagtcagcctccacagccca

SEQ ID NO: 25236 - DNA, 20 bp, Artificial sequence
  synthetic polynucleotide sequence
gggccgctcgaaggaggaga

SEQ ID NO: 25237 - DNA, 20 bp, Artificial sequence
  synthetic polynucleotide sequence
ggacgtgcacggcaagaaca

SEQ ID NO: 25238 - DNA, 20 bp, Artificial sequence
  synthetic polynucleotide sequence
gtgggccagcagcatgcaca

SEQ ID NO: 25239 - DNA, 20 bp, Artificial sequence
  synthetic polynucleotide sequence
gctgtccctgctggaggaga

SEQ ID NO: 25240 - DNA, 20 bp, Artificial sequence
  synthetic polynucleotide sequence
tgtctccgcaacagctggca

SEQ ID NO: 25241 - DNA, 18 bp, Artificial sequence
  synthetic polynucleotide sequence
tcagaagcgaggggagca

SEQ ID NO: 25242 - DNA, 18 bp, Artificial sequence
  synthetic polynucleotide sequence
cccaggactgcactggca

SEQ ID NO: 25243 - DNA, 18 bp, Artificial sequence
  synthetic polynucleotide sequence
ccgctgcgtggacaccaa

SEQ ID NO: 25244 - DNA, 18 bp, Artificial sequence
  synthetic polynucleotide sequence
gcgagtttccagcacgga

SEQ ID NO: 25245 - DNA, 21 bp, Artificial sequence
  synthetic polynucleotide sequence
ctccggacacttctgagacca

SEQ ID NO: 25246 - DNA, 21 bp, Artificial sequence
  synthetic polynucleotide sequence
ctgatgcgacgaattcgggga

SEQ ID NO: 25247 - DNA, 20 bp, Artificial sequence
  synthetic polynucleotide sequence
gggcaagtaccttggcagga

SEQ ID NO: 25248 - DNA, 20 bp, Artificial sequence
  synthetic polynucleotide sequence
caaggatgatgaaccggtga

SEQ ID NO: 25249 - DNA, 22 bp, Artificial sequence
  synthetic polynucleotide sequence
atcccccagtgcaatgtccaga

SEQ ID NO: 25250 - DNA, 21 bp, Artificial sequence
  synthetic polynucleotide sequence
gactgagtcatcccacaggca

SEQ ID NO: 25251 - DNA, 18 bp, Artificial sequence
  synthetic polynucleotide sequence
caagctcagcttccggga

SEQ ID NO: 25252 - DNA, 19 bp, Artificial sequence
  synthetic polynucleotide sequence
cagggccacatcgatctca

SEQ ID NO: 25253 - DNA, 20 bp, Artificial sequence
  synthetic polynucleotide sequence
cggggagcttcaggaggaca

SEQ ID NO: 25254 - DNA, 19 bp, Artificial sequence
  synthetic polynucleotide sequence
cctcctcgaagcggctgga

SEQ ID NO: 25255 - DNA, 21 bp, Artificial sequence
  synthetic polynucleotide sequence
caggacagctaattgccacca

SEQ ID NO: 25256 - DNA, 21 bp, Artificial sequence
  synthetic polynucleotide sequence
cgagaacatcaccagtggcca

SEQ ID NO: 25257 - DNA, 18 bp, Artificial sequence
  synthetic polynucleotide sequence
tcacagtcctcaggccca

SEQ ID NO: 25258 - DNA, 20 bp, Artificial sequence
  synthetic polynucleotide sequence
cacagtccaggcaagtggga

SEQ ID NO: 25259 - DNA, 21 bp, Artificial sequence
  synthetic polynucleotide sequence
gaccaacgagaccctgtacga

SEQ ID NO: 25260 - DNA, 18 bp, Artificial sequence
  synthetic polynucleotide sequence
gggtccagagcacgggga

SEQ ID NO: 25261 - DNA, 18 bp, Artificial sequence
  synthetic polynucleotide sequence
gttccacgccggccacga

SEQ ID NO: 25262 - DNA, 20 bp, Artificial sequence
  synthetic polynucleotide sequence
gagtgcgatgtggaggcgca

SEQ ID NO: 25263 - DNA, 18 bp, Artificial sequence
  synthetic polynucleotide sequence
gcccatcccccaggagga

SEQ ID NO: 25264 - DNA, 18 bp, Artificial sequence
  synthetic polynucleotide sequence
cacagggcacagatggca

SEQ ID NO: 25265 - DNA, 18 bp, Artificial sequence
  synthetic polynucleotide sequence
catgagtcagccgagcca

SEQ ID NO: 25266 - DNA, 22 bp, Artificial sequence
  synthetic polynucleotide sequence
atcgccaggaggaacagtagga

SEQ ID NO: 25267 - DNA, 18 bp, Artificial sequence
  synthetic polynucleotide sequence
ccaggagttcagccccaa

SEQ ID NO: 25268 - DNA, 18 bp, Artificial sequence
  synthetic polynucleotide sequence
ggcgtcacagcattggga

SEQ ID NO: 25269 - DNA, 19 bp, Artificial sequence
  synthetic polynucleotide sequence
ccgctaaggactgcggaca

SEQ ID NO: 25270 - DNA, 18 bp, Artificial sequence
  synthetic polynucleotide sequence
ccgggctctgcgggggca

SEQ ID NO: 25271 - DNA, 20 bp, Artificial sequence
  synthetic polynucleotide sequence
ctgggaaggagaacctgcca

SEQ ID NO: 25272 - DNA, 18 bp, Artificial sequence
  synthetic polynucleotide sequence
ctccgccaacacatggca

SEQ ID NO: 25273 - DNA, 18 bp, Artificial sequence
  synthetic polynucleotide sequence
cccgggttcgagcaggta

SEQ ID NO: 25274 - DNA, 20 bp, Artificial sequence
  synthetic polynucleotide sequence
gaattcaacgctgagacgca

SEQ ID NO: 25275 - DNA, 21 bp, Artificial sequence
  synthetic polynucleotide sequence
gctgttcaggacgtggcccaa

SEQ ID NO: 25276 - DNA, 21 bp, Artificial sequence
  synthetic polynucleotide sequence
aggagctcaatgaccacccca

SEQ ID NO: 25277 - DNA, 18 bp, Artificial sequence
  synthetic polynucleotide sequence
tgggcaatgccagagcca

SEQ ID NO: 25278 - DNA, 18 bp, Artificial sequence
  synthetic polynucleotide sequence
ccaggcgatgagcagcca

SEQ ID NO: 25279 - DNA, 18 bp, Artificial sequence
  synthetic polynucleotide sequence
aaccgaaccccgaggcaa

SEQ ID NO: 25280 - DNA, 18 bp, Artificial sequence
  synthetic polynucleotide sequence
tgcgcaggccatcaagca

SEQ ID NO: 25281 - DNA, 19 bp, Artificial sequence
  synthetic polynucleotide sequence
ggcctgctgacactgagga

SEQ ID NO: 25282 - DNA, 18 bp, Artificial sequence
  synthetic polynucleotide sequence
gcctggccatcctcacca

SEQ ID NO: 25283 - DNA, 18 bp, Artificial sequence
  synthetic polynucleotide sequence
tggcatgggagaagacca

SEQ ID NO: 25284 - DNA, 18 bp, Artificial sequence
  synthetic polynucleotide sequence
agacgccatccactgcga

SEQ ID NO: 25285 - DNA, 20 bp, Artificial sequence
  synthetic polynucleotide sequence
caacccgacaggagtggaca

SEQ ID NO: 25286 - DNA, 18 bp, Artificial sequence
  synthetic polynucleotide sequence
tgtgcagtggggccagca

SEQ ID NO: 25287 - DNA, 18 bp, Artificial sequence
  synthetic polynucleotide sequence
catggaggggtccccaga

SEQ ID NO: 25288 - DNA, 18 bp, Artificial sequence
  synthetic polynucleotide sequence
gcagctcttcaggcggca

SEQ ID NO: 25289 - DNA, 18 bp, Artificial sequence
  synthetic polynucleotide sequence
caggcaaatccccaggca

SEQ ID NO: 25290 - DNA, 18 bp, Artificial sequence
  synthetic polynucleotide sequence
ccacggcatcttccacga

SEQ ID NO: 25291 - DNA, 18 bp, Artificial sequence
  synthetic polynucleotide sequence
ggggtgcaggagaggaga

SEQ ID NO: 25292 - DNA, 18 bp, Artificial sequence
  synthetic polynucleotide sequence
tttgcggcagaccaggca

SEQ ID NO: 25293 - DNA, 21 bp, Artificial sequence
  synthetic polynucleotide sequence
tcaatggccggacgaaagcca

SEQ ID NO: 25294 - DNA, 21 bp, Artificial sequence
  synthetic polynucleotide sequence
tcatgagggttgcgacggtca

SEQ ID NO: 25295 - DNA, 19 bp, Artificial sequence
  synthetic polynucleotide sequence
ctagtgagccagagggcga

SEQ ID NO: 25296 - DNA, 18 bp, Artificial sequence
  synthetic polynucleotide sequence
acatgggccatgagggca

SEQ ID NO: 25297 - DNA, 21 bp, Artificial sequence
  synthetic polynucleotide sequence
tcaaggagaggtctaaggcaa

SEQ ID NO: 25298 - DNA, 18 bp, Artificial sequence
  synthetic polynucleotide sequence
atgcaggtgatgcagcga

SEQ ID NO: 25299 - DNA, 18 bp, Artificial sequence
  synthetic polynucleotide sequence
acccatcccctgtgcaca

SEQ ID NO: 25300 - DNA, 18 bp, Artificial sequence
  synthetic polynucleotide sequence
tgtggaggcgctgaagga

SEQ ID NO: 25301 - DNA, 18 bp, Artificial sequence
  synthetic polynucleotide sequence
gaggaagcgccacaccaa

SEQ ID NO: 25302 - DNA, 18 bp, Artificial sequence
  synthetic polynucleotide sequence
gagaggagcaaggggcga

SEQ ID NO: 25303 - DNA, 18 bp, Artificial sequence
  synthetic polynucleotide sequence
cgctcaccctcaagccca

SEQ ID NO: 25304 - DNA, 18 bp, Artificial sequence
  synthetic polynucleotide sequence
tgcagatccggcactgga

SEQ ID NO: 25305 - DNA, 18 bp, Artificial sequence
  synthetic polynucleotide sequence
gcacccacaccggcgaga

SEQ ID NO: 25306 - DNA, 20 bp, Artificial sequence
  synthetic polynucleotide sequence
agaagcgaaggagaggccca

SEQ ID NO: 25307 - DNA, 18 bp, Artificial sequence
  synthetic polynucleotide sequence
gagctgctgaaccgggaa

SEQ ID NO: 25308 - DNA, 18 bp, Artificial sequence
  synthetic polynucleotide sequence
accagggccaccagctca

SEQ ID NO: 25309 - DNA, 21 bp, Artificial sequence
  synthetic polynucleotide sequence
gctgctcatggaggagcagga

SEQ ID NO: 25310 - DNA, 19 bp, Artificial sequence
  synthetic polynucleotide sequence
ctcggtgctgctgagcgga

SEQ ID NO: 25311 - DNA, 18 bp, Artificial sequence
  synthetic polynucleotide sequence
cctccgcaagatgcagga

SEQ ID NO: 25312 - DNA, 18 bp, Artificial sequence
  synthetic polynucleotide sequence
cccttgaccacctgggaa

SEQ ID NO: 25313 - DNA, 19 bp, Artificial sequence
  synthetic polynucleotide sequence
ccatggaggacggcgagga

SEQ ID NO: 25314 - DNA, 20 bp, Artificial sequence
  synthetic polynucleotide sequence
gagcttccagatgcgcccca

SEQ ID NO: 25315 - DNA, 21 bp, Artificial sequence
  synthetic polynucleotide sequence
acaagcccatgtacgacgaga

SEQ ID NO: 25316 - DNA, 21 bp, Artificial sequence
  synthetic polynucleotide sequence
caatgtcggccagcttccaga

SEQ ID NO: 25317 - DNA, 19 bp, Artificial sequence
  synthetic polynucleotide sequence
ccgagggccccttcaacca

SEQ ID NO: 25318 - DNA, 19 bp, Artificial sequence
  synthetic polynucleotide sequence
cccaggacgctgttgggca

SEQ ID NO: 25319 - DNA, 20 bp, Artificial sequence
  synthetic polynucleotide sequence
aacggccagtgcagtagtga

SEQ ID NO: 25320 - DNA, 22 bp, Artificial sequence
  synthetic polynucleotide sequence
atcaggtgactctgcaacagga

SEQ ID NO: 25321 - DNA, 18 bp, Artificial sequence
  synthetic polynucleotide sequence
aatgcaacagagcggcca

SEQ ID NO: 25322 - DNA, 21 bp, Artificial sequence
  synthetic polynucleotide sequence
gtgccaatgaccaagtgagga

SEQ ID NO: 25323 - DNA, 19 bp, Artificial sequence
  synthetic polynucleotide sequence
gccgacaccacaacgggca

SEQ ID NO: 25324 - DNA, 19 bp, Artificial sequence
  synthetic polynucleotide sequence
ttttccgagtcgagggcga

SEQ ID NO: 25325 - DNA, 20 bp, Artificial sequence
  synthetic polynucleotide sequence
ctgctgctgagcacaggaca

SEQ ID NO: 25326 - DNA, 18 bp, Artificial sequence
  synthetic polynucleotide sequence
gcgtcagtagcatgcgga

SEQ ID NO: 25327 - DNA, 22 bp, Artificial sequence
  synthetic polynucleotide sequence
agcaaagacccctggcaaagca

SEQ ID NO: 25328 - DNA, 21 bp, Artificial sequence
  synthetic polynucleotide sequence
ttcagtttggcaggcgacgga

SEQ ID NO: 25329 - DNA, 21 bp, Artificial sequence
  synthetic polynucleotide sequence
ggaaggcccaatggaggagga

SEQ ID NO: 25330 - DNA, 18 bp, Artificial sequence
  synthetic polynucleotide sequence
cgaagtctgcgcccgcca

SEQ ID NO: 25331 - DNA, 18 bp, Artificial sequence
  synthetic polynucleotide sequence
ctccgtctccgccaccca

SEQ ID NO: 25332 - DNA, 20 bp, Artificial sequence
  synthetic polynucleotide sequence
gctctgcaggcttccacgaa

SEQ ID NO: 25333 - DNA, 21 bp, Artificial sequence
  synthetic polynucleotide sequence
gggatttcgaggaacgccgca

SEQ ID NO: 25334 - DNA, 19 bp, Artificial sequence
  synthetic polynucleotide sequence
gaggactgagggcctcgga

SEQ ID NO: 25335 - DNA, 20 bp, Artificial sequence
  synthetic polynucleotide sequence
tgacgaggagaagtgccgca

SEQ ID NO: 25336 - DNA, 21 bp, Artificial sequence
  synthetic polynucleotide sequence
ctccagagcctcggttaagga

SEQ ID NO: 25337 - DNA, 20 bp, Artificial sequence
  synthetic polynucleotide sequence
gagcatccggaatatggaga

SEQ ID NO: 25338 - DNA, 22 bp, Artificial sequence
  synthetic polynucleotide sequence
caatctctacgaggaactggca

SEQ ID NO: 25339 - DNA, 22 bp, Artificial sequence
  synthetic polynucleotide sequence
gcatgccctccaaataccgcaa

SEQ ID NO: 25340 - DNA, 21 bp, Artificial sequence
  synthetic polynucleotide sequence
cctccttctgcagagagcgca

SEQ ID NO: 25341 - DNA, 21 bp, Artificial sequence
  synthetic polynucleotide sequence
gaaatggacggctagaagcaa

SEQ ID NO: 25342 - DNA, 18 bp, Artificial sequence
  synthetic polynucleotide sequence
tcgccgtatgccttcaga

SEQ ID NO: 25343 - DNA, 22 bp, Artificial sequence
  synthetic polynucleotide sequence
ggtaaaaacaggcgcaggggta

SEQ ID NO: 25344 - DNA, 22 bp, Artificial sequence
  synthetic polynucleotide sequence
tgatagtcccgtagaccaacca

SEQ ID NO: 25345 - DNA, 20 bp, Artificial sequence
  synthetic polynucleotide sequence
aacggaacggcagaaagaca

SEQ ID NO: 25346 - DNA, 20 bp, Artificial sequence
  synthetic polynucleotide sequence
caatgccaacctccaagaga

SEQ ID NO: 25347 - DNA, 20 bp, Artificial sequence
  synthetic polynucleotide sequence
cgtccacgccgctcttgaca

SEQ ID NO: 25348 - DNA, 21 bp, Artificial sequence
  synthetic polynucleotide sequence
ccccaggcaaacaaggtccca

SEQ ID NO: 25349 - DNA, 20 bp, Artificial sequence
  synthetic polynucleotide sequence
ctggaccaacagaaacggga

SEQ ID NO: 25350 - DNA, 19 bp, Artificial sequence
  synthetic polynucleotide sequence
ggattccggcaactgacca

SEQ ID NO: 25351 - DNA, 22 bp, Artificial sequence
  synthetic polynucleotide sequence
cgatacatgagcccagaacaga

SEQ ID NO: 25352 - DNA, 22 bp, Artificial sequence
  synthetic polynucleotide sequence
agatgtgttaggtcgatcctca

SEQ ID NO: 25353 - DNA, 21 bp, Artificial sequence
  synthetic polynucleotide sequence
ccaagcttgaacacccgggca

SEQ ID NO: 25354 - DNA, 21 bp, Artificial sequence
  synthetic polynucleotide sequence
gctaggagagctgagtggcca

SEQ ID NO: 25355 - DNA, 21 bp, Artificial sequence
  synthetic polynucleotide sequence
agaaactctggacagcaggca

SEQ ID NO: 25356 - DNA, 19 bp, Artificial sequence
  synthetic polynucleotide sequence
ttatccgagacaagggcca

SEQ ID NO: 25357 - DNA, 22 bp, Artificial sequence
  synthetic polynucleotide sequence
taaaccagcaagacgtcccaga

SEQ ID NO: 25358 - DNA, 22 bp, Artificial sequence
  synthetic polynucleotide sequence
aaggaaggggcagtgtagtcga

SEQ ID NO: 25359 - DNA, 21 bp, Artificial sequence
  synthetic polynucleotide sequence
agaggctgcccgaaagaggaa

SEQ ID NO: 25360 - DNA, 20 bp, Artificial sequence
  synthetic polynucleotide sequence
ctgccagtgccagagtgtga

SEQ ID NO: 25361 - DNA, 21 bp, Artificial sequence
  synthetic polynucleotide sequence
gacgctgacatgggaactgca

SEQ ID NO: 25362 - DNA, 22 bp, Artificial sequence
  synthetic polynucleotide sequence
ccaatgaagtcacgctgctcca

SEQ ID NO: 25363 - DNA, 22 bp, Artificial sequence
  synthetic polynucleotide sequence
atctgcaatgtaagcggggaga

SEQ ID NO: 25364 - DNA, 21 bp, Artificial sequence
  synthetic polynucleotide sequence
ggatcatccccagctccgtga

SEQ ID NO: 25365 - DNA, 22 bp, Artificial sequence
  synthetic polynucleotide sequence
caatgctgaggtcaaggaacga

SEQ ID NO: 25366 - DNA, 21 bp, Artificial sequence
  synthetic polynucleotide sequence
catctggagggtgcaaagaga

SEQ ID NO: 25367 - DNA, 21 bp, Artificial sequence
  synthetic polynucleotide sequence
acagccctatcaccctccaga

SEQ ID NO: 25368 - DNA, 19 bp, Artificial sequence
  synthetic polynucleotide sequence
cggacctcactgccctcca

SEQ ID NO: 25369 - DNA, 18 bp, Artificial sequence
  synthetic polynucleotide sequence
taggcgcttgaccccaca

SEQ ID NO: 25370 - DNA, 23 bp, Artificial sequence
  synthetic polynucleotide sequence
cattacataccgaggaggagcta

SEQ ID NO: 25371 - DNA, 21 bp, Artificial sequence
  synthetic polynucleotide sequence
atcaccggacacaatcctgca

SEQ ID NO: 25372 - DNA, 20 bp, Artificial sequence
  synthetic polynucleotide sequence
cttgcccgtgacagcctgga

SEQ ID NO: 25373 - DNA, 18 bp, Artificial sequence
  synthetic polynucleotide sequence
cggtgcagcagtgatgga

SEQ ID NO: 25374 - DNA, 18 bp, Artificial sequence
  synthetic polynucleotide sequence
agcagccaggtgttccga

SEQ ID NO: 25375 - DNA, 19 bp, Artificial sequence
  synthetic polynucleotide sequence
cgacagggaccgaagagga

SEQ ID NO: 25376 - DNA, 18 bp, Artificial sequence
  synthetic polynucleotide sequence
gctgggggaggaactcga

SEQ ID NO: 25377 - DNA, 21 bp, Artificial sequence
  synthetic polynucleotide sequence
agcgcaaccaggagcaggaga

SEQ ID NO: 25378 - DNA, 20 bp, Artificial sequence
  synthetic polynucleotide sequence
agcgaccacatgttcccgca

SEQ ID NO: 25379 - DNA, 20 bp, Artificial sequence
  synthetic polynucleotide sequence
gtcatcctaggcacccagca

SEQ ID NO: 25380 - DNA, 21 bp, Artificial sequence
  synthetic polynucleotide sequence
catgcagatgtcaatgacgca

SEQ ID NO: 25381 - DNA, 21 bp, Artificial sequence
  synthetic polynucleotide sequence
tgactacctggcggacaagca

SEQ ID NO: 25382 - DNA, 21 bp, Artificial sequence
  synthetic polynucleotide sequence
tcttccatggctgcatcccaa

SEQ ID NO: 25383 - DNA, 18 bp, Artificial sequence
  synthetic polynucleotide sequence
ccaaccccatccacctca

SEQ ID NO: 25384 - DNA, 19 bp, Artificial sequence
  synthetic polynucleotide sequence
ggcgtgaacatcactccca

SEQ ID NO: 25385 - DNA, 21 bp, Artificial sequence
  synthetic polynucleotide sequence
tccatgcagcccaaccgcaga

SEQ ID NO: 25386 - DNA, 19 bp, Artificial sequence
  synthetic polynucleotide sequence
tagccaggtagatgcggga

SEQ ID NO: 25387 - DNA, 18 bp, Artificial sequence
  synthetic polynucleotide sequence
cccgctccctgaggagga

SEQ ID NO: 25388 - DNA, 19 bp, Artificial sequence
  synthetic polynucleotide sequence
gcaatgagcagcgagtcca

SEQ ID NO: 25389 - DNA, 21 bp, Artificial sequence
  synthetic polynucleotide sequence
actcccggcagatcaacgaca

SEQ ID NO: 25390 - DNA, 19 bp, Artificial sequence
  synthetic polynucleotide sequence
gcttcctgaccaccgccca

SEQ ID NO: 25391 - DNA, 20 bp, Artificial sequence
  synthetic polynucleotide sequence
gacctgctggagacctgcca

SEQ ID NO: 25392 - DNA, 22 bp, Artificial sequence
  synthetic polynucleotide sequence
tacagatgaagatctgccccga

SEQ ID NO: 25393 - DNA, 22 bp, Artificial sequence
  synthetic polynucleotide sequence
agctgcgggagaaatatgggga

SEQ ID NO: 25394 - DNA, 22 bp, Artificial sequence
  synthetic polynucleotide sequence
catagttgggcactacaggcga

SEQ ID NO: 25395 - DNA, 20 bp, Artificial sequence
  synthetic polynucleotide sequence
cgtcccggccttcatcgaca

SEQ ID NO: 25396 - DNA, 21 bp, Artificial sequence
  synthetic polynucleotide sequence
ggcatcaactcgagcctggga

SEQ ID NO: 25397 - DNA, 18 bp, Artificial sequence
  synthetic polynucleotide sequence
acctgctggccagaggca

SEQ ID NO: 25398 - DNA, 18 bp, Artificial sequence
  synthetic polynucleotide sequence
gccacacctttacggcca

SEQ ID NO: 25399 - DNA, 18 bp, Artificial sequence
  synthetic polynucleotide sequence
gccccagaaagagcggga

SEQ ID NO: 25400 - DNA, 20 bp, Artificial sequence
  synthetic polynucleotide sequence
gatgagggacacctgaggga

SEQ ID NO: 25401 - DNA, 21 bp, Artificial sequence
  synthetic polynucleotide sequence
gggaacggtcgaggacaggaa

SEQ ID NO: 25402 - DNA, 21 bp, Artificial sequence
  synthetic polynucleotide sequence
tctgagctctgagatcgagca

SEQ ID NO: 25403 - DNA, 22 bp, Artificial sequence
  synthetic polynucleotide sequence
atcaggaggttgctaacccaga

SEQ ID NO: 25404 - DNA, 22 bp, Artificial sequence
  synthetic polynucleotide sequence
tcaaacttggagatcagccgca

SEQ ID NO: 25405 - DNA, 21 bp, Artificial sequence
  synthetic polynucleotide sequence
gacaggccacagtgacttcca

SEQ ID NO: 25406 - DNA, 19 bp, Artificial sequence
  synthetic polynucleotide sequence
tcctgaaagcggacagaca

SEQ ID NO: 25407 - DNA, 21 bp, Artificial sequence
  synthetic polynucleotide sequence
catcggggaacagttcacaga

SEQ ID NO: 25408 - DNA, 19 bp, Artificial sequence
  synthetic polynucleotide sequence
tctcggtcccgaacactga

SEQ ID NO: 25409 - DNA, 18 bp, Artificial sequence
  synthetic polynucleotide sequence
ccggggactacagcacga

SEQ ID NO: 25410 - DNA, 20 bp, Artificial sequence
  synthetic polynucleotide sequence
gttccgacactccatcagga

SEQ ID NO: 25411 - DNA, 21 bp, Artificial sequence
  synthetic polynucleotide sequence
cacctgcccaatatcccagga

SEQ ID NO: 25412 - DNA, 21 bp, Artificial sequence
  synthetic polynucleotide sequence
tgagcatcatccccaactgca

SEQ ID NO: 25413 - DNA, 20 bp, Artificial sequence
  synthetic polynucleotide sequence
aacgtccactagctgcccga

SEQ ID NO: 25414 - DNA, 18 bp, Artificial sequence
  synthetic polynucleotide sequence
aggggggtgtccgggcaa

SEQ ID NO: 25415 - DNA, 19 bp, Artificial sequence
  synthetic polynucleotide sequence
gaggatgctggcccaggga

SEQ ID NO: 25416 - DNA, 21 bp, Artificial sequence
  synthetic polynucleotide sequence
agatgcagaggtgttccagga

SEQ ID NO: 25417 - DNA, 18 bp, Artificial sequence
  synthetic polynucleotide sequence
gccatcgacaccgaggaa

SEQ ID NO: 25418 - DNA, 18 bp, Artificial sequence
  synthetic polynucleotide sequence
ccatgaggcagcggcaca

SEQ ID NO: 25419 - DNA, 22 bp, Artificial sequence
  synthetic polynucleotide sequence
cagcaaacaactccgcaaacga

SEQ ID NO: 25420 - DNA, 21 bp, Artificial sequence
  synthetic polynucleotide sequence
cacattgaggagctcaaggca

SEQ ID NO: 25421 - DNA, 18 bp, Artificial sequence
  synthetic polynucleotide sequence
gctggggaaaaggcagca

SEQ ID NO: 25422 - DNA, 18 bp, Artificial sequence
  synthetic polynucleotide sequence
gctggaggttgcagggca

SEQ ID NO: 25423 - DNA, 20 bp, Artificial sequence
  synthetic polynucleotide sequence
caatacggttcagggcgaca

SEQ ID NO: 25424 - DNA, 19 bp, Artificial sequence
  synthetic polynucleotide sequence
ctgccttctgcaatgtcca

SEQ ID NO: 25425 - DNA, 20 bp, Artificial sequence
  synthetic polynucleotide sequence
atcgaggcatgcttgacaca

SEQ ID NO: 25426 - DNA, 20 bp, Artificial sequence
  synthetic polynucleotide sequence
cactgctggatacggagcca

SEQ ID NO: 25427 - DNA, 20 bp, Artificial sequence
  synthetic polynucleotide sequence
ctcaaaggacgaccatgcaa

SEQ ID NO: 25428 - DNA, 20 bp, Artificial sequence
  synthetic polynucleotide sequence
caacaaggtgaaccttggca

SEQ ID NO: 25429 - DNA, 22 bp, Artificial sequence
  synthetic polynucleotide sequence
atggggactctgacagatagca

SEQ ID NO: 25430 - DNA, 25 bp, Artificial sequence
  synthetic polynucleotide sequence
gacagaacacggatttacaggggaa

SEQ ID NO: 25431 - DNA, 21 bp, Artificial sequence
  synthetic polynucleotide sequence
catggtttggagccccagaca

SEQ ID NO: 25432 - DNA, 22 bp, Artificial sequence
  synthetic polynucleotide sequence
agtagcagccacatcagagtca

SEQ ID NO: 25433 - DNA, 20 bp, Artificial sequence
  synthetic polynucleotide sequence
ggagggctggtgcatcccaa

SEQ ID NO: 25434 - DNA, 22 bp, Artificial sequence
  synthetic polynucleotide sequence
tgaagacactctccaccactga

SEQ ID NO: 25435 - DNA, 21 bp, Artificial sequence
  synthetic polynucleotide sequence
tctgcacaatcagcctgcaga

SEQ ID NO: 25436 - DNA, 21 bp, Artificial sequence
  synthetic polynucleotide sequence
gaagaccagctccgtgtgaga

SEQ ID NO: 25437 - DNA, 21 bp, Artificial sequence
  synthetic polynucleotide sequence
tcagccccaacttcagcgaga

SEQ ID NO: 25438 - DNA, 21 bp, Artificial sequence
  synthetic polynucleotide sequence
atctcctcgatgtcgccagca

SEQ ID NO: 25439 - DNA, 17 bp, Artificial sequence
  synthetic polynucleotide sequence
gggcaggaaccgtggga

SEQ ID NO: 25440 - DNA, 17 bp, Artificial sequence
  synthetic polynucleotide sequence
cccggacgaaggaggca

SEQ ID NO: 25441 - DNA, 20 bp, Artificial sequence
  synthetic polynucleotide sequence
tgcagccaaccccaaccaga

SEQ ID NO: 25442 - DNA, 21 bp, Artificial sequence
  synthetic polynucleotide sequence
gatgaaaatgcaccagccgga

SEQ ID NO: 25443 - DNA, 20 bp, Artificial sequence
  synthetic polynucleotide sequence
gaccattgacggaatgacca

SEQ ID NO: 25444 - DNA, 18 bp, Artificial sequence
  synthetic polynucleotide sequence
catctgcgtcaggagcca

SEQ ID NO: 25445 - DNA, 21 bp, Artificial sequence
  synthetic polynucleotide sequence
gctgctcacccacctctacca

SEQ ID NO: 25446 - DNA, 19 bp, Artificial sequence
  synthetic polynucleotide sequence
cgccaggccgctcatacca

SEQ ID NO: 25447 - DNA, 20 bp, Artificial sequence
  synthetic polynucleotide sequence
cccagccagaagtccagcca

SEQ ID NO: 25448 - DNA, 22 bp, Artificial sequence
  synthetic polynucleotide sequence
atcgggggacaggttgtagaca

SEQ ID NO: 25449 - DNA, 21 bp, Artificial sequence
  synthetic polynucleotide sequence
agggagaagcagctagaacca

SEQ ID NO: 25450 - DNA, 22 bp, Artificial sequence
  synthetic polynucleotide sequence
tgattcctaggagacacaacca

SEQ ID NO: 25451 - DNA, 19 bp, Artificial sequence
  synthetic polynucleotide sequence
catccgggccgtggaagca

SEQ ID NO: 25452 - DNA, 21 bp, Artificial sequence
  synthetic polynucleotide sequence
acatctggcctcatagcagca

SEQ ID NO: 25453 - DNA, 18 bp, Artificial sequence
  synthetic polynucleotide sequence
acgacggtcagcaagcca

SEQ ID NO: 25454 - DNA, 18 bp, Artificial sequence
  synthetic polynucleotide sequence
cacgtcacttccaccgga

SEQ ID NO: 25455 - DNA, 20 bp, Artificial sequence
  synthetic polynucleotide sequence
gatccccactacctccacca

SEQ ID NO: 25456 - DNA, 21 bp, Artificial sequence
  synthetic polynucleotide sequence
gccgctggaacactctggaga

SEQ ID NO: 25457 - DNA, 21 bp, Artificial sequence
  synthetic polynucleotide sequence
cctggcaaagatgtggggaca

SEQ ID NO: 25458 - DNA, 20 bp, Artificial sequence
  synthetic polynucleotide sequence
cttcctgccacccgtgtgca

SEQ ID NO: 25459 - DNA, 19 bp, Artificial sequence
  synthetic polynucleotide sequence
gctactcctccagccccga

SEQ ID NO: 25460 - DNA, 21 bp, Artificial sequence
  synthetic polynucleotide sequence
tagtccaggatgtcgtgcaga

SEQ ID NO: 25461 - DNA, 20 bp, Artificial sequence
  synthetic polynucleotide sequence
caggagccgccagtccccaa

SEQ ID NO: 25462 - DNA, 20 bp, Artificial sequence
  synthetic polynucleotide sequence
ggttcaaggccctcagagga

SEQ ID NO: 25463 - DNA, 18 bp, Artificial sequence
  synthetic polynucleotide sequence
ggaccccaggatcgggaa

SEQ ID NO: 25464 - DNA, 18 bp, Artificial sequence
  synthetic polynucleotide sequence
acgggggtcgagaggcca

SEQ ID NO: 25465 - DNA, 20 bp, Artificial sequence
  synthetic polynucleotide sequence
cgtccctgtcccccaactca

SEQ ID NO: 25466 - DNA, 20 bp, Artificial sequence
  synthetic polynucleotide sequence
aagaaggctggggtgaggga

SEQ ID NO: 25467 - DNA, 20 bp, Artificial sequence
  synthetic polynucleotide sequence
ctcccctaagtccagccaga

SEQ ID NO: 25468 - DNA, 18 bp, Artificial sequence
  synthetic polynucleotide sequence
aatgggccaggggtggaa

SEQ ID NO: 25469 - DNA, 18 bp, Artificial sequence
  synthetic polynucleotide sequence
cctggccgatgtcagcaa

SEQ ID NO: 25470 - DNA, 18 bp, Artificial sequence
  synthetic polynucleotide sequence
agtccgtcagcaggggca

SEQ ID NO: 25471 - DNA, 20 bp, Artificial sequence
  synthetic polynucleotide sequence
aaggcctacaagaaaccgga

SEQ ID NO: 25472 - DNA, 20 bp, Artificial sequence
  synthetic polynucleotide sequence
ctgcagcattctgagacgga

SEQ ID NO: 25473 - DNA, 20 bp, Artificial sequence
  synthetic polynucleotide sequence
gccaccgagggtatctgaga

SEQ ID NO: 25474 - DNA, 20 bp, Artificial sequence
  synthetic polynucleotide sequence
gcgttggcacacaaggtcca

SEQ ID NO: 25475 - DNA, 18 bp, Artificial sequence
  synthetic polynucleotide sequence
accgccttgtggaaggga

SEQ ID NO: 25476 - DNA, 18 bp, Artificial sequence
  synthetic polynucleotide sequence
gcaaggaatcgtggggca

SEQ ID NO: 25477 - DNA, 21 bp, Artificial sequence
  synthetic polynucleotide sequence
atgcaagtcgtccgagagcaa

SEQ ID NO: 25478 - DNA, 21 bp, Artificial sequence
  synthetic polynucleotide sequence
gctcaaggatctcgggctgga

SEQ ID NO: 25479 - DNA, 20 bp, Artificial sequence
  synthetic polynucleotide sequence
atgaccgtggggaggaggaa

SEQ ID NO: 25480 - DNA, 21 bp, Artificial sequence
  synthetic polynucleotide sequence
acgttctccagctccagcaga

SEQ ID NO: 25481 - DNA, 22 bp, Artificial sequence
  synthetic polynucleotide sequence
aatatcgccccagaagctccaa

SEQ ID NO: 25482 - DNA, 21 bp, Artificial sequence
  synthetic polynucleotide sequence
cgaggcagcaaaatgtgggca

SEQ ID NO: 25483 - DNA, 20 bp, Artificial sequence
  synthetic polynucleotide sequence
gcagtggggaaaccgaggca

SEQ ID NO: 25484 - DNA, 25 bp, Artificial sequence
  synthetic polynucleotide sequence
agtgcccatagaagaactcccacaa

SEQ ID NO: 25485 - DNA, 20 bp, Artificial sequence
  synthetic polynucleotide sequence
gagcaggaagaggggcgaga

SEQ ID NO: 25486 - DNA, 20 bp, Artificial sequence
  synthetic polynucleotide sequence
gttggactcgtggctccgga

SEQ ID NO: 25487 - DNA, 18 bp, Artificial sequence
  synthetic polynucleotide sequence
tacggagtggggacccca

SEQ ID NO: 25488 - DNA, 18 bp, Artificial sequence
  synthetic polynucleotide sequence
gcagctgcaactccacca

SEQ ID NO: 25489 - DNA, 18 bp, Artificial sequence
  synthetic polynucleotide sequence
tacccgcgatacaggcca

SEQ ID NO: 25490 - DNA, 20 bp, Artificial sequence
  synthetic polynucleotide sequence
taggcacacttggaaccaga

SEQ ID NO: 25491 - DNA, 25 bp, Artificial sequence
  synthetic polynucleotide sequence
ggaacgaaacttccaatggacacca

SEQ ID NO: 25492 - DNA, 20 bp, Artificial sequence
  synthetic polynucleotide sequence
cacagggccagcacatgaca

SEQ ID NO: 25493 - DNA, 20 bp, Artificial sequence
  synthetic polynucleotide sequence
tcagccgtaccgcacagaga

SEQ ID NO: 25494 - DNA, 20 bp, Artificial sequence
  synthetic polynucleotide sequence
cgcaggtacagctcccgcca

SEQ ID NO: 25495 - DNA, 18 bp, Artificial sequence
  synthetic polynucleotide sequence
gcggcctcctgacgagca

SEQ ID NO: 25496 - DNA, 20 bp, Artificial sequence
  synthetic polynucleotide sequence
gctcgatgcacagggcctca

SEQ ID NO: 25497 - DNA, 21 bp, Artificial sequence
  synthetic polynucleotide sequence
gctgtgaaggacctgatgcca

SEQ ID NO: 25498 - DNA, 21 bp, Artificial sequence
  synthetic polynucleotide sequence
caaactgacctgggccactca

SEQ ID NO: 25499 - DNA, 18 bp, Artificial sequence
  synthetic polynucleotide sequence
aggcaccctcgagaccca

SEQ ID NO: 25500 - DNA, 22 bp, Artificial sequence
  synthetic polynucleotide sequence
tctaggcacacggtacaagaga

SEQ ID NO: 25501 - DNA, 22 bp, Artificial sequence
  synthetic polynucleotide sequence
aagaggtgatgaagcacgcaga

SEQ ID NO: 25502 - DNA, 22 bp, Artificial sequence
  synthetic polynucleotide sequence
acaatgtagagggagagtgcca

SEQ ID NO: 25503 - DNA, 19 bp, Artificial sequence
  synthetic polynucleotide sequence
ctgacatccgggtagccaa

SEQ ID NO: 25504 - DNA, 20 bp, Artificial sequence
  synthetic polynucleotide sequence
atccagttcaagacacacca

SEQ ID NO: 25505 - DNA, 19 bp, Artificial sequence
  synthetic polynucleotide sequence
ctggtaccaccacagcaca

SEQ ID NO: 25506 - DNA, 18 bp, Artificial sequence
  synthetic polynucleotide sequence
tgatgagcatgggcagca

SEQ ID NO: 25507 - DNA, 21 bp, Artificial sequence
  synthetic polynucleotide sequence
tgtggctgggtccaaaatgga

SEQ ID NO: 25508 - DNA, 22 bp, Artificial sequence
  synthetic polynucleotide sequence
aaagtaccaccacagagcagca

SEQ ID NO: 25509 - DNA, 18 bp, Artificial sequence
  synthetic polynucleotide sequence
agaccagctgcggggtca

SEQ ID NO: 25510 - DNA, 18 bp, Artificial sequence
  synthetic polynucleotide sequence
acagcagccatggaccca

SEQ ID NO: 25511 - DNA, 20 bp, Artificial sequence
  synthetic polynucleotide sequence
ccaaaggcctgaagcagtca

SEQ ID NO: 25512 - DNA, 19 bp, Artificial sequence
  synthetic polynucleotide sequence
gagtacatcacggcgtgca

SEQ ID NO: 25513 - DNA, 21 bp, Artificial sequence
  synthetic polynucleotide sequence
ggtcacccacagctttgagga

SEQ ID NO: 25514 - DNA, 22 bp, Artificial sequence
  synthetic polynucleotide sequence
gaatgttcccaaaccacctgca

SEQ ID NO: 25515 - DNA, 20 bp, Artificial sequence
  synthetic polynucleotide sequence
gagacagtgctagccggtca

SEQ ID NO: 25516 - DNA, 20 bp, Artificial sequence
  synthetic polynucleotide sequence
ctcttcatctggagcccaga

SEQ ID NO: 25517 - DNA, 18 bp, Artificial sequence
  synthetic polynucleotide sequence
gacctgccaaacgtggga

SEQ ID NO: 25518 - DNA, 18 bp, Artificial sequence
  synthetic polynucleotide sequence
atggaggcacgagggcta

SEQ ID NO: 25519 - DNA, 21 bp, Artificial sequence
  synthetic polynucleotide sequence
ccagcaagagcaacgtcacca

SEQ ID NO: 25520 - DNA, 20 bp, Artificial sequence
  synthetic polynucleotide sequence
gagcccggttgataccagca

SEQ ID NO: 25521 - DNA, 20 bp, Artificial sequence
  synthetic polynucleotide sequence
gagtcccagccctactccga

SEQ ID NO: 25522 - DNA, 18 bp, Artificial sequence
  synthetic polynucleotide sequence
tccctgaccccaccccca

SEQ ID NO: 25523 - DNA, 18 bp, Artificial sequence
  synthetic polynucleotide sequence
ggagccacaccccctgca

SEQ ID NO: 25524 - DNA, 20 bp, Artificial sequence
  synthetic polynucleotide sequence
cagcacacggtggctctgca

SEQ ID NO: 25525 - DNA, 21 bp, Artificial sequence
  synthetic polynucleotide sequence
cggccagtggaagtactgcca

SEQ ID NO: 25526 - DNA, 21 bp, Artificial sequence
  synthetic polynucleotide sequence
cagaggtgactgagcaccaca

SEQ ID NO: 25527 - DNA, 21 bp, Artificial sequence
  synthetic polynucleotide sequence
agaagcactcagatgagggga

SEQ ID NO: 25528 - DNA, 19 bp, Artificial sequence
  synthetic polynucleotide sequence
tcactggcccagagactca

SEQ ID NO: 25529 - DNA, 20 bp, Artificial sequence
  synthetic polynucleotide sequence
cgccccgagatcccaacaga

SEQ ID NO: 25530 - DNA, 21 bp, Artificial sequence
  synthetic polynucleotide sequence
acaagtggactccagacccga

SEQ ID NO: 25531 - DNA, 21 bp, Artificial sequence
  synthetic polynucleotide sequence
ccatgaggtggaggacgtgga

SEQ ID NO: 25532 - DNA, 21 bp, Artificial sequence
  synthetic polynucleotide sequence
tgttccatctccaggcgctca

SEQ ID NO: 25533 - DNA, 20 bp, Artificial sequence
  synthetic polynucleotide sequence
ccctggcagtcacagagtca

SEQ ID NO: 25534 - DNA, 20 bp, Artificial sequence
  synthetic polynucleotide sequence
cagctcccgaatggcctcca

SEQ ID NO: 25535 - DNA, 19 bp, Artificial sequence
  synthetic polynucleotide sequence
tgtcacaaccaaggtccca

SEQ ID NO: 25536 - DNA, 19 bp, Artificial sequence
  synthetic polynucleotide sequence
gtgtctgcgggcatggcca

SEQ ID NO: 25537 - DNA, 21 bp, Artificial sequence
  synthetic polynucleotide sequence
tggagaagcgctgctgggaca

SEQ ID NO: 25538 - DNA, 21 bp, Artificial sequence
  synthetic polynucleotide sequence
aagtgcctgaatgggtcgcca

SEQ ID NO: 25539 - DNA, 20 bp, Artificial sequence
  synthetic polynucleotide sequence
ggcgggaaggaggtggaaca

SEQ ID NO: 25540 - DNA, 20 bp, Artificial sequence
  synthetic polynucleotide sequence
gtgcaccatgccgtagagga

SEQ ID NO: 25541 - DNA, 20 bp, Artificial sequence
  synthetic polynucleotide sequence
ctggtagacggagaagagca

SEQ ID NO: 25542 - DNA, 21 bp, Artificial sequence
  synthetic polynucleotide sequence
ggagaggatagggcagtctga

SEQ ID NO: 25543 - DNA, 21 bp, Artificial sequence
  synthetic polynucleotide sequence
tcctggtggccgagaagcaga

SEQ ID NO: 25544 - DNA, 22 bp, Artificial sequence
  synthetic polynucleotide sequence
gaatcaatcagggtgagagcca

SEQ ID NO: 25545 - DNA, 20 bp, Artificial sequence
  synthetic polynucleotide sequence
ctccgctgggtccctaagga

SEQ ID NO: 25546 - DNA, 22 bp, Artificial sequence
  synthetic polynucleotide sequence
tcaaggtggcagtcaaagtcca

SEQ ID NO: 25547 - DNA, 21 bp, Artificial sequence
  synthetic polynucleotide sequence
atgcaagcacttcagcaacca

SEQ ID NO: 25548 - DNA, 19 bp, Artificial sequence
  synthetic polynucleotide sequence
tcggtacaaacccaccaga

SEQ ID NO: 25549 - DNA, 21 bp, Artificial sequence
  synthetic polynucleotide sequence
tgcctaccagagcatcacgca

SEQ ID NO: 25550 - DNA, 18 bp, Artificial sequence
  synthetic polynucleotide sequence
cagagcgggacctggcga

SEQ ID NO: 25551 - DNA, 22 bp, Artificial sequence
  synthetic polynucleotide sequence
agaagagggaaacagggagcaa

SEQ ID NO: 25552 - DNA, 21 bp, Artificial sequence
  synthetic polynucleotide sequence
tgtgtagctgcagatccacca

SEQ ID NO: 25553 - DNA, 21 bp, Artificial sequence
  synthetic polynucleotide sequence
caagcagtaccgggaatccca

SEQ ID NO: 25554 - DNA, 20 bp, Artificial sequence
  synthetic polynucleotide sequence
gggaggggaaggctgtgaca

SEQ ID NO: 25555 - DNA, 21 bp, Artificial sequence
  synthetic polynucleotide sequence
atggatagtcccctgaaccga

SEQ ID NO: 25556 - DNA, 21 bp, Artificial sequence
  synthetic polynucleotide sequence
ttcaaaagcttctgggggcca

SEQ ID NO: 25557 - DNA, 20 bp, Artificial sequence
  synthetic polynucleotide sequence
agtgaccgcccgtgagtgga

SEQ ID NO: 25558 - DNA, 20 bp, Artificial sequence
  synthetic polynucleotide sequence
cgccgcatggtactgcccga

SEQ ID NO: 25559 - DNA, 18 bp, Artificial sequence
  synthetic polynucleotide sequence
acggtccccttcgacaga

SEQ ID NO: 25560 - DNA, 18 bp, Artificial sequence
  synthetic polynucleotide sequence
tgaggctgaagacgccca

SEQ ID NO: 25561 - DNA, 18 bp, Artificial sequence
  synthetic polynucleotide sequence
gcagaggttgcagagcca

SEQ ID NO: 25562 - DNA, 20 bp, Artificial sequence
  synthetic polynucleotide sequence
ctgcctgacacagttccaca

SEQ ID NO: 25563 - DNA, 19 bp, Artificial sequence
  synthetic polynucleotide sequence
ggacagctggcagaaggga

SEQ ID NO: 25564 - DNA, 18 bp, Artificial sequence
  synthetic polynucleotide sequence
gggacgtgttggcagcca

SEQ ID NO: 25565 - DNA, 20 bp, Artificial sequence
  synthetic polynucleotide sequence
cagggcactctgtcagggga

SEQ ID NO: 25566 - DNA, 20 bp, Artificial sequence
  synthetic polynucleotide sequence
gtgacccacagcgtcccaga

SEQ ID NO: 25567 - DNA, 19 bp, Artificial sequence
  synthetic polynucleotide sequence
ttgtcaccaactccgggga

SEQ ID NO: 25568 - DNA, 21 bp, Artificial sequence
  synthetic polynucleotide sequence
gaccagatcccaaacacccca

SEQ ID NO: 25569 - DNA, 20 bp, Artificial sequence
  synthetic polynucleotide sequence
ctctgggggctctgcacaca

SEQ ID NO: 25570 - DNA, 21 bp, Artificial sequence
  synthetic polynucleotide sequence
gtgttcagtcctacggccaca

SEQ ID NO: 25571 - DNA, 20 bp, Artificial sequence
  synthetic polynucleotide sequence
tatggaaggtgcactggaca

SEQ ID NO: 25572 - DNA, 20 bp, Artificial sequence
  synthetic polynucleotide sequence
atccttctggccagacacca

SEQ ID NO: 25573 - DNA, 22 bp, Artificial sequence
  synthetic polynucleotide sequence
caatctggggactagcaacaca

SEQ ID NO: 25574 - DNA, 22 bp, Artificial sequence
  synthetic polynucleotide sequence
gtaacacacagtacgagcagca

SEQ ID NO: 25575 - DNA, 19 bp, Artificial sequence
  synthetic polynucleotide sequence
ttcagctggagaccgggca

SEQ ID NO: 25576 - DNA, 20 bp, Artificial sequence
  synthetic polynucleotide sequence
cttgtcagccaggtcccaga

SEQ ID NO: 25577 - DNA, 23 bp, Artificial sequence
  synthetic polynucleotide sequence
taccaacattagctgcagtgaca

SEQ ID NO: 25578 - DNA, 18 bp, Artificial sequence
  synthetic polynucleotide sequence
acgaagaccaggagggca

SEQ ID NO: 25579 - DNA, 21 bp, Artificial sequence
  synthetic polynucleotide sequence
tcaagagtactccacgctgca

SEQ ID NO: 25580 - DNA, 18 bp, Artificial sequence
  synthetic polynucleotide sequence
ggccgcaatcatgacaca

SEQ ID NO: 25581 - DNA, 19 bp, Artificial sequence
  synthetic polynucleotide sequence
ctacaccatgcgacgagga

SEQ ID NO: 25582 - DNA, 18 bp, Artificial sequence
  synthetic polynucleotide sequence
ccacccaggccagggcga

SEQ ID NO: 25583 - DNA, 21 bp, Artificial sequence
  synthetic polynucleotide sequence
tcagatccctaaccagtggga

SEQ ID NO: 25584 - DNA, 25 bp, Artificial sequence
  synthetic polynucleotide sequence
gtgctgcttagagcacaaaggaaca

SEQ ID NO: 25585 - DNA, 20 bp, Artificial sequence
  synthetic polynucleotide sequence
caagcccaagcggatccgca

SEQ ID NO: 25586 - DNA, 20 bp, Artificial sequence
  synthetic polynucleotide sequence
gaggctgagactgccggcca

SEQ ID NO: 25587 - DNA, 25 bp, Artificial sequence
  synthetic polynucleotide sequence
agggtgcccacaaaaagaatcagga

SEQ ID NO: 25588 - DNA, 25 bp, Artificial sequence
  synthetic polynucleotide sequence
agcctcaggatgttaggaaagggaa

SEQ ID NO: 25589 - DNA, 18 bp, Artificial sequence
  synthetic polynucleotide sequence
ggtgcctcccgacccgca

SEQ ID NO: 25590 - DNA, 20 bp, Artificial sequence
  synthetic polynucleotide sequence
cgaaaggggggcagaacaga

SEQ ID NO: 25591 - DNA, 21 bp, Artificial sequence
  synthetic polynucleotide sequence
tgagcctcaacgagtcacaga

SEQ ID NO: 25592 - DNA, 20 bp, Artificial sequence
  synthetic polynucleotide sequence
gttgtacaagccctgtgcca

SEQ ID NO: 25593 - DNA, 20 bp, Artificial sequence
  synthetic polynucleotide sequence
gtgggcaggaagattcagga

SEQ ID NO: 25594 - DNA, 20 bp, Artificial sequence
  synthetic polynucleotide sequence
tgctgccaaagttgagacca

SEQ ID NO: 25595 - DNA, 21 bp, Artificial sequence
  synthetic polynucleotide sequence
ctggggagaaccaagacacca

SEQ ID NO: 25596 - DNA, 21 bp, Artificial sequence
  synthetic polynucleotide sequence
tgttcctcctcagcgtggaca

SEQ ID NO: 25597 - DNA, 20 bp, Artificial sequence
  synthetic polynucleotide sequence
aggtgggagatgtgacagca

SEQ ID NO: 25598 - DNA, 20 bp, Artificial sequence
  synthetic polynucleotide sequence
aggaatcagcgagtacggga

SEQ ID NO: 25599 - DNA, 20 bp, Artificial sequence
  synthetic polynucleotide sequence
tggggaagagttggtgagca

SEQ ID NO: 25600 - DNA, 20 bp, Artificial sequence
  synthetic polynucleotide sequence
gcagtgagacagtgccacca

SEQ ID NO: 25601 - DNA, 20 bp, Artificial sequence
  synthetic polynucleotide sequence
tcggcaagaaccacgtggca

SEQ ID NO: 25602 - DNA, 20 bp, Artificial sequence
  synthetic polynucleotide sequence
atccacaggtgcgttgggca

SEQ ID NO: 25603 - DNA, 18 bp, Artificial sequence
  synthetic polynucleotide sequence
catcgccaggccaggcaa

SEQ ID NO: 25604 - DNA, 21 bp, Artificial sequence
  synthetic polynucleotide sequence
acactatgtaggctgtggcga

SEQ ID NO: 25605 - DNA, 18 bp, Artificial sequence
  synthetic polynucleotide sequence
gccacgaccgcagcacca

SEQ ID NO: 25606 - DNA, 21 bp, Artificial sequence
  synthetic polynucleotide sequence
agcagatgtcagcctggcgca

SEQ ID NO: 25607 - DNA, 19 bp, Artificial sequence
  synthetic polynucleotide sequence
ccgggtctcaagaccagga

SEQ ID NO: 25608 - DNA, 20 bp, Artificial sequence
  synthetic polynucleotide sequence
ccagagtgcagcagtgagca

SEQ ID NO: 25609 - DNA, 20 bp, Artificial sequence
  synthetic polynucleotide sequence
gggtagtcgggaggaggaga

SEQ ID NO: 25610 - DNA, 21 bp, Artificial sequence
  synthetic polynucleotide sequence
aacggacttgtgagaggagga

SEQ ID NO: 25611 - DNA, 17 bp, Artificial sequence
  synthetic polynucleotide sequence
cggcatgggcctcacca

SEQ ID NO: 25612 - DNA, 18 bp, Artificial sequence
  synthetic polynucleotide sequence
gcagcaagaagcccacga

SEQ ID NO: 25613 - DNA, 20 bp, Artificial sequence
  synthetic polynucleotide sequence
accaagctgctccagagcca

SEQ ID NO: 25614 - DNA, 20 bp, Artificial sequence
  synthetic polynucleotide sequence
ctgcaccagcttccggtcca

SEQ ID NO: 25615 - DNA, 21 bp, Artificial sequence
  synthetic polynucleotide sequence
tccgatgaagaaagggaggca

SEQ ID NO: 25616 - DNA, 21 bp, Artificial sequence
  synthetic polynucleotide sequence
aaagaccgagagggactggaa

SEQ ID NO: 25617 - DNA, 21 bp, Artificial sequence
  synthetic polynucleotide sequence
caacccaaagaggatcgccaa

SEQ ID NO: 25618 - DNA, 20 bp, Artificial sequence
  synthetic polynucleotide sequence
ggccagcttgcacgcctgaa

SEQ ID NO: 25619 - DNA, 21 bp, Artificial sequence
  synthetic polynucleotide sequence
tcaggagagactgaggacaca

SEQ ID NO: 25620 - DNA, 19 bp, Artificial sequence
  synthetic polynucleotide sequence
ccagacgttcagaacggca

SEQ ID NO: 25621 - DNA, 18 bp, Artificial sequence
  synthetic polynucleotide sequence
atcggctcggtgaccgaa

SEQ ID NO: 25622 - DNA, 18 bp, Artificial sequence
  synthetic polynucleotide sequence
gtcctgtgcagagcccca

SEQ ID NO: 25623 - DNA, 21 bp, Artificial sequence
  synthetic polynucleotide sequence
accccctccacctcctaccaa

SEQ ID NO: 25624 - DNA, 20 bp, Artificial sequence
  synthetic polynucleotide sequence
agctagtgacacggccccta

SEQ ID NO: 25625 - DNA, 21 bp, Artificial sequence
  synthetic polynucleotide sequence
cgggcattctacggagggaga

SEQ ID NO: 25626 - DNA, 21 bp, Artificial sequence
  synthetic polynucleotide sequence
cgttgcctggtctcaccacca

SEQ ID NO: 25627 - DNA, 19 bp, Artificial sequence
  synthetic polynucleotide sequence
ttgcccccatgctggtgga

SEQ ID NO: 25628 - DNA, 21 bp, Artificial sequence
  synthetic polynucleotide sequence
gcatgtaggaagcccgctgga

SEQ ID NO: 25629 - DNA, 19 bp, Artificial sequence
  synthetic polynucleotide sequence
catgggcatccgccgcgaa

SEQ ID NO: 25630 - DNA, 20 bp, Artificial sequence
  synthetic polynucleotide sequence
tcagagcgtaggcctgggca

SEQ ID NO: 25631 - DNA, 20 bp, Artificial sequence
  synthetic polynucleotide sequence
gtccaccatctccaccccca

SEQ ID NO: 25632 - DNA, 18 bp, Artificial sequence
  synthetic polynucleotide sequence
cgttcaccaggcggcgga

SEQ ID NO: 25633 - DNA, 18 bp, Artificial sequence
  synthetic polynucleotide sequence
gtggtcgaggcggaggaa

SEQ ID NO: 25634 - DNA, 18 bp, Artificial sequence
  synthetic polynucleotide sequence
gagggagccgttcagcca

SEQ ID NO: 25635 - DNA, 20 bp, Artificial sequence
  synthetic polynucleotide sequence
caccggctcctaataacgga

SEQ ID NO: 25636 - DNA, 19 bp, Artificial sequence
  synthetic polynucleotide sequence
gtgaaggggcactgtacca

SEQ ID NO: 25637 - DNA, 18 bp, Artificial sequence
  synthetic polynucleotide sequence
tggggaggtcaaccgcta

SEQ ID NO: 25638 - DNA, 18 bp, Artificial sequence
  synthetic polynucleotide sequence
atctggcagggtgagcca

SEQ ID NO: 25639 - DNA, 21 bp, Artificial sequence
  synthetic polynucleotide sequence
tgagccatcccatgcagagga

SEQ ID NO: 25640 - DNA, 21 bp, Artificial sequence
  synthetic polynucleotide sequence
tgcagtaccctaggcctccca

SEQ ID NO: 25641 - DNA, 19 bp, Artificial sequence
  synthetic polynucleotide sequence
ttgagcccagttgctgcaa

SEQ ID NO: 25642 - DNA, 22 bp, Artificial sequence
  synthetic polynucleotide sequence
attgtccagccttcatcggcaa

SEQ ID NO: 25643 - DNA, 21 bp, Artificial sequence
  synthetic polynucleotide sequence
cacaaaccagagggcaggaca

SEQ ID NO: 25644 - DNA, 19 bp, Artificial sequence
  synthetic polynucleotide sequence
gacaggccccatgagcgga

SEQ ID NO: 25645 - DNA, 18 bp, Artificial sequence
  synthetic polynucleotide sequence
ggatgaacagcaccggca

SEQ ID NO: 25646 - DNA, 18 bp, Artificial sequence
  synthetic polynucleotide sequence
gcacatcaccctggacca

SEQ ID NO: 25647 - DNA, 20 bp, Artificial sequence
  synthetic polynucleotide sequence
agctcctggactacggacca

SEQ ID NO: 25648 - DNA, 18 bp, Artificial sequence
  synthetic polynucleotide sequence
agtggaaggcctcgggga

SEQ ID NO: 25649 - DNA, 21 bp, Artificial sequence
  synthetic polynucleotide sequence
ggagaagcaggacacgcagga

SEQ ID NO: 25650 - DNA, 21 bp, Artificial sequence
  synthetic polynucleotide sequence
atgaggaagtcggagcctcca

SEQ ID NO: 25651 - DNA, 20 bp, Artificial sequence
  synthetic polynucleotide sequence
tagcctctccagagaagtca

SEQ ID NO: 25652 - DNA, 21 bp, Artificial sequence
  synthetic polynucleotide sequence
tcagaagacactgggccccta

SEQ ID NO: 25653 - DNA, 18 bp, Artificial sequence
  synthetic polynucleotide sequence
caagatccagggcagcga

SEQ ID NO: 25654 - DNA, 22 bp, Artificial sequence
  synthetic polynucleotide sequence
aagacataggtggagtgggaga

SEQ ID NO: 25655 - DNA, 18 bp, Artificial sequence
  synthetic polynucleotide sequence
cgtggccaccctgcagca

SEQ ID NO: 25656 - DNA, 20 bp, Artificial sequence
  synthetic polynucleotide sequence
ctggaagatcacgccgccga

SEQ ID NO: 25657 - DNA, 20 bp, Artificial sequence
  synthetic polynucleotide sequence
gaaaccacgggtgccctgga

SEQ ID NO: 25658 - DNA, 21 bp, Artificial sequence
  synthetic polynucleotide sequence
atacgtagccatacagggaca

SEQ ID NO: 25659 - DNA, 19 bp, Artificial sequence
  synthetic polynucleotide sequence
tccgagccagtcacaccca

SEQ ID NO: 25660 - DNA, 18 bp, Artificial sequence
  synthetic polynucleotide sequence
ggggcattctgggcggga

SEQ ID NO: 25661 - DNA, 19 bp, Artificial sequence
  synthetic polynucleotide sequence
gccctggagacagaaggga

SEQ ID NO: 25662 - DNA, 20 bp, Artificial sequence
  synthetic polynucleotide sequence
ctcagcacttcggcatagca

SEQ ID NO: 25663 - DNA, 21 bp, Artificial sequence
  synthetic polynucleotide sequence
caggacggaggaagtgaagca

SEQ ID NO: 25664 - DNA, 20 bp, Artificial sequence
  synthetic polynucleotide sequence
tgtgtctccagggtccgaca

SEQ ID NO: 25665 - DNA, 18 bp, Artificial sequence
  synthetic polynucleotide sequence
aggtgtccgacaagccca

SEQ ID NO: 25666 - DNA, 19 bp, Artificial sequence
  synthetic polynucleotide sequence
gcaccacctcttcaagcca

SEQ ID NO: 25667 - DNA, 22 bp, Artificial sequence
  synthetic polynucleotide sequence
ggaaggatcagttgaaggcaca

SEQ ID NO: 25668 - DNA, 18 bp, Artificial sequence
  synthetic polynucleotide sequence
ggcatgctgagcaaggaa

SEQ ID NO: 25669 - DNA, 21 bp, Artificial sequence
  synthetic polynucleotide sequence
cacggagcacagaataccgga

SEQ ID NO: 25670 - DNA, 22 bp, Artificial sequence
  synthetic polynucleotide sequence
aaatacagcagcccagtctgga

SEQ ID NO: 25671 - DNA, 21 bp, Artificial sequence
  synthetic polynucleotide sequence
tgtccagcaacctgggaccaa

SEQ ID NO: 25672 - DNA, 21 bp, Artificial sequence
  synthetic polynucleotide sequence
catgggatgtctgaaggggca

SEQ ID NO: 25673 - DNA, 20 bp, Artificial sequence
  synthetic polynucleotide sequence
aagaggaggaagaccagcca

SEQ ID NO: 25674 - DNA, 20 bp, Artificial sequence
  synthetic polynucleotide sequence
gagggtccacaggttgacga

SEQ ID NO: 25675 - DNA, 18 bp, Artificial sequence
  synthetic polynucleotide sequence
gtggccagcatccagcaa

SEQ ID NO: 25676 - DNA, 18 bp, Artificial sequence
  synthetic polynucleotide sequence
tgctgaaccacctgggca

SEQ ID NO: 25677 - DNA, 19 bp, Artificial sequence
  synthetic polynucleotide sequence
gctgcccgaactgaccaga

SEQ ID NO: 25678 - DNA, 18 bp, Artificial sequence
  synthetic polynucleotide sequence
ggtccagggctctgagga

SEQ ID NO: 25679 - DNA, 18 bp, Artificial sequence
  synthetic polynucleotide sequence
gggcaaatccccacagga

SEQ ID NO: 25680 - DNA, 20 bp, Artificial sequence
  synthetic polynucleotide sequence
ctgggcagcctcataagtga

SEQ ID NO: 25681 - DNA, 21 bp, Artificial sequence
  synthetic polynucleotide sequence
ccacctggccattgagcgcaa

SEQ ID NO: 25682 - DNA, 21 bp, Artificial sequence
  synthetic polynucleotide sequence
ccttgttgagatcccgggaga

SEQ ID NO: 25683 - DNA, 18 bp, Artificial sequence
  synthetic polynucleotide sequence
gggcttatcgccagcaca

SEQ ID NO: 25684 - DNA, 19 bp, Artificial sequence
  synthetic polynucleotide sequence
ccattagcacacacgccca

SEQ ID NO: 25685 - DNA, 21 bp, Artificial sequence
  synthetic polynucleotide sequence
ctgagaaggtggtgcaggaga

SEQ ID NO: 25686 - DNA, 18 bp, Artificial sequence
  synthetic polynucleotide sequence
cccctccgtcaaggcaga

SEQ ID NO: 25687 - DNA, 20 bp, Artificial sequence
  synthetic polynucleotide sequence
gccgaaacccctcctgtgga

SEQ ID NO: 25688 - DNA, 21 bp, Artificial sequence
  synthetic polynucleotide sequence
actgaggcgctgaatcaacca

SEQ ID NO: 25689 - DNA, 21 bp, Artificial sequence
  synthetic polynucleotide sequence
cagattcagtgggcggacaga

SEQ ID NO: 25690 - DNA, 18 bp, Artificial sequence
  synthetic polynucleotide sequence
ggggctggctgggatgga

SEQ ID NO: 25691 - DNA, 21 bp, Artificial sequence
  synthetic polynucleotide sequence
caacaggcttgggggatgaga

SEQ ID NO: 25692 - DNA, 18 bp, Artificial sequence
  synthetic polynucleotide sequence
ggtctggggtgggggcaa

SEQ ID NO: 25693 - DNA, 20 bp, Artificial sequence
  synthetic polynucleotide sequence
gaactccctagatgccccca

SEQ ID NO: 25694 - DNA, 18 bp, Artificial sequence
  synthetic polynucleotide sequence
caggccacactgaacgga

SEQ ID NO: 25695 - DNA, 19 bp, Artificial sequence
  synthetic polynucleotide sequence
gccgatcttatccgaccga

SEQ ID NO: 25696 - DNA, 19 bp, Artificial sequence
  synthetic polynucleotide sequence
ctcagcttccgaagagcca

SEQ ID NO: 25697 - DNA, 21 bp, Artificial sequence
  synthetic polynucleotide sequence
cagcaacccactcctgagaca

SEQ ID NO: 25698 - DNA, 20 bp, Artificial sequence
  synthetic polynucleotide sequence
tagcttggtccaaacgagga

SEQ ID NO: 25699 - DNA, 22 bp, Artificial sequence
  synthetic polynucleotide sequence
gaatggctcaaaacttgggaga

SEQ ID NO: 25700 - DNA, 19 bp, Artificial sequence
  synthetic polynucleotide sequence
gaccccagcagtgttcaca

SEQ ID NO: 25701 - DNA, 18 bp, Artificial sequence
  synthetic polynucleotide sequence
tgaccaagccaccaagca

SEQ ID NO: 25702 - DNA, 19 bp, Artificial sequence
  synthetic polynucleotide sequence
gaccactcctggacggtga

SEQ ID NO: 25703 - DNA, 20 bp, Artificial sequence
  synthetic polynucleotide sequence
ctctgggatcctgggggcaa

SEQ ID NO: 25704 - DNA, 20 bp, Artificial sequence
  synthetic polynucleotide sequence
agagccaggcctcaaacgga

SEQ ID NO: 25705 - DNA, 18 bp, Artificial sequence
  synthetic polynucleotide sequence
gcactgaccgaagaggca

SEQ ID NO: 25706 - DNA, 20 bp, Artificial sequence
  synthetic polynucleotide sequence
catggtggaatgcacaagca

SEQ ID NO: 25707 - DNA, 18 bp, Artificial sequence
  synthetic polynucleotide sequence
actgcttgccaaccccca

SEQ ID NO: 25708 - DNA, 19 bp, Artificial sequence
  synthetic polynucleotide sequence
gccgagtggaagtgcagga

SEQ ID NO: 25709 - DNA, 18 bp, Artificial sequence
  synthetic polynucleotide sequence
tggcaaaggaggagggga

SEQ ID NO: 25710 - DNA, 18 bp, Artificial sequence
  synthetic polynucleotide sequence
gatgcacagcctgcagca

SEQ ID NO: 25711 - DNA, 18 bp, Artificial sequence
  synthetic polynucleotide sequence
ctgtgcagtggatggcga

SEQ ID NO: 25712 - DNA, 19 bp, Artificial sequence
  synthetic polynucleotide sequence
gctcagggcactccaagca

SEQ ID NO: 25713 - DNA, 18 bp, Artificial sequence
  synthetic polynucleotide sequence
gtgagccatgcagcccaa

SEQ ID NO: 25714 - DNA, 18 bp, Artificial sequence
  synthetic polynucleotide sequence
gtgatgctgaccgcagca

SEQ ID NO: 25715 - DNA, 18 bp, Artificial sequence
  synthetic polynucleotide sequence
tcggacagctgccaggaa

SEQ ID NO: 25716 - DNA, 20 bp, Artificial sequence
  synthetic polynucleotide sequence
tgcccgagacagagaccaga

SEQ ID NO: 25717 - DNA, 19 bp, Artificial sequence
  synthetic polynucleotide sequence
tcgagcacgtacagcagca

SEQ ID NO: 25718 - DNA, 18 bp, Artificial sequence
  synthetic polynucleotide sequence
gctgtagccacaccgcca

SEQ ID NO: 25719 - DNA, 22 bp, Artificial sequence
  synthetic polynucleotide sequence
accaaaagatccttcccggcca

SEQ ID NO: 25720 - DNA, 21 bp, Artificial sequence
  synthetic polynucleotide sequence
gcaaagatcctccccctggca

SEQ ID NO: 25721 - DNA, 20 bp, Artificial sequence
  synthetic polynucleotide sequence
gcagttgggagcagggcgaa

SEQ ID NO: 25722 - DNA, 20 bp, Artificial sequence
  synthetic polynucleotide sequence
agcgtgggctagcaggtcca

SEQ ID NO: 25723 - DNA, 19 bp, Artificial sequence
  synthetic polynucleotide sequence
ccttcctgaggacccacga

SEQ ID NO: 25724 - DNA, 20 bp, Artificial sequence
  synthetic polynucleotide sequence
gtctcggtggacatagccca

SEQ ID NO: 25725 - DNA, 23 bp, Artificial sequence
  synthetic polynucleotide sequence
caaaatggtccagtacagggaca

SEQ ID NO: 25726 - DNA, 20 bp, Artificial sequence
  synthetic polynucleotide sequence
ctgatggcctgccaaggtga

SEQ ID NO: 25727 - DNA, 18 bp, Artificial sequence
  synthetic polynucleotide sequence
catgggccagttcgacca

SEQ ID NO: 25728 - DNA, 20 bp, Artificial sequence
  synthetic polynucleotide sequence
gaaaggagtccagggagcca

SEQ ID NO: 25729 - DNA, 20 bp, Artificial sequence
  synthetic polynucleotide sequence
ctgaaggtgggctacaccga

SEQ ID NO: 25730 - DNA, 18 bp, Artificial sequence
  synthetic polynucleotide sequence
cccgcaacatgcccacca

SEQ ID NO: 25731 - DNA, 18 bp, Artificial sequence
  synthetic polynucleotide sequence
gcggctaaacgacggaca

SEQ ID NO: 25732 - DNA, 18 bp, Artificial sequence
  synthetic polynucleotide sequence
ggatgttgcgagcagcca

SEQ ID NO: 25733 - DNA, 19 bp, Artificial sequence
  synthetic polynucleotide sequence
cgtggtcaccaagagccga

SEQ ID NO: 25734 - DNA, 18 bp, Artificial sequence
  synthetic polynucleotide sequence
acagcgagcgatggacga

SEQ ID NO: 25735 - DNA, 18 bp, Artificial sequence
  synthetic polynucleotide sequence
cccagaagcatgagcgga

SEQ ID NO: 25736 - DNA, 18 bp, Artificial sequence
  synthetic polynucleotide sequence
gctccagcaccgacagga

SEQ ID NO: 25737 - DNA, 18 bp, Artificial sequence
  synthetic polynucleotide sequence
ccccacctgaaaagggga

SEQ ID NO: 25738 - DNA, 19 bp, Artificial sequence
  synthetic polynucleotide sequence
gggcatcagaatccagcca

SEQ ID NO: 25739 - DNA, 19 bp, Artificial sequence
  synthetic polynucleotide sequence
cagctccgggagttccaga

SEQ ID NO: 25740 - DNA, 18 bp, Artificial sequence
  synthetic polynucleotide sequence
tgggggcaccactgacca

SEQ ID NO: 25741 - DNA, 21 bp, Artificial sequence
  synthetic polynucleotide sequence
agtcacagcactggcattgga

SEQ ID NO: 25742 - DNA, 19 bp, Artificial sequence
  synthetic polynucleotide sequence
ttgagaggcaggcagctga

SEQ ID NO: 25743 - DNA, 21 bp, Artificial sequence
  synthetic polynucleotide sequence
ccgagtacagatgctgcccca

SEQ ID NO: 25744 - DNA, 22 bp, Artificial sequence
  synthetic polynucleotide sequence
accttcctcagattccagccca

SEQ ID NO: 25745 - DNA, 21 bp, Artificial sequence
  synthetic polynucleotide sequence
cactacgaggctgagcacgaa

SEQ ID NO: 25746 - DNA, 21 bp, Artificial sequence
  synthetic polynucleotide sequence
tacaaagtccccctcacccca

SEQ ID NO: 25747 - DNA, 20 bp, Artificial sequence
  synthetic polynucleotide sequence
cccaatgcagccctcgtcga

SEQ ID NO: 25748 - DNA, 18 bp, Artificial sequence
  synthetic polynucleotide sequence
agggtgagcgtcgcggga

SEQ ID NO: 25749 - DNA, 18 bp, Artificial sequence
  synthetic polynucleotide sequence
tgaaccagcttcggggga

SEQ ID NO: 25750 - DNA, 18 bp, Artificial sequence
  synthetic polynucleotide sequence
tacccacactgcccacca

SEQ ID NO: 25751 - DNA, 21 bp, Artificial sequence
  synthetic polynucleotide sequence
ctgggcatactaggggaagca

SEQ ID NO: 25752 - DNA, 20 bp, Artificial sequence
  synthetic polynucleotide sequence
tggggtgccttgaccaacga

SEQ ID NO: 25753 - DNA, 19 bp, Artificial sequence
  synthetic polynucleotide sequence
cgccccctcttcccccgaa

SEQ ID NO: 25754 - DNA, 22 bp, Artificial sequence
  synthetic polynucleotide sequence
aaaggagacaagtccttcccca

SEQ ID NO: 25755 - DNA, 18 bp, Artificial sequence
  synthetic polynucleotide sequence
cccttcacggaggaccca

SEQ ID NO: 25756 - DNA, 18 bp, Artificial sequence
  synthetic polynucleotide sequence
tgcccactggctccagca

SEQ ID NO: 25757 - DNA, 22 bp, Artificial sequence
  synthetic polynucleotide sequence
caaaggacagacaatgccagga

SEQ ID NO: 25758 - DNA, 21 bp, Artificial sequence
  synthetic polynucleotide sequence
ttgtttccctggcagccacca

SEQ ID NO: 25759 - DNA, 19 bp, Artificial sequence
  synthetic polynucleotide sequence
ctgacccctacaccgggca

SEQ ID NO: 25760 - DNA, 19 bp, Artificial sequence
  synthetic polynucleotide sequence
gtggcgatctgggcctcca

SEQ ID NO: 25761 - DNA, 18 bp, Artificial sequence
  synthetic polynucleotide sequence
ccgagctggcagaaccaa

SEQ ID NO: 25762 - DNA, 18 bp, Artificial sequence
  synthetic polynucleotide sequence
tgaattcccaacgcacca

SEQ ID NO: 25763 - DNA, 20 bp, Artificial sequence
  synthetic polynucleotide sequence
cagcagcagtgaaacagcca

SEQ ID NO: 25764 - DNA, 21 bp, Artificial sequence
  synthetic polynucleotide sequence
catcagtcacaccagaaggca

SEQ ID NO: 25765 - DNA, 22 bp, Artificial sequence
  synthetic polynucleotide sequence
tcaagtccctgaagtcaacgca

SEQ ID NO: 25766 - DNA, 19 bp, Artificial sequence
  synthetic polynucleotide sequence
caggtcggtcaggctggca

SEQ ID NO: 25767 - DNA, 22 bp, Artificial sequence
  synthetic polynucleotide sequence
tccatcacctcctccaacacca

SEQ ID NO: 25768 - DNA, 21 bp, Artificial sequence
  synthetic polynucleotide sequence
ctgtctcgcacgatactgcca

SEQ ID NO: 25769 - DNA, 19 bp, Artificial sequence
  synthetic polynucleotide sequence
ccgagacttggagccagaa

SEQ ID NO: 25770 - DNA, 17 bp, Artificial sequence
  synthetic polynucleotide sequence
ccgctgcttgaccgaca

SEQ ID NO: 25771 - DNA, 18 bp, Artificial sequence
  synthetic polynucleotide sequence
gcagctgaaccagcggaa

SEQ ID NO: 25772 - DNA, 18 bp, Artificial sequence
  synthetic polynucleotide sequence
tcaggtccagaggcccga

SEQ ID NO: 25773 - DNA, 21 bp, Artificial sequence
  synthetic polynucleotide sequence
ggagcggctacattccaagca

SEQ ID NO: 25774 - DNA, 21 bp, Artificial sequence
  synthetic polynucleotide sequence
tcaggcctcgagctaagtcga

SEQ ID NO: 25775 - DNA, 18 bp, Artificial sequence
  synthetic polynucleotide sequence
acggcagcagcaagagca

SEQ ID NO: 25776 - DNA, 18 bp, Artificial sequence
  synthetic polynucleotide sequence
ccagattgctcgaggcca

SEQ ID NO: 25777 - DNA, 21 bp, Artificial sequence
  synthetic polynucleotide sequence
tgtttcggcaagtgaggagga

SEQ ID NO: 25778 - DNA, 19 bp, Artificial sequence
  synthetic polynucleotide sequence
ggctgggagagcccacaga

SEQ ID NO: 25779 - DNA, 21 bp, Artificial sequence
  synthetic polynucleotide sequence
cagggaacagagagctcctca

SEQ ID NO: 25780 - DNA, 20 bp, Artificial sequence
  synthetic polynucleotide sequence
gctcctggggagaagagcca

SEQ ID NO: 25781 - DNA, 21 bp, Artificial sequence
  synthetic polynucleotide sequence
tcaaccccaaacgtgcctgca

SEQ ID NO: 25782 - DNA, 22 bp, Artificial sequence
  synthetic polynucleotide sequence
aagaggaccacaaagaggagga

SEQ ID NO: 25783 - DNA, 22 bp, Artificial sequence
  synthetic polynucleotide sequence
actagccagacaccagaagaga

SEQ ID NO: 25784 - DNA, 21 bp, Artificial sequence
  synthetic polynucleotide sequence
tgttggataaccagctcccca

SEQ ID NO: 25785 - DNA, 20 bp, Artificial sequence
  synthetic polynucleotide sequence
atcacagtgagggggaggaa

SEQ ID NO: 25786 - DNA, 20 bp, Artificial sequence
  synthetic polynucleotide sequence
gaacatgccacaggtaccca

SEQ ID NO: 25787 - DNA, 20 bp, Artificial sequence
  synthetic polynucleotide sequence
ctggcctgtgacctgaacca

SEQ ID NO: 25788 - DNA, 20 bp, Artificial sequence
  synthetic polynucleotide sequence
gttgtctgagcacccacaga

SEQ ID NO: 25789 - DNA, 20 bp, Artificial sequence
  synthetic polynucleotide sequence
tggcacagtctacaagggca

SEQ ID NO: 25790 - DNA, 17 bp, Artificial sequence
  synthetic polynucleotide sequence
ggagcccacaccagcca

SEQ ID NO: 25791 - DNA, 20 bp, Artificial sequence
  synthetic polynucleotide sequence
atgaaccggaggagaaggca

SEQ ID NO: 25792 - DNA, 19 bp, Artificial sequence
  synthetic polynucleotide sequence
gtacagggtggagtgggca

SEQ ID NO: 25793 - DNA, 20 bp, Artificial sequence
  synthetic polynucleotide sequence
cacccagactacctgcagga

SEQ ID NO: 25794 - DNA, 18 bp, Artificial sequence
  synthetic polynucleotide sequence
tgtaaggtggaggcggca

SEQ ID NO: 25795 - DNA, 19 bp, Artificial sequence
  synthetic polynucleotide sequence
gggccatctcaccaaacga

SEQ ID NO: 25796 - DNA, 21 bp, Artificial sequence
  synthetic polynucleotide sequence
cttgtagagcctggatcacca

SEQ ID NO: 25797 - DNA, 20 bp, Artificial sequence
  synthetic polynucleotide sequence
aaggggacacaagctggaga

SEQ ID NO: 25798 - DNA, 20 bp, Artificial sequence
  synthetic polynucleotide sequence
gtggtgtcagcctgcaagga

SEQ ID NO: 25799 - DNA, 22 bp, Artificial sequence
  synthetic polynucleotide sequence
aaagcagcagacccagaacaga

SEQ ID NO: 25800 - DNA, 20 bp, Artificial sequence
  synthetic polynucleotide sequence
gcgacctcccaggagatcga

SEQ ID NO: 25801 - DNA, 18 bp, Artificial sequence
  synthetic polynucleotide sequence
ccagcaggccctcaagga

SEQ ID NO: 25802 - DNA, 18 bp, Artificial sequence
  synthetic polynucleotide sequence
gtctccaggtaccgccca

SEQ ID NO: 25803 - DNA, 18 bp, Artificial sequence
  synthetic polynucleotide sequence
gcagcatgtggtgcagga

SEQ ID NO: 25804 - DNA, 18 bp, Artificial sequence
  synthetic polynucleotide sequence
aaggagggtgagcgggga

SEQ ID NO: 25805 - DNA, 20 bp, Artificial sequence
  synthetic polynucleotide sequence
gagtggctcaagacccagga

SEQ ID NO: 25806 - DNA, 18 bp, Artificial sequence
  synthetic polynucleotide sequence
gggcaccagacctcagca

SEQ ID NO: 25807 - DNA, 19 bp, Artificial sequence
  synthetic polynucleotide sequence
gaggcacagcatctgcaga

SEQ ID NO: 25808 - DNA, 18 bp, Artificial sequence
  synthetic polynucleotide sequence
atgtcaatgccccgacga

SEQ ID NO: 25809 - DNA, 18 bp, Artificial sequence
  synthetic polynucleotide sequence
ccaaaggccgtggaacca

SEQ ID NO: 25810 - DNA, 19 bp, Artificial sequence
  synthetic polynucleotide sequence
caggaggctctcggactca

SEQ ID NO: 25811 - DNA, 19 bp, Artificial sequence
  synthetic polynucleotide sequence
ggacgtgctggaacaggga

SEQ ID NO: 25812 - DNA, 20 bp, Artificial sequence
  synthetic polynucleotide sequence
gtgaggtcatccaggaccga

SEQ ID NO: 25813 - DNA, 20 bp, Artificial sequence
  synthetic polynucleotide sequence
tagcaaggatgaacggacca

SEQ ID NO: 25814 - DNA, 18 bp, Artificial sequence
  synthetic polynucleotide sequence
cctgtgaggaggaggcga

SEQ ID NO: 25815 - DNA, 22 bp, Artificial sequence
  synthetic polynucleotide sequence
ggatgaattggacacctgggga

SEQ ID NO: 25816 - DNA, 21 bp, Artificial sequence
  synthetic polynucleotide sequence
ttccagtgaggccaatgcgga

SEQ ID NO: 25817 - DNA, 22 bp, Artificial sequence
  synthetic polynucleotide sequence
gcagttggtactagaggaccca

SEQ ID NO: 25818 - DNA, 22 bp, Artificial sequence
  synthetic polynucleotide sequence
agtcataacgtggagaccagga

SEQ ID NO: 25819 - DNA, 18 bp, Artificial sequence
  synthetic polynucleotide sequence
cggggaggaggatggaga

SEQ ID NO: 25820 - DNA, 19 bp, Artificial sequence
  synthetic polynucleotide sequence
cacttgagccacacgtgga

SEQ ID NO: 25821 - DNA, 21 bp, Artificial sequence
  synthetic polynucleotide sequence
agtcggaggaggtagaggtga

SEQ ID NO: 25822 - DNA, 19 bp, Artificial sequence
  synthetic polynucleotide sequence
tgaggggcatgcactggga

SEQ ID NO: 25823 - DNA, 20 bp, Artificial sequence
  synthetic polynucleotide sequence
ctgggaaaggcctggtgcga

SEQ ID NO: 25824 - DNA, 20 bp, Artificial sequence
  synthetic polynucleotide sequence
gcagtacccaggccagccca

SEQ ID NO: 25825 - DNA, 18 bp, Artificial sequence
  synthetic polynucleotide sequence
atccaggcagtggccaga

SEQ ID NO: 25826 - DNA, 18 bp, Artificial sequence
  synthetic polynucleotide sequence
cgggccacctcgtcggga

SEQ ID NO: 25827 - DNA, 19 bp, Artificial sequence
  synthetic polynucleotide sequence
cccagccacagaacccaga

SEQ ID NO: 25828 - DNA, 18 bp, Artificial sequence
  synthetic polynucleotide sequence
ccagggggttggaggtga

SEQ ID NO: 25829 - DNA, 21 bp, Artificial sequence
  synthetic polynucleotide sequence
agtgggcaaggcaattccaca

SEQ ID NO: 25830 - DNA, 19 bp, Artificial sequence
  synthetic polynucleotide sequence
tgctggaacaagctctcca

SEQ ID NO: 25831 - DNA, 18 bp, Artificial sequence
  synthetic polynucleotide sequence
ccccctggaccacaccaa

SEQ ID NO: 25832 - DNA, 18 bp, Artificial sequence
  synthetic polynucleotide sequence
tcaccatcatgggcgaga

SEQ ID NO: 25833 - DNA, 20 bp, Artificial sequence
  synthetic polynucleotide sequence
accgagctgatacccagaca

SEQ ID NO: 25834 - DNA, 18 bp, Artificial sequence
  synthetic polynucleotide sequence
gttgggcctgccgacgaa

SEQ ID NO: 25835 - DNA, 20 bp, Artificial sequence
  synthetic polynucleotide sequence
cgcgtcccagtcccgaggaa

SEQ ID NO: 25836 - DNA, 22 bp, Artificial sequence
  synthetic polynucleotide sequence
cactgaagtcactcgcactgga

SEQ ID NO: 25837 - DNA, 23 bp, Artificial sequence
  synthetic polynucleotide sequence
ggcagctggacttggaaaagcaa

SEQ ID NO: 25838 - DNA, 20 bp, Artificial sequence
  synthetic polynucleotide sequence
taatccaagctgccgcgcga

SEQ ID NO: 25839 - DNA, 19 bp, Artificial sequence
  synthetic polynucleotide sequence
ggcgcatccatggcggcaa

SEQ ID NO: 25840 - DNA, 21 bp, Artificial sequence
  synthetic polynucleotide sequence
ggcttggctgaccatccacca

SEQ ID NO: 25841 - DNA, 20 bp, Artificial sequence
  synthetic polynucleotide sequence
gcagacgccagcgaggaaga

SEQ ID NO: 25842 - DNA, 22 bp, Artificial sequence
  synthetic polynucleotide sequence
tgcatctctggagacaccgtca

SEQ ID NO: 25843 - DNA, 20 bp, Artificial sequence
  synthetic polynucleotide sequence
gaaaatcctgaggccaagga

SEQ ID NO: 25844 - DNA, 20 bp, Artificial sequence
  synthetic polynucleotide sequence
gcagcaacactcatgatcca

SEQ ID NO: 25845 - DNA, 22 bp, Artificial sequence
  synthetic polynucleotide sequence
aagaaacctggcaccaacagga

SEQ ID NO: 25846 - DNA, 20 bp, Artificial sequence
  synthetic polynucleotide sequence
cagggctcctggagtgccca

SEQ ID NO: 25847 - DNA, 20 bp, Artificial sequence
  synthetic polynucleotide sequence
ccccagaggaagcaggagga

SEQ ID NO: 25848 - DNA, 20 bp, Artificial sequence
  synthetic polynucleotide sequence
tccactggcagagcctcaga

SEQ ID NO: 25849 - DNA, 22 bp, Artificial sequence
  synthetic polynucleotide sequence
aaagccacatgcactgggaaga

SEQ ID NO: 25850 - DNA, 20 bp, Artificial sequence
  synthetic polynucleotide sequence
aggcggcccagattcctcca

SEQ ID NO: 25851 - DNA, 20 bp, Artificial sequence
  synthetic polynucleotide sequence
gtggcagcgatctaagagca

SEQ ID NO: 25852 - DNA, 21 bp, Artificial sequence
  synthetic polynucleotide sequence
acctcactaccatgggctgca

SEQ ID NO: 25853 - DNA, 23 bp, Artificial sequence
  synthetic polynucleotide sequence
gagctccagggaaaaaaaaccca

SEQ ID NO: 25854 - DNA, 20 bp, Artificial sequence
  synthetic polynucleotide sequence
ggagccacgacaggtcccaa

SEQ ID NO: 25855 - DNA, 20 bp, Artificial sequence
  synthetic polynucleotide sequence
tgaaacagaaccggcccaga

SEQ ID NO: 25856 - DNA, 20 bp, Artificial sequence
  synthetic polynucleotide sequence
ctccagctgcctcagggtga

SEQ ID NO: 25857 - DNA, 20 bp, Artificial sequence
  synthetic polynucleotide sequence
gtgcccacacacttcaggaa

SEQ ID NO: 25858 - DNA, 20 bp, Artificial sequence
  synthetic polynucleotide sequence
tatagtgagacctggggcca

SEQ ID NO: 25859 - DNA, 21 bp, Artificial sequence
  synthetic polynucleotide sequence
cactccagacagatgaggtga

SEQ ID NO: 25860 - DNA, 18 bp, Artificial sequence
  synthetic polynucleotide sequence
acactgcgttcgggacca

SEQ ID NO: 25861 - DNA, 18 bp, Artificial sequence
  synthetic polynucleotide sequence
gccagaagggaaaggcca

SEQ ID NO: 25862 - DNA, 18 bp, Artificial sequence
  synthetic polynucleotide sequence
tcctgaagggctgggcca

SEQ ID NO: 25863 - DNA, 21 bp, Artificial sequence
  synthetic polynucleotide sequence
ccccgaagaactcactcggca

SEQ ID NO: 25864 - DNA, 22 bp, Artificial sequence
  synthetic polynucleotide sequence
agcacaaccagcacttccagca

SEQ ID NO: 25865 - DNA, 22 bp, Artificial sequence
  synthetic polynucleotide sequence
atgaggagcagaaggtttggga

SEQ ID NO: 25866 - DNA, 21 bp, Artificial sequence
  synthetic polynucleotide sequence
gtcacagcttgggaactggca

SEQ ID NO: 25867 - DNA, 21 bp, Artificial sequence
  synthetic polynucleotide sequence
ggcagcaggtgtaggagggaa

SEQ ID NO: 25868 - DNA, 22 bp, Artificial sequence
  synthetic polynucleotide sequence
tgaaaaacctcctgagccacca

SEQ ID NO: 25869 - DNA, 18 bp, Artificial sequence
  synthetic polynucleotide sequence
gcccaatgcacacggcaa

SEQ ID NO: 25870 - DNA, 18 bp, Artificial sequence
  synthetic polynucleotide sequence
tctgtgccaggcacccca

SEQ ID NO: 25871 - DNA, 20 bp, Artificial sequence
  synthetic polynucleotide sequence
cgggacaactggcacgagca

SEQ ID NO: 25872 - DNA, 20 bp, Artificial sequence
  synthetic polynucleotide sequence
cttgttcctcacagcacgga

SEQ ID NO: 25873 - DNA, 20 bp, Artificial sequence
  synthetic polynucleotide sequence
atctggcctacatgcaagca

SEQ ID NO: 25874 - DNA, 19 bp, Artificial sequence
  synthetic polynucleotide sequence
gggcgctcgaagaatggta

SEQ ID NO: 25875 - DNA, 21 bp, Artificial sequence
  synthetic polynucleotide sequence
catggagagtgtggaacagca

SEQ ID NO: 25876 - DNA, 18 bp, Artificial sequence
  synthetic polynucleotide sequence
cgcctcggctaggcgcca

SEQ ID NO: 25877 - DNA, 18 bp, Artificial sequence
  synthetic polynucleotide sequence
gtgctgcccaggaaccca

SEQ ID NO: 25878 - DNA, 21 bp, Artificial sequence
  synthetic polynucleotide sequence
aagcctatgacagccacctca

SEQ ID NO: 25879 - DNA, 18 bp, Artificial sequence
  synthetic polynucleotide sequence
gcagcggcctgcacacca

SEQ ID NO: 25880 - DNA, 20 bp, Artificial sequence
  synthetic polynucleotide sequence
ctccaaccttaactgcccca

SEQ ID NO: 25881 - DNA, 19 bp, Artificial sequence
  synthetic polynucleotide sequence
tggcagattacatcaggca

SEQ ID NO: 25882 - DNA, 21 bp, Artificial sequence
  synthetic polynucleotide sequence
gaaaggcacagtcatcatgca

SEQ ID NO: 25883 - DNA, 19 bp, Artificial sequence
  synthetic polynucleotide sequence
cctcccaaagtaccgccaa

SEQ ID NO: 25884 - DNA, 20 bp, Artificial sequence
  synthetic polynucleotide sequence
catacttgggatcaggggca

SEQ ID NO: 25885 - DNA, 22 bp, Artificial sequence
  synthetic polynucleotide sequence
atggccatgggaagcaagggaa

SEQ ID NO: 25886 - DNA, 21 bp, Artificial sequence
  synthetic polynucleotide sequence
gtaaaggcctttccccagcga

SEQ ID NO: 25887 - DNA, 22 bp, Artificial sequence
  synthetic polynucleotide sequence
tcgattcaccaatgcctcccca

SEQ ID NO: 25888 - DNA, 18 bp, Artificial sequence
  synthetic polynucleotide sequence
ccctcctcaccctgggca

SEQ ID NO: 25889 - DNA, 21 bp, Artificial sequence
  synthetic polynucleotide sequence
gctgtgcagcttgggaaggaa

SEQ ID NO: 25890 - DNA, 19 bp, Artificial sequence
  synthetic polynucleotide sequence
ggggatagaggccctccca

SEQ ID NO: 25891 - DNA, 20 bp, Artificial sequence
  synthetic polynucleotide sequence
acttttgggaccacggggga

SEQ ID NO: 25892 - DNA, 18 bp, Artificial sequence
  synthetic polynucleotide sequence
accctccccatggggcga

SEQ ID NO: 25893 - DNA, 21 bp, Artificial sequence
  synthetic polynucleotide sequence
ggagcaggagtgctaggtgca

SEQ ID NO: 25894 - DNA, 21 bp, Artificial sequence
  synthetic polynucleotide sequence
atcttgcaaggtgaccaggga

SEQ ID NO: 25895 - DNA, 21 bp, Artificial sequence
  synthetic polynucleotide sequence
tggcccaagagctcagacaca

SEQ ID NO: 25896 - DNA, 18 bp, Artificial sequence
  synthetic polynucleotide sequence
agggcctggctggagaga

SEQ ID NO: 25897 - DNA, 22 bp, Artificial sequence
  synthetic polynucleotide sequence
aaaccacagaaagggctcctga

SEQ ID NO: 25898 - DNA, 21 bp, Artificial sequence
  synthetic polynucleotide sequence
tgttggggagctgaacctgga

SEQ ID NO: 25899 - DNA, 20 bp, Artificial sequence
  synthetic polynucleotide sequence
aatgtcctagggcttggcaa

SEQ ID NO: 25900 - DNA, 19 bp, Artificial sequence
  synthetic polynucleotide sequence
gccatctggtgttgggtca

SEQ ID NO: 25901 - DNA, 22 bp, Artificial sequence
  synthetic polynucleotide sequence
agaaacaggaaagtgccctgca

SEQ ID NO: 25902 - DNA, 23 bp, Artificial sequence
  synthetic polynucleotide sequence
cataaaatccagcaccagtgcca

SEQ ID NO: 25903 - DNA, 22 bp, Artificial sequence
  synthetic polynucleotide sequence
atgatggatgaggacgaggaca

SEQ ID NO: 25904 - DNA, 22 bp, Artificial sequence
  synthetic polynucleotide sequence
aaattgggatctgaggggtcca

SEQ ID NO: 25905 - DNA, 18 bp, Artificial sequence
  synthetic polynucleotide sequence
ggtggccgcctggagcaa

SEQ ID NO: 25906 - DNA, 20 bp, Artificial sequence
  synthetic polynucleotide sequence
gcagcagccacagtcgtcga

SEQ ID NO: 25907 - DNA, 20 bp, Artificial sequence
  synthetic polynucleotide sequence
gtgaagctggctggagagga

SEQ ID NO: 25908 - DNA, 18 bp, Artificial sequence
  synthetic polynucleotide sequence
tcaaggaagcgggcacca

SEQ ID NO: 25909 - DNA, 19 bp, Artificial sequence
  synthetic polynucleotide sequence
ctgaagccgacgccccaga

SEQ ID NO: 25910 - DNA, 19 bp, Artificial sequence
  synthetic polynucleotide sequence
gcaggagtagtgggcggca

SEQ ID NO: 25911 - DNA, 19 bp, Artificial sequence
  synthetic polynucleotide sequence
ccaacctggcagacaggga

SEQ ID NO: 25912 - DNA, 18 bp, Artificial sequence
  synthetic polynucleotide sequence
gagcgccagacgagacca

SEQ ID NO: 25913 - DNA, 18 bp, Artificial sequence
  synthetic polynucleotide sequence
cctgaccaagttggccga

SEQ ID NO: 25914 - DNA, 18 bp, Artificial sequence
  synthetic polynucleotide sequence
ggtcaattgagcgccaca

SEQ ID NO: 25915 - DNA, 20 bp, Artificial sequence
  synthetic polynucleotide sequence
atggcttatccccaccgcca

SEQ ID NO: 25916 - DNA, 21 bp, Artificial sequence
  synthetic polynucleotide sequence
acagagggctggtaaatggca

SEQ ID NO: 25917 - DNA, 20 bp, Artificial sequence
  synthetic polynucleotide sequence
cctactacccaagcccccca

SEQ ID NO: 25918 - DNA, 20 bp, Artificial sequence
  synthetic polynucleotide sequence
accaaggctcctgactggga

SEQ ID NO: 25919 - DNA, 18 bp, Artificial sequence
  synthetic polynucleotide sequence
gcgagaagctctgcacga

SEQ ID NO: 25920 - DNA, 18 bp, Artificial sequence
  synthetic polynucleotide sequence
ccctccagcttcacccca

SEQ ID NO: 25921 - DNA, 20 bp, Artificial sequence
  synthetic polynucleotide sequence
gccggacaagctctatgcca

SEQ ID NO: 25922 - DNA, 21 bp, Artificial sequence
  synthetic polynucleotide sequence
gcccagccaatgatgaccaca

SEQ ID NO: 25923 - DNA, 19 bp, Artificial sequence
  synthetic polynucleotide sequence
tcagccagccaaaaagcca

SEQ ID NO: 25924 - DNA, 20 bp, Artificial sequence
  synthetic polynucleotide sequence
caccaactctcggtcggcca

SEQ ID NO: 25925 - DNA, 21 bp, Artificial sequence
  synthetic polynucleotide sequence
accacagcccccagagaggaa

SEQ ID NO: 25926 - DNA, 20 bp, Artificial sequence
  synthetic polynucleotide sequence
ctcgcgccacaacgtcggga

SEQ ID NO: 25927 - DNA, 18 bp, Artificial sequence
  synthetic polynucleotide sequence
atcacctcctcagcccca

SEQ ID NO: 25928 - DNA, 18 bp, Artificial sequence
  synthetic polynucleotide sequence
cgaagggaccggcaacca

SEQ ID NO: 25929 - DNA, 20 bp, Artificial sequence
  synthetic polynucleotide sequence
catctcgctgcccatcgcca

SEQ ID NO: 25930 - DNA, 19 bp, Artificial sequence
  synthetic polynucleotide sequence
ctctgcgagctgtgccgga

SEQ ID NO: 25931 - DNA, 21 bp, Artificial sequence
  synthetic polynucleotide sequence
atcccaagagacaggcccaga

SEQ ID NO: 25932 - DNA, 20 bp, Artificial sequence
  synthetic polynucleotide sequence
gggacctgggacagtcagga

SEQ ID NO: 25933 - DNA, 21 bp, Artificial sequence
  synthetic polynucleotide sequence
gcccgaagaaaacgccgcaca

SEQ ID NO: 25934 - DNA, 18 bp, Artificial sequence
  synthetic polynucleotide sequence
cccctctctagccccgca

SEQ ID NO: 25935 - DNA, 21 bp, Artificial sequence
  synthetic polynucleotide sequence
cacggtagaggaggtcagtca

SEQ ID NO: 25936 - DNA, 21 bp, Artificial sequence
  synthetic polynucleotide sequence
taaagtcagcggatccagcta

SEQ ID NO: 25937 - DNA, 23 bp, Artificial sequence
  synthetic polynucleotide sequence
caaaaagtgatcgaccagagcta

SEQ ID NO: 25938 - DNA, 18 bp, Artificial sequence
  synthetic polynucleotide sequence
cgggaagcaccaactgca

SEQ ID NO: 25939 - DNA, 18 bp, Artificial sequence
  synthetic polynucleotide sequence
tgctgggcaaacaggcca

SEQ ID NO: 25940 - DNA, 19 bp, Artificial sequence
  synthetic polynucleotide sequence
gctgtcaccacagctggca

SEQ ID NO: 25941 - DNA, 20 bp, Artificial sequence
  synthetic polynucleotide sequence
agtggtagcctcacccctga

SEQ ID NO: 25942 - DNA, 21 bp, Artificial sequence
  synthetic polynucleotide sequence
tcctggccagtagattgccca

SEQ ID NO: 25943 - DNA, 18 bp, Artificial sequence
  synthetic polynucleotide sequence
agaccgtcctgccacgga

SEQ ID NO: 25944 - DNA, 18 bp, Artificial sequence
  synthetic polynucleotide sequence
tcagagtccacggctcca

SEQ ID NO: 25945 - DNA, 21 bp, Artificial sequence
  synthetic polynucleotide sequence
gaacttattgcacagggcgaa

SEQ ID NO: 25946 - DNA, 19 bp, Artificial sequence
  synthetic polynucleotide sequence
cagtagggcagctcaggga

SEQ ID NO: 25947 - DNA, 18 bp, Artificial sequence
  synthetic polynucleotide sequence
ccgtggaggaggagagga

SEQ ID NO: 25948 - DNA, 18 bp, Artificial sequence
  synthetic polynucleotide sequence
tctgcaccccacagcgca

SEQ ID NO: 25949 - DNA, 21 bp, Artificial sequence
  synthetic polynucleotide sequence
cgtgggaaacaccatggagga

SEQ ID NO: 25950 - DNA, 20 bp, Artificial sequence
  synthetic polynucleotide sequence
tgcacacccatgagcctgca

SEQ ID NO: 25951 - DNA, 22 bp, Artificial sequence
  synthetic polynucleotide sequence
tgcactactacctgcaggcaca

SEQ ID NO: 25952 - DNA, 18 bp, Artificial sequence
  synthetic polynucleotide sequence
gagggcccagagagccca

SEQ ID NO: 25953 - DNA, 22 bp, Artificial sequence
  synthetic polynucleotide sequence
tacatgtggcaccaactccaga

SEQ ID NO: 25954 - DNA, 19 bp, Artificial sequence
  synthetic polynucleotide sequence
tgtccgccacaactctgca

SEQ ID NO: 25955 - DNA, 22 bp, Artificial sequence
  synthetic polynucleotide sequence
atgacagcttcgactcagagga

SEQ ID NO: 25956 - DNA, 18 bp, Artificial sequence
  synthetic polynucleotide sequence
ggtcagcacggtcccgca

SEQ ID NO: 25957 - DNA, 20 bp, Artificial sequence
  synthetic polynucleotide sequence
ccctgagaacggtgcggaca

SEQ ID NO: 25958 - DNA, 21 bp, Artificial sequence
  synthetic polynucleotide sequence
tcgaagctctcgaaggaagga

SEQ ID NO: 25959 - DNA, 22 bp, Artificial sequence
  synthetic polynucleotide sequence
aagagccaggaatgtatcggga

SEQ ID NO: 25960 - DNA, 21 bp, Artificial sequence
  synthetic polynucleotide sequence
ttccatgcctcgaccagtcca

SEQ ID NO: 25961 - DNA, 22 bp, Artificial sequence
  synthetic polynucleotide sequence
gaaagccgggcatgaattacga

SEQ ID NO: 25962 - DNA, 20 bp, Artificial sequence
  synthetic polynucleotide sequence
cggataggctaggctgggca

SEQ ID NO: 25963 - DNA, 22 bp, Artificial sequence
  synthetic polynucleotide sequence
catcagaaacgcaagcctgaca

SEQ ID NO: 25964 - DNA, 20 bp, Artificial sequence
  synthetic polynucleotide sequence
taaggacacctccgcggcca

SEQ ID NO: 25965 - DNA, 20 bp, Artificial sequence
  synthetic polynucleotide sequence
ctcttggcagggctgggaca

SEQ ID NO: 25966 - DNA, 19 bp, Artificial sequence
  synthetic polynucleotide sequence
ctgcgggtctctgggcaga

SEQ ID NO: 25967 - DNA, 18 bp, Artificial sequence
  synthetic polynucleotide sequence
agcctgaggaggtcgcca

SEQ ID NO: 25968 - DNA, 18 bp, Artificial sequence
  synthetic polynucleotide sequence
gattgtccgggaaggcca

SEQ ID NO: 25969 - DNA, 18 bp, Artificial sequence
  synthetic polynucleotide sequence
cccccttaccagaggcga

SEQ ID NO: 25970 - DNA, 18 bp, Artificial sequence
  synthetic polynucleotide sequence
cctcgacctgtccaggca

SEQ ID NO: 25971 - DNA, 18 bp, Artificial sequence
  synthetic polynucleotide sequence
agctgatgcccagcccca

SEQ ID NO: 25972 - DNA, 18 bp, Artificial sequence
  synthetic polynucleotide sequence
atgcagcccgtcctcgga

SEQ ID NO: 25973 - DNA, 21 bp, Artificial sequence
  synthetic polynucleotide sequence
ggatctgcaagctgccaggaa

SEQ ID NO: 25974 - DNA, 20 bp, Artificial sequence
  synthetic polynucleotide sequence
aacccgtgctccgcggtgca

SEQ ID NO: 25975 - DNA, 20 bp, Artificial sequence
  synthetic polynucleotide sequence
gacagagagagcagcagcga

SEQ ID NO: 25976 - DNA, 19 bp, Artificial sequence
  synthetic polynucleotide sequence
ctccgcagaggtgaacaca

SEQ ID NO: 25977 - DNA, 21 bp, Artificial sequence
  synthetic polynucleotide sequence
aggacgaggaggacacggtga

SEQ ID NO: 25978 - DNA, 18 bp, Artificial sequence
  synthetic polynucleotide sequence
ctccagctcctccgccga

SEQ ID NO: 25979 - DNA, 19 bp, Artificial sequence
  synthetic polynucleotide sequence
tagagcccacccggagaga

SEQ ID NO: 25980 - DNA, 18 bp, Artificial sequence
  synthetic polynucleotide sequence
ccagctgctccctcccca

SEQ ID NO: 25981 - DNA, 20 bp, Artificial sequence
  synthetic polynucleotide sequence
ggaggaccacgagggcacca

SEQ ID NO: 25982 - DNA, 20 bp, Artificial sequence
  synthetic polynucleotide sequence
ctccggagggctgagcgcaa

SEQ ID NO: 25983 - DNA, 21 bp, Artificial sequence
  synthetic polynucleotide sequence
gcaggcggaggaaacaccaga

SEQ ID NO: 25984 - DNA, 20 bp, Artificial sequence
  synthetic polynucleotide sequence
tccagtgacaggtgtggcca

SEQ ID NO: 25985 - DNA, 22 bp, Artificial sequence
  synthetic polynucleotide sequence
atgcccacggacatggaacaca

SEQ ID NO: 25986 - DNA, 21 bp, Artificial sequence
  synthetic polynucleotide sequence
ctgttagcccacagacgggta

SEQ ID NO: 25987 - DNA, 18 bp, Artificial sequence
  synthetic polynucleotide sequence
aacttgcccctgccacca

SEQ ID NO: 25988 - DNA, 18 bp, Artificial sequence
  synthetic polynucleotide sequence
aggtggaggtggcaggga

SEQ ID NO: 25989 - DNA, 18 bp, Artificial sequence
  synthetic polynucleotide sequence
aggggcttctcaggccaa

SEQ ID NO: 25990 - DNA, 18 bp, Artificial sequence
  synthetic polynucleotide sequence
ctgccactgcggggtcca

SEQ ID NO: 25991 - DNA, 20 bp, Artificial sequence
  synthetic polynucleotide sequence
atccagggccagctgaacca

SEQ ID NO: 25992 - DNA, 21 bp, Artificial sequence
  synthetic polynucleotide sequence
ggctcagcccatcgaaagcca

SEQ ID NO: 25993 - DNA, 18 bp, Artificial sequence
  synthetic polynucleotide sequence
cagacaagccagccgaga

SEQ ID NO: 25994 - DNA, 20 bp, Artificial sequence
  synthetic polynucleotide sequence
gacacaggcttctccaccga

SEQ ID NO: 25995 - DNA, 18 bp, Artificial sequence
  synthetic polynucleotide sequence
tccgcgagaaggaccaga

SEQ ID NO: 25996 - DNA, 18 bp, Artificial sequence
  synthetic polynucleotide sequence
aggcctcgtatggggaca

SEQ ID NO: 25997 - DNA, 20 bp, Artificial sequence
  synthetic polynucleotide sequence
gacatcgagcagctgcacga

SEQ ID NO: 25998 - DNA, 20 bp, Artificial sequence
  synthetic polynucleotide sequence
cagcacgtgtgcccagtcga

SEQ ID NO: 25999 - DNA, 18 bp, Artificial sequence
  synthetic polynucleotide sequence
ggaaacgtccagcaccga

SEQ ID NO: 26000 - DNA, 18 bp, Artificial sequence
  synthetic polynucleotide sequence
ccacgatccatgaggcca

SEQ ID NO: 26001 - DNA, 21 bp, Artificial sequence
  synthetic polynucleotide sequence
aaggggtcagaggaccagaga

SEQ ID NO: 26002 - DNA, 21 bp, Artificial sequence
  synthetic polynucleotide sequence
ttctccaaggctggacaggga

SEQ ID NO: 26003 - DNA, 21 bp, Artificial sequence
  synthetic polynucleotide sequence
cagacgtggtcacagaggaga

SEQ ID NO: 26004 - DNA, 20 bp, Artificial sequence
  synthetic polynucleotide sequence
tccaggaagtgctgacgcca

SEQ ID NO: 26005 - DNA, 20 bp, Artificial sequence
  synthetic polynucleotide sequence
ggcgcgacgttgaagctgca

SEQ ID NO: 26006 - DNA, 20 bp, Artificial sequence
  synthetic polynucleotide sequence
gaccagcagcctcctctgga

SEQ ID NO: 26007 - DNA, 20 bp, Artificial sequence
  synthetic polynucleotide sequence
cactaagctacgctgggcaa

SEQ ID NO: 26008 - DNA, 19 bp, Artificial sequence
  synthetic polynucleotide sequence
tgaatgggcaggcatagca

SEQ ID NO: 26009 - DNA, 22 bp, Artificial sequence
  synthetic polynucleotide sequence
aaagagaaggaggtgagagcca

SEQ ID NO: 26010 - DNA, 21 bp, Artificial sequence
  synthetic polynucleotide sequence
tgcataggtacacgtccggca

SEQ ID NO: 26011 - DNA, 20 bp, Artificial sequence
  synthetic polynucleotide sequence
agggcataagggaggaggaa

SEQ ID NO: 26012 - DNA, 19 bp, Artificial sequence
  synthetic polynucleotide sequence
ggagtgccacaccacctga

SEQ ID NO: 26013 - DNA, 18 bp, Artificial sequence
  synthetic polynucleotide sequence
tcgctcacgccatccaga

SEQ ID NO: 26014 - DNA, 18 bp, Artificial sequence
  synthetic polynucleotide sequence
caacgtggccattacgca

SEQ ID NO: 26015 - DNA, 21 bp, Artificial sequence
  synthetic polynucleotide sequence
gatggttagggaggcagagca

SEQ ID NO: 26016 - DNA, 20 bp, Artificial sequence
  synthetic polynucleotide sequence
cttgctgaccagagtggaga

SEQ ID NO: 26017 - DNA, 20 bp, Artificial sequence
  synthetic polynucleotide sequence
ggacgagttgcagaggagga

SEQ ID NO: 26018 - DNA, 19 bp, Artificial sequence
  synthetic polynucleotide sequence
gctcagggctcgacagcca

SEQ ID NO: 26019 - DNA, 20 bp, Artificial sequence
  synthetic polynucleotide sequence
gaagacacgcccagcatcca

SEQ ID NO: 26020 - DNA, 19 bp, Artificial sequence
  synthetic polynucleotide sequence
gtgttgcgcaggccacgga

SEQ ID NO: 26021 - DNA, 21 bp, Artificial sequence
  synthetic polynucleotide sequence
gaagatgagcctggatgccca

SEQ ID NO: 26022 - DNA, 19 bp, Artificial sequence
  synthetic polynucleotide sequence
ttgtaggtctcgcccagga

SEQ ID NO: 26023 - DNA, 18 bp, Artificial sequence
  synthetic polynucleotide sequence
tgccagcactggacgaga

SEQ ID NO: 26024 - DNA, 18 bp, Artificial sequence
  synthetic polynucleotide sequence
ctcgcagataggcgctca

SEQ ID NO: 26025 - DNA, 22 bp, Artificial sequence
  synthetic polynucleotide sequence
taaagcaagtctgctcaggaga

SEQ ID NO: 26026 - DNA, 19 bp, Artificial sequence
  synthetic polynucleotide sequence
gtgtcgagcaaggcgggca

SEQ ID NO: 26027 - DNA, 20 bp, Artificial sequence
  synthetic polynucleotide sequence
ctcgacatgcagcagaagga

SEQ ID NO: 26028 - DNA, 21 bp, Artificial sequence
  synthetic polynucleotide sequence
tgacagatgctggcaggctga

SEQ ID NO: 26029 - DNA, 22 bp, Artificial sequence
  synthetic polynucleotide sequence
actaccaagctctatggcacca

SEQ ID NO: 26030 - DNA, 21 bp, Artificial sequence
  synthetic polynucleotide sequence
acatacacgctgtctgggcca

SEQ ID NO: 26031 - DNA, 20 bp, Artificial sequence
  synthetic polynucleotide sequence
gtccgaaggctactcgcaga

SEQ ID NO: 26032 - DNA, 18 bp, Artificial sequence
  synthetic polynucleotide sequence
tcgatgcgaagctgacga

SEQ ID NO: 26033 - DNA, 21 bp, Artificial sequence
  synthetic polynucleotide sequence
agccggatggtgatgcagaca

SEQ ID NO: 26034 - DNA, 21 bp, Artificial sequence
  synthetic polynucleotide sequence
atgtgtcctcgtgaccaccca

SEQ ID NO: 26035 - DNA, 20 bp, Artificial sequence
  synthetic polynucleotide sequence
caaggaagatgtccgagcaa

SEQ ID NO: 26036 - DNA, 18 bp, Artificial sequence
  synthetic polynucleotide sequence
gggctaccaccactccca

SEQ ID NO: 26037 - DNA, 18 bp, Artificial sequence
  synthetic polynucleotide sequence
gcggcagcagatcaacga

SEQ ID NO: 26038 - DNA, 18 bp, Artificial sequence
  synthetic polynucleotide sequence
tagccatccggaggggca

SEQ ID NO: 26039 - DNA, 19 bp, Artificial sequence
  synthetic polynucleotide sequence
cagtgctgaggtccaggca

SEQ ID NO: 26040 - DNA, 20 bp, Artificial sequence
  synthetic polynucleotide sequence
taccgagaatcactgaggca

SEQ ID NO: 26041 - DNA, 22 bp, Artificial sequence
  synthetic polynucleotide sequence
tggactctcagcagaagcggta

SEQ ID NO: 26042 - DNA, 21 bp, Artificial sequence
  synthetic polynucleotide sequence
atgagatctccaacctgcaca

SEQ ID NO: 26043 - DNA, 18 bp, Artificial sequence
  synthetic polynucleotide sequence
tggatgccgggataccca

SEQ ID NO: 26044 - DNA, 18 bp, Artificial sequence
  synthetic polynucleotide sequence
tccatctcaagcagcgca

SEQ ID NO: 26045 - DNA, 18 bp, Artificial sequence
  synthetic polynucleotide sequence
tgcagagaagagccggga

SEQ ID NO: 26046 - DNA, 18 bp, Artificial sequence
  synthetic polynucleotide sequence
atcagagtccagggcgca

SEQ ID NO: 26047 - DNA, 19 bp, Artificial sequence
  synthetic polynucleotide sequence
gatgaccttggcaccgaga

SEQ ID NO: 26048 - DNA, 20 bp, Artificial sequence
  synthetic polynucleotide sequence
tccaccacattccagaagca

SEQ ID NO: 26049 - DNA, 18 bp, Artificial sequence
  synthetic polynucleotide sequence
ggcccaagtggctagcca

SEQ ID NO: 26050 - DNA, 19 bp, Artificial sequence
  synthetic polynucleotide sequence
tccatcgtagtcgaggcaa

SEQ ID NO: 26051 - DNA, 20 bp, Artificial sequence
  synthetic polynucleotide sequence
gaacctggcaggcagtcaga

SEQ ID NO: 26052 - DNA, 20 bp, Artificial sequence
  synthetic polynucleotide sequence
gacataaggccacgattgca

SEQ ID NO: 26053 - DNA, 18 bp, Artificial sequence
  synthetic polynucleotide sequence
gcttatcgcagcgggaca

SEQ ID NO: 26054 - DNA, 20 bp, Artificial sequence
  synthetic polynucleotide sequence
ctggcacctgactactggga

SEQ ID NO: 26055 - DNA, 18 bp, Artificial sequence
  synthetic polynucleotide sequence
ggtggaccaattggccaa

SEQ ID NO: 26056 - DNA, 18 bp, Artificial sequence
  synthetic polynucleotide sequence
gagagtggatcagcggca

SEQ ID NO: 26057 - DNA, 20 bp, Artificial sequence
  synthetic polynucleotide sequence
tacccacaggtgctacagga

SEQ ID NO: 26058 - DNA, 18 bp, Artificial sequence
  synthetic polynucleotide sequence
acaaccgggacacagcca

SEQ ID NO: 26059 - DNA, 20 bp, Artificial sequence
  synthetic polynucleotide sequence
gtgtggcagagcttcccaga

SEQ ID NO: 26060 - DNA, 18 bp, Artificial sequence
  synthetic polynucleotide sequence
cggctgtggtgagaacca

SEQ ID NO: 26061 - DNA, 20 bp, Artificial sequence
  synthetic polynucleotide sequence
acactcatcagcaccccaga

SEQ ID NO: 26062 - DNA, 20 bp, Artificial sequence
  synthetic polynucleotide sequence
gaatgaggctccaatcagca

SEQ ID NO: 26063 - DNA, 20 bp, Artificial sequence
  synthetic polynucleotide sequence
ctcacctccgccatgacgaa

SEQ ID NO: 26064 - DNA, 21 bp, Artificial sequence
  synthetic polynucleotide sequence
caccatggacagctcacagga

SEQ ID NO: 26065 - DNA, 22 bp, Artificial sequence
  synthetic polynucleotide sequence
taacggacaggacctaagcaca

SEQ ID NO: 26066 - DNA, 20 bp, Artificial sequence
  synthetic polynucleotide sequence
agggccagtgtcaaccagga

SEQ ID NO: 26067 - DNA, 20 bp, Artificial sequence
  synthetic polynucleotide sequence
ctacgtcccggccagcagca

SEQ ID NO: 26068 - DNA, 21 bp, Artificial sequence
  synthetic polynucleotide sequence
tcaccagcaagtgactcggaa

SEQ ID NO: 26069 - DNA, 19 bp, Artificial sequence
  synthetic polynucleotide sequence
gccagccaagcccagcaca

SEQ ID NO: 26070 - DNA, 21 bp, Artificial sequence
  synthetic polynucleotide sequence
tccaaagctggagctggggta

SEQ ID NO: 26071 - DNA, 22 bp, Artificial sequence
  synthetic polynucleotide sequence
gtaagaggaggggttgactgga

SEQ ID NO: 26072 - DNA, 20 bp, Artificial sequence
  synthetic polynucleotide sequence
catccctcttggcagggcca

SEQ ID NO: 26073 - DNA, 20 bp, Artificial sequence
  synthetic polynucleotide sequence
gtgaagcttggagcaagaca

SEQ ID NO: 26074 - DNA, 22 bp, Artificial sequence
  synthetic polynucleotide sequence
tgtaaatggtgggtgacagaca

SEQ ID NO: 26075 - DNA, 18 bp, Artificial sequence
  synthetic polynucleotide sequence
ctgccagtgcaacccaga

SEQ ID NO: 26076 - DNA, 18 bp, Artificial sequence
  synthetic polynucleotide sequence
cagtgctctgaggcccca

SEQ ID NO: 26077 - DNA, 18 bp, Artificial sequence
  synthetic polynucleotide sequence
ccgctgaccattgggaca

SEQ ID NO: 26078 - DNA, 18 bp, Artificial sequence
  synthetic polynucleotide sequence
ccagcctgccacgtcaga

SEQ ID NO: 26079 - DNA, 21 bp, Artificial sequence
  synthetic polynucleotide sequence
taaggaggagctggagagaca

SEQ ID NO: 26080 - DNA, 18 bp, Artificial sequence
  synthetic polynucleotide sequence
gcctcttccaggagggca

SEQ ID NO: 26081 - DNA, 18 bp, Artificial sequence
  synthetic polynucleotide sequence
ccacgctgatgacgcaga

SEQ ID NO: 26082 - DNA, 18 bp, Artificial sequence
  synthetic polynucleotide sequence
tgcggtccacgtagggca

SEQ ID NO: 26083 - DNA, 20 bp, Artificial sequence
  synthetic polynucleotide sequence
acttcacgggagaggaggca

SEQ ID NO: 26084 - DNA, 21 bp, Artificial sequence
  synthetic polynucleotide sequence
cgaacagacgcagttcctcca

SEQ ID NO: 26085 - DNA, 21 bp, Artificial sequence
  synthetic polynucleotide sequence
acacgggaagacactgggaca

SEQ ID NO: 26086 - DNA, 19 bp, Artificial sequence
  synthetic polynucleotide sequence
cagcactgcccggttccca

SEQ ID NO: 26087 - DNA, 20 bp, Artificial sequence
  synthetic polynucleotide sequence
cagctgtgagccgtgccaga

SEQ ID NO: 26088 - DNA, 20 bp, Artificial sequence
  synthetic polynucleotide sequence
cgcatcctcctgaaggcgca

SEQ ID NO: 26089 - DNA, 18 bp, Artificial sequence
  synthetic polynucleotide sequence
tccaccgtgcagtgggaa

SEQ ID NO: 26090 - DNA, 19 bp, Artificial sequence
  synthetic polynucleotide sequence
gtccagctcgccatacaca

SEQ ID NO: 26091 - DNA, 21 bp, Artificial sequence
  synthetic polynucleotide sequence
ttggcaagctatgcaacagga

SEQ ID NO: 26092 - DNA, 20 bp, Artificial sequence
  synthetic polynucleotide sequence
caaacaggtggggatgacca

SEQ ID NO: 26093 - DNA, 18 bp, Artificial sequence
  synthetic polynucleotide sequence
cggatgcagagatcggca

SEQ ID NO: 26094 - DNA, 18 bp, Artificial sequence
  synthetic polynucleotide sequence
gcttgccaatgcgcacca

SEQ ID NO: 26095 - DNA, 18 bp, Artificial sequence
  synthetic polynucleotide sequence
gcacctggccacggcaga

SEQ ID NO: 26096 - DNA, 18 bp, Artificial sequence
  synthetic polynucleotide sequence
agcccagatggccagaca

SEQ ID NO: 26097 - DNA, 22 bp, Artificial sequence
  synthetic polynucleotide sequence
attcctgccctgaacatcacga

SEQ ID NO: 26098 - DNA, 21 bp, Artificial sequence
  synthetic polynucleotide sequence
cataggcagaggctgtgagga

SEQ ID NO: 26099 - DNA, 19 bp, Artificial sequence
  synthetic polynucleotide sequence
gcctgcccaagcacaccta

SEQ ID NO: 26100 - DNA, 20 bp, Artificial sequence
  synthetic polynucleotide sequence
aagggagatgaggactcgca

SEQ ID NO: 26101 - DNA, 25 bp, Artificial sequence
  synthetic polynucleotide sequence
gacggacacaaactaagggatgcca

SEQ ID NO: 26102 - DNA, 20 bp, Artificial sequence
  synthetic polynucleotide sequence
gtgagggagagcccgtccca

SEQ ID NO: 26103 - DNA, 20 bp, Artificial sequence
  synthetic polynucleotide sequence
gagtgtgacctcaccgacga

SEQ ID NO: 26104 - DNA, 18 bp, Artificial sequence
  synthetic polynucleotide sequence
cagaggctccccagcaga

SEQ ID NO: 26105 - DNA, 18 bp, Artificial sequence
  synthetic polynucleotide sequence
gcagggatgcaaacgcca

SEQ ID NO: 26106 - DNA, 18 bp, Artificial sequence
  synthetic polynucleotide sequence
tgggctcccagtaaccca

SEQ ID NO: 26107 - DNA, 18 bp, Artificial sequence
  synthetic polynucleotide sequence
acgacggggatgagcaga

SEQ ID NO: 26108 - DNA, 20 bp, Artificial sequence
  synthetic polynucleotide sequence
ggccagcgtcctctcagaga

SEQ ID NO: 26109 - DNA, 22 bp, Artificial sequence
  synthetic polynucleotide sequence
gcaagtggacttccagaagaca

SEQ ID NO: 26110 - DNA, 22 bp, Artificial sequence
  synthetic polynucleotide sequence
aaagagagtccactgatggcca

SEQ ID NO: 26111 - DNA, 20 bp, Artificial sequence
  synthetic polynucleotide sequence
accagcaccccgagaacaca

SEQ ID NO: 26112 - DNA, 20 bp, Artificial sequence
  synthetic polynucleotide sequence
cgttaggtggaagcagcgga

SEQ ID NO: 26113 - DNA, 20 bp, Artificial sequence
  synthetic polynucleotide sequence
gtggagaagatgccaaacca

SEQ ID NO: 26114 - DNA, 18 bp, Artificial sequence
  synthetic polynucleotide sequence
tcaacacagtgggcagca

SEQ ID NO: 26115 - DNA, 20 bp, Artificial sequence
  synthetic polynucleotide sequence
ttgcccagggcaacgtccga

SEQ ID NO: 26116 - DNA, 21 bp, Artificial sequence
  synthetic polynucleotide sequence
ggctccagaggaatgtcccca

SEQ ID NO: 26117 - DNA, 19 bp, Artificial sequence
  synthetic polynucleotide sequence
cggtgactgctgaggacga

SEQ ID NO: 26118 - DNA, 18 bp, Artificial sequence
  synthetic polynucleotide sequence
tcccgcatgaaccgcaga

SEQ ID NO: 26119 - DNA, 20 bp, Artificial sequence
  synthetic polynucleotide sequence
cccacagtggcacctaagca

SEQ ID NO: 26120 - DNA, 19 bp, Artificial sequence
  synthetic polynucleotide sequence
ggtccagccacaacctgga

SEQ ID NO: 26121 - DNA, 21 bp, Artificial sequence
  synthetic polynucleotide sequence
ttccatcaaggtgtcggcgga

SEQ ID NO: 26122 - DNA, 20 bp, Artificial sequence
  synthetic polynucleotide sequence
catggccacctctcggacga

SEQ ID NO: 26123 - DNA, 19 bp, Artificial sequence
  synthetic polynucleotide sequence
ggacaccctttccgccgga

SEQ ID NO: 26124 - DNA, 20 bp, Artificial sequence
  synthetic polynucleotide sequence
cacagacggctgctgctcca

SEQ ID NO: 26125 - DNA, 21 bp, Artificial sequence
  synthetic polynucleotide sequence
cagcagatcccaggagttgga

SEQ ID NO: 26126 - DNA, 20 bp, Artificial sequence
  synthetic polynucleotide sequence
tgggctgcgtgaagaaggca

SEQ ID NO: 26127 - DNA, 18 bp, Artificial sequence
  synthetic polynucleotide sequence
ttcacggtgggggaggaa

SEQ ID NO: 26128 - DNA, 20 bp, Artificial sequence
  synthetic polynucleotide sequence
gtcaccttccaactgaacca

SEQ ID NO: 26129 - DNA, 21 bp, Artificial sequence
  synthetic polynucleotide sequence
tgggccgtttggcaaaaccca

SEQ ID NO: 26130 - DNA, 19 bp, Artificial sequence
  synthetic polynucleotide sequence
ttgtggccacctggcgtga

SEQ ID NO: 26131 - DNA, 21 bp, Artificial sequence
  synthetic polynucleotide sequence
ttggaaggtagaccggagtga

SEQ ID NO: 26132 - DNA, 18 bp, Artificial sequence
  synthetic polynucleotide sequence
ggctccaggtccccctga

SEQ ID NO: 26133 - DNA, 22 bp, Artificial sequence
  synthetic polynucleotide sequence
ccaagcctaccacaatcatcga

SEQ ID NO: 26134 - DNA, 18 bp, Artificial sequence
  synthetic polynucleotide sequence
catcgaactccaccccca

SEQ ID NO: 26135 - DNA, 18 bp, Artificial sequence
  synthetic polynucleotide sequence
tgggctttgccaccagga

SEQ ID NO: 26136 - DNA, 20 bp, Artificial sequence
  synthetic polynucleotide sequence
catgtaccaggacaccccca

SEQ ID NO: 26137 - DNA, 18 bp, Artificial sequence
  synthetic polynucleotide sequence
cgcaatggccaagccaga

SEQ ID NO: 26138 - DNA, 20 bp, Artificial sequence
  synthetic polynucleotide sequence
gatgctgaaccaatgcacca

SEQ ID NO: 26139 - DNA, 21 bp, Artificial sequence
  synthetic polynucleotide sequence
ccggcaagttcgagatggaga

SEQ ID NO: 26140 - DNA, 18 bp, Artificial sequence
  synthetic polynucleotide sequence
cccggagtagtgctggga

SEQ ID NO: 26141 - DNA, 21 bp, Artificial sequence
  synthetic polynucleotide sequence
ctggaagctgaccaacagtca

SEQ ID NO: 26142 - DNA, 22 bp, Artificial sequence
  synthetic polynucleotide sequence
ttgaatgtgctgagagtcctga

SEQ ID NO: 26143 - DNA, 19 bp, Artificial sequence
  synthetic polynucleotide sequence
cgcagcccggaacatggca

SEQ ID NO: 26144 - DNA, 22 bp, Artificial sequence
  synthetic polynucleotide sequence
attcttcccccagcttgaagga

SEQ ID NO: 26145 - DNA, 21 bp, Artificial sequence
  synthetic polynucleotide sequence
atcgacagcatcgaggacaga

SEQ ID NO: 26146 - DNA, 19 bp, Artificial sequence
  synthetic polynucleotide sequence
tgtaccaggtcagccacca

SEQ ID NO: 26147 - DNA, 18 bp, Artificial sequence
  synthetic polynucleotide sequence
gctccaggccacatgcaa

SEQ ID NO: 26148 - DNA, 20 bp, Artificial sequence
  synthetic polynucleotide sequence
ggcacacaaggactgcacca

SEQ ID NO: 26149 - DNA, 19 bp, Artificial sequence
  synthetic polynucleotide sequence
ccccggcacaacttacaca

SEQ ID NO: 26150 - DNA, 18 bp, Artificial sequence
  synthetic polynucleotide sequence
aaggtaggcgtccagcca

SEQ ID NO: 26151 - DNA, 19 bp, Artificial sequence
  synthetic polynucleotide sequence
gccacgagaagcaccggga

SEQ ID NO: 26152 - DNA, 20 bp, Artificial sequence
  synthetic polynucleotide sequence
tgtctcggcatcctggggaa

SEQ ID NO: 26153 - DNA, 21 bp, Artificial sequence
  synthetic polynucleotide sequence
aggaaggtggagctcgggaca

SEQ ID NO: 26154 - DNA, 20 bp, Artificial sequence
  synthetic polynucleotide sequence
gtcccgggagaacatgggca

SEQ ID NO: 26155 - DNA, 18 bp, Artificial sequence
  synthetic polynucleotide sequence
cctgcacagacccgggaa

SEQ ID NO: 26156 - DNA, 18 bp, Artificial sequence
  synthetic polynucleotide sequence
gcagatgacgccatgcca

SEQ ID NO: 26157 - DNA, 20 bp, Artificial sequence
  synthetic polynucleotide sequence
aagaaacgggaggagcggga

SEQ ID NO: 26158 - DNA, 19 bp, Artificial sequence
  synthetic polynucleotide sequence
ggggaaggttcagggggca

SEQ ID NO: 26159 - DNA, 18 bp, Artificial sequence
  synthetic polynucleotide sequence
ccaaggcccatgagcaca

SEQ ID NO: 26160 - DNA, 18 bp, Artificial sequence
  synthetic polynucleotide sequence
gagcatccatgggcacca

SEQ ID NO: 26161 - DNA, 18 bp, Artificial sequence
  synthetic polynucleotide sequence
ccgtgcccaaggagccca

SEQ ID NO: 26162 - DNA, 19 bp, Artificial sequence
  synthetic polynucleotide sequence
tgccagtcacgagcactca

SEQ ID NO: 26163 - DNA, 21 bp, Artificial sequence
  synthetic polynucleotide sequence
ggctccagtcacatggccaga

SEQ ID NO: 26164 - DNA, 20 bp, Artificial sequence
  synthetic polynucleotide sequence
ctttccaatgaccacggcca

SEQ ID NO: 26165 - DNA, 18 bp, Artificial sequence
  synthetic polynucleotide sequence
gcagccgagtcggaacca

SEQ ID NO: 26166 - DNA, 23 bp, Artificial sequence
  synthetic polynucleotide sequence
caacatcccaaacagctacgaga

SEQ ID NO: 26167 - DNA, 21 bp, Artificial sequence
  synthetic polynucleotide sequence
gactatgtccaggccaaccca

SEQ ID NO: 26168 - DNA, 21 bp, Artificial sequence
  synthetic polynucleotide sequence
tctggaagctgaagacggtga

SEQ ID NO: 26169 - DNA, 18 bp, Artificial sequence
  synthetic polynucleotide sequence
cgacctgggtggacgaca

SEQ ID NO: 26170 - DNA, 18 bp, Artificial sequence
  synthetic polynucleotide sequence
ggctcacgaacagccgga

SEQ ID NO: 26171 - DNA, 22 bp, Artificial sequence
  synthetic polynucleotide sequence
accagggtggatgcagatgaca

SEQ ID NO: 26172 - DNA, 19 bp, Artificial sequence
  synthetic polynucleotide sequence
tcataagctccagacccca

SEQ ID NO: 26173 - DNA, 22 bp, Artificial sequence
  synthetic polynucleotide sequence
aatacctgaaacgccctcctga

SEQ ID NO: 26174 - DNA, 21 bp, Artificial sequence
  synthetic polynucleotide sequence
accccaggatcgtccatgcca

SEQ ID NO: 26175 - DNA, 20 bp, Artificial sequence
  synthetic polynucleotide sequence
cgactgaggggtactcgcca

SEQ ID NO: 26176 - DNA, 19 bp, Artificial sequence
  synthetic polynucleotide sequence
gctcatggcagctggcgga

SEQ ID NO: 26177 - DNA, 19 bp, Artificial sequence
  synthetic polynucleotide sequence
cacagcagggaaggaacca

SEQ ID NO: 26178 - DNA, 19 bp, Artificial sequence
  synthetic polynucleotide sequence
acttgacccaggaagccca

SEQ ID NO: 26179 - DNA, 21 bp, Artificial sequence
  synthetic polynucleotide sequence
agacaccccgtaacaagctga

SEQ ID NO: 26180 - DNA, 22 bp, Artificial sequence
  synthetic polynucleotide sequence
ggaaaagagatgccctggctga

SEQ ID NO: 26181 - DNA, 20 bp, Artificial sequence
  synthetic polynucleotide sequence
cagggcagccgtgcagacga

SEQ ID NO: 26182 - DNA, 25 bp, Artificial sequence
  synthetic polynucleotide sequence
atcctaagctgcaaaggagactgga

SEQ ID NO: 26183 - DNA, 21 bp, Artificial sequence
  synthetic polynucleotide sequence
gcagcttgaacttgagaagca

SEQ ID NO: 26184 - DNA, 20 bp, Artificial sequence
  synthetic polynucleotide sequence
ggtgcagcctcagcctagga

SEQ ID NO: 26185 - DNA, 21 bp, Artificial sequence
  synthetic polynucleotide sequence
tgagagtcaggatgccatgga

SEQ ID NO: 26186 - DNA, 18 bp, Artificial sequence
  synthetic polynucleotide sequence
gggatgggactggggcca

SEQ ID NO: 26187 - DNA, 19 bp, Artificial sequence
  synthetic polynucleotide sequence
tggctgagtgggagctgca

SEQ ID NO: 26188 - DNA, 21 bp, Artificial sequence
  synthetic polynucleotide sequence
agctccacgatctcctggcca

SEQ ID NO: 26189 - DNA, 19 bp, Artificial sequence
  synthetic polynucleotide sequence
ggggtcggggcagtgggga

SEQ ID NO: 26190 - DNA, 25 bp, Artificial sequence
  synthetic polynucleotide sequence
gagagggaagtcaaagcaatgcaga

SEQ ID NO: 26191 - DNA, 19 bp, Artificial sequence
  synthetic polynucleotide sequence
ggccgaccctgtggaacca

SEQ ID NO: 26192 - DNA, 20 bp, Artificial sequence
  synthetic polynucleotide sequence
tcttccgggtccagtccaca

SEQ ID NO: 26193 - DNA, 20 bp, Artificial sequence
  synthetic polynucleotide sequence
gtcggactgtgtgaccctca

SEQ ID NO: 26194 - DNA, 18 bp, Artificial sequence
  synthetic polynucleotide sequence
tgcgggcgttcctctcga

SEQ ID NO: 26195 - DNA, 20 bp, Artificial sequence
  synthetic polynucleotide sequence
gggagctgaggaaggagcaa

SEQ ID NO: 26196 - DNA, 20 bp, Artificial sequence
  synthetic polynucleotide sequence
caggatcacacagccgggaa

SEQ ID NO: 26197 - DNA, 22 bp, Artificial sequence
  synthetic polynucleotide sequence
caaatcgtggctcagtacccca

SEQ ID NO: 26198 - DNA, 21 bp, Artificial sequence
  synthetic polynucleotide sequence
aagcaggtggcgtaacccgta

SEQ ID NO: 26199 - DNA, 21 bp, Artificial sequence
  synthetic polynucleotide sequence
ctccaggactatggcgacaga

SEQ ID NO: 26200 - DNA, 20 bp, Artificial sequence
  synthetic polynucleotide sequence
ctggccttcaggatgaccaa

SEQ ID NO: 26201 - DNA, 19 bp, Artificial sequence
  synthetic polynucleotide sequence
gccgaggtccttaacccca

SEQ ID NO: 26202 - DNA, 20 bp, Artificial sequence
  synthetic polynucleotide sequence
tgagacctgcagaacaggca

SEQ ID NO: 26203 - DNA, 22 bp, Artificial sequence
  synthetic polynucleotide sequence
aggaagcaggaagtgacagcca

SEQ ID NO: 26204 - DNA, 21 bp, Artificial sequence
  synthetic polynucleotide sequence
gtagctgaaaggcgtcctgga

SEQ ID NO: 26205 - DNA, 18 bp, Artificial sequence
  synthetic polynucleotide sequence
cctggaagggctcaacca

SEQ ID NO: 26206 - DNA, 18 bp, Artificial sequence
  synthetic polynucleotide sequence
aggccacaaggctgggga

SEQ ID NO: 26207 - DNA, 21 bp, Artificial sequence
  synthetic polynucleotide sequence
ctcgtcagcatcctcaagcca

SEQ ID NO: 26208 - DNA, 21 bp, Artificial sequence
  synthetic polynucleotide sequence
tgtttgtagacagggaggcca

SEQ ID NO: 26209 - DNA, 20 bp, Artificial sequence
  synthetic polynucleotide sequence
aagcccatggagtccctgga

SEQ ID NO: 26210 - DNA, 18 bp, Artificial sequence
  synthetic polynucleotide sequence
gtccagcaccaccccgca

SEQ ID NO: 26211 - DNA, 21 bp, Artificial sequence
  synthetic polynucleotide sequence
aacctcccaccaaaaagccca

SEQ ID NO: 26212 - DNA, 19 bp, Artificial sequence
  synthetic polynucleotide sequence
ggctggaacttggggcgca

SEQ ID NO: 26213 - DNA, 18 bp, Artificial sequence
  synthetic polynucleotide sequence
ctcaaagccagccgggaa

SEQ ID NO: 26214 - DNA, 19 bp, Artificial sequence
  synthetic polynucleotide sequence
gaggcagggtagaagggca

SEQ ID NO: 26215 - DNA, 25 bp, Artificial sequence
  synthetic polynucleotide sequence
taagcaccagcagaacaccaaagga

SEQ ID NO: 26216 - DNA, 20 bp, Artificial sequence
  synthetic polynucleotide sequence
acctatgaagcgccagggca

SEQ ID NO: 26217 - DNA, 22 bp, Artificial sequence
  synthetic polynucleotide sequence
tgcaaggcctgcatgaaggaga

SEQ ID NO: 26218 - DNA, 21 bp, Artificial sequence
  synthetic polynucleotide sequence
tgtccctgactggaacggcta

SEQ ID NO: 26219 - DNA, 20 bp, Artificial sequence
  synthetic polynucleotide sequence
ctggatgcccgagggatcca

SEQ ID NO: 26220 - DNA, 21 bp, Artificial sequence
  synthetic polynucleotide sequence
catggacagcaatgctcccaa

SEQ ID NO: 26221 - DNA, 18 bp, Artificial sequence
  synthetic polynucleotide sequence
cccagcccaacgacccga

SEQ ID NO: 26222 - DNA, 22 bp, Artificial sequence
  synthetic polynucleotide sequence
atctgacagctgtgcaacgtca

SEQ ID NO: 26223 - DNA, 22 bp, Artificial sequence
  synthetic polynucleotide sequence
gacagaaagtcagcccaagaga

SEQ ID NO: 26224 - DNA, 20 bp, Artificial sequence
  synthetic polynucleotide sequence
gatcagacagttgcgcggca

SEQ ID NO: 26225 - DNA, 21 bp, Artificial sequence
  synthetic polynucleotide sequence
ttccactaccgcagacggcaa

SEQ ID NO: 26226 - DNA, 20 bp, Artificial sequence
  synthetic polynucleotide sequence
tgatgaaggcggctgatgga

SEQ ID NO: 26227 - DNA, 21 bp, Artificial sequence
  synthetic polynucleotide sequence
atcagagtggaggcatggcca

SEQ ID NO: 26228 - DNA, 21 bp, Artificial sequence
  synthetic polynucleotide sequence
agagaccacagacaggtccga

SEQ ID NO: 26229 - DNA, 19 bp, Artificial sequence
  synthetic polynucleotide sequence
ccaggtggcagactcagga

SEQ ID NO: 26230 - DNA, 18 bp, Artificial sequence
  synthetic polynucleotide sequence
tatgatggcaccaccgca

SEQ ID NO: 26231 - DNA, 22 bp, Artificial sequence
  synthetic polynucleotide sequence
acaaccagccaatccctaccta

SEQ ID NO: 26232 - DNA, 19 bp, Artificial sequence
  synthetic polynucleotide sequence
ggcatctgtcccagcccca

SEQ ID NO: 26233 - DNA, 18 bp, Artificial sequence
  synthetic polynucleotide sequence
tgggcgttcagccaagga

SEQ ID NO: 26234 - DNA, 18 bp, Artificial sequence
  synthetic polynucleotide sequence
ggcaccacctggccagca

SEQ ID NO: 26235 - DNA, 19 bp, Artificial sequence
  synthetic polynucleotide sequence
cgtcgctggaggaacccga

SEQ ID NO: 26236 - DNA, 20 bp, Artificial sequence
  synthetic polynucleotide sequence
cttcagggcgtcgctggaga

SEQ ID NO: 26237 - DNA, 19 bp, Artificial sequence
  synthetic polynucleotide sequence
cgtcgctggaggaacccga

SEQ ID NO: 26238 - DNA, 21 bp, Artificial sequence
  synthetic polynucleotide sequence
ccttcagggcgtcgttggaga

SEQ ID NO: 26239 - DNA, 19 bp, Artificial sequence
  synthetic polynucleotide sequence
cgtcgctggaggaacccga

SEQ ID NO: 26240 - DNA, 20 bp, Artificial sequence
  synthetic polynucleotide sequence
cgtgaggcgggtgatgagga

SEQ ID NO: 26241 - DNA, 20 bp, Artificial sequence
  synthetic polynucleotide sequence
atctgcctcagtgagagcca

SEQ ID NO: 26242 - DNA, 18 bp, Artificial sequence
  synthetic polynucleotide sequence
agcatcctccaccaccca

SEQ ID NO: 26243 - DNA, 21 bp, Artificial sequence
  synthetic polynucleotide sequence
acaacctctaccgggacagca

SEQ ID NO: 26244 - DNA, 21 bp, Artificial sequence
  synthetic polynucleotide sequence
acctcctcatcctggaccaca

SEQ ID NO: 26245 - DNA, 20 bp, Artificial sequence
  synthetic polynucleotide sequence
ctccaaccccaccttccgaa

SEQ ID NO: 26246 - DNA, 21 bp, Artificial sequence
  synthetic polynucleotide sequence
ccgtccggggtaaaaggaaga

SEQ ID NO: 26247 - DNA, 18 bp, Artificial sequence
  synthetic polynucleotide sequence
gcccaccactaacgggca

SEQ ID NO: 26248 - DNA, 20 bp, Artificial sequence
  synthetic polynucleotide sequence
catctaaggacaccacccca

SEQ ID NO: 26249 - DNA, 20 bp, Artificial sequence
  synthetic polynucleotide sequence
ctgaggaggagaagaggcca

SEQ ID NO: 26250 - DNA, 21 bp, Artificial sequence
  synthetic polynucleotide sequence
cgtcagacaccttccggctga

SEQ ID NO: 26251 - DNA, 20 bp, Artificial sequence
  synthetic polynucleotide sequence
cagcaaaggtggggtgacca

SEQ ID NO: 26252 - DNA, 20 bp, Artificial sequence
  synthetic polynucleotide sequence
gagatgggagggagccgcaa

SEQ ID NO: 26253 - DNA, 21 bp, Artificial sequence
  synthetic polynucleotide sequence
gagaaggtgtgaagagcgaga

SEQ ID NO: 26254 - DNA, 18 bp, Artificial sequence
  synthetic polynucleotide sequence
acacaggggaactcggca

SEQ ID NO: 26255 - DNA, 20 bp, Artificial sequence
  synthetic polynucleotide sequence
ccaaggcctacctgggaaga

SEQ ID NO: 26256 - DNA, 23 bp, Artificial sequence
  synthetic polynucleotide sequence
gaagaactgctggaagaatcaga

SEQ ID NO: 26257 - DNA, 20 bp, Artificial sequence
  synthetic polynucleotide sequence
actgagccccgagacagtga

SEQ ID NO: 26258 - DNA, 21 bp, Artificial sequence
  synthetic polynucleotide sequence
aggtgggagaatggaagggga

SEQ ID NO: 26259 - DNA, 18 bp, Artificial sequence
  synthetic polynucleotide sequence
aagacccaggctcagcca

SEQ ID NO: 26260 - DNA, 22 bp, Artificial sequence
  synthetic polynucleotide sequence
aatgtgcacacactacagacca

SEQ ID NO: 26261 - DNA, 21 bp, Artificial sequence
  synthetic polynucleotide sequence
taggatccaacctcaccagca

SEQ ID NO: 26262 - DNA, 22 bp, Artificial sequence
  synthetic polynucleotide sequence
ttcaaagtcatccccctcagca

SEQ ID NO: 26263 - DNA, 21 bp, Artificial sequence
  synthetic polynucleotide sequence
gatcactcagaccctcgccaa

SEQ ID NO: 26264 - DNA, 19 bp, Artificial sequence
  synthetic polynucleotide sequence
ttcaatgcgggcagagtga

SEQ ID NO: 26265 - DNA, 20 bp, Artificial sequence
  synthetic polynucleotide sequence
ctgcagctgaccttcaggga

SEQ ID NO: 26266 - DNA, 22 bp, Artificial sequence
  synthetic polynucleotide sequence
ataacggtcttggggagaagca

SEQ ID NO: 26267 - DNA, 22 bp, Artificial sequence
  synthetic polynucleotide sequence
atccggaagatgcagggtctca

SEQ ID NO: 26268 - DNA, 20 bp, Artificial sequence
  synthetic polynucleotide sequence
ctccagctcactggtgacca

SEQ ID NO: 26269 - DNA, 18 bp, Artificial sequence
  synthetic polynucleotide sequence
cggcaggtgatgaagcca

SEQ ID NO: 26270 - DNA, 18 bp, Artificial sequence
  synthetic polynucleotide sequence
ccgcttgctggaggggga

SEQ ID NO: 26271 - DNA, 21 bp, Artificial sequence
  synthetic polynucleotide sequence
aaggggaagcagcgtgtgtca

SEQ ID NO: 26272 - DNA, 21 bp, Artificial sequence
  synthetic polynucleotide sequence
gcaggaaatggctcctcccca

SEQ ID NO: 26273 - DNA, 18 bp, Artificial sequence
  synthetic polynucleotide sequence
aacccactgctgtcgcca

SEQ ID NO: 26274 - DNA, 18 bp, Artificial sequence
  synthetic polynucleotide sequence
gccatctccacagctgca

SEQ ID NO: 26275 - DNA, 20 bp, Artificial sequence
  synthetic polynucleotide sequence
ggacgggcctcagacactca

SEQ ID NO: 26276 - DNA, 18 bp, Artificial sequence
  synthetic polynucleotide sequence
ccgtgactagcgggggga

SEQ ID NO: 26277 - DNA, 21 bp, Artificial sequence
  synthetic polynucleotide sequence
gacgcaatccaccaccacgaa

SEQ ID NO: 26278 - DNA, 19 bp, Artificial sequence
  synthetic polynucleotide sequence
gactcaggggcgtcggtga

SEQ ID NO: 26279 - DNA, 20 bp, Artificial sequence
  synthetic polynucleotide sequence
cccacgtgactgtggcacca

SEQ ID NO: 26280 - DNA, 21 bp, Artificial sequence
  synthetic polynucleotide sequence
catggcctgcatctggaagga

SEQ ID NO: 26281 - DNA, 22 bp, Artificial sequence
  synthetic polynucleotide sequence
tcatgcagctaaccacaaggca

SEQ ID NO: 26282 - DNA, 20 bp, Artificial sequence
  synthetic polynucleotide sequence
tgtttcagggggatgggcca

SEQ ID NO: 26283 - DNA, 20 bp, Artificial sequence
  synthetic polynucleotide sequence
agcatgtgccagggcagaca

SEQ ID NO: 26284 - DNA, 20 bp, Artificial sequence
  synthetic polynucleotide sequence
tgccagcgtggctgggtcca

SEQ ID NO: 26285 - DNA, 25 bp, Artificial sequence
  synthetic polynucleotide sequence
acggcaggatccaagaagcactgaa

SEQ ID NO: 26286 - DNA, 23 bp, Artificial sequence
  synthetic polynucleotide sequence
cctctacatacagaagcctccaa

SEQ ID NO: 26287 - DNA, 19 bp, Artificial sequence
  synthetic polynucleotide sequence
tcacggtggagaatgcgga

SEQ ID NO: 26288 - DNA, 19 bp, Artificial sequence
  synthetic polynucleotide sequence
tgggactggacaaccccga

SEQ ID NO: 26289 - DNA, 20 bp, Artificial sequence
  synthetic polynucleotide sequence
acagacagcagagccgggca

SEQ ID NO: 26290 - DNA, 20 bp, Artificial sequence
  synthetic polynucleotide sequence
ggtaagagggagggcagaga

SEQ ID NO: 26291 - DNA, 21 bp, Artificial sequence
  synthetic polynucleotide sequence
ggagagtaacagggccccaca

SEQ ID NO: 26292 - DNA, 20 bp, Artificial sequence
  synthetic polynucleotide sequence
ctggagtgccgcttcaggca

SEQ ID NO: 26293 - DNA, 21 bp, Artificial sequence
  synthetic polynucleotide sequence
gccagcggtacagagaggaga

SEQ ID NO: 26294 - DNA, 20 bp, Artificial sequence
  synthetic polynucleotide sequence
tctcctcctcacatgccgca

SEQ ID NO: 26295 - DNA, 22 bp, Artificial sequence
  synthetic polynucleotide sequence
ctaagccccacacaaagttgga

SEQ ID NO: 26296 - DNA, 20 bp, Artificial sequence
  synthetic polynucleotide sequence
tccagctgcgggttcaagca

SEQ ID NO: 26297 - DNA, 21 bp, Artificial sequence
  synthetic polynucleotide sequence
agcaccccattcacaggccca

SEQ ID NO: 26298 - DNA, 22 bp, Artificial sequence
  synthetic polynucleotide sequence
aggacctgatagagagagcgga

SEQ ID NO: 26299 - DNA, 20 bp, Artificial sequence
  synthetic polynucleotide sequence
gtccttcagcctgggcgaga

SEQ ID NO: 26300 - DNA, 20 bp, Artificial sequence
  synthetic polynucleotide sequence
agcctgagatgagagggcca

SEQ ID NO: 26301 - DNA, 20 bp, Artificial sequence
  synthetic polynucleotide sequence
ggagcagctggaccaccaga

SEQ ID NO: 26302 - DNA, 21 bp, Artificial sequence
  synthetic polynucleotide sequence
tggcgaggatcatgtggggga

SEQ ID NO: 26303 - DNA, 20 bp, Artificial sequence
  synthetic polynucleotide sequence
ctccaaggcgtaagtcacca

SEQ ID NO: 26304 - DNA, 19 bp, Artificial sequence
  synthetic polynucleotide sequence
ctggaagataccgtgggca

SEQ ID NO: 26305 - DNA, 21 bp, Artificial sequence
  synthetic polynucleotide sequence
agaaaagagagcacaggccca

SEQ ID NO: 26306 - DNA, 20 bp, Artificial sequence
  synthetic polynucleotide sequence
acacccactccatggacgca

SEQ ID NO: 26307 - DNA, 18 bp, Artificial sequence
  synthetic polynucleotide sequence
ccggagctccatcccgca

SEQ ID NO: 26308 - DNA, 22 bp, Artificial sequence
  synthetic polynucleotide sequence
gcatcaagcatctccaacgaga

SEQ ID NO: 26309 - DNA, 19 bp, Artificial sequence
  synthetic polynucleotide sequence
gaggagatcccgcctcgga

SEQ ID NO: 26310 - DNA, 22 bp, Artificial sequence
  synthetic polynucleotide sequence
actatcacagcaaagcaggcga

SEQ ID NO: 26311 - DNA, 19 bp, Artificial sequence
  synthetic polynucleotide sequence
gcagctcccaagccctgga

SEQ ID NO: 26312 - DNA, 21 bp, Artificial sequence
  synthetic polynucleotide sequence
gtatggggagcaggtagtgca

SEQ ID NO: 26313 - DNA, 19 bp, Artificial sequence
  synthetic polynucleotide sequence
tcagccagaagtccccgca

SEQ ID NO: 26314 - DNA, 18 bp, Artificial sequence
  synthetic polynucleotide sequence
gctccccgccgttcagca

SEQ ID NO: 26315 - DNA, 21 bp, Artificial sequence
  synthetic polynucleotide sequence
cgagaagctgcctggaacaca

SEQ ID NO: 26316 - DNA, 19 bp, Artificial sequence
  synthetic polynucleotide sequence
tgccgaatgtcagggcgta

SEQ ID NO: 26317 - DNA, 22 bp, Artificial sequence
  synthetic polynucleotide sequence
cctactccatggatgacaggga

SEQ ID NO: 26318 - DNA, 21 bp, Artificial sequence
  synthetic polynucleotide sequence
atgttctgggaagtgggggga

SEQ ID NO: 26319 - DNA, 18 bp, Artificial sequence
  synthetic polynucleotide sequence
cctgccgcctccacagga

SEQ ID NO: 26320 - DNA, 21 bp, Artificial sequence
  synthetic polynucleotide sequence
tggtgtggagaggctgaagga

SEQ ID NO: 26321 - DNA, 22 bp, Artificial sequence
  synthetic polynucleotide sequence
tgcaccgactgaagatggacca

SEQ ID NO: 26322 - DNA, 18 bp, Artificial sequence
  synthetic polynucleotide sequence
tgaggcccaggtgccgca

SEQ ID NO: 26323 - DNA, 20 bp, Artificial sequence
  synthetic polynucleotide sequence
tgcccctgcctacaatccca

SEQ ID NO: 26324 - DNA, 21 bp, Artificial sequence
  synthetic polynucleotide sequence
ggtgccttcagtgccacagga

SEQ ID NO: 26325 - DNA, 21 bp, Artificial sequence
  synthetic polynucleotide sequence
tacacacagccgctgtatgca

SEQ ID NO: 26326 - DNA, 20 bp, Artificial sequence
  synthetic polynucleotide sequence
gttgcctctaggagggggga

SEQ ID NO: 26327 - DNA, 22 bp, Artificial sequence
  synthetic polynucleotide sequence
gaaaaggggcacatggaagaga

SEQ ID NO: 26328 - DNA, 21 bp, Artificial sequence
  synthetic polynucleotide sequence
ggctcagataccccctcctca

SEQ ID NO: 26329 - DNA, 21 bp, Artificial sequence
  synthetic polynucleotide sequence
catcaggaggaaacactggca

SEQ ID NO: 26330 - DNA, 19 bp, Artificial sequence
  synthetic polynucleotide sequence
tggtacatggcaggagaca

SEQ ID NO: 26331 - DNA, 22 bp, Artificial sequence
  synthetic polynucleotide sequence
acatggaatcagagagcaccca

SEQ ID NO: 26332 - DNA, 20 bp, Artificial sequence
  synthetic polynucleotide sequence
tccaggatctcctcaggcca

SEQ ID NO: 26333 - DNA, 23 bp, Artificial sequence
  synthetic polynucleotide sequence
gcaggcacaacatctgaaaccca

SEQ ID NO: 26334 - DNA, 20 bp, Artificial sequence
  synthetic polynucleotide sequence
cctgcctgatccaccggcaa

SEQ ID NO: 26335 - DNA, 18 bp, Artificial sequence
  synthetic polynucleotide sequence
cccagcttccctgaacga

SEQ ID NO: 26336 - DNA, 18 bp, Artificial sequence
  synthetic polynucleotide sequence
ggacctgccatccaagga

SEQ ID NO: 26337 - DNA, 18 bp, Artificial sequence
  synthetic polynucleotide sequence
gaggcaacagcaccgcaa

SEQ ID NO: 26338 - DNA, 20 bp, Artificial sequence
  synthetic polynucleotide sequence
aagaagtcatcccgggagga

SEQ ID NO: 26339 - DNA, 19 bp, Artificial sequence
  synthetic polynucleotide sequence
tggagccgatactcaagca

SEQ ID NO: 26340 - DNA, 18 bp, Artificial sequence
  synthetic polynucleotide sequence
ggctctgggatgcgggga

SEQ ID NO: 26341 - DNA, 19 bp, Artificial sequence
  synthetic polynucleotide sequence
caccgaccgtcacgagcta

SEQ ID NO: 26342 - DNA, 18 bp, Artificial sequence
  synthetic polynucleotide sequence
gtgcttgatgcggtggga

SEQ ID NO: 26343 - DNA, 19 bp, Artificial sequence
  synthetic polynucleotide sequence
ctgtgaccgcggttggcga

SEQ ID NO: 26344 - DNA, 20 bp, Artificial sequence
  synthetic polynucleotide sequence
cagaactaggtccgggggca

SEQ ID NO: 26345 - DNA, 20 bp, Artificial sequence
  synthetic polynucleotide sequence
tgtaacgccagcccttcgaa

SEQ ID NO: 26346 - DNA, 20 bp, Artificial sequence
  synthetic polynucleotide sequence
tcttcgcagccgctatgaca

SEQ ID NO: 26347 - DNA, 18 bp, Artificial sequence
  synthetic polynucleotide sequence
ggagggaaggccggggaa

SEQ ID NO: 26348 - DNA, 21 bp, Artificial sequence
  synthetic polynucleotide sequence
tcatcctgaccgtcctgacca

SEQ ID NO: 26349 - DNA, 18 bp, Artificial sequence
  synthetic polynucleotide sequence
ccctcaaggcagccgtga

SEQ ID NO: 26350 - DNA, 18 bp, Artificial sequence
  synthetic polynucleotide sequence
ccgacctgaagacgcgca

SEQ ID NO: 26351 - DNA, 20 bp, Artificial sequence
  synthetic polynucleotide sequence
tagagagaggctgcttcaca

SEQ ID NO: 26352 - DNA, 22 bp, Artificial sequence
  synthetic polynucleotide sequence
ttcagacatgcccagattggca

SEQ ID NO: 26353 - DNA, 20 bp, Artificial sequence
  synthetic polynucleotide sequence
tgagccactctcgcatggaa

SEQ ID NO: 26354 - DNA, 19 bp, Artificial sequence
  synthetic polynucleotide sequence
ttggggaggaggaaggtca

SEQ ID NO: 26355 - DNA, 20 bp, Artificial sequence
  synthetic polynucleotide sequence
gtcccaaggagagtcatcca

SEQ ID NO: 26356 - DNA, 19 bp, Artificial sequence
  synthetic polynucleotide sequence
gatgtagcagcccgaagca

SEQ ID NO: 26357 - DNA, 20 bp, Artificial sequence
  synthetic polynucleotide sequence
agggagggtctggtggcaga

SEQ ID NO: 26358 - DNA, 25 bp, Artificial sequence
  synthetic polynucleotide sequence
aaggaacagatccagggaaactgca

SEQ ID NO: 26359 - DNA, 18 bp, Artificial sequence
  synthetic polynucleotide sequence
ccagtggggcgagctgca

SEQ ID NO: 26360 - DNA, 21 bp, Artificial sequence
  synthetic polynucleotide sequence
gggtagccaggtccttgagca

SEQ ID NO: 26361 - DNA, 20 bp, Artificial sequence
  synthetic polynucleotide sequence
cctacacagcctaccgcaca

SEQ ID NO: 26362 - DNA, 18 bp, Artificial sequence
  synthetic polynucleotide sequence
ccggctgtgaggagcgca

SEQ ID NO: 26363 - DNA, 20 bp, Artificial sequence
  synthetic polynucleotide sequence
gggggagtaaggctgggaga

SEQ ID NO: 26364 - DNA, 21 bp, Artificial sequence
  synthetic polynucleotide sequence
agcaacacagaatcagggcca

SEQ ID NO: 26365 - DNA, 18 bp, Artificial sequence
  synthetic polynucleotide sequence
cccagcctttcccgggga

SEQ ID NO: 26366 - DNA, 21 bp, Artificial sequence
  synthetic polynucleotide sequence
cattgaagatgggtgggggca

SEQ ID NO: 26367 - DNA, 25 bp, Artificial sequence
  synthetic polynucleotide sequence
gaccagaggagtcaagaaaccaaga

SEQ ID NO: 26368 - DNA, 25 bp, Artificial sequence
  synthetic polynucleotide sequence
aatagaagggacaggtggctacaga

SEQ ID NO: 26369 - DNA, 21 bp, Artificial sequence
  synthetic polynucleotide sequence
tgctgcccagggaccaaggaa

SEQ ID NO: 26370 - DNA, 21 bp, Artificial sequence
  synthetic polynucleotide sequence
tgatgtcactgcagaccctga

SEQ ID NO: 26371 - DNA, 21 bp, Artificial sequence
  synthetic polynucleotide sequence
atcctaaccgcctggatccca

SEQ ID NO: 26372 - DNA, 18 bp, Artificial sequence
  synthetic polynucleotide sequence
cactcctggcgctgggga

SEQ ID NO: 26373 - DNA, 20 bp, Artificial sequence
  synthetic polynucleotide sequence
tggagacactgcgccaggaa

SEQ ID NO: 26374 - DNA, 21 bp, Artificial sequence
  synthetic polynucleotide sequence
tgcaggcggccaatgagctga

SEQ ID NO: 26375 - DNA, 20 bp, Artificial sequence
  synthetic polynucleotide sequence
gcttctagaggccacccaca

SEQ ID NO: 26376 - DNA, 25 bp, Artificial sequence
  synthetic polynucleotide sequence
caaagcatgagaagaactcagcgca

SEQ ID NO: 26377 - DNA, 21 bp, Artificial sequence
  synthetic polynucleotide sequence
cctcctgccactgctgagcaa

SEQ ID NO: 26378 - DNA, 20 bp, Artificial sequence
  synthetic polynucleotide sequence
acggccatagtgtgggagga

SEQ ID NO: 26379 - DNA, 20 bp, Artificial sequence
  synthetic polynucleotide sequence
gagcctccggcaagaagcga

SEQ ID NO: 26380 - DNA, 20 bp, Artificial sequence
  synthetic polynucleotide sequence
gagactctgcaggcggtcaa

SEQ ID NO: 26381 - DNA, 21 bp, Artificial sequence
  synthetic polynucleotide sequence
gtggagagagaacgatgccca

SEQ ID NO: 26382 - DNA, 19 bp, Artificial sequence
  synthetic polynucleotide sequence
cacttgagcagcgccccca

SEQ ID NO: 26383 - DNA, 18 bp, Artificial sequence
  synthetic polynucleotide sequence
gaccccaccttgtgcaca

SEQ ID NO: 26384 - DNA, 18 bp, Artificial sequence
  synthetic polynucleotide sequence
gaagcgctcccaggcaca

SEQ ID NO: 26385 - DNA, 20 bp, Artificial sequence
  synthetic polynucleotide sequence
gtggcgaggttcctggagca

SEQ ID NO: 26386 - DNA, 18 bp, Artificial sequence
  synthetic polynucleotide sequence
gccaggctgtctccgcga

SEQ ID NO: 26387 - DNA, 20 bp, Artificial sequence
  synthetic polynucleotide sequence
ggctctagcccgtcggagga

SEQ ID NO: 26388 - DNA, 20 bp, Artificial sequence
  synthetic polynucleotide sequence
ggctgaggcagtagccggca

SEQ ID NO: 26389 - DNA, 23 bp, Artificial sequence
  synthetic polynucleotide sequence
cataagagctcagagagtggcaa

SEQ ID NO: 26390 - DNA, 21 bp, Artificial sequence
  synthetic polynucleotide sequence
acatactgcagcagaggggca

SEQ ID NO: 26391 - DNA, 18 bp, Artificial sequence
  synthetic polynucleotide sequence
gcagtccagcaacagcca

SEQ ID NO: 26392 - DNA, 20 bp, Artificial sequence
  synthetic polynucleotide sequence
caaggtgaggtgtggaggca

SEQ ID NO: 26393 - DNA, 19 bp, Artificial sequence
  synthetic polynucleotide sequence
ctcaggcccagcaaggcca

SEQ ID NO: 26394 - DNA, 20 bp, Artificial sequence
  synthetic polynucleotide sequence
gggcaggaacacatcgtcca

SEQ ID NO: 26395 - DNA, 20 bp, Artificial sequence
  synthetic polynucleotide sequence
cctccatccgaagagcccga

SEQ ID NO: 26396 - DNA, 19 bp, Artificial sequence
  synthetic polynucleotide sequence
gtttccgagggcgcctgga

SEQ ID NO: 26397 - DNA, 21 bp, Artificial sequence
  synthetic polynucleotide sequence
aaccccaccgagtcagacaca

SEQ ID NO: 26398 - DNA, 19 bp, Artificial sequence
  synthetic polynucleotide sequence
gtcggccttggaggtcgca

SEQ ID NO: 26399 - DNA, 21 bp, Artificial sequence
  synthetic polynucleotide sequence
tccacatcctggtccggagca

SEQ ID NO: 26400 - DNA, 20 bp, Artificial sequence
  synthetic polynucleotide sequence
ctatgccctccagcagccga

SEQ ID NO: 26401 - DNA, 18 bp, Artificial sequence
  synthetic polynucleotide sequence
gaagcccaagcgcaggaa

SEQ ID NO: 26402 - DNA, 20 bp, Artificial sequence
  synthetic polynucleotide sequence
cgtacccaggtgctacagca

SEQ ID NO: 26403 - DNA, 21 bp, Artificial sequence
  synthetic polynucleotide sequence
ggcagttaccaggcagtgaca

SEQ ID NO: 26404 - DNA, 21 bp, Artificial sequence
  synthetic polynucleotide sequence
caagttgctcccgaagaccca

SEQ ID NO: 26405 - DNA, 22 bp, Artificial sequence
  synthetic polynucleotide sequence
tctacctggaaaagtggctgga

SEQ ID NO: 26406 - DNA, 21 bp, Artificial sequence
  synthetic polynucleotide sequence
tgttgcgcacatccatccaga

SEQ ID NO: 26407 - DNA, 20 bp, Artificial sequence
  synthetic polynucleotide sequence
aggtggtggcactccacaga

SEQ ID NO: 26408 - DNA, 20 bp, Artificial sequence
  synthetic polynucleotide sequence
ggctgcatatggcaccacca

SEQ ID NO: 26409 - DNA, 18 bp, Artificial sequence
  synthetic polynucleotide sequence
ccggaaccgcatcgagga

SEQ ID NO: 26410 - DNA, 19 bp, Artificial sequence
  synthetic polynucleotide sequence
ggcagggctccatctgaca

SEQ ID NO: 26411 - DNA, 20 bp, Artificial sequence
  synthetic polynucleotide sequence
ccaccaaatcaagcaaggga

SEQ ID NO: 26412 - DNA, 20 bp, Artificial sequence
  synthetic polynucleotide sequence
cacaagaaggttgagcccga

SEQ ID NO: 26413 - DNA, 20 bp, Artificial sequence
  synthetic polynucleotide sequence
gaccaagcagtggtgtgaca

SEQ ID NO: 26414 - DNA, 18 bp, Artificial sequence
  synthetic polynucleotide sequence
gggctgcgtgcacgtcca

SEQ ID NO: 26415 - DNA, 22 bp, Artificial sequence
  synthetic polynucleotide sequence
gatagtgaaggtggaggaggaa

SEQ ID NO: 26416 - DNA, 19 bp, Artificial sequence
  synthetic polynucleotide sequence
tcagccgctgtgtgagcca

SEQ ID NO: 26417 - DNA, 23 bp, Artificial sequence
  synthetic polynucleotide sequence
gctgtaaccatccagaaacggca

SEQ ID NO: 26418 - DNA, 22 bp, Artificial sequence
  synthetic polynucleotide sequence
taagggagtacacagaaaggca

SEQ ID NO: 26419 - DNA, 25 bp, Artificial sequence
  synthetic polynucleotide sequence
agcggaggtaaagaaccactcagca

SEQ ID NO: 26420 - DNA, 25 bp, Artificial sequence
  synthetic polynucleotide sequence
gtaggaaacctctgacaacgacaga

SEQ ID NO: 26421 - DNA, 20 bp, Artificial sequence
  synthetic polynucleotide sequence
agggaccacagagaagggga

SEQ ID NO: 26422 - DNA, 20 bp, Artificial sequence
  synthetic polynucleotide sequence
aagctacggctccatcgcca

SEQ ID NO: 26423 - DNA, 23 bp, Artificial sequence
  synthetic polynucleotide sequence
gtggggagctacaacacagaaga

SEQ ID NO: 26424 - DNA, 20 bp, Artificial sequence
  synthetic polynucleotide sequence
ggcactgggggcatcacaga

SEQ ID NO: 26425 - DNA, 20 bp, Artificial sequence
  synthetic polynucleotide sequence
gcatacctaacagccagcca

SEQ ID NO: 26426 - DNA, 18 bp, Artificial sequence
  synthetic polynucleotide sequence
gtacatgggcaggccaga

SEQ ID NO: 26427 - DNA, 21 bp, Artificial sequence
  synthetic polynucleotide sequence
ccagagacagcagcttctcga

SEQ ID NO: 26428 - DNA, 18 bp, Artificial sequence
  synthetic polynucleotide sequence
gctgcatctgccgggcca

SEQ ID NO: 26429 - DNA, 22 bp, Artificial sequence
  synthetic polynucleotide sequence
aggagggaatgcaagaagccca

SEQ ID NO: 26430 - DNA, 20 bp, Artificial sequence
  synthetic polynucleotide sequence
tggcacacactgctcctcca

SEQ ID NO: 26431 - DNA, 20 bp, Artificial sequence
  synthetic polynucleotide sequence
acttggcaggtggcagacga

SEQ ID NO: 26432 - DNA, 22 bp, Artificial sequence
  synthetic polynucleotide sequence
tgcagaaatggggcctcagaga

SEQ ID NO: 26433 - DNA, 21 bp, Artificial sequence
  synthetic polynucleotide sequence
ccaaggctggcttgggagcaa

SEQ ID NO: 26434 - DNA, 20 bp, Artificial sequence
  synthetic polynucleotide sequence
agtgaagttggccgcctcga

SEQ ID NO: 26435 - DNA, 21 bp, Artificial sequence
  synthetic polynucleotide sequence
ccaaggctggcttgggagcaa

SEQ ID NO: 26436 - DNA, 20 bp, Artificial sequence
  synthetic polynucleotide sequence
tagtggagtgcgaaatggga

SEQ ID NO: 26437 - DNA, 19 bp, Artificial sequence
  synthetic polynucleotide sequence
ccagagggttcggacgaca

SEQ ID NO: 26438 - DNA, 18 bp, Artificial sequence
  synthetic polynucleotide sequence
agtcagcttgggccagca

SEQ ID NO: 26439 - DNA, 21 bp, Artificial sequence
  synthetic polynucleotide sequence
caaacctgtcgccacagagca

SEQ ID NO: 26440 - DNA, 21 bp, Artificial sequence
  synthetic polynucleotide sequence
ttctcggtaagtcctgcccca

SEQ ID NO: 26441 - DNA, 20 bp, Artificial sequence
  synthetic polynucleotide sequence
gaccctgactactgcgagga

SEQ ID NO: 26442 - DNA, 18 bp, Artificial sequence
  synthetic polynucleotide sequence
gcggcaccaggatggaga

SEQ ID NO: 26443 - DNA, 21 bp, Artificial sequence
  synthetic polynucleotide sequence
agtggaaatgccctcacagca

SEQ ID NO: 26444 - DNA, 20 bp, Artificial sequence
  synthetic polynucleotide sequence
gcggcgtggacatgtagcca

SEQ ID NO: 26445 - DNA, 21 bp, Artificial sequence
  synthetic polynucleotide sequence
gcgtcagctgcacagaggaga

SEQ ID NO: 26446 - DNA, 21 bp, Artificial sequence
  synthetic polynucleotide sequence
ctggcgcaaacagcttgtgga

SEQ ID NO: 26447 - DNA, 19 bp, Artificial sequence
  synthetic polynucleotide sequence
ggcccaagtccaccccaga

SEQ ID NO: 26448 - DNA, 21 bp, Artificial sequence
  synthetic polynucleotide sequence
tgtctcaggcagctccatcca

SEQ ID NO: 26449 - DNA, 18 bp, Artificial sequence
  synthetic polynucleotide sequence
gaaaggccagccccagga

SEQ ID NO: 26450 - DNA, 18 bp, Artificial sequence
  synthetic polynucleotide sequence
tcacggtcaggccgcaca

SEQ ID NO: 26451 - DNA, 21 bp, Artificial sequence
  synthetic polynucleotide sequence
ctatggtccacaaaggcggaa

SEQ ID NO: 26452 - DNA, 20 bp, Artificial sequence
  synthetic polynucleotide sequence
ctttcctgatcccaccacga

SEQ ID NO: 26453 - DNA, 20 bp, Artificial sequence
  synthetic polynucleotide sequence
gatcgcccaggacctcagca

SEQ ID NO: 26454 - DNA, 20 bp, Artificial sequence
  synthetic polynucleotide sequence
caggtagagctctcccgcga

SEQ ID NO: 26455 - DNA, 20 bp, Artificial sequence
  synthetic polynucleotide sequence
ctcgacagaatggtgaccga

SEQ ID NO: 26456 - DNA, 21 bp, Artificial sequence
  synthetic polynucleotide sequence
gattgtctgggcaaggactga

SEQ ID NO: 26457 - DNA, 21 bp, Artificial sequence
  synthetic polynucleotide sequence
gaagggttacagcgtgcccaa

SEQ ID NO: 26458 - DNA, 20 bp, Artificial sequence
  synthetic polynucleotide sequence
ggcagcaggcatgtccgaga

SEQ ID NO: 26459 - DNA, 20 bp, Artificial sequence
  synthetic polynucleotide sequence
agacctcaccacaggccaga

SEQ ID NO: 26460 - DNA, 20 bp, Artificial sequence
  synthetic polynucleotide sequence
aggtgcagatgcagctgcga

SEQ ID NO: 26461 - DNA, 21 bp, Artificial sequence
  synthetic polynucleotide sequence
aaccaagagagcctcagccaa

SEQ ID NO: 26462 - DNA, 19 bp, Artificial sequence
  synthetic polynucleotide sequence
tgggccctaggtagaacca

SEQ ID NO: 26463 - DNA, 23 bp, Artificial sequence
  synthetic polynucleotide sequence
gaaggaagaaattaaggcaccga

SEQ ID NO: 26464 - DNA, 19 bp, Artificial sequence
  synthetic polynucleotide sequence
gcaataagggaaggcgaca

SEQ ID NO: 26465 - DNA, 20 bp, Artificial sequence
  synthetic polynucleotide sequence
agctcctgggacctacgaga

SEQ ID NO: 26466 - DNA, 21 bp, Artificial sequence
  synthetic polynucleotide sequence
gtctggacttgcagccactca

SEQ ID NO: 26467 - DNA, 21 bp, Artificial sequence
  synthetic polynucleotide sequence
ctcatggtgcccagagaggaa

SEQ ID NO: 26468 - DNA, 22 bp, Artificial sequence
  synthetic polynucleotide sequence
acaaaaagaggctgggacctga

SEQ ID NO: 26469 - DNA, 21 bp, Artificial sequence
  synthetic polynucleotide sequence
agcccttgacacggacagcga

SEQ ID NO: 26470 - DNA, 18 bp, Artificial sequence
  synthetic polynucleotide sequence
ggaggacgtggcctggca

SEQ ID NO: 26471 - DNA, 18 bp, Artificial sequence
  synthetic polynucleotide sequence
gcaccgggacctggccaa

SEQ ID NO: 26472 - DNA, 21 bp, Artificial sequence
  synthetic polynucleotide sequence
atcactgtcagagtcgaggga

SEQ ID NO: 26473 - DNA, 19 bp, Artificial sequence
  synthetic polynucleotide sequence
gcgagactggctgggagga

SEQ ID NO: 26474 - DNA, 20 bp, Artificial sequence
  synthetic polynucleotide sequence
cagagcccagacccttggga

SEQ ID NO: 26475 - DNA, 21 bp, Artificial sequence
  synthetic polynucleotide sequence
tggtcagcctgcatatgccca

SEQ ID NO: 26476 - DNA, 20 bp, Artificial sequence
  synthetic polynucleotide sequence
atgtagccttccgccagcga

SEQ ID NO: 26477 - DNA, 21 bp, Artificial sequence
  synthetic polynucleotide sequence
acgggccacctttgaccccaa

SEQ ID NO: 26478 - DNA, 20 bp, Artificial sequence
  synthetic polynucleotide sequence
aacagccgcagcaacagcca

SEQ ID NO: 26479 - DNA, 22 bp, Artificial sequence
  synthetic polynucleotide sequence
aggcagggaaagataggcagga

SEQ ID NO: 26480 - DNA, 20 bp, Artificial sequence
  synthetic polynucleotide sequence
accgcttccagagcgccaga

SEQ ID NO: 26481 - DNA, 20 bp, Artificial sequence
  synthetic polynucleotide sequence
caggaactctgcctggcgca

SEQ ID NO: 26482 - DNA, 20 bp, Artificial sequence
  synthetic polynucleotide sequence
gagaccccgagctgtcgcta

SEQ ID NO: 26483 - DNA, 20 bp, Artificial sequence
  synthetic polynucleotide sequence
catccccgcaaccccagaga

SEQ ID NO: 26484 - DNA, 25 bp, Artificial sequence
  synthetic polynucleotide sequence
aaggcaggatgagagggattagaca

SEQ ID NO: 26485 - DNA, 19 bp, Artificial sequence
  synthetic polynucleotide sequence
gggggggggttagacggga

SEQ ID NO: 26486 - DNA, 19 bp, Artificial sequence
  synthetic polynucleotide sequence
gcttgaggcgggtcccgga

SEQ ID NO: 26487 - DNA, 22 bp, Artificial sequence
  synthetic polynucleotide sequence
aaaagacggccgacctaagtca

SEQ ID NO: 26488 - DNA, 20 bp, Artificial sequence
  synthetic polynucleotide sequence
ctgcaaagccctgcatgcca

SEQ ID NO: 26489 - DNA, 22 bp, Artificial sequence
  synthetic polynucleotide sequence
aatccaagtgccaaagaggcca

SEQ ID NO: 26490 - DNA, 20 bp, Artificial sequence
  synthetic polynucleotide sequence
ctccagcttcagcagcccca

SEQ ID NO: 26491 - DNA, 18 bp, Artificial sequence
  synthetic polynucleotide sequence
agcgttctcccgcggcca

SEQ ID NO: 26492 - DNA, 18 bp, Artificial sequence
  synthetic polynucleotide sequence
cgggagtctccggcctca

SEQ ID NO: 26493 - DNA, 22 bp, Artificial sequence
  synthetic polynucleotide sequence
aacccagccaaggaggtttcca

SEQ ID NO: 26494 - DNA, 19 bp, Artificial sequence
  synthetic polynucleotide sequence
cttccagggcacctccgga

SEQ ID NO: 26495 - DNA, 20 bp, Artificial sequence
  synthetic polynucleotide sequence
caaccggagggagagcagca

SEQ ID NO: 26496 - DNA, 20 bp, Artificial sequence
  synthetic polynucleotide sequence
tggtcagggagtgtggagga

SEQ ID NO: 26497 - DNA, 19 bp, Artificial sequence
  synthetic polynucleotide sequence
gcagcacctgggccaacga

SEQ ID NO: 26498 - DNA, 19 bp, Artificial sequence
  synthetic polynucleotide sequence
ggtgatcagggggcgtgga

SEQ ID NO: 26499 - DNA, 21 bp, Artificial sequence
  synthetic polynucleotide sequence
gaggcacagtagcctgatgga

SEQ ID NO: 26500 - DNA, 22 bp, Artificial sequence
  synthetic polynucleotide sequence
accaccaaatcctgcactccaa

SEQ ID NO: 26501 - DNA, 20 bp, Artificial sequence
  synthetic polynucleotide sequence
gagagcagcacctgggccaa

SEQ ID NO: 26502 - DNA, 19 bp, Artificial sequence
  synthetic polynucleotide sequence
ggtcagggggtgtggagga

SEQ ID NO: 26503 - DNA, 19 bp, Artificial sequence
  synthetic polynucleotide sequence
ggacacccaaggcagccca

SEQ ID NO: 26504 - DNA, 21 bp, Artificial sequence
  synthetic polynucleotide sequence
tcgggagggctaggctacaca

SEQ ID NO: 26505 - DNA, 19 bp, Artificial sequence
  synthetic polynucleotide sequence
gctgtcgcactgcgggaca

SEQ ID NO: 26506 - DNA, 21 bp, Artificial sequence
  synthetic polynucleotide sequence
gattttgcccccgaagcagca

SEQ ID NO: 26507 - DNA, 23 bp, Artificial sequence
  synthetic polynucleotide sequence
ctaaaagctgcaaaggaccctga

SEQ ID NO: 26508 - DNA, 22 bp, Artificial sequence
  synthetic polynucleotide sequence
acaaccttcacagcactggaga

SEQ ID NO: 26509 - DNA, 20 bp, Artificial sequence
  synthetic polynucleotide sequence
tggtgggccaagaacagcca

SEQ ID NO: 26510 - DNA, 21 bp, Artificial sequence
  synthetic polynucleotide sequence
tgtcgcaacagcaaggtggca

SEQ ID NO: 26511 - DNA, 19 bp, Artificial sequence
  synthetic polynucleotide sequence
gcccaagagtcaggggaca

SEQ ID NO: 26512 - DNA, 18 bp, Artificial sequence
  synthetic polynucleotide sequence
ggaagggccgtggtagca

SEQ ID NO: 26513 - DNA, 21 bp, Artificial sequence
  synthetic polynucleotide sequence
tcaccgagacagtgaccaaca

SEQ ID NO: 26514 - DNA, 20 bp, Artificial sequence
  synthetic polynucleotide sequence
gggccgtggtagcaggtgca

SEQ ID NO: 26515 - DNA, 21 bp, Artificial sequence
  synthetic polynucleotide sequence
ccagccacctccagaatgaga

SEQ ID NO: 26516 - DNA, 21 bp, Artificial sequence
  synthetic polynucleotide sequence
tcactcccgggaatgaagcca

SEQ ID NO: 26517 - DNA, 21 bp, Artificial sequence
  synthetic polynucleotide sequence
cccttcaggcccagtctcaga

SEQ ID NO: 26518 - DNA, 21 bp, Artificial sequence
  synthetic polynucleotide sequence
cccaggcagcaaacgtaggca

SEQ ID NO: 26519 - DNA, 20 bp, Artificial sequence
  synthetic polynucleotide sequence
gtgcaggacctcctgaagga

SEQ ID NO: 26520 - DNA, 20 bp, Artificial sequence
  synthetic polynucleotide sequence
gagataggcatcgggtgaca

SEQ ID NO: 26521 - DNA, 18 bp, Artificial sequence
  synthetic polynucleotide sequence
ggacacactcacggagca

SEQ ID NO: 26522 - DNA, 20 bp, Artificial sequence
  synthetic polynucleotide sequence
aggaaacacacacaacccca

SEQ ID NO: 26523 - DNA, 22 bp, Artificial sequence
  synthetic polynucleotide sequence
atgaggaccaatggattggcga

SEQ ID NO: 26524 - DNA, 19 bp, Artificial sequence
  synthetic polynucleotide sequence
ctgaggctgcctcggagga

SEQ ID NO: 26525 - DNA, 20 bp, Artificial sequence
  synthetic polynucleotide sequence
tacgacgacccagccaccaa

SEQ ID NO: 26526 - DNA, 18 bp, Artificial sequence
  synthetic polynucleotide sequence
gcacacccttggccccga

SEQ ID NO: 26527 - DNA, 21 bp, Artificial sequence
  synthetic polynucleotide sequence
tgacctatgacgacggaagca

SEQ ID NO: 26528 - DNA, 21 bp, Artificial sequence
  synthetic polynucleotide sequence
tggatctctgcaggccagcca

SEQ ID NO: 26529 - DNA, 21 bp, Artificial sequence
  synthetic polynucleotide sequence
tggggaggagatgtggcacca

SEQ ID NO: 26530 - DNA, 19 bp, Artificial sequence
  synthetic polynucleotide sequence
taatgcccttcccaccaca

SEQ ID NO: 26531 - DNA, 21 bp, Artificial sequence
  synthetic polynucleotide sequence
gctgtgctgggacagaaggca

SEQ ID NO: 26532 - DNA, 20 bp, Artificial sequence
  synthetic polynucleotide sequence
atcgtcgtaggaggccacca

SEQ ID NO: 26533 - DNA, 19 bp, Artificial sequence
  synthetic polynucleotide sequence
cgaggacctgctcggcgaa

SEQ ID NO: 26534 - DNA, 20 bp, Artificial sequence
  synthetic polynucleotide sequence
ctccccacggccattctcca

SEQ ID NO: 26535 - DNA, 20 bp, Artificial sequence
  synthetic polynucleotide sequence
caggtaacagccctgcacca

SEQ ID NO: 26536 - DNA, 19 bp, Artificial sequence
  synthetic polynucleotide sequence
ggcacctaggagggggcca

SEQ ID NO: 26537 - DNA, 21 bp, Artificial sequence
  synthetic polynucleotide sequence
cggtccaggagttcaccagga

SEQ ID NO: 26538 - DNA, 21 bp, Artificial sequence
  synthetic polynucleotide sequence
atctgcagggcttccagctca

SEQ ID NO: 26539 - DNA, 21 bp, Artificial sequence
  synthetic polynucleotide sequence
gccagccccctatgtagcaga

SEQ ID NO: 26540 - DNA, 19 bp, Artificial sequence
  synthetic polynucleotide sequence
tgcagggtagccaagtgga

SEQ ID NO: 26541 - DNA, 18 bp, Artificial sequence
  synthetic polynucleotide sequence
ggactcggtgagacgcca

SEQ ID NO: 26542 - DNA, 19 bp, Artificial sequence
  synthetic polynucleotide sequence
gggtggaaggcctcagaca

SEQ ID NO: 26543 - DNA, 18 bp, Artificial sequence
  synthetic polynucleotide sequence
aggcccacagaccaggaa

SEQ ID NO: 26544 - DNA, 18 bp, Artificial sequence
  synthetic polynucleotide sequence
cgttcaccaccctgcgaa

SEQ ID NO: 26545 - DNA, 25 bp, Artificial sequence
  synthetic polynucleotide sequence
gagacttccaggaagcaatgacaca

SEQ ID NO: 26546 - DNA, 22 bp, Artificial sequence
  synthetic polynucleotide sequence
gcagtacttcagaaggccacca

SEQ ID NO: 26547 - DNA, 21 bp, Artificial sequence
  synthetic polynucleotide sequence
gagcctcccaagattcgagca

SEQ ID NO: 26548 - DNA, 21 bp, Artificial sequence
  synthetic polynucleotide sequence
tcatcagctcccaggtctcca

SEQ ID NO: 26549 - DNA, 20 bp, Artificial sequence
  synthetic polynucleotide sequence
cggagcctaccaagaccgga

SEQ ID NO: 26550 - DNA, 21 bp, Artificial sequence
  synthetic polynucleotide sequence
aactcctaggtctccagccca

SEQ ID NO: 26551 - DNA, 21 bp, Artificial sequence
  synthetic polynucleotide sequence
gacaactgacgaacccacgga

SEQ ID NO: 26552 - DNA, 20 bp, Artificial sequence
  synthetic polynucleotide sequence
ggctgtgggcggagatggga

SEQ ID NO: 26553 - DNA, 19 bp, Artificial sequence
  synthetic polynucleotide sequence
gctccccaactggccccaa

SEQ ID NO: 26554 - DNA, 18 bp, Artificial sequence
  synthetic polynucleotide sequence
gggcctccacgtcctcca

SEQ ID NO: 26555 - DNA, 21 bp, Artificial sequence
  synthetic polynucleotide sequence
ggcccagagatccgagatgca

SEQ ID NO: 26556 - DNA, 22 bp, Artificial sequence
  synthetic polynucleotide sequence
tgtagggtggacaagtcagaga

SEQ ID NO: 26557 - DNA, 22 bp, Artificial sequence
  synthetic polynucleotide sequence
atgcccagcctacagagtctga

SEQ ID NO: 26558 - DNA, 21 bp, Artificial sequence
  synthetic polynucleotide sequence
tagtggaacaactgcacccca

SEQ ID NO: 26559 - DNA, 21 bp, Artificial sequence
  synthetic polynucleotide sequence
agtgggaagccaagcaggaga

SEQ ID NO: 26560 - DNA, 18 bp, Artificial sequence
  synthetic polynucleotide sequence
ctgctccacccctgcgga

SEQ ID NO: 26561 - DNA, 21 bp, Artificial sequence
  synthetic polynucleotide sequence
gcagcgcgagaaagtgaagga

SEQ ID NO: 26562 - DNA, 21 bp, Artificial sequence
  synthetic polynucleotide sequence
aggtgtggtagtgcggcagga

SEQ ID NO: 26563 - DNA, 21 bp, Artificial sequence
  synthetic polynucleotide sequence
gcgtgctcagtgggaagagga

SEQ ID NO: 26564 - DNA, 21 bp, Artificial sequence
  synthetic polynucleotide sequence
gatgctgtaagctcacgccga

SEQ ID NO: 26565 - DNA, 21 bp, Artificial sequence
  synthetic polynucleotide sequence
tgtcctgtgaggagtcagaca

SEQ ID NO: 26566 - DNA, 21 bp, Artificial sequence
  synthetic polynucleotide sequence
caatgtccaactcgccgtcca

SEQ ID NO: 26567 - DNA, 19 bp, Artificial sequence
  synthetic polynucleotide sequence
ctctcccgcatcctcccca

SEQ ID NO: 26568 - DNA, 18 bp, Artificial sequence
  synthetic polynucleotide sequence
tggcgccgcttgacccca

SEQ ID NO: 26569 - DNA, 19 bp, Artificial sequence
  synthetic polynucleotide sequence
gctgcatcttcacggcaga

SEQ ID NO: 26570 - DNA, 19 bp, Artificial sequence
  synthetic polynucleotide sequence
ggaagagaaggatccggca

SEQ ID NO: 26571 - DNA, 20 bp, Artificial sequence
  synthetic polynucleotide sequence
gttgatggcagaggtcagca

SEQ ID NO: 26572 - DNA, 21 bp, Artificial sequence
  synthetic polynucleotide sequence
taggcccagtacaggtaggga

SEQ ID NO: 26573 - DNA, 21 bp, Artificial sequence
  synthetic polynucleotide sequence
tctccttccagcatccacaca

SEQ ID NO: 26574 - DNA, 18 bp, Artificial sequence
  synthetic polynucleotide sequence
gctgggcctggaagcgga

SEQ ID NO: 26575 - DNA, 21 bp, Artificial sequence
  synthetic polynucleotide sequence
tagatgcaagggctggaccca

SEQ ID NO: 26576 - DNA, 22 bp, Artificial sequence
  synthetic polynucleotide sequence
aacaaggagattgagctgggga

SEQ ID NO: 26577 - DNA, 21 bp, Artificial sequence
  synthetic polynucleotide sequence
ccaccaagcccaacaatcaga

SEQ ID NO: 26578 - DNA, 21 bp, Artificial sequence
  synthetic polynucleotide sequence
ctccatcagccaccgtcaaga

SEQ ID NO: 26579 - DNA, 19 bp, Artificial sequence
  synthetic polynucleotide sequence
gcgcactgctacggggcta

SEQ ID NO: 26580 - DNA, 21 bp, Artificial sequence
  synthetic polynucleotide sequence
tcttgaggtggctgagcacca

SEQ ID NO: 26581 - DNA, 20 bp, Artificial sequence
  synthetic polynucleotide sequence
gagggctctcggtcagaaga

SEQ ID NO: 26582 - DNA, 23 bp, Artificial sequence
  synthetic polynucleotide sequence
gcacccagacacaggcatacaca

SEQ ID NO: 26583 - DNA, 19 bp, Artificial sequence
  synthetic polynucleotide sequence
ggagcagcaggcacaggga

SEQ ID NO: 26584 - DNA, 21 bp, Artificial sequence
  synthetic polynucleotide sequence
ggaaccggaactggtggtcca

SEQ ID NO: 26585 - DNA, 22 bp, Artificial sequence
  synthetic polynucleotide sequence
tcatctccaccttgcaaagcga

SEQ ID NO: 26586 - DNA, 19 bp, Artificial sequence
  synthetic polynucleotide sequence
cagatgcggaccggtggga

SEQ ID NO: 26587 - DNA, 21 bp, Artificial sequence
  synthetic polynucleotide sequence
gagaaagtccgcctgcagaga

SEQ ID NO: 26588 - DNA, 21 bp, Artificial sequence
  synthetic polynucleotide sequence
ccgtggcaagcttcaggtgga

SEQ ID NO: 26589 - DNA, 21 bp, Artificial sequence
  synthetic polynucleotide sequence
atgcggagaacatgagcctga

SEQ ID NO: 26590 - DNA, 21 bp, Artificial sequence
  synthetic polynucleotide sequence
catacatgtacggggtcagga

SEQ ID NO: 26591 - DNA, 21 bp, Artificial sequence
  synthetic polynucleotide sequence
ggctccaacgctacctccaga

SEQ ID NO: 26592 - DNA, 21 bp, Artificial sequence
  synthetic polynucleotide sequence
ccagaagcaataggtccggga

SEQ ID NO: 26593 - DNA, 21 bp, Artificial sequence
  synthetic polynucleotide sequence
aggaacacggccaccaaggca

SEQ ID NO: 26594 - DNA, 18 bp, Artificial sequence
  synthetic polynucleotide sequence
cgcatccggccactcgga

SEQ ID NO: 26595 - DNA, 21 bp, Artificial sequence
  synthetic polynucleotide sequence
aaccagttgaggagcagcaga

SEQ ID NO: 26596 - DNA, 21 bp, Artificial sequence
  synthetic polynucleotide sequence
tgagtagtgagaggggctgca

SEQ ID NO: 26597 - DNA, 20 bp, Artificial sequence
  synthetic polynucleotide sequence
ggctgagcagaccagtggca

SEQ ID NO: 26598 - DNA, 21 bp, Artificial sequence
  synthetic polynucleotide sequence
gattggagatgccactggaga

SEQ ID NO: 26599 - DNA, 21 bp, Artificial sequence
  synthetic polynucleotide sequence
ccctcctaccaacgcagtgga

SEQ ID NO: 26600 - DNA, 22 bp, Artificial sequence
  synthetic polynucleotide sequence
tatctctggcaagttgccccaa

SEQ ID NO: 26601 - DNA, 21 bp, Artificial sequence
  synthetic polynucleotide sequence
gacatccctcctaccaacgca

SEQ ID NO: 26602 - DNA, 22 bp, Artificial sequence
  synthetic polynucleotide sequence
tatctctggcaagttgccccaa

SEQ ID NO: 26603 - DNA, 21 bp, Artificial sequence
  synthetic polynucleotide sequence
gacatccctcctaccaacgca

SEQ ID NO: 26604 - DNA, 21 bp, Artificial sequence
  synthetic polynucleotide sequence
gcaagttgccccgaagtagga

SEQ ID NO: 26605 - DNA, 21 bp, Artificial sequence
  synthetic polynucleotide sequence
ggccagcagctctgcaaggaa

SEQ ID NO: 26606 - DNA, 20 bp, Artificial sequence
  synthetic polynucleotide sequence
gacaaggcttgggcgtccca

SEQ ID NO: 26607 - DNA, 21 bp, Artificial sequence
  synthetic polynucleotide sequence
caacgtggccaagctcaccaa

SEQ ID NO: 26608 - DNA, 20 bp, Artificial sequence
  synthetic polynucleotide sequence
gcgccagtgcagcgtctgca

SEQ ID NO: 26609 - DNA, 21 bp, Artificial sequence
  synthetic polynucleotide sequence
agtggaggatgagggtggaca

SEQ ID NO: 26610 - DNA, 20 bp, Artificial sequence
  synthetic polynucleotide sequence
tccacatgaggacctgggca

SEQ ID NO: 26611 - DNA, 20 bp, Artificial sequence
  synthetic polynucleotide sequence
aagaccctggagatgcgcca

SEQ ID NO: 26612 - DNA, 21 bp, Artificial sequence
  synthetic polynucleotide sequence
ttcaagtgctggagcccctca

SEQ ID NO: 26613 - DNA, 21 bp, Artificial sequence
  synthetic polynucleotide sequence
tgaacaaccaggcgcgtacca

SEQ ID NO: 26614 - DNA, 21 bp, Artificial sequence
  synthetic polynucleotide sequence
cagtaacttcctggcgagcga

SEQ ID NO: 26615 - DNA, 21 bp, Artificial sequence
  synthetic polynucleotide sequence
gcatcacccggactagccaga

SEQ ID NO: 26616 - DNA, 21 bp, Artificial sequence
  synthetic polynucleotide sequence
aggtggcggaactcctcgtca

SEQ ID NO: 26617 - DNA, 22 bp, Artificial sequence
  synthetic polynucleotide sequence
ttcagaagctacaccggactca

SEQ ID NO: 26618 - DNA, 22 bp, Artificial sequence
  synthetic polynucleotide sequence
ctaaagaggaacgaagccgaga

SEQ ID NO: 26619 - DNA, 19 bp, Artificial sequence
  synthetic polynucleotide sequence
ccagatgagcggcggcaga

SEQ ID NO: 26620 - DNA, 21 bp, Artificial sequence
  synthetic polynucleotide sequence
cgtttctcatccccagaccca

SEQ ID NO: 26621 - DNA, 22 bp, Artificial sequence
  synthetic polynucleotide sequence
acaaaccagcatcaccacagca

SEQ ID NO: 26622 - DNA, 21 bp, Artificial sequence
  synthetic polynucleotide sequence
gcttgccacagagccttggga

SEQ ID NO: 26623 - DNA, 18 bp, Artificial sequence
  synthetic polynucleotide sequence
cagcggggcactggagga

SEQ ID NO: 26624 - DNA, 21 bp, Artificial sequence
  synthetic polynucleotide sequence
tgaatgtagcatccccaccga

SEQ ID NO: 26625 - DNA, 21 bp, Artificial sequence
  synthetic polynucleotide sequence
agttcctcccatgtggacaga

SEQ ID NO: 26626 - DNA, 21 bp, Artificial sequence
  synthetic polynucleotide sequence
gtggaggagtaatggaggcca

SEQ ID NO: 26627 - DNA, 22 bp, Artificial sequence
  synthetic polynucleotide sequence
aagaatctcagagtgcggagca

SEQ ID NO: 26628 - DNA, 20 bp, Artificial sequence
  synthetic polynucleotide sequence
cgcacacagcccggtctcca

SEQ ID NO: 26629 - DNA, 19 bp, Artificial sequence
  synthetic polynucleotide sequence
cgacccacaacagccccga

SEQ ID NO: 26630 - DNA, 20 bp, Artificial sequence
  synthetic polynucleotide sequence
catgctctccatgcggcgca

SEQ ID NO: 26631 - DNA, 22 bp, Artificial sequence
  synthetic polynucleotide sequence
acctgggagagaacaaggtcca

SEQ ID NO: 26632 - DNA, 18 bp, Artificial sequence
  synthetic polynucleotide sequence
ggtcggcgagctcctgga

SEQ ID NO: 26633 - DNA, 20 bp, Artificial sequence
  synthetic polynucleotide sequence
aacaagtgcaagccgggcga

SEQ ID NO: 26634 - DNA, 20 bp, Artificial sequence
  synthetic polynucleotide sequence
aatcacctccagccggtgca

SEQ ID NO: 26635 - DNA, 20 bp, Artificial sequence
  synthetic polynucleotide sequence
cagcagcgctccacttccaa

SEQ ID NO: 26636 - DNA, 20 bp, Artificial sequence
  synthetic polynucleotide sequence
ccgagaggagggtgctcaca

SEQ ID NO: 26637 - DNA, 22 bp, Artificial sequence
  synthetic polynucleotide sequence
ctcacacatgactccaaaggga

SEQ ID NO: 26638 - DNA, 20 bp, Artificial sequence
  synthetic polynucleotide sequence
ggcacccacacgcctagaca

SEQ ID NO: 26639 - DNA, 18 bp, Artificial sequence
  synthetic polynucleotide sequence
tggtcggggtcctgcgga

SEQ ID NO: 26640 - DNA, 21 bp, Artificial sequence
  synthetic polynucleotide sequence
ccatctgatcccagtccagca

SEQ ID NO: 26641 - DNA, 20 bp, Artificial sequence
  synthetic polynucleotide sequence
gcgcatccaggacgagctga

SEQ ID NO: 26642 - DNA, 22 bp, Artificial sequence
  synthetic polynucleotide sequence
tgtacagttggcagagcaagga

SEQ ID NO: 26643 - DNA, 19 bp, Artificial sequence
  synthetic polynucleotide sequence
gggctgcggcagttggaca

SEQ ID NO: 26644 - DNA, 20 bp, Artificial sequence
  synthetic polynucleotide sequence
gaggatgacaggtcctggca

SEQ ID NO: 26645 - DNA, 20 bp, Artificial sequence
  synthetic polynucleotide sequence
cggctacctcacctggcaca

SEQ ID NO: 26646 - DNA, 18 bp, Artificial sequence
  synthetic polynucleotide sequence
aggcccgcgactggagca

SEQ ID NO: 26647 - DNA, 19 bp, Artificial sequence
  synthetic polynucleotide sequence
tcggagactggaaaacgga

SEQ ID NO: 26648 - DNA, 21 bp, Artificial sequence
  synthetic polynucleotide sequence
catagaggacgcttggtggga

SEQ ID NO: 26649 - DNA, 21 bp, Artificial sequence
  synthetic polynucleotide sequence
tctggtgccacaacagaagca

SEQ ID NO: 26650 - DNA, 19 bp, Artificial sequence
  synthetic polynucleotide sequence
tctgcaaaggccatgtgca

SEQ ID NO: 26651 - DNA, 23 bp, Artificial sequence
  synthetic polynucleotide sequence
gaaaaccggaacgctcaaacgaa

SEQ ID NO: 26652 - DNA, 19 bp, Artificial sequence
  synthetic polynucleotide sequence
ttccgcacataggcagcga

SEQ ID NO: 26653 - DNA, 20 bp, Artificial sequence
  synthetic polynucleotide sequence
aggtccagctgagtagggca

SEQ ID NO: 26654 - DNA, 20 bp, Artificial sequence
  synthetic polynucleotide sequence
ctggaagcatgagatgccca

SEQ ID NO: 26655 - DNA, 20 bp, Artificial sequence
  synthetic polynucleotide sequence
agaactatccgggacccaga

SEQ ID NO: 26656 - DNA, 22 bp, Artificial sequence
  synthetic polynucleotide sequence
caatgaggtactgttggcgtga

SEQ ID NO: 26657 - DNA, 21 bp, Artificial sequence
  synthetic polynucleotide sequence
caaccattccgcactgcagca

SEQ ID NO: 26658 - DNA, 18 bp, Artificial sequence
  synthetic polynucleotide sequence
gaggcatgggtccccgga

SEQ ID NO: 26659 - DNA, 20 bp, Artificial sequence
  synthetic polynucleotide sequence
ccgagggggaggaagaggaa

SEQ ID NO: 26660 - DNA, 21 bp, Artificial sequence
  synthetic polynucleotide sequence
cctccgccttgatagccacca

SEQ ID NO: 26661 - DNA, 19 bp, Artificial sequence
  synthetic polynucleotide sequence
cagcgtggctgtccgcaga

SEQ ID NO: 26662 - DNA, 18 bp, Artificial sequence
  synthetic polynucleotide sequence
ggctcctccaggtgggca

SEQ ID NO: 26663 - DNA, 18 bp, Artificial sequence
  synthetic polynucleotide sequence
aggacaaccagccacgga

SEQ ID NO: 26664 - DNA, 22 bp, Artificial sequence
  synthetic polynucleotide sequence
ctcacattcatcacggactgga

SEQ ID NO: 26665 - DNA, 20 bp, Artificial sequence
  synthetic polynucleotide sequence
cttgaagcgcctggaaccga

SEQ ID NO: 26666 - DNA, 20 bp, Artificial sequence
  synthetic polynucleotide sequence
acagctcggagactctcgca

SEQ ID NO: 26667 - DNA, 18 bp, Artificial sequence
  synthetic polynucleotide sequence
cggctccagcggagacca

SEQ ID NO: 26668 - DNA, 21 bp, Artificial sequence
  synthetic polynucleotide sequence
gacagaaggaaagacgggaga

SEQ ID NO: 26669 - DNA, 20 bp, Artificial sequence
  synthetic polynucleotide sequence
ggcgggaggtttggagcaga

SEQ ID NO: 26670 - DNA, 21 bp, Artificial sequence
  synthetic polynucleotide sequence
tgaaactcaacgcagcggcaa

SEQ ID NO: 26671 - DNA, 21 bp, Artificial sequence
  synthetic polynucleotide sequence
ctggctccagacactgaagca

SEQ ID NO: 26672 - DNA, 20 bp, Artificial sequence
  synthetic polynucleotide sequence
tctgccaccatctcagccca

SEQ ID NO: 26673 - DNA, 19 bp, Artificial sequence
  synthetic polynucleotide sequence
gcagcagactcgcagcaga

SEQ ID NO: 26674 - DNA, 20 bp, Artificial sequence
  synthetic polynucleotide sequence
actgaagtctaggagcggca

SEQ ID NO: 26675 - DNA, 21 bp, Artificial sequence
  synthetic polynucleotide sequence
acacatcagagttgcgcacga

SEQ ID NO: 26676 - DNA, 22 bp, Artificial sequence
  synthetic polynucleotide sequence
aaactctgaaagtcccggtcca

SEQ ID NO: 26677 - DNA, 18 bp, Artificial sequence
  synthetic polynucleotide sequence
cctggagccagatgcaca

SEQ ID NO: 26678 - DNA, 21 bp, Artificial sequence
  synthetic polynucleotide sequence
ctaggagtgactgcaacacca

SEQ ID NO: 26679 - DNA, 18 bp, Artificial sequence
  synthetic polynucleotide sequence
cctggagaggggagccaa

SEQ ID NO: 26680 - DNA, 18 bp, Artificial sequence
  synthetic polynucleotide sequence
gcaactcctcccagggca

SEQ ID NO: 26681 - DNA, 18 bp, Artificial sequence
  synthetic polynucleotide sequence
ctgatccaggcaggcaga

SEQ ID NO: 26682 - DNA, 18 bp, Artificial sequence
  synthetic polynucleotide sequence
aagcaggtgggtggcaga

SEQ ID NO: 26683 - DNA, 18 bp, Artificial sequence
  synthetic polynucleotide sequence
ggaaaacagccgggagga

SEQ ID NO: 26684 - DNA, 18 bp, Artificial sequence
  synthetic polynucleotide sequence
cctgggacaagtcacgca

SEQ ID NO: 26685 - DNA, 20 bp, Artificial sequence
  synthetic polynucleotide sequence
ctgccccagaaccggtcgaa

SEQ ID NO: 26686 - DNA, 20 bp, Artificial sequence
  synthetic polynucleotide sequence
tagatcaggagagtgctgca

SEQ ID NO: 26687 - DNA, 19 bp, Artificial sequence
  synthetic polynucleotide sequence
cgggactaccagctgcaca

SEQ ID NO: 26688 - DNA, 18 bp, Artificial sequence
  synthetic polynucleotide sequence
ttggggccatgaagacca

SEQ ID NO: 26689 - DNA, 21 bp, Artificial sequence
  synthetic polynucleotide sequence
tgtctacaaccagagagccca

SEQ ID NO: 26690 - DNA, 20 bp, Artificial sequence
  synthetic polynucleotide sequence
gtgtcccgcatagcacgcca

SEQ ID NO: 26691 - DNA, 18 bp, Artificial sequence
  synthetic polynucleotide sequence
gtggcaagtgggaggcca

SEQ ID NO: 26692 - DNA, 18 bp, Artificial sequence
  synthetic polynucleotide sequence
cctgggccgtagcagaca

SEQ ID NO: 26693 - DNA, 20 bp, Artificial sequence
  synthetic polynucleotide sequence
ccaccacctgtggatcccaa

SEQ ID NO: 26694 - DNA, 21 bp, Artificial sequence
  synthetic polynucleotide sequence
ccaactggcaccaacaatcga

SEQ ID NO: 26695 - DNA, 21 bp, Artificial sequence
  synthetic polynucleotide sequence
agagacctttcaggaggccaa

SEQ ID NO: 26696 - DNA, 21 bp, Artificial sequence
  synthetic polynucleotide sequence
gcttccttccagtgagccgca

SEQ ID NO: 26697 - DNA, 20 bp, Artificial sequence
  synthetic polynucleotide sequence
ccttctccctccagccggaa

SEQ ID NO: 26698 - DNA, 20 bp, Artificial sequence
  synthetic polynucleotide sequence
cttcaccactgcgctgcgga

SEQ ID NO: 26699 - DNA, 21 bp, Artificial sequence
  synthetic polynucleotide sequence
tgaccagatcgactcccagca

SEQ ID NO: 26700 - DNA, 21 bp, Artificial sequence
  synthetic polynucleotide sequence
ctacaagcttcacggcctcca

SEQ ID NO: 26701 - DNA, 18 bp, Artificial sequence
  synthetic polynucleotide sequence
cccacaccacatcagcca

SEQ ID NO: 26702 - DNA, 18 bp, Artificial sequence
  synthetic polynucleotide sequence
tggtgaagaactcccgca

SEQ ID NO: 26703 - DNA, 20 bp, Artificial sequence
  synthetic polynucleotide sequence
ctggtgaagacaagggggga

SEQ ID NO: 26704 - DNA, 22 bp, Artificial sequence
  synthetic polynucleotide sequence
aacgtcaggatgaaggacccca

SEQ ID NO: 26705 - DNA, 21 bp, Artificial sequence
  synthetic polynucleotide sequence
tcagaacttggaaggcctgca

SEQ ID NO: 26706 - DNA, 20 bp, Artificial sequence
  synthetic polynucleotide sequence
ccttcttggcagggcacgca

SEQ ID NO: 26707 - DNA, 19 bp, Artificial sequence
  synthetic polynucleotide sequence
gcctccactaccgctgcca

SEQ ID NO: 26708 - DNA, 20 bp, Artificial sequence
  synthetic polynucleotide sequence
cccaggcccaatcctaccaa

SEQ ID NO: 26709 - DNA, 20 bp, Artificial sequence
  synthetic polynucleotide sequence
ctcagcacctctatccccga

SEQ ID NO: 26710 - DNA, 18 bp, Artificial sequence
  synthetic polynucleotide sequence
aggccacgcttcaggaca

SEQ ID NO: 26711 - DNA, 20 bp, Artificial sequence
  synthetic polynucleotide sequence
tactcgagaccctgcccaga

SEQ ID NO: 26712 - DNA, 19 bp, Artificial sequence
  synthetic polynucleotide sequence
tcctcgaagggtagcggca

SEQ ID NO: 26713 - DNA, 21 bp, Artificial sequence
  synthetic polynucleotide sequence
agtgttgggagcaatgggaga

SEQ ID NO: 26714 - DNA, 22 bp, Artificial sequence
  synthetic polynucleotide sequence
tccaagtgaggagaagggagca

SEQ ID NO: 26715 - DNA, 21 bp, Artificial sequence
  synthetic polynucleotide sequence
ccttctgggaggtgaaggaca

SEQ ID NO: 26716 - DNA, 20 bp, Artificial sequence
  synthetic polynucleotide sequence
tctggggtggcttgaaccca

SEQ ID NO: 26717 - DNA, 21 bp, Artificial sequence
  synthetic polynucleotide sequence
agtcgggcacaactgacccaa

SEQ ID NO: 26718 - DNA, 21 bp, Artificial sequence
  synthetic polynucleotide sequence
gagaatccacaggggtctcca

SEQ ID NO: 26719 - DNA, 22 bp, Artificial sequence
  synthetic polynucleotide sequence
atgtgggagtcagccttacaga

SEQ ID NO: 26720 - DNA, 20 bp, Artificial sequence
  synthetic polynucleotide sequence
gcacaggccagccatctcca

SEQ ID NO: 26721 - DNA, 18 bp, Artificial sequence
  synthetic polynucleotide sequence
gaattccaccgaggccga

SEQ ID NO: 26722 - DNA, 18 bp, Artificial sequence
  synthetic polynucleotide sequence
tcacgacaacgtgggcca

SEQ ID NO: 26723 - DNA, 19 bp, Artificial sequence
  synthetic polynucleotide sequence
cagccaccactctcagcca

SEQ ID NO: 26724 - DNA, 20 bp, Artificial sequence
  synthetic polynucleotide sequence
ctctacgctgatgaccccca

SEQ ID NO: 26725 - DNA, 18 bp, Artificial sequence
  synthetic polynucleotide sequence
ggagatgcacagcagcga

SEQ ID NO: 26726 - DNA, 19 bp, Artificial sequence
  synthetic polynucleotide sequence
gacagtccagccctgagca

SEQ ID NO: 26727 - DNA, 19 bp, Artificial sequence
  synthetic polynucleotide sequence
ggcactctggtaggcacca

SEQ ID NO: 26728 - DNA, 18 bp, Artificial sequence
  synthetic polynucleotide sequence
cattgaggtcccgcacca

SEQ ID NO: 26729 - DNA, 21 bp, Artificial sequence
  synthetic polynucleotide sequence
gtgcctcccagaagaagcaga

SEQ ID NO: 26730 - DNA, 22 bp, Artificial sequence
  synthetic polynucleotide sequence
aaattgccagcgtactcctgga

SEQ ID NO: 26731 - DNA, 22 bp, Artificial sequence
  synthetic polynucleotide sequence
agtggccagtgcaggaagtgaa

SEQ ID NO: 26732 - DNA, 20 bp, Artificial sequence
  synthetic polynucleotide sequence
cagaaggggaatgggggaca

SEQ ID NO: 26733 - DNA, 21 bp, Artificial sequence
  synthetic polynucleotide sequence
accggctccttcaccacccaa

SEQ ID NO: 26734 - DNA, 22 bp, Artificial sequence
  synthetic polynucleotide sequence
atggtggtgatgatgagggcca

SEQ ID NO: 26735 - DNA, 20 bp, Artificial sequence
  synthetic polynucleotide sequence
ctggaccgcgcacgacagga

SEQ ID NO: 26736 - DNA, 20 bp, Artificial sequence
  synthetic polynucleotide sequence
accaacgggtggtgggagca

SEQ ID NO: 26737 - DNA, 18 bp, Artificial sequence
  synthetic polynucleotide sequence
ctccacagcctcagccga

SEQ ID NO: 26738 - DNA, 18 bp, Artificial sequence
  synthetic polynucleotide sequence
actcccacgaccacggca

SEQ ID NO: 26739 - DNA, 18 bp, Artificial sequence
  synthetic polynucleotide sequence
tcgcccccgtctgcagca

SEQ ID NO: 26740 - DNA, 20 bp, Artificial sequence
  synthetic polynucleotide sequence
cttggtccgtgggctcgaca

SEQ ID NO: 26741 - DNA, 19 bp, Artificial sequence
  synthetic polynucleotide sequence
gaggctaccagctcagcga

SEQ ID NO: 26742 - DNA, 19 bp, Artificial sequence
  synthetic polynucleotide sequence
ccagcctgtagccagacga

SEQ ID NO: 26743 - DNA, 18 bp, Artificial sequence
  synthetic polynucleotide sequence
gctacaccatgacggcca

SEQ ID NO: 26744 - DNA, 18 bp, Artificial sequence
  synthetic polynucleotide sequence
gaggacactcgaagcgca

SEQ ID NO: 26745 - DNA, 18 bp, Artificial sequence
  synthetic polynucleotide sequence
ccccatccgctgtgagga

SEQ ID NO: 26746 - DNA, 18 bp, Artificial sequence
  synthetic polynucleotide sequence
tggaagatgtcagcggga

SEQ ID NO: 26747 - DNA, 18 bp, Artificial sequence
  synthetic polynucleotide sequence
agcgttcagaccggcaga

SEQ ID NO: 26748 - DNA, 18 bp, Artificial sequence
  synthetic polynucleotide sequence
ccgacatgtcgacgtcca

SEQ ID NO: 26749 - DNA, 18 bp, Artificial sequence
  synthetic polynucleotide sequence
taaccaccgctgccagca

SEQ ID NO: 26750 - DNA, 18 bp, Artificial sequence
  synthetic polynucleotide sequence
gatgtgagcgctgaggca

SEQ ID NO: 26751 - DNA, 21 bp, Artificial sequence
  synthetic polynucleotide sequence
tgagctgtgccccaaagacga

SEQ ID NO: 26752 - DNA, 22 bp, Artificial sequence
  synthetic polynucleotide sequence
aaatgcctgggctctcaagaca

SEQ ID NO: 26753 - DNA, 20 bp, Artificial sequence
  synthetic polynucleotide sequence
gtggacgagtgtgcaaggga

SEQ ID NO: 26754 - DNA, 18 bp, Artificial sequence
  synthetic polynucleotide sequence
acactggccatggggaca

SEQ ID NO: 26755 - DNA, 18 bp, Artificial sequence
  synthetic polynucleotide sequence
ggccaccactgggaagga

SEQ ID NO: 26756 - DNA, 18 bp, Artificial sequence
  synthetic polynucleotide sequence
gagcacgtcgtcggggga

SEQ ID NO: 26757 - DNA, 18 bp, Artificial sequence
  synthetic polynucleotide sequence
tggcctccatcggaacca

SEQ ID NO: 26758 - DNA, 18 bp, Artificial sequence
  synthetic polynucleotide sequence
tcaccaagagccgggtca

SEQ ID NO: 26759 - DNA, 20 bp, Artificial sequence
  synthetic polynucleotide sequence
gccgtccacgctgcagccaa

SEQ ID NO: 26760 - DNA, 22 bp, Artificial sequence
  synthetic polynucleotide sequence
caaagaggcgaagcttgtggga

SEQ ID NO: 26761 - DNA, 19 bp, Artificial sequence
  synthetic polynucleotide sequence
tgcaggcttccactaccca

SEQ ID NO: 26762 - DNA, 20 bp, Artificial sequence
  synthetic polynucleotide sequence
cccaaaggcgtggctgctca

SEQ ID NO: 26763 - DNA, 21 bp, Artificial sequence
  synthetic polynucleotide sequence
gcaagatccggctgaccgtga

SEQ ID NO: 26764 - DNA, 19 bp, Artificial sequence
  synthetic polynucleotide sequence
ttctggggtgacgagggga

SEQ ID NO: 26765 - DNA, 22 bp, Artificial sequence
  synthetic polynucleotide sequence
ataggctgcaaacaactccgga

SEQ ID NO: 26766 - DNA, 21 bp, Artificial sequence
  synthetic polynucleotide sequence
ccaaaccaacgtggagggtca

SEQ ID NO: 26767 - DNA, 21 bp, Artificial sequence
  synthetic polynucleotide sequence
acaacatcagtgacacgggca

SEQ ID NO: 26768 - DNA, 18 bp, Artificial sequence
  synthetic polynucleotide sequence
gcccgtgcatctgccgca

SEQ ID NO: 26769 - DNA, 21 bp, Artificial sequence
  synthetic polynucleotide sequence
aactccaccaccttgacctca

SEQ ID NO: 26770 - DNA, 19 bp, Artificial sequence
  synthetic polynucleotide sequence
ctcaggctggactccgcca

SEQ ID NO: 26771 - DNA, 20 bp, Artificial sequence
  synthetic polynucleotide sequence
gacctgcaccgcctagagga

SEQ ID NO: 26772 - DNA, 20 bp, Artificial sequence
  synthetic polynucleotide sequence
caggaggtgcttcagcccga

SEQ ID NO: 26773 - DNA, 22 bp, Artificial sequence
  synthetic polynucleotide sequence
gaaatcacagaccaaggagcca

SEQ ID NO: 26774 - DNA, 20 bp, Artificial sequence
  synthetic polynucleotide sequence
gtgggggtactgctgcacca

SEQ ID NO: 26775 - DNA, 19 bp, Artificial sequence
  synthetic polynucleotide sequence
ctggtctctcgcagcggca

SEQ ID NO: 26776 - DNA, 19 bp, Artificial sequence
  synthetic polynucleotide sequence
ggcctggaagctgcggaga

SEQ ID NO: 26777 - DNA, 18 bp, Artificial sequence
  synthetic polynucleotide sequence
cgtccccactccgcgaga

SEQ ID NO: 26778 - DNA, 20 bp, Artificial sequence
  synthetic polynucleotide sequence
cgggcacaagcttcgggtga

SEQ ID NO: 26779 - DNA, 20 bp, Artificial sequence
  synthetic polynucleotide sequence
gagaggctgcgggtactgga

SEQ ID NO: 26780 - DNA, 20 bp, Artificial sequence
  synthetic polynucleotide sequence
ctggcagtcgtacagctcga

SEQ ID NO: 26781 - DNA, 21 bp, Artificial sequence
  synthetic polynucleotide sequence
tccgatcgccgttggaccgaa

SEQ ID NO: 26782 - DNA, 18 bp, Artificial sequence
  synthetic polynucleotide sequence
tggaggtggcggtcccca

SEQ ID NO: 26783 - DNA, 19 bp, Artificial sequence
  synthetic polynucleotide sequence
tggccgtgtgggaatgaca

SEQ ID NO: 26784 - DNA, 21 bp, Artificial sequence
  synthetic polynucleotide sequence
aattgagataggcggccacca

SEQ ID NO: 26785 - DNA, 22 bp, Artificial sequence
  synthetic polynucleotide sequence
acctatcatcccggagcagtca

SEQ ID NO: 26786 - DNA, 19 bp, Artificial sequence
  synthetic polynucleotide sequence
taaactggcgagcttggga

SEQ ID NO: 26787 - DNA, 21 bp, Artificial sequence
  synthetic polynucleotide sequence
tggtggggctctactgcgaca

SEQ ID NO: 26788 - DNA, 22 bp, Artificial sequence
  synthetic polynucleotide sequence
caaagaggctaagcatctcgga

SEQ ID NO: 26789 - DNA, 21 bp, Artificial sequence
  synthetic polynucleotide sequence
cctactccacggctctcccaa

SEQ ID NO: 26790 - DNA, 21 bp, Artificial sequence
  synthetic polynucleotide sequence
ttctcactgaacccctggcca

SEQ ID NO: 26791 - DNA, 21 bp, Artificial sequence
  synthetic polynucleotide sequence
cctcgccaagaactgcaccaa

SEQ ID NO: 26792 - DNA, 21 bp, Artificial sequence
  synthetic polynucleotide sequence
cagcgtctggaggtcaaagca

SEQ ID NO: 26793 - DNA, 18 bp, Artificial sequence
  synthetic polynucleotide sequence
cacaccactacgccgcaa

SEQ ID NO: 26794 - DNA, 18 bp, Artificial sequence
  synthetic polynucleotide sequence
agcgtaggcctccaggga

SEQ ID NO: 26795 - DNA, 21 bp, Artificial sequence
  synthetic polynucleotide sequence
tgtgatccacgcgaatgggga

SEQ ID NO: 26796 - DNA, 21 bp, Artificial sequence
  synthetic polynucleotide sequence
tgggcctcaaccttgacccca

SEQ ID NO: 26797 - DNA, 19 bp, Artificial sequence
  synthetic polynucleotide sequence
ggactggaagcaaccccaa

SEQ ID NO: 26798 - DNA, 18 bp, Artificial sequence
  synthetic polynucleotide sequence
aggagacctcgaccccca

SEQ ID NO: 26799 - DNA, 20 bp, Artificial sequence
  synthetic polynucleotide sequence
gttccccggtgtgcctgaga

SEQ ID NO: 26800 - DNA, 21 bp, Artificial sequence
  synthetic polynucleotide sequence
ctctgatccacaccagctcca

SEQ ID NO: 26801 - DNA, 21 bp, Artificial sequence
  synthetic polynucleotide sequence
cacctggacacccctaaacca

SEQ ID NO: 26802 - DNA, 22 bp, Artificial sequence
  synthetic polynucleotide sequence
tgcacaacgacaaaggctccga

SEQ ID NO: 26803 - DNA, 21 bp, Artificial sequence
  synthetic polynucleotide sequence
ctccaagaggcagcttgtgga

SEQ ID NO: 26804 - DNA, 19 bp, Artificial sequence
  synthetic polynucleotide sequence
ggcagcccctctcagtcca

SEQ ID NO: 26805 - DNA, 20 bp, Artificial sequence
  synthetic polynucleotide sequence
tacgggcacatagggcggaa

SEQ ID NO: 26806 - DNA, 21 bp, Artificial sequence
  synthetic polynucleotide sequence
cggctcgcttcaaggacacca

SEQ ID NO: 26807 - DNA, 21 bp, Artificial sequence
  synthetic polynucleotide sequence
tcacccacgatgagagcgtca

SEQ ID NO: 26808 - DNA, 18 bp, Artificial sequence
  synthetic polynucleotide sequence
gctgcggcccgagtacca

SEQ ID NO: 26809 - DNA, 21 bp, Artificial sequence
  synthetic polynucleotide sequence
aggaggtgggcgtagaggtga

SEQ ID NO: 26810 - DNA, 21 bp, Artificial sequence
  synthetic polynucleotide sequence
gggtcccagccgtagatcaca

SEQ ID NO: 26811 - DNA, 20 bp, Artificial sequence
  synthetic polynucleotide sequence
ctcaccttcctgcccgccaa

SEQ ID NO: 26812 - DNA, 21 bp, Artificial sequence
  synthetic polynucleotide sequence
gaaccaagcaatgcccctcca

SEQ ID NO: 26813 - DNA, 20 bp, Artificial sequence
  synthetic polynucleotide sequence
ctccctggtgctgagccaga

SEQ ID NO: 26814 - DNA, 20 bp, Artificial sequence
  synthetic polynucleotide sequence
ggagcttgacgaaggaggca

SEQ ID NO: 26815 - DNA, 20 bp, Artificial sequence
  synthetic polynucleotide sequence
cttaggccaggtgaccccca

SEQ ID NO: 26816 - DNA, 22 bp, Artificial sequence
  synthetic polynucleotide sequence
aaagagaatgctgcagtgccga

SEQ ID NO: 26817 - DNA, 20 bp, Artificial sequence
  synthetic polynucleotide sequence
atggtgcaacacggtgggga

SEQ ID NO: 26818 - DNA, 22 bp, Artificial sequence
  synthetic polynucleotide sequence
tcaatcctgccactatccagca

SEQ ID NO: 26819 - DNA, 20 bp, Artificial sequence
  synthetic polynucleotide sequence
agcggatggcagaggaagga

SEQ ID NO: 26820 - DNA, 19 bp, Artificial sequence
  synthetic polynucleotide sequence
ttgaggcagctggtccgga

SEQ ID NO: 26821 - DNA, 21 bp, Artificial sequence
  synthetic polynucleotide sequence
gtccagaccaaatggctcgaa

SEQ ID NO: 26822 - DNA, 21 bp, Artificial sequence
  synthetic polynucleotide sequence
tctctgatgatggggaagcca

SEQ ID NO: 26823 - DNA, 18 bp, Artificial sequence
  synthetic polynucleotide sequence
ccaggccagagccaggga

SEQ ID NO: 26824 - DNA, 22 bp, Artificial sequence
  synthetic polynucleotide sequence
cacaccacacttgcaggacaca

SEQ ID NO: 26825 - DNA, 18 bp, Artificial sequence
  synthetic polynucleotide sequence
gggcgtgagctccaggaa

SEQ ID NO: 26826 - DNA, 21 bp, Artificial sequence
  synthetic polynucleotide sequence
ccggctgtacaggctgaagga

SEQ ID NO: 26827 - DNA, 18 bp, Artificial sequence
  synthetic polynucleotide sequence
cggcagatccgcaaacga

SEQ ID NO: 26828 - DNA, 19 bp, Artificial sequence
  synthetic polynucleotide sequence
gttattggcagtgcacgga

SEQ ID NO: 26829 - DNA, 21 bp, Artificial sequence
  synthetic polynucleotide sequence
tgttgccaacaccatggagca

SEQ ID NO: 26830 - DNA, 23 bp, Artificial sequence
  synthetic polynucleotide sequence
aaaatccaaggcaagtgagtgca

SEQ ID NO: 26831 - DNA, 20 bp, Artificial sequence
  synthetic polynucleotide sequence
cactcaggctgatgaaggca

SEQ ID NO: 26832 - DNA, 19 bp, Artificial sequence
  synthetic polynucleotide sequence
ggggcagtcctgagaagca

SEQ ID NO: 26833 - DNA, 20 bp, Artificial sequence
  synthetic polynucleotide sequence
caaggcccgccgcctagcaa

SEQ ID NO: 26834 - DNA, 22 bp, Artificial sequence
  synthetic polynucleotide sequence
gagagccgttcaaggaagtcaa

SEQ ID NO: 26835 - DNA, 21 bp, Artificial sequence
  synthetic polynucleotide sequence
tgccacccgagagaaaccgca

SEQ ID NO: 26836 - DNA, 21 bp, Artificial sequence
  synthetic polynucleotide sequence
tagtgtccatccagctgcgaa

SEQ ID NO: 26837 - DNA, 18 bp, Artificial sequence
  synthetic polynucleotide sequence
ccagcaccctccggacca

SEQ ID NO: 26838 - DNA, 20 bp, Artificial sequence
  synthetic polynucleotide sequence
ctgcaagaggattcgggcca

SEQ ID NO: 26839 - DNA, 20 bp, Artificial sequence
  synthetic polynucleotide sequence
cacgtggagctccacagcga

SEQ ID NO: 26840 - DNA, 22 bp, Artificial sequence
  synthetic polynucleotide sequence
acattcttgaagtgcaggggga

SEQ ID NO: 26841 - DNA, 20 bp, Artificial sequence
  synthetic polynucleotide sequence
gcctggcatcactcgcgaga

SEQ ID NO: 26842 - DNA, 20 bp, Artificial sequence
  synthetic polynucleotide sequence
cttcaggccttcccggcaga

SEQ ID NO: 26843 - DNA, 19 bp, Artificial sequence
  synthetic polynucleotide sequence
ttctttggccccccgacga

SEQ ID NO: 26844 - DNA, 21 bp, Artificial sequence
  synthetic polynucleotide sequence
tggcttccagactccgacgca

SEQ ID NO: 26845 - DNA, 20 bp, Artificial sequence
  synthetic polynucleotide sequence
ggggactgtgtagccgaaca

SEQ ID NO: 26846 - DNA, 25 bp, Artificial sequence
  synthetic polynucleotide sequence
cagacccatgataagcacacagaca

SEQ ID NO: 26847 - DNA, 21 bp, Artificial sequence
  synthetic polynucleotide sequence
agattgcgggtccaagtacca

SEQ ID NO: 26848 - DNA, 19 bp, Artificial sequence
  synthetic polynucleotide sequence
ccgggcgggtagttggaga

SEQ ID NO: 26849 - DNA, 19 bp, Artificial sequence
  synthetic polynucleotide sequence
gggccgccatgcatgggaa

SEQ ID NO: 26850 - DNA, 20 bp, Artificial sequence
  synthetic polynucleotide sequence
tccaccagattccagcccca

SEQ ID NO: 26851 - DNA, 20 bp, Artificial sequence
  synthetic polynucleotide sequence
gtctcctcaccccagccaca

SEQ ID NO: 26852 - DNA, 25 bp, Artificial sequence
  synthetic polynucleotide sequence
agaagcttccagaaccacgatggaa

SEQ ID NO: 26853 - DNA, 21 bp, Artificial sequence
  synthetic polynucleotide sequence
gctgcctgacaggagacaaga

SEQ ID NO: 26854 - DNA, 22 bp, Artificial sequence
  synthetic polynucleotide sequence
aacactgcataggagctgcaca

SEQ ID NO: 26855 - DNA, 22 bp, Artificial sequence
  synthetic polynucleotide sequence
acatgcaggagctggaatgaca

SEQ ID NO: 26856 - DNA, 20 bp, Artificial sequence
  synthetic polynucleotide sequence
ctcagcagtatcaccctcca

SEQ ID NO: 26857 - DNA, 22 bp, Artificial sequence
  synthetic polynucleotide sequence
aacgggcaacctgcaaacgaga

SEQ ID NO: 26858 - DNA, 20 bp, Artificial sequence
  synthetic polynucleotide sequence
tctttgtaccaggcagggga

SEQ ID NO: 26859 - DNA, 20 bp, Artificial sequence
  synthetic polynucleotide sequence
ccgagtcaccaacagcagca

SEQ ID NO: 26860 - DNA, 18 bp, Artificial sequence
  synthetic polynucleotide sequence
cggtagggcgattgggca

SEQ ID NO: 26861 - DNA, 20 bp, Artificial sequence
  synthetic polynucleotide sequence
atcgggggtgaatatgacca

SEQ ID NO: 26862 - DNA, 18 bp, Artificial sequence
  synthetic polynucleotide sequence
ggtcctggaagtgggcca

SEQ ID NO: 26863 - DNA, 21 bp, Artificial sequence
  synthetic polynucleotide sequence
tgcccctgaagagcgtggaga

SEQ ID NO: 26864 - DNA, 19 bp, Artificial sequence
  synthetic polynucleotide sequence
ttgagcagcgcgacgggta

SEQ ID NO: 26865 - DNA, 21 bp, Artificial sequence
  synthetic polynucleotide sequence
cccctgaagagcctcagtcca

SEQ ID NO: 26866 - DNA, 22 bp, Artificial sequence
  synthetic polynucleotide sequence
ggaacatagctgtagccccaca

SEQ ID NO: 26867 - DNA, 20 bp, Artificial sequence
  synthetic polynucleotide sequence
gtccaccataccccagccca

SEQ ID NO: 26868 - DNA, 20 bp, Artificial sequence
  synthetic polynucleotide sequence
caggggacccgtactgcaca

SEQ ID NO: 26869 - DNA, 20 bp, Artificial sequence
  synthetic polynucleotide sequence
caaagtctggagcacgagca

SEQ ID NO: 26870 - DNA, 18 bp, Artificial sequence
  synthetic polynucleotide sequence
accggatgcatcggacca

SEQ ID NO: 26871 - DNA, 20 bp, Artificial sequence
  synthetic polynucleotide sequence
tgaggaccatcaggcagcca

SEQ ID NO: 26872 - DNA, 21 bp, Artificial sequence
  synthetic polynucleotide sequence
ccaggtgacagcagctcctga

SEQ ID NO: 26873 - DNA, 22 bp, Artificial sequence
  synthetic polynucleotide sequence
atcatggacttgcggacagaga

SEQ ID NO: 26874 - DNA, 21 bp, Artificial sequence
  synthetic polynucleotide sequence
atccagtccattcagccagga

SEQ ID NO: 26875 - DNA, 19 bp, Artificial sequence
  synthetic polynucleotide sequence
gaggagccccacgacagca

SEQ ID NO: 26876 - DNA, 19 bp, Artificial sequence
  synthetic polynucleotide sequence
cacagggctgctgagggga

SEQ ID NO: 26877 - DNA, 21 bp, Artificial sequence
  synthetic polynucleotide sequence
cctcacctactccccacacca

SEQ ID NO: 26878 - DNA, 21 bp, Artificial sequence
  synthetic polynucleotide sequence
tccagcgcgtcgaagaaggca

SEQ ID NO: 26879 - DNA, 19 bp, Artificial sequence
  synthetic polynucleotide sequence
tgcaaggtcccaacaagca

SEQ ID NO: 26880 - DNA, 18 bp, Artificial sequence
  synthetic polynucleotide sequence
ccgactcccaactgcaca

SEQ ID NO: 26881 - DNA, 20 bp, Artificial sequence
  synthetic polynucleotide sequence
gctctccgcccatcagctca

SEQ ID NO: 26882 - DNA, 20 bp, Artificial sequence
  synthetic polynucleotide sequence
tgcccggaatacacctccca

SEQ ID NO: 26883 - DNA, 21 bp, Artificial sequence
  synthetic polynucleotide sequence
ccacagacccaccaaggacca

SEQ ID NO: 26884 - DNA, 20 bp, Artificial sequence
  synthetic polynucleotide sequence
agcctccagacctctagcga

SEQ ID NO: 26885 - DNA, 21 bp, Artificial sequence
  synthetic polynucleotide sequence
agctgtcaccatccagtgcca

SEQ ID NO: 26886 - DNA, 20 bp, Artificial sequence
  synthetic polynucleotide sequence
gtggacacaatggtctggca

SEQ ID NO: 26887 - DNA, 18 bp, Artificial sequence
  synthetic polynucleotide sequence
cgcatggccgtggcagga

SEQ ID NO: 26888 - DNA, 18 bp, Artificial sequence
  synthetic polynucleotide sequence
cagctcggttcagccaca

SEQ ID NO: 26889 - DNA, 18 bp, Artificial sequence
  synthetic polynucleotide sequence
ggtggtgatggagggcca

SEQ ID NO: 26890 - DNA, 20 bp, Artificial sequence
  synthetic polynucleotide sequence
ctcatagtccagctgccaca

SEQ ID NO: 26891 - DNA, 19 bp, Artificial sequence
  synthetic polynucleotide sequence
gatccaagtgcgaaaggca

SEQ ID NO: 26892 - DNA, 20 bp, Artificial sequence
  synthetic polynucleotide sequence
gctggaagaaccagaagcca

SEQ ID NO: 26893 - DNA, 18 bp, Artificial sequence
  synthetic polynucleotide sequence
tgacgacatggaagggca

SEQ ID NO: 26894 - DNA, 18 bp, Artificial sequence
  synthetic polynucleotide sequence
ccgaaggccaatccagga

SEQ ID NO: 26895 - DNA, 22 bp, Artificial sequence
  synthetic polynucleotide sequence
agaaaagaaggatcccagcgca

SEQ ID NO: 26896 - DNA, 21 bp, Artificial sequence
  synthetic polynucleotide sequence
ggatgtggtaaggtgggccca

SEQ ID NO: 26897 - DNA, 18 bp, Artificial sequence
  synthetic polynucleotide sequence
tcacggtccaggtggcaa

SEQ ID NO: 26898 - DNA, 18 bp, Artificial sequence
  synthetic polynucleotide sequence
gttcccacacaggccaca

SEQ ID NO: 26899 - DNA, 18 bp, Artificial sequence
  synthetic polynucleotide sequence
ctgcgaggcaggaacaca

SEQ ID NO: 26900 - DNA, 21 bp, Artificial sequence
  synthetic polynucleotide sequence
ggccaagcacttgaagctcca

SEQ ID NO: 26901 - DNA, 18 bp, Artificial sequence
  synthetic polynucleotide sequence
cagggcgaagtgacccca

SEQ ID NO: 26902 - DNA, 19 bp, Artificial sequence
  synthetic polynucleotide sequence
gcatgacacctcaaggcca

SEQ ID NO: 26903 - DNA, 20 bp, Artificial sequence
  synthetic polynucleotide sequence
ctcatccaagcctgtgacca

SEQ ID NO: 26904 - DNA, 18 bp, Artificial sequence
  synthetic polynucleotide sequence
tgggcagccttcacagga

SEQ ID NO: 26905 - DNA, 20 bp, Artificial sequence
  synthetic polynucleotide sequence
ctcatccaagcctgtgacca

SEQ ID NO: 26906 - DNA, 20 bp, Artificial sequence
  synthetic polynucleotide sequence
tcaaggccactacagcagca

SEQ ID NO: 26907 - DNA, 18 bp, Artificial sequence
  synthetic polynucleotide sequence
agctggcatgcggactga

SEQ ID NO: 26908 - DNA, 19 bp, Artificial sequence
  synthetic polynucleotide sequence
tctcgagcaccctgtacca

SEQ ID NO: 26909 - DNA, 21 bp, Artificial sequence
  synthetic polynucleotide sequence
cccggtgcagctagaagtcca

SEQ ID NO: 26910 - DNA, 18 bp, Artificial sequence
  synthetic polynucleotide sequence
cccaacaagccccctgca

SEQ ID NO: 26911 - DNA, 18 bp, Artificial sequence
  synthetic polynucleotide sequence
ggccccaacagtgacgga

SEQ ID NO: 26912 - DNA, 18 bp, Artificial sequence
  synthetic polynucleotide sequence
cgatgacgattcccacca

SEQ ID NO: 26913 - DNA, 20 bp, Artificial sequence
  synthetic polynucleotide sequence
gtgggggagcctgtgaccaa

SEQ ID NO: 26914 - DNA, 21 bp, Artificial sequence
  synthetic polynucleotide sequence
cgctggtgaactgtgcagcca

SEQ ID NO: 26915 - DNA, 22 bp, Artificial sequence
  synthetic polynucleotide sequence
agtacaattcctcagcgaggga

SEQ ID NO: 26916 - DNA, 21 bp, Artificial sequence
  synthetic polynucleotide sequence
caatccgccaggtatcgtcca

SEQ ID NO: 26917 - DNA, 20 bp, Artificial sequence
  synthetic polynucleotide sequence
gacggcttctggaggggaga

SEQ ID NO: 26918 - DNA, 21 bp, Artificial sequence
  synthetic polynucleotide sequence
tcatgtccaggaacccaggga

SEQ ID NO: 26919 - DNA, 22 bp, Artificial sequence
  synthetic polynucleotide sequence
taccccagcccagataagagga

SEQ ID NO: 26920 - DNA, 21 bp, Artificial sequence
  synthetic polynucleotide sequence
ttctgtgtaggtggaggggga

SEQ ID NO: 26921 - DNA, 19 bp, Artificial sequence
  synthetic polynucleotide sequence
gctgcacaggcagagagca

SEQ ID NO: 26922 - DNA, 18 bp, Artificial sequence
  synthetic polynucleotide sequence
ttcaccaccagccccaga

SEQ ID NO: 26923 - DNA, 18 bp, Artificial sequence
  synthetic polynucleotide sequence
tgagcggctggcacacca

SEQ ID NO: 26924 - DNA, 18 bp, Artificial sequence
  synthetic polynucleotide sequence
gggcagtcagggcgtgga

SEQ ID NO: 26925 - DNA, 18 bp, Artificial sequence
  synthetic polynucleotide sequence
tgaccgcccagggaacca

SEQ ID NO: 26926 - DNA, 18 bp, Artificial sequence
  synthetic polynucleotide sequence
gtcagggaatctcccgca

SEQ ID NO: 26927 - DNA, 18 bp, Artificial sequence
  synthetic polynucleotide sequence
ccagctggcactgggcaa

SEQ ID NO: 26928 - DNA, 20 bp, Artificial sequence
  synthetic polynucleotide sequence
cagacactgcatagcgacca

SEQ ID NO: 26929 - DNA, 20 bp, Artificial sequence
  synthetic polynucleotide sequence
gaggacaggtgatggaggga

SEQ ID NO: 26930 - DNA, 18 bp, Artificial sequence
  synthetic polynucleotide sequence
ttgggcgagacaccggga

SEQ ID NO: 26931 - DNA, 21 bp, Artificial sequence
  synthetic polynucleotide sequence
ctactcctgtgaggccaacaa

SEQ ID NO: 26932 - DNA, 21 bp, Artificial sequence
  synthetic polynucleotide sequence
aacagtccccagagaactcca

SEQ ID NO: 26933 - DNA, 21 bp, Artificial sequence
  synthetic polynucleotide sequence
ccagatctggagcatccagca

SEQ ID NO: 26934 - DNA, 20 bp, Artificial sequence
  synthetic polynucleotide sequence
ctgctagcctcccctgcaga

SEQ ID NO: 26935 - DNA, 21 bp, Artificial sequence
  synthetic polynucleotide sequence
agagaccccaggcaacagaga

SEQ ID NO: 26936 - DNA, 20 bp, Artificial sequence
  synthetic polynucleotide sequence
gacttcctccgacgccagca

SEQ ID NO: 26937 - DNA, 19 bp, Artificial sequence
  synthetic polynucleotide sequence
gcagtggcctctgacccca

SEQ ID NO: 26938 - DNA, 21 bp, Artificial sequence
  synthetic polynucleotide sequence
tgaggaagccaagaacaggga

SEQ ID NO: 26939 - DNA, 20 bp, Artificial sequence
  synthetic polynucleotide sequence
caggtggagagcagtgccca

SEQ ID NO: 26940 - DNA, 19 bp, Artificial sequence
  synthetic polynucleotide sequence
tctccccacggtgaactca

SEQ ID NO: 26941 - DNA, 20 bp, Artificial sequence
  synthetic polynucleotide sequence
cagccactgaggacaaccaa

SEQ ID NO: 26942 - DNA, 20 bp, Artificial sequence
  synthetic polynucleotide sequence
caggagcagttcctggagca

SEQ ID NO: 26943 - DNA, 21 bp, Artificial sequence
  synthetic polynucleotide sequence
ctacttccactccagcgccaa

SEQ ID NO: 26944 - DNA, 20 bp, Artificial sequence
  synthetic polynucleotide sequence
gaacatgggcgcgctctcca

SEQ ID NO: 26945 - DNA, 21 bp, Artificial sequence
  synthetic polynucleotide sequence
ctctcaagaccaggaacgaga

SEQ ID NO: 26946 - DNA, 21 bp, Artificial sequence
  synthetic polynucleotide sequence
ttgtaggggcagattcaggta

SEQ ID NO: 26947 - DNA, 22 bp, Artificial sequence
  synthetic polynucleotide sequence
acctctgaacaggagtgggaca

SEQ ID NO: 26948 - DNA, 19 bp, Artificial sequence
  synthetic polynucleotide sequence
caggcccatagagttggca

SEQ ID NO: 26949 - DNA, 18 bp, Artificial sequence
  synthetic polynucleotide sequence
accccagtgtgaccggca

SEQ ID NO: 26950 - DNA, 18 bp, Artificial sequence
  synthetic polynucleotide sequence
ggagtggcccgttgcaga

SEQ ID NO: 26951 - DNA, 20 bp, Artificial sequence
  synthetic polynucleotide sequence
gcccggagcagctcagaaga

SEQ ID NO: 26952 - DNA, 21 bp, Artificial sequence
  synthetic polynucleotide sequence
gaacaagccagggttccctca

SEQ ID NO: 26953 - DNA, 20 bp, Artificial sequence
  synthetic polynucleotide sequence
aggcccgggagagacgtgga

SEQ ID NO: 26954 - DNA, 19 bp, Artificial sequence
  synthetic polynucleotide sequence
gggccctgtccccaccaga

SEQ ID NO: 26955 - DNA, 21 bp, Artificial sequence
  synthetic polynucleotide sequence
cctgactggtgggacatcaca

SEQ ID NO: 26956 - DNA, 22 bp, Artificial sequence
  synthetic polynucleotide sequence
aggtccactgaggatgtgcaga

SEQ ID NO: 26957 - DNA, 18 bp, Artificial sequence
  synthetic polynucleotide sequence
agggtgtcgatgaggcca

SEQ ID NO: 26958 - DNA, 19 bp, Artificial sequence
  synthetic polynucleotide sequence
gcagtagaggcctggcaca

SEQ ID NO: 26959 - DNA, 19 bp, Artificial sequence
  synthetic polynucleotide sequence
cctcaggaggtaagcgcca

SEQ ID NO: 26960 - DNA, 18 bp, Artificial sequence
  synthetic polynucleotide sequence
gaggacccaaccagggca

SEQ ID NO: 26961 - DNA, 21 bp, Artificial sequence
  synthetic polynucleotide sequence
agaaagtggagtgcaccccca

SEQ ID NO: 26962 - DNA, 18 bp, Artificial sequence
  synthetic polynucleotide sequence
ccacgtgcagggagggga

SEQ ID NO: 26963 - DNA, 22 bp, Artificial sequence
  synthetic polynucleotide sequence
agcacattgtggagccacagca

SEQ ID NO: 26964 - DNA, 20 bp, Artificial sequence
  synthetic polynucleotide sequence
atggcgtcatcccatggcca

SEQ ID NO: 26965 - DNA, 21 bp, Artificial sequence
  synthetic polynucleotide sequence
ggatgacaacagtcccctgca

SEQ ID NO: 26966 - DNA, 20 bp, Artificial sequence
  synthetic polynucleotide sequence
atgacacgagcagcaagaca

SEQ ID NO: 26967 - DNA, 18 bp, Artificial sequence
  synthetic polynucleotide sequence
tgctgcggctaccgagga

SEQ ID NO: 26968 - DNA, 18 bp, Artificial sequence
  synthetic polynucleotide sequence
tgggcccaataccccgga

SEQ ID NO: 26969 - DNA, 20 bp, Artificial sequence
  synthetic polynucleotide sequence
gtgcgagagagtcatgggaa

SEQ ID NO: 26970 - DNA, 20 bp, Artificial sequence
  synthetic polynucleotide sequence
tgaaaacccagtgccctcga

SEQ ID NO: 26971 - DNA, 21 bp, Artificial sequence
  synthetic polynucleotide sequence
catcaggatgatggacgccga

SEQ ID NO: 26972 - DNA, 20 bp, Artificial sequence
  synthetic polynucleotide sequence
accttgcccgacaagcgcca

SEQ ID NO: 26973 - DNA, 22 bp, Artificial sequence
  synthetic polynucleotide sequence
gaaactcggccactgtaccaca

SEQ ID NO: 26974 - DNA, 19 bp, Artificial sequence
  synthetic polynucleotide sequence
ttgggtcgccttggagaga

SEQ ID NO: 26975 - DNA, 21 bp, Artificial sequence
  synthetic polynucleotide sequence
aagggtgatcacctacgccca

SEQ ID NO: 26976 - DNA, 20 bp, Artificial sequence
  synthetic polynucleotide sequence
ctcgtaagcaaacgtgggca

SEQ ID NO: 26977 - DNA, 21 bp, Artificial sequence
  synthetic polynucleotide sequence
ttcatccaggcgtggcagtca

SEQ ID NO: 26978 - DNA, 20 bp, Artificial sequence
  synthetic polynucleotide sequence
ctggaatcccggtggctgca

SEQ ID NO: 26979 - DNA, 19 bp, Artificial sequence
  synthetic polynucleotide sequence
ggaagccccttgtcaccaa

SEQ ID NO: 26980 - DNA, 21 bp, Artificial sequence
  synthetic polynucleotide sequence
aatacttgaatcggagcagca

SEQ ID NO: 26981 - DNA, 22 bp, Artificial sequence
  synthetic polynucleotide sequence
aagggcagcaggaaagacgaga

SEQ ID NO: 26982 - DNA, 21 bp, Artificial sequence
  synthetic polynucleotide sequence
agttgacattccactggcgca

SEQ ID NO: 26983 - DNA, 18 bp, Artificial sequence
  synthetic polynucleotide sequence
tggccattcaccgggaga

SEQ ID NO: 26984 - DNA, 18 bp, Artificial sequence
  synthetic polynucleotide sequence
acgtcaggtgcggaccca

SEQ ID NO: 26985 - DNA, 18 bp, Artificial sequence
  synthetic polynucleotide sequence
gggaggcgatggggacga

SEQ ID NO: 26986 - DNA, 18 bp, Artificial sequence
  synthetic polynucleotide sequence
gagtgcagcccaagccga

SEQ ID NO: 26987 - DNA, 20 bp, Artificial sequence
  synthetic polynucleotide sequence
ccaccgtcctccgtgacaca

SEQ ID NO: 26988 - DNA, 20 bp, Artificial sequence
  synthetic polynucleotide sequence
gggtcagaaacacaccggga

SEQ ID NO: 26989 - DNA, 20 bp, Artificial sequence
  synthetic polynucleotide sequence
aagcagaaggagcagcgaga

SEQ ID NO: 26990 - DNA, 18 bp, Artificial sequence
  synthetic polynucleotide sequence
tgaagcgcttgagaggca

SEQ ID NO: 26991 - DNA, 22 bp, Artificial sequence
  synthetic polynucleotide sequence
tgcagcttggaggagaagctga

SEQ ID NO: 26992 - DNA, 20 bp, Artificial sequence
  synthetic polynucleotide sequence
aatctcgtccccctgcagga

SEQ ID NO: 26993 - DNA, 22 bp, Artificial sequence
  synthetic polynucleotide sequence
gcaacatgatgagcacgtccaa

SEQ ID NO: 26994 - DNA, 20 bp, Artificial sequence
  synthetic polynucleotide sequence
gggtaaggctccctgcagga

SEQ ID NO: 26995 - DNA, 22 bp, Artificial sequence
  synthetic polynucleotide sequence
catatgcacacccacaacgaca

SEQ ID NO: 26996 - DNA, 19 bp, Artificial sequence
  synthetic polynucleotide sequence
gtcctttgcggagggggca

SEQ ID NO: 26997 - DNA, 22 bp, Artificial sequence
  synthetic polynucleotide sequence
taggaccctacaacgcctccaa

SEQ ID NO: 26998 - DNA, 21 bp, Artificial sequence
  synthetic polynucleotide sequence
ttcccaagtaaccggtcacca

SEQ ID NO: 26999 - DNA, 21 bp, Artificial sequence
  synthetic polynucleotide sequence
tggtgcgcagggcatttggga

SEQ ID NO: 27000 - DNA, 20 bp, Artificial sequence
  synthetic polynucleotide sequence
gacccacacccctgtcctca

SEQ ID NO: 27001 - DNA, 20 bp, Artificial sequence
  synthetic polynucleotide sequence
gggccctacaacgtgtccca

SEQ ID NO: 27002 - DNA, 21 bp, Artificial sequence
  synthetic polynucleotide sequence
agagcccacacaacctcctca

SEQ ID NO: 27003 - DNA, 22 bp, Artificial sequence
  synthetic polynucleotide sequence
atcaaggaagaggctcacggta

SEQ ID NO: 27004 - DNA, 20 bp, Artificial sequence
  synthetic polynucleotide sequence
ctggatcaggatgaggagga

SEQ ID NO: 27005 - DNA, 19 bp, Artificial sequence
  synthetic polynucleotide sequence
gggggctcctatgacccaa

SEQ ID NO: 27006 - DNA, 18 bp, Artificial sequence
  synthetic polynucleotide sequence
gcgaacagccctgaggga

SEQ ID NO: 27007 - DNA, 18 bp, Artificial sequence
  synthetic polynucleotide sequence
gctcgtccagccaaagca

SEQ ID NO: 27008 - DNA, 19 bp, Artificial sequence
  synthetic polynucleotide sequence
gtaggacacaacaccccca

SEQ ID NO: 27009 - DNA, 21 bp, Artificial sequence
  synthetic polynucleotide sequence
tacgcccatccgggaaaagga

SEQ ID NO: 27010 - DNA, 21 bp, Artificial sequence
  synthetic polynucleotide sequence
cccacaaaccacatgcccgca

SEQ ID NO: 27011 - DNA, 20 bp, Artificial sequence
  synthetic polynucleotide sequence
cctgcagctcatcggggaca

SEQ ID NO: 27012 - DNA, 21 bp, Artificial sequence
  synthetic polynucleotide sequence
caacagtcacctggtagccca

SEQ ID NO: 27013 - DNA, 20 bp, Artificial sequence
  synthetic polynucleotide sequence
catgctggagcccgtgcaga

SEQ ID NO: 27014 - DNA, 20 bp, Artificial sequence
  synthetic polynucleotide sequence
gctccaaggacctctccgca

SEQ ID NO: 27015 - DNA, 19 bp, Artificial sequence
  synthetic polynucleotide sequence
gtcagagcccaggccacca

SEQ ID NO: 27016 - DNA, 21 bp, Artificial sequence
  synthetic polynucleotide sequence
tgtctgcagcaaagctgtgca

SEQ ID NO: 27017 - DNA, 20 bp, Artificial sequence
  synthetic polynucleotide sequence
cagagccctgtccacagcaa

SEQ ID NO: 27018 - DNA, 18 bp, Artificial sequence
  synthetic polynucleotide sequence
tgccgacgagatgggaca

SEQ ID NO: 27019 - DNA, 23 bp, Artificial sequence
  synthetic polynucleotide sequence
gccagagcagtcttccaacaaca

SEQ ID NO: 27020 - DNA, 21 bp, Artificial sequence
  synthetic polynucleotide sequence
tccatgccaagtcactgggaa

SEQ ID NO: 27021 - DNA, 20 bp, Artificial sequence
  synthetic polynucleotide sequence
gaaaggctggaggagaacca

SEQ ID NO: 27022 - DNA, 18 bp, Artificial sequence
  synthetic polynucleotide sequence
gagactggcagggggaga

SEQ ID NO: 27023 - DNA, 21 bp, Artificial sequence
  synthetic polynucleotide sequence
gggaaggcatgtgcggagcta

SEQ ID NO: 27024 - DNA, 20 bp, Artificial sequence
  synthetic polynucleotide sequence
tccaggatgctgtacgggca

SEQ ID NO: 27025 - DNA, 21 bp, Artificial sequence
  synthetic polynucleotide sequence
tggacaaggagggccaggtca

SEQ ID NO: 27026 - DNA, 18 bp, Artificial sequence
  synthetic polynucleotide sequence
aaggggaggcctcgggga

SEQ ID NO: 27027 - DNA, 18 bp, Artificial sequence
  synthetic polynucleotide sequence
cctgcagatgcacccaga

SEQ ID NO: 27028 - DNA, 18 bp, Artificial sequence
  synthetic polynucleotide sequence
ggatggccactacacgca

SEQ ID NO: 27029 - DNA, 21 bp, Artificial sequence
  synthetic polynucleotide sequence
taccaagctatacagccgaca

SEQ ID NO: 27030 - DNA, 19 bp, Artificial sequence
  synthetic polynucleotide sequence
tggatagccaccactcgca

SEQ ID NO: 27031 - DNA, 25 bp, Artificial sequence
  synthetic polynucleotide sequence
tgggtgggaaatggctcaaacacaa

SEQ ID NO: 27032 - DNA, 25 bp, Artificial sequence
  synthetic polynucleotide sequence
cacacacaaagaaactagaggggga

SEQ ID NO: 27033 - DNA, 21 bp, Artificial sequence
  synthetic polynucleotide sequence
tggagatcttccccaacggca

SEQ ID NO: 27034 - DNA, 19 bp, Artificial sequence
  synthetic polynucleotide sequence
ccagagtccactccccgga

SEQ ID NO: 27035 - DNA, 20 bp, Artificial sequence
  synthetic polynucleotide sequence
gaagcccagcgggaagagca

SEQ ID NO: 27036 - DNA, 20 bp, Artificial sequence
  synthetic polynucleotide sequence
cgcgtgaaggccatgaacca

SEQ ID NO: 27037 - DNA, 18 bp, Artificial sequence
  synthetic polynucleotide sequence
cgatggcaccagcaagga

SEQ ID NO: 27038 - DNA, 19 bp, Artificial sequence
  synthetic polynucleotide sequence
tggtgaagcccacgtacca

SEQ ID NO: 27039 - DNA, 18 bp, Artificial sequence
  synthetic polynucleotide sequence
cagtgccaaacagcggca

SEQ ID NO: 27040 - DNA, 18 bp, Artificial sequence
  synthetic polynucleotide sequence
cctctgggaccatgggca

SEQ ID NO: 27041 - DNA, 18 bp, Artificial sequence
  synthetic polynucleotide sequence
gccacttcaaggacccca

SEQ ID NO: 27042 - DNA, 22 bp, Artificial sequence
  synthetic polynucleotide sequence
tagccaggtaacggttagcaca

SEQ ID NO: 27043 - DNA, 20 bp, Artificial sequence
  synthetic polynucleotide sequence
gtttaccagtccgaagccca

SEQ ID NO: 27044 - DNA, 18 bp, Artificial sequence
  synthetic polynucleotide sequence
gcaggcctggtagtggca

SEQ ID NO: 27045 - DNA, 20 bp, Artificial sequence
  synthetic polynucleotide sequence
cacaacacctacgcctcaca

SEQ ID NO: 27046 - DNA, 18 bp, Artificial sequence
  synthetic polynucleotide sequence
gggcaggaagtgggcgga

SEQ ID NO: 27047 - DNA, 22 bp, Artificial sequence
  synthetic polynucleotide sequence
aaaacgggtacgacgtctacca

SEQ ID NO: 27048 - DNA, 20 bp, Artificial sequence
  synthetic polynucleotide sequence
ctccgggacaggaactggga

SEQ ID NO: 27049 - DNA, 19 bp, Artificial sequence
  synthetic polynucleotide sequence
gaccacagggaccacgaga

SEQ ID NO: 27050 - DNA, 19 bp, Artificial sequence
  synthetic polynucleotide sequence
gcccagtctcgaagcctga

SEQ ID NO: 27051 - DNA, 18 bp, Artificial sequence
  synthetic polynucleotide sequence
cctccaggcgctccccga

SEQ ID NO: 27052 - DNA, 18 bp, Artificial sequence
  synthetic polynucleotide sequence
gctgctcatggccacgaa

SEQ ID NO: 27053 - DNA, 18 bp, Artificial sequence
  synthetic polynucleotide sequence
cctgggctcacggggaga

SEQ ID NO: 27054 - DNA, 20 bp, Artificial sequence
  synthetic polynucleotide sequence
gaggaggaggcagaagagga

SEQ ID NO: 27055 - DNA, 19 bp, Artificial sequence
  synthetic polynucleotide sequence
gagaaaccctcctgcccaa

SEQ ID NO: 27056 - DNA, 20 bp, Artificial sequence
  synthetic polynucleotide sequence
gtgacagtcatgatcgggga

SEQ ID NO: 27057 - DNA, 22 bp, Artificial sequence
  synthetic polynucleotide sequence
cgaacacagtggtacctgagga

SEQ ID NO: 27058 - DNA, 19 bp, Artificial sequence
  synthetic polynucleotide sequence
gccacaattccaactgcca

SEQ ID NO: 27059 - DNA, 18 bp, Artificial sequence
  synthetic polynucleotide sequence
caacggcaaaggcaagga

SEQ ID NO: 27060 - DNA, 18 bp, Artificial sequence
  synthetic polynucleotide sequence
ccttgcgggtgaaggcca

SEQ ID NO: 27061 - DNA, 21 bp, Artificial sequence
  synthetic polynucleotide sequence
ggaggcagctatactgcagga

SEQ ID NO: 27062 - DNA, 20 bp, Artificial sequence
  synthetic polynucleotide sequence
cacgcctcgaatgctgacca

SEQ ID NO: 27063 - DNA, 18 bp, Artificial sequence
  synthetic polynucleotide sequence
ctgagcaggaggagggca

SEQ ID NO: 27064 - DNA, 18 bp, Artificial sequence
  synthetic polynucleotide sequence
gagcgcagattccgggca

SEQ ID NO: 27065 - DNA, 18 bp, Artificial sequence
  synthetic polynucleotide sequence
gccgcaacacagaccaga

SEQ ID NO: 27066 - DNA, 18 bp, Artificial sequence
  synthetic polynucleotide sequence
catggtgaaggcgcctca

SEQ ID NO: 27067 - DNA, 22 bp, Artificial sequence
  synthetic polynucleotide sequence
aacccctcagagaggaagacca

SEQ ID NO: 27068 - DNA, 18 bp, Artificial sequence
  synthetic polynucleotide sequence
gtgccacttctcagcgca

SEQ ID NO: 27069 - DNA, 19 bp, Artificial sequence
  synthetic polynucleotide sequence
ctggaccagtactccccca

SEQ ID NO: 27070 - DNA, 18 bp, Artificial sequence
  synthetic polynucleotide sequence
gcagcggctcatgagaga

SEQ ID NO: 27071 - DNA, 19 bp, Artificial sequence
  synthetic polynucleotide sequence
caaggctgaactccgagca

SEQ ID NO: 27072 - DNA, 19 bp, Artificial sequence
  synthetic polynucleotide sequence
tctgcaacaagactagcca

SEQ ID NO: 27073 - DNA, 20 bp, Artificial sequence
  synthetic polynucleotide sequence
gagacatcggccacggtcca

SEQ ID NO: 27074 - DNA, 21 bp, Artificial sequence
  synthetic polynucleotide sequence
ataagttccaaggccgactga

SEQ ID NO: 27075 - DNA, 19 bp, Artificial sequence
  synthetic polynucleotide sequence
tcaacggcagacaccccca

SEQ ID NO: 27076 - DNA, 18 bp, Artificial sequence
  synthetic polynucleotide sequence
ctcccaggggcttgccca

SEQ ID NO: 27077 - DNA, 18 bp, Artificial sequence
  synthetic polynucleotide sequence
cgccaactgcacacacga

SEQ ID NO: 27078 - DNA, 18 bp, Artificial sequence
  synthetic polynucleotide sequence
gctcgaaaggcgccgaca

SEQ ID NO: 27079 - DNA, 20 bp, Artificial sequence
  synthetic polynucleotide sequence
gaccgggtgtacacacacca

SEQ ID NO: 27080 - DNA, 18 bp, Artificial sequence
  synthetic polynucleotide sequence
acagctcctccaccggga

SEQ ID NO: 27081 - DNA, 18 bp, Artificial sequence
  synthetic polynucleotide sequence
gccttggcgccaacacca

SEQ ID NO: 27082 - DNA, 18 bp, Artificial sequence
  synthetic polynucleotide sequence
caggctagtggccgagga

SEQ ID NO: 27083 - DNA, 19 bp, Artificial sequence
  synthetic polynucleotide sequence
gagaaaggctgggacgaca

SEQ ID NO: 27084 - DNA, 18 bp, Artificial sequence
  synthetic polynucleotide sequence
cgaccgcaatcccaggga

SEQ ID NO: 27085 - DNA, 19 bp, Artificial sequence
  synthetic polynucleotide sequence
tcagcacgtgggacagaga

SEQ ID NO: 27086 - DNA, 20 bp, Artificial sequence
  synthetic polynucleotide sequence
gaataccaccacccatgcca

SEQ ID NO: 27087 - DNA, 24 bp, Artificial sequence
  synthetic polynucleotide sequence
taactataatggcacagctggaga

SEQ ID NO: 27088 - DNA, 20 bp, Artificial sequence
  synthetic polynucleotide sequence
tacagcccacagttcccaga

SEQ ID NO: 27089 - DNA, 18 bp, Artificial sequence
  synthetic polynucleotide sequence
cccaggtagctgagggca

SEQ ID NO: 27090 - DNA, 18 bp, Artificial sequence
  synthetic polynucleotide sequence
atgagacgcgccaagcca

SEQ ID NO: 27091 - DNA, 19 bp, Artificial sequence
  synthetic polynucleotide sequence
cccaagtcatggggaacca

SEQ ID NO: 27092 - DNA, 18 bp, Artificial sequence
  synthetic polynucleotide sequence
ctgaagcatcccccagca

SEQ ID NO: 27093 - DNA, 22 bp, Artificial sequence
  synthetic polynucleotide sequence
agatagaacccgtccacactga

SEQ ID NO: 27094 - DNA, 18 bp, Artificial sequence
  synthetic polynucleotide sequence
gacctcctcgtgccggga

SEQ ID NO: 27095 - DNA, 18 bp, Artificial sequence
  synthetic polynucleotide sequence
ccagggacaaacccacca

SEQ ID NO: 27096 - DNA, 18 bp, Artificial sequence
  synthetic polynucleotide sequence
ggtcagggtccgcacaga

SEQ ID NO: 27097 - DNA, 18 bp, Artificial sequence
  synthetic polynucleotide sequence
cccgctgcggccagtgga

SEQ ID NO: 27098 - DNA, 22 bp, Artificial sequence
  synthetic polynucleotide sequence
ggaaaaggtgagagaggtccca

SEQ ID NO: 27099 - DNA, 20 bp, Artificial sequence
  synthetic polynucleotide sequence
caaggggaccgtctggcaca

SEQ ID NO: 27100 - DNA, 21 bp, Artificial sequence
  synthetic polynucleotide sequence
catggcaagtcacgcagtaga

SEQ ID NO: 27101 - DNA, 18 bp, Artificial sequence
  synthetic polynucleotide sequence
accaaccccatcagcgga

SEQ ID NO: 27102 - DNA, 18 bp, Artificial sequence
  synthetic polynucleotide sequence
tgaggaagccacgcccca

SEQ ID NO: 27103 - DNA, 21 bp, Artificial sequence
  synthetic polynucleotide sequence
ctgacacagggtggagtgaca

SEQ ID NO: 27104 - DNA, 22 bp, Artificial sequence
  synthetic polynucleotide sequence
aaaacaggccacacagtaggga

SEQ ID NO: 27105 - DNA, 21 bp, Artificial sequence
  synthetic polynucleotide sequence
ctgcgtggactgctacaacca

SEQ ID NO: 27106 - DNA, 21 bp, Artificial sequence
  synthetic polynucleotide sequence
tcaggaagcctttacccacca

SEQ ID NO: 27107 - DNA, 21 bp, Artificial sequence
  synthetic polynucleotide sequence
gcatccccagaagaaccccca

SEQ ID NO: 27108 - DNA, 20 bp, Artificial sequence
  synthetic polynucleotide sequence
ccctagcagctaaggcacga

SEQ ID NO: 27109 - DNA, 18 bp, Artificial sequence
  synthetic polynucleotide sequence
cgtcaagtcagccaccca

SEQ ID NO: 27110 - DNA, 18 bp, Artificial sequence
  synthetic polynucleotide sequence
aggtgccaaccaagccca

SEQ ID NO: 27111 - DNA, 20 bp, Artificial sequence
  synthetic polynucleotide sequence
cctcctgaagcacagcggca

SEQ ID NO: 27112 - DNA, 20 bp, Artificial sequence
  synthetic polynucleotide sequence
tggcagttgcggtaccacca

SEQ ID NO: 27113 - DNA, 20 bp, Artificial sequence
  synthetic polynucleotide sequence
gagagcaggctcaacgagga

SEQ ID NO: 27114 - DNA, 18 bp, Artificial sequence
  synthetic polynucleotide sequence
gtccctgagccccacaga

SEQ ID NO: 27115 - DNA, 19 bp, Artificial sequence
  synthetic polynucleotide sequence
gccgccaagctgacccaca

SEQ ID NO: 27116 - DNA, 20 bp, Artificial sequence
  synthetic polynucleotide sequence
gtgcccatgtagcggtccca

SEQ ID NO: 27117 - DNA, 18 bp, Artificial sequence
  synthetic polynucleotide sequence
gcccatcaccatccgcaa

SEQ ID NO: 27118 - DNA, 18 bp, Artificial sequence
  synthetic polynucleotide sequence
cacttggcgatgaagcga

SEQ ID NO: 27119 - DNA, 21 bp, Artificial sequence
  synthetic polynucleotide sequence
tgatgcaggagacagtgccaa

SEQ ID NO: 27120 - DNA, 21 bp, Artificial sequence
  synthetic polynucleotide sequence
tgttgactctgccccagctga

SEQ ID NO: 27121 - DNA, 22 bp, Artificial sequence
  synthetic polynucleotide sequence
atcctcggcaagacagctgtca

SEQ ID NO: 27122 - DNA, 21 bp, Artificial sequence
  synthetic polynucleotide sequence
gtagacatcacactgtggcga

SEQ ID NO: 27123 - DNA, 20 bp, Artificial sequence
  synthetic polynucleotide sequence
gacggccttacctcggagca

SEQ ID NO: 27124 - DNA, 21 bp, Artificial sequence
  synthetic polynucleotide sequence
gcgactagtccagaaccggca

SEQ ID NO: 27125 - DNA, 19 bp, Artificial sequence
  synthetic polynucleotide sequence
cccatgttgaggccagaca

SEQ ID NO: 27126 - DNA, 19 bp, Artificial sequence
  synthetic polynucleotide sequence
ctgacaccttgcaacagca

SEQ ID NO: 27127 - DNA, 20 bp, Artificial sequence
  synthetic polynucleotide sequence
gggagttgcaggccagagaa

SEQ ID NO: 27128 - DNA, 20 bp, Artificial sequence
  synthetic polynucleotide sequence
atctcggtgcaggacccgca

SEQ ID NO: 27129 - DNA, 20 bp, Artificial sequence
  synthetic polynucleotide sequence
gccagagcacagaccccaga

SEQ ID NO: 27130 - DNA, 20 bp, Artificial sequence
  synthetic polynucleotide sequence
gatgactgccggtctgggga

SEQ ID NO: 27131 - DNA, 21 bp, Artificial sequence
  synthetic polynucleotide sequence
ctatcagccgagtagaaggca

SEQ ID NO: 27132 - DNA, 19 bp, Artificial sequence
  synthetic polynucleotide sequence
gacagtcggaggaggtgga

SEQ ID NO: 27133 - DNA, 20 bp, Artificial sequence
  synthetic polynucleotide sequence
cagaacaaccaggccaagga

SEQ ID NO: 27134 - DNA, 18 bp, Artificial sequence
  synthetic polynucleotide sequence
ccagggccatgcctccca

SEQ ID NO: 27135 - DNA, 19 bp, Artificial sequence
  synthetic polynucleotide sequence
gcttcgagccactgcccca

SEQ ID NO: 27136 - DNA, 21 bp, Artificial sequence
  synthetic polynucleotide sequence
tcagcaggaagacaaggcgca

SEQ ID NO: 27137 - DNA, 22 bp, Artificial sequence
  synthetic polynucleotide sequence
aacatcgaacactacacgggca

SEQ ID NO: 27138 - DNA, 19 bp, Artificial sequence
  synthetic polynucleotide sequence
tcacctcatgcagcacaga

SEQ ID NO: 27139 - DNA, 20 bp, Artificial sequence
  synthetic polynucleotide sequence
atccctaggggaagggggca

SEQ ID NO: 27140 - DNA, 19 bp, Artificial sequence
  synthetic polynucleotide sequence
ggagagggacgagggggca

SEQ ID NO: 27141 - DNA, 18 bp, Artificial sequence
  synthetic polynucleotide sequence
cgaccggctcgtaagcaa

SEQ ID NO: 27142 - DNA, 20 bp, Artificial sequence
  synthetic polynucleotide sequence
gaacacgcacactgactgca

SEQ ID NO: 27143 - DNA, 20 bp, Artificial sequence
  synthetic polynucleotide sequence
cagctactcccgcaaccaca

SEQ ID NO: 27144 - DNA, 18 bp, Artificial sequence
  synthetic polynucleotide sequence
cgttcccccatgcaggca

SEQ ID NO: 27145 - DNA, 19 bp, Artificial sequence
  synthetic polynucleotide sequence
ggcctatggaaaacgggga

SEQ ID NO: 27146 - DNA, 20 bp, Artificial sequence
  synthetic polynucleotide sequence
gtgcaatcagctccacgtca

SEQ ID NO: 27147 - DNA, 22 bp, Artificial sequence
  synthetic polynucleotide sequence
aaacataacaatggtcagccca

SEQ ID NO: 27148 - DNA, 19 bp, Artificial sequence
  synthetic polynucleotide sequence
tccatagcccagagcagga

SEQ ID NO: 27149 - DNA, 19 bp, Artificial sequence
  synthetic polynucleotide sequence
cctcctcaggccctcacca

SEQ ID NO: 27150 - DNA, 21 bp, Artificial sequence
  synthetic polynucleotide sequence
gaattgaagtcgggggcccta

SEQ ID NO: 27151 - DNA, 19 bp, Artificial sequence
  synthetic polynucleotide sequence
gtgtgggtcagagagccaa

SEQ ID NO: 27152 - DNA, 20 bp, Artificial sequence
  synthetic polynucleotide sequence
aagctccacatcgaagacga

SEQ ID NO: 27153 - DNA, 18 bp, Artificial sequence
  synthetic polynucleotide sequence
catcaagggctgggacca

SEQ ID NO: 27154 - DNA, 20 bp, Artificial sequence
  synthetic polynucleotide sequence
ataccctagctcggatggga

SEQ ID NO: 27155 - DNA, 18 bp, Artificial sequence
  synthetic polynucleotide sequence
ctggatgagggtccacca

SEQ ID NO: 27156 - DNA, 21 bp, Artificial sequence
  synthetic polynucleotide sequence
agtcaagagagcttcatccca

SEQ ID NO: 27157 - DNA, 18 bp, Artificial sequence
  synthetic polynucleotide sequence
tgggggaggtgtgccaca

SEQ ID NO: 27158 - DNA, 18 bp, Artificial sequence
  synthetic polynucleotide sequence
ccagtgcaacctccacga

SEQ ID NO: 27159 - DNA, 19 bp, Artificial sequence
  synthetic polynucleotide sequence
gtcatcaaggcatgggaca

SEQ ID NO: 27160 - DNA, 18 bp, Artificial sequence
  synthetic polynucleotide sequence
agggagactgccagccga

SEQ ID NO: 27161 - DNA, 19 bp, Artificial sequence
  synthetic polynucleotide sequence
cggagaggagagctggcca

SEQ ID NO: 27162 - DNA, 20 bp, Artificial sequence
  synthetic polynucleotide sequence
gtctgactcagcacagtcca

SEQ ID NO: 27163 - DNA, 23 bp, Artificial sequence
  synthetic polynucleotide sequence
caaaagaaagaggagagcaccga

SEQ ID NO: 27164 - DNA, 21 bp, Artificial sequence
  synthetic polynucleotide sequence
tctttagccaggtagccgtca

SEQ ID NO: 27165 - DNA, 22 bp, Artificial sequence
  synthetic polynucleotide sequence
ccaacaagacgatccacgcaga

SEQ ID NO: 27166 - DNA, 19 bp, Artificial sequence
  synthetic polynucleotide sequence
ggcaacagcagtcgcccca

SEQ ID NO: 27167 - DNA, 20 bp, Artificial sequence
  synthetic polynucleotide sequence
cagctactctcggaaccgca

SEQ ID NO: 27168 - DNA, 18 bp, Artificial sequence
  synthetic polynucleotide sequence
aggtgaggcgggaccaca

SEQ ID NO: 27169 - DNA, 18 bp, Artificial sequence
  synthetic polynucleotide sequence
ccgaaggggggttgccca

SEQ ID NO: 27170 - DNA, 21 bp, Artificial sequence
  synthetic polynucleotide sequence
cctgaatgaccaccttcccca

SEQ ID NO: 27171 - DNA, 20 bp, Artificial sequence
  synthetic polynucleotide sequence
gaccaccggcaggatgtgga

SEQ ID NO: 27172 - DNA, 20 bp, Artificial sequence
  synthetic polynucleotide sequence
gggcccgaacttgagctcca

SEQ ID NO: 27173 - DNA, 21 bp, Artificial sequence
  synthetic polynucleotide sequence
tgacaggccagagttacagca

SEQ ID NO: 27174 - DNA, 21 bp, Artificial sequence
  synthetic polynucleotide sequence
aagttccactgctcagccaga

SEQ ID NO: 27175 - DNA, 20 bp, Artificial sequence
  synthetic polynucleotide sequence
tgctggaggggatgaaggga

SEQ ID NO: 27176 - DNA, 18 bp, Artificial sequence
  synthetic polynucleotide sequence
ccagcgatccctggggca

SEQ ID NO: 27177 - DNA, 18 bp, Artificial sequence
  synthetic polynucleotide sequence
atcgtggaggtccacgca

SEQ ID NO: 27178 - DNA, 18 bp, Artificial sequence
  synthetic polynucleotide sequence
ggctcccactggtcacca

SEQ ID NO: 27179 - DNA, 21 bp, Artificial sequence
  synthetic polynucleotide sequence
catgggcagtcaggatccaga

SEQ ID NO: 27180 - DNA, 20 bp, Artificial sequence
  synthetic polynucleotide sequence
ctggaagcagacccagacca

SEQ ID NO: 27181 - DNA, 22 bp, Artificial sequence
  synthetic polynucleotide sequence
acaaagacagccaggatccaca

SEQ ID NO: 27182 - DNA, 19 bp, Artificial sequence
  synthetic polynucleotide sequence
gctgccaccagaaggccca

SEQ ID NO: 27183 - DNA, 18 bp, Artificial sequence
  synthetic polynucleotide sequence
cctcccaccacagcagga

SEQ ID NO: 27184 - DNA, 18 bp, Artificial sequence
  synthetic polynucleotide sequence
acgctgcagtccaccgga

SEQ ID NO: 27185 - DNA, 18 bp, Artificial sequence
  synthetic polynucleotide sequence
ggaagccttccacggcaa

SEQ ID NO: 27186 - DNA, 18 bp, Artificial sequence
  synthetic polynucleotide sequence
acagtgcggcactcagca

SEQ ID NO: 27187 - DNA, 18 bp, Artificial sequence
  synthetic polynucleotide sequence
tgcccaacttccccagca

SEQ ID NO: 27188 - DNA, 18 bp, Artificial sequence
  synthetic polynucleotide sequence
ccctcaataccaggccca

SEQ ID NO: 27189 - DNA, 20 bp, Artificial sequence
  synthetic polynucleotide sequence
gtgtctgagctggagccaga

SEQ ID NO: 27190 - DNA, 18 bp, Artificial sequence
  synthetic polynucleotide sequence
tgccataggcggacacca

SEQ ID NO: 27191 - DNA, 19 bp, Artificial sequence
  synthetic polynucleotide sequence
gtcaccagcctccaggaga

SEQ ID NO: 27192 - DNA, 18 bp, Artificial sequence
  synthetic polynucleotide sequence
tcgatggagtggacgcca

SEQ ID NO: 27193 - DNA, 19 bp, Artificial sequence
  synthetic polynucleotide sequence
ccccaggtggcagaggaga

SEQ ID NO: 27194 - DNA, 20 bp, Artificial sequence
  synthetic polynucleotide sequence
ccacactctctggcaggcga

SEQ ID NO: 27195 - DNA, 18 bp, Artificial sequence
  synthetic polynucleotide sequence
caaaatcggggaggcgga

SEQ ID NO: 27196 - DNA, 18 bp, Artificial sequence
  synthetic polynucleotide sequence
gcagggcctctagcacca

SEQ ID NO: 27197 - DNA, 20 bp, Artificial sequence
  synthetic polynucleotide sequence
tacaaccggggcagcaggaa

SEQ ID NO: 27198 - DNA, 19 bp, Artificial sequence
  synthetic polynucleotide sequence
ctgctgccgttggagggga

SEQ ID NO: 27199 - DNA, 19 bp, Artificial sequence
  synthetic polynucleotide sequence
tcctgactgggatggcaga

SEQ ID NO: 27200 - DNA, 21 bp, Artificial sequence
  synthetic polynucleotide sequence
cacggtgaagagagagagcca

SEQ ID NO: 27201 - DNA, 25 bp, Artificial sequence
  synthetic polynucleotide sequence
caaccctacaaccaccctcaatcga

SEQ ID NO: 27202 - DNA, 20 bp, Artificial sequence
  synthetic polynucleotide sequence
ggcaatggtaaccagggcca

SEQ ID NO: 27203 - DNA, 19 bp, Artificial sequence
  synthetic polynucleotide sequence
tctggcacccctgtaacca

SEQ ID NO: 27204 - DNA, 20 bp, Artificial sequence
  synthetic polynucleotide sequence
cacaaccaaggtgctagcca

SEQ ID NO: 27205 - DNA, 18 bp, Artificial sequence
  synthetic polynucleotide sequence
tcgcagaagcatcggcaa

SEQ ID NO: 27206 - DNA, 20 bp, Artificial sequence
  synthetic polynucleotide sequence
tgcacagcacttgaccagga

SEQ ID NO: 27207 - DNA, 18 bp, Artificial sequence
  synthetic polynucleotide sequence
gctcgggactcagtggga

SEQ ID NO: 27208 - DNA, 19 bp, Artificial sequence
  synthetic polynucleotide sequence
catcttggacccagcgaca

SEQ ID NO: 27209 - DNA, 18 bp, Artificial sequence
  synthetic polynucleotide sequence
caacaaggtgggccagga

SEQ ID NO: 27210 - DNA, 18 bp, Artificial sequence
  synthetic polynucleotide sequence
cttggcagctcaggagca

SEQ ID NO: 27211 - DNA, 19 bp, Artificial sequence
  synthetic polynucleotide sequence
ctggcctacgtgcccctca

SEQ ID NO: 27212 - DNA, 22 bp, Artificial sequence
  synthetic polynucleotide sequence
acctctttgggcccaaaccaca

SEQ ID NO: 27213 - DNA, 18 bp, Artificial sequence
  synthetic polynucleotide sequence
tgaagctgggcagcctga

SEQ ID NO: 27214 - DNA, 20 bp, Artificial sequence
  synthetic polynucleotide sequence
caggagggaccaagaaccca

SEQ ID NO: 27215 - DNA, 19 bp, Artificial sequence
  synthetic polynucleotide sequence
gagaaggcggctggggaga

SEQ ID NO: 27216 - DNA, 18 bp, Artificial sequence
  synthetic polynucleotide sequence
ggcgggtggcagtgacca

SEQ ID NO: 27217 - DNA, 21 bp, Artificial sequence
  synthetic polynucleotide sequence
cagcctccaaagacagcacca

SEQ ID NO: 27218 - DNA, 18 bp, Artificial sequence
  synthetic polynucleotide sequence
cggggtgggtctggagga

SEQ ID NO: 27219 - DNA, 21 bp, Artificial sequence
  synthetic polynucleotide sequence
atccggaaacatgtggcccta

SEQ ID NO: 27220 - DNA, 19 bp, Artificial sequence
  synthetic polynucleotide sequence
ctcccagcccttccctcca

SEQ ID NO: 27221 - DNA, 20 bp, Artificial sequence
  synthetic polynucleotide sequence
tctgtctccaaggctcccca

SEQ ID NO: 27222 - DNA, 20 bp, Artificial sequence
  synthetic polynucleotide sequence
gtggctccaaggtgtcagca

SEQ ID NO: 27223 - DNA, 21 bp, Artificial sequence
  synthetic polynucleotide sequence
ccaactcgcccaccatggaca

SEQ ID NO: 27224 - DNA, 21 bp, Artificial sequence
  synthetic polynucleotide sequence
ggagaagaacaggcctgggga

SEQ ID NO: 27225 - DNA, 22 bp, Artificial sequence
  synthetic polynucleotide sequence
aacagggccaaaaatcttgcca

SEQ ID NO: 27226 - DNA, 23 bp, Artificial sequence
  synthetic polynucleotide sequence
catcaagcattccacaaagtcca

SEQ ID NO: 27227 - DNA, 20 bp, Artificial sequence
  synthetic polynucleotide sequence
taccaagtccactgaccgga

SEQ ID NO: 27228 - DNA, 18 bp, Artificial sequence
  synthetic polynucleotide sequence
ccttcacgtccagcagca

SEQ ID NO: 27229 - DNA, 20 bp, Artificial sequence
  synthetic polynucleotide sequence
atgctcctaacggatccaca

SEQ ID NO: 27230 - DNA, 18 bp, Artificial sequence
  synthetic polynucleotide sequence
ctgggccagtcaagcgga

SEQ ID NO: 27231 - DNA, 20 bp, Artificial sequence
  synthetic polynucleotide sequence
ccgcaatgtactgccacgaa

SEQ ID NO: 27232 - DNA, 21 bp, Artificial sequence
  synthetic polynucleotide sequence
cagagtagacgacttgggaca

SEQ ID NO: 27233 - DNA, 20 bp, Artificial sequence
  synthetic polynucleotide sequence
ctcagccgcacagcagaaca

SEQ ID NO: 27234 - DNA, 22 bp, Artificial sequence
  synthetic polynucleotide sequence
ccaaatcgagtgacgagcagca

SEQ ID NO: 27235 - DNA, 21 bp, Artificial sequence
  synthetic polynucleotide sequence
catgggccctggaaaatggga

SEQ ID NO: 27236 - DNA, 21 bp, Artificial sequence
  synthetic polynucleotide sequence
tgacatggaggcaggcttgga

SEQ ID NO: 27237 - DNA, 19 bp, Artificial sequence
  synthetic polynucleotide sequence
ggctccagggaggatgaca

SEQ ID NO: 27238 - DNA, 21 bp, Artificial sequence
  synthetic polynucleotide sequence
ctaagggctgaatcaagccta

SEQ ID NO: 27239 - DNA, 21 bp, Artificial sequence
  synthetic polynucleotide sequence
tctcctacaaccagctgcaga

SEQ ID NO: 27240 - DNA, 18 bp, Artificial sequence
  synthetic polynucleotide sequence
gcacctgcagcttggaga

SEQ ID NO: 27241 - DNA, 20 bp, Artificial sequence
  synthetic polynucleotide sequence
cagctggagagttcaaggca

SEQ ID NO: 27242 - DNA, 22 bp, Artificial sequence
  synthetic polynucleotide sequence
tagatcaatagcagtgacccca

SEQ ID NO: 27243 - DNA, 18 bp, Artificial sequence
  synthetic polynucleotide sequence
catcatcggggaccacga

SEQ ID NO: 27244 - DNA, 20 bp, Artificial sequence
  synthetic polynucleotide sequence
aatgggcagacataccagga

SEQ ID NO: 27245 - DNA, 18 bp, Artificial sequence
  synthetic polynucleotide sequence
ccaccggaagatccccaa

SEQ ID NO: 27246 - DNA, 18 bp, Artificial sequence
  synthetic polynucleotide sequence
tcgcatggtgcccaagga

SEQ ID NO: 27247 - DNA, 20 bp, Artificial sequence
  synthetic polynucleotide sequence
ccagccttactccacgggga

SEQ ID NO: 27248 - DNA, 21 bp, Artificial sequence
  synthetic polynucleotide sequence
ctaaagcccccaaacatgcca

SEQ ID NO: 27249 - DNA, 18 bp, Artificial sequence
  synthetic polynucleotide sequence
ccctccctgccataggga

SEQ ID NO: 27250 - DNA, 18 bp, Artificial sequence
  synthetic polynucleotide sequence
cgaatgcgggtccagcca

SEQ ID NO: 27251 - DNA, 22 bp, Artificial sequence
  synthetic polynucleotide sequence
aacaggtgggagaggagacaga

SEQ ID NO: 27252 - DNA, 22 bp, Artificial sequence
  synthetic polynucleotide sequence
atcaaactcattgtggtgacca

SEQ ID NO: 27253 - DNA, 22 bp, Artificial sequence
  synthetic polynucleotide sequence
accagctcccaaaatgccacca

SEQ ID NO: 27254 - DNA, 21 bp, Artificial sequence
  synthetic polynucleotide sequence
tctctgccatgccactaacca

SEQ ID NO: 27255 - DNA, 18 bp, Artificial sequence
  synthetic polynucleotide sequence
gactgccatggacggcaa

SEQ ID NO: 27256 - DNA, 19 bp, Artificial sequence
  synthetic polynucleotide sequence
cctgacaggctcctgacga

SEQ ID NO: 27257 - DNA, 19 bp, Artificial sequence
  synthetic polynucleotide sequence
ctgcccgacgtgcacgaca

SEQ ID NO: 27258 - DNA, 18 bp, Artificial sequence
  synthetic polynucleotide sequence
cgcagatggagccgccca

SEQ ID NO: 27259 - DNA, 20 bp, Artificial sequence
  synthetic polynucleotide sequence
tcaccatccagccagccaca

SEQ ID NO: 27260 - DNA, 21 bp, Artificial sequence
  synthetic polynucleotide sequence
ggttgggcagcaggtttcgga

SEQ ID NO: 27261 - DNA, 21 bp, Artificial sequence
  synthetic polynucleotide sequence
agtggggaggagttgaaggaa

SEQ ID NO: 27262 - DNA, 22 bp, Artificial sequence
  synthetic polynucleotide sequence
aagacaggtcacaatgccagga

SEQ ID NO: 27263 - DNA, 22 bp, Artificial sequence
  synthetic polynucleotide sequence
agtacaggttggaatggggaga

SEQ ID NO: 27264 - DNA, 22 bp, Artificial sequence
  synthetic polynucleotide sequence
agaaggtgaatcagggtaggca

SEQ ID NO: 27265 - DNA, 19 bp, Artificial sequence
  synthetic polynucleotide sequence
ccccgggtgcacttccgaa

SEQ ID NO: 27266 - DNA, 21 bp, Artificial sequence
  synthetic polynucleotide sequence
cagcccaattacagcagccca

SEQ ID NO: 27267 - DNA, 21 bp, Artificial sequence
  synthetic polynucleotide sequence
tccacgtgcaggccatctcca

SEQ ID NO: 27268 - DNA, 22 bp, Artificial sequence
  synthetic polynucleotide sequence
aggaccacgacgatgatcagca

SEQ ID NO: 27269 - DNA, 20 bp, Artificial sequence
  synthetic polynucleotide sequence
gccaccgggttgactgcaga

SEQ ID NO: 27270 - DNA, 20 bp, Artificial sequence
  synthetic polynucleotide sequence
gccagtagatccggatgcca

SEQ ID NO: 27271 - DNA, 21 bp, Artificial sequence
  synthetic polynucleotide sequence
tggggtggggaagtggtgcaa

SEQ ID NO: 27272 - DNA, 18 bp, Artificial sequence
  synthetic polynucleotide sequence
gcatctcctccggcccga

SEQ ID NO: 27273 - DNA, 21 bp, Artificial sequence
  synthetic polynucleotide sequence
tcagagggaggaagacctgca

SEQ ID NO: 27274 - DNA, 18 bp, Artificial sequence
  synthetic polynucleotide sequence
gcacccgcatcaggggca

SEQ ID NO: 27275 - DNA, 21 bp, Artificial sequence
  synthetic polynucleotide sequence
tagccagagacgagtgacaga

SEQ ID NO: 27276 - DNA, 21 bp, Artificial sequence
  synthetic polynucleotide sequence
caatccccagaaccactccca

SEQ ID NO: 27277 - DNA, 21 bp, Artificial sequence
  synthetic polynucleotide sequence
aagtggagctgcctctgccaa

SEQ ID NO: 27278 - DNA, 20 bp, Artificial sequence
  synthetic polynucleotide sequence
tgtgtggacaaggtcggcca

SEQ ID NO: 27279 - DNA, 21 bp, Artificial sequence
  synthetic polynucleotide sequence
agcagcagcacaaggaagaga

SEQ ID NO: 27280 - DNA, 20 bp, Artificial sequence
  synthetic polynucleotide sequence
tacaggacataggagggcga

SEQ ID NO: 27281 - DNA, 20 bp, Artificial sequence
  synthetic polynucleotide sequence
tgacaagccggcagatgcga

SEQ ID NO: 27282 - DNA, 18 bp, Artificial sequence
  synthetic polynucleotide sequence
tccagaagcccccccgca

SEQ ID NO: 27283 - DNA, 21 bp, Artificial sequence
  synthetic polynucleotide sequence
tgatgccaatcggatcgccca

SEQ ID NO: 27284 - DNA, 21 bp, Artificial sequence
  synthetic polynucleotide sequence
tgtgcagaatcatccaggcca

SEQ ID NO: 27285 - DNA, 18 bp, Artificial sequence
  synthetic polynucleotide sequence
atgctccaagcagccaca

SEQ ID NO: 27286 - DNA, 18 bp, Artificial sequence
  synthetic polynucleotide sequence
tctctgcagctgcctgca

SEQ ID NO: 27287 - DNA, 20 bp, Artificial sequence
  synthetic polynucleotide sequence
cagcaactacagccgaggga

SEQ ID NO: 27288 - DNA, 18 bp, Artificial sequence
  synthetic polynucleotide sequence
gccccactcatggctgca

SEQ ID NO: 27289 - DNA, 18 bp, Artificial sequence
  synthetic polynucleotide sequence
ggcaaccccaacgaggaa

SEQ ID NO: 27290 - DNA, 18 bp, Artificial sequence
  synthetic polynucleotide sequence
gttgcagcatcagggcca

SEQ ID NO: 27291 - DNA, 18 bp, Artificial sequence
  synthetic polynucleotide sequence
ggagtgcccagcccagga

SEQ ID NO: 27292 - DNA, 18 bp, Artificial sequence
  synthetic polynucleotide sequence
ctggccgtgcagcaggca

SEQ ID NO: 27293 - DNA, 19 bp, Artificial sequence
  synthetic polynucleotide sequence
ccaagcggagacagaccaa

SEQ ID NO: 27294 - DNA, 20 bp, Artificial sequence
  synthetic polynucleotide sequence
agggtcattgaggagaggca

SEQ ID NO: 27295 - DNA, 18 bp, Artificial sequence
  synthetic polynucleotide sequence
cccttccagaccagccaa

SEQ ID NO: 27296 - DNA, 18 bp, Artificial sequence
  synthetic polynucleotide sequence
gagggcgagttcagggga

SEQ ID NO: 27297 - DNA, 18 bp, Artificial sequence
  synthetic polynucleotide sequence
cccccacactcatgacca

SEQ ID NO: 27298 - DNA, 20 bp, Artificial sequence
  synthetic polynucleotide sequence
aaagcgaggagggttggaga

SEQ ID NO: 27299 - DNA, 18 bp, Artificial sequence
  synthetic polynucleotide sequence
gtgaggagcccctgcaca

SEQ ID NO: 27300 - DNA, 18 bp, Artificial sequence
  synthetic polynucleotide sequence
gcggtgagccttggagca

SEQ ID NO: 27301 - DNA, 18 bp, Artificial sequence
  synthetic polynucleotide sequence
cctgaaaggggaccccca

SEQ ID NO: 27302 - DNA, 19 bp, Artificial sequence
  synthetic polynucleotide sequence
cgggcaacgtagagccgta

SEQ ID NO: 27303 - DNA, 20 bp, Artificial sequence
  synthetic polynucleotide sequence
agggccacacagatacccca

SEQ ID NO: 27304 - DNA, 25 bp, Artificial sequence
  synthetic polynucleotide sequence
ctgcaacaacagcaatggaggagaa

SEQ ID NO: 27305 - DNA, 20 bp, Artificial sequence
  synthetic polynucleotide sequence
gctcacccgcttcctccaca

SEQ ID NO: 27306 - DNA, 18 bp, Artificial sequence
  synthetic polynucleotide sequence
tcagccccgtagccccca

SEQ ID NO: 27307 - DNA, 21 bp, Artificial sequence
  synthetic polynucleotide sequence
gagaacatcatcgcgcgggaa

SEQ ID NO: 27308 - DNA, 18 bp, Artificial sequence
  synthetic polynucleotide sequence
ggagatgggggtggccga

SEQ ID NO: 27309 - DNA, 19 bp, Artificial sequence
  synthetic polynucleotide sequence
gagtccctgtaggcccgga

SEQ ID NO: 27310 - DNA, 18 bp, Artificial sequence
  synthetic polynucleotide sequence
acggtggatggcgccgga

SEQ ID NO: 27311 - DNA, 18 bp, Artificial sequence
  synthetic polynucleotide sequence
acaagcagggctggcaga

SEQ ID NO: 27312 - DNA, 20 bp, Artificial sequence
  synthetic polynucleotide sequence
gttgtaggagtccgggtcca

SEQ ID NO: 27313 - DNA, 18 bp, Artificial sequence
  synthetic polynucleotide sequence
cagcggggacctgaacca

SEQ ID NO: 27314 - DNA, 18 bp, Artificial sequence
  synthetic polynucleotide sequence
aatccccagccggtggga

SEQ ID NO: 27315 - DNA, 20 bp, Artificial sequence
  synthetic polynucleotide sequence
gccaagaacccgctggtgaa

SEQ ID NO: 27316 - DNA, 20 bp, Artificial sequence
  synthetic polynucleotide sequence
cggccgctgatgaactcaca

SEQ ID NO: 27317 - DNA, 20 bp, Artificial sequence
  synthetic polynucleotide sequence
ggtgggggtggagtgggcaa

SEQ ID NO: 27318 - DNA, 23 bp, Artificial sequence
  synthetic polynucleotide sequence
cttccacacagaccatcagacga

SEQ ID NO: 27319 - DNA, 18 bp, Artificial sequence
  synthetic polynucleotide sequence
gttcagggggcggcagca

SEQ ID NO: 27320 - DNA, 19 bp, Artificial sequence
  synthetic polynucleotide sequence
gtggcagtcgtccggctca

SEQ ID NO: 27321 - DNA, 21 bp, Artificial sequence
  synthetic polynucleotide sequence
cctgctggagagcaaacacga

SEQ ID NO: 27322 - DNA, 23 bp, Artificial sequence
  synthetic polynucleotide sequence
ccaggaaatgtgcaaatccggaa

SEQ ID NO: 27323 - DNA, 18 bp, Artificial sequence
  synthetic polynucleotide sequence
tcgcccggccagttcgga

SEQ ID NO: 27324 - DNA, 20 bp, Artificial sequence
  synthetic polynucleotide sequence
tcccaccgggataagcggca

SEQ ID NO: 27325 - DNA, 20 bp, Artificial sequence
  synthetic polynucleotide sequence
caagccgcctcctccaccga

SEQ ID NO: 27326 - DNA, 20 bp, Artificial sequence
  synthetic polynucleotide sequence
ccaggaagaagctgagggca

SEQ ID NO: 27327 - DNA, 20 bp, Artificial sequence
  synthetic polynucleotide sequence
tccacgcactccctggagca

SEQ ID NO: 27328 - DNA, 20 bp, Artificial sequence
  synthetic polynucleotide sequence
cggtcacacatgctgggcga

SEQ ID NO: 27329 - DNA, 20 bp, Artificial sequence
  synthetic polynucleotide sequence
agggcagactcaggtgggaa

SEQ ID NO: 27330 - DNA, 21 bp, Artificial sequence
  synthetic polynucleotide sequence
aggcaacgaagatcccacaga

SEQ ID NO: 27331 - DNA, 18 bp, Artificial sequence
  synthetic polynucleotide sequence
ctcgctgggcaacaacca

SEQ ID NO: 27332 - DNA, 18 bp, Artificial sequence
  synthetic polynucleotide sequence
aactggtctggcccgcga

SEQ ID NO: 27333 - DNA, 20 bp, Artificial sequence
  synthetic polynucleotide sequence
aaccctctccccagagccta

SEQ ID NO: 27334 - DNA, 21 bp, Artificial sequence
  synthetic polynucleotide sequence
taggcaagtaggaggtgggca

SEQ ID NO: 27335 - DNA, 20 bp, Artificial sequence
  synthetic polynucleotide sequence
cagtgacaagacggggcaga

SEQ ID NO: 27336 - DNA, 19 bp, Artificial sequence
  synthetic polynucleotide sequence
gggctgaattggctgagca

SEQ ID NO: 27337 - DNA, 20 bp, Artificial sequence
  synthetic polynucleotide sequence
aggacccatgctcacctcca

SEQ ID NO: 27338 - DNA, 20 bp, Artificial sequence
  synthetic polynucleotide sequence
tctgagatggaggtcgggga

SEQ ID NO: 27339 - DNA, 18 bp, Artificial sequence
  synthetic polynucleotide sequence
ctacgccaccaatccgca

SEQ ID NO: 27340 - DNA, 19 bp, Artificial sequence
  synthetic polynucleotide sequence
gcgtggcggaagtagcaga

SEQ ID NO: 27341 - DNA, 19 bp, Artificial sequence
  synthetic polynucleotide sequence
caggactggagaggccaca

SEQ ID NO: 27342 - DNA, 22 bp, Artificial sequence
  synthetic polynucleotide sequence
ggacaaggaagacctcagagga

SEQ ID NO: 27343 - DNA, 21 bp, Artificial sequence
  synthetic polynucleotide sequence
ccacaggcactcagcactcca

SEQ ID NO: 27344 - DNA, 21 bp, Artificial sequence
  synthetic polynucleotide sequence
gatgtcatctggaggcaggga

SEQ ID NO: 27345 - DNA, 21 bp, Artificial sequence
  synthetic polynucleotide sequence
gcctggaggagaaacccacca

SEQ ID NO: 27346 - DNA, 19 bp, Artificial sequence
  synthetic polynucleotide sequence
ggaaggtggtgctgcccga

SEQ ID NO: 27347 - DNA, 22 bp, Artificial sequence
  synthetic polynucleotide sequence
atcattcagacggcacagacca

SEQ ID NO: 27348 - DNA, 18 bp, Artificial sequence
  synthetic polynucleotide sequence
acctggccgtggaccgca

SEQ ID NO: 27349 - DNA, 21 bp, Artificial sequence
  synthetic polynucleotide sequence
gggagaagaggtctgcaacga

SEQ ID NO: 27350 - DNA, 20 bp, Artificial sequence
  synthetic polynucleotide sequence
cccggaagctgcaagctgaa

SEQ ID NO: 27351 - DNA, 22 bp, Artificial sequence
  synthetic polynucleotide sequence
aggagaaatgtgaaacccggca

SEQ ID NO: 27352 - DNA, 25 bp, Artificial sequence
  synthetic polynucleotide sequence
ttggtcccccaaacaacaagctaca

SEQ ID NO: 27353 - DNA, 21 bp, Artificial sequence
  synthetic polynucleotide sequence
ggctggaatcggtctccccaa

SEQ ID NO: 27354 - DNA, 18 bp, Artificial sequence
  synthetic polynucleotide sequence
tagagctgggccgccgga

SEQ ID NO: 27355 - DNA, 20 bp, Artificial sequence
  synthetic polynucleotide sequence
gagctcccgttcccagcaga

SEQ ID NO: 27356 - DNA, 21 bp, Artificial sequence
  synthetic polynucleotide sequence
tgctgagatccatcagcccca

SEQ ID NO: 27357 - DNA, 20 bp, Artificial sequence
  synthetic polynucleotide sequence
tggtgacctcatccccgaca

SEQ ID NO: 27358 - DNA, 20 bp, Artificial sequence
  synthetic polynucleotide sequence
ctgccaagtcacctgcccca

SEQ ID NO: 27359 - DNA, 22 bp, Artificial sequence
  synthetic polynucleotide sequence
catagagggagatgatgtgcca

SEQ ID NO: 27360 - DNA, 20 bp, Artificial sequence
  synthetic polynucleotide sequence
tggagagtgctcaatggcca

SEQ ID NO: 27361 - DNA, 18 bp, Artificial sequence
  synthetic polynucleotide sequence
gcacatcaggtccaccca

SEQ ID NO: 27362 - DNA, 18 bp, Artificial sequence
  synthetic polynucleotide sequence
ctcagtccgcatccggca

SEQ ID NO: 27363 - DNA, 21 bp, Artificial sequence
  synthetic polynucleotide sequence
gaagaactcggtgcggcacaa

SEQ ID NO: 27364 - DNA, 20 bp, Artificial sequence
  synthetic polynucleotide sequence
cgatgcgggccaggttcaga

SEQ ID NO: 27365 - DNA, 18 bp, Artificial sequence
  synthetic polynucleotide sequence
acctatggcagccaggca

SEQ ID NO: 27366 - DNA, 18 bp, Artificial sequence
  synthetic polynucleotide sequence
ggacgcccgttaactgca

SEQ ID NO: 27367 - DNA, 22 bp, Artificial sequence
  synthetic polynucleotide sequence
caccaattctaacgccagcaca

SEQ ID NO: 27368 - DNA, 20 bp, Artificial sequence
  synthetic polynucleotide sequence
gctgtagagcatgggcgaga

SEQ ID NO: 27369 - DNA, 18 bp, Artificial sequence
  synthetic polynucleotide sequence
ccttccgtccacgaagca

SEQ ID NO: 27370 - DNA, 21 bp, Artificial sequence
  synthetic polynucleotide sequence
gaagaggtgagattgagccca

SEQ ID NO: 27371 - DNA, 20 bp, Artificial sequence
  synthetic polynucleotide sequence
cccggcgcgtatcgtaggca

SEQ ID NO: 27372 - DNA, 20 bp, Artificial sequence
  synthetic polynucleotide sequence
ctcgacacggcacacacgca

SEQ ID NO: 27373 - DNA, 18 bp, Artificial sequence
  synthetic polynucleotide sequence
gaagagctgaacggggca

SEQ ID NO: 27374 - DNA, 18 bp, Artificial sequence
  synthetic polynucleotide sequence
caggatgcacggcttgca

SEQ ID NO: 27375 - DNA, 22 bp, Artificial sequence
  synthetic polynucleotide sequence
tgaacacgcattggatgaccga

SEQ ID NO: 27376 - DNA, 19 bp, Artificial sequence
  synthetic polynucleotide sequence
ttgggctctgagggtcgca

SEQ ID NO: 27377 - DNA, 20 bp, Artificial sequence
  synthetic polynucleotide sequence
catcctgccacctggaagaa

SEQ ID NO: 27378 - DNA, 19 bp, Artificial sequence
  synthetic polynucleotide sequence
cggaactccagctcatcca

SEQ ID NO: 27379 - DNA, 19 bp, Artificial sequence
  synthetic polynucleotide sequence
ggactgtggacgagcggga

SEQ ID NO: 27380 - DNA, 19 bp, Artificial sequence
  synthetic polynucleotide sequence
gggctgttgaggaggggga

SEQ ID NO: 27381 - DNA, 21 bp, Artificial sequence
  synthetic polynucleotide sequence
cccccctaagtacatcaggga

SEQ ID NO: 27382 - DNA, 20 bp, Artificial sequence
  synthetic polynucleotide sequence
acacggatgggggcccagaa

SEQ ID NO: 27383 - DNA, 22 bp, Artificial sequence
  synthetic polynucleotide sequence
aaccagacgacaactccctcca

SEQ ID NO: 27384 - DNA, 21 bp, Artificial sequence
  synthetic polynucleotide sequence
atctcctgcacactgaggcca

SEQ ID NO: 27385 - DNA, 21 bp, Artificial sequence
  synthetic polynucleotide sequence
gctacctgtggagccgaggaa

SEQ ID NO: 27386 - DNA, 20 bp, Artificial sequence
  synthetic polynucleotide sequence
cctgctcagtggggctacga

SEQ ID NO: 27387 - DNA, 20 bp, Artificial sequence
  synthetic polynucleotide sequence
gtgaggttccgccctgcaca

SEQ ID NO: 27388 - DNA, 21 bp, Artificial sequence
  synthetic polynucleotide sequence
tcagaggtaggatgtgcccga

SEQ ID NO: 27389 - DNA, 18 bp, Artificial sequence
  synthetic polynucleotide sequence
cctcccctgcaccaccca

SEQ ID NO: 27390 - DNA, 20 bp, Artificial sequence
  synthetic polynucleotide sequence
cctggcgtccggtataggca

SEQ ID NO: 27391 - DNA, 18 bp, Artificial sequence
  synthetic polynucleotide sequence
aaagggcctcctcaccca

SEQ ID NO: 27392 - DNA, 19 bp, Artificial sequence
  synthetic polynucleotide sequence
ggctccagcagcttcagga

SEQ ID NO: 27393 - DNA, 20 bp, Artificial sequence
  synthetic polynucleotide sequence
gctgggggtgacattgccga

SEQ ID NO: 27394 - DNA, 20 bp, Artificial sequence
  synthetic polynucleotide sequence
tccaggtcccaaagcctgca

SEQ ID NO: 27395 - DNA, 21 bp, Artificial sequence
  synthetic polynucleotide sequence
tgccaccaagatccacaagca

SEQ ID NO: 27396 - DNA, 21 bp, Artificial sequence
  synthetic polynucleotide sequence
ggccaccacctgatatgggga

SEQ ID NO: 27397 - DNA, 21 bp, Artificial sequence
  synthetic polynucleotide sequence
gcaccgtctggctcaaagaga

SEQ ID NO: 27398 - DNA, 22 bp, Artificial sequence
  synthetic polynucleotide sequence
cgtaaagcatggggttgaggca

SEQ ID NO: 27399 - DNA, 21 bp, Artificial sequence
  synthetic polynucleotide sequence
gggtgatgacgggactctgga

SEQ ID NO: 27400 - DNA, 21 bp, Artificial sequence
  synthetic polynucleotide sequence
ctctacagcagtgtcacccca

SEQ ID NO: 27401 - DNA, 21 bp, Artificial sequence
  synthetic polynucleotide sequence
agacacttcagtccccggcaa

SEQ ID NO: 27402 - DNA, 20 bp, Artificial sequence
  synthetic polynucleotide sequence
atccccccttctggaaccca

SEQ ID NO: 27403 - DNA, 18 bp, Artificial sequence
  synthetic polynucleotide sequence
tcaaggaggccgtgcgaa

SEQ ID NO: 27404 - DNA, 18 bp, Artificial sequence
  synthetic polynucleotide sequence
gcgaagggggttcatgca

SEQ ID NO: 27405 - DNA, 18 bp, Artificial sequence
  synthetic polynucleotide sequence
ggctcagggacgcggtca

SEQ ID NO: 27406 - DNA, 22 bp, Artificial sequence
  synthetic polynucleotide sequence
ttgatgaggtttcccgagagca

SEQ ID NO: 27407 - DNA, 18 bp, Artificial sequence
  synthetic polynucleotide sequence
cccagcaggatgtggaca

SEQ ID NO: 27408 - DNA, 19 bp, Artificial sequence
  synthetic polynucleotide sequence
gccccacttgagaagggga

SEQ ID NO: 27409 - DNA, 21 bp, Artificial sequence
  synthetic polynucleotide sequence
tggaccgcaccaagaggcaga

SEQ ID NO: 27410 - DNA, 19 bp, Artificial sequence
  synthetic polynucleotide sequence
cgtggtgcctcccaccaca

SEQ ID NO: 27411 - DNA, 20 bp, Artificial sequence
  synthetic polynucleotide sequence
caggcgtgcgcatgcagaca

SEQ ID NO: 27412 - DNA, 21 bp, Artificial sequence
  synthetic polynucleotide sequence
caagcactgcacccataggca

SEQ ID NO: 27413 - DNA, 18 bp, Artificial sequence
  synthetic polynucleotide sequence
ccctgggagctccacaca

SEQ ID NO: 27414 - DNA, 18 bp, Artificial sequence
  synthetic polynucleotide sequence
cgcccaacaacaagtcca

SEQ ID NO: 27415 - DNA, 21 bp, Artificial sequence
  synthetic polynucleotide sequence
ggtgtgggcacagcagatcca

SEQ ID NO: 27416 - DNA, 20 bp, Artificial sequence
  synthetic polynucleotide sequence
ctggcagtgtggctgggaca

SEQ ID NO: 27417 - DNA, 21 bp, Artificial sequence
  synthetic polynucleotide sequence
gtgatgcccaccataggggaa

SEQ ID NO: 27418 - DNA, 20 bp, Artificial sequence
  synthetic polynucleotide sequence
agcctccgacatagctcgca

SEQ ID NO: 27419 - DNA, 18 bp, Artificial sequence
  synthetic polynucleotide sequence
tccccagtcacagaggca

SEQ ID NO: 27420 - DNA, 18 bp, Artificial sequence
  synthetic polynucleotide sequence
accaccagccctcatgca

SEQ ID NO: 27421 - DNA, 20 bp, Artificial sequence
  synthetic polynucleotide sequence
agtgaggagcagcacagcca

SEQ ID NO: 27422 - DNA, 20 bp, Artificial sequence
  synthetic polynucleotide sequence
agggcgagacagttgctgga

SEQ ID NO: 27423 - DNA, 20 bp, Artificial sequence
  synthetic polynucleotide sequence
acacacacacctggccggga

SEQ ID NO: 27424 - DNA, 20 bp, Artificial sequence
  synthetic polynucleotide sequence
ccatgcatggagctggggaa

SEQ ID NO: 27425 - DNA, 21 bp, Artificial sequence
  synthetic polynucleotide sequence
cgggtacacaccctatgcaga

SEQ ID NO: 27426 - DNA, 20 bp, Artificial sequence
  synthetic polynucleotide sequence
tgggctgaggaccggtagga

SEQ ID NO: 27427 - DNA, 22 bp, Artificial sequence
  synthetic polynucleotide sequence
gaatctgaagccagcaccccaa

SEQ ID NO: 27428 - DNA, 22 bp, Artificial sequence
  synthetic polynucleotide sequence
gtaaggatgatcaggaggagga

SEQ ID NO: 27429 - DNA, 21 bp, Artificial sequence
  synthetic polynucleotide sequence
aagtcagcccagacatgtgca

SEQ ID NO: 27430 - DNA, 20 bp, Artificial sequence
  synthetic polynucleotide sequence
tctgaagagctcgaggtgga

SEQ ID NO: 27431 - DNA, 21 bp, Artificial sequence
  synthetic polynucleotide sequence
caggactagcggtaggagcaa

SEQ ID NO: 27432 - DNA, 21 bp, Artificial sequence
  synthetic polynucleotide sequence
tgagagcaggacaaggcccta

SEQ ID NO: 27433 - DNA, 20 bp, Artificial sequence
  synthetic polynucleotide sequence
atctactccaagcaggccga

SEQ ID NO: 27434 - DNA, 18 bp, Artificial sequence
  synthetic polynucleotide sequence
atccggctggacaccaca

SEQ ID NO: 27435 - DNA, 20 bp, Artificial sequence
  synthetic polynucleotide sequence
tgcgagagaggctaccacga

SEQ ID NO: 27436 - DNA, 20 bp, Artificial sequence
  synthetic polynucleotide sequence
agggccgtggatgcccggaa

SEQ ID NO: 27437 - DNA, 21 bp, Artificial sequence
  synthetic polynucleotide sequence
caactcacatgctggcagcca

SEQ ID NO: 27438 - DNA, 21 bp, Artificial sequence
  synthetic polynucleotide sequence
tggactcctcagctgcacgca

SEQ ID NO: 27439 - DNA, 21 bp, Artificial sequence
  synthetic polynucleotide sequence
ctcaggacttggtcaagggga

SEQ ID NO: 27440 - DNA, 21 bp, Artificial sequence
  synthetic polynucleotide sequence
ggaaggatggtcgcaggtgga

SEQ ID NO: 27441 - DNA, 22 bp, Artificial sequence
  synthetic polynucleotide sequence
agatgacattcaggccaggaga

SEQ ID NO: 27442 - DNA, 21 bp, Artificial sequence
  synthetic polynucleotide sequence
aaggagccaataggagggcca

SEQ ID NO: 27443 - DNA, 19 bp, Artificial sequence
  synthetic polynucleotide sequence
tcgcgggggagttctacga

SEQ ID NO: 27444 - DNA, 22 bp, Artificial sequence
  synthetic polynucleotide sequence
cctatcatccggtagctgagga

SEQ ID NO: 27445 - DNA, 20 bp, Artificial sequence
  synthetic polynucleotide sequence
cgctgaaagcagcacaccaa

SEQ ID NO: 27446 - DNA, 19 bp, Artificial sequence
  synthetic polynucleotide sequence
tgaacaggggttggcccta

SEQ ID NO: 27447 - DNA, 22 bp, Artificial sequence
  synthetic polynucleotide sequence
cccaccaagttcaaggtgacaa

SEQ ID NO: 27448 - DNA, 20 bp, Artificial sequence
  synthetic polynucleotide sequence
gacggcctcacgccgatgca

SEQ ID NO: 27449 - DNA, 21 bp, Artificial sequence
  synthetic polynucleotide sequence
ggacaccaccgtgcatgagga

SEQ ID NO: 27450 - DNA, 21 bp, Artificial sequence
  synthetic polynucleotide sequence
gatggctgagaagaagggcga

SEQ ID NO: 27451 - DNA, 19 bp, Artificial sequence
  synthetic polynucleotide sequence
ccggcggcggagtaacaca

SEQ ID NO: 27452 - DNA, 20 bp, Artificial sequence
  synthetic polynucleotide sequence
gttgagaagcctgagagcca

SEQ ID NO: 27453 - DNA, 18 bp, Artificial sequence
  synthetic polynucleotide sequence
acttccagcacgagccca

SEQ ID NO: 27454 - DNA, 18 bp, Artificial sequence
  synthetic polynucleotide sequence
cgatggcctcgggagaga

SEQ ID NO: 27455 - DNA, 19 bp, Artificial sequence
  synthetic polynucleotide sequence
gaggcacaggctggtacca

SEQ ID NO: 27456 - DNA, 21 bp, Artificial sequence
  synthetic polynucleotide sequence
ggaaagtgaaggcgacaagga

SEQ ID NO: 27457 - DNA, 19 bp, Artificial sequence
  synthetic polynucleotide sequence
ctacggagcctcctgcaga

SEQ ID NO: 27458 - DNA, 22 bp, Artificial sequence
  synthetic polynucleotide sequence
tgatggagactgaacttcagca

SEQ ID NO: 27459 - DNA, 18 bp, Artificial sequence
  synthetic polynucleotide sequence
gagggcgtccaatggcaa

SEQ ID NO: 27460 - DNA, 18 bp, Artificial sequence
  synthetic polynucleotide sequence
gcccgtgaccttgcggca

SEQ ID NO: 27461 - DNA, 21 bp, Artificial sequence
  synthetic polynucleotide sequence
cattcacgccacagccacaca

SEQ ID NO: 27462 - DNA, 22 bp, Artificial sequence
  synthetic polynucleotide sequence
acaaaatcgctgatagccgcca

SEQ ID NO: 27463 - DNA, 20 bp, Artificial sequence
  synthetic polynucleotide sequence
ctcatcgggccatgacctca

SEQ ID NO: 27464 - DNA, 21 bp, Artificial sequence
  synthetic polynucleotide sequence
agttgctcccctgaagctcga

SEQ ID NO: 27465 - DNA, 20 bp, Artificial sequence
  synthetic polynucleotide sequence
cgctacgagccggacagcaa

SEQ ID NO: 27466 - DNA, 19 bp, Artificial sequence
  synthetic polynucleotide sequence
tgttgacgtgcaggcacca

SEQ ID NO: 27467 - DNA, 21 bp, Artificial sequence
  synthetic polynucleotide sequence
ggccaccagcagtaagaggca

SEQ ID NO: 27468 - DNA, 21 bp, Artificial sequence
  synthetic polynucleotide sequence
ttctgggccttgacctcccaa

SEQ ID NO: 27469 - DNA, 19 bp, Artificial sequence
  synthetic polynucleotide sequence
tgccatccctggctgacca

SEQ ID NO: 27470 - DNA, 22 bp, Artificial sequence
  synthetic polynucleotide sequence
atgacagcaacacacctggtga

SEQ ID NO: 27471 - DNA, 21 bp, Artificial sequence
  synthetic polynucleotide sequence
gtgagctgaccaacatcacca

SEQ ID NO: 27472 - DNA, 21 bp, Artificial sequence
  synthetic polynucleotide sequence
ctggtgtagcagtagccagca

SEQ ID NO: 27473 - DNA, 18 bp, Artificial sequence
  synthetic polynucleotide sequence
tgacaccaggatcgccaa

SEQ ID NO: 27474 - DNA, 19 bp, Artificial sequence
  synthetic polynucleotide sequence
gacacagtgatgaggggca

SEQ ID NO: 27475 - DNA, 22 bp, Artificial sequence
  synthetic polynucleotide sequence
ccaaagagcaacgcgatctgca

SEQ ID NO: 27476 - DNA, 21 bp, Artificial sequence
  synthetic polynucleotide sequence
tggacctggaaagctggggga

SEQ ID NO: 27477 - DNA, 22 bp, Artificial sequence
  synthetic polynucleotide sequence
aaatgttgtcagaccacagcca

SEQ ID NO: 27478 - DNA, 21 bp, Artificial sequence
  synthetic polynucleotide sequence
gtggccatgtcaagctcagca

SEQ ID NO: 27479 - DNA, 22 bp, Artificial sequence
  synthetic polynucleotide sequence
ggaagtccagtaccaaggcaga

SEQ ID NO: 27480 - DNA, 22 bp, Artificial sequence
  synthetic polynucleotide sequence
aatccaatagatctgcccagca

SEQ ID NO: 27481 - DNA, 20 bp, Artificial sequence
  synthetic polynucleotide sequence
atccagtggctggaagctga

SEQ ID NO: 27482 - DNA, 18 bp, Artificial sequence
  synthetic polynucleotide sequence
tcactggagtccaggcga

SEQ ID NO: 27483 - DNA, 19 bp, Artificial sequence
  synthetic polynucleotide sequence
tgcggcaacaacaacgtca

SEQ ID NO: 27484 - DNA, 18 bp, Artificial sequence
  synthetic polynucleotide sequence
ctcaggggtgcctgcgca

SEQ ID NO: 27485 - DNA, 22 bp, Artificial sequence
  synthetic polynucleotide sequence
gtgagatccagaggcacctcaa

SEQ ID NO: 27486 - DNA, 21 bp, Artificial sequence
  synthetic polynucleotide sequence
gactgcagatacccactggca

SEQ ID NO: 27487 - DNA, 19 bp, Artificial sequence
  synthetic polynucleotide sequence
ggctgcaaacctgacagca

SEQ ID NO: 27488 - DNA, 21 bp, Artificial sequence
  synthetic polynucleotide sequence
ggtagtggccatctggagaga

SEQ ID NO: 27489 - DNA, 18 bp, Artificial sequence
  synthetic polynucleotide sequence
ctgccgagaagcacagga

SEQ ID NO: 27490 - DNA, 18 bp, Artificial sequence
  synthetic polynucleotide sequence
acagggagtccaggccca

SEQ ID NO: 27491 - DNA, 21 bp, Artificial sequence
  synthetic polynucleotide sequence
caacagccacatcacgctgga

SEQ ID NO: 27492 - DNA, 20 bp, Artificial sequence
  synthetic polynucleotide sequence
gcgcaggaagtagcggaaga

SEQ ID NO: 27493 - DNA, 25 bp, Artificial sequence
  synthetic polynucleotide sequence
aaagaactaggtgaccacgtgcaca

SEQ ID NO: 27494 - DNA, 20 bp, Artificial sequence
  synthetic polynucleotide sequence
aaaggtactccgccaggcca

SEQ ID NO: 27495 - DNA, 21 bp, Artificial sequence
  synthetic polynucleotide sequence
atgccaggtgccagtcacgaa

SEQ ID NO: 27496 - DNA, 22 bp, Artificial sequence
  synthetic polynucleotide sequence
atgtctgtgaggtcaaacggca

SEQ ID NO: 27497 - DNA, 18 bp, Artificial sequence
  synthetic polynucleotide sequence
ccccccatctcgccacca

SEQ ID NO: 27498 - DNA, 20 bp, Artificial sequence
  synthetic polynucleotide sequence
gggctggggaaacgtgtcca

SEQ ID NO: 27499 - DNA, 21 bp, Artificial sequence
  synthetic polynucleotide sequence
catcggatactggaccccgaa

SEQ ID NO: 27500 - DNA, 21 bp, Artificial sequence
  synthetic polynucleotide sequence
tcttgcacaaaccactccgga

SEQ ID NO: 27501 - DNA, 18 bp, Artificial sequence
  synthetic polynucleotide sequence
gcacagccaccaccagca

SEQ ID NO: 27502 - DNA, 18 bp, Artificial sequence
  synthetic polynucleotide sequence
ggaggagccccagtcgga

SEQ ID NO: 27503 - DNA, 21 bp, Artificial sequence
  synthetic polynucleotide sequence
agcaggtcccaagccagcaga

SEQ ID NO: 27504 - DNA, 18 bp, Artificial sequence
  synthetic polynucleotide sequence
ggggagctggcctgagga

SEQ ID NO: 27505 - DNA, 19 bp, Artificial sequence
  synthetic polynucleotide sequence
tgggaacagctctccggaa

SEQ ID NO: 27506 - DNA, 19 bp, Artificial sequence
  synthetic polynucleotide sequence
cccactccccatcagacca

SEQ ID NO: 27507 - DNA, 20 bp, Artificial sequence
  synthetic polynucleotide sequence
gaggtgaaactactgggcca

SEQ ID NO: 27508 - DNA, 18 bp, Artificial sequence
  synthetic polynucleotide sequence
ggctagagcccagcccca

SEQ ID NO: 27509 - DNA, 20 bp, Artificial sequence
  synthetic polynucleotide sequence
agcaggtggaactgccggga

SEQ ID NO: 27510 - DNA, 20 bp, Artificial sequence
  synthetic polynucleotide sequence
cccgccaagctcataggcaa

SEQ ID NO: 27511 - DNA, 22 bp, Artificial sequence
  synthetic polynucleotide sequence
gaaacgagcgaacaaagcagca

SEQ ID NO: 27512 - DNA, 21 bp, Artificial sequence
  synthetic polynucleotide sequence
gtccgagcaaaaagcctccca

SEQ ID NO: 27513 - DNA, 21 bp, Artificial sequence
  synthetic polynucleotide sequence
tggccgcgtccagtcaaggaa

SEQ ID NO: 27514 - DNA, 22 bp, Artificial sequence
  synthetic polynucleotide sequence
ccaatgaacagctgggttgcca

SEQ ID NO: 27515 - DNA, 19 bp, Artificial sequence
  synthetic polynucleotide sequence
cagggccggctgtgtgaga

SEQ ID NO: 27516 - DNA, 20 bp, Artificial sequence
  synthetic polynucleotide sequence
ggcaagcacccccttcctga

SEQ ID NO: 27517 - DNA, 20 bp, Artificial sequence
  synthetic polynucleotide sequence
tggcgagtgggtcctagaga

SEQ ID NO: 27518 - DNA, 18 bp, Artificial sequence
  synthetic polynucleotide sequence
ggagggcagtgctggaca

SEQ ID NO: 27519 - DNA, 18 bp, Artificial sequence
  synthetic polynucleotide sequence
gaggtggcatgggcggaa

SEQ ID NO: 27520 - DNA, 18 bp, Artificial sequence
  synthetic polynucleotide sequence
tcacccaggccttgcaca

SEQ ID NO: 27521 - DNA, 20 bp, Artificial sequence
  synthetic polynucleotide sequence
gaagggtgtggtgggcgaca

SEQ ID NO: 27522 - DNA, 20 bp, Artificial sequence
  synthetic polynucleotide sequence
cctcctgtccatcgccagca

SEQ ID NO: 27523 - DNA, 20 bp, Artificial sequence
  synthetic polynucleotide sequence
agtcagactgtgacccacca

SEQ ID NO: 27524 - DNA, 20 bp, Artificial sequence
  synthetic polynucleotide sequence
cggcatccatagaggctgga

SEQ ID NO: 27525 - DNA, 19 bp, Artificial sequence
  synthetic polynucleotide sequence
cggctacaggacacagcca

SEQ ID NO: 27526 - DNA, 18 bp, Artificial sequence
  synthetic polynucleotide sequence
aaccgcggtacacgggca

SEQ ID NO: 27527 - DNA, 21 bp, Artificial sequence
  synthetic polynucleotide sequence
ggatctgggccgcatacctca

SEQ ID NO: 27528 - DNA, 20 bp, Artificial sequence
  synthetic polynucleotide sequence
tctgcggcaatccctgtcca

SEQ ID NO: 27529 - DNA, 18 bp, Artificial sequence
  synthetic polynucleotide sequence
accgcagcgactccgaca

SEQ ID NO: 27530 - DNA, 18 bp, Artificial sequence
  synthetic polynucleotide sequence
acaccgcccaggccacca

SEQ ID NO: 27531 - DNA, 18 bp, Artificial sequence
  synthetic polynucleotide sequence
gaactcgcagcacctgga

SEQ ID NO: 27532 - DNA, 19 bp, Artificial sequence
  synthetic polynucleotide sequence
gggaggaggcacttgggaa

SEQ ID NO: 27533 - DNA, 21 bp, Artificial sequence
  synthetic polynucleotide sequence
accccgactacatcaccgaga

SEQ ID NO: 27534 - DNA, 18 bp, Artificial sequence
  synthetic polynucleotide sequence
tgaaggagcgaggccgca

SEQ ID NO: 27535 - DNA, 20 bp, Artificial sequence
  synthetic polynucleotide sequence
ctggcatgaatgagagccga

SEQ ID NO: 27536 - DNA, 20 bp, Artificial sequence
  synthetic polynucleotide sequence
gtgtgggtagcggtcacaga

SEQ ID NO: 27537 - DNA, 21 bp, Artificial sequence
  synthetic polynucleotide sequence
catgcacagacagatctggca

SEQ ID NO: 27538 - DNA, 20 bp, Artificial sequence
  synthetic polynucleotide sequence
gagacacccaccacactgca

SEQ ID NO: 27539 - DNA, 22 bp, Artificial sequence
  synthetic polynucleotide sequence
atcaccaactcacactccccaa

SEQ ID NO: 27540 - DNA, 21 bp, Artificial sequence
  synthetic polynucleotide sequence
gaatcacggcggtaagtcaga

SEQ ID NO: 27541 - DNA, 20 bp, Artificial sequence
  synthetic polynucleotide sequence
tggagcgctggtggcagcca

SEQ ID NO: 27542 - DNA, 20 bp, Artificial sequence
  synthetic polynucleotide sequence
gaggagcagcagcccgagga

SEQ ID NO: 27543 - DNA, 20 bp, Artificial sequence
  synthetic polynucleotide sequence
aagaccttgcagacaagcca

SEQ ID NO: 27544 - DNA, 18 bp, Artificial sequence
  synthetic polynucleotide sequence
tctgcggccagcagctca

SEQ ID NO: 27545 - DNA, 20 bp, Artificial sequence
  synthetic polynucleotide sequence
gatgatcgagacagccgaca

SEQ ID NO: 27546 - DNA, 18 bp, Artificial sequence
  synthetic polynucleotide sequence
acgacctcgaccccctga

SEQ ID NO: 27547 - DNA, 20 bp, Artificial sequence
  synthetic polynucleotide sequence
agagtctcagagccgccaga

SEQ ID NO: 27548 - DNA, 19 bp, Artificial sequence
  synthetic polynucleotide sequence
ccaactccaagggggcgga

SEQ ID NO: 27549 - DNA, 19 bp, Artificial sequence
  synthetic polynucleotide sequence
ccagtccctgcagatcgga

SEQ ID NO: 27550 - DNA, 19 bp, Artificial sequence
  synthetic polynucleotide sequence
ctgctcagcacgatgagga

SEQ ID NO: 27551 - DNA, 19 bp, Artificial sequence
  synthetic polynucleotide sequence
gcaataagaagcgcaggca

SEQ ID NO: 27552 - DNA, 17 bp, Artificial sequence
  synthetic polynucleotide sequence
gggaggcgccagaggca

SEQ ID NO: 27553 - DNA, 20 bp, Artificial sequence
  synthetic polynucleotide sequence
ctcagcccagcgagatgcca

SEQ ID NO: 27554 - DNA, 20 bp, Artificial sequence
  synthetic polynucleotide sequence
cattggcgtccaggacagga

SEQ ID NO: 27555 - DNA, 21 bp, Artificial sequence
  synthetic polynucleotide sequence
gccttggaagccaatgaccca

SEQ ID NO: 27556 - DNA, 20 bp, Artificial sequence
  synthetic polynucleotide sequence
gccactcagaactgccgcga

SEQ ID NO: 27557 - DNA, 18 bp, Artificial sequence
  synthetic polynucleotide sequence
ccccagaccctcaagcca

SEQ ID NO: 27558 - DNA, 18 bp, Artificial sequence
  synthetic polynucleotide sequence
attccggcataaccggga

SEQ ID NO: 27559 - DNA, 18 bp, Artificial sequence
  synthetic polynucleotide sequence
cccccatggtcctggcca

SEQ ID NO: 27560 - DNA, 22 bp, Artificial sequence
  synthetic polynucleotide sequence
ggataaggaggatcccaaccga

SEQ ID NO: 27561 - DNA, 21 bp, Artificial sequence
  synthetic polynucleotide sequence
tgggcatgactctggcaacca

SEQ ID NO: 27562 - DNA, 20 bp, Artificial sequence
  synthetic polynucleotide sequence
caccaggggctgaagaggga

SEQ ID NO: 27563 - DNA, 18 bp, Artificial sequence
  synthetic polynucleotide sequence
tggggccaaagtcaggaa

SEQ ID NO: 27564 - DNA, 20 bp, Artificial sequence
  synthetic polynucleotide sequence
gtggaggtggacccaaggta

SEQ ID NO: 27565 - DNA, 21 bp, Artificial sequence
  synthetic polynucleotide sequence
tacagactacaggccaccgga

SEQ ID NO: 27566 - DNA, 21 bp, Artificial sequence
  synthetic polynucleotide sequence
ttctccagacttcagcaggca

SEQ ID NO: 27567 - DNA, 20 bp, Artificial sequence
  synthetic polynucleotide sequence
aagagactgggaaatgggca

SEQ ID NO: 27568 - DNA, 21 bp, Artificial sequence
  synthetic polynucleotide sequence
acaccactgcatagagctgga

SEQ ID NO: 27569 - DNA, 21 bp, Artificial sequence
  synthetic polynucleotide sequence
agacctagccagctaagcaga

SEQ ID NO: 27570 - DNA, 19 bp, Artificial sequence
  synthetic polynucleotide sequence
ttgtggtggaagtccgcca

SEQ ID NO: 27571 - DNA, 22 bp, Artificial sequence
  synthetic polynucleotide sequence
tcatgaagcacgatggcaccaa

SEQ ID NO: 27572 - DNA, 21 bp, Artificial sequence
  synthetic polynucleotide sequence
gctcgtagaagtagcaggcga

SEQ ID NO: 27573 - DNA, 20 bp, Artificial sequence
  synthetic polynucleotide sequence
catcccggcggtgaagacca

SEQ ID NO: 27574 - DNA, 21 bp, Artificial sequence
  synthetic polynucleotide sequence
cagagaagagcccgatacgca

SEQ ID NO: 27575 - DNA, 20 bp, Artificial sequence
  synthetic polynucleotide sequence
ggagcggctcatggtgcgca

SEQ ID NO: 27576 - DNA, 20 bp, Artificial sequence
  synthetic polynucleotide sequence
ctcacccacgagcgctccca

SEQ ID NO: 27577 - DNA, 18 bp, Artificial sequence
  synthetic polynucleotide sequence
gaaggagccccagtggca

SEQ ID NO: 27578 - DNA, 20 bp, Artificial sequence
  synthetic polynucleotide sequence
aacaatcacgcacatgcaga

SEQ ID NO: 27579 - DNA, 18 bp, Artificial sequence
  synthetic polynucleotide sequence
tccccgcagtgaaaacca

SEQ ID NO: 27580 - DNA, 18 bp, Artificial sequence
  synthetic polynucleotide sequence
acgaacccggtgagggca

SEQ ID NO: 27581 - DNA, 18 bp, Artificial sequence
  synthetic polynucleotide sequence
ccgcagcgtcatcaagca

SEQ ID NO: 27582 - DNA, 20 bp, Artificial sequence
  synthetic polynucleotide sequence
ctcgtacaggtagcaggcca

SEQ ID NO: 27583 - DNA, 22 bp, Artificial sequence
  synthetic polynucleotide sequence
accagcacaggagctacagcaa

SEQ ID NO: 27584 - DNA, 18 bp, Artificial sequence
  synthetic polynucleotide sequence
ggcgaggcaggttcacca

SEQ ID NO: 27585 - DNA, 18 bp, Artificial sequence
  synthetic polynucleotide sequence
catgaagtggggccacga

SEQ ID NO: 27586 - DNA, 18 bp, Artificial sequence
  synthetic polynucleotide sequence
agacgaacagaggcgcca

SEQ ID NO: 27587 - DNA, 20 bp, Artificial sequence
  synthetic polynucleotide sequence
ggcgtttccagaacccgaga

SEQ ID NO: 27588 - DNA, 25 bp, Artificial sequence
  synthetic polynucleotide sequence
cgagggagaaaaagaggttctccca

SEQ ID NO: 27589 - DNA, 20 bp, Artificial sequence
  synthetic polynucleotide sequence
tggccagcacggatgcagca

SEQ ID NO: 27590 - DNA, 20 bp, Artificial sequence
  synthetic polynucleotide sequence
gcggatgtggaagagggcca

SEQ ID NO: 27591 - DNA, 20 bp, Artificial sequence
  synthetic polynucleotide sequence
cacgcacggctactcacaga

SEQ ID NO: 27592 - DNA, 20 bp, Artificial sequence
  synthetic polynucleotide sequence
gtctccagcaccagtgacga

SEQ ID NO: 27593 - DNA, 22 bp, Artificial sequence
  synthetic polynucleotide sequence
aagcgcaaggggaagatggtga

SEQ ID NO: 27594 - DNA, 20 bp, Artificial sequence
  synthetic polynucleotide sequence
ctggagagcctgtcgctcca

SEQ ID NO: 27595 - DNA, 19 bp, Artificial sequence
  synthetic polynucleotide sequence
tggaagtgagcatcctgga

SEQ ID NO: 27596 - DNA, 21 bp, Artificial sequence
  synthetic polynucleotide sequence
ccaggtgaaggaccaccgtga

SEQ ID NO: 27597 - DNA, 18 bp, Artificial sequence
  synthetic polynucleotide sequence
cgtgaggctggtgagcaa

SEQ ID NO: 27598 - DNA, 20 bp, Artificial sequence
  synthetic polynucleotide sequence
gttaatgcgcaactccacca

SEQ ID NO: 27599 - DNA, 20 bp, Artificial sequence
  synthetic polynucleotide sequence
cgcagggatattaggcgcaa

SEQ ID NO: 27600 - DNA, 18 bp, Artificial sequence
  synthetic polynucleotide sequence
atgccaccccttggagga

SEQ ID NO: 27601 - DNA, 18 bp, Artificial sequence
  synthetic polynucleotide sequence
acccccatcccaagtcga

SEQ ID NO: 27602 - DNA, 20 bp, Artificial sequence
  synthetic polynucleotide sequence
taggggatgacactgacgga

SEQ ID NO: 27603 - DNA, 18 bp, Artificial sequence
  synthetic polynucleotide sequence
accccgactggatccaca

SEQ ID NO: 27604 - DNA, 18 bp, Artificial sequence
  synthetic polynucleotide sequence
aggcacagagcaaccgga

SEQ ID NO: 27605 - DNA, 20 bp, Artificial sequence
  synthetic polynucleotide sequence
gtgtgagcggcctgagtgga

SEQ ID NO: 27606 - DNA, 18 bp, Artificial sequence
  synthetic polynucleotide sequence
agtccagggggcccagca

SEQ ID NO: 27607 - DNA, 18 bp, Artificial sequence
  synthetic polynucleotide sequence
ccatctggaaccgggaca

SEQ ID NO: 27608 - DNA, 18 bp, Artificial sequence
  synthetic polynucleotide sequence
ctccatggccaccagaca

SEQ ID NO: 27609 - DNA, 18 bp, Artificial sequence
  synthetic polynucleotide sequence
ctggaagtgctggagcga

SEQ ID NO: 27610 - DNA, 20 bp, Artificial sequence
  synthetic polynucleotide sequence
gacagggacaccgttggaga

SEQ ID NO: 27611 - DNA, 20 bp, Artificial sequence
  synthetic polynucleotide sequence
cagccctatgatcaagccca

SEQ ID NO: 27612 - DNA, 18 bp, Artificial sequence
  synthetic polynucleotide sequence
acactgctgcctgagcca

SEQ ID NO: 27613 - DNA, 19 bp, Artificial sequence
  synthetic polynucleotide sequence
cccatctccacccagagca

SEQ ID NO: 27614 - DNA, 18 bp, Artificial sequence
  synthetic polynucleotide sequence
gctggaagtccagggcca

SEQ ID NO: 27615 - DNA, 20 bp, Artificial sequence
  synthetic polynucleotide sequence
tatgtgcccatgagccccca

SEQ ID NO: 27616 - DNA, 19 bp, Artificial sequence
  synthetic polynucleotide sequence
ccagaggaggtggccgtga

SEQ ID NO: 27617 - DNA, 20 bp, Artificial sequence
  synthetic polynucleotide sequence
cagctcctcccaacacccca

SEQ ID NO: 27618 - DNA, 19 bp, Artificial sequence
  synthetic polynucleotide sequence
tcttgccggacgtgacaga

SEQ ID NO: 27619 - DNA, 21 bp, Artificial sequence
  synthetic polynucleotide sequence
gctcccaaagctcggatagga

SEQ ID NO: 27620 - DNA, 21 bp, Artificial sequence
  synthetic polynucleotide sequence
acaaggcatcctcagctcgga

SEQ ID NO: 27621 - DNA, 18 bp, Artificial sequence
  synthetic polynucleotide sequence
cggacagggtccccgtga

SEQ ID NO: 27622 - DNA, 21 bp, Artificial sequence
  synthetic polynucleotide sequence
ctggccaacagtaaggtcaga

SEQ ID NO: 27623 - DNA, 18 bp, Artificial sequence
  synthetic polynucleotide sequence
ccgacagggttccggtga

SEQ ID NO: 27624 - DNA, 20 bp, Artificial sequence
  synthetic polynucleotide sequence
gatccacatgaactgagcca

SEQ ID NO: 27625 - DNA, 19 bp, Artificial sequence
  synthetic polynucleotide sequence
gtgaatagccgcagggaca

SEQ ID NO: 27626 - DNA, 17 bp, Artificial sequence
  synthetic polynucleotide sequence
agcagcctcagccacca

SEQ ID NO: 27627 - DNA, 19 bp, Artificial sequence
  synthetic polynucleotide sequence
ccttcctgacccgggacca

SEQ ID NO: 27628 - DNA, 21 bp, Artificial sequence
  synthetic polynucleotide sequence
gggtgatgagcttcggcacga

SEQ ID NO: 27629 - DNA, 22 bp, Artificial sequence
  synthetic polynucleotide sequence
atccagatgcccaccatgctga

SEQ ID NO: 27630 - DNA, 21 bp, Artificial sequence
  synthetic polynucleotide sequence
ctatagccttccagtgcagca

SEQ ID NO: 27631 - DNA, 21 bp, Artificial sequence
  synthetic polynucleotide sequence
tgagcagagatgccagaacca

SEQ ID NO: 27632 - DNA, 21 bp, Artificial sequence
  synthetic polynucleotide sequence
tgttctgtggcccaatggaga

SEQ ID NO: 27633 - DNA, 20 bp, Artificial sequence
  synthetic polynucleotide sequence
cccgacagcagcccaatgga

SEQ ID NO: 27634 - DNA, 21 bp, Artificial sequence
  synthetic polynucleotide sequence
tggtccctgctgacccagtca

SEQ ID NO: 27635 - DNA, 20 bp, Artificial sequence
  synthetic polynucleotide sequence
ctcctgcggatcacagagga

SEQ ID NO: 27636 - DNA, 18 bp, Artificial sequence
  synthetic polynucleotide sequence
agtgggcaagcatgggca

SEQ ID NO: 27637 - DNA, 21 bp, Artificial sequence
  synthetic polynucleotide sequence
gccaatcaatcggaaaggaga

SEQ ID NO: 27638 - DNA, 21 bp, Artificial sequence
  synthetic polynucleotide sequence
cacagttcttgcaggcacaga

SEQ ID NO: 27639 - DNA, 21 bp, Artificial sequence
  synthetic polynucleotide sequence
atgtgcatgcctgcccactga

SEQ ID NO: 27640 - DNA, 22 bp, Artificial sequence
  synthetic polynucleotide sequence
aagcgagaaccatcctgtgcca

SEQ ID NO: 27641 - DNA, 21 bp, Artificial sequence
  synthetic polynucleotide sequence
tcaccatgaccacactaagca

SEQ ID NO: 27642 - DNA, 18 bp, Artificial sequence
  synthetic polynucleotide sequence
tgcactggagcagcggga

SEQ ID NO: 27643 - DNA, 25 bp, Artificial sequence
  synthetic polynucleotide sequence
ccacccactacctgaacaatagcca

SEQ ID NO: 27644 - DNA, 21 bp, Artificial sequence
  synthetic polynucleotide sequence
acatgggccaagtgctgagaa

SEQ ID NO: 27645 - DNA, 25 bp, Artificial sequence
  synthetic polynucleotide sequence
cgaggccaataaagtgctcacgaga

SEQ ID NO: 27646 - DNA, 20 bp, Artificial sequence
  synthetic polynucleotide sequence
gcctccaaaggctggcgaga

SEQ ID NO: 27647 - DNA, 18 bp, Artificial sequence
  synthetic polynucleotide sequence
accgcaagcccctgagca

SEQ ID NO: 27648 - DNA, 18 bp, Artificial sequence
  synthetic polynucleotide sequence
gggaggcacgcctgcgga

SEQ ID NO: 27649 - DNA, 18 bp, Artificial sequence
  synthetic polynucleotide sequence
tcgggagaccttgcccaa

SEQ ID NO: 27650 - DNA, 20 bp, Artificial sequence
  synthetic polynucleotide sequence
atactccagaagggccagga

SEQ ID NO: 27651 - DNA, 18 bp, Artificial sequence
  synthetic polynucleotide sequence
tggacgtgaggaacgcca

SEQ ID NO: 27652 - DNA, 18 bp, Artificial sequence
  synthetic polynucleotide sequence
tgtctccacccccaccga

SEQ ID NO: 27653 - DNA, 19 bp, Artificial sequence
  synthetic polynucleotide sequence
gcccggacctctctaggga

SEQ ID NO: 27654 - DNA, 20 bp, Artificial sequence
  synthetic polynucleotide sequence
aaactccaacagagcgcaga

SEQ ID NO: 27655 - DNA, 21 bp, Artificial sequence
  synthetic polynucleotide sequence
gatcttggagggaaggaagga

SEQ ID NO: 27656 - DNA, 20 bp, Artificial sequence
  synthetic polynucleotide sequence
cagggcaaaagcggttggga

SEQ ID NO: 27657 - DNA, 20 bp, Artificial sequence
  synthetic polynucleotide sequence
gagtgtctggacggcaagga

SEQ ID NO: 27658 - DNA, 18 bp, Artificial sequence
  synthetic polynucleotide sequence
ggcagaaggcagtgggga

SEQ ID NO: 27659 - DNA, 20 bp, Artificial sequence
  synthetic polynucleotide sequence
gaccatgaccaccctgagca

SEQ ID NO: 27660 - DNA, 20 bp, Artificial sequence
  synthetic polynucleotide sequence
atactccatcagcgcggcga

SEQ ID NO: 27661 - DNA, 18 bp, Artificial sequence
  synthetic polynucleotide sequence
acagcgctggatggacca

SEQ ID NO: 27662 - DNA, 18 bp, Artificial sequence
  synthetic polynucleotide sequence
gcatacaggaccgtgcca

SEQ ID NO: 27663 - DNA, 18 bp, Artificial sequence
  synthetic polynucleotide sequence
tcggaaagcctcagccca

SEQ ID NO: 27664 - DNA, 19 bp, Artificial sequence
  synthetic polynucleotide sequence
ctctgaggtggaggggaga

SEQ ID NO: 27665 - DNA, 18 bp, Artificial sequence
  synthetic polynucleotide sequence
tcacaacggtgctgacca

SEQ ID NO: 27666 - DNA, 18 bp, Artificial sequence
  synthetic polynucleotide sequence
aggtagttgacggccgca

SEQ ID NO: 27667 - DNA, 20 bp, Artificial sequence
  synthetic polynucleotide sequence
gcagagctgtgcctgccaga

SEQ ID NO: 27668 - DNA, 20 bp, Artificial sequence
  synthetic polynucleotide sequence
cacggccttgacgtaggaga

SEQ ID NO: 27669 - DNA, 21 bp, Artificial sequence
  synthetic polynucleotide sequence
gaatcaccacagtgctgacca

SEQ ID NO: 27670 - DNA, 21 bp, Artificial sequence
  synthetic polynucleotide sequence
cacaaagagggagctgaccca

SEQ ID NO: 27671 - DNA, 18 bp, Artificial sequence
  synthetic polynucleotide sequence
gctctctgaccaccccga

SEQ ID NO: 27672 - DNA, 18 bp, Artificial sequence
  synthetic polynucleotide sequence
tgacctgtgcgaacccca

SEQ ID NO: 27673 - DNA, 22 bp, Artificial sequence
  synthetic polynucleotide sequence
gtgacgtggaatccacacaaga

SEQ ID NO: 27674 - DNA, 22 bp, Artificial sequence
  synthetic polynucleotide sequence
tgaaagaggtaggaggcatgca

SEQ ID NO: 27675 - DNA, 18 bp, Artificial sequence
  synthetic polynucleotide sequence
ggtgtacgaagcggccaa

SEQ ID NO: 27676 - DNA, 18 bp, Artificial sequence
  synthetic polynucleotide sequence
acgcctggatcagggtga

SEQ ID NO: 27677 - DNA, 20 bp, Artificial sequence
  synthetic polynucleotide sequence
gatgaatgtggacccagaca

SEQ ID NO: 27678 - DNA, 18 bp, Artificial sequence
  synthetic polynucleotide sequence
gcatgcccgacacccgca

SEQ ID NO: 27679 - DNA, 20 bp, Artificial sequence
  synthetic polynucleotide sequence
ctgcgagaacgacatcgaca

SEQ ID NO: 27680 - DNA, 18 bp, Artificial sequence
  synthetic polynucleotide sequence
caaggcgggatccttcca

SEQ ID NO: 27681 - DNA, 19 bp, Artificial sequence
  synthetic polynucleotide sequence
tccaggagctgctccagga

SEQ ID NO: 27682 - DNA, 21 bp, Artificial sequence
  synthetic polynucleotide sequence
gggtcttgagccacagctgca

SEQ ID NO: 27683 - DNA, 21 bp, Artificial sequence
  synthetic polynucleotide sequence
gcatggcatccacagggctga

SEQ ID NO: 27684 - DNA, 22 bp, Artificial sequence
  synthetic polynucleotide sequence
aagatgccttggcagagtagca

SEQ ID NO: 27685 - DNA, 20 bp, Artificial sequence
  synthetic polynucleotide sequence
cctgaccccctcagtgcgga

SEQ ID NO: 27686 - DNA, 25 bp, Artificial sequence
  synthetic polynucleotide sequence
agagtaggctaaagcatcctcgcaa

SEQ ID NO: 27687 - DNA, 21 bp, Artificial sequence
  synthetic polynucleotide sequence
aagggagaggatgagggagca

SEQ ID NO: 27688 - DNA, 21 bp, Artificial sequence
  synthetic polynucleotide sequence
atctcctgcccatcaggacca

SEQ ID NO: 27689 - DNA, 23 bp, Artificial sequence
  synthetic polynucleotide sequence
cctagaccaagaccctatgtaca

SEQ ID NO: 27690 - DNA, 20 bp, Artificial sequence
  synthetic polynucleotide sequence
cctcctgagcagctgcagga

SEQ ID NO: 27691 - DNA, 21 bp, Artificial sequence
  synthetic polynucleotide sequence
ggaggatctgctcagcgagga

SEQ ID NO: 27692 - DNA, 19 bp, Artificial sequence
  synthetic polynucleotide sequence
ggaagtcggcgctgcagga

SEQ ID NO: 27693 - DNA, 18 bp, Artificial sequence
  synthetic polynucleotide sequence
cctcaccagcaagcggga

SEQ ID NO: 27694 - DNA, 18 bp, Artificial sequence
  synthetic polynucleotide sequence
aggaggcggtcgagggca

SEQ ID NO: 27695 - DNA, 18 bp, Artificial sequence
  synthetic polynucleotide sequence
ccatccaggacgaggcca

SEQ ID NO: 27696 - DNA, 18 bp, Artificial sequence
  synthetic polynucleotide sequence
ggatctcgggcgtgagca

SEQ ID NO: 27697 - DNA, 18 bp, Artificial sequence
  synthetic polynucleotide sequence
ccagccgcaaggtggaca

SEQ ID NO: 27698 - DNA, 19 bp, Artificial sequence
  synthetic polynucleotide sequence
gagtactggacctcgggca

SEQ ID NO: 27699 - DNA, 19 bp, Artificial sequence
  synthetic polynucleotide sequence
cataagcagggcctcagca

SEQ ID NO: 27700 - DNA, 22 bp, Artificial sequence
  synthetic polynucleotide sequence
tgaagtggacatagagagccca

SEQ ID NO: 27701 - DNA, 18 bp, Artificial sequence
  synthetic polynucleotide sequence
tgagccctcccacatgca

SEQ ID NO: 27702 - DNA, 18 bp, Artificial sequence
  synthetic polynucleotide sequence
cgcccacaatccaggtca

SEQ ID NO: 27703 - DNA, 18 bp, Artificial sequence
  synthetic polynucleotide sequence
tggcacaggtgtccggga

SEQ ID NO: 27704 - DNA, 19 bp, Artificial sequence
  synthetic polynucleotide sequence
tgtagatccggcagccaca

SEQ ID NO: 27705 - DNA, 18 bp, Artificial sequence
  synthetic polynucleotide sequence
ctgcccagagctggacca

SEQ ID NO: 27706 - DNA, 18 bp, Artificial sequence
  synthetic polynucleotide sequence
agtgtcaccgtgcagcca

SEQ ID NO: 27707 - DNA, 18 bp, Artificial sequence
  synthetic polynucleotide sequence
tacagcgaggctgcgcga

SEQ ID NO: 27708 - DNA, 18 bp, Artificial sequence
  synthetic polynucleotide sequence
ctgatccagctcggggca

SEQ ID NO: 27709 - DNA, 18 bp, Artificial sequence
  synthetic polynucleotide sequence
ggagggtggccaaccgaa

SEQ ID NO: 27710 - DNA, 18 bp, Artificial sequence
  synthetic polynucleotide sequence
ggacgccatttgacagca

SEQ ID NO: 27711 - DNA, 18 bp, Artificial sequence
  synthetic polynucleotide sequence
gcacgtcactgcaggcca

SEQ ID NO: 27712 - DNA, 18 bp, Artificial sequence
  synthetic polynucleotide sequence
gggaggaggttgaggcca

SEQ ID NO: 27713 - DNA, 20 bp, Artificial sequence
  synthetic polynucleotide sequence
atgccaccacctaaaaggca

SEQ ID NO: 27714 - DNA, 20 bp, Artificial sequence
  synthetic polynucleotide sequence
gcagtctctaatgctgggca

SEQ ID NO: 27715 - DNA, 18 bp, Artificial sequence
  synthetic polynucleotide sequence
cttaagcgggtggccgaa

SEQ ID NO: 27716 - DNA, 19 bp, Artificial sequence
  synthetic polynucleotide sequence
cagttaagggagctgcgga

SEQ ID NO: 27717 - DNA, 19 bp, Artificial sequence
  synthetic polynucleotide sequence
ggtcaggaggatcccagca

SEQ ID NO: 27718 - DNA, 22 bp, Artificial sequence
  synthetic polynucleotide sequence
aatgccactgctgtgaagagga

SEQ ID NO: 27719 - DNA, 20 bp, Artificial sequence
  synthetic polynucleotide sequence
tggggatgtgacagagagga

SEQ ID NO: 27720 - DNA, 18 bp, Artificial sequence
  synthetic polynucleotide sequence
agcatcccgaagaagcca

SEQ ID NO: 27721 - DNA, 20 bp, Artificial sequence
  synthetic polynucleotide sequence
gagagactcacgttgcgaca

SEQ ID NO: 27722 - DNA, 22 bp, Artificial sequence
  synthetic polynucleotide sequence
aggtcatgttccttagcagcca

SEQ ID NO: 27723 - DNA, 18 bp, Artificial sequence
  synthetic polynucleotide sequence
ctgacatcgcccagggca

SEQ ID NO: 27724 - DNA, 18 bp, Artificial sequence
  synthetic polynucleotide sequence
cctctgagctccgaggca

SEQ ID NO: 27725 - DNA, 21 bp, Artificial sequence
  synthetic polynucleotide sequence
acccatctgaacccaggccca

SEQ ID NO: 27726 - DNA, 21 bp, Artificial sequence
  synthetic polynucleotide sequence
tgccggctgtcactgcaagga

SEQ ID NO: 27727 - DNA, 20 bp, Artificial sequence
  synthetic polynucleotide sequence
aagggctgatccggtcccga

SEQ ID NO: 27728 - DNA, 20 bp, Artificial sequence
  synthetic polynucleotide sequence
tgcagcatgggcggcagcca

SEQ ID NO: 27729 - DNA, 21 bp, Artificial sequence
  synthetic polynucleotide sequence
ctgcaaggaaggctctcagga

SEQ ID NO: 27730 - DNA, 20 bp, Artificial sequence
  synthetic polynucleotide sequence
tgaggcgtcatcccatggca

SEQ ID NO: 27731 - DNA, 18 bp, Artificial sequence
  synthetic polynucleotide sequence
aaagggtggcggaggaca

SEQ ID NO: 27732 - DNA, 18 bp, Artificial sequence
  synthetic polynucleotide sequence
ccgcccttcaagtcagca

SEQ ID NO: 27733 - DNA, 19 bp, Artificial sequence
  synthetic polynucleotide sequence
ttcgcagcaaaagccctca

SEQ ID NO: 27734 - DNA, 21 bp, Artificial sequence
  synthetic polynucleotide sequence
tctggcacatacacctctgga

SEQ ID NO: 27735 - DNA, 22 bp, Artificial sequence
  synthetic polynucleotide sequence
gaatggaagtgtggggaggtga

SEQ ID NO: 27736 - DNA, 21 bp, Artificial sequence
  synthetic polynucleotide sequence
tgtaggaaattggggcgagca

SEQ ID NO: 27737 - DNA, 18 bp, Artificial sequence
  synthetic polynucleotide sequence
ggcaacctcacccagcaa

SEQ ID NO: 27738 - DNA, 22 bp, Artificial sequence
  synthetic polynucleotide sequence
aatgggagcccttaagtcagga

SEQ ID NO: 27739 - DNA, 22 bp, Artificial sequence
  synthetic polynucleotide sequence
aggaatgggaattggcccagga

SEQ ID NO: 27740 - DNA, 21 bp, Artificial sequence
  synthetic polynucleotide sequence
aactgatgggggtcactggga

SEQ ID NO: 27741 - DNA, 21 bp, Artificial sequence
  synthetic polynucleotide sequence
atgctggaggagattcccaga

SEQ ID NO: 27742 - DNA, 21 bp, Artificial sequence
  synthetic polynucleotide sequence
gctttctctccagggccacca

SEQ ID NO: 27743 - DNA, 18 bp, Artificial sequence
  synthetic polynucleotide sequence
ttccaggcaacaccccca

SEQ ID NO: 27744 - DNA, 18 bp, Artificial sequence
  synthetic polynucleotide sequence
gccagggtctgtcaggca

SEQ ID NO: 27745 - DNA, 19 bp, Artificial sequence
  synthetic polynucleotide sequence
ctctacccctgccacggga

SEQ ID NO: 27746 - DNA, 22 bp, Artificial sequence
  synthetic polynucleotide sequence
accagacacttggagtcaggca

SEQ ID NO: 27747 - DNA, 18 bp, Artificial sequence
  synthetic polynucleotide sequence
aggggctgattcgagcaa

SEQ ID NO: 27748 - DNA, 18 bp, Artificial sequence
  synthetic polynucleotide sequence
tggcaatggcatgcagca

SEQ ID NO: 27749 - DNA, 20 bp, Artificial sequence
  synthetic polynucleotide sequence
ctgggtcgaaggagtcagga

SEQ ID NO: 27750 - DNA, 21 bp, Artificial sequence
  synthetic polynucleotide sequence
tctcagaagcagctggtgaga

SEQ ID NO: 27751 - DNA, 20 bp, Artificial sequence
  synthetic polynucleotide sequence
gtctccaagcacttccgcaa

SEQ ID NO: 27752 - DNA, 20 bp, Artificial sequence
  synthetic polynucleotide sequence
tcgaggatgcatggctggga

SEQ ID NO: 27753 - DNA, 19 bp, Artificial sequence
  synthetic polynucleotide sequence
gacgcccggcctagcggga

SEQ ID NO: 27754 - DNA, 19 bp, Artificial sequence
  synthetic polynucleotide sequence
gcagcctctccgccgtgga

SEQ ID NO: 27755 - DNA, 20 bp, Artificial sequence
  synthetic polynucleotide sequence
ctgacccctgctgagcgtga

SEQ ID NO: 27756 - DNA, 22 bp, Artificial sequence
  synthetic polynucleotide sequence
tgaatttccggacagtggcaga

SEQ ID NO: 27757 - DNA, 21 bp, Artificial sequence
  synthetic polynucleotide sequence
ggagacctggcacacacacca

SEQ ID NO: 27758 - DNA, 19 bp, Artificial sequence
  synthetic polynucleotide sequence
tcatcagctccccccagga

SEQ ID NO: 27759 - DNA, 21 bp, Artificial sequence
  synthetic polynucleotide sequence
caacttcaaaccccggggcta

SEQ ID NO: 27760 - DNA, 21 bp, Artificial sequence
  synthetic polynucleotide sequence
tcggcatgcttaaaggggcca

SEQ ID NO: 27761 - DNA, 18 bp, Artificial sequence
  synthetic polynucleotide sequence
tctgcctggccaagggga

SEQ ID NO: 27762 - DNA, 18 bp, Artificial sequence
  synthetic polynucleotide sequence
ctcgcatccatcgaggca

SEQ ID NO: 27763 - DNA, 21 bp, Artificial sequence
  synthetic polynucleotide sequence
tgtctgcagaaatggccagga

SEQ ID NO: 27764 - DNA, 19 bp, Artificial sequence
  synthetic polynucleotide sequence
ggcaacctcacgctgggca

SEQ ID NO: 27765 - DNA, 18 bp, Artificial sequence
  synthetic polynucleotide sequence
gctgccacagagcaggca

SEQ ID NO: 27766 - DNA, 18 bp, Artificial sequence
  synthetic polynucleotide sequence
agccttggaggacggcga

SEQ ID NO: 27767 - DNA, 18 bp, Artificial sequence
  synthetic polynucleotide sequence
aagacagtggacgggcca

SEQ ID NO: 27768 - DNA, 18 bp, Artificial sequence
  synthetic polynucleotide sequence
atggctgagtagggggca

SEQ ID NO: 27769 - DNA, 21 bp, Artificial sequence
  synthetic polynucleotide sequence
aagcaggtcctcccaaagcta

SEQ ID NO: 27770 - DNA, 21 bp, Artificial sequence
  synthetic polynucleotide sequence
cagaaggacgaggcttctgga

SEQ ID NO: 27771 - DNA, 20 bp, Artificial sequence
  synthetic polynucleotide sequence
ctcccagactctgcaagcca

SEQ ID NO: 27772 - DNA, 19 bp, Artificial sequence
  synthetic polynucleotide sequence
ggtcagcactgggaaggca

SEQ ID NO: 27773 - DNA, 20 bp, Artificial sequence
  synthetic polynucleotide sequence
gcggcaggggaggatttgga

SEQ ID NO: 27774 - DNA, 22 bp, Artificial sequence
  synthetic polynucleotide sequence
tcatcttcacagggatgcagga

SEQ ID NO: 27775 - DNA, 21 bp, Artificial sequence
  synthetic polynucleotide sequence
accagatctctcggaggacca

SEQ ID NO: 27776 - DNA, 19 bp, Artificial sequence
  synthetic polynucleotide sequence
caggtggctgccatgggga

SEQ ID NO: 27777 - DNA, 19 bp, Artificial sequence
  synthetic polynucleotide sequence
ccccaccccactgtcacca

SEQ ID NO: 27778 - DNA, 21 bp, Artificial sequence
  synthetic polynucleotide sequence
ccacatcctctgagagcccga

SEQ ID NO: 27779 - DNA, 21 bp, Artificial sequence
  synthetic polynucleotide sequence
ctcggatgaaggtggacccaa

SEQ ID NO: 27780 - DNA, 19 bp, Artificial sequence
  synthetic polynucleotide sequence
tccaaggagcctgatggga

SEQ ID NO: 27781 - DNA, 21 bp, Artificial sequence
  synthetic polynucleotide sequence
ctctgagggaccgtgactcaa

SEQ ID NO: 27782 - DNA, 20 bp, Artificial sequence
  synthetic polynucleotide sequence
cagaggatacctggcctcca

SEQ ID NO: 27783 - DNA, 21 bp, Artificial sequence
  synthetic polynucleotide sequence
gcagtcacagccatccgggaa

SEQ ID NO: 27784 - DNA, 22 bp, Artificial sequence
  synthetic polynucleotide sequence
aaagctatggcacgaaagccga

SEQ ID NO: 27785 - DNA, 19 bp, Artificial sequence
  synthetic polynucleotide sequence
cgcaccgtcattgaggaca

SEQ ID NO: 27786 - DNA, 20 bp, Artificial sequence
  synthetic polynucleotide sequence
ctccttgaccgactcgcaga

SEQ ID NO: 27787 - DNA, 20 bp, Artificial sequence
  synthetic polynucleotide sequence
ctccacaagcaacccagaga

SEQ ID NO: 27788 - DNA, 21 bp, Artificial sequence
  synthetic polynucleotide sequence
gaaggtgaaggagaaggggca

SEQ ID NO: 27789 - DNA, 18 bp, Artificial sequence
  synthetic polynucleotide sequence
ccctcgaggacctgggca

SEQ ID NO: 27790 - DNA, 18 bp, Artificial sequence
  synthetic polynucleotide sequence
cagctctgcgggtccgga

SEQ ID NO: 27791 - DNA, 21 bp, Artificial sequence
  synthetic polynucleotide sequence
ccttcacgaatccccaggcca

SEQ ID NO: 27792 - DNA, 20 bp, Artificial sequence
  synthetic polynucleotide sequence
gaagctccatccacccggga

SEQ ID NO: 27793 - DNA, 18 bp, Artificial sequence
  synthetic polynucleotide sequence
cctgattcgcctgccaga

SEQ ID NO: 27794 - DNA, 21 bp, Artificial sequence
  synthetic polynucleotide sequence
aacggactgacatagagccca

SEQ ID NO: 27795 - DNA, 18 bp, Artificial sequence
  synthetic polynucleotide sequence
tcggccgtgtcaccagca

SEQ ID NO: 27796 - DNA, 18 bp, Artificial sequence
  synthetic polynucleotide sequence
cagctcctcatgcagcca

SEQ ID NO: 27797 - DNA, 18 bp, Artificial sequence
  synthetic polynucleotide sequence
aagagcctggcggacgaa

SEQ ID NO: 27798 - DNA, 18 bp, Artificial sequence
  synthetic polynucleotide sequence
aggcatagcggctggcga

SEQ ID NO: 27799 - DNA, 22 bp, Artificial sequence
  synthetic polynucleotide sequence
agaacctcgtgctagaacgcaa

SEQ ID NO: 27800 - DNA, 20 bp, Artificial sequence
  synthetic polynucleotide sequence
atcctccagcttgcgggaca

SEQ ID NO: 27801 - DNA, 21 bp, Artificial sequence
  synthetic polynucleotide sequence
acccttaggtacaggggccaa

SEQ ID NO: 27802 - DNA, 18 bp, Artificial sequence
  synthetic polynucleotide sequence
tcttggacgggtctgcca

SEQ ID NO: 27803 - DNA, 18 bp, Artificial sequence
  synthetic polynucleotide sequence
ctgggaggcacaggagca

SEQ ID NO: 27804 - DNA, 19 bp, Artificial sequence
  synthetic polynucleotide sequence
cccagtaggggtccaggga

SEQ ID NO: 27805 - DNA, 18 bp, Artificial sequence
  synthetic polynucleotide sequence
ggcggagtgcttcgagga

SEQ ID NO: 27806 - DNA, 18 bp, Artificial sequence
  synthetic polynucleotide sequence
tgggcgtcggagtgggca

SEQ ID NO: 27807 - DNA, 20 bp, Artificial sequence
  synthetic polynucleotide sequence
ctcactggaggacttcccca

SEQ ID NO: 27808 - DNA, 18 bp, Artificial sequence
  synthetic polynucleotide sequence
agtggctgaagggcgaga

SEQ ID NO: 27809 - DNA, 21 bp, Artificial sequence
  synthetic polynucleotide sequence
catctcactacgggcacagca

SEQ ID NO: 27810 - DNA, 20 bp, Artificial sequence
  synthetic polynucleotide sequence
gtggagactggctgacggga

SEQ ID NO: 27811 - DNA, 21 bp, Artificial sequence
  synthetic polynucleotide sequence
ccacttcgaaagccaagccca

SEQ ID NO: 27812 - DNA, 18 bp, Artificial sequence
  synthetic polynucleotide sequence
tccaagtggccgggggca

SEQ ID NO: 27813 - DNA, 19 bp, Artificial sequence
  synthetic polynucleotide sequence
gagagcaccaatcccgaga

SEQ ID NO: 27814 - DNA, 18 bp, Artificial sequence
  synthetic polynucleotide sequence
ggaatccggtcgcacgga

SEQ ID NO: 27815 - DNA, 20 bp, Artificial sequence
  synthetic polynucleotide sequence
attgcgagaagagtgcagca

SEQ ID NO: 27816 - DNA, 21 bp, Artificial sequence
  synthetic polynucleotide sequence
gtctggtgggaactgtgggaa

SEQ ID NO: 27817 - DNA, 21 bp, Artificial sequence
  synthetic polynucleotide sequence
aagaagacgcccctcagcaca

SEQ ID NO: 27818 - DNA, 19 bp, Artificial sequence
  synthetic polynucleotide sequence
cacgtggctgactggggga

SEQ ID NO: 27819 - DNA, 18 bp, Artificial sequence
  synthetic polynucleotide sequence
ctcacaggctgcagccaa

SEQ ID NO: 27820 - DNA, 18 bp, Artificial sequence
  synthetic polynucleotide sequence
tgtgcggcactgggcaca

SEQ ID NO: 27821 - DNA, 22 bp, Artificial sequence
  synthetic polynucleotide sequence
gaagagggaaggcaagactcca

SEQ ID NO: 27822 - DNA, 21 bp, Artificial sequence
  synthetic polynucleotide sequence
tgaggatgggcctccatcaca

SEQ ID NO: 27823 - DNA, 19 bp, Artificial sequence
  synthetic polynucleotide sequence
cggggtggagcccatggaa

SEQ ID NO: 27824 - DNA, 21 bp, Artificial sequence
  synthetic polynucleotide sequence
aagtactcctccacgacgcga

SEQ ID NO: 27825 - DNA, 22 bp, Artificial sequence
  synthetic polynucleotide sequence
gcaatgcctcgagacatcctga

SEQ ID NO: 27826 - DNA, 19 bp, Artificial sequence
  synthetic polynucleotide sequence
cacttggcgccacggtgga

SEQ ID NO: 27827 - DNA, 21 bp, Artificial sequence
  synthetic polynucleotide sequence
gccaagtcagtcatcgcccca

SEQ ID NO: 27828 - DNA, 22 bp, Artificial sequence
  synthetic polynucleotide sequence
tgatgacaacgtgtgggtgaca

SEQ ID NO: 27829 - DNA, 18 bp, Artificial sequence
  synthetic polynucleotide sequence
gcctgttccccaacacca

SEQ ID NO: 27830 - DNA, 18 bp, Artificial sequence
  synthetic polynucleotide sequence
tccagtcggtccagccga

SEQ ID NO: 27831 - DNA, 21 bp, Artificial sequence
  synthetic polynucleotide sequence
tggggcacaggacatccagga

SEQ ID NO: 27832 - DNA, 22 bp, Artificial sequence
  synthetic polynucleotide sequence
atagtttggagagcacggacca

SEQ ID NO: 27833 - DNA, 21 bp, Artificial sequence
  synthetic polynucleotide sequence
gaggctgggatgcagatggaa

SEQ ID NO: 27834 - DNA, 21 bp, Artificial sequence
  synthetic polynucleotide sequence
tcccacagagtgtagctgcca

SEQ ID NO: 27835 - DNA, 21 bp, Artificial sequence
  synthetic polynucleotide sequence
ctgtgccaagatccggaccta

SEQ ID NO: 27836 - DNA, 21 bp, Artificial sequence
  synthetic polynucleotide sequence
tgcaccatgtacagctgccca

SEQ ID NO: 27837 - DNA, 21 bp, Artificial sequence
  synthetic polynucleotide sequence
agggcatcagagactggacca

SEQ ID NO: 27838 - DNA, 22 bp, Artificial sequence
  synthetic polynucleotide sequence
acattctgaaggatgagggcca

SEQ ID NO: 27839 - DNA, 20 bp, Artificial sequence
  synthetic polynucleotide sequence
gtgctatcccgagtcagcca

SEQ ID NO: 27840 - DNA, 18 bp, Artificial sequence
  synthetic polynucleotide sequence
agccgatgcactccagca

SEQ ID NO: 27841 - DNA, 20 bp, Artificial sequence
  synthetic polynucleotide sequence
atggagaccatcagccagca

SEQ ID NO: 27842 - DNA, 18 bp, Artificial sequence
  synthetic polynucleotide sequence
gcctgcgctcatagggga

SEQ ID NO: 27843 - DNA, 20 bp, Artificial sequence
  synthetic polynucleotide sequence
ggcctctatcgcacaggcaa

SEQ ID NO: 27844 - DNA, 20 bp, Artificial sequence
  synthetic polynucleotide sequence
gggatgaggcacacaccaca

SEQ ID NO: 27845 - DNA, 22 bp, Artificial sequence
  synthetic polynucleotide sequence
ctgaagctaacgcaaggtacca

SEQ ID NO: 27846 - DNA, 20 bp, Artificial sequence
  synthetic polynucleotide sequence
gcggtgaatgggcagatcga

SEQ ID NO: 27847 - DNA, 19 bp, Artificial sequence
  synthetic polynucleotide sequence
gccccacctctctaagcca

SEQ ID NO: 27848 - DNA, 20 bp, Artificial sequence
  synthetic polynucleotide sequence
gctgcttagaagcacagcca

SEQ ID NO: 27849 - DNA, 19 bp, Artificial sequence
  synthetic polynucleotide sequence
tggctggcagagcaacaga

SEQ ID NO: 27850 - DNA, 19 bp, Artificial sequence
  synthetic polynucleotide sequence
ctgggcgtgctggagctca

SEQ ID NO: 27851 - DNA, 18 bp, Artificial sequence
  synthetic polynucleotide sequence
gatgtggtgcgtgcccca

SEQ ID NO: 27852 - DNA, 20 bp, Artificial sequence
  synthetic polynucleotide sequence
gacaaaggtgctgcacagga

SEQ ID NO: 27853 - DNA, 21 bp, Artificial sequence
  synthetic polynucleotide sequence
atgccatcaacagtggagcga

SEQ ID NO: 27854 - DNA, 22 bp, Artificial sequence
  synthetic polynucleotide sequence
caaactgcatgcacgtccagca

SEQ ID NO: 27855 - DNA, 19 bp, Artificial sequence
  synthetic polynucleotide sequence
caggcggtgacagcgagga

SEQ ID NO: 27856 - DNA, 18 bp, Artificial sequence
  synthetic polynucleotide sequence
accggtgccccctcctca

SEQ ID NO: 27857 - DNA, 20 bp, Artificial sequence
  synthetic polynucleotide sequence
cggcggcggtaacttcgaca

SEQ ID NO: 27858 - DNA, 20 bp, Artificial sequence
  synthetic polynucleotide sequence
accgtctcggccgcggagaa

SEQ ID NO: 27859 - DNA, 21 bp, Artificial sequence
  synthetic polynucleotide sequence
aaagagctgcctgaacacaca

SEQ ID NO: 27860 - DNA, 18 bp, Artificial sequence
  synthetic polynucleotide sequence
catctggaagctcgggga

SEQ ID NO: 27861 - DNA, 21 bp, Artificial sequence
  synthetic polynucleotide sequence
ctgggccagcatattcagaca

SEQ ID NO: 27862 - DNA, 19 bp, Artificial sequence
  synthetic polynucleotide sequence
tcaccatcctgtccagcaa

SEQ ID NO: 27863 - DNA, 21 bp, Artificial sequence
  synthetic polynucleotide sequence
ctatggctgccaagacccaga

SEQ ID NO: 27864 - DNA, 21 bp, Artificial sequence
  synthetic polynucleotide sequence
tcttcagcatgtcatccgcca

SEQ ID NO: 27865 - DNA, 20 bp, Artificial sequence
  synthetic polynucleotide sequence
tggacttcagggaccgcaca

SEQ ID NO: 27866 - DNA, 21 bp, Artificial sequence
  synthetic polynucleotide sequence
ttgggtcaggctatcagagga

SEQ ID NO: 27867 - DNA, 19 bp, Artificial sequence
  synthetic polynucleotide sequence
tccgagatcaagtgcgaca

SEQ ID NO: 27868 - DNA, 21 bp, Artificial sequence
  synthetic polynucleotide sequence
tgtgcatgtctagaagcggga

SEQ ID NO: 27869 - DNA, 18 bp, Artificial sequence
  synthetic polynucleotide sequence
acagcggaagtgacccca

SEQ ID NO: 27870 - DNA, 19 bp, Artificial sequence
  synthetic polynucleotide sequence
catcttcacaccgagccca

SEQ ID NO: 27871 - DNA, 19 bp, Artificial sequence
  synthetic polynucleotide sequence
cccgggttctgcggaggaa

SEQ ID NO: 27872 - DNA, 19 bp, Artificial sequence
  synthetic polynucleotide sequence
ctttggtggcacgccggga

SEQ ID NO: 27873 - DNA, 19 bp, Artificial sequence
  synthetic polynucleotide sequence
ggactccaggcgtgcccaa

SEQ ID NO: 27874 - DNA, 20 bp, Artificial sequence
  synthetic polynucleotide sequence
cctcggcctttcaccagcca

SEQ ID NO: 27875 - DNA, 18 bp, Artificial sequence
  synthetic polynucleotide sequence
gcggaacaccagcaacca

SEQ ID NO: 27876 - DNA, 20 bp, Artificial sequence
  synthetic polynucleotide sequence
cagccaatctagggaggcca

SEQ ID NO: 27877 - DNA, 19 bp, Artificial sequence
  synthetic polynucleotide sequence
ctcagcaaacttgcgagga

SEQ ID NO: 27878 - DNA, 20 bp, Artificial sequence
  synthetic polynucleotide sequence
caaccactaccccgactcca

SEQ ID NO: 27879 - DNA, 20 bp, Artificial sequence
  synthetic polynucleotide sequence
gtgggcgatgaacagtcgga

SEQ ID NO: 27880 - DNA, 18 bp, Artificial sequence
  synthetic polynucleotide sequence
tctggcccacccccgtca

SEQ ID NO: 27881 - DNA, 21 bp, Artificial sequence
  synthetic polynucleotide sequence
tctggacagtccaaggctcga

SEQ ID NO: 27882 - DNA, 21 bp, Artificial sequence
  synthetic polynucleotide sequence
tgcaacctggacatggcagga

SEQ ID NO: 27883 - DNA, 18 bp, Artificial sequence
  synthetic polynucleotide sequence
gagcgaggactggagcca

SEQ ID NO: 27884 - DNA, 18 bp, Artificial sequence
  synthetic polynucleotide sequence
gagcaacatgctgggcca

SEQ ID NO: 27885 - DNA, 20 bp, Artificial sequence
  synthetic polynucleotide sequence
gtgggcacaggtaaaaccaa

SEQ ID NO: 27886 - DNA, 18 bp, Artificial sequence
  synthetic polynucleotide sequence
gcagtagccacagcggca

SEQ ID NO: 27887 - DNA, 21 bp, Artificial sequence
  synthetic polynucleotide sequence
atggcgatctacaagcgtgga

SEQ ID NO: 27888 - DNA, 20 bp, Artificial sequence
  synthetic polynucleotide sequence
ggagagaagctgcaaggcca

SEQ ID NO: 27889 - DNA, 20 bp, Artificial sequence
  synthetic polynucleotide sequence
ttgccgggccatcagaccca

SEQ ID NO: 27890 - DNA, 20 bp, Artificial sequence
  synthetic polynucleotide sequence
cggagcccagcccagacaga

SEQ ID NO: 27891 - DNA, 19 bp, Artificial sequence
  synthetic polynucleotide sequence
tccagtgttgcgggaagga

SEQ ID NO: 27892 - DNA, 20 bp, Artificial sequence
  synthetic polynucleotide sequence
ccagctgaacctgtccccca

SEQ ID NO: 27893 - DNA, 20 bp, Artificial sequence
  synthetic polynucleotide sequence
gtggccagaagagctccgaa

SEQ ID NO: 27894 - DNA, 21 bp, Artificial sequence
  synthetic polynucleotide sequence
gaagacccactggtgtcacca

SEQ ID NO: 27895 - DNA, 18 bp, Artificial sequence
  synthetic polynucleotide sequence
gggccaccatccaaagga

SEQ ID NO: 27896 - DNA, 18 bp, Artificial sequence
  synthetic polynucleotide sequence
atgcacactgagcgcaca

SEQ ID NO: 27897 - DNA, 18 bp, Artificial sequence
  synthetic polynucleotide sequence
accacgctgttggacgga

SEQ ID NO: 27898 - DNA, 21 bp, Artificial sequence
  synthetic polynucleotide sequence
tcttggaggacgaagttagca

SEQ ID NO: 27899 - DNA, 21 bp, Artificial sequence
  synthetic polynucleotide sequence
ccaaccaccccaagtacgaca

SEQ ID NO: 27900 - DNA, 20 bp, Artificial sequence
  synthetic polynucleotide sequence
tccccagccccataaacgca

SEQ ID NO: 27901 - DNA, 19 bp, Artificial sequence
  synthetic polynucleotide sequence
ccaaggaagcaccccccca

SEQ ID NO: 27902 - DNA, 21 bp, Artificial sequence
  synthetic polynucleotide sequence
atcagacacatcctgggctga

SEQ ID NO: 27903 - DNA, 21 bp, Artificial sequence
  synthetic polynucleotide sequence
taaaggccgctacgtcgaaga

SEQ ID NO: 27904 - DNA, 22 bp, Artificial sequence
  synthetic polynucleotide sequence
gagaaggcgactgaatgagcca

SEQ ID NO: 27905 - DNA, 22 bp, Artificial sequence
  synthetic polynucleotide sequence
catatgccttctacagacccca

SEQ ID NO: 27906 - DNA, 21 bp, Artificial sequence
  synthetic polynucleotide sequence
tcagaaggggccataagtgga

SEQ ID NO: 27907 - DNA, 19 bp, Artificial sequence
  synthetic polynucleotide sequence
cacaggaagcgttgggaga

SEQ ID NO: 27908 - DNA, 21 bp, Artificial sequence
  synthetic polynucleotide sequence
cagtgtcatcttgatcagcca

SEQ ID NO: 27909 - DNA, 18 bp, Artificial sequence
  synthetic polynucleotide sequence
aggagcatccatcgcaca

SEQ ID NO: 27910 - DNA, 19 bp, Artificial sequence
  synthetic polynucleotide sequence
ccagccacgtctgtaccca

SEQ ID NO: 27911 - DNA, 22 bp, Artificial sequence
  synthetic polynucleotide sequence
cggaaagcgaccaaacttggaa

SEQ ID NO: 27912 - DNA, 22 bp, Artificial sequence
  synthetic polynucleotide sequence
atgctgttggcagcactgcaga

SEQ ID NO: 27913 - DNA, 22 bp, Artificial sequence
  synthetic polynucleotide sequence
agaagaggaagctggagaacga

SEQ ID NO: 27914 - DNA, 21 bp, Artificial sequence
  synthetic polynucleotide sequence
ccaggaacttgaggcggtgca

SEQ ID NO: 27915 - DNA, 23 bp, Artificial sequence
  synthetic polynucleotide sequence
gaatacaatcacctggactccga

SEQ ID NO: 27916 - DNA, 21 bp, Artificial sequence
  synthetic polynucleotide sequence
agctggtggaggctgtccaca

SEQ ID NO: 27917 - DNA, 18 bp, Artificial sequence
  synthetic polynucleotide sequence
caggcgtggagttggaca

SEQ ID NO: 27918 - DNA, 18 bp, Artificial sequence
  synthetic polynucleotide sequence
cacaatcgcccagtccca

SEQ ID NO: 27919 - DNA, 18 bp, Artificial sequence
  synthetic polynucleotide sequence
ggacacctggcgcaagga

SEQ ID NO: 27920 - DNA, 18 bp, Artificial sequence
  synthetic polynucleotide sequence
gccaaggcatgcagccga

SEQ ID NO: 27921 - DNA, 19 bp, Artificial sequence
  synthetic polynucleotide sequence
gcaggaagaagggccagga

SEQ ID NO: 27922 - DNA, 20 bp, Artificial sequence
  synthetic polynucleotide sequence
atggttggatggacgaacga

SEQ ID NO: 27923 - DNA, 20 bp, Artificial sequence
  synthetic polynucleotide sequence
cggcggaacctgggtctgga

SEQ ID NO: 27924 - DNA, 21 bp, Artificial sequence
  synthetic polynucleotide sequence
aggtgcgatgatccagtccca

SEQ ID NO: 27925 - DNA, 18 bp, Artificial sequence
  synthetic polynucleotide sequence
ccgtcgcagtcggaccaa

SEQ ID NO: 27926 - DNA, 18 bp, Artificial sequence
  synthetic polynucleotide sequence
gcccaggtcttccagcga

SEQ ID NO: 27927 - DNA, 18 bp, Artificial sequence
  synthetic polynucleotide sequence
cgatgtgacgccgacgaa

SEQ ID NO: 27928 - DNA, 20 bp, Artificial sequence
  synthetic polynucleotide sequence
atggtacttgagggtgggca

SEQ ID NO: 27929 - DNA, 18 bp, Artificial sequence
  synthetic polynucleotide sequence
agccatccctgtccccaa

SEQ ID NO: 27930 - DNA, 22 bp, Artificial sequence
  synthetic polynucleotide sequence
agatggtcagtgagaagggaca

SEQ ID NO: 27931 - DNA, 20 bp, Artificial sequence
  synthetic polynucleotide sequence
cagggcaagcgacccagcaa

SEQ ID NO: 27932 - DNA, 21 bp, Artificial sequence
  synthetic polynucleotide sequence
cctcgtactcaaggggtgcga

SEQ ID NO: 27933 - DNA, 18 bp, Artificial sequence
  synthetic polynucleotide sequence
tcgccatggcaagcggca

SEQ ID NO: 27934 - DNA, 18 bp, Artificial sequence
  synthetic polynucleotide sequence
gtcgcatacaccctcgca

SEQ ID NO: 27935 - DNA, 21 bp, Artificial sequence
  synthetic polynucleotide sequence
ccgcacaggtacaaccctcga

SEQ ID NO: 27936 - DNA, 21 bp, Artificial sequence
  synthetic polynucleotide sequence
gtcttggcactgaggagtcca

SEQ ID NO: 27937 - DNA, 21 bp, Artificial sequence
  synthetic polynucleotide sequence
gggcgtgaagtctgagggaga

SEQ ID NO: 27938 - DNA, 20 bp, Artificial sequence
  synthetic polynucleotide sequence
cttgatggggtggctaagga

SEQ ID NO: 27939 - DNA, 19 bp, Artificial sequence
  synthetic polynucleotide sequence
tgcgcacaatgtagcagca

SEQ ID NO: 27940 - DNA, 20 bp, Artificial sequence
  synthetic polynucleotide sequence
tggtaccaggaggtcactga

SEQ ID NO: 27941 - DNA, 18 bp, Artificial sequence
  synthetic polynucleotide sequence
gagaggccagaggggcaa

SEQ ID NO: 27942 - DNA, 18 bp, Artificial sequence
  synthetic polynucleotide sequence
atcgcaagagccgctgca

SEQ ID NO: 27943 - DNA, 18 bp, Artificial sequence
  synthetic polynucleotide sequence
ccgcggaggtgctggaga

SEQ ID NO: 27944 - DNA, 19 bp, Artificial sequence
  synthetic polynucleotide sequence
ttgccaaggtaaggtggga

SEQ ID NO: 27945 - DNA, 20 bp, Artificial sequence
  synthetic polynucleotide sequence
aacagaacggagaggcccca

SEQ ID NO: 27946 - DNA, 23 bp, Artificial sequence
  synthetic polynucleotide sequence
aataagccagatagggtaacgca

SEQ ID NO: 27947 - DNA, 22 bp, Artificial sequence
  synthetic polynucleotide sequence
agaacgaagagctcatccgtga

SEQ ID NO: 27948 - DNA, 20 bp, Artificial sequence
  synthetic polynucleotide sequence
agcagccccaggtagtagga

SEQ ID NO: 27949 - DNA, 21 bp, Artificial sequence
  synthetic polynucleotide sequence
agaatttggggcccaagccaa

SEQ ID NO: 27950 - DNA, 21 bp, Artificial sequence
  synthetic polynucleotide sequence
gtctccaatccatgggctcca

SEQ ID NO: 27951 - DNA, 19 bp, Artificial sequence
  synthetic polynucleotide sequence
ggatcatgcccccggacga

SEQ ID NO: 27952 - DNA, 20 bp, Artificial sequence
  synthetic polynucleotide sequence
cgtatgccacccaggcgcca

SEQ ID NO: 27953 - DNA, 19 bp, Artificial sequence
  synthetic polynucleotide sequence
ggtgcactgagggcaggga

SEQ ID NO: 27954 - DNA, 18 bp, Artificial sequence
  synthetic polynucleotide sequence
cgggcagtctgtgggcca

SEQ ID NO: 27955 - DNA, 18 bp, Artificial sequence
  synthetic polynucleotide sequence
gcgagcttcgagaaggca

SEQ ID NO: 27956 - DNA, 19 bp, Artificial sequence
  synthetic polynucleotide sequence
tgtgctggacagctgcaga

SEQ ID NO: 27957 - DNA, 19 bp, Artificial sequence
  synthetic polynucleotide sequence
gatgccaacccgcccctga

SEQ ID NO: 27958 - DNA, 20 bp, Artificial sequence
  synthetic polynucleotide sequence
ctggtccaacagccccgtca

SEQ ID NO: 27959 - DNA, 18 bp, Artificial sequence
  synthetic polynucleotide sequence
ccgtgaaaccccaaggga

SEQ ID NO: 27960 - DNA, 19 bp, Artificial sequence
  synthetic polynucleotide sequence
cggtccaagagctggcaca

SEQ ID NO: 27961 - DNA, 21 bp, Artificial sequence
  synthetic polynucleotide sequence
catcaatcccctgccacacca

SEQ ID NO: 27962 - DNA, 20 bp, Artificial sequence
  synthetic polynucleotide sequence
ctggcttggctcaacagaga

SEQ ID NO: 27963 - DNA, 21 bp, Artificial sequence
  synthetic polynucleotide sequence
tccgagtgacagccagtgaga

SEQ ID NO: 27964 - DNA, 21 bp, Artificial sequence
  synthetic polynucleotide sequence
cagtctgcacagcatgtccca

SEQ ID NO: 27965 - DNA, 19 bp, Artificial sequence
  synthetic polynucleotide sequence
tgaggccagaggttcctga

SEQ ID NO: 27966 - DNA, 21 bp, Artificial sequence
  synthetic polynucleotide sequence
tgaagctcacctgatgaccca

SEQ ID NO: 27967 - DNA, 21 bp, Artificial sequence
  synthetic polynucleotide sequence
agaagatctgggcagcatcca

SEQ ID NO: 27968 - DNA, 21 bp, Artificial sequence
  synthetic polynucleotide sequence
tctctgcaaagtactggcgga

SEQ ID NO: 27969 - DNA, 21 bp, Artificial sequence
  synthetic polynucleotide sequence
aaggggaaccaccaaagctga

SEQ ID NO: 27970 - DNA, 20 bp, Artificial sequence
  synthetic polynucleotide sequence
cagcttccccagcagcctga

SEQ ID NO: 27971 - DNA, 18 bp, Artificial sequence
  synthetic polynucleotide sequence
gcactcagcggacgggga

SEQ ID NO: 27972 - DNA, 20 bp, Artificial sequence
  synthetic polynucleotide sequence
cgtcagcttcccaccgtcca

SEQ ID NO: 27973 - DNA, 18 bp, Artificial sequence
  synthetic polynucleotide sequence
tcgggaactccaggagca

SEQ ID NO: 27974 - DNA, 18 bp, Artificial sequence
  synthetic polynucleotide sequence
gcatgttgctggacgcca

SEQ ID NO: 27975 - DNA, 21 bp, Artificial sequence
  synthetic polynucleotide sequence
acagcagcaagacatggccca

SEQ ID NO: 27976 - DNA, 21 bp, Artificial sequence
  synthetic polynucleotide sequence
agtcgaagtcaggcttgccca

SEQ ID NO: 27977 - DNA, 20 bp, Artificial sequence
  synthetic polynucleotide sequence
ggccacgctgtgagcctgga

SEQ ID NO: 27978 - DNA, 20 bp, Artificial sequence
  synthetic polynucleotide sequence
aggtgggtggacagcgtgga

SEQ ID NO: 27979 - DNA, 21 bp, Artificial sequence
  synthetic polynucleotide sequence
gtggtgcaggccagtatggaa

SEQ ID NO: 27980 - DNA, 21 bp, Artificial sequence
  synthetic polynucleotide sequence
agcccagagagcttgtgacca

SEQ ID NO: 27981 - DNA, 19 bp, Artificial sequence
  synthetic polynucleotide sequence
tcatggcccaagagcgaga

SEQ ID NO: 27982 - DNA, 20 bp, Artificial sequence
  synthetic polynucleotide sequence
tctgggcctctacaccagca

SEQ ID NO: 27983 - DNA, 21 bp, Artificial sequence
  synthetic polynucleotide sequence
catcccgctgctgaaagacga

SEQ ID NO: 27984 - DNA, 21 bp, Artificial sequence
  synthetic polynucleotide sequence
cacaccaagtccacgtcctga

SEQ ID NO: 27985 - DNA, 18 bp, Artificial sequence
  synthetic polynucleotide sequence
cacgggctgctcaagaca

SEQ ID NO: 27986 - DNA, 19 bp, Artificial sequence
  synthetic polynucleotide sequence
cctgcagagcctaccacca

SEQ ID NO: 27987 - DNA, 19 bp, Artificial sequence
  synthetic polynucleotide sequence
cccggtggaagaaaaagca

SEQ ID NO: 27988 - DNA, 18 bp, Artificial sequence
  synthetic polynucleotide sequence
acagctcgtccggggtga

SEQ ID NO: 27989 - DNA, 19 bp, Artificial sequence
  synthetic polynucleotide sequence
ccctggagctctacacgca

SEQ ID NO: 27990 - DNA, 18 bp, Artificial sequence
  synthetic polynucleotide sequence
gcttcagctccccagcca

SEQ ID NO: 27991 - DNA, 18 bp, Artificial sequence
  synthetic polynucleotide sequence
gcacagtcatgaccccca

SEQ ID NO: 27992 - DNA, 18 bp, Artificial sequence
  synthetic polynucleotide sequence
acggtcacatcggagcca

SEQ ID NO: 27993 - DNA, 21 bp, Artificial sequence
  synthetic polynucleotide sequence
gcttcacagagctcacgacaa

SEQ ID NO: 27994 - DNA, 21 bp, Artificial sequence
  synthetic polynucleotide sequence
caggacagacagcacggtcaa

SEQ ID NO: 27995 - DNA, 21 bp, Artificial sequence
  synthetic polynucleotide sequence
tacgagcatacctggggctga

SEQ ID NO: 27996 - DNA, 21 bp, Artificial sequence
  synthetic polynucleotide sequence
agcaaaggtagggtgtggcca

SEQ ID NO: 27997 - DNA, 20 bp, Artificial sequence
  synthetic polynucleotide sequence
ctggaccagctgaaccccca

SEQ ID NO: 27998 - DNA, 22 bp, Artificial sequence
  synthetic polynucleotide sequence
gagccaggacaggaagtatgga

SEQ ID NO: 27999 - DNA, 21 bp, Artificial sequence
  synthetic polynucleotide sequence
ggcagaggcatgtgtagggga

SEQ ID NO: 28000 - DNA, 20 bp, Artificial sequence
  synthetic polynucleotide sequence
tgaggcaagtagggggtgga

SEQ ID NO: 28001 - DNA, 20 bp, Artificial sequence
  synthetic polynucleotide sequence
cggcttccggacgacggaga

SEQ ID NO: 28002 - DNA, 20 bp, Artificial sequence
  synthetic polynucleotide sequence
ggtggcgatgtgggaaggga

SEQ ID NO: 28003 - DNA, 21 bp, Artificial sequence
  synthetic polynucleotide sequence
gatggtgatgagccacagcca

SEQ ID NO: 28004 - DNA, 20 bp, Artificial sequence
  synthetic polynucleotide sequence
gtcactcgccagtcggaaga

SEQ ID NO: 28005 - DNA, 19 bp, Artificial sequence
  synthetic polynucleotide sequence
ccacttctcccagacggga

SEQ ID NO: 28006 - DNA, 18 bp, Artificial sequence
  synthetic polynucleotide sequence
tcccagacaggctgggga

SEQ ID NO: 28007 - DNA, 20 bp, Artificial sequence
  synthetic polynucleotide sequence
ggcctcaggacctccacgga

SEQ ID NO: 28008 - DNA, 20 bp, Artificial sequence
  synthetic polynucleotide sequence
gtcggcgaggcccaagcaga

SEQ ID NO: 28009 - DNA, 25 bp, Artificial sequence
  synthetic polynucleotide sequence
aagcaaggcagagaactgactgaca

SEQ ID NO: 28010 - DNA, 22 bp, Artificial sequence
  synthetic polynucleotide sequence
ctctgccagtagactaccagca

SEQ ID NO: 28011 - DNA, 20 bp, Artificial sequence
  synthetic polynucleotide sequence
aaggacgtcacgggtccaga

SEQ ID NO: 28012 - DNA, 20 bp, Artificial sequence
  synthetic polynucleotide sequence
aatcctgcaggcgggccaca

SEQ ID NO: 28013 - DNA, 19 bp, Artificial sequence
  synthetic polynucleotide sequence
gtgagtgaagacctgggca

SEQ ID NO: 28014 - DNA, 20 bp, Artificial sequence
  synthetic polynucleotide sequence
atggtactcaccagcaggca

SEQ ID NO: 28015 - DNA, 20 bp, Artificial sequence
  synthetic polynucleotide sequence
gttgacctcagacgctcaga

SEQ ID NO: 28016 - DNA, 19 bp, Artificial sequence
  synthetic polynucleotide sequence
ccagtgaagttcagcggca

SEQ ID NO: 28017 - DNA, 21 bp, Artificial sequence
  synthetic polynucleotide sequence
cctctcagactggggcagcta

SEQ ID NO: 28018 - DNA, 18 bp, Artificial sequence
  synthetic polynucleotide sequence
ggccaccagagagccgga

SEQ ID NO: 28019 - DNA, 21 bp, Artificial sequence
  synthetic polynucleotide sequence
tcacgcgaagtcctgagtgca

SEQ ID NO: 28020 - DNA, 19 bp, Artificial sequence
  synthetic polynucleotide sequence
taggggttcaagagcagga

SEQ ID NO: 28021 - DNA, 20 bp, Artificial sequence
  synthetic polynucleotide sequence
atcttgcgccagagaacaga

SEQ ID NO: 28022 - DNA, 20 bp, Artificial sequence
  synthetic polynucleotide sequence
ctagctcagggttcccacca

SEQ ID NO: 28023 - DNA, 20 bp, Artificial sequence
  synthetic polynucleotide sequence
aacggcagcctcacggccca

SEQ ID NO: 28024 - DNA, 20 bp, Artificial sequence
  synthetic polynucleotide sequence
gtacagcaccacgtctccca

SEQ ID NO: 28025 - DNA, 19 bp, Artificial sequence
  synthetic polynucleotide sequence
ggccagaaccagacccaga

SEQ ID NO: 28026 - DNA, 18 bp, Artificial sequence
  synthetic polynucleotide sequence
tccgagacggcgtacaca

SEQ ID NO: 28027 - DNA, 21 bp, Artificial sequence
  synthetic polynucleotide sequence
gactcacaccctactcaggca

SEQ ID NO: 28028 - DNA, 20 bp, Artificial sequence
  synthetic polynucleotide sequence
agcagggtcccttggccaca

SEQ ID NO: 28029 - DNA, 21 bp, Artificial sequence
  synthetic polynucleotide sequence
cagctaaccactctgcaccca

SEQ ID NO: 28030 - DNA, 22 bp, Artificial sequence
  synthetic polynucleotide sequence
aggttccggttcaaggtcagga

SEQ ID NO: 28031 - DNA, 21 bp, Artificial sequence
  synthetic polynucleotide sequence
aagtgactgcagccctggaga

SEQ ID NO: 28032 - DNA, 21 bp, Artificial sequence
  synthetic polynucleotide sequence
cctttcctggagtccgaggca

SEQ ID NO: 28033 - DNA, 22 bp, Artificial sequence
  synthetic polynucleotide sequence
aggaggacaaggctgacaagca

SEQ ID NO: 28034 - DNA, 20 bp, Artificial sequence
  synthetic polynucleotide sequence
gctgctcacaggggaagcca

SEQ ID NO: 28035 - DNA, 20 bp, Artificial sequence
  synthetic polynucleotide sequence
ccgacaccctccaacaggga

SEQ ID NO: 28036 - DNA, 20 bp, Artificial sequence
  synthetic polynucleotide sequence
ggcgaagacactcctgagga

SEQ ID NO: 28037 - DNA, 22 bp, Artificial sequence
  synthetic polynucleotide sequence
ccaacaccttccaacagggtga

SEQ ID NO: 28038 - DNA, 21 bp, Artificial sequence
  synthetic polynucleotide sequence
tgttggcgaagacgctcctga

SEQ ID NO: 28039 - DNA, 20 bp, Artificial sequence
  synthetic polynucleotide sequence
gagctgctcccagtcaagga

SEQ ID NO: 28040 - DNA, 18 bp, Artificial sequence
  synthetic polynucleotide sequence
caccaaccactcgcacca

SEQ ID NO: 28041 - DNA, 21 bp, Artificial sequence
  synthetic polynucleotide sequence
atcagagctgcatggtacaca

SEQ ID NO: 28042 - DNA, 18 bp, Artificial sequence
  synthetic polynucleotide sequence
agacgagacccaggccca

SEQ ID NO: 28043 - DNA, 18 bp, Artificial sequence
  synthetic polynucleotide sequence
gaggcctgggacaggaga

SEQ ID NO: 28044 - DNA, 18 bp, Artificial sequence
  synthetic polynucleotide sequence
tcaggcaagggcaaggca

SEQ ID NO: 28045 - DNA, 18 bp, Artificial sequence
  synthetic polynucleotide sequence
cagcccggggcaggtgca

SEQ ID NO: 28046 - DNA, 21 bp, Artificial sequence
  synthetic polynucleotide sequence
ggccccagtaagaggaatgga

SEQ ID NO: 28047 - DNA, 20 bp, Artificial sequence
  synthetic polynucleotide sequence
tgagccctgaacaccagaga

SEQ ID NO: 28048 - DNA, 18 bp, Artificial sequence
  synthetic polynucleotide sequence
ctagagctcggggctgca

SEQ ID NO: 28049 - DNA, 18 bp, Artificial sequence
  synthetic polynucleotide sequence
cccttgggacaccaacga

SEQ ID NO: 28050 - DNA, 18 bp, Artificial sequence
  synthetic polynucleotide sequence
tggtccctgagcgaggca

SEQ ID NO: 28051 - DNA, 22 bp, Artificial sequence
  synthetic polynucleotide sequence
ttgatcggaaacactggggcaa

SEQ ID NO: 28052 - DNA, 21 bp, Artificial sequence
  synthetic polynucleotide sequence
aacccggcaaaagaagcacca

SEQ ID NO: 28053 - DNA, 18 bp, Artificial sequence
  synthetic polynucleotide sequence
gacagaggcggcgctgga

SEQ ID NO: 28054 - DNA, 19 bp, Artificial sequence
  synthetic polynucleotide sequence
gaagggcgactcctcggga

SEQ ID NO: 28055 - DNA, 18 bp, Artificial sequence
  synthetic polynucleotide sequence
agccccaacgctgaagca

SEQ ID NO: 28056 - DNA, 20 bp, Artificial sequence
  synthetic polynucleotide sequence
gaagggagaggagttggcca

SEQ ID NO: 28057 - DNA, 21 bp, Artificial sequence
  synthetic polynucleotide sequence
tgctgaagctgctgcagggca

SEQ ID NO: 28058 - DNA, 22 bp, Artificial sequence
  synthetic polynucleotide sequence
aatcgtggacatcataggggga

SEQ ID NO: 28059 - DNA, 20 bp, Artificial sequence
  synthetic polynucleotide sequence
cagcacctgcagtaccagca

SEQ ID NO: 28060 - DNA, 20 bp, Artificial sequence
  synthetic polynucleotide sequence
gagccagtatctggcacgga

SEQ ID NO: 28061 - DNA, 20 bp, Artificial sequence
  synthetic polynucleotide sequence
ggtgaggcaggtgagggaca

SEQ ID NO: 28062 - DNA, 21 bp, Artificial sequence
  synthetic polynucleotide sequence
gtggcccggttatcaaaggca

SEQ ID NO: 28063 - DNA, 22 bp, Artificial sequence
  synthetic polynucleotide sequence
aaaagtcagggaagctggggaa

SEQ ID NO: 28064 - DNA, 20 bp, Artificial sequence
  synthetic polynucleotide sequence
ctgtgaggtatagcggccca

SEQ ID NO: 28065 - DNA, 18 bp, Artificial sequence
  synthetic polynucleotide sequence
cgacacagaggtgcccaa

SEQ ID NO: 28066 - DNA, 19 bp, Artificial sequence
  synthetic polynucleotide sequence
tcctcagtgtaacggccca

SEQ ID NO: 28067 - DNA, 21 bp, Artificial sequence
  synthetic polynucleotide sequence
caaagaggacttagggggcca

SEQ ID NO: 28068 - DNA, 21 bp, Artificial sequence
  synthetic polynucleotide sequence
ccagcctctcaatcacagcca

SEQ ID NO: 28069 - DNA, 19 bp, Artificial sequence
  synthetic polynucleotide sequence
tcacggatgaggatcagca

SEQ ID NO: 28070 - DNA, 18 bp, Artificial sequence
  synthetic polynucleotide sequence
tcttccagggagccgcca

SEQ ID NO: 28071 - DNA, 23 bp, Artificial sequence
  synthetic polynucleotide sequence
gaaaagtgcaacagcgaacacca

SEQ ID NO: 28072 - DNA, 21 bp, Artificial sequence
  synthetic polynucleotide sequence
ttggtgtcaaagagccctgga

SEQ ID NO: 28073 - DNA, 20 bp, Artificial sequence
  synthetic polynucleotide sequence
aggacatgggacggacagga

SEQ ID NO: 28074 - DNA, 19 bp, Artificial sequence
  synthetic polynucleotide sequence
tccttccgggtgaacagca

SEQ ID NO: 28075 - DNA, 20 bp, Artificial sequence
  synthetic polynucleotide sequence
ccacacagcaggctgagcaa

SEQ ID NO: 28076 - DNA, 20 bp, Artificial sequence
  synthetic polynucleotide sequence
gtggagacccccttgcccga

SEQ ID NO: 28077 - DNA, 22 bp, Artificial sequence
  synthetic polynucleotide sequence
aagacaacttcactgggccaga

SEQ ID NO: 28078 - DNA, 20 bp, Artificial sequence
  synthetic polynucleotide sequence
atgacacaaggaccaaccca

SEQ ID NO: 28079 - DNA, 21 bp, Artificial sequence
  synthetic polynucleotide sequence
gtggttggaattacaggagca

SEQ ID NO: 28080 - DNA, 19 bp, Artificial sequence
  synthetic polynucleotide sequence
ggcaacaggctacttcgga

SEQ ID NO: 28081 - DNA, 22 bp, Artificial sequence
  synthetic polynucleotide sequence
caaagtcaggtggacgaagtga

SEQ ID NO: 28082 - DNA, 18 bp, Artificial sequence
  synthetic polynucleotide sequence
atccgaagcaagcggtca

SEQ ID NO: 28083 - DNA, 20 bp, Artificial sequence
  synthetic polynucleotide sequence
gaattcctcgccgagaagga

SEQ ID NO: 28084 - DNA, 20 bp, Artificial sequence
  synthetic polynucleotide sequence
atccatccactctggaggga

SEQ ID NO: 28085 - DNA, 22 bp, Artificial sequence
  synthetic polynucleotide sequence
tggaactccccaagatctacca

SEQ ID NO: 28086 - DNA, 18 bp, Artificial sequence
  synthetic polynucleotide sequence
tgcaggagctgggagcca

SEQ ID NO: 28087 - DNA, 20 bp, Artificial sequence
  synthetic polynucleotide sequence
cagcatccaccaaatggaga

SEQ ID NO: 28088 - DNA, 18 bp, Artificial sequence
  synthetic polynucleotide sequence
ggccaactcttccggcga

SEQ ID NO: 28089 - DNA, 20 bp, Artificial sequence
  synthetic polynucleotide sequence
tgagcagccctcaacctcga

SEQ ID NO: 28090 - DNA, 20 bp, Artificial sequence
  synthetic polynucleotide sequence
gggccagcagccagttcaca

SEQ ID NO: 28091 - DNA, 20 bp, Artificial sequence
  synthetic polynucleotide sequence
atggtggagctgggaaagga

SEQ ID NO: 28092 - DNA, 18 bp, Artificial sequence
  synthetic polynucleotide sequence
gtccccaatggcgcccca

SEQ ID NO: 28093 - DNA, 18 bp, Artificial sequence
  synthetic polynucleotide sequence
tggtggagggcgagccga

SEQ ID NO: 28094 - DNA, 23 bp, Artificial sequence
  synthetic polynucleotide sequence
caatataagatctccgacggcga

SEQ ID NO: 28095 - DNA, 20 bp, Artificial sequence
  synthetic polynucleotide sequence
ggggcccccagaagcagcaa

SEQ ID NO: 28096 - DNA, 20 bp, Artificial sequence
  synthetic polynucleotide sequence
tctgagccaggaccggtgaa

SEQ ID NO: 28097 - DNA, 19 bp, Artificial sequence
  synthetic polynucleotide sequence
ctggctcgctccacgctga

SEQ ID NO: 28098 - DNA, 20 bp, Artificial sequence
  synthetic polynucleotide sequence
gccgagcttggcgaagcgca

SEQ ID NO: 28099 - DNA, 20 bp, Artificial sequence
  synthetic polynucleotide sequence
ctgctggggctggaagggaa

SEQ ID NO: 28100 - DNA, 21 bp, Artificial sequence
  synthetic polynucleotide sequence
tctttgggaagagggaggcca

SEQ ID NO: 28101 - DNA, 21 bp, Artificial sequence
  synthetic polynucleotide sequence
gacagcgtggcatcagacgaa

SEQ ID NO: 28102 - DNA, 22 bp, Artificial sequence
  synthetic polynucleotide sequence
tgtatcttggcctcagaagcca

SEQ ID NO: 28103 - DNA, 21 bp, Artificial sequence
  synthetic polynucleotide sequence
gaccttcaagcagagccagca

SEQ ID NO: 28104 - DNA, 19 bp, Artificial sequence
  synthetic polynucleotide sequence
gagtaccacctccaccgga

SEQ ID NO: 28105 - DNA, 20 bp, Artificial sequence
  synthetic polynucleotide sequence
gcagccctaccgatcatgga

SEQ ID NO: 28106 - DNA, 25 bp, Artificial sequence
  synthetic polynucleotide sequence
cacaccccaggaagaaagaaaggaa

SEQ ID NO: 28107 - DNA, 21 bp, Artificial sequence
  synthetic polynucleotide sequence
cagaaggcaggtggaaacgca

SEQ ID NO: 28108 - DNA, 20 bp, Artificial sequence
  synthetic polynucleotide sequence
cctacggcatacccgacaca

SEQ ID NO: 28109 - DNA, 19 bp, Artificial sequence
  synthetic polynucleotide sequence
cgccccacggagaagacca

SEQ ID NO: 28110 - DNA, 20 bp, Artificial sequence
  synthetic polynucleotide sequence
ccggctgaggcagcgacaca

SEQ ID NO: 28111 - DNA, 19 bp, Artificial sequence
  synthetic polynucleotide sequence
cggtggcagagaaggcaga

SEQ ID NO: 28112 - DNA, 18 bp, Artificial sequence
  synthetic polynucleotide sequence
acagggactcctgcggca

SEQ ID NO: 28113 - DNA, 20 bp, Artificial sequence
  synthetic polynucleotide sequence
actccaccgtcatcggcaga

SEQ ID NO: 28114 - DNA, 20 bp, Artificial sequence
  synthetic polynucleotide sequence
agcagacgttctcgcagcca

SEQ ID NO: 28115 - DNA, 22 bp, Artificial sequence
  synthetic polynucleotide sequence
tacagaacaaccaggctgcaga

SEQ ID NO: 28116 - DNA, 21 bp, Artificial sequence
  synthetic polynucleotide sequence
atctcctccgatccctaggca

SEQ ID NO: 28117 - DNA, 21 bp, Artificial sequence
  synthetic polynucleotide sequence
tgaagaggcacaaggtccaca

SEQ ID NO: 28118 - DNA, 18 bp, Artificial sequence
  synthetic polynucleotide sequence
tctcggtggggcgggaca

SEQ ID NO: 28119 - DNA, 21 bp, Artificial sequence
  synthetic polynucleotide sequence
ggaggtgtggggagatgagca

SEQ ID NO: 28120 - DNA, 20 bp, Artificial sequence
  synthetic polynucleotide sequence
aagatcagctgcagggccca

SEQ ID NO: 28121 - DNA, 18 bp, Artificial sequence
  synthetic polynucleotide sequence
ccagaaacacggggacca

SEQ ID NO: 28122 - DNA, 18 bp, Artificial sequence
  synthetic polynucleotide sequence
cgcggcatattgaagcca

SEQ ID NO: 28123 - DNA, 20 bp, Artificial sequence
  synthetic polynucleotide sequence
gccactctccccaaatcgga

SEQ ID NO: 28124 - DNA, 20 bp, Artificial sequence
  synthetic polynucleotide sequence
gaaggcagcagggacctgga

SEQ ID NO: 28125 - DNA, 21 bp, Artificial sequence
  synthetic polynucleotide sequence
ccacgcagatccatgtcccaa

SEQ ID NO: 28126 - DNA, 21 bp, Artificial sequence
  synthetic polynucleotide sequence
tcaccaggtagatgagctcca

SEQ ID NO: 28127 - DNA, 21 bp, Artificial sequence
  synthetic polynucleotide sequence
caggcgaggagagaagaggaa

SEQ ID NO: 28128 - DNA, 22 bp, Artificial sequence
  synthetic polynucleotide sequence
agcagtcaacaaggttggggca

SEQ ID NO: 28129 - DNA, 21 bp, Artificial sequence
  synthetic polynucleotide sequence
cagtagacagcccggttgcaa

SEQ ID NO: 28130 - DNA, 20 bp, Artificial sequence
  synthetic polynucleotide sequence
aagcgtaccataggccccca

SEQ ID NO: 28131 - DNA, 21 bp, Artificial sequence
  synthetic polynucleotide sequence
ggaggaggacaacgaagagga

SEQ ID NO: 28132 - DNA, 22 bp, Artificial sequence
  synthetic polynucleotide sequence
acctcaaacacggtccttgcca

SEQ ID NO: 28133 - DNA, 20 bp, Artificial sequence
  synthetic polynucleotide sequence
ctggcaaacctggccctgca

SEQ ID NO: 28134 - DNA, 18 bp, Artificial sequence
  synthetic polynucleotide sequence
tccccgacagtgcccgca

SEQ ID NO: 28135 - DNA, 19 bp, Artificial sequence
  synthetic polynucleotide sequence
ccaggggctggaagcctca

SEQ ID NO: 28136 - DNA, 20 bp, Artificial sequence
  synthetic polynucleotide sequence
caaggcaaggttctcggcga

SEQ ID NO: 28137 - DNA, 21 bp, Artificial sequence
  synthetic polynucleotide sequence
ccgctacccctgcatcaagga

SEQ ID NO: 28138 - DNA, 21 bp, Artificial sequence
  synthetic polynucleotide sequence
agttcagccaggttgagcaca

SEQ ID NO: 28139 - DNA, 20 bp, Artificial sequence
  synthetic polynucleotide sequence
acaccactgccatgcccgaa

SEQ ID NO: 28140 - DNA, 25 bp, Artificial sequence
  synthetic polynucleotide sequence
ggacacagaactgtcatcagagaga

SEQ ID NO: 28141 - DNA, 21 bp, Artificial sequence
  synthetic polynucleotide sequence
ataccagtagtgaagccctca

SEQ ID NO: 28142 - DNA, 19 bp, Artificial sequence
  synthetic polynucleotide sequence
tcaaaccgctccatcgtga

SEQ ID NO: 28143 - DNA, 21 bp, Artificial sequence
  synthetic polynucleotide sequence
agacaggccttccactcagca

SEQ ID NO: 28144 - DNA, 22 bp, Artificial sequence
  synthetic polynucleotide sequence
atctgtacaatgcacgcctcca

SEQ ID NO: 28145 - DNA, 18 bp, Artificial sequence
  synthetic polynucleotide sequence
atccgggcagatggagga

SEQ ID NO: 28146 - DNA, 18 bp, Artificial sequence
  synthetic polynucleotide sequence
aacccaacagcaaggcca

SEQ ID NO: 28147 - DNA, 20 bp, Artificial sequence
  synthetic polynucleotide sequence
tgcgaataagtttcggagca

SEQ ID NO: 28148 - DNA, 20 bp, Artificial sequence
  synthetic polynucleotide sequence
cagaatcagagccactgcca

SEQ ID NO: 28149 - DNA, 18 bp, Artificial sequence
  synthetic polynucleotide sequence
cacctcccaagggcctga

SEQ ID NO: 28150 - DNA, 19 bp, Artificial sequence
  synthetic polynucleotide sequence
gttggaatcccacgacaca

SEQ ID NO: 28151 - DNA, 19 bp, Artificial sequence
  synthetic polynucleotide sequence
ccaagcaacaatggtggca

SEQ ID NO: 28152 - DNA, 18 bp, Artificial sequence
  synthetic polynucleotide sequence
tcgggagagcaccctgga

SEQ ID NO: 28153 - DNA, 18 bp, Artificial sequence
  synthetic polynucleotide sequence
ccgacacatcagccctca

SEQ ID NO: 28154 - DNA, 20 bp, Artificial sequence
  synthetic polynucleotide sequence
tgagagaggtcgttcccaca

SEQ ID NO: 28155 - DNA, 19 bp, Artificial sequence
  synthetic polynucleotide sequence
ccagacttgccccaggaca

SEQ ID NO: 28156 - DNA, 19 bp, Artificial sequence
  synthetic polynucleotide sequence
ccacgaacgtcacagcaca

SEQ ID NO: 28157 - DNA, 19 bp, Artificial sequence
  synthetic polynucleotide sequence
ggcctgttgaagccaccaa

SEQ ID NO: 28158 - DNA, 20 bp, Artificial sequence
  synthetic polynucleotide sequence
ggccagaaggagcttgagga

SEQ ID NO: 28159 - DNA, 18 bp, Artificial sequence
  synthetic polynucleotide sequence
cggcgattacacggccaa

SEQ ID NO: 28160 - DNA, 18 bp, Artificial sequence
  synthetic polynucleotide sequence
acttgagggcgtcccaca

SEQ ID NO: 28161 - DNA, 19 bp, Artificial sequence
  synthetic polynucleotide sequence
gtcccccggaatcccagga

SEQ ID NO: 28162 - DNA, 21 bp, Artificial sequence
  synthetic polynucleotide sequence
acatgaaaagagaggggccga

SEQ ID NO: 28163 - DNA, 21 bp, Artificial sequence
  synthetic polynucleotide sequence
accacagcccacatggctgca

SEQ ID NO: 28164 - DNA, 20 bp, Artificial sequence
  synthetic polynucleotide sequence
cttgcccttgggccatggca

SEQ ID NO: 28165 - DNA, 19 bp, Artificial sequence
  synthetic polynucleotide sequence
cccactgagtcggaggaca

SEQ ID NO: 28166 - DNA, 20 bp, Artificial sequence
  synthetic polynucleotide sequence
caggtcagggagtgtggaga

SEQ ID NO: 28167 - DNA, 22 bp, Artificial sequence
  synthetic polynucleotide sequence
aaaggggagaaaagggagacca

SEQ ID NO: 28168 - DNA, 21 bp, Artificial sequence
  synthetic polynucleotide sequence
tgccaggagcacgtcgttgga

SEQ ID NO: 28169 - DNA, 20 bp, Artificial sequence
  synthetic polynucleotide sequence
ctaccatcccagtgagccaa

SEQ ID NO: 28170 - DNA, 19 bp, Artificial sequence
  synthetic polynucleotide sequence
ggagctcccagatcccgga

SEQ ID NO: 28171 - DNA, 18 bp, Artificial sequence
  synthetic polynucleotide sequence
gcaggaagccaaggagca

SEQ ID NO: 28172 - DNA, 18 bp, Artificial sequence
  synthetic polynucleotide sequence
gatctggctccaagcgga

SEQ ID NO: 28173 - DNA, 19 bp, Artificial sequence
  synthetic polynucleotide sequence
cagtggagcccaagaggga

SEQ ID NO: 28174 - DNA, 20 bp, Artificial sequence
  synthetic polynucleotide sequence
gagtggtcactgctgcagga

SEQ ID NO: 28175 - DNA, 19 bp, Artificial sequence
  synthetic polynucleotide sequence
cctcaccaggggtcaacca

SEQ ID NO: 28176 - DNA, 20 bp, Artificial sequence
  synthetic polynucleotide sequence
gctcagagcacccgagaaca

SEQ ID NO: 28177 - DNA, 18 bp, Artificial sequence
  synthetic polynucleotide sequence
cgagggcagcaaaaccga

SEQ ID NO: 28178 - DNA, 18 bp, Artificial sequence
  synthetic polynucleotide sequence
tctgcgggtggacgacca

SEQ ID NO: 28179 - DNA, 20 bp, Artificial sequence
  synthetic polynucleotide sequence
gccttcggccagagctccca

SEQ ID NO: 28180 - DNA, 19 bp, Artificial sequence
  synthetic polynucleotide sequence
gtaggaggccgagccccga

SEQ ID NO: 28181 - DNA, 21 bp, Artificial sequence
  synthetic polynucleotide sequence
cataatacacggctgaagcca

SEQ ID NO: 28182 - DNA, 18 bp, Artificial sequence
  synthetic polynucleotide sequence
gggcacagacccagtcca

SEQ ID NO: 28183 - DNA, 22 bp, Artificial sequence
  synthetic polynucleotide sequence
aaagcatgggcaaaccagtgca

SEQ ID NO: 28184 - DNA, 19 bp, Artificial sequence
  synthetic polynucleotide sequence
tgcaactgcacaaccgaca

SEQ ID NO: 28185 - DNA, 18 bp, Artificial sequence
  synthetic polynucleotide sequence
ctggacacttcacggcca

SEQ ID NO: 28186 - DNA, 18 bp, Artificial sequence
  synthetic polynucleotide sequence
ggacccgtcacttgcgga

SEQ ID NO: 28187 - DNA, 19 bp, Artificial sequence
  synthetic polynucleotide sequence
cccggcctcctctcaccaa

SEQ ID NO: 28188 - DNA, 21 bp, Artificial sequence
  synthetic polynucleotide sequence
gctctggaagggtgggtagga

SEQ ID NO: 28189 - DNA, 20 bp, Artificial sequence
  synthetic polynucleotide sequence
caagcgctacacggacccca

SEQ ID NO: 28190 - DNA, 21 bp, Artificial sequence
  synthetic polynucleotide sequence
tgatgatctgggccccactga

SEQ ID NO: 28191 - DNA, 18 bp, Artificial sequence
  synthetic polynucleotide sequence
ccatgcgcaccttcacca

SEQ ID NO: 28192 - DNA, 18 bp, Artificial sequence
  synthetic polynucleotide sequence
gtcgatccagcggcagca

SEQ ID NO: 28193 - DNA, 20 bp, Artificial sequence
  synthetic polynucleotide sequence
aagggcacacagaccagcta

SEQ ID NO: 28194 - DNA, 21 bp, Artificial sequence
  synthetic polynucleotide sequence
aaaaggcatcgaacaacagga

SEQ ID NO: 28195 - DNA, 21 bp, Artificial sequence
  synthetic polynucleotide sequence
ggaggtagccacattgggcca

SEQ ID NO: 28196 - DNA, 21 bp, Artificial sequence
  synthetic polynucleotide sequence
gaaggctcggacaatgggtga

SEQ ID NO: 28197 - DNA, 21 bp, Artificial sequence
  synthetic polynucleotide sequence
gaccatgctacgagtgaagga

SEQ ID NO: 28198 - DNA, 18 bp, Artificial sequence
  synthetic polynucleotide sequence
tggagagcgcccaggcta

SEQ ID NO: 28199 - DNA, 20 bp, Artificial sequence
  synthetic polynucleotide sequence
ccattcccagcgcctgacga

SEQ ID NO: 28200 - DNA, 21 bp, Artificial sequence
  synthetic polynucleotide sequence
taagaggggggtggttaacca

SEQ ID NO: 28201 - DNA, 19 bp, Artificial sequence
  synthetic polynucleotide sequence
cagtcagacccctccccca

SEQ ID NO: 28202 - DNA, 22 bp, Artificial sequence
  synthetic polynucleotide sequence
aaagtcatgacctccatgccca

SEQ ID NO: 28203 - DNA, 21 bp, Artificial sequence
  synthetic polynucleotide sequence
gctgctggaccaggaactcca

SEQ ID NO: 28204 - DNA, 22 bp, Artificial sequence
  synthetic polynucleotide sequence
taccacgatgcagatgacccga

SEQ ID NO: 28205 - DNA, 20 bp, Artificial sequence
  synthetic polynucleotide sequence
tcggaaggagatggcgctga

SEQ ID NO: 28206 - DNA, 20 bp, Artificial sequence
  synthetic polynucleotide sequence
cccctcactgcactcggaca

SEQ ID NO: 28207 - DNA, 19 bp, Artificial sequence
  synthetic polynucleotide sequence
caacccccctcctgcacca

SEQ ID NO: 28208 - DNA, 22 bp, Artificial sequence
  synthetic polynucleotide sequence
aaaatgaggaaggccatgggga

SEQ ID NO: 28209 - DNA, 20 bp, Artificial sequence
  synthetic polynucleotide sequence
cccactcccacaaccgccaa

SEQ ID NO: 28210 - DNA, 23 bp, Artificial sequence
  synthetic polynucleotide sequence
gaaaatgaggaaggccaatggga

SEQ ID NO: 28211 - DNA, 18 bp, Artificial sequence
  synthetic polynucleotide sequence
gcacccgtacaagtggca

SEQ ID NO: 28212 - DNA, 19 bp, Artificial sequence
  synthetic polynucleotide sequence
cgctccagatggaatcgca

SEQ ID NO: 28213 - DNA, 18 bp, Artificial sequence
  synthetic polynucleotide sequence
cacaacccttgccgctga

SEQ ID NO: 28214 - DNA, 22 bp, Artificial sequence
  synthetic polynucleotide sequence
tggacaactgcatactccacca

SEQ ID NO: 28215 - DNA, 21 bp, Artificial sequence
  synthetic polynucleotide sequence
ccaccaaccacactaacgaga

SEQ ID NO: 28216 - DNA, 18 bp, Artificial sequence
  synthetic polynucleotide sequence
cgcgtcagcagttcccca

SEQ ID NO: 28217 - DNA, 20 bp, Artificial sequence
  synthetic polynucleotide sequence
ctcggcaggctggcttgaca

SEQ ID NO: 28218 - DNA, 20 bp, Artificial sequence
  synthetic polynucleotide sequence
gttcacaggcgccgtcgcta

SEQ ID NO: 28219 - DNA, 21 bp, Artificial sequence
  synthetic polynucleotide sequence
gggctccacagtgtgcacaga

SEQ ID NO: 28220 - DNA, 19 bp, Artificial sequence
  synthetic polynucleotide sequence
tagcgctgggtaggaagga

SEQ ID NO: 28221 - DNA, 18 bp, Artificial sequence
  synthetic polynucleotide sequence
cggagctccgacaaggca

SEQ ID NO: 28222 - DNA, 20 bp, Artificial sequence
  synthetic polynucleotide sequence
gttcttccaccaagtcccca

SEQ ID NO: 28223 - DNA, 19 bp, Artificial sequence
  synthetic polynucleotide sequence
caaagagctggtggcctca

SEQ ID NO: 28224 - DNA, 20 bp, Artificial sequence
  synthetic polynucleotide sequence
ctgggatcagacgttcgcaa

SEQ ID NO: 28225 - DNA, 18 bp, Artificial sequence
  synthetic polynucleotide sequence
acggtgggatctgcccca

SEQ ID NO: 28226 - DNA, 18 bp, Artificial sequence
  synthetic polynucleotide sequence
acttggctggcaggccca

SEQ ID NO: 28227 - DNA, 21 bp, Artificial sequence
  synthetic polynucleotide sequence
ccatctagaggctgcagggca

SEQ ID NO: 28228 - DNA, 22 bp, Artificial sequence
  synthetic polynucleotide sequence
atagagatgaagagccagggca

SEQ ID NO: 28229 - DNA, 22 bp, Artificial sequence
  synthetic polynucleotide sequence
aagctgcctgacatagagccca

SEQ ID NO: 28230 - DNA, 21 bp, Artificial sequence
  synthetic polynucleotide sequence
tgttcacccaggctcttcaca

SEQ ID NO: 28231 - DNA, 21 bp, Artificial sequence
  synthetic polynucleotide sequence
ttcccagcgcaaagaaggcca

SEQ ID NO: 28232 - DNA, 19 bp, Artificial sequence
  synthetic polynucleotide sequence
tcctgctccacggatgaca

SEQ ID NO: 28233 - DNA, 21 bp, Artificial sequence
  synthetic polynucleotide sequence
accagactcatcgaggcctga

SEQ ID NO: 28234 - DNA, 20 bp, Artificial sequence
  synthetic polynucleotide sequence
ccggtagtccagatagccca

SEQ ID NO: 28235 - DNA, 21 bp, Artificial sequence
  synthetic polynucleotide sequence
ttccaggcagcactgtacgca

SEQ ID NO: 28236 - DNA, 20 bp, Artificial sequence
  synthetic polynucleotide sequence
gttgactaggaagaggcgga

SEQ ID NO: 28237 - DNA, 19 bp, Artificial sequence
  synthetic polynucleotide sequence
ctagggaggccttcaccaa

SEQ ID NO: 28238 - DNA, 18 bp, Artificial sequence
  synthetic polynucleotide sequence
agagctgggaccagcgca

SEQ ID NO: 28239 - DNA, 20 bp, Artificial sequence
  synthetic polynucleotide sequence
ctcccccagtgactaccaca

SEQ ID NO: 28240 - DNA, 20 bp, Artificial sequence
  synthetic polynucleotide sequence
cctccgggactcctccagga

SEQ ID NO: 28241 - DNA, 22 bp, Artificial sequence
  synthetic polynucleotide sequence
ggaccgatgcttaacaaccaga

SEQ ID NO: 28242 - DNA, 20 bp, Artificial sequence
  synthetic polynucleotide sequence
gtccacccacaagctgagga

SEQ ID NO: 28243 - DNA, 20 bp, Artificial sequence
  synthetic polynucleotide sequence
gcgggagaaggctgtgcaca

SEQ ID NO: 28244 - DNA, 20 bp, Artificial sequence
  synthetic polynucleotide sequence
ctggtacttgagccgcccca

SEQ ID NO: 28245 - DNA, 20 bp, Artificial sequence
  synthetic polynucleotide sequence
cacggcagagttccaagaca

SEQ ID NO: 28246 - DNA, 18 bp, Artificial sequence
  synthetic polynucleotide sequence
gcctggcagaacgctcca

SEQ ID NO: 28247 - DNA, 22 bp, Artificial sequence
  synthetic polynucleotide sequence
ccaatgggccaacaactccaga

SEQ ID NO: 28248 - DNA, 21 bp, Artificial sequence
  synthetic polynucleotide sequence
tctgccgtgggtacaatggga

SEQ ID NO: 28249 - DNA, 18 bp, Artificial sequence
  synthetic polynucleotide sequence
gcatacgcattccccgga

SEQ ID NO: 28250 - DNA, 18 bp, Artificial sequence
  synthetic polynucleotide sequence
aaggggtcgcagttggca

SEQ ID NO: 28251 - DNA, 18 bp, Artificial sequence
  synthetic polynucleotide sequence
gtggcaaacccaaggcca

SEQ ID NO: 28252 - DNA, 18 bp, Artificial sequence
  synthetic polynucleotide sequence
ccctcaggccccaggaga

SEQ ID NO: 28253 - DNA, 20 bp, Artificial sequence
  synthetic polynucleotide sequence
gctgagacaggccacccaga

SEQ ID NO: 28254 - DNA, 18 bp, Artificial sequence
  synthetic polynucleotide sequence
ggactccctctgggccga

SEQ ID NO: 28255 - DNA, 21 bp, Artificial sequence
  synthetic polynucleotide sequence
cccggcctcagaaacaggaga

SEQ ID NO: 28256 - DNA, 22 bp, Artificial sequence
  synthetic polynucleotide sequence
ttcatccaagccctcttggcaa

SEQ ID NO: 28257 - DNA, 21 bp, Artificial sequence
  synthetic polynucleotide sequence
aggaagttgcaaagccgggga

SEQ ID NO: 28258 - DNA, 22 bp, Artificial sequence
  synthetic polynucleotide sequence
gaataagcctgtggaagcgaca

SEQ ID NO: 28259 - DNA, 18 bp, Artificial sequence
  synthetic polynucleotide sequence
caacctcccggaccgcga

SEQ ID NO: 28260 - DNA, 18 bp, Artificial sequence
  synthetic polynucleotide sequence
cctccacagggtccccca

SEQ ID NO: 28261 - DNA, 21 bp, Artificial sequence
  synthetic polynucleotide sequence
tccaagggagcttcatggcca

SEQ ID NO: 28262 - DNA, 20 bp, Artificial sequence
  synthetic polynucleotide sequence
gtccaggaagatgctggcca

SEQ ID NO: 28263 - DNA, 20 bp, Artificial sequence
  synthetic polynucleotide sequence
ccagagcccctgcgtaccta

SEQ ID NO: 28264 - DNA, 18 bp, Artificial sequence
  synthetic polynucleotide sequence
tggtgagccaactgggca

SEQ ID NO: 28265 - DNA, 18 bp, Artificial sequence
  synthetic polynucleotide sequence
tgcgggcagaacaggaca

SEQ ID NO: 28266 - DNA, 20 bp, Artificial sequence
  synthetic polynucleotide sequence
tacaagtaggtcgaagccga

SEQ ID NO: 28267 - DNA, 21 bp, Artificial sequence
  synthetic polynucleotide sequence
agaccggcaaagttcacgtga

SEQ ID NO: 28268 - DNA, 21 bp, Artificial sequence
  synthetic polynucleotide sequence
cgtgcaccatctccctcacca

SEQ ID NO: 28269 - DNA, 21 bp, Artificial sequence
  synthetic polynucleotide sequence
aaggccaggatcacaggctga

SEQ ID NO: 28270 - DNA, 21 bp, Artificial sequence
  synthetic polynucleotide sequence
agtgtgtggacagtcacagga

SEQ ID NO: 28271 - DNA, 20 bp, Artificial sequence
  synthetic polynucleotide sequence
gtgctcacccagtctgccca

SEQ ID NO: 28272 - DNA, 18 bp, Artificial sequence
  synthetic polynucleotide sequence
ggggtaggtggagccgga

SEQ ID NO: 28273 - DNA, 19 bp, Artificial sequence
  synthetic polynucleotide sequence
gatgaggagcttgagggca

SEQ ID NO: 28274 - DNA, 22 bp, Artificial sequence
  synthetic polynucleotide sequence
gcttacatccaacaggactgga

SEQ ID NO: 28275 - DNA, 20 bp, Artificial sequence
  synthetic polynucleotide sequence
ctgcaagccggaacaacaga

SEQ ID NO: 28276 - DNA, 19 bp, Artificial sequence
  synthetic polynucleotide sequence
ccaggcctcagtgaggtca

SEQ ID NO: 28277 - DNA, 20 bp, Artificial sequence
  synthetic polynucleotide sequence
cacagtaccctggagcagca

SEQ ID NO: 28278 - DNA, 18 bp, Artificial sequence
  synthetic polynucleotide sequence
cgcacagcttggaagcca

SEQ ID NO: 28279 - DNA, 21 bp, Artificial sequence
  synthetic polynucleotide sequence
agcctcctgaagccccaggaa

SEQ ID NO: 28280 - DNA, 19 bp, Artificial sequence
  synthetic polynucleotide sequence
tttgatacccccagcctca

SEQ ID NO: 28281 - DNA, 20 bp, Artificial sequence
  synthetic polynucleotide sequence
gatgaggagggaggctggaa

SEQ ID NO: 28282 - DNA, 25 bp, Artificial sequence
  synthetic polynucleotide sequence
gtggcaggagacagtctaagcaaca

SEQ ID NO: 28283 - DNA, 22 bp, Artificial sequence
  synthetic polynucleotide sequence
attgcccgcctgaaaaaggaga

SEQ ID NO: 28284 - DNA, 19 bp, Artificial sequence
  synthetic polynucleotide sequence
tccttcagcacacgtgcca

SEQ ID NO: 28285 - DNA, 20 bp, Artificial sequence
  synthetic polynucleotide sequence
accatccgcctagagcagga

SEQ ID NO: 28286 - DNA, 20 bp, Artificial sequence
  synthetic polynucleotide sequence
tagagggctgaacctgcgga

SEQ ID NO: 28287 - DNA, 19 bp, Artificial sequence
  synthetic polynucleotide sequence
ttgagaggaacggacggaa

SEQ ID NO: 28288 - DNA, 18 bp, Artificial sequence
  synthetic polynucleotide sequence
tggacctcagtcccccga

SEQ ID NO: 28289 - DNA, 20 bp, Artificial sequence
  synthetic polynucleotide sequence
gagcctcagagggaaagaca

SEQ ID NO: 28290 - DNA, 22 bp, Artificial sequence
  synthetic polynucleotide sequence
acataggtacacgtagagcgga

SEQ ID NO: 28291 - DNA, 19 bp, Artificial sequence
  synthetic polynucleotide sequence
tcaccgtgcagaacagaga

SEQ ID NO: 28292 - DNA, 19 bp, Artificial sequence
  synthetic polynucleotide sequence
tgagggcctcttcaacaga

SEQ ID NO: 28293 - DNA, 20 bp, Artificial sequence
  synthetic polynucleotide sequence
ctggtggactacttccccga

SEQ ID NO: 28294 - DNA, 18 bp, Artificial sequence
  synthetic polynucleotide sequence
tgtccttcacggccgcga

SEQ ID NO: 28295 - DNA, 20 bp, Artificial sequence
  synthetic polynucleotide sequence
gtccagcgctacctggtcca

SEQ ID NO: 28296 - DNA, 21 bp, Artificial sequence
  synthetic polynucleotide sequence
cagcatggaacacgaagcgga

SEQ ID NO: 28297 - DNA, 18 bp, Artificial sequence
  synthetic polynucleotide sequence
ccatggcagcccaaggaa

SEQ ID NO: 28298 - DNA, 18 bp, Artificial sequence
  synthetic polynucleotide sequence
cgacgccggtcataggca

SEQ ID NO: 28299 - DNA, 21 bp, Artificial sequence
  synthetic polynucleotide sequence
gagcgatggacacgctaagga

SEQ ID NO: 28300 - DNA, 20 bp, Artificial sequence
  synthetic polynucleotide sequence
ctccacctgctccctggaga

SEQ ID NO: 28301 - DNA, 18 bp, Artificial sequence
  synthetic polynucleotide sequence
ccgacgcctcttcagcca

SEQ ID NO: 28302 - DNA, 18 bp, Artificial sequence
  synthetic polynucleotide sequence
cgagcaccgagtcccgca

SEQ ID NO: 28303 - DNA, 21 bp, Artificial sequence
  synthetic polynucleotide sequence
gatctgagcggaagaagtgga

SEQ ID NO: 28304 - DNA, 22 bp, Artificial sequence
  synthetic polynucleotide sequence
cttcagctagaaccaggtcgta

SEQ ID NO: 28305 - DNA, 18 bp, Artificial sequence
  synthetic polynucleotide sequence
gcgtaaagaccacgggga

SEQ ID NO: 28306 - DNA, 18 bp, Artificial sequence
  synthetic polynucleotide sequence
cgctcagaccgctgacca

SEQ ID NO: 28307 - DNA, 18 bp, Artificial sequence
  synthetic polynucleotide sequence
ggaagctgccagggcaga

SEQ ID NO: 28308 - DNA, 20 bp, Artificial sequence
  synthetic polynucleotide sequence
tgaagcaagcttgtacccca

SEQ ID NO: 28309 - DNA, 21 bp, Artificial sequence
  synthetic polynucleotide sequence
gacgcaacaccagatgcagga

SEQ ID NO: 28310 - DNA, 21 bp, Artificial sequence
  synthetic polynucleotide sequence
agtcgttgaacaccctgcgga

SEQ ID NO: 28311 - DNA, 19 bp, Artificial sequence
  synthetic polynucleotide sequence
ccgcctacatccaagcaca

SEQ ID NO: 28312 - DNA, 18 bp, Artificial sequence
  synthetic polynucleotide sequence
cgtcgaacaccacctgga

SEQ ID NO: 28313 - DNA, 21 bp, Artificial sequence
  synthetic polynucleotide sequence
cctgcctacctgcctacgcaa

SEQ ID NO: 28314 - DNA, 19 bp, Artificial sequence
  synthetic polynucleotide sequence
tggccccctacatcgacca

SEQ ID NO: 28315 - DNA, 18 bp, Artificial sequence
  synthetic polynucleotide sequence
agaaggcgcacctcagca

SEQ ID NO: 28316 - DNA, 20 bp, Artificial sequence
  synthetic polynucleotide sequence
gttgagctcgaggaactgca

SEQ ID NO: 28317 - DNA, 21 bp, Artificial sequence
  synthetic polynucleotide sequence
acagctcaacaacctggctga

SEQ ID NO: 28318 - DNA, 21 bp, Artificial sequence
  synthetic polynucleotide sequence
ctctctcgaagcaggcttgca

SEQ ID NO: 28319 - DNA, 22 bp, Artificial sequence
  synthetic polynucleotide sequence
ttctcgagtgaaaacgactgga

SEQ ID NO: 28320 - DNA, 23 bp, Artificial sequence
  synthetic polynucleotide sequence
cataggcactaagtgcagcacaa

SEQ ID NO: 28321 - DNA, 20 bp, Artificial sequence
  synthetic polynucleotide sequence
gggcagaggtcagagcgcaa

SEQ ID NO: 28322 - DNA, 21 bp, Artificial sequence
  synthetic polynucleotide sequence
agatggagtcaaagaggcgca

SEQ ID NO: 28323 - DNA, 21 bp, Artificial sequence
  synthetic polynucleotide sequence
tcactggccacgagtctgaca

SEQ ID NO: 28324 - DNA, 21 bp, Artificial sequence
  synthetic polynucleotide sequence
ttgaagtcgtcgtacccagca

SEQ ID NO: 28325 - DNA, 21 bp, Artificial sequence
  synthetic polynucleotide sequence
atgaactcaccaatcccggga

SEQ ID NO: 28326 - DNA, 19 bp, Artificial sequence
  synthetic polynucleotide sequence
gtggctgcatcgtccgcca

SEQ ID NO: 28327 - DNA, 20 bp, Artificial sequence
  synthetic polynucleotide sequence
gccatctgcacgggctcgga

SEQ ID NO: 28328 - DNA, 20 bp, Artificial sequence
  synthetic polynucleotide sequence
gccacggacgtgatgccgca

SEQ ID NO: 28329 - DNA, 18 bp, Artificial sequence
  synthetic polynucleotide sequence
gcccagcagaccaccaca

SEQ ID NO: 28330 - DNA, 20 bp, Artificial sequence
  synthetic polynucleotide sequence
aagtggcatcatcagagcca

SEQ ID NO: 28331 - DNA, 18 bp, Artificial sequence
  synthetic polynucleotide sequence
ggacgtggagagcgggca

SEQ ID NO: 28332 - DNA, 17 bp, Artificial sequence
  synthetic polynucleotide sequence
gcactggccggagcgca

SEQ ID NO: 28333 - DNA, 18 bp, Artificial sequence
  synthetic polynucleotide sequence
gtggaagccatgggtgca

SEQ ID NO: 28334 - DNA, 18 bp, Artificial sequence
  synthetic polynucleotide sequence
tgagatggagcgcaccca

SEQ ID NO: 28335 - DNA, 19 bp, Artificial sequence
  synthetic polynucleotide sequence
gaggctggcgtggagagga

SEQ ID NO: 28336 - DNA, 20 bp, Artificial sequence
  synthetic polynucleotide sequence
acaggatctaggctcccgga

SEQ ID NO: 28337 - DNA, 18 bp, Artificial sequence
  synthetic polynucleotide sequence
ctgccagagctagcccga

SEQ ID NO: 28338 - DNA, 19 bp, Artificial sequence
  synthetic polynucleotide sequence
cgaagctgctcaacttcca

SEQ ID NO: 28339 - DNA, 21 bp, Artificial sequence
  synthetic polynucleotide sequence
aatatagcccaggcaaggaga

SEQ ID NO: 28340 - DNA, 20 bp, Artificial sequence
  synthetic polynucleotide sequence
taggacatgaggtccgctga

SEQ ID NO: 28341 - DNA, 22 bp, Artificial sequence
  synthetic polynucleotide sequence
aggtggagagcctcaagtacca

SEQ ID NO: 28342 - DNA, 21 bp, Artificial sequence
  synthetic polynucleotide sequence
tcatcaggtcggggttcagga

SEQ ID NO: 28343 - DNA, 18 bp, Artificial sequence
  synthetic polynucleotide sequence
gtccaaggcagctgcaga

SEQ ID NO: 28344 - DNA, 18 bp, Artificial sequence
  synthetic polynucleotide sequence
aagccggaacaggggtca

SEQ ID NO: 28345 - DNA, 22 bp, Artificial sequence
  synthetic polynucleotide sequence
aagcacgcaagatggtggaaca

SEQ ID NO: 28346 - DNA, 20 bp, Artificial sequence
  synthetic polynucleotide sequence
gatcctcacaggcgtgggca

SEQ ID NO: 28347 - DNA, 21 bp, Artificial sequence
  synthetic polynucleotide sequence
tagcatctcccaagccaggaa

SEQ ID NO: 28348 - DNA, 22 bp, Artificial sequence
  synthetic polynucleotide sequence
atgatgagaggatcttcccgca

SEQ ID NO: 28349 - DNA, 18 bp, Artificial sequence
  synthetic polynucleotide sequence
cctccagcgtcgccgcta

SEQ ID NO: 28350 - DNA, 20 bp, Artificial sequence
  synthetic polynucleotide sequence
ctccagtcagcagagggtca

SEQ ID NO: 28351 - DNA, 18 bp, Artificial sequence
  synthetic polynucleotide sequence
aagccgggattgagcgca

SEQ ID NO: 28352 - DNA, 18 bp, Artificial sequence
  synthetic polynucleotide sequence
aggcagggactccgacca

SEQ ID NO: 28353 - DNA, 22 bp, Artificial sequence
  synthetic polynucleotide sequence
gcaagacggtggaacagctgaa

SEQ ID NO: 28354 - DNA, 20 bp, Artificial sequence
  synthetic polynucleotide sequence
cgtctcgcagaaagccagga

SEQ ID NO: 28355 - DNA, 22 bp, Artificial sequence
  synthetic polynucleotide sequence
ttgaggacctgacagaaaagga

SEQ ID NO: 28356 - DNA, 19 bp, Artificial sequence
  synthetic polynucleotide sequence
ccagtggatcctcgccaga

SEQ ID NO: 28357 - DNA, 20 bp, Artificial sequence
  synthetic polynucleotide sequence
caggatctcagcgagaagga

SEQ ID NO: 28358 - DNA, 18 bp, Artificial sequence
  synthetic polynucleotide sequence
ttcctgcttgggcctcca

SEQ ID NO: 28359 - DNA, 22 bp, Artificial sequence
  synthetic polynucleotide sequence
aagaggaacggagcttccaaga

SEQ ID NO: 28360 - DNA, 20 bp, Artificial sequence
  synthetic polynucleotide sequence
acccgccacagctgcctcca

SEQ ID NO: 28361 - DNA, 21 bp, Artificial sequence
  synthetic polynucleotide sequence
ttgtcccagaagcagcccaga

SEQ ID NO: 28362 - DNA, 22 bp, Artificial sequence
  synthetic polynucleotide sequence
tcatccccagaaaactgaggca

SEQ ID NO: 28363 - DNA, 18 bp, Artificial sequence
  synthetic polynucleotide sequence
ccaggctgatgctcgaca

SEQ ID NO: 28364 - DNA, 22 bp, Artificial sequence
  synthetic polynucleotide sequence
aggagtccaagatgtaggggga

SEQ ID NO: 28365 - DNA, 21 bp, Artificial sequence
  synthetic polynucleotide sequence
agctgactgggtgagcgggaa

SEQ ID NO: 28366 - DNA, 21 bp, Artificial sequence
  synthetic polynucleotide sequence
agattctccggtggccaagca

SEQ ID NO: 28367 - DNA, 18 bp, Artificial sequence
  synthetic polynucleotide sequence
cggagaaactgcccagca

SEQ ID NO: 28368 - DNA, 17 bp, Artificial sequence
  synthetic polynucleotide sequence
agcgaggagccggcaga

SEQ ID NO: 28369 - DNA, 22 bp, Artificial sequence
  synthetic polynucleotide sequence
gtcatcgaagaagccaactgga

SEQ ID NO: 28370 - DNA, 20 bp, Artificial sequence
  synthetic polynucleotide sequence
gcagtctggcaagtgagcga

SEQ ID NO: 28371 - DNA, 18 bp, Artificial sequence
  synthetic polynucleotide sequence
ctgcttcagaaccggcca

SEQ ID NO: 28372 - DNA, 20 bp, Artificial sequence
  synthetic polynucleotide sequence
gagcataagcccatcgacca

SEQ ID NO: 28373 - DNA, 20 bp, Artificial sequence
  synthetic polynucleotide sequence
cgaggagggagtgaaccaca

SEQ ID NO: 28374 - DNA, 19 bp, Artificial sequence
  synthetic polynucleotide sequence
ctgtacaaggggtccacca

SEQ ID NO: 28375 - DNA, 20 bp, Artificial sequence
  synthetic polynucleotide sequence
cttgacgggaatgctgcaga

SEQ ID NO: 28376 - DNA, 22 bp, Artificial sequence
  synthetic polynucleotide sequence
atccatcactgtccccacacca

SEQ ID NO: 28377 - DNA, 20 bp, Artificial sequence
  synthetic polynucleotide sequence
tccccaacacatcctggaga

SEQ ID NO: 28378 - DNA, 20 bp, Artificial sequence
  synthetic polynucleotide sequence
gttcagggctgacaactcca

SEQ ID NO: 28379 - DNA, 22 bp, Artificial sequence
  synthetic polynucleotide sequence
gaaacagtggagggagtcgcta

SEQ ID NO: 28380 - DNA, 22 bp, Artificial sequence
  synthetic polynucleotide sequence
agaacttatcagcgagccagga

SEQ ID NO: 28381 - DNA, 18 bp, Artificial sequence
  synthetic polynucleotide sequence
cgagtgggagatcgccaa

SEQ ID NO: 28382 - DNA, 18 bp, Artificial sequence
  synthetic polynucleotide sequence
gctcggacacatgggcca

SEQ ID NO: 28383 - DNA, 21 bp, Artificial sequence
  synthetic polynucleotide sequence
gcgccctggaggaaagagaga

SEQ ID NO: 28384 - DNA, 20 bp, Artificial sequence
  synthetic polynucleotide sequence
ctttcaggtctcggagggga

SEQ ID NO: 28385 - DNA, 18 bp, Artificial sequence
  synthetic polynucleotide sequence
cctcagctcagcccagga

SEQ ID NO: 28386 - DNA, 18 bp, Artificial sequence
  synthetic polynucleotide sequence
gcatcacttgggaggcca

SEQ ID NO: 28387 - DNA, 19 bp, Artificial sequence
  synthetic polynucleotide sequence
ggcaacctccccactctga

SEQ ID NO: 28388 - DNA, 19 bp, Artificial sequence
  synthetic polynucleotide sequence
cacatcccatccagtggca

SEQ ID NO: 28389 - DNA, 20 bp, Artificial sequence
  synthetic polynucleotide sequence
gactgcagacccagaccaga

SEQ ID NO: 28390 - DNA, 18 bp, Artificial sequence
  synthetic polynucleotide sequence
aacccctggagtgcgaca

SEQ ID NO: 28391 - DNA, 21 bp, Artificial sequence
  synthetic polynucleotide sequence
acctgacagatgcccgcgaga

SEQ ID NO: 28392 - DNA, 21 bp, Artificial sequence
  synthetic polynucleotide sequence
ggtttgagatagacggccgga

SEQ ID NO: 28393 - DNA, 20 bp, Artificial sequence
  synthetic polynucleotide sequence
ctgtagaccaggcgagggca

SEQ ID NO: 28394 - DNA, 19 bp, Artificial sequence
  synthetic polynucleotide sequence
ggcggccctacccctggaa

SEQ ID NO: 28395 - DNA, 20 bp, Artificial sequence
  synthetic polynucleotide sequence
ctacgagaacgccgtgggca

SEQ ID NO: 28396 - DNA, 19 bp, Artificial sequence
  synthetic polynucleotide sequence
ccagcaccttctcccggga

SEQ ID NO: 28397 - DNA, 21 bp, Artificial sequence
  synthetic polynucleotide sequence
cgggaccttcagcaagaagca

SEQ ID NO: 28398 - DNA, 21 bp, Artificial sequence
  synthetic polynucleotide sequence
cagcttccagatgaacagcca

SEQ ID NO: 28399 - DNA, 18 bp, Artificial sequence
  synthetic polynucleotide sequence
agcgcctcgaacagcaga

SEQ ID NO: 28400 - DNA, 20 bp, Artificial sequence
  synthetic polynucleotide sequence
caggaacatttcgcagacga

SEQ ID NO: 28401 - DNA, 20 bp, Artificial sequence
  synthetic polynucleotide sequence
gcaccaggagtggccaggga

SEQ ID NO: 28402 - DNA, 20 bp, Artificial sequence
  synthetic polynucleotide sequence
gacaggagacagctgcacga

SEQ ID NO: 28403 - DNA, 20 bp, Artificial sequence
  synthetic polynucleotide sequence
ttggtacaggagaggcggca

SEQ ID NO: 28404 - DNA, 20 bp, Artificial sequence
  synthetic polynucleotide sequence
cctgttctccgcagcccgaa

SEQ ID NO: 28405 - DNA, 20 bp, Artificial sequence
  synthetic polynucleotide sequence
aggcgggagatagaggccca

SEQ ID NO: 28406 - DNA, 20 bp, Artificial sequence
  synthetic polynucleotide sequence
atgatgcaagcggccggcga

SEQ ID NO: 28407 - DNA, 20 bp, Artificial sequence
  synthetic polynucleotide sequence
gaacaggagaggcggcagga

SEQ ID NO: 28408 - DNA, 21 bp, Artificial sequence
  synthetic polynucleotide sequence
cctcatccaggagctcctcca

SEQ ID NO: 28409 - DNA, 23 bp, Artificial sequence
  synthetic polynucleotide sequence
caaagacccactgtatgcacaca

SEQ ID NO: 28410 - DNA, 22 bp, Artificial sequence
  synthetic polynucleotide sequence
tgtttccagagggcaaaccaca

SEQ ID NO: 28411 - DNA, 19 bp, Artificial sequence
  synthetic polynucleotide sequence
tcctctgcatggagaccca

SEQ ID NO: 28412 - DNA, 21 bp, Artificial sequence
  synthetic polynucleotide sequence
tctgtaagtaggaggcctcga

SEQ ID NO: 28413 - DNA, 20 bp, Artificial sequence
  synthetic polynucleotide sequence
ctgctgaacccagtccagga

SEQ ID NO: 28414 - DNA, 21 bp, Artificial sequence
  synthetic polynucleotide sequence
tctcaccaaggagctgcacga

SEQ ID NO: 28415 - DNA, 21 bp, Artificial sequence
  synthetic polynucleotide sequence
gacaaccctactgcacagcca

SEQ ID NO: 28416 - DNA, 20 bp, Artificial sequence
  synthetic polynucleotide sequence
cttctcggcagccaagccca

SEQ ID NO: 28417 - DNA, 20 bp, Artificial sequence
  synthetic polynucleotide sequence
cactggcgagacagacgcca

SEQ ID NO: 28418 - DNA, 21 bp, Artificial sequence
  synthetic polynucleotide sequence
tcatcagcagggttgtgggca

SEQ ID NO: 28419 - DNA, 22 bp, Artificial sequence
  synthetic polynucleotide sequence
aggaaaacctctcctggcagca

SEQ ID NO: 28420 - DNA, 19 bp, Artificial sequence
  synthetic polynucleotide sequence
tgagaggctgagtctggga

SEQ ID NO: 28421 - DNA, 19 bp, Artificial sequence
  synthetic polynucleotide sequence
tgaggaggaacacgatcca

SEQ ID NO: 28422 - DNA, 18 bp, Artificial sequence
  synthetic polynucleotide sequence
cacgcgcgtgcccttcca

SEQ ID NO: 28423 - DNA, 19 bp, Artificial sequence
  synthetic polynucleotide sequence
gaggagcctcagagggaca

SEQ ID NO: 28424 - DNA, 18 bp, Artificial sequence
  synthetic polynucleotide sequence
cctcctgtccgtcgggga

SEQ ID NO: 28425 - DNA, 22 bp, Artificial sequence
  synthetic polynucleotide sequence
atgacaacacatcccctcacca

SEQ ID NO: 28426 - DNA, 22 bp, Artificial sequence
  synthetic polynucleotide sequence
atactgctcgtccagaagagga

SEQ ID NO: 28427 - DNA, 21 bp, Artificial sequence
  synthetic polynucleotide sequence
gtcagacagcccaacaggtga

SEQ ID NO: 28428 - DNA, 21 bp, Artificial sequence
  synthetic polynucleotide sequence
ggttccaggtctcaccagtga

SEQ ID NO: 28429 - DNA, 22 bp, Artificial sequence
  synthetic polynucleotide sequence
ccaacggcacaaactcaaggga

SEQ ID NO: 28430 - DNA, 21 bp, Artificial sequence
  synthetic polynucleotide sequence
tgaagtctccggaacagcgca

SEQ ID NO: 28431 - DNA, 22 bp, Artificial sequence
  synthetic polynucleotide sequence
atctccttaacggacacgcaga

SEQ ID NO: 28432 - DNA, 20 bp, Artificial sequence
  synthetic polynucleotide sequence
tacaaaagccaagccggcta

SEQ ID NO: 28433 - DNA, 22 bp, Artificial sequence
  synthetic polynucleotide sequence
atgaaggaacctcagggacaga

SEQ ID NO: 28434 - DNA, 19 bp, Artificial sequence
  synthetic polynucleotide sequence
ggcccaactggagtcccca

SEQ ID NO: 28435 - DNA, 20 bp, Artificial sequence
  synthetic polynucleotide sequence
gcaggaagggaagccgcaga

SEQ ID NO: 28436 - DNA, 20 bp, Artificial sequence
  synthetic polynucleotide sequence
cccctgtaccagagggtcga

SEQ ID NO: 28437 - DNA, 20 bp, Artificial sequence
  synthetic polynucleotide sequence
ggcaggaagggtccaacaga

SEQ ID NO: 28438 - DNA, 18 bp, Artificial sequence
  synthetic polynucleotide sequence
ctgcaggctcggatcaca

SEQ ID NO: 28439 - DNA, 23 bp, Artificial sequence
  synthetic polynucleotide sequence
caaaagaactcaggcagagacca

SEQ ID NO: 28440 - DNA, 22 bp, Artificial sequence
  synthetic polynucleotide sequence
tgaatagtctaagctggcctga

SEQ ID NO: 28441 - DNA, 19 bp, Artificial sequence
  synthetic polynucleotide sequence
gagcggggtggtgaggcta

SEQ ID NO: 28442 - DNA, 20 bp, Artificial sequence
  synthetic polynucleotide sequence
tggtgaggctgcagaggtga

SEQ ID NO: 28443 - DNA, 21 bp, Artificial sequence
  synthetic polynucleotide sequence
ctccccgaaacttacctggca

SEQ ID NO: 28444 - DNA, 19 bp, Artificial sequence
  synthetic polynucleotide sequence
gtgggcgggagggaagaca

SEQ ID NO: 28445 - DNA, 21 bp, Artificial sequence
  synthetic polynucleotide sequence
agatggaagacgcgacaggta

SEQ ID NO: 28446 - DNA, 21 bp, Artificial sequence
  synthetic polynucleotide sequence
catcagggctgcattcaagga

SEQ ID NO: 28447 - DNA, 22 bp, Artificial sequence
  synthetic polynucleotide sequence
actaacgactctgacaccacca

SEQ ID NO: 28448 - DNA, 18 bp, Artificial sequence
  synthetic polynucleotide sequence
aagcccagcatgttggca

SEQ ID NO: 28449 - DNA, 18 bp, Artificial sequence
  synthetic polynucleotide sequence
tgacccaactccggagca

SEQ ID NO: 28450 - DNA, 18 bp, Artificial sequence
  synthetic polynucleotide sequence
tagcgaatggcccaggca

SEQ ID NO: 28451 - DNA, 21 bp, Artificial sequence
  synthetic polynucleotide sequence
gagaaactccagctcctggga

SEQ ID NO: 28452 - DNA, 20 bp, Artificial sequence
  synthetic polynucleotide sequence
caagatagccgtgggtccca

SEQ ID NO: 28453 - DNA, 20 bp, Artificial sequence
  synthetic polynucleotide sequence
gtccggaacagtggaaggaa

SEQ ID NO: 28454 - DNA, 19 bp, Artificial sequence
  synthetic polynucleotide sequence
ggctcctacacgctcacca

SEQ ID NO: 28455 - DNA, 19 bp, Artificial sequence
  synthetic polynucleotide sequence
gtggggtgctccaagggca

SEQ ID NO: 28456 - DNA, 20 bp, Artificial sequence
  synthetic polynucleotide sequence
tggctgtggtcagagcagca

SEQ ID NO: 28457 - DNA, 18 bp, Artificial sequence
  synthetic polynucleotide sequence
cgcctcctccgctgccca

SEQ ID NO: 28458 - DNA, 19 bp, Artificial sequence
  synthetic polynucleotide sequence
cctcggggtagggtgggca

SEQ ID NO: 28459 - DNA, 20 bp, Artificial sequence
  synthetic polynucleotide sequence
atcactcggagaggtgcaca

SEQ ID NO: 28460 - DNA, 18 bp, Artificial sequence
  synthetic polynucleotide sequence
agccaagccaggaggaca

SEQ ID NO: 28461 - DNA, 20 bp, Artificial sequence
  synthetic polynucleotide sequence
acttagcccagcggcctgca

SEQ ID NO: 28462 - DNA, 20 bp, Artificial sequence
  synthetic polynucleotide sequence
catccgcaggggaagacaga

SEQ ID NO: 28463 - DNA, 18 bp, Artificial sequence
  synthetic polynucleotide sequence
catgaccgctgaacccca

SEQ ID NO: 28464 - DNA, 20 bp, Artificial sequence
  synthetic polynucleotide sequence
gacagacagacactggccga

SEQ ID NO: 28465 - DNA, 18 bp, Artificial sequence
  synthetic polynucleotide sequence
ccagctgcagaccctcga

SEQ ID NO: 28466 - DNA, 18 bp, Artificial sequence
  synthetic polynucleotide sequence
tggggctggcacagcgga

SEQ ID NO: 28467 - DNA, 22 bp, Artificial sequence
  synthetic polynucleotide sequence
aagcctatgaggagccaccaga

SEQ ID NO: 28468 - DNA, 18 bp, Artificial sequence
  synthetic polynucleotide sequence
gtcgaggtggtccgggga

SEQ ID NO: 28469 - DNA, 20 bp, Artificial sequence
  synthetic polynucleotide sequence
cttcctgctggccaccacca

SEQ ID NO: 28470 - DNA, 21 bp, Artificial sequence
  synthetic polynucleotide sequence
acaggaacaggctgccaagga

SEQ ID NO: 28471 - DNA, 22 bp, Artificial sequence
  synthetic polynucleotide sequence
agatgacagtggtccaactgca

SEQ ID NO: 28472 - DNA, 22 bp, Artificial sequence
  synthetic polynucleotide sequence
gaaaccaggtggcaatgcagga

SEQ ID NO: 28473 - DNA, 20 bp, Artificial sequence
  synthetic polynucleotide sequence
caatccaaggagcaccagca

SEQ ID NO: 28474 - DNA, 20 bp, Artificial sequence
  synthetic polynucleotide sequence
caggttctggaacaggacca

SEQ ID NO: 28475 - DNA, 20 bp, Artificial sequence
  synthetic polynucleotide sequence
ccgtgccaatcccatcccca

SEQ ID NO: 28476 - DNA, 20 bp, Artificial sequence
  synthetic polynucleotide sequence
gtctctccctcccagccaca

SEQ ID NO: 28477 - DNA, 19 bp, Artificial sequence
  synthetic polynucleotide sequence
gcggacccaaagctcgcca

SEQ ID NO: 28478 - DNA, 21 bp, Artificial sequence
  synthetic polynucleotide sequence
caggctggcaaaagtagggga

SEQ ID NO: 28479 - DNA, 18 bp, Artificial sequence
  synthetic polynucleotide sequence
cgcagagctggccgggaa

SEQ ID NO: 28480 - DNA, 20 bp, Artificial sequence
  synthetic polynucleotide sequence
gtagatctcggagatgccca

SEQ ID NO: 28481 - DNA, 21 bp, Artificial sequence
  synthetic polynucleotide sequence
cctgcctcccatgactagaga

SEQ ID NO: 28482 - DNA, 18 bp, Artificial sequence
  synthetic polynucleotide sequence
tcccacagcaggtccaca

SEQ ID NO: 28483 - DNA, 22 bp, Artificial sequence
  synthetic polynucleotide sequence
aagaggaagagcatgcaccaga

SEQ ID NO: 28484 - DNA, 19 bp, Artificial sequence
  synthetic polynucleotide sequence
ctccccagagcctgcctga

SEQ ID NO: 28485 - DNA, 22 bp, Artificial sequence
  synthetic polynucleotide sequence
caaatccgagaagcccgtcgaa

SEQ ID NO: 28486 - DNA, 22 bp, Artificial sequence
  synthetic polynucleotide sequence
tgatgcctcatgaccaatgcca

SEQ ID NO: 28487 - DNA, 21 bp, Artificial sequence
  synthetic polynucleotide sequence
tcagagcaagctcgaggtgga

SEQ ID NO: 28488 - DNA, 21 bp, Artificial sequence
  synthetic polynucleotide sequence
taagcagtgaccagtctccca

SEQ ID NO: 28489 - DNA, 21 bp, Artificial sequence
  synthetic polynucleotide sequence
cggaaaccagtggccacagca

SEQ ID NO: 28490 - DNA, 21 bp, Artificial sequence
  synthetic polynucleotide sequence
caaccactcagagctgggtga

SEQ ID NO: 28491 - DNA, 18 bp, Artificial sequence
  synthetic polynucleotide sequence
gatggccaacaccccaga

SEQ ID NO: 28492 - DNA, 20 bp, Artificial sequence
  synthetic polynucleotide sequence
atgaggggctgtctgaagca

SEQ ID NO: 28493 - DNA, 22 bp, Artificial sequence
  synthetic polynucleotide sequence
aggtggcaccatgaagaggaga

SEQ ID NO: 28494 - DNA, 19 bp, Artificial sequence
  synthetic polynucleotide sequence
tcggctgcatgggtcagca

SEQ ID NO: 28495 - DNA, 21 bp, Artificial sequence
  synthetic polynucleotide sequence
ccatccccaaccacttgccca

SEQ ID NO: 28496 - DNA, 20 bp, Artificial sequence
  synthetic polynucleotide sequence
gtagggtggggtagagggca

SEQ ID NO: 28497 - DNA, 20 bp, Artificial sequence
  synthetic polynucleotide sequence
ccgtccagctcagccatcca

SEQ ID NO: 28498 - DNA, 20 bp, Artificial sequence
  synthetic polynucleotide sequence
tgcggggtcaaacagaggca

SEQ ID NO: 28499 - DNA, 21 bp, Artificial sequence
  synthetic polynucleotide sequence
ccgtgctggctcagagaagga

SEQ ID NO: 28500 - DNA, 20 bp, Artificial sequence
  synthetic polynucleotide sequence
gtgggaaggttgaagaccga

SEQ ID NO: 28501 - DNA, 20 bp, Artificial sequence
  synthetic polynucleotide sequence
cgccgaaccaccgacaggaa

SEQ ID NO: 28502 - DNA, 21 bp, Artificial sequence
  synthetic polynucleotide sequence
tgatgacagccttcctcccca

SEQ ID NO: 28503 - DNA, 18 bp, Artificial sequence
  synthetic polynucleotide sequence
cttcaggcacgctggaga

SEQ ID NO: 28504 - DNA, 18 bp, Artificial sequence
  synthetic polynucleotide sequence
ggccatcccgttccagca

SEQ ID NO: 28505 - DNA, 18 bp, Artificial sequence
  synthetic polynucleotide sequence
gtctgaaggctgcagcca

SEQ ID NO: 28506 - DNA, 20 bp, Artificial sequence
  synthetic polynucleotide sequence
cagccaggatcaggagacca

SEQ ID NO: 28507 - DNA, 21 bp, Artificial sequence
  synthetic polynucleotide sequence
caactccgaaggacaacgaga

SEQ ID NO: 28508 - DNA, 22 bp, Artificial sequence
  synthetic polynucleotide sequence
tgcaccaggaagaagaagcaca

SEQ ID NO: 28509 - DNA, 18 bp, Artificial sequence
  synthetic polynucleotide sequence
caaccacagcagctggca

SEQ ID NO: 28510 - DNA, 18 bp, Artificial sequence
  synthetic polynucleotide sequence
gctcggaagggaggacca

SEQ ID NO: 28511 - DNA, 19 bp, Artificial sequence
  synthetic polynucleotide sequence
caggcactcaatctgggca

SEQ ID NO: 28512 - DNA, 19 bp, Artificial sequence
  synthetic polynucleotide sequence
caaggcttagtgagcgcca

SEQ ID NO: 28513 - DNA, 19 bp, Artificial sequence
  synthetic polynucleotide sequence
gcacgtccaacgaggagga

SEQ ID NO: 28514 - DNA, 18 bp, Artificial sequence
  synthetic polynucleotide sequence
ggccgagtgatgtccaca

SEQ ID NO: 28515 - DNA, 19 bp, Artificial sequence
  synthetic polynucleotide sequence
tggatgcctgaacaaccaa

SEQ ID NO: 28516 - DNA, 20 bp, Artificial sequence
  synthetic polynucleotide sequence
caaagcggctaacagtggga

SEQ ID NO: 28517 - DNA, 20 bp, Artificial sequence
  synthetic polynucleotide sequence
tggtgcaagaggtggacaca

SEQ ID NO: 28518 - DNA, 20 bp, Artificial sequence
  synthetic polynucleotide sequence
ctctccaagaaggtggcaga

SEQ ID NO: 28519 - DNA, 18 bp, Artificial sequence
  synthetic polynucleotide sequence
gcagggacagagccagga

SEQ ID NO: 28520 - DNA, 19 bp, Artificial sequence
  synthetic polynucleotide sequence
cctcaggaaaggctgcaca

SEQ ID NO: 28521 - DNA, 18 bp, Artificial sequence
  synthetic polynucleotide sequence
cacagcatcttgccgcca

SEQ ID NO: 28522 - DNA, 19 bp, Artificial sequence
  synthetic polynucleotide sequence
ccaggcgagtacgacgtga

SEQ ID NO: 28523 - DNA, 21 bp, Artificial sequence
  synthetic polynucleotide sequence
tgcacgagcggtactacgaca

SEQ ID NO: 28524 - DNA, 18 bp, Artificial sequence
  synthetic polynucleotide sequence
cagcgtggctgacacgga

SEQ ID NO: 28525 - DNA, 18 bp, Artificial sequence
  synthetic polynucleotide sequence
gggctcccacgtggcaca

SEQ ID NO: 28526 - DNA, 20 bp, Artificial sequence
  synthetic polynucleotide sequence
gatggtgcagcactgagaga

SEQ ID NO: 28527 - DNA, 20 bp, Artificial sequence
  synthetic polynucleotide sequence
tgctccactgccaccacgga

SEQ ID NO: 28528 - DNA, 20 bp, Artificial sequence
  synthetic polynucleotide sequence
cacacaggtgggtctgcaga

SEQ ID NO: 28529 - DNA, 18 bp, Artificial sequence
  synthetic polynucleotide sequence
tgctgatggcccaggaga

SEQ ID NO: 28530 - DNA, 18 bp, Artificial sequence
  synthetic polynucleotide sequence
ctggccgagcttgcacca

SEQ ID NO: 28531 - DNA, 19 bp, Artificial sequence
  synthetic polynucleotide sequence
gggtgtgagacacacgcca

SEQ ID NO: 28532 - DNA, 18 bp, Artificial sequence
  synthetic polynucleotide sequence
ctggaccgggatgaggaa

SEQ ID NO: 28533 - DNA, 20 bp, Artificial sequence
  synthetic polynucleotide sequence
ctcccgagtccaggacccaa

SEQ ID NO: 28534 - DNA, 20 bp, Artificial sequence
  synthetic polynucleotide sequence
ccattgctccaaggccggca

SEQ ID NO: 28535 - DNA, 18 bp, Artificial sequence
  synthetic polynucleotide sequence
cggacagatgaaggccga

SEQ ID NO: 28536 - DNA, 18 bp, Artificial sequence
  synthetic polynucleotide sequence
cccagcaccaccatcaca

SEQ ID NO: 28537 - DNA, 18 bp, Artificial sequence
  synthetic polynucleotide sequence
gaacgtggaggcagccaa

SEQ ID NO: 28538 - DNA, 18 bp, Artificial sequence
  synthetic polynucleotide sequence
ggctcccaaccaacagca

SEQ ID NO: 28539 - DNA, 21 bp, Artificial sequence
  synthetic polynucleotide sequence
aactgctggagacacactgga

SEQ ID NO: 28540 - DNA, 21 bp, Artificial sequence
  synthetic polynucleotide sequence
gcagtgaggtgaaagccgtga

SEQ ID NO: 28541 - DNA, 22 bp, Artificial sequence
  synthetic polynucleotide sequence
taaaacaaccgcttgtggccga

SEQ ID NO: 28542 - DNA, 20 bp, Artificial sequence
  synthetic polynucleotide sequence
atccacacagatctgctcca

SEQ ID NO: 28543 - DNA, 22 bp, Artificial sequence
  synthetic polynucleotide sequence
agaaggcccagaacatgtccaa

SEQ ID NO: 28544 - DNA, 22 bp, Artificial sequence
  synthetic polynucleotide sequence
aagatgctgcaggcatagagca

SEQ ID NO: 28545 - DNA, 20 bp, Artificial sequence
  synthetic polynucleotide sequence
atccctctcaacatccagga

SEQ ID NO: 28546 - DNA, 19 bp, Artificial sequence
  synthetic polynucleotide sequence
gtcggctcccattgcggca

SEQ ID NO: 28547 - DNA, 21 bp, Artificial sequence
  synthetic polynucleotide sequence
tcttggccatgtagaggacga

SEQ ID NO: 28548 - DNA, 21 bp, Artificial sequence
  synthetic polynucleotide sequence
tccacagactcggaactccca

SEQ ID NO: 28549 - DNA, 18 bp, Artificial sequence
  synthetic polynucleotide sequence
agggagcattcccacgga

SEQ ID NO: 28550 - DNA, 19 bp, Artificial sequence
  synthetic polynucleotide sequence
ccccagggtgaggttcaca

SEQ ID NO: 28551 - DNA, 21 bp, Artificial sequence
  synthetic polynucleotide sequence
gggagctcaccattcaccaca

SEQ ID NO: 28552 - DNA, 20 bp, Artificial sequence
  synthetic polynucleotide sequence
ctcagcaactgaggaccgga

SEQ ID NO: 28553 - DNA, 20 bp, Artificial sequence
  synthetic polynucleotide sequence
cccaggtgctaccagtgcaa

SEQ ID NO: 28554 - DNA, 20 bp, Artificial sequence
  synthetic polynucleotide sequence
atccacccacacggccagga

SEQ ID NO: 28555 - DNA, 18 bp, Artificial sequence
  synthetic polynucleotide sequence
ccaccgaggagggcacga

SEQ ID NO: 28556 - DNA, 22 bp, Artificial sequence
  synthetic polynucleotide sequence
aatggaacagcgagtttgagga

SEQ ID NO: 28557 - DNA, 18 bp, Artificial sequence
  synthetic polynucleotide sequence
catcaacagccagggcca

SEQ ID NO: 28558 - DNA, 18 bp, Artificial sequence
  synthetic polynucleotide sequence
cctgcatggggatcacga

SEQ ID NO: 28559 - DNA, 20 bp, Artificial sequence
  synthetic polynucleotide sequence
cctcccactcggaatcccca

SEQ ID NO: 28560 - DNA, 21 bp, Artificial sequence
  synthetic polynucleotide sequence
caaagaggagcatggctggga

SEQ ID NO: 28561 - DNA, 21 bp, Artificial sequence
  synthetic polynucleotide sequence
tcagatagccctgcagcacca

SEQ ID NO: 28562 - DNA, 22 bp, Artificial sequence
  synthetic polynucleotide sequence
gaaaggcatccagcaagcagca

SEQ ID NO: 28563 - DNA, 20 bp, Artificial sequence
  synthetic polynucleotide sequence
tgccgggtactactacgcca

SEQ ID NO: 28564 - DNA, 18 bp, Artificial sequence
  synthetic polynucleotide sequence
gggcagcgcttaagccca

SEQ ID NO: 28565 - DNA, 20 bp, Artificial sequence
  synthetic polynucleotide sequence
tcgatgctcctagggcgcaa

SEQ ID NO: 28566 - DNA, 20 bp, Artificial sequence
  synthetic polynucleotide sequence
catcctgttgcaggccccca

SEQ ID NO: 28567 - DNA, 20 bp, Artificial sequence
  synthetic polynucleotide sequence
gaccaggcggacctggtgaa

SEQ ID NO: 28568 - DNA, 20 bp, Artificial sequence
  synthetic polynucleotide sequence
gtgcacccggaagaagccca

SEQ ID NO: 28569 - DNA, 21 bp, Artificial sequence
  synthetic polynucleotide sequence
ggaatggtccccagccatgga

SEQ ID NO: 28570 - DNA, 20 bp, Artificial sequence
  synthetic polynucleotide sequence
cctgaagtccctgaggggca

SEQ ID NO: 28571 - DNA, 20 bp, Artificial sequence
  synthetic polynucleotide sequence
gtgggcagcgctcaggacca

SEQ ID NO: 28572 - DNA, 21 bp, Artificial sequence
  synthetic polynucleotide sequence
gttgaggagacagagcgtgga

SEQ ID NO: 28573 - DNA, 18 bp, Artificial sequence
  synthetic polynucleotide sequence
cggggaagaccaccgcca

SEQ ID NO: 28574 - DNA, 19 bp, Artificial sequence
  synthetic polynucleotide sequence
gttctggatgggcgcccca

SEQ ID NO: 28575 - DNA, 20 bp, Artificial sequence
  synthetic polynucleotide sequence
agtgaccaccatggcggtca

SEQ ID NO: 28576 - DNA, 22 bp, Artificial sequence
  synthetic polynucleotide sequence
aaatttgcagaagggcagccca

SEQ ID NO: 28577 - DNA, 21 bp, Artificial sequence
  synthetic polynucleotide sequence
ctcacccagaacactggacga

SEQ ID NO: 28578 - DNA, 20 bp, Artificial sequence
  synthetic polynucleotide sequence
tgtggtgatgcccaggagga

SEQ ID NO: 28579 - DNA, 20 bp, Artificial sequence
  synthetic polynucleotide sequence
ctacggctggacaggatgca

SEQ ID NO: 28580 - DNA, 21 bp, Artificial sequence
  synthetic polynucleotide sequence
cacttgagacaccttcccgga

SEQ ID NO: 28581 - DNA, 19 bp, Artificial sequence
  synthetic polynucleotide sequence
ctactctcccgcgtccgca

SEQ ID NO: 28582 - DNA, 19 bp, Artificial sequence
  synthetic polynucleotide sequence
gtgtggcgtccagagccca

SEQ ID NO: 28583 - DNA, 21 bp, Artificial sequence
  synthetic polynucleotide sequence
cagaggccaagacttcaggca

SEQ ID NO: 28584 - DNA, 20 bp, Artificial sequence
  synthetic polynucleotide sequence
gtcagcaccatgtccaggga

SEQ ID NO: 28585 - DNA, 22 bp, Artificial sequence
  synthetic polynucleotide sequence
acatcagtcagtcctccacaca

SEQ ID NO: 28586 - DNA, 20 bp, Artificial sequence
  synthetic polynucleotide sequence
ctggtgggcaaaaagaggga

SEQ ID NO: 28587 - DNA, 20 bp, Artificial sequence
  synthetic polynucleotide sequence
gcaaggaagctgtgtgccca

SEQ ID NO: 28588 - DNA, 20 bp, Artificial sequence
  synthetic polynucleotide sequence
attgaagggcagccaggaga

SEQ ID NO: 28589 - DNA, 21 bp, Artificial sequence
  synthetic polynucleotide sequence
atccccagcatccataccaga

SEQ ID NO: 28590 - DNA, 21 bp, Artificial sequence
  synthetic polynucleotide sequence
tctacgtcaggaaggatggga

SEQ ID NO: 28591 - DNA, 20 bp, Artificial sequence
  synthetic polynucleotide sequence
ctaacgtccagacccctgca

SEQ ID NO: 28592 - DNA, 20 bp, Artificial sequence
  synthetic polynucleotide sequence
cctggggtaggatgcgagga

SEQ ID NO: 28593 - DNA, 20 bp, Artificial sequence
  synthetic polynucleotide sequence
gaaggtggcatctccccgga

SEQ ID NO: 28594 - DNA, 20 bp, Artificial sequence
  synthetic polynucleotide sequence
cagtgggtagagctggggca

SEQ ID NO: 28595 - DNA, 20 bp, Artificial sequence
  synthetic polynucleotide sequence
atagcacctacctgtggaca

SEQ ID NO: 28596 - DNA, 22 bp, Artificial sequence
  synthetic polynucleotide sequence
aacaccaacaaggagagcagga

SEQ ID NO: 28597 - DNA, 21 bp, Artificial sequence
  synthetic polynucleotide sequence
acaaagccagacagagcccga

SEQ ID NO: 28598 - DNA, 21 bp, Artificial sequence
  synthetic polynucleotide sequence
aggtgaggctttggagaggca

SEQ ID NO: 28599 - DNA, 19 bp, Artificial sequence
  synthetic polynucleotide sequence
ggcctcagggtctggagca

SEQ ID NO: 28600 - DNA, 22 bp, Artificial sequence
  synthetic polynucleotide sequence
gcaacagagagagaagagccga

SEQ ID NO: 28601 - DNA, 20 bp, Artificial sequence
  synthetic polynucleotide sequence
ggagagccaaggccagtcca

SEQ ID NO: 28602 - DNA, 22 bp, Artificial sequence
  synthetic polynucleotide sequence
agcacacacattggctgcacga

SEQ ID NO: 28603 - DNA, 19 bp, Artificial sequence
  synthetic polynucleotide sequence
gttttgggagacccagcca

SEQ ID NO: 28604 - DNA, 21 bp, Artificial sequence
  synthetic polynucleotide sequence
caccatgaaaaatgacagcca

SEQ ID NO: 28605 - DNA, 19 bp, Artificial sequence
  synthetic polynucleotide sequence
gtctccccgagcctggaga

SEQ ID NO: 28606 - DNA, 19 bp, Artificial sequence
  synthetic polynucleotide sequence
gcgcagtgaggtgtgggga

SEQ ID NO: 28607 - DNA, 18 bp, Artificial sequence
  synthetic polynucleotide sequence
tccgggaggagatcacca

SEQ ID NO: 28608 - DNA, 18 bp, Artificial sequence
  synthetic polynucleotide sequence
ctcaggggacccaaggga

SEQ ID NO: 28609 - DNA, 21 bp, Artificial sequence
  synthetic polynucleotide sequence
tgatcgccatagtgctggcca

SEQ ID NO: 28610 - DNA, 20 bp, Artificial sequence
  synthetic polynucleotide sequence
gatgcggtttgccagggcca

SEQ ID NO: 28611 - DNA, 22 bp, Artificial sequence
  synthetic polynucleotide sequence
acgaatcacaggtgtgtgagca

SEQ ID NO: 28612 - DNA, 21 bp, Artificial sequence
  synthetic polynucleotide sequence
ttgcagctgtgtgtcagctga

SEQ ID NO: 28613 - DNA, 21 bp, Artificial sequence
  synthetic polynucleotide sequence
cagccatcagccagaactgga

SEQ ID NO: 28614 - DNA, 21 bp, Artificial sequence
  synthetic polynucleotide sequence
ccttgacctcgtccatgccca

SEQ ID NO: 28615 - DNA, 20 bp, Artificial sequence
  synthetic polynucleotide sequence
ccactcctcagaaccagtga

SEQ ID NO: 28616 - DNA, 20 bp, Artificial sequence
  synthetic polynucleotide sequence
cataacaacggactgggcca

SEQ ID NO: 28617 - DNA, 22 bp, Artificial sequence
  synthetic polynucleotide sequence
atgaggaagagagtgaggccaa

SEQ ID NO: 28618 - DNA, 18 bp, Artificial sequence
  synthetic polynucleotide sequence
gtgctcaggggtggggca

SEQ ID NO: 28619 - DNA, 21 bp, Artificial sequence
  synthetic polynucleotide sequence
ggggaacggaaagctgagaga

SEQ ID NO: 28620 - DNA, 20 bp, Artificial sequence
  synthetic polynucleotide sequence
gcagttcctgccacccgaca

SEQ ID NO: 28621 - DNA, 18 bp, Artificial sequence
  synthetic polynucleotide sequence
tgaccctgaccacgacca

SEQ ID NO: 28622 - DNA, 23 bp, Artificial sequence
  synthetic polynucleotide sequence
gaataatgaccaagtagcaccca

SEQ ID NO: 28623 - DNA, 21 bp, Artificial sequence
  synthetic polynucleotide sequence
agaaaggcggacccatgcaca

SEQ ID NO: 28624 - DNA, 21 bp, Artificial sequence
  synthetic polynucleotide sequence
caggcgtagaatcccactgga

SEQ ID NO: 28625 - DNA, 25 bp, Artificial sequence
  synthetic polynucleotide sequence
acaggatcaggagcgatagagagca

SEQ ID NO: 28626 - DNA, 23 bp, Artificial sequence
  synthetic polynucleotide sequence
ctccttagacacaaggaccgaga

SEQ ID NO: 28627 - DNA, 19 bp, Artificial sequence
  synthetic polynucleotide sequence
caccgctttgcctacacga

SEQ ID NO: 28628 - DNA, 18 bp, Artificial sequence
  synthetic polynucleotide sequence
agagggtgcaccacagca

SEQ ID NO: 28629 - DNA, 19 bp, Artificial sequence
  synthetic polynucleotide sequence
ccgaacggtgaggaggaca

SEQ ID NO: 28630 - DNA, 18 bp, Artificial sequence
  synthetic polynucleotide sequence
aaggcagccaggagagca

SEQ ID NO: 28631 - DNA, 20 bp, Artificial sequence
  synthetic polynucleotide sequence
tggctacccagagcaccgca

SEQ ID NO: 28632 - DNA, 21 bp, Artificial sequence
  synthetic polynucleotide sequence
acgtgctataccccaggaaca

SEQ ID NO: 28633 - DNA, 21 bp, Artificial sequence
  synthetic polynucleotide sequence
tggggagactggggaagtgca

SEQ ID NO: 28634 - DNA, 22 bp, Artificial sequence
  synthetic polynucleotide sequence
caggtggtcaagaaggatgcga

SEQ ID NO: 28635 - DNA, 22 bp, Artificial sequence
  synthetic polynucleotide sequence
gtcacaaagcagtggtgggaga

SEQ ID NO: 28636 - DNA, 20 bp, Artificial sequence
  synthetic polynucleotide sequence
tcacagctcgccggagggca

SEQ ID NO: 28637 - DNA, 18 bp, Artificial sequence
  synthetic polynucleotide sequence
gctgcgccaacccgctca

SEQ ID NO: 28638 - DNA, 18 bp, Artificial sequence
  synthetic polynucleotide sequence
ccggcaacggaacacgga

SEQ ID NO: 28639 - DNA, 21 bp, Artificial sequence
  synthetic polynucleotide sequence
gagccaccaagaagatcagca

SEQ ID NO: 28640 - DNA, 20 bp, Artificial sequence
  synthetic polynucleotide sequence
ccagtgggagccgatgggca

SEQ ID NO: 28641 - DNA, 21 bp, Artificial sequence
  synthetic polynucleotide sequence
gacggagaagaggctgtgcaa

SEQ ID NO: 28642 - DNA, 20 bp, Artificial sequence
  synthetic polynucleotide sequence
ggccctgaagcagtccctca

SEQ ID NO: 28643 - DNA, 21 bp, Artificial sequence
  synthetic polynucleotide sequence
tccctgccacctacaactcca

SEQ ID NO: 28644 - DNA, 22 bp, Artificial sequence
  synthetic polynucleotide sequence
ggaaggggatcttggaagagga

SEQ ID NO: 28645 - DNA, 21 bp, Artificial sequence
  synthetic polynucleotide sequence
agaactccaccaggtgccaca

SEQ ID NO: 28646 - DNA, 22 bp, Artificial sequence
  synthetic polynucleotide sequence
attgcagaacacgatgaggcca

SEQ ID NO: 28647 - DNA, 18 bp, Artificial sequence
  synthetic polynucleotide sequence
cataggcacctgcgccca

SEQ ID NO: 28648 - DNA, 18 bp, Artificial sequence
  synthetic polynucleotide sequence
gtcgccacagatggacca

SEQ ID NO: 28649 - DNA, 21 bp, Artificial sequence
  synthetic polynucleotide sequence
catagcgaccaaccgccacaa

SEQ ID NO: 28650 - DNA, 20 bp, Artificial sequence
  synthetic polynucleotide sequence
gttcccaaccagtcccacga

SEQ ID NO: 28651 - DNA, 20 bp, Artificial sequence
  synthetic polynucleotide sequence
cgcctcgcagtgggctggaa

SEQ ID NO: 28652 - DNA, 20 bp, Artificial sequence
  synthetic polynucleotide sequence
tagcagatggcgtccaggca

SEQ ID NO: 28653 - DNA, 22 bp, Artificial sequence
  synthetic polynucleotide sequence
tacaggggtttcacagcagaca

SEQ ID NO: 28654 - DNA, 22 bp, Artificial sequence
  synthetic polynucleotide sequence
attcctcacagcaacagcagca

SEQ ID NO: 28655 - DNA, 21 bp, Artificial sequence
  synthetic polynucleotide sequence
cctcctgggcctcatcaacca

SEQ ID NO: 28656 - DNA, 19 bp, Artificial sequence
  synthetic polynucleotide sequence
cgccgcactcctcacagca

SEQ ID NO: 28657 - DNA, 21 bp, Artificial sequence
  synthetic polynucleotide sequence
tgcggccaaacccaagcacga

SEQ ID NO: 28658 - DNA, 19 bp, Artificial sequence
  synthetic polynucleotide sequence
gtcggtggtggagtgcgca

SEQ ID NO: 28659 - DNA, 20 bp, Artificial sequence
  synthetic polynucleotide sequence
caactgtgtggcggacccca

SEQ ID NO: 28660 - DNA, 19 bp, Artificial sequence
  synthetic polynucleotide sequence
gggtctccagggtgagcga

SEQ ID NO: 28661 - DNA, 20 bp, Artificial sequence
  synthetic polynucleotide sequence
agggaggggaggagcagaga

SEQ ID NO: 28662 - DNA, 20 bp, Artificial sequence
  synthetic polynucleotide sequence
acctggccaccagttccaca

SEQ ID NO: 28663 - DNA, 21 bp, Artificial sequence
  synthetic polynucleotide sequence
agaccaaggccttcaccacca

SEQ ID NO: 28664 - DNA, 19 bp, Artificial sequence
  synthetic polynucleotide sequence
tggaaggtctggggcagca

SEQ ID NO: 28665 - DNA, 19 bp, Artificial sequence
  synthetic polynucleotide sequence
gcctcccattgccccgaga

SEQ ID NO: 28666 - DNA, 21 bp, Artificial sequence
  synthetic polynucleotide sequence
tagggtcaggaaggtcagcga

SEQ ID NO: 28667 - DNA, 21 bp, Artificial sequence
  synthetic polynucleotide sequence
tccacaggtgtccacgagtca

SEQ ID NO: 28668 - DNA, 20 bp, Artificial sequence
  synthetic polynucleotide sequence
aaccaggtttcccccagcca

SEQ ID NO: 28669 - DNA, 20 bp, Artificial sequence
  synthetic polynucleotide sequence
tacccgctactggtgagcca

SEQ ID NO: 28670 - DNA, 21 bp, Artificial sequence
  synthetic polynucleotide sequence
agccaaacacctccagcggga

SEQ ID NO: 28671 - DNA, 20 bp, Artificial sequence
  synthetic polynucleotide sequence
tgccttccgcaaccaggaga

SEQ ID NO: 28672 - DNA, 20 bp, Artificial sequence
  synthetic polynucleotide sequence
cacggggcgagcccttcaga

SEQ ID NO: 28673 - DNA, 18 bp, Artificial sequence
  synthetic polynucleotide sequence
cctggctgtggggggaca

SEQ ID NO: 28674 - DNA, 22 bp, Artificial sequence
  synthetic polynucleotide sequence
aagtagccaatccaggtgacca

SEQ ID NO: 28675 - DNA, 20 bp, Artificial sequence
  synthetic polynucleotide sequence
ctggacgacttcacccccaa

SEQ ID NO: 28676 - DNA, 20 bp, Artificial sequence
  synthetic polynucleotide sequence
gcagctgaggtcctggagga

SEQ ID NO: 28677 - DNA, 20 bp, Artificial sequence
  synthetic polynucleotide sequence
ataccttcccgagctcccca

SEQ ID NO: 28678 - DNA, 21 bp, Artificial sequence
  synthetic polynucleotide sequence
tctgcagactcatgagaccca

SEQ ID NO: 28679 - DNA, 21 bp, Artificial sequence
  synthetic polynucleotide sequence
ctgcaaccggaaagtctacca

SEQ ID NO: 28680 - DNA, 19 bp, Artificial sequence
  synthetic polynucleotide sequence
atgcagcgaatcagcaaca

SEQ ID NO: 28681 - DNA, 20 bp, Artificial sequence
  synthetic polynucleotide sequence
taccccatccaggcatggca

SEQ ID NO: 28682 - DNA, 21 bp, Artificial sequence
  synthetic polynucleotide sequence
gcagcaacacgtggtagggca

SEQ ID NO: 28683 - DNA, 21 bp, Artificial sequence
  synthetic polynucleotide sequence
ttcgagccatgggaaaaggga

SEQ ID NO: 28684 - DNA, 21 bp, Artificial sequence
  synthetic polynucleotide sequence
ggtcgagctgctctgaccaca

SEQ ID NO: 28685 - DNA, 20 bp, Artificial sequence
  synthetic polynucleotide sequence
gtggccgacccgttcacgta

SEQ ID NO: 28686 - DNA, 21 bp, Artificial sequence
  synthetic polynucleotide sequence
tcttcagcagctggtgcacca

SEQ ID NO: 28687 - DNA, 20 bp, Artificial sequence
  synthetic polynucleotide sequence
tgccagacttccctgagcca

SEQ ID NO: 28688 - DNA, 20 bp, Artificial sequence
  synthetic polynucleotide sequence
acgagcgtaggccacagaga

SEQ ID NO: 28689 - DNA, 21 bp, Artificial sequence
  synthetic polynucleotide sequence
cccagccaattaaaggagcca

SEQ ID NO: 28690 - DNA, 21 bp, Artificial sequence
  synthetic polynucleotide sequence
aaggggatgtagctcagggca

SEQ ID NO: 28691 - DNA, 23 bp, Artificial sequence
  synthetic polynucleotide sequence
aaaatgcaaacaccacaggcaga

SEQ ID NO: 28692 - DNA, 18 bp, Artificial sequence
  synthetic polynucleotide sequence
caccaggtaggggcccca

SEQ ID NO: 28693 - DNA, 22 bp, Artificial sequence
  synthetic polynucleotide sequence
aatggtcagccaacagaggaca

SEQ ID NO: 28694 - DNA, 21 bp, Artificial sequence
  synthetic polynucleotide sequence
tcagaatcaccagcacggcca

SEQ ID NO: 28695 - DNA, 22 bp, Artificial sequence
  synthetic polynucleotide sequence
taccacatcaaatctgggccca

SEQ ID NO: 28696 - DNA, 20 bp, Artificial sequence
  synthetic polynucleotide sequence
cccaggcgtgcaacaaagca

SEQ ID NO: 28697 - DNA, 17 bp, Artificial sequence
  synthetic polynucleotide sequence
gggaagtggaggcagga

SEQ ID NO: 28698 - DNA, 19 bp, Artificial sequence
  synthetic polynucleotide sequence
gcaaacgtcacggagaaga

SEQ ID NO: 28699 - DNA, 21 bp, Artificial sequence
  synthetic polynucleotide sequence
cacctgtgagtccaagccaga

SEQ ID NO: 28700 - DNA, 21 bp, Artificial sequence
  synthetic polynucleotide sequence
ctcatctcctgcccagaacca

SEQ ID NO: 28701 - DNA, 19 bp, Artificial sequence
  synthetic polynucleotide sequence
ggaactgaggagggggcca

SEQ ID NO: 28702 - DNA, 21 bp, Artificial sequence
  synthetic polynucleotide sequence
atctctgtcccagaaccagga

SEQ ID NO: 28703 - DNA, 19 bp, Artificial sequence
  synthetic polynucleotide sequence
tcacgggctggaagagaca

SEQ ID NO: 28704 - DNA, 18 bp, Artificial sequence
  synthetic polynucleotide sequence
cccagccattggcagcca

SEQ ID NO: 28705 - DNA, 20 bp, Artificial sequence
  synthetic polynucleotide sequence
tcccaacggcagcttgggaa

SEQ ID NO: 28706 - DNA, 19 bp, Artificial sequence
  synthetic polynucleotide sequence
ccgttgagcacgacggcca

SEQ ID NO: 28707 - DNA, 18 bp, Artificial sequence
  synthetic polynucleotide sequence
tgctcctcaccacagcca

SEQ ID NO: 28708 - DNA, 20 bp, Artificial sequence
  synthetic polynucleotide sequence
tagaagaggacgaaggccca

SEQ ID NO: 28709 - DNA, 21 bp, Artificial sequence
  synthetic polynucleotide sequence
tgccccgtcacagcctaccaa

SEQ ID NO: 28710 - DNA, 21 bp, Artificial sequence
  synthetic polynucleotide sequence
ggatcaacagtctgcggctga

SEQ ID NO: 28711 - DNA, 21 bp, Artificial sequence
  synthetic polynucleotide sequence
ctgccaccaagattaccacca

SEQ ID NO: 28712 - DNA, 22 bp, Artificial sequence
  synthetic polynucleotide sequence
gtcactgggaagcaagtgcaga

SEQ ID NO: 28713 - DNA, 20 bp, Artificial sequence
  synthetic polynucleotide sequence
gtcacagctgggctcacaga

SEQ ID NO: 28714 - DNA, 21 bp, Artificial sequence
  synthetic polynucleotide sequence
acactgagtggtcacaaggga

SEQ ID NO: 28715 - DNA, 21 bp, Artificial sequence
  synthetic polynucleotide sequence
tgcaggctcagcatggggtga

SEQ ID NO: 28716 - DNA, 20 bp, Artificial sequence
  synthetic polynucleotide sequence
caggctctgggactaaccca

SEQ ID NO: 28717 - DNA, 22 bp, Artificial sequence
  synthetic polynucleotide sequence
aggttctggcaagaagacccca

SEQ ID NO: 28718 - DNA, 21 bp, Artificial sequence
  synthetic polynucleotide sequence
tgagcagcagctgctgtcaca

SEQ ID NO: 28719 - DNA, 19 bp, Artificial sequence
  synthetic polynucleotide sequence
ggagagcgtgacagccaga

SEQ ID NO: 28720 - DNA, 21 bp, Artificial sequence
  synthetic polynucleotide sequence
aaggagctgctggagatgaca

SEQ ID NO: 28721 - DNA, 18 bp, Artificial sequence
  synthetic polynucleotide sequence
cagatgcagccagcagga

SEQ ID NO: 28722 - DNA, 18 bp, Artificial sequence
  synthetic polynucleotide sequence
tggatgaaggggagccga

SEQ ID NO: 28723 - DNA, 18 bp, Artificial sequence
  synthetic polynucleotide sequence
tggacgaccagcgggcca

SEQ ID NO: 28724 - DNA, 19 bp, Artificial sequence
  synthetic polynucleotide sequence
gggcagcgctggtcatcga

SEQ ID NO: 28725 - DNA, 22 bp, Artificial sequence
  synthetic polynucleotide sequence
taatgacaaggtgggagaagca

SEQ ID NO: 28726 - DNA, 20 bp, Artificial sequence
  synthetic polynucleotide sequence
ccacggctgcctgcagagca

SEQ ID NO: 28727 - DNA, 20 bp, Artificial sequence
  synthetic polynucleotide sequence
atcctcagtcaccagtgcca

SEQ ID NO: 28728 - DNA, 20 bp, Artificial sequence
  synthetic polynucleotide sequence
gctcctccattcgaccccca

SEQ ID NO: 28729 - DNA, 20 bp, Artificial sequence
  synthetic polynucleotide sequence
gcggacgaggtgtaccagga

SEQ ID NO: 28730 - DNA, 19 bp, Artificial sequence
  synthetic polynucleotide sequence
tggaggtggagtggaagga

SEQ ID NO: 28731 - DNA, 18 bp, Artificial sequence
  synthetic polynucleotide sequence
ggaggctgctcaggccca

SEQ ID NO: 28732 - DNA, 21 bp, Artificial sequence
  synthetic polynucleotide sequence
gcttctccactggagggagga

SEQ ID NO: 28733 - DNA, 18 bp, Artificial sequence
  synthetic polynucleotide sequence
gccagctcccagcgacga

SEQ ID NO: 28734 - DNA, 18 bp, Artificial sequence
  synthetic polynucleotide sequence
tcgttgcgacacaccgga

SEQ ID NO: 28735 - DNA, 21 bp, Artificial sequence
  synthetic polynucleotide sequence
cctgaaggacaagctccccta

SEQ ID NO: 28736 - DNA, 18 bp, Artificial sequence
  synthetic polynucleotide sequence
cggcgcacagggctccaa

SEQ ID NO: 28737 - DNA, 20 bp, Artificial sequence
  synthetic polynucleotide sequence
tacaggaagagcttgcacca

SEQ ID NO: 28738 - DNA, 20 bp, Artificial sequence
  synthetic polynucleotide sequence
gaggcggtcagatgtaccca

SEQ ID NO: 28739 - DNA, 19 bp, Artificial sequence
  synthetic polynucleotide sequence
ccagtgaggcaagaccgaa

SEQ ID NO: 28740 - DNA, 20 bp, Artificial sequence
  synthetic polynucleotide sequence
cccgaactggttacacggga

SEQ ID NO: 28741 - DNA, 20 bp, Artificial sequence
  synthetic polynucleotide sequence
caaagacgagaaaggcacca

SEQ ID NO: 28742 - DNA, 22 bp, Artificial sequence
  synthetic polynucleotide sequence
accaggatattgcgctgtcaga

SEQ ID NO: 28743 - DNA, 22 bp, Artificial sequence
  synthetic polynucleotide sequence
aacaaaggggtaacaggcacca

SEQ ID NO: 28744 - DNA, 21 bp, Artificial sequence
  synthetic polynucleotide sequence
ccaagcctcaataggcggcca

SEQ ID NO: 28745 - DNA, 18 bp, Artificial sequence
  synthetic polynucleotide sequence
ctaccgagccctgcagca

SEQ ID NO: 28746 - DNA, 18 bp, Artificial sequence
  synthetic polynucleotide sequence
gggcaccagtaccggtga

SEQ ID NO: 28747 - DNA, 18 bp, Artificial sequence
  synthetic polynucleotide sequence
gtggccagtgactgccaa

SEQ ID NO: 28748 - DNA, 19 bp, Artificial sequence
  synthetic polynucleotide sequence
ccaacacgctgaagtggga

SEQ ID NO: 28749 - DNA, 20 bp, Artificial sequence
  synthetic polynucleotide sequence
ctggaggaaggcgggaagga

SEQ ID NO: 28750 - DNA, 20 bp, Artificial sequence
  synthetic polynucleotide sequence
gagcaggacgttgagggcga

SEQ ID NO: 28751 - DNA, 21 bp, Artificial sequence
  synthetic polynucleotide sequence
aggttccacacagacgcggca

SEQ ID NO: 28752 - DNA, 21 bp, Artificial sequence
  synthetic polynucleotide sequence
ttggagccttagaccctgcca

SEQ ID NO: 28753 - DNA, 21 bp, Artificial sequence
  synthetic polynucleotide sequence
caggccattgaagaccctgga

SEQ ID NO: 28754 - DNA, 21 bp, Artificial sequence
  synthetic polynucleotide sequence
cctttggcacctaagcccaca

SEQ ID NO: 28755 - DNA, 21 bp, Artificial sequence
  synthetic polynucleotide sequence
agatgccgaactgctctccca

SEQ ID NO: 28756 - DNA, 22 bp, Artificial sequence
  synthetic polynucleotide sequence
atgaggacatgaccaggaagca

SEQ ID NO: 28757 - DNA, 21 bp, Artificial sequence
  synthetic polynucleotide sequence
ttctagtgccaaacgccctga

SEQ ID NO: 28758 - DNA, 19 bp, Artificial sequence
  synthetic polynucleotide sequence
gaagggcggtctgctcgga

SEQ ID NO: 28759 - DNA, 21 bp, Artificial sequence
  synthetic polynucleotide sequence
ccacagcaccaagaagggcaa

SEQ ID NO: 28760 - DNA, 21 bp, Artificial sequence
  synthetic polynucleotide sequence
aattctccgtgacgtagagca

SEQ ID NO: 28761 - DNA, 21 bp, Artificial sequence
  synthetic polynucleotide sequence
ctatggagaccaggtgcagca

SEQ ID NO: 28762 - DNA, 20 bp, Artificial sequence
  synthetic polynucleotide sequence
ggtgcggtagaagtcgacca

SEQ ID NO: 28763 - DNA, 18 bp, Artificial sequence
  synthetic polynucleotide sequence
acgagctggggttccaca

SEQ ID NO: 28764 - DNA, 18 bp, Artificial sequence
  synthetic polynucleotide sequence
ggtcatgggtgccacgta

SEQ ID NO: 28765 - DNA, 18 bp, Artificial sequence
  synthetic polynucleotide sequence
ctccggggtgtcgaggga

SEQ ID NO: 28766 - DNA, 21 bp, Artificial sequence
  synthetic polynucleotide sequence
tctcactctcccggatcagga

SEQ ID NO: 28767 - DNA, 22 bp, Artificial sequence
  synthetic polynucleotide sequence
aatggcctgaatgtggaaggca

SEQ ID NO: 28768 - DNA, 21 bp, Artificial sequence
  synthetic polynucleotide sequence
ggtactgcagacgagcctcca

SEQ ID NO: 28769 - DNA, 20 bp, Artificial sequence
  synthetic polynucleotide sequence
tacaacgcccctacagacca

SEQ ID NO: 28770 - DNA, 20 bp, Artificial sequence
  synthetic polynucleotide sequence
cacgagggagttctcggaga

SEQ ID NO: 28771 - DNA, 20 bp, Artificial sequence
  synthetic polynucleotide sequence
tctcaggccagaaaagcaga

SEQ ID NO: 28772 - DNA, 20 bp, Artificial sequence
  synthetic polynucleotide sequence
gtgaagaggcagtggggcta

SEQ ID NO: 28773 - DNA, 18 bp, Artificial sequence
  synthetic polynucleotide sequence
tagcaaacagcggcacga

SEQ ID NO: 28774 - DNA, 22 bp, Artificial sequence
  synthetic polynucleotide sequence
ccaaacttgacagagagggaga

SEQ ID NO: 28775 - DNA, 18 bp, Artificial sequence
  synthetic polynucleotide sequence
catcctgccgagcgagga

SEQ ID NO: 28776 - DNA, 18 bp, Artificial sequence
  synthetic polynucleotide sequence
gcgtgcagcaatggcgca

SEQ ID NO: 28777 - DNA, 21 bp, Artificial sequence
  synthetic polynucleotide sequence
ccccaaggtggtgggaacaga

SEQ ID NO: 28778 - DNA, 20 bp, Artificial sequence
  synthetic polynucleotide sequence
tggttctccagaggccacca

SEQ ID NO: 28779 - DNA, 20 bp, Artificial sequence
  synthetic polynucleotide sequence
gtggtcgacatgagcacgga

SEQ ID NO: 28780 - DNA, 21 bp, Artificial sequence
  synthetic polynucleotide sequence
agtacttgcggtacagaggca

SEQ ID NO: 28781 - DNA, 18 bp, Artificial sequence
  synthetic polynucleotide sequence
gctgcaacagtcgcacca

SEQ ID NO: 28782 - DNA, 18 bp, Artificial sequence
  synthetic polynucleotide sequence
gggcttgcagaaggagca

SEQ ID NO: 28783 - DNA, 20 bp, Artificial sequence
  synthetic polynucleotide sequence
caccgagcgcaagtacctca

SEQ ID NO: 28784 - DNA, 18 bp, Artificial sequence
  synthetic polynucleotide sequence
gggcttgcagaaggcgca

SEQ ID NO: 28785 - DNA, 21 bp, Artificial sequence
  synthetic polynucleotide sequence
tgacaagggagctgagcggaa

SEQ ID NO: 28786 - DNA, 21 bp, Artificial sequence
  synthetic polynucleotide sequence
agacagagccttcaccctcca

SEQ ID NO: 28787 - DNA, 21 bp, Artificial sequence
  synthetic polynucleotide sequence
agggccccatgacctacctca

SEQ ID NO: 28788 - DNA, 22 bp, Artificial sequence
  synthetic polynucleotide sequence
accaccatcaccacactcctga

SEQ ID NO: 28789 - DNA, 20 bp, Artificial sequence
  synthetic polynucleotide sequence
gacctgaaggggctgaggaa

SEQ ID NO: 28790 - DNA, 18 bp, Artificial sequence
  synthetic polynucleotide sequence
gctcccccatgtccagca

SEQ ID NO: 28791 - DNA, 18 bp, Artificial sequence
  synthetic polynucleotide sequence
caacatcagcaggggcga

SEQ ID NO: 28792 - DNA, 20 bp, Artificial sequence
  synthetic polynucleotide sequence
tcgtcacatccagtccagca

SEQ ID NO: 28793 - DNA, 21 bp, Artificial sequence
  synthetic polynucleotide sequence
atggtggtacgacaagggcga

SEQ ID NO: 28794 - DNA, 21 bp, Artificial sequence
  synthetic polynucleotide sequence
gtccaagtcctccgatcagga

SEQ ID NO: 28795 - DNA, 25 bp, Artificial sequence
  synthetic polynucleotide sequence
atgaggaacaaggcaaggctgtcaa

SEQ ID NO: 28796 - DNA, 21 bp, Artificial sequence
  synthetic polynucleotide sequence
tcacgtaagggacagcatgca

SEQ ID NO: 28797 - DNA, 22 bp, Artificial sequence
  synthetic polynucleotide sequence
accaaccagaacaccaccgaga

SEQ ID NO: 28798 - DNA, 20 bp, Artificial sequence
  synthetic polynucleotide sequence
cctctcgagaactgggagca

SEQ ID NO: 28799 - DNA, 20 bp, Artificial sequence
  synthetic polynucleotide sequence
attcaagggctgacagggaa

SEQ ID NO: 28800 - DNA, 20 bp, Artificial sequence
  synthetic polynucleotide sequence
tagcagctgtgtcattgcca

SEQ ID NO: 28801 - DNA, 19 bp, Artificial sequence
  synthetic polynucleotide sequence
gctgtgacctcaccagcca

SEQ ID NO: 28802 - DNA, 18 bp, Artificial sequence
  synthetic polynucleotide sequence
caccacaactccagggca

SEQ ID NO: 28803 - DNA, 18 bp, Artificial sequence
  synthetic polynucleotide sequence
acgtgcctgagcaccgaa

SEQ ID NO: 28804 - DNA, 20 bp, Artificial sequence
  synthetic polynucleotide sequence
attacccagattgagcccca

SEQ ID NO: 28805 - DNA, 25 bp, Artificial sequence
  synthetic polynucleotide sequence
caaggtagagcagacagaatgggga

SEQ ID NO: 28806 - DNA, 20 bp, Artificial sequence
  synthetic polynucleotide sequence
caccatccgtccaggtgaga

SEQ ID NO: 28807 - DNA, 20 bp, Artificial sequence
  synthetic polynucleotide sequence
ctggtccagggacatgctga

SEQ ID NO: 28808 - DNA, 19 bp, Artificial sequence
  synthetic polynucleotide sequence
ccaccacagtggcgctgga

SEQ ID NO: 28809 - DNA, 18 bp, Artificial sequence
  synthetic polynucleotide sequence
gaagtggtggcgtgggaa

SEQ ID NO: 28810 - DNA, 18 bp, Artificial sequence
  synthetic polynucleotide sequence
accagtccggcagccaga

SEQ ID NO: 28811 - DNA, 22 bp, Artificial sequence
  synthetic polynucleotide sequence
aacgattgcaggcacctccgaa

SEQ ID NO: 28812 - DNA, 22 bp, Artificial sequence
  synthetic polynucleotide sequence
gaaactgttgaacggccacaga

SEQ ID NO: 28813 - DNA, 20 bp, Artificial sequence
  synthetic polynucleotide sequence
caaagccctgtccacacgca

SEQ ID NO: 28814 - DNA, 20 bp, Artificial sequence
  synthetic polynucleotide sequence
ccatgcgctccacggtcaga

SEQ ID NO: 28815 - DNA, 20 bp, Artificial sequence
  synthetic polynucleotide sequence
tcggggggttcatgcagcaa

SEQ ID NO: 28816 - DNA, 22 bp, Artificial sequence
  synthetic polynucleotide sequence
tcatccactgactcaatgggca

SEQ ID NO: 28817 - DNA, 18 bp, Artificial sequence
  synthetic polynucleotide sequence
tgaccctggggatcagca

SEQ ID NO: 28818 - DNA, 19 bp, Artificial sequence
  synthetic polynucleotide sequence
gctgacagccaggtaggca

SEQ ID NO: 28819 - DNA, 18 bp, Artificial sequence
  synthetic polynucleotide sequence
acgccacggtgaagcaga

SEQ ID NO: 28820 - DNA, 18 bp, Artificial sequence
  synthetic polynucleotide sequence
aggcctcgaactccagca

SEQ ID NO: 28821 - DNA, 19 bp, Artificial sequence
  synthetic polynucleotide sequence
cgcacagtgagaccagcga

SEQ ID NO: 28822 - DNA, 18 bp, Artificial sequence
  synthetic polynucleotide sequence
ggcctgaataggtgggca

SEQ ID NO: 28823 - DNA, 18 bp, Artificial sequence
  synthetic polynucleotide sequence
ccggacatcaccaccaca

SEQ ID NO: 28824 - DNA, 18 bp, Artificial sequence
  synthetic polynucleotide sequence
tggtgacaagggcccgga

SEQ ID NO: 28825 - DNA, 19 bp, Artificial sequence
  synthetic polynucleotide sequence
caagaagtccgggggccca

SEQ ID NO: 28826 - DNA, 20 bp, Artificial sequence
  synthetic polynucleotide sequence
cttgtcactgaggcccgaca

SEQ ID NO: 28827 - DNA, 18 bp, Artificial sequence
  synthetic polynucleotide sequence
atggcatcgccctgcaca

SEQ ID NO: 28828 - DNA, 18 bp, Artificial sequence
  synthetic polynucleotide sequence
tgtagaagacgcccgcca

SEQ ID NO: 28829 - DNA, 21 bp, Artificial sequence
  synthetic polynucleotide sequence
cggaccaccaatgggaaagca

SEQ ID NO: 28830 - DNA, 20 bp, Artificial sequence
  synthetic polynucleotide sequence
cagctgcagctcctgacgga

SEQ ID NO: 28831 - DNA, 20 bp, Artificial sequence
  synthetic polynucleotide sequence
aactcgccgctcacctccaa

SEQ ID NO: 28832 - DNA, 19 bp, Artificial sequence
  synthetic polynucleotide sequence
cgcttgccgcaaggcacca

SEQ ID NO: 28833 - DNA, 18 bp, Artificial sequence
  synthetic polynucleotide sequence
gccgtgggcatcaccaca

SEQ ID NO: 28834 - DNA, 20 bp, Artificial sequence
  synthetic polynucleotide sequence
gaggaagcaggtgaagagca

SEQ ID NO: 28835 - DNA, 22 bp, Artificial sequence
  synthetic polynucleotide sequence
tacagccaaacaactcggagca

SEQ ID NO: 28836 - DNA, 21 bp, Artificial sequence
  synthetic polynucleotide sequence
ccaccaagatctcctggccca

SEQ ID NO: 28837 - DNA, 20 bp, Artificial sequence
  synthetic polynucleotide sequence
tgggcccgggtgcgaatcca

SEQ ID NO: 28838 - DNA, 20 bp, Artificial sequence
  synthetic polynucleotide sequence
ggaggctcacagaggaagca

SEQ ID NO: 28839 - DNA, 19 bp, Artificial sequence
  synthetic polynucleotide sequence
gcaggccacacagaccgca

SEQ ID NO: 28840 - DNA, 20 bp, Artificial sequence
  synthetic polynucleotide sequence
actccttgctgagccgcaca

SEQ ID NO: 28841 - DNA, 18 bp, Artificial sequence
  synthetic polynucleotide sequence
ccggcagcacaagaccaa

SEQ ID NO: 28842 - DNA, 19 bp, Artificial sequence
  synthetic polynucleotide sequence
ccatctgccagtccaggga

SEQ ID NO: 28843 - DNA, 22 bp, Artificial sequence
  synthetic polynucleotide sequence
acatcaacttcaggaggctgga

SEQ ID NO: 28844 - DNA, 22 bp, Artificial sequence
  synthetic polynucleotide sequence
tagatccctttcaccaccgaga

SEQ ID NO: 28845 - DNA, 18 bp, Artificial sequence
  synthetic polynucleotide sequence
agcgcttagaagccggga

SEQ ID NO: 28846 - DNA, 20 bp, Artificial sequence
  synthetic polynucleotide sequence
gacgcccttcacagtggaga

SEQ ID NO: 28847 - DNA, 20 bp, Artificial sequence
  synthetic polynucleotide sequence
ccgttcaagcctgaccccca

SEQ ID NO: 28848 - DNA, 19 bp, Artificial sequence
  synthetic polynucleotide sequence
tggaagcactcggtctcca

SEQ ID NO: 28849 - DNA, 22 bp, Artificial sequence
  synthetic polynucleotide sequence
agctggcctaattgaaccccca

SEQ ID NO: 28850 - DNA, 20 bp, Artificial sequence
  synthetic polynucleotide sequence
taccctcctcacaacccgta

SEQ ID NO: 28851 - DNA, 20 bp, Artificial sequence
  synthetic polynucleotide sequence
tactgtaccgggacacacca

SEQ ID NO: 28852 - DNA, 18 bp, Artificial sequence
  synthetic polynucleotide sequence
atcgcagaggagaggcca

SEQ ID NO: 28853 - DNA, 18 bp, Artificial sequence
  synthetic polynucleotide sequence
cttcgaactgccccagga

SEQ ID NO: 28854 - DNA, 20 bp, Artificial sequence
  synthetic polynucleotide sequence
gaggaagacaccacccagca

SEQ ID NO: 28855 - DNA, 20 bp, Artificial sequence
  synthetic polynucleotide sequence
cagccctgctgaccaagaca

SEQ ID NO: 28856 - DNA, 19 bp, Artificial sequence
  synthetic polynucleotide sequence
tgcaccaggatcagaccca

SEQ ID NO: 28857 - DNA, 20 bp, Artificial sequence
  synthetic polynucleotide sequence
gtggtggacttccaggacca

SEQ ID NO: 28858 - DNA, 18 bp, Artificial sequence
  synthetic polynucleotide sequence
acacggtgcacgtgacca

SEQ ID NO: 28859 - DNA, 19 bp, Artificial sequence
  synthetic polynucleotide sequence
ccaagccagacctggagga

SEQ ID NO: 28860 - DNA, 18 bp, Artificial sequence
  synthetic polynucleotide sequence
agagggccgactcggaca

SEQ ID NO: 28861 - DNA, 20 bp, Artificial sequence
  synthetic polynucleotide sequence
gcggtacaacaacacgccca

SEQ ID NO: 28862 - DNA, 20 bp, Artificial sequence
  synthetic polynucleotide sequence
aggctcagccaccatgagga

SEQ ID NO: 28863 - DNA, 22 bp, Artificial sequence
  synthetic polynucleotide sequence
atccgctacaatgacacgccca

SEQ ID NO: 28864 - DNA, 22 bp, Artificial sequence
  synthetic polynucleotide sequence
aagcccaagaaaactcgccgga

SEQ ID NO: 28865 - DNA, 18 bp, Artificial sequence
  synthetic polynucleotide sequence
agcctgccgtgtaagcca

SEQ ID NO: 28866 - DNA, 18 bp, Artificial sequence
  synthetic polynucleotide sequence
caccacagcccagggaga

SEQ ID NO: 28867 - DNA, 18 bp, Artificial sequence
  synthetic polynucleotide sequence
ctgccgagacaaccgaca

SEQ ID NO: 28868 - DNA, 18 bp, Artificial sequence
  synthetic polynucleotide sequence
gcggaagccagcaggaca

SEQ ID NO: 28869 - DNA, 18 bp, Artificial sequence
  synthetic polynucleotide sequence
ggccctgggcaatcagca

SEQ ID NO: 28870 - DNA, 20 bp, Artificial sequence
  synthetic polynucleotide sequence
cacgttgagaacctggagca

SEQ ID NO: 28871 - DNA, 18 bp, Artificial sequence
  synthetic polynucleotide sequence
gaaccctgtcggagccaa

SEQ ID NO: 28872 - DNA, 18 bp, Artificial sequence
  synthetic polynucleotide sequence
ggtctcagagtgcgccca

SEQ ID NO: 28873 - DNA, 20 bp, Artificial sequence
  synthetic polynucleotide sequence
ccgcgtgggagagcaaggga

SEQ ID NO: 28874 - DNA, 20 bp, Artificial sequence
  synthetic polynucleotide sequence
gttcagcaagagggggccca

SEQ ID NO: 28875 - DNA, 20 bp, Artificial sequence
  synthetic polynucleotide sequence
agctgtgccccatacccaca

SEQ ID NO: 28876 - DNA, 21 bp, Artificial sequence
  synthetic polynucleotide sequence
gatgacatgattggggagcca

SEQ ID NO: 28877 - DNA, 19 bp, Artificial sequence
  synthetic polynucleotide sequence
tgcctaaggaggtgccaga

SEQ ID NO: 28878 - DNA, 22 bp, Artificial sequence
  synthetic polynucleotide sequence
cctatgatgaacgtgggaccga

SEQ ID NO: 28879 - DNA, 21 bp, Artificial sequence
  synthetic polynucleotide sequence
ggaggacgccatcaggacaga

SEQ ID NO: 28880 - DNA, 20 bp, Artificial sequence
  synthetic polynucleotide sequence
atggtgcccatatgccagca

SEQ ID NO: 28881 - DNA, 20 bp, Artificial sequence
  synthetic polynucleotide sequence
cacacacgctctgtggagga

SEQ ID NO: 28882 - DNA, 18 bp, Artificial sequence
  synthetic polynucleotide sequence
ggatgtcccagatgcgga

SEQ ID NO: 28883 - DNA, 18 bp, Artificial sequence
  synthetic polynucleotide sequence
actgccgagggtcgggca

SEQ ID NO: 28884 - DNA, 18 bp, Artificial sequence
  synthetic polynucleotide sequence
tgcaggcagggcacctca

SEQ ID NO: 28885 - DNA, 21 bp, Artificial sequence
  synthetic polynucleotide sequence
gtctgcggcatacgtgaggaa

SEQ ID NO: 28886 - DNA, 21 bp, Artificial sequence
  synthetic polynucleotide sequence
gctcagacaccatcagcccca

SEQ ID NO: 28887 - DNA, 19 bp, Artificial sequence
  synthetic polynucleotide sequence
ccctacatgaacgtgggca

SEQ ID NO: 28888 - DNA, 21 bp, Artificial sequence
  synthetic polynucleotide sequence
tcctggaagaggttctcgaga

SEQ ID NO: 28889 - DNA, 20 bp, Artificial sequence
  synthetic polynucleotide sequence
gagcagctgcaggcgctcga

SEQ ID NO: 28890 - DNA, 20 bp, Artificial sequence
  synthetic polynucleotide sequence
aggagcctcgcggaagccga

SEQ ID NO: 28891 - DNA, 20 bp, Artificial sequence
  synthetic polynucleotide sequence
gaggagctgaccctcacgga

SEQ ID NO: 28892 - DNA, 20 bp, Artificial sequence
  synthetic polynucleotide sequence
aagagcacagaggcgaggga

SEQ ID NO: 28893 - DNA, 22 bp, Artificial sequence
  synthetic polynucleotide sequence
gcaaggaggatattcggcagga

SEQ ID NO: 28894 - DNA, 19 bp, Artificial sequence
  synthetic polynucleotide sequence
ttgcacgcgcttctaccaa

SEQ ID NO: 28895 - DNA, 22 bp, Artificial sequence
  synthetic polynucleotide sequence
aacttcagatacccctggagca

SEQ ID NO: 28896 - DNA, 21 bp, Artificial sequence
  synthetic polynucleotide sequence
tccagctccatcctaaggcca

SEQ ID NO: 28897 - DNA, 21 bp, Artificial sequence
  synthetic polynucleotide sequence
tgggcagcctcttggagcaga

SEQ ID NO: 28898 - DNA, 20 bp, Artificial sequence
  synthetic polynucleotide sequence
ccagggaggcgtagagtgca

SEQ ID NO: 28899 - DNA, 18 bp, Artificial sequence
  synthetic polynucleotide sequence
gctccgtgccatgaagca

SEQ ID NO: 28900 - DNA, 18 bp, Artificial sequence
  synthetic polynucleotide sequence
ccaaccggcttctccaca

SEQ ID NO: 28901 - DNA, 21 bp, Artificial sequence
  synthetic polynucleotide sequence
ggtccagaagactggagacca

SEQ ID NO: 28902 - DNA, 19 bp, Artificial sequence
  synthetic polynucleotide sequence
tgaaggtggtgacagccga

SEQ ID NO: 28903 - DNA, 21 bp, Artificial sequence
  synthetic polynucleotide sequence
catcgacgggctcaagctcaa

SEQ ID NO: 28904 - DNA, 20 bp, Artificial sequence
  synthetic polynucleotide sequence
gaggctcacggtgacctgga

SEQ ID NO: 28905 - DNA, 20 bp, Artificial sequence
  synthetic polynucleotide sequence
gcacagaacggcagtcggca

SEQ ID NO: 28906 - DNA, 21 bp, Artificial sequence
  synthetic polynucleotide sequence
gcttgttcagcagggcaagga

SEQ ID NO: 28907 - DNA, 21 bp, Artificial sequence
  synthetic polynucleotide sequence
accgagacttacactggggga

SEQ ID NO: 28908 - DNA, 20 bp, Artificial sequence
  synthetic polynucleotide sequence
ccatcccgttccaagcgcga

SEQ ID NO: 28909 - DNA, 18 bp, Artificial sequence
  synthetic polynucleotide sequence
gcgatgtctgggaaccca

SEQ ID NO: 28910 - DNA, 20 bp, Artificial sequence
  synthetic polynucleotide sequence
ctggggacctcaagtgagga

SEQ ID NO: 28911 - DNA, 20 bp, Artificial sequence
  synthetic polynucleotide sequence
ctcggtactatagggcacca

SEQ ID NO: 28912 - DNA, 20 bp, Artificial sequence
  synthetic polynucleotide sequence
ctaccaactgatccacacca

SEQ ID NO: 28913 - DNA, 21 bp, Artificial sequence
  synthetic polynucleotide sequence
aactcactgaagcagggctca

SEQ ID NO: 28914 - DNA, 18 bp, Artificial sequence
  synthetic polynucleotide sequence
ctcggtaggcggggctga

SEQ ID NO: 28915 - DNA, 21 bp, Artificial sequence
  synthetic polynucleotide sequence
tgggaggtacccctgtccaga

SEQ ID NO: 28916 - DNA, 20 bp, Artificial sequence
  synthetic polynucleotide sequence
cagtgcaccagccttaggca

SEQ ID NO: 28917 - DNA, 20 bp, Artificial sequence
  synthetic polynucleotide sequence
ccgccagaggaaagtgccca

SEQ ID NO: 28918 - DNA, 20 bp, Artificial sequence
  synthetic polynucleotide sequence
gccagcatctacgtgcccaa

SEQ ID NO: 28919 - DNA, 21 bp, Artificial sequence
  synthetic polynucleotide sequence
gcccccagaagaaagtggcca

SEQ ID NO: 28920 - DNA, 20 bp, Artificial sequence
  synthetic polynucleotide sequence
gccagcgtctacatggccaa

SEQ ID NO: 28921 - DNA, 19 bp, Artificial sequence
  synthetic polynucleotide sequence
taccccgatgtatcacgca

SEQ ID NO: 28922 - DNA, 18 bp, Artificial sequence
  synthetic polynucleotide sequence
cacacccaagtccctgca

SEQ ID NO: 28923 - DNA, 19 bp, Artificial sequence
  synthetic polynucleotide sequence
gtgcagcaggagctaagca

SEQ ID NO: 28924 - DNA, 18 bp, Artificial sequence
  synthetic polynucleotide sequence
aaccggctaggggcagca

SEQ ID NO: 28925 - DNA, 20 bp, Artificial sequence
  synthetic polynucleotide sequence
acggggcagaatggagtcca

SEQ ID NO: 28926 - DNA, 21 bp, Artificial sequence
  synthetic polynucleotide sequence
gtctgcaccagcttcatccca

SEQ ID NO: 28927 - DNA, 21 bp, Artificial sequence
  synthetic polynucleotide sequence
tacggggcagaatggagtcca

SEQ ID NO: 28928 - DNA, 21 bp, Artificial sequence
  synthetic polynucleotide sequence
gtctgcaccagcttcatccca

SEQ ID NO: 28929 - DNA, 22 bp, Artificial sequence
  synthetic polynucleotide sequence
aagttggtacagaccagagcca

SEQ ID NO: 28930 - DNA, 21 bp, Artificial sequence
  synthetic polynucleotide sequence
cctcaggtcgacataagggca

SEQ ID NO: 28931 - DNA, 20 bp, Artificial sequence
  synthetic polynucleotide sequence
aatcagctgagccttgcaga

SEQ ID NO: 28932 - DNA, 20 bp, Artificial sequence
  synthetic polynucleotide sequence
gaggcttcttcttgctgcca

SEQ ID NO: 28933 - DNA, 20 bp, Artificial sequence
  synthetic polynucleotide sequence
cagcagtcagcccaaaggaa

SEQ ID NO: 28934 - DNA, 20 bp, Artificial sequence
  synthetic polynucleotide sequence
aacctgacatgatggcagca

SEQ ID NO: 28935 - DNA, 19 bp, Artificial sequence
  synthetic polynucleotide sequence
ggcagcctgcagatacgga

SEQ ID NO: 28936 - DNA, 18 bp, Artificial sequence
  synthetic polynucleotide sequence
agcagctccatccggtca

SEQ ID NO: 28937 - DNA, 20 bp, Artificial sequence
  synthetic polynucleotide sequence
caaccatatgcagctgggca

SEQ ID NO: 28938 - DNA, 18 bp, Artificial sequence
  synthetic polynucleotide sequence
tgggaaggcgtccaagca

SEQ ID NO: 28939 - DNA, 18 bp, Artificial sequence
  synthetic polynucleotide sequence
cctgcaggcactccctga

SEQ ID NO: 28940 - DNA, 18 bp, Artificial sequence
  synthetic polynucleotide sequence
tgggaaggcatccaggca

SEQ ID NO: 28941 - DNA, 18 bp, Artificial sequence
  synthetic polynucleotide sequence
tcgaagccaatggctgga

SEQ ID NO: 28942 - DNA, 18 bp, Artificial sequence
  synthetic polynucleotide sequence
tgcgagcgatgtagcgca

SEQ ID NO: 28943 - DNA, 21 bp, Artificial sequence
  synthetic polynucleotide sequence
gtggggagacagaagaggaga

SEQ ID NO: 28944 - DNA, 22 bp, Artificial sequence
  synthetic polynucleotide sequence
tcaaagtcagggctgtagcaga

SEQ ID NO: 28945 - DNA, 21 bp, Artificial sequence
  synthetic polynucleotide sequence
gcgctacattgcccgcaagca

SEQ ID NO: 28946 - DNA, 22 bp, Artificial sequence
  synthetic polynucleotide sequence
tagcacagtctgaccagctcca

SEQ ID NO: 28947 - DNA, 22 bp, Artificial sequence
  synthetic polynucleotide sequence
gaaaacagtcagggtcagctga

SEQ ID NO: 28948 - DNA, 18 bp, Artificial sequence
  synthetic polynucleotide sequence
cataggggtcatccggca

SEQ ID NO: 28949 - DNA, 20 bp, Artificial sequence
  synthetic polynucleotide sequence
ctgtcctggagaccagccaa

SEQ ID NO: 28950 - DNA, 21 bp, Artificial sequence
  synthetic polynucleotide sequence
tcccacatctcaacgctacca

SEQ ID NO: 28951 - DNA, 18 bp, Artificial sequence
  synthetic polynucleotide sequence
cctcttccaggaggccca

SEQ ID NO: 28952 - DNA, 18 bp, Artificial sequence
  synthetic polynucleotide sequence
tggccagcacccagggca

SEQ ID NO: 28953 - DNA, 20 bp, Artificial sequence
  synthetic polynucleotide sequence
gaaggtggaacgcaacagga

SEQ ID NO: 28954 - DNA, 18 bp, Artificial sequence
  synthetic polynucleotide sequence
tcagctcctccagggcca

SEQ ID NO: 28955 - DNA, 21 bp, Artificial sequence
  synthetic polynucleotide sequence
agcatggcgtggacgagtgga

SEQ ID NO: 28956 - DNA, 19 bp, Artificial sequence
  synthetic polynucleotide sequence
tcgaagcagcatagcctga

SEQ ID NO: 28957 - DNA, 21 bp, Artificial sequence
  synthetic polynucleotide sequence
gtgtaggagacgaggtgacca

SEQ ID NO: 28958 - DNA, 21 bp, Artificial sequence
  synthetic polynucleotide sequence
atggtagggtagggggtgaga

SEQ ID NO: 28959 - DNA, 21 bp, Artificial sequence
  synthetic polynucleotide sequence
agaaccgccgagtgaagcaca

SEQ ID NO: 28960 - DNA, 20 bp, Artificial sequence
  synthetic polynucleotide sequence
tcggagcacttggctgagga

SEQ ID NO: 28961 - DNA, 20 bp, Artificial sequence
  synthetic polynucleotide sequence
gaagggcacgcagaggaaca

SEQ ID NO: 28962 - DNA, 19 bp, Artificial sequence
  synthetic polynucleotide sequence
ctgaggccggcgacaggga

SEQ ID NO: 28963 - DNA, 22 bp, Artificial sequence
  synthetic polynucleotide sequence
gcatcatcagacccaagtgcca

SEQ ID NO: 28964 - DNA, 20 bp, Artificial sequence
  synthetic polynucleotide sequence
gtcgtgcagtatcaaggcca

SEQ ID NO: 28965 - DNA, 20 bp, Artificial sequence
  synthetic polynucleotide sequence
cagcaagcgcagacccagca

SEQ ID NO: 28966 - DNA, 21 bp, Artificial sequence
  synthetic polynucleotide sequence
cacctgaagaagctggcctga

SEQ ID NO: 28967 - DNA, 22 bp, Artificial sequence
  synthetic polynucleotide sequence
gacagagacttctggaagagca

SEQ ID NO: 28968 - DNA, 21 bp, Artificial sequence
  synthetic polynucleotide sequence
tctactggcccagaaggtaga

SEQ ID NO: 28969 - DNA, 21 bp, Artificial sequence
  synthetic polynucleotide sequence
tgggaaacagtcttcaggaga

SEQ ID NO: 28970 - DNA, 18 bp, Artificial sequence
  synthetic polynucleotide sequence
tcctgaccctctgagcca

SEQ ID NO: 28971 - DNA, 22 bp, Artificial sequence
  synthetic polynucleotide sequence
aagagcctgaagggaagagcta

SEQ ID NO: 28972 - DNA, 22 bp, Artificial sequence
  synthetic polynucleotide sequence
aaaggttggaacagaacctgga

SEQ ID NO: 28973 - DNA, 18 bp, Artificial sequence
  synthetic polynucleotide sequence
tctccaccccgtccggca

SEQ ID NO: 28974 - DNA, 20 bp, Artificial sequence
  synthetic polynucleotide sequence
tgtaggagaacggacggcca

SEQ ID NO: 28975 - DNA, 21 bp, Artificial sequence
  synthetic polynucleotide sequence
tcaaggctttgggggaccaga

SEQ ID NO: 28976 - DNA, 22 bp, Artificial sequence
  synthetic polynucleotide sequence
tctacagtgacactcctccaca

SEQ ID NO: 28977 - DNA, 18 bp, Artificial sequence
  synthetic polynucleotide sequence
cgcaggagaagaagcgca

SEQ ID NO: 28978 - DNA, 18 bp, Artificial sequence
  synthetic polynucleotide sequence
cgccatgaagagggctga

SEQ ID NO: 28979 - DNA, 20 bp, Artificial sequence
  synthetic polynucleotide sequence
tgggaaactgcggattgcca

SEQ ID NO: 28980 - DNA, 20 bp, Artificial sequence
  synthetic polynucleotide sequence
tcactggcagctggtcggca

SEQ ID NO: 28981 - DNA, 20 bp, Artificial sequence
  synthetic polynucleotide sequence
gtgcgtcaaaagaagcagga

SEQ ID NO: 28982 - DNA, 20 bp, Artificial sequence
  synthetic polynucleotide sequence
gtcccctgcatgtaggacca

SEQ ID NO: 28983 - DNA, 22 bp, Artificial sequence
  synthetic polynucleotide sequence
ctaagcgatgggaaggaggcta

SEQ ID NO: 28984 - DNA, 21 bp, Artificial sequence
  synthetic polynucleotide sequence
ctaccacataaaggtggcgca

SEQ ID NO: 28985 - DNA, 20 bp, Artificial sequence
  synthetic polynucleotide sequence
gcagaagacagtgcgttgca

SEQ ID NO: 28986 - DNA, 21 bp, Artificial sequence
  synthetic polynucleotide sequence
gaagagaaggcatctgaggca

SEQ ID NO: 28987 - DNA, 21 bp, Artificial sequence
  synthetic polynucleotide sequence
agcaggcaatcgccagtggca

SEQ ID NO: 28988 - DNA, 18 bp, Artificial sequence
  synthetic polynucleotide sequence
cggtgatggtggggggca

SEQ ID NO: 28989 - DNA, 21 bp, Artificial sequence
  synthetic polynucleotide sequence
tgagtccaatgccctggggaa

SEQ ID NO: 28990 - DNA, 19 bp, Artificial sequence
  synthetic polynucleotide sequence
tcacccactcgctcctgga

SEQ ID NO: 28991 - DNA, 22 bp, Artificial sequence
  synthetic polynucleotide sequence
atgagaagatgctgcgagacca

SEQ ID NO: 28992 - DNA, 20 bp, Artificial sequence
  synthetic polynucleotide sequence
taccatcacacgaccaccta

SEQ ID NO: 28993 - DNA, 18 bp, Artificial sequence
  synthetic polynucleotide sequence
catcaacacgctccggga

SEQ ID NO: 28994 - DNA, 18 bp, Artificial sequence
  synthetic polynucleotide sequence
tccgcttcagcttgggga

SEQ ID NO: 28995 - DNA, 22 bp, Artificial sequence
  synthetic polynucleotide sequence
gcaacacggtcctgaagacgaa

SEQ ID NO: 28996 - DNA, 21 bp, Artificial sequence
  synthetic polynucleotide sequence
aatggagaacagctgttcgca

SEQ ID NO: 28997 - DNA, 21 bp, Artificial sequence
  synthetic polynucleotide sequence
tctctccaaggacactcccaa

SEQ ID NO: 28998 - DNA, 20 bp, Artificial sequence
  synthetic polynucleotide sequence
cagggtgggaaagtgggcca

SEQ ID NO: 28999 - DNA, 21 bp, Artificial sequence
  synthetic polynucleotide sequence
tgtccaagagaaggctgtgga

SEQ ID NO: 29000 - DNA, 22 bp, Artificial sequence
  synthetic polynucleotide sequence
tatccactgagatgagaggcca

SEQ ID NO: 29001 - DNA, 18 bp, Artificial sequence
  synthetic polynucleotide sequence
aggcacagctcaggccaa

SEQ ID NO: 29002 - DNA, 18 bp, Artificial sequence
  synthetic polynucleotide sequence
cagacaggttccgcacca

SEQ ID NO: 29003 - DNA, 20 bp, Artificial sequence
  synthetic polynucleotide sequence
taactcacccctgcagcgga

SEQ ID NO: 29004 - DNA, 20 bp, Artificial sequence
  synthetic polynucleotide sequence
gtagggaagcagccaggcca

SEQ ID NO: 29005 - DNA, 18 bp, Artificial sequence
  synthetic polynucleotide sequence
cgcactcaccctgacgaa

SEQ ID NO: 29006 - DNA, 20 bp, Artificial sequence
  synthetic polynucleotide sequence
cacaagtggagggagctcca

SEQ ID NO: 29007 - DNA, 20 bp, Artificial sequence
  synthetic polynucleotide sequence
ctgcacacctggatcacaga

SEQ ID NO: 29008 - DNA, 20 bp, Artificial sequence
  synthetic polynucleotide sequence
gttaagaagcaccggagcca

SEQ ID NO: 29009 - DNA, 18 bp, Artificial sequence
  synthetic polynucleotide sequence
gcaatgacggggcagaga

SEQ ID NO: 29010 - DNA, 18 bp, Artificial sequence
  synthetic polynucleotide sequence
caggcctcttggagcgga

SEQ ID NO: 29011 - DNA, 21 bp, Artificial sequence
  synthetic polynucleotide sequence
agacgaggaagaggaggagca

SEQ ID NO: 29012 - DNA, 22 bp, Artificial sequence
  synthetic polynucleotide sequence
catactccccagcaaagacaca

SEQ ID NO: 29013 - DNA, 20 bp, Artificial sequence
  synthetic polynucleotide sequence
cagcctggagtggaccaaga

SEQ ID NO: 29014 - DNA, 20 bp, Artificial sequence
  synthetic polynucleotide sequence
ggcctgtcatgccgaagaca

SEQ ID NO: 29015 - DNA, 21 bp, Artificial sequence
  synthetic polynucleotide sequence
tgggttgtagcccagaacaga

SEQ ID NO: 29016 - DNA, 19 bp, Artificial sequence
  synthetic polynucleotide sequence
tgctcctactccagccaca

SEQ ID NO: 29017 - DNA, 18 bp, Artificial sequence
  synthetic polynucleotide sequence
catgcagcagctgacgga

SEQ ID NO: 29018 - DNA, 21 bp, Artificial sequence
  synthetic polynucleotide sequence
gccagtgtagcagcctgacca

SEQ ID NO: 29019 - DNA, 21 bp, Artificial sequence
  synthetic polynucleotide sequence
ctgaggaaggagctagctgca

SEQ ID NO: 29020 - DNA, 20 bp, Artificial sequence
  synthetic polynucleotide sequence
gtagtggccgagggcatcca

SEQ ID NO: 29021 - DNA, 21 bp, Artificial sequence
  synthetic polynucleotide sequence
gcccattacgcagtccaggca

SEQ ID NO: 29022 - DNA, 21 bp, Artificial sequence
  synthetic polynucleotide sequence
ggagttcgagagcaactccca

SEQ ID NO: 29023 - DNA, 19 bp, Artificial sequence
  synthetic polynucleotide sequence
ccctggaagacgtggccca

SEQ ID NO: 29024 - DNA, 20 bp, Artificial sequence
  synthetic polynucleotide sequence
tgcaggccacgcagcgtgga

SEQ ID NO: 29025 - DNA, 20 bp, Artificial sequence
  synthetic polynucleotide sequence
cttcacggccactgaacgga

SEQ ID NO: 29026 - DNA, 20 bp, Artificial sequence
  synthetic polynucleotide sequence
acacacctctggccgcggaa

SEQ ID NO: 29027 - DNA, 22 bp, Artificial sequence
  synthetic polynucleotide sequence
aaacttacaccgactccctgga

SEQ ID NO: 29028 - DNA, 21 bp, Artificial sequence
  synthetic polynucleotide sequence
tggtggcgagcattgaaggga

SEQ ID NO: 29029 - DNA, 21 bp, Artificial sequence
  synthetic polynucleotide sequence
caccgaatcccactcagcaga

SEQ ID NO: 29030 - DNA, 19 bp, Artificial sequence
  synthetic polynucleotide sequence
tgatggggaccacgtggca

SEQ ID NO: 29031 - DNA, 21 bp, Artificial sequence
  synthetic polynucleotide sequence
gactgcagaggagttcaccga

SEQ ID NO: 29032 - DNA, 21 bp, Artificial sequence
  synthetic polynucleotide sequence
gtgtcagtgtgtccaggagca

SEQ ID NO: 29033 - DNA, 20 bp, Artificial sequence
  synthetic polynucleotide sequence
cagctgctcacacccgagga

SEQ ID NO: 29034 - DNA, 20 bp, Artificial sequence
  synthetic polynucleotide sequence
cccacttgtcccgacgggca

SEQ ID NO: 29035 - DNA, 21 bp, Artificial sequence
  synthetic polynucleotide sequence
caagccctcaatggccagcaa

SEQ ID NO: 29036 - DNA, 21 bp, Artificial sequence
  synthetic polynucleotide sequence
cctagaccagccttgtcagga

SEQ ID NO: 29037 - DNA, 20 bp, Artificial sequence
  synthetic polynucleotide sequence
ggagcccaatgcccaggaga

SEQ ID NO: 29038 - DNA, 17 bp, Artificial sequence
  synthetic polynucleotide sequence
cggaggggaggcaggca

SEQ ID NO: 29039 - DNA, 20 bp, Artificial sequence
  synthetic polynucleotide sequence
ccgggtccagctggaatcca

SEQ ID NO: 29040 - DNA, 20 bp, Artificial sequence
  synthetic polynucleotide sequence
gaagcctcctgcgaggcgca

SEQ ID NO: 29041 - DNA, 21 bp, Artificial sequence
  synthetic polynucleotide sequence
ccagcagctctaccactggga

SEQ ID NO: 29042 - DNA, 21 bp, Artificial sequence
  synthetic polynucleotide sequence
agtggtgcatcaggtaggcca

SEQ ID NO: 29043 - DNA, 20 bp, Artificial sequence
  synthetic polynucleotide sequence
ctggtgatgtagcccagcaa

SEQ ID NO: 29044 - DNA, 20 bp, Artificial sequence
  synthetic polynucleotide sequence
gcatgggagtacactgggca

SEQ ID NO: 29045 - DNA, 18 bp, Artificial sequence
  synthetic polynucleotide sequence
cagctgtggcaagggcaa

SEQ ID NO: 29046 - DNA, 18 bp, Artificial sequence
  synthetic polynucleotide sequence
gatgacctgcagcggtga

SEQ ID NO: 29047 - DNA, 18 bp, Artificial sequence
  synthetic polynucleotide sequence
gaatcacgcatcagccca

SEQ ID NO: 29048 - DNA, 18 bp, Artificial sequence
  synthetic polynucleotide sequence
caggctggagctggggga

SEQ ID NO: 29049 - DNA, 20 bp, Artificial sequence
  synthetic polynucleotide sequence
agagggacagggctgacaga

SEQ ID NO: 29050 - DNA, 21 bp, Artificial sequence
  synthetic polynucleotide sequence
ccaccatgtacgcatcaccga

SEQ ID NO: 29051 - DNA, 20 bp, Artificial sequence
  synthetic polynucleotide sequence
cgcggcagagatcgccaaca

SEQ ID NO: 29052 - DNA, 20 bp, Artificial sequence
  synthetic polynucleotide sequence
ccacgcctgccacgcatgga

SEQ ID NO: 29053 - DNA, 21 bp, Artificial sequence
  synthetic polynucleotide sequence
tgagagctccaagaggcagca

SEQ ID NO: 29054 - DNA, 21 bp, Artificial sequence
  synthetic polynucleotide sequence
tggagacattctggaggggca

SEQ ID NO: 29055 - DNA, 21 bp, Artificial sequence
  synthetic polynucleotide sequence
ttgcacacgtggatcatggca

SEQ ID NO: 29056 - DNA, 22 bp, Artificial sequence
  synthetic polynucleotide sequence
gtaaaacaccctggcaagcaga

SEQ ID NO: 29057 - DNA, 18 bp, Artificial sequence
  synthetic polynucleotide sequence
cggcgacttcatcgagca

SEQ ID NO: 29058 - DNA, 18 bp, Artificial sequence
  synthetic polynucleotide sequence
gcacaccctgcaggtcca

SEQ ID NO: 29059 - DNA, 18 bp, Artificial sequence
  synthetic polynucleotide sequence
cagcacctccagcaggca

SEQ ID NO: 29060 - DNA, 18 bp, Artificial sequence
  synthetic polynucleotide sequence
tgccattgcgagtaggca

SEQ ID NO: 29061 - DNA, 22 bp, Artificial sequence
  synthetic polynucleotide sequence
tgactgagggatggagggaaga

SEQ ID NO: 29062 - DNA, 23 bp, Artificial sequence
  synthetic polynucleotide sequence
gatcagaaggttggaggagtaga

SEQ ID NO: 29063 - DNA, 19 bp, Artificial sequence
  synthetic polynucleotide sequence
cctgagcacgaaatcccca

SEQ ID NO: 29064 - DNA, 20 bp, Artificial sequence
  synthetic polynucleotide sequence
caacatgtcctcccaagcca

SEQ ID NO: 29065 - DNA, 20 bp, Artificial sequence
  synthetic polynucleotide sequence
gccacccctcaggtctcaga

SEQ ID NO: 29066 - DNA, 22 bp, Artificial sequence
  synthetic polynucleotide sequence
agctttgtcagcgtgacaccca

SEQ ID NO: 29067 - DNA, 20 bp, Artificial sequence
  synthetic polynucleotide sequence
gtcgaccacagacatccaca

SEQ ID NO: 29068 - DNA, 19 bp, Artificial sequence
  synthetic polynucleotide sequence
tctggtagaccgtccacca

SEQ ID NO: 29069 - DNA, 22 bp, Artificial sequence
  synthetic polynucleotide sequence
aaacgggacacatatgcagcca

SEQ ID NO: 29070 - DNA, 20 bp, Artificial sequence
  synthetic polynucleotide sequence
atcagtcggcgaataccgta

SEQ ID NO: 29071 - DNA, 22 bp, Artificial sequence
  synthetic polynucleotide sequence
accactgaggtggcaatgcaca

SEQ ID NO: 29072 - DNA, 22 bp, Artificial sequence
  synthetic polynucleotide sequence
actacaggagctggtacagtga

SEQ ID NO: 29073 - DNA, 20 bp, Artificial sequence
  synthetic polynucleotide sequence
cacccccaccataatggaca

SEQ ID NO: 29074 - DNA, 18 bp, Artificial sequence
  synthetic polynucleotide sequence
gccggtacatgtagcgca

SEQ ID NO: 29075 - DNA, 20 bp, Artificial sequence
  synthetic polynucleotide sequence
tgcactaacttcaggagcca

SEQ ID NO: 29076 - DNA, 18 bp, Artificial sequence
  synthetic polynucleotide sequence
cgagccatcgcccaccaa

SEQ ID NO: 29077 - DNA, 18 bp, Artificial sequence
  synthetic polynucleotide sequence
cgcaacatccgtgcacca

SEQ ID NO: 29078 - DNA, 18 bp, Artificial sequence
  synthetic polynucleotide sequence
gaggtggccgtgtccaca

SEQ ID NO: 29079 - DNA, 20 bp, Artificial sequence
  synthetic polynucleotide sequence
caccaccaacgacagaagga

SEQ ID NO: 29080 - DNA, 19 bp, Artificial sequence
  synthetic polynucleotide sequence
ctgaggactggaggcctga

SEQ ID NO: 29081 - DNA, 22 bp, Artificial sequence
  synthetic polynucleotide sequence
aacctggctgcagtccaagaca

SEQ ID NO: 29082 - DNA, 20 bp, Artificial sequence
  synthetic polynucleotide sequence
actgatggtggtggccagga

SEQ ID NO: 29083 - DNA, 21 bp, Artificial sequence
  synthetic polynucleotide sequence
gaggtggaagagactcgtgca

SEQ ID NO: 29084 - DNA, 18 bp, Artificial sequence
  synthetic polynucleotide sequence
cccacgagggtctccgca

SEQ ID NO: 29085 - DNA, 22 bp, Artificial sequence
  synthetic polynucleotide sequence
gcaggaagatcgaaagtgcgaa

SEQ ID NO: 29086 - DNA, 22 bp, Artificial sequence
  synthetic polynucleotide sequence
gttacacacaagagggcctcca

SEQ ID NO: 29087 - DNA, 20 bp, Artificial sequence
  synthetic polynucleotide sequence
gaggagatcatcgggggcca

SEQ ID NO: 29088 - DNA, 19 bp, Artificial sequence
  synthetic polynucleotide sequence
tctcactaggatgccgcca

SEQ ID NO: 29089 - DNA, 22 bp, Artificial sequence
  synthetic polynucleotide sequence
gccaaagttactacaacggcga

SEQ ID NO: 29090 - DNA, 20 bp, Artificial sequence
  synthetic polynucleotide sequence
cagatcaaggggccccctga

SEQ ID NO: 29091 - DNA, 18 bp, Artificial sequence
  synthetic polynucleotide sequence
tcaagcgcctggtcacca

SEQ ID NO: 29092 - DNA, 20 bp, Artificial sequence
  synthetic polynucleotide sequence
ctcttggctagccggaagga

SEQ ID NO: 29093 - DNA, 18 bp, Artificial sequence
  synthetic polynucleotide sequence
cctgggcccagtggcgaa

SEQ ID NO: 29094 - DNA, 21 bp, Artificial sequence
  synthetic polynucleotide sequence
tctgagcacggagcttgagca

SEQ ID NO: 29095 - DNA, 18 bp, Artificial sequence
  synthetic polynucleotide sequence
gcaggggccaaacaccaa

SEQ ID NO: 29096 - DNA, 18 bp, Artificial sequence
  synthetic polynucleotide sequence
gccttgatgggcagccca

SEQ ID NO: 29097 - DNA, 19 bp, Artificial sequence
  synthetic polynucleotide sequence
gtaggctgggcgagcgcaa

SEQ ID NO: 29098 - DNA, 21 bp, Artificial sequence
  synthetic polynucleotide sequence
tacttgaggtaggtgcgccca

SEQ ID NO: 29099 - DNA, 19 bp, Artificial sequence
  synthetic polynucleotide sequence
tttcagtgagccaggtgga

SEQ ID NO: 29100 - DNA, 18 bp, Artificial sequence
  synthetic polynucleotide sequence
ccgggaccttggccgtca

SEQ ID NO: 29101 - DNA, 18 bp, Artificial sequence
  synthetic polynucleotide sequence
gtgggccgagtgcacaga

SEQ ID NO: 29102 - DNA, 20 bp, Artificial sequence
  synthetic polynucleotide sequence
ctccgccgtaaggtactcca

SEQ ID NO: 29103 - DNA, 18 bp, Artificial sequence
  synthetic polynucleotide sequence
ggacagtgggaaggccaa

SEQ ID NO: 29104 - DNA, 18 bp, Artificial sequence
  synthetic polynucleotide sequence
tacacggcagcagtggca

SEQ ID NO: 29105 - DNA, 20 bp, Artificial sequence
  synthetic polynucleotide sequence
ggagtacctcaccgctgaga

SEQ ID NO: 29106 - DNA, 20 bp, Artificial sequence
  synthetic polynucleotide sequence
gatcgtcacgccgcccagca

SEQ ID NO: 29107 - DNA, 18 bp, Artificial sequence
  synthetic polynucleotide sequence
cacccaaccacagccgaa

SEQ ID NO: 29108 - DNA, 18 bp, Artificial sequence
  synthetic polynucleotide sequence
cggagccccactgaggga

SEQ ID NO: 29109 - DNA, 19 bp, Artificial sequence
  synthetic polynucleotide sequence
cgcagagagccggcttgca

SEQ ID NO: 29110 - DNA, 20 bp, Artificial sequence
  synthetic polynucleotide sequence
tgcggtgaggtactccagga

SEQ ID NO: 29111 - DNA, 19 bp, Artificial sequence
  synthetic polynucleotide sequence
tacaccaagcgcgtgacca

SEQ ID NO: 29112 - DNA, 21 bp, Artificial sequence
  synthetic polynucleotide sequence
aatgaagttctgagggcggca

SEQ ID NO: 29113 - DNA, 21 bp, Artificial sequence
  synthetic polynucleotide sequence
ctacgtcccagaagcagagca

SEQ ID NO: 29114 - DNA, 20 bp, Artificial sequence
  synthetic polynucleotide sequence
ctgcttcagcacccggcgga

SEQ ID NO: 29115 - DNA, 19 bp, Artificial sequence
  synthetic polynucleotide sequence
cgcttccagagcgcagcta

SEQ ID NO: 29116 - DNA, 19 bp, Artificial sequence
  synthetic polynucleotide sequence
ttggcatggatagcacaca

SEQ ID NO: 29117 - DNA, 19 bp, Artificial sequence
  synthetic polynucleotide sequence
ccgtcggtgcgctgcagga

SEQ ID NO: 29118 - DNA, 20 bp, Artificial sequence
  synthetic polynucleotide sequence
tatccggcgagccaactgga

SEQ ID NO: 29119 - DNA, 20 bp, Artificial sequence
  synthetic polynucleotide sequence
cagggccaagtaccgagaga

SEQ ID NO: 29120 - DNA, 19 bp, Artificial sequence
  synthetic polynucleotide sequence
ggtctgagagtgggacgca

SEQ ID NO: 29121 - DNA, 22 bp, Artificial sequence
  synthetic polynucleotide sequence
accattccctctgagcacacga

SEQ ID NO: 29122 - DNA, 22 bp, Artificial sequence
  synthetic polynucleotide sequence
taggtgtccccaaacaggctga

SEQ ID NO: 29123 - DNA, 18 bp, Artificial sequence
  synthetic polynucleotide sequence
ctgcccactgcaccgaca

SEQ ID NO: 29124 - DNA, 18 bp, Artificial sequence
  synthetic polynucleotide sequence
ggacccatcaggcaagca

SEQ ID NO: 29125 - DNA, 21 bp, Artificial sequence
  synthetic polynucleotide sequence
ggaagaggagtctccagccaa

SEQ ID NO: 29126 - DNA, 22 bp, Artificial sequence
  synthetic polynucleotide sequence
aatcaccacggctttggaagga

SEQ ID NO: 29127 - DNA, 20 bp, Artificial sequence
  synthetic polynucleotide sequence
agcgacgaggacggcaccaa

SEQ ID NO: 29128 - DNA, 22 bp, Artificial sequence
  synthetic polynucleotide sequence
cgatgtcgtagaaggtgagcca

SEQ ID NO: 29129 - DNA, 19 bp, Artificial sequence
  synthetic polynucleotide sequence
tgcatggacgatcacggaa

SEQ ID NO: 29130 - DNA, 21 bp, Artificial sequence
  synthetic polynucleotide sequence
ctgacaaagggcagagctgca

SEQ ID NO: 29131 - DNA, 22 bp, Artificial sequence
  synthetic polynucleotide sequence
tcaaggacatggtgccaaagga

SEQ ID NO: 29132 - DNA, 21 bp, Artificial sequence
  synthetic polynucleotide sequence
gtctctcccaccactgactca

SEQ ID NO: 29133 - DNA, 21 bp, Artificial sequence
  synthetic polynucleotide sequence
gctgcagcccaggtataggaa

SEQ ID NO: 29134 - DNA, 21 bp, Artificial sequence
  synthetic polynucleotide sequence
atatgtgcagcagttccagga

SEQ ID NO: 29135 - DNA, 21 bp, Artificial sequence
  synthetic polynucleotide sequence
tgaaccacaggcagctggtca

SEQ ID NO: 29136 - DNA, 21 bp, Artificial sequence
  synthetic polynucleotide sequence
acaagaatactcccaccccca

SEQ ID NO: 29137 - DNA, 20 bp, Artificial sequence
  synthetic polynucleotide sequence
atctgacaagcaggccagga

SEQ ID NO: 29138 - DNA, 22 bp, Artificial sequence
  synthetic polynucleotide sequence
tctacaagcttcaacctgagga

SEQ ID NO: 29139 - DNA, 20 bp, Artificial sequence
  synthetic polynucleotide sequence
attaggagccggttacccca

SEQ ID NO: 29140 - DNA, 18 bp, Artificial sequence
  synthetic polynucleotide sequence
catgccacccatccacga

SEQ ID NO: 29141 - DNA, 22 bp, Artificial sequence
  synthetic polynucleotide sequence
aggagggtgtgaagaggaagga

SEQ ID NO: 29142 - DNA, 21 bp, Artificial sequence
  synthetic polynucleotide sequence
ttgtcaccaggcggaactgga

SEQ ID NO: 29143 - DNA, 18 bp, Artificial sequence
  synthetic polynucleotide sequence
ggccactctgcagaccga

SEQ ID NO: 29144 - DNA, 18 bp, Artificial sequence
  synthetic polynucleotide sequence
gaggaaggacggatgcca

SEQ ID NO: 29145 - DNA, 18 bp, Artificial sequence
  synthetic polynucleotide sequence
ggtgtacgggggtgacga

SEQ ID NO: 29146 - DNA, 20 bp, Artificial sequence
  synthetic polynucleotide sequence
catagaacttcccgcagcca

SEQ ID NO: 29147 - DNA, 21 bp, Artificial sequence
  synthetic polynucleotide sequence
gtcctgggctaagaagaggga

SEQ ID NO: 29148 - DNA, 18 bp, Artificial sequence
  synthetic polynucleotide sequence
ggaccgccttgcccgtga

SEQ ID NO: 29149 - DNA, 18 bp, Artificial sequence
  synthetic polynucleotide sequence
cgcagccacggaggacca

SEQ ID NO: 29150 - DNA, 20 bp, Artificial sequence
  synthetic polynucleotide sequence
ccttacaacagagcgcacca

SEQ ID NO: 29151 - DNA, 19 bp, Artificial sequence
  synthetic polynucleotide sequence
cgagacacccacttcccca

SEQ ID NO: 29152 - DNA, 20 bp, Artificial sequence
  synthetic polynucleotide sequence
gtcttgcagcacatcccaca

SEQ ID NO: 29153 - DNA, 22 bp, Artificial sequence
  synthetic polynucleotide sequence
aagagaaccagacgcaggaaga

SEQ ID NO: 29154 - DNA, 25 bp, Artificial sequence
  synthetic polynucleotide sequence
gaactaaacaggaagtgcagcgaca

SEQ ID NO: 29155 - DNA, 18 bp, Artificial sequence
  synthetic polynucleotide sequence
ccaacgtacccgccgaca

SEQ ID NO: 29156 - DNA, 18 bp, Artificial sequence
  synthetic polynucleotide sequence
aaggcctccgcctcgcca

SEQ ID NO: 29157 - DNA, 18 bp, Artificial sequence
  synthetic polynucleotide sequence
tggggctcgacaactcga

SEQ ID NO: 29158 - DNA, 18 bp, Artificial sequence
  synthetic polynucleotide sequence
aacacagccttggcgcca

SEQ ID NO: 29159 - DNA, 18 bp, Artificial sequence
  synthetic polynucleotide sequence
cggggtccgaactggcaa

SEQ ID NO: 29160 - DNA, 18 bp, Artificial sequence
  synthetic polynucleotide sequence
ggcagcctgtaagggcca

SEQ ID NO: 29161 - DNA, 22 bp, Artificial sequence
  synthetic polynucleotide sequence
aaggggtgatggaagaggcaga

SEQ ID NO: 29162 - DNA, 20 bp, Artificial sequence
  synthetic polynucleotide sequence
gtccaggtgtgaagggccca

SEQ ID NO: 29163 - DNA, 22 bp, Artificial sequence
  synthetic polynucleotide sequence
tcaattttcacgaggcgcagca

SEQ ID NO: 29164 - DNA, 19 bp, Artificial sequence
  synthetic polynucleotide sequence
gccagccggcattgcacca

SEQ ID NO: 29165 - DNA, 18 bp, Artificial sequence
  synthetic polynucleotide sequence
gggatccgcagctacgga

SEQ ID NO: 29166 - DNA, 18 bp, Artificial sequence
  synthetic polynucleotide sequence
gcactggtctagccccga

SEQ ID NO: 29167 - DNA, 18 bp, Artificial sequence
  synthetic polynucleotide sequence
gatcgccaaggtgggaca

SEQ ID NO: 29168 - DNA, 20 bp, Artificial sequence
  synthetic polynucleotide sequence
gttaggatgcgggtgaacca

SEQ ID NO: 29169 - DNA, 20 bp, Artificial sequence
  synthetic polynucleotide sequence
cgcaactacgggtatcgcca

SEQ ID NO: 29170 - DNA, 19 bp, Artificial sequence
  synthetic polynucleotide sequence
cagcggtctagcagctgca

SEQ ID NO: 29171 - DNA, 19 bp, Artificial sequence
  synthetic polynucleotide sequence
gcagggatgccaggggtga

SEQ ID NO: 29172 - DNA, 21 bp, Artificial sequence
  synthetic polynucleotide sequence
tactgagggaagactgctgca

SEQ ID NO: 29173 - DNA, 18 bp, Artificial sequence
  synthetic polynucleotide sequence
cgaccccaaagggcgcaa

SEQ ID NO: 29174 - DNA, 20 bp, Artificial sequence
  synthetic polynucleotide sequence
ctgtgcagatgccacaagca

SEQ ID NO: 29175 - DNA, 19 bp, Artificial sequence
  synthetic polynucleotide sequence
caactcaggctggggagga

SEQ ID NO: 29176 - DNA, 18 bp, Artificial sequence
  synthetic polynucleotide sequence
aacatgcccaccagccca

SEQ ID NO: 29177 - DNA, 18 bp, Artificial sequence
  synthetic polynucleotide sequence
ccaaccgcatgctcagca

SEQ ID NO: 29178 - DNA, 18 bp, Artificial sequence
  synthetic polynucleotide sequence
ggaacaggccggagacca

SEQ ID NO: 29179 - DNA, 20 bp, Artificial sequence
  synthetic polynucleotide sequence
gtggatgacctacgaagcga

SEQ ID NO: 29180 - DNA, 19 bp, Artificial sequence
  synthetic polynucleotide sequence
tcctctaaggcagctggca

SEQ ID NO: 29181 - DNA, 22 bp, Artificial sequence
  synthetic polynucleotide sequence
tcagccaagtgcagagttcaga

SEQ ID NO: 29182 - DNA, 21 bp, Artificial sequence
  synthetic polynucleotide sequence
aaggcagagctgatggtagga

SEQ ID NO: 29183 - DNA, 21 bp, Artificial sequence
  synthetic polynucleotide sequence
agtggagaagaaactggcaga

SEQ ID NO: 29184 - DNA, 19 bp, Artificial sequence
  synthetic polynucleotide sequence
tgttgacaggctaccagca

SEQ ID NO: 29185 - DNA, 20 bp, Artificial sequence
  synthetic polynucleotide sequence
aacagggtccgggacaggga

SEQ ID NO: 29186 - DNA, 20 bp, Artificial sequence
  synthetic polynucleotide sequence
ggccaccgcactgtcaacca

SEQ ID NO: 29187 - DNA, 21 bp, Artificial sequence
  synthetic polynucleotide sequence
gttgaaacccatgtgccagga

SEQ ID NO: 29188 - DNA, 22 bp, Artificial sequence
  synthetic polynucleotide sequence
aaagtcacagccaactccagca

SEQ ID NO: 29189 - DNA, 20 bp, Artificial sequence
  synthetic polynucleotide sequence
aagagcaaagcacagcagca

SEQ ID NO: 29190 - DNA, 19 bp, Artificial sequence
  synthetic polynucleotide sequence
gcgagctgcagtctagcca

SEQ ID NO: 29191 - DNA, 22 bp, Artificial sequence
  synthetic polynucleotide sequence
caaaggtgtggaaactcgcaga

SEQ ID NO: 29192 - DNA, 20 bp, Artificial sequence
  synthetic polynucleotide sequence
cagcggagaagcacctggga

SEQ ID NO: 29193 - DNA, 20 bp, Artificial sequence
  synthetic polynucleotide sequence
caagacccgcctgtgccgga

SEQ ID NO: 29194 - DNA, 20 bp, Artificial sequence
  synthetic polynucleotide sequence
ctcctccagacagcgcagca

SEQ ID NO: 29195 - DNA, 20 bp, Artificial sequence
  synthetic polynucleotide sequence
gttggcccccatttgaccaa

SEQ ID NO: 29196 - DNA, 23 bp, Artificial sequence
  synthetic polynucleotide sequence
ataaacttaggaccaccaggaga

SEQ ID NO: 29197 - DNA, 21 bp, Artificial sequence
  synthetic polynucleotide sequence
acatcagcaccctagaccaga

SEQ ID NO: 29198 - DNA, 19 bp, Artificial sequence
  synthetic polynucleotide sequence
cctggatgatggggccgca

SEQ ID NO: 29199 - DNA, 20 bp, Artificial sequence
  synthetic polynucleotide sequence
gcccctgtctgaggacgaca

SEQ ID NO: 29200 - DNA, 21 bp, Artificial sequence
  synthetic polynucleotide sequence
gacaagtccctccctgaacga

SEQ ID NO: 29201 - DNA, 20 bp, Artificial sequence
  synthetic polynucleotide sequence
aacccacgtcacctatcgga

SEQ ID NO: 29202 - DNA, 22 bp, Artificial sequence
  synthetic polynucleotide sequence
caatatacgccactgtcagaca

SEQ ID NO: 29203 - DNA, 19 bp, Artificial sequence
  synthetic polynucleotide sequence
ggcaacgtggtgctcagga

SEQ ID NO: 29204 - DNA, 19 bp, Artificial sequence
  synthetic polynucleotide sequence
ccggcagcagtagatccca

SEQ ID NO: 29205 - DNA, 20 bp, Artificial sequence
  synthetic polynucleotide sequence
ctggccacaccaaacaagga

SEQ ID NO: 29206 - DNA, 18 bp, Artificial sequence
  synthetic polynucleotide sequence
actgggaggctcagccca

SEQ ID NO: 29207 - DNA, 20 bp, Artificial sequence
  synthetic polynucleotide sequence
acggtgtaccccagcaccaa

SEQ ID NO: 29208 - DNA, 18 bp, Artificial sequence
  synthetic polynucleotide sequence
tggctgggtccacgcgca

SEQ ID NO: 29209 - DNA, 20 bp, Artificial sequence
  synthetic polynucleotide sequence
cctatgcacgccctccacca

SEQ ID NO: 29210 - DNA, 22 bp, Artificial sequence
  synthetic polynucleotide sequence
ttgaaggccaggaattgcacca

SEQ ID NO: 29211 - DNA, 18 bp, Artificial sequence
  synthetic polynucleotide sequence
ccacctgcacgcgtgcca

SEQ ID NO: 29212 - DNA, 18 bp, Artificial sequence
  synthetic polynucleotide sequence
gggcgagggttaccagca

SEQ ID NO: 29213 - DNA, 20 bp, Artificial sequence
  synthetic polynucleotide sequence
tcgccgtcaacagctgctca

SEQ ID NO: 29214 - DNA, 21 bp, Artificial sequence
  synthetic polynucleotide sequence
tcatctggcacagcatctcca

SEQ ID NO: 29215 - DNA, 20 bp, Artificial sequence
  synthetic polynucleotide sequence
gccctgtccaagctgagcga

SEQ ID NO: 29216 - DNA, 18 bp, Artificial sequence
  synthetic polynucleotide sequence
ccgtgaagtcggcgggga

SEQ ID NO: 29217 - DNA, 21 bp, Artificial sequence
  synthetic polynucleotide sequence
aggctcggatgaagaaggcga

SEQ ID NO: 29218 - DNA, 20 bp, Artificial sequence
  synthetic polynucleotide sequence
tatgtgcagggccccatgga

SEQ ID NO: 29219 - DNA, 21 bp, Artificial sequence
  synthetic polynucleotide sequence
atgccaagatcaagagagcca

SEQ ID NO: 29220 - DNA, 18 bp, Artificial sequence
  synthetic polynucleotide sequence
gaacgccaggtccaccga

SEQ ID NO: 29221 - DNA, 20 bp, Artificial sequence
  synthetic polynucleotide sequence
cagagacaaatggaccggca

SEQ ID NO: 29222 - DNA, 18 bp, Artificial sequence
  synthetic polynucleotide sequence
acaccacggggtccagca

SEQ ID NO: 29223 - DNA, 22 bp, Artificial sequence
  synthetic polynucleotide sequence
aacaaggactaccagttcacca

SEQ ID NO: 29224 - DNA, 18 bp, Artificial sequence
  synthetic polynucleotide sequence
tccaacgccaccaagcga

SEQ ID NO: 29225 - DNA, 18 bp, Artificial sequence
  synthetic polynucleotide sequence
tcactaccacgcaggcca

SEQ ID NO: 29226 - DNA, 18 bp, Artificial sequence
  synthetic polynucleotide sequence
gggtgatgatggccgaca

SEQ ID NO: 29227 - DNA, 20 bp, Artificial sequence
  synthetic polynucleotide sequence
ggtggacagtgcccctccca

SEQ ID NO: 29228 - DNA, 20 bp, Artificial sequence
  synthetic polynucleotide sequence
cctactctgcaggagaggga

SEQ ID NO: 29229 - DNA, 20 bp, Artificial sequence
  synthetic polynucleotide sequence
ctgccagctgttagaggaga

SEQ ID NO: 29230 - DNA, 21 bp, Artificial sequence
  synthetic polynucleotide sequence
aagctatgtccaagccgagga

SEQ ID NO: 29231 - DNA, 19 bp, Artificial sequence
  synthetic polynucleotide sequence
cgagtacacggctcgggaa

SEQ ID NO: 29232 - DNA, 18 bp, Artificial sequence
  synthetic polynucleotide sequence
cacgctccagagctcgga

SEQ ID NO: 29233 - DNA, 20 bp, Artificial sequence
  synthetic polynucleotide sequence
gaggtgctcgagcctgaaga

SEQ ID NO: 29234 - DNA, 20 bp, Artificial sequence
  synthetic polynucleotide sequence
agccacagctgagatcccca

SEQ ID NO: 29235 - DNA, 21 bp, Artificial sequence
  synthetic polynucleotide sequence
acctcatcccactgtgggcga

SEQ ID NO: 29236 - DNA, 18 bp, Artificial sequence
  synthetic polynucleotide sequence
gtgacgcgctgcgggaca

SEQ ID NO: 29237 - DNA, 19 bp, Artificial sequence
  synthetic polynucleotide sequence
cgctgttcgccaacgccga

SEQ ID NO: 29238 - DNA, 20 bp, Artificial sequence
  synthetic polynucleotide sequence
gagcaggcagatctccccga

SEQ ID NO: 29239 - DNA, 21 bp, Artificial sequence
  synthetic polynucleotide sequence
tggtggcatcatggagcagca

SEQ ID NO: 29240 - DNA, 21 bp, Artificial sequence
  synthetic polynucleotide sequence
agcaaggagggtggctggaga

SEQ ID NO: 29241 - DNA, 20 bp, Artificial sequence
  synthetic polynucleotide sequence
cactgagcacgccagagaca

SEQ ID NO: 29242 - DNA, 19 bp, Artificial sequence
  synthetic polynucleotide sequence
gctgagacctcctcgggga

SEQ ID NO: 29243 - DNA, 19 bp, Artificial sequence
  synthetic polynucleotide sequence
gaggctccggctcggggga

SEQ ID NO: 29244 - DNA, 21 bp, Artificial sequence
  synthetic polynucleotide sequence
ggggacacaagctcagacaga

SEQ ID NO: 29245 - DNA, 21 bp, Artificial sequence
  synthetic polynucleotide sequence
ccagaaggaaaacagcccgga

SEQ ID NO: 29246 - DNA, 25 bp, Artificial sequence
  synthetic polynucleotide sequence
ccagtgtgaaaaggtaaaccaggca

SEQ ID NO: 29247 - DNA, 21 bp, Artificial sequence
  synthetic polynucleotide sequence
cagacgactccaggagagaga

SEQ ID NO: 29248 - DNA, 18 bp, Artificial sequence
  synthetic polynucleotide sequence
gtgggcgtgcgcacagga

SEQ ID NO: 29249 - DNA, 18 bp, Artificial sequence
  synthetic polynucleotide sequence
tggccctggatacggaga

SEQ ID NO: 29250 - DNA, 18 bp, Artificial sequence
  synthetic polynucleotide sequence
gggatggcgtcctcagga

SEQ ID NO: 29251 - DNA, 20 bp, Artificial sequence
  synthetic polynucleotide sequence
gaggagaactccacacccca

SEQ ID NO: 29252 - DNA, 18 bp, Artificial sequence
  synthetic polynucleotide sequence
tcctctggggaggccaca

SEQ ID NO: 29253 - DNA, 18 bp, Artificial sequence
  synthetic polynucleotide sequence
gggcatcgtgaagcggga

SEQ ID NO: 29254 - DNA, 18 bp, Artificial sequence
  synthetic polynucleotide sequence
ccaatgagccccaggcca

SEQ ID NO: 29255 - DNA, 19 bp, Artificial sequence
  synthetic polynucleotide sequence
cccataaagccactgccga

SEQ ID NO: 29256 - DNA, 18 bp, Artificial sequence
  synthetic polynucleotide sequence
ccagcaactgaaccgcca

SEQ ID NO: 29257 - DNA, 18 bp, Artificial sequence
  synthetic polynucleotide sequence
cctcagcatccgagggca

SEQ ID NO: 29258 - DNA, 18 bp, Artificial sequence
  synthetic polynucleotide sequence
cgggcaacatttcggaca

SEQ ID NO: 29259 - DNA, 19 bp, Artificial sequence
  synthetic polynucleotide sequence
cggatccaccagctgagga

SEQ ID NO: 29260 - DNA, 18 bp, Artificial sequence
  synthetic polynucleotide sequence
ggggctcctgcacagaca

SEQ ID NO: 29261 - DNA, 18 bp, Artificial sequence
  synthetic polynucleotide sequence
gatgcccattgcccacga

SEQ ID NO: 29262 - DNA, 19 bp, Artificial sequence
  synthetic polynucleotide sequence
ggcggtgacagagtagcca

SEQ ID NO: 29263 - DNA, 20 bp, Artificial sequence
  synthetic polynucleotide sequence
caggaccttggagctaggca

SEQ ID NO: 29264 - DNA, 18 bp, Artificial sequence
  synthetic polynucleotide sequence
aatggggacaccagggca

SEQ ID NO: 29265 - DNA, 18 bp, Artificial sequence
  synthetic polynucleotide sequence
ggacgtgcaccatggcaa

SEQ ID NO: 29266 - DNA, 18 bp, Artificial sequence
  synthetic polynucleotide sequence
acctcatccacagcccca

SEQ ID NO: 29267 - DNA, 18 bp, Artificial sequence
  synthetic polynucleotide sequence
acgatcacagctgcccaa

SEQ ID NO: 29268 - DNA, 18 bp, Artificial sequence
  synthetic polynucleotide sequence
tgtgcagggacacggtca

SEQ ID NO: 29269 - DNA, 18 bp, Artificial sequence
  synthetic polynucleotide sequence
ctggaacccacgcacaca

SEQ ID NO: 29270 - DNA, 18 bp, Artificial sequence
  synthetic polynucleotide sequence
aacagaggcagcagggga

SEQ ID NO: 29271 - DNA, 18 bp, Artificial sequence
  synthetic polynucleotide sequence
tccagtccaggccaggaa

SEQ ID NO: 29272 - DNA, 18 bp, Artificial sequence
  synthetic polynucleotide sequence
tgcaactgagggagcgca

SEQ ID NO: 29273 - DNA, 21 bp, Artificial sequence
  synthetic polynucleotide sequence
gaaatgtccagaggccggaga

SEQ ID NO: 29274 - DNA, 21 bp, Artificial sequence
  synthetic polynucleotide sequence
catgaaccagggctaggcgta

SEQ ID NO: 29275 - DNA, 22 bp, Artificial sequence
  synthetic polynucleotide sequence
agctggagagaaagaggctgca

SEQ ID NO: 29276 - DNA, 19 bp, Artificial sequence
  synthetic polynucleotide sequence
tacctctggggtgcagcga

SEQ ID NO: 29277 - DNA, 22 bp, Artificial sequence
  synthetic polynucleotide sequence
aggagcgttgaagaggagagca

SEQ ID NO: 29278 - DNA, 20 bp, Artificial sequence
  synthetic polynucleotide sequence
aaggggcctctcaacctcca

SEQ ID NO: 29279 - DNA, 18 bp, Artificial sequence
  synthetic polynucleotide sequence
gcacatgacccagcccaa

SEQ ID NO: 29280 - DNA, 18 bp, Artificial sequence
  synthetic polynucleotide sequence
ggctaatgggcagtcgga

SEQ ID NO: 29281 - DNA, 19 bp, Artificial sequence
  synthetic polynucleotide sequence
gcggcccgaggagaagcaa

SEQ ID NO: 29282 - DNA, 19 bp, Artificial sequence
  synthetic polynucleotide sequence
tcccagctcctctagggca

SEQ ID NO: 29283 - DNA, 22 bp, Artificial sequence
  synthetic polynucleotide sequence
gaaactgagggagaaggtggaa

SEQ ID NO: 29284 - DNA, 19 bp, Artificial sequence
  synthetic polynucleotide sequence
gcccgcatctccaccctca

SEQ ID NO: 29285 - DNA, 20 bp, Artificial sequence
  synthetic polynucleotide sequence
tggggctcaagatgtcggca

SEQ ID NO: 29286 - DNA, 21 bp, Artificial sequence
  synthetic polynucleotide sequence
tgtggtccacagcatgaggga

SEQ ID NO: 29287 - DNA, 20 bp, Artificial sequence
  synthetic polynucleotide sequence
cacggggtctgagactggca

SEQ ID NO: 29288 - DNA, 20 bp, Artificial sequence
  synthetic polynucleotide sequence
cgaggcccctggtaatcgca

SEQ ID NO: 29289 - DNA, 20 bp, Artificial sequence
  synthetic polynucleotide sequence
aggcgtctacaatcccagga

SEQ ID NO: 29290 - DNA, 18 bp, Artificial sequence
  synthetic polynucleotide sequence
accagctgcacagcctca

SEQ ID NO: 29291 - DNA, 18 bp, Artificial sequence
  synthetic polynucleotide sequence
gccaaggcaccttccaga

SEQ ID NO: 29292 - DNA, 18 bp, Artificial sequence
  synthetic polynucleotide sequence
ggagggtcttgggagcca

SEQ ID NO: 29293 - DNA, 22 bp, Artificial sequence
  synthetic polynucleotide sequence
caatggagactggagatgctga

SEQ ID NO: 29294 - DNA, 21 bp, Artificial sequence
  synthetic polynucleotide sequence
tcagctcgaagggaactgcca

SEQ ID NO: 29295 - DNA, 20 bp, Artificial sequence
  synthetic polynucleotide sequence
atcagagggctggtgggcaa

SEQ ID NO: 29296 - DNA, 20 bp, Artificial sequence
  synthetic polynucleotide sequence
cttacgctgcacaatggcca

SEQ ID NO: 29297 - DNA, 19 bp, Artificial sequence
  synthetic polynucleotide sequence
tcagtgagtgcgggggaca

SEQ ID NO: 29298 - DNA, 22 bp, Artificial sequence
  synthetic polynucleotide sequence
aggagggacacaagactctgga

SEQ ID NO: 29299 - DNA, 18 bp, Artificial sequence
  synthetic polynucleotide sequence
aagtcccgagctgacgga

SEQ ID NO: 29300 - DNA, 20 bp, Artificial sequence
  synthetic polynucleotide sequence
gtggttctccaggagcagca

SEQ ID NO: 29301 - DNA, 18 bp, Artificial sequence
  synthetic polynucleotide sequence
gatgtgcagacctgggca

SEQ ID NO: 29302 - DNA, 21 bp, Artificial sequence
  synthetic polynucleotide sequence
cttcagcatgagtaggaggca

SEQ ID NO: 29303 - DNA, 20 bp, Artificial sequence
  synthetic polynucleotide sequence
taaaccaggcatcaggagca

SEQ ID NO: 29304 - DNA, 22 bp, Artificial sequence
  synthetic polynucleotide sequence
tatggactcgagcataagggga

SEQ ID NO: 29305 - DNA, 20 bp, Artificial sequence
  synthetic polynucleotide sequence
ctcgggctgaatgacagcaa

SEQ ID NO: 29306 - DNA, 20 bp, Artificial sequence
  synthetic polynucleotide sequence
tctgtcaggttgcccaggga

SEQ ID NO: 29307 - DNA, 22 bp, Artificial sequence
  synthetic polynucleotide sequence
agaaagagcctgagaacccaga

SEQ ID NO: 29308 - DNA, 22 bp, Artificial sequence
  synthetic polynucleotide sequence
gcaatttcagcaaggacccgga

SEQ ID NO: 29309 - DNA, 22 bp, Artificial sequence
  synthetic polynucleotide sequence
aagattgaggaacgggaaggca

SEQ ID NO: 29310 - DNA, 18 bp, Artificial sequence
  synthetic polynucleotide sequence
gctgtgccctccagggca

SEQ ID NO: 29311 - DNA, 22 bp, Artificial sequence
  synthetic polynucleotide sequence
ccatccagacgggctttacgaa

SEQ ID NO: 29312 - DNA, 21 bp, Artificial sequence
  synthetic polynucleotide sequence
gactctaaaggcctgggtgga

SEQ ID NO: 29313 - DNA, 18 bp, Artificial sequence
  synthetic polynucleotide sequence
ggatggcagctggcacca

SEQ ID NO: 29314 - DNA, 18 bp, Artificial sequence
  synthetic polynucleotide sequence
gatcaccggcttcccaca

SEQ ID NO: 29315 - DNA, 20 bp, Artificial sequence
  synthetic polynucleotide sequence
acagaaccgacgtgaagcca

SEQ ID NO: 29316 - DNA, 22 bp, Artificial sequence
  synthetic polynucleotide sequence
ccattccatcagtgactcgcca

SEQ ID NO: 29317 - DNA, 21 bp, Artificial sequence
  synthetic polynucleotide sequence
ctgtggaagtcctgacctgga

SEQ ID NO: 29318 - DNA, 21 bp, Artificial sequence
  synthetic polynucleotide sequence
gattgaagcaggtatgggcca

SEQ ID NO: 29319 - DNA, 21 bp, Artificial sequence
  synthetic polynucleotide sequence
tctgctgaaggtggtaccaca

SEQ ID NO: 29320 - DNA, 19 bp, Artificial sequence
  synthetic polynucleotide sequence
cggcccgtgacaaagcgca

SEQ ID NO: 29321 - DNA, 20 bp, Artificial sequence
  synthetic polynucleotide sequence
ctgtacgacgaggagacgca

SEQ ID NO: 29322 - DNA, 18 bp, Artificial sequence
  synthetic polynucleotide sequence
agggtcacttcggccaca

SEQ ID NO: 29323 - DNA, 20 bp, Artificial sequence
  synthetic polynucleotide sequence
agatcagccccatgtccgca

SEQ ID NO: 29324 - DNA, 22 bp, Artificial sequence
  synthetic polynucleotide sequence
aaatcacagggcagtctcagga

SEQ ID NO: 29325 - DNA, 21 bp, Artificial sequence
  synthetic polynucleotide sequence
accacaactcccgcaccacca

SEQ ID NO: 29326 - DNA, 21 bp, Artificial sequence
  synthetic polynucleotide sequence
tcttctcctacctcacccgca

SEQ ID NO: 29327 - DNA, 21 bp, Artificial sequence
  synthetic polynucleotide sequence
tgcaagcggaagagtcccgaa

SEQ ID NO: 29328 - DNA, 19 bp, Artificial sequence
  synthetic polynucleotide sequence
tccacagttgagaccacca

SEQ ID NO: 29329 - DNA, 19 bp, Artificial sequence
  synthetic polynucleotide sequence
cagtggaggacccagcaca

SEQ ID NO: 29330 - DNA, 18 bp, Artificial sequence
  synthetic polynucleotide sequence
cgaagaggcctcgctcca

SEQ ID NO: 29331 - DNA, 21 bp, Artificial sequence
  synthetic polynucleotide sequence
ccggccatgctagaagaggaa

SEQ ID NO: 29332 - DNA, 21 bp, Artificial sequence
  synthetic polynucleotide sequence
tctctatcccaagacatgcga

SEQ ID NO: 29333 - DNA, 20 bp, Artificial sequence
  synthetic polynucleotide sequence
agccaactcagtccagcaga

SEQ ID NO: 29334 - DNA, 22 bp, Artificial sequence
  synthetic polynucleotide sequence
gaatgaggcagttccagtgaga

SEQ ID NO: 29335 - DNA, 21 bp, Artificial sequence
  synthetic polynucleotide sequence
cagagtagaagcccaccagca

SEQ ID NO: 29336 - DNA, 20 bp, Artificial sequence
  synthetic polynucleotide sequence
atttcaagggaggaggggca

SEQ ID NO: 29337 - DNA, 18 bp, Artificial sequence
  synthetic polynucleotide sequence
tcctggacgtgaggcaga

SEQ ID NO: 29338 - DNA, 18 bp, Artificial sequence
  synthetic polynucleotide sequence
cctgtgggaactgcacca

SEQ ID NO: 29339 - DNA, 23 bp, Artificial sequence
  synthetic polynucleotide sequence
aaaatccagcagaaccagaggaa

SEQ ID NO: 29340 - DNA, 20 bp, Artificial sequence
  synthetic polynucleotide sequence
atgagagggggctttaggca

SEQ ID NO: 29341 - DNA, 21 bp, Artificial sequence
  synthetic polynucleotide sequence
ggcttcggttgcaggacagga

SEQ ID NO: 29342 - DNA, 19 bp, Artificial sequence
  synthetic polynucleotide sequence
ctgcggatctcaggggcca

SEQ ID NO: 29343 - DNA, 20 bp, Artificial sequence
  synthetic polynucleotide sequence
gctcaaaggcccctgtccca

SEQ ID NO: 29344 - DNA, 22 bp, Artificial sequence
  synthetic polynucleotide sequence
agaaccatcactgctcagagga

SEQ ID NO: 29345 - DNA, 18 bp, Artificial sequence
  synthetic polynucleotide sequence
ccccggagaccgaggaga

SEQ ID NO: 29346 - DNA, 18 bp, Artificial sequence
  synthetic polynucleotide sequence
gggcagagcggatgggca

SEQ ID NO: 29347 - DNA, 19 bp, Artificial sequence
  synthetic polynucleotide sequence
tcaccatgatgccacccaa

SEQ ID NO: 29348 - DNA, 19 bp, Artificial sequence
  synthetic polynucleotide sequence
ccgagtgcccccttccaca

SEQ ID NO: 29349 - DNA, 18 bp, Artificial sequence
  synthetic polynucleotide sequence
ggagatggtggccagcaa

SEQ ID NO: 29350 - DNA, 18 bp, Artificial sequence
  synthetic polynucleotide sequence
ggatctgcatgcccagca

SEQ ID NO: 29351 - DNA, 20 bp, Artificial sequence
  synthetic polynucleotide sequence
cgaccaccacgagaggagca

SEQ ID NO: 29352 - DNA, 20 bp, Artificial sequence
  synthetic polynucleotide sequence
acaccctgggctgagatgga

SEQ ID NO: 29353 - DNA, 22 bp, Artificial sequence
  synthetic polynucleotide sequence
ttgatggcgaatcagagctgga

SEQ ID NO: 29354 - DNA, 20 bp, Artificial sequence
  synthetic polynucleotide sequence
catgcccatgccaccgccta

SEQ ID NO: 29355 - DNA, 21 bp, Artificial sequence
  synthetic polynucleotide sequence
atggctccctgcatgagagca

SEQ ID NO: 29356 - DNA, 20 bp, Artificial sequence
  synthetic polynucleotide sequence
ccaggatgcagggtcaggga

SEQ ID NO: 29357 - DNA, 18 bp, Artificial sequence
  synthetic polynucleotide sequence
tcgtgacacccaacggga

SEQ ID NO: 29358 - DNA, 18 bp, Artificial sequence
  synthetic polynucleotide sequence
gccagctgcttccagaca

SEQ ID NO: 29359 - DNA, 18 bp, Artificial sequence
  synthetic polynucleotide sequence
cccaagccagcccacaga

SEQ ID NO: 29360 - DNA, 23 bp, Artificial sequence
  synthetic polynucleotide sequence
aaaaacagctcctgagagagaca

SEQ ID NO: 29361 - DNA, 22 bp, Artificial sequence
  synthetic polynucleotide sequence
catgcaagttgcagcaggagga

SEQ ID NO: 29362 - DNA, 21 bp, Artificial sequence
  synthetic polynucleotide sequence
cccaactgaccataccctcca

SEQ ID NO: 29363 - DNA, 21 bp, Artificial sequence
  synthetic polynucleotide sequence
cagtgccctactcacacagga

SEQ ID NO: 29364 - DNA, 20 bp, Artificial sequence
  synthetic polynucleotide sequence
atacccaacaagctcagcca

SEQ ID NO: 29365 - DNA, 19 bp, Artificial sequence
  synthetic polynucleotide sequence
cgtggggaaagaacagcca

SEQ ID NO: 29366 - DNA, 18 bp, Artificial sequence
  synthetic polynucleotide sequence
tacgcccactgagggcca

SEQ ID NO: 29367 - DNA, 18 bp, Artificial sequence
  synthetic polynucleotide sequence
cctccctccagacaggga

SEQ ID NO: 29368 - DNA, 21 bp, Artificial sequence
  synthetic polynucleotide sequence
ccttctggaagaagagaggca

SEQ ID NO: 29369 - DNA, 22 bp, Artificial sequence
  synthetic polynucleotide sequence
agctccaaacctagtggcccaa

SEQ ID NO: 29370 - DNA, 22 bp, Artificial sequence
  synthetic polynucleotide sequence
taaggagaatcgcagctcgtga

SEQ ID NO: 29371 - DNA, 18 bp, Artificial sequence
  synthetic polynucleotide sequence
ctgcaagctgggcagcca

SEQ ID NO: 29372 - DNA, 21 bp, Artificial sequence
  synthetic polynucleotide sequence
ctggtgtagacggggatgaca

SEQ ID NO: 29373 - DNA, 20 bp, Artificial sequence
  synthetic polynucleotide sequence
ggagctgcgcaagagcctga

SEQ ID NO: 29374 - DNA, 20 bp, Artificial sequence
  synthetic polynucleotide sequence
gttggagttctcccggccca

SEQ ID NO: 29375 - DNA, 20 bp, Artificial sequence
  synthetic polynucleotide sequence
ctggagatgaccgtgagaca

SEQ ID NO: 29376 - DNA, 20 bp, Artificial sequence
  synthetic polynucleotide sequence
ctccgccagacactcgtgga

SEQ ID NO: 29377 - DNA, 19 bp, Artificial sequence
  synthetic polynucleotide sequence
gggagggtgggtgcctcca

SEQ ID NO: 29378 - DNA, 20 bp, Artificial sequence
  synthetic polynucleotide sequence
gtcgtgcccacacgcatcca

SEQ ID NO: 29379 - DNA, 20 bp, Artificial sequence
  synthetic polynucleotide sequence
ctcccaggttcacccaccca

SEQ ID NO: 29380 - DNA, 20 bp, Artificial sequence
  synthetic polynucleotide sequence
gcctggaacactagtgccca

SEQ ID NO: 29381 - DNA, 21 bp, Artificial sequence
  synthetic polynucleotide sequence
cgaagctggagaaagcggaga

SEQ ID NO: 29382 - DNA, 19 bp, Artificial sequence
  synthetic polynucleotide sequence
cgaagcaggcactcgcgga

SEQ ID NO: 29383 - DNA, 19 bp, Artificial sequence
  synthetic polynucleotide sequence
cctgcagctcatcagggaa

SEQ ID NO: 29384 - DNA, 19 bp, Artificial sequence
  synthetic polynucleotide sequence
tgggtgatccaccacgcta

SEQ ID NO: 29385 - DNA, 19 bp, Artificial sequence
  synthetic polynucleotide sequence
ccgaaaggctgtggagcaa

SEQ ID NO: 29386 - DNA, 18 bp, Artificial sequence
  synthetic polynucleotide sequence
aggggttgggcctggaca

SEQ ID NO: 29387 - DNA, 20 bp, Artificial sequence
  synthetic polynucleotide sequence
tggcggtactcagaaacaga

SEQ ID NO: 29388 - DNA, 21 bp, Artificial sequence
  synthetic polynucleotide sequence
cagagtctctcaccaacagca

SEQ ID NO: 29389 - DNA, 20 bp, Artificial sequence
  synthetic polynucleotide sequence
tggaggagtggctggaggaa

SEQ ID NO: 29390 - DNA, 21 bp, Artificial sequence
  synthetic polynucleotide sequence
tcctgagcaacgtccctgcca

SEQ ID NO: 29391 - DNA, 20 bp, Artificial sequence
  synthetic polynucleotide sequence
gaagaagggggtgaggagga

SEQ ID NO: 29392 - DNA, 18 bp, Artificial sequence
  synthetic polynucleotide sequence
ccgagaagtcccgctgca

SEQ ID NO: 29393 - DNA, 18 bp, Artificial sequence
  synthetic polynucleotide sequence
acggcctcacccacggaa

SEQ ID NO: 29394 - DNA, 18 bp, Artificial sequence
  synthetic polynucleotide sequence
aggccgacagggaggcca

SEQ ID NO: 29395 - DNA, 18 bp, Artificial sequence
  synthetic polynucleotide sequence
agccctgctccagcccaa

SEQ ID NO: 29396 - DNA, 19 bp, Artificial sequence
  synthetic polynucleotide sequence
gaggtggagagaggtggca

SEQ ID NO: 29397 - DNA, 18 bp, Artificial sequence
  synthetic polynucleotide sequence
gggcatcttccacccgga

SEQ ID NO: 29398 - DNA, 18 bp, Artificial sequence
  synthetic polynucleotide sequence
agccacgtaagcagccga

SEQ ID NO: 29399 - DNA, 21 bp, Artificial sequence
  synthetic polynucleotide sequence
ctggattggagagcagcagaa

SEQ ID NO: 29400 - DNA, 22 bp, Artificial sequence
  synthetic polynucleotide sequence
agtggtcactgaagaggtcaca

SEQ ID NO: 29401 - DNA, 20 bp, Artificial sequence
  synthetic polynucleotide sequence
ccctgggaaccatgtggaga

SEQ ID NO: 29402 - DNA, 20 bp, Artificial sequence
  synthetic polynucleotide sequence
ctgttcagctgagaaggcca

SEQ ID NO: 29403 - DNA, 23 bp, Artificial sequence
  synthetic polynucleotide sequence
gagaaggcatgttcaaagcacca

SEQ ID NO: 29404 - DNA, 25 bp, Artificial sequence
  synthetic polynucleotide sequence
gacagccttcaaggaacctaaacca

SEQ ID NO: 29405 - DNA, 20 bp, Artificial sequence
  synthetic polynucleotide sequence
tgagaaggccagcaaggtca

SEQ ID NO: 29406 - DNA, 20 bp, Artificial sequence
  synthetic polynucleotide sequence
ctggaggccttgagtcccca

SEQ ID NO: 29407 - DNA, 19 bp, Artificial sequence
  synthetic polynucleotide sequence
ggagaaggctacaggggca

SEQ ID NO: 29408 - DNA, 20 bp, Artificial sequence
  synthetic polynucleotide sequence
ggagcagtagccaactcgga

SEQ ID NO: 29409 - DNA, 18 bp, Artificial sequence
  synthetic polynucleotide sequence
cttcaaccgcacgacgga

SEQ ID NO: 29410 - DNA, 18 bp, Artificial sequence
  synthetic polynucleotide sequence
ctgcgagcgtgtggcaca

SEQ ID NO: 29411 - DNA, 18 bp, Artificial sequence
  synthetic polynucleotide sequence
caggtgcgggaccaggga

SEQ ID NO: 29412 - DNA, 21 bp, Artificial sequence
  synthetic polynucleotide sequence
caggctcgtccccaataagca

SEQ ID NO: 29413 - DNA, 21 bp, Artificial sequence
  synthetic polynucleotide sequence
gcacggcgtgtacatgagcca

SEQ ID NO: 29414 - DNA, 21 bp, Artificial sequence
  synthetic polynucleotide sequence
tggactgcggaggctgagaga

SEQ ID NO: 29415 - DNA, 18 bp, Artificial sequence
  synthetic polynucleotide sequence
aggggctgtggacaggaa

SEQ ID NO: 29416 - DNA, 18 bp, Artificial sequence
  synthetic polynucleotide sequence
agagggcagtggcgacga

SEQ ID NO: 29417 - DNA, 20 bp, Artificial sequence
  synthetic polynucleotide sequence
gggggcaatgaggttgggaa

SEQ ID NO: 29418 - DNA, 18 bp, Artificial sequence
  synthetic polynucleotide sequence
ggcgtaggtctgggccca

SEQ ID NO: 29419 - DNA, 19 bp, Artificial sequence
  synthetic polynucleotide sequence
gccaaccgcctcccagaca

SEQ ID NO: 29420 - DNA, 19 bp, Artificial sequence
  synthetic polynucleotide sequence
ggtccaggtggtcgaggca

SEQ ID NO: 29421 - DNA, 23 bp, Artificial sequence
  synthetic polynucleotide sequence
gaaaacaagtcagaggaccagca

SEQ ID NO: 29422 - DNA, 19 bp, Artificial sequence
  synthetic polynucleotide sequence
gaagagacgttgcgagcca

SEQ ID NO: 29423 - DNA, 20 bp, Artificial sequence
  synthetic polynucleotide sequence
acccacactagctgggcaga

SEQ ID NO: 29424 - DNA, 20 bp, Artificial sequence
  synthetic polynucleotide sequence
acactgagcagggatgggga

SEQ ID NO: 29425 - DNA, 18 bp, Artificial sequence
  synthetic polynucleotide sequence
ggcaggctcacatggcaa

SEQ ID NO: 29426 - DNA, 18 bp, Artificial sequence
  synthetic polynucleotide sequence
gtccacagcacaacgcca

SEQ ID NO: 29427 - DNA, 20 bp, Artificial sequence
  synthetic polynucleotide sequence
gaagccaggaggagcagaca

SEQ ID NO: 29428 - DNA, 18 bp, Artificial sequence
  synthetic polynucleotide sequence
gcactgggacagcgctca

SEQ ID NO: 29429 - DNA, 21 bp, Artificial sequence
  synthetic polynucleotide sequence
cctcccgcagaggaatgcaga

SEQ ID NO: 29430 - DNA, 19 bp, Artificial sequence
  synthetic polynucleotide sequence
ttccgttgacaagacggca

SEQ ID NO: 29431 - DNA, 20 bp, Artificial sequence
  synthetic polynucleotide sequence
tgcacgatctgggaacctca

SEQ ID NO: 29432 - DNA, 19 bp, Artificial sequence
  synthetic polynucleotide sequence
cccagtcccaacagctcca

SEQ ID NO: 29433 - DNA, 21 bp, Artificial sequence
  synthetic polynucleotide sequence
tgtgccgggggtgatatcaga

SEQ ID NO: 29434 - DNA, 21 bp, Artificial sequence
  synthetic polynucleotide sequence
aacctccacccacatcaggga

SEQ ID NO: 29435 - DNA, 18 bp, Artificial sequence
  synthetic polynucleotide sequence
gtagcagcgaggacccca

SEQ ID NO: 29436 - DNA, 18 bp, Artificial sequence
  synthetic polynucleotide sequence
tgccgcacggaatgcaca

SEQ ID NO: 29437 - DNA, 21 bp, Artificial sequence
  synthetic polynucleotide sequence
agacctacaaggacccagcca

SEQ ID NO: 29438 - DNA, 21 bp, Artificial sequence
  synthetic polynucleotide sequence
ggtactgacgggtgaagcgca

SEQ ID NO: 29439 - DNA, 19 bp, Artificial sequence
  synthetic polynucleotide sequence
ctaagggggagcccagcca

SEQ ID NO: 29440 - DNA, 21 bp, Artificial sequence
  synthetic polynucleotide sequence
tcttctccacctgcggaacca

SEQ ID NO: 29441 - DNA, 18 bp, Artificial sequence
  synthetic polynucleotide sequence
tgcactgcacaggccaca

SEQ ID NO: 29442 - DNA, 20 bp, Artificial sequence
  synthetic polynucleotide sequence
aatcagcaccaagcaggtca

SEQ ID NO: 29443 - DNA, 19 bp, Artificial sequence
  synthetic polynucleotide sequence
gaaagcgtggctgggggca

SEQ ID NO: 29444 - DNA, 21 bp, Artificial sequence
  synthetic polynucleotide sequence
aacagggtatgggtagaggca

SEQ ID NO: 29445 - DNA, 21 bp, Artificial sequence
  synthetic polynucleotide sequence
tcccccagcccagaacacgaa

SEQ ID NO: 29446 - DNA, 20 bp, Artificial sequence
  synthetic polynucleotide sequence
ctcgtctgagtacggagaga

SEQ ID NO: 29447 - DNA, 21 bp, Artificial sequence
  synthetic polynucleotide sequence
ggtaccacctgacgacgaaga

SEQ ID NO: 29448 - DNA, 20 bp, Artificial sequence
  synthetic polynucleotide sequence
gcaccagtggagattcccga

SEQ ID NO: 29449 - DNA, 21 bp, Artificial sequence
  synthetic polynucleotide sequence
agcagatgaggatgaaggcca

SEQ ID NO: 29450 - DNA, 23 bp, Artificial sequence
  synthetic polynucleotide sequence
gaccacaggacaccacagtcaca

SEQ ID NO: 29451 - DNA, 21 bp, Artificial sequence
  synthetic polynucleotide sequence
aaccatcgaagcctccagtca

SEQ ID NO: 29452 - DNA, 21 bp, Artificial sequence
  synthetic polynucleotide sequence
ggtgcgcatcatgagctgaga

SEQ ID NO: 29453 - DNA, 22 bp, Artificial sequence
  synthetic polynucleotide sequence
acgaatgggaagccaagtgcca

SEQ ID NO: 29454 - DNA, 21 bp, Artificial sequence
  synthetic polynucleotide sequence
ctacaggagtctgctgagcca

SEQ ID NO: 29455 - DNA, 18 bp, Artificial sequence
  synthetic polynucleotide sequence
ccaacacagagcccacca

SEQ ID NO: 29456 - DNA, 18 bp, Artificial sequence
  synthetic polynucleotide sequence
caggccttgcccaggcaa

SEQ ID NO: 29457 - DNA, 20 bp, Artificial sequence
  synthetic polynucleotide sequence
gggaagatcatccgcaagga

SEQ ID NO: 29458 - DNA, 18 bp, Artificial sequence
  synthetic polynucleotide sequence
ttcaggcccagatcagca

SEQ ID NO: 29459 - DNA, 19 bp, Artificial sequence
  synthetic polynucleotide sequence
cctggacaagagcctccca

SEQ ID NO: 29460 - DNA, 20 bp, Artificial sequence
  synthetic polynucleotide sequence
cagcctggctaatccgagga

SEQ ID NO: 29461 - DNA, 19 bp, Artificial sequence
  synthetic polynucleotide sequence
gactgtgaggcctcggcga

SEQ ID NO: 29462 - DNA, 20 bp, Artificial sequence
  synthetic polynucleotide sequence
gcgatccggcagaacacgca

SEQ ID NO: 29463 - DNA, 20 bp, Artificial sequence
  synthetic polynucleotide sequence
aactggccagcacagaggaa

SEQ ID NO: 29464 - DNA, 18 bp, Artificial sequence
  synthetic polynucleotide sequence
atctgcagacccagcgca

SEQ ID NO: 29465 - DNA, 20 bp, Artificial sequence
  synthetic polynucleotide sequence
gccaacaagcacagccccca

SEQ ID NO: 29466 - DNA, 19 bp, Artificial sequence
  synthetic polynucleotide sequence
tgatgagggacaggccgga

SEQ ID NO: 29467 - DNA, 22 bp, Artificial sequence
  synthetic polynucleotide sequence
tggatgctgtatcacccccaca

SEQ ID NO: 29468 - DNA, 20 bp, Artificial sequence
  synthetic polynucleotide sequence
cctggcttggcaggtgagca

SEQ ID NO: 29469 - DNA, 20 bp, Artificial sequence
  synthetic polynucleotide sequence
caccaaggggagcctggaga

SEQ ID NO: 29470 - DNA, 19 bp, Artificial sequence
  synthetic polynucleotide sequence
tggacttgtaggaggacga

SEQ ID NO: 29471 - DNA, 19 bp, Artificial sequence
  synthetic polynucleotide sequence
tgtggtgccaccagtggaa

SEQ ID NO: 29472 - DNA, 21 bp, Artificial sequence
  synthetic polynucleotide sequence
ctgacgagtacccactgcaga

SEQ ID NO: 29473 - DNA, 20 bp, Artificial sequence
  synthetic polynucleotide sequence
actggccaccatgtgcccga

SEQ ID NO: 29474 - DNA, 20 bp, Artificial sequence
  synthetic polynucleotide sequence
agtcggacttggaacccgca

SEQ ID NO: 29475 - DNA, 20 bp, Artificial sequence
  synthetic polynucleotide sequence
ccgagacctcctggagagca

SEQ ID NO: 29476 - DNA, 19 bp, Artificial sequence
  synthetic polynucleotide sequence
ggcagctggagactggaca

SEQ ID NO: 29477 - DNA, 19 bp, Artificial sequence
  synthetic polynucleotide sequence
tcagagtcgggctggctca

SEQ ID NO: 29478 - DNA, 20 bp, Artificial sequence
  synthetic polynucleotide sequence
gtgtgagcaacaggagccca

SEQ ID NO: 29479 - DNA, 20 bp, Artificial sequence
  synthetic polynucleotide sequence
cgcaggctacgacgtggaga

SEQ ID NO: 29480 - DNA, 19 bp, Artificial sequence
  synthetic polynucleotide sequence
tgagcttgaaggaacccga

SEQ ID NO: 29481 - DNA, 18 bp, Artificial sequence
  synthetic polynucleotide sequence
ctcctgccgagacagcca

SEQ ID NO: 29482 - DNA, 20 bp, Artificial sequence
  synthetic polynucleotide sequence
gcgctccttagaagcagcca

SEQ ID NO: 29483 - DNA, 18 bp, Artificial sequence
  synthetic polynucleotide sequence
cgcggccactgtaaccaa

SEQ ID NO: 29484 - DNA, 21 bp, Artificial sequence
  synthetic polynucleotide sequence
gccgccttcttaggcttgaca

SEQ ID NO: 29485 - DNA, 21 bp, Artificial sequence
  synthetic polynucleotide sequence
taccattcctgcacccgcaga

SEQ ID NO: 29486 - DNA, 20 bp, Artificial sequence
  synthetic polynucleotide sequence
tcagatactgggggtccgga

SEQ ID NO: 29487 - DNA, 21 bp, Artificial sequence
  synthetic polynucleotide sequence
cgaagaagcccaagaaggcga

SEQ ID NO: 29488 - DNA, 19 bp, Artificial sequence
  synthetic polynucleotide sequence
tttggctccagcagctgca

SEQ ID NO: 29489 - DNA, 21 bp, Artificial sequence
  synthetic polynucleotide sequence
aaccaagaagcgagggaggaa

SEQ ID NO: 29490 - DNA, 18 bp, Artificial sequence
  synthetic polynucleotide sequence
cgtagccagcagcggcca

SEQ ID NO: 29491 - DNA, 20 bp, Artificial sequence
  synthetic polynucleotide sequence
acgagggaagcagggaggaa

SEQ ID NO: 29492 - DNA, 22 bp, Artificial sequence
  synthetic polynucleotide sequence
agatactctaacactgccgcca

SEQ ID NO: 29493 - DNA, 21 bp, Artificial sequence
  synthetic polynucleotide sequence
ctaaccgccgagatcctggaa

SEQ ID NO: 29494 - DNA, 20 bp, Artificial sequence
  synthetic polynucleotide sequence
cagctgcaagtggcgcggga

SEQ ID NO: 29495 - DNA, 21 bp, Artificial sequence
  synthetic polynucleotide sequence
gcaagaggacccgtaaggaga

SEQ ID NO: 29496 - DNA, 21 bp, Artificial sequence
  synthetic polynucleotide sequence
gaagagatgccagtgtccgga

SEQ ID NO: 29497 - DNA, 20 bp, Artificial sequence
  synthetic polynucleotide sequence
cacctccagggagattcaga

SEQ ID NO: 29498 - DNA, 20 bp, Artificial sequence
  synthetic polynucleotide sequence
ccttagtgccctcggacaca

SEQ ID NO: 29499 - DNA, 21 bp, Artificial sequence
  synthetic polynucleotide sequence
catcacctccagggagatcca

SEQ ID NO: 29500 - DNA, 20 bp, Artificial sequence
  synthetic polynucleotide sequence
tgacacggcgtgcttagcca

SEQ ID NO: 29501 - DNA, 21 bp, Artificial sequence
  synthetic polynucleotide sequence
aggttcaccccgatactggca

SEQ ID NO: 29502 - DNA, 19 bp, Artificial sequence
  synthetic polynucleotide sequence
tgtagtgggccagacggga

SEQ ID NO: 29503 - DNA, 20 bp, Artificial sequence
  synthetic polynucleotide sequence
ttcgagcgcattgcaggcga

SEQ ID NO: 29504 - DNA, 18 bp, Artificial sequence
  synthetic polynucleotide sequence
ccagctccccgggtagca

SEQ ID NO: 29505 - DNA, 20 bp, Artificial sequence
  synthetic polynucleotide sequence
tcgaaagagcgctccagcca

SEQ ID NO: 29506 - DNA, 21 bp, Artificial sequence
  synthetic polynucleotide sequence
tctcacggactagacgctgga

SEQ ID NO: 29507 - DNA, 23 bp, Artificial sequence
  synthetic polynucleotide sequence
gtaaatccacaggcggtaaagca

SEQ ID NO: 29508 - DNA, 18 bp, Artificial sequence
  synthetic polynucleotide sequence
cgcagagccacggtgcca

SEQ ID NO: 29509 - DNA, 20 bp, Artificial sequence
  synthetic polynucleotide sequence
gtgctatccacgccaagcga

SEQ ID NO: 29510 - DNA, 20 bp, Artificial sequence
  synthetic polynucleotide sequence
tggcgcacaccctcagtaca

SEQ ID NO: 29511 - DNA, 20 bp, Artificial sequence
  synthetic polynucleotide sequence
ggataccaacctgtgcgcca

SEQ ID NO: 29512 - DNA, 19 bp, Artificial sequence
  synthetic polynucleotide sequence
cctcggatgcggcgcgcaa

SEQ ID NO: 29513 - DNA, 21 bp, Artificial sequence
  synthetic polynucleotide sequence
ctgctcatccgcaaactgcca

SEQ ID NO: 29514 - DNA, 20 bp, Artificial sequence
  synthetic polynucleotide sequence
gcacgcctcttgcagcgcca

SEQ ID NO: 29515 - DNA, 19 bp, Artificial sequence
  synthetic polynucleotide sequence
tgggtaaggggggtgccaa

SEQ ID NO: 29516 - DNA, 21 bp, Artificial sequence
  synthetic polynucleotide sequence
agaccagagatccgcttcaca

SEQ ID NO: 29517 - DNA, 18 bp, Artificial sequence
  synthetic polynucleotide sequence
gcggtggcgtcaagcgca

SEQ ID NO: 29518 - DNA, 18 bp, Artificial sequence
  synthetic polynucleotide sequence
aggtgacggcgtctcgaa

SEQ ID NO: 29519 - DNA, 21 bp, Artificial sequence
  synthetic polynucleotide sequence
aaggaatcaccaagcccgcta

SEQ ID NO: 29520 - DNA, 21 bp, Artificial sequence
  synthetic polynucleotide sequence
tgttccgtgtaggtgacagca

SEQ ID NO: 29521 - DNA, 25 bp, Artificial sequence
  synthetic polynucleotide sequence
agcgtaagacagtcactgcaatgga

SEQ ID NO: 29522 - DNA, 21 bp, Artificial sequence
  synthetic polynucleotide sequence
cagccaccaaagccgtacaga

SEQ ID NO: 29523 - DNA, 19 bp, Artificial sequence
  synthetic polynucleotide sequence
gttcggggcaaggccggaa

SEQ ID NO: 29524 - DNA, 18 bp, Artificial sequence
  synthetic polynucleotide sequence
acccggcgggtctcctca

SEQ ID NO: 29525 - DNA, 20 bp, Artificial sequence
  synthetic polynucleotide sequence
gggtatcaccaagccagcca

SEQ ID NO: 29526 - DNA, 23 bp, Artificial sequence
  synthetic polynucleotide sequence
gttctccaggaacaccttcaaca

SEQ ID NO: 29527 - DNA, 20 bp, Artificial sequence
  synthetic polynucleotide sequence
gcgtggaggcgttaagcgca

SEQ ID NO: 29528 - DNA, 20 bp, Artificial sequence
  synthetic polynucleotide sequence
gtaggtaactgcatcgcgga

SEQ ID NO: 29529 - DNA, 19 bp, Artificial sequence
  synthetic polynucleotide sequence
cgcgcatcatccctcgcca

SEQ ID NO: 29530 - DNA, 20 bp, Artificial sequence
  synthetic polynucleotide sequence
gggcaacaggacagcctgga

SEQ ID NO: 29531 - DNA, 18 bp, Artificial sequence
  synthetic polynucleotide sequence
cccggtagggcgagtgca

SEQ ID NO: 29532 - DNA, 20 bp, Artificial sequence
  synthetic polynucleotide sequence
ctccaggatctcggcggtca

SEQ ID NO: 29533 - DNA, 22 bp, Artificial sequence
  synthetic polynucleotide sequence
aagaggaggtggcaatggtaga

SEQ ID NO: 29534 - DNA, 20 bp, Artificial sequence
  synthetic polynucleotide sequence
gggaacaccatgaggggaga

SEQ ID NO: 29535 - DNA, 18 bp, Artificial sequence
  synthetic polynucleotide sequence
gctgcaggaggccagcga

SEQ ID NO: 29536 - DNA, 20 bp, Artificial sequence
  synthetic polynucleotide sequence
ggtcacgcgcttggcgtgga

SEQ ID NO: 29537 - DNA, 18 bp, Artificial sequence
  synthetic polynucleotide sequence
tggcgctgcaggaggcca

SEQ ID NO: 29538 - DNA, 18 bp, Artificial sequence
  synthetic polynucleotide sequence
tgcggcgggccaactgga

SEQ ID NO: 29539 - DNA, 18 bp, Artificial sequence
  synthetic polynucleotide sequence
agggggcgctaagcgcca

SEQ ID NO: 29540 - DNA, 20 bp, Artificial sequence
  synthetic polynucleotide sequence
agatccgcttaacgccgcca

SEQ ID NO: 29541 - DNA, 20 bp, Artificial sequence
  synthetic polynucleotide sequence
cacgtcccgcgaagtgcaga

SEQ ID NO: 29542 - DNA, 20 bp, Artificial sequence
  synthetic polynucleotide sequence
gggttcaggacgccgaggaa

SEQ ID NO: 29543 - DNA, 19 bp, Artificial sequence
  synthetic polynucleotide sequence
gagacccggggagtcctca

SEQ ID NO: 29544 - DNA, 21 bp, Artificial sequence
  synthetic polynucleotide sequence
cgtttcagcgcgtacaccaca

SEQ ID NO: 29545 - DNA, 20 bp, Artificial sequence
  synthetic polynucleotide sequence
tcctgctgcagctgagcaca

SEQ ID NO: 29546 - DNA, 21 bp, Artificial sequence
  synthetic polynucleotide sequence
gtggagtatgtgaggccagca

SEQ ID NO: 29547 - DNA, 20 bp, Artificial sequence
  synthetic polynucleotide sequence
acccacattgcccctgccaa

SEQ ID NO: 29548 - DNA, 19 bp, Artificial sequence
  synthetic polynucleotide sequence
tcatcaacagccgaggaga

SEQ ID NO: 29549 - DNA, 21 bp, Artificial sequence
  synthetic polynucleotide sequence
aacgactcatctccccagcga

SEQ ID NO: 29550 - DNA, 20 bp, Artificial sequence
  synthetic polynucleotide sequence
gggcagagggtgagaggaga

SEQ ID NO: 29551 - DNA, 21 bp, Artificial sequence
  synthetic polynucleotide sequence
ccaaccccacacacagcgcaa

SEQ ID NO: 29552 - DNA, 21 bp, Artificial sequence
  synthetic polynucleotide sequence
ctgcccaggagatttgaggca

SEQ ID NO: 29553 - DNA, 20 bp, Artificial sequence
  synthetic polynucleotide sequence
atgcaccagacggtgaagga

SEQ ID NO: 29554 - DNA, 18 bp, Artificial sequence
  synthetic polynucleotide sequence
tgcgtaaccgcacgccca

SEQ ID NO: 29555 - DNA, 20 bp, Artificial sequence
  synthetic polynucleotide sequence
gagcacctgtgacgacagca

SEQ ID NO: 29556 - DNA, 18 bp, Artificial sequence
  synthetic polynucleotide sequence
gggtcccatccacaccca

SEQ ID NO: 29557 - DNA, 20 bp, Artificial sequence
  synthetic polynucleotide sequence
gtggtggagaagatccggga

SEQ ID NO: 29558 - DNA, 18 bp, Artificial sequence
  synthetic polynucleotide sequence
aggcaacagcggtgacca

SEQ ID NO: 29559 - DNA, 20 bp, Artificial sequence
  synthetic polynucleotide sequence
cagcacgtgtgaggacagca

SEQ ID NO: 29560 - DNA, 18 bp, Artificial sequence
  synthetic polynucleotide sequence
gtgccgtccacacccaca

SEQ ID NO: 29561 - DNA, 21 bp, Artificial sequence
  synthetic polynucleotide sequence
ctcagctgcagtgaggagaga

SEQ ID NO: 29562 - DNA, 20 bp, Artificial sequence
  synthetic polynucleotide sequence
gtggagaggggatgcaggga

SEQ ID NO: 29563 - DNA, 20 bp, Artificial sequence
  synthetic polynucleotide sequence
gtgccttctggacaagagca

SEQ ID NO: 29564 - DNA, 21 bp, Artificial sequence
  synthetic polynucleotide sequence
caacgatgcccatgatgggga

SEQ ID NO: 29565 - DNA, 22 bp, Artificial sequence
  synthetic polynucleotide sequence
gaaattgaccgctacacagcaa

SEQ ID NO: 29566 - DNA, 20 bp, Artificial sequence
  synthetic polynucleotide sequence
gatgagaacaatgcccacga

SEQ ID NO: 29567 - DNA, 21 bp, Artificial sequence
  synthetic polynucleotide sequence
ctctcacagcacctcaaccaa

SEQ ID NO: 29568 - DNA, 20 bp, Artificial sequence
  synthetic polynucleotide sequence
catagcaggccagcatcaca

SEQ ID NO: 29569 - DNA, 18 bp, Artificial sequence
  synthetic polynucleotide sequence
tgactgccaggtggagca

SEQ ID NO: 29570 - DNA, 18 bp, Artificial sequence
  synthetic polynucleotide sequence
accagggtctccatggca

SEQ ID NO: 29571 - DNA, 19 bp, Artificial sequence
  synthetic polynucleotide sequence
ctgaatgggcaggaggaga

SEQ ID NO: 29572 - DNA, 20 bp, Artificial sequence
  synthetic polynucleotide sequence
cacagaaacagggctcagca

SEQ ID NO: 29573 - DNA, 20 bp, Artificial sequence
  synthetic polynucleotide sequence
ctgggaggcccaagagccaa

SEQ ID NO: 29574 - DNA, 20 bp, Artificial sequence
  synthetic polynucleotide sequence
tatgatgaggacggtgccca

SEQ ID NO: 29575 - DNA, 20 bp, Artificial sequence
  synthetic polynucleotide sequence
gtggagcacaccagcctgga

SEQ ID NO: 29576 - DNA, 21 bp, Artificial sequence
  synthetic polynucleotide sequence
ctccacagatgatgagcccca

SEQ ID NO: 29577 - DNA, 20 bp, Artificial sequence
  synthetic polynucleotide sequence
tatgactgcaaggtggagca

SEQ ID NO: 29578 - DNA, 19 bp, Artificial sequence
  synthetic polynucleotide sequence
gaagcaccaactgaacgca

SEQ ID NO: 29579 - DNA, 25 bp, Artificial sequence
  synthetic polynucleotide sequence
aaggtgcatcaccatctacaggaga

SEQ ID NO: 29580 - DNA, 25 bp, Artificial sequence
  synthetic polynucleotide sequence
gtcccagagaagaggtgagagaaga

SEQ ID NO: 29581 - DNA, 18 bp, Artificial sequence
  synthetic polynucleotide sequence
ccagcctccagagcccca

SEQ ID NO: 29582 - DNA, 19 bp, Artificial sequence
  synthetic polynucleotide sequence
tgacggatgataaggccca

SEQ ID NO: 29583 - DNA, 20 bp, Artificial sequence
  synthetic polynucleotide sequence
gcggagcatcgaggactgga

SEQ ID NO: 29584 - DNA, 20 bp, Artificial sequence
  synthetic polynucleotide sequence
ccgctgcaaggtcgtgcgca

SEQ ID NO: 29585 - DNA, 20 bp, Artificial sequence
  synthetic polynucleotide sequence
gagagagcccaacgtcctca

SEQ ID NO: 29586 - DNA, 21 bp, Artificial sequence
  synthetic polynucleotide sequence
ggagatagtggaacttgcgga

SEQ ID NO: 29587 - DNA, 21 bp, Artificial sequence
  synthetic polynucleotide sequence
acaagccctctcacagtggaa

SEQ ID NO: 29588 - DNA, 19 bp, Artificial sequence
  synthetic polynucleotide sequence
gatgaacagcccggcccca

SEQ ID NO: 29589 - DNA, 21 bp, Artificial sequence
  synthetic polynucleotide sequence
gtccacaggcctgattcagaa

SEQ ID NO: 29590 - DNA, 18 bp, Artificial sequence
  synthetic polynucleotide sequence
ccccgactccactcagca

SEQ ID NO: 29591 - DNA, 20 bp, Artificial sequence
  synthetic polynucleotide sequence
cgccagggacaccgcacaga

SEQ ID NO: 29592 - DNA, 20 bp, Artificial sequence
  synthetic polynucleotide sequence
agctcgcagccatgcatcca

SEQ ID NO: 29593 - DNA, 20 bp, Artificial sequence
  synthetic polynucleotide sequence
gaccgagtggccctgaggaa

SEQ ID NO: 29594 - DNA, 20 bp, Artificial sequence
  synthetic polynucleotide sequence
ctggtgatacccgcggagga

SEQ ID NO: 29595 - DNA, 20 bp, Artificial sequence
  synthetic polynucleotide sequence
ggcaaaggacggggagggaa

SEQ ID NO: 29596 - DNA, 21 bp, Artificial sequence
  synthetic polynucleotide sequence
tcactgcttccacgacagcca

SEQ ID NO: 29597 - DNA, 19 bp, Artificial sequence
  synthetic polynucleotide sequence
gcagagccccatcagacca

SEQ ID NO: 29598 - DNA, 18 bp, Artificial sequence
  synthetic polynucleotide sequence
aacccactgggacctgga

SEQ ID NO: 29599 - DNA, 18 bp, Artificial sequence
  synthetic polynucleotide sequence
aatgcgctaatgcacgca

SEQ ID NO: 29600 - DNA, 18 bp, Artificial sequence
  synthetic polynucleotide sequence
gggccatggaaccatcca

SEQ ID NO: 29601 - DNA, 20 bp, Artificial sequence
  synthetic polynucleotide sequence
cgactccgagtccctggaca

SEQ ID NO: 29602 - DNA, 19 bp, Artificial sequence
  synthetic polynucleotide sequence
gctgctcccaccactccca

SEQ ID NO: 29603 - DNA, 21 bp, Artificial sequence
  synthetic polynucleotide sequence
gagtagagctcctgcacctca

SEQ ID NO: 29604 - DNA, 20 bp, Artificial sequence
  synthetic polynucleotide sequence
tgcctcgaaggacttggcca

SEQ ID NO: 29605 - DNA, 21 bp, Artificial sequence
  synthetic polynucleotide sequence
tgaggagggacagcagtgtga

SEQ ID NO: 29606 - DNA, 21 bp, Artificial sequence
  synthetic polynucleotide sequence
tgatccctgctgcaacagcca

SEQ ID NO: 29607 - DNA, 21 bp, Artificial sequence
  synthetic polynucleotide sequence
tgttccccagtggtccagtca

SEQ ID NO: 29608 - DNA, 21 bp, Artificial sequence
  synthetic polynucleotide sequence
ggctgtaaggacgcttggcca

SEQ ID NO: 29609 - DNA, 19 bp, Artificial sequence
  synthetic polynucleotide sequence
gggggaccagactcccaga

SEQ ID NO: 29610 - DNA, 20 bp, Artificial sequence
  synthetic polynucleotide sequence
cacctcctccacaggaggca

SEQ ID NO: 29611 - DNA, 21 bp, Artificial sequence
  synthetic polynucleotide sequence
agtggagaagctggaggtgga

SEQ ID NO: 29612 - DNA, 20 bp, Artificial sequence
  synthetic polynucleotide sequence
tccacttccaggcaagggca

SEQ ID NO: 29613 - DNA, 19 bp, Artificial sequence
  synthetic polynucleotide sequence
gcgagcgtctggagcagga

SEQ ID NO: 29614 - DNA, 22 bp, Artificial sequence
  synthetic polynucleotide sequence
atgtagaagtccagagtgccca

SEQ ID NO: 29615 - DNA, 20 bp, Artificial sequence
  synthetic polynucleotide sequence
gaaggaaaccaaggggcaga

SEQ ID NO: 29616 - DNA, 18 bp, Artificial sequence
  synthetic polynucleotide sequence
ctccgaggactcctgcga

SEQ ID NO: 29617 - DNA, 21 bp, Artificial sequence
  synthetic polynucleotide sequence
ttatgaggtgggaggagcgaa

SEQ ID NO: 29618 - DNA, 22 bp, Artificial sequence
  synthetic polynucleotide sequence
gagggagaggaagagagagaga

SEQ ID NO: 29619 - DNA, 18 bp, Artificial sequence
  synthetic polynucleotide sequence
ggatcccaatgcacccaa

SEQ ID NO: 29620 - DNA, 19 bp, Artificial sequence
  synthetic polynucleotide sequence
tcgcaacatcaccaatgga

SEQ ID NO: 29621 - DNA, 22 bp, Artificial sequence
  synthetic polynucleotide sequence
aaagctcgctatgacagggaga

SEQ ID NO: 29622 - DNA, 19 bp, Artificial sequence
  synthetic polynucleotide sequence
tgggcgatgttcagagcaa

SEQ ID NO: 29623 - DNA, 22 bp, Artificial sequence
  synthetic polynucleotide sequence
atcaaatccacaaaccccggca

SEQ ID NO: 29624 - DNA, 20 bp, Artificial sequence
  synthetic polynucleotide sequence
tccgggcaactttagcagga

SEQ ID NO: 29625 - DNA, 21 bp, Artificial sequence
  synthetic polynucleotide sequence
gaagaaacggagaaagcggga

SEQ ID NO: 29626 - DNA, 20 bp, Artificial sequence
  synthetic polynucleotide sequence
ttggccacctgcaccaccga

SEQ ID NO: 29627 - DNA, 18 bp, Artificial sequence
  synthetic polynucleotide sequence
tctccctgggggacacca

SEQ ID NO: 29628 - DNA, 20 bp, Artificial sequence
  synthetic polynucleotide sequence
gtccacgacactcactccca

SEQ ID NO: 29629 - DNA, 20 bp, Artificial sequence
  synthetic polynucleotide sequence
tacggcccttcagatgggaa

SEQ ID NO: 29630 - DNA, 21 bp, Artificial sequence
  synthetic polynucleotide sequence
cctgtattgagccccaggcca

SEQ ID NO: 29631 - DNA, 18 bp, Artificial sequence
  synthetic polynucleotide sequence
acaacgcccatgcagcaa

SEQ ID NO: 29632 - DNA, 18 bp, Artificial sequence
  synthetic polynucleotide sequence
ggttggtcccaccaccca

SEQ ID NO: 29633 - DNA, 21 bp, Artificial sequence
  synthetic polynucleotide sequence
gaagctcagagaggacaccca

SEQ ID NO: 29634 - DNA, 18 bp, Artificial sequence
  synthetic polynucleotide sequence
agtgggacgccgagcgta

SEQ ID NO: 29635 - DNA, 18 bp, Artificial sequence
  synthetic polynucleotide sequence
tggcctcggagtacccaa

SEQ ID NO: 29636 - DNA, 18 bp, Artificial sequence
  synthetic polynucleotide sequence
catcaggcgagccagaga

SEQ ID NO: 29637 - DNA, 18 bp, Artificial sequence
  synthetic polynucleotide sequence
cggaaaacggggaaacga

SEQ ID NO: 29638 - DNA, 21 bp, Artificial sequence
  synthetic polynucleotide sequence
caagaagggagacagggacca

SEQ ID NO: 29639 - DNA, 21 bp, Artificial sequence
  synthetic polynucleotide sequence
caagagaaaggctgaagggga

SEQ ID NO: 29640 - DNA, 18 bp, Artificial sequence
  synthetic polynucleotide sequence
agcagacaacctcgcgga

SEQ ID NO: 29641 - DNA, 18 bp, Artificial sequence
  synthetic polynucleotide sequence
ggcaccccacccagcaca

SEQ ID NO: 29642 - DNA, 22 bp, Artificial sequence
  synthetic polynucleotide sequence
gagtgaagaagacaaggcagga

SEQ ID NO: 29643 - DNA, 22 bp, Artificial sequence
  synthetic polynucleotide sequence
aaaggcctctgcaaagaaggga

SEQ ID NO: 29644 - DNA, 21 bp, Artificial sequence
  synthetic polynucleotide sequence
tgggactggagtgtagaggca

SEQ ID NO: 29645 - DNA, 22 bp, Artificial sequence
  synthetic polynucleotide sequence
tatgaggcaggagccaaagaga

SEQ ID NO: 29646 - DNA, 19 bp, Artificial sequence
  synthetic polynucleotide sequence
ttcagcaactgcttgggca

SEQ ID NO: 29647 - DNA, 22 bp, Artificial sequence
  synthetic polynucleotide sequence
aaatctacaaggtgtgccccca

SEQ ID NO: 29648 - DNA, 20 bp, Artificial sequence
  synthetic polynucleotide sequence
agtcagctctgggtagcaga

SEQ ID NO: 29649 - DNA, 19 bp, Artificial sequence
  synthetic polynucleotide sequence
tggacaccgtctgcaggaa

SEQ ID NO: 29650 - DNA, 21 bp, Artificial sequence
  synthetic polynucleotide sequence
agtcccggcatgatgtaagca

SEQ ID NO: 29651 - DNA, 20 bp, Artificial sequence
  synthetic polynucleotide sequence
ggtgtggatgagcagggaca

SEQ ID NO: 29652 - DNA, 20 bp, Artificial sequence
  synthetic polynucleotide sequence
cagagcagaggcaaagggca

SEQ ID NO: 29653 - DNA, 21 bp, Artificial sequence
  synthetic polynucleotide sequence
gaacatggtgcagctcaggaa

SEQ ID NO: 29654 - DNA, 20 bp, Artificial sequence
  synthetic polynucleotide sequence
tttagcaagctgacagcgga

SEQ ID NO: 29655 - DNA, 21 bp, Artificial sequence
  synthetic polynucleotide sequence
cagtgccaccaagttcaagca

SEQ ID NO: 29656 - DNA, 20 bp, Artificial sequence
  synthetic polynucleotide sequence
ggatgttgagcaggaacgca

SEQ ID NO: 29657 - DNA, 20 bp, Artificial sequence
  synthetic polynucleotide sequence
ctccacactggccagagaga

SEQ ID NO: 29658 - DNA, 18 bp, Artificial sequence
  synthetic polynucleotide sequence
gtccagcagctagggcca

SEQ ID NO: 29659 - DNA, 21 bp, Artificial sequence
  synthetic polynucleotide sequence
agggaagttccgggtgccgaa

SEQ ID NO: 29660 - DNA, 21 bp, Artificial sequence
  synthetic polynucleotide sequence
atagacgaatccctctgggca

SEQ ID NO: 29661 - DNA, 21 bp, Artificial sequence
  synthetic polynucleotide sequence
ggggcaaagggaaacactgca

SEQ ID NO: 29662 - DNA, 20 bp, Artificial sequence
  synthetic polynucleotide sequence
ctccaaagagcccgttggca

SEQ ID NO: 29663 - DNA, 20 bp, Artificial sequence
  synthetic polynucleotide sequence
agctcacggagacccaggta

SEQ ID NO: 29664 - DNA, 18 bp, Artificial sequence
  synthetic polynucleotide sequence
cccggaacaccagcggca

SEQ ID NO: 29665 - DNA, 18 bp, Artificial sequence
  synthetic polynucleotide sequence
gcatcgtgcgggtgccca

SEQ ID NO: 29666 - DNA, 20 bp, Artificial sequence
  synthetic polynucleotide sequence
gtagtagacggggtgcggga

SEQ ID NO: 29667 - DNA, 18 bp, Artificial sequence
  synthetic polynucleotide sequence
aaatccccctggcggcaa

SEQ ID NO: 29668 - DNA, 20 bp, Artificial sequence
  synthetic polynucleotide sequence
gtgcagttcacaagcatgga

SEQ ID NO: 29669 - DNA, 20 bp, Artificial sequence
  synthetic polynucleotide sequence
tggagggaagaccagcgaca

SEQ ID NO: 29670 - DNA, 18 bp, Artificial sequence
  synthetic polynucleotide sequence
gctctgctccagccggga

SEQ ID NO: 29671 - DNA, 20 bp, Artificial sequence
  synthetic polynucleotide sequence
ctctacagccacaagcccga

SEQ ID NO: 29672 - DNA, 18 bp, Artificial sequence
  synthetic polynucleotide sequence
aagcccggactcactgga

SEQ ID NO: 29673 - DNA, 18 bp, Artificial sequence
  synthetic polynucleotide sequence
agcaagtctccccagcca

SEQ ID NO: 29674 - DNA, 18 bp, Artificial sequence
  synthetic polynucleotide sequence
aggtgctgactgggggca

SEQ ID NO: 29675 - DNA, 19 bp, Artificial sequence
  synthetic polynucleotide sequence
gctcggagccaccaagaga

SEQ ID NO: 29676 - DNA, 18 bp, Artificial sequence
  synthetic polynucleotide sequence
gcagctcctggaagggca

SEQ ID NO: 29677 - DNA, 20 bp, Artificial sequence
  synthetic polynucleotide sequence
cttgcaggttcagtcggcaa

SEQ ID NO: 29678 - DNA, 21 bp, Artificial sequence
  synthetic polynucleotide sequence
tgcttgacccagggcttgaga

SEQ ID NO: 29679 - DNA, 19 bp, Artificial sequence
  synthetic polynucleotide sequence
gacaagaagctgccaggca

SEQ ID NO: 29680 - DNA, 18 bp, Artificial sequence
  synthetic polynucleotide sequence
cacctgcacctccgccta

SEQ ID NO: 29681 - DNA, 19 bp, Artificial sequence
  synthetic polynucleotide sequence
ctactccggtgggggtgga

SEQ ID NO: 29682 - DNA, 20 bp, Artificial sequence
  synthetic polynucleotide sequence
ccgccgaagccgttaccgta

SEQ ID NO: 29683 - DNA, 18 bp, Artificial sequence
  synthetic polynucleotide sequence
cagggtgggggctacgga

SEQ ID NO: 29684 - DNA, 18 bp, Artificial sequence
  synthetic polynucleotide sequence
ctcccaccataaccccca

SEQ ID NO: 29685 - DNA, 18 bp, Artificial sequence
  synthetic polynucleotide sequence
gacccatgaaagggggca

SEQ ID NO: 29686 - DNA, 18 bp, Artificial sequence
  synthetic polynucleotide sequence
ccaccacttccaccacca

SEQ ID NO: 29687 - DNA, 21 bp, Artificial sequence
  synthetic polynucleotide sequence
agtttggggagattgaggcca

SEQ ID NO: 29688 - DNA, 18 bp, Artificial sequence
  synthetic polynucleotide sequence
cggtttccacggccccca

SEQ ID NO: 29689 - DNA, 20 bp, Artificial sequence
  synthetic polynucleotide sequence
gaaacgatccgcagcggaga

SEQ ID NO: 29690 - DNA, 20 bp, Artificial sequence
  synthetic polynucleotide sequence
gggcactacagccagagcaa

SEQ ID NO: 29691 - DNA, 23 bp, Artificial sequence
  synthetic polynucleotide sequence
gtctgaagaggagcagaccagca

SEQ ID NO: 29692 - DNA, 20 bp, Artificial sequence
  synthetic polynucleotide sequence
aggtccccctcctcaacaga

SEQ ID NO: 29693 - DNA, 18 bp, Artificial sequence
  synthetic polynucleotide sequence
gaggcaccgaagggggca

SEQ ID NO: 29694 - DNA, 19 bp, Artificial sequence
  synthetic polynucleotide sequence
cagagtgtcgtggggagga

SEQ ID NO: 29695 - DNA, 21 bp, Artificial sequence
  synthetic polynucleotide sequence
gtcactgggagatcaagagga

SEQ ID NO: 29696 - DNA, 18 bp, Artificial sequence
  synthetic polynucleotide sequence
ccgggctcaatccaccca

SEQ ID NO: 29697 - DNA, 18 bp, Artificial sequence
  synthetic polynucleotide sequence
accgacctgttcgggaga

SEQ ID NO: 29698 - DNA, 18 bp, Artificial sequence
  synthetic polynucleotide sequence
aggcccctcatgtggaca

SEQ ID NO: 29699 - DNA, 20 bp, Artificial sequence
  synthetic polynucleotide sequence
tcatggctatgcagcggcca

SEQ ID NO: 29700 - DNA, 20 bp, Artificial sequence
  synthetic polynucleotide sequence
accataggcaccacgcctca

SEQ ID NO: 29701 - DNA, 21 bp, Artificial sequence
  synthetic polynucleotide sequence
ggaggctacggaagagatgga

SEQ ID NO: 29702 - DNA, 19 bp, Artificial sequence
  synthetic polynucleotide sequence
cccacgccatccacctcca

SEQ ID NO: 29703 - DNA, 21 bp, Artificial sequence
  synthetic polynucleotide sequence
tctcccatcaaaggacgtgca

SEQ ID NO: 29704 - DNA, 20 bp, Artificial sequence
  synthetic polynucleotide sequence
atcccactgggcgtccgcga

SEQ ID NO: 29705 - DNA, 19 bp, Artificial sequence
  synthetic polynucleotide sequence
gctgggagtgaagcggcca

SEQ ID NO: 29706 - DNA, 22 bp, Artificial sequence
  synthetic polynucleotide sequence
gtaatggttcaggaagcccaga

SEQ ID NO: 29707 - DNA, 22 bp, Artificial sequence
  synthetic polynucleotide sequence
aaaaggatcactcggccaggaa

SEQ ID NO: 29708 - DNA, 19 bp, Artificial sequence
  synthetic polynucleotide sequence
tctgggcacaaaggactga

SEQ ID NO: 29709 - DNA, 22 bp, Artificial sequence
  synthetic polynucleotide sequence
acaaattcaacgagtgcggcca

SEQ ID NO: 29710 - DNA, 18 bp, Artificial sequence
  synthetic polynucleotide sequence
ggcaggctctctcggcca

SEQ ID NO: 29711 - DNA, 20 bp, Artificial sequence
  synthetic polynucleotide sequence
gaggctctaggggtggcaga

SEQ ID NO: 29712 - DNA, 18 bp, Artificial sequence
  synthetic polynucleotide sequence
cccccacgattgccccga

SEQ ID NO: 29713 - DNA, 18 bp, Artificial sequence
  synthetic polynucleotide sequence
aggaggagcccctgggaa

SEQ ID NO: 29714 - DNA, 20 bp, Artificial sequence
  synthetic polynucleotide sequence
atggatagccgattccacca

SEQ ID NO: 29715 - DNA, 20 bp, Artificial sequence
  synthetic polynucleotide sequence
cgccaataccagcaccccca

SEQ ID NO: 29716 - DNA, 21 bp, Artificial sequence
  synthetic polynucleotide sequence
ttgtaggcaggtggtggtgga

SEQ ID NO: 29717 - DNA, 21 bp, Artificial sequence
  synthetic polynucleotide sequence
gaggctggagttgaggaagga

SEQ ID NO: 29718 - DNA, 18 bp, Artificial sequence
  synthetic polynucleotide sequence
gcttctcggaggggggca

SEQ ID NO: 29719 - DNA, 19 bp, Artificial sequence
  synthetic polynucleotide sequence
ggtgtgccagctggagcga

SEQ ID NO: 29720 - DNA, 20 bp, Artificial sequence
  synthetic polynucleotide sequence
gatcccaaagcgccgggtca

SEQ ID NO: 29721 - DNA, 22 bp, Artificial sequence
  synthetic polynucleotide sequence
agctgctcgactagcaaaggaa

SEQ ID NO: 29722 - DNA, 21 bp, Artificial sequence
  synthetic polynucleotide sequence
ggctctgagttctgtgtcaca

SEQ ID NO: 29723 - DNA, 18 bp, Artificial sequence
  synthetic polynucleotide sequence
tgtcaacgggacggacga

SEQ ID NO: 29724 - DNA, 18 bp, Artificial sequence
  synthetic polynucleotide sequence
gcgctctgcgtcaaggca

SEQ ID NO: 29725 - DNA, 20 bp, Artificial sequence
  synthetic polynucleotide sequence
gtgcaaaccaaggaccagga

SEQ ID NO: 29726 - DNA, 18 bp, Artificial sequence
  synthetic polynucleotide sequence
cctccaggctgcgctcca

SEQ ID NO: 29727 - DNA, 22 bp, Artificial sequence
  synthetic polynucleotide sequence
aaagtggtttcgggacaacgca

SEQ ID NO: 29728 - DNA, 18 bp, Artificial sequence
  synthetic polynucleotide sequence
ggggtggagggatcggca

SEQ ID NO: 29729 - DNA, 22 bp, Artificial sequence
  synthetic polynucleotide sequence
ggatgttggggacaactggaga

SEQ ID NO: 29730 - DNA, 22 bp, Artificial sequence
  synthetic polynucleotide sequence
aataagctggagcaacctccca

SEQ ID NO: 29731 - DNA, 20 bp, Artificial sequence
  synthetic polynucleotide sequence
ataccgccgctacgtggaca

SEQ ID NO: 29732 - DNA, 20 bp, Artificial sequence
  synthetic polynucleotide sequence
ctccaggtgtcggatgcgga

SEQ ID NO: 29733 - DNA, 18 bp, Artificial sequence
  synthetic polynucleotide sequence
gggcggagctgtgcgaga

SEQ ID NO: 29734 - DNA, 20 bp, Artificial sequence
  synthetic polynucleotide sequence
gaagaacctgggccatcaca

SEQ ID NO: 29735 - DNA, 21 bp, Artificial sequence
  synthetic polynucleotide sequence
acaagcacccggattccacca

SEQ ID NO: 29736 - DNA, 20 bp, Artificial sequence
  synthetic polynucleotide sequence
tctgagggcaggccttctga

SEQ ID NO: 29737 - DNA, 21 bp, Artificial sequence
  synthetic polynucleotide sequence
ctgacaccaagaaagcaagca

SEQ ID NO: 29738 - DNA, 20 bp, Artificial sequence
  synthetic polynucleotide sequence
caccatccttaaaaccggga

SEQ ID NO: 29739 - DNA, 22 bp, Artificial sequence
  synthetic polynucleotide sequence
acaaggagcctatcaacgtgca

SEQ ID NO: 29740 - DNA, 21 bp, Artificial sequence
  synthetic polynucleotide sequence
agtctagaccctgatgggcga

SEQ ID NO: 29741 - DNA, 20 bp, Artificial sequence
  synthetic polynucleotide sequence
ccagccggctacctaccaga

SEQ ID NO: 29742 - DNA, 20 bp, Artificial sequence
  synthetic polynucleotide sequence
cgtaggggctgtaaggcgca

SEQ ID NO: 29743 - DNA, 21 bp, Artificial sequence
  synthetic polynucleotide sequence
agagattagccgcagcgtcca

SEQ ID NO: 29744 - DNA, 20 bp, Artificial sequence
  synthetic polynucleotide sequence
gttggctgtgagctcccgga

SEQ ID NO: 29745 - DNA, 18 bp, Artificial sequence
  synthetic polynucleotide sequence
gcgctgcccctataccaa

SEQ ID NO: 29746 - DNA, 18 bp, Artificial sequence
  synthetic polynucleotide sequence
gcatgcgggacagttgca

SEQ ID NO: 29747 - DNA, 20 bp, Artificial sequence
  synthetic polynucleotide sequence
ccaacggctggaacggccaa

SEQ ID NO: 29748 - DNA, 20 bp, Artificial sequence
  synthetic polynucleotide sequence
aggagctggcatccgaggga

SEQ ID NO: 29749 - DNA, 19 bp, Artificial sequence
  synthetic polynucleotide sequence
tttcagcaccagtcaccca

SEQ ID NO: 29750 - DNA, 21 bp, Artificial sequence
  synthetic polynucleotide sequence
atctacgggactgtcgaggga

SEQ ID NO: 29751 - DNA, 21 bp, Artificial sequence
  synthetic polynucleotide sequence
ggaccccacacatacagggaa

SEQ ID NO: 29752 - DNA, 18 bp, Artificial sequence
  synthetic polynucleotide sequence
gcagcgtgggggaggtga

SEQ ID NO: 29753 - DNA, 22 bp, Artificial sequence
  synthetic polynucleotide sequence
aacaccaagatgcgatcctcca

SEQ ID NO: 29754 - DNA, 20 bp, Artificial sequence
  synthetic polynucleotide sequence
gaggagggaacgggtgtgga

SEQ ID NO: 29755 - DNA, 20 bp, Artificial sequence
  synthetic polynucleotide sequence
acccacatcagcagcagaga

SEQ ID NO: 29756 - DNA, 18 bp, Artificial sequence
  synthetic polynucleotide sequence
gggccgcctatgttgtca

SEQ ID NO: 29757 - DNA, 19 bp, Artificial sequence
  synthetic polynucleotide sequence
tacccttggatgcagcgga

SEQ ID NO: 29758 - DNA, 18 bp, Artificial sequence
  synthetic polynucleotide sequence
ctggcgctcggtgaggca

SEQ ID NO: 29759 - DNA, 21 bp, Artificial sequence
  synthetic polynucleotide sequence
ccagacctacacgcgctacca

SEQ ID NO: 29760 - DNA, 18 bp, Artificial sequence
  synthetic polynucleotide sequence
ctggcgctcggtgaggca

SEQ ID NO: 29761 - DNA, 20 bp, Artificial sequence
  synthetic polynucleotide sequence
cctccaccatccccgcacaa

SEQ ID NO: 29762 - DNA, 20 bp, Artificial sequence
  synthetic polynucleotide sequence
tcaaagcggcaggcctacga

SEQ ID NO: 29763 - DNA, 20 bp, Artificial sequence
  synthetic polynucleotide sequence
accacaaggcagctgacaga

SEQ ID NO: 29764 - DNA, 18 bp, Artificial sequence
  synthetic polynucleotide sequence
agctccagggtggcggca

SEQ ID NO: 29765 - DNA, 21 bp, Artificial sequence
  synthetic polynucleotide sequence
cagggagaacagaacccacca

SEQ ID NO: 29766 - DNA, 19 bp, Artificial sequence
  synthetic polynucleotide sequence
gccgcatactcccgctcca

SEQ ID NO: 29767 - DNA, 18 bp, Artificial sequence
  synthetic polynucleotide sequence
cttctcggggcgccagga

SEQ ID NO: 29768 - DNA, 21 bp, Artificial sequence
  synthetic polynucleotide sequence
ggaaactgcaggtcgatggca

SEQ ID NO: 29769 - DNA, 18 bp, Artificial sequence
  synthetic polynucleotide sequence
gcccatctccagccggca

SEQ ID NO: 29770 - DNA, 20 bp, Artificial sequence
  synthetic polynucleotide sequence
tagttggagggcagcgcgta

SEQ ID NO: 29771 - DNA, 18 bp, Artificial sequence
  synthetic polynucleotide sequence
cgcctacacgcgccagca

SEQ ID NO: 29772 - DNA, 21 bp, Artificial sequence
  synthetic polynucleotide sequence
tcttgatctggcgctcggaga

SEQ ID NO: 29773 - DNA, 20 bp, Artificial sequence
  synthetic polynucleotide sequence
ggtctggctagagggcccaa

SEQ ID NO: 29774 - DNA, 25 bp, Artificial sequence
  synthetic polynucleotide sequence
aggccccgcaaagacagatttcaca

SEQ ID NO: 29775 - DNA, 18 bp, Artificial sequence
  synthetic polynucleotide sequence
cgagccgcggaagtcgga

SEQ ID NO: 29776 - DNA, 22 bp, Artificial sequence
  synthetic polynucleotide sequence
caaaggaggaactgttgcacga

SEQ ID NO: 29777 - DNA, 19 bp, Artificial sequence
  synthetic polynucleotide sequence
cgcaaacgaggccgccaga

SEQ ID NO: 29778 - DNA, 18 bp, Artificial sequence
  synthetic polynucleotide sequence
ggcagagcgtgtgcgcga

SEQ ID NO: 29779 - DNA, 18 bp, Artificial sequence
  synthetic polynucleotide sequence
ggacgcgcctccagccaa

SEQ ID NO: 29780 - DNA, 21 bp, Artificial sequence
  synthetic polynucleotide sequence
gatgtaagggtggtagacgga

SEQ ID NO: 29781 - DNA, 20 bp, Artificial sequence
  synthetic polynucleotide sequence
agcgcagagaagcgggcgaa

SEQ ID NO: 29782 - DNA, 20 bp, Artificial sequence
  synthetic polynucleotide sequence
ggcgcggtagtagctgggca

SEQ ID NO: 29783 - DNA, 20 bp, Artificial sequence
  synthetic polynucleotide sequence
gaggcagtagggagatggga

SEQ ID NO: 29784 - DNA, 20 bp, Artificial sequence
  synthetic polynucleotide sequence
agcagggtggggagtgcaca

SEQ ID NO: 29785 - DNA, 19 bp, Artificial sequence
  synthetic polynucleotide sequence
cgaccccggcagcttggta

SEQ ID NO: 29786 - DNA, 21 bp, Artificial sequence
  synthetic polynucleotide sequence
tgaccagaaactcgccctcca

SEQ ID NO: 29787 - DNA, 21 bp, Artificial sequence
  synthetic polynucleotide sequence
ctccaatggctgggacagtca

SEQ ID NO: 29788 - DNA, 19 bp, Artificial sequence
  synthetic polynucleotide sequence
ctgctcacctcgggctgca

SEQ ID NO: 29789 - DNA, 22 bp, Artificial sequence
  synthetic polynucleotide sequence
atctggttccaaaaccgtcgca

SEQ ID NO: 29790 - DNA, 21 bp, Artificial sequence
  synthetic polynucleotide sequence
tcttcagaagtacccggggta

SEQ ID NO: 29791 - DNA, 21 bp, Artificial sequence
  synthetic polynucleotide sequence
caggcgcatagagatcgccaa

SEQ ID NO: 29792 - DNA, 20 bp, Artificial sequence
  synthetic polynucleotide sequence
cctgcggttctggaaccaga

SEQ ID NO: 29793 - DNA, 21 bp, Artificial sequence
  synthetic polynucleotide sequence
agatctactcgcggtaccaga

SEQ ID NO: 29794 - DNA, 21 bp, Artificial sequence
  synthetic polynucleotide sequence
atctgtcgctcggtcaggcaa

SEQ ID NO: 29795 - DNA, 19 bp, Artificial sequence
  synthetic polynucleotide sequence
ttccatggatgagacccca

SEQ ID NO: 29796 - DNA, 19 bp, Artificial sequence
  synthetic polynucleotide sequence
ctcggtcagtcccagggca

SEQ ID NO: 29797 - DNA, 18 bp, Artificial sequence
  synthetic polynucleotide sequence
cgcccgctccacgaggaa

SEQ ID NO: 29798 - DNA, 21 bp, Artificial sequence
  synthetic polynucleotide sequence
tgagattgagaacccgggcca

SEQ ID NO: 29799 - DNA, 19 bp, Artificial sequence
  synthetic polynucleotide sequence
tgcacctgaatgacacgca

SEQ ID NO: 29800 - DNA, 20 bp, Artificial sequence
  synthetic polynucleotide sequence
agaggggaagttggagggga

SEQ ID NO: 29801 - DNA, 20 bp, Artificial sequence
  synthetic polynucleotide sequence
agcggccaggagcccaccaa

SEQ ID NO: 29802 - DNA, 20 bp, Artificial sequence
  synthetic polynucleotide sequence
acttcgggactggacacgga

SEQ ID NO: 29803 - DNA, 18 bp, Artificial sequence
  synthetic polynucleotide sequence
ccgcgaactggaacgcga

SEQ ID NO: 29804 - DNA, 20 bp, Artificial sequence
  synthetic polynucleotide sequence
gtgaggttgagcatccgaga

SEQ ID NO: 29805 - DNA, 22 bp, Artificial sequence
  synthetic polynucleotide sequence
tcaacaggcagaaacgcaagga

SEQ ID NO: 29806 - DNA, 20 bp, Artificial sequence
  synthetic polynucleotide sequence
cagcgcctgctcccgaagca

SEQ ID NO: 29807 - DNA, 18 bp, Artificial sequence
  synthetic polynucleotide sequence
aacgaggtgccagcgcga

SEQ ID NO: 29808 - DNA, 20 bp, Artificial sequence
  synthetic polynucleotide sequence
ccaggactggtacccctcca

SEQ ID NO: 29809 - DNA, 20 bp, Artificial sequence
  synthetic polynucleotide sequence
gagggaccagagcttggaga

SEQ ID NO: 29810 - DNA, 21 bp, Artificial sequence
  synthetic polynucleotide sequence
ccttacggcacaggaaggaga

SEQ ID NO: 29811 - DNA, 19 bp, Artificial sequence
  synthetic polynucleotide sequence
ctgacaaggcgccgtcgga

SEQ ID NO: 29812 - DNA, 22 bp, Artificial sequence
  synthetic polynucleotide sequence
atgaggaggaagatgaggacga

SEQ ID NO: 29813 - DNA, 22 bp, Artificial sequence
  synthetic polynucleotide sequence
agctcctggtagacgaagagga

SEQ ID NO: 29814 - DNA, 18 bp, Artificial sequence
  synthetic polynucleotide sequence
gagggctagggcgtggga

SEQ ID NO: 29815 - DNA, 19 bp, Artificial sequence
  synthetic polynucleotide sequence
cagcgaccacccgatccca

SEQ ID NO: 29816 - DNA, 18 bp, Artificial sequence
  synthetic polynucleotide sequence
gggtggagcgagcgtgga

SEQ ID NO: 29817 - DNA, 19 bp, Artificial sequence
  synthetic polynucleotide sequence
gctgaccaagaccaatgca

SEQ ID NO: 29818 - DNA, 22 bp, Artificial sequence
  synthetic polynucleotide sequence
ggtacttagacatgccagcaca

SEQ ID NO: 29819 - DNA, 19 bp, Artificial sequence
  synthetic polynucleotide sequence
cagctagccagggcccaga

SEQ ID NO: 29820 - DNA, 23 bp, Artificial sequence
  synthetic polynucleotide sequence
gaatagcaaccactgatgcacca

SEQ ID NO: 29821 - DNA, 21 bp, Artificial sequence
  synthetic polynucleotide sequence
gtccgtgatgaagatgccgga

SEQ ID NO: 29822 - DNA, 20 bp, Artificial sequence
  synthetic polynucleotide sequence
cccgcggatgaactcctcca

SEQ ID NO: 29823 - DNA, 19 bp, Artificial sequence
  synthetic polynucleotide sequence
tcagcatgtacgacctgga

SEQ ID NO: 29824 - DNA, 20 bp, Artificial sequence
  synthetic polynucleotide sequence
ggtggactcatcctccggca

SEQ ID NO: 29825 - DNA, 20 bp, Artificial sequence
  synthetic polynucleotide sequence
gaccaggataaggacgacca

SEQ ID NO: 29826 - DNA, 20 bp, Artificial sequence
  synthetic polynucleotide sequence
ctgcatgtcacactgcagca

SEQ ID NO: 29827 - DNA, 18 bp, Artificial sequence
  synthetic polynucleotide sequence
acgcaggtgcacacggaa

SEQ ID NO: 29828 - DNA, 18 bp, Artificial sequence
  synthetic polynucleotide sequence
gcgatgtgctggacccca

SEQ ID NO: 29829 - DNA, 21 bp, Artificial sequence
  synthetic polynucleotide sequence
atctgcttgctcgacagggga

SEQ ID NO: 29830 - DNA, 21 bp, Artificial sequence
  synthetic polynucleotide sequence
atgttgccctgaccaaagcca

SEQ ID NO: 29831 - DNA, 22 bp, Artificial sequence
  synthetic polynucleotide sequence
aactcacagaagcagccagaga

SEQ ID NO: 29832 - DNA, 20 bp, Artificial sequence
  synthetic polynucleotide sequence
cagggagctctcggtaccca

SEQ ID NO: 29833 - DNA, 19 bp, Artificial sequence
  synthetic polynucleotide sequence
ggctcagggcataggcaga

SEQ ID NO: 29834 - DNA, 18 bp, Artificial sequence
  synthetic polynucleotide sequence
cagccacatcgcactgga

SEQ ID NO: 29835 - DNA, 21 bp, Artificial sequence
  synthetic polynucleotide sequence
gggcagacttctactgggaga

SEQ ID NO: 29836 - DNA, 19 bp, Artificial sequence
  synthetic polynucleotide sequence
tatccagttagcgacggca

SEQ ID NO: 29837 - DNA, 18 bp, Artificial sequence
  synthetic polynucleotide sequence
aggaggctcgagtcccca

SEQ ID NO: 29838 - DNA, 18 bp, Artificial sequence
  synthetic polynucleotide sequence
aatgccacacagccgcca

SEQ ID NO: 29839 - DNA, 18 bp, Artificial sequence
  synthetic polynucleotide sequence
gctatggcgatgcgggca

SEQ ID NO: 29840 - DNA, 20 bp, Artificial sequence
  synthetic polynucleotide sequence
caccatactcagccacagca

SEQ ID NO: 29841 - DNA, 21 bp, Artificial sequence
  synthetic polynucleotide sequence
ccagaacatccccgtgcagca

SEQ ID NO: 29842 - DNA, 20 bp, Artificial sequence
  synthetic polynucleotide sequence
aggggaaggagctggtgtga

SEQ ID NO: 29843 - DNA, 21 bp, Artificial sequence
  synthetic polynucleotide sequence
tgagccaaagcaagtgcccca

SEQ ID NO: 29844 - DNA, 22 bp, Artificial sequence
  synthetic polynucleotide sequence
aatcaacagccgaggttccaga

SEQ ID NO: 29845 - DNA, 22 bp, Artificial sequence
  synthetic polynucleotide sequence
gaatgcagttcaggctcagcaa

SEQ ID NO: 29846 - DNA, 20 bp, Artificial sequence
  synthetic polynucleotide sequence
agcaccagccctttgacgca

SEQ ID NO: 29847 - DNA, 21 bp, Artificial sequence
  synthetic polynucleotide sequence
atcccagagaccgtggaggaa

SEQ ID NO: 29848 - DNA, 21 bp, Artificial sequence
  synthetic polynucleotide sequence
tgtagcagtgaccaagcccga

SEQ ID NO: 29849 - DNA, 21 bp, Artificial sequence
  synthetic polynucleotide sequence
ggcaagctgaggtcccaagca

SEQ ID NO: 29850 - DNA, 21 bp, Artificial sequence
  synthetic polynucleotide sequence
tcctcacctagcactgccaga

SEQ ID NO: 29851 - DNA, 20 bp, Artificial sequence
  synthetic polynucleotide sequence
ttcacccaggagccgctgca

SEQ ID NO: 29852 - DNA, 22 bp, Artificial sequence
  synthetic polynucleotide sequence
cgaagctttggagaacccagga

SEQ ID NO: 29853 - DNA, 18 bp, Artificial sequence
  synthetic polynucleotide sequence
tgctggccaatcagggca

SEQ ID NO: 29854 - DNA, 18 bp, Artificial sequence
  synthetic polynucleotide sequence
agcccagccacatgcaca

SEQ ID NO: 29855 - DNA, 18 bp, Artificial sequence
  synthetic polynucleotide sequence
ccaagccacgtggacaga

SEQ ID NO: 29856 - DNA, 18 bp, Artificial sequence
  synthetic polynucleotide sequence
aggtacaagccgggacca

SEQ ID NO: 29857 - DNA, 18 bp, Artificial sequence
  synthetic polynucleotide sequence
gtgcatgccgacacacca

SEQ ID NO: 29858 - DNA, 18 bp, Artificial sequence
  synthetic polynucleotide sequence
cggaacacgtgccacaca

SEQ ID NO: 29859 - DNA, 18 bp, Artificial sequence
  synthetic polynucleotide sequence
acgggtgaaggactcgga

SEQ ID NO: 29860 - DNA, 18 bp, Artificial sequence
  synthetic polynucleotide sequence
gagcctgccgagattcca

SEQ ID NO: 29861 - DNA, 20 bp, Artificial sequence
  synthetic polynucleotide sequence
accccggcttgagagtgaga

SEQ ID NO: 29862 - DNA, 21 bp, Artificial sequence
  synthetic polynucleotide sequence
ttggcgcttgtaaaggacgca

SEQ ID NO: 29863 - DNA, 22 bp, Artificial sequence
  synthetic polynucleotide sequence
gcaagcagctgagggaaaacca

SEQ ID NO: 29864 - DNA, 21 bp, Artificial sequence
  synthetic polynucleotide sequence
ctgcccacctcaaactcctca

SEQ ID NO: 29865 - DNA, 20 bp, Artificial sequence
  synthetic polynucleotide sequence
gaggacacaggtccacagga

SEQ ID NO: 29866 - DNA, 18 bp, Artificial sequence
  synthetic polynucleotide sequence
agcttcctggagcgcaga

SEQ ID NO: 29867 - DNA, 21 bp, Artificial sequence
  synthetic polynucleotide sequence
gtgacgtggagaggaaccgta

SEQ ID NO: 29868 - DNA, 21 bp, Artificial sequence
  synthetic polynucleotide sequence
acgtggccaggatgacggtga

SEQ ID NO: 29869 - DNA, 18 bp, Artificial sequence
  synthetic polynucleotide sequence
tcatggacaccaccccca

SEQ ID NO: 29870 - DNA, 20 bp, Artificial sequence
  synthetic polynucleotide sequence
gtggtgggtcacaaggtcca

SEQ ID NO: 29871 - DNA, 21 bp, Artificial sequence
  synthetic polynucleotide sequence
accatcccaaacccccaagga

SEQ ID NO: 29872 - DNA, 19 bp, Artificial sequence
  synthetic polynucleotide sequence
gccgcagcctgcatgtgca

SEQ ID NO: 29873 - DNA, 18 bp, Artificial sequence
  synthetic polynucleotide sequence
ccaccatcagggagcaca

SEQ ID NO: 29874 - DNA, 18 bp, Artificial sequence
  synthetic polynucleotide sequence
gttggcatagcccagcca

SEQ ID NO: 29875 - DNA, 21 bp, Artificial sequence
  synthetic polynucleotide sequence
gctcactcaagaggggctcca

SEQ ID NO: 29876 - DNA, 20 bp, Artificial sequence
  synthetic polynucleotide sequence
tcctgtcccgagacagccga

SEQ ID NO: 29877 - DNA, 20 bp, Artificial sequence
  synthetic polynucleotide sequence
gtctaggagggaggatggca

SEQ ID NO: 29878 - DNA, 20 bp, Artificial sequence
  synthetic polynucleotide sequence
ggtgggggagatagcaacca

SEQ ID NO: 29879 - DNA, 18 bp, Artificial sequence
  synthetic polynucleotide sequence
aggggtgaacgacacgga

SEQ ID NO: 29880 - DNA, 19 bp, Artificial sequence
  synthetic polynucleotide sequence
cgaagactgacgggagcca

SEQ ID NO: 29881 - DNA, 20 bp, Artificial sequence
  synthetic polynucleotide sequence
cgggcaggaagctgtctcca

SEQ ID NO: 29882 - DNA, 20 bp, Artificial sequence
  synthetic polynucleotide sequence
cagcaggagggagtcaccca

SEQ ID NO: 29883 - DNA, 19 bp, Artificial sequence
  synthetic polynucleotide sequence
ccgagaaattgagcagcga

SEQ ID NO: 29884 - DNA, 20 bp, Artificial sequence
  synthetic polynucleotide sequence
tgcacacaggtcataggcga

SEQ ID NO: 29885 - DNA, 19 bp, Artificial sequence
  synthetic polynucleotide sequence
cctacccgtccatcgagga

SEQ ID NO: 29886 - DNA, 18 bp, Artificial sequence
  synthetic polynucleotide sequence
ggatgtggcgcagcggga

SEQ ID NO: 29887 - DNA, 21 bp, Artificial sequence
  synthetic polynucleotide sequence
ccaagaagcccgacatcccga

SEQ ID NO: 29888 - DNA, 22 bp, Artificial sequence
  synthetic polynucleotide sequence
aagtgaatctgagctagcggga

SEQ ID NO: 29889 - DNA, 21 bp, Artificial sequence
  synthetic polynucleotide sequence
tgggcaagaccaagggcagga

SEQ ID NO: 29890 - DNA, 21 bp, Artificial sequence
  synthetic polynucleotide sequence
agccaaagtcgtgcccggtca

SEQ ID NO: 29891 - DNA, 20 bp, Artificial sequence
  synthetic polynucleotide sequence
ctgccggagcttgcacccca

SEQ ID NO: 29892 - DNA, 23 bp, Artificial sequence
  synthetic polynucleotide sequence
cacgtgccaggacaaattgccga

SEQ ID NO: 29893 - DNA, 18 bp, Artificial sequence
  synthetic polynucleotide sequence
accccgtgaccagggcca

SEQ ID NO: 29894 - DNA, 20 bp, Artificial sequence
  synthetic polynucleotide sequence
gaggatctgggagaggggga

SEQ ID NO: 29895 - DNA, 21 bp, Artificial sequence
  synthetic polynucleotide sequence
agaagctggccatagacccta

SEQ ID NO: 29896 - DNA, 21 bp, Artificial sequence
  synthetic polynucleotide sequence
tgatgaggcgatctccatcga

SEQ ID NO: 29897 - DNA, 18 bp, Artificial sequence
  synthetic polynucleotide sequence
catgtccccggacacgaa

SEQ ID NO: 29898 - DNA, 18 bp, Artificial sequence
  synthetic polynucleotide sequence
acagggggaagtagcgca

SEQ ID NO: 29899 - DNA, 18 bp, Artificial sequence
  synthetic polynucleotide sequence
gggctgcacgctacagga

SEQ ID NO: 29900 - DNA, 20 bp, Artificial sequence
  synthetic polynucleotide sequence
ggacaggttgtagcagccca

SEQ ID NO: 29901 - DNA, 19 bp, Artificial sequence
  synthetic polynucleotide sequence
ggctgagaccgtccaggaa

SEQ ID NO: 29902 - DNA, 19 bp, Artificial sequence
  synthetic polynucleotide sequence
ccagtgtagcagctgggca

SEQ ID NO: 29903 - DNA, 21 bp, Artificial sequence
  synthetic polynucleotide sequence
acactcctgcagcagatgcaa

SEQ ID NO: 29904 - DNA, 19 bp, Artificial sequence
  synthetic polynucleotide sequence
tccaccccagcctgtgtca

SEQ ID NO: 29905 - DNA, 19 bp, Artificial sequence
  synthetic polynucleotide sequence
gcaccagagaaggaggcca

SEQ ID NO: 29906 - DNA, 18 bp, Artificial sequence
  synthetic polynucleotide sequence
gtctgcccaggactgcca

SEQ ID NO: 29907 - DNA, 22 bp, Artificial sequence
  synthetic polynucleotide sequence
agcacaggtaccagcaactgca

SEQ ID NO: 29908 - DNA, 18 bp, Artificial sequence
  synthetic polynucleotide sequence
ctctgctcaggggggcca

SEQ ID NO: 29909 - DNA, 22 bp, Artificial sequence
  synthetic polynucleotide sequence
ctgaagcagagcaatggaagca

SEQ ID NO: 29910 - DNA, 22 bp, Artificial sequence
  synthetic polynucleotide sequence
atggaggagaagaacccatcca

SEQ ID NO: 29911 - DNA, 18 bp, Artificial sequence
  synthetic polynucleotide sequence
cagcctgacggacagcaa

SEQ ID NO: 29912 - DNA, 18 bp, Artificial sequence
  synthetic polynucleotide sequence
cgcgatctcggaggccca

SEQ ID NO: 29913 - DNA, 18 bp, Artificial sequence
  synthetic polynucleotide sequence
gtgggaaaagcgcaagca

SEQ ID NO: 29914 - DNA, 18 bp, Artificial sequence
  synthetic polynucleotide sequence
catggccaggcgtagcga

SEQ ID NO: 29915 - DNA, 18 bp, Artificial sequence
  synthetic polynucleotide sequence
agtgcggcccagtgcaca

SEQ ID NO: 29916 - DNA, 18 bp, Artificial sequence
  synthetic polynucleotide sequence
cttgcttgctgtgggcga

SEQ ID NO: 29917 - DNA, 18 bp, Artificial sequence
  synthetic polynucleotide sequence
gcaccccactgctgacca

SEQ ID NO: 29918 - DNA, 19 bp, Artificial sequence
  synthetic polynucleotide sequence
ggcctgtacgaggtgagca

SEQ ID NO: 29919 - DNA, 18 bp, Artificial sequence
  synthetic polynucleotide sequence
gggcatggaattgggaga

SEQ ID NO: 29920 - DNA, 18 bp, Artificial sequence
  synthetic polynucleotide sequence
ggcacccagtcccttgca

SEQ ID NO: 29921 - DNA, 21 bp, Artificial sequence
  synthetic polynucleotide sequence
ctctcagtgcctccatgagga

SEQ ID NO: 29922 - DNA, 20 bp, Artificial sequence
  synthetic polynucleotide sequence
ggttcgggattgcaggccga

SEQ ID NO: 29923 - DNA, 21 bp, Artificial sequence
  synthetic polynucleotide sequence
tgggcatggaataggcaggca

SEQ ID NO: 29924 - DNA, 21 bp, Artificial sequence
  synthetic polynucleotide sequence
gtgctgagaagatcggctgga

SEQ ID NO: 29925 - DNA, 19 bp, Artificial sequence
  synthetic polynucleotide sequence
ctagggccacaatccgaga

SEQ ID NO: 29926 - DNA, 18 bp, Artificial sequence
  synthetic polynucleotide sequence
tggcttcggaggccagga

SEQ ID NO: 29927 - DNA, 20 bp, Artificial sequence
  synthetic polynucleotide sequence
caggaagactacggccagga

SEQ ID NO: 29928 - DNA, 18 bp, Artificial sequence
  synthetic polynucleotide sequence
gctggatgtcccgcagca

SEQ ID NO: 29929 - DNA, 19 bp, Artificial sequence
  synthetic polynucleotide sequence
caggcgatggaattgggaa

SEQ ID NO: 29930 - DNA, 19 bp, Artificial sequence
  synthetic polynucleotide sequence
ctccctgtagtccgctcga

SEQ ID NO: 29931 - DNA, 20 bp, Artificial sequence
  synthetic polynucleotide sequence
ccgcctcagtggagactgga

SEQ ID NO: 29932 - DNA, 19 bp, Artificial sequence
  synthetic polynucleotide sequence
gtaacacacgcctggcaga

SEQ ID NO: 29933 - DNA, 19 bp, Artificial sequence
  synthetic polynucleotide sequence
ggaaagaagcccccaagca

SEQ ID NO: 29934 - DNA, 18 bp, Artificial sequence
  synthetic polynucleotide sequence
agttcgcggatgcaccga

SEQ ID NO: 29935 - DNA, 19 bp, Artificial sequence
  synthetic polynucleotide sequence
gcacagcaaaggcaaggaa

SEQ ID NO: 29936 - DNA, 19 bp, Artificial sequence
  synthetic polynucleotide sequence
gctgtacctggacaggcca

SEQ ID NO: 29937 - DNA, 22 bp, Artificial sequence
  synthetic polynucleotide sequence
gcatcgtaggaaaggtggggaa

SEQ ID NO: 29938 - DNA, 21 bp, Artificial sequence
  synthetic polynucleotide sequence
ggaggacagagttacagcgga

SEQ ID NO: 29939 - DNA, 20 bp, Artificial sequence
  synthetic polynucleotide sequence
gccccaagcatccgaggaca

SEQ ID NO: 29940 - DNA, 22 bp, Artificial sequence
  synthetic polynucleotide sequence
attggcctgagtaggaagctca

SEQ ID NO: 29941 - DNA, 18 bp, Artificial sequence
  synthetic polynucleotide sequence
tatggggaaggaggccca

SEQ ID NO: 29942 - DNA, 18 bp, Artificial sequence
  synthetic polynucleotide sequence
gcagagccctcaaggcca

SEQ ID NO: 29943 - DNA, 18 bp, Artificial sequence
  synthetic polynucleotide sequence
cgacaaggctcagcgcca

SEQ ID NO: 29944 - DNA, 18 bp, Artificial sequence
  synthetic polynucleotide sequence
cgtagcggcctgtaccca

SEQ ID NO: 29945 - DNA, 21 bp, Artificial sequence
  synthetic polynucleotide sequence
agttagcaagccgaggtctca

SEQ ID NO: 29946 - DNA, 21 bp, Artificial sequence
  synthetic polynucleotide sequence
accatcaaactagcggcggca

SEQ ID NO: 29947 - DNA, 20 bp, Artificial sequence
  synthetic polynucleotide sequence
gaacgtgaacaccagaggca

SEQ ID NO: 29948 - DNA, 20 bp, Artificial sequence
  synthetic polynucleotide sequence
ctcccagcatatccatagca

SEQ ID NO: 29949 - DNA, 18 bp, Artificial sequence
  synthetic polynucleotide sequence
ccgaggcagagaacagca

SEQ ID NO: 29950 - DNA, 18 bp, Artificial sequence
  synthetic polynucleotide sequence
gctcaaacagcaccggca

SEQ ID NO: 29951 - DNA, 21 bp, Artificial sequence
  synthetic polynucleotide sequence
ttccaggccatgctatcagga

SEQ ID NO: 29952 - DNA, 22 bp, Artificial sequence
  synthetic polynucleotide sequence
aacagaagaagcagggttccca

SEQ ID NO: 29953 - DNA, 22 bp, Artificial sequence
  synthetic polynucleotide sequence
atacatcagcgagagtccagga

SEQ ID NO: 29954 - DNA, 22 bp, Artificial sequence
  synthetic polynucleotide sequence
acattatgctccagagtgcgga

SEQ ID NO: 29955 - DNA, 20 bp, Artificial sequence
  synthetic polynucleotide sequence
cccagtctccaagggcgaga

SEQ ID NO: 29956 - DNA, 22 bp, Artificial sequence
  synthetic polynucleotide sequence
gaatttaaccccttgaccgcca

SEQ ID NO: 29957 - DNA, 22 bp, Artificial sequence
  synthetic polynucleotide sequence
aagggccaccattcagcacaca

SEQ ID NO: 29958 - DNA, 19 bp, Artificial sequence
  synthetic polynucleotide sequence
ggcttgctagcaggcccca

SEQ ID NO: 29959 - DNA, 20 bp, Artificial sequence
  synthetic polynucleotide sequence
ccttcccacagcgtcccgta

SEQ ID NO: 29960 - DNA, 20 bp, Artificial sequence
  synthetic polynucleotide sequence
atggtggtgcagagctggga

SEQ ID NO: 29961 - DNA, 21 bp, Artificial sequence
  synthetic polynucleotide sequence
acatgcaagcaaggggccaca

SEQ ID NO: 29962 - DNA, 22 bp, Artificial sequence
  synthetic polynucleotide sequence
gatatcgtgtgggaacagcaga

SEQ ID NO: 29963 - DNA, 21 bp, Artificial sequence
  synthetic polynucleotide sequence
aagcaaggggccacattgtga

SEQ ID NO: 29964 - DNA, 21 bp, Artificial sequence
  synthetic polynucleotide sequence
cctggaatgaggggcagctga

SEQ ID NO: 29965 - DNA, 20 bp, Artificial sequence
  synthetic polynucleotide sequence
aaggaagccgtcagcagaga

SEQ ID NO: 29966 - DNA, 18 bp, Artificial sequence
  synthetic polynucleotide sequence
accgtggatctccggaca

SEQ ID NO: 29967 - DNA, 21 bp, Artificial sequence
  synthetic polynucleotide sequence
aggggtggtagactcggagga

SEQ ID NO: 29968 - DNA, 22 bp, Artificial sequence
  synthetic polynucleotide sequence
aaccatctcatcaccagaggca

SEQ ID NO: 29969 - DNA, 20 bp, Artificial sequence
  synthetic polynucleotide sequence
caccggtgtaggaatgacca

SEQ ID NO: 29970 - DNA, 19 bp, Artificial sequence
  synthetic polynucleotide sequence
ctgctacaaggaaggcgga

SEQ ID NO: 29971 - DNA, 21 bp, Artificial sequence
  synthetic polynucleotide sequence
tgagaagctgctggtgaagga

SEQ ID NO: 29972 - DNA, 20 bp, Artificial sequence
  synthetic polynucleotide sequence
cttcaccccgggatcagtga

SEQ ID NO: 29973 - DNA, 20 bp, Artificial sequence
  synthetic polynucleotide sequence
cttgcaccccaccccagcca

SEQ ID NO: 29974 - DNA, 21 bp, Artificial sequence
  synthetic polynucleotide sequence
tcaatagcagagctgggacca

SEQ ID NO: 29975 - DNA, 22 bp, Artificial sequence
  synthetic polynucleotide sequence
agcaggacaggaaggaacctca

SEQ ID NO: 29976 - DNA, 18 bp, Artificial sequence
  synthetic polynucleotide sequence
aacccactgttcacgcga

SEQ ID NO: 29977 - DNA, 22 bp, Artificial sequence
  synthetic polynucleotide sequence
cgaacagtgctgaagtagcgaa

SEQ ID NO: 29978 - DNA, 21 bp, Artificial sequence
  synthetic polynucleotide sequence
gggattcgagaagaccctcca

SEQ ID NO: 29979 - DNA, 18 bp, Artificial sequence
  synthetic polynucleotide sequence
ctgccctgatcaagcgca

SEQ ID NO: 29980 - DNA, 20 bp, Artificial sequence
  synthetic polynucleotide sequence
ctcgtacacctggatcagca

SEQ ID NO: 29981 - DNA, 18 bp, Artificial sequence
  synthetic polynucleotide sequence
cgccaacaccttggccga

SEQ ID NO: 29982 - DNA, 20 bp, Artificial sequence
  synthetic polynucleotide sequence
caatggtagggcctgaccca

SEQ ID NO: 29983 - DNA, 18 bp, Artificial sequence
  synthetic polynucleotide sequence
gcagcggctgcttcagga

SEQ ID NO: 29984 - DNA, 18 bp, Artificial sequence
  synthetic polynucleotide sequence
agccccagggacagggga

SEQ ID NO: 29985 - DNA, 18 bp, Artificial sequence
  synthetic polynucleotide sequence
ccatcctcatcggcgaca

SEQ ID NO: 29986 - DNA, 18 bp, Artificial sequence
  synthetic polynucleotide sequence
ggggtcatgacaccgcca

SEQ ID NO: 29987 - DNA, 20 bp, Artificial sequence
  synthetic polynucleotide sequence
tagctagagtggagccacca

SEQ ID NO: 29988 - DNA, 20 bp, Artificial sequence
  synthetic polynucleotide sequence
aagcaggcgataagatggca

SEQ ID NO: 29989 - DNA, 18 bp, Artificial sequence
  synthetic polynucleotide sequence
aagaaccatcctgcccca

SEQ ID NO: 29990 - DNA, 19 bp, Artificial sequence
  synthetic polynucleotide sequence
tactgatgcgctagccaca

SEQ ID NO: 29991 - DNA, 19 bp, Artificial sequence
  synthetic polynucleotide sequence
catcaacgagcctacggca

SEQ ID NO: 29992 - DNA, 18 bp, Artificial sequence
  synthetic polynucleotide sequence
cgaaggttccgccaccca

SEQ ID NO: 29993 - DNA, 20 bp, Artificial sequence
  synthetic polynucleotide sequence
caaggaggaggtggagagga

SEQ ID NO: 29994 - DNA, 18 bp, Artificial sequence
  synthetic polynucleotide sequence
gctccagccaggcaagga

SEQ ID NO: 29995 - DNA, 21 bp, Artificial sequence
  synthetic polynucleotide sequence
agtagagaaagcccttcgaga

SEQ ID NO: 29996 - DNA, 21 bp, Artificial sequence
  synthetic polynucleotide sequence
gaggagtgacatccaagagca

SEQ ID NO: 29997 - DNA, 18 bp, Artificial sequence
  synthetic polynucleotide sequence
ggagctgccattcaggga

SEQ ID NO: 29998 - DNA, 21 bp, Artificial sequence
  synthetic polynucleotide sequence
gaccatcagcggcagtagaga

SEQ ID NO: 29999 - DNA, 18 bp, Artificial sequence
  synthetic polynucleotide sequence
ccacgcagtccaacgaga

SEQ ID NO: 30000 - DNA, 18 bp, Artificial sequence
  synthetic polynucleotide sequence
ggcggcagtctcatcgga

SEQ ID NO: 30001 - DNA, 19 bp, Artificial sequence
  synthetic polynucleotide sequence
tggtacacacagaggggca

SEQ ID NO: 30002 - DNA, 20 bp, Artificial sequence
  synthetic polynucleotide sequence
gcagaaacgctatgcacaga

SEQ ID NO: 30003 - DNA, 20 bp, Artificial sequence
  synthetic polynucleotide sequence
gtcccgagagttctgccgca

SEQ ID NO: 30004 - DNA, 19 bp, Artificial sequence
  synthetic polynucleotide sequence
ccaccccgaggtgcttcca

SEQ ID NO: 30005 - DNA, 23 bp, Artificial sequence
  synthetic polynucleotide sequence
taaaagcacaacacggaaccaga

SEQ ID NO: 30006 - DNA, 22 bp, Artificial sequence
  synthetic polynucleotide sequence
tcatgacagaggactgcagaca

SEQ ID NO: 30007 - DNA, 20 bp, Artificial sequence
  synthetic polynucleotide sequence
cacggattcgtcgcgcgcga

SEQ ID NO: 30008 - DNA, 20 bp, Artificial sequence
  synthetic polynucleotide sequence
tgcggcctggatggacagga

SEQ ID NO: 30009 - DNA, 20 bp, Artificial sequence
  synthetic polynucleotide sequence
catcgaggtgcgggctgaga

SEQ ID NO: 30010 - DNA, 18 bp, Artificial sequence
  synthetic polynucleotide sequence
ctgccgtcctcccgcaga

SEQ ID NO: 30011 - DNA, 20 bp, Artificial sequence
  synthetic polynucleotide sequence
cacagcttcaagccagagga

SEQ ID NO: 30012 - DNA, 20 bp, Artificial sequence
  synthetic polynucleotide sequence
cacctctgcaggaagctgga

SEQ ID NO: 30013 - DNA, 21 bp, Artificial sequence
  synthetic polynucleotide sequence
ccaacctgagtcctaccgcca

SEQ ID NO: 30014 - DNA, 22 bp, Artificial sequence
  synthetic polynucleotide sequence
aggttggaagccttagagccga

SEQ ID NO: 30015 - DNA, 21 bp, Artificial sequence
  synthetic polynucleotide sequence
ggttacactgagcccaggaca

SEQ ID NO: 30016 - DNA, 21 bp, Artificial sequence
  synthetic polynucleotide sequence
tcttctacccgggctaggtga

SEQ ID NO: 30017 - DNA, 19 bp, Artificial sequence
  synthetic polynucleotide sequence
cggaactgggcctggagga

SEQ ID NO: 30018 - DNA, 18 bp, Artificial sequence
  synthetic polynucleotide sequence
cgtccgctgggctggaga

SEQ ID NO: 30019 - DNA, 19 bp, Artificial sequence
  synthetic polynucleotide sequence
tgtggcagtcaaggctcca

SEQ ID NO: 30020 - DNA, 20 bp, Artificial sequence
  synthetic polynucleotide sequence
cactgcaccaccagtagcaa

SEQ ID NO: 30021 - DNA, 20 bp, Artificial sequence
  synthetic polynucleotide sequence
cggagggagtaatggcagga

SEQ ID NO: 30022 - DNA, 19 bp, Artificial sequence
  synthetic polynucleotide sequence
gaacccgatccaacagcga

SEQ ID NO: 30023 - DNA, 20 bp, Artificial sequence
  synthetic polynucleotide sequence
gcagaagcgagtcccaggga

SEQ ID NO: 30024 - DNA, 21 bp, Artificial sequence
  synthetic polynucleotide sequence
tcacggtgtggaaatggccca

SEQ ID NO: 30025 - DNA, 20 bp, Artificial sequence
  synthetic polynucleotide sequence
ctaggacagaggctgcagca

SEQ ID NO: 30026 - DNA, 20 bp, Artificial sequence
  synthetic polynucleotide sequence
cctgagcacgtacaactgga

SEQ ID NO: 30027 - DNA, 18 bp, Artificial sequence
  synthetic polynucleotide sequence
aggcaagaatctcgccca

SEQ ID NO: 30028 - DNA, 22 bp, Artificial sequence
  synthetic polynucleotide sequence
attgctctaaccacggtcacca

SEQ ID NO: 30029 - DNA, 21 bp, Artificial sequence
  synthetic polynucleotide sequence
ctacgagtgggacctggacaa

SEQ ID NO: 30030 - DNA, 21 bp, Artificial sequence
  synthetic polynucleotide sequence
gcggtagaactagatgcgcca

SEQ ID NO: 30031 - DNA, 23 bp, Artificial sequence
  synthetic polynucleotide sequence
catcataccgcatcacactacca

SEQ ID NO: 30032 - DNA, 24 bp, Artificial sequence
  synthetic polynucleotide sequence
ggaagggaagtatcatgaaacaca

SEQ ID NO: 30033 - DNA, 18 bp, Artificial sequence
  synthetic polynucleotide sequence
cagtgaagacgctgggca

SEQ ID NO: 30034 - DNA, 20 bp, Artificial sequence
  synthetic polynucleotide sequence
gagttggagtagcccagcca

SEQ ID NO: 30035 - DNA, 19 bp, Artificial sequence
  synthetic polynucleotide sequence
gtggtgaacaccgaccaca

SEQ ID NO: 30036 - DNA, 18 bp, Artificial sequence
  synthetic polynucleotide sequence
tgcggccatagagggcga

SEQ ID NO: 30037 - DNA, 18 bp, Artificial sequence
  synthetic polynucleotide sequence
cagtgccctggaacgcaa

SEQ ID NO: 30038 - DNA, 18 bp, Artificial sequence
  synthetic polynucleotide sequence
agcaggagtcccggcaga

SEQ ID NO: 30039 - DNA, 19 bp, Artificial sequence
  synthetic polynucleotide sequence
ctggacaggtactgggcca

SEQ ID NO: 30040 - DNA, 18 bp, Artificial sequence
  synthetic polynucleotide sequence
acagagggggcatggaga

SEQ ID NO: 30041 - DNA, 21 bp, Artificial sequence
  synthetic polynucleotide sequence
gaagctgcaccatccagccaa

SEQ ID NO: 30042 - DNA, 21 bp, Artificial sequence
  synthetic polynucleotide sequence
tgtcacagaccacttgcccca

SEQ ID NO: 30043 - DNA, 20 bp, Artificial sequence
  synthetic polynucleotide sequence
acaggcaggaggactatgca

SEQ ID NO: 30044 - DNA, 18 bp, Artificial sequence
  synthetic polynucleotide sequence
agcagggccccaatgaca

SEQ ID NO: 30045 - DNA, 18 bp, Artificial sequence
  synthetic polynucleotide sequence
caccggaaaaggtggcaa

SEQ ID NO: 30046 - DNA, 22 bp, Artificial sequence
  synthetic polynucleotide sequence
aagaagggacaccacataagca

SEQ ID NO: 30047 - DNA, 20 bp, Artificial sequence
  synthetic polynucleotide sequence
gtgcgtgctcaacgacccaa

SEQ ID NO: 30048 - DNA, 22 bp, Artificial sequence
  synthetic polynucleotide sequence
aacatcaaagcttgtcggcgca

SEQ ID NO: 30049 - DNA, 18 bp, Artificial sequence
  synthetic polynucleotide sequence
gcgggatgagatccgaga

SEQ ID NO: 30050 - DNA, 20 bp, Artificial sequence
  synthetic polynucleotide sequence
ctgccagatggaccagagca

SEQ ID NO: 30051 - DNA, 21 bp, Artificial sequence
  synthetic polynucleotide sequence
gacagaccaacaggaggcaga

SEQ ID NO: 30052 - DNA, 18 bp, Artificial sequence
  synthetic polynucleotide sequence
cgccccacagtgcccaga

SEQ ID NO: 30053 - DNA, 20 bp, Artificial sequence
  synthetic polynucleotide sequence
ccgggggagttagcagggaa

SEQ ID NO: 30054 - DNA, 21 bp, Artificial sequence
  synthetic polynucleotide sequence
tgaagagcaggtagaggcgga

SEQ ID NO: 30055 - DNA, 20 bp, Artificial sequence
  synthetic polynucleotide sequence
agcacagggtggaccctgca

SEQ ID NO: 30056 - DNA, 21 bp, Artificial sequence
  synthetic polynucleotide sequence
ccagatggcagacaaggtgaa

SEQ ID NO: 30057 - DNA, 20 bp, Artificial sequence
  synthetic polynucleotide sequence
cagccacgcgatggacgcca

SEQ ID NO: 30058 - DNA, 20 bp, Artificial sequence
  synthetic polynucleotide sequence
ggtactcaggaaagggggga

SEQ ID NO: 30059 - DNA, 18 bp, Artificial sequence
  synthetic polynucleotide sequence
tcaacaagccctacgcca

SEQ ID NO: 30060 - DNA, 18 bp, Artificial sequence
  synthetic polynucleotide sequence
aggcctgctctcggagga

SEQ ID NO: 30061 - DNA, 18 bp, Artificial sequence
  synthetic polynucleotide sequence
ctgccaaacagccccaga

SEQ ID NO: 30062 - DNA, 18 bp, Artificial sequence
  synthetic polynucleotide sequence
aggggatccagcagagca

SEQ ID NO: 30063 - DNA, 20 bp, Artificial sequence
  synthetic polynucleotide sequence
tgtgcgactgcatctcccca

SEQ ID NO: 30064 - DNA, 19 bp, Artificial sequence
  synthetic polynucleotide sequence
gcccgcttgaagtcccgca

SEQ ID NO: 30065 - DNA, 20 bp, Artificial sequence
  synthetic polynucleotide sequence
cactgtgggtggagaggaca

SEQ ID NO: 30066 - DNA, 19 bp, Artificial sequence
  synthetic polynucleotide sequence
cggtactggcactggagca

SEQ ID NO: 30067 - DNA, 18 bp, Artificial sequence
  synthetic polynucleotide sequence
gcaccgggacttcccaga

SEQ ID NO: 30068 - DNA, 18 bp, Artificial sequence
  synthetic polynucleotide sequence
catcattggcggagacca

SEQ ID NO: 30069 - DNA, 18 bp, Artificial sequence
  synthetic polynucleotide sequence
tgaccctgagtcccagca

SEQ ID NO: 30070 - DNA, 18 bp, Artificial sequence
  synthetic polynucleotide sequence
tcacatcaccaggccgca

SEQ ID NO: 30071 - DNA, 18 bp, Artificial sequence
  synthetic polynucleotide sequence
gcaagaggttgcgccgaa

SEQ ID NO: 30072 - DNA, 20 bp, Artificial sequence
  synthetic polynucleotide sequence
ctgcagctcactcgagtcca

SEQ ID NO: 30073 - DNA, 20 bp, Artificial sequence
  synthetic polynucleotide sequence
gcaggcccgctcaggaggaa

SEQ ID NO: 30074 - DNA, 21 bp, Artificial sequence
  synthetic polynucleotide sequence
ggaacaagcctgctgccgtga

SEQ ID NO: 30075 - DNA, 21 bp, Artificial sequence
  synthetic polynucleotide sequence
atcagcgaggaggaggaggaa

SEQ ID NO: 30076 - DNA, 21 bp, Artificial sequence
  synthetic polynucleotide sequence
atgacccaaggccaacaccga

SEQ ID NO: 30077 - DNA, 21 bp, Artificial sequence
  synthetic polynucleotide sequence
aagaccccctgatgctggaca

SEQ ID NO: 30078 - DNA, 22 bp, Artificial sequence
  synthetic polynucleotide sequence
gcaaaggagtatggagaggcga

SEQ ID NO: 30079 - DNA, 21 bp, Artificial sequence
  synthetic polynucleotide sequence
gacaagctggctaatggagga

SEQ ID NO: 30080 - DNA, 19 bp, Artificial sequence
  synthetic polynucleotide sequence
tctgcagagacaccctcca

SEQ ID NO: 30081 - DNA, 20 bp, Artificial sequence
  synthetic polynucleotide sequence
gtgcgggtggacaatcggaa

SEQ ID NO: 30082 - DNA, 20 bp, Artificial sequence
  synthetic polynucleotide sequence
tgcacagggccgtcgtagga

SEQ ID NO: 30083 - DNA, 18 bp, Artificial sequence
  synthetic polynucleotide sequence
tcctacggcagtccacga

SEQ ID NO: 30084 - DNA, 18 bp, Artificial sequence
  synthetic polynucleotide sequence
gacggacatgcacagcca

SEQ ID NO: 30085 - DNA, 19 bp, Artificial sequence
  synthetic polynucleotide sequence
gcagagctgcagcccctga

SEQ ID NO: 30086 - DNA, 22 bp, Artificial sequence
  synthetic polynucleotide sequence
tgatgacctgaaacctgtggga

SEQ ID NO: 30087 - DNA, 20 bp, Artificial sequence
  synthetic polynucleotide sequence
tgtgtccgccgcaccagcca

SEQ ID NO: 30088 - DNA, 18 bp, Artificial sequence
  synthetic polynucleotide sequence
gtgagagggcaccccgca

SEQ ID NO: 30089 - DNA, 18 bp, Artificial sequence
  synthetic polynucleotide sequence
cggggtacaccacaagca

SEQ ID NO: 30090 - DNA, 18 bp, Artificial sequence
  synthetic polynucleotide sequence
cgcagctggggttcacca

SEQ ID NO: 30091 - DNA, 21 bp, Artificial sequence
  synthetic polynucleotide sequence
tcaatgtgaccagggcagcga

SEQ ID NO: 30092 - DNA, 22 bp, Artificial sequence
  synthetic polynucleotide sequence
agtaacagtggcagctgaagga

SEQ ID NO: 30093 - DNA, 23 bp, Artificial sequence
  synthetic polynucleotide sequence
cttgaaccctgcaagttaccaca

SEQ ID NO: 30094 - DNA, 21 bp, Artificial sequence
  synthetic polynucleotide sequence
agtgaaccaggagaaggggaa

SEQ ID NO: 30095 - DNA, 20 bp, Artificial sequence
  synthetic polynucleotide sequence
ctggtgcagggagacagcaa

SEQ ID NO: 30096 - DNA, 18 bp, Artificial sequence
  synthetic polynucleotide sequence
ttcggaggggcagacgga

SEQ ID NO: 30097 - DNA, 19 bp, Artificial sequence
  synthetic polynucleotide sequence
ccacctgatggctggccga

SEQ ID NO: 30098 - DNA, 20 bp, Artificial sequence
  synthetic polynucleotide sequence
gatgggctccagcagtccca

SEQ ID NO: 30099 - DNA, 23 bp, Artificial sequence
  synthetic polynucleotide sequence
gtcagaggctcttagcaaaccca

SEQ ID NO: 30100 - DNA, 20 bp, Artificial sequence
  synthetic polynucleotide sequence
gaagtggccggaccttggaa

SEQ ID NO: 30101 - DNA, 21 bp, Artificial sequence
  synthetic polynucleotide sequence
ccgaaaccggggcaagacaga

SEQ ID NO: 30102 - DNA, 20 bp, Artificial sequence
  synthetic polynucleotide sequence
atctgctctcggacacccca

SEQ ID NO: 30103 - DNA, 19 bp, Artificial sequence
  synthetic polynucleotide sequence
gggacaagtctgaggccca

SEQ ID NO: 30104 - DNA, 20 bp, Artificial sequence
  synthetic polynucleotide sequence
atcctctggcaagtcaggca

SEQ ID NO: 30105 - DNA, 18 bp, Artificial sequence
  synthetic polynucleotide sequence
cggcctccggagaagcca

SEQ ID NO: 30106 - DNA, 21 bp, Artificial sequence
  synthetic polynucleotide sequence
tcacagacatggccgtctcca

SEQ ID NO: 30107 - DNA, 22 bp, Artificial sequence
  synthetic polynucleotide sequence
ccaaagccagagttcctccaca

SEQ ID NO: 30108 - DNA, 19 bp, Artificial sequence
  synthetic polynucleotide sequence
ctcagcgctgtggggctca

SEQ ID NO: 30109 - DNA, 21 bp, Artificial sequence
  synthetic polynucleotide sequence
caagcagcacattcccctgga

SEQ ID NO: 30110 - DNA, 20 bp, Artificial sequence
  synthetic polynucleotide sequence
acaaagtggggtcggcgtga

SEQ ID NO: 30111 - DNA, 18 bp, Artificial sequence
  synthetic polynucleotide sequence
cccactgtgggtcagcga

SEQ ID NO: 30112 - DNA, 21 bp, Artificial sequence
  synthetic polynucleotide sequence
aatgaacctgagcatagggca

SEQ ID NO: 30113 - DNA, 21 bp, Artificial sequence
  synthetic polynucleotide sequence
tggctcaggaaccacgagaga

SEQ ID NO: 30114 - DNA, 19 bp, Artificial sequence
  synthetic polynucleotide sequence
tctgcacatcgaggacaca

SEQ ID NO: 30115 - DNA, 20 bp, Artificial sequence
  synthetic polynucleotide sequence
ctacattggccaggagctga

SEQ ID NO: 30116 - DNA, 20 bp, Artificial sequence
  synthetic polynucleotide sequence
gccagccctgaacttgccca

SEQ ID NO: 30117 - DNA, 21 bp, Artificial sequence
  synthetic polynucleotide sequence
tgaatacgagggggagtacga

SEQ ID NO: 30118 - DNA, 18 bp, Artificial sequence
  synthetic polynucleotide sequence
gccggatgcaaagccaga

SEQ ID NO: 30119 - DNA, 21 bp, Artificial sequence
  synthetic polynucleotide sequence
tcctggagggcgattaggaca

SEQ ID NO: 30120 - DNA, 20 bp, Artificial sequence
  synthetic polynucleotide sequence
tacaactggaaggcggtgga

SEQ ID NO: 30121 - DNA, 18 bp, Artificial sequence
  synthetic polynucleotide sequence
gaccccaaggcccagaca

SEQ ID NO: 30122 - DNA, 19 bp, Artificial sequence
  synthetic polynucleotide sequence
ggcagtcaggtctgaggca

SEQ ID NO: 30123 - DNA, 19 bp, Artificial sequence
  synthetic polynucleotide sequence
ttgggcaacccagaccaga

SEQ ID NO: 30124 - DNA, 22 bp, Artificial sequence
  synthetic polynucleotide sequence
tccagttcagcatcagacgcca

SEQ ID NO: 30125 - DNA, 18 bp, Artificial sequence
  synthetic polynucleotide sequence
caagaaccagacccggga

SEQ ID NO: 30126 - DNA, 18 bp, Artificial sequence
  synthetic polynucleotide sequence
gacacttgagctcgggca

SEQ ID NO: 30127 - DNA, 20 bp, Artificial sequence
  synthetic polynucleotide sequence
cacaaacactcagccccgaa

SEQ ID NO: 30128 - DNA, 20 bp, Artificial sequence
  synthetic polynucleotide sequence
gagcaggacagatgtcacga

SEQ ID NO: 30129 - DNA, 18 bp, Artificial sequence
  synthetic polynucleotide sequence
gtccagctcacgaggcaa

SEQ ID NO: 30130 - DNA, 18 bp, Artificial sequence
  synthetic polynucleotide sequence
cgatagtcaccacgccca

SEQ ID NO: 30131 - DNA, 20 bp, Artificial sequence
  synthetic polynucleotide sequence
ctcggcacccattacactga

SEQ ID NO: 30132 - DNA, 18 bp, Artificial sequence
  synthetic polynucleotide sequence
ataggtacgcagcgccca

SEQ ID NO: 30133 - DNA, 20 bp, Artificial sequence
  synthetic polynucleotide sequence
tacctgcccaagtcaccaga

SEQ ID NO: 30134 - DNA, 18 bp, Artificial sequence
  synthetic polynucleotide sequence
cgcattggtggccacaca

SEQ ID NO: 30135 - DNA, 20 bp, Artificial sequence
  synthetic polynucleotide sequence
ctggactccagtgggacaca

SEQ ID NO: 30136 - DNA, 18 bp, Artificial sequence
  synthetic polynucleotide sequence
acagccagggcctcacca

SEQ ID NO: 30137 - DNA, 22 bp, Artificial sequence
  synthetic polynucleotide sequence
ctgcaaagaaatgtgcgcagga

SEQ ID NO: 30138 - DNA, 22 bp, Artificial sequence
  synthetic polynucleotide sequence
tacactgcccaatgcgagaaga

SEQ ID NO: 30139 - DNA, 20 bp, Artificial sequence
  synthetic polynucleotide sequence
atctccaggaggacaagcca

SEQ ID NO: 30140 - DNA, 21 bp, Artificial sequence
  synthetic polynucleotide sequence
caagtcatccaagtcagccca

SEQ ID NO: 30141 - DNA, 21 bp, Artificial sequence
  synthetic polynucleotide sequence
cgctaccagatagccatccga

SEQ ID NO: 30142 - DNA, 22 bp, Artificial sequence
  synthetic polynucleotide sequence
atgacagggagcacatgtacca

SEQ ID NO: 30143 - DNA, 22 bp, Artificial sequence
  synthetic polynucleotide sequence
aaggggggcaaatactctgcga

SEQ ID NO: 30144 - DNA, 22 bp, Artificial sequence
  synthetic polynucleotide sequence
gtaaccagaacttcagctggca

SEQ ID NO: 30145 - DNA, 18 bp, Artificial sequence
  synthetic polynucleotide sequence
agccgctaccggaaccga

SEQ ID NO: 30146 - DNA, 18 bp, Artificial sequence
  synthetic polynucleotide sequence
tgacgttgaacaagcgca

SEQ ID NO: 30147 - DNA, 20 bp, Artificial sequence
  synthetic polynucleotide sequence
caaggtgagcaaggtggaga

SEQ ID NO: 30148 - DNA, 18 bp, Artificial sequence
  synthetic polynucleotide sequence
gcggagcccggaccggca

SEQ ID NO: 30149 - DNA, 20 bp, Artificial sequence
  synthetic polynucleotide sequence
ctgggcatctcccggagcaa

SEQ ID NO: 30150 - DNA, 20 bp, Artificial sequence
  synthetic polynucleotide sequence
gttctgggggatgctgggca

SEQ ID NO: 30151 - DNA, 18 bp, Artificial sequence
  synthetic polynucleotide sequence
cagctgaggagccgctga

SEQ ID NO: 30152 - DNA, 18 bp, Artificial sequence
  synthetic polynucleotide sequence
tcgggactccgggtacca

SEQ ID NO: 30153 - DNA, 18 bp, Artificial sequence
  synthetic polynucleotide sequence
gcgctgtaaggcggccga

SEQ ID NO: 30154 - DNA, 18 bp, Artificial sequence
  synthetic polynucleotide sequence
tgggcgggatggtgggca

SEQ ID NO: 30155 - DNA, 22 bp, Artificial sequence
  synthetic polynucleotide sequence
gacatgcaaagcacctcagaga

SEQ ID NO: 30156 - DNA, 20 bp, Artificial sequence
  synthetic polynucleotide sequence
gctcgacgtggcccgctgaa

SEQ ID NO: 30157 - DNA, 20 bp, Artificial sequence
  synthetic polynucleotide sequence
agggttagcccacagagcaa

SEQ ID NO: 30158 - DNA, 19 bp, Artificial sequence
  synthetic polynucleotide sequence
ggtcatgaagccagcctca

SEQ ID NO: 30159 - DNA, 18 bp, Artificial sequence
  synthetic polynucleotide sequence
ggggaagctggatgggaa

SEQ ID NO: 30160 - DNA, 18 bp, Artificial sequence
  synthetic polynucleotide sequence
gctgaggccgtgaatgca

SEQ ID NO: 30161 - DNA, 18 bp, Artificial sequence
  synthetic polynucleotide sequence
atgggacggctccagaca

SEQ ID NO: 30162 - DNA, 18 bp, Artificial sequence
  synthetic polynucleotide sequence
cgcagcatcatcacggca

SEQ ID NO: 30163 - DNA, 20 bp, Artificial sequence
  synthetic polynucleotide sequence
cgagagcagacagaagggga

SEQ ID NO: 30164 - DNA, 19 bp, Artificial sequence
  synthetic polynucleotide sequence
tcctcacagcactgcagga

SEQ ID NO: 30165 - DNA, 18 bp, Artificial sequence
  synthetic polynucleotide sequence
ccggcaagagtatcgcca

SEQ ID NO: 30166 - DNA, 18 bp, Artificial sequence
  synthetic polynucleotide sequence
ggccgttgatgacgcgga

SEQ ID NO: 30167 - DNA, 20 bp, Artificial sequence
  synthetic polynucleotide sequence
ctcctgggaatggagcagga

SEQ ID NO: 30168 - DNA, 22 bp, Artificial sequence
  synthetic polynucleotide sequence
agacgcgggaacacatcatcca

SEQ ID NO: 30169 - DNA, 21 bp, Artificial sequence
  synthetic polynucleotide sequence
gactcctgtagtagccaccca

SEQ ID NO: 30170 - DNA, 21 bp, Artificial sequence
  synthetic polynucleotide sequence
tctgctccccaggaattccca

SEQ ID NO: 30171 - DNA, 22 bp, Artificial sequence
  synthetic polynucleotide sequence
taagagatgtagcctcgggaca

SEQ ID NO: 30172 - DNA, 22 bp, Artificial sequence
  synthetic polynucleotide sequence
taagcgtccagagatgacctca

SEQ ID NO: 30173 - DNA, 19 bp, Artificial sequence
  synthetic polynucleotide sequence
gaaaggcaacccccagcta

SEQ ID NO: 30174 - DNA, 19 bp, Artificial sequence
  synthetic polynucleotide sequence
ctggaggaactgagcagca

SEQ ID NO: 30175 - DNA, 20 bp, Artificial sequence
  synthetic polynucleotide sequence
gggcaggtgggcctggagaa

SEQ ID NO: 30176 - DNA, 22 bp, Artificial sequence
  synthetic polynucleotide sequence
ttgtgaagccaacagctctcaa

SEQ ID NO: 30177 - DNA, 18 bp, Artificial sequence
  synthetic polynucleotide sequence
atggagccaggcaggcaa

SEQ ID NO: 30178 - DNA, 18 bp, Artificial sequence
  synthetic polynucleotide sequence
cacggggattaccaggga

SEQ ID NO: 30179 - DNA, 18 bp, Artificial sequence
  synthetic polynucleotide sequence
cgctcctgagcaacgaca

SEQ ID NO: 30180 - DNA, 18 bp, Artificial sequence
  synthetic polynucleotide sequence
gctgctcctcatccagca

SEQ ID NO: 30181 - DNA, 20 bp, Artificial sequence
  synthetic polynucleotide sequence
aagaagaggagggagcgtca

SEQ ID NO: 30182 - DNA, 18 bp, Artificial sequence
  synthetic polynucleotide sequence
gcagttcaggaggccgga

SEQ ID NO: 30183 - DNA, 18 bp, Artificial sequence
  synthetic polynucleotide sequence
gacgcccctaacgccgca

SEQ ID NO: 30184 - DNA, 20 bp, Artificial sequence
  synthetic polynucleotide sequence
gtgctgaggtccagagcgta

SEQ ID NO: 30185 - DNA, 18 bp, Artificial sequence
  synthetic polynucleotide sequence
tggggaacagaccaggga

SEQ ID NO: 30186 - DNA, 20 bp, Artificial sequence
  synthetic polynucleotide sequence
gacaagtgcaaggtcagcca

SEQ ID NO: 30187 - DNA, 20 bp, Artificial sequence
  synthetic polynucleotide sequence
gaggagatggagaccgggaa

SEQ ID NO: 30188 - DNA, 19 bp, Artificial sequence
  synthetic polynucleotide sequence
ttccgtaggagtcccgaga

SEQ ID NO: 30189 - DNA, 19 bp, Artificial sequence
  synthetic polynucleotide sequence
tcgaggacttctgcccgga

SEQ ID NO: 30190 - DNA, 18 bp, Artificial sequence
  synthetic polynucleotide sequence
ctcgagtccaggcgccga

SEQ ID NO: 30191 - DNA, 21 bp, Artificial sequence
  synthetic polynucleotide sequence
gcctggacgtgcagatggaga

SEQ ID NO: 30192 - DNA, 21 bp, Artificial sequence
  synthetic polynucleotide sequence
acatcgcgatcggagtcctca

SEQ ID NO: 30193 - DNA, 21 bp, Artificial sequence
  synthetic polynucleotide sequence
catgaaccgacacctgcacga

SEQ ID NO: 30194 - DNA, 18 bp, Artificial sequence
  synthetic polynucleotide sequence
gtcgctgctggccacgga

SEQ ID NO: 30195 - DNA, 20 bp, Artificial sequence
  synthetic polynucleotide sequence
atccttcagaggccagcaca

SEQ ID NO: 30196 - DNA, 19 bp, Artificial sequence
  synthetic polynucleotide sequence
tgatggaggcatctgagga

SEQ ID NO: 30197 - DNA, 19 bp, Artificial sequence
  synthetic polynucleotide sequence
ctgcagtcactgggagcaa

SEQ ID NO: 30198 - DNA, 18 bp, Artificial sequence
  synthetic polynucleotide sequence
ctcgcaatgacagccgca

SEQ ID NO: 30199 - DNA, 19 bp, Artificial sequence
  synthetic polynucleotide sequence
cattgccaacgggggcgga

SEQ ID NO: 30200 - DNA, 19 bp, Artificial sequence
  synthetic polynucleotide sequence
gtcccagcaaagcccccga

SEQ ID NO: 30201 - DNA, 19 bp, Artificial sequence
  synthetic polynucleotide sequence
ggcagctggactctccaca

SEQ ID NO: 30202 - DNA, 19 bp, Artificial sequence
  synthetic polynucleotide sequence
cgggttcagctgggagaga

SEQ ID NO: 30203 - DNA, 18 bp, Artificial sequence
  synthetic polynucleotide sequence
catgcacgccaacgccca

SEQ ID NO: 30204 - DNA, 22 bp, Artificial sequence
  synthetic polynucleotide sequence
aactggcagacaagggtaagga

SEQ ID NO: 30205 - DNA, 19 bp, Artificial sequence
  synthetic polynucleotide sequence
cgggagctactgccaggga

SEQ ID NO: 30206 - DNA, 18 bp, Artificial sequence
  synthetic polynucleotide sequence
accagtaccgagcgggga

SEQ ID NO: 30207 - DNA, 22 bp, Artificial sequence
  synthetic polynucleotide sequence
gggagctggaccctgtaaagga

SEQ ID NO: 30208 - DNA, 22 bp, Artificial sequence
  synthetic polynucleotide sequence
ctaagaagtcatctgcagccca

SEQ ID NO: 30209 - DNA, 22 bp, Artificial sequence
  synthetic polynucleotide sequence
agcataaccgagcggtatagga

SEQ ID NO: 30210 - DNA, 18 bp, Artificial sequence
  synthetic polynucleotide sequence
ctgccccatctagcccca

SEQ ID NO: 30211 - DNA, 20 bp, Artificial sequence
  synthetic polynucleotide sequence
ccgtcggaggaggactcgca

SEQ ID NO: 30212 - DNA, 21 bp, Artificial sequence
  synthetic polynucleotide sequence
cccattcaggatcgcagacca

SEQ ID NO: 30213 - DNA, 20 bp, Artificial sequence
  synthetic polynucleotide sequence
gtaggagtcaaagcccacca

SEQ ID NO: 30214 - DNA, 20 bp, Artificial sequence
  synthetic polynucleotide sequence
ggtgacgagaccataacgga

SEQ ID NO: 30215 - DNA, 20 bp, Artificial sequence
  synthetic polynucleotide sequence
aaggaggctacaaaagggca

SEQ ID NO: 30216 - DNA, 21 bp, Artificial sequence
  synthetic polynucleotide sequence
ttgccaggtctagatgagcca

SEQ ID NO: 30217 - DNA, 22 bp, Artificial sequence
  synthetic polynucleotide sequence
tgaaggacaggaagctgaagga

SEQ ID NO: 30218 - DNA, 20 bp, Artificial sequence
  synthetic polynucleotide sequence
tgccctgtagcaaagcccca

SEQ ID NO: 30219 - DNA, 18 bp, Artificial sequence
  synthetic polynucleotide sequence
gccttggagaaagcccca

SEQ ID NO: 30220 - DNA, 19 bp, Artificial sequence
  synthetic polynucleotide sequence
tgccctatagcagcaccca

SEQ ID NO: 30221 - DNA, 21 bp, Artificial sequence
  synthetic polynucleotide sequence
tgaagcaggccattgagctga

SEQ ID NO: 30222 - DNA, 19 bp, Artificial sequence
  synthetic polynucleotide sequence
ttggctgcactgcggagga

SEQ ID NO: 30223 - DNA, 21 bp, Artificial sequence
  synthetic polynucleotide sequence
caccccttcgcaccaaactga

SEQ ID NO: 30224 - DNA, 22 bp, Artificial sequence
  synthetic polynucleotide sequence
aaatggaaagtcggagctcaca

SEQ ID NO: 30225 - DNA, 20 bp, Artificial sequence
  synthetic polynucleotide sequence
ctccctcaaagtgcgagaca

SEQ ID NO: 30226 - DNA, 22 bp, Artificial sequence
  synthetic polynucleotide sequence
tgaagacgaggatgatgcagga

SEQ ID NO: 30227 - DNA, 19 bp, Artificial sequence
  synthetic polynucleotide sequence
ctgcccccagaggccagga

SEQ ID NO: 30228 - DNA, 20 bp, Artificial sequence
  synthetic polynucleotide sequence
ctgtggggacagggcgagga

SEQ ID NO: 30229 - DNA, 20 bp, Artificial sequence
  synthetic polynucleotide sequence
caggaggagagggtgggaga

SEQ ID NO: 30230 - DNA, 18 bp, Artificial sequence
  synthetic polynucleotide sequence
gacaacctcccaggcaca

SEQ ID NO: 30231 - DNA, 21 bp, Artificial sequence
  synthetic polynucleotide sequence
acagcctggataacaggagga

SEQ ID NO: 30232 - DNA, 20 bp, Artificial sequence
  synthetic polynucleotide sequence
ggaggacagagatggctgga

SEQ ID NO: 30233 - DNA, 20 bp, Artificial sequence
  synthetic polynucleotide sequence
ggaggttggggtggaagaga

SEQ ID NO: 30234 - DNA, 18 bp, Artificial sequence
  synthetic polynucleotide sequence
gacaacctcccaggcaca

SEQ ID NO: 30235 - DNA, 22 bp, Artificial sequence
  synthetic polynucleotide sequence
ttccatgagatgatccagcaga

SEQ ID NO: 30236 - DNA, 21 bp, Artificial sequence
  synthetic polynucleotide sequence
ggtctcatcccaagcagcaga

SEQ ID NO: 30237 - DNA, 22 bp, Artificial sequence
  synthetic polynucleotide sequence
tggaagcatgtgtgatacagga

SEQ ID NO: 30238 - DNA, 18 bp, Artificial sequence
  synthetic polynucleotide sequence
gacaacctcccaggcaca

SEQ ID NO: 30239 - DNA, 19 bp, Artificial sequence
  synthetic polynucleotide sequence
ggggtgggggtgacagaga

SEQ ID NO: 30240 - DNA, 18 bp, Artificial sequence
  synthetic polynucleotide sequence
gacaacctcccaggcaca

SEQ ID NO: 30241 - DNA, 22 bp, Artificial sequence
  synthetic polynucleotide sequence
tggaagcctgtatgatgcagga

SEQ ID NO: 30242 - DNA, 20 bp, Artificial sequence
  synthetic polynucleotide sequence
ctctgacaacctcccatgca

SEQ ID NO: 30243 - DNA, 20 bp, Artificial sequence
  synthetic polynucleotide sequence
tgatggccaccagttccaga

SEQ ID NO: 30244 - DNA, 21 bp, Artificial sequence
  synthetic polynucleotide sequence
gctctgttcccaagcagcaga

SEQ ID NO: 30245 - DNA, 21 bp, Artificial sequence
  synthetic polynucleotide sequence
tgagacctggtacaacacgga

SEQ ID NO: 30246 - DNA, 21 bp, Artificial sequence
  synthetic polynucleotide sequence
tgcccatacagctgaacagga

SEQ ID NO: 30247 - DNA, 18 bp, Artificial sequence
  synthetic polynucleotide sequence
ccgcagccgcaggtggaa

SEQ ID NO: 30248 - DNA, 23 bp, Artificial sequence
  synthetic polynucleotide sequence
gaaaaagtcacattcccgacaga

SEQ ID NO: 30249 - DNA, 18 bp, Artificial sequence
  synthetic polynucleotide sequence
cccggagtccgaggagga

SEQ ID NO: 30250 - DNA, 18 bp, Artificial sequence
  synthetic polynucleotide sequence
tctcacagggcccactca

SEQ ID NO: 30251 - DNA, 21 bp, Artificial sequence
  synthetic polynucleotide sequence
gcagcagttccagaaggagga

SEQ ID NO: 30252 - DNA, 20 bp, Artificial sequence
  synthetic polynucleotide sequence
tagccaggaggttctcaaca

SEQ ID NO: 30253 - DNA, 21 bp, Artificial sequence
  synthetic polynucleotide sequence
tcatgggactggaagcagaga

SEQ ID NO: 30254 - DNA, 20 bp, Artificial sequence
  synthetic polynucleotide sequence
cttggacaatggcccaggca

SEQ ID NO: 30255 - DNA, 21 bp, Artificial sequence
  synthetic polynucleotide sequence
ctgacttgaatgtccaacgca

SEQ ID NO: 30256 - DNA, 20 bp, Artificial sequence
  synthetic polynucleotide sequence
gggatgctcttcgacctcga

SEQ ID NO: 30257 - DNA, 23 bp, Artificial sequence
  synthetic polynucleotide sequence
aaaatactcacgcagaaggaaga

SEQ ID NO: 30258 - DNA, 21 bp, Artificial sequence
  synthetic polynucleotide sequence
tcagttgtaacaccccacaca

SEQ ID NO: 30259 - DNA, 19 bp, Artificial sequence
  synthetic polynucleotide sequence
ctgagctgggagcactcca

SEQ ID NO: 30260 - DNA, 19 bp, Artificial sequence
  synthetic polynucleotide sequence
gccgtggaggtatcagcga

SEQ ID NO: 30261 - DNA, 19 bp, Artificial sequence
  synthetic polynucleotide sequence
cagaagccagggtccccca

SEQ ID NO: 30262 - DNA, 20 bp, Artificial sequence
  synthetic polynucleotide sequence
ctcggacaatctcccaggca

SEQ ID NO: 30263 - DNA, 18 bp, Artificial sequence
  synthetic polynucleotide sequence
tggaccagccccttcaca

SEQ ID NO: 30264 - DNA, 18 bp, Artificial sequence
  synthetic polynucleotide sequence
ctggagccggtacagcca

SEQ ID NO: 30265 - DNA, 20 bp, Artificial sequence
  synthetic polynucleotide sequence
ccccttcacaccctgcacca

SEQ ID NO: 30266 - DNA, 21 bp, Artificial sequence
  synthetic polynucleotide sequence
tgaaggtgacagaggcctcga

SEQ ID NO: 30267 - DNA, 23 bp, Artificial sequence
  synthetic polynucleotide sequence
ggcatctaagggacaccaatcca

SEQ ID NO: 30268 - DNA, 22 bp, Artificial sequence
  synthetic polynucleotide sequence
aagaaccacagtcggttaagga

SEQ ID NO: 30269 - DNA, 20 bp, Artificial sequence
  synthetic polynucleotide sequence
gttcaagggacgcgtgcgga

SEQ ID NO: 30270 - DNA, 20 bp, Artificial sequence
  synthetic polynucleotide sequence
cgtctgggtgagcaccagga

SEQ ID NO: 30271 - DNA, 22 bp, Artificial sequence
  synthetic polynucleotide sequence
tgaccctcctagaccaactcca

SEQ ID NO: 30272 - DNA, 20 bp, Artificial sequence
  synthetic polynucleotide sequence
ctgcagcaagcaggtctcca

SEQ ID NO: 30273 - DNA, 19 bp, Artificial sequence
  synthetic polynucleotide sequence
ggccttggcaacagatgga

SEQ ID NO: 30274 - DNA, 18 bp, Artificial sequence
  synthetic polynucleotide sequence
cctccactgccctcagga

SEQ ID NO: 30275 - DNA, 21 bp, Artificial sequence
  synthetic polynucleotide sequence
tgcgcactctggccactgaca

SEQ ID NO: 30276 - DNA, 21 bp, Artificial sequence
  synthetic polynucleotide sequence
aggtggtggtgcatgcccgaa

SEQ ID NO: 30277 - DNA, 20 bp, Artificial sequence
  synthetic polynucleotide sequence
cgccaagcccttccacgaca

SEQ ID NO: 30278 - DNA, 20 bp, Artificial sequence
  synthetic polynucleotide sequence
acgtcgtaggaagaggcgga

SEQ ID NO: 30279 - DNA, 21 bp, Artificial sequence
  synthetic polynucleotide sequence
agggcgctgctcaaatccgga

SEQ ID NO: 30280 - DNA, 19 bp, Artificial sequence
  synthetic polynucleotide sequence
ccttccgccagtccaggga

SEQ ID NO: 30281 - DNA, 19 bp, Artificial sequence
  synthetic polynucleotide sequence
gagcagggccagtgggaca

SEQ ID NO: 30282 - DNA, 20 bp, Artificial sequence
  synthetic polynucleotide sequence
ggttccaggagagctcacca

SEQ ID NO: 30283 - DNA, 23 bp, Artificial sequence
  synthetic polynucleotide sequence
gacagcactacaagtctggggga

SEQ ID NO: 30284 - DNA, 20 bp, Artificial sequence
  synthetic polynucleotide sequence
acactgcagggccaccagca

SEQ ID NO: 30285 - DNA, 21 bp, Artificial sequence
  synthetic polynucleotide sequence
aagccaccggaaggaaatgga

SEQ ID NO: 30286 - DNA, 22 bp, Artificial sequence
  synthetic polynucleotide sequence
agcttgttcaagggtggcgaca

SEQ ID NO: 30287 - DNA, 20 bp, Artificial sequence
  synthetic polynucleotide sequence
tggtggtgaagacagtgcca

SEQ ID NO: 30288 - DNA, 20 bp, Artificial sequence
  synthetic polynucleotide sequence
gaccgagccttctccagcca

SEQ ID NO: 30289 - DNA, 19 bp, Artificial sequence
  synthetic polynucleotide sequence
gagtcagcgcaggccgaga

SEQ ID NO: 30290 - DNA, 19 bp, Artificial sequence
  synthetic polynucleotide sequence
tcacggaatcacctgccca

SEQ ID NO: 30291 - DNA, 21 bp, Artificial sequence
  synthetic polynucleotide sequence
aggggcctatgaccctgcaga

SEQ ID NO: 30292 - DNA, 21 bp, Artificial sequence
  synthetic polynucleotide sequence
gctttccatcaggacgtggga

SEQ ID NO: 30293 - DNA, 20 bp, Artificial sequence
  synthetic polynucleotide sequence
tgccctacacagccacccta

SEQ ID NO: 30294 - DNA, 20 bp, Artificial sequence
  synthetic polynucleotide sequence
cgcaggctgaagggttggca

SEQ ID NO: 30295 - DNA, 20 bp, Artificial sequence
  synthetic polynucleotide sequence
ctgaaggccccgtccagaca

SEQ ID NO: 30296 - DNA, 20 bp, Artificial sequence
  synthetic polynucleotide sequence
cttgaggctgctcaaaggga

SEQ ID NO: 30297 - DNA, 20 bp, Artificial sequence
  synthetic polynucleotide sequence
cttctgggatacgaccccta

SEQ ID NO: 30298 - DNA, 20 bp, Artificial sequence
  synthetic polynucleotide sequence
gtgttacagggcgatgggca

SEQ ID NO: 30299 - DNA, 20 bp, Artificial sequence
  synthetic polynucleotide sequence
gcctgggctccagatggaga

SEQ ID NO: 30300 - DNA, 22 bp, Artificial sequence
  synthetic polynucleotide sequence
tccatttccacaggctccagca

SEQ ID NO: 30301 - DNA, 21 bp, Artificial sequence
  synthetic polynucleotide sequence
ccagagcagacagccaaacga

SEQ ID NO: 30302 - DNA, 21 bp, Artificial sequence
  synthetic polynucleotide sequence
tctgaagaagccagtggagca

SEQ ID NO: 30303 - DNA, 21 bp, Artificial sequence
  synthetic polynucleotide sequence
cagcgcataaagtcaggcaga

SEQ ID NO: 30304 - DNA, 21 bp, Artificial sequence
  synthetic polynucleotide sequence
tggccactatcaccgctagca

SEQ ID NO: 30305 - DNA, 23 bp, Artificial sequence
  synthetic polynucleotide sequence
gaaaagcagctcagcaacaggaa

SEQ ID NO: 30306 - DNA, 21 bp, Artificial sequence
  synthetic polynucleotide sequence
cggttcccatagcccctagga

SEQ ID NO: 30307 - DNA, 20 bp, Artificial sequence
  synthetic polynucleotide sequence
taaatggggcgagacgggga

SEQ ID NO: 30308 - DNA, 21 bp, Artificial sequence
  synthetic polynucleotide sequence
agctgggtctcctcacacgga

SEQ ID NO: 30309 - DNA, 19 bp, Artificial sequence
  synthetic polynucleotide sequence
ctacccggacctccagcca

SEQ ID NO: 30310 - DNA, 19 bp, Artificial sequence
  synthetic polynucleotide sequence
cagaggaggagaccgggga

SEQ ID NO: 30311 - DNA, 19 bp, Artificial sequence
  synthetic polynucleotide sequence
cccacagggtatggctcca

SEQ ID NO: 30312 - DNA, 18 bp, Artificial sequence
  synthetic polynucleotide sequence
tggcgctgggcacggaca

SEQ ID NO: 30313 - DNA, 18 bp, Artificial sequence
  synthetic polynucleotide sequence
ccaggaacaacggggaga

SEQ ID NO: 30314 - DNA, 18 bp, Artificial sequence
  synthetic polynucleotide sequence
ccagctgttggagccgca

SEQ ID NO: 30315 - DNA, 18 bp, Artificial sequence
  synthetic polynucleotide sequence
ccgtggcatcgttgagga

SEQ ID NO: 30316 - DNA, 18 bp, Artificial sequence
  synthetic polynucleotide sequence
gaacttgcccacggggta

SEQ ID NO: 30317 - DNA, 18 bp, Artificial sequence
  synthetic polynucleotide sequence
aggctcccgagcaggaga

SEQ ID NO: 30318 - DNA, 18 bp, Artificial sequence
  synthetic polynucleotide sequence
tgatggaggcgctggcaa

SEQ ID NO: 30319 - DNA, 20 bp, Artificial sequence
  synthetic polynucleotide sequence
gttcaaggcccagggacgga

SEQ ID NO: 30320 - DNA, 21 bp, Artificial sequence
  synthetic polynucleotide sequence
cctttgccaatcacccggcca

SEQ ID NO: 30321 - DNA, 20 bp, Artificial sequence
  synthetic polynucleotide sequence
ggatgccacctcccacctca

SEQ ID NO: 30322 - DNA, 21 bp, Artificial sequence
  synthetic polynucleotide sequence
caccgactgatagagctggga

SEQ ID NO: 30323 - DNA, 20 bp, Artificial sequence
  synthetic polynucleotide sequence
gacgacgggcagatgcacaa

SEQ ID NO: 30324 - DNA, 20 bp, Artificial sequence
  synthetic polynucleotide sequence
gtagagcaacagggccagca

SEQ ID NO: 30325 - DNA, 18 bp, Artificial sequence
  synthetic polynucleotide sequence
cttccagggcctgggcaa

SEQ ID NO: 30326 - DNA, 18 bp, Artificial sequence
  synthetic polynucleotide sequence
ccaagaggctgttgggca

SEQ ID NO: 30327 - DNA, 20 bp, Artificial sequence
  synthetic polynucleotide sequence
atggccccttctgaagagga

SEQ ID NO: 30328 - DNA, 18 bp, Artificial sequence
  synthetic polynucleotide sequence
tggagagccttcgagcca

SEQ ID NO: 30329 - DNA, 18 bp, Artificial sequence
  synthetic polynucleotide sequence
ctccctgcacatccccaa

SEQ ID NO: 30330 - DNA, 18 bp, Artificial sequence
  synthetic polynucleotide sequence
ggggttcacacaccagca

SEQ ID NO: 30331 - DNA, 18 bp, Artificial sequence
  synthetic polynucleotide sequence
caagttccaccccctcca

SEQ ID NO: 30332 - DNA, 18 bp, Artificial sequence
  synthetic polynucleotide sequence
ccgcttggactcggagga

SEQ ID NO: 30333 - DNA, 18 bp, Artificial sequence
  synthetic polynucleotide sequence
ggatgggcagcgtggcaa

SEQ ID NO: 30334 - DNA, 18 bp, Artificial sequence
  synthetic polynucleotide sequence
ccagctggtggcagtcca

SEQ ID NO: 30335 - DNA, 21 bp, Artificial sequence
  synthetic polynucleotide sequence
ccgtagcccacatggatagca

SEQ ID NO: 30336 - DNA, 25 bp, Artificial sequence
  synthetic polynucleotide sequence
aaaacaaccggtaggcaactcggaa

SEQ ID NO: 30337 - DNA, 22 bp, Artificial sequence
  synthetic polynucleotide sequence
aaccgcagagaccaacagagga

SEQ ID NO: 30338 - DNA, 19 bp, Artificial sequence
  synthetic polynucleotide sequence
tgctgcagcactgagtcca

SEQ ID NO: 30339 - DNA, 18 bp, Artificial sequence
  synthetic polynucleotide sequence
gcgagcaaggtccttcca

SEQ ID NO: 30340 - DNA, 18 bp, Artificial sequence
  synthetic polynucleotide sequence
tgtcccggtcaccaggca

SEQ ID NO: 30341 - DNA, 18 bp, Artificial sequence
  synthetic polynucleotide sequence
acggtcgctcgtacccca

SEQ ID NO: 30342 - DNA, 20 bp, Artificial sequence
  synthetic polynucleotide sequence
acagccctcacttcacagga

SEQ ID NO: 30343 - DNA, 21 bp, Artificial sequence
  synthetic polynucleotide sequence
ccaggacccagacgtgtggaa

SEQ ID NO: 30344 - DNA, 20 bp, Artificial sequence
  synthetic polynucleotide sequence
gaggtccgggctgagtcgca

SEQ ID NO: 30345 - DNA, 21 bp, Artificial sequence
  synthetic polynucleotide sequence
cacccaggtgtggagacaaga

SEQ ID NO: 30346 - DNA, 20 bp, Artificial sequence
  synthetic polynucleotide sequence
gagctcaaagcagggccaga

SEQ ID NO: 30347 - DNA, 20 bp, Artificial sequence
  synthetic polynucleotide sequence
ccgacacccaggtgtgggaa

SEQ ID NO: 30348 - DNA, 21 bp, Artificial sequence
  synthetic polynucleotide sequence
tgggggccaaaagactcggga

SEQ ID NO: 30349 - DNA, 19 bp, Artificial sequence
  synthetic polynucleotide sequence
ctctgcggctccagctgca

SEQ ID NO: 30350 - DNA, 20 bp, Artificial sequence
  synthetic polynucleotide sequence
ctgggcacagatcctggtga

SEQ ID NO: 30351 - DNA, 21 bp, Artificial sequence
  synthetic polynucleotide sequence
tgagatggtggtggcaaggga

SEQ ID NO: 30352 - DNA, 21 bp, Artificial sequence
  synthetic polynucleotide sequence
cagcaaaccccagatgagcca

SEQ ID NO: 30353 - DNA, 21 bp, Artificial sequence
  synthetic polynucleotide sequence
acagtcaaggtcggggacaca

SEQ ID NO: 30354 - DNA, 21 bp, Artificial sequence
  synthetic polynucleotide sequence
tgcagggtcctcagcaccaca

SEQ ID NO: 30355 - DNA, 20 bp, Artificial sequence
  synthetic polynucleotide sequence
gatctgcccacggaggagga

SEQ ID NO: 30356 - DNA, 20 bp, Artificial sequence
  synthetic polynucleotide sequence
gcagccatggatctcgggca

SEQ ID NO: 30357 - DNA, 18 bp, Artificial sequence
  synthetic polynucleotide sequence
gaggaggcccagagcaca

SEQ ID NO: 30358 - DNA, 20 bp, Artificial sequence
  synthetic polynucleotide sequence
agagacttgagaccagggca

SEQ ID NO: 30359 - DNA, 20 bp, Artificial sequence
  synthetic polynucleotide sequence
ggtctggccgtggtaaccca

SEQ ID NO: 30360 - DNA, 18 bp, Artificial sequence
  synthetic polynucleotide sequence
tgccccaccggctcctca

SEQ ID NO: 30361 - DNA, 21 bp, Artificial sequence
  synthetic polynucleotide sequence
tggcctggaaggcagatggca

SEQ ID NO: 30362 - DNA, 20 bp, Artificial sequence
  synthetic polynucleotide sequence
cttccactgctcgggcgtca

SEQ ID NO: 30363 - DNA, 20 bp, Artificial sequence
  synthetic polynucleotide sequence
gaggctcagagacagacgga

SEQ ID NO: 30364 - DNA, 18 bp, Artificial sequence
  synthetic polynucleotide sequence
ggaacgggcagttccaca

SEQ ID NO: 30365 - DNA, 21 bp, Artificial sequence
  synthetic polynucleotide sequence
ttgtagcctaccctccccgaa

SEQ ID NO: 30366 - DNA, 21 bp, Artificial sequence
  synthetic polynucleotide sequence
agagaagggagtggtcaggca

SEQ ID NO: 30367 - DNA, 22 bp, Artificial sequence
  synthetic polynucleotide sequence
gaaacacagagtcagtcagcca

SEQ ID NO: 30368 - DNA, 18 bp, Artificial sequence
  synthetic polynucleotide sequence
tgttgacccgggaccaga

SEQ ID NO: 30369 - DNA, 18 bp, Artificial sequence
  synthetic polynucleotide sequence
gctccaccgacacgcaca

SEQ ID NO: 30370 - DNA, 18 bp, Artificial sequence
  synthetic polynucleotide sequence
gtggggccaatggaacca

SEQ ID NO: 30371 - DNA, 20 bp, Artificial sequence
  synthetic polynucleotide sequence
gcccacagtgaccctctaca

SEQ ID NO: 30372 - DNA, 20 bp, Artificial sequence
  synthetic polynucleotide sequence
cttgagcgtgcaggtgggga

SEQ ID NO: 30373 - DNA, 21 bp, Artificial sequence
  synthetic polynucleotide sequence
ggtggtgacaatggaccctga

SEQ ID NO: 30374 - DNA, 21 bp, Artificial sequence
  synthetic polynucleotide sequence
atgtaggtgcccagctgctca

SEQ ID NO: 30375 - DNA, 20 bp, Artificial sequence
  synthetic polynucleotide sequence
ggttctcaaccgcaccagca

SEQ ID NO: 30376 - DNA, 20 bp, Artificial sequence
  synthetic polynucleotide sequence
aaggtggcgtcacggctcaa

SEQ ID NO: 30377 - DNA, 21 bp, Artificial sequence
  synthetic polynucleotide sequence
gacttggactagcaggcacca

SEQ ID NO: 30378 - DNA, 22 bp, Artificial sequence
  synthetic polynucleotide sequence
agaaacaacaacggcagcagca

SEQ ID NO: 30379 - DNA, 19 bp, Artificial sequence
  synthetic polynucleotide sequence
gacaggaggagggaccaca

SEQ ID NO: 30380 - DNA, 20 bp, Artificial sequence
  synthetic polynucleotide sequence
ggagaggagtatgaaggcca

SEQ ID NO: 30381 - DNA, 18 bp, Artificial sequence
  synthetic polynucleotide sequence
ggtggagcgaccagagga

SEQ ID NO: 30382 - DNA, 18 bp, Artificial sequence
  synthetic polynucleotide sequence
gtcggcatgctgcaccca

SEQ ID NO: 30383 - DNA, 19 bp, Artificial sequence
  synthetic polynucleotide sequence
gacaccagcagctgggcca

SEQ ID NO: 30384 - DNA, 21 bp, Artificial sequence
  synthetic polynucleotide sequence
atgggcagtgttcaggaggca

SEQ ID NO: 30385 - DNA, 21 bp, Artificial sequence
  synthetic polynucleotide sequence
catccccgaggagaatggaga

SEQ ID NO: 30386 - DNA, 19 bp, Artificial sequence
  synthetic polynucleotide sequence
ggctgcagactctcgggca

SEQ ID NO: 30387 - DNA, 19 bp, Artificial sequence
  synthetic polynucleotide sequence
cggctgacaatcacacgga

SEQ ID NO: 30388 - DNA, 19 bp, Artificial sequence
  synthetic polynucleotide sequence
cagaaggccaactgagcca

SEQ ID NO: 30389 - DNA, 21 bp, Artificial sequence
  synthetic polynucleotide sequence
gagcgagaacgagatcgggaa

SEQ ID NO: 30390 - DNA, 20 bp, Artificial sequence
  synthetic polynucleotide sequence
tgtcaacgtccatgggctca

SEQ ID NO: 30391 - DNA, 18 bp, Artificial sequence
  synthetic polynucleotide sequence
tgctgcggagcccgggaa

SEQ ID NO: 30392 - DNA, 20 bp, Artificial sequence
  synthetic polynucleotide sequence
agcgacagcaggctcaggca

SEQ ID NO: 30393 - DNA, 19 bp, Artificial sequence
  synthetic polynucleotide sequence
cactggacgactgaccgga

SEQ ID NO: 30394 - DNA, 18 bp, Artificial sequence
  synthetic polynucleotide sequence
gtgcacatgggaggcgga

SEQ ID NO: 30395 - DNA, 18 bp, Artificial sequence
  synthetic polynucleotide sequence
ctcagcagctcaaggcca

SEQ ID NO: 30396 - DNA, 18 bp, Artificial sequence
  synthetic polynucleotide sequence
cgcccacagagctccaca

SEQ ID NO: 30397 - DNA, 20 bp, Artificial sequence
  synthetic polynucleotide sequence
caggaggagtgcgtgcagaa

SEQ ID NO: 30398 - DNA, 21 bp, Artificial sequence
  synthetic polynucleotide sequence
cagccacagaacagccaacca

SEQ ID NO: 30399 - DNA, 18 bp, Artificial sequence
  synthetic polynucleotide sequence
cttccaggctgagaggca

SEQ ID NO: 30400 - DNA, 17 bp, Artificial sequence
  synthetic polynucleotide sequence
ggcctgggagacctcga

SEQ ID NO: 30401 - DNA, 21 bp, Artificial sequence
  synthetic polynucleotide sequence
tgcaaaacgaaggtctaggca

SEQ ID NO: 30402 - DNA, 20 bp, Artificial sequence
  synthetic polynucleotide sequence
ctcaaagctgtccagcagca

SEQ ID NO: 30403 - DNA, 21 bp, Artificial sequence
  synthetic polynucleotide sequence
catgcgattcagctacccaga

SEQ ID NO: 30404 - DNA, 18 bp, Artificial sequence
  synthetic polynucleotide sequence
ctggggccacttcagcga

SEQ ID NO: 30405 - DNA, 21 bp, Artificial sequence
  synthetic polynucleotide sequence
cacggacactgacagcaacca

SEQ ID NO: 30406 - DNA, 18 bp, Artificial sequence
  synthetic polynucleotide sequence
tgggcgggggcttgagga

SEQ ID NO: 30407 - DNA, 18 bp, Artificial sequence
  synthetic polynucleotide sequence
cgccaaagaggaccccaa

SEQ ID NO: 30408 - DNA, 18 bp, Artificial sequence
  synthetic polynucleotide sequence
tgaagccatggcagccca

SEQ ID NO: 30409 - DNA, 21 bp, Artificial sequence
  synthetic polynucleotide sequence
agtctgccacccgaaaaccaa

SEQ ID NO: 30410 - DNA, 21 bp, Artificial sequence
  synthetic polynucleotide sequence
ttctgggcttgtgggagagga

SEQ ID NO: 30411 - DNA, 18 bp, Artificial sequence
  synthetic polynucleotide sequence
gccccaagctgagaacca

SEQ ID NO: 30412 - DNA, 22 bp, Artificial sequence
  synthetic polynucleotide sequence
cacagggaagaaatcgatgaca

SEQ ID NO: 30413 - DNA, 20 bp, Artificial sequence
  synthetic polynucleotide sequence
cagctgcagtgacctgggaa

SEQ ID NO: 30414 - DNA, 20 bp, Artificial sequence
  synthetic polynucleotide sequence
caggctagagatgaggggca

SEQ ID NO: 30415 - DNA, 20 bp, Artificial sequence
  synthetic polynucleotide sequence
aaagctggggaatggagtga

SEQ ID NO: 30416 - DNA, 18 bp, Artificial sequence
  synthetic polynucleotide sequence
gcaaggcgaagcagccga

SEQ ID NO: 30417 - DNA, 18 bp, Artificial sequence
  synthetic polynucleotide sequence
ctacctgcggcacgtgca

SEQ ID NO: 30418 - DNA, 18 bp, Artificial sequence
  synthetic polynucleotide sequence
gcagggccaggcgggaca

SEQ ID NO: 30419 - DNA, 20 bp, Artificial sequence
  synthetic polynucleotide sequence
cagctacacacgcagccaga

SEQ ID NO: 30420 - DNA, 19 bp, Artificial sequence
  synthetic polynucleotide sequence
cactgaggccaagaaccca

SEQ ID NO: 30421 - DNA, 20 bp, Artificial sequence
  synthetic polynucleotide sequence
cagcctcctccttgtggcta

SEQ ID NO: 30422 - DNA, 18 bp, Artificial sequence
  synthetic polynucleotide sequence
tgttgctgacggccctca

SEQ ID NO: 30423 - DNA, 21 bp, Artificial sequence
  synthetic polynucleotide sequence
aagaacttgcagctgaagcca

SEQ ID NO: 30424 - DNA, 19 bp, Artificial sequence
  synthetic polynucleotide sequence
cctggacctgaacgcagaa

SEQ ID NO: 30425 - DNA, 18 bp, Artificial sequence
  synthetic polynucleotide sequence
aggccaaggccaccagga

SEQ ID NO: 30426 - DNA, 18 bp, Artificial sequence
  synthetic polynucleotide sequence
tggttcaggccaggacca

SEQ ID NO: 30427 - DNA, 18 bp, Artificial sequence
  synthetic polynucleotide sequence
ctgctccaactggccaca

SEQ ID NO: 30428 - DNA, 18 bp, Artificial sequence
  synthetic polynucleotide sequence
gggagcaccgtccaggga

SEQ ID NO: 30429 - DNA, 18 bp, Artificial sequence
  synthetic polynucleotide sequence
tgcatgtccgagacacca

SEQ ID NO: 30430 - DNA, 18 bp, Artificial sequence
  synthetic polynucleotide sequence
ctgaagacgggcagcaca

SEQ ID NO: 30431 - DNA, 18 bp, Artificial sequence
  synthetic polynucleotide sequence
cccgagggagccagctca

SEQ ID NO: 30432 - DNA, 19 bp, Artificial sequence
  synthetic polynucleotide sequence
gtgctacactgggacccca

SEQ ID NO: 30433 - DNA, 20 bp, Artificial sequence
  synthetic polynucleotide sequence
aacaagggcattgaagcgaa

SEQ ID NO: 30434 - DNA, 20 bp, Artificial sequence
  synthetic polynucleotide sequence
atgcatgatccaagccctca

SEQ ID NO: 30435 - DNA, 22 bp, Artificial sequence
  synthetic polynucleotide sequence
gggcttcctaaaacagaagcca

SEQ ID NO: 30436 - DNA, 20 bp, Artificial sequence
  synthetic polynucleotide sequence
ctttgcaactggggtgaaca

SEQ ID NO: 30437 - DNA, 18 bp, Artificial sequence
  synthetic polynucleotide sequence
ggcaccccctctcagaca

SEQ ID NO: 30438 - DNA, 20 bp, Artificial sequence
  synthetic polynucleotide sequence
cttgaggtagcatgccagga

SEQ ID NO: 30439 - DNA, 18 bp, Artificial sequence
  synthetic polynucleotide sequence
tctcaaggggaccacgca

SEQ ID NO: 30440 - DNA, 20 bp, Artificial sequence
  synthetic polynucleotide sequence
ctccagtgtcaccgtgcaga

SEQ ID NO: 30441 - DNA, 21 bp, Artificial sequence
  synthetic polynucleotide sequence
gctgcatcaacgctgatggga

SEQ ID NO: 30442 - DNA, 19 bp, Artificial sequence
  synthetic polynucleotide sequence
gccggaaggagttggggca

SEQ ID NO: 30443 - DNA, 21 bp, Artificial sequence
  synthetic polynucleotide sequence
cccgcatggaggagtatgaga

SEQ ID NO: 30444 - DNA, 19 bp, Artificial sequence
  synthetic polynucleotide sequence
tggacatccacagctgcaa

SEQ ID NO: 30445 - DNA, 19 bp, Artificial sequence
  synthetic polynucleotide sequence
ggctgtatcgatgcacgga

SEQ ID NO: 30446 - DNA, 18 bp, Artificial sequence
  synthetic polynucleotide sequence
tgaacggggcagcacgca

SEQ ID NO: 30447 - DNA, 18 bp, Artificial sequence
  synthetic polynucleotide sequence
tcgccctgggcctacaga

SEQ ID NO: 30448 - DNA, 19 bp, Artificial sequence
  synthetic polynucleotide sequence
gacggtgggcatgtagaca

SEQ ID NO: 30449 - DNA, 22 bp, Artificial sequence
  synthetic polynucleotide sequence
gaattccgttcccatccagcaa

SEQ ID NO: 30450 - DNA, 20 bp, Artificial sequence
  synthetic polynucleotide sequence
gggtgacgcaggtgcagcca

SEQ ID NO: 30451 - DNA, 19 bp, Artificial sequence
  synthetic polynucleotide sequence
ggccgtcagaagcaggaga

SEQ ID NO: 30452 - DNA, 19 bp, Artificial sequence
  synthetic polynucleotide sequence
ggcctcttgaagtccggga

SEQ ID NO: 30453 - DNA, 18 bp, Artificial sequence
  synthetic polynucleotide sequence
gtggcaagagcgagggca

SEQ ID NO: 30454 - DNA, 19 bp, Artificial sequence
  synthetic polynucleotide sequence
ggggcagacactgagagca

SEQ ID NO: 30455 - DNA, 18 bp, Artificial sequence
  synthetic polynucleotide sequence
caaaaccccggtggcaca

SEQ ID NO: 30456 - DNA, 20 bp, Artificial sequence
  synthetic polynucleotide sequence
gagtcaggttccagaggcca

SEQ ID NO: 30457 - DNA, 19 bp, Artificial sequence
  synthetic polynucleotide sequence
ctccactgcgctaccggga

SEQ ID NO: 30458 - DNA, 19 bp, Artificial sequence
  synthetic polynucleotide sequence
gtcttggtccaggccccca

SEQ ID NO: 30459 - DNA, 19 bp, Artificial sequence
  synthetic polynucleotide sequence
gcctatatcccttgccgca

SEQ ID NO: 30460 - DNA, 18 bp, Artificial sequence
  synthetic polynucleotide sequence
acaggtgacgacgaggca

SEQ ID NO: 30461 - DNA, 20 bp, Artificial sequence
  synthetic polynucleotide sequence
agccagacactgagctggga

SEQ ID NO: 30462 - DNA, 21 bp, Artificial sequence
  synthetic polynucleotide sequence
aggacccccaactggtagaga

SEQ ID NO: 30463 - DNA, 21 bp, Artificial sequence
  synthetic polynucleotide sequence
cacaggtacgcagctgtgcaa

SEQ ID NO: 30464 - DNA, 20 bp, Artificial sequence
  synthetic polynucleotide sequence
caggacgacgtgacgctgga

SEQ ID NO: 30465 - DNA, 18 bp, Artificial sequence
  synthetic polynucleotide sequence
ggctgatatcccaggcca

SEQ ID NO: 30466 - DNA, 21 bp, Artificial sequence
  synthetic polynucleotide sequence
tcactaggcacactactgcca

SEQ ID NO: 30467 - DNA, 20 bp, Artificial sequence
  synthetic polynucleotide sequence
aacccagtccgtccaactga

SEQ ID NO: 30468 - DNA, 20 bp, Artificial sequence
  synthetic polynucleotide sequence
ctggtaggtccggtacagca

SEQ ID NO: 30469 - DNA, 20 bp, Artificial sequence
  synthetic polynucleotide sequence
cagcccaccttgaaggggaa

SEQ ID NO: 30470 - DNA, 20 bp, Artificial sequence
  synthetic polynucleotide sequence
cctgaggccagccagtggga

SEQ ID NO: 30471 - DNA, 22 bp, Artificial sequence
  synthetic polynucleotide sequence
ccatcacaggtagtgagaccaa

SEQ ID NO: 30472 - DNA, 18 bp, Artificial sequence
  synthetic polynucleotide sequence
ccctgccaagcacaccca

SEQ ID NO: 30473 - DNA, 18 bp, Artificial sequence
  synthetic polynucleotide sequence
gaactgcacgctccggga

SEQ ID NO: 30474 - DNA, 22 bp, Artificial sequence
  synthetic polynucleotide sequence
acaaaggacatggagaacacca

SEQ ID NO: 30475 - DNA, 25 bp, Artificial sequence
  synthetic polynucleotide sequence
aagggagagtcagagagagaatgga

SEQ ID NO: 30476 - DNA, 20 bp, Artificial sequence
  synthetic polynucleotide sequence
gctcaaggcccctcactcca

SEQ ID NO: 30477 - DNA, 19 bp, Artificial sequence
  synthetic polynucleotide sequence
cgttgcaggagacggagga

SEQ ID NO: 30478 - DNA, 19 bp, Artificial sequence
  synthetic polynucleotide sequence
tcagccacattcatcacga

SEQ ID NO: 30479 - DNA, 18 bp, Artificial sequence
  synthetic polynucleotide sequence
ccccgcatcaacctgaca

SEQ ID NO: 30480 - DNA, 20 bp, Artificial sequence
  synthetic polynucleotide sequence
tagtgcagacgtaggtgcca

SEQ ID NO: 30481 - DNA, 19 bp, Artificial sequence
  synthetic polynucleotide sequence
cgggaccttgaggagccaa

SEQ ID NO: 30482 - DNA, 18 bp, Artificial sequence
  synthetic polynucleotide sequence
ggccggaaccacagcaca

SEQ ID NO: 30483 - DNA, 22 bp, Artificial sequence
  synthetic polynucleotide sequence
accatcaagctcctgacggtca

SEQ ID NO: 30484 - DNA, 21 bp, Artificial sequence
  synthetic polynucleotide sequence
gaacggagatctggatgggca

SEQ ID NO: 30485 - DNA, 21 bp, Artificial sequence
  synthetic polynucleotide sequence
acagacaagcctcccaagcca

SEQ ID NO: 30486 - DNA, 21 bp, Artificial sequence
  synthetic polynucleotide sequence
ttggcccagactctccactga

SEQ ID NO: 30487 - DNA, 23 bp, Artificial sequence
  synthetic polynucleotide sequence
ctgtgccaagcaaaattcccaga

SEQ ID NO: 30488 - DNA, 21 bp, Artificial sequence
  synthetic polynucleotide sequence
gggcataagccagctaggaga

SEQ ID NO: 30489 - DNA, 21 bp, Artificial sequence
  synthetic polynucleotide sequence
ggacttcacggagcagtcaca

SEQ ID NO: 30490 - DNA, 20 bp, Artificial sequence
  synthetic polynucleotide sequence
tgtgtgctgcagcagctgga

SEQ ID NO: 30491 - DNA, 21 bp, Artificial sequence
  synthetic polynucleotide sequence
actgacctgagcgagaacaga

SEQ ID NO: 30492 - DNA, 18 bp, Artificial sequence
  synthetic polynucleotide sequence
gggcaggcggcagactca

SEQ ID NO: 30493 - DNA, 18 bp, Artificial sequence
  synthetic polynucleotide sequence
gcccaagaaggccacaga

SEQ ID NO: 30494 - DNA, 22 bp, Artificial sequence
  synthetic polynucleotide sequence
ttcagatccctttagttccaga

SEQ ID NO: 30495 - DNA, 22 bp, Artificial sequence
  synthetic polynucleotide sequence
cagtgtgcaagccaaagatgga

SEQ ID NO: 30496 - DNA, 20 bp, Artificial sequence
  synthetic polynucleotide sequence
ggaggcagcatcgattcgca

SEQ ID NO: 30497 - DNA, 20 bp, Artificial sequence
  synthetic polynucleotide sequence
gagcacacagactcggagga

SEQ ID NO: 30498 - DNA, 18 bp, Artificial sequence
  synthetic polynucleotide sequence
ccctcctctccgagccca

SEQ ID NO: 30499 - DNA, 20 bp, Artificial sequence
  synthetic polynucleotide sequence
gtggcctactggaggaggga

SEQ ID NO: 30500 - DNA, 20 bp, Artificial sequence
  synthetic polynucleotide sequence
cacgaccacaaggatcagca

SEQ ID NO: 30501 - DNA, 21 bp, Artificial sequence
  synthetic polynucleotide sequence
tgagatccagtcctggcaaca

SEQ ID NO: 30502 - DNA, 20 bp, Artificial sequence
  synthetic polynucleotide sequence
gtggaccagtgtccccaaga

SEQ ID NO: 30503 - DNA, 18 bp, Artificial sequence
  synthetic polynucleotide sequence
ccggcctggatatggaca

SEQ ID NO: 30504 - DNA, 18 bp, Artificial sequence
  synthetic polynucleotide sequence
gtggcggaggaatgacca

SEQ ID NO: 30505 - DNA, 20 bp, Artificial sequence
  synthetic polynucleotide sequence
gacgttcgtctcattgggga

SEQ ID NO: 30506 - DNA, 18 bp, Artificial sequence
  synthetic polynucleotide sequence
agggcaccacctcctgca

SEQ ID NO: 30507 - DNA, 18 bp, Artificial sequence
  synthetic polynucleotide sequence
ggggaggaagggacacca

SEQ ID NO: 30508 - DNA, 21 bp, Artificial sequence
  synthetic polynucleotide sequence
gacacacaagggactccagca

SEQ ID NO: 30509 - DNA, 19 bp, Artificial sequence
  synthetic polynucleotide sequence
gtgggtagcaggagaagga

SEQ ID NO: 30510 - DNA, 18 bp, Artificial sequence
  synthetic polynucleotide sequence
caggagaggcagtgagca

SEQ ID NO: 30511 - DNA, 19 bp, Artificial sequence
  synthetic polynucleotide sequence
ccccaaggactcagggaca

SEQ ID NO: 30512 - DNA, 19 bp, Artificial sequence
  synthetic polynucleotide sequence
ggctgaggcccagtaggga

SEQ ID NO: 30513 - DNA, 21 bp, Artificial sequence
  synthetic polynucleotide sequence
aggacccctggagacaagaga

SEQ ID NO: 30514 - DNA, 18 bp, Artificial sequence
  synthetic polynucleotide sequence
gatggcttccctcaggca

SEQ ID NO: 30515 - DNA, 20 bp, Artificial sequence
  synthetic polynucleotide sequence
cgccagtgacagtcagggaa

SEQ ID NO: 30516 - DNA, 23 bp, Artificial sequence
  synthetic polynucleotide sequence
ggggtaaagaagcatggggcaca

SEQ ID NO: 30517 - DNA, 18 bp, Artificial sequence
  synthetic polynucleotide sequence
cccccaggacctgtacca

SEQ ID NO: 30518 - DNA, 19 bp, Artificial sequence
  synthetic polynucleotide sequence
tgtggtagagcagctccga

SEQ ID NO: 30519 - DNA, 20 bp, Artificial sequence
  synthetic polynucleotide sequence
gctgagtggggtgaagggaa

SEQ ID NO: 30520 - DNA, 25 bp, Artificial sequence
  synthetic polynucleotide sequence
agacagagtgactaacagcaaccca

SEQ ID NO: 30521 - DNA, 19 bp, Artificial sequence
  synthetic polynucleotide sequence
gaggaaggggctgctccca

SEQ ID NO: 30522 - DNA, 21 bp, Artificial sequence
  synthetic polynucleotide sequence
agacgagctccaaggagtgca

SEQ ID NO: 30523 - DNA, 18 bp, Artificial sequence
  synthetic polynucleotide sequence
agaggtcccaaggcacca

SEQ ID NO: 30524 - DNA, 18 bp, Artificial sequence
  synthetic polynucleotide sequence
cagctcacagggacccca

SEQ ID NO: 30525 - DNA, 19 bp, Artificial sequence
  synthetic polynucleotide sequence
cacgggaagacaaggtgga

SEQ ID NO: 30526 - DNA, 19 bp, Artificial sequence
  synthetic polynucleotide sequence
tgttgtgacgaggcaggaa

SEQ ID NO: 30527 - DNA, 21 bp, Artificial sequence
  synthetic polynucleotide sequence
gtcctgaagtgtaacacccca

SEQ ID NO: 30528 - DNA, 18 bp, Artificial sequence
  synthetic polynucleotide sequence
gcgagatctcaggtgcca

SEQ ID NO: 30529 - DNA, 20 bp, Artificial sequence
  synthetic polynucleotide sequence
ccggactgactgggaccaca

SEQ ID NO: 30530 - DNA, 18 bp, Artificial sequence
  synthetic polynucleotide sequence
accacggcttccaatgca

SEQ ID NO: 30531 - DNA, 23 bp, Artificial sequence
  synthetic polynucleotide sequence
cacacattccaggaccagaagca

SEQ ID NO: 30532 - DNA, 20 bp, Artificial sequence
  synthetic polynucleotide sequence
ggccaaatgggagctgcaca

SEQ ID NO: 30533 - DNA, 18 bp, Artificial sequence
  synthetic polynucleotide sequence
agcccagccatccgggca

SEQ ID NO: 30534 - DNA, 19 bp, Artificial sequence
  synthetic polynucleotide sequence
tcatgggtgtctgttggca

SEQ ID NO: 30535 - DNA, 21 bp, Artificial sequence
  synthetic polynucleotide sequence
gtcctgagaccaaggtggaga

SEQ ID NO: 30536 - DNA, 21 bp, Artificial sequence
  synthetic polynucleotide sequence
cacaatgagatgggggagcca

SEQ ID NO: 30537 - DNA, 18 bp, Artificial sequence
  synthetic polynucleotide sequence
tgaggagcagcacccaga

SEQ ID NO: 30538 - DNA, 18 bp, Artificial sequence
  synthetic polynucleotide sequence
ctgcatggaccagggcca

SEQ ID NO: 30539 - DNA, 20 bp, Artificial sequence
  synthetic polynucleotide sequence
atgagtctcaacacccctca

SEQ ID NO: 30540 - DNA, 21 bp, Artificial sequence
  synthetic polynucleotide sequence
caaagaaggcctggtctggca

SEQ ID NO: 30541 - DNA, 18 bp, Artificial sequence
  synthetic polynucleotide sequence
ccccagggccaaacctga

SEQ ID NO: 30542 - DNA, 20 bp, Artificial sequence
  synthetic polynucleotide sequence
ctgggctgcaagactgagga

SEQ ID NO: 30543 - DNA, 21 bp, Artificial sequence
  synthetic polynucleotide sequence
caaccaacccgagcctgtgaa

SEQ ID NO: 30544 - DNA, 21 bp, Artificial sequence
  synthetic polynucleotide sequence
gagaggacagcctccttcaga

SEQ ID NO: 30545 - DNA, 20 bp, Artificial sequence
  synthetic polynucleotide sequence
ccacctccaccacatcagga

SEQ ID NO: 30546 - DNA, 20 bp, Artificial sequence
  synthetic polynucleotide sequence
cacccacagcctaggctgga

SEQ ID NO: 30547 - DNA, 22 bp, Artificial sequence
  synthetic polynucleotide sequence
tggatctgtatggccaacccga

SEQ ID NO: 30548 - DNA, 21 bp, Artificial sequence
  synthetic polynucleotide sequence
cttggaggaggcaatgaacca

SEQ ID NO: 30549 - DNA, 20 bp, Artificial sequence
  synthetic polynucleotide sequence
ggacatggggctcacctcca

SEQ ID NO: 30550 - DNA, 20 bp, Artificial sequence
  synthetic polynucleotide sequence
ccagccaccattctcgggaa

SEQ ID NO: 30551 - DNA, 20 bp, Artificial sequence
  synthetic polynucleotide sequence
ctgcccaaaaggaatcagca

SEQ ID NO: 30552 - DNA, 20 bp, Artificial sequence
  synthetic polynucleotide sequence
ctgtcaccccaacaggctca

SEQ ID NO: 30553 - DNA, 21 bp, Artificial sequence
  synthetic polynucleotide sequence
caacaggcgtcaacagtacga

SEQ ID NO: 30554 - DNA, 20 bp, Artificial sequence
  synthetic polynucleotide sequence
gagaaccgctggagagtcga

SEQ ID NO: 30555 - DNA, 18 bp, Artificial sequence
  synthetic polynucleotide sequence
ccacggacacaagtgcga

SEQ ID NO: 30556 - DNA, 18 bp, Artificial sequence
  synthetic polynucleotide sequence
cggtcaactcggtgcaca

SEQ ID NO: 30557 - DNA, 20 bp, Artificial sequence
  synthetic polynucleotide sequence
cagactccagtacagccgca

SEQ ID NO: 30558 - DNA, 18 bp, Artificial sequence
  synthetic polynucleotide sequence
tcgccgtcagcagcacca

SEQ ID NO: 30559 - DNA, 22 bp, Artificial sequence
  synthetic polynucleotide sequence
aggaggaggaggaggtagagga

SEQ ID NO: 30560 - DNA, 18 bp, Artificial sequence
  synthetic polynucleotide sequence
tcccagggcatgtgagca

SEQ ID NO: 30561 - DNA, 21 bp, Artificial sequence
  synthetic polynucleotide sequence
acgcagaacgtttcagagcca

SEQ ID NO: 30562 - DNA, 21 bp, Artificial sequence
  synthetic polynucleotide sequence
tacacgtaggcagctccaaga

SEQ ID NO: 30563 - DNA, 21 bp, Artificial sequence
  synthetic polynucleotide sequence
agcaaagacacactggggaga

SEQ ID NO: 30564 - DNA, 18 bp, Artificial sequence
  synthetic polynucleotide sequence
tcaatggcgtgaagggca

SEQ ID NO: 30565 - DNA, 18 bp, Artificial sequence
  synthetic polynucleotide sequence
acccctgacccaaccaca

SEQ ID NO: 30566 - DNA, 19 bp, Artificial sequence
  synthetic polynucleotide sequence
gaagagccctcaggctgga

SEQ ID NO: 30567 - DNA, 18 bp, Artificial sequence
  synthetic polynucleotide sequence
tccacccccatgcaggca

SEQ ID NO: 30568 - DNA, 18 bp, Artificial sequence
  synthetic polynucleotide sequence
ggagcgttccgaaggcca

SEQ ID NO: 30569 - DNA, 18 bp, Artificial sequence
  synthetic polynucleotide sequence
gcgctgtggagacgcgga

SEQ ID NO: 30570 - DNA, 21 bp, Artificial sequence
  synthetic polynucleotide sequence
aaacaaggcttgcactagcca

SEQ ID NO: 30571 - DNA, 20 bp, Artificial sequence
  synthetic polynucleotide sequence
ctgctcgcaagttgaggcaa

SEQ ID NO: 30572 - DNA, 18 bp, Artificial sequence
  synthetic polynucleotide sequence
tgggcttcacccagggca

SEQ ID NO: 30573 - DNA, 21 bp, Artificial sequence
  synthetic polynucleotide sequence
taatagctcaggggagatgga

SEQ ID NO: 30574 - DNA, 18 bp, Artificial sequence
  synthetic polynucleotide sequence
atcggggagactgggcca

SEQ ID NO: 30575 - DNA, 17 bp, Artificial sequence
  synthetic polynucleotide sequence
ggcggggatcctggaca

SEQ ID NO: 30576 - DNA, 21 bp, Artificial sequence
  synthetic polynucleotide sequence
cagagggaatgcccaaacaga

SEQ ID NO: 30577 - DNA, 20 bp, Artificial sequence
  synthetic polynucleotide sequence
gacaaggccctctgatccca

SEQ ID NO: 30578 - DNA, 21 bp, Artificial sequence
  synthetic polynucleotide sequence
tgggcgacagcttgaacagga

SEQ ID NO: 30579 - DNA, 20 bp, Artificial sequence
  synthetic polynucleotide sequence
actgcccagaaccctggcca

SEQ ID NO: 30580 - DNA, 22 bp, Artificial sequence
  synthetic polynucleotide sequence
caagacatgccatggaggaaga

SEQ ID NO: 30581 - DNA, 18 bp, Artificial sequence
  synthetic polynucleotide sequence
ctgcccatgctgcccaga

SEQ ID NO: 30582 - DNA, 19 bp, Artificial sequence
  synthetic polynucleotide sequence
gacaccggagacagaggga

SEQ ID NO: 30583 - DNA, 18 bp, Artificial sequence
  synthetic polynucleotide sequence
acaggcgctgcttgcaga

SEQ ID NO: 30584 - DNA, 21 bp, Artificial sequence
  synthetic polynucleotide sequence
catgtgagaggattcggacga

SEQ ID NO: 30585 - DNA, 18 bp, Artificial sequence
  synthetic polynucleotide sequence
ggcggctcctcataccaa

SEQ ID NO: 30586 - DNA, 18 bp, Artificial sequence
  synthetic polynucleotide sequence
taggagctgggagggcca

SEQ ID NO: 30587 - DNA, 18 bp, Artificial sequence
  synthetic polynucleotide sequence
gctggcagggcaatgaca

SEQ ID NO: 30588 - DNA, 18 bp, Artificial sequence
  synthetic polynucleotide sequence
ggtggagactggcaggca

SEQ ID NO: 30589 - DNA, 22 bp, Artificial sequence
  synthetic polynucleotide sequence
aacctcggagatagtcgggcaa

SEQ ID NO: 30590 - DNA, 21 bp, Artificial sequence
  synthetic polynucleotide sequence
gcttgtactgcccgtccccaa

SEQ ID NO: 30591 - DNA, 18 bp, Artificial sequence
  synthetic polynucleotide sequence
cctcagccacagcagcaa

SEQ ID NO: 30592 - DNA, 18 bp, Artificial sequence
  synthetic polynucleotide sequence
cccacatctccctgcaca

SEQ ID NO: 30593 - DNA, 18 bp, Artificial sequence
  synthetic polynucleotide sequence
gaggccaatggtggcaga

SEQ ID NO: 30594 - DNA, 21 bp, Artificial sequence
  synthetic polynucleotide sequence
gaacacatgacaacaccacca

SEQ ID NO: 30595 - DNA, 21 bp, Artificial sequence
  synthetic polynucleotide sequence
tcaaagtcccccgtggtcaca

SEQ ID NO: 30596 - DNA, 20 bp, Artificial sequence
  synthetic polynucleotide sequence
ctggtaagcgctctggagga

SEQ ID NO: 30597 - DNA, 19 bp, Artificial sequence
  synthetic polynucleotide sequence
cagagctctgccctgagga

SEQ ID NO: 30598 - DNA, 20 bp, Artificial sequence
  synthetic polynucleotide sequence
ctgctagctccagatcacca

SEQ ID NO: 30599 - DNA, 19 bp, Artificial sequence
  synthetic polynucleotide sequence
tgtggagcaagggcacgta

SEQ ID NO: 30600 - DNA, 20 bp, Artificial sequence
  synthetic polynucleotide sequence
atcttggacgagtccaccca

SEQ ID NO: 30601 - DNA, 20 bp, Artificial sequence
  synthetic polynucleotide sequence
aagaagacagaccaccgcaa

SEQ ID NO: 30602 - DNA, 18 bp, Artificial sequence
  synthetic polynucleotide sequence
gtaagggtgccagcgcca

SEQ ID NO: 30603 - DNA, 21 bp, Artificial sequence
  synthetic polynucleotide sequence
gcaactggcggagcagatgca

SEQ ID NO: 30604 - DNA, 22 bp, Artificial sequence
  synthetic polynucleotide sequence
aacatccattagcacgccacca

SEQ ID NO: 30605 - DNA, 18 bp, Artificial sequence
  synthetic polynucleotide sequence
gctgcatgccaaggcgca

SEQ ID NO: 30606 - DNA, 18 bp, Artificial sequence
  synthetic polynucleotide sequence
gtcgaggggtccacccga

SEQ ID NO: 30607 - DNA, 21 bp, Artificial sequence
  synthetic polynucleotide sequence
gatgacagaaccaggcccaga

SEQ ID NO: 30608 - DNA, 20 bp, Artificial sequence
  synthetic polynucleotide sequence
gggacaaaccactggagcca

SEQ ID NO: 30609 - DNA, 21 bp, Artificial sequence
  synthetic polynucleotide sequence
agaagagacagtgctctgcca

SEQ ID NO: 30610 - DNA, 21 bp, Artificial sequence
  synthetic polynucleotide sequence
agtccacactgccaaaaggga

SEQ ID NO: 30611 - DNA, 21 bp, Artificial sequence
  synthetic polynucleotide sequence
ggctcaagaagtaccggggca

SEQ ID NO: 30612 - DNA, 18 bp, Artificial sequence
  synthetic polynucleotide sequence
ccgagacaccctgcgcga

SEQ ID NO: 30613 - DNA, 18 bp, Artificial sequence
  synthetic polynucleotide sequence
tgccaagagcttgaccca

SEQ ID NO: 30614 - DNA, 18 bp, Artificial sequence
  synthetic polynucleotide sequence
tggaggctatggacgcca

SEQ ID NO: 30615 - DNA, 20 bp, Artificial sequence
  synthetic polynucleotide sequence
gaggtaccagagctcagcga

SEQ ID NO: 30616 - DNA, 18 bp, Artificial sequence
  synthetic polynucleotide sequence
ggtcgttggagaaggcca

SEQ ID NO: 30617 - DNA, 20 bp, Artificial sequence
  synthetic polynucleotide sequence
ctggaccggataggcacaga

SEQ ID NO: 30618 - DNA, 20 bp, Artificial sequence
  synthetic polynucleotide sequence
gggccaagccacactaacca

SEQ ID NO: 30619 - DNA, 21 bp, Artificial sequence
  synthetic polynucleotide sequence
ccaccttcgggaataccagga

SEQ ID NO: 30620 - DNA, 22 bp, Artificial sequence
  synthetic polynucleotide sequence
ggattctaggtgggagcaggta

SEQ ID NO: 30621 - DNA, 19 bp, Artificial sequence
  synthetic polynucleotide sequence
cacccagagagacgccaga

SEQ ID NO: 30622 - DNA, 18 bp, Artificial sequence
  synthetic polynucleotide sequence
gccggaccaatccagaga

SEQ ID NO: 30623 - DNA, 22 bp, Artificial sequence
  synthetic polynucleotide sequence
tgatctggaagaggagagagca

SEQ ID NO: 30624 - DNA, 21 bp, Artificial sequence
  synthetic polynucleotide sequence
tgacagtgctgaacgaggcca

SEQ ID NO: 30625 - DNA, 20 bp, Artificial sequence
  synthetic polynucleotide sequence
cagcacctggaggatgagga

SEQ ID NO: 30626 - DNA, 18 bp, Artificial sequence
  synthetic polynucleotide sequence
aggtcggggtcatgagca

SEQ ID NO: 30627 - DNA, 21 bp, Artificial sequence
  synthetic polynucleotide sequence
tggggagatgatcggctgcga

SEQ ID NO: 30628 - DNA, 18 bp, Artificial sequence
  synthetic polynucleotide sequence
tccccccggcacttggga

SEQ ID NO: 30629 - DNA, 17 bp, Artificial sequence
  synthetic polynucleotide sequence
aactccggcgacagcga

SEQ ID NO: 30630 - DNA, 18 bp, Artificial sequence
  synthetic polynucleotide sequence
gtgaagcggtcccgcaga

SEQ ID NO: 30631 - DNA, 20 bp, Artificial sequence
  synthetic polynucleotide sequence
gagtagtgcccgcagcctga

SEQ ID NO: 30632 - DNA, 22 bp, Artificial sequence
  synthetic polynucleotide sequence
taggtctgcatggcaagctgca

SEQ ID NO: 30633 - DNA, 21 bp, Artificial sequence
  synthetic polynucleotide sequence
aggcaggaggacatcagagga

SEQ ID NO: 30634 - DNA, 18 bp, Artificial sequence
  synthetic polynucleotide sequence
cgtggtaaggtccacgca

SEQ ID NO: 30635 - DNA, 18 bp, Artificial sequence
  synthetic polynucleotide sequence
cccagtggaggggagaga

SEQ ID NO: 30636 - DNA, 18 bp, Artificial sequence
  synthetic polynucleotide sequence
tccaccgttcccagccca

SEQ ID NO: 30637 - DNA, 21 bp, Artificial sequence
  synthetic polynucleotide sequence
tcttccctgtctccagcagca

SEQ ID NO: 30638 - DNA, 21 bp, Artificial sequence
  synthetic polynucleotide sequence
aggagaaccaagctggcgcca

SEQ ID NO: 30639 - DNA, 19 bp, Artificial sequence
  synthetic polynucleotide sequence
gtggtgaaccagtaccgca

SEQ ID NO: 30640 - DNA, 18 bp, Artificial sequence
  synthetic polynucleotide sequence
gcacgtcccgcttgacga

SEQ ID NO: 30641 - DNA, 21 bp, Artificial sequence
  synthetic polynucleotide sequence
gagttgggggcaaacaccaga

SEQ ID NO: 30642 - DNA, 20 bp, Artificial sequence
  synthetic polynucleotide sequence
gatccagtcgtgccagccaa

SEQ ID NO: 30643 - DNA, 20 bp, Artificial sequence
  synthetic polynucleotide sequence
gaccaaggaggaggcgccaa

SEQ ID NO: 30644 - DNA, 21 bp, Artificial sequence
  synthetic polynucleotide sequence
gacttctcacccctcaagcca

SEQ ID NO: 30645 - DNA, 18 bp, Artificial sequence
  synthetic polynucleotide sequence
gcagcccaacagaaggca

SEQ ID NO: 30646 - DNA, 20 bp, Artificial sequence
  synthetic polynucleotide sequence
caaggcgaggtaaaacagga

SEQ ID NO: 30647 - DNA, 18 bp, Artificial sequence
  synthetic polynucleotide sequence
cgatgtccacctgggcaa

SEQ ID NO: 30648 - DNA, 19 bp, Artificial sequence
  synthetic polynucleotide sequence
cccaccatgtaggacggga

SEQ ID NO: 30649 - DNA, 19 bp, Artificial sequence
  synthetic polynucleotide sequence
cccctgaactggctgcaga

SEQ ID NO: 30650 - DNA, 18 bp, Artificial sequence
  synthetic polynucleotide sequence
tgagccgagtcagcagga

SEQ ID NO: 30651 - DNA, 18 bp, Artificial sequence
  synthetic polynucleotide sequence
tgtccccggctgtcccca

SEQ ID NO: 30652 - DNA, 21 bp, Artificial sequence
  synthetic polynucleotide sequence
gtagccaaaaggggggatcca

SEQ ID NO: 30653 - DNA, 21 bp, Artificial sequence
  synthetic polynucleotide sequence
gaaagggcattgccgtggcaa

SEQ ID NO: 30654 - DNA, 22 bp, Artificial sequence
  synthetic polynucleotide sequence
tgtagttggcaagcagacctga

SEQ ID NO: 30655 - DNA, 21 bp, Artificial sequence
  synthetic polynucleotide sequence
accccagaactcactggggca

SEQ ID NO: 30656 - DNA, 20 bp, Artificial sequence
  synthetic polynucleotide sequence
gtgggtggcgtggataggga

SEQ ID NO: 30657 - DNA, 20 bp, Artificial sequence
  synthetic polynucleotide sequence
ctgaggcccaagcgggagaa

SEQ ID NO: 30658 - DNA, 18 bp, Artificial sequence
  synthetic polynucleotide sequence
cagaaccccggccaggga

SEQ ID NO: 30659 - DNA, 21 bp, Artificial sequence
  synthetic polynucleotide sequence
ttgtccaaggcctcgttgaca

SEQ ID NO: 30660 - DNA, 18 bp, Artificial sequence
  synthetic polynucleotide sequence
gcccaccgatccacccca

SEQ ID NO: 30661 - DNA, 18 bp, Artificial sequence
  synthetic polynucleotide sequence
gaacgtgcatgcccggaa

SEQ ID NO: 30662 - DNA, 20 bp, Artificial sequence
  synthetic polynucleotide sequence
ctgctccagtgtcaccgaca

SEQ ID NO: 30663 - DNA, 18 bp, Artificial sequence
  synthetic polynucleotide sequence
ccccaagaccaaccccca

SEQ ID NO: 30664 - DNA, 18 bp, Artificial sequence
  synthetic polynucleotide sequence
tccccacattggcccaca

SEQ ID NO: 30665 - DNA, 18 bp, Artificial sequence
  synthetic polynucleotide sequence
tccgagacaacaacggca

SEQ ID NO: 30666 - DNA, 18 bp, Artificial sequence
  synthetic polynucleotide sequence
agcaccagctccttggca

SEQ ID NO: 30667 - DNA, 22 bp, Artificial sequence
  synthetic polynucleotide sequence
agtatgatacgggctctgacga

SEQ ID NO: 30668 - DNA, 21 bp, Artificial sequence
  synthetic polynucleotide sequence
catttacgaccctcaccccga

SEQ ID NO: 30669 - DNA, 20 bp, Artificial sequence
  synthetic polynucleotide sequence
gacacaggagtcaaggccca

SEQ ID NO: 30670 - DNA, 20 bp, Artificial sequence
  synthetic polynucleotide sequence
ggaaggaactcagggaccca

SEQ ID NO: 30671 - DNA, 19 bp, Artificial sequence
  synthetic polynucleotide sequence
gtgacgggaaggtggcgga

SEQ ID NO: 30672 - DNA, 21 bp, Artificial sequence
  synthetic polynucleotide sequence
cctcatcgaagcgggtggtga

SEQ ID NO: 30673 - DNA, 20 bp, Artificial sequence
  synthetic polynucleotide sequence
ccttcagggacgacatgcca

SEQ ID NO: 30674 - DNA, 20 bp, Artificial sequence
  synthetic polynucleotide sequence
ccaggagctgcgggcgaaca

SEQ ID NO: 30675 - DNA, 20 bp, Artificial sequence
  synthetic polynucleotide sequence
gcctgtccccacatccagca

SEQ ID NO: 30676 - DNA, 20 bp, Artificial sequence
  synthetic polynucleotide sequence
gcgggggagagtatgcaaca

SEQ ID NO: 30677 - DNA, 18 bp, Artificial sequence
  synthetic polynucleotide sequence
tggagcgggagaagcaca

SEQ ID NO: 30678 - DNA, 18 bp, Artificial sequence
  synthetic polynucleotide sequence
ggtcacaccatgagggca

SEQ ID NO: 30679 - DNA, 18 bp, Artificial sequence
  synthetic polynucleotide sequence
gcaggtggggcaggtgga

SEQ ID NO: 30680 - DNA, 20 bp, Artificial sequence
  synthetic polynucleotide sequence
tccagctggtagagggagca

SEQ ID NO: 30681 - DNA, 21 bp, Artificial sequence
  synthetic polynucleotide sequence
ctgtgagcgagtccagcagaa

SEQ ID NO: 30682 - DNA, 21 bp, Artificial sequence
  synthetic polynucleotide sequence
gcagagctcgatgagacggga

SEQ ID NO: 30683 - DNA, 20 bp, Artificial sequence
  synthetic polynucleotide sequence
cacctcggagaaccccacaa

SEQ ID NO: 30684 - DNA, 20 bp, Artificial sequence
  synthetic polynucleotide sequence
gcccaaggccacttctggaa

SEQ ID NO: 30685 - DNA, 21 bp, Artificial sequence
  synthetic polynucleotide sequence
atacccctgcattgacagaca

SEQ ID NO: 30686 - DNA, 19 bp, Artificial sequence
  synthetic polynucleotide sequence
tgagtgaccacagttgcca

SEQ ID NO: 30687 - DNA, 21 bp, Artificial sequence
  synthetic polynucleotide sequence
acagtggctggagagacgaca

SEQ ID NO: 30688 - DNA, 18 bp, Artificial sequence
  synthetic polynucleotide sequence
gcacggtggtggcggtga

SEQ ID NO: 30689 - DNA, 22 bp, Artificial sequence
  synthetic polynucleotide sequence
acaggagagttcaggtccagga

SEQ ID NO: 30690 - DNA, 20 bp, Artificial sequence
  synthetic polynucleotide sequence
agttggctcagcagcagcca

SEQ ID NO: 30691 - DNA, 18 bp, Artificial sequence
  synthetic polynucleotide sequence
agcgcaaaaccttccgaa

SEQ ID NO: 30692 - DNA, 20 bp, Artificial sequence
  synthetic polynucleotide sequence
atggaacagccatcagtgca

SEQ ID NO: 30693 - DNA, 20 bp, Artificial sequence
  synthetic polynucleotide sequence
gtgcggcaggtacttggtga

SEQ ID NO: 30694 - DNA, 18 bp, Artificial sequence
  synthetic polynucleotide sequence
ggcttcgaccttctccga

SEQ ID NO: 30695 - DNA, 20 bp, Artificial sequence
  synthetic polynucleotide sequence
tgagggacgagagaccagga

SEQ ID NO: 30696 - DNA, 25 bp, Artificial sequence
  synthetic polynucleotide sequence
gaagaaagccccacagaaattccca

SEQ ID NO: 30697 - DNA, 18 bp, Artificial sequence
  synthetic polynucleotide sequence
cggtcaacgagtcagcca

SEQ ID NO: 30698 - DNA, 18 bp, Artificial sequence
  synthetic polynucleotide sequence
tggacaccactcccagga

SEQ ID NO: 30699 - DNA, 20 bp, Artificial sequence
  synthetic polynucleotide sequence
aacaaccctgggctcccaca

SEQ ID NO: 30700 - DNA, 20 bp, Artificial sequence
  synthetic polynucleotide sequence
agtcatcccgaagtccccga

SEQ ID NO: 30701 - DNA, 21 bp, Artificial sequence
  synthetic polynucleotide sequence
ccatgcagaacagccccagca

SEQ ID NO: 30702 - DNA, 21 bp, Artificial sequence
  synthetic polynucleotide sequence
tcacggcctccatatgcagga

SEQ ID NO: 30703 - DNA, 20 bp, Artificial sequence
  synthetic polynucleotide sequence
tgcttggcctggaagacgga

SEQ ID NO: 30704 - DNA, 20 bp, Artificial sequence
  synthetic polynucleotide sequence
tcccctagcgcaaagtggca

SEQ ID NO: 30705 - DNA, 20 bp, Artificial sequence
  synthetic polynucleotide sequence
ctgaagcgggagatggcgca

SEQ ID NO: 30706 - DNA, 20 bp, Artificial sequence
  synthetic polynucleotide sequence
gaggtggctgtagacgcgca

SEQ ID NO: 30707 - DNA, 20 bp, Artificial sequence
  synthetic polynucleotide sequence
cgcagaaaccagcccctgca

SEQ ID NO: 30708 - DNA, 22 bp, Artificial sequence
  synthetic polynucleotide sequence
agctgcccatccagttaagcca

SEQ ID NO: 30709 - DNA, 21 bp, Artificial sequence
  synthetic polynucleotide sequence
gagcaaacccccagaagagga

SEQ ID NO: 30710 - DNA, 21 bp, Artificial sequence
  synthetic polynucleotide sequence
aggttctggggaatcaggcga

SEQ ID NO: 30711 - DNA, 21 bp, Artificial sequence
  synthetic polynucleotide sequence
tgctgaaaggggtggctgaca

SEQ ID NO: 30712 - DNA, 21 bp, Artificial sequence
  synthetic polynucleotide sequence
gcatactcagaggtgccggta

SEQ ID NO: 30713 - DNA, 22 bp, Artificial sequence
  synthetic polynucleotide sequence
aggtgtctgagtccaacggaga

SEQ ID NO: 30714 - DNA, 20 bp, Artificial sequence
  synthetic polynucleotide sequence
atcaggaacattggccacca

SEQ ID NO: 30715 - DNA, 20 bp, Artificial sequence
  synthetic polynucleotide sequence
tactacctgagggccagcaa

SEQ ID NO: 30716 - DNA, 18 bp, Artificial sequence
  synthetic polynucleotide sequence
agggcgtgaggtggcaca

SEQ ID NO: 30717 - DNA, 21 bp, Artificial sequence
  synthetic polynucleotide sequence
atatccagatggccaggctca

SEQ ID NO: 30718 - DNA, 20 bp, Artificial sequence
  synthetic polynucleotide sequence
tctgtccaagcggtgtggga

SEQ ID NO: 30719 - DNA, 21 bp, Artificial sequence
  synthetic polynucleotide sequence
agtccagaggcagccaaagca

SEQ ID NO: 30720 - DNA, 20 bp, Artificial sequence
  synthetic polynucleotide sequence
agaggcttcccaatggccca

SEQ ID NO: 30721 - DNA, 22 bp, Artificial sequence
  synthetic polynucleotide sequence
taaaagtccggagccgatcaca

SEQ ID NO: 30722 - DNA, 21 bp, Artificial sequence
  synthetic polynucleotide sequence
tctagcagtctgtgagggaca

SEQ ID NO: 30723 - DNA, 21 bp, Artificial sequence
  synthetic polynucleotide sequence
acgacgaacccccgtactgca

SEQ ID NO: 30724 - DNA, 22 bp, Artificial sequence
  synthetic polynucleotide sequence
ggatcttagagcctgaccgaga

SEQ ID NO: 30725 - DNA, 22 bp, Artificial sequence
  synthetic polynucleotide sequence
attggacgatcagccacagaca

SEQ ID NO: 30726 - DNA, 19 bp, Artificial sequence
  synthetic polynucleotide sequence
tctgaggcaacctgagtca

SEQ ID NO: 30727 - DNA, 20 bp, Artificial sequence
  synthetic polynucleotide sequence
attggccatggaaccaggca

SEQ ID NO: 30728 - DNA, 20 bp, Artificial sequence
  synthetic polynucleotide sequence
ctggaagtatgctgcgccca

SEQ ID NO: 30729 - DNA, 19 bp, Artificial sequence
  synthetic polynucleotide sequence
tcactggtgcccatggaga

SEQ ID NO: 30730 - DNA, 21 bp, Artificial sequence
  synthetic polynucleotide sequence
ccacagggatggaaccgctca

SEQ ID NO: 30731 - DNA, 22 bp, Artificial sequence
  synthetic polynucleotide sequence
cagctcgactcagaaacctcaa

SEQ ID NO: 30732 - DNA, 21 bp, Artificial sequence
  synthetic polynucleotide sequence
caggcaggccaattagcaaca

SEQ ID NO: 30733 - DNA, 22 bp, Artificial sequence
  synthetic polynucleotide sequence
acctcaggcacaaagtccacca

SEQ ID NO: 30734 - DNA, 21 bp, Artificial sequence
  synthetic polynucleotide sequence
tcactgagttgagacgcagca

SEQ ID NO: 30735 - DNA, 20 bp, Artificial sequence
  synthetic polynucleotide sequence
agctgactgagctcaaggca

SEQ ID NO: 30736 - DNA, 20 bp, Artificial sequence
  synthetic polynucleotide sequence
caaagtcgatcatgcgcaca

SEQ ID NO: 30737 - DNA, 22 bp, Artificial sequence
  synthetic polynucleotide sequence
cataatggaagccacctccgga

SEQ ID NO: 30738 - DNA, 21 bp, Artificial sequence
  synthetic polynucleotide sequence
gatgacaaggagagagctgga

SEQ ID NO: 30739 - DNA, 20 bp, Artificial sequence
  synthetic polynucleotide sequence
ccgaagctgacagccaggaa

SEQ ID NO: 30740 - DNA, 18 bp, Artificial sequence
  synthetic polynucleotide sequence
gtcatcaggggcaggcga

SEQ ID NO: 30741 - DNA, 23 bp, Artificial sequence
  synthetic polynucleotide sequence
gaagattcagcaacaggtcagca

SEQ ID NO: 30742 - DNA, 21 bp, Artificial sequence
  synthetic polynucleotide sequence
aaccctcatgccaagcaccaa

SEQ ID NO: 30743 - DNA, 19 bp, Artificial sequence
  synthetic polynucleotide sequence
gcagtgggagacacagcca

SEQ ID NO: 30744 - DNA, 18 bp, Artificial sequence
  synthetic polynucleotide sequence
tgatgagccctgcacgca

SEQ ID NO: 30745 - DNA, 20 bp, Artificial sequence
  synthetic polynucleotide sequence
tctcttccagcaagggccca

SEQ ID NO: 30746 - DNA, 21 bp, Artificial sequence
  synthetic polynucleotide sequence
gactctacttccccacaccga

SEQ ID NO: 30747 - DNA, 18 bp, Artificial sequence
  synthetic polynucleotide sequence
caggaaaccagagcccca

SEQ ID NO: 30748 - DNA, 18 bp, Artificial sequence
  synthetic polynucleotide sequence
agaagctcgggagccaca

SEQ ID NO: 30749 - DNA, 22 bp, Artificial sequence
  synthetic polynucleotide sequence
atggccagacagacaatgggga

SEQ ID NO: 30750 - DNA, 20 bp, Artificial sequence
  synthetic polynucleotide sequence
gtgccatgactcccaggcca

SEQ ID NO: 30751 - DNA, 20 bp, Artificial sequence
  synthetic polynucleotide sequence
aacccaacagcttgagggaa

SEQ ID NO: 30752 - DNA, 22 bp, Artificial sequence
  synthetic polynucleotide sequence
atacaaggggtagtagctgcca

SEQ ID NO: 30753 - DNA, 19 bp, Artificial sequence
  synthetic polynucleotide sequence
ctggcagagcaccgacgga

SEQ ID NO: 30754 - DNA, 21 bp, Artificial sequence
  synthetic polynucleotide sequence
ttgttgctgggcacagtccca

SEQ ID NO: 30755 - DNA, 18 bp, Artificial sequence
  synthetic polynucleotide sequence
gtggacaagccgacagca

SEQ ID NO: 30756 - DNA, 18 bp, Artificial sequence
  synthetic polynucleotide sequence
acttagagcgggtgcgga

SEQ ID NO: 30757 - DNA, 19 bp, Artificial sequence
  synthetic polynucleotide sequence
ggctcgaagtgggctggga

SEQ ID NO: 30758 - DNA, 22 bp, Artificial sequence
  synthetic polynucleotide sequence
tatctcagctccaacccatcca

SEQ ID NO: 30759 - DNA, 21 bp, Artificial sequence
  synthetic polynucleotide sequence
acctcaagccctacgagagca

SEQ ID NO: 30760 - DNA, 19 bp, Artificial sequence
  synthetic polynucleotide sequence
tccttgaaccgagtcgaca

SEQ ID NO: 30761 - DNA, 20 bp, Artificial sequence
  synthetic polynucleotide sequence
attttggtgcccagaccaga

SEQ ID NO: 30762 - DNA, 19 bp, Artificial sequence
  synthetic polynucleotide sequence
tgggtgaagccgtcagtga

SEQ ID NO: 30763 - DNA, 20 bp, Artificial sequence
  synthetic polynucleotide sequence
gaggaggccaagctggacaa

SEQ ID NO: 30764 - DNA, 20 bp, Artificial sequence
  synthetic polynucleotide sequence
cactgccctgtcccacgcca

SEQ ID NO: 30765 - DNA, 20 bp, Artificial sequence
  synthetic polynucleotide sequence
ctccttggcgaggactccaa

SEQ ID NO: 30766 - DNA, 20 bp, Artificial sequence
  synthetic polynucleotide sequence
ggagctccctactgaccaca

SEQ ID NO: 30767 - DNA, 20 bp, Artificial sequence
  synthetic polynucleotide sequence
ggtccgacgccagttccaga

SEQ ID NO: 30768 - DNA, 20 bp, Artificial sequence
  synthetic polynucleotide sequence
ggaggaatcgcggcctggga

SEQ ID NO: 30769 - DNA, 20 bp, Artificial sequence
  synthetic polynucleotide sequence
gatccgggaagagcgggaga

SEQ ID NO: 30770 - DNA, 20 bp, Artificial sequence
  synthetic polynucleotide sequence
ggatctgagcagggagcgca

SEQ ID NO: 30771 - DNA, 21 bp, Artificial sequence
  synthetic polynucleotide sequence
ccaccgcagcttctaccagga

SEQ ID NO: 30772 - DNA, 20 bp, Artificial sequence
  synthetic polynucleotide sequence
atccccaggtagaggtgcca

SEQ ID NO: 30773 - DNA, 21 bp, Artificial sequence
  synthetic polynucleotide sequence
catccgcagacgctattgcca

SEQ ID NO: 30774 - DNA, 21 bp, Artificial sequence
  synthetic polynucleotide sequence
tgtcacaatgcaaggccctga

SEQ ID NO: 30775 - DNA, 20 bp, Artificial sequence
  synthetic polynucleotide sequence
gctgtcgagggtgctggaga

SEQ ID NO: 30776 - DNA, 20 bp, Artificial sequence
  synthetic polynucleotide sequence
agcacctggcagtatcgcca

SEQ ID NO: 30777 - DNA, 20 bp, Artificial sequence
  synthetic polynucleotide sequence
gtgcagagacggatccgtca

SEQ ID NO: 30778 - DNA, 20 bp, Artificial sequence
  synthetic polynucleotide sequence
acattgccggcactgccaca

SEQ ID NO: 30779 - DNA, 20 bp, Artificial sequence
  synthetic polynucleotide sequence
gctggcaaagaggcggagga

SEQ ID NO: 30780 - DNA, 21 bp, Artificial sequence
  synthetic polynucleotide sequence
aacgacagtaacgctggcgga

SEQ ID NO: 30781 - DNA, 21 bp, Artificial sequence
  synthetic polynucleotide sequence
actcagagcctgggtcatcca

SEQ ID NO: 30782 - DNA, 19 bp, Artificial sequence
  synthetic polynucleotide sequence
gcaccttcaccaccgccca

SEQ ID NO: 30783 - DNA, 22 bp, Artificial sequence
  synthetic polynucleotide sequence
caaaggccagtgacttagcaca

SEQ ID NO: 30784 - DNA, 18 bp, Artificial sequence
  synthetic polynucleotide sequence
ctcgccaccaggcctgga

SEQ ID NO: 30785 - DNA, 21 bp, Artificial sequence
  synthetic polynucleotide sequence
ctggcaaccagtcgctatgca

SEQ ID NO: 30786 - DNA, 21 bp, Artificial sequence
  synthetic polynucleotide sequence
tagccaatgccatgggcccta

SEQ ID NO: 30787 - DNA, 21 bp, Artificial sequence
  synthetic polynucleotide sequence
agctggccatggatgcagaga

SEQ ID NO: 30788 - DNA, 22 bp, Artificial sequence
  synthetic polynucleotide sequence
ttcatgctgacagagctgctca

SEQ ID NO: 30789 - DNA, 21 bp, Artificial sequence
  synthetic polynucleotide sequence
tcatggcttcagtgcagagca

SEQ ID NO: 30790 - DNA, 19 bp, Artificial sequence
  synthetic polynucleotide sequence
tggtgaagcaggctagcca

SEQ ID NO: 30791 - DNA, 21 bp, Artificial sequence
  synthetic polynucleotide sequence
gtgcctggagatgagaatgca

SEQ ID NO: 30792 - DNA, 18 bp, Artificial sequence
  synthetic polynucleotide sequence
ttggcatcacggatagca

SEQ ID NO: 30793 - DNA, 19 bp, Artificial sequence
  synthetic polynucleotide sequence
gccacaagctcaggaccca

SEQ ID NO: 30794 - DNA, 18 bp, Artificial sequence
  synthetic polynucleotide sequence
tgccattcggaaccagga

SEQ ID NO: 30795 - DNA, 21 bp, Artificial sequence
  synthetic polynucleotide sequence
caaccagcacagacacaggca

SEQ ID NO: 30796 - DNA, 19 bp, Artificial sequence
  synthetic polynucleotide sequence
ctcttggagtcgggggcca

SEQ ID NO: 30797 - DNA, 21 bp, Artificial sequence
  synthetic polynucleotide sequence
acaccgacatgtacagcccca

SEQ ID NO: 30798 - DNA, 19 bp, Artificial sequence
  synthetic polynucleotide sequence
cggtggggcagagagagca

SEQ ID NO: 30799 - DNA, 21 bp, Artificial sequence
  synthetic polynucleotide sequence
gctagggttgcatcagcggga

SEQ ID NO: 30800 - DNA, 21 bp, Artificial sequence
  synthetic polynucleotide sequence
cgagggggaaagactgacgga

SEQ ID NO: 30801 - DNA, 20 bp, Artificial sequence
  synthetic polynucleotide sequence
caggcagcgcatcagaggga

SEQ ID NO: 30802 - DNA, 20 bp, Artificial sequence
  synthetic polynucleotide sequence
ctgcatctcgtccgagccca

SEQ ID NO: 30803 - DNA, 20 bp, Artificial sequence
  synthetic polynucleotide sequence
atcatccacctcacgccgca

SEQ ID NO: 30804 - DNA, 22 bp, Artificial sequence
  synthetic polynucleotide sequence
agattgtcgcaagcactgagga

SEQ ID NO: 30805 - DNA, 18 bp, Artificial sequence
  synthetic polynucleotide sequence
tcaaccctgcccgacaga

SEQ ID NO: 30806 - DNA, 18 bp, Artificial sequence
  synthetic polynucleotide sequence
ggagggagctggacgaca

SEQ ID NO: 30807 - DNA, 22 bp, Artificial sequence
  synthetic polynucleotide sequence
tgcaagtaagcggcacctcaga

SEQ ID NO: 30808 - DNA, 18 bp, Artificial sequence
  synthetic polynucleotide sequence
gcacgccctgctgctgga

SEQ ID NO: 30809 - DNA, 20 bp, Artificial sequence
  synthetic polynucleotide sequence
gccgcgtatctgccagagga

SEQ ID NO: 30810 - DNA, 21 bp, Artificial sequence
  synthetic polynucleotide sequence
ccattgcagggatgcccgtga

SEQ ID NO: 30811 - DNA, 18 bp, Artificial sequence
  synthetic polynucleotide sequence
gcctccctgccctcggaa

SEQ ID NO: 30812 - DNA, 21 bp, Artificial sequence
  synthetic polynucleotide sequence
gatgtgggaggatcttcagca

SEQ ID NO: 30813 - DNA, 21 bp, Artificial sequence
  synthetic polynucleotide sequence
ctcagggtgcagctaatggca

SEQ ID NO: 30814 - DNA, 22 bp, Artificial sequence
  synthetic polynucleotide sequence
aaacttctcagaagcccgtgca

SEQ ID NO: 30815 - DNA, 18 bp, Artificial sequence
  synthetic polynucleotide sequence
ggctgccaaaggaccgta

SEQ ID NO: 30816 - DNA, 19 bp, Artificial sequence
  synthetic polynucleotide sequence
tctctaccggagaggccca

SEQ ID NO: 30817 - DNA, 18 bp, Artificial sequence
  synthetic polynucleotide sequence
aacctggagtccagccca

SEQ ID NO: 30818 - DNA, 18 bp, Artificial sequence
  synthetic polynucleotide sequence
tggcctggatggagggca

SEQ ID NO: 30819 - DNA, 22 bp, Artificial sequence
  synthetic polynucleotide sequence
agaacggccttctaagaaagga

SEQ ID NO: 30820 - DNA, 20 bp, Artificial sequence
  synthetic polynucleotide sequence
tagttgaagtcaggaccgca

SEQ ID NO: 30821 - DNA, 20 bp, Artificial sequence
  synthetic polynucleotide sequence
gaggagcagcagcaacggca

SEQ ID NO: 30822 - DNA, 18 bp, Artificial sequence
  synthetic polynucleotide sequence
cccagggcttcggccaca

SEQ ID NO: 30823 - DNA, 21 bp, Artificial sequence
  synthetic polynucleotide sequence
ggagcaggcaacacaggagga

SEQ ID NO: 30824 - DNA, 20 bp, Artificial sequence
  synthetic polynucleotide sequence
tgtctggagcaagggaagca

SEQ ID NO: 30825 - DNA, 19 bp, Artificial sequence
  synthetic polynucleotide sequence
ccacccgggcatggaccaa

SEQ ID NO: 30826 - DNA, 21 bp, Artificial sequence
  synthetic polynucleotide sequence
ggacggaagggcactgaacga

SEQ ID NO: 30827 - DNA, 19 bp, Artificial sequence
  synthetic polynucleotide sequence
cttcacggaaggaagcgga

SEQ ID NO: 30828 - DNA, 21 bp, Artificial sequence
  synthetic polynucleotide sequence
gcacaaccttgaccatcacga

SEQ ID NO: 30829 - DNA, 21 bp, Artificial sequence
  synthetic polynucleotide sequence
gagccagctggacatctcaga

SEQ ID NO: 30830 - DNA, 18 bp, Artificial sequence
  synthetic polynucleotide sequence
gtaggggtggctcatgga

SEQ ID NO: 30831 - DNA, 18 bp, Artificial sequence
  synthetic polynucleotide sequence
cagaccaacaccccacca

SEQ ID NO: 30832 - DNA, 20 bp, Artificial sequence
  synthetic polynucleotide sequence
cagtcgagctgctacaggca

SEQ ID NO: 30833 - DNA, 19 bp, Artificial sequence
  synthetic polynucleotide sequence
cggaactgtgacaccccca

SEQ ID NO: 30834 - DNA, 18 bp, Artificial sequence
  synthetic polynucleotide sequence
tggacaggcagaggctga

SEQ ID NO: 30835 - DNA, 19 bp, Artificial sequence
  synthetic polynucleotide sequence
gcatcctagtggccagcaa

SEQ ID NO: 30836 - DNA, 20 bp, Artificial sequence
  synthetic polynucleotide sequence
gttctgaagagctccacgca

SEQ ID NO: 30837 - DNA, 21 bp, Artificial sequence
  synthetic polynucleotide sequence
ggtgggcaaacaggcaggtga

SEQ ID NO: 30838 - DNA, 21 bp, Artificial sequence
  synthetic polynucleotide sequence
gccaccagcgtcccaaacaca

SEQ ID NO: 30839 - DNA, 20 bp, Artificial sequence
  synthetic polynucleotide sequence
aaagcctcagcagatgggaa

SEQ ID NO: 30840 - DNA, 20 bp, Artificial sequence
  synthetic polynucleotide sequence
gtggacatcccattgccaga

SEQ ID NO: 30841 - DNA, 21 bp, Artificial sequence
  synthetic polynucleotide sequence
ggactcccagggctatgcgaa

SEQ ID NO: 30842 - DNA, 19 bp, Artificial sequence
  synthetic polynucleotide sequence
gccgccagactagccagca

SEQ ID NO: 30843 - DNA, 18 bp, Artificial sequence
  synthetic polynucleotide sequence
tacgtggacacctcgcca

SEQ ID NO: 30844 - DNA, 18 bp, Artificial sequence
  synthetic polynucleotide sequence
aaggcgctcatgccccca

SEQ ID NO: 30845 - DNA, 18 bp, Artificial sequence
  synthetic polynucleotide sequence
cgacttcagctcccccaa

SEQ ID NO: 30846 - DNA, 18 bp, Artificial sequence
  synthetic polynucleotide sequence
cggctgcagagacgacga

SEQ ID NO: 30847 - DNA, 20 bp, Artificial sequence
  synthetic polynucleotide sequence
accctggagcccacaaccca

SEQ ID NO: 30848 - DNA, 20 bp, Artificial sequence
  synthetic polynucleotide sequence
ttggcacccggcgactgcga

SEQ ID NO: 30849 - DNA, 19 bp, Artificial sequence
  synthetic polynucleotide sequence
gacaaggcctcggtccgca

SEQ ID NO: 30850 - DNA, 20 bp, Artificial sequence
  synthetic polynucleotide sequence
gttgtcgcgtaccggctgga

SEQ ID NO: 30851 - DNA, 19 bp, Artificial sequence
  synthetic polynucleotide sequence
cgcacccgctcgagtccca

SEQ ID NO: 30852 - DNA, 20 bp, Artificial sequence
  synthetic polynucleotide sequence
ctggacgcccccgccaacca

SEQ ID NO: 30853 - DNA, 21 bp, Artificial sequence
  synthetic polynucleotide sequence
accaggactccccggtaacca

SEQ ID NO: 30854 - DNA, 18 bp, Artificial sequence
  synthetic polynucleotide sequence
cccagcgagcgtcccaga

SEQ ID NO: 30855 - DNA, 21 bp, Artificial sequence
  synthetic polynucleotide sequence
agatcgccacatcgtcggaca

SEQ ID NO: 30856 - DNA, 21 bp, Artificial sequence
  synthetic polynucleotide sequence
tggaaaaggacactgcgccga

SEQ ID NO: 30857 - DNA, 20 bp, Artificial sequence
  synthetic polynucleotide sequence
ggcgactctcagtccccaga

SEQ ID NO: 30858 - DNA, 18 bp, Artificial sequence
  synthetic polynucleotide sequence
tccagacgggtactggca

SEQ ID NO: 30859 - DNA, 18 bp, Artificial sequence
  synthetic polynucleotide sequence
gcagccctcaccctgaca

SEQ ID NO: 30860 - DNA, 18 bp, Artificial sequence
  synthetic polynucleotide sequence
cccctggttcggacacca

SEQ ID NO: 30861 - DNA, 21 bp, Artificial sequence
  synthetic polynucleotide sequence
ccaggtggacttcagccaaga

SEQ ID NO: 30862 - DNA, 25 bp, Artificial sequence
  synthetic polynucleotide sequence
tagagaaagatgacccacaggagca

SEQ ID NO: 30863 - DNA, 20 bp, Artificial sequence
  synthetic polynucleotide sequence
aaggaaagacggtggaggaa

SEQ ID NO: 30864 - DNA, 18 bp, Artificial sequence
  synthetic polynucleotide sequence
ccagcatggagcagtgca

SEQ ID NO: 30865 - DNA, 18 bp, Artificial sequence
  synthetic polynucleotide sequence
gcaagtgagcgggctgga

SEQ ID NO: 30866 - DNA, 18 bp, Artificial sequence
  synthetic polynucleotide sequence
caggggcttgaggccgta

SEQ ID NO: 30867 - DNA, 18 bp, Artificial sequence
  synthetic polynucleotide sequence
gggtcacccctcagcaca

SEQ ID NO: 30868 - DNA, 20 bp, Artificial sequence
  synthetic polynucleotide sequence
cttcaggtcatgacccacca

SEQ ID NO: 30869 - DNA, 18 bp, Artificial sequence
  synthetic polynucleotide sequence
cccagaagttgccacgga

SEQ ID NO: 30870 - DNA, 20 bp, Artificial sequence
  synthetic polynucleotide sequence
gacaatgctacatcgagcca

SEQ ID NO: 30871 - DNA, 23 bp, Artificial sequence
  synthetic polynucleotide sequence
cagcaaaagcgcaggaagagaga

SEQ ID NO: 30872 - DNA, 20 bp, Artificial sequence
  synthetic polynucleotide sequence
ccagctacaggacaggccaa

SEQ ID NO: 30873 - DNA, 21 bp, Artificial sequence
  synthetic polynucleotide sequence
gcagtcccatccgccatgaga

SEQ ID NO: 30874 - DNA, 19 bp, Artificial sequence
  synthetic polynucleotide sequence
tggaaggcgggttggtcca

SEQ ID NO: 30875 - DNA, 18 bp, Artificial sequence
  synthetic polynucleotide sequence
gacaacgaggtgcagcca

SEQ ID NO: 30876 - DNA, 18 bp, Artificial sequence
  synthetic polynucleotide sequence
gcctcagggttcccagca

SEQ ID NO: 30877 - DNA, 19 bp, Artificial sequence
  synthetic polynucleotide sequence
tcgtacctcgagtccgaga

SEQ ID NO: 30878 - DNA, 18 bp, Artificial sequence
  synthetic polynucleotide sequence
tggactgggactccacca

SEQ ID NO: 30879 - DNA, 18 bp, Artificial sequence
  synthetic polynucleotide sequence
ccgcatcaagcgcaagga

SEQ ID NO: 30880 - DNA, 18 bp, Artificial sequence
  synthetic polynucleotide sequence
gggacagcatggagcgga

SEQ ID NO: 30881 - DNA, 21 bp, Artificial sequence
  synthetic polynucleotide sequence
gaccatcaaggtggtggagga

SEQ ID NO: 30882 - DNA, 20 bp, Artificial sequence
  synthetic polynucleotide sequence
gaaggaccagagggcgggca

SEQ ID NO: 30883 - DNA, 18 bp, Artificial sequence
  synthetic polynucleotide sequence
agttggccgaggagtcga

SEQ ID NO: 30884 - DNA, 18 bp, Artificial sequence
  synthetic polynucleotide sequence
atcccggttcgagcgaga

SEQ ID NO: 30885 - DNA, 19 bp, Artificial sequence
  synthetic polynucleotide sequence
tccgccacaacatcgccta

SEQ ID NO: 30886 - DNA, 19 bp, Artificial sequence
  synthetic polynucleotide sequence
ccacctggctgcgtgagga

SEQ ID NO: 30887 - DNA, 18 bp, Artificial sequence
  synthetic polynucleotide sequence
cacccgcaagccgtggca

SEQ ID NO: 30888 - DNA, 21 bp, Artificial sequence
  synthetic polynucleotide sequence
agctgatgagcggcctctcca

SEQ ID NO: 30889 - DNA, 21 bp, Artificial sequence
  synthetic polynucleotide sequence
catccacctcagataccagca

SEQ ID NO: 30890 - DNA, 22 bp, Artificial sequence
  synthetic polynucleotide sequence
agatggcaactctggtaggaca

SEQ ID NO: 30891 - DNA, 20 bp, Artificial sequence
  synthetic polynucleotide sequence
gggaggtcatccgctgagca

SEQ ID NO: 30892 - DNA, 20 bp, Artificial sequence
  synthetic polynucleotide sequence
ggagcaggccctgtcctcca

SEQ ID NO: 30893 - DNA, 20 bp, Artificial sequence
  synthetic polynucleotide sequence
gaggaggagtcggacgagga

SEQ ID NO: 30894 - DNA, 19 bp, Artificial sequence
  synthetic polynucleotide sequence
tcgcaccagtgcctcctca

SEQ ID NO: 30895 - DNA, 21 bp, Artificial sequence
  synthetic polynucleotide sequence
atgctgggcggaaccaacaca

SEQ ID NO: 30896 - DNA, 21 bp, Artificial sequence
  synthetic polynucleotide sequence
gaagaggaagctgagcaggga

SEQ ID NO: 30897 - DNA, 20 bp, Artificial sequence
  synthetic polynucleotide sequence
cacaatgggaagaccccaga

SEQ ID NO: 30898 - DNA, 19 bp, Artificial sequence
  synthetic polynucleotide sequence
tgctgacaccagaaccgga

SEQ ID NO: 30899 - DNA, 21 bp, Artificial sequence
  synthetic polynucleotide sequence
ccaactcagccaatccgcaca

SEQ ID NO: 30900 - DNA, 19 bp, Artificial sequence
  synthetic polynucleotide sequence
ttctccagatggacgggga

SEQ ID NO: 30901 - DNA, 21 bp, Artificial sequence
  synthetic polynucleotide sequence
ggagcggatggagtctaccaa

SEQ ID NO: 30902 - DNA, 20 bp, Artificial sequence
  synthetic polynucleotide sequence
gaagcagggcacgagtcaca

SEQ ID NO: 30903 - DNA, 20 bp, Artificial sequence
  synthetic polynucleotide sequence
caggtggggatggtaagaca

SEQ ID NO: 30904 - DNA, 18 bp, Artificial sequence
  synthetic polynucleotide sequence
tacggccacatctcggga

SEQ ID NO: 30905 - DNA, 21 bp, Artificial sequence
  synthetic polynucleotide sequence
cagaacctgactgaaccccca

SEQ ID NO: 30906 - DNA, 20 bp, Artificial sequence
  synthetic polynucleotide sequence
cccaaggtggcacctcacca

SEQ ID NO: 30907 - DNA, 21 bp, Artificial sequence
  synthetic polynucleotide sequence
gcttgttccccatccacggga

SEQ ID NO: 30908 - DNA, 19 bp, Artificial sequence
  synthetic polynucleotide sequence
tgccccagatgttacagga

SEQ ID NO: 30909 - DNA, 18 bp, Artificial sequence
  synthetic polynucleotide sequence
agagttgccccgagcaca

SEQ ID NO: 30910 - DNA, 19 bp, Artificial sequence
  synthetic polynucleotide sequence
ggcttcaagggcagggcta

SEQ ID NO: 30911 - DNA, 18 bp, Artificial sequence
  synthetic polynucleotide sequence
gatggacgcagccaacga

SEQ ID NO: 30912 - DNA, 19 bp, Artificial sequence
  synthetic polynucleotide sequence
cccagctcacacagcacca

SEQ ID NO: 30913 - DNA, 18 bp, Artificial sequence
  synthetic polynucleotide sequence
caggccatcatccccaca

SEQ ID NO: 30914 - DNA, 19 bp, Artificial sequence
  synthetic polynucleotide sequence
ggatggggcactctagcca

SEQ ID NO: 30915 - DNA, 21 bp, Artificial sequence
  synthetic polynucleotide sequence
cggagccagcatactaccgaa

SEQ ID NO: 30916 - DNA, 20 bp, Artificial sequence
  synthetic polynucleotide sequence
ctgcattgaggtccacagca

SEQ ID NO: 30917 - DNA, 20 bp, Artificial sequence
  synthetic polynucleotide sequence
gggactcaactgcaccacca

SEQ ID NO: 30918 - DNA, 20 bp, Artificial sequence
  synthetic polynucleotide sequence
aagcagagctgcggcttgga

SEQ ID NO: 30919 - DNA, 18 bp, Artificial sequence
  synthetic polynucleotide sequence
ggctgccaaatgcaggca

SEQ ID NO: 30920 - DNA, 20 bp, Artificial sequence
  synthetic polynucleotide sequence
aagcatcaagatcccagcga

SEQ ID NO: 30921 - DNA, 18 bp, Artificial sequence
  synthetic polynucleotide sequence
catgcagtctgagcggga

SEQ ID NO: 30922 - DNA, 18 bp, Artificial sequence
  synthetic polynucleotide sequence
tgaggaaggcagagccca

SEQ ID NO: 30923 - DNA, 22 bp, Artificial sequence
  synthetic polynucleotide sequence
caaagaggaggaggttggacca

SEQ ID NO: 30924 - DNA, 19 bp, Artificial sequence
  synthetic polynucleotide sequence
cccgggcagagaaaggcca

SEQ ID NO: 30925 - DNA, 18 bp, Artificial sequence
  synthetic polynucleotide sequence
gatggctgacgtggccaa

SEQ ID NO: 30926 - DNA, 18 bp, Artificial sequence
  synthetic polynucleotide sequence
cgcttcacatgggccaca

SEQ ID NO: 30927 - DNA, 21 bp, Artificial sequence
  synthetic polynucleotide sequence
gctgcagtgtcaaccacccca

SEQ ID NO: 30928 - DNA, 21 bp, Artificial sequence
  synthetic polynucleotide sequence
ttgcactggccctcataagca

SEQ ID NO: 30929 - DNA, 20 bp, Artificial sequence
  synthetic polynucleotide sequence
ctcatgcccacagagggaga

SEQ ID NO: 30930 - DNA, 20 bp, Artificial sequence
  synthetic polynucleotide sequence
ctcagtgtagcggtccagga

SEQ ID NO: 30931 - DNA, 18 bp, Artificial sequence
  synthetic polynucleotide sequence
tggcagaggtgtcccgaa

SEQ ID NO: 30932 - DNA, 18 bp, Artificial sequence
  synthetic polynucleotide sequence
atggaggggcttcaggca

SEQ ID NO: 30933 - DNA, 20 bp, Artificial sequence
  synthetic polynucleotide sequence
ctcgagtacgtgccacacca

SEQ ID NO: 30934 - DNA, 18 bp, Artificial sequence
  synthetic polynucleotide sequence
cagcagggtgaacacgga

SEQ ID NO: 30935 - DNA, 18 bp, Artificial sequence
  synthetic polynucleotide sequence
gcaaggtgagcgggacca

SEQ ID NO: 30936 - DNA, 21 bp, Artificial sequence
  synthetic polynucleotide sequence
caagcactgagcaactccaca

SEQ ID NO: 30937 - DNA, 20 bp, Artificial sequence
  synthetic polynucleotide sequence
gagggacctgcctgtcagca

SEQ ID NO: 30938 - DNA, 20 bp, Artificial sequence
  synthetic polynucleotide sequence
tctgaggagcaccgaaggga

SEQ ID NO: 30939 - DNA, 22 bp, Artificial sequence
  synthetic polynucleotide sequence
accaaggtagaaagtcgggaca

SEQ ID NO: 30940 - DNA, 20 bp, Artificial sequence
  synthetic polynucleotide sequence
caattccagcaaccacacca

SEQ ID NO: 30941 - DNA, 21 bp, Artificial sequence
  synthetic polynucleotide sequence
tagcagttcccaaagtagcga

SEQ ID NO: 30942 - DNA, 18 bp, Artificial sequence
  synthetic polynucleotide sequence
gtgtcgaggctggccaca

SEQ ID NO: 30943 - DNA, 21 bp, Artificial sequence
  synthetic polynucleotide sequence
tgggggaatagtgacaccaga

SEQ ID NO: 30944 - DNA, 22 bp, Artificial sequence
  synthetic polynucleotide sequence
caatgatgccacatggccaaca

SEQ ID NO: 30945 - DNA, 18 bp, Artificial sequence
  synthetic polynucleotide sequence
tgagcgctacaacggcca

SEQ ID NO: 30946 - DNA, 18 bp, Artificial sequence
  synthetic polynucleotide sequence
gcatacgttgcagcggca

SEQ ID NO: 30947 - DNA, 19 bp, Artificial sequence
  synthetic polynucleotide sequence
ggggagccctacatgacga

SEQ ID NO: 30948 - DNA, 18 bp, Artificial sequence
  synthetic polynucleotide sequence
cggcaaggccaatgagca

SEQ ID NO: 30949 - DNA, 19 bp, Artificial sequence
  synthetic polynucleotide sequence
gcactcaccatgagcacca

SEQ ID NO: 30950 - DNA, 19 bp, Artificial sequence
  synthetic polynucleotide sequence
cacctgccaactgctacga

SEQ ID NO: 30951 - DNA, 19 bp, Artificial sequence
  synthetic polynucleotide sequence
cggaggaccagaagggcaa

SEQ ID NO: 30952 - DNA, 18 bp, Artificial sequence
  synthetic polynucleotide sequence
gcacacacactgtccgca

SEQ ID NO: 30953 - DNA, 18 bp, Artificial sequence
  synthetic polynucleotide sequence
tggccagatctgcagcga

SEQ ID NO: 30954 - DNA, 18 bp, Artificial sequence
  synthetic polynucleotide sequence
tcccagagtggagcagca

SEQ ID NO: 30955 - DNA, 18 bp, Artificial sequence
  synthetic polynucleotide sequence
atccctcctgcagcggaa

SEQ ID NO: 30956 - DNA, 18 bp, Artificial sequence
  synthetic polynucleotide sequence
tccagccgctcctgcaca

SEQ ID NO: 30957 - DNA, 18 bp, Artificial sequence
  synthetic polynucleotide sequence
atgcgagagacaccggga

SEQ ID NO: 30958 - DNA, 18 bp, Artificial sequence
  synthetic polynucleotide sequence
agataggggccaaggcca

SEQ ID NO: 30959 - DNA, 18 bp, Artificial sequence
  synthetic polynucleotide sequence
ttcagcagcagcccagca

SEQ ID NO: 30960 - DNA, 18 bp, Artificial sequence
  synthetic polynucleotide sequence
gttcacagaagcggccga

SEQ ID NO: 30961 - DNA, 20 bp, Artificial sequence
  synthetic polynucleotide sequence
gctgtcagctgaggagagca

SEQ ID NO: 30962 - DNA, 18 bp, Artificial sequence
  synthetic polynucleotide sequence
cggcgatctcctggagga

SEQ ID NO: 30963 - DNA, 18 bp, Artificial sequence
  synthetic polynucleotide sequence
ccacgatggtggtgagga

SEQ ID NO: 30964 - DNA, 18 bp, Artificial sequence
  synthetic polynucleotide sequence
tcgatgagtccagcccca

SEQ ID NO: 30965 - DNA, 18 bp, Artificial sequence
  synthetic polynucleotide sequence
agaagccagaggccagca

SEQ ID NO: 30966 - DNA, 22 bp, Artificial sequence
  synthetic polynucleotide sequence
agaaagctgtagagctgaggca

SEQ ID NO: 30967 - DNA, 18 bp, Artificial sequence
  synthetic polynucleotide sequence
ctggcgacaagagaggca

SEQ ID NO: 30968 - DNA, 18 bp, Artificial sequence
  synthetic polynucleotide sequence
gcacggccctgttccaca

SEQ ID NO: 30969 - DNA, 18 bp, Artificial sequence
  synthetic polynucleotide sequence
ccggcctgaagatgacca

SEQ ID NO: 30970 - DNA, 19 bp, Artificial sequence
  synthetic polynucleotide sequence
cctccaacgtggctggaga

SEQ ID NO: 30971 - DNA, 18 bp, Artificial sequence
  synthetic polynucleotide sequence
cccctccaaatggccaca

SEQ ID NO: 30972 - DNA, 18 bp, Artificial sequence
  synthetic polynucleotide sequence
ggcgttggcagacacgga

SEQ ID NO: 30973 - DNA, 21 bp, Artificial sequence
  synthetic polynucleotide sequence
acgaaggcaccatggcccaga

SEQ ID NO: 30974 - DNA, 20 bp, Artificial sequence
  synthetic polynucleotide sequence
tgagagcgcttcaccagcca

SEQ ID NO: 30975 - DNA, 22 bp, Artificial sequence
  synthetic polynucleotide sequence
tcaggatggaaacagtcaggca

SEQ ID NO: 30976 - DNA, 22 bp, Artificial sequence
  synthetic polynucleotide sequence
agtgctcaagccagagtaggca

SEQ ID NO: 30977 - DNA, 18 bp, Artificial sequence
  synthetic polynucleotide sequence
ggacggcaactgggccaa

SEQ ID NO: 30978 - DNA, 18 bp, Artificial sequence
  synthetic polynucleotide sequence
ccagtgctgcatggggga

SEQ ID NO: 30979 - DNA, 21 bp, Artificial sequence
  synthetic polynucleotide sequence
ggaatgacaatggcccagcca

SEQ ID NO: 30980 - DNA, 21 bp, Artificial sequence
  synthetic polynucleotide sequence
cggaactgaacgaatcctgca

SEQ ID NO: 30981 - DNA, 19 bp, Artificial sequence
  synthetic polynucleotide sequence
caaactggcgagtggcaga

SEQ ID NO: 30982 - DNA, 20 bp, Artificial sequence
  synthetic polynucleotide sequence
caagaggtctctgcgacgaa

SEQ ID NO: 30983 - DNA, 20 bp, Artificial sequence
  synthetic polynucleotide sequence
gtggactgcaaggacccaga

SEQ ID NO: 30984 - DNA, 18 bp, Artificial sequence
  synthetic polynucleotide sequence
agctggggcatctgcaga

SEQ ID NO: 30985 - DNA, 21 bp, Artificial sequence
  synthetic polynucleotide sequence
tgaccctgcagacatcatcca

SEQ ID NO: 30986 - DNA, 21 bp, Artificial sequence
  synthetic polynucleotide sequence
cactgacatgctccgtgacca

SEQ ID NO: 30987 - DNA, 18 bp, Artificial sequence
  synthetic polynucleotide sequence
acccagaggctgccagga

SEQ ID NO: 30988 - DNA, 18 bp, Artificial sequence
  synthetic polynucleotide sequence
cccggaagcgatgggaga

SEQ ID NO: 30989 - DNA, 18 bp, Artificial sequence
  synthetic polynucleotide sequence
aggagggcctgaacgcca

SEQ ID NO: 30990 - DNA, 18 bp, Artificial sequence
  synthetic polynucleotide sequence
gtgagggcctctggacca

SEQ ID NO: 30991 - DNA, 21 bp, Artificial sequence
  synthetic polynucleotide sequence
ggacaccctggaggtatccga

SEQ ID NO: 30992 - DNA, 20 bp, Artificial sequence
  synthetic polynucleotide sequence
gccgaagtcgatgagccaca

SEQ ID NO: 30993 - DNA, 19 bp, Artificial sequence
  synthetic polynucleotide sequence
cgagggagcaggtcaccga

SEQ ID NO: 30994 - DNA, 21 bp, Artificial sequence
  synthetic polynucleotide sequence
gtcgtggatgaagaggaggga

SEQ ID NO: 30995 - DNA, 21 bp, Artificial sequence
  synthetic polynucleotide sequence
gagctagtgaaggcacgggaa

SEQ ID NO: 30996 - DNA, 20 bp, Artificial sequence
  synthetic polynucleotide sequence
cttgatgccctcgatccgga

SEQ ID NO: 30997 - DNA, 20 bp, Artificial sequence
  synthetic polynucleotide sequence
gttccccaggatgagagcca

SEQ ID NO: 30998 - DNA, 21 bp, Artificial sequence
  synthetic polynucleotide sequence
taattccgacagctggccaga

SEQ ID NO: 30999 - DNA, 18 bp, Artificial sequence
  synthetic polynucleotide sequence
cgtacgaccttgcgccaa

SEQ ID NO: 31000 - DNA, 18 bp, Artificial sequence
  synthetic polynucleotide sequence
cactgtcctgcaccccca

SEQ ID NO: 31001 - DNA, 20 bp, Artificial sequence
  synthetic polynucleotide sequence
ctgtggtctggagagggaca

SEQ ID NO: 31002 - DNA, 18 bp, Artificial sequence
  synthetic polynucleotide sequence
ttcacgcggaccagcaca

SEQ ID NO: 31003 - DNA, 19 bp, Artificial sequence
  synthetic polynucleotide sequence
cgcaaggtgcctgaggcca

SEQ ID NO: 31004 - DNA, 20 bp, Artificial sequence
  synthetic polynucleotide sequence
ggtaggctggtctgagggga

SEQ ID NO: 31005 - DNA, 20 bp, Artificial sequence
  synthetic polynucleotide sequence
ctctcagcggctccaggaca

SEQ ID NO: 31006 - DNA, 21 bp, Artificial sequence
  synthetic polynucleotide sequence
aagagattgaccggctcagca

SEQ ID NO: 31007 - DNA, 18 bp, Artificial sequence
  synthetic polynucleotide sequence
aggtgggtcccctgccca

SEQ ID NO: 31008 - DNA, 21 bp, Artificial sequence
  synthetic polynucleotide sequence
gcctttgccacgtggacagca

SEQ ID NO: 31009 - DNA, 18 bp, Artificial sequence
  synthetic polynucleotide sequence
acgactacaccgcgcaga

SEQ ID NO: 31010 - DNA, 18 bp, Artificial sequence
  synthetic polynucleotide sequence
tggatgggaagagcccca

SEQ ID NO: 31011 - DNA, 21 bp, Artificial sequence
  synthetic polynucleotide sequence
gaggtgcatggaggaagagga

SEQ ID NO: 31012 - DNA, 22 bp, Artificial sequence
  synthetic polynucleotide sequence
aactgaataggctgccgaggta

SEQ ID NO: 31013 - DNA, 20 bp, Artificial sequence
  synthetic polynucleotide sequence
atgagtgggctggacctgga

SEQ ID NO: 31014 - DNA, 22 bp, Artificial sequence
  synthetic polynucleotide sequence
tgcatcaactggaagtggccga

SEQ ID NO: 31015 - DNA, 19 bp, Artificial sequence
  synthetic polynucleotide sequence
cccagagcagcaggacgga

SEQ ID NO: 31016 - DNA, 18 bp, Artificial sequence
  synthetic polynucleotide sequence
tggcctggagctggggca

SEQ ID NO: 31017 - DNA, 21 bp, Artificial sequence
  synthetic polynucleotide sequence
acagcccacagagctcaccaa

SEQ ID NO: 31018 - DNA, 22 bp, Artificial sequence
  synthetic polynucleotide sequence
tcatgggagcaagaaaggacca

SEQ ID NO: 31019 - DNA, 22 bp, Artificial sequence
  synthetic polynucleotide sequence
aaggtgctgacaggagaggaga

SEQ ID NO: 31020 - DNA, 21 bp, Artificial sequence
  synthetic polynucleotide sequence
ggaggtcgcctgaaacctgga

SEQ ID NO: 31021 - DNA, 21 bp, Artificial sequence
  synthetic polynucleotide sequence
atcgctgggtcacagacctca

SEQ ID NO: 31022 - DNA, 21 bp, Artificial sequence
  synthetic polynucleotide sequence
ttgccatttgcggcgaaacca

SEQ ID NO: 31023 - DNA, 20 bp, Artificial sequence
  synthetic polynucleotide sequence
cacgtcacagtgttgcccaa

SEQ ID NO: 31024 - DNA, 18 bp, Artificial sequence
  synthetic polynucleotide sequence
cagtgctagggagccgca

SEQ ID NO: 31025 - DNA, 18 bp, Artificial sequence
  synthetic polynucleotide sequence
aaagccagccctgagcga

SEQ ID NO: 31026 - DNA, 18 bp, Artificial sequence
  synthetic polynucleotide sequence
atggggcagagctggcga

SEQ ID NO: 31027 - DNA, 18 bp, Artificial sequence
  synthetic polynucleotide sequence
gggccgtgctgatgggca

SEQ ID NO: 31028 - DNA, 18 bp, Artificial sequence
  synthetic polynucleotide sequence
aggacgccacaaggtcca

SEQ ID NO: 31029 - DNA, 22 bp, Artificial sequence
  synthetic polynucleotide sequence
gaactcagctgcttgaacggca

SEQ ID NO: 31030 - DNA, 20 bp, Artificial sequence
  synthetic polynucleotide sequence
gctgaacagccaacacccga

SEQ ID NO: 31031 - DNA, 18 bp, Artificial sequence
  synthetic polynucleotide sequence
gcgaaacatcttccggga

SEQ ID NO: 31032 - DNA, 20 bp, Artificial sequence
  synthetic polynucleotide sequence
gtagttcaggaggccctgga

SEQ ID NO: 31033 - DNA, 18 bp, Artificial sequence
  synthetic polynucleotide sequence
gccctggaagtgaaggca

SEQ ID NO: 31034 - DNA, 20 bp, Artificial sequence
  synthetic polynucleotide sequence
aaagctctctgggaccacca

SEQ ID NO: 31035 - DNA, 21 bp, Artificial sequence
  synthetic polynucleotide sequence
ccacctaccaggaagccacca

SEQ ID NO: 31036 - DNA, 19 bp, Artificial sequence
  synthetic polynucleotide sequence
cttgctgcagggccaggca

SEQ ID NO: 31037 - DNA, 20 bp, Artificial sequence
  synthetic polynucleotide sequence
ggtgccagtcagtcaaggca

SEQ ID NO: 31038 - DNA, 21 bp, Artificial sequence
  synthetic polynucleotide sequence
aacacaactgggggagaggaa

SEQ ID NO: 31039 - DNA, 18 bp, Artificial sequence
  synthetic polynucleotide sequence
ggtgccaagtgccaggaa

SEQ ID NO: 31040 - DNA, 18 bp, Artificial sequence
  synthetic polynucleotide sequence
gcaaggtcgagggccaca

SEQ ID NO: 31041 - DNA, 18 bp, Artificial sequence
  synthetic polynucleotide sequence
ctgcgaccagtacggcaa

SEQ ID NO: 31042 - DNA, 17 bp, Artificial sequence
  synthetic polynucleotide sequence
ccggggtaggggacaca

SEQ ID NO: 31043 - DNA, 18 bp, Artificial sequence
  synthetic polynucleotide sequence
gctctaccgccatggcaa

SEQ ID NO: 31044 - DNA, 18 bp, Artificial sequence
  synthetic polynucleotide sequence
gccaggcatgcacttgca

SEQ ID NO: 31045 - DNA, 20 bp, Artificial sequence
  synthetic polynucleotide sequence
ctctgcaggtatgaccccga

SEQ ID NO: 31046 - DNA, 18 bp, Artificial sequence
  synthetic polynucleotide sequence
aggcttcccgaaggcaga

SEQ ID NO: 31047 - DNA, 19 bp, Artificial sequence
  synthetic polynucleotide sequence
gtggcagcaacagagccta

SEQ ID NO: 31048 - DNA, 20 bp, Artificial sequence
  synthetic polynucleotide sequence
aacactgccatcccaagaca

SEQ ID NO: 31049 - DNA, 18 bp, Artificial sequence
  synthetic polynucleotide sequence
gatgggatgtgagcggga

SEQ ID NO: 31050 - DNA, 20 bp, Artificial sequence
  synthetic polynucleotide sequence
ctgggtgagcagtgaaggca

SEQ ID NO: 31051 - DNA, 18 bp, Artificial sequence
  synthetic polynucleotide sequence
accccagccacgcccgaa

SEQ ID NO: 31052 - DNA, 20 bp, Artificial sequence
  synthetic polynucleotide sequence
cagggcgtaggcgcgttgca

SEQ ID NO: 31053 - DNA, 21 bp, Artificial sequence
  synthetic polynucleotide sequence
agagagagacgatcccctcca

SEQ ID NO: 31054 - DNA, 20 bp, Artificial sequence
  synthetic polynucleotide sequence
tctggtgtagggcagcctca

SEQ ID NO: 31055 - DNA, 21 bp, Artificial sequence
  synthetic polynucleotide sequence
tacagggcttgtgaacaccga

SEQ ID NO: 31056 - DNA, 20 bp, Artificial sequence
  synthetic polynucleotide sequence
cgtcagtgcctccaaaccca

SEQ ID NO: 31057 - DNA, 21 bp, Artificial sequence
  synthetic polynucleotide sequence
tgacaagaagtgatgcgggga

SEQ ID NO: 31058 - DNA, 21 bp, Artificial sequence
  synthetic polynucleotide sequence
atgatggaactgctggagcca

SEQ ID NO: 31059 - DNA, 20 bp, Artificial sequence
  synthetic polynucleotide sequence
caggtgtgaggagcaggaga

SEQ ID NO: 31060 - DNA, 18 bp, Artificial sequence
  synthetic polynucleotide sequence
ccaacgtgatcagggcca

SEQ ID NO: 31061 - DNA, 18 bp, Artificial sequence
  synthetic polynucleotide sequence
gcccggaagagcctcgaa

SEQ ID NO: 31062 - DNA, 20 bp, Artificial sequence
  synthetic polynucleotide sequence
tatcagaacagggagcagca

SEQ ID NO: 31063 - DNA, 20 bp, Artificial sequence
  synthetic polynucleotide sequence
ctcctggatgagctcaggga

SEQ ID NO: 31064 - DNA, 19 bp, Artificial sequence
  synthetic polynucleotide sequence
gcgcagagcacactccaga

SEQ ID NO: 31065 - DNA, 20 bp, Artificial sequence
  synthetic polynucleotide sequence
ctggaccacagagagtgcca

SEQ ID NO: 31066 - DNA, 19 bp, Artificial sequence
  synthetic polynucleotide sequence
tacatccaggaactgggca

SEQ ID NO: 31067 - DNA, 22 bp, Artificial sequence
  synthetic polynucleotide sequence
atcctacagaagtggagctgga

SEQ ID NO: 31068 - DNA, 21 bp, Artificial sequence
  synthetic polynucleotide sequence
caccaccatatacgagtggga

SEQ ID NO: 31069 - DNA, 20 bp, Artificial sequence
  synthetic polynucleotide sequence
atccgagcggctggaactca

SEQ ID NO: 31070 - DNA, 21 bp, Artificial sequence
  synthetic polynucleotide sequence
tcttgacactgtcggtccgga

SEQ ID NO: 31071 - DNA, 20 bp, Artificial sequence
  synthetic polynucleotide sequence
ctcggggaaaaagagttcca

SEQ ID NO: 31072 - DNA, 22 bp, Artificial sequence
  synthetic polynucleotide sequence
agaacaccaactggatcactca

SEQ ID NO: 31073 - DNA, 19 bp, Artificial sequence
  synthetic polynucleotide sequence
caggctgtctcacagggca

SEQ ID NO: 31074 - DNA, 21 bp, Artificial sequence
  synthetic polynucleotide sequence
actggtagtatcggcagcaga

SEQ ID NO: 31075 - DNA, 18 bp, Artificial sequence
  synthetic polynucleotide sequence
catgcccgactggcacca

SEQ ID NO: 31076 - DNA, 18 bp, Artificial sequence
  synthetic polynucleotide sequence
gcgcaaccaaggaggcca

SEQ ID NO: 31077 - DNA, 21 bp, Artificial sequence
  synthetic polynucleotide sequence
gcggataacgtggaaagggca

SEQ ID NO: 31078 - DNA, 20 bp, Artificial sequence
  synthetic polynucleotide sequence
cagaccagccctcttgcgca

SEQ ID NO: 31079 - DNA, 21 bp, Artificial sequence
  synthetic polynucleotide sequence
agccctgggaaagatgcccga

SEQ ID NO: 31080 - DNA, 19 bp, Artificial sequence
  synthetic polynucleotide sequence
gccaaggggtccagtggga

SEQ ID NO: 31081 - DNA, 18 bp, Artificial sequence
  synthetic polynucleotide sequence
cactactccccaccccca

SEQ ID NO: 31082 - DNA, 20 bp, Artificial sequence
  synthetic polynucleotide sequence
aaccagcgcttacgaccgta

SEQ ID NO: 31083 - DNA, 18 bp, Artificial sequence
  synthetic polynucleotide sequence
cgagatgaccgagcagga

SEQ ID NO: 31084 - DNA, 19 bp, Artificial sequence
  synthetic polynucleotide sequence
cggtgaagagcacctggga

SEQ ID NO: 31085 - DNA, 20 bp, Artificial sequence
  synthetic polynucleotide sequence
agcaatgccttcacccggga

SEQ ID NO: 31086 - DNA, 20 bp, Artificial sequence
  synthetic polynucleotide sequence
agtgagggcaatgacaccga

SEQ ID NO: 31087 - DNA, 20 bp, Artificial sequence
  synthetic polynucleotide sequence
gcacactgcatgcctgggaa

SEQ ID NO: 31088 - DNA, 20 bp, Artificial sequence
  synthetic polynucleotide sequence
agcagcggcagtggggagca

SEQ ID NO: 31089 - DNA, 21 bp, Artificial sequence
  synthetic polynucleotide sequence
tcaggggcgagactcaaccaa

SEQ ID NO: 31090 - DNA, 18 bp, Artificial sequence
  synthetic polynucleotide sequence
gggatgtggtggcggcca

SEQ ID NO: 31091 - DNA, 21 bp, Artificial sequence
  synthetic polynucleotide sequence
ggctctacaagggcgagtgga

SEQ ID NO: 31092 - DNA, 21 bp, Artificial sequence
  synthetic polynucleotide sequence
ccatagccgtcttgcaggcca

SEQ ID NO: 31093 - DNA, 19 bp, Artificial sequence
  synthetic polynucleotide sequence
gggcttcggggtgcagaga

SEQ ID NO: 31094 - DNA, 20 bp, Artificial sequence
  synthetic polynucleotide sequence
ctcgtcggactctagagcga

SEQ ID NO: 31095 - DNA, 19 bp, Artificial sequence
  synthetic polynucleotide sequence
gcccagagacggttcccca

SEQ ID NO: 31096 - DNA, 20 bp, Artificial sequence
  synthetic polynucleotide sequence
ccagcatcaggacccctcga

SEQ ID NO: 31097 - DNA, 21 bp, Artificial sequence
  synthetic polynucleotide sequence
tgaggaggagttggaggcaga

SEQ ID NO: 31098 - DNA, 21 bp, Artificial sequence
  synthetic polynucleotide sequence
ccacacaacctctgctggcga

SEQ ID NO: 31099 - DNA, 22 bp, Artificial sequence
  synthetic polynucleotide sequence
tggagatgagactgcggtggaa

SEQ ID NO: 31100 - DNA, 19 bp, Artificial sequence
  synthetic polynucleotide sequence
tgtgcccagggacagtgca

SEQ ID NO: 31101 - DNA, 18 bp, Artificial sequence
  synthetic polynucleotide sequence
ccaagcacgtgtgcccga

SEQ ID NO: 31102 - DNA, 18 bp, Artificial sequence
  synthetic polynucleotide sequence
ttctctgcagcctcccga

SEQ ID NO: 31103 - DNA, 21 bp, Artificial sequence
  synthetic polynucleotide sequence
aagctgtcagcaagcacctca

SEQ ID NO: 31104 - DNA, 21 bp, Artificial sequence
  synthetic polynucleotide sequence
ttccatcaaagctgagcggca

SEQ ID NO: 31105 - DNA, 18 bp, Artificial sequence
  synthetic polynucleotide sequence
gcaggccctgaaggagga

SEQ ID NO: 31106 - DNA, 18 bp, Artificial sequence
  synthetic polynucleotide sequence
ccatgtcgatgggggaca

SEQ ID NO: 31107 - DNA, 20 bp, Artificial sequence
  synthetic polynucleotide sequence
cttcaaggaggaaccgcaga

SEQ ID NO: 31108 - DNA, 18 bp, Artificial sequence
  synthetic polynucleotide sequence
gcagccgcttgcgctcca

SEQ ID NO: 31109 - DNA, 18 bp, Artificial sequence
  synthetic polynucleotide sequence
tctcgcgcctggaagaga

SEQ ID NO: 31110 - DNA, 18 bp, Artificial sequence
  synthetic polynucleotide sequence
cgctgttgacgtggctga

SEQ ID NO: 31111 - DNA, 18 bp, Artificial sequence
  synthetic polynucleotide sequence
gcgtgctggtgacaagga

SEQ ID NO: 31112 - DNA, 19 bp, Artificial sequence
  synthetic polynucleotide sequence
cgcacagagttctgggcca

SEQ ID NO: 31113 - DNA, 22 bp, Artificial sequence
  synthetic polynucleotide sequence
tacacaagcacgctcttcacga

SEQ ID NO: 31114 - DNA, 20 bp, Artificial sequence
  synthetic polynucleotide sequence
acagcggaggtgcctcccga

SEQ ID NO: 31115 - DNA, 18 bp, Artificial sequence
  synthetic polynucleotide sequence
ctccaaggcagtgcacca

SEQ ID NO: 31116 - DNA, 18 bp, Artificial sequence
  synthetic polynucleotide sequence
ccgggctcgatgtaggga

SEQ ID NO: 31117 - DNA, 21 bp, Artificial sequence
  synthetic polynucleotide sequence
tctgaacaccctccagcacga

SEQ ID NO: 31118 - DNA, 22 bp, Artificial sequence
  synthetic polynucleotide sequence
atctcgaagttggagtgggaca

SEQ ID NO: 31119 - DNA, 20 bp, Artificial sequence
  synthetic polynucleotide sequence
tgagcacggccacaaggaga

SEQ ID NO: 31120 - DNA, 21 bp, Artificial sequence
  synthetic polynucleotide sequence
tgacattggggcaaacgagca

SEQ ID NO: 31121 - DNA, 20 bp, Artificial sequence
  synthetic polynucleotide sequence
ccagtcagacggggcagaca

SEQ ID NO: 31122 - DNA, 19 bp, Artificial sequence
  synthetic polynucleotide sequence
catcagcgctgtggcccca

SEQ ID NO: 31123 - DNA, 20 bp, Artificial sequence
  synthetic polynucleotide sequence
gtccagcctcactccccaca

SEQ ID NO: 31124 - DNA, 22 bp, Artificial sequence
  synthetic polynucleotide sequence
aagagcttccagacaacagcca

SEQ ID NO: 31125 - DNA, 20 bp, Artificial sequence
  synthetic polynucleotide sequence
caggcggagtgtgaggacca

SEQ ID NO: 31126 - DNA, 20 bp, Artificial sequence
  synthetic polynucleotide sequence
atgccgactcttgaggggga

SEQ ID NO: 31127 - DNA, 21 bp, Artificial sequence
  synthetic polynucleotide sequence
gaatcctcaggttccccagga

SEQ ID NO: 31128 - DNA, 21 bp, Artificial sequence
  synthetic polynucleotide sequence
ggggacaagttgagaggggca

SEQ ID NO: 31129 - DNA, 20 bp, Artificial sequence
  synthetic polynucleotide sequence
gccagcgctatggagtggaa

SEQ ID NO: 31130 - DNA, 21 bp, Artificial sequence
  synthetic polynucleotide sequence
aagcacctctgactggaacga

SEQ ID NO: 31131 - DNA, 20 bp, Artificial sequence
  synthetic polynucleotide sequence
gttgcccacccccatgcaga

SEQ ID NO: 31132 - DNA, 20 bp, Artificial sequence
  synthetic polynucleotide sequence
ccaacttagcgaggccccca

SEQ ID NO: 31133 - DNA, 18 bp, Artificial sequence
  synthetic polynucleotide sequence
tggacgccagttccggaa

SEQ ID NO: 31134 - DNA, 18 bp, Artificial sequence
  synthetic polynucleotide sequence
ccatgttgattcgccgga

SEQ ID NO: 31135 - DNA, 20 bp, Artificial sequence
  synthetic polynucleotide sequence
gaggaagcctcagctggaga

SEQ ID NO: 31136 - DNA, 19 bp, Artificial sequence
  synthetic polynucleotide sequence
cggagtcatggcaacagca

SEQ ID NO: 31137 - DNA, 18 bp, Artificial sequence
  synthetic polynucleotide sequence
agcgcaaacaggcccaga

SEQ ID NO: 31138 - DNA, 19 bp, Artificial sequence
  synthetic polynucleotide sequence
gccaggaacgctctccaca

SEQ ID NO: 31139 - DNA, 18 bp, Artificial sequence
  synthetic polynucleotide sequence
ccagggatgaggcggcaa

SEQ ID NO: 31140 - DNA, 19 bp, Artificial sequence
  synthetic polynucleotide sequence
tctgtaggccaaccagcca

SEQ ID NO: 31141 - DNA, 18 bp, Artificial sequence
  synthetic polynucleotide sequence
acgacatcgtcacccgga

SEQ ID NO: 31142 - DNA, 18 bp, Artificial sequence
  synthetic polynucleotide sequence
acggccgtacttgaggca

SEQ ID NO: 31143 - DNA, 18 bp, Artificial sequence
  synthetic polynucleotide sequence
gctgcagcagctgaccaa

SEQ ID NO: 31144 - DNA, 20 bp, Artificial sequence
  synthetic polynucleotide sequence
gaggagtcccagctaaggga

SEQ ID NO: 31145 - DNA, 20 bp, Artificial sequence
  synthetic polynucleotide sequence
tagcaacctcacctccagca

SEQ ID NO: 31146 - DNA, 18 bp, Artificial sequence
  synthetic polynucleotide sequence
tcggaggcctctccacca

SEQ ID NO: 31147 - DNA, 20 bp, Artificial sequence
  synthetic polynucleotide sequence
aagttaaggctgcaaggcca

SEQ ID NO: 31148 - DNA, 18 bp, Artificial sequence
  synthetic polynucleotide sequence
agacgtcccagccgtgca

SEQ ID NO: 31149 - DNA, 20 bp, Artificial sequence
  synthetic polynucleotide sequence
aagtactggaagggccagca

SEQ ID NO: 31150 - DNA, 18 bp, Artificial sequence
  synthetic polynucleotide sequence
gggtgcccacttgaggca

SEQ ID NO: 31151 - DNA, 19 bp, Artificial sequence
  synthetic polynucleotide sequence
cagcaaaaggcagggagga

SEQ ID NO: 31152 - DNA, 19 bp, Artificial sequence
  synthetic polynucleotide sequence
cattgccatcaaggacgca

SEQ ID NO: 31153 - DNA, 20 bp, Artificial sequence
  synthetic polynucleotide sequence
ggacctgtaggccgagcaca

SEQ ID NO: 31154 - DNA, 19 bp, Artificial sequence
  synthetic polynucleotide sequence
ttcaagggcttccaccaga

SEQ ID NO: 31155 - DNA, 22 bp, Artificial sequence
  synthetic polynucleotide sequence
gaagcctgcggatgaagacaga

SEQ ID NO: 31156 - DNA, 20 bp, Artificial sequence
  synthetic polynucleotide sequence
atggcacagtccagctccca

SEQ ID NO: 31157 - DNA, 18 bp, Artificial sequence
  synthetic polynucleotide sequence
cgctgtggccatcaacga

SEQ ID NO: 31158 - DNA, 18 bp, Artificial sequence
  synthetic polynucleotide sequence
gcaggacggtggtgcaca

SEQ ID NO: 31159 - DNA, 21 bp, Artificial sequence
  synthetic polynucleotide sequence
tcttcacagacagaaagccca

SEQ ID NO: 31160 - DNA, 19 bp, Artificial sequence
  synthetic polynucleotide sequence
gcaatctaccacaacgcca

SEQ ID NO: 31161 - DNA, 20 bp, Artificial sequence
  synthetic polynucleotide sequence
gaggaaggatggcttggaca

SEQ ID NO: 31162 - DNA, 18 bp, Artificial sequence
  synthetic polynucleotide sequence
cctcatcactgggacgca

SEQ ID NO: 31163 - DNA, 21 bp, Artificial sequence
  synthetic polynucleotide sequence
ccatccggcagagtcaacaga

SEQ ID NO: 31164 - DNA, 21 bp, Artificial sequence
  synthetic polynucleotide sequence
ttcttctgaactgggccggga

SEQ ID NO: 31165 - DNA, 18 bp, Artificial sequence
  synthetic polynucleotide sequence
agtgcccgtgcagcagca

SEQ ID NO: 31166 - DNA, 19 bp, Artificial sequence
  synthetic polynucleotide sequence
ccaggcagtggtatcggga

SEQ ID NO: 31167 - DNA, 21 bp, Artificial sequence
  synthetic polynucleotide sequence
ttgcagtatgaccccagccaa

SEQ ID NO: 31168 - DNA, 19 bp, Artificial sequence
  synthetic polynucleotide sequence
gcggagtgagaggagggga

SEQ ID NO: 31169 - DNA, 21 bp, Artificial sequence
  synthetic polynucleotide sequence
tgttcacgctgctctacgcca

SEQ ID NO: 31170 - DNA, 18 bp, Artificial sequence
  synthetic polynucleotide sequence
acaggcccaggagcgcca

SEQ ID NO: 31171 - DNA, 21 bp, Artificial sequence
  synthetic polynucleotide sequence
ggaggagatagcgtaggtgga

SEQ ID NO: 31172 - DNA, 21 bp, Artificial sequence
  synthetic polynucleotide sequence
aaccacaactgctgcactcca

SEQ ID NO: 31173 - DNA, 21 bp, Artificial sequence
  synthetic polynucleotide sequence
cctgatgctcgaccatccaca

SEQ ID NO: 31174 - DNA, 23 bp, Artificial sequence
  synthetic polynucleotide sequence
caatatgcagtcgaaccgttcga

SEQ ID NO: 31175 - DNA, 19 bp, Artificial sequence
  synthetic polynucleotide sequence
tcatcgtggctgaagggga

SEQ ID NO: 31176 - DNA, 20 bp, Artificial sequence
  synthetic polynucleotide sequence
tatatcggtcccggaagaca

SEQ ID NO: 31177 - DNA, 21 bp, Artificial sequence
  synthetic polynucleotide sequence
ctgtgatccatactcggggga

SEQ ID NO: 31178 - DNA, 20 bp, Artificial sequence
  synthetic polynucleotide sequence
atgccacatccatgccctca

SEQ ID NO: 31179 - DNA, 20 bp, Artificial sequence
  synthetic polynucleotide sequence
taggggagaatggaggcgga

SEQ ID NO: 31180 - DNA, 22 bp, Artificial sequence
  synthetic polynucleotide sequence
aactctgaccaggttcaaggca

SEQ ID NO: 31181 - DNA, 21 bp, Artificial sequence
  synthetic polynucleotide sequence
gtacaggccaagcagcagtga

SEQ ID NO: 31182 - DNA, 23 bp, Artificial sequence
  synthetic polynucleotide sequence
cataaacacgacctccgattgca

SEQ ID NO: 31183 - DNA, 20 bp, Artificial sequence
  synthetic polynucleotide sequence
aagcgagcgtgcagaccgca

SEQ ID NO: 31184 - DNA, 20 bp, Artificial sequence
  synthetic polynucleotide sequence
aatctgccatctccccccga

SEQ ID NO: 31185 - DNA, 21 bp, Artificial sequence
  synthetic polynucleotide sequence
tgagagagctagggctgctca

SEQ ID NO: 31186 - DNA, 21 bp, Artificial sequence
  synthetic polynucleotide sequence
ggggatactggagaagtgcga

SEQ ID NO: 31187 - DNA, 20 bp, Artificial sequence
  synthetic polynucleotide sequence
gtccctggccatcctgagga

SEQ ID NO: 31188 - DNA, 22 bp, Artificial sequence
  synthetic polynucleotide sequence
tagactgcactggagaagagga

SEQ ID NO: 31189 - DNA, 18 bp, Artificial sequence
  synthetic polynucleotide sequence
gctcagggcctgccagga

SEQ ID NO: 31190 - DNA, 21 bp, Artificial sequence
  synthetic polynucleotide sequence
aagtggactgctggtacccga

SEQ ID NO: 31191 - DNA, 18 bp, Artificial sequence
  synthetic polynucleotide sequence
cgagctggccgaacgaca

SEQ ID NO: 31192 - DNA, 18 bp, Artificial sequence
  synthetic polynucleotide sequence
gcaatcccagctcccgca

SEQ ID NO: 31193 - DNA, 21 bp, Artificial sequence
  synthetic polynucleotide sequence
ggcactccaaaggcctgcaga

SEQ ID NO: 31194 - DNA, 21 bp, Artificial sequence
  synthetic polynucleotide sequence
gcttcatgtccccatagccca

SEQ ID NO: 31195 - DNA, 20 bp, Artificial sequence
  synthetic polynucleotide sequence
cttctgcaaggctgggggga

SEQ ID NO: 31196 - DNA, 21 bp, Artificial sequence
  synthetic polynucleotide sequence
gggcataaagggacctccgca

SEQ ID NO: 31197 - DNA, 18 bp, Artificial sequence
  synthetic polynucleotide sequence
acggggacatgtacccca

SEQ ID NO: 31198 - DNA, 18 bp, Artificial sequence
  synthetic polynucleotide sequence
tggagacgatgacgggca

SEQ ID NO: 31199 - DNA, 21 bp, Artificial sequence
  synthetic polynucleotide sequence
cactggccatcctgagagtca

SEQ ID NO: 31200 - DNA, 21 bp, Artificial sequence
  synthetic polynucleotide sequence
tccacccggtcaacttcggca

SEQ ID NO: 31201 - DNA, 20 bp, Artificial sequence
  synthetic polynucleotide sequence
ggcctgtgcccagtacagaa

SEQ ID NO: 31202 - DNA, 25 bp, Artificial sequence
  synthetic polynucleotide sequence
gacagcagacacctcaaagaatcca

SEQ ID NO: 31203 - DNA, 19 bp, Artificial sequence
  synthetic polynucleotide sequence
tccagcgtgagaaagtgga

SEQ ID NO: 31204 - DNA, 18 bp, Artificial sequence
  synthetic polynucleotide sequence
gccggccctcctcactga

SEQ ID NO: 31205 - DNA, 21 bp, Artificial sequence
  synthetic polynucleotide sequence
ggctcaaggacaaagtgcaga

SEQ ID NO: 31206 - DNA, 21 bp, Artificial sequence
  synthetic polynucleotide sequence
acgcaatagcaagctgggcca

SEQ ID NO: 31207 - DNA, 19 bp, Artificial sequence
  synthetic polynucleotide sequence
tcttcatcgagagccccaa

SEQ ID NO: 31208 - DNA, 19 bp, Artificial sequence
  synthetic polynucleotide sequence
tgtccaaaagcgtggcaca

SEQ ID NO: 31209 - DNA, 21 bp, Artificial sequence
  synthetic polynucleotide sequence
agtctgacaatgccaccgaca

SEQ ID NO: 31210 - DNA, 19 bp, Artificial sequence
  synthetic polynucleotide sequence
gctgcggggtagtgagcga

SEQ ID NO: 31211 - DNA, 20 bp, Artificial sequence
  synthetic polynucleotide sequence
ctccgagccagcaccaacga

SEQ ID NO: 31212 - DNA, 20 bp, Artificial sequence
  synthetic polynucleotide sequence
tccatagcccagggtcgtca

SEQ ID NO: 31213 - DNA, 18 bp, Artificial sequence
  synthetic polynucleotide sequence
cccaaacatggtcaggca

SEQ ID NO: 31214 - DNA, 20 bp, Artificial sequence
  synthetic polynucleotide sequence
gtgagcttgcctgaggagca

SEQ ID NO: 31215 - DNA, 21 bp, Artificial sequence
  synthetic polynucleotide sequence
ggactgcccagccattgacca

SEQ ID NO: 31216 - DNA, 21 bp, Artificial sequence
  synthetic polynucleotide sequence
aaggggcatagtcggtgagga

SEQ ID NO: 31217 - DNA, 20 bp, Artificial sequence
  synthetic polynucleotide sequence
cgaccgcaacgtgacagaga

SEQ ID NO: 31218 - DNA, 20 bp, Artificial sequence
  synthetic polynucleotide sequence
cagcacacatacgccctcga

SEQ ID NO: 31219 - DNA, 18 bp, Artificial sequence
  synthetic polynucleotide sequence
ggtgcccaagaacgacga

SEQ ID NO: 31220 - DNA, 18 bp, Artificial sequence
  synthetic polynucleotide sequence
aagcccagctcagaggca

SEQ ID NO: 31221 - DNA, 20 bp, Artificial sequence
  synthetic polynucleotide sequence
taccgcactgggaagctcca

SEQ ID NO: 31222 - DNA, 21 bp, Artificial sequence
  synthetic polynucleotide sequence
cctcataacagcagtcgccga

SEQ ID NO: 31223 - DNA, 21 bp, Artificial sequence
  synthetic polynucleotide sequence
cctcggccagcaagttcacaa

SEQ ID NO: 31224 - DNA, 20 bp, Artificial sequence
  synthetic polynucleotide sequence
ggagcagatggagccgaaga

SEQ ID NO: 31225 - DNA, 21 bp, Artificial sequence
  synthetic polynucleotide sequence
gacagttcagcagggtggcaa

SEQ ID NO: 31226 - DNA, 21 bp, Artificial sequence
  synthetic polynucleotide sequence
tgcccagggtgaagaagccga

SEQ ID NO: 31227 - DNA, 20 bp, Artificial sequence
  synthetic polynucleotide sequence
cggcccctgtgtaagccaga

SEQ ID NO: 31228 - DNA, 20 bp, Artificial sequence
  synthetic polynucleotide sequence
agtgcgtgccagggatcaca

SEQ ID NO: 31229 - DNA, 21 bp, Artificial sequence
  synthetic polynucleotide sequence
ctccaatgacccctaccacca

SEQ ID NO: 31230 - DNA, 19 bp, Artificial sequence
  synthetic polynucleotide sequence
tttgaacccagccgcacca

SEQ ID NO: 31231 - DNA, 18 bp, Artificial sequence
  synthetic polynucleotide sequence
tggggccagacaaccaga

SEQ ID NO: 31232 - DNA, 18 bp, Artificial sequence
  synthetic polynucleotide sequence
agcgggtgtatcccagga

SEQ ID NO: 31233 - DNA, 21 bp, Artificial sequence
  synthetic polynucleotide sequence
tgcaccaccggggtaatgcca

SEQ ID NO: 31234 - DNA, 18 bp, Artificial sequence
  synthetic polynucleotide sequence
gggagcgggtgtaggcca

SEQ ID NO: 31235 - DNA, 20 bp, Artificial sequence
  synthetic polynucleotide sequence
accatgaccaccgtcggcta

SEQ ID NO: 31236 - DNA, 21 bp, Artificial sequence
  synthetic polynucleotide sequence
tgatgatggggtggatgggca

SEQ ID NO: 31237 - DNA, 21 bp, Artificial sequence
  synthetic polynucleotide sequence
cgggcaacagctacctggaca

SEQ ID NO: 31238 - DNA, 20 bp, Artificial sequence
  synthetic polynucleotide sequence
cagcccaccagtagcaggca

SEQ ID NO: 31239 - DNA, 18 bp, Artificial sequence
  synthetic polynucleotide sequence
ccgtgggctacggcgaca

SEQ ID NO: 31240 - DNA, 19 bp, Artificial sequence
  synthetic polynucleotide sequence
gctcggagtaggagcgcga

SEQ ID NO: 31241 - DNA, 20 bp, Artificial sequence
  synthetic polynucleotide sequence
gtctacgtggccgagaagga

SEQ ID NO: 31242 - DNA, 18 bp, Artificial sequence
  synthetic polynucleotide sequence
tgaggatcccgctcagga

SEQ ID NO: 31243 - DNA, 20 bp, Artificial sequence
  synthetic polynucleotide sequence
ctggtcctacaccaacggca

SEQ ID NO: 31244 - DNA, 20 bp, Artificial sequence
  synthetic polynucleotide sequence
gaagtacagggcggtgagca

SEQ ID NO: 31245 - DNA, 20 bp, Artificial sequence
  synthetic polynucleotide sequence
cttcggcaggcggtgacaga

SEQ ID NO: 31246 - DNA, 20 bp, Artificial sequence
  synthetic polynucleotide sequence
aggatgccccagtgtccaca

SEQ ID NO: 31247 - DNA, 18 bp, Artificial sequence
  synthetic polynucleotide sequence
tgtgcgtccagaccacca

SEQ ID NO: 31248 - DNA, 18 bp, Artificial sequence
  synthetic polynucleotide sequence
ctcaagtccaggagcgca

SEQ ID NO: 31249 - DNA, 21 bp, Artificial sequence
  synthetic polynucleotide sequence
tgtggctaggaaactggacca

SEQ ID NO: 31250 - DNA, 21 bp, Artificial sequence
  synthetic polynucleotide sequence
caaagccagctggtagagcca

SEQ ID NO: 31251 - DNA, 21 bp, Artificial sequence
  synthetic polynucleotide sequence
aagccctcaggaagacccaga

SEQ ID NO: 31252 - DNA, 21 bp, Artificial sequence
  synthetic polynucleotide sequence
aaggccaggtcattggaggca

SEQ ID NO: 31253 - DNA, 22 bp, Artificial sequence
  synthetic polynucleotide sequence
tacaaactgcagacaccacgca

SEQ ID NO: 31254 - DNA, 21 bp, Artificial sequence
  synthetic polynucleotide sequence
tcattgaggaggaaggctgca

SEQ ID NO: 31255 - DNA, 21 bp, Artificial sequence
  synthetic polynucleotide sequence
tctccaggtcaaattccccca

SEQ ID NO: 31256 - DNA, 19 bp, Artificial sequence
  synthetic polynucleotide sequence
gaggtctgggggtccagca

SEQ ID NO: 31257 - DNA, 21 bp, Artificial sequence
  synthetic polynucleotide sequence
cactccaaggcagcatgtgga

SEQ ID NO: 31258 - DNA, 22 bp, Artificial sequence
  synthetic polynucleotide sequence
tgaaacagctggagagacctca

SEQ ID NO: 31259 - DNA, 20 bp, Artificial sequence
  synthetic polynucleotide sequence
tcctcaaggagactccagca

SEQ ID NO: 31260 - DNA, 18 bp, Artificial sequence
  synthetic polynucleotide sequence
ctcccggagtgcagggta

SEQ ID NO: 31261 - DNA, 20 bp, Artificial sequence
  synthetic polynucleotide sequence
acggtgcgccaccagccaga

SEQ ID NO: 31262 - DNA, 20 bp, Artificial sequence
  synthetic polynucleotide sequence
tccaccaggcccgtgggaca

SEQ ID NO: 31263 - DNA, 20 bp, Artificial sequence
  synthetic polynucleotide sequence
gaacagcaccaagcgcagca

SEQ ID NO: 31264 - DNA, 20 bp, Artificial sequence
  synthetic polynucleotide sequence
ccgatgcctgacggtggcca

SEQ ID NO: 31265 - DNA, 18 bp, Artificial sequence
  synthetic polynucleotide sequence
acctgccaagtccggaca

SEQ ID NO: 31266 - DNA, 20 bp, Artificial sequence
  synthetic polynucleotide sequence
aaaggcacatggcacagtga

SEQ ID NO: 31267 - DNA, 21 bp, Artificial sequence
  synthetic polynucleotide sequence
ccaccaaaccaaggaagggga

SEQ ID NO: 31268 - DNA, 20 bp, Artificial sequence
  synthetic polynucleotide sequence
tggcaggtaggaagtgcgca

SEQ ID NO: 31269 - DNA, 21 bp, Artificial sequence
  synthetic polynucleotide sequence
gctggaccagatcgacatcga

SEQ ID NO: 31270 - DNA, 20 bp, Artificial sequence
  synthetic polynucleotide sequence
ctgccggctgatgccgaaga

SEQ ID NO: 31271 - DNA, 20 bp, Artificial sequence
  synthetic polynucleotide sequence
ccgacctagccctctaacca

SEQ ID NO: 31272 - DNA, 20 bp, Artificial sequence
  synthetic polynucleotide sequence
ggagcagagtagccagagga

SEQ ID NO: 31273 - DNA, 22 bp, Artificial sequence
  synthetic polynucleotide sequence
agtatgaggtcgactatcgcca

SEQ ID NO: 31274 - DNA, 19 bp, Artificial sequence
  synthetic polynucleotide sequence
gcagtcagagagccgggga

SEQ ID NO: 31275 - DNA, 21 bp, Artificial sequence
  synthetic polynucleotide sequence
ccaaaaagcgggctgagacca

SEQ ID NO: 31276 - DNA, 22 bp, Artificial sequence
  synthetic polynucleotide sequence
gaatgaggaaggggctctcaga

SEQ ID NO: 31277 - DNA, 21 bp, Artificial sequence
  synthetic polynucleotide sequence
ctggaaagaccagcagctcca

SEQ ID NO: 31278 - DNA, 21 bp, Artificial sequence
  synthetic polynucleotide sequence
tcacagctgctgacaatggca

SEQ ID NO: 31279 - DNA, 22 bp, Artificial sequence
  synthetic polynucleotide sequence
atcgtggtcatcctggaaggca

SEQ ID NO: 31280 - DNA, 21 bp, Artificial sequence
  synthetic polynucleotide sequence
tcctcgaagagcacgggctca

SEQ ID NO: 31281 - DNA, 18 bp, Artificial sequence
  synthetic polynucleotide sequence
gccaagatggcaaagcca

SEQ ID NO: 31282 - DNA, 21 bp, Artificial sequence
  synthetic polynucleotide sequence
ctcgaacatgagcttccacca

SEQ ID NO: 31283 - DNA, 20 bp, Artificial sequence
  synthetic polynucleotide sequence
cacggcaacctgggcagcga

SEQ ID NO: 31284 - DNA, 20 bp, Artificial sequence
  synthetic polynucleotide sequence
aggccacggtgtaggtgaga

SEQ ID NO: 31285 - DNA, 21 bp, Artificial sequence
  synthetic polynucleotide sequence
caggctcagctgcatcaggaa

SEQ ID NO: 31286 - DNA, 21 bp, Artificial sequence
  synthetic polynucleotide sequence
tggtgtgaatcggtggcccca

SEQ ID NO: 31287 - DNA, 21 bp, Artificial sequence
  synthetic polynucleotide sequence
ctggaggacgggttctacgaa

SEQ ID NO: 31288 - DNA, 22 bp, Artificial sequence
  synthetic polynucleotide sequence
gatacagaccaactcaggggca

SEQ ID NO: 31289 - DNA, 20 bp, Artificial sequence
  synthetic polynucleotide sequence
caggctcacagaagggcaga

SEQ ID NO: 31290 - DNA, 18 bp, Artificial sequence
  synthetic polynucleotide sequence
accacctggatgcgcaca

SEQ ID NO: 31291 - DNA, 25 bp, Artificial sequence
  synthetic polynucleotide sequence
ggagtagctgagaggaagatgaaga

SEQ ID NO: 31292 - DNA, 25 bp, Artificial sequence
  synthetic polynucleotide sequence
cacacataaaaccccacccttcaca

SEQ ID NO: 31293 - DNA, 22 bp, Artificial sequence
  synthetic polynucleotide sequence
tccaccacaggttatggccaca

SEQ ID NO: 31294 - DNA, 19 bp, Artificial sequence
  synthetic polynucleotide sequence
gagaagacagcggccggga

SEQ ID NO: 31295 - DNA, 21 bp, Artificial sequence
  synthetic polynucleotide sequence
gagcatcaacaaccggcccaa

SEQ ID NO: 31296 - DNA, 20 bp, Artificial sequence
  synthetic polynucleotide sequence
gagtctggaggtggacccga

SEQ ID NO: 31297 - DNA, 20 bp, Artificial sequence
  synthetic polynucleotide sequence
gggctctaccgcctgggcaa

SEQ ID NO: 31298 - DNA, 20 bp, Artificial sequence
  synthetic polynucleotide sequence
gcgcagcatccagttgagca

SEQ ID NO: 31299 - DNA, 19 bp, Artificial sequence
  synthetic polynucleotide sequence
ccgggagcctccgcaagca

SEQ ID NO: 31300 - DNA, 20 bp, Artificial sequence
  synthetic polynucleotide sequence
caggccccccatccctggaa

SEQ ID NO: 31301 - DNA, 18 bp, Artificial sequence
  synthetic polynucleotide sequence
caccatcggcttcggcga

SEQ ID NO: 31302 - DNA, 18 bp, Artificial sequence
  synthetic polynucleotide sequence
aggttgaggaaggcgcca

SEQ ID NO: 31303 - DNA, 21 bp, Artificial sequence
  synthetic polynucleotide sequence
ctgtgtccaccatcaccacca

SEQ ID NO: 31304 - DNA, 21 bp, Artificial sequence
  synthetic polynucleotide sequence
gcaccacgaggttgagtggga

SEQ ID NO: 31305 - DNA, 21 bp, Artificial sequence
  synthetic polynucleotide sequence
ttctcacggacacaggcgaca

SEQ ID NO: 31306 - DNA, 22 bp, Artificial sequence
  synthetic polynucleotide sequence
tgaagagagatttggggcacca

SEQ ID NO: 31307 - DNA, 18 bp, Artificial sequence
  synthetic polynucleotide sequence
ggagtgccctggacgcca

SEQ ID NO: 31308 - DNA, 19 bp, Artificial sequence
  synthetic polynucleotide sequence
catgctcaggacagcagca

SEQ ID NO: 31309 - DNA, 20 bp, Artificial sequence
  synthetic polynucleotide sequence
cagcgcgcacactacggaca

SEQ ID NO: 31310 - DNA, 21 bp, Artificial sequence
  synthetic polynucleotide sequence
gctcttgtaccacaggcacga

SEQ ID NO: 31311 - DNA, 18 bp, Artificial sequence
  synthetic polynucleotide sequence
gcgcagatcacgtgcaca

SEQ ID NO: 31312 - DNA, 20 bp, Artificial sequence
  synthetic polynucleotide sequence
gtagatccagagctccacga

SEQ ID NO: 31313 - DNA, 19 bp, Artificial sequence
  synthetic polynucleotide sequence
cacggcctcacggagctca

SEQ ID NO: 31314 - DNA, 19 bp, Artificial sequence
  synthetic polynucleotide sequence
gtcggtgtgggagctggca

SEQ ID NO: 31315 - DNA, 20 bp, Artificial sequence
  synthetic polynucleotide sequence
tgcaggcagttgcactggga

SEQ ID NO: 31316 - DNA, 21 bp, Artificial sequence
  synthetic polynucleotide sequence
agcagaagtagacggccccca

SEQ ID NO: 31317 - DNA, 20 bp, Artificial sequence
  synthetic polynucleotide sequence
tacaaggcggacgtcccgga

SEQ ID NO: 31318 - DNA, 20 bp, Artificial sequence
  synthetic polynucleotide sequence
gcaagcttggcgctgaagga

SEQ ID NO: 31319 - DNA, 18 bp, Artificial sequence
  synthetic polynucleotide sequence
ctggggtcaacatcccca

SEQ ID NO: 31320 - DNA, 18 bp, Artificial sequence
  synthetic polynucleotide sequence
tccaggacactgacggca

SEQ ID NO: 31321 - DNA, 18 bp, Artificial sequence
  synthetic polynucleotide sequence
ctcgggggaacgaaacca

SEQ ID NO: 31322 - DNA, 19 bp, Artificial sequence
  synthetic polynucleotide sequence
ccgccaggatggacaggta

SEQ ID NO: 31323 - DNA, 25 bp, Artificial sequence
  synthetic polynucleotide sequence
tctgacccagaaggaaaccagaaga

SEQ ID NO: 31324 - DNA, 23 bp, Artificial sequence
  synthetic polynucleotide sequence
gttggccagaagagtgaatggaa

SEQ ID NO: 31325 - DNA, 19 bp, Artificial sequence
  synthetic polynucleotide sequence
ggagaggaccgagccgtga

SEQ ID NO: 31326 - DNA, 19 bp, Artificial sequence
  synthetic polynucleotide sequence
ccctgaccgtggcagtgca

SEQ ID NO: 31327 - DNA, 21 bp, Artificial sequence
  synthetic polynucleotide sequence
ccagctcctgaccaaccccaa

SEQ ID NO: 31328 - DNA, 22 bp, Artificial sequence
  synthetic polynucleotide sequence
aggaccacaatgagaacgccca

SEQ ID NO: 31329 - DNA, 21 bp, Artificial sequence
  synthetic polynucleotide sequence
tcggaagctggagctcaccaa

SEQ ID NO: 31330 - DNA, 20 bp, Artificial sequence
  synthetic polynucleotide sequence
gagccacgtctccctgagaa

SEQ ID NO: 31331 - DNA, 21 bp, Artificial sequence
  synthetic polynucleotide sequence
catcaggcagcagcagagaga

SEQ ID NO: 31332 - DNA, 20 bp, Artificial sequence
  synthetic polynucleotide sequence
ggtggtgctgtggaagagga

SEQ ID NO: 31333 - DNA, 18 bp, Artificial sequence
  synthetic polynucleotide sequence
ctcagctcaccaagcgga

SEQ ID NO: 31334 - DNA, 22 bp, Artificial sequence
  synthetic polynucleotide sequence
aactggtggatagcttggagga

SEQ ID NO: 31335 - DNA, 18 bp, Artificial sequence
  synthetic polynucleotide sequence
acgcttcctaccgcagca

SEQ ID NO: 31336 - DNA, 18 bp, Artificial sequence
  synthetic polynucleotide sequence
ccacgtcaccatagccga

SEQ ID NO: 31337 - DNA, 18 bp, Artificial sequence
  synthetic polynucleotide sequence
acagctgcgggaacacca

SEQ ID NO: 31338 - DNA, 18 bp, Artificial sequence
  synthetic polynucleotide sequence
gctcaatgacgtcccgca

SEQ ID NO: 31339 - DNA, 18 bp, Artificial sequence
  synthetic polynucleotide sequence
gcagcacaggcagaagca

SEQ ID NO: 31340 - DNA, 18 bp, Artificial sequence
  synthetic polynucleotide sequence
gcaggtctgtgcgcgaga

SEQ ID NO: 31341 - DNA, 20 bp, Artificial sequence
  synthetic polynucleotide sequence
aacgtatgtggagaggccca

SEQ ID NO: 31342 - DNA, 20 bp, Artificial sequence
  synthetic polynucleotide sequence
gttgaccgacatcagggaca

SEQ ID NO: 31343 - DNA, 21 bp, Artificial sequence
  synthetic polynucleotide sequence
ctgcaaactcgggtggaccaa

SEQ ID NO: 31344 - DNA, 21 bp, Artificial sequence
  synthetic polynucleotide sequence
agaagcccaacagcaggtcca

SEQ ID NO: 31345 - DNA, 20 bp, Artificial sequence
  synthetic polynucleotide sequence
gtgggtcccgaagagacaga

SEQ ID NO: 31346 - DNA, 18 bp, Artificial sequence
  synthetic polynucleotide sequence
tgaggcaagctgagggca

SEQ ID NO: 31347 - DNA, 22 bp, Artificial sequence
  synthetic polynucleotide sequence
aaacccatacctgctacagcca

SEQ ID NO: 31348 - DNA, 21 bp, Artificial sequence
  synthetic polynucleotide sequence
gtaaggtcatctgaggaggga

SEQ ID NO: 31349 - DNA, 21 bp, Artificial sequence
  synthetic polynucleotide sequence
tggtagcactccccatcacca

SEQ ID NO: 31350 - DNA, 21 bp, Artificial sequence
  synthetic polynucleotide sequence
tgtctccagagatgcctccga

SEQ ID NO: 31351 - DNA, 21 bp, Artificial sequence
  synthetic polynucleotide sequence
caacgacgcctccaagttcga

SEQ ID NO: 31352 - DNA, 21 bp, Artificial sequence
  synthetic polynucleotide sequence
ccatcaccaccaggatggaca

SEQ ID NO: 31353 - DNA, 21 bp, Artificial sequence
  synthetic polynucleotide sequence
acatgggcaaggtggtccaga

SEQ ID NO: 31354 - DNA, 22 bp, Artificial sequence
  synthetic polynucleotide sequence
aatgcccacagagaggaagaga

SEQ ID NO: 31355 - DNA, 20 bp, Artificial sequence
  synthetic polynucleotide sequence
cgagatgaacgaccaccaga

SEQ ID NO: 31356 - DNA, 18 bp, Artificial sequence
  synthetic polynucleotide sequence
cggggttgcaggacgaca

SEQ ID NO: 31357 - DNA, 21 bp, Artificial sequence
  synthetic polynucleotide sequence
actcaccccgccaacatgaga

SEQ ID NO: 31358 - DNA, 22 bp, Artificial sequence
  synthetic polynucleotide sequence
tgtagtgtccagtcccaacaga

SEQ ID NO: 31359 - DNA, 20 bp, Artificial sequence
  synthetic polynucleotide sequence
gtgatcacccggccagccaa

SEQ ID NO: 31360 - DNA, 25 bp, Artificial sequence
  synthetic polynucleotide sequence
gctgaagggtatggcacaaaacaca

SEQ ID NO: 31361 - DNA, 19 bp, Artificial sequence
  synthetic polynucleotide sequence
taagctggctggacctgca

SEQ ID NO: 31362 - DNA, 20 bp, Artificial sequence
  synthetic polynucleotide sequence
gaagcgacacctgtcccgca

SEQ ID NO: 31363 - DNA, 21 bp, Artificial sequence
  synthetic polynucleotide sequence
ccatcctggagcacgtggaga

SEQ ID NO: 31364 - DNA, 21 bp, Artificial sequence
  synthetic polynucleotide sequence
tgaggatgcggaagatgcgca

SEQ ID NO: 31365 - DNA, 21 bp, Artificial sequence
  synthetic polynucleotide sequence
taagggttcatcaggccagga

SEQ ID NO: 31366 - DNA, 20 bp, Artificial sequence
  synthetic polynucleotide sequence
caggctccagtgtccaggca

SEQ ID NO: 31367 - DNA, 21 bp, Artificial sequence
  synthetic polynucleotide sequence
actcagtccaggtcctcgaga

SEQ ID NO: 31368 - DNA, 18 bp, Artificial sequence
  synthetic polynucleotide sequence
cgcctcagttcccgccga

SEQ ID NO: 31369 - DNA, 19 bp, Artificial sequence
  synthetic polynucleotide sequence
tgctgtatgaggcccagga

SEQ ID NO: 31370 - DNA, 18 bp, Artificial sequence
  synthetic polynucleotide sequence
tcctccgcacgcgctcga

SEQ ID NO: 31371 - DNA, 20 bp, Artificial sequence
  synthetic polynucleotide sequence
gacgcgctgcgggaactgga

SEQ ID NO: 31372 - DNA, 20 bp, Artificial sequence
  synthetic polynucleotide sequence
ccggcgagcagagaagtgca

SEQ ID NO: 31373 - DNA, 20 bp, Artificial sequence
  synthetic polynucleotide sequence
ctaccgcggctcctacacca

SEQ ID NO: 31374 - DNA, 21 bp, Artificial sequence
  synthetic polynucleotide sequence
ccccaaacacctccttggcca

SEQ ID NO: 31375 - DNA, 21 bp, Artificial sequence
  synthetic polynucleotide sequence
tgaagctcctgcacaaccgca

SEQ ID NO: 31376 - DNA, 22 bp, Artificial sequence
  synthetic polynucleotide sequence
catagacaatggaggtgcagca

SEQ ID NO: 31377 - DNA, 21 bp, Artificial sequence
  synthetic polynucleotide sequence
tgagcaggtgtctcggaagca

SEQ ID NO: 31378 - DNA, 20 bp, Artificial sequence
  synthetic polynucleotide sequence
ctcagtttccaccaggcaca

SEQ ID NO: 31379 - DNA, 19 bp, Artificial sequence
  synthetic polynucleotide sequence
ggtcttccccgagaccgga

SEQ ID NO: 31380 - DNA, 20 bp, Artificial sequence
  synthetic polynucleotide sequence
agttgagccggcagtagcca

SEQ ID NO: 31381 - DNA, 20 bp, Artificial sequence
  synthetic polynucleotide sequence
gaccctgatcgagccccaga

SEQ ID NO: 31382 - DNA, 21 bp, Artificial sequence
  synthetic polynucleotide sequence
agttacaggccaccatgtgga

SEQ ID NO: 31383 - DNA, 19 bp, Artificial sequence
  synthetic polynucleotide sequence
cccaggtcccacccaagca

SEQ ID NO: 31384 - DNA, 21 bp, Artificial sequence
  synthetic polynucleotide sequence
cgtagttgtaggaggagccga

SEQ ID NO: 31385 - DNA, 21 bp, Artificial sequence
  synthetic polynucleotide sequence
cgacaagaagcctacacccca

SEQ ID NO: 31386 - DNA, 19 bp, Artificial sequence
  synthetic polynucleotide sequence
cgggaagcggcttgaggga

SEQ ID NO: 31387 - DNA, 19 bp, Artificial sequence
  synthetic polynucleotide sequence
cacccacagccagtcccca

SEQ ID NO: 31388 - DNA, 22 bp, Artificial sequence
  synthetic polynucleotide sequence
tgatgatgtcagccaggaagca

SEQ ID NO: 31389 - DNA, 22 bp, Artificial sequence
  synthetic polynucleotide sequence
acaaggatgagacaggagccta

SEQ ID NO: 31390 - DNA, 21 bp, Artificial sequence
  synthetic polynucleotide sequence
aactccgcttcctccagcaca

SEQ ID NO: 31391 - DNA, 19 bp, Artificial sequence
  synthetic polynucleotide sequence
ggcggccggtctgaagtca

SEQ ID NO: 31392 - DNA, 22 bp, Artificial sequence
  synthetic polynucleotide sequence
acatcatctccagcagctacca

SEQ ID NO: 31393 - DNA, 22 bp, Artificial sequence
  synthetic polynucleotide sequence
tccaaggccgagaagaatgcca

SEQ ID NO: 31394 - DNA, 22 bp, Artificial sequence
  synthetic polynucleotide sequence
atgttggcgttgaagacctcca

SEQ ID NO: 31395 - DNA, 22 bp, Artificial sequence
  synthetic polynucleotide sequence
aggaggatttgaagggggagga

SEQ ID NO: 31396 - DNA, 19 bp, Artificial sequence
  synthetic polynucleotide sequence
tgtaggagatggggacgca

SEQ ID NO: 31397 - DNA, 20 bp, Artificial sequence
  synthetic polynucleotide sequence
gtgtccaaaagcaggctgga

SEQ ID NO: 31398 - DNA, 21 bp, Artificial sequence
  synthetic polynucleotide sequence
aacaatccaggctggtcagca

SEQ ID NO: 31399 - DNA, 21 bp, Artificial sequence
  synthetic polynucleotide sequence
tgagacacggcaagctggtga

SEQ ID NO: 31400 - DNA, 20 bp, Artificial sequence
  synthetic polynucleotide sequence
cagccgtcggacatggtgga

SEQ ID NO: 31401 - DNA, 21 bp, Artificial sequence
  synthetic polynucleotide sequence
gatggacaccagagactgcca

SEQ ID NO: 31402 - DNA, 18 bp, Artificial sequence
  synthetic polynucleotide sequence
gcacccgggtgttgcgga

SEQ ID NO: 31403 - DNA, 21 bp, Artificial sequence
  synthetic polynucleotide sequence
acttggagcggattgtggaga

SEQ ID NO: 31404 - DNA, 21 bp, Artificial sequence
  synthetic polynucleotide sequence
tctcactccgctcaaatcgca

SEQ ID NO: 31405 - DNA, 18 bp, Artificial sequence
  synthetic polynucleotide sequence
gctcaacgagagccgcga

SEQ ID NO: 31406 - DNA, 19 bp, Artificial sequence
  synthetic polynucleotide sequence
cccgaggagttacacgcca

SEQ ID NO: 31407 - DNA, 21 bp, Artificial sequence
  synthetic polynucleotide sequence
tggccagcagtaaactcggca

SEQ ID NO: 31408 - DNA, 19 bp, Artificial sequence
  synthetic polynucleotide sequence
tgtaaagtaccgccctcca

SEQ ID NO: 31409 - DNA, 21 bp, Artificial sequence
  synthetic polynucleotide sequence
cagccgcaaagagagactcga

SEQ ID NO: 31410 - DNA, 21 bp, Artificial sequence
  synthetic polynucleotide sequence
ggcaggcgataagctgctaca

SEQ ID NO: 31411 - DNA, 21 bp, Artificial sequence
  synthetic polynucleotide sequence
gtagagacagccgagaggaga

SEQ ID NO: 31412 - DNA, 18 bp, Artificial sequence
  synthetic polynucleotide sequence
ccagactgtcgcccagca

SEQ ID NO: 31413 - DNA, 20 bp, Artificial sequence
  synthetic polynucleotide sequence
gcggagaccatcaccagcca

SEQ ID NO: 31414 - DNA, 21 bp, Artificial sequence
  synthetic polynucleotide sequence
agtagaggactgtctggacca

SEQ ID NO: 31415 - DNA, 20 bp, Artificial sequence
  synthetic polynucleotide sequence
ggaggccgagaccatcacca

SEQ ID NO: 31416 - DNA, 20 bp, Artificial sequence
  synthetic polynucleotide sequence
ggtctggactacgccggcca

SEQ ID NO: 31417 - DNA, 20 bp, Artificial sequence
  synthetic polynucleotide sequence
catctctgggaagagccaga

SEQ ID NO: 31418 - DNA, 18 bp, Artificial sequence
  synthetic polynucleotide sequence
ggccaatgactgggacca

SEQ ID NO: 31419 - DNA, 21 bp, Artificial sequence
  synthetic polynucleotide sequence
ctaccacctggatgagcagga

SEQ ID NO: 31420 - DNA, 20 bp, Artificial sequence
  synthetic polynucleotide sequence
cgagttgaacgaccctccga

SEQ ID NO: 31421 - DNA, 18 bp, Artificial sequence
  synthetic polynucleotide sequence
ctgaagcagcagccacca

SEQ ID NO: 31422 - DNA, 18 bp, Artificial sequence
  synthetic polynucleotide sequence
ggatcccagaacacccga

SEQ ID NO: 31423 - DNA, 22 bp, Artificial sequence
  synthetic polynucleotide sequence
agcacagacccatggatccaga

SEQ ID NO: 31424 - DNA, 19 bp, Artificial sequence
  synthetic polynucleotide sequence
ttgttgcctcaccagcgaa

SEQ ID NO: 31425 - DNA, 21 bp, Artificial sequence
  synthetic polynucleotide sequence
ctcgtcaataggctgccagga

SEQ ID NO: 31426 - DNA, 20 bp, Artificial sequence
  synthetic polynucleotide sequence
atcagccggtggagtaagca

SEQ ID NO: 31427 - DNA, 20 bp, Artificial sequence
  synthetic polynucleotide sequence
caggccaggtcagatggaca

SEQ ID NO: 31428 - DNA, 18 bp, Artificial sequence
  synthetic polynucleotide sequence
gatgatgagccgcaggga

SEQ ID NO: 31429 - DNA, 22 bp, Artificial sequence
  synthetic polynucleotide sequence
aagaggcctcaaggactaacca

SEQ ID NO: 31430 - DNA, 19 bp, Artificial sequence
  synthetic polynucleotide sequence
gggtcttgcaagcacagca

SEQ ID NO: 31431 - DNA, 18 bp, Artificial sequence
  synthetic polynucleotide sequence
ggccaatgttggggacca

SEQ ID NO: 31432 - DNA, 18 bp, Artificial sequence
  synthetic polynucleotide sequence
tctcccgtacaccacgca

SEQ ID NO: 31433 - DNA, 18 bp, Artificial sequence
  synthetic polynucleotide sequence
gtccggtggatgtgagca

SEQ ID NO: 31434 - DNA, 18 bp, Artificial sequence
  synthetic polynucleotide sequence
tgcatcatcacaccggca

SEQ ID NO: 31435 - DNA, 21 bp, Artificial sequence
  synthetic polynucleotide sequence
cgacgatggctcctacagcga

SEQ ID NO: 31436 - DNA, 20 bp, Artificial sequence
  synthetic polynucleotide sequence
gtcagtccaccggagctcca

SEQ ID NO: 31437 - DNA, 19 bp, Artificial sequence
  synthetic polynucleotide sequence
ggtcacagggcagtcagga

SEQ ID NO: 31438 - DNA, 19 bp, Artificial sequence
  synthetic polynucleotide sequence
tccagtacttgcgctccaa

SEQ ID NO: 31439 - DNA, 21 bp, Artificial sequence
  synthetic polynucleotide sequence
tgctcttcactcccacgccga

SEQ ID NO: 31440 - DNA, 20 bp, Artificial sequence
  synthetic polynucleotide sequence
tctggagggtcagctcctga

SEQ ID NO: 31441 - DNA, 20 bp, Artificial sequence
  synthetic polynucleotide sequence
taccctggggatgtcagcca

SEQ ID NO: 31442 - DNA, 22 bp, Artificial sequence
  synthetic polynucleotide sequence
acaacaaccatgaccacgacca

SEQ ID NO: 31443 - DNA, 20 bp, Artificial sequence
  synthetic polynucleotide sequence
cggcaggctctagccacaga

SEQ ID NO: 31444 - DNA, 18 bp, Artificial sequence
  synthetic polynucleotide sequence
gagccgcctgttccacca

SEQ ID NO: 31445 - DNA, 21 bp, Artificial sequence
  synthetic polynucleotide sequence
gctcaccagtgagacccagca

SEQ ID NO: 31446 - DNA, 19 bp, Artificial sequence
  synthetic polynucleotide sequence
tcccaccgctcactggaga

SEQ ID NO: 31447 - DNA, 18 bp, Artificial sequence
  synthetic polynucleotide sequence
gccctcacttgcagcaga

SEQ ID NO: 31448 - DNA, 18 bp, Artificial sequence
  synthetic polynucleotide sequence
gtgcggacaactggcaca

SEQ ID NO: 31449 - DNA, 21 bp, Artificial sequence
  synthetic polynucleotide sequence
acaggccaaacccagaccaga

SEQ ID NO: 31450 - DNA, 21 bp, Artificial sequence
  synthetic polynucleotide sequence
atcatgagctcctccagggga

SEQ ID NO: 31451 - DNA, 20 bp, Artificial sequence
  synthetic polynucleotide sequence
gtccacctccaagaccacca

SEQ ID NO: 31452 - DNA, 18 bp, Artificial sequence
  synthetic polynucleotide sequence
agagctccagcaaggcca

SEQ ID NO: 31453 - DNA, 18 bp, Artificial sequence
  synthetic polynucleotide sequence
gggtaacatccacgggca

SEQ ID NO: 31454 - DNA, 18 bp, Artificial sequence
  synthetic polynucleotide sequence
ctcgtgcaccgcgaacca

SEQ ID NO: 31455 - DNA, 18 bp, Artificial sequence
  synthetic polynucleotide sequence
gaggcaggcagacagcaa

SEQ ID NO: 31456 - DNA, 21 bp, Artificial sequence
  synthetic polynucleotide sequence
ctatatcagggacctccacca

SEQ ID NO: 31457 - DNA, 18 bp, Artificial sequence
  synthetic polynucleotide sequence
agatcgctggctgccgaa

SEQ ID NO: 31458 - DNA, 18 bp, Artificial sequence
  synthetic polynucleotide sequence
ggctgcagtagtcgggga

SEQ ID NO: 31459 - DNA, 19 bp, Artificial sequence
  synthetic polynucleotide sequence
gagcccagtcagagaccca

SEQ ID NO: 31460 - DNA, 22 bp, Artificial sequence
  synthetic polynucleotide sequence
ggaaacaggtgaggtaggcaga

SEQ ID NO: 31461 - DNA, 20 bp, Artificial sequence
  synthetic polynucleotide sequence
acccaccagacacagacaca

SEQ ID NO: 31462 - DNA, 20 bp, Artificial sequence
  synthetic polynucleotide sequence
gttactggagccatcccaca

SEQ ID NO: 31463 - DNA, 18 bp, Artificial sequence
  synthetic polynucleotide sequence
ccatgaagcaccggcgaa

SEQ ID NO: 31464 - DNA, 18 bp, Artificial sequence
  synthetic polynucleotide sequence
gctccatggtgacagcca

SEQ ID NO: 31465 - DNA, 20 bp, Artificial sequence
  synthetic polynucleotide sequence
aagaggctgttacggcacca

SEQ ID NO: 31466 - DNA, 18 bp, Artificial sequence
  synthetic polynucleotide sequence
caccacgtgcacagcgga

SEQ ID NO: 31467 - DNA, 22 bp, Artificial sequence
  synthetic polynucleotide sequence
aggttccccgaatcagtgctca

SEQ ID NO: 31468 - DNA, 21 bp, Artificial sequence
  synthetic polynucleotide sequence
tcgttctgcaggcagcatgga

SEQ ID NO: 31469 - DNA, 21 bp, Artificial sequence
  synthetic polynucleotide sequence
atcatgctcgaggcctggaga

SEQ ID NO: 31470 - DNA, 20 bp, Artificial sequence
  synthetic polynucleotide sequence
tatcctgggagccaaagaca

SEQ ID NO: 31471 - DNA, 20 bp, Artificial sequence
  synthetic polynucleotide sequence
cattgcgtggggagccagga

SEQ ID NO: 31472 - DNA, 20 bp, Artificial sequence
  synthetic polynucleotide sequence
tacggtggcaggctaacgga

SEQ ID NO: 31473 - DNA, 20 bp, Artificial sequence
  synthetic polynucleotide sequence
actcagaaggccgagaccca

SEQ ID NO: 31474 - DNA, 20 bp, Artificial sequence
  synthetic polynucleotide sequence
cggagaaccctgtgtcccga

SEQ ID NO: 31475 - DNA, 21 bp, Artificial sequence
  synthetic polynucleotide sequence
ccagcaccaagagcacggaca

SEQ ID NO: 31476 - DNA, 22 bp, Artificial sequence
  synthetic polynucleotide sequence
atcttgaacctccccatgtcca

SEQ ID NO: 31477 - DNA, 18 bp, Artificial sequence
  synthetic polynucleotide sequence
cccccaccacctggacga

SEQ ID NO: 31478 - DNA, 18 bp, Artificial sequence
  synthetic polynucleotide sequence
gggctcgaggggtaggga

SEQ ID NO: 31479 - DNA, 20 bp, Artificial sequence
  synthetic polynucleotide sequence
gaggagttacagcccggcca

SEQ ID NO: 31480 - DNA, 20 bp, Artificial sequence
  synthetic polynucleotide sequence
tctgtacccagttgggggga

SEQ ID NO: 31481 - DNA, 21 bp, Artificial sequence
  synthetic polynucleotide sequence
agacgcacacaacaccaggca

SEQ ID NO: 31482 - DNA, 21 bp, Artificial sequence
  synthetic polynucleotide sequence
cacgaccatacaagcccctca

SEQ ID NO: 31483 - DNA, 18 bp, Artificial sequence
  synthetic polynucleotide sequence
gcggctccacaatgggaa

SEQ ID NO: 31484 - DNA, 18 bp, Artificial sequence
  synthetic polynucleotide sequence
gtcaccccggtctccaca

SEQ ID NO: 31485 - DNA, 19 bp, Artificial sequence
  synthetic polynucleotide sequence
tcgtagagatctcccggca

SEQ ID NO: 31486 - DNA, 18 bp, Artificial sequence
  synthetic polynucleotide sequence
gcctggtccaactgggca

SEQ ID NO: 31487 - DNA, 19 bp, Artificial sequence
  synthetic polynucleotide sequence
gacccaggcatgcctccca

SEQ ID NO: 31488 - DNA, 22 bp, Artificial sequence
  synthetic polynucleotide sequence
atgtgcacacacttgggaacca

SEQ ID NO: 31489 - DNA, 18 bp, Artificial sequence
  synthetic polynucleotide sequence
tgggaagggtgtggcaca

SEQ ID NO: 31490 - DNA, 20 bp, Artificial sequence
  synthetic polynucleotide sequence
gtactccagacagggcagca

SEQ ID NO: 31491 - DNA, 21 bp, Artificial sequence
  synthetic polynucleotide sequence
aggaacctcacgcctaccaca

SEQ ID NO: 31492 - DNA, 18 bp, Artificial sequence
  synthetic polynucleotide sequence
gggtaggggtgtggggga

SEQ ID NO: 31493 - DNA, 21 bp, Artificial sequence
  synthetic polynucleotide sequence
tgtgggagggacagaaagaga

SEQ ID NO: 31494 - DNA, 21 bp, Artificial sequence
  synthetic polynucleotide sequence
actaggtggtacgactgccca

SEQ ID NO: 31495 - DNA, 18 bp, Artificial sequence
  synthetic polynucleotide sequence
ctgctgaagtggcccgaa

SEQ ID NO: 31496 - DNA, 18 bp, Artificial sequence
  synthetic polynucleotide sequence
agggggtcgcagtgacca

SEQ ID NO: 31497 - DNA, 20 bp, Artificial sequence
  synthetic polynucleotide sequence
aaacgagcctccccaccaga

SEQ ID NO: 31498 - DNA, 20 bp, Artificial sequence
  synthetic polynucleotide sequence
tcacagtggccatggtcgga

SEQ ID NO: 31499 - DNA, 19 bp, Artificial sequence
  synthetic polynucleotide sequence
ggtcgggtgctcagggaga

SEQ ID NO: 31500 - DNA, 20 bp, Artificial sequence
  synthetic polynucleotide sequence
gaggagaggtggtgagggca

SEQ ID NO: 31501 - DNA, 21 bp, Artificial sequence
  synthetic polynucleotide sequence
tggaccgaagtgtggcaggaa

SEQ ID NO: 31502 - DNA, 19 bp, Artificial sequence
  synthetic polynucleotide sequence
ccagccaggccttgcagca

SEQ ID NO: 31503 - DNA, 21 bp, Artificial sequence
  synthetic polynucleotide sequence
gtggagtcgggatgagatgga

SEQ ID NO: 31504 - DNA, 21 bp, Artificial sequence
  synthetic polynucleotide sequence
ggtcttggcatcaggcagaca

SEQ ID NO: 31505 - DNA, 21 bp, Artificial sequence
  synthetic polynucleotide sequence
aggtcagctgatcccaggtca

SEQ ID NO: 31506 - DNA, 20 bp, Artificial sequence
  synthetic polynucleotide sequence
cttcctgtcccccccacaca

SEQ ID NO: 31507 - DNA, 21 bp, Artificial sequence
  synthetic polynucleotide sequence
gaatcgcacacagcctcggaa

SEQ ID NO: 31508 - DNA, 19 bp, Artificial sequence
  synthetic polynucleotide sequence
gaggggacaggcgcacaca

SEQ ID NO: 31509 - DNA, 21 bp, Artificial sequence
  synthetic polynucleotide sequence
ggaggacttggatcaggagga

SEQ ID NO: 31510 - DNA, 22 bp, Artificial sequence
  synthetic polynucleotide sequence
tgatgacactcgaacagcacca

SEQ ID NO: 31511 - DNA, 19 bp, Artificial sequence
  synthetic polynucleotide sequence
gggtgaacaggacccagga

SEQ ID NO: 31512 - DNA, 18 bp, Artificial sequence
  synthetic polynucleotide sequence
cttcacgcctcggaagga

SEQ ID NO: 31513 - DNA, 21 bp, Artificial sequence
  synthetic polynucleotide sequence
gatggagacctgccactggaa

SEQ ID NO: 31514 - DNA, 21 bp, Artificial sequence
  synthetic polynucleotide sequence
acctggcatctgtgaggggga

SEQ ID NO: 31515 - DNA, 23 bp, Artificial sequence
  synthetic polynucleotide sequence
gtaaaagcagagtgcagcagaca

SEQ ID NO: 31516 - DNA, 19 bp, Artificial sequence
  synthetic polynucleotide sequence
taggagacgctggtgggga

SEQ ID NO: 31517 - DNA, 20 bp, Artificial sequence
  synthetic polynucleotide sequence
ctgctcaggggttagaggga

SEQ ID NO: 31518 - DNA, 18 bp, Artificial sequence
  synthetic polynucleotide sequence
tgcagccagcccttcaga

SEQ ID NO: 31519 - DNA, 20 bp, Artificial sequence
  synthetic polynucleotide sequence
ggacctctcctgccacagca

SEQ ID NO: 31520 - DNA, 25 bp, Artificial sequence
  synthetic polynucleotide sequence
gagacgtcctagagaggaaatggaa

SEQ ID NO: 31521 - DNA, 21 bp, Artificial sequence
  synthetic polynucleotide sequence
caacctccagcagccatggaa

SEQ ID NO: 31522 - DNA, 22 bp, Artificial sequence
  synthetic polynucleotide sequence
aacagtgtagtagaggagggca

SEQ ID NO: 31523 - DNA, 19 bp, Artificial sequence
  synthetic polynucleotide sequence
gctacgtgcaggacgccga

SEQ ID NO: 31524 - DNA, 20 bp, Artificial sequence
  synthetic polynucleotide sequence
ctcataggacaccttgccca

SEQ ID NO: 31525 - DNA, 18 bp, Artificial sequence
  synthetic polynucleotide sequence
ccccctcctcagcagcca

SEQ ID NO: 31526 - DNA, 19 bp, Artificial sequence
  synthetic polynucleotide sequence
tggcacaggtgggactcca

SEQ ID NO: 31527 - DNA, 19 bp, Artificial sequence
  synthetic polynucleotide sequence
ccgccctacctcacaagca

SEQ ID NO: 31528 - DNA, 18 bp, Artificial sequence
  synthetic polynucleotide sequence
ggggttgatggggcagca

SEQ ID NO: 31529 - DNA, 21 bp, Artificial sequence
  synthetic polynucleotide sequence
actgaagaggactccagccca

SEQ ID NO: 31530 - DNA, 20 bp, Artificial sequence
  synthetic polynucleotide sequence
cctcttgagggatggggaga

SEQ ID NO: 31531 - DNA, 20 bp, Artificial sequence
  synthetic polynucleotide sequence
tggactgcaaggactgccca

SEQ ID NO: 31532 - DNA, 20 bp, Artificial sequence
  synthetic polynucleotide sequence
cagggcctgcaacctgtcca

SEQ ID NO: 31533 - DNA, 23 bp, Artificial sequence
  synthetic polynucleotide sequence
ccagagagccatgaaactccaga

SEQ ID NO: 31534 - DNA, 22 bp, Artificial sequence
  synthetic polynucleotide sequence
ctctcgctgatgcagaacacca

SEQ ID NO: 31535 - DNA, 21 bp, Artificial sequence
  synthetic polynucleotide sequence
cagacctgaccagttccagca

SEQ ID NO: 31536 - DNA, 20 bp, Artificial sequence
  synthetic polynucleotide sequence
ctgatccaggtgtgaggcca

SEQ ID NO: 31537 - DNA, 22 bp, Artificial sequence
  synthetic polynucleotide sequence
gcaagcggaaccaggtatcgta

SEQ ID NO: 31538 - DNA, 20 bp, Artificial sequence
  synthetic polynucleotide sequence
catctgggggctgaggctga

SEQ ID NO: 31539 - DNA, 22 bp, Artificial sequence
  synthetic polynucleotide sequence
atcaacagtgctgacagggaga

SEQ ID NO: 31540 - DNA, 19 bp, Artificial sequence
  synthetic polynucleotide sequence
tgactggcagacacctcca

SEQ ID NO: 31541 - DNA, 20 bp, Artificial sequence
  synthetic polynucleotide sequence
cgcgactggttccagggaca

SEQ ID NO: 31542 - DNA, 20 bp, Artificial sequence
  synthetic polynucleotide sequence
aggtcgtagccccacacaga

SEQ ID NO: 31543 - DNA, 20 bp, Artificial sequence
  synthetic polynucleotide sequence
ccagtccaccccaagcacca

SEQ ID NO: 31544 - DNA, 20 bp, Artificial sequence
  synthetic polynucleotide sequence
atccccacttccagagtcca

SEQ ID NO: 31545 - DNA, 21 bp, Artificial sequence
  synthetic polynucleotide sequence
ggaggcctgaagacccacaga

SEQ ID NO: 31546 - DNA, 21 bp, Artificial sequence
  synthetic polynucleotide sequence
agaactggcagaaacagggga

SEQ ID NO: 31547 - DNA, 21 bp, Artificial sequence
  synthetic polynucleotide sequence
accagtcagaccccaccagca

SEQ ID NO: 31548 - DNA, 20 bp, Artificial sequence
  synthetic polynucleotide sequence
caggcagaggtggggaagca

SEQ ID NO: 31549 - DNA, 19 bp, Artificial sequence
  synthetic polynucleotide sequence
gcttcacgctcccgcacca

SEQ ID NO: 31550 - DNA, 19 bp, Artificial sequence
  synthetic polynucleotide sequence
ggtgatccagggtggcgca

SEQ ID NO: 31551 - DNA, 20 bp, Artificial sequence
  synthetic polynucleotide sequence
gggagatgccccagtggaca

SEQ ID NO: 31552 - DNA, 20 bp, Artificial sequence
  synthetic polynucleotide sequence
ttcgacgaggaggtggcgga

SEQ ID NO: 31553 - DNA, 20 bp, Artificial sequence
  synthetic polynucleotide sequence
ctgggtgtcgtgggagcaga

SEQ ID NO: 31554 - DNA, 21 bp, Artificial sequence
  synthetic polynucleotide sequence
acgtcgtctgtgaagccggca

SEQ ID NO: 31555 - DNA, 18 bp, Artificial sequence
  synthetic polynucleotide sequence
gcagtcggtgatggcaga

SEQ ID NO: 31556 - DNA, 18 bp, Artificial sequence
  synthetic polynucleotide sequence
ggtcctctggaaggccca

SEQ ID NO: 31557 - DNA, 19 bp, Artificial sequence
  synthetic polynucleotide sequence
tcccagttccaacaagcca

SEQ ID NO: 31558 - DNA, 21 bp, Artificial sequence
  synthetic polynucleotide sequence
atgctccgtacacagagggca

SEQ ID NO: 31559 - DNA, 19 bp, Artificial sequence
  synthetic polynucleotide sequence
tgtcaccacagcctcacca

SEQ ID NO: 31560 - DNA, 20 bp, Artificial sequence
  synthetic polynucleotide sequence
ctctggagggatagcgctga

SEQ ID NO: 31561 - DNA, 22 bp, Artificial sequence
  synthetic polynucleotide sequence
caaaacaagactcccttggcca

SEQ ID NO: 31562 - DNA, 21 bp, Artificial sequence
  synthetic polynucleotide sequence
tgtaactccttgagccccaca

SEQ ID NO: 31563 - DNA, 20 bp, Artificial sequence
  synthetic polynucleotide sequence
ctgtgggccactggtagaga

SEQ ID NO: 31564 - DNA, 21 bp, Artificial sequence
  synthetic polynucleotide sequence
cgggaactaagaccctggcca

SEQ ID NO: 31565 - DNA, 20 bp, Artificial sequence
  synthetic polynucleotide sequence
cggagagcgggacagaacca

SEQ ID NO: 31566 - DNA, 20 bp, Artificial sequence
  synthetic polynucleotide sequence
atcagtggacaccctgggga

SEQ ID NO: 31567 - DNA, 20 bp, Artificial sequence
  synthetic polynucleotide sequence
aagaggccagatgatgagca

SEQ ID NO: 31568 - DNA, 22 bp, Artificial sequence
  synthetic polynucleotide sequence
gaaagaaccaaggagctacgga

SEQ ID NO: 31569 - DNA, 21 bp, Artificial sequence
  synthetic polynucleotide sequence
cagtggatgagcaccaggaca

SEQ ID NO: 31570 - DNA, 20 bp, Artificial sequence
  synthetic polynucleotide sequence
tgtctccatggtcccagcca

SEQ ID NO: 31571 - DNA, 19 bp, Artificial sequence
  synthetic polynucleotide sequence
gcgccactctgggaagcca

SEQ ID NO: 31572 - DNA, 22 bp, Artificial sequence
  synthetic polynucleotide sequence
atcagccgaggaacagttagca

SEQ ID NO: 31573 - DNA, 18 bp, Artificial sequence
  synthetic polynucleotide sequence
gcagggcacagatgcaga

SEQ ID NO: 31574 - DNA, 18 bp, Artificial sequence
  synthetic polynucleotide sequence
ctcagcgtcggcaggaca

SEQ ID NO: 31575 - DNA, 21 bp, Artificial sequence
  synthetic polynucleotide sequence
aggagccaggagtcatcggca

SEQ ID NO: 31576 - DNA, 20 bp, Artificial sequence
  synthetic polynucleotide sequence
gctcgtctccactgcaggga

SEQ ID NO: 31577 - DNA, 19 bp, Artificial sequence
  synthetic polynucleotide sequence
ccagtgtgacctgcaggca

SEQ ID NO: 31578 - DNA, 19 bp, Artificial sequence
  synthetic polynucleotide sequence
cccaatgcacagcagtgga

SEQ ID NO: 31579 - DNA, 21 bp, Artificial sequence
  synthetic polynucleotide sequence
agctggccctgaggcatctga

SEQ ID NO: 31580 - DNA, 22 bp, Artificial sequence
  synthetic polynucleotide sequence
tcatcaccacagaccagatcga

SEQ ID NO: 31581 - DNA, 20 bp, Artificial sequence
  synthetic polynucleotide sequence
agggaagcctgcagaggaca

SEQ ID NO: 31582 - DNA, 20 bp, Artificial sequence
  synthetic polynucleotide sequence
tccacactgtagctgcggga

SEQ ID NO: 31583 - DNA, 22 bp, Artificial sequence
  synthetic polynucleotide sequence
agctccgagggttacatgcaca

SEQ ID NO: 31584 - DNA, 18 bp, Artificial sequence
  synthetic polynucleotide sequence
ggatgccccaccgtgcca

SEQ ID NO: 31585 - DNA, 20 bp, Artificial sequence
  synthetic polynucleotide sequence
ccccctgccaacatccgaga

SEQ ID NO: 31586 - DNA, 21 bp, Artificial sequence
  synthetic polynucleotide sequence
tccagtccctgactcccacca

SEQ ID NO: 31587 - DNA, 20 bp, Artificial sequence
  synthetic polynucleotide sequence
gcgctcttgggaccagcaga

SEQ ID NO: 31588 - DNA, 20 bp, Artificial sequence
  synthetic polynucleotide sequence
cccacgaagtccccactgca

SEQ ID NO: 31589 - DNA, 20 bp, Artificial sequence
  synthetic polynucleotide sequence
tgcagaggctgaagacggca

SEQ ID NO: 31590 - DNA, 20 bp, Artificial sequence
  synthetic polynucleotide sequence
ctgaggagaagctgccccca

SEQ ID NO: 31591 - DNA, 21 bp, Artificial sequence
  synthetic polynucleotide sequence
tgatcaaggtgaaggcggaga

SEQ ID NO: 31592 - DNA, 21 bp, Artificial sequence
  synthetic polynucleotide sequence
tcatcacagaggccaacccca

SEQ ID NO: 31593 - DNA, 21 bp, Artificial sequence
  synthetic polynucleotide sequence
atgagcattcccggggacaca

SEQ ID NO: 31594 - DNA, 21 bp, Artificial sequence
  synthetic polynucleotide sequence
caattccccgaagagagcgca

SEQ ID NO: 31595 - DNA, 22 bp, Artificial sequence
  synthetic polynucleotide sequence
aaacaagcccaggaacaagcca

SEQ ID NO: 31596 - DNA, 22 bp, Artificial sequence
  synthetic polynucleotide sequence
agcactagcactggacagtgaa

SEQ ID NO: 31597 - DNA, 21 bp, Artificial sequence
  synthetic polynucleotide sequence
gggggctgcagttcacagaga

SEQ ID NO: 31598 - DNA, 19 bp, Artificial sequence
  synthetic polynucleotide sequence
ccacgggactccacggaca

SEQ ID NO: 31599 - DNA, 19 bp, Artificial sequence
  synthetic polynucleotide sequence
ggggaaggagagcagccca

SEQ ID NO: 31600 - DNA, 22 bp, Artificial sequence
  synthetic polynucleotide sequence
ccagaggcaatgttggacaaga

SEQ ID NO: 31601 - DNA, 21 bp, Artificial sequence
  synthetic polynucleotide sequence
cgtctacagtgggcacaccaa

SEQ ID NO: 31602 - DNA, 20 bp, Artificial sequence
  synthetic polynucleotide sequence
atagctggcacagtgcctga

SEQ ID NO: 31603 - DNA, 19 bp, Artificial sequence
  synthetic polynucleotide sequence
tccagtcccaacccaacca

SEQ ID NO: 31604 - DNA, 20 bp, Artificial sequence
  synthetic polynucleotide sequence
ctgctgcatggagctccgga

SEQ ID NO: 31605 - DNA, 19 bp, Artificial sequence
  synthetic polynucleotide sequence
ggatggcagctcaaagcaa

SEQ ID NO: 31606 - DNA, 21 bp, Artificial sequence
  synthetic polynucleotide sequence
cagagacactggaagacagca

SEQ ID NO: 31607 - DNA, 20 bp, Artificial sequence
  synthetic polynucleotide sequence
aatagccgagacctggccca

SEQ ID NO: 31608 - DNA, 20 bp, Artificial sequence
  synthetic polynucleotide sequence
gcaggagtagaggggtggca

SEQ ID NO: 31609 - DNA, 21 bp, Artificial sequence
  synthetic polynucleotide sequence
ctcctggcagcaaggagtgaa

SEQ ID NO: 31610 - DNA, 20 bp, Artificial sequence
  synthetic polynucleotide sequence
cctgccggagccgttcaaga

SEQ ID NO: 31611 - DNA, 21 bp, Artificial sequence
  synthetic polynucleotide sequence
cctgccaaagtgccttcccca

SEQ ID NO: 31612 - DNA, 19 bp, Artificial sequence
  synthetic polynucleotide sequence
gacagggtcgcggtggaga

SEQ ID NO: 31613 - DNA, 22 bp, Artificial sequence
  synthetic polynucleotide sequence
tgatgacccagaccaagacaga

SEQ ID NO: 31614 - DNA, 18 bp, Artificial sequence
  synthetic polynucleotide sequence
gccgtagagcagcgctca

SEQ ID NO: 31615 - DNA, 22 bp, Artificial sequence
  synthetic polynucleotide sequence
agaaggaagccctgattcagga

SEQ ID NO: 31616 - DNA, 20 bp, Artificial sequence
  synthetic polynucleotide sequence
tctggggatcctcagcagca

SEQ ID NO: 31617 - DNA, 21 bp, Artificial sequence
  synthetic polynucleotide sequence
ttcccctcatggatgccagga

SEQ ID NO: 31618 - DNA, 20 bp, Artificial sequence
  synthetic polynucleotide sequence
gcagaggacgtagcgtggga

SEQ ID NO: 31619 - DNA, 20 bp, Artificial sequence
  synthetic polynucleotide sequence
ccggcaggagcgtgactcca

SEQ ID NO: 31620 - DNA, 20 bp, Artificial sequence
  synthetic polynucleotide sequence
ccagcaggactcacgcagaa

SEQ ID NO: 31621 - DNA, 21 bp, Artificial sequence
  synthetic polynucleotide sequence
acaccagcccaaatcctcaga

SEQ ID NO: 31622 - DNA, 19 bp, Artificial sequence
  synthetic polynucleotide sequence
gggtccccttagcaccgga

SEQ ID NO: 31623 - DNA, 18 bp, Artificial sequence
  synthetic polynucleotide sequence
cctgctccaagcagccaa

SEQ ID NO: 31624 - DNA, 20 bp, Artificial sequence
  synthetic polynucleotide sequence
aacacagctcctgagccaga

SEQ ID NO: 31625 - DNA, 19 bp, Artificial sequence
  synthetic polynucleotide sequence
cagcccctggtatccggca

SEQ ID NO: 31626 - DNA, 20 bp, Artificial sequence
  synthetic polynucleotide sequence
ggaacagccaggggtgagga

SEQ ID NO: 31627 - DNA, 18 bp, Artificial sequence
  synthetic polynucleotide sequence
tcagtgccagcgagagca

SEQ ID NO: 31628 - DNA, 18 bp, Artificial sequence
  synthetic polynucleotide sequence
cgtaccgcccttcaacca

SEQ ID NO: 31629 - DNA, 18 bp, Artificial sequence
  synthetic polynucleotide sequence
cgccatcacacctagcga

SEQ ID NO: 31630 - DNA, 19 bp, Artificial sequence
  synthetic polynucleotide sequence
tgcaggcacttggtagcca

SEQ ID NO: 31631 - DNA, 22 bp, Artificial sequence
  synthetic polynucleotide sequence
ctaaaacgccagcttgagcaca

SEQ ID NO: 31632 - DNA, 22 bp, Artificial sequence
  synthetic polynucleotide sequence
gataaacagtgcctggcctcca

SEQ ID NO: 31633 - DNA, 18 bp, Artificial sequence
  synthetic polynucleotide sequence
ggcccaggatcatgagga

SEQ ID NO: 31634 - DNA, 18 bp, Artificial sequence
  synthetic polynucleotide sequence
agccagcgaagacgacca

SEQ ID NO: 31635 - DNA, 18 bp, Artificial sequence
  synthetic polynucleotide sequence
gcgccttggtaccaacca

SEQ ID NO: 31636 - DNA, 18 bp, Artificial sequence
  synthetic polynucleotide sequence
aacgccgtgagcgtagga

SEQ ID NO: 31637 - DNA, 20 bp, Artificial sequence
  synthetic polynucleotide sequence
acgggctaaccaattcagga

SEQ ID NO: 31638 - DNA, 20 bp, Artificial sequence
  synthetic polynucleotide sequence
aagttcgaggcagaatgcca

SEQ ID NO: 31639 - DNA, 18 bp, Artificial sequence
  synthetic polynucleotide sequence
cccgaaggagaaccacca

SEQ ID NO: 31640 - DNA, 18 bp, Artificial sequence
  synthetic polynucleotide sequence
ggtaagccaggtggggga

SEQ ID NO: 31641 - DNA, 21 bp, Artificial sequence
  synthetic polynucleotide sequence
ggacatccgggactcagccaa

SEQ ID NO: 31642 - DNA, 20 bp, Artificial sequence
  synthetic polynucleotide sequence
caggcacatcacagggccga

SEQ ID NO: 31643 - DNA, 18 bp, Artificial sequence
  synthetic polynucleotide sequence
gcccagaaggctgaggaa

SEQ ID NO: 31644 - DNA, 20 bp, Artificial sequence
  synthetic polynucleotide sequence
tagctgtaggggcatcacca

SEQ ID NO: 31645 - DNA, 20 bp, Artificial sequence
  synthetic polynucleotide sequence
cacgctctgcaggagacaga

SEQ ID NO: 31646 - DNA, 20 bp, Artificial sequence
  synthetic polynucleotide sequence
ctgtgatggcatgagggaca

SEQ ID NO: 31647 - DNA, 20 bp, Artificial sequence
  synthetic polynucleotide sequence
gttcccagctgctctcccaa

SEQ ID NO: 31648 - DNA, 20 bp, Artificial sequence
  synthetic polynucleotide sequence
cttgaagccgagctcagcca

SEQ ID NO: 31649 - DNA, 21 bp, Artificial sequence
  synthetic polynucleotide sequence
aggcaggaagggcaggaagga

SEQ ID NO: 31650 - DNA, 21 bp, Artificial sequence
  synthetic polynucleotide sequence
gagtccacgagctgtagtcga

SEQ ID NO: 31651 - DNA, 19 bp, Artificial sequence
  synthetic polynucleotide sequence
gggtgggggggccttggga

SEQ ID NO: 31652 - DNA, 20 bp, Artificial sequence
  synthetic polynucleotide sequence
ggacgtcgcaaacgctggca

SEQ ID NO: 31653 - DNA, 20 bp, Artificial sequence
  synthetic polynucleotide sequence
tactgcgctgctgagaccaa

SEQ ID NO: 31654 - DNA, 21 bp, Artificial sequence
  synthetic polynucleotide sequence
tggactttcggacagggggca

SEQ ID NO: 31655 - DNA, 18 bp, Artificial sequence
  synthetic polynucleotide sequence
agcaccccccagtgggca

SEQ ID NO: 31656 - DNA, 22 bp, Artificial sequence
  synthetic polynucleotide sequence
caatgccaactccaagactgga

SEQ ID NO: 31657 - DNA, 20 bp, Artificial sequence
  synthetic polynucleotide sequence
gtgggattacaggaacggga

SEQ ID NO: 31658 - DNA, 18 bp, Artificial sequence
  synthetic polynucleotide sequence
aacactgcatggctccga

SEQ ID NO: 31659 - DNA, 21 bp, Artificial sequence
  synthetic polynucleotide sequence
cagaacaagcctcacacccca

SEQ ID NO: 31660 - DNA, 21 bp, Artificial sequence
  synthetic polynucleotide sequence
tcacaagaggtcatccccgga

SEQ ID NO: 31661 - DNA, 18 bp, Artificial sequence
  synthetic polynucleotide sequence
ggcgctgattccaggcaa

SEQ ID NO: 31662 - DNA, 18 bp, Artificial sequence
  synthetic polynucleotide sequence
gcttgctgggccagagca

SEQ ID NO: 31663 - DNA, 19 bp, Artificial sequence
  synthetic polynucleotide sequence
tgggcaaggatcagacaca

SEQ ID NO: 31664 - DNA, 22 bp, Artificial sequence
  synthetic polynucleotide sequence
agcttccccatcctgacatgca

SEQ ID NO: 31665 - DNA, 18 bp, Artificial sequence
  synthetic polynucleotide sequence
ccattgagccagcacgca

SEQ ID NO: 31666 - DNA, 18 bp, Artificial sequence
  synthetic polynucleotide sequence
gcaatggctggaccctca

SEQ ID NO: 31667 - DNA, 19 bp, Artificial sequence
  synthetic polynucleotide sequence
ggcgtcagtagcagccaga

SEQ ID NO: 31668 - DNA, 20 bp, Artificial sequence
  synthetic polynucleotide sequence
aaagacagctggaggggaca

SEQ ID NO: 31669 - DNA, 18 bp, Artificial sequence
  synthetic polynucleotide sequence
cggacccaggattccgaa

SEQ ID NO: 31670 - DNA, 19 bp, Artificial sequence
  synthetic polynucleotide sequence
tgacagcacctgctccaca

SEQ ID NO: 31671 - DNA, 22 bp, Artificial sequence
  synthetic polynucleotide sequence
tgatgagggggatgatgaggaa

SEQ ID NO: 31672 - DNA, 21 bp, Artificial sequence
  synthetic polynucleotide sequence
tcacagctacagtccacacca

SEQ ID NO: 31673 - DNA, 20 bp, Artificial sequence
  synthetic polynucleotide sequence
atctctacctgcaggccaca

SEQ ID NO: 31674 - DNA, 18 bp, Artificial sequence
  synthetic polynucleotide sequence
cctcatagccacacggca

SEQ ID NO: 31675 - DNA, 20 bp, Artificial sequence
  synthetic polynucleotide sequence
aagagggcattctgcacaga

SEQ ID NO: 31676 - DNA, 18 bp, Artificial sequence
  synthetic polynucleotide sequence
ctccacctcgcactgcca

SEQ ID NO: 31677 - DNA, 22 bp, Artificial sequence
  synthetic polynucleotide sequence
ataacctggagcagctcaccaa

SEQ ID NO: 31678 - DNA, 21 bp, Artificial sequence
  synthetic polynucleotide sequence
tccttcagcgcgctctccaga

SEQ ID NO: 31679 - DNA, 20 bp, Artificial sequence
  synthetic polynucleotide sequence
aggccagagtgaaggggaga

SEQ ID NO: 31680 - DNA, 20 bp, Artificial sequence
  synthetic polynucleotide sequence
gagatggagtggtcagggga

SEQ ID NO: 31681 - DNA, 19 bp, Artificial sequence
  synthetic polynucleotide sequence
tagcagacagcaggaggca

SEQ ID NO: 31682 - DNA, 20 bp, Artificial sequence
  synthetic polynucleotide sequence
tacagcgttcacaccgccga

SEQ ID NO: 31683 - DNA, 21 bp, Artificial sequence
  synthetic polynucleotide sequence
ccagcgagaccacacagcaca

SEQ ID NO: 31684 - DNA, 21 bp, Artificial sequence
  synthetic polynucleotide sequence
tgagcttgaggatcagcagga

SEQ ID NO: 31685 - DNA, 19 bp, Artificial sequence
  synthetic polynucleotide sequence
ggaaacacaggctccagca

SEQ ID NO: 31686 - DNA, 20 bp, Artificial sequence
  synthetic polynucleotide sequence
ctaccatctccagccactga

SEQ ID NO: 31687 - DNA, 22 bp, Artificial sequence
  synthetic polynucleotide sequence
aaactgacctacctgctgcaga

SEQ ID NO: 31688 - DNA, 19 bp, Artificial sequence
  synthetic polynucleotide sequence
tggaggcaaagcgtagaga

SEQ ID NO: 31689 - DNA, 20 bp, Artificial sequence
  synthetic polynucleotide sequence
cggaggatctcggggagaca

SEQ ID NO: 31690 - DNA, 20 bp, Artificial sequence
  synthetic polynucleotide sequence
agggaagaaggcgtcccgga

SEQ ID NO: 31691 - DNA, 18 bp, Artificial sequence
  synthetic polynucleotide sequence
tgcagagcgtggacgaca

SEQ ID NO: 31692 - DNA, 18 bp, Artificial sequence
  synthetic polynucleotide sequence
agccagccaagtccacca

SEQ ID NO: 31693 - DNA, 21 bp, Artificial sequence
  synthetic polynucleotide sequence
ggaaggaacaggaggtcccta

SEQ ID NO: 31694 - DNA, 21 bp, Artificial sequence
  synthetic polynucleotide sequence
tcttcagtgcactcggtccca

SEQ ID NO: 31695 - DNA, 18 bp, Artificial sequence
  synthetic polynucleotide sequence
acccccgacacctgcaca

SEQ ID NO: 31696 - DNA, 19 bp, Artificial sequence
  synthetic polynucleotide sequence
gagcaccagcgatgaagga

SEQ ID NO: 31697 - DNA, 21 bp, Artificial sequence
  synthetic polynucleotide sequence
caacggaacattccaggccga

SEQ ID NO: 31698 - DNA, 22 bp, Artificial sequence
  synthetic polynucleotide sequence
aaacaagcagtgggtcactcga

SEQ ID NO: 31699 - DNA, 20 bp, Artificial sequence
  synthetic polynucleotide sequence
ctcaggaggtgacatacgca

SEQ ID NO: 31700 - DNA, 18 bp, Artificial sequence
  synthetic polynucleotide sequence
aacgctctgggctcagca

SEQ ID NO: 31701 - DNA, 21 bp, Artificial sequence
  synthetic polynucleotide sequence
ccaaggttcaggcaggagaga

SEQ ID NO: 31702 - DNA, 20 bp, Artificial sequence
  synthetic polynucleotide sequence
gaccttgcgcactgcaggga

SEQ ID NO: 31703 - DNA, 20 bp, Artificial sequence
  synthetic polynucleotide sequence
tcaggcaggagagaacgtga

SEQ ID NO: 31704 - DNA, 18 bp, Artificial sequence
  synthetic polynucleotide sequence
ccttgggcactgcacgga

SEQ ID NO: 31705 - DNA, 21 bp, Artificial sequence
  synthetic polynucleotide sequence
taccagcagctggactctgaa

SEQ ID NO: 31706 - DNA, 20 bp, Artificial sequence
  synthetic polynucleotide sequence
tctccagcaggcagtgggga

SEQ ID NO: 31707 - DNA, 23 bp, Artificial sequence
  synthetic polynucleotide sequence
ggaaagagcagccaaaatcccaa

SEQ ID NO: 31708 - DNA, 25 bp, Artificial sequence
  synthetic polynucleotide sequence
tgggtagaaaatgtgaccacaggga

SEQ ID NO: 31709 - DNA, 18 bp, Artificial sequence
  synthetic polynucleotide sequence
ggccgattctgcaggcaa

SEQ ID NO: 31710 - DNA, 18 bp, Artificial sequence
  synthetic polynucleotide sequence
ccaccgacggaagacgca

SEQ ID NO: 31711 - DNA, 19 bp, Artificial sequence
  synthetic polynucleotide sequence
gcaacatcgtgcgggccga

SEQ ID NO: 31712 - DNA, 20 bp, Artificial sequence
  synthetic polynucleotide sequence
cacaccagctcctacggcca

SEQ ID NO: 31713 - DNA, 21 bp, Artificial sequence
  synthetic polynucleotide sequence
ggaagccagctgctactgcca

SEQ ID NO: 31714 - DNA, 20 bp, Artificial sequence
  synthetic polynucleotide sequence
cttctcccgctgcaccagca

SEQ ID NO: 31715 - DNA, 20 bp, Artificial sequence
  synthetic polynucleotide sequence
gtggatggcacctgaaagca

SEQ ID NO: 31716 - DNA, 18 bp, Artificial sequence
  synthetic polynucleotide sequence
agggctgagcatccggaa

SEQ ID NO: 31717 - DNA, 23 bp, Artificial sequence
  synthetic polynucleotide sequence
caaaactgaagggatctgcagga

SEQ ID NO: 31718 - DNA, 21 bp, Artificial sequence
  synthetic polynucleotide sequence
gcaaaacatccatcccgggga

SEQ ID NO: 31719 - DNA, 20 bp, Artificial sequence
  synthetic polynucleotide sequence
tacagaagagtgtggccgta

SEQ ID NO: 31720 - DNA, 19 bp, Artificial sequence
  synthetic polynucleotide sequence
tgggatatctgcagccaca

SEQ ID NO: 31721 - DNA, 20 bp, Artificial sequence
  synthetic polynucleotide sequence
gagctcggccatcacgtcaa

SEQ ID NO: 31722 - DNA, 21 bp, Artificial sequence
  synthetic polynucleotide sequence
tacacatgccaagccagggca

SEQ ID NO: 31723 - DNA, 21 bp, Artificial sequence
  synthetic polynucleotide sequence
cgactcggacagggacatcca

SEQ ID NO: 31724 - DNA, 20 bp, Artificial sequence
  synthetic polynucleotide sequence
ggagccggtcatcctccaga

SEQ ID NO: 31725 - DNA, 18 bp, Artificial sequence
  synthetic polynucleotide sequence
aggacacgaccacccgga

SEQ ID NO: 31726 - DNA, 19 bp, Artificial sequence
  synthetic polynucleotide sequence
ctcacgaatagccaaggca

SEQ ID NO: 31727 - DNA, 19 bp, Artificial sequence
  synthetic polynucleotide sequence
cccaggatgaagcgggcca

SEQ ID NO: 31728 - DNA, 19 bp, Artificial sequence
  synthetic polynucleotide sequence
ccagggagcttcgtcggga

SEQ ID NO: 31729 - DNA, 21 bp, Artificial sequence
  synthetic polynucleotide sequence
cgtgagtctatcaggcgagga

SEQ ID NO: 31730 - DNA, 19 bp, Artificial sequence
  synthetic polynucleotide sequence
gtccgaggggccttgtcca

SEQ ID NO: 31731 - DNA, 20 bp, Artificial sequence
  synthetic polynucleotide sequence
ccaccctgatgtcgccacca

SEQ ID NO: 31732 - DNA, 20 bp, Artificial sequence
  synthetic polynucleotide sequence
tctcccggatgctaagggca

SEQ ID NO: 31733 - DNA, 18 bp, Artificial sequence
  synthetic polynucleotide sequence
attcgcgcgctcggacga

SEQ ID NO: 31734 - DNA, 18 bp, Artificial sequence
  synthetic polynucleotide sequence
gcttcatgtgcaaggcca

SEQ ID NO: 31735 - DNA, 21 bp, Artificial sequence
  synthetic polynucleotide sequence
gccgctgtgtcaccaaacaga

SEQ ID NO: 31736 - DNA, 20 bp, Artificial sequence
  synthetic polynucleotide sequence
gaccgtctctgaggaaggca

SEQ ID NO: 31737 - DNA, 21 bp, Artificial sequence
  synthetic polynucleotide sequence
cagtgaccacctgacgaagca

SEQ ID NO: 31738 - DNA, 20 bp, Artificial sequence
  synthetic polynucleotide sequence
agaggctggcatgctcacca

SEQ ID NO: 31739 - DNA, 21 bp, Artificial sequence
  synthetic polynucleotide sequence
gagagcacaagacgccagaga

SEQ ID NO: 31740 - DNA, 22 bp, Artificial sequence
  synthetic polynucleotide sequence
aacgagcgaacttccaggtgca

SEQ ID NO: 31741 - DNA, 20 bp, Artificial sequence
  synthetic polynucleotide sequence
tgcagctggcaggactgcaa

SEQ ID NO: 31742 - DNA, 21 bp, Artificial sequence
  synthetic polynucleotide sequence
gcatgaagcgcttctcgcaga

SEQ ID NO: 31743 - DNA, 18 bp, Artificial sequence
  synthetic polynucleotide sequence
ggtcaacatccaggggca

SEQ ID NO: 31744 - DNA, 18 bp, Artificial sequence
  synthetic polynucleotide sequence
cccatgaggagaccggca

SEQ ID NO: 31745 - DNA, 20 bp, Artificial sequence
  synthetic polynucleotide sequence
acccctccactctcccagga

SEQ ID NO: 31746 - DNA, 20 bp, Artificial sequence
  synthetic polynucleotide sequence
cgccacccacggaaagcaca

SEQ ID NO: 31747 - DNA, 20 bp, Artificial sequence
  synthetic polynucleotide sequence
gccaggcccttcggtgggaa

SEQ ID NO: 31748 - DNA, 20 bp, Artificial sequence
  synthetic polynucleotide sequence
ggccagggtaaggcactgga

SEQ ID NO: 31749 - DNA, 18 bp, Artificial sequence
  synthetic polynucleotide sequence
ccgaaagcacacgggcca

SEQ ID NO: 31750 - DNA, 18 bp, Artificial sequence
  synthetic polynucleotide sequence
atgtgcagcgccaggtga

SEQ ID NO: 31751 - DNA, 18 bp, Artificial sequence
  synthetic polynucleotide sequence
cgcggcatggaatacgga

SEQ ID NO: 31752 - DNA, 22 bp, Artificial sequence
  synthetic polynucleotide sequence
atctcctccgataaggagacca

SEQ ID NO: 31753 - DNA, 18 bp, Artificial sequence
  synthetic polynucleotide sequence
ccagcaggactaccccga

SEQ ID NO: 31754 - DNA, 18 bp, Artificial sequence
  synthetic polynucleotide sequence
gcatctgatcgggcagga

SEQ ID NO: 31755 - DNA, 20 bp, Artificial sequence
  synthetic polynucleotide sequence
agggccacctgtaccagcta

SEQ ID NO: 31756 - DNA, 18 bp, Artificial sequence
  synthetic polynucleotide sequence
gcagtctgcggaacagca

SEQ ID NO: 31757 - DNA, 18 bp, Artificial sequence
  synthetic polynucleotide sequence
gcggacgcacacaggaga

SEQ ID NO: 31758 - DNA, 20 bp, Artificial sequence
  synthetic polynucleotide sequence
cacctgtcacagtgggagca

SEQ ID NO: 31759 - DNA, 18 bp, Artificial sequence
  synthetic polynucleotide sequence
agccgtcaaccaggccca

SEQ ID NO: 31760 - DNA, 18 bp, Artificial sequence
  synthetic polynucleotide sequence
accgtgccatccacggca

SEQ ID NO: 31761 - DNA, 21 bp, Artificial sequence
  synthetic polynucleotide sequence
ggtggcctgaagaccatccca

SEQ ID NO: 31762 - DNA, 21 bp, Artificial sequence
  synthetic polynucleotide sequence
ggagacatggaggtggggtca

SEQ ID NO: 31763 - DNA, 18 bp, Artificial sequence
  synthetic polynucleotide sequence
cgcctccgaaaagaggca

SEQ ID NO: 31764 - DNA, 18 bp, Artificial sequence
  synthetic polynucleotide sequence
cagctcgtctgagcggga

SEQ ID NO: 31765 - DNA, 18 bp, Artificial sequence
  synthetic polynucleotide sequence
ggaggaacgcagcggcca

SEQ ID NO: 31766 - DNA, 21 bp, Artificial sequence
  synthetic polynucleotide sequence
ttcctgacatggaggctggga

SEQ ID NO: 31767 - DNA, 21 bp, Artificial sequence
  synthetic polynucleotide sequence
ccagctaccatgccagagcca

SEQ ID NO: 31768 - DNA, 21 bp, Artificial sequence
  synthetic polynucleotide sequence
tgtgtgagtccaaggtgcaga

SEQ ID NO: 31769 - DNA, 19 bp, Artificial sequence
  synthetic polynucleotide sequence
cctgggccagccttcgaga

SEQ ID NO: 31770 - DNA, 20 bp, Artificial sequence
  synthetic polynucleotide sequence
actcttgtagccgccccaga

SEQ ID NO: 31771 - DNA, 18 bp, Artificial sequence
  synthetic polynucleotide sequence
ccgaaggggaaggggcca

SEQ ID NO: 31772 - DNA, 18 bp, Artificial sequence
  synthetic polynucleotide sequence
acggccagtttgcacaga

SEQ ID NO: 31773 - DNA, 19 bp, Artificial sequence
  synthetic polynucleotide sequence
gctgaagccagaggacgga

SEQ ID NO: 31774 - DNA, 18 bp, Artificial sequence
  synthetic polynucleotide sequence
cgtcacagacacccccga

SEQ ID NO: 31775 - DNA, 20 bp, Artificial sequence
  synthetic polynucleotide sequence
ctcacggggatctggagcga

SEQ ID NO: 31776 - DNA, 20 bp, Artificial sequence
  synthetic polynucleotide sequence
ggcgaacgtgtcactgggga

SEQ ID NO: 31777 - DNA, 20 bp, Artificial sequence
  synthetic polynucleotide sequence
gaacagacgcctggacccca

SEQ ID NO: 31778 - DNA, 20 bp, Artificial sequence
  synthetic polynucleotide sequence
cgcagcaggtcgaagcggta

SEQ ID NO: 31779 - DNA, 18 bp, Artificial sequence
  synthetic polynucleotide sequence
aggtcgcctctaccggca

SEQ ID NO: 31780 - DNA, 20 bp, Artificial sequence
  synthetic polynucleotide sequence
cagccactatgacccgtcca

SEQ ID NO: 31781 - DNA, 20 bp, Artificial sequence
  synthetic polynucleotide sequence
ggggccttggaaaccagcca

SEQ ID NO: 31782 - DNA, 20 bp, Artificial sequence
  synthetic polynucleotide sequence
taacaaacagccggggccca

SEQ ID NO: 31783 - DNA, 20 bp, Artificial sequence
  synthetic polynucleotide sequence
acagcctcacgctcaggtca

SEQ ID NO: 31784 - DNA, 20 bp, Artificial sequence
  synthetic polynucleotide sequence
tcccatgactccaatgccca

SEQ ID NO: 31785 - DNA, 19 bp, Artificial sequence
  synthetic polynucleotide sequence
gggtgtcggagtggccaca

SEQ ID NO: 31786 - DNA, 21 bp, Artificial sequence
  synthetic polynucleotide sequence
tcaccaaggagacagacccca

SEQ ID NO: 31787 - DNA, 21 bp, Artificial sequence
  synthetic polynucleotide sequence
cagtgtgacagtcctcggcaa

SEQ ID NO: 31788 - DNA, 20 bp, Artificial sequence
  synthetic polynucleotide sequence
atgggggcgatgagtgtcca

SEQ ID NO: 31789 - DNA, 20 bp, Artificial sequence
  synthetic polynucleotide sequence
gctgacgcagtggagagaca

SEQ ID NO: 31790 - DNA, 23 bp, Artificial sequence
  synthetic polynucleotide sequence
cataacgaggcaatagtgacaca

SEQ ID NO: 31791 - DNA, 21 bp, Artificial sequence
  synthetic polynucleotide sequence
agtagccctgctgaatgacca

SEQ ID NO: 31792 - DNA, 19 bp, Artificial sequence
  synthetic polynucleotide sequence
tgcatagagtctcccccga

SEQ ID NO: 31793 - DNA, 20 bp, Artificial sequence
  synthetic polynucleotide sequence
caaggcaggacctacacgca

SEQ ID NO: 31794 - DNA, 21 bp, Artificial sequence
  synthetic polynucleotide sequence
ggcatcagggtcacatcacaa

SEQ ID NO: 31795 - DNA, 23 bp, Artificial sequence
  synthetic polynucleotide sequence
cttacaagagccacaggagccaa

SEQ ID NO: 31796 - DNA, 20 bp, Artificial sequence
  synthetic polynucleotide sequence
gcacccgaaggtgaggaaga

SEQ ID NO: 31797 - DNA, 22 bp, Artificial sequence
  synthetic polynucleotide sequence
catagaacaacggaccaggaga

SEQ ID NO: 31798 - DNA, 20 bp, Artificial sequence
  synthetic polynucleotide sequence
tgtccagcacagtcacacca

SEQ ID NO: 31799 - DNA, 20 bp, Artificial sequence
  synthetic polynucleotide sequence
cacgcatgacctggtggcca

SEQ ID NO: 31800 - DNA, 20 bp, Artificial sequence
  synthetic polynucleotide sequence
cgccgggtgaacatgcagga

SEQ ID NO: 31801 - DNA, 22 bp, Artificial sequence
  synthetic polynucleotide sequence
acctactcacctgagacggaca

SEQ ID NO: 31802 - DNA, 19 bp, Artificial sequence
  synthetic polynucleotide sequence
ccatcgtagcccccgcaga

SEQ ID NO: 31803 - DNA, 21 bp, Artificial sequence
  synthetic polynucleotide sequence
ctacgaccctgtgaaggacca

SEQ ID NO: 31804 - DNA, 21 bp, Artificial sequence
  synthetic polynucleotide sequence
tactcccatcaaagcctccca

SEQ ID NO: 31805 - DNA, 21 bp, Artificial sequence
  synthetic polynucleotide sequence
accaaggacgagaccacggaa

SEQ ID NO: 31806 - DNA, 21 bp, Artificial sequence
  synthetic polynucleotide sequence
aacactgaccccaactccgca

SEQ ID NO: 31807 - DNA, 21 bp, Artificial sequence
  synthetic polynucleotide sequence
tagaggcctatgacccagaga

SEQ ID NO: 31808 - DNA, 21 bp, Artificial sequence
  synthetic polynucleotide sequence
ccactgtccaactcgaagcca

SEQ ID NO: 31809 - DNA, 19 bp, Artificial sequence
  synthetic polynucleotide sequence
cgcacaggctacgtgcaca

SEQ ID NO: 31810 - DNA, 18 bp, Artificial sequence
  synthetic polynucleotide sequence
cggctcaaggagcaggga

SEQ ID NO: 31811 - DNA, 20 bp, Artificial sequence
  synthetic polynucleotide sequence
cccagaggtccacagccaca

SEQ ID NO: 31812 - DNA, 20 bp, Artificial sequence
  synthetic polynucleotide sequence
tatccgtcctgtagccccca

SEQ ID NO: 31813 - DNA, 22 bp, Artificial sequence
  synthetic polynucleotide sequence
gaaaatggagaagccacagaca

SEQ ID NO: 31814 - DNA, 21 bp, Artificial sequence
  synthetic polynucleotide sequence
tcacacagccatgataggaca

SEQ ID NO: 31815 - DNA, 21 bp, Artificial sequence
  synthetic polynucleotide sequence
atcatgggaggtgacacggaa

SEQ ID NO: 31816 - DNA, 20 bp, Artificial sequence
  synthetic polynucleotide sequence
ggtcccaaagtagcccccga

SEQ ID NO: 31817 - DNA, 22 bp, Artificial sequence
  synthetic polynucleotide sequence
tacgggatctcagtggaggaca

SEQ ID NO: 31818 - DNA, 20 bp, Artificial sequence
  synthetic polynucleotide sequence
acagccagcacgtcgaagca

SEQ ID NO: 31819 - DNA, 22 bp, Artificial sequence
  synthetic polynucleotide sequence
acctgtggcaccaatgacgaca

SEQ ID NO: 31820 - DNA, 23 bp, Artificial sequence
  synthetic polynucleotide sequence
aataaagcctagcatgacaccca

SEQ ID NO: 31821 - DNA, 21 bp, Artificial sequence
  synthetic polynucleotide sequence
ggcgggcccaaacatgaacca

SEQ ID NO: 31822 - DNA, 19 bp, Artificial sequence
  synthetic polynucleotide sequence
cagggcatgtgggggagga

SEQ ID NO: 31823 - DNA, 21 bp, Artificial sequence
  synthetic polynucleotide sequence
ggttggagtgcttagcggaca

SEQ ID NO: 31824 - DNA, 22 bp, Artificial sequence
  synthetic polynucleotide sequence
tccaaccacatacaggagccca

SEQ ID NO: 31825 - DNA, 20 bp, Artificial sequence
  synthetic polynucleotide sequence
agagcccagagctgaggaga

SEQ ID NO: 31826 - DNA, 21 bp, Artificial sequence
  synthetic polynucleotide sequence
tccacatggaaacagagccca

SEQ ID NO: 31827 - DNA, 19 bp, Artificial sequence
  synthetic polynucleotide sequence
gagtgctacagccccgcga

SEQ ID NO: 31828 - DNA, 19 bp, Artificial sequence
  synthetic polynucleotide sequence
ccgacagtggcctcgggta

SEQ ID NO: 31829 - DNA, 20 bp, Artificial sequence
  synthetic polynucleotide sequence
ccgtagccccatgctgcaga

SEQ ID NO: 31830 - DNA, 21 bp, Artificial sequence
  synthetic polynucleotide sequence
tggcgcacaaggatccggtca

SEQ ID NO: 31831 - DNA, 20 bp, Artificial sequence
  synthetic polynucleotide sequence
gggctactgagagctgccca

SEQ ID NO: 31832 - DNA, 20 bp, Artificial sequence
  synthetic polynucleotide sequence
acagggccaggcaacgggca

SEQ ID NO: 31833 - DNA, 20 bp, Artificial sequence
  synthetic polynucleotide sequence
agggagggagaggttggaga

SEQ ID NO: 31834 - DNA, 22 bp, Artificial sequence
  synthetic polynucleotide sequence
tccattgcggaaggaaaccgga

SEQ ID NO: 31835 - DNA, 21 bp, Artificial sequence
  synthetic polynucleotide sequence
gtgctttgaccccaaggagga

SEQ ID NO: 31836 - DNA, 18 bp, Artificial sequence
  synthetic polynucleotide sequence
gacagctgcctcccccca

SEQ ID NO: 31837 - DNA, 19 bp, Artificial sequence
  synthetic polynucleotide sequence
cacgggacaacggagggga

SEQ ID NO: 31838 - DNA, 21 bp, Artificial sequence
  synthetic polynucleotide sequence
ggttcttgcggtaggggccaa

SEQ ID NO: 31839 - DNA, 21 bp, Artificial sequence
  synthetic polynucleotide sequence
aggatgcaccatggggccaca

SEQ ID NO: 31840 - DNA, 21 bp, Artificial sequence
  synthetic polynucleotide sequence
ggggtcgtagcaatcgaagga

SEQ ID NO: 31841 - DNA, 21 bp, Artificial sequence
  synthetic polynucleotide sequence
tgatgcccctgcttccaacca

SEQ ID NO: 31842 - DNA, 21 bp, Artificial sequence
  synthetic polynucleotide sequence
acagcaacagcatctcgagga

SEQ ID NO: 31843 - DNA, 21 bp, Artificial sequence
  synthetic polynucleotide sequence
tggagagctggttcccacaga

SEQ ID NO: 31844 - DNA, 21 bp, Artificial sequence
  synthetic polynucleotide sequence
ggcacagcacattgagccgca

SEQ ID NO: 31845 - DNA, 22 bp, Artificial sequence
  synthetic polynucleotide sequence
tgattgcaggaggtgtcactga

SEQ ID NO: 31846 - DNA, 20 bp, Artificial sequence
  synthetic polynucleotide sequence
tccttcaacatcccagccca

SEQ ID NO: 31847 - DNA, 21 bp, Artificial sequence
  synthetic polynucleotide sequence
ctacaaccccagcaccaacga

SEQ ID NO: 31848 - DNA, 20 bp, Artificial sequence
  synthetic polynucleotide sequence
aggattgggtaagggcgcca

SEQ ID NO: 31849 - DNA, 21 bp, Artificial sequence
  synthetic polynucleotide sequence
taggaggacatgatggctgga

SEQ ID NO: 31850 - DNA, 22 bp, Artificial sequence
  synthetic polynucleotide sequence
agaacttccatcacgaccacca

SEQ ID NO: 31851 - DNA, 18 bp, Artificial sequence
  synthetic polynucleotide sequence
aacgcaccaagcccagga

SEQ ID NO: 31852 - DNA, 19 bp, Artificial sequence
  synthetic polynucleotide sequence
gcaggtcacctctgccaca

SEQ ID NO: 31853 - DNA, 20 bp, Artificial sequence
  synthetic polynucleotide sequence
tcctccgacacctcgagaca

SEQ ID NO: 31854 - DNA, 20 bp, Artificial sequence
  synthetic polynucleotide sequence
gctgcagcgctgggtcagca

SEQ ID NO: 31855 - DNA, 21 bp, Artificial sequence
  synthetic polynucleotide sequence
gaggtggagtgggaatcgcaa

SEQ ID NO: 31856 - DNA, 22 bp, Artificial sequence
  synthetic polynucleotide sequence
agatccaacaagctcccaccta

SEQ ID NO: 31857 - DNA, 21 bp, Artificial sequence
  synthetic polynucleotide sequence
ggatgctccccgttaccagca

SEQ ID NO: 31858 - DNA, 20 bp, Artificial sequence
  synthetic polynucleotide sequence
tggccagttcaccagctgca

SEQ ID NO: 31859 - DNA, 18 bp, Artificial sequence
  synthetic polynucleotide sequence
ccgccaagcagacgagga

SEQ ID NO: 31860 - DNA, 17 bp, Artificial sequence
  synthetic polynucleotide sequence
ccccagccggaagccaa

SEQ ID NO: 31861 - DNA, 18 bp, Artificial sequence
  synthetic polynucleotide sequence
gcctgacctgctccagca

SEQ ID NO: 31862 - DNA, 18 bp, Artificial sequence
  synthetic polynucleotide sequence
ccggtccagtccagcaca

SEQ ID NO: 31863 - DNA, 18 bp, Artificial sequence
  synthetic polynucleotide sequence
gcaggaagggggcaagga

SEQ ID NO: 31864 - DNA, 18 bp, Artificial sequence
  synthetic polynucleotide sequence
cgggtgatcgcacacgga

SEQ ID NO: 31865 - DNA, 20 bp, Artificial sequence
  synthetic polynucleotide sequence
gagtgtgggcgtaactcaca

SEQ ID NO: 31866 - DNA, 20 bp, Artificial sequence
  synthetic polynucleotide sequence
gaggttgaggcactggagca

SEQ ID NO: 31867 - DNA, 18 bp, Artificial sequence
  synthetic polynucleotide sequence
caccaccaccagccccca

SEQ ID NO: 31868 - DNA, 19 bp, Artificial sequence
  synthetic polynucleotide sequence
ccccagagtcaccctcaca

SEQ ID NO: 31869 - DNA, 21 bp, Artificial sequence
  synthetic polynucleotide sequence
aggtaccccgcctctctgcaa

SEQ ID NO: 31870 - DNA, 20 bp, Artificial sequence
  synthetic polynucleotide sequence
gggaactcctgcacagacca

SEQ ID NO: 31871 - DNA, 20 bp, Artificial sequence
  synthetic polynucleotide sequence
cccagagcaactacggacca

SEQ ID NO: 31872 - DNA, 18 bp, Artificial sequence
  synthetic polynucleotide sequence
tcaggcgtgcgggctgga

SEQ ID NO: 31873 - DNA, 18 bp, Artificial sequence
  synthetic polynucleotide sequence
cagccacagcttcccaca

SEQ ID NO: 31874 - DNA, 18 bp, Artificial sequence
  synthetic polynucleotide sequence
caggctctgacaggcgga

SEQ ID NO: 31875 - DNA, 19 bp, Artificial sequence
  synthetic polynucleotide sequence
gaccacctgctacgcctca

SEQ ID NO: 31876 - DNA, 18 bp, Artificial sequence
  synthetic polynucleotide sequence
agggtgaacttgcgcaca

SEQ ID NO: 31877 - DNA, 18 bp, Artificial sequence
  synthetic polynucleotide sequence
gcggagggcaagaccaga

SEQ ID NO: 31878 - DNA, 18 bp, Artificial sequence
  synthetic polynucleotide sequence
tagacacctggcacgcca

SEQ ID NO: 31879 - DNA, 20 bp, Artificial sequence
  synthetic polynucleotide sequence
gaggatgcttacccgagaca

SEQ ID NO: 31880 - DNA, 19 bp, Artificial sequence
  synthetic polynucleotide sequence
caggacacgagtccctgca

SEQ ID NO: 31881 - DNA, 18 bp, Artificial sequence
  synthetic polynucleotide sequence
acaccaccagctgccaca

SEQ ID NO: 31882 - DNA, 18 bp, Artificial sequence
  synthetic polynucleotide sequence
atctggccagggtaggca

SEQ ID NO: 31883 - DNA, 19 bp, Artificial sequence
  synthetic polynucleotide sequence
gcactaccacgagcccaga

SEQ ID NO: 31884 - DNA, 18 bp, Artificial sequence
  synthetic polynucleotide sequence
gtcggggatgccagcgca

SEQ ID NO: 31885 - DNA, 18 bp, Artificial sequence
  synthetic polynucleotide sequence
tgacacgtgccagggcga

SEQ ID NO: 31886 - DNA, 18 bp, Artificial sequence
  synthetic polynucleotide sequence
acaggggtctgagcccca

SEQ ID NO: 31887 - DNA, 18 bp, Artificial sequence
  synthetic polynucleotide sequence
atgggagggtccggagca

SEQ ID NO: 31888 - DNA, 18 bp, Artificial sequence
  synthetic polynucleotide sequence
tgggcaggcggatcagca

SEQ ID NO: 31889 - DNA, 21 bp, Artificial sequence
  synthetic polynucleotide sequence
tcacaaggcagagtaccggaa

SEQ ID NO: 31890 - DNA, 21 bp, Artificial sequence
  synthetic polynucleotide sequence
agttggggtgataggtgcaga

SEQ ID NO: 31891 - DNA, 20 bp, Artificial sequence
  synthetic polynucleotide sequence
tacacaagcacccacatcca

SEQ ID NO: 31892 - DNA, 20 bp, Artificial sequence
  synthetic polynucleotide sequence
gctcttagggtagcaggcga

SEQ ID NO: 31893 - DNA, 18 bp, Artificial sequence
  synthetic polynucleotide sequence
cccacagactcaggccca

SEQ ID NO: 31894 - DNA, 20 bp, Artificial sequence
  synthetic polynucleotide sequence
tgccaaggtgaaccctgaca

SEQ ID NO: 31895 - DNA, 22 bp, Artificial sequence
  synthetic polynucleotide sequence
aaacccaaagaggcagcaacga

SEQ ID NO: 31896 - DNA, 22 bp, Artificial sequence
  synthetic polynucleotide sequence
actatcgttaccacagaggcca

SEQ ID NO: 31897 - DNA, 22 bp, Artificial sequence
  synthetic polynucleotide sequence
ggtttactgccacctccagaga

SEQ ID NO: 31898 - DNA, 20 bp, Artificial sequence
  synthetic polynucleotide sequence
taacacagtggccatcagga

SEQ ID NO: 31899 - DNA, 18 bp, Artificial sequence
  synthetic polynucleotide sequence
ggacccaaagaggcagca

SEQ ID NO: 31900 - DNA, 19 bp, Artificial sequence
  synthetic polynucleotide sequence
cacagtggccatcaggaca

SEQ ID NO: 31901 - DNA, 21 bp, Artificial sequence
  synthetic polynucleotide sequence
cagcatttactccaggaccca

SEQ ID NO: 31902 - DNA, 20 bp, Artificial sequence
  synthetic polynucleotide sequence
gagaagcacagagatgccga

SEQ ID NO: 31903 - DNA, 22 bp, Artificial sequence
  synthetic polynucleotide sequence
aaagaaaaggagttctgcccaa

SEQ ID NO: 31904 - DNA, 22 bp, Artificial sequence
  synthetic polynucleotide sequence
aggatcaaggagatcaaagtca

SEQ ID NO: 31905 - DNA, 21 bp, Artificial sequence
  synthetic polynucleotide sequence
caggaaatgagcctgctccaa

SEQ ID NO: 31906 - DNA, 20 bp, Artificial sequence
  synthetic polynucleotide sequence
ggcaccgcatgtctgcacaa

SEQ ID NO: 31907 - DNA, 21 bp, Artificial sequence
  synthetic polynucleotide sequence
cctgctaagccacacccagga

SEQ ID NO: 31908 - DNA, 19 bp, Artificial sequence
  synthetic polynucleotide sequence
gtggggcctcgtcgatcca

SEQ ID NO: 31909 - DNA, 20 bp, Artificial sequence
  synthetic polynucleotide sequence
gtctcgacacagctgggaga

SEQ ID NO: 31910 - DNA, 20 bp, Artificial sequence
  synthetic polynucleotide sequence
gctacagcgatgaagcagca

SEQ ID NO: 31911 - DNA, 19 bp, Artificial sequence
  synthetic polynucleotide sequence
ctgttgcctgcccagccca

SEQ ID NO: 31912 - DNA, 21 bp, Artificial sequence
  synthetic polynucleotide sequence
aagcagtcttcaaagcccgca

SEQ ID NO: 31913 - DNA, 20 bp, Artificial sequence
  synthetic polynucleotide sequence
ctgcaggaagtcctacccca

SEQ ID NO: 31914 - DNA, 18 bp, Artificial sequence
  synthetic polynucleotide sequence
ccgctggggtgataagga

SEQ ID NO: 31915 - DNA, 20 bp, Artificial sequence
  synthetic polynucleotide sequence
gccgcccgcttcatcaacca

SEQ ID NO: 31916 - DNA, 20 bp, Artificial sequence
  synthetic polynucleotide sequence
accacgcaggatgcggcgca

SEQ ID NO: 31917 - DNA, 21 bp, Artificial sequence
  synthetic polynucleotide sequence
gtcactggagaactgaacgca

SEQ ID NO: 31918 - DNA, 20 bp, Artificial sequence
  synthetic polynucleotide sequence
ctgaatccgagaccgtgcca

SEQ ID NO: 31919 - DNA, 18 bp, Artificial sequence
  synthetic polynucleotide sequence
tctgagcctggggaacca

SEQ ID NO: 31920 - DNA, 18 bp, Artificial sequence
  synthetic polynucleotide sequence
gcatcagctgaggcgaca

SEQ ID NO: 31921 - DNA, 20 bp, Artificial sequence
  synthetic polynucleotide sequence
aacaggcagtgtcctggaga

SEQ ID NO: 31922 - DNA, 18 bp, Artificial sequence
  synthetic polynucleotide sequence
cattgtgccccgtccaga

SEQ ID NO: 31923 - DNA, 18 bp, Artificial sequence
  synthetic polynucleotide sequence
cgacgccaagaaacggga

SEQ ID NO: 31924 - DNA, 18 bp, Artificial sequence
  synthetic polynucleotide sequence
agccgcgatgtctcggga

SEQ ID NO: 31925 - DNA, 20 bp, Artificial sequence
  synthetic polynucleotide sequence
aaagacgacgcggtaccaga

SEQ ID NO: 31926 - DNA, 18 bp, Artificial sequence
  synthetic polynucleotide sequence
caaccgacgggtgaagga

SEQ ID NO: 31927 - DNA, 21 bp, Artificial sequence
  synthetic polynucleotide sequence
gtaccagctgcgtgagaccaa

SEQ ID NO: 31928 - DNA, 20 bp, Artificial sequence
  synthetic polynucleotide sequence
gcagaatgggtcccggcgca

SEQ ID NO: 31929 - DNA, 21 bp, Artificial sequence
  synthetic polynucleotide sequence
catccccatcagcagcagaga

SEQ ID NO: 31930 - DNA, 22 bp, Artificial sequence
  synthetic polynucleotide sequence
aataaagacaccgcccatggca

SEQ ID NO: 31931 - DNA, 18 bp, Artificial sequence
  synthetic polynucleotide sequence
tgccggtgaacagcgaca

SEQ ID NO: 31932 - DNA, 18 bp, Artificial sequence
  synthetic polynucleotide sequence
gcgttctgcgcgaggaca

SEQ ID NO: 31933 - DNA, 18 bp, Artificial sequence
  synthetic polynucleotide sequence
ccgtggggaagaggagca

SEQ ID NO: 31934 - DNA, 19 bp, Artificial sequence
  synthetic polynucleotide sequence
cacagccgaggcagtcgta

SEQ ID NO: 31935 - DNA, 20 bp, Artificial sequence
  synthetic polynucleotide sequence
cagagcaatctcccaggcaa

SEQ ID NO: 31936 - DNA, 18 bp, Artificial sequence
  synthetic polynucleotide sequence
ttggcgacgagcctcaca

SEQ ID NO: 31937 - DNA, 21 bp, Artificial sequence
  synthetic polynucleotide sequence
acatagaccaggtgaggcgaa

SEQ ID NO: 31938 - DNA, 21 bp, Artificial sequence
  synthetic polynucleotide sequence
ccagcagtatcccactggcca

SEQ ID NO: 31939 - DNA, 22 bp, Artificial sequence
  synthetic polynucleotide sequence
aactgagacgagagaatgggca

SEQ ID NO: 31940 - DNA, 20 bp, Artificial sequence
  synthetic polynucleotide sequence
gtcccgaaacttctccagca

SEQ ID NO: 31941 - DNA, 18 bp, Artificial sequence
  synthetic polynucleotide sequence
aggtgaggagcccaagca

SEQ ID NO: 31942 - DNA, 20 bp, Artificial sequence
  synthetic polynucleotide sequence
caggcactgtcactgggaca

SEQ ID NO: 31943 - DNA, 21 bp, Artificial sequence
  synthetic polynucleotide sequence
ctgaccatgacccggaatgca

SEQ ID NO: 31944 - DNA, 22 bp, Artificial sequence
  synthetic polynucleotide sequence
atagatatgagagggcccagca

SEQ ID NO: 31945 - DNA, 18 bp, Artificial sequence
  synthetic polynucleotide sequence
cctgctcaccaaccccaa

SEQ ID NO: 31946 - DNA, 18 bp, Artificial sequence
  synthetic polynucleotide sequence
agttggtcacggcccaca

SEQ ID NO: 31947 - DNA, 22 bp, Artificial sequence
  synthetic polynucleotide sequence
atggccggtgatgaagcaagca

SEQ ID NO: 31948 - DNA, 20 bp, Artificial sequence
  synthetic polynucleotide sequence
cttcaggaatgaggcaggga

SEQ ID NO: 31949 - DNA, 21 bp, Artificial sequence
  synthetic polynucleotide sequence
tgatgggccccagtgtagaga

SEQ ID NO: 31950 - DNA, 21 bp, Artificial sequence
  synthetic polynucleotide sequence
agtaaggtaagagagggccca

SEQ ID NO: 31951 - DNA, 22 bp, Artificial sequence
  synthetic polynucleotide sequence
tagaggcaaaaaccctcctcca

SEQ ID NO: 31952 - DNA, 22 bp, Artificial sequence
  synthetic polynucleotide sequence
atcattgggtccatcggagaga

SEQ ID NO: 31953 - DNA, 20 bp, Artificial sequence
  synthetic polynucleotide sequence
ctcttcagcagcgactcgga

SEQ ID NO: 31954 - DNA, 18 bp, Artificial sequence
  synthetic polynucleotide sequence
cccacggctctcagggca

SEQ ID NO: 31955 - DNA, 20 bp, Artificial sequence
  synthetic polynucleotide sequence
atgctgaacgtgctccccca

SEQ ID NO: 31956 - DNA, 21 bp, Artificial sequence
  synthetic polynucleotide sequence
ggaggcaagacgtcgtaggca

SEQ ID NO: 31957 - DNA, 18 bp, Artificial sequence
  synthetic polynucleotide sequence
tggaaggaccagagccca

SEQ ID NO: 31958 - DNA, 18 bp, Artificial sequence
  synthetic polynucleotide sequence
tggcagcttcaggaagca

SEQ ID NO: 31959 - DNA, 20 bp, Artificial sequence
  synthetic polynucleotide sequence
cccaactgagtggagtcgga

SEQ ID NO: 31960 - DNA, 21 bp, Artificial sequence
  synthetic polynucleotide sequence
agccttgctaagcaacagcca

SEQ ID NO: 31961 - DNA, 18 bp, Artificial sequence
  synthetic polynucleotide sequence
gcttcctgaggcccagca

SEQ ID NO: 31962 - DNA, 18 bp, Artificial sequence
  synthetic polynucleotide sequence
cgcccttcagggagacca

SEQ ID NO: 31963 - DNA, 21 bp, Artificial sequence
  synthetic polynucleotide sequence
taggcaagagtgccttgacga

SEQ ID NO: 31964 - DNA, 20 bp, Artificial sequence
  synthetic polynucleotide sequence
aaagccctccccagtcctca

SEQ ID NO: 31965 - DNA, 20 bp, Artificial sequence
  synthetic polynucleotide sequence
taggccacgtgtgccccaca

SEQ ID NO: 31966 - DNA, 22 bp, Artificial sequence
  synthetic polynucleotide sequence
tcaaggctcctgagatcaggaa

SEQ ID NO: 31967 - DNA, 21 bp, Artificial sequence
  synthetic polynucleotide sequence
cagtgccaccagaagaaccca

SEQ ID NO: 31968 - DNA, 21 bp, Artificial sequence
  synthetic polynucleotide sequence
gaactcaccatcggcactgga

SEQ ID NO: 31969 - DNA, 20 bp, Artificial sequence
  synthetic polynucleotide sequence
taacaaccaggccccaggaa

SEQ ID NO: 31970 - DNA, 21 bp, Artificial sequence
  synthetic polynucleotide sequence
tgggtggcactacaaaggcca

SEQ ID NO: 31971 - DNA, 21 bp, Artificial sequence
  synthetic polynucleotide sequence
ggaggagtggcagcaactgga

SEQ ID NO: 31972 - DNA, 18 bp, Artificial sequence
  synthetic polynucleotide sequence
gggtccccccatctgcca

SEQ ID NO: 31973 - DNA, 22 bp, Artificial sequence
  synthetic polynucleotide sequence
gaaagccagaggcttagagcca

SEQ ID NO: 31974 - DNA, 20 bp, Artificial sequence
  synthetic polynucleotide sequence
ggctggtaaccactgaggca

SEQ ID NO: 31975 - DNA, 18 bp, Artificial sequence
  synthetic polynucleotide sequence
acacctatgccacgggga

SEQ ID NO: 31976 - DNA, 18 bp, Artificial sequence
  synthetic polynucleotide sequence
tggaagcgggctaggaca

SEQ ID NO: 31977 - DNA, 22 bp, Artificial sequence
  synthetic polynucleotide sequence
gagaccaaaagtcggacaggaa

SEQ ID NO: 31978 - DNA, 20 bp, Artificial sequence
  synthetic polynucleotide sequence
gcagtccaggaccaccccca

SEQ ID NO: 31979 - DNA, 20 bp, Artificial sequence
  synthetic polynucleotide sequence
cagcttgatggggccggaga

SEQ ID NO: 31980 - DNA, 20 bp, Artificial sequence
  synthetic polynucleotide sequence
aagcatcacagtggggccca

SEQ ID NO: 31981 - DNA, 19 bp, Artificial sequence
  synthetic polynucleotide sequence
tagccctagagaaagcaga

SEQ ID NO: 31982 - DNA, 20 bp, Artificial sequence
  synthetic polynucleotide sequence
gtctggagctcctagaccaa

SEQ ID NO: 31983 - DNA, 18 bp, Artificial sequence
  synthetic polynucleotide sequence
agaagccgaagccggaga

SEQ ID NO: 31984 - DNA, 18 bp, Artificial sequence
  synthetic polynucleotide sequence
ctgcaccaatggccaaca

SEQ ID NO: 31985 - DNA, 18 bp, Artificial sequence
  synthetic polynucleotide sequence
ctggagaatgtgccccga

SEQ ID NO: 31986 - DNA, 18 bp, Artificial sequence
  synthetic polynucleotide sequence
ccgccacctccagaacca

SEQ ID NO: 31987 - DNA, 21 bp, Artificial sequence
  synthetic polynucleotide sequence
ggagcctcgtgactacagcaa

SEQ ID NO: 31988 - DNA, 20 bp, Artificial sequence
  synthetic polynucleotide sequence
ctccaggtcagccttggtca

SEQ ID NO: 31989 - DNA, 21 bp, Artificial sequence
  synthetic polynucleotide sequence
tgcgggcgcagtatgaaacca

SEQ ID NO: 31990 - DNA, 21 bp, Artificial sequence
  synthetic polynucleotide sequence
tccaggttctgaaaggcgcga

SEQ ID NO: 31991 - DNA, 18 bp, Artificial sequence
  synthetic polynucleotide sequence
cgctccaaggcctggaga

SEQ ID NO: 31992 - DNA, 18 bp, Artificial sequence
  synthetic polynucleotide sequence
ctgcagggcatagcggca

SEQ ID NO: 31993 - DNA, 18 bp, Artificial sequence
  synthetic polynucleotide sequence
gtgagctccgatgcgaga

SEQ ID NO: 31994 - DNA, 20 bp, Artificial sequence
  synthetic polynucleotide sequence
caggctgcggtaagtagcga

SEQ ID NO: 31995 - DNA, 21 bp, Artificial sequence
  synthetic polynucleotide sequence
gattggcagtgtggaggagca

SEQ ID NO: 31996 - DNA, 20 bp, Artificial sequence
  synthetic polynucleotide sequence
gctgggaggaaaggtgggca

SEQ ID NO: 31997 - DNA, 18 bp, Artificial sequence
  synthetic polynucleotide sequence
gctggtgcagagtggcaa

SEQ ID NO: 31998 - DNA, 20 bp, Artificial sequence
  synthetic polynucleotide sequence
ctggatctgggacagctgca

SEQ ID NO: 31999 - DNA, 18 bp, Artificial sequence
  synthetic polynucleotide sequence
ggctcggaagaaccgaga

SEQ ID NO: 32000 - DNA, 20 bp, Artificial sequence
  synthetic polynucleotide sequence
tccaggtcgatctccaagga

SEQ ID NO: 32001 - DNA, 18 bp, Artificial sequence
  synthetic polynucleotide sequence
gggcaccgatctcgccaa

SEQ ID NO: 32002 - DNA, 19 bp, Artificial sequence
  synthetic polynucleotide sequence
ggtgaaccaggcttcagca

SEQ ID NO: 32003 - DNA, 20 bp, Artificial sequence
  synthetic polynucleotide sequence
gccgacagtctggctccaga

SEQ ID NO: 32004 - DNA, 20 bp, Artificial sequence
  synthetic polynucleotide sequence
cccttagagccaccaccaga

SEQ ID NO: 32005 - DNA, 21 bp, Artificial sequence
  synthetic polynucleotide sequence
aactccagtcccatctcagca

SEQ ID NO: 32006 - DNA, 21 bp, Artificial sequence
  synthetic polynucleotide sequence
catcagttgggcctccagaga

SEQ ID NO: 32007 - DNA, 20 bp, Artificial sequence
  synthetic polynucleotide sequence
cagaactcaaggaggcccga

SEQ ID NO: 32008 - DNA, 20 bp, Artificial sequence
  synthetic polynucleotide sequence
caaggcccctttccacagca

SEQ ID NO: 32009 - DNA, 21 bp, Artificial sequence
  synthetic polynucleotide sequence
atccacgaactgaagcgcaca

SEQ ID NO: 32010 - DNA, 21 bp, Artificial sequence
  synthetic polynucleotide sequence
tggagcttgcaggagtaccga

SEQ ID NO: 32011 - DNA, 25 bp, Artificial sequence
  synthetic polynucleotide sequence
ggtcaaggacgagattcaagcaaga

SEQ ID NO: 32012 - DNA, 21 bp, Artificial sequence
  synthetic polynucleotide sequence
agacaaccttgccatccacca

SEQ ID NO: 32013 - DNA, 22 bp, Artificial sequence
  synthetic polynucleotide sequence
caacatgcgagctgagtacgaa

SEQ ID NO: 32014 - DNA, 20 bp, Artificial sequence
  synthetic polynucleotide sequence
ggctccgacatcctcagaga

SEQ ID NO: 32015 - DNA, 20 bp, Artificial sequence
  synthetic polynucleotide sequence
caacgcagacctggagcaga

SEQ ID NO: 32016 - DNA, 20 bp, Artificial sequence
  synthetic polynucleotide sequence
cgtgttcccgggaagagcca

SEQ ID NO: 32017 - DNA, 20 bp, Artificial sequence
  synthetic polynucleotide sequence
cctcgcagagcagaaccgca

SEQ ID NO: 32018 - DNA, 19 bp, Artificial sequence
  synthetic polynucleotide sequence
ggctgaggtggtggcgcca

SEQ ID NO: 32019 - DNA, 20 bp, Artificial sequence
  synthetic polynucleotide sequence
ctgtacgcagctggcgcaga

SEQ ID NO: 32020 - DNA, 22 bp, Artificial sequence
  synthetic polynucleotide sequence
aagtggaccttgacatcgagga

SEQ ID NO: 32021 - DNA, 20 bp, Artificial sequence
  synthetic polynucleotide sequence
gcacgacttccgcctccgca

SEQ ID NO: 32022 - DNA, 20 bp, Artificial sequence
  synthetic polynucleotide sequence
cggccaaagccactgcctga

SEQ ID NO: 32023 - DNA, 19 bp, Artificial sequence
  synthetic polynucleotide sequence
cagctgtcccaggtgcaga

SEQ ID NO: 32024 - DNA, 18 bp, Artificial sequence
  synthetic polynucleotide sequence
gggcacgcacatccagca

SEQ ID NO: 32025 - DNA, 20 bp, Artificial sequence
  synthetic polynucleotide sequence
gctgctgcatccacaagcca

SEQ ID NO: 32026 - DNA, 23 bp, Artificial sequence
  synthetic polynucleotide sequence
cctctatggaagcagaaggagca

SEQ ID NO: 32027 - DNA, 20 bp, Artificial sequence
  synthetic polynucleotide sequence
aacccctgcgccacaaccaa

SEQ ID NO: 32028 - DNA, 20 bp, Artificial sequence
  synthetic polynucleotide sequence
tgcaaggcccacaccgagca

SEQ ID NO: 32029 - DNA, 21 bp, Artificial sequence
  synthetic polynucleotide sequence
ctaccaggcggagatcatcga

SEQ ID NO: 32030 - DNA, 20 bp, Artificial sequence
  synthetic polynucleotide sequence
atcaggctctgcacctggga

SEQ ID NO: 32031 - DNA, 25 bp, Artificial sequence
  synthetic polynucleotide sequence
ttcctgacccaagcaaagacacaca

SEQ ID NO: 32032 - DNA, 21 bp, Artificial sequence
  synthetic polynucleotide sequence
ctcgaccctcaacaggaagga

SEQ ID NO: 32033 - DNA, 20 bp, Artificial sequence
  synthetic polynucleotide sequence
gctgcccccaaaggtctcaa

SEQ ID NO: 32034 - DNA, 20 bp, Artificial sequence
  synthetic polynucleotide sequence
ccaccggaacagcacctaga

SEQ ID NO: 32035 - DNA, 20 bp, Artificial sequence
  synthetic polynucleotide sequence
atcagcaacgtggaggccca

SEQ ID NO: 32036 - DNA, 21 bp, Artificial sequence
  synthetic polynucleotide sequence
aggtagcgatctcgccctcca

SEQ ID NO: 32037 - DNA, 20 bp, Artificial sequence
  synthetic polynucleotide sequence
atggagccagcatggggaga

SEQ ID NO: 32038 - DNA, 20 bp, Artificial sequence
  synthetic polynucleotide sequence
gcactcctgaccccagtgca

SEQ ID NO: 32039 - DNA, 20 bp, Artificial sequence
  synthetic polynucleotide sequence
atggccctagggagagggaa

SEQ ID NO: 32040 - DNA, 20 bp, Artificial sequence
  synthetic polynucleotide sequence
ggaggcaggaggataggaga

SEQ ID NO: 32041 - DNA, 20 bp, Artificial sequence
  synthetic polynucleotide sequence
cggtgtgccctggaaagaca

SEQ ID NO: 32042 - DNA, 20 bp, Artificial sequence
  synthetic polynucleotide sequence
gccatccgagctctccagaa

SEQ ID NO: 32043 - DNA, 18 bp, Artificial sequence
  synthetic polynucleotide sequence
actggaggcatcagcgga

SEQ ID NO: 32044 - DNA, 18 bp, Artificial sequence
  synthetic polynucleotide sequence
gctgctggaactgccaga

SEQ ID NO: 32045 - DNA, 20 bp, Artificial sequence
  synthetic polynucleotide sequence
gtggcagaaaccgaggccca

SEQ ID NO: 32046 - DNA, 19 bp, Artificial sequence
  synthetic polynucleotide sequence
cgggccttcacgtccagga

SEQ ID NO: 32047 - DNA, 18 bp, Artificial sequence
  synthetic polynucleotide sequence
gtcccagatgcagacgca

SEQ ID NO: 32048 - DNA, 18 bp, Artificial sequence
  synthetic polynucleotide sequence
ttgcggaggtcatcgcca

SEQ ID NO: 32049 - DNA, 23 bp, Artificial sequence
  synthetic polynucleotide sequence
caggcagtatccatgaaagcaca

SEQ ID NO: 32050 - DNA, 22 bp, Artificial sequence
  synthetic polynucleotide sequence
attgcaaacagcgaagagcaca

SEQ ID NO: 32051 - DNA, 20 bp, Artificial sequence
  synthetic polynucleotide sequence
ggtccagctgcagatgagga

SEQ ID NO: 32052 - DNA, 22 bp, Artificial sequence
  synthetic polynucleotide sequence
gagaaagcagtgcaggaatgca

SEQ ID NO: 32053 - DNA, 18 bp, Artificial sequence
  synthetic polynucleotide sequence
gggaaccatgggcagcaa

SEQ ID NO: 32054 - DNA, 18 bp, Artificial sequence
  synthetic polynucleotide sequence
actcctgcgactggcgga

SEQ ID NO: 32055 - DNA, 22 bp, Artificial sequence
  synthetic polynucleotide sequence
atctccatcatcagcagcacca

SEQ ID NO: 32056 - DNA, 19 bp, Artificial sequence
  synthetic polynucleotide sequence
ccgcctctcacgctgcaca

SEQ ID NO: 32057 - DNA, 21 bp, Artificial sequence
  synthetic polynucleotide sequence
gagtgcaggatgtctggcgaa

SEQ ID NO: 32058 - DNA, 22 bp, Artificial sequence
  synthetic polynucleotide sequence
gctataactgcttgaggcgcca

SEQ ID NO: 32059 - DNA, 18 bp, Artificial sequence
  synthetic polynucleotide sequence
ccagtcccacatcagcga

SEQ ID NO: 32060 - DNA, 20 bp, Artificial sequence
  synthetic polynucleotide sequence
ctcctcatactgggcacgga

SEQ ID NO: 32061 - DNA, 20 bp, Artificial sequence
  synthetic polynucleotide sequence
aggcctggccgacacaagga

SEQ ID NO: 32062 - DNA, 20 bp, Artificial sequence
  synthetic polynucleotide sequence
agccccagagagactgtgga

SEQ ID NO: 32063 - DNA, 21 bp, Artificial sequence
  synthetic polynucleotide sequence
gctatggaagcggcagcagca

SEQ ID NO: 32064 - DNA, 20 bp, Artificial sequence
  synthetic polynucleotide sequence
cagaacctcccaggcctgca

SEQ ID NO: 32065 - DNA, 20 bp, Artificial sequence
  synthetic polynucleotide sequence
gcacggccaagatctccaga

SEQ ID NO: 32066 - DNA, 23 bp, Artificial sequence
  synthetic polynucleotide sequence
gctcagggaattaggggacagaa

SEQ ID NO: 32067 - DNA, 21 bp, Artificial sequence
  synthetic polynucleotide sequence
tgctgaggagagaggcgagca

SEQ ID NO: 32068 - DNA, 21 bp, Artificial sequence
  synthetic polynucleotide sequence
gcatggcctggtagtcacgca

SEQ ID NO: 32069 - DNA, 19 bp, Artificial sequence
  synthetic polynucleotide sequence
gggtcctgctgcaccagca

SEQ ID NO: 32070 - DNA, 18 bp, Artificial sequence
  synthetic polynucleotide sequence
gagccagcgctggagcca

SEQ ID NO: 32071 - DNA, 20 bp, Artificial sequence
  synthetic polynucleotide sequence
ctgcagtaggatgggaggga

SEQ ID NO: 32072 - DNA, 20 bp, Artificial sequence
  synthetic polynucleotide sequence
ggtcacccccaagtcaccca

SEQ ID NO: 32073 - DNA, 21 bp, Artificial sequence
  synthetic polynucleotide sequence
ggctggagtctgggatgcaga

SEQ ID NO: 32074 - DNA, 21 bp, Artificial sequence
  synthetic polynucleotide sequence
tggagcccaggctgtagctga

SEQ ID NO: 32075 - DNA, 20 bp, Artificial sequence
  synthetic polynucleotide sequence
cagctgcgcaagtaccagga

SEQ ID NO: 32076 - DNA, 19 bp, Artificial sequence
  synthetic polynucleotide sequence
ccacagtggctgagggcga

SEQ ID NO: 32077 - DNA, 20 bp, Artificial sequence
  synthetic polynucleotide sequence
cgggaacgtggcggtgagca

SEQ ID NO: 32078 - DNA, 20 bp, Artificial sequence
  synthetic polynucleotide sequence
cacccagggagctgatacca

SEQ ID NO: 32079 - DNA, 20 bp, Artificial sequence
  synthetic polynucleotide sequence
cagcacgcctgtcctcagca

SEQ ID NO: 32080 - DNA, 20 bp, Artificial sequence
  synthetic polynucleotide sequence
gatttccgcccgctcccaca

SEQ ID NO: 32081 - DNA, 21 bp, Artificial sequence
  synthetic polynucleotide sequence
agccgaggtggagaatgccaa

SEQ ID NO: 32082 - DNA, 18 bp, Artificial sequence
  synthetic polynucleotide sequence
gctcctcgccctccagca

SEQ ID NO: 32083 - DNA, 21 bp, Artificial sequence
  synthetic polynucleotide sequence
cccagagaagaaccagctcca

SEQ ID NO: 32084 - DNA, 21 bp, Artificial sequence
  synthetic polynucleotide sequence
ccaggcagaataatcggggga

SEQ ID NO: 32085 - DNA, 21 bp, Artificial sequence
  synthetic polynucleotide sequence
gcgggacagagagttaagcca

SEQ ID NO: 32086 - DNA, 20 bp, Artificial sequence
  synthetic polynucleotide sequence
cccagaaggcaatgcaccca

SEQ ID NO: 32087 - DNA, 20 bp, Artificial sequence
  synthetic polynucleotide sequence
atggagacgcggaccctgga

SEQ ID NO: 32088 - DNA, 20 bp, Artificial sequence
  synthetic polynucleotide sequence
tcttgagggcagccccggaa

SEQ ID NO: 32089 - DNA, 20 bp, Artificial sequence
  synthetic polynucleotide sequence
ccagatgggcagactcccga

SEQ ID NO: 32090 - DNA, 22 bp, Artificial sequence
  synthetic polynucleotide sequence
accctgaaggcatcaaagccaa

SEQ ID NO: 32091 - DNA, 20 bp, Artificial sequence
  synthetic polynucleotide sequence
agctactcccccagacccaa

SEQ ID NO: 32092 - DNA, 20 bp, Artificial sequence
  synthetic polynucleotide sequence
gggtgctgcccagggtggaa

SEQ ID NO: 32093 - DNA, 20 bp, Artificial sequence
  synthetic polynucleotide sequence
tgcctccacctgccagccca

SEQ ID NO: 32094 - DNA, 20 bp, Artificial sequence
  synthetic polynucleotide sequence
cctgaggagaggccgcagca

SEQ ID NO: 32095 - DNA, 20 bp, Artificial sequence
  synthetic polynucleotide sequence
gggaggggggcgcttctaga

SEQ ID NO: 32096 - DNA, 21 bp, Artificial sequence
  synthetic polynucleotide sequence
gacagagacctcacgggtcaa

SEQ ID NO: 32097 - DNA, 21 bp, Artificial sequence
  synthetic polynucleotide sequence
tcctctgccgccccatatgca

SEQ ID NO: 32098 - DNA, 19 bp, Artificial sequence
  synthetic polynucleotide sequence
ggcagaggagggacacgca

SEQ ID NO: 32099 - DNA, 23 bp, Artificial sequence
  synthetic polynucleotide sequence
gaaatgagggtagacaggtacca

SEQ ID NO: 32100 - DNA, 23 bp, Artificial sequence
  synthetic polynucleotide sequence
gggaagacagagaaagaggccca

SEQ ID NO: 32101 - DNA, 19 bp, Artificial sequence
  synthetic polynucleotide sequence
cgcccacctgctctgagga

SEQ ID NO: 32102 - DNA, 21 bp, Artificial sequence
  synthetic polynucleotide sequence
gcagcagacaggcttacagca

SEQ ID NO: 32103 - DNA, 20 bp, Artificial sequence
  synthetic polynucleotide sequence
ccagccacgctgctgtgaga

SEQ ID NO: 32104 - DNA, 22 bp, Artificial sequence
  synthetic polynucleotide sequence
ctggcagcagctagagtcacaa

SEQ ID NO: 32105 - DNA, 19 bp, Artificial sequence
  synthetic polynucleotide sequence
cccctgggaggcatctcca

SEQ ID NO: 32106 - DNA, 21 bp, Artificial sequence
  synthetic polynucleotide sequence
tgatacgtcctggagacccca

SEQ ID NO: 32107 - DNA, 21 bp, Artificial sequence
  synthetic polynucleotide sequence
agatgaggccacacctgtaca

SEQ ID NO: 32108 - DNA, 20 bp, Artificial sequence
  synthetic polynucleotide sequence
caagttcagccagggctcca

SEQ ID NO: 32109 - DNA, 21 bp, Artificial sequence
  synthetic polynucleotide sequence
agatgaggccacacctgtaca

SEQ ID NO: 32110 - DNA, 20 bp, Artificial sequence
  synthetic polynucleotide sequence
gggatgggcaaggtcagcaa

SEQ ID NO: 32111 - DNA, 20 bp, Artificial sequence
  synthetic polynucleotide sequence
tatccacctgctgccagcca

SEQ ID NO: 32112 - DNA, 20 bp, Artificial sequence
  synthetic polynucleotide sequence
ctatagaccagggtggggca

SEQ ID NO: 32113 - DNA, 20 bp, Artificial sequence
  synthetic polynucleotide sequence
agcgccgacgagaccatgga

SEQ ID NO: 32114 - DNA, 20 bp, Artificial sequence
  synthetic polynucleotide sequence
caggacggtgggatacagga

SEQ ID NO: 32115 - DNA, 21 bp, Artificial sequence
  synthetic polynucleotide sequence
acctcctgctaccgtcccaga

SEQ ID NO: 32116 - DNA, 22 bp, Artificial sequence
  synthetic polynucleotide sequence
ataacccagggatctgaagcca

SEQ ID NO: 32117 - DNA, 20 bp, Artificial sequence
  synthetic polynucleotide sequence
accagctgccagacgtccta

SEQ ID NO: 32118 - DNA, 22 bp, Artificial sequence
  synthetic polynucleotide sequence
ataacccagggatctgacacca

SEQ ID NO: 32119 - DNA, 19 bp, Artificial sequence
  synthetic polynucleotide sequence
gagtccagcccctgccaca

SEQ ID NO: 32120 - DNA, 22 bp, Artificial sequence
  synthetic polynucleotide sequence
aagccattggatccacagccca

SEQ ID NO: 32121 - DNA, 20 bp, Artificial sequence
  synthetic polynucleotide sequence
ctaccgccccaggacctcca

SEQ ID NO: 32122 - DNA, 20 bp, Artificial sequence
  synthetic polynucleotide sequence
atccatagccctgggagcga

SEQ ID NO: 32123 - DNA, 21 bp, Artificial sequence
  synthetic polynucleotide sequence
gagcccacttgctgaaagcca

SEQ ID NO: 32124 - DNA, 20 bp, Artificial sequence
  synthetic polynucleotide sequence
gtccagaggtggtcaaggga

SEQ ID NO: 32125 - DNA, 20 bp, Artificial sequence
  synthetic polynucleotide sequence
cttctgcagtccccgccaga

SEQ ID NO: 32126 - DNA, 20 bp, Artificial sequence
  synthetic polynucleotide sequence
gttgggtggtagaagctgga

SEQ ID NO: 32127 - DNA, 19 bp, Artificial sequence
  synthetic polynucleotide sequence
cgtccgatctgccgcccaa

SEQ ID NO: 32128 - DNA, 20 bp, Artificial sequence
  synthetic polynucleotide sequence
cggaagtagactgggcggca

SEQ ID NO: 32129 - DNA, 21 bp, Artificial sequence
  synthetic polynucleotide sequence
acctgctgcacccaggagcaa

SEQ ID NO: 32130 - DNA, 18 bp, Artificial sequence
  synthetic polynucleotide sequence
aggcccacagcacccgga

SEQ ID NO: 32131 - DNA, 21 bp, Artificial sequence
  synthetic polynucleotide sequence
cactacggcagctactacgga

SEQ ID NO: 32132 - DNA, 21 bp, Artificial sequence
  synthetic polynucleotide sequence
tagcctccaaagccagagcca

SEQ ID NO: 32133 - DNA, 20 bp, Artificial sequence
  synthetic polynucleotide sequence
gtggctatggaggctacgga

SEQ ID NO: 32134 - DNA, 20 bp, Artificial sequence
  synthetic polynucleotide sequence
atgatgggcggtagcagcca

SEQ ID NO: 32135 - DNA, 22 bp, Artificial sequence
  synthetic polynucleotide sequence
gctattacagaggcctgggcta

SEQ ID NO: 32136 - DNA, 21 bp, Artificial sequence
  synthetic polynucleotide sequence
tccatagcatgatgggcggca

SEQ ID NO: 32137 - DNA, 20 bp, Artificial sequence
  synthetic polynucleotide sequence
gcctgggctacggctacgga

SEQ ID NO: 32138 - DNA, 20 bp, Artificial sequence
  synthetic polynucleotide sequence
gtagccaccgccatagccca

SEQ ID NO: 32139 - DNA, 20 bp, Artificial sequence
  synthetic polynucleotide sequence
gctactacagaggcctggga

SEQ ID NO: 32140 - DNA, 20 bp, Artificial sequence
  synthetic polynucleotide sequence
tcacggcatgatgggcggca

SEQ ID NO: 32141 - DNA, 21 bp, Artificial sequence
  synthetic polynucleotide sequence
tactccggcagctactatgga

SEQ ID NO: 32142 - DNA, 22 bp, Artificial sequence
  synthetic polynucleotide sequence
catagcatgatgggtggcagca

SEQ ID NO: 32143 - DNA, 23 bp, Artificial sequence
  synthetic polynucleotide sequence
gctgaaccatgagctactacaga

SEQ ID NO: 32144 - DNA, 18 bp, Artificial sequence
  synthetic polynucleotide sequence
agccacagccatagccca

SEQ ID NO: 32145 - DNA, 21 bp, Artificial sequence
  synthetic polynucleotide sequence
gtgttgcaactactacggcaa

SEQ ID NO: 32146 - DNA, 18 bp, Artificial sequence
  synthetic polynucleotide sequence
gagccaaacccacagcca

SEQ ID NO: 32147 - DNA, 18 bp, Artificial sequence
  synthetic polynucleotide sequence
aaggctgctgccgcccca

SEQ ID NO: 32148 - DNA, 18 bp, Artificial sequence
  synthetic polynucleotide sequence
ccgcagggggactgcaca

SEQ ID NO: 32149 - DNA, 23 bp, Artificial sequence
  synthetic polynucleotide sequence
gacaccatgtgctactaccacaa

SEQ ID NO: 32150 - DNA, 22 bp, Artificial sequence
  synthetic polynucleotide sequence
gaatcttccataggagcacgga

SEQ ID NO: 32151 - DNA, 23 bp, Artificial sequence
  synthetic polynucleotide sequence
cctagctgatcctcaagcacgaa

SEQ ID NO: 32152 - DNA, 20 bp, Artificial sequence
  synthetic polynucleotide sequence
gagggccaggattagctgca

SEQ ID NO: 32153 - DNA, 20 bp, Artificial sequence
  synthetic polynucleotide sequence
ccccagcaacctggtctaca

SEQ ID NO: 32154 - DNA, 23 bp, Artificial sequence
  synthetic polynucleotide sequence
gcccttgcagagagaggaaccca

SEQ ID NO: 32155 - DNA, 22 bp, Artificial sequence
  synthetic polynucleotide sequence
tccattaccaccctcacccaca

SEQ ID NO: 32156 - DNA, 21 bp, Artificial sequence
  synthetic polynucleotide sequence
ttgcaaagtccaccccaggaa

SEQ ID NO: 32157 - DNA, 20 bp, Artificial sequence
  synthetic polynucleotide sequence
ctgtgagcccaagacctgca

SEQ ID NO: 32158 - DNA, 20 bp, Artificial sequence
  synthetic polynucleotide sequence
tgatggggagttgcagggca

SEQ ID NO: 32159 - DNA, 21 bp, Artificial sequence
  synthetic polynucleotide sequence
tagttgccacccccaaaacca

SEQ ID NO: 32160 - DNA, 23 bp, Artificial sequence
  synthetic polynucleotide sequence
gaaatggagattgccaacccaca

SEQ ID NO: 32161 - DNA, 21 bp, Artificial sequence
  synthetic polynucleotide sequence
tccaagagttgccagccccaa

SEQ ID NO: 32162 - DNA, 21 bp, Artificial sequence
  synthetic polynucleotide sequence
acatgggtcagaggttggcaa

SEQ ID NO: 32163 - DNA, 22 bp, Artificial sequence
  synthetic polynucleotide sequence
accaccagctgccaaatgacca

SEQ ID NO: 32164 - DNA, 20 bp, Artificial sequence
  synthetic polynucleotide sequence
tcgcagggcctggaattgga

SEQ ID NO: 32165 - DNA, 20 bp, Artificial sequence
  synthetic polynucleotide sequence
cccgtcagtggtgaaggcca

SEQ ID NO: 32166 - DNA, 20 bp, Artificial sequence
  synthetic polynucleotide sequence
aagtcgatggctggcaggga

SEQ ID NO: 32167 - DNA, 21 bp, Artificial sequence
  synthetic polynucleotide sequence
agatcagcctccttcagccca

SEQ ID NO: 32168 - DNA, 21 bp, Artificial sequence
  synthetic polynucleotide sequence
ttgatcccactcagtccggga

SEQ ID NO: 32169 - DNA, 20 bp, Artificial sequence
  synthetic polynucleotide sequence
ccgggcctggagaccctcaa

SEQ ID NO: 32170 - DNA, 22 bp, Artificial sequence
  synthetic polynucleotide sequence
cactgagcaaagtagccatcca

SEQ ID NO: 32171 - DNA, 21 bp, Artificial sequence
  synthetic polynucleotide sequence
taccacaatcaccccctgcaa

SEQ ID NO: 32172 - DNA, 23 bp, Artificial sequence
  synthetic polynucleotide sequence
cttcaggaagctataggcatcca

SEQ ID NO: 32173 - DNA, 25 bp, Artificial sequence
  synthetic polynucleotide sequence
ccactaagtaactggtgaaagggca

SEQ ID NO: 32174 - DNA, 21 bp, Artificial sequence
  synthetic polynucleotide sequence
gctgggaagagatccatggga

SEQ ID NO: 32175 - DNA, 22 bp, Artificial sequence
  synthetic polynucleotide sequence
gcaggcccacagttgtagacca

SEQ ID NO: 32176 - DNA, 25 bp, Artificial sequence
  synthetic polynucleotide sequence
gaagagaaagaaagcaagggaggga

SEQ ID NO: 32177 - DNA, 20 bp, Artificial sequence
  synthetic polynucleotide sequence
tggccagaccacctgctgca

SEQ ID NO: 32178 - DNA, 23 bp, Artificial sequence
  synthetic polynucleotide sequence
cagcagcaagagccactagagca

SEQ ID NO: 32179 - DNA, 20 bp, Artificial sequence
  synthetic polynucleotide sequence
ccaccccatctgctgcggca

SEQ ID NO: 32180 - DNA, 25 bp, Artificial sequence
  synthetic polynucleotide sequence
gagagcaagaaggtgcacaaatcca

SEQ ID NO: 32181 - DNA, 20 bp, Artificial sequence
  synthetic polynucleotide sequence
ccgccccaactgctgccaga

SEQ ID NO: 32182 - DNA, 23 bp, Artificial sequence
  synthetic polynucleotide sequence
gacagcctcagcagcaagaagca

SEQ ID NO: 32183 - DNA, 20 bp, Artificial sequence
  synthetic polynucleotide sequence
caggaccacctgctgcagga

SEQ ID NO: 32184 - DNA, 20 bp, Artificial sequence
  synthetic polynucleotide sequence
tcacagcaagaggggtggca

SEQ ID NO: 32185 - DNA, 20 bp, Artificial sequence
  synthetic polynucleotide sequence
ccgagtctcctgccacacca

SEQ ID NO: 32186 - DNA, 20 bp, Artificial sequence
  synthetic polynucleotide sequence
cagcaagaggaggcacagca

SEQ ID NO: 32187 - DNA, 20 bp, Artificial sequence
  synthetic polynucleotide sequence
ccgagtctcctgccacacca

SEQ ID NO: 32188 - DNA, 20 bp, Artificial sequence
  synthetic polynucleotide sequence
cagcaagaggaggcgcagca

SEQ ID NO: 32189 - DNA, 20 bp, Artificial sequence
  synthetic polynucleotide sequence
cttcaccactggcccacaga

SEQ ID NO: 32190 - DNA, 20 bp, Artificial sequence
  synthetic polynucleotide sequence
ttggtgccaccaccggaaga

SEQ ID NO: 32191 - DNA, 20 bp, Artificial sequence
  synthetic polynucleotide sequence
cttgcgcggggtctaaggga

SEQ ID NO: 32192 - DNA, 20 bp, Artificial sequence
  synthetic polynucleotide sequence
gcactggcagcacacgggga

SEQ ID NO: 32193 - DNA, 19 bp, Artificial sequence
  synthetic polynucleotide sequence
ccttgcctggacgcgggca

SEQ ID NO: 32194 - DNA, 20 bp, Artificial sequence
  synthetic polynucleotide sequence
ctcagtcagccgagggagaa

SEQ ID NO: 32195 - DNA, 20 bp, Artificial sequence
  synthetic polynucleotide sequence
ccaaaccctgctgctgccaa

SEQ ID NO: 32196 - DNA, 20 bp, Artificial sequence
  synthetic polynucleotide sequence
cagcagcagggcttgaagca

SEQ ID NO: 32197 - DNA, 20 bp, Artificial sequence
  synthetic polynucleotide sequence
caaggggggctgtggctcca

SEQ ID NO: 32198 - DNA, 20 bp, Artificial sequence
  synthetic polynucleotide sequence
ccacagcctgaggagcagca

SEQ ID NO: 32199 - DNA, 20 bp, Artificial sequence
  synthetic polynucleotide sequence
tccagctgctgcaagcccta

SEQ ID NO: 32200 - DNA, 21 bp, Artificial sequence
  synthetic polynucleotide sequence
acagcaactagactgggagca

SEQ ID NO: 32201 - DNA, 21 bp, Artificial sequence
  synthetic polynucleotide sequence
gctcccgaaactgactgagga

SEQ ID NO: 32202 - DNA, 20 bp, Artificial sequence
  synthetic polynucleotide sequence
gtgaggagcagggagaggaa

SEQ ID NO: 32203 - DNA, 20 bp, Artificial sequence
  synthetic polynucleotide sequence
cttgtgggggctccaaggga

SEQ ID NO: 32204 - DNA, 20 bp, Artificial sequence
  synthetic polynucleotide sequence
gcactggcagcaaatgggga

SEQ ID NO: 32205 - DNA, 20 bp, Artificial sequence
  synthetic polynucleotide sequence
tgtaagccctgctgctgcca

SEQ ID NO: 32206 - DNA, 19 bp, Artificial sequence
  synthetic polynucleotide sequence
cactggcagcacacgggga

SEQ ID NO: 32207 - DNA, 20 bp, Artificial sequence
  synthetic polynucleotide sequence
ctgagctgccacagctccga

SEQ ID NO: 32208 - DNA, 21 bp, Artificial sequence
  synthetic polynucleotide sequence
caaggccaggtcagaggtaga

SEQ ID NO: 32209 - DNA, 21 bp, Artificial sequence
  synthetic polynucleotide sequence
ctgccaatccagctgctgcaa

SEQ ID NO: 32210 - DNA, 20 bp, Artificial sequence
  synthetic polynucleotide sequence
gcactggtagcacacaggga

SEQ ID NO: 32211 - DNA, 20 bp, Artificial sequence
  synthetic polynucleotide sequence
gtgtggcagctactacggaa

SEQ ID NO: 32212 - DNA, 18 bp, Artificial sequence
  synthetic polynucleotide sequence
gccagagccagagccgca

SEQ ID NO: 32213 - DNA, 21 bp, Artificial sequence
  synthetic polynucleotide sequence
ctacggaaactactacggcga

SEQ ID NO: 32214 - DNA, 21 bp, Artificial sequence
  synthetic polynucleotide sequence
acagccacagaagaagcggga

SEQ ID NO: 32215 - DNA, 22 bp, Artificial sequence
  synthetic polynucleotide sequence
acaaccaacaccatgtgtggca

SEQ ID NO: 32216 - DNA, 21 bp, Artificial sequence
  synthetic polynucleotide sequence
gtagccacagccacagaagga

SEQ ID NO: 32217 - DNA, 25 bp, Artificial sequence
  synthetic polynucleotide sequence
ctgcacagaacaacctgaagagcaa

SEQ ID NO: 32218 - DNA, 25 bp, Artificial sequence
  synthetic polynucleotide sequence
agaccacagcaagaagtcagcaaga

SEQ ID NO: 32219 - DNA, 20 bp, Artificial sequence
  synthetic polynucleotide sequence
cccaggatgctactggggca

SEQ ID NO: 32220 - DNA, 20 bp, Artificial sequence
  synthetic polynucleotide sequence
tcctgtagccgaaagcccca

SEQ ID NO: 32221 - DNA, 21 bp, Artificial sequence
  synthetic polynucleotide sequence
agatccacctgctgccaacca

SEQ ID NO: 32222 - DNA, 20 bp, Artificial sequence
  synthetic polynucleotide sequence
tagcaggtggtctggcagca

SEQ ID NO: 32223 - DNA, 20 bp, Artificial sequence
  synthetic polynucleotide sequence
cacaccctgctgccagccca

SEQ ID NO: 32224 - DNA, 20 bp, Artificial sequence
  synthetic polynucleotide sequence
ctgcagtacacaggtgcaca

SEQ ID NO: 32225 - DNA, 25 bp, Artificial sequence
  synthetic polynucleotide sequence
ccaagagaactaccatcctcacaca

SEQ ID NO: 32226 - DNA, 25 bp, Artificial sequence
  synthetic polynucleotide sequence
ccacaaggtgtaaggaaagagggaa

SEQ ID NO: 32227 - DNA, 20 bp, Artificial sequence
  synthetic polynucleotide sequence
cacaccctgctgtcagccca

SEQ ID NO: 32228 - DNA, 20 bp, Artificial sequence
  synthetic polynucleotide sequence
ctgcagtacacaggtgcaca

SEQ ID NO: 32229 - DNA, 20 bp, Artificial sequence
  synthetic polynucleotide sequence
ccccgcctgctgtgagacca

SEQ ID NO: 32230 - DNA, 20 bp, Artificial sequence
  synthetic polynucleotide sequence
gaaggctggcagcagctgga

SEQ ID NO: 32231 - DNA, 22 bp, Artificial sequence
  synthetic polynucleotide sequence
ggatgcagatgtacagccgtca

SEQ ID NO: 32232 - DNA, 21 bp, Artificial sequence
  synthetic polynucleotide sequence
tggtgacacagactcggtgga

SEQ ID NO: 32233 - DNA, 20 bp, Artificial sequence
  synthetic polynucleotide sequence
actgcccctttgaccccaca

SEQ ID NO: 32234 - DNA, 19 bp, Artificial sequence
  synthetic polynucleotide sequence
gtccttcctgcagggccca

SEQ ID NO: 32235 - DNA, 18 bp, Artificial sequence
  synthetic polynucleotide sequence
actctgcccagggagcca

SEQ ID NO: 32236 - DNA, 18 bp, Artificial sequence
  synthetic polynucleotide sequence
gcctcgggtcgtgacgca

SEQ ID NO: 32237 - DNA, 19 bp, Artificial sequence
  synthetic polynucleotide sequence
cctgcatgaacccgcccca

SEQ ID NO: 32238 - DNA, 21 bp, Artificial sequence
  synthetic polynucleotide sequence
ctgagatcccaaacagcccga

SEQ ID NO: 32239 - DNA, 21 bp, Artificial sequence
  synthetic polynucleotide sequence
tgaggccgaagagtcagagga

SEQ ID NO: 32240 - DNA, 21 bp, Artificial sequence
  synthetic polynucleotide sequence
cctttccaatgagctcgccga

SEQ ID NO: 32241 - DNA, 20 bp, Artificial sequence
  synthetic polynucleotide sequence
aggccgacgtacccaaggaa

SEQ ID NO: 32242 - DNA, 20 bp, Artificial sequence
  synthetic polynucleotide sequence
ctcaaacagggcagagcgga

SEQ ID NO: 32243 - DNA, 18 bp, Artificial sequence
  synthetic polynucleotide sequence
tgcccctccaccaagaga

SEQ ID NO: 32244 - DNA, 21 bp, Artificial sequence
  synthetic polynucleotide sequence
tctaccacaggacttgagtca

SEQ ID NO: 32245 - DNA, 22 bp, Artificial sequence
  synthetic polynucleotide sequence
attgccacctcagaacagagca

SEQ ID NO: 32246 - DNA, 20 bp, Artificial sequence
  synthetic polynucleotide sequence
cgttgatggctggggagcca

SEQ ID NO: 32247 - DNA, 20 bp, Artificial sequence
  synthetic polynucleotide sequence
caccgggagaagcagaccga

SEQ ID NO: 32248 - DNA, 21 bp, Artificial sequence
  synthetic polynucleotide sequence
gctctcagggaacatgggcca

SEQ ID NO: 32249 - DNA, 21 bp, Artificial sequence
  synthetic polynucleotide sequence
tgctcttccgccaacccagca

SEQ ID NO: 32250 - DNA, 21 bp, Artificial sequence
  synthetic polynucleotide sequence
atgaggaagtagctgccctga

SEQ ID NO: 32251 - DNA, 22 bp, Artificial sequence
  synthetic polynucleotide sequence
atgacacactctgcatcagcga

SEQ ID NO: 32252 - DNA, 19 bp, Artificial sequence
  synthetic polynucleotide sequence
tggaccaatggaccagcca

SEQ ID NO: 32253 - DNA, 22 bp, Artificial sequence
  synthetic polynucleotide sequence
cgacaatgaaggcattgcggaa

SEQ ID NO: 32254 - DNA, 20 bp, Artificial sequence
  synthetic polynucleotide sequence
gaggaactggagccactcga

SEQ ID NO: 32255 - DNA, 18 bp, Artificial sequence
  synthetic polynucleotide sequence
ggagaggatgttccggca

SEQ ID NO: 32256 - DNA, 20 bp, Artificial sequence
  synthetic polynucleotide sequence
gaggatgagcaggacgagga

SEQ ID NO: 32257 - DNA, 21 bp, Artificial sequence
  synthetic polynucleotide sequence
cagagcactcatcctgcgaca

SEQ ID NO: 32258 - DNA, 20 bp, Artificial sequence
  synthetic polynucleotide sequence
atagggcctgaagtctggga

SEQ ID NO: 32259 - DNA, 21 bp, Artificial sequence
  synthetic polynucleotide sequence
gtgcagtgacagaggcagtga

SEQ ID NO: 32260 - DNA, 20 bp, Artificial sequence
  synthetic polynucleotide sequence
tcactcctgagccagtggga

SEQ ID NO: 32261 - DNA, 21 bp, Artificial sequence
  synthetic polynucleotide sequence
cgacagtcgccaagtggacca

SEQ ID NO: 32262 - DNA, 23 bp, Artificial sequence
  synthetic polynucleotide sequence
caaatgagtgggtagagagcaga

SEQ ID NO: 32263 - DNA, 18 bp, Artificial sequence
  synthetic polynucleotide sequence
cacaccgctgaaggccaa

SEQ ID NO: 32264 - DNA, 18 bp, Artificial sequence
  synthetic polynucleotide sequence
gagggtcgtcctccagca

SEQ ID NO: 32265 - DNA, 19 bp, Artificial sequence
  synthetic polynucleotide sequence
cggcgaagctgttcaagga

SEQ ID NO: 32266 - DNA, 18 bp, Artificial sequence
  synthetic polynucleotide sequence
cctccgcgacggtgagga

SEQ ID NO: 32267 - DNA, 22 bp, Artificial sequence
  synthetic polynucleotide sequence
aaaggtgaacagtcagcccaga

SEQ ID NO: 32268 - DNA, 18 bp, Artificial sequence
  synthetic polynucleotide sequence
gggctgacaccgtggaca

SEQ ID NO: 32269 - DNA, 22 bp, Artificial sequence
  synthetic polynucleotide sequence
gacatccgtaaagccacaagga

SEQ ID NO: 32270 - DNA, 21 bp, Artificial sequence
  synthetic polynucleotide sequence
aaggccatctcggacatggga

SEQ ID NO: 32271 - DNA, 17 bp, Artificial sequence
  synthetic polynucleotide sequence
gacgggagggcacggga

SEQ ID NO: 32272 - DNA, 21 bp, Artificial sequence
  synthetic polynucleotide sequence
ggtaaccaagagcgaccagga

SEQ ID NO: 32273 - DNA, 22 bp, Artificial sequence
  synthetic polynucleotide sequence
gatctcaggtccagcagaacca

SEQ ID NO: 32274 - DNA, 20 bp, Artificial sequence
  synthetic polynucleotide sequence
cctgaactgctgccgccgaa

SEQ ID NO: 32275 - DNA, 21 bp, Artificial sequence
  synthetic polynucleotide sequence
gaccccagtccctaacacaga

SEQ ID NO: 32276 - DNA, 21 bp, Artificial sequence
  synthetic polynucleotide sequence
accagcaggacactactggca

SEQ ID NO: 32277 - DNA, 21 bp, Artificial sequence
  synthetic polynucleotide sequence
ctcccacggaatcctcagaga

SEQ ID NO: 32278 - DNA, 21 bp, Artificial sequence
  synthetic polynucleotide sequence
tcatcagtgtggccaggggta

SEQ ID NO: 32279 - DNA, 19 bp, Artificial sequence
  synthetic polynucleotide sequence
gccaccaccaaggagcaga

SEQ ID NO: 32280 - DNA, 18 bp, Artificial sequence
  synthetic polynucleotide sequence
ggagtgtgacgggtggga

SEQ ID NO: 32281 - DNA, 20 bp, Artificial sequence
  synthetic polynucleotide sequence
gtgcccaacgctctgggaga

SEQ ID NO: 32282 - DNA, 22 bp, Artificial sequence
  synthetic polynucleotide sequence
aagccaaaggctccagtcacca

SEQ ID NO: 32283 - DNA, 19 bp, Artificial sequence
  synthetic polynucleotide sequence
gacccccttggaggcggaa

SEQ ID NO: 32284 - DNA, 20 bp, Artificial sequence
  synthetic polynucleotide sequence
ggacgaccaggatcctgcca

SEQ ID NO: 32285 - DNA, 18 bp, Artificial sequence
  synthetic polynucleotide sequence
gccgtcggacaacagtca

SEQ ID NO: 32286 - DNA, 18 bp, Artificial sequence
  synthetic polynucleotide sequence
tctggcgatggaggcaga

SEQ ID NO: 32287 - DNA, 18 bp, Artificial sequence
  synthetic polynucleotide sequence
ccgcctggagagggagga

SEQ ID NO: 32288 - DNA, 22 bp, Artificial sequence
  synthetic polynucleotide sequence
ggaagtcactgtgctcagacca

SEQ ID NO: 32289 - DNA, 20 bp, Artificial sequence
  synthetic polynucleotide sequence
ctgccatcctggccaagcaa

SEQ ID NO: 32290 - DNA, 20 bp, Artificial sequence
  synthetic polynucleotide sequence
caggcaaagcgatgcctcca

SEQ ID NO: 32291 - DNA, 20 bp, Artificial sequence
  synthetic polynucleotide sequence
cagtgacacctgtgacccca

SEQ ID NO: 32292 - DNA, 19 bp, Artificial sequence
  synthetic polynucleotide sequence
ggctgtgaggacaggcaca

SEQ ID NO: 32293 - DNA, 20 bp, Artificial sequence
  synthetic polynucleotide sequence
gtggagctcactgatgggca

SEQ ID NO: 32294 - DNA, 18 bp, Artificial sequence
  synthetic polynucleotide sequence
agcgttggcaggccacca

SEQ ID NO: 32295 - DNA, 18 bp, Artificial sequence
  synthetic polynucleotide sequence
actcggtggcagtcacca

SEQ ID NO: 32296 - DNA, 18 bp, Artificial sequence
  synthetic polynucleotide sequence
tggcaggtgggaagggga

SEQ ID NO: 32297 - DNA, 19 bp, Artificial sequence
  synthetic polynucleotide sequence
cctggaccctgaggacaca

SEQ ID NO: 32298 - DNA, 18 bp, Artificial sequence
  synthetic polynucleotide sequence
agtggccagttccaggca

SEQ ID NO: 32299 - DNA, 18 bp, Artificial sequence
  synthetic polynucleotide sequence
acgcgcagagcaaccaca

SEQ ID NO: 32300 - DNA, 18 bp, Artificial sequence
  synthetic polynucleotide sequence
cagagcgagtcatggcga

SEQ ID NO: 32301 - DNA, 18 bp, Artificial sequence
  synthetic polynucleotide sequence
gccagtgcgacaaagcca

SEQ ID NO: 32302 - DNA, 18 bp, Artificial sequence
  synthetic polynucleotide sequence
gcaagatggcccgaagga

SEQ ID NO: 32303 - DNA, 18 bp, Artificial sequence
  synthetic polynucleotide sequence
tcacacagggggtgagca

SEQ ID NO: 32304 - DNA, 19 bp, Artificial sequence
  synthetic polynucleotide sequence
ggccttcaggacagggaca

SEQ ID NO: 32305 - DNA, 18 bp, Artificial sequence
  synthetic polynucleotide sequence
ccgacactgatgcagcca

SEQ ID NO: 32306 - DNA, 18 bp, Artificial sequence
  synthetic polynucleotide sequence
tggtctgggacagcacca

SEQ ID NO: 32307 - DNA, 20 bp, Artificial sequence
  synthetic polynucleotide sequence
ggcatcacggctgtcaccca

SEQ ID NO: 32308 - DNA, 20 bp, Artificial sequence
  synthetic polynucleotide sequence
agcgatcacagcggcggcca

SEQ ID NO: 32309 - DNA, 18 bp, Artificial sequence
  synthetic polynucleotide sequence
tcacgtgactggccagga

SEQ ID NO: 32310 - DNA, 19 bp, Artificial sequence
  synthetic polynucleotide sequence
gcgctcacagtgctgacca

SEQ ID NO: 32311 - DNA, 20 bp, Artificial sequence
  synthetic polynucleotide sequence
cagagctggaagagagggca

SEQ ID NO: 32312 - DNA, 18 bp, Artificial sequence
  synthetic polynucleotide sequence
tgtagcagcctgggggca

SEQ ID NO: 32313 - DNA, 18 bp, Artificial sequence
  synthetic polynucleotide sequence
ggaccagtgccatcccaa

SEQ ID NO: 32314 - DNA, 18 bp, Artificial sequence
  synthetic polynucleotide sequence
ggcagcccttgatggaga

SEQ ID NO: 32315 - DNA, 20 bp, Artificial sequence
  synthetic polynucleotide sequence
gagcacgtccgtgtcacgaa

SEQ ID NO: 32316 - DNA, 20 bp, Artificial sequence
  synthetic polynucleotide sequence
gtccagcagacactcctcca

SEQ ID NO: 32317 - DNA, 22 bp, Artificial sequence
  synthetic polynucleotide sequence
tgcagctgaacatcactcagga

SEQ ID NO: 32318 - DNA, 19 bp, Artificial sequence
  synthetic polynucleotide sequence
gagcagtgtgagaacggca

SEQ ID NO: 32319 - DNA, 19 bp, Artificial sequence
  synthetic polynucleotide sequence
gcctccagttgtcagccca

SEQ ID NO: 32320 - DNA, 20 bp, Artificial sequence
  synthetic polynucleotide sequence
tgattgacaccttaggcgga

SEQ ID NO: 32321 - DNA, 21 bp, Artificial sequence
  synthetic polynucleotide sequence
atccgcagaagacggtcacca

SEQ ID NO: 32322 - DNA, 20 bp, Artificial sequence
  synthetic polynucleotide sequence
taccatgatgacgaggccca

SEQ ID NO: 32323 - DNA, 20 bp, Artificial sequence
  synthetic polynucleotide sequence
cttgccaagacagccagcaa

SEQ ID NO: 32324 - DNA, 20 bp, Artificial sequence
  synthetic polynucleotide sequence
tggggctggctggtaagaga

SEQ ID NO: 32325 - DNA, 20 bp, Artificial sequence
  synthetic polynucleotide sequence
aacatctgggccgcctacga

SEQ ID NO: 32326 - DNA, 18 bp, Artificial sequence
  synthetic polynucleotide sequence
gggtgaggggctcctcca

SEQ ID NO: 32327 - DNA, 25 bp, Artificial sequence
  synthetic polynucleotide sequence
agacgggatcacaatgggaaaagga

SEQ ID NO: 32328 - DNA, 24 bp, Artificial sequence
  synthetic polynucleotide sequence
cacttccctagcaggcatagagaa

SEQ ID NO: 32329 - DNA, 20 bp, Artificial sequence
  synthetic polynucleotide sequence
atcccagaccagctcggcta

SEQ ID NO: 32330 - DNA, 19 bp, Artificial sequence
  synthetic polynucleotide sequence
ggtgcagccggaaaccgca

SEQ ID NO: 32331 - DNA, 20 bp, Artificial sequence
  synthetic polynucleotide sequence
gaggcgaccttggagcagca

SEQ ID NO: 32332 - DNA, 20 bp, Artificial sequence
  synthetic polynucleotide sequence
tctgacagggtcccgcggca

SEQ ID NO: 32333 - DNA, 20 bp, Artificial sequence
  synthetic polynucleotide sequence
tgccacggttctgcagggaa

SEQ ID NO: 32334 - DNA, 19 bp, Artificial sequence
  synthetic polynucleotide sequence
tgtggggactagcaggtca

SEQ ID NO: 32335 - DNA, 21 bp, Artificial sequence
  synthetic polynucleotide sequence
gctacgggatatgccatggga

SEQ ID NO: 32336 - DNA, 21 bp, Artificial sequence
  synthetic polynucleotide sequence
gggtctgtcaggaatgcggca

SEQ ID NO: 32337 - DNA, 22 bp, Artificial sequence
  synthetic polynucleotide sequence
tggaaccgaatacttgggggca

SEQ ID NO: 32338 - DNA, 18 bp, Artificial sequence
  synthetic polynucleotide sequence
gccgagctcaggtggcca

SEQ ID NO: 32339 - DNA, 20 bp, Artificial sequence
  synthetic polynucleotide sequence
cactacaaaggcagccccaa

SEQ ID NO: 32340 - DNA, 20 bp, Artificial sequence
  synthetic polynucleotide sequence
aagctttgcagcagacacga

SEQ ID NO: 32341 - DNA, 20 bp, Artificial sequence
  synthetic polynucleotide sequence
aaactccatgccagctgtca

SEQ ID NO: 32342 - DNA, 20 bp, Artificial sequence
  synthetic polynucleotide sequence
gaatggaatcagccaaccca

SEQ ID NO: 32343 - DNA, 18 bp, Artificial sequence
  synthetic polynucleotide sequence
gcagcctggatcatccca

SEQ ID NO: 32344 - DNA, 21 bp, Artificial sequence
  synthetic polynucleotide sequence
aattaggaggcagttgccgta

SEQ ID NO: 32345 - DNA, 21 bp, Artificial sequence
  synthetic polynucleotide sequence
cggcgtagtcaagaaccggga

SEQ ID NO: 32346 - DNA, 21 bp, Artificial sequence
  synthetic polynucleotide sequence
ccaacttgaggtaggcgggca

SEQ ID NO: 32347 - DNA, 20 bp, Artificial sequence
  synthetic polynucleotide sequence
ctctacctgtcagacgccga

SEQ ID NO: 32348 - DNA, 18 bp, Artificial sequence
  synthetic polynucleotide sequence
gcccatacatgggcagga

SEQ ID NO: 32349 - DNA, 18 bp, Artificial sequence
  synthetic polynucleotide sequence
cagggcctccattgagca

SEQ ID NO: 32350 - DNA, 19 bp, Artificial sequence
  synthetic polynucleotide sequence
ggtgtagagagtgcccgca

SEQ ID NO: 32351 - DNA, 21 bp, Artificial sequence
  synthetic polynucleotide sequence
tcgcccgctctctaccaacca

SEQ ID NO: 32352 - DNA, 21 bp, Artificial sequence
  synthetic polynucleotide sequence
ctcacgggaatccatcaccca

SEQ ID NO: 32353 - DNA, 21 bp, Artificial sequence
  synthetic polynucleotide sequence
tcacatacagagtctgcccca

SEQ ID NO: 32354 - DNA, 19 bp, Artificial sequence
  synthetic polynucleotide sequence
tctgagtccaagtcaggca

SEQ ID NO: 32355 - DNA, 19 bp, Artificial sequence
  synthetic polynucleotide sequence
tttcgtggagcaggtagca

SEQ ID NO: 32356 - DNA, 21 bp, Artificial sequence
  synthetic polynucleotide sequence
accctcaggatgagcacctga

SEQ ID NO: 32357 - DNA, 20 bp, Artificial sequence
  synthetic polynucleotide sequence
cccgcagagagataccggga

SEQ ID NO: 32358 - DNA, 19 bp, Artificial sequence
  synthetic polynucleotide sequence
cggctgagacgcttcccca

SEQ ID NO: 32359 - DNA, 20 bp, Artificial sequence
  synthetic polynucleotide sequence
ccggaaggtgaggaggacca

SEQ ID NO: 32360 - DNA, 20 bp, Artificial sequence
  synthetic polynucleotide sequence
ccagagcccacagcttagga

SEQ ID NO: 32361 - DNA, 21 bp, Artificial sequence
  synthetic polynucleotide sequence
aagagtgtcgcacccaggaga

SEQ ID NO: 32362 - DNA, 22 bp, Artificial sequence
  synthetic polynucleotide sequence
attgctgccaaagtatcccgga

SEQ ID NO: 32363 - DNA, 21 bp, Artificial sequence
  synthetic polynucleotide sequence
agaagccctcacattgcacca

SEQ ID NO: 32364 - DNA, 22 bp, Artificial sequence
  synthetic polynucleotide sequence
aaatccagaatacgaggcccca

SEQ ID NO: 32365 - DNA, 20 bp, Artificial sequence
  synthetic polynucleotide sequence
gacccggagttcctgcagca

SEQ ID NO: 32366 - DNA, 19 bp, Artificial sequence
  synthetic polynucleotide sequence
tgcaaaagcctgacaccca

SEQ ID NO: 32367 - DNA, 18 bp, Artificial sequence
  synthetic polynucleotide sequence
ggtcagaccgaggaccca

SEQ ID NO: 32368 - DNA, 18 bp, Artificial sequence
  synthetic polynucleotide sequence
caccacagctcaggccca

SEQ ID NO: 32369 - DNA, 25 bp, Artificial sequence
  synthetic polynucleotide sequence
taacaagaagcccagtggtgaggaa

SEQ ID NO: 32370 - DNA, 20 bp, Artificial sequence
  synthetic polynucleotide sequence
ggagggacatgagagggaga

SEQ ID NO: 32371 - DNA, 18 bp, Artificial sequence
  synthetic polynucleotide sequence
cccctggcatccgagaca

SEQ ID NO: 32372 - DNA, 18 bp, Artificial sequence
  synthetic polynucleotide sequence
tagccgctccaggatgca

SEQ ID NO: 32373 - DNA, 20 bp, Artificial sequence
  synthetic polynucleotide sequence
gcgcgagtccaggaaggtca

SEQ ID NO: 32374 - DNA, 18 bp, Artificial sequence
  synthetic polynucleotide sequence
gtggctgccacctcccca

SEQ ID NO: 32375 - DNA, 20 bp, Artificial sequence
  synthetic polynucleotide sequence
agggagacctggaatgcaga

SEQ ID NO: 32376 - DNA, 20 bp, Artificial sequence
  synthetic polynucleotide sequence
tatgacgaaggagcagcaga

SEQ ID NO: 32377 - DNA, 18 bp, Artificial sequence
  synthetic polynucleotide sequence
gagccgcaaaagcgccaa

SEQ ID NO: 32378 - DNA, 18 bp, Artificial sequence
  synthetic polynucleotide sequence
ttgcggacgggaacggga

SEQ ID NO: 32379 - DNA, 22 bp, Artificial sequence
  synthetic polynucleotide sequence
aatgtccccacagcagaagaga

SEQ ID NO: 32380 - DNA, 21 bp, Artificial sequence
  synthetic polynucleotide sequence
ccagcatctccacagccctca

SEQ ID NO: 32381 - DNA, 18 bp, Artificial sequence
  synthetic polynucleotide sequence
gggagaagccactcccga

SEQ ID NO: 32382 - DNA, 19 bp, Artificial sequence
  synthetic polynucleotide sequence
ccactctccacgctcacca

SEQ ID NO: 32383 - DNA, 21 bp, Artificial sequence
  synthetic polynucleotide sequence
gatcttcccagacccgtcaga

SEQ ID NO: 32384 - DNA, 19 bp, Artificial sequence
  synthetic polynucleotide sequence
ggaactcctcagggggcca

SEQ ID NO: 32385 - DNA, 22 bp, Artificial sequence
  synthetic polynucleotide sequence
gcaaggttgaaggtcaccagca

SEQ ID NO: 32386 - DNA, 18 bp, Artificial sequence
  synthetic polynucleotide sequence
ggtcctgcccccagctga

SEQ ID NO: 32387 - DNA, 19 bp, Artificial sequence
  synthetic polynucleotide sequence
tagccaggctctaccccaa

SEQ ID NO: 32388 - DNA, 18 bp, Artificial sequence
  synthetic polynucleotide sequence
tggccacactgagccgga

SEQ ID NO: 32389 - DNA, 18 bp, Artificial sequence
  synthetic polynucleotide sequence
ccgagaagctcgtgacga

SEQ ID NO: 32390 - DNA, 19 bp, Artificial sequence
  synthetic polynucleotide sequence
ggtagggcacacgctgaca

SEQ ID NO: 32391 - DNA, 20 bp, Artificial sequence
  synthetic polynucleotide sequence
gagacgggctagctacgcga

SEQ ID NO: 32392 - DNA, 20 bp, Artificial sequence
  synthetic polynucleotide sequence
ctgcacaggacttccgggga

SEQ ID NO: 32393 - DNA, 20 bp, Artificial sequence
  synthetic polynucleotide sequence
tagaagtccagcctccccta

SEQ ID NO: 32394 - DNA, 20 bp, Artificial sequence
  synthetic polynucleotide sequence
tgctgctaccactggcacca

SEQ ID NO: 32395 - DNA, 22 bp, Artificial sequence
  synthetic polynucleotide sequence
aataggaggtctgcagcatgca

SEQ ID NO: 32396 - DNA, 22 bp, Artificial sequence
  synthetic polynucleotide sequence
taaacttccacaggagcactga

SEQ ID NO: 32397 - DNA, 18 bp, Artificial sequence
  synthetic polynucleotide sequence
agcagcgcataaccacca

SEQ ID NO: 32398 - DNA, 18 bp, Artificial sequence
  synthetic polynucleotide sequence
ctgggagtcctgccagga

SEQ ID NO: 32399 - DNA, 20 bp, Artificial sequence
  synthetic polynucleotide sequence
gcctgcaagagtggctgaga

SEQ ID NO: 32400 - DNA, 20 bp, Artificial sequence
  synthetic polynucleotide sequence
tggatcccagggcagaggga

SEQ ID NO: 32401 - DNA, 20 bp, Artificial sequence
  synthetic polynucleotide sequence
cacccctagatgccccccaa

SEQ ID NO: 32402 - DNA, 18 bp, Artificial sequence
  synthetic polynucleotide sequence
cagcagccacctccccca

SEQ ID NO: 32403 - DNA, 23 bp, Artificial sequence
  synthetic polynucleotide sequence
caggtccaagggaaagctctgaa

SEQ ID NO: 32404 - DNA, 20 bp, Artificial sequence
  synthetic polynucleotide sequence
gcgtgggagggtagccacaa

SEQ ID NO: 32405 - DNA, 20 bp, Artificial sequence
  synthetic polynucleotide sequence
ccaccgtcgcagaccccaga

SEQ ID NO: 32406 - DNA, 20 bp, Artificial sequence
  synthetic polynucleotide sequence
cttcagcagcagcctccaga

SEQ ID NO: 32407 - DNA, 20 bp, Artificial sequence
  synthetic polynucleotide sequence
gtaaccgcatccctcaggca

SEQ ID NO: 32408 - DNA, 20 bp, Artificial sequence
  synthetic polynucleotide sequence
gaaggagtggggaacgagga

SEQ ID NO: 32409 - DNA, 20 bp, Artificial sequence
  synthetic polynucleotide sequence
cacaccgaagtgccccccaa

SEQ ID NO: 32410 - DNA, 18 bp, Artificial sequence
  synthetic polynucleotide sequence
caacagccgcctccccca

SEQ ID NO: 32411 - DNA, 20 bp, Artificial sequence
  synthetic polynucleotide sequence
agtgccgacctcagtgccca

SEQ ID NO: 32412 - DNA, 18 bp, Artificial sequence
  synthetic polynucleotide sequence
gccacccccagagctgca

SEQ ID NO: 32413 - DNA, 21 bp, Artificial sequence
  synthetic polynucleotide sequence
tccccctaaatgcctgcccca

SEQ ID NO: 32414 - DNA, 20 bp, Artificial sequence
  synthetic polynucleotide sequence
cagagttgcagcagccccca

SEQ ID NO: 32415 - DNA, 21 bp, Artificial sequence
  synthetic polynucleotide sequence
tccccccaaatgcccaccaca

SEQ ID NO: 32416 - DNA, 18 bp, Artificial sequence
  synthetic polynucleotide sequence
cggcgccggtggaagaga

SEQ ID NO: 32417 - DNA, 20 bp, Artificial sequence
  synthetic polynucleotide sequence
cactcatgggtggacaggga

SEQ ID NO: 32418 - DNA, 20 bp, Artificial sequence
  synthetic polynucleotide sequence
ggggtgctccatcaagcaca

SEQ ID NO: 32419 - DNA, 22 bp, Artificial sequence
  synthetic polynucleotide sequence
agcagaaccagaagcagtgcca

SEQ ID NO: 32420 - DNA, 18 bp, Artificial sequence
  synthetic polynucleotide sequence
cccccagagcttggggca

SEQ ID NO: 32421 - DNA, 21 bp, Artificial sequence
  synthetic polynucleotide sequence
cctgagccaccacagacacca

SEQ ID NO: 32422 - DNA, 20 bp, Artificial sequence
  synthetic polynucleotide sequence
caacagccccctccagagca

SEQ ID NO: 32423 - DNA, 21 bp, Artificial sequence
  synthetic polynucleotide sequence
tcccatggaaggacttcggaa

SEQ ID NO: 32424 - DNA, 20 bp, Artificial sequence
  synthetic polynucleotide sequence
gagggaaagccaggccagaa

SEQ ID NO: 32425 - DNA, 21 bp, Artificial sequence
  synthetic polynucleotide sequence
cccaaatgctcccctccccaa

SEQ ID NO: 32426 - DNA, 21 bp, Artificial sequence
  synthetic polynucleotide sequence
tgcccctacttaggcagcgca

SEQ ID NO: 32427 - DNA, 18 bp, Artificial sequence
  synthetic polynucleotide sequence
agggatgaccaacccgga

SEQ ID NO: 32428 - DNA, 19 bp, Artificial sequence
  synthetic polynucleotide sequence
ccagcacactgcgcaggta

SEQ ID NO: 32429 - DNA, 22 bp, Artificial sequence
  synthetic polynucleotide sequence
tcatattcccagaagggactga

SEQ ID NO: 32430 - DNA, 20 bp, Artificial sequence
  synthetic polynucleotide sequence
gtgaggatacgccacagtga

SEQ ID NO: 32431 - DNA, 21 bp, Artificial sequence
  synthetic polynucleotide sequence
cctcctgaagtgggcagccaa

SEQ ID NO: 32432 - DNA, 19 bp, Artificial sequence
  synthetic polynucleotide sequence
tcccacccattcgacagga

SEQ ID NO: 32433 - DNA, 21 bp, Artificial sequence
  synthetic polynucleotide sequence
accccaaggtactcccacaca

SEQ ID NO: 32434 - DNA, 21 bp, Artificial sequence
  synthetic polynucleotide sequence
aagcagttcccaccacctcca

SEQ ID NO: 32435 - DNA, 18 bp, Artificial sequence
  synthetic polynucleotide sequence
gggggcaagcacgtggca

SEQ ID NO: 32436 - DNA, 20 bp, Artificial sequence
  synthetic polynucleotide sequence
cacgagcttcacccctcgga

SEQ ID NO: 32437 - DNA, 18 bp, Artificial sequence
  synthetic polynucleotide sequence
ctggggcgtgcaacccaa

SEQ ID NO: 32438 - DNA, 18 bp, Artificial sequence
  synthetic polynucleotide sequence
tgacggcggccttggaga

SEQ ID NO: 32439 - DNA, 18 bp, Artificial sequence
  synthetic polynucleotide sequence
gctgataccggcagccca

SEQ ID NO: 32440 - DNA, 18 bp, Artificial sequence
  synthetic polynucleotide sequence
gggacagcatcagggcga

SEQ ID NO: 32441 - DNA, 20 bp, Artificial sequence
  synthetic polynucleotide sequence
cagctctacagccggaccca

SEQ ID NO: 32442 - DNA, 21 bp, Artificial sequence
  synthetic polynucleotide sequence
atgcatctgactggggcagca

SEQ ID NO: 32443 - DNA, 20 bp, Artificial sequence
  synthetic polynucleotide sequence
cgggagaaccaaggagctga

SEQ ID NO: 32444 - DNA, 18 bp, Artificial sequence
  synthetic polynucleotide sequence
ggtcgattgggacaggga

SEQ ID NO: 32445 - DNA, 20 bp, Artificial sequence
  synthetic polynucleotide sequence
cagtagggatggcgcccaca

SEQ ID NO: 32446 - DNA, 19 bp, Artificial sequence
  synthetic polynucleotide sequence
ctggtgctgggccccggga

SEQ ID NO: 32447 - DNA, 21 bp, Artificial sequence
  synthetic polynucleotide sequence
atggccctgagtgacatccga

SEQ ID NO: 32448 - DNA, 19 bp, Artificial sequence
  synthetic polynucleotide sequence
tccaccttccgcgtgcaga

SEQ ID NO: 32449 - DNA, 19 bp, Artificial sequence
  synthetic polynucleotide sequence
cgcccagacggacttcgga

SEQ ID NO: 32450 - DNA, 22 bp, Artificial sequence
  synthetic polynucleotide sequence
ctaatctgcagggatcgagcca

SEQ ID NO: 32451 - DNA, 20 bp, Artificial sequence
  synthetic polynucleotide sequence
ggaaggccccttagacctca

SEQ ID NO: 32452 - DNA, 19 bp, Artificial sequence
  synthetic polynucleotide sequence
gtagcatgccagccactga

SEQ ID NO: 32453 - DNA, 21 bp, Artificial sequence
  synthetic polynucleotide sequence
aacccctttcaccattcagga

SEQ ID NO: 32454 - DNA, 20 bp, Artificial sequence
  synthetic polynucleotide sequence
ccacagaagtcccaggacca

SEQ ID NO: 32455 - DNA, 19 bp, Artificial sequence
  synthetic polynucleotide sequence
ggaactggactccgaggga

SEQ ID NO: 32456 - DNA, 21 bp, Artificial sequence
  synthetic polynucleotide sequence
catcaatgagcagaagtggca

SEQ ID NO: 32457 - DNA, 18 bp, Artificial sequence
  synthetic polynucleotide sequence
gcatctgggatccacgca

SEQ ID NO: 32458 - DNA, 19 bp, Artificial sequence
  synthetic polynucleotide sequence
ggaagatccgggaccagga

SEQ ID NO: 32459 - DNA, 22 bp, Artificial sequence
  synthetic polynucleotide sequence
taaaatgtgggccctggacaga

SEQ ID NO: 32460 - DNA, 21 bp, Artificial sequence
  synthetic polynucleotide sequence
ttgtctttgggagccaacgca

SEQ ID NO: 32461 - DNA, 18 bp, Artificial sequence
  synthetic polynucleotide sequence
cttcagcatccggcagca

SEQ ID NO: 32462 - DNA, 21 bp, Artificial sequence
  synthetic polynucleotide sequence
catgggctcgagtatcacaca

SEQ ID NO: 32463 - DNA, 24 bp, Artificial sequence
  synthetic polynucleotide sequence
aacttacaacctcagtccccgaga

SEQ ID NO: 32464 - DNA, 20 bp, Artificial sequence
  synthetic polynucleotide sequence
ggagccaccatcctctgcca

SEQ ID NO: 32465 - DNA, 18 bp, Artificial sequence
  synthetic polynucleotide sequence
ggtcctcaggtgccacca

SEQ ID NO: 32466 - DNA, 18 bp, Artificial sequence
  synthetic polynucleotide sequence
cggcccatggctaccaga

SEQ ID NO: 32467 - DNA, 20 bp, Artificial sequence
  synthetic polynucleotide sequence
gggcaaaggcttggcatcca

SEQ ID NO: 32468 - DNA, 21 bp, Artificial sequence
  synthetic polynucleotide sequence
agatccttcagagggacgcca

SEQ ID NO: 32469 - DNA, 22 bp, Artificial sequence
  synthetic polynucleotide sequence
aacatggcagccctttcacgaa

SEQ ID NO: 32470 - DNA, 20 bp, Artificial sequence
  synthetic polynucleotide sequence
agtgggggctgtactggaca

SEQ ID NO: 32471 - DNA, 18 bp, Artificial sequence
  synthetic polynucleotide sequence
gcagctgccatggatgga

SEQ ID NO: 32472 - DNA, 21 bp, Artificial sequence
  synthetic polynucleotide sequence
cataggcactttcaaccacca

SEQ ID NO: 32473 - DNA, 21 bp, Artificial sequence
  synthetic polynucleotide sequence
gagtgcacccagtttccacca

SEQ ID NO: 32474 - DNA, 21 bp, Artificial sequence
  synthetic polynucleotide sequence
ttgaaaagggcctcctcctca

SEQ ID NO: 32475 - DNA, 20 bp, Artificial sequence
  synthetic polynucleotide sequence
ggctctccacggaacgtgca

SEQ ID NO: 32476 - DNA, 18 bp, Artificial sequence
  synthetic polynucleotide sequence
cggccttgagctgccgca

SEQ ID NO: 32477 - DNA, 18 bp, Artificial sequence
  synthetic polynucleotide sequence
cagcacacaaccacccga

SEQ ID NO: 32478 - DNA, 18 bp, Artificial sequence
  synthetic polynucleotide sequence
agcacgatggggaggaca

SEQ ID NO: 32479 - DNA, 20 bp, Artificial sequence
  synthetic polynucleotide sequence
gcccagtaactgtgtgccca

SEQ ID NO: 32480 - DNA, 20 bp, Artificial sequence
  synthetic polynucleotide sequence
gtccgggacaggcatactca

SEQ ID NO: 32481 - DNA, 18 bp, Artificial sequence
  synthetic polynucleotide sequence
ctccggtgcccagccaga

SEQ ID NO: 32482 - DNA, 18 bp, Artificial sequence
  synthetic polynucleotide sequence
gggatcctgcagacccga

SEQ ID NO: 32483 - DNA, 21 bp, Artificial sequence
  synthetic polynucleotide sequence
ccaccactgcaacgtcaccta

SEQ ID NO: 32484 - DNA, 19 bp, Artificial sequence
  synthetic polynucleotide sequence
cacgcaggcctctggtcca

SEQ ID NO: 32485 - DNA, 18 bp, Artificial sequence
  synthetic polynucleotide sequence
tcagccgcttccagccca

SEQ ID NO: 32486 - DNA, 18 bp, Artificial sequence
  synthetic polynucleotide sequence
ttcaccgtcggacaggga

SEQ ID NO: 32487 - DNA, 18 bp, Artificial sequence
  synthetic polynucleotide sequence
gagggacaaagccagcca

SEQ ID NO: 32488 - DNA, 18 bp, Artificial sequence
  synthetic polynucleotide sequence
agactgggcaagcctcga

SEQ ID NO: 32489 - DNA, 18 bp, Artificial sequence
  synthetic polynucleotide sequence
gacgccatgaaggtggca

SEQ ID NO: 32490 - DNA, 18 bp, Artificial sequence
  synthetic polynucleotide sequence
cgtcgtcatcccagccaa

SEQ ID NO: 32491 - DNA, 21 bp, Artificial sequence
  synthetic polynucleotide sequence
acctccaacctctctgcccga

SEQ ID NO: 32492 - DNA, 21 bp, Artificial sequence
  synthetic polynucleotide sequence
ttgttgcgcaaggggctgtca

SEQ ID NO: 32493 - DNA, 22 bp, Artificial sequence
  synthetic polynucleotide sequence
agaagtgagttcggcaaagaga

SEQ ID NO: 32494 - DNA, 20 bp, Artificial sequence
  synthetic polynucleotide sequence
ggaggctccaataggcctga

SEQ ID NO: 32495 - DNA, 20 bp, Artificial sequence
  synthetic polynucleotide sequence
ctaccgcactggcagggcca

SEQ ID NO: 32496 - DNA, 21 bp, Artificial sequence
  synthetic polynucleotide sequence
gcagagcacaagatgtccaca

SEQ ID NO: 32497 - DNA, 18 bp, Artificial sequence
  synthetic polynucleotide sequence
gcacgtgaagcctcagca

SEQ ID NO: 32498 - DNA, 18 bp, Artificial sequence
  synthetic polynucleotide sequence
acgggagagggcatgcca

SEQ ID NO: 32499 - DNA, 18 bp, Artificial sequence
  synthetic polynucleotide sequence
aggagggaggcaggacca

SEQ ID NO: 32500 - DNA, 18 bp, Artificial sequence
  synthetic polynucleotide sequence
ctccttggcacgagcgca

SEQ ID NO: 32501 - DNA, 20 bp, Artificial sequence
  synthetic polynucleotide sequence
ctgtgaccctgaagcaccaa

SEQ ID NO: 32502 - DNA, 20 bp, Artificial sequence
  synthetic polynucleotide sequence
gcccacacactcgtaagcca

SEQ ID NO: 32503 - DNA, 21 bp, Artificial sequence
  synthetic polynucleotide sequence
gaccgggaaagccgtttcaca

SEQ ID NO: 32504 - DNA, 19 bp, Artificial sequence
  synthetic polynucleotide sequence
ggcaacgcatgcatgggaa

SEQ ID NO: 32505 - DNA, 21 bp, Artificial sequence
  synthetic polynucleotide sequence
agcccaagaactgcgatccca

SEQ ID NO: 32506 - DNA, 19 bp, Artificial sequence
  synthetic polynucleotide sequence
cttggtgcagggctgggga

SEQ ID NO: 32507 - DNA, 21 bp, Artificial sequence
  synthetic polynucleotide sequence
gcaggacagtgatgacagcga

SEQ ID NO: 32508 - DNA, 20 bp, Artificial sequence
  synthetic polynucleotide sequence
gtggtggaagcctcaggcca

SEQ ID NO: 32509 - DNA, 20 bp, Artificial sequence
  synthetic polynucleotide sequence
catcctgcacgtgcgcgaca

SEQ ID NO: 32510 - DNA, 19 bp, Artificial sequence
  synthetic polynucleotide sequence
ctcctgcaacgcggtggga

SEQ ID NO: 32511 - DNA, 21 bp, Artificial sequence
  synthetic polynucleotide sequence
tgcccccgccacttactgaca

SEQ ID NO: 32512 - DNA, 21 bp, Artificial sequence
  synthetic polynucleotide sequence
tgagtgaactagaggcggcca

SEQ ID NO: 32513 - DNA, 18 bp, Artificial sequence
  synthetic polynucleotide sequence
gaggggcccctcgagaca

SEQ ID NO: 32514 - DNA, 22 bp, Artificial sequence
  synthetic polynucleotide sequence
ttgatacaccagcagcagagga

SEQ ID NO: 32515 - DNA, 22 bp, Artificial sequence
  synthetic polynucleotide sequence
atctggggaagaagagacagca

SEQ ID NO: 32516 - DNA, 20 bp, Artificial sequence
  synthetic polynucleotide sequence
tccgcagacgttcagctcga

SEQ ID NO: 32517 - DNA, 19 bp, Artificial sequence
  synthetic polynucleotide sequence
tgcctggcaatgtgggcga

SEQ ID NO: 32518 - DNA, 22 bp, Artificial sequence
  synthetic polynucleotide sequence
aaacttgtccacgaggtagcca

SEQ ID NO: 32519 - DNA, 18 bp, Artificial sequence
  synthetic polynucleotide sequence
cgtggccaaggtgcccca

SEQ ID NO: 32520 - DNA, 21 bp, Artificial sequence
  synthetic polynucleotide sequence
ctgtcctccctatacggcaca

SEQ ID NO: 32521 - DNA, 21 bp, Artificial sequence
  synthetic polynucleotide sequence
tcagcagcgccgaatgagaga

SEQ ID NO: 32522 - DNA, 21 bp, Artificial sequence
  synthetic polynucleotide sequence
aatggcagccaagctgatgga

SEQ ID NO: 32523 - DNA, 18 bp, Artificial sequence
  synthetic polynucleotide sequence
caaggcccaagaagccca

SEQ ID NO: 32524 - DNA, 18 bp, Artificial sequence
  synthetic polynucleotide sequence
atgggcacagcttggaca

SEQ ID NO: 32525 - DNA, 20 bp, Artificial sequence
  synthetic polynucleotide sequence
ctgtggacagagcaagcaca

SEQ ID NO: 32526 - DNA, 22 bp, Artificial sequence
  synthetic polynucleotide sequence
taagcactgagtgactgcacga

SEQ ID NO: 32527 - DNA, 19 bp, Artificial sequence
  synthetic polynucleotide sequence
ccatctcccccatccccca

SEQ ID NO: 32528 - DNA, 20 bp, Artificial sequence
  synthetic polynucleotide sequence
cctgccaacacaaggccgca

SEQ ID NO: 32529 - DNA, 20 bp, Artificial sequence
  synthetic polynucleotide sequence
tggaggagcaatcggactga

SEQ ID NO: 32530 - DNA, 21 bp, Artificial sequence
  synthetic polynucleotide sequence
agtgcacaagctccccactca

SEQ ID NO: 32531 - DNA, 20 bp, Artificial sequence
  synthetic polynucleotide sequence
cagcgaggacttgcaggaga

SEQ ID NO: 32532 - DNA, 18 bp, Artificial sequence
  synthetic polynucleotide sequence
ccatctccagctgcgaga

SEQ ID NO: 32533 - DNA, 21 bp, Artificial sequence
  synthetic polynucleotide sequence
cctcagctggagcaagccaca

SEQ ID NO: 32534 - DNA, 21 bp, Artificial sequence
  synthetic polynucleotide sequence
ctgtccatgcaacagcctcca

SEQ ID NO: 32535 - DNA, 21 bp, Artificial sequence
  synthetic polynucleotide sequence
ggcttcacagcatggcacaca

SEQ ID NO: 32536 - DNA, 20 bp, Artificial sequence
  synthetic polynucleotide sequence
cacacggaccacccctagca

SEQ ID NO: 32537 - DNA, 18 bp, Artificial sequence
  synthetic polynucleotide sequence
cccggcctcatcagggga

SEQ ID NO: 32538 - DNA, 21 bp, Artificial sequence
  synthetic polynucleotide sequence
gcttgctccgatcaccagaga

SEQ ID NO: 32539 - DNA, 18 bp, Artificial sequence
  synthetic polynucleotide sequence
gcaagcccagcctggaca

SEQ ID NO: 32540 - DNA, 18 bp, Artificial sequence
  synthetic polynucleotide sequence
agtcatcaggcagccgga

SEQ ID NO: 32541 - DNA, 18 bp, Artificial sequence
  synthetic polynucleotide sequence
cgcccacggcgacgccaa

SEQ ID NO: 32542 - DNA, 20 bp, Artificial sequence
  synthetic polynucleotide sequence
cacttccaggctggaaggga

SEQ ID NO: 32543 - DNA, 20 bp, Artificial sequence
  synthetic polynucleotide sequence
actgtgagcctgagggacca

SEQ ID NO: 32544 - DNA, 22 bp, Artificial sequence
  synthetic polynucleotide sequence
ggtaaaagaggaagggggctga

SEQ ID NO: 32545 - DNA, 21 bp, Artificial sequence
  synthetic polynucleotide sequence
tcacagggacaccgatcctca

SEQ ID NO: 32546 - DNA, 22 bp, Artificial sequence
  synthetic polynucleotide sequence
ggatgaccaaagtgcagtcgga

SEQ ID NO: 32547 - DNA, 20 bp, Artificial sequence
  synthetic polynucleotide sequence
atcaacgaaccacagctgca

SEQ ID NO: 32548 - DNA, 20 bp, Artificial sequence
  synthetic polynucleotide sequence
gtgacacacgtagatgcgca

SEQ ID NO: 32549 - DNA, 20 bp, Artificial sequence
  synthetic polynucleotide sequence
cagcccagggtcagaggtca

SEQ ID NO: 32550 - DNA, 21 bp, Artificial sequence
  synthetic polynucleotide sequence
agctcaggtggctgtgaccca

SEQ ID NO: 32551 - DNA, 18 bp, Artificial sequence
  synthetic polynucleotide sequence
aagtgccaccggagccta

SEQ ID NO: 32552 - DNA, 18 bp, Artificial sequence
  synthetic polynucleotide sequence
ggcttcaccgtgcccaga

SEQ ID NO: 32553 - DNA, 18 bp, Artificial sequence
  synthetic polynucleotide sequence
acctccccaccatccaga

SEQ ID NO: 32554 - DNA, 18 bp, Artificial sequence
  synthetic polynucleotide sequence
cgaagagcccttcgcaga

SEQ ID NO: 32555 - DNA, 18 bp, Artificial sequence
  synthetic polynucleotide sequence
cggtaccgtggtccggaa

SEQ ID NO: 32556 - DNA, 18 bp, Artificial sequence
  synthetic polynucleotide sequence
caccctctggaaggccga

SEQ ID NO: 32557 - DNA, 18 bp, Artificial sequence
  synthetic polynucleotide sequence
gctgtgcggggaggagca

SEQ ID NO: 32558 - DNA, 20 bp, Artificial sequence
  synthetic polynucleotide sequence
gtctgacgcgatgatgagca

SEQ ID NO: 32559 - DNA, 20 bp, Artificial sequence
  synthetic polynucleotide sequence
ggttcctcccaatgccagca

SEQ ID NO: 32560 - DNA, 20 bp, Artificial sequence
  synthetic polynucleotide sequence
ctgttgaagaccacctccga

SEQ ID NO: 32561 - DNA, 18 bp, Artificial sequence
  synthetic polynucleotide sequence
acaggatcggcccagaga

SEQ ID NO: 32562 - DNA, 17 bp, Artificial sequence
  synthetic polynucleotide sequence
agctggggcgtgccaga

SEQ ID NO: 32563 - DNA, 18 bp, Artificial sequence
  synthetic polynucleotide sequence
cccagctcccattaccca

SEQ ID NO: 32564 - DNA, 19 bp, Artificial sequence
  synthetic polynucleotide sequence
gggatggcgggagtagaga

SEQ ID NO: 32565 - DNA, 20 bp, Artificial sequence
  synthetic polynucleotide sequence
caaggtgatggtgaacggga

SEQ ID NO: 32566 - DNA, 18 bp, Artificial sequence
  synthetic polynucleotide sequence
caggctgggagaacggca

SEQ ID NO: 32567 - DNA, 22 bp, Artificial sequence
  synthetic polynucleotide sequence
aaggtggcatgagaccaggcaa

SEQ ID NO: 32568 - DNA, 20 bp, Artificial sequence
  synthetic polynucleotide sequence
cgattgccacatcggcagga

SEQ ID NO: 32569 - DNA, 22 bp, Artificial sequence
  synthetic polynucleotide sequence
aatgccagatccattccacgca

SEQ ID NO: 32570 - DNA, 20 bp, Artificial sequence
  synthetic polynucleotide sequence
agctgcagcgatggcgtgaa

SEQ ID NO: 32571 - DNA, 21 bp, Artificial sequence
  synthetic polynucleotide sequence
cccccatggtgacatccccaa

SEQ ID NO: 32572 - DNA, 18 bp, Artificial sequence
  synthetic polynucleotide sequence
tgacccgggagtccccga

SEQ ID NO: 32573 - DNA, 18 bp, Artificial sequence
  synthetic polynucleotide sequence
gagtcgcacccagaagca

SEQ ID NO: 32574 - DNA, 18 bp, Artificial sequence
  synthetic polynucleotide sequence
tgtagcggctgaggcaca

SEQ ID NO: 32575 - DNA, 18 bp, Artificial sequence
  synthetic polynucleotide sequence
gctcatcgccagggacca

SEQ ID NO: 32576 - DNA, 18 bp, Artificial sequence
  synthetic polynucleotide sequence
tgtcaggctcaaggcgga

SEQ ID NO: 32577 - DNA, 19 bp, Artificial sequence
  synthetic polynucleotide sequence
gagcagctcctgtccgaga

SEQ ID NO: 32578 - DNA, 19 bp, Artificial sequence
  synthetic polynucleotide sequence
gggagtgccagttgaagca

SEQ ID NO: 32579 - DNA, 18 bp, Artificial sequence
  synthetic polynucleotide sequence
cctcagtccccgaggaca

SEQ ID NO: 32580 - DNA, 18 bp, Artificial sequence
  synthetic polynucleotide sequence
gcgcctgtagggtgggca

SEQ ID NO: 32581 - DNA, 21 bp, Artificial sequence
  synthetic polynucleotide sequence
acatgctcacgggagtctcca

SEQ ID NO: 32582 - DNA, 21 bp, Artificial sequence
  synthetic polynucleotide sequence
tcacagagaacccacgctcca

SEQ ID NO: 32583 - DNA, 20 bp, Artificial sequence
  synthetic polynucleotide sequence
ctccagctggagatggagga

SEQ ID NO: 32584 - DNA, 18 bp, Artificial sequence
  synthetic polynucleotide sequence
cagcgaacacggtcagca

SEQ ID NO: 32585 - DNA, 22 bp, Artificial sequence
  synthetic polynucleotide sequence
attgcatgagggacagcagtca

SEQ ID NO: 32586 - DNA, 20 bp, Artificial sequence
  synthetic polynucleotide sequence
agacctggacacgccgtgga

SEQ ID NO: 32587 - DNA, 19 bp, Artificial sequence
  synthetic polynucleotide sequence
gagggctgcccagtgtgca

SEQ ID NO: 32588 - DNA, 18 bp, Artificial sequence
  synthetic polynucleotide sequence
gtccacaccacgcgggca

SEQ ID NO: 32589 - DNA, 19 bp, Artificial sequence
  synthetic polynucleotide sequence
cttacccaagacaccccga

SEQ ID NO: 32590 - DNA, 22 bp, Artificial sequence
  synthetic polynucleotide sequence
tcaactgaggctatgagcagca

SEQ ID NO: 32591 - DNA, 21 bp, Artificial sequence
  synthetic polynucleotide sequence
tgggaagagtggctggaggaa

SEQ ID NO: 32592 - DNA, 21 bp, Artificial sequence
  synthetic polynucleotide sequence
tgtagccacaagtctgccgga

SEQ ID NO: 32593 - DNA, 21 bp, Artificial sequence
  synthetic polynucleotide sequence
cagatggggaagccagtgtca

SEQ ID NO: 32594 - DNA, 21 bp, Artificial sequence
  synthetic polynucleotide sequence
gatgagctcctccatgcagca

SEQ ID NO: 32595 - DNA, 25 bp, Artificial sequence
  synthetic polynucleotide sequence
ccaagggccaaaagagttaaaggca

SEQ ID NO: 32596 - DNA, 20 bp, Artificial sequence
  synthetic polynucleotide sequence
ccccctcagccttggaagga

SEQ ID NO: 32597 - DNA, 23 bp, Artificial sequence
  synthetic polynucleotide sequence
gatgtgtggagaaaagacagaca

SEQ ID NO: 32598 - DNA, 21 bp, Artificial sequence
  synthetic polynucleotide sequence
tgagaggatcagggcatccaa

SEQ ID NO: 32599 - DNA, 20 bp, Artificial sequence
  synthetic polynucleotide sequence
ccgcagagctctgatgggca

SEQ ID NO: 32600 - DNA, 20 bp, Artificial sequence
  synthetic polynucleotide sequence
agcagcagaaggggtcagga

SEQ ID NO: 32601 - DNA, 20 bp, Artificial sequence
  synthetic polynucleotide sequence
gtacacgctgggccactgca

SEQ ID NO: 32602 - DNA, 20 bp, Artificial sequence
  synthetic polynucleotide sequence
gtcctgccggtagcccaaca

SEQ ID NO: 32603 - DNA, 18 bp, Artificial sequence
  synthetic polynucleotide sequence
gcccagtgacgagcacca

SEQ ID NO: 32604 - DNA, 18 bp, Artificial sequence
  synthetic polynucleotide sequence
gctgcagcagcaggtcca

SEQ ID NO: 32605 - DNA, 18 bp, Artificial sequence
  synthetic polynucleotide sequence
gacatcctggcgcaccca

SEQ ID NO: 32606 - DNA, 18 bp, Artificial sequence
  synthetic polynucleotide sequence
cgccccaccgttgaccga

SEQ ID NO: 32607 - DNA, 18 bp, Artificial sequence
  synthetic polynucleotide sequence
gcgcaacctcttacggca

SEQ ID NO: 32608 - DNA, 18 bp, Artificial sequence
  synthetic polynucleotide sequence
tgagcgaggcgttggaga

SEQ ID NO: 32609 - DNA, 20 bp, Artificial sequence
  synthetic polynucleotide sequence
tgtgcgtgccccagacacaa

SEQ ID NO: 32610 - DNA, 25 bp, Artificial sequence
  synthetic polynucleotide sequence
cacagaaccaataggtagctcgaga

SEQ ID NO: 32611 - DNA, 20 bp, Artificial sequence
  synthetic polynucleotide sequence
tccatggacgggacaggaca

SEQ ID NO: 32612 - DNA, 21 bp, Artificial sequence
  synthetic polynucleotide sequence
tccaccgtgtaatccagccca

SEQ ID NO: 32613 - DNA, 22 bp, Artificial sequence
  synthetic polynucleotide sequence
ctcctgaaaccaaaacgcccga

SEQ ID NO: 32614 - DNA, 20 bp, Artificial sequence
  synthetic polynucleotide sequence
cagccgaggagcagctgcca

SEQ ID NO: 32615 - DNA, 20 bp, Artificial sequence
  synthetic polynucleotide sequence
ggccaaccaagccctaccca

SEQ ID NO: 32616 - DNA, 22 bp, Artificial sequence
  synthetic polynucleotide sequence
cgcaaggaatagaccctgagga

SEQ ID NO: 32617 - DNA, 22 bp, Artificial sequence
  synthetic polynucleotide sequence
cagaattgtagagcacgccaca

SEQ ID NO: 32618 - DNA, 21 bp, Artificial sequence
  synthetic polynucleotide sequence
gcacgtaggcagaataagcca

SEQ ID NO: 32619 - DNA, 18 bp, Artificial sequence
  synthetic polynucleotide sequence
tctgaccacgggcgacca

SEQ ID NO: 32620 - DNA, 20 bp, Artificial sequence
  synthetic polynucleotide sequence
gttgaagtaaggcagggcca

SEQ ID NO: 32621 - DNA, 21 bp, Artificial sequence
  synthetic polynucleotide sequence
ctgatgggggagctgaacaca

SEQ ID NO: 32622 - DNA, 22 bp, Artificial sequence
  synthetic polynucleotide sequence
aaaattggcccgaggatcacga

SEQ ID NO: 32623 - DNA, 18 bp, Artificial sequence
  synthetic polynucleotide sequence
acatcacccgggaccaga

SEQ ID NO: 32624 - DNA, 21 bp, Artificial sequence
  synthetic polynucleotide sequence
ggcacagcacgttgctaagga

SEQ ID NO: 32625 - DNA, 20 bp, Artificial sequence
  synthetic polynucleotide sequence
gaagctggagggactgcaca

SEQ ID NO: 32626 - DNA, 20 bp, Artificial sequence
  synthetic polynucleotide sequence
ctgcccctcctacagggtca

SEQ ID NO: 32627 - DNA, 18 bp, Artificial sequence
  synthetic polynucleotide sequence
tgtggagacagagggcga

SEQ ID NO: 32628 - DNA, 18 bp, Artificial sequence
  synthetic polynucleotide sequence
catcagcccctcgcagga

SEQ ID NO: 32629 - DNA, 18 bp, Artificial sequence
  synthetic polynucleotide sequence
caagtgtgcaggaggcca

SEQ ID NO: 32630 - DNA, 18 bp, Artificial sequence
  synthetic polynucleotide sequence
gtgatctcccacacggca

SEQ ID NO: 32631 - DNA, 20 bp, Artificial sequence
  synthetic polynucleotide sequence
aaaagctccaccaagcagca

SEQ ID NO: 32632 - DNA, 18 bp, Artificial sequence
  synthetic polynucleotide sequence
aaacgcaaggtgcagcca

SEQ ID NO: 32633 - DNA, 18 bp, Artificial sequence
  synthetic polynucleotide sequence
caccctcagcccatcaca

SEQ ID NO: 32634 - DNA, 18 bp, Artificial sequence
  synthetic polynucleotide sequence
gcagaatcccgaggacca

SEQ ID NO: 32635 - DNA, 20 bp, Artificial sequence
  synthetic polynucleotide sequence
caccaagctcagcagaacca

SEQ ID NO: 32636 - DNA, 18 bp, Artificial sequence
  synthetic polynucleotide sequence
agggggtcactggggaga

SEQ ID NO: 32637 - DNA, 18 bp, Artificial sequence
  synthetic polynucleotide sequence
ccgtgagcccaagtcgca

SEQ ID NO: 32638 - DNA, 20 bp, Artificial sequence
  synthetic polynucleotide sequence
ctgtcgtagccggcatcaga

SEQ ID NO: 32639 - DNA, 21 bp, Artificial sequence
  synthetic polynucleotide sequence
ccacggtgacctcaggagaga

SEQ ID NO: 32640 - DNA, 20 bp, Artificial sequence
  synthetic polynucleotide sequence
atctcagacgcaacggggga

SEQ ID NO: 32641 - DNA, 18 bp, Artificial sequence
  synthetic polynucleotide sequence
ctgtgacccccagccaca

SEQ ID NO: 32642 - DNA, 20 bp, Artificial sequence
  synthetic polynucleotide sequence
gaaggtgtgaggcagtccca

SEQ ID NO: 32643 - DNA, 18 bp, Artificial sequence
  synthetic polynucleotide sequence
caaagaaggggcagccca

SEQ ID NO: 32644 - DNA, 19 bp, Artificial sequence
  synthetic polynucleotide sequence
gtcacaggactcatgggga

SEQ ID NO: 32645 - DNA, 18 bp, Artificial sequence
  synthetic polynucleotide sequence
gacatcgacgtcagggca

SEQ ID NO: 32646 - DNA, 20 bp, Artificial sequence
  synthetic polynucleotide sequence
gagtgtccatctccacccca

SEQ ID NO: 32647 - DNA, 18 bp, Artificial sequence
  synthetic polynucleotide sequence
cctgaactcccagcccca

SEQ ID NO: 32648 - DNA, 19 bp, Artificial sequence
  synthetic polynucleotide sequence
ccggctgcactgagagtga

SEQ ID NO: 32649 - DNA, 21 bp, Artificial sequence
  synthetic polynucleotide sequence
ccagctgctgacgtccaggaa

SEQ ID NO: 32650 - DNA, 19 bp, Artificial sequence
  synthetic polynucleotide sequence
ttcaccggggcatacgtca

SEQ ID NO: 32651 - DNA, 19 bp, Artificial sequence
  synthetic polynucleotide sequence
ctacagggtcagtccccca

SEQ ID NO: 32652 - DNA, 20 bp, Artificial sequence
  synthetic polynucleotide sequence
ctgacgccagtgttggagga

SEQ ID NO: 32653 - DNA, 20 bp, Artificial sequence
  synthetic polynucleotide sequence
cgtgaaggacacacagccca

SEQ ID NO: 32654 - DNA, 20 bp, Artificial sequence
  synthetic polynucleotide sequence
gcagctgggcgtaggtcaca

SEQ ID NO: 32655 - DNA, 22 bp, Artificial sequence
  synthetic polynucleotide sequence
tcctaggctggaaggaggaaga

SEQ ID NO: 32656 - DNA, 20 bp, Artificial sequence
  synthetic polynucleotide sequence
acctgccaggcagacgggga

SEQ ID NO: 32657 - DNA, 18 bp, Artificial sequence
  synthetic polynucleotide sequence
cgttccacccctgccgaa

SEQ ID NO: 32658 - DNA, 20 bp, Artificial sequence
  synthetic polynucleotide sequence
aacggaagcagctgatgtga

SEQ ID NO: 32659 - DNA, 20 bp, Artificial sequence
  synthetic polynucleotide sequence
cggaccttgcccatggagaa

SEQ ID NO: 32660 - DNA, 20 bp, Artificial sequence
  synthetic polynucleotide sequence
actcgtcgcacagggcagaa

SEQ ID NO: 32661 - DNA, 21 bp, Artificial sequence
  synthetic polynucleotide sequence
tgtcgtgtccatggacagaga

SEQ ID NO: 32662 - DNA, 19 bp, Artificial sequence
  synthetic polynucleotide sequence
tcacgtggcaggagtgaca

SEQ ID NO: 32663 - DNA, 20 bp, Artificial sequence
  synthetic polynucleotide sequence
ctgcaagcactgtcacacca

SEQ ID NO: 32664 - DNA, 20 bp, Artificial sequence
  synthetic polynucleotide sequence
cggccaaacccctcgtcgta

SEQ ID NO: 32665 - DNA, 18 bp, Artificial sequence
  synthetic polynucleotide sequence
agagccacagcaggggaa

SEQ ID NO: 32666 - DNA, 18 bp, Artificial sequence
  synthetic polynucleotide sequence
aggcttgcagaccctgga

SEQ ID NO: 32667 - DNA, 18 bp, Artificial sequence
  synthetic polynucleotide sequence
tcaagaagccagaccgca

SEQ ID NO: 32668 - DNA, 17 bp, Artificial sequence
  synthetic polynucleotide sequence
cgcacaggacgatccca

SEQ ID NO: 32669 - DNA, 19 bp, Artificial sequence
  synthetic polynucleotide sequence
ccgttcccctggcagcaga

SEQ ID NO: 32670 - DNA, 21 bp, Artificial sequence
  synthetic polynucleotide sequence
acagcccaaagtctgccacca

SEQ ID NO: 32671 - DNA, 22 bp, Artificial sequence
  synthetic polynucleotide sequence
tgcaacagcaagctcaccctga

SEQ ID NO: 32672 - DNA, 18 bp, Artificial sequence
  synthetic polynucleotide sequence
gggccttgcgggaggtca

SEQ ID NO: 32673 - DNA, 21 bp, Artificial sequence
  synthetic polynucleotide sequence
caggagctgaaaggggagcta

SEQ ID NO: 32674 - DNA, 20 bp, Artificial sequence
  synthetic polynucleotide sequence
cttgcccatggcgttcacca

SEQ ID NO: 32675 - DNA, 18 bp, Artificial sequence
  synthetic polynucleotide sequence
agcatgcagaagcgcaga

SEQ ID NO: 32676 - DNA, 20 bp, Artificial sequence
  synthetic polynucleotide sequence
cagcggacatgaggctacca

SEQ ID NO: 32677 - DNA, 22 bp, Artificial sequence
  synthetic polynucleotide sequence
tgagtcaatacgggtaacagga

SEQ ID NO: 32678 - DNA, 21 bp, Artificial sequence
  synthetic polynucleotide sequence
atgatgatcaaggccaccaca

SEQ ID NO: 32679 - DNA, 22 bp, Artificial sequence
  synthetic polynucleotide sequence
aggagggctcagaggtaaccaa

SEQ ID NO: 32680 - DNA, 20 bp, Artificial sequence
  synthetic polynucleotide sequence
agtggagatgggatgcggga

SEQ ID NO: 32681 - DNA, 21 bp, Artificial sequence
  synthetic polynucleotide sequence
acttgaccgtgcctcaccaga

SEQ ID NO: 32682 - DNA, 20 bp, Artificial sequence
  synthetic polynucleotide sequence
tctggactcatccagcccca

SEQ ID NO: 32683 - DNA, 22 bp, Artificial sequence
  synthetic polynucleotide sequence
aactactagccagccacagcaa

SEQ ID NO: 32684 - DNA, 20 bp, Artificial sequence
  synthetic polynucleotide sequence
tcccggagctggtgccagga

SEQ ID NO: 32685 - DNA, 20 bp, Artificial sequence
  synthetic polynucleotide sequence
ccgctcaccctggacagaga

SEQ ID NO: 32686 - DNA, 21 bp, Artificial sequence
  synthetic polynucleotide sequence
ttcaactactcgagggtggga

SEQ ID NO: 32687 - DNA, 21 bp, Artificial sequence
  synthetic polynucleotide sequence
ttgagggtgagcagcatgaga

SEQ ID NO: 32688 - DNA, 20 bp, Artificial sequence
  synthetic polynucleotide sequence
cttctcgaaccgggcctcca

SEQ ID NO: 32689 - DNA, 19 bp, Artificial sequence
  synthetic polynucleotide sequence
ccgtgcggctggagagaga

SEQ ID NO: 32690 - DNA, 22 bp, Artificial sequence
  synthetic polynucleotide sequence
ttcactggcagcaaatgcagca

SEQ ID NO: 32691 - DNA, 21 bp, Artificial sequence
  synthetic polynucleotide sequence
cagggcttggaacccatacca

SEQ ID NO: 32692 - DNA, 21 bp, Artificial sequence
  synthetic polynucleotide sequence
ttctccacggcgactgtccta

SEQ ID NO: 32693 - DNA, 18 bp, Artificial sequence
  synthetic polynucleotide sequence
agggagaggccaacagca

SEQ ID NO: 32694 - DNA, 18 bp, Artificial sequence
  synthetic polynucleotide sequence
agaagaggacgacgccca

SEQ ID NO: 32695 - DNA, 22 bp, Artificial sequence
  synthetic polynucleotide sequence
atgaccgactccaatgacacca

SEQ ID NO: 32696 - DNA, 22 bp, Artificial sequence
  synthetic polynucleotide sequence
tacctccccttccacaacagca

SEQ ID NO: 32697 - DNA, 20 bp, Artificial sequence
  synthetic polynucleotide sequence
cagcgtcgcaagaccctcaa

SEQ ID NO: 32698 - DNA, 20 bp, Artificial sequence
  synthetic polynucleotide sequence
gcggcacacgaagtactcga

SEQ ID NO: 32699 - DNA, 21 bp, Artificial sequence
  synthetic polynucleotide sequence
tggatagcagaggtgtggcca

SEQ ID NO: 32700 - DNA, 20 bp, Artificial sequence
  synthetic polynucleotide sequence
cagtgacccggttaccccca

SEQ ID NO: 32701 - DNA, 22 bp, Artificial sequence
  synthetic polynucleotide sequence
atcgcctccagaatccacctga

SEQ ID NO: 32702 - DNA, 21 bp, Artificial sequence
  synthetic polynucleotide sequence
aagccagcatgtccaccgcta

SEQ ID NO: 32703 - DNA, 19 bp, Artificial sequence
  synthetic polynucleotide sequence
tgaagtggctgggtaccca

SEQ ID NO: 32704 - DNA, 19 bp, Artificial sequence
  synthetic polynucleotide sequence
ttgcacagaagttccagca

SEQ ID NO: 32705 - DNA, 18 bp, Artificial sequence
  synthetic polynucleotide sequence
gggaagtgcccccagcaa

SEQ ID NO: 32706 - DNA, 18 bp, Artificial sequence
  synthetic polynucleotide sequence
cgatcgctcgtgggagca

SEQ ID NO: 32707 - DNA, 18 bp, Artificial sequence
  synthetic polynucleotide sequence
ctgctgggccatcaagca

SEQ ID NO: 32708 - DNA, 19 bp, Artificial sequence
  synthetic polynucleotide sequence
gggtccatgaggctcagca

SEQ ID NO: 32709 - DNA, 18 bp, Artificial sequence
  synthetic polynucleotide sequence
gtggaacggtggcaagga

SEQ ID NO: 32710 - DNA, 18 bp, Artificial sequence
  synthetic polynucleotide sequence
gggcatccattgcccaga

SEQ ID NO: 32711 - DNA, 20 bp, Artificial sequence
  synthetic polynucleotide sequence
ctggtctacaccgaggagga

SEQ ID NO: 32712 - DNA, 19 bp, Artificial sequence
  synthetic polynucleotide sequence
tgcggggttgagacaggta

SEQ ID NO: 32713 - DNA, 21 bp, Artificial sequence
  synthetic polynucleotide sequence
gcccaaggtacaagctcagga

SEQ ID NO: 32714 - DNA, 22 bp, Artificial sequence
  synthetic polynucleotide sequence
aagatcataccgacacagctga

SEQ ID NO: 32715 - DNA, 20 bp, Artificial sequence
  synthetic polynucleotide sequence
tatgactggggcagtcctga

SEQ ID NO: 32716 - DNA, 22 bp, Artificial sequence
  synthetic polynucleotide sequence
ttcagggtcagccaacaagtca

SEQ ID NO: 32717 - DNA, 21 bp, Artificial sequence
  synthetic polynucleotide sequence
ctctactacgtgggccactca

SEQ ID NO: 32718 - DNA, 21 bp, Artificial sequence
  synthetic polynucleotide sequence
taactgtgacaactggagcca

SEQ ID NO: 32719 - DNA, 21 bp, Artificial sequence
  synthetic polynucleotide sequence
aatgtggacaggaggtcagga

SEQ ID NO: 32720 - DNA, 18 bp, Artificial sequence
  synthetic polynucleotide sequence
ctcacaccgtccctggga

SEQ ID NO: 32721 - DNA, 20 bp, Artificial sequence
  synthetic polynucleotide sequence
accccaggatgtggccagga

SEQ ID NO: 32722 - DNA, 20 bp, Artificial sequence
  synthetic polynucleotide sequence
ggcatcgaggccccagacaa

SEQ ID NO: 32723 - DNA, 21 bp, Artificial sequence
  synthetic polynucleotide sequence
tctgaatgctgtccaacccca

SEQ ID NO: 32724 - DNA, 20 bp, Artificial sequence
  synthetic polynucleotide sequence
ataggcagtagtccggccga

SEQ ID NO: 32725 - DNA, 21 bp, Artificial sequence
  synthetic polynucleotide sequence
tggaaggcacatcacatccca

SEQ ID NO: 32726 - DNA, 20 bp, Artificial sequence
  synthetic polynucleotide sequence
agtgacgcctgtcccaacca

SEQ ID NO: 32727 - DNA, 18 bp, Artificial sequence
  synthetic polynucleotide sequence
atacccagccagcgccca

SEQ ID NO: 32728 - DNA, 18 bp, Artificial sequence
  synthetic polynucleotide sequence
agcccgctatgcacccca

SEQ ID NO: 32729 - DNA, 19 bp, Artificial sequence
  synthetic polynucleotide sequence
gtagcctccaccagcggca

SEQ ID NO: 32730 - DNA, 22 bp, Artificial sequence
  synthetic polynucleotide sequence
atcagctcctgaaactccagca

SEQ ID NO: 32731 - DNA, 20 bp, Artificial sequence
  synthetic polynucleotide sequence
ccgggggcactgtctagaga

SEQ ID NO: 32732 - DNA, 22 bp, Artificial sequence
  synthetic polynucleotide sequence
catattgcccaactgcccagca

SEQ ID NO: 32733 - DNA, 18 bp, Artificial sequence
  synthetic polynucleotide sequence
ggtgagcgcgaagaccaa

SEQ ID NO: 32734 - DNA, 18 bp, Artificial sequence
  synthetic polynucleotide sequence
acccaggttggtgaggca

SEQ ID NO: 32735 - DNA, 18 bp, Artificial sequence
  synthetic polynucleotide sequence
gccctgacatgcagggaa

SEQ ID NO: 32736 - DNA, 18 bp, Artificial sequence
  synthetic polynucleotide sequence
cgcccaggttggtaagga

SEQ ID NO: 32737 - DNA, 19 bp, Artificial sequence
  synthetic polynucleotide sequence
cctgggcagcatgggcaga

SEQ ID NO: 32738 - DNA, 19 bp, Artificial sequence
  synthetic polynucleotide sequence
gcagagccagggtgctgca

SEQ ID NO: 32739 - DNA, 21 bp, Artificial sequence
  synthetic polynucleotide sequence
ctacgtgcacttcaggcagga

SEQ ID NO: 32740 - DNA, 20 bp, Artificial sequence
  synthetic polynucleotide sequence
caggcatgctggcagggaga

SEQ ID NO: 32741 - DNA, 18 bp, Artificial sequence
  synthetic polynucleotide sequence
acacgcccgacgaggaga

SEQ ID NO: 32742 - DNA, 18 bp, Artificial sequence
  synthetic polynucleotide sequence
gatgcccaggagagcgca

SEQ ID NO: 32743 - DNA, 18 bp, Artificial sequence
  synthetic polynucleotide sequence
cacagccattgtccgcaa

SEQ ID NO: 32744 - DNA, 18 bp, Artificial sequence
  synthetic polynucleotide sequence
tgatggaggaggtgccga

SEQ ID NO: 32745 - DNA, 21 bp, Artificial sequence
  synthetic polynucleotide sequence
gagcagcacttccacagccaa

SEQ ID NO: 32746 - DNA, 19 bp, Artificial sequence
  synthetic polynucleotide sequence
gccccagctgacactgcga

SEQ ID NO: 32747 - DNA, 20 bp, Artificial sequence
  synthetic polynucleotide sequence
acagagggtcctgctggaga

SEQ ID NO: 32748 - DNA, 21 bp, Artificial sequence
  synthetic polynucleotide sequence
catcgatgagcagctccagga

SEQ ID NO: 32749 - DNA, 21 bp, Artificial sequence
  synthetic polynucleotide sequence
tcgacctttgccagcaaggga

SEQ ID NO: 32750 - DNA, 21 bp, Artificial sequence
  synthetic polynucleotide sequence
ccccagacgatcttcagggga

SEQ ID NO: 32751 - DNA, 21 bp, Artificial sequence
  synthetic polynucleotide sequence
acaggactgaaagggaccgga

SEQ ID NO: 32752 - DNA, 20 bp, Artificial sequence
  synthetic polynucleotide sequence
atgtcactgcgagacatcga

SEQ ID NO: 32753 - DNA, 21 bp, Artificial sequence
  synthetic polynucleotide sequence
gctaaggacctcaacccagga

SEQ ID NO: 32754 - DNA, 20 bp, Artificial sequence
  synthetic polynucleotide sequence
gaatgtggctcgaagcccga

SEQ ID NO: 32755 - DNA, 19 bp, Artificial sequence
  synthetic polynucleotide sequence
ggtgggtccgaggagagca

SEQ ID NO: 32756 - DNA, 20 bp, Artificial sequence
  synthetic polynucleotide sequence
cggagggaagtaggctccga

SEQ ID NO: 32757 - DNA, 19 bp, Artificial sequence
  synthetic polynucleotide sequence
ccacgcctggactggcaga

SEQ ID NO: 32758 - DNA, 19 bp, Artificial sequence
  synthetic polynucleotide sequence
tggctctggacaaggcgga

SEQ ID NO: 32759 - DNA, 21 bp, Artificial sequence
  synthetic polynucleotide sequence
ccagccactaacctgacccga

SEQ ID NO: 32760 - DNA, 22 bp, Artificial sequence
  synthetic polynucleotide sequence
aagaaatccagccagcagagga

SEQ ID NO: 32761 - DNA, 19 bp, Artificial sequence
  synthetic polynucleotide sequence
cgacctggtgtggaaggca

SEQ ID NO: 32762 - DNA, 20 bp, Artificial sequence
  synthetic polynucleotide sequence
aaccacagtcactgagcgca

SEQ ID NO: 32763 - DNA, 21 bp, Artificial sequence
  synthetic polynucleotide sequence
cgtgtgacagtatcccgagca

SEQ ID NO: 32764 - DNA, 18 bp, Artificial sequence
  synthetic polynucleotide sequence
tccagtggctgaggcgga

SEQ ID NO: 32765 - DNA, 19 bp, Artificial sequence
  synthetic polynucleotide sequence
gtcttggagggggaggaga

SEQ ID NO: 32766 - DNA, 18 bp, Artificial sequence
  synthetic polynucleotide sequence
cgccatccgcgttaacca

SEQ ID NO: 32767 - DNA, 21 bp, Artificial sequence
  synthetic polynucleotide sequence
tgggcagcagcatctgaagca

SEQ ID NO: 32768 - DNA, 21 bp, Artificial sequence
  synthetic polynucleotide sequence
tggataggggtgtaccacgca

SEQ ID NO: 32769 - DNA, 19 bp, Artificial sequence
  synthetic polynucleotide sequence
cacctcgacccctgcgcaa

SEQ ID NO: 32770 - DNA, 19 bp, Artificial sequence
  synthetic polynucleotide sequence
cgacagtcctccaggccca

SEQ ID NO: 32771 - DNA, 20 bp, Artificial sequence
  synthetic polynucleotide sequence
accctctacaccaaggccaa

SEQ ID NO: 32772 - DNA, 18 bp, Artificial sequence
  synthetic polynucleotide sequence
cccgcatcaccatctcga

SEQ ID NO: 32773 - DNA, 18 bp, Artificial sequence
  synthetic polynucleotide sequence
ggactgcctgagctgcga

SEQ ID NO: 32774 - DNA, 18 bp, Artificial sequence
  synthetic polynucleotide sequence
tgtcacaggatgcgcaga

SEQ ID NO: 32775 - DNA, 20 bp, Artificial sequence
  synthetic polynucleotide sequence
ctggcatgaagactgcctga

SEQ ID NO: 32776 - DNA, 22 bp, Artificial sequence
  synthetic polynucleotide sequence
atcaccatctcaaaggcaggga

SEQ ID NO: 32777 - DNA, 18 bp, Artificial sequence
  synthetic polynucleotide sequence
ctcctgctgccaggcgca

SEQ ID NO: 32778 - DNA, 21 bp, Artificial sequence
  synthetic polynucleotide sequence
cgcaggaatcgactgtccgca

SEQ ID NO: 32779 - DNA, 18 bp, Artificial sequence
  synthetic polynucleotide sequence
cagtcagtgggaagcgca

SEQ ID NO: 32780 - DNA, 19 bp, Artificial sequence
  synthetic polynucleotide sequence
ggaagagcctccgaggtca

SEQ ID NO: 32781 - DNA, 21 bp, Artificial sequence
  synthetic polynucleotide sequence
tcaccaatctgctcagccgca

SEQ ID NO: 32782 - DNA, 21 bp, Artificial sequence
  synthetic polynucleotide sequence
gccttgggtacctccagcaga

SEQ ID NO: 32783 - DNA, 21 bp, Artificial sequence
  synthetic polynucleotide sequence
gcacaacacggtgctcacgga

SEQ ID NO: 32784 - DNA, 22 bp, Artificial sequence
  synthetic polynucleotide sequence
aaatggtatcccagcctcagca

SEQ ID NO: 32785 - DNA, 21 bp, Artificial sequence
  synthetic polynucleotide sequence
gaattcttccagccaccgcca

SEQ ID NO: 32786 - DNA, 21 bp, Artificial sequence
  synthetic polynucleotide sequence
tcttcagcttcaccacccgga

SEQ ID NO: 32787 - DNA, 21 bp, Artificial sequence
  synthetic polynucleotide sequence
gatgcagacgaggaggacgaa

SEQ ID NO: 32788 - DNA, 20 bp, Artificial sequence
  synthetic polynucleotide sequence
gttgctgaggatgatgggca

SEQ ID NO: 32789 - DNA, 20 bp, Artificial sequence
  synthetic polynucleotide sequence
gagcccctcgacacagcgga

SEQ ID NO: 32790 - DNA, 20 bp, Artificial sequence
  synthetic polynucleotide sequence
ctggggagggaaaggggaga

SEQ ID NO: 32791 - DNA, 21 bp, Artificial sequence
  synthetic polynucleotide sequence
agctcctggccatcgagcaga

SEQ ID NO: 32792 - DNA, 21 bp, Artificial sequence
  synthetic polynucleotide sequence
tcatggaaaaggggctcggca

SEQ ID NO: 32793 - DNA, 19 bp, Artificial sequence
  synthetic polynucleotide sequence
gcagcgaccccttccagca

SEQ ID NO: 32794 - DNA, 19 bp, Artificial sequence
  synthetic polynucleotide sequence
gggagcccacgtctgagga

SEQ ID NO: 32795 - DNA, 22 bp, Artificial sequence
  synthetic polynucleotide sequence
tgcaagccaccagtcacaggaa

SEQ ID NO: 32796 - DNA, 19 bp, Artificial sequence
  synthetic polynucleotide sequence
cccgtacgtggctacggca

SEQ ID NO: 32797 - DNA, 20 bp, Artificial sequence
  synthetic polynucleotide sequence
gaactcagcctacacccgaa

SEQ ID NO: 32798 - DNA, 21 bp, Artificial sequence
  synthetic polynucleotide sequence
catgtgacctgaagagcctga

SEQ ID NO: 32799 - DNA, 21 bp, Artificial sequence
  synthetic polynucleotide sequence
aacaccagcaagccctaacca

SEQ ID NO: 32800 - DNA, 22 bp, Artificial sequence
  synthetic polynucleotide sequence
ggatgaagacccattccaggca

SEQ ID NO: 32801 - DNA, 22 bp, Artificial sequence
  synthetic polynucleotide sequence
aagagtatgagccccaggaaga

SEQ ID NO: 32802 - DNA, 20 bp, Artificial sequence
  synthetic polynucleotide sequence
ccagtcactgggtggggcca

SEQ ID NO: 32803 - DNA, 21 bp, Artificial sequence
  synthetic polynucleotide sequence
gcaccacacaccaccaccgta

SEQ ID NO: 32804 - DNA, 20 bp, Artificial sequence
  synthetic polynucleotide sequence
ctgccatctcgtgcaaggca

SEQ ID NO: 32805 - DNA, 18 bp, Artificial sequence
  synthetic polynucleotide sequence
gtgtccgcaacctgcaga

SEQ ID NO: 32806 - DNA, 18 bp, Artificial sequence
  synthetic polynucleotide sequence
ccattgcggtccaggcca

SEQ ID NO: 32807 - DNA, 18 bp, Artificial sequence
  synthetic polynucleotide sequence
gatgaaggagtccgccca

SEQ ID NO: 32808 - DNA, 19 bp, Artificial sequence
  synthetic polynucleotide sequence
gctccagctgggaagtgca

SEQ ID NO: 32809 - DNA, 18 bp, Artificial sequence
  synthetic polynucleotide sequence
tgcactgccgacattgaa

SEQ ID NO: 32810 - DNA, 21 bp, Artificial sequence
  synthetic polynucleotide sequence
atcgtgggtctacagggagaa

SEQ ID NO: 32811 - DNA, 19 bp, Artificial sequence
  synthetic polynucleotide sequence
gccttgaccacgccccaca

SEQ ID NO: 32812 - DNA, 22 bp, Artificial sequence
  synthetic polynucleotide sequence
aaaacgtggagtggacatggga

SEQ ID NO: 32813 - DNA, 21 bp, Artificial sequence
  synthetic polynucleotide sequence
cagatgaacccgaatggccca

SEQ ID NO: 32814 - DNA, 20 bp, Artificial sequence
  synthetic polynucleotide sequence
tcgggatatgaaggccagga

SEQ ID NO: 32815 - DNA, 20 bp, Artificial sequence
  synthetic polynucleotide sequence
caccagacccagcagaagca

SEQ ID NO: 32816 - DNA, 20 bp, Artificial sequence
  synthetic polynucleotide sequence
gcccatcggtgcccctggaa

SEQ ID NO: 32817 - DNA, 18 bp, Artificial sequence
  synthetic polynucleotide sequence
cggcatggtgggcgacga

SEQ ID NO: 32818 - DNA, 18 bp, Artificial sequence
  synthetic polynucleotide sequence
gccaccaggtctgggaga

SEQ ID NO: 32819 - DNA, 22 bp, Artificial sequence
  synthetic polynucleotide sequence
agctttgccagcaaggtccaga

SEQ ID NO: 32820 - DNA, 21 bp, Artificial sequence
  synthetic polynucleotide sequence
cgttggccccaaagatggtca

SEQ ID NO: 32821 - DNA, 18 bp, Artificial sequence
  synthetic polynucleotide sequence
tctgcctggaggacagca

SEQ ID NO: 32822 - DNA, 18 bp, Artificial sequence
  synthetic polynucleotide sequence
cgatccactggcagtcga

SEQ ID NO: 32823 - DNA, 22 bp, Artificial sequence
  synthetic polynucleotide sequence
agcagaccacctacctggagga

SEQ ID NO: 32824 - DNA, 18 bp, Artificial sequence
  synthetic polynucleotide sequence
tctgggaggagaagcgca

SEQ ID NO: 32825 - DNA, 18 bp, Artificial sequence
  synthetic polynucleotide sequence
cccatcatggcacccaca

SEQ ID NO: 32826 - DNA, 18 bp, Artificial sequence
  synthetic polynucleotide sequence
aggcggtctcctgcacca

SEQ ID NO: 32827 - DNA, 18 bp, Artificial sequence
  synthetic polynucleotide sequence
atggactggccctacgga

SEQ ID NO: 32828 - DNA, 18 bp, Artificial sequence
  synthetic polynucleotide sequence
tcagccaccttggagcca

SEQ ID NO: 32829 - DNA, 18 bp, Artificial sequence
  synthetic polynucleotide sequence
gcctcaagtggagccgaa

SEQ ID NO: 32830 - DNA, 18 bp, Artificial sequence
  synthetic polynucleotide sequence
agcagcagtcagcaccca

SEQ ID NO: 32831 - DNA, 18 bp, Artificial sequence
  synthetic polynucleotide sequence
ggcggaatcgggatacca

SEQ ID NO: 32832 - DNA, 18 bp, Artificial sequence
  synthetic polynucleotide sequence
ataggccagcacgtcgca

SEQ ID NO: 32833 - DNA, 21 bp, Artificial sequence
  synthetic polynucleotide sequence
tggtggctgtgtacacccgca

SEQ ID NO: 32834 - DNA, 21 bp, Artificial sequence
  synthetic polynucleotide sequence
tacagccaggacattgcagga

SEQ ID NO: 32835 - DNA, 21 bp, Artificial sequence
  synthetic polynucleotide sequence
tcaactccgtcgtgaacccca

SEQ ID NO: 32836 - DNA, 21 bp, Artificial sequence
  synthetic polynucleotide sequence
tgctgaggactgtggagggga

SEQ ID NO: 32837 - DNA, 19 bp, Artificial sequence
  synthetic polynucleotide sequence
ttggtgacaccctctgcaa

SEQ ID NO: 32838 - DNA, 22 bp, Artificial sequence
  synthetic polynucleotide sequence
caaagaggctgaaataccgcca

SEQ ID NO: 32839 - DNA, 20 bp, Artificial sequence
  synthetic polynucleotide sequence
cgaaaggtccgccgtcacca

SEQ ID NO: 32840 - DNA, 19 bp, Artificial sequence
  synthetic polynucleotide sequence
gggcggaatcctggggaca

SEQ ID NO: 32841 - DNA, 20 bp, Artificial sequence
  synthetic polynucleotide sequence
ctgtgatcggaggaagtgca

SEQ ID NO: 32842 - DNA, 20 bp, Artificial sequence
  synthetic polynucleotide sequence
caaagcaggcttctgaggca

SEQ ID NO: 32843 - DNA, 18 bp, Artificial sequence
  synthetic polynucleotide sequence
gacggcagcgtcggcgaa

SEQ ID NO: 32844 - DNA, 22 bp, Artificial sequence
  synthetic polynucleotide sequence
gcaaacctgtggaagtcagcga

SEQ ID NO: 32845 - DNA, 20 bp, Artificial sequence
  synthetic polynucleotide sequence
aggaggagaatggccccaga

SEQ ID NO: 32846 - DNA, 20 bp, Artificial sequence
  synthetic polynucleotide sequence
cttgccatgtccaggtcaca

SEQ ID NO: 32847 - DNA, 18 bp, Artificial sequence
  synthetic polynucleotide sequence
gggcaaggcaaagtggga

SEQ ID NO: 32848 - DNA, 18 bp, Artificial sequence
  synthetic polynucleotide sequence
cgtgccagagggccagga

SEQ ID NO: 32849 - DNA, 21 bp, Artificial sequence
  synthetic polynucleotide sequence
ccaggaagagtttgccaggca

SEQ ID NO: 32850 - DNA, 20 bp, Artificial sequence
  synthetic polynucleotide sequence
agctgctagtgcaagggcca

SEQ ID NO: 32851 - DNA, 22 bp, Artificial sequence
  synthetic polynucleotide sequence
aagatgtacccctggagactga

SEQ ID NO: 32852 - DNA, 20 bp, Artificial sequence
  synthetic polynucleotide sequence
tatggcccttggaaggtgga

SEQ ID NO: 32853 - DNA, 18 bp, Artificial sequence
  synthetic polynucleotide sequence
agtgatgaggagcgcgca

SEQ ID NO: 32854 - DNA, 18 bp, Artificial sequence
  synthetic polynucleotide sequence
gctcggaagtcagccgga

SEQ ID NO: 32855 - DNA, 18 bp, Artificial sequence
  synthetic polynucleotide sequence
gggcaaagactggaccca

SEQ ID NO: 32856 - DNA, 18 bp, Artificial sequence
  synthetic polynucleotide sequence
gaacaagctgctggggga

SEQ ID NO: 32857 - DNA, 21 bp, Artificial sequence
  synthetic polynucleotide sequence
gagagctcatccaggagctca

SEQ ID NO: 32858 - DNA, 20 bp, Artificial sequence
  synthetic polynucleotide sequence
atcaaggtccacagcaggca

SEQ ID NO: 32859 - DNA, 19 bp, Artificial sequence
  synthetic polynucleotide sequence
cctctcacagccgcagaca

SEQ ID NO: 32860 - DNA, 18 bp, Artificial sequence
  synthetic polynucleotide sequence
cccgacccctttccacca

SEQ ID NO: 32861 - DNA, 20 bp, Artificial sequence
  synthetic polynucleotide sequence
attctccgagccaccgggaa

SEQ ID NO: 32862 - DNA, 21 bp, Artificial sequence
  synthetic polynucleotide sequence
atgcagtgaatgagcccgcca

SEQ ID NO: 32863 - DNA, 18 bp, Artificial sequence
  synthetic polynucleotide sequence
cacagtgcccaagggcca

SEQ ID NO: 32864 - DNA, 18 bp, Artificial sequence
  synthetic polynucleotide sequence
gggcagtaggccaagcca

SEQ ID NO: 32865 - DNA, 20 bp, Artificial sequence
  synthetic polynucleotide sequence
aggtggcgcggagggctgaa

SEQ ID NO: 32866 - DNA, 19 bp, Artificial sequence
  synthetic polynucleotide sequence
gggactgatcggggtgcca

SEQ ID NO: 32867 - DNA, 18 bp, Artificial sequence
  synthetic polynucleotide sequence
cgtgaccacgtgacagca

SEQ ID NO: 32868 - DNA, 19 bp, Artificial sequence
  synthetic polynucleotide sequence
cccagtagtcaaggcgcca

SEQ ID NO: 32869 - DNA, 21 bp, Artificial sequence
  synthetic polynucleotide sequence
ccgagccttctgacgaagaca

SEQ ID NO: 32870 - DNA, 21 bp, Artificial sequence
  synthetic polynucleotide sequence
cctttaacggggctaaggcga

SEQ ID NO: 32871 - DNA, 20 bp, Artificial sequence
  synthetic polynucleotide sequence
atggggcagcagatccagga

SEQ ID NO: 32872 - DNA, 22 bp, Artificial sequence
  synthetic polynucleotide sequence
aacaaccccatccatcagtgca

SEQ ID NO: 32873 - DNA, 20 bp, Artificial sequence
  synthetic polynucleotide sequence
gtagagcgcactcggagaga

SEQ ID NO: 32874 - DNA, 18 bp, Artificial sequence
  synthetic polynucleotide sequence
gggtagcagcacagccca

SEQ ID NO: 32875 - DNA, 20 bp, Artificial sequence
  synthetic polynucleotide sequence
cggtacccccaggttccaga

SEQ ID NO: 32876 - DNA, 20 bp, Artificial sequence
  synthetic polynucleotide sequence
actggccagagcctcggcca

SEQ ID NO: 32877 - DNA, 20 bp, Artificial sequence
  synthetic polynucleotide sequence
aggagttgtgcacgccccaa

SEQ ID NO: 32878 - DNA, 20 bp, Artificial sequence
  synthetic polynucleotide sequence
tccctcagctggatgcagca

SEQ ID NO: 32879 - DNA, 20 bp, Artificial sequence
  synthetic polynucleotide sequence
cagttcaccaccgctgggga

SEQ ID NO: 32880 - DNA, 21 bp, Artificial sequence
  synthetic polynucleotide sequence
aacgatgaagacgaggaccga

SEQ ID NO: 32881 - DNA, 20 bp, Artificial sequence
  synthetic polynucleotide sequence
cctaccccgcaacacccaca

SEQ ID NO: 32882 - DNA, 20 bp, Artificial sequence
  synthetic polynucleotide sequence
actcagggctcagtccggca

SEQ ID NO: 32883 - DNA, 21 bp, Artificial sequence
  synthetic polynucleotide sequence
ccgtgtatgaggacagcgcca

SEQ ID NO: 32884 - DNA, 21 bp, Artificial sequence
  synthetic polynucleotide sequence
agaccagtaccgaggctacga

SEQ ID NO: 32885 - DNA, 18 bp, Artificial sequence
  synthetic polynucleotide sequence
ctgacctcacggccacca

SEQ ID NO: 32886 - DNA, 18 bp, Artificial sequence
  synthetic polynucleotide sequence
cccgaaccagcaaggcca

SEQ ID NO: 32887 - DNA, 19 bp, Artificial sequence
  synthetic polynucleotide sequence
gggcaacacaaggtcacca

SEQ ID NO: 32888 - DNA, 18 bp, Artificial sequence
  synthetic polynucleotide sequence
tggacacggactggggca

SEQ ID NO: 32889 - DNA, 18 bp, Artificial sequence
  synthetic polynucleotide sequence
cctcttgccgcagccgga

SEQ ID NO: 32890 - DNA, 20 bp, Artificial sequence
  synthetic polynucleotide sequence
ggagaggtccagcatgtcca

SEQ ID NO: 32891 - DNA, 21 bp, Artificial sequence
  synthetic polynucleotide sequence
agccagtgacagtgagaccga

SEQ ID NO: 32892 - DNA, 20 bp, Artificial sequence
  synthetic polynucleotide sequence
tgacgttggaacctgggcga

SEQ ID NO: 32893 - DNA, 22 bp, Artificial sequence
  synthetic polynucleotide sequence
attccagcccatgctgaagtga

SEQ ID NO: 32894 - DNA, 21 bp, Artificial sequence
  synthetic polynucleotide sequence
gcatttgggaggcctcaacca

SEQ ID NO: 32895 - DNA, 18 bp, Artificial sequence
  synthetic polynucleotide sequence
ctcaggccaatgggcaca

SEQ ID NO: 32896 - DNA, 18 bp, Artificial sequence
  synthetic polynucleotide sequence
acgcagacccagcacaga

SEQ ID NO: 32897 - DNA, 21 bp, Artificial sequence
  synthetic polynucleotide sequence
atctgcctttcccaccaacca

SEQ ID NO: 32898 - DNA, 21 bp, Artificial sequence
  synthetic polynucleotide sequence
tcatggactggctgctgggaa

SEQ ID NO: 32899 - DNA, 18 bp, Artificial sequence
  synthetic polynucleotide sequence
ggccactgttggaccgaa

SEQ ID NO: 32900 - DNA, 18 bp, Artificial sequence
  synthetic polynucleotide sequence
ggatcacactgaggcgca

SEQ ID NO: 32901 - DNA, 21 bp, Artificial sequence
  synthetic polynucleotide sequence
gcaccccaggctaagaacaca

SEQ ID NO: 32902 - DNA, 22 bp, Artificial sequence
  synthetic polynucleotide sequence
acgatggccacactgatcacca

SEQ ID NO: 32903 - DNA, 21 bp, Artificial sequence
  synthetic polynucleotide sequence
tggttcacattggccccggaa

SEQ ID NO: 32904 - DNA, 22 bp, Artificial sequence
  synthetic polynucleotide sequence
aggaccactgtgacatgcagga

SEQ ID NO: 32905 - DNA, 21 bp, Artificial sequence
  synthetic polynucleotide sequence
tccaaaaggagtgcctcccca

SEQ ID NO: 32906 - DNA, 21 bp, Artificial sequence
  synthetic polynucleotide sequence
cacaggcagtactggtcacca

SEQ ID NO: 32907 - DNA, 22 bp, Artificial sequence
  synthetic polynucleotide sequence
agtagaaaggacaaggaagcca

SEQ ID NO: 32908 - DNA, 18 bp, Artificial sequence
  synthetic polynucleotide sequence
gtgggagcggcatccaca

SEQ ID NO: 32909 - DNA, 21 bp, Artificial sequence
  synthetic polynucleotide sequence
agggcttccagcaccaacgga

SEQ ID NO: 32910 - DNA, 20 bp, Artificial sequence
  synthetic polynucleotide sequence
cgtccagtaggcctcccaca

SEQ ID NO: 32911 - DNA, 19 bp, Artificial sequence
  synthetic polynucleotide sequence
ctcactgcccctagagcca

SEQ ID NO: 32912 - DNA, 18 bp, Artificial sequence
  synthetic polynucleotide sequence
catcttccagggccagga

SEQ ID NO: 32913 - DNA, 21 bp, Artificial sequence
  synthetic polynucleotide sequence
gcagcctactccacaggagga

SEQ ID NO: 32914 - DNA, 18 bp, Artificial sequence
  synthetic polynucleotide sequence
ttgcggtccaggcccaga

SEQ ID NO: 32915 - DNA, 25 bp, Artificial sequence
  synthetic polynucleotide sequence
tcaaggacaagggcttagacaacca

SEQ ID NO: 32916 - DNA, 20 bp, Artificial sequence
  synthetic polynucleotide sequence
gctcacaggggccatctcga

SEQ ID NO: 32917 - DNA, 21 bp, Artificial sequence
  synthetic polynucleotide sequence
tggtcaggcacacagtgtgaa

SEQ ID NO: 32918 - DNA, 21 bp, Artificial sequence
  synthetic polynucleotide sequence
acgagaggcacaatgatggca

SEQ ID NO: 32919 - DNA, 19 bp, Artificial sequence
  synthetic polynucleotide sequence
gggagtgcacagagagcga

SEQ ID NO: 32920 - DNA, 18 bp, Artificial sequence
  synthetic polynucleotide sequence
gcctggcagtatgcacca

SEQ ID NO: 32921 - DNA, 21 bp, Artificial sequence
  synthetic polynucleotide sequence
cgacatccccatgatcgccca

SEQ ID NO: 32922 - DNA, 21 bp, Artificial sequence
  synthetic polynucleotide sequence
tccctggtgatgcccaagcca

SEQ ID NO: 32923 - DNA, 19 bp, Artificial sequence
  synthetic polynucleotide sequence
gccactggtagacggccca

SEQ ID NO: 32924 - DNA, 19 bp, Artificial sequence
  synthetic polynucleotide sequence
gggttcctgcagaccccca

SEQ ID NO: 32925 - DNA, 20 bp, Artificial sequence
  synthetic polynucleotide sequence
gaggaagtcagcctggagga

SEQ ID NO: 32926 - DNA, 18 bp, Artificial sequence
  synthetic polynucleotide sequence
gtggactgggcatgagca

SEQ ID NO: 32927 - DNA, 21 bp, Artificial sequence
  synthetic polynucleotide sequence
gatcgaggcgatcagtgtcga

SEQ ID NO: 32928 - DNA, 20 bp, Artificial sequence
  synthetic polynucleotide sequence
ctgccaggcggtccagtaga

SEQ ID NO: 32929 - DNA, 18 bp, Artificial sequence
  synthetic polynucleotide sequence
gtggccaaaaccgcacca

SEQ ID NO: 32930 - DNA, 19 bp, Artificial sequence
  synthetic polynucleotide sequence
gagagtagtgggcagggca

SEQ ID NO: 32931 - DNA, 18 bp, Artificial sequence
  synthetic polynucleotide sequence
cgacctggtgaagcggaa

SEQ ID NO: 32932 - DNA, 18 bp, Artificial sequence
  synthetic polynucleotide sequence
tgccaggccctctggaga

SEQ ID NO: 32933 - DNA, 18 bp, Artificial sequence
  synthetic polynucleotide sequence
gcacacggagctgaagga

SEQ ID NO: 32934 - DNA, 18 bp, Artificial sequence
  synthetic polynucleotide sequence
gccaggtcccacaggtca

SEQ ID NO: 32935 - DNA, 18 bp, Artificial sequence
  synthetic polynucleotide sequence
aacgcaagttaggcggga

SEQ ID NO: 32936 - DNA, 18 bp, Artificial sequence
  synthetic polynucleotide sequence
cctggatgacacgggtca

SEQ ID NO: 32937 - DNA, 20 bp, Artificial sequence
  synthetic polynucleotide sequence
gtggaggtgatcagccggca

SEQ ID NO: 32938 - DNA, 20 bp, Artificial sequence
  synthetic polynucleotide sequence
cttcagggtggagatgagca

SEQ ID NO: 32939 - DNA, 21 bp, Artificial sequence
  synthetic polynucleotide sequence
ggcagggaacaggttgctgca

SEQ ID NO: 32940 - DNA, 19 bp, Artificial sequence
  synthetic polynucleotide sequence
tgacagcacgctcgttcca

SEQ ID NO: 32941 - DNA, 18 bp, Artificial sequence
  synthetic polynucleotide sequence
cctcacccagctgccgga

SEQ ID NO: 32942 - DNA, 21 bp, Artificial sequence
  synthetic polynucleotide sequence
ccaggctggggaagtaacgga

SEQ ID NO: 32943 - DNA, 19 bp, Artificial sequence
  synthetic polynucleotide sequence
gcctctcccacggcctgca

SEQ ID NO: 32944 - DNA, 21 bp, Artificial sequence
  synthetic polynucleotide sequence
gtgacggagtggaggtacaga

SEQ ID NO: 32945 - DNA, 21 bp, Artificial sequence
  synthetic polynucleotide sequence
tggcacaggctgagctgcgta

SEQ ID NO: 32946 - DNA, 21 bp, Artificial sequence
  synthetic polynucleotide sequence
agatgtccgtggtccagagca

SEQ ID NO: 32947 - DNA, 21 bp, Artificial sequence
  synthetic polynucleotide sequence
gaggatcctgacactggagga

SEQ ID NO: 32948 - DNA, 21 bp, Artificial sequence
  synthetic polynucleotide sequence
ccgggaactcaatgcagcgca

SEQ ID NO: 32949 - DNA, 20 bp, Artificial sequence
  synthetic polynucleotide sequence
gcctaggttagggacggaca

SEQ ID NO: 32950 - DNA, 21 bp, Artificial sequence
  synthetic polynucleotide sequence
gggacatggacgcttggaaca

SEQ ID NO: 32951 - DNA, 18 bp, Artificial sequence
  synthetic polynucleotide sequence
ggcagtgtgagaagccga

SEQ ID NO: 32952 - DNA, 18 bp, Artificial sequence
  synthetic polynucleotide sequence
cctgaggccaaccaggca

SEQ ID NO: 32953 - DNA, 20 bp, Artificial sequence
  synthetic polynucleotide sequence
atgccaaaacgcccgggaca

SEQ ID NO: 32954 - DNA, 19 bp, Artificial sequence
  synthetic polynucleotide sequence
tcccaggagtccttggcca

SEQ ID NO: 32955 - DNA, 18 bp, Artificial sequence
  synthetic polynucleotide sequence
accccaacagcctgcaga

SEQ ID NO: 32956 - DNA, 23 bp, Artificial sequence
  synthetic polynucleotide sequence
gtacagtgacaacaacaccaaca

SEQ ID NO: 32957 - DNA, 21 bp, Artificial sequence
  synthetic polynucleotide sequence
ttgagaagagcgccttggaga

SEQ ID NO: 32958 - DNA, 22 bp, Artificial sequence
  synthetic polynucleotide sequence
tcaatcttgtccagaagccgca

SEQ ID NO: 32959 - DNA, 22 bp, Artificial sequence
  synthetic polynucleotide sequence
atcaacctggaggagaacgaga

SEQ ID NO: 32960 - DNA, 18 bp, Artificial sequence
  synthetic polynucleotide sequence
tgatgagcggcggggcga

SEQ ID NO: 32961 - DNA, 22 bp, Artificial sequence
  synthetic polynucleotide sequence
gaagaacctctacctggcccaa

SEQ ID NO: 32962 - DNA, 22 bp, Artificial sequence
  synthetic polynucleotide sequence
gagaagccactcagggtgtcaa

SEQ ID NO: 32963 - DNA, 21 bp, Artificial sequence
  synthetic polynucleotide sequence
tacgttcgcacagctagagga

SEQ ID NO: 32964 - DNA, 19 bp, Artificial sequence
  synthetic polynucleotide sequence
ctgttccgggccgcagtca

SEQ ID NO: 32965 - DNA, 21 bp, Artificial sequence
  synthetic polynucleotide sequence
atgtttgtgggccagccagca

SEQ ID NO: 32966 - DNA, 19 bp, Artificial sequence
  synthetic polynucleotide sequence
gcctggcccagtgactgca

SEQ ID NO: 32967 - DNA, 18 bp, Artificial sequence
  synthetic polynucleotide sequence
cgggacgcctgacgctca

SEQ ID NO: 32968 - DNA, 20 bp, Artificial sequence
  synthetic polynucleotide sequence
cggcccgagcgtgtaaacca

SEQ ID NO: 32969 - DNA, 21 bp, Artificial sequence
  synthetic polynucleotide sequence
tgtgaacgctcaggacccaga

SEQ ID NO: 32970 - DNA, 21 bp, Artificial sequence
  synthetic polynucleotide sequence
tcagcttccaaaagcgcctga

SEQ ID NO: 32971 - DNA, 18 bp, Artificial sequence
  synthetic polynucleotide sequence
gccgcgccatctctgcca

SEQ ID NO: 32972 - DNA, 22 bp, Artificial sequence
  synthetic polynucleotide sequence
aggaaagcagcttcacctcgga

SEQ ID NO: 32973 - DNA, 21 bp, Artificial sequence
  synthetic polynucleotide sequence
atctcaacctgtccagctgca

SEQ ID NO: 32974 - DNA, 18 bp, Artificial sequence
  synthetic polynucleotide sequence
agcgtctgacggcggcca

SEQ ID NO: 32975 - DNA, 21 bp, Artificial sequence
  synthetic polynucleotide sequence
ccacacctcagtgcaggagga

SEQ ID NO: 32976 - DNA, 20 bp, Artificial sequence
  synthetic polynucleotide sequence
gtggcgcacatagtacacga

SEQ ID NO: 32977 - DNA, 20 bp, Artificial sequence
  synthetic polynucleotide sequence
ctgacagaggtgccggccga

SEQ ID NO: 32978 - DNA, 20 bp, Artificial sequence
  synthetic polynucleotide sequence
cagtctagagaggtcggcga

SEQ ID NO: 32979 - DNA, 19 bp, Artificial sequence
  synthetic polynucleotide sequence
tcctgcagaagctgggcaa

SEQ ID NO: 32980 - DNA, 22 bp, Artificial sequence
  synthetic polynucleotide sequence
aagtctgggagaaaaggcagca

SEQ ID NO: 32981 - DNA, 18 bp, Artificial sequence
  synthetic polynucleotide sequence
actcagctgctgcggcaa

SEQ ID NO: 32982 - DNA, 18 bp, Artificial sequence
  synthetic polynucleotide sequence
gcacgtggctcagggaca

SEQ ID NO: 32983 - DNA, 21 bp, Artificial sequence
  synthetic polynucleotide sequence
tgggtgagaggagcatgggga

SEQ ID NO: 32984 - DNA, 19 bp, Artificial sequence
  synthetic polynucleotide sequence
gattcgcgctggaccgcca

SEQ ID NO: 32985 - DNA, 21 bp, Artificial sequence
  synthetic polynucleotide sequence
tgtcctcagacagctcctgga

SEQ ID NO: 32986 - DNA, 21 bp, Artificial sequence
  synthetic polynucleotide sequence
tcattagggaccagctgcgca

SEQ ID NO: 32987 - DNA, 21 bp, Artificial sequence
  synthetic polynucleotide sequence
aggagacctgagtcctcaaga

SEQ ID NO: 32988 - DNA, 20 bp, Artificial sequence
  synthetic polynucleotide sequence
cggaatctgcctcaggagga

SEQ ID NO: 32989 - DNA, 21 bp, Artificial sequence
  synthetic polynucleotide sequence
ggaacagccccacacacagca

SEQ ID NO: 32990 - DNA, 19 bp, Artificial sequence
  synthetic polynucleotide sequence
gaaggcgcgcccttggaga

SEQ ID NO: 32991 - DNA, 20 bp, Artificial sequence
  synthetic polynucleotide sequence
tcacaaaactcgctcccgca

SEQ ID NO: 32992 - DNA, 21 bp, Artificial sequence
  synthetic polynucleotide sequence
ctcttcgctgcagagaacgga

SEQ ID NO: 32993 - DNA, 18 bp, Artificial sequence
  synthetic polynucleotide sequence
cctcatccccaacgagga

SEQ ID NO: 32994 - DNA, 18 bp, Artificial sequence
  synthetic polynucleotide sequence
caggaggcctgttcgcaa

SEQ ID NO: 32995 - DNA, 21 bp, Artificial sequence
  synthetic polynucleotide sequence
tgcccatggagagcaggagga

SEQ ID NO: 32996 - DNA, 21 bp, Artificial sequence
  synthetic polynucleotide sequence
aagctggagatgatggccgca

SEQ ID NO: 32997 - DNA, 21 bp, Artificial sequence
  synthetic polynucleotide sequence
gtgcggatctgggaagaacga

SEQ ID NO: 32998 - DNA, 22 bp, Artificial sequence
  synthetic polynucleotide sequence
gagaagaagggagggtcttcca

SEQ ID NO: 32999 - DNA, 20 bp, Artificial sequence
  synthetic polynucleotide sequence
aacaacccctggcactgcga

SEQ ID NO: 33000 - DNA, 22 bp, Artificial sequence
  synthetic polynucleotide sequence
attgaggaatggtctgccagca

SEQ ID NO: 33001 - DNA, 19 bp, Artificial sequence
  synthetic polynucleotide sequence
gggggctggctgacactca

SEQ ID NO: 33002 - DNA, 21 bp, Artificial sequence
  synthetic polynucleotide sequence
cactgtgctgaggatggagga

SEQ ID NO: 33003 - DNA, 22 bp, Artificial sequence
  synthetic polynucleotide sequence
cagacaccactgacaagatgca

SEQ ID NO: 33004 - DNA, 22 bp, Artificial sequence
  synthetic polynucleotide sequence
gaagacaatcaacatggcggca

SEQ ID NO: 33005 - DNA, 22 bp, Artificial sequence
  synthetic polynucleotide sequence
gaaacctcagtgaagtgccgca

SEQ ID NO: 33006 - DNA, 22 bp, Artificial sequence
  synthetic polynucleotide sequence
tcaagaacagtcagtgcaggca

SEQ ID NO: 33007 - DNA, 20 bp, Artificial sequence
  synthetic polynucleotide sequence
ctcgctgactgtcagagcga

SEQ ID NO: 33008 - DNA, 18 bp, Artificial sequence
  synthetic polynucleotide sequence
catctgccaaggccagca

SEQ ID NO: 33009 - DNA, 20 bp, Artificial sequence
  synthetic polynucleotide sequence
tgggacagggctcaaggaca

SEQ ID NO: 33010 - DNA, 19 bp, Artificial sequence
  synthetic polynucleotide sequence
ccgcagtcacacgctccca

SEQ ID NO: 33011 - DNA, 21 bp, Artificial sequence
  synthetic polynucleotide sequence
gaagaaagagccgcccaagga

SEQ ID NO: 33012 - DNA, 21 bp, Artificial sequence
  synthetic polynucleotide sequence
ggaccacgccgaagttgcaca

SEQ ID NO: 33013 - DNA, 18 bp, Artificial sequence
  synthetic polynucleotide sequence
cgtgggaggcgcctggga

SEQ ID NO: 33014 - DNA, 20 bp, Artificial sequence
  synthetic polynucleotide sequence
ccgcagcgttcacggtgaca

SEQ ID NO: 33015 - DNA, 18 bp, Artificial sequence
  synthetic polynucleotide sequence
gcagcccaccctcaccga

SEQ ID NO: 33016 - DNA, 19 bp, Artificial sequence
  synthetic polynucleotide sequence
gagaggaggcctggggtga

SEQ ID NO: 33017 - DNA, 20 bp, Artificial sequence
  synthetic polynucleotide sequence
gaggccgaggagcagaggaa

SEQ ID NO: 33018 - DNA, 21 bp, Artificial sequence
  synthetic polynucleotide sequence
acatcaccgtctgcatccaca

SEQ ID NO: 33019 - DNA, 21 bp, Artificial sequence
  synthetic polynucleotide sequence
acagggcctctagactcagga

SEQ ID NO: 33020 - DNA, 21 bp, Artificial sequence
  synthetic polynucleotide sequence
gattccagtgctcctgagcca

SEQ ID NO: 33021 - DNA, 18 bp, Artificial sequence
  synthetic polynucleotide sequence
ccgagctcaaatgccgca

SEQ ID NO: 33022 - DNA, 18 bp, Artificial sequence
  synthetic polynucleotide sequence
gcgtgccgtcatgcagga

SEQ ID NO: 33023 - DNA, 20 bp, Artificial sequence
  synthetic polynucleotide sequence
ggaagcagcaccatcggcaa

SEQ ID NO: 33024 - DNA, 20 bp, Artificial sequence
  synthetic polynucleotide sequence
ctcgatagcaggcatgggca

SEQ ID NO: 33025 - DNA, 21 bp, Artificial sequence
  synthetic polynucleotide sequence
agaacacccgccacaagtcga

SEQ ID NO: 33026 - DNA, 20 bp, Artificial sequence
  synthetic polynucleotide sequence
tgagggaactcctggaccga

SEQ ID NO: 33027 - DNA, 21 bp, Artificial sequence
  synthetic polynucleotide sequence
gcaccatggaacccctgctga

SEQ ID NO: 33028 - DNA, 21 bp, Artificial sequence
  synthetic polynucleotide sequence
aatcatccagggtcagggtca

SEQ ID NO: 33029 - DNA, 20 bp, Artificial sequence
  synthetic polynucleotide sequence
ccccaacacaggccaggaga

SEQ ID NO: 33030 - DNA, 19 bp, Artificial sequence
  synthetic polynucleotide sequence
ctataggggagggggcgca

SEQ ID NO: 33031 - DNA, 21 bp, Artificial sequence
  synthetic polynucleotide sequence
cagtgggagagctgcaagtca

SEQ ID NO: 33032 - DNA, 22 bp, Artificial sequence
  synthetic polynucleotide sequence
agattgccttccacagcaagca

SEQ ID NO: 33033 - DNA, 19 bp, Artificial sequence
  synthetic polynucleotide sequence
tcagccagcaattgcccaa

SEQ ID NO: 33034 - DNA, 20 bp, Artificial sequence
  synthetic polynucleotide sequence
agtgcatcagtgggaggcga

SEQ ID NO: 33035 - DNA, 20 bp, Artificial sequence
  synthetic polynucleotide sequence
cattggagagctgagcagca

SEQ ID NO: 33036 - DNA, 21 bp, Artificial sequence
  synthetic polynucleotide sequence
gtggaagagttgctaccacga

SEQ ID NO: 33037 - DNA, 21 bp, Artificial sequence
  synthetic polynucleotide sequence
tgctgcctggcctgaaagtca

SEQ ID NO: 33038 - DNA, 19 bp, Artificial sequence
  synthetic polynucleotide sequence
ctctggggcctggactgga

SEQ ID NO: 33039 - DNA, 22 bp, Artificial sequence
  synthetic polynucleotide sequence
atgtccgtgagcagattccaga

SEQ ID NO: 33040 - DNA, 21 bp, Artificial sequence
  synthetic polynucleotide sequence
tgagcgataactgagccagga

SEQ ID NO: 33041 - DNA, 20 bp, Artificial sequence
  synthetic polynucleotide sequence
agaagcacccgcgatgtgca

SEQ ID NO: 33042 - DNA, 20 bp, Artificial sequence
  synthetic polynucleotide sequence
caggctgaaggcgacaagga

SEQ ID NO: 33043 - DNA, 21 bp, Artificial sequence
  synthetic polynucleotide sequence
ggtacccacaagtcaggagca

SEQ ID NO: 33044 - DNA, 20 bp, Artificial sequence
  synthetic polynucleotide sequence
ggagaggcaccagcttcaga

SEQ ID NO: 33045 - DNA, 21 bp, Artificial sequence
  synthetic polynucleotide sequence
gagcagcagccgtatgaagga

SEQ ID NO: 33046 - DNA, 19 bp, Artificial sequence
  synthetic polynucleotide sequence
taagcaccgtccaggctga

SEQ ID NO: 33047 - DNA, 19 bp, Artificial sequence
  synthetic polynucleotide sequence
tgtcagaatcccccatcca

SEQ ID NO: 33048 - DNA, 18 bp, Artificial sequence
  synthetic polynucleotide sequence
caggccatcattagcgca

SEQ ID NO: 33049 - DNA, 21 bp, Artificial sequence
  synthetic polynucleotide sequence
caggcaaggggaaggtaacca

SEQ ID NO: 33050 - DNA, 20 bp, Artificial sequence
  synthetic polynucleotide sequence
gtgctccacaggctccagga

SEQ ID NO: 33051 - DNA, 20 bp, Artificial sequence
  synthetic polynucleotide sequence
cggaccaaccgctccatcca

SEQ ID NO: 33052 - DNA, 20 bp, Artificial sequence
  synthetic polynucleotide sequence
ggtccagagccacgagggca

SEQ ID NO: 33053 - DNA, 20 bp, Artificial sequence
  synthetic polynucleotide sequence
tgccaagccctgtcgaccaa

SEQ ID NO: 33054 - DNA, 19 bp, Artificial sequence
  synthetic polynucleotide sequence
tccagctcagatccagtga

SEQ ID NO: 33055 - DNA, 21 bp, Artificial sequence
  synthetic polynucleotide sequence
gcaggggagacacttggacca

SEQ ID NO: 33056 - DNA, 19 bp, Artificial sequence
  synthetic polynucleotide sequence
gcctccagtcccctggcaa

SEQ ID NO: 33057 - DNA, 20 bp, Artificial sequence
  synthetic polynucleotide sequence
ctgacctcccgagacctgga

SEQ ID NO: 33058 - DNA, 20 bp, Artificial sequence
  synthetic polynucleotide sequence
ggtgctgagtgctggcagca

SEQ ID NO: 33059 - DNA, 21 bp, Artificial sequence
  synthetic polynucleotide sequence
acctgagcttcacggggctga

SEQ ID NO: 33060 - DNA, 21 bp, Artificial sequence
  synthetic polynucleotide sequence
gcatcagtgagcttgcgggca

SEQ ID NO: 33061 - DNA, 21 bp, Artificial sequence
  synthetic polynucleotide sequence
catccccatccagatcggcaa

SEQ ID NO: 33062 - DNA, 20 bp, Artificial sequence
  synthetic polynucleotide sequence
aggtagcgcagcttgcggca

SEQ ID NO: 33063 - DNA, 19 bp, Artificial sequence
  synthetic polynucleotide sequence
ccacccgcgccctttcaga

SEQ ID NO: 33064 - DNA, 21 bp, Artificial sequence
  synthetic polynucleotide sequence
acctggctgtgggtagggcaa

SEQ ID NO: 33065 - DNA, 22 bp, Artificial sequence
  synthetic polynucleotide sequence
gcatcacctacatcccagagca

SEQ ID NO: 33066 - DNA, 20 bp, Artificial sequence
  synthetic polynucleotide sequence
taggaagaggtgggaaggca

SEQ ID NO: 33067 - DNA, 21 bp, Artificial sequence
  synthetic polynucleotide sequence
agagccacatatcctcgcaca

SEQ ID NO: 33068 - DNA, 20 bp, Artificial sequence
  synthetic polynucleotide sequence
agaataccacggaagggcca

SEQ ID NO: 33069 - DNA, 20 bp, Artificial sequence
  synthetic polynucleotide sequence
gcacgtgcggaagctcagga

SEQ ID NO: 33070 - DNA, 20 bp, Artificial sequence
  synthetic polynucleotide sequence
ggacacatccagcagacgga

SEQ ID NO: 33071 - DNA, 21 bp, Artificial sequence
  synthetic polynucleotide sequence
cgactgccagggtacagagca

SEQ ID NO: 33072 - DNA, 21 bp, Artificial sequence
  synthetic polynucleotide sequence
ttctaggcactgcagctgtga

SEQ ID NO: 33073 - DNA, 21 bp, Artificial sequence
  synthetic polynucleotide sequence
actaactgggaggactgcaga

SEQ ID NO: 33074 - DNA, 22 bp, Artificial sequence
  synthetic polynucleotide sequence
aagttatctgcccctaggccaa

SEQ ID NO: 33075 - DNA, 18 bp, Artificial sequence
  synthetic polynucleotide sequence
aggaggttccagcgcaca

SEQ ID NO: 33076 - DNA, 19 bp, Artificial sequence
  synthetic polynucleotide sequence
tcctgctggagaaccagga

SEQ ID NO: 33077 - DNA, 22 bp, Artificial sequence
  synthetic polynucleotide sequence
agcaggaggaacagatggcaga

SEQ ID NO: 33078 - DNA, 22 bp, Artificial sequence
  synthetic polynucleotide sequence
acctgagcagcttcctgagaca

SEQ ID NO: 33079 - DNA, 22 bp, Artificial sequence
  synthetic polynucleotide sequence
gaaatgcccagccaacatgaca

SEQ ID NO: 33080 - DNA, 21 bp, Artificial sequence
  synthetic polynucleotide sequence
taatccacagcgtcgaaggga

SEQ ID NO: 33081 - DNA, 23 bp, Artificial sequence
  synthetic polynucleotide sequence
cccggaaaaccatgatgtggaga

SEQ ID NO: 33082 - DNA, 20 bp, Artificial sequence
  synthetic polynucleotide sequence
ccagccccaacacagtcaga

SEQ ID NO: 33083 - DNA, 21 bp, Artificial sequence
  synthetic polynucleotide sequence
ggaaatcgggctgagcgggaa

SEQ ID NO: 33084 - DNA, 21 bp, Artificial sequence
  synthetic polynucleotide sequence
ggcttaggtccaggaagcgca

SEQ ID NO: 33085 - DNA, 18 bp, Artificial sequence
  synthetic polynucleotide sequence
gccagatgaaggacccga

SEQ ID NO: 33086 - DNA, 18 bp, Artificial sequence
  synthetic polynucleotide sequence
caccttcatcccagggca

SEQ ID NO: 33087 - DNA, 18 bp, Artificial sequence
  synthetic polynucleotide sequence
ccgagacctgaaacccca

SEQ ID NO: 33088 - DNA, 19 bp, Artificial sequence
  synthetic polynucleotide sequence
ggcaacttcaggtgcacga

SEQ ID NO: 33089 - DNA, 21 bp, Artificial sequence
  synthetic polynucleotide sequence
agaatgtccaaggggcagaca

SEQ ID NO: 33090 - DNA, 19 bp, Artificial sequence
  synthetic polynucleotide sequence
tcatggacatcgactggga

SEQ ID NO: 33091 - DNA, 21 bp, Artificial sequence
  synthetic polynucleotide sequence
ttgccacagagccttagggga

SEQ ID NO: 33092 - DNA, 19 bp, Artificial sequence
  synthetic polynucleotide sequence
gcaggacgaggggagcaga

SEQ ID NO: 33093 - DNA, 19 bp, Artificial sequence
  synthetic polynucleotide sequence
ctgcagaaccacagcctga

SEQ ID NO: 33094 - DNA, 20 bp, Artificial sequence
  synthetic polynucleotide sequence
cagacttcaagtcagcgcca

SEQ ID NO: 33095 - DNA, 20 bp, Artificial sequence
  synthetic polynucleotide sequence
atcgctccccactgccgcca

SEQ ID NO: 33096 - DNA, 21 bp, Artificial sequence
  synthetic polynucleotide sequence
agagaggcactgactgctgaa

SEQ ID NO: 33097 - DNA, 20 bp, Artificial sequence
  synthetic polynucleotide sequence
ggtccgcagagccgaactga

SEQ ID NO: 33098 - DNA, 18 bp, Artificial sequence
  synthetic polynucleotide sequence
ggatgtcggccccctcga

SEQ ID NO: 33099 - DNA, 19 bp, Artificial sequence
  synthetic polynucleotide sequence
gcctcaggcagctcagaca

SEQ ID NO: 33100 - DNA, 18 bp, Artificial sequence
  synthetic polynucleotide sequence
gggcagacatggcagcca

SEQ ID NO: 33101 - DNA, 22 bp, Artificial sequence
  synthetic polynucleotide sequence
tagagcacaaccagctgacgaa

SEQ ID NO: 33102 - DNA, 20 bp, Artificial sequence
  synthetic polynucleotide sequence
tctaaagtgccccaggtcca

SEQ ID NO: 33103 - DNA, 21 bp, Artificial sequence
  synthetic polynucleotide sequence
atgactcccagcacccaggaa

SEQ ID NO: 33104 - DNA, 20 bp, Artificial sequence
  synthetic polynucleotide sequence
tcacactccctggagcccga

SEQ ID NO: 33105 - DNA, 21 bp, Artificial sequence
  synthetic polynucleotide sequence
gcggcggaaaaaggccagaga

SEQ ID NO: 33106 - DNA, 21 bp, Artificial sequence
  synthetic polynucleotide sequence
gggcccagatccattaaccga

SEQ ID NO: 33107 - DNA, 21 bp, Artificial sequence
  synthetic polynucleotide sequence
atcctccggagagtccaggaa

SEQ ID NO: 33108 - DNA, 20 bp, Artificial sequence
  synthetic polynucleotide sequence
cctgcacctccagctctgca

SEQ ID NO: 33109 - DNA, 21 bp, Artificial sequence
  synthetic polynucleotide sequence
aagggggactaacagacggca

SEQ ID NO: 33110 - DNA, 20 bp, Artificial sequence
  synthetic polynucleotide sequence
gttctcaggaggcctcagga

SEQ ID NO: 33111 - DNA, 19 bp, Artificial sequence
  synthetic polynucleotide sequence
ccagagcctgctaagccca

SEQ ID NO: 33112 - DNA, 18 bp, Artificial sequence
  synthetic polynucleotide sequence
gatgcagacgacgccgca

SEQ ID NO: 33113 - DNA, 22 bp, Artificial sequence
  synthetic polynucleotide sequence
aggacaggactacgaccactga

SEQ ID NO: 33114 - DNA, 20 bp, Artificial sequence
  synthetic polynucleotide sequence
ctccaacagctgtgaagcca

SEQ ID NO: 33115 - DNA, 19 bp, Artificial sequence
  synthetic polynucleotide sequence
ctgcaggcccccacacaga

SEQ ID NO: 33116 - DNA, 21 bp, Artificial sequence
  synthetic polynucleotide sequence
ggcggtgaggtaggtgaagga

SEQ ID NO: 33117 - DNA, 22 bp, Artificial sequence
  synthetic polynucleotide sequence
atgagtgcaaagctgccaacga

SEQ ID NO: 33118 - DNA, 21 bp, Artificial sequence
  synthetic polynucleotide sequence
actcaaagtcaggtgcaggca

SEQ ID NO: 33119 - DNA, 19 bp, Artificial sequence
  synthetic polynucleotide sequence
tcagcatcaacaccagcga

SEQ ID NO: 33120 - DNA, 20 bp, Artificial sequence
  synthetic polynucleotide sequence
actcccgggcttgtaaccca

SEQ ID NO: 33121 - DNA, 19 bp, Artificial sequence
  synthetic polynucleotide sequence
gccagcctcatcgaggaca

SEQ ID NO: 33122 - DNA, 20 bp, Artificial sequence
  synthetic polynucleotide sequence
gcccacatgaatacgctcca

SEQ ID NO: 33123 - DNA, 21 bp, Artificial sequence
  synthetic polynucleotide sequence
tggcccacggacgcatagaca

SEQ ID NO: 33124 - DNA, 20 bp, Artificial sequence
  synthetic polynucleotide sequence
tgggatgtggacgtagcgga

SEQ ID NO: 33125 - DNA, 21 bp, Artificial sequence
  synthetic polynucleotide sequence
cagtgtggggaagagcagaca

SEQ ID NO: 33126 - DNA, 22 bp, Artificial sequence
  synthetic polynucleotide sequence
aaaaggtacctcccacactgga

SEQ ID NO: 33127 - DNA, 21 bp, Artificial sequence
  synthetic polynucleotide sequence
acagaaacccctcctccccta

SEQ ID NO: 33128 - DNA, 21 bp, Artificial sequence
  synthetic polynucleotide sequence
gctgctggccctctagagaga

SEQ ID NO: 33129 - DNA, 23 bp, Artificial sequence
  synthetic polynucleotide sequence
caaaaggcaggagagaatcagga

SEQ ID NO: 33130 - DNA, 18 bp, Artificial sequence
  synthetic polynucleotide sequence
cttcccctgccaccccga

SEQ ID NO: 33131 - DNA, 20 bp, Artificial sequence
  synthetic polynucleotide sequence
tggtgacccagagtgccgaa

SEQ ID NO: 33132 - DNA, 21 bp, Artificial sequence
  synthetic polynucleotide sequence
agaaacctccctgacacccca

SEQ ID NO: 33133 - DNA, 22 bp, Artificial sequence
  synthetic polynucleotide sequence
atcagtgtcacagaccctgaga

SEQ ID NO: 33134 - DNA, 20 bp, Artificial sequence
  synthetic polynucleotide sequence
cttgccgcatcctgtagcaa

SEQ ID NO: 33135 - DNA, 20 bp, Artificial sequence
  synthetic polynucleotide sequence
actgtagaggagcccctgga

SEQ ID NO: 33136 - DNA, 20 bp, Artificial sequence
  synthetic polynucleotide sequence
gacaacgccatctccccgga

SEQ ID NO: 33137 - DNA, 18 bp, Artificial sequence
  synthetic polynucleotide sequence
gggacaagttctggcgga

SEQ ID NO: 33138 - DNA, 18 bp, Artificial sequence
  synthetic polynucleotide sequence
gtcggggatgcgcaggta

SEQ ID NO: 33139 - DNA, 21 bp, Artificial sequence
  synthetic polynucleotide sequence
cgctactaccaacccgtcgca

SEQ ID NO: 33140 - DNA, 19 bp, Artificial sequence
  synthetic polynucleotide sequence
tctcctccaggaaccagca

SEQ ID NO: 33141 - DNA, 20 bp, Artificial sequence
  synthetic polynucleotide sequence
ctggttcccgccggcgagga

SEQ ID NO: 33142 - DNA, 21 bp, Artificial sequence
  synthetic polynucleotide sequence
ccaggacccctcgataatcca

SEQ ID NO: 33143 - DNA, 20 bp, Artificial sequence
  synthetic polynucleotide sequence
tccgggtaaagttccaggga

SEQ ID NO: 33144 - DNA, 18 bp, Artificial sequence
  synthetic polynucleotide sequence
caatggtgccgtccagca

SEQ ID NO: 33145 - DNA, 21 bp, Artificial sequence
  synthetic polynucleotide sequence
ctaaacctctgtccagccgga

SEQ ID NO: 33146 - DNA, 21 bp, Artificial sequence
  synthetic polynucleotide sequence
gtgccaggctgacaatcagca

SEQ ID NO: 33147 - DNA, 21 bp, Artificial sequence
  synthetic polynucleotide sequence
gtggagtccatcagcgaccta

SEQ ID NO: 33148 - DNA, 21 bp, Artificial sequence
  synthetic polynucleotide sequence
tcgtctgtacacagggctgca

SEQ ID NO: 33149 - DNA, 18 bp, Artificial sequence
  synthetic polynucleotide sequence
agcagcccaggacaccca

SEQ ID NO: 33150 - DNA, 19 bp, Artificial sequence
  synthetic polynucleotide sequence
ggtggtagggctcagggga

SEQ ID NO: 33151 - DNA, 20 bp, Artificial sequence
  synthetic polynucleotide sequence
gaccaagacgactcgaggga

SEQ ID NO: 33152 - DNA, 18 bp, Artificial sequence
  synthetic polynucleotide sequence
ataggggaggtccccgga

SEQ ID NO: 33153 - DNA, 18 bp, Artificial sequence
  synthetic polynucleotide sequence
ctaccgccagatgcgcaa

SEQ ID NO: 33154 - DNA, 18 bp, Artificial sequence
  synthetic polynucleotide sequence
ctcggtgacatggggaca

SEQ ID NO: 33155 - DNA, 21 bp, Artificial sequence
  synthetic polynucleotide sequence
gagcaggaactccactatgca

SEQ ID NO: 33156 - DNA, 18 bp, Artificial sequence
  synthetic polynucleotide sequence
acccgcctgggttgagga

SEQ ID NO: 33157 - DNA, 19 bp, Artificial sequence
  synthetic polynucleotide sequence
gtatccagggctgcaggaa

SEQ ID NO: 33158 - DNA, 19 bp, Artificial sequence
  synthetic polynucleotide sequence
ctgaggactaggtggggga

SEQ ID NO: 33159 - DNA, 18 bp, Artificial sequence
  synthetic polynucleotide sequence
cagacgctccagagggca

SEQ ID NO: 33160 - DNA, 18 bp, Artificial sequence
  synthetic polynucleotide sequence
attgaatgcagagccgca

SEQ ID NO: 33161 - DNA, 19 bp, Artificial sequence
  synthetic polynucleotide sequence
cggccaggagacaagggta

SEQ ID NO: 33162 - DNA, 19 bp, Artificial sequence
  synthetic polynucleotide sequence
cctctcgcgaagtccacca

SEQ ID NO: 33163 - DNA, 23 bp, Artificial sequence
  synthetic polynucleotide sequence
gccccaggaaacaaagattccca

SEQ ID NO: 33164 - DNA, 23 bp, Artificial sequence
  synthetic polynucleotide sequence
cttgtcagaacagagttggacca

SEQ ID NO: 33165 - DNA, 19 bp, Artificial sequence
  synthetic polynucleotide sequence
gccccctaccacgcagtca

SEQ ID NO: 33166 - DNA, 21 bp, Artificial sequence
  synthetic polynucleotide sequence
tagagcaccgggttgacgcta

SEQ ID NO: 33167 - DNA, 18 bp, Artificial sequence
  synthetic polynucleotide sequence
cggagccagaagtggcaa

SEQ ID NO: 33168 - DNA, 20 bp, Artificial sequence
  synthetic polynucleotide sequence
gagacagctggggttgacca

SEQ ID NO: 33169 - DNA, 20 bp, Artificial sequence
  synthetic polynucleotide sequence
ctgtgaccagggcttcgaga

SEQ ID NO: 33170 - DNA, 19 bp, Artificial sequence
  synthetic polynucleotide sequence
cctccaggtcactggcaca

SEQ ID NO: 33171 - DNA, 18 bp, Artificial sequence
  synthetic polynucleotide sequence
gtgaacgagtgcgaggca

SEQ ID NO: 33172 - DNA, 18 bp, Artificial sequence
  synthetic polynucleotide sequence
gttcaggtccacgcacga

SEQ ID NO: 33173 - DNA, 21 bp, Artificial sequence
  synthetic polynucleotide sequence
accccgcttcgacatgccaga

SEQ ID NO: 33174 - DNA, 19 bp, Artificial sequence
  synthetic polynucleotide sequence
cctcgggctctgggaagga

SEQ ID NO: 33175 - DNA, 18 bp, Artificial sequence
  synthetic polynucleotide sequence
agccactgcccccagaga

SEQ ID NO: 33176 - DNA, 18 bp, Artificial sequence
  synthetic polynucleotide sequence
gcggacgcctcttgagca

SEQ ID NO: 33177 - DNA, 18 bp, Artificial sequence
  synthetic polynucleotide sequence
ccaggtgaactgcagcga

SEQ ID NO: 33178 - DNA, 18 bp, Artificial sequence
  synthetic polynucleotide sequence
agtgggcgagcaggccga

SEQ ID NO: 33179 - DNA, 18 bp, Artificial sequence
  synthetic polynucleotide sequence
gcctcgatggcaaacgga

SEQ ID NO: 33180 - DNA, 18 bp, Artificial sequence
  synthetic polynucleotide sequence
atccgagacaccacggca

SEQ ID NO: 33181 - DNA, 20 bp, Artificial sequence
  synthetic polynucleotide sequence
gagtgcctaagacccccaca

SEQ ID NO: 33182 - DNA, 18 bp, Artificial sequence
  synthetic polynucleotide sequence
gaggggcttgaggccaga

SEQ ID NO: 33183 - DNA, 22 bp, Artificial sequence
  synthetic polynucleotide sequence
ggaagcatccaaagtgagccca

SEQ ID NO: 33184 - DNA, 22 bp, Artificial sequence
  synthetic polynucleotide sequence
tatgacagtagctagaccccga

SEQ ID NO: 33185 - DNA, 21 bp, Artificial sequence
  synthetic polynucleotide sequence
cagatgagagtgcaccccaga

SEQ ID NO: 33186 - DNA, 22 bp, Artificial sequence
  synthetic polynucleotide sequence
gaataagctctgaaggcccaga

SEQ ID NO: 33187 - DNA, 22 bp, Artificial sequence
  synthetic polynucleotide sequence
gacggagacgaaaccagacaga

SEQ ID NO: 33188 - DNA, 20 bp, Artificial sequence
  synthetic polynucleotide sequence
tcggagggccaagtcgtgga

SEQ ID NO: 33189 - DNA, 21 bp, Artificial sequence
  synthetic polynucleotide sequence
gaggtcccgatcacacagcaa

SEQ ID NO: 33190 - DNA, 18 bp, Artificial sequence
  synthetic polynucleotide sequence
gcggctacggctgctgga

SEQ ID NO: 33191 - DNA, 20 bp, Artificial sequence
  synthetic polynucleotide sequence
agttaatgggccgggaccga

SEQ ID NO: 33192 - DNA, 20 bp, Artificial sequence
  synthetic polynucleotide sequence
gctctcgtggtcccaccgca

SEQ ID NO: 33193 - DNA, 20 bp, Artificial sequence
  synthetic polynucleotide sequence
ctgccctgaaagctacccaa

SEQ ID NO: 33194 - DNA, 22 bp, Artificial sequence
  synthetic polynucleotide sequence
atctagaatgagccactgcaga

SEQ ID NO: 33195 - DNA, 19 bp, Artificial sequence
  synthetic polynucleotide sequence
gggccaggactgaggtgga

SEQ ID NO: 33196 - DNA, 20 bp, Artificial sequence
  synthetic polynucleotide sequence
ccagaaccagtgggcctcga

SEQ ID NO: 33197 - DNA, 21 bp, Artificial sequence
  synthetic polynucleotide sequence
cgatggcagtgatgggctgga

SEQ ID NO: 33198 - DNA, 22 bp, Artificial sequence
  synthetic polynucleotide sequence
tctatgagggagctgtcactga

SEQ ID NO: 33199 - DNA, 21 bp, Artificial sequence
  synthetic polynucleotide sequence
ggtaggaccaagttcagggga

SEQ ID NO: 33200 - DNA, 20 bp, Artificial sequence
  synthetic polynucleotide sequence
agtggttccaggctgcgaca

SEQ ID NO: 33201 - DNA, 21 bp, Artificial sequence
  synthetic polynucleotide sequence
gaaagcagctcttgacaggga

SEQ ID NO: 33202 - DNA, 21 bp, Artificial sequence
  synthetic polynucleotide sequence
ctgggtgggagtaacatccga

SEQ ID NO: 33203 - DNA, 21 bp, Artificial sequence
  synthetic polynucleotide sequence
gagatctcgtagccagggaga

SEQ ID NO: 33204 - DNA, 21 bp, Artificial sequence
  synthetic polynucleotide sequence
tctctctcagtggccacgaga

SEQ ID NO: 33205 - DNA, 22 bp, Artificial sequence
  synthetic polynucleotide sequence
acccagttaagcatggaagaga

SEQ ID NO: 33206 - DNA, 18 bp, Artificial sequence
  synthetic polynucleotide sequence
aggagggcactctcacca

SEQ ID NO: 33207 - DNA, 18 bp, Artificial sequence
  synthetic polynucleotide sequence
ggcactgggaacgccaca

SEQ ID NO: 33208 - DNA, 18 bp, Artificial sequence
  synthetic polynucleotide sequence
ccttcaccaggcccgaga

SEQ ID NO: 33209 - DNA, 18 bp, Artificial sequence
  synthetic polynucleotide sequence
acccagcagcaagcagga

SEQ ID NO: 33210 - DNA, 18 bp, Artificial sequence
  synthetic polynucleotide sequence
caccaaggccgccctgga

SEQ ID NO: 33211 - DNA, 21 bp, Artificial sequence
  synthetic polynucleotide sequence
ggagtcgtgcacacccagcta

SEQ ID NO: 33212 - DNA, 19 bp, Artificial sequence
  synthetic polynucleotide sequence
ctgagggcactgtgggcga

SEQ ID NO: 33213 - DNA, 20 bp, Artificial sequence
  synthetic polynucleotide sequence
ctgcttgaaccagaagagca

SEQ ID NO: 33214 - DNA, 18 bp, Artificial sequence
  synthetic polynucleotide sequence
ccaatgccggcactagca

SEQ ID NO: 33215 - DNA, 18 bp, Artificial sequence
  synthetic polynucleotide sequence
ctggaccccatggtcaca

SEQ ID NO: 33216 - DNA, 19 bp, Artificial sequence
  synthetic polynucleotide sequence
caagagtccagcctgggga

SEQ ID NO: 33217 - DNA, 21 bp, Artificial sequence
  synthetic polynucleotide sequence
atgcctcttggagaccaagga

SEQ ID NO: 33218 - DNA, 20 bp, Artificial sequence
  synthetic polynucleotide sequence
acttcggcagtcactcacca

SEQ ID NO: 33219 - DNA, 21 bp, Artificial sequence
  synthetic polynucleotide sequence
tgtcaggaggccttcaaccaa

SEQ ID NO: 33220 - DNA, 19 bp, Artificial sequence
  synthetic polynucleotide sequence
gacaaggcccagggctgga

SEQ ID NO: 33221 - DNA, 19 bp, Artificial sequence
  synthetic polynucleotide sequence
gagtcggtgggagacgtga

SEQ ID NO: 33222 - DNA, 19 bp, Artificial sequence
  synthetic polynucleotide sequence
gagacaggtcagggcggta

SEQ ID NO: 33223 - DNA, 20 bp, Artificial sequence
  synthetic polynucleotide sequence
agcctggcagcctccatcga

SEQ ID NO: 33224 - DNA, 20 bp, Artificial sequence
  synthetic polynucleotide sequence
tctgcctggagccccacgga

SEQ ID NO: 33225 - DNA, 18 bp, Artificial sequence
  synthetic polynucleotide sequence
gaccaccaactccagcca

SEQ ID NO: 33226 - DNA, 20 bp, Artificial sequence
  synthetic polynucleotide sequence
gtgattcggacactggcaca

SEQ ID NO: 33227 - DNA, 18 bp, Artificial sequence
  synthetic polynucleotide sequence
ctcccagcgaacggacga

SEQ ID NO: 33228 - DNA, 18 bp, Artificial sequence
  synthetic polynucleotide sequence
cgctgcacaaccagcgga

SEQ ID NO: 33229 - DNA, 21 bp, Artificial sequence
  synthetic polynucleotide sequence
aaagcagacagacgttgcaga

SEQ ID NO: 33230 - DNA, 18 bp, Artificial sequence
  synthetic polynucleotide sequence
tgaaggagcgcctgcaca

SEQ ID NO: 33231 - DNA, 18 bp, Artificial sequence
  synthetic polynucleotide sequence
agcgacagcggcttggaa

SEQ ID NO: 33232 - DNA, 18 bp, Artificial sequence
  synthetic polynucleotide sequence
ttgggcagagccgcctca

SEQ ID NO: 33233 - DNA, 18 bp, Artificial sequence
  synthetic polynucleotide sequence
ctgaggtgcacaagccca

SEQ ID NO: 33234 - DNA, 21 bp, Artificial sequence
  synthetic polynucleotide sequence
gtgacatatggagtgacggga

SEQ ID NO: 33235 - DNA, 19 bp, Artificial sequence
  synthetic polynucleotide sequence
gccgaggatctgatgacga

SEQ ID NO: 33236 - DNA, 22 bp, Artificial sequence
  synthetic polynucleotide sequence
acaaactccaagcaaaagagca

SEQ ID NO: 33237 - DNA, 18 bp, Artificial sequence
  synthetic polynucleotide sequence
gacgccgtggaacagcaa

SEQ ID NO: 33238 - DNA, 18 bp, Artificial sequence
  synthetic polynucleotide sequence
gggacttcctccccacca

SEQ ID NO: 33239 - DNA, 20 bp, Artificial sequence
  synthetic polynucleotide sequence
ctggctctcaagctcccaca

SEQ ID NO: 33240 - DNA, 18 bp, Artificial sequence
  synthetic polynucleotide sequence
gcacccccactgtaggca

SEQ ID NO: 33241 - DNA, 20 bp, Artificial sequence
  synthetic polynucleotide sequence
gattgccaccccatcggaca

SEQ ID NO: 33242 - DNA, 20 bp, Artificial sequence
  synthetic polynucleotide sequence
gccaacctggcccacccaca

SEQ ID NO: 33243 - DNA, 18 bp, Artificial sequence
  synthetic polynucleotide sequence
gttcaccaacagccggga

SEQ ID NO: 33244 - DNA, 18 bp, Artificial sequence
  synthetic polynucleotide sequence
gccgcaccaggaagccga

SEQ ID NO: 33245 - DNA, 18 bp, Artificial sequence
  synthetic polynucleotide sequence
cccaagccacagaagcca

SEQ ID NO: 33246 - DNA, 18 bp, Artificial sequence
  synthetic polynucleotide sequence
tccaggaaggcttgcaca

SEQ ID NO: 33247 - DNA, 21 bp, Artificial sequence
  synthetic polynucleotide sequence
atgtaccgcaagtcctgtgca

SEQ ID NO: 33248 - DNA, 21 bp, Artificial sequence
  synthetic polynucleotide sequence
acaaagaggggtgttgcagca

SEQ ID NO: 33249 - DNA, 21 bp, Artificial sequence
  synthetic polynucleotide sequence
ccacactctactcccgggaga

SEQ ID NO: 33250 - DNA, 20 bp, Artificial sequence
  synthetic polynucleotide sequence
gcagggtctggccgatgcca

SEQ ID NO: 33251 - DNA, 18 bp, Artificial sequence
  synthetic polynucleotide sequence
ccaccaggaccgcagcaa

SEQ ID NO: 33252 - DNA, 18 bp, Artificial sequence
  synthetic polynucleotide sequence
ccaacagaagggctgcca

SEQ ID NO: 33253 - DNA, 20 bp, Artificial sequence
  synthetic polynucleotide sequence
tggacagccatcgacctcca

SEQ ID NO: 33254 - DNA, 18 bp, Artificial sequence
  synthetic polynucleotide sequence
ctgggaggagcagggcca

SEQ ID NO: 33255 - DNA, 21 bp, Artificial sequence
  synthetic polynucleotide sequence
tggctgcagagactccgagca

SEQ ID NO: 33256 - DNA, 20 bp, Artificial sequence
  synthetic polynucleotide sequence
tataggtgacgtcgtggcaa

SEQ ID NO: 33257 - DNA, 19 bp, Artificial sequence
  synthetic polynucleotide sequence
cagccacggaagaagcaca

SEQ ID NO: 33258 - DNA, 18 bp, Artificial sequence
  synthetic polynucleotide sequence
gagcgtgcattacggcaa

SEQ ID NO: 33259 - DNA, 21 bp, Artificial sequence
  synthetic polynucleotide sequence
gaacgtgtccagcaacgcaga

SEQ ID NO: 33260 - DNA, 22 bp, Artificial sequence
  synthetic polynucleotide sequence
ggaacagcctttcagcacgaga

SEQ ID NO: 33261 - DNA, 21 bp, Artificial sequence
  synthetic polynucleotide sequence
ctgcccttaccacacagcaga

SEQ ID NO: 33262 - DNA, 21 bp, Artificial sequence
  synthetic polynucleotide sequence
atcaggggaaccaaagggtca

SEQ ID NO: 33263 - DNA, 20 bp, Artificial sequence
  synthetic polynucleotide sequence
gtccctctacacggccctca

SEQ ID NO: 33264 - DNA, 20 bp, Artificial sequence
  synthetic polynucleotide sequence
ctggaccctggcaggtgtga

SEQ ID NO: 33265 - DNA, 22 bp, Artificial sequence
  synthetic polynucleotide sequence
agtggcatcaagaagaacagga

SEQ ID NO: 33266 - DNA, 22 bp, Artificial sequence
  synthetic polynucleotide sequence
gaagagcctggtaaacagcaga

SEQ ID NO: 33267 - DNA, 23 bp, Artificial sequence
  synthetic polynucleotide sequence
aaaatctcacggacacagaccta

SEQ ID NO: 33268 - DNA, 18 bp, Artificial sequence
  synthetic polynucleotide sequence
gaagtccccggcctcgga

SEQ ID NO: 33269 - DNA, 18 bp, Artificial sequence
  synthetic polynucleotide sequence
accccatgcccatagcca

SEQ ID NO: 33270 - DNA, 18 bp, Artificial sequence
  synthetic polynucleotide sequence
agccagcctaggcaacca

SEQ ID NO: 33271 - DNA, 21 bp, Artificial sequence
  synthetic polynucleotide sequence
gggcgatgctgagagagagca

SEQ ID NO: 33272 - DNA, 22 bp, Artificial sequence
  synthetic polynucleotide sequence
ccaatgtggacctgtcgacgaa

SEQ ID NO: 33273 - DNA, 21 bp, Artificial sequence
  synthetic polynucleotide sequence
gcagaactggttcggaggcca

SEQ ID NO: 33274 - DNA, 22 bp, Artificial sequence
  synthetic polynucleotide sequence
tgaacccgaaaactctgcctga

SEQ ID NO: 33275 - DNA, 22 bp, Artificial sequence
  synthetic polynucleotide sequence
caatggtgaagtcctccccaca

SEQ ID NO: 33276 - DNA, 21 bp, Artificial sequence
  synthetic polynucleotide sequence
tggagacctgcatcctcccca

SEQ ID NO: 33277 - DNA, 20 bp, Artificial sequence
  synthetic polynucleotide sequence
ctcgtacggcagcaccgcca

SEQ ID NO: 33278 - DNA, 20 bp, Artificial sequence
  synthetic polynucleotide sequence
gacaccgtacttgagcgcga

SEQ ID NO: 33279 - DNA, 21 bp, Artificial sequence
  synthetic polynucleotide sequence
acccccatcacagcagagaga

SEQ ID NO: 33280 - DNA, 21 bp, Artificial sequence
  synthetic polynucleotide sequence
tgttgagcagcaggtgactga

SEQ ID NO: 33281 - DNA, 18 bp, Artificial sequence
  synthetic polynucleotide sequence
cccaggccggccaactga

SEQ ID NO: 33282 - DNA, 19 bp, Artificial sequence
  synthetic polynucleotide sequence
tccaccactgaatgccaca

SEQ ID NO: 33283 - DNA, 23 bp, Artificial sequence
  synthetic polynucleotide sequence
gataagtgtgagcagagacggaa

SEQ ID NO: 33284 - DNA, 20 bp, Artificial sequence
  synthetic polynucleotide sequence
atccccgttcaccgtccaga

SEQ ID NO: 33285 - DNA, 20 bp, Artificial sequence
  synthetic polynucleotide sequence
gtcacaggcgccgagtccaa

SEQ ID NO: 33286 - DNA, 21 bp, Artificial sequence
  synthetic polynucleotide sequence
cgatgctgccgtcatccagga

SEQ ID NO: 33287 - DNA, 20 bp, Artificial sequence
  synthetic polynucleotide sequence
gtcacaggcgccgagtccaa

SEQ ID NO: 33288 - DNA, 22 bp, Artificial sequence
  synthetic polynucleotide sequence
atctggaagatgccgtagtcga

SEQ ID NO: 33289 - DNA, 21 bp, Artificial sequence
  synthetic polynucleotide sequence
atggccatctacgagaacaca

SEQ ID NO: 33290 - DNA, 18 bp, Artificial sequence
  synthetic polynucleotide sequence
ccgggaccaggtgggcca

SEQ ID NO: 33291 - DNA, 18 bp, Artificial sequence
  synthetic polynucleotide sequence
tccactgcgcaaaaagga

SEQ ID NO: 33292 - DNA, 18 bp, Artificial sequence
  synthetic polynucleotide sequence
ccggcctgaacagtgcaa

SEQ ID NO: 33293 - DNA, 22 bp, Artificial sequence
  synthetic polynucleotide sequence
atctgatggtaggaaagctgga

SEQ ID NO: 33294 - DNA, 19 bp, Artificial sequence
  synthetic polynucleotide sequence
tgctgacaagaaggcctca

SEQ ID NO: 33295 - DNA, 20 bp, Artificial sequence
  synthetic polynucleotide sequence
ggtggaggacaccttcacca

SEQ ID NO: 33296 - DNA, 22 bp, Artificial sequence
  synthetic polynucleotide sequence
cagctgtcgcagaagtaacaca

SEQ ID NO: 33297 - DNA, 20 bp, Artificial sequence
  synthetic polynucleotide sequence
gaagcggcactgcctgcaca

SEQ ID NO: 33298 - DNA, 20 bp, Artificial sequence
  synthetic polynucleotide sequence
gtctgagatgtgggaggcca

SEQ ID NO: 33299 - DNA, 18 bp, Artificial sequence
  synthetic polynucleotide sequence
caagcccaaggagcagga

SEQ ID NO: 33300 - DNA, 18 bp, Artificial sequence
  synthetic polynucleotide sequence
gtcccacgggtgtgacca

SEQ ID NO: 33301 - DNA, 21 bp, Artificial sequence
  synthetic polynucleotide sequence
gaagcggcaattgcaggacga

SEQ ID NO: 33302 - DNA, 20 bp, Artificial sequence
  synthetic polynucleotide sequence
ctcctcaagcctcggcccga

SEQ ID NO: 33303 - DNA, 20 bp, Artificial sequence
  synthetic polynucleotide sequence
gcccaggacacagccagaga

SEQ ID NO: 33304 - DNA, 21 bp, Artificial sequence
  synthetic polynucleotide sequence
ctgtccagcatgctctccaca

SEQ ID NO: 33305 - DNA, 21 bp, Artificial sequence
  synthetic polynucleotide sequence
tgctggaggactggactgcta

SEQ ID NO: 33306 - DNA, 20 bp, Artificial sequence
  synthetic polynucleotide sequence
gttgccagcttcccggcaca

SEQ ID NO: 33307 - DNA, 22 bp, Artificial sequence
  synthetic polynucleotide sequence
gaaggaagggcactagcagaca

SEQ ID NO: 33308 - DNA, 18 bp, Artificial sequence
  synthetic polynucleotide sequence
tccacctggcgccgacca

SEQ ID NO: 33309 - DNA, 19 bp, Artificial sequence
  synthetic polynucleotide sequence
ggcggaggtcaaggcggaa

SEQ ID NO: 33310 - DNA, 21 bp, Artificial sequence
  synthetic polynucleotide sequence
tggcccggcagttcaaggtga

SEQ ID NO: 33311 - DNA, 22 bp, Artificial sequence
  synthetic polynucleotide sequence
agaaacacccacgagaaacgga

SEQ ID NO: 33312 - DNA, 21 bp, Artificial sequence
  synthetic polynucleotide sequence
gaaagaggtcgaggttgggca

SEQ ID NO: 33313 - DNA, 21 bp, Artificial sequence
  synthetic polynucleotide sequence
cgctggccttcccaagagaga

SEQ ID NO: 33314 - DNA, 21 bp, Artificial sequence
  synthetic polynucleotide sequence
gtaacacctgctcagcacgga

SEQ ID NO: 33315 - DNA, 23 bp, Artificial sequence
  synthetic polynucleotide sequence
caaaagcagttggaagcaggtga

SEQ ID NO: 33316 - DNA, 23 bp, Artificial sequence
  synthetic polynucleotide sequence
caaatagcctggcagattcgaga

SEQ ID NO: 33317 - DNA, 20 bp, Artificial sequence
  synthetic polynucleotide sequence
caagagcacacccaggagga

SEQ ID NO: 33318 - DNA, 18 bp, Artificial sequence
  synthetic polynucleotide sequence
gagcgcagagttgggaca

SEQ ID NO: 33319 - DNA, 18 bp, Artificial sequence
  synthetic polynucleotide sequence
gctggccacgctgcgaga

SEQ ID NO: 33320 - DNA, 20 bp, Artificial sequence
  synthetic polynucleotide sequence
cacggggaagtagtggggga

SEQ ID NO: 33321 - DNA, 22 bp, Artificial sequence
  synthetic polynucleotide sequence
caaaaggcggtgaagtgacaga

SEQ ID NO: 33322 - DNA, 20 bp, Artificial sequence
  synthetic polynucleotide sequence
gttgctccacaatcacggca

SEQ ID NO: 33323 - DNA, 22 bp, Artificial sequence
  synthetic polynucleotide sequence
aagatgacagtgcacccagaga

SEQ ID NO: 33324 - DNA, 21 bp, Artificial sequence
  synthetic polynucleotide sequence
gaacgaaggcggacttcctca

SEQ ID NO: 33325 - DNA, 20 bp, Artificial sequence
  synthetic polynucleotide sequence
gtcctcagccacctggagga

SEQ ID NO: 33326 - DNA, 19 bp, Artificial sequence
  synthetic polynucleotide sequence
gccatgacgacggtgccca

SEQ ID NO: 33327 - DNA, 21 bp, Artificial sequence
  synthetic polynucleotide sequence
tgcacacgagagaagccgcca

SEQ ID NO: 33328 - DNA, 20 bp, Artificial sequence
  synthetic polynucleotide sequence
gtggtatcagccgggggtca

SEQ ID NO: 33329 - DNA, 20 bp, Artificial sequence
  synthetic polynucleotide sequence
tccaaacctgcgggtgacca

SEQ ID NO: 33330 - DNA, 20 bp, Artificial sequence
  synthetic polynucleotide sequence
gtgccggcagcgtttccaga

SEQ ID NO: 33331 - DNA, 18 bp, Artificial sequence
  synthetic polynucleotide sequence
gcaccaagtgccacagga

SEQ ID NO: 33332 - DNA, 20 bp, Artificial sequence
  synthetic polynucleotide sequence
tagacgtcaggctcacacca

SEQ ID NO: 33333 - DNA, 20 bp, Artificial sequence
  synthetic polynucleotide sequence
ggaggacggcagctccaaga

SEQ ID NO: 33334 - DNA, 20 bp, Artificial sequence
  synthetic polynucleotide sequence
atcttgcagaccaggcggga

SEQ ID NO: 33335 - DNA, 20 bp, Artificial sequence
  synthetic polynucleotide sequence
tgggccctcagagaagcaga

SEQ ID NO: 33336 - DNA, 21 bp, Artificial sequence
  synthetic polynucleotide sequence
caatgaggaggtagctcgcca

SEQ ID NO: 33337 - DNA, 20 bp, Artificial sequence
  synthetic polynucleotide sequence
tgccgcttcaagagggtgca

SEQ ID NO: 33338 - DNA, 20 bp, Artificial sequence
  synthetic polynucleotide sequence
ctctcgcgcaccagcctgga

SEQ ID NO: 33339 - DNA, 22 bp, Artificial sequence
  synthetic polynucleotide sequence
tacaacaagcggctcaagcgaa

SEQ ID NO: 33340 - DNA, 18 bp, Artificial sequence
  synthetic polynucleotide sequence
ccacctcctcctccccca

SEQ ID NO: 33341 - DNA, 20 bp, Artificial sequence
  synthetic polynucleotide sequence
ctcaggggccatcagtggga

SEQ ID NO: 33342 - DNA, 19 bp, Artificial sequence
  synthetic polynucleotide sequence
ggcgcgccttccactccga

SEQ ID NO: 33343 - DNA, 20 bp, Artificial sequence
  synthetic polynucleotide sequence
tcgacgtgaagaaggagcca

SEQ ID NO: 33344 - DNA, 18 bp, Artificial sequence
  synthetic polynucleotide sequence
agctgggcgacgagggca

SEQ ID NO: 33345 - DNA, 18 bp, Artificial sequence
  synthetic polynucleotide sequence
ggtgacacggctcaagca

SEQ ID NO: 33346 - DNA, 18 bp, Artificial sequence
  synthetic polynucleotide sequence
ctcgcgctccagctccga

SEQ ID NO: 33347 - DNA, 20 bp, Artificial sequence
  synthetic polynucleotide sequence
cagaaggcggagctgcagca

SEQ ID NO: 33348 - DNA, 20 bp, Artificial sequence
  synthetic polynucleotide sequence
cgtccgggcgaaggtctgca

SEQ ID NO: 33349 - DNA, 20 bp, Artificial sequence
  synthetic polynucleotide sequence
ggcgcgtgagaacagcagca

SEQ ID NO: 33350 - DNA, 20 bp, Artificial sequence
  synthetic polynucleotide sequence
ccaccttggagggcgccaca

SEQ ID NO: 33351 - DNA, 18 bp, Artificial sequence
  synthetic polynucleotide sequence
ggaacctctatggcgcca

SEQ ID NO: 33352 - DNA, 19 bp, Artificial sequence
  synthetic polynucleotide sequence
gctgctgaacaggacggga

SEQ ID NO: 33353 - DNA, 20 bp, Artificial sequence
  synthetic polynucleotide sequence
tgccggacagtgatcccgca

SEQ ID NO: 33354 - DNA, 21 bp, Artificial sequence
  synthetic polynucleotide sequence
cttcacgcagggatgggaaga

SEQ ID NO: 33355 - DNA, 21 bp, Artificial sequence
  synthetic polynucleotide sequence
tgatgtccagagcatgcccaa

SEQ ID NO: 33356 - DNA, 22 bp, Artificial sequence
  synthetic polynucleotide sequence
tccatcccatcatacagcccca

SEQ ID NO: 33357 - DNA, 20 bp, Artificial sequence
  synthetic polynucleotide sequence
gaagtggaccccactagcca

SEQ ID NO: 33358 - DNA, 19 bp, Artificial sequence
  synthetic polynucleotide sequence
cttccagcatacaccccca

SEQ ID NO: 33359 - DNA, 21 bp, Artificial sequence
  synthetic polynucleotide sequence
agatcagtggaggacctcaca

SEQ ID NO: 33360 - DNA, 20 bp, Artificial sequence
  synthetic polynucleotide sequence
ggaaggtgcactggcccaga

SEQ ID NO: 33361 - DNA, 18 bp, Artificial sequence
  synthetic polynucleotide sequence
ggggtccaagggccctca

SEQ ID NO: 33362 - DNA, 21 bp, Artificial sequence
  synthetic polynucleotide sequence
ttcatgcaggggtgggtagga

SEQ ID NO: 33363 - DNA, 19 bp, Artificial sequence
  synthetic polynucleotide sequence
tggcatcgaggtggtggaa

SEQ ID NO: 33364 - DNA, 21 bp, Artificial sequence
  synthetic polynucleotide sequence
ttgcgattatggccaggacga

SEQ ID NO: 33365 - DNA, 18 bp, Artificial sequence
  synthetic polynucleotide sequence
gccggtcacaaaggcaga

SEQ ID NO: 33366 - DNA, 18 bp, Artificial sequence
  synthetic polynucleotide sequence
ttgtcacccagcaggcca

SEQ ID NO: 33367 - DNA, 18 bp, Artificial sequence
  synthetic polynucleotide sequence
gagggttccagcagccaa

SEQ ID NO: 33368 - DNA, 18 bp, Artificial sequence
  synthetic polynucleotide sequence
tggctcgatacttgcgga

SEQ ID NO: 33369 - DNA, 19 bp, Artificial sequence
  synthetic polynucleotide sequence
ctgatggaagtggacccca

SEQ ID NO: 33370 - DNA, 18 bp, Artificial sequence
  synthetic polynucleotide sequence
ttgtcacccagcaggcca

SEQ ID NO: 33371 - DNA, 20 bp, Artificial sequence
  synthetic polynucleotide sequence
caccgacagcactctgtgga

SEQ ID NO: 33372 - DNA, 20 bp, Artificial sequence
  synthetic polynucleotide sequence
agtgcttcccggaacaggga

SEQ ID NO: 33373 - DNA, 20 bp, Artificial sequence
  synthetic polynucleotide sequence
ggtcagggccccatccagca

SEQ ID NO: 33374 - DNA, 21 bp, Artificial sequence
  synthetic polynucleotide sequence
cacccactgccactgagaaca

SEQ ID NO: 33375 - DNA, 21 bp, Artificial sequence
  synthetic polynucleotide sequence
cacccaagattgggtgcagga

SEQ ID NO: 33376 - DNA, 19 bp, Artificial sequence
  synthetic polynucleotide sequence
ttcagcgtgggccttggaa

SEQ ID NO: 33377 - DNA, 21 bp, Artificial sequence
  synthetic polynucleotide sequence
caacagtgatcccccacgcta

SEQ ID NO: 33378 - DNA, 21 bp, Artificial sequence
  synthetic polynucleotide sequence
tgggatgggaagtcacgggga

SEQ ID NO: 33379 - DNA, 21 bp, Artificial sequence
  synthetic polynucleotide sequence
gtgcccaacagtgatcctcca

SEQ ID NO: 33380 - DNA, 20 bp, Artificial sequence
  synthetic polynucleotide sequence
taacgcgagccttggctgca

SEQ ID NO: 33381 - DNA, 21 bp, Artificial sequence
  synthetic polynucleotide sequence
gccccaggagcttgtcaccaa

SEQ ID NO: 33382 - DNA, 18 bp, Artificial sequence
  synthetic polynucleotide sequence
tcagcacgggccctggga

SEQ ID NO: 33383 - DNA, 21 bp, Artificial sequence
  synthetic polynucleotide sequence
gtgcccaacagtgatcctcca

SEQ ID NO: 33384 - DNA, 22 bp, Artificial sequence
  synthetic polynucleotide sequence
ttcatagcaggatgggaaggca

SEQ ID NO: 33385 - DNA, 18 bp, Artificial sequence
  synthetic polynucleotide sequence
agtcaaccccaacggcca

SEQ ID NO: 33386 - DNA, 18 bp, Artificial sequence
  synthetic polynucleotide sequence
tcacacccaggagaggca

SEQ ID NO: 33387 - DNA, 22 bp, Artificial sequence
  synthetic polynucleotide sequence
tggagtaccgacaagtgcccaa

SEQ ID NO: 33388 - DNA, 22 bp, Artificial sequence
  synthetic polynucleotide sequence
ttgaccttggcccaaaactcca

SEQ ID NO: 33389 - DNA, 21 bp, Artificial sequence
  synthetic polynucleotide sequence
tgaaggaggtcaaccccacca

SEQ ID NO: 33390 - DNA, 21 bp, Artificial sequence
  synthetic polynucleotide sequence
agtagaggcatcagaagccca

SEQ ID NO: 33391 - DNA, 20 bp, Artificial sequence
  synthetic polynucleotide sequence
ctgaagtgtgtccgcagaga

SEQ ID NO: 33392 - DNA, 22 bp, Artificial sequence
  synthetic polynucleotide sequence
tgaagatcacaaccaggagcga

SEQ ID NO: 33393 - DNA, 20 bp, Artificial sequence
  synthetic polynucleotide sequence
gtgaagagtccagcagccca

SEQ ID NO: 33394 - DNA, 18 bp, Artificial sequence
  synthetic polynucleotide sequence
ggagaagaaaccgcgcca

SEQ ID NO: 33395 - DNA, 20 bp, Artificial sequence
  synthetic polynucleotide sequence
aacacagtaggcctcaccga

SEQ ID NO: 33396 - DNA, 20 bp, Artificial sequence
  synthetic polynucleotide sequence
aggtaatgtccctgcaccca

SEQ ID NO: 33397 - DNA, 22 bp, Artificial sequence
  synthetic polynucleotide sequence
atgaggagtccagcagtgaaga

SEQ ID NO: 33398 - DNA, 22 bp, Artificial sequence
  synthetic polynucleotide sequence
agaaactgcaccaactcagcca

SEQ ID NO: 33399 - DNA, 19 bp, Artificial sequence
  synthetic polynucleotide sequence
gggtcctccagactggcaa

SEQ ID NO: 33400 - DNA, 18 bp, Artificial sequence
  synthetic polynucleotide sequence
ggcacgcgagttgggaga

SEQ ID NO: 33401 - DNA, 20 bp, Artificial sequence
  synthetic polynucleotide sequence
cagtgccagtgccagcacca

SEQ ID NO: 33402 - DNA, 19 bp, Artificial sequence
  synthetic polynucleotide sequence
gccactggtgctggcacca

SEQ ID NO: 33403 - DNA, 20 bp, Artificial sequence
  synthetic polynucleotide sequence
ccagagcgcctcctctcaga

SEQ ID NO: 33404 - DNA, 20 bp, Artificial sequence
  synthetic polynucleotide sequence
ccacctccgactgacaggaa

SEQ ID NO: 33405 - DNA, 21 bp, Artificial sequence
  synthetic polynucleotide sequence
agcccgccatgagaccagcaa

SEQ ID NO: 33406 - DNA, 21 bp, Artificial sequence
  synthetic polynucleotide sequence
caatcagcgcttcatccccga

SEQ ID NO: 33407 - DNA, 21 bp, Artificial sequence
  synthetic polynucleotide sequence
caaccgaagggagatggaaga

SEQ ID NO: 33408 - DNA, 18 bp, Artificial sequence
  synthetic polynucleotide sequence
cccgcagaaaggcccaga

SEQ ID NO: 33409 - DNA, 21 bp, Artificial sequence
  synthetic polynucleotide sequence
cctccttgtccagcaaccaga

SEQ ID NO: 33410 - DNA, 21 bp, Artificial sequence
  synthetic polynucleotide sequence
tgacacggttgcccatcagga

SEQ ID NO: 33411 - DNA, 21 bp, Artificial sequence
  synthetic polynucleotide sequence
gtgcctcacaccaatccacca

SEQ ID NO: 33412 - DNA, 20 bp, Artificial sequence
  synthetic polynucleotide sequence
tctgctagggcctcacggta

SEQ ID NO: 33413 - DNA, 20 bp, Artificial sequence
  synthetic polynucleotide sequence
gtctggaaagtgctggggaa

SEQ ID NO: 33414 - DNA, 21 bp, Artificial sequence
  synthetic polynucleotide sequence
tcatactccaccggactgcta

SEQ ID NO: 33415 - DNA, 19 bp, Artificial sequence
  synthetic polynucleotide sequence
cctgtccagcgctcggaga

SEQ ID NO: 33416 - DNA, 22 bp, Artificial sequence
  synthetic polynucleotide sequence
aagatgaggctcaagaccacca

SEQ ID NO: 33417 - DNA, 22 bp, Artificial sequence
  synthetic polynucleotide sequence
aagctgaaagtaggagaccgga

SEQ ID NO: 33418 - DNA, 19 bp, Artificial sequence
  synthetic polynucleotide sequence
cgaggactcatccccagga

SEQ ID NO: 33419 - DNA, 22 bp, Artificial sequence
  synthetic polynucleotide sequence
gacatgacacatgccagagcaa

SEQ ID NO: 33420 - DNA, 20 bp, Artificial sequence
  synthetic polynucleotide sequence
gcggcagcgggagaactcca

SEQ ID NO: 33421 - DNA, 22 bp, Artificial sequence
  synthetic polynucleotide sequence
aatgcaggaagtttggaggcca

SEQ ID NO: 33422 - DNA, 20 bp, Artificial sequence
  synthetic polynucleotide sequence
ctcctagcaccctgaagcca

SEQ ID NO: 33423 - DNA, 20 bp, Artificial sequence
  synthetic polynucleotide sequence
cgtggcagcgctggtacgca

SEQ ID NO: 33424 - DNA, 21 bp, Artificial sequence
  synthetic polynucleotide sequence
ccacaatagtggcatgaggca

SEQ ID NO: 33425 - DNA, 21 bp, Artificial sequence
  synthetic polynucleotide sequence
tgagtttcgaccggacgggaa

SEQ ID NO: 33426 - DNA, 18 bp, Artificial sequence
  synthetic polynucleotide sequence
caagctcctgccggccca

SEQ ID NO: 33427 - DNA, 21 bp, Artificial sequence
  synthetic polynucleotide sequence
tgatagggttggccgacagga

SEQ ID NO: 33428 - DNA, 23 bp, Artificial sequence
  synthetic polynucleotide sequence
aaaatactcgaaggccttcagga

SEQ ID NO: 33429 - DNA, 18 bp, Artificial sequence
  synthetic polynucleotide sequence
tggaagcagtcaagccca

SEQ ID NO: 33430 - DNA, 22 bp, Artificial sequence
  synthetic polynucleotide sequence
acaacaagtccaataccagcca

SEQ ID NO: 33431 - DNA, 20 bp, Artificial sequence
  synthetic polynucleotide sequence
gaagcgctagggccttggca

SEQ ID NO: 33432 - DNA, 20 bp, Artificial sequence
  synthetic polynucleotide sequence
ctgtagctgcgctgagggca

SEQ ID NO: 33433 - DNA, 22 bp, Artificial sequence
  synthetic polynucleotide sequence
aaatgcagcgctggaaagagga

SEQ ID NO: 33434 - DNA, 20 bp, Artificial sequence
  synthetic polynucleotide sequence
cagaggactcagcatgggga

SEQ ID NO: 33435 - DNA, 20 bp, Artificial sequence
  synthetic polynucleotide sequence
cagctggttcccccaagcca

SEQ ID NO: 33436 - DNA, 20 bp, Artificial sequence
  synthetic polynucleotide sequence
tgccccagcagctgaacgca

SEQ ID NO: 33437 - DNA, 21 bp, Artificial sequence
  synthetic polynucleotide sequence
agaaggtggagcgtagggaga

SEQ ID NO: 33438 - DNA, 20 bp, Artificial sequence
  synthetic polynucleotide sequence
gtcgaaggcatgaatgggga

SEQ ID NO: 33439 - DNA, 17 bp, Artificial sequence
  synthetic polynucleotide sequence
ctccgcggagccagcga

SEQ ID NO: 33440 - DNA, 19 bp, Artificial sequence
  synthetic polynucleotide sequence
ggtgaagaccgagaagcca

SEQ ID NO: 33441 - DNA, 17 bp, Artificial sequence
  synthetic polynucleotide sequence
tggaagcagcagccaca

SEQ ID NO: 33442 - DNA, 20 bp, Artificial sequence
  synthetic polynucleotide sequence
ccagacccaaactgcaacca

SEQ ID NO: 33443 - DNA, 18 bp, Artificial sequence
  synthetic polynucleotide sequence
gcctgtaccacgggacca

SEQ ID NO: 33444 - DNA, 18 bp, Artificial sequence
  synthetic polynucleotide sequence
gaagaacgaggctgccga

SEQ ID NO: 33445 - DNA, 19 bp, Artificial sequence
  synthetic polynucleotide sequence
tcccgtgctctacagacga

SEQ ID NO: 33446 - DNA, 22 bp, Artificial sequence
  synthetic polynucleotide sequence
gatacagctgttggaggaggca

SEQ ID NO: 33447 - DNA, 21 bp, Artificial sequence
  synthetic polynucleotide sequence
ctacccgacacttacatgcca

SEQ ID NO: 33448 - DNA, 22 bp, Artificial sequence
  synthetic polynucleotide sequence
ccatgctgccaaaatccacgca

SEQ ID NO: 33449 - DNA, 18 bp, Artificial sequence
  synthetic polynucleotide sequence
ttaccgggagcaccccaa

SEQ ID NO: 33450 - DNA, 20 bp, Artificial sequence
  synthetic polynucleotide sequence
ctcatccacagcattacgca

SEQ ID NO: 33451 - DNA, 22 bp, Artificial sequence
  synthetic polynucleotide sequence
aactcccacttcctacacagga

SEQ ID NO: 33452 - DNA, 19 bp, Artificial sequence
  synthetic polynucleotide sequence
tccagagactcctcgcaga

SEQ ID NO: 33453 - DNA, 20 bp, Artificial sequence
  synthetic polynucleotide sequence
acaggctgcaggtctcagga

SEQ ID NO: 33454 - DNA, 25 bp, Artificial sequence
  synthetic polynucleotide sequence
ttcacagagcaacagagtcagcaca

SEQ ID NO: 33455 - DNA, 18 bp, Artificial sequence
  synthetic polynucleotide sequence
cctggcagcatcagggaa

SEQ ID NO: 33456 - DNA, 18 bp, Artificial sequence
  synthetic polynucleotide sequence
ctgagctcatgggagcca

SEQ ID NO: 33457 - DNA, 19 bp, Artificial sequence
  synthetic polynucleotide sequence
gccacctaccttagggcca

SEQ ID NO: 33458 - DNA, 19 bp, Artificial sequence
  synthetic polynucleotide sequence
ggaagcggactcctgcaga

SEQ ID NO: 33459 - DNA, 19 bp, Artificial sequence
  synthetic polynucleotide sequence
cagggcatgcctgggagga

SEQ ID NO: 33460 - DNA, 21 bp, Artificial sequence
  synthetic polynucleotide sequence
catccacgactgactggctca

SEQ ID NO: 33461 - DNA, 21 bp, Artificial sequence
  synthetic polynucleotide sequence
agccccagcatcaacacggga

SEQ ID NO: 33462 - DNA, 21 bp, Artificial sequence
  synthetic polynucleotide sequence
ctctgaggtgctgtacgagga

SEQ ID NO: 33463 - DNA, 21 bp, Artificial sequence
  synthetic polynucleotide sequence
ttcactcccgtctcccacgaa

SEQ ID NO: 33464 - DNA, 19 bp, Artificial sequence
  synthetic polynucleotide sequence
ggtgggggaccagaaccca

SEQ ID NO: 33465 - DNA, 18 bp, Artificial sequence
  synthetic polynucleotide sequence
cgcaagtctagcagcgga

SEQ ID NO: 33466 - DNA, 18 bp, Artificial sequence
  synthetic polynucleotide sequence
catcagccccgagtgcga

SEQ ID NO: 33467 - DNA, 19 bp, Artificial sequence
  synthetic polynucleotide sequence
gtcggtggcctgggagaca

SEQ ID NO: 33468 - DNA, 20 bp, Artificial sequence
  synthetic polynucleotide sequence
gtgcaaacattcccccagca

SEQ ID NO: 33469 - DNA, 21 bp, Artificial sequence
  synthetic polynucleotide sequence
agatgaaccggcagatggaga

SEQ ID NO: 33470 - DNA, 20 bp, Artificial sequence
  synthetic polynucleotide sequence
tgcagaatctcccagcccca

SEQ ID NO: 33471 - DNA, 20 bp, Artificial sequence
  synthetic polynucleotide sequence
tacgcccgctcagacaccaa

SEQ ID NO: 33472 - DNA, 18 bp, Artificial sequence
  synthetic polynucleotide sequence
caccacctcccagcccca

SEQ ID NO: 33473 - DNA, 18 bp, Artificial sequence
  synthetic polynucleotide sequence
ctggggagtccccccaga

SEQ ID NO: 33474 - DNA, 21 bp, Artificial sequence
  synthetic polynucleotide sequence
ctcctagtggagccaggagaa

SEQ ID NO: 33475 - DNA, 20 bp, Artificial sequence
  synthetic polynucleotide sequence
gctttcaggtgcagccccga

SEQ ID NO: 33476 - DNA, 21 bp, Artificial sequence
  synthetic polynucleotide sequence
aagatcacctccagctggcca

SEQ ID NO: 33477 - DNA, 18 bp, Artificial sequence
  synthetic polynucleotide sequence
aaggacgatggacgcgga

SEQ ID NO: 33478 - DNA, 18 bp, Artificial sequence
  synthetic polynucleotide sequence
gggctgtgtccagcagca

SEQ ID NO: 33479 - DNA, 18 bp, Artificial sequence
  synthetic polynucleotide sequence
gaaaggccatcgagggga

SEQ ID NO: 33480 - DNA, 18 bp, Artificial sequence
  synthetic polynucleotide sequence
tgcagcacagcctccaga

SEQ ID NO: 33481 - DNA, 20 bp, Artificial sequence
  synthetic polynucleotide sequence
cacctgcagcgacctaccca

SEQ ID NO: 33482 - DNA, 21 bp, Artificial sequence
  synthetic polynucleotide sequence
ggaaagagcccttgtgcggca

SEQ ID NO: 33483 - DNA, 18 bp, Artificial sequence
  synthetic polynucleotide sequence
gccgtagtcgcagcgaga

SEQ ID NO: 33484 - DNA, 22 bp, Artificial sequence
  synthetic polynucleotide sequence
cgtactcaagagaagcccagga

SEQ ID NO: 33485 - DNA, 20 bp, Artificial sequence
  synthetic polynucleotide sequence
agaacctgctacggtacgga

SEQ ID NO: 33486 - DNA, 19 bp, Artificial sequence
  synthetic polynucleotide sequence
gggcttcctcgtcacctca

SEQ ID NO: 33487 - DNA, 18 bp, Artificial sequence
  synthetic polynucleotide sequence
cgtccatggaacacgcaa

SEQ ID NO: 33488 - DNA, 19 bp, Artificial sequence
  synthetic polynucleotide sequence
ctgaagtgcggcactcaga

SEQ ID NO: 33489 - DNA, 20 bp, Artificial sequence
  synthetic polynucleotide sequence
tactatgagacggccctgca

SEQ ID NO: 33490 - DNA, 20 bp, Artificial sequence
  synthetic polynucleotide sequence
ctggtgaggcaggtagtcca

SEQ ID NO: 33491 - DNA, 18 bp, Artificial sequence
  synthetic polynucleotide sequence
tgagcgtgctgccgggca

SEQ ID NO: 33492 - DNA, 21 bp, Artificial sequence
  synthetic polynucleotide sequence
tgtggccccgatatagtagca

SEQ ID NO: 33493 - DNA, 18 bp, Artificial sequence
  synthetic polynucleotide sequence
gcagttcctcccagggca

SEQ ID NO: 33494 - DNA, 22 bp, Artificial sequence
  synthetic polynucleotide sequence
gattccgagaggattctaccca

SEQ ID NO: 33495 - DNA, 22 bp, Artificial sequence
  synthetic polynucleotide sequence
taagcatggggtggacatcaga

SEQ ID NO: 33496 - DNA, 21 bp, Artificial sequence
  synthetic polynucleotide sequence
ttccgaagacagcagctccta

SEQ ID NO: 33497 - DNA, 18 bp, Artificial sequence
  synthetic polynucleotide sequence
tcgggaaggtgaccgaga

SEQ ID NO: 33498 - DNA, 21 bp, Artificial sequence
  synthetic polynucleotide sequence
aatgatcttcagcaggccaga

SEQ ID NO: 33499 - DNA, 18 bp, Artificial sequence
  synthetic polynucleotide sequence
cacagcccatcaccacca

SEQ ID NO: 33500 - DNA, 18 bp, Artificial sequence
  synthetic polynucleotide sequence
ttgtgggccaggaagcca

SEQ ID NO: 33501 - DNA, 22 bp, Artificial sequence
  synthetic polynucleotide sequence
aaatcccagaggcacagaagga

SEQ ID NO: 33502 - DNA, 20 bp, Artificial sequence
  synthetic polynucleotide sequence
ctcccattgccagcacctga

SEQ ID NO: 33503 - DNA, 21 bp, Artificial sequence
  synthetic polynucleotide sequence
agacaccccctacatcagcca

SEQ ID NO: 33504 - DNA, 20 bp, Artificial sequence
  synthetic polynucleotide sequence
ggtctggctgtgggagagga

SEQ ID NO: 33505 - DNA, 18 bp, Artificial sequence
  synthetic polynucleotide sequence
acacccaagtccacccca

SEQ ID NO: 33506 - DNA, 18 bp, Artificial sequence
  synthetic polynucleotide sequence
cccacacacgctcaccca

SEQ ID NO: 33507 - DNA, 20 bp, Artificial sequence
  synthetic polynucleotide sequence
ctgcagctgaaccccacgca

SEQ ID NO: 33508 - DNA, 19 bp, Artificial sequence
  synthetic polynucleotide sequence
tcctgggaggcgtagacca

SEQ ID NO: 33509 - DNA, 19 bp, Artificial sequence
  synthetic polynucleotide sequence
gcagcgccgcaccttcgaa

SEQ ID NO: 33510 - DNA, 21 bp, Artificial sequence
  synthetic polynucleotide sequence
tgtgtccgttcaccaacagga

SEQ ID NO: 33511 - DNA, 19 bp, Artificial sequence
  synthetic polynucleotide sequence
gcagcggcgcaccttcgaa

SEQ ID NO: 33512 - DNA, 21 bp, Artificial sequence
  synthetic polynucleotide sequence
tgtgtccgttcaccaacagga

SEQ ID NO: 33513 - DNA, 20 bp, Artificial sequence
  synthetic polynucleotide sequence
gagcgcaaccatggcagaga

SEQ ID NO: 33514 - DNA, 20 bp, Artificial sequence
  synthetic polynucleotide sequence
tgtcctcaaggctgctccca

SEQ ID NO: 33515 - DNA, 19 bp, Artificial sequence
  synthetic polynucleotide sequence
gcctcacccacagtgacca

SEQ ID NO: 33516 - DNA, 18 bp, Artificial sequence
  synthetic polynucleotide sequence
accaggcacaggtccaca

SEQ ID NO: 33517 - DNA, 18 bp, Artificial sequence
  synthetic polynucleotide sequence
accccgacgactcagcaa

SEQ ID NO: 33518 - DNA, 20 bp, Artificial sequence
  synthetic polynucleotide sequence
agcagtgacatcctcagcca

SEQ ID NO: 33519 - DNA, 18 bp, Artificial sequence
  synthetic polynucleotide sequence
ccccgcagagagagcaga

SEQ ID NO: 33520 - DNA, 18 bp, Artificial sequence
  synthetic polynucleotide sequence
gagcagagccaacctgca

SEQ ID NO: 33521 - DNA, 18 bp, Artificial sequence
  synthetic polynucleotide sequence
cttcggggtgagcggcca

SEQ ID NO: 33522 - DNA, 20 bp, Artificial sequence
  synthetic polynucleotide sequence
cagatgtccgactgcaccga

SEQ ID NO: 33523 - DNA, 18 bp, Artificial sequence
  synthetic polynucleotide sequence
ggagcctgggcatcacca

SEQ ID NO: 33524 - DNA, 18 bp, Artificial sequence
  synthetic polynucleotide sequence
gggacggctcctccacca

SEQ ID NO: 33525 - DNA, 20 bp, Artificial sequence
  synthetic polynucleotide sequence
gacttcggcatcagtggaca

SEQ ID NO: 33526 - DNA, 20 bp, Artificial sequence
  synthetic polynucleotide sequence
tccagacatcagagcggaca

SEQ ID NO: 33527 - DNA, 19 bp, Artificial sequence
  synthetic polynucleotide sequence
gcagcccagcagtctcaga

SEQ ID NO: 33528 - DNA, 18 bp, Artificial sequence
  synthetic polynucleotide sequence
actgtgcctccgttgcca

SEQ ID NO: 33529 - DNA, 18 bp, Artificial sequence
  synthetic polynucleotide sequence
agcgggcagatcatggca

SEQ ID NO: 33530 - DNA, 23 bp, Artificial sequence
  synthetic polynucleotide sequence
taaaaggtgacagtgaatggaca

SEQ ID NO: 33531 - DNA, 18 bp, Artificial sequence
  synthetic polynucleotide sequence
cgcttctgcccggacaca

SEQ ID NO: 33532 - DNA, 18 bp, Artificial sequence
  synthetic polynucleotide sequence
ccttgaaccaggacgcca

SEQ ID NO: 33533 - DNA, 18 bp, Artificial sequence
  synthetic polynucleotide sequence
gcagtggaagcagcccga

SEQ ID NO: 33534 - DNA, 19 bp, Artificial sequence
  synthetic polynucleotide sequence
tgtagacagggtcagcaca

SEQ ID NO: 33535 - DNA, 21 bp, Artificial sequence
  synthetic polynucleotide sequence
cttggcagagaagctagacga

SEQ ID NO: 33536 - DNA, 19 bp, Artificial sequence
  synthetic polynucleotide sequence
cacagcttgcccagagaca

SEQ ID NO: 33537 - DNA, 19 bp, Artificial sequence
  synthetic polynucleotide sequence
ccggccagctgaggagaca

SEQ ID NO: 33538 - DNA, 19 bp, Artificial sequence
  synthetic polynucleotide sequence
gctggctccagggaggaca

SEQ ID NO: 33539 - DNA, 20 bp, Artificial sequence
  synthetic polynucleotide sequence
gggagagaccgatggagaca

SEQ ID NO: 33540 - DNA, 22 bp, Artificial sequence
  synthetic polynucleotide sequence
cagatctcggccagcatacaca

SEQ ID NO: 33541 - DNA, 19 bp, Artificial sequence
  synthetic polynucleotide sequence
tggatggccccagaagtca

SEQ ID NO: 33542 - DNA, 22 bp, Artificial sequence
  synthetic polynucleotide sequence
aagtggtctggtaaaggaggca

SEQ ID NO: 33543 - DNA, 20 bp, Artificial sequence
  synthetic polynucleotide sequence
ctggatgagccctgaagtca

SEQ ID NO: 33544 - DNA, 20 bp, Artificial sequence
  synthetic polynucleotide sequence
gtctgagacatgaggtggca

SEQ ID NO: 33545 - DNA, 21 bp, Artificial sequence
  synthetic polynucleotide sequence
tacacaacaaggcggagtgga

SEQ ID NO: 33546 - DNA, 21 bp, Artificial sequence
  synthetic polynucleotide sequence
caagagaagcggggtgttgga

SEQ ID NO: 33547 - DNA, 20 bp, Artificial sequence
  synthetic polynucleotide sequence
caggaagtggtcgtgagcca

SEQ ID NO: 33548 - DNA, 19 bp, Artificial sequence
  synthetic polynucleotide sequence
ggcagagtggcagtgcaga

SEQ ID NO: 33549 - DNA, 18 bp, Artificial sequence
  synthetic polynucleotide sequence
gcaaacgcctgcagacga

SEQ ID NO: 33550 - DNA, 18 bp, Artificial sequence
  synthetic polynucleotide sequence
ccaccacagtgcagccca

SEQ ID NO: 33551 - DNA, 18 bp, Artificial sequence
  synthetic polynucleotide sequence
tcagccggtcatcgccaa

SEQ ID NO: 33552 - DNA, 18 bp, Artificial sequence
  synthetic polynucleotide sequence
tccacgcggtcaatggca

SEQ ID NO: 33553 - DNA, 20 bp, Artificial sequence
  synthetic polynucleotide sequence
gaaggcggtacagacagcca

SEQ ID NO: 33554 - DNA, 18 bp, Artificial sequence
  synthetic polynucleotide sequence
tcacgcctgaggtagcca

SEQ ID NO: 33555 - DNA, 18 bp, Artificial sequence
  synthetic polynucleotide sequence
gcaccaggagcagaagca

SEQ ID NO: 33556 - DNA, 18 bp, Artificial sequence
  synthetic polynucleotide sequence
ggtctgtgcagaagcgca

SEQ ID NO: 33557 - DNA, 20 bp, Artificial sequence
  synthetic polynucleotide sequence
gaagtgataacgcgtcggaa

SEQ ID NO: 33558 - DNA, 18 bp, Artificial sequence
  synthetic polynucleotide sequence
cattgaagggcgctggga

SEQ ID NO: 33559 - DNA, 22 bp, Artificial sequence
  synthetic polynucleotide sequence
atgactccgaggaatccatgga

SEQ ID NO: 33560 - DNA, 19 bp, Artificial sequence
  synthetic polynucleotide sequence
tgagactgggccaacctca

SEQ ID NO: 33561 - DNA, 21 bp, Artificial sequence
  synthetic polynucleotide sequence
gaggctgctgagtaggaagga

SEQ ID NO: 33562 - DNA, 22 bp, Artificial sequence
  synthetic polynucleotide sequence
acaagattgaagtagccagcca

SEQ ID NO: 33563 - DNA, 18 bp, Artificial sequence
  synthetic polynucleotide sequence
gcaatgggttgagcccca

SEQ ID NO: 33564 - DNA, 18 bp, Artificial sequence
  synthetic polynucleotide sequence
tgccggttggcagaagga

SEQ ID NO: 33565 - DNA, 22 bp, Artificial sequence
  synthetic polynucleotide sequence
gaaaaccgggaactcagagtca

SEQ ID NO: 33566 - DNA, 21 bp, Artificial sequence
  synthetic polynucleotide sequence
catgaccaccattggctagga

SEQ ID NO: 33567 - DNA, 19 bp, Artificial sequence
  synthetic polynucleotide sequence
cgcacacctgagatcccca

SEQ ID NO: 33568 - DNA, 18 bp, Artificial sequence
  synthetic polynucleotide sequence
cactacaggcctggggga

SEQ ID NO: 33569 - DNA, 20 bp, Artificial sequence
  synthetic polynucleotide sequence
gatgggaaggagctgccgca

SEQ ID NO: 33570 - DNA, 19 bp, Artificial sequence
  synthetic polynucleotide sequence
gatgtcgggcgtcaggcca

SEQ ID NO: 33571 - DNA, 20 bp, Artificial sequence
  synthetic polynucleotide sequence
tcccagattacccccacaca

SEQ ID NO: 33572 - DNA, 20 bp, Artificial sequence
  synthetic polynucleotide sequence
taggtgttggaggaagacca

SEQ ID NO: 33573 - DNA, 21 bp, Artificial sequence
  synthetic polynucleotide sequence
tcagggtccagcaactcagga

SEQ ID NO: 33574 - DNA, 19 bp, Artificial sequence
  synthetic polynucleotide sequence
ttccaggcgctgagatgga

SEQ ID NO: 33575 - DNA, 19 bp, Artificial sequence
  synthetic polynucleotide sequence
tgtgggcctgtggcagaga

SEQ ID NO: 33576 - DNA, 18 bp, Artificial sequence
  synthetic polynucleotide sequence
ggggtgggtggaaggcca

SEQ ID NO: 33577 - DNA, 18 bp, Artificial sequence
  synthetic polynucleotide sequence
agtgccatggccacagca

SEQ ID NO: 33578 - DNA, 18 bp, Artificial sequence
  synthetic polynucleotide sequence
tcacggactcggggacca

SEQ ID NO: 33579 - DNA, 21 bp, Artificial sequence
  synthetic polynucleotide sequence
cccacacttcgggatgggaca

SEQ ID NO: 33580 - DNA, 18 bp, Artificial sequence
  synthetic polynucleotide sequence
cggggagctgaggcctga

SEQ ID NO: 33581 - DNA, 18 bp, Artificial sequence
  synthetic polynucleotide sequence
ttctgcaggcaccaccga

SEQ ID NO: 33582 - DNA, 18 bp, Artificial sequence
  synthetic polynucleotide sequence
cagccacacgttgagcca

SEQ ID NO: 33583 - DNA, 20 bp, Artificial sequence
  synthetic polynucleotide sequence
gccaacggttccagcccaga

SEQ ID NO: 33584 - DNA, 20 bp, Artificial sequence
  synthetic polynucleotide sequence
gtgtgctgggagaggctgca

SEQ ID NO: 33585 - DNA, 22 bp, Artificial sequence
  synthetic polynucleotide sequence
cagaccgagctcatcacatgca

SEQ ID NO: 33586 - DNA, 22 bp, Artificial sequence
  synthetic polynucleotide sequence
ctgcccagagagcatgactgaa

SEQ ID NO: 33587 - DNA, 22 bp, Artificial sequence
  synthetic polynucleotide sequence
atctcccaaggcaaaagcgaga

SEQ ID NO: 33588 - DNA, 20 bp, Artificial sequence
  synthetic polynucleotide sequence
agtgctgatgggagacggca

SEQ ID NO: 33589 - DNA, 21 bp, Artificial sequence
  synthetic polynucleotide sequence
aaccatcacctcggccaagga

SEQ ID NO: 33590 - DNA, 21 bp, Artificial sequence
  synthetic polynucleotide sequence
ccattcggcgttggaagggaa

SEQ ID NO: 33591 - DNA, 20 bp, Artificial sequence
  synthetic polynucleotide sequence
atggaacaggctgttcccaa

SEQ ID NO: 33592 - DNA, 18 bp, Artificial sequence
  synthetic polynucleotide sequence
ccagatatgggtgggcca

SEQ ID NO: 33593 - DNA, 18 bp, Artificial sequence
  synthetic polynucleotide sequence
tgacccagccgaagtgga

SEQ ID NO: 33594 - DNA, 20 bp, Artificial sequence
  synthetic polynucleotide sequence
tcactgctgcacctgaagga

SEQ ID NO: 33595 - DNA, 20 bp, Artificial sequence
  synthetic polynucleotide sequence
ctggtaccgggcacctgaga

SEQ ID NO: 33596 - DNA, 20 bp, Artificial sequence
  synthetic polynucleotide sequence
gaagagggccttgccctgga

SEQ ID NO: 33597 - DNA, 18 bp, Artificial sequence
  synthetic polynucleotide sequence
atgaagggcctccccgaa

SEQ ID NO: 33598 - DNA, 18 bp, Artificial sequence
  synthetic polynucleotide sequence
cgaagtagggatgggcca

SEQ ID NO: 33599 - DNA, 18 bp, Artificial sequence
  synthetic polynucleotide sequence
gctggcgcgacatgcaga

SEQ ID NO: 33600 - DNA, 20 bp, Artificial sequence
  synthetic polynucleotide sequence
gtagtgcatccagctgagga

SEQ ID NO: 33601 - DNA, 18 bp, Artificial sequence
  synthetic polynucleotide sequence
actggctcggcacacaga

SEQ ID NO: 33602 - DNA, 18 bp, Artificial sequence
  synthetic polynucleotide sequence
cagtcaacagctcggcca

SEQ ID NO: 33603 - DNA, 19 bp, Artificial sequence
  synthetic polynucleotide sequence
cgagagagaagggcccgga

SEQ ID NO: 33604 - DNA, 22 bp, Artificial sequence
  synthetic polynucleotide sequence
cctaggagagcagtttggagca

SEQ ID NO: 33605 - DNA, 22 bp, Artificial sequence
  synthetic polynucleotide sequence
accatatcctgcccctacagga

SEQ ID NO: 33606 - DNA, 20 bp, Artificial sequence
  synthetic polynucleotide sequence
ggccaccaggcattggtgga

SEQ ID NO: 33607 - DNA, 21 bp, Artificial sequence
  synthetic polynucleotide sequence
aaacggatcacagtggaggaa

SEQ ID NO: 33608 - DNA, 18 bp, Artificial sequence
  synthetic polynucleotide sequence
gctccatggcgaaggtga

SEQ ID NO: 33609 - DNA, 18 bp, Artificial sequence
  synthetic polynucleotide sequence
ggcacgcctgctggagca

SEQ ID NO: 33610 - DNA, 20 bp, Artificial sequence
  synthetic polynucleotide sequence
ctgtgcagcacgttggcgga

SEQ ID NO: 33611 - DNA, 21 bp, Artificial sequence
  synthetic polynucleotide sequence
ttcccagcatgagcctactga

SEQ ID NO: 33612 - DNA, 22 bp, Artificial sequence
  synthetic polynucleotide sequence
gaaaaaacagtcctccccacca

SEQ ID NO: 33613 - DNA, 19 bp, Artificial sequence
  synthetic polynucleotide sequence
gaaagcgacctgcaccaga

SEQ ID NO: 33614 - DNA, 17 bp, Artificial sequence
  synthetic polynucleotide sequence
gcacaggccacgagcca

SEQ ID NO: 33615 - DNA, 19 bp, Artificial sequence
  synthetic polynucleotide sequence
gcagaagctccaccaccaa

SEQ ID NO: 33616 - DNA, 20 bp, Artificial sequence
  synthetic polynucleotide sequence
cagacgacgatgatgatgga

SEQ ID NO: 33617 - DNA, 19 bp, Artificial sequence
  synthetic polynucleotide sequence
cccaggaggccaaggggaa

SEQ ID NO: 33618 - DNA, 20 bp, Artificial sequence
  synthetic polynucleotide sequence
tgtggggcaggtgtactcca

SEQ ID NO: 33619 - DNA, 19 bp, Artificial sequence
  synthetic polynucleotide sequence
tcaacatgcgcacggggga

SEQ ID NO: 33620 - DNA, 21 bp, Artificial sequence
  synthetic polynucleotide sequence
agagatctcgaggtcacagga

SEQ ID NO: 33621 - DNA, 18 bp, Artificial sequence
  synthetic polynucleotide sequence
gcacgtcatccagcccaa

SEQ ID NO: 33622 - DNA, 18 bp, Artificial sequence
  synthetic polynucleotide sequence
agtccaggcggatggaca

SEQ ID NO: 33623 - DNA, 18 bp, Artificial sequence
  synthetic polynucleotide sequence
accgggcgcccgaagtca

SEQ ID NO: 33624 - DNA, 20 bp, Artificial sequence
  synthetic polynucleotide sequence
gtctcttcccgggaacagga

SEQ ID NO: 33625 - DNA, 18 bp, Artificial sequence
  synthetic polynucleotide sequence
gaagcagagcgagcccaa

SEQ ID NO: 33626 - DNA, 18 bp, Artificial sequence
  synthetic polynucleotide sequence
gttctcgcggaccaggca

SEQ ID NO: 33627 - DNA, 21 bp, Artificial sequence
  synthetic polynucleotide sequence
cagaagtgctgggtccagaga

SEQ ID NO: 33628 - DNA, 20 bp, Artificial sequence
  synthetic polynucleotide sequence
atggcaaggccgtggttgga

SEQ ID NO: 33629 - DNA, 19 bp, Artificial sequence
  synthetic polynucleotide sequence
ccacagaccccactccaca

SEQ ID NO: 33630 - DNA, 18 bp, Artificial sequence
  synthetic polynucleotide sequence
cgcatagtggccaaggca

SEQ ID NO: 33631 - DNA, 20 bp, Artificial sequence
  synthetic polynucleotide sequence
atcgagggagtgctggacca

SEQ ID NO: 33632 - DNA, 22 bp, Artificial sequence
  synthetic polynucleotide sequence
atcatcagctgagcagaaggca

SEQ ID NO: 33633 - DNA, 18 bp, Artificial sequence
  synthetic polynucleotide sequence
tgagcagccgagaggcaa

SEQ ID NO: 33634 - DNA, 20 bp, Artificial sequence
  synthetic polynucleotide sequence
ctgtcagggttgagacggca

SEQ ID NO: 33635 - DNA, 20 bp, Artificial sequence
  synthetic polynucleotide sequence
gcagctgagttgatgcagca

SEQ ID NO: 33636 - DNA, 18 bp, Artificial sequence
  synthetic polynucleotide sequence
cccctcgttctcctggca

SEQ ID NO: 33637 - DNA, 21 bp, Artificial sequence
  synthetic polynucleotide sequence
ttctcgaccctcatcagccaa

SEQ ID NO: 33638 - DNA, 19 bp, Artificial sequence
  synthetic polynucleotide sequence
ttccacgccttcaagggca

SEQ ID NO: 33639 - DNA, 18 bp, Artificial sequence
  synthetic polynucleotide sequence
atgtggcccccccctgca

SEQ ID NO: 33640 - DNA, 20 bp, Artificial sequence
  synthetic polynucleotide sequence
ctccagcccatccactgtca

SEQ ID NO: 33641 - DNA, 18 bp, Artificial sequence
  synthetic polynucleotide sequence
gcgagaacgccaaagcca

SEQ ID NO: 33642 - DNA, 18 bp, Artificial sequence
  synthetic polynucleotide sequence
gctggggcgagtctacca

SEQ ID NO: 33643 - DNA, 18 bp, Artificial sequence
  synthetic polynucleotide sequence
gggactgtggcgaggcca

SEQ ID NO: 33644 - DNA, 20 bp, Artificial sequence
  synthetic polynucleotide sequence
atgaggacgtctcggtcgca

SEQ ID NO: 33645 - DNA, 21 bp, Artificial sequence
  synthetic polynucleotide sequence
taaaggcagagactgtggcaa

SEQ ID NO: 33646 - DNA, 18 bp, Artificial sequence
  synthetic polynucleotide sequence
catgatcaggagcgggca

SEQ ID NO: 33647 - DNA, 20 bp, Artificial sequence
  synthetic polynucleotide sequence
gcagcccaacaacagggaca

SEQ ID NO: 33648 - DNA, 20 bp, Artificial sequence
  synthetic polynucleotide sequence
aagcgcagtgtcccagtgca

SEQ ID NO: 33649 - DNA, 20 bp, Artificial sequence
  synthetic polynucleotide sequence
aatcgcacagcccgagagca

SEQ ID NO: 33650 - DNA, 20 bp, Artificial sequence
  synthetic polynucleotide sequence
ggctgtgacgatgggaccaa

SEQ ID NO: 33651 - DNA, 21 bp, Artificial sequence
  synthetic polynucleotide sequence
cagtgtggcagaggaaggaca

SEQ ID NO: 33652 - DNA, 20 bp, Artificial sequence
  synthetic polynucleotide sequence
ccgcagagctgtcaatggca

SEQ ID NO: 33653 - DNA, 18 bp, Artificial sequence
  synthetic polynucleotide sequence
gcctcgacccctcacaga

SEQ ID NO: 33654 - DNA, 20 bp, Artificial sequence
  synthetic polynucleotide sequence
atagatggtgaagagggcga

SEQ ID NO: 33655 - DNA, 18 bp, Artificial sequence
  synthetic polynucleotide sequence
gggcagcagccaagagga

SEQ ID NO: 33656 - DNA, 22 bp, Artificial sequence
  synthetic polynucleotide sequence
acctgaagtggcagagttcaca

SEQ ID NO: 33657 - DNA, 21 bp, Artificial sequence
  synthetic polynucleotide sequence
aggttcaggttgcagccgcca

SEQ ID NO: 33658 - DNA, 21 bp, Artificial sequence
  synthetic polynucleotide sequence
cacaccacgtccatgaagcca

SEQ ID NO: 33659 - DNA, 21 bp, Artificial sequence
  synthetic polynucleotide sequence
ctgtctacaacgctgggtgga

SEQ ID NO: 33660 - DNA, 22 bp, Artificial sequence
  synthetic polynucleotide sequence
aagacgtaaaccactggaccca

SEQ ID NO: 33661 - DNA, 18 bp, Artificial sequence
  synthetic polynucleotide sequence
tccatgggggagcaccaa

SEQ ID NO: 33662 - DNA, 18 bp, Artificial sequence
  synthetic polynucleotide sequence
gcaggctgatcagcagca

SEQ ID NO: 33663 - DNA, 21 bp, Artificial sequence
  synthetic polynucleotide sequence
aaggaggcgagagggaagaga

SEQ ID NO: 33664 - DNA, 21 bp, Artificial sequence
  synthetic polynucleotide sequence
gtctgttggcagcagctccaa

SEQ ID NO: 33665 - DNA, 20 bp, Artificial sequence
  synthetic polynucleotide sequence
tggagaccaagctgaagcca

SEQ ID NO: 33666 - DNA, 22 bp, Artificial sequence
  synthetic polynucleotide sequence
cacatacaaggaccagaccaca

SEQ ID NO: 33667 - DNA, 20 bp, Artificial sequence
  synthetic polynucleotide sequence
gagggacggcagggaagtca

SEQ ID NO: 33668 - DNA, 19 bp, Artificial sequence
  synthetic polynucleotide sequence
tgtataaccgcagcgctga

SEQ ID NO: 33669 - DNA, 17 bp, Artificial sequence
  synthetic polynucleotide sequence
ccagcggaggcggcaga

SEQ ID NO: 33670 - DNA, 21 bp, Artificial sequence
  synthetic polynucleotide sequence
caaaaccagtacctggcacca

SEQ ID NO: 33671 - DNA, 19 bp, Artificial sequence
  synthetic polynucleotide sequence
cccccaagggtgaagggga

SEQ ID NO: 33672 - DNA, 19 bp, Artificial sequence
  synthetic polynucleotide sequence
ctcccccttggcctcagca

SEQ ID NO: 33673 - DNA, 19 bp, Artificial sequence
  synthetic polynucleotide sequence
ccagaagggagaccaggga

SEQ ID NO: 33674 - DNA, 18 bp, Artificial sequence
  synthetic polynucleotide sequence
gtaacccagcatgcggca

SEQ ID NO: 33675 - DNA, 18 bp, Artificial sequence
  synthetic polynucleotide sequence
gtcagaggtcccggccca

SEQ ID NO: 33676 - DNA, 22 bp, Artificial sequence
  synthetic polynucleotide sequence
tacagcaggaggaatggatgga

SEQ ID NO: 33677 - DNA, 18 bp, Artificial sequence
  synthetic polynucleotide sequence
gaacagctgccagagcga

SEQ ID NO: 33678 - DNA, 20 bp, Artificial sequence
  synthetic polynucleotide sequence
aatcgaaccccgttgagaga

SEQ ID NO: 33679 - DNA, 21 bp, Artificial sequence
  synthetic polynucleotide sequence
ctgcgactatgagcagaggga

SEQ ID NO: 33680 - DNA, 20 bp, Artificial sequence
  synthetic polynucleotide sequence
taaaccggaccccgttcaga

SEQ ID NO: 33681 - DNA, 18 bp, Artificial sequence
  synthetic polynucleotide sequence
cagccacagcaaagggca

SEQ ID NO: 33682 - DNA, 18 bp, Artificial sequence
  synthetic polynucleotide sequence
tgcaggggatgggccaca

SEQ ID NO: 33683 - DNA, 21 bp, Artificial sequence
  synthetic polynucleotide sequence
tgaatgagccctggaagcgga

SEQ ID NO: 33684 - DNA, 21 bp, Artificial sequence
  synthetic polynucleotide sequence
ttgtggcactaaccgtgggca

SEQ ID NO: 33685 - DNA, 19 bp, Artificial sequence
  synthetic polynucleotide sequence
tgtccaaaggcatgcacca

SEQ ID NO: 33686 - DNA, 20 bp, Artificial sequence
  synthetic polynucleotide sequence
agagacccccagcctagaca

SEQ ID NO: 33687 - DNA, 18 bp, Artificial sequence
  synthetic polynucleotide sequence
ccacccgacctgccccca

SEQ ID NO: 33688 - DNA, 20 bp, Artificial sequence
  synthetic polynucleotide sequence
ggccccagactgggatggga

SEQ ID NO: 33689 - DNA, 21 bp, Artificial sequence
  synthetic polynucleotide sequence
atagcgccagatctcaaacca

SEQ ID NO: 33690 - DNA, 21 bp, Artificial sequence
  synthetic polynucleotide sequence
tcccggggaaacactgcgtca

SEQ ID NO: 33691 - DNA, 20 bp, Artificial sequence
  synthetic polynucleotide sequence
atatctgccctcgaccccca

SEQ ID NO: 33692 - DNA, 20 bp, Artificial sequence
  synthetic polynucleotide sequence
accacacctctcccagtgca

SEQ ID NO: 33693 - DNA, 21 bp, Artificial sequence
  synthetic polynucleotide sequence
gtcgggaatgcacatcggcaa

SEQ ID NO: 33694 - DNA, 21 bp, Artificial sequence
  synthetic polynucleotide sequence
tctcatccggaagcacaggaa

SEQ ID NO: 33695 - DNA, 20 bp, Artificial sequence
  synthetic polynucleotide sequence
gtacagatgccaccgcccaa

SEQ ID NO: 33696 - DNA, 22 bp, Artificial sequence
  synthetic polynucleotide sequence
ggatagcatggaagagcccaga

SEQ ID NO: 33697 - DNA, 22 bp, Artificial sequence
  synthetic polynucleotide sequence
ccacccagacttcaacatccaa

SEQ ID NO: 33698 - DNA, 20 bp, Artificial sequence
  synthetic polynucleotide sequence
ctcaagccttggcaggcaga

SEQ ID NO: 33699 - DNA, 18 bp, Artificial sequence
  synthetic polynucleotide sequence
tgcagaggtgacagcgga

SEQ ID NO: 33700 - DNA, 20 bp, Artificial sequence
  synthetic polynucleotide sequence
attcatggaaccccaggaca

SEQ ID NO: 33701 - DNA, 19 bp, Artificial sequence
  synthetic polynucleotide sequence
cccccacctagagtcggaa

SEQ ID NO: 33702 - DNA, 19 bp, Artificial sequence
  synthetic polynucleotide sequence
cgcggagagcaggaagaga

SEQ ID NO: 33703 - DNA, 18 bp, Artificial sequence
  synthetic polynucleotide sequence
tcaaaggccgagaccgga

SEQ ID NO: 33704 - DNA, 18 bp, Artificial sequence
  synthetic polynucleotide sequence
atccaggaggcctgagca

SEQ ID NO: 33705 - DNA, 18 bp, Artificial sequence
  synthetic polynucleotide sequence
ctcccaccggttcagcaa

SEQ ID NO: 33706 - DNA, 18 bp, Artificial sequence
  synthetic polynucleotide sequence
ctcagccggatgtcagca

SEQ ID NO: 33707 - DNA, 20 bp, Artificial sequence
  synthetic polynucleotide sequence
ggagccctgactgggaggta

SEQ ID NO: 33708 - DNA, 18 bp, Artificial sequence
  synthetic polynucleotide sequence
catgcgcacgaggttgga

SEQ ID NO: 33709 - DNA, 20 bp, Artificial sequence
  synthetic polynucleotide sequence
gtgcccttcccaccactgga

SEQ ID NO: 33710 - DNA, 21 bp, Artificial sequence
  synthetic polynucleotide sequence
cccaccagaatccacagccca

SEQ ID NO: 33711 - DNA, 19 bp, Artificial sequence
  synthetic polynucleotide sequence
ttgtcatcggaggtcccca

SEQ ID NO: 33712 - DNA, 20 bp, Artificial sequence
  synthetic polynucleotide sequence
tggacaagcactctccggca

SEQ ID NO: 33713 - DNA, 21 bp, Artificial sequence
  synthetic polynucleotide sequence
ggttggggtgctcatggagga

SEQ ID NO: 33714 - DNA, 21 bp, Artificial sequence
  synthetic polynucleotide sequence
ctgaacaagaaccctccggca

SEQ ID NO: 33715 - DNA, 22 bp, Artificial sequence
  synthetic polynucleotide sequence
ggaagacataccagctccccta

SEQ ID NO: 33716 - DNA, 20 bp, Artificial sequence
  synthetic polynucleotide sequence
ctctgctagctgccggcaca

SEQ ID NO: 33717 - DNA, 21 bp, Artificial sequence
  synthetic polynucleotide sequence
ccgtgcacgtcctcatgagca

SEQ ID NO: 33718 - DNA, 18 bp, Artificial sequence
  synthetic polynucleotide sequence
gagacggaggctggggca

SEQ ID NO: 33719 - DNA, 20 bp, Artificial sequence
  synthetic polynucleotide sequence
atcaaggcggctgtgcggaa

SEQ ID NO: 33720 - DNA, 19 bp, Artificial sequence
  synthetic polynucleotide sequence
ggcctagccccactggaca

SEQ ID NO: 33721 - DNA, 18 bp, Artificial sequence
  synthetic polynucleotide sequence
ggctggccctgaaacaca

SEQ ID NO: 33722 - DNA, 18 bp, Artificial sequence
  synthetic polynucleotide sequence
cgtccgtcggtgaacaca

SEQ ID NO: 33723 - DNA, 20 bp, Artificial sequence
  synthetic polynucleotide sequence
agtgagcccctagaggagca

SEQ ID NO: 33724 - DNA, 21 bp, Artificial sequence
  synthetic polynucleotide sequence
ttccaagcacacaggggtcca

SEQ ID NO: 33725 - DNA, 20 bp, Artificial sequence
  synthetic polynucleotide sequence
accgcagccgaggtgaagca

SEQ ID NO: 33726 - DNA, 20 bp, Artificial sequence
  synthetic polynucleotide sequence
tgcaccctgcgcctcggaga

SEQ ID NO: 33727 - DNA, 22 bp, Artificial sequence
  synthetic polynucleotide sequence
caaaggatgaccagacagagca

SEQ ID NO: 33728 - DNA, 21 bp, Artificial sequence
  synthetic polynucleotide sequence
tcgtctcccactgaactgcca

SEQ ID NO: 33729 - DNA, 19 bp, Artificial sequence
  synthetic polynucleotide sequence
ctcgcactgcctccgagca

SEQ ID NO: 33730 - DNA, 21 bp, Artificial sequence
  synthetic polynucleotide sequence
acgaccacagctgtaccgaca

SEQ ID NO: 33731 - DNA, 18 bp, Artificial sequence
  synthetic polynucleotide sequence
cgaccggaagttccagga

SEQ ID NO: 33732 - DNA, 18 bp, Artificial sequence
  synthetic polynucleotide sequence
gccggtacagcaccacca

SEQ ID NO: 33733 - DNA, 20 bp, Artificial sequence
  synthetic polynucleotide sequence
gagcgacgaagagcaaccga

SEQ ID NO: 33734 - DNA, 21 bp, Artificial sequence
  synthetic polynucleotide sequence
actgagtcccgcaaactgtga

SEQ ID NO: 33735 - DNA, 18 bp, Artificial sequence
  synthetic polynucleotide sequence
cagccagggtcctcacca

SEQ ID NO: 33736 - DNA, 19 bp, Artificial sequence
  synthetic polynucleotide sequence
ggctgagagctcacaggca

SEQ ID NO: 33737 - DNA, 20 bp, Artificial sequence
  synthetic polynucleotide sequence
atccccgtgaagtacctgga

SEQ ID NO: 33738 - DNA, 18 bp, Artificial sequence
  synthetic polynucleotide sequence
gccccctgggcatcagca

SEQ ID NO: 33739 - DNA, 21 bp, Artificial sequence
  synthetic polynucleotide sequence
gaagttgaagctcagccgcga

SEQ ID NO: 33740 - DNA, 19 bp, Artificial sequence
  synthetic polynucleotide sequence
cgacgcctctgaacgcgga

SEQ ID NO: 33741 - DNA, 19 bp, Artificial sequence
  synthetic polynucleotide sequence
gctctgggcctgcgacaga

SEQ ID NO: 33742 - DNA, 18 bp, Artificial sequence
  synthetic polynucleotide sequence
ctgccgggtctgagcgca

SEQ ID NO: 33743 - DNA, 19 bp, Artificial sequence
  synthetic polynucleotide sequence
ccccatcacagtccccaga

SEQ ID NO: 33744 - DNA, 20 bp, Artificial sequence
  synthetic polynucleotide sequence
ctctgaccagacactgggca

SEQ ID NO: 33745 - DNA, 21 bp, Artificial sequence
  synthetic polynucleotide sequence
caggaagagcgagtacagcaa

SEQ ID NO: 33746 - DNA, 19 bp, Artificial sequence
  synthetic polynucleotide sequence
gtatcagcagctcgcgaca

SEQ ID NO: 33747 - DNA, 19 bp, Artificial sequence
  synthetic polynucleotide sequence
gactggagagcagccagca

SEQ ID NO: 33748 - DNA, 18 bp, Artificial sequence
  synthetic polynucleotide sequence
cgcatggcagggcagaga

SEQ ID NO: 33749 - DNA, 22 bp, Artificial sequence
  synthetic polynucleotide sequence
gaattacaccccatcctggcaa

SEQ ID NO: 33750 - DNA, 21 bp, Artificial sequence
  synthetic polynucleotide sequence
gaccactggcaagatcctcca

SEQ ID NO: 33751 - DNA, 19 bp, Artificial sequence
  synthetic polynucleotide sequence
cgcagcccgcttgagccca

SEQ ID NO: 33752 - DNA, 20 bp, Artificial sequence
  synthetic polynucleotide sequence
aagggaccgaaagcccagga

SEQ ID NO: 33753 - DNA, 20 bp, Artificial sequence
  synthetic polynucleotide sequence
taccatcccacgaacacaga

SEQ ID NO: 33754 - DNA, 20 bp, Artificial sequence
  synthetic polynucleotide sequence
gtagcgatgagaagcttcca

SEQ ID NO: 33755 - DNA, 18 bp, Artificial sequence
  synthetic polynucleotide sequence
ccagtgtcaccacggcaa

SEQ ID NO: 33756 - DNA, 19 bp, Artificial sequence
  synthetic polynucleotide sequence
ccccaactggccagagaga

SEQ ID NO: 33757 - DNA, 21 bp, Artificial sequence
  synthetic polynucleotide sequence
cggagcttaatcgcccgagca

SEQ ID NO: 33758 - DNA, 21 bp, Artificial sequence
  synthetic polynucleotide sequence
tgaggtcaagctgtccaacca

SEQ ID NO: 33759 - DNA, 19 bp, Artificial sequence
  synthetic polynucleotide sequence
ggaacgagggtgaacccaa

SEQ ID NO: 33760 - DNA, 19 bp, Artificial sequence
  synthetic polynucleotide sequence
gggaactcacagacggcca

SEQ ID NO: 33761 - DNA, 20 bp, Artificial sequence
  synthetic polynucleotide sequence
acgaggattcgtggcaggca

SEQ ID NO: 33762 - DNA, 18 bp, Artificial sequence
  synthetic polynucleotide sequence
cgaaaggggggcccgtga

SEQ ID NO: 33763 - DNA, 21 bp, Artificial sequence
  synthetic polynucleotide sequence
ctcgcggggacaactttgaga

SEQ ID NO: 33764 - DNA, 22 bp, Artificial sequence
  synthetic polynucleotide sequence
ttgatcacatccccatcctgca

SEQ ID NO: 33765 - DNA, 21 bp, Artificial sequence
  synthetic polynucleotide sequence
ccccattacaacccgtgccaa

SEQ ID NO: 33766 - DNA, 20 bp, Artificial sequence
  synthetic polynucleotide sequence
ctgccgggaccaggcttgga

SEQ ID NO: 33767 - DNA, 21 bp, Artificial sequence
  synthetic polynucleotide sequence
aggggcgttgcatgagggaga

SEQ ID NO: 33768 - DNA, 19 bp, Artificial sequence
  synthetic polynucleotide sequence
gcaccagggggaaaggcca

SEQ ID NO: 33769 - DNA, 21 bp, Artificial sequence
  synthetic polynucleotide sequence
gactaacctgcagctcccaca

SEQ ID NO: 33770 - DNA, 19 bp, Artificial sequence
  synthetic polynucleotide sequence
tgctgcagacacagtggta

SEQ ID NO: 33771 - DNA, 21 bp, Artificial sequence
  synthetic polynucleotide sequence
ctggaggtgaactggaagcga

SEQ ID NO: 33772 - DNA, 22 bp, Artificial sequence
  synthetic polynucleotide sequence
caaaccagtcatccacaaggca

SEQ ID NO: 33773 - DNA, 18 bp, Artificial sequence
  synthetic polynucleotide sequence
gggatcctggcaggccca

SEQ ID NO: 33774 - DNA, 22 bp, Artificial sequence
  synthetic polynucleotide sequence
gaaataacaaggacagcccaca

SEQ ID NO: 33775 - DNA, 19 bp, Artificial sequence
  synthetic polynucleotide sequence
tgccagcaattcgagtgca

SEQ ID NO: 33776 - DNA, 18 bp, Artificial sequence
  synthetic polynucleotide sequence
agcccgctgcgtggagga

SEQ ID NO: 33777 - DNA, 20 bp, Artificial sequence
  synthetic polynucleotide sequence
cgctaccgcacctacctgga

SEQ ID NO: 33778 - DNA, 20 bp, Artificial sequence
  synthetic polynucleotide sequence
caggaacagcaggccgaaga

SEQ ID NO: 33779 - DNA, 19 bp, Artificial sequence
  synthetic polynucleotide sequence
ccctgccccagaagtcaca

SEQ ID NO: 33780 - DNA, 18 bp, Artificial sequence
  synthetic polynucleotide sequence
ggtgtgcgaggcgtcaca

SEQ ID NO: 33781 - DNA, 23 bp, Artificial sequence
  synthetic polynucleotide sequence
caaaagcagcagtctccatggaa

SEQ ID NO: 33782 - DNA, 18 bp, Artificial sequence
  synthetic polynucleotide sequence
caccccagcaggtcccca

SEQ ID NO: 33783 - DNA, 18 bp, Artificial sequence
  synthetic polynucleotide sequence
tggccgctacaaccagga

SEQ ID NO: 33784 - DNA, 18 bp, Artificial sequence
  synthetic polynucleotide sequence
agaaggccaggaccacca

SEQ ID NO: 33785 - DNA, 22 bp, Artificial sequence
  synthetic polynucleotide sequence
taccatcgcctatgagccccaa

SEQ ID NO: 33786 - DNA, 21 bp, Artificial sequence
  synthetic polynucleotide sequence
tgctttccgggcaggaagaca

SEQ ID NO: 33787 - DNA, 21 bp, Artificial sequence
  synthetic polynucleotide sequence
acgtgatcacctgcagctcca

SEQ ID NO: 33788 - DNA, 22 bp, Artificial sequence
  synthetic polynucleotide sequence
atagccaggaagaagaccacga

SEQ ID NO: 33789 - DNA, 21 bp, Artificial sequence
  synthetic polynucleotide sequence
ttctcccatcatgtgcccaca

SEQ ID NO: 33790 - DNA, 20 bp, Artificial sequence
  synthetic polynucleotide sequence
ggtgtgggatcgagccagca

SEQ ID NO: 33791 - DNA, 20 bp, Artificial sequence
  synthetic polynucleotide sequence
cagcatcatgaccgtgagga

SEQ ID NO: 33792 - DNA, 18 bp, Artificial sequence
  synthetic polynucleotide sequence
agagggtgcccatgagga

SEQ ID NO: 33793 - DNA, 20 bp, Artificial sequence
  synthetic polynucleotide sequence
cctgatggccaggcttcaca

SEQ ID NO: 33794 - DNA, 20 bp, Artificial sequence
  synthetic polynucleotide sequence
tggaggaagaatggggccca

SEQ ID NO: 33795 - DNA, 18 bp, Artificial sequence
  synthetic polynucleotide sequence
gcgcggtcaccgtcacca

SEQ ID NO: 33796 - DNA, 21 bp, Artificial sequence
  synthetic polynucleotide sequence
gtgagacatgaagcgagagca

SEQ ID NO: 33797 - DNA, 18 bp, Artificial sequence
  synthetic polynucleotide sequence
acgtcaacggcacggcaa

SEQ ID NO: 33798 - DNA, 20 bp, Artificial sequence
  synthetic polynucleotide sequence
gaccagctccaggaagagga

SEQ ID NO: 33799 - DNA, 19 bp, Artificial sequence
  synthetic polynucleotide sequence
gtgcactgtcagcccgcga

SEQ ID NO: 33800 - DNA, 21 bp, Artificial sequence
  synthetic polynucleotide sequence
ccggcaaacactagggctgca

SEQ ID NO: 33801 - DNA, 21 bp, Artificial sequence
  synthetic polynucleotide sequence
aggagcagaaggagcagcgga

SEQ ID NO: 33802 - DNA, 21 bp, Artificial sequence
  synthetic polynucleotide sequence
tcctgagttcggctagggaca

SEQ ID NO: 33803 - DNA, 20 bp, Artificial sequence
  synthetic polynucleotide sequence
gagtacggcaaggagacgaa

SEQ ID NO: 33804 - DNA, 18 bp, Artificial sequence
  synthetic polynucleotide sequence
gtcaatgccgcctggcga

SEQ ID NO: 33805 - DNA, 19 bp, Artificial sequence
  synthetic polynucleotide sequence
tggccacgataacaaagga

SEQ ID NO: 33806 - DNA, 22 bp, Artificial sequence
  synthetic polynucleotide sequence
ctaaaactgagacccaagacca

SEQ ID NO: 33807 - DNA, 23 bp, Artificial sequence
  synthetic polynucleotide sequence
caaaaccccaaagcaagcatgga

SEQ ID NO: 33808 - DNA, 20 bp, Artificial sequence
  synthetic polynucleotide sequence
cttcagctcgggccagctca

SEQ ID NO: 33809 - DNA, 20 bp, Artificial sequence
  synthetic polynucleotide sequence
ctgggggcccaggtaagtga

SEQ ID NO: 33810 - DNA, 22 bp, Artificial sequence
  synthetic polynucleotide sequence
caattggactgtcacgtcccaa

SEQ ID NO: 33811 - DNA, 21 bp, Artificial sequence
  synthetic polynucleotide sequence
tcaaggtgcccatgacccaga

SEQ ID NO: 33812 - DNA, 22 bp, Artificial sequence
  synthetic polynucleotide sequence
atgatgcagaggacaaaggcca

SEQ ID NO: 33813 - DNA, 21 bp, Artificial sequence
  synthetic polynucleotide sequence
catggacacaagcttgcagca

SEQ ID NO: 33814 - DNA, 19 bp, Artificial sequence
  synthetic polynucleotide sequence
tgacgagcctgctgtagga

SEQ ID NO: 33815 - DNA, 18 bp, Artificial sequence
  synthetic polynucleotide sequence
cggagatcgcaaggagga

SEQ ID NO: 33816 - DNA, 18 bp, Artificial sequence
  synthetic polynucleotide sequence
ccacaggttgtgaggcca

SEQ ID NO: 33817 - DNA, 21 bp, Artificial sequence
  synthetic polynucleotide sequence
ggatgggccaaagagaaccaa

SEQ ID NO: 33818 - DNA, 20 bp, Artificial sequence
  synthetic polynucleotide sequence
gctgctaggtccacagccaa

SEQ ID NO: 33819 - DNA, 19 bp, Artificial sequence
  synthetic polynucleotide sequence
cagtgcacgaccaagagca

SEQ ID NO: 33820 - DNA, 23 bp, Artificial sequence
  synthetic polynucleotide sequence
ggagagttctaagccatcaagca

SEQ ID NO: 33821 - DNA, 20 bp, Artificial sequence
  synthetic polynucleotide sequence
gttgtccatcagccgcccga

SEQ ID NO: 33822 - DNA, 20 bp, Artificial sequence
  synthetic polynucleotide sequence
gcggaacgtctcacagagca

SEQ ID NO: 33823 - DNA, 21 bp, Artificial sequence
  synthetic polynucleotide sequence
caaggtacaagaccatccgga

SEQ ID NO: 33824 - DNA, 22 bp, Artificial sequence
  synthetic polynucleotide sequence
accagagtacatcgtcagggga

SEQ ID NO: 33825 - DNA, 20 bp, Artificial sequence
  synthetic polynucleotide sequence
cctaccctggccagcggaga

SEQ ID NO: 33826 - DNA, 20 bp, Artificial sequence
  synthetic polynucleotide sequence
gcgcagcggtggtgactgca

SEQ ID NO: 33827 - DNA, 18 bp, Artificial sequence
  synthetic polynucleotide sequence
accttcgggagcaggcca

SEQ ID NO: 33828 - DNA, 18 bp, Artificial sequence
  synthetic polynucleotide sequence
catccccaacccgtcgta

SEQ ID NO: 33829 - DNA, 18 bp, Artificial sequence
  synthetic polynucleotide sequence
gtgcggatctgcagtcca

SEQ ID NO: 33830 - DNA, 19 bp, Artificial sequence
  synthetic polynucleotide sequence
tgaagctgcatacgaggca

SEQ ID NO: 33831 - DNA, 18 bp, Artificial sequence
  synthetic polynucleotide sequence
ccattacggtgcggcaca

SEQ ID NO: 33832 - DNA, 18 bp, Artificial sequence
  synthetic polynucleotide sequence
tctccagcatcacgcgga

SEQ ID NO: 33833 - DNA, 18 bp, Artificial sequence
  synthetic polynucleotide sequence
tcgccagccagatgccaa

SEQ ID NO: 33834 - DNA, 20 bp, Artificial sequence
  synthetic polynucleotide sequence
gaacacatccaagagggcca

SEQ ID NO: 33835 - DNA, 18 bp, Artificial sequence
  synthetic polynucleotide sequence
ggacgccgttgagaagga

SEQ ID NO: 33836 - DNA, 18 bp, Artificial sequence
  synthetic polynucleotide sequence
gtcaagggaatgggggca

SEQ ID NO: 33837 - DNA, 18 bp, Artificial sequence
  synthetic polynucleotide sequence
ccgcttagcagaagccca

SEQ ID NO: 33838 - DNA, 18 bp, Artificial sequence
  synthetic polynucleotide sequence
acgatgccagtccgggga

SEQ ID NO: 33839 - DNA, 18 bp, Artificial sequence
  synthetic polynucleotide sequence
cttcgccacagaggcaga

SEQ ID NO: 33840 - DNA, 18 bp, Artificial sequence
  synthetic polynucleotide sequence
ccctgacagggtaccgga

SEQ ID NO: 33841 - DNA, 19 bp, Artificial sequence
  synthetic polynucleotide sequence
gtgcgacagcttgagagca

SEQ ID NO: 33842 - DNA, 19 bp, Artificial sequence
  synthetic polynucleotide sequence
gatcccgttcacaggagca

SEQ ID NO: 33843 - DNA, 18 bp, Artificial sequence
  synthetic polynucleotide sequence
cgtggagatgaggcgaga

SEQ ID NO: 33844 - DNA, 19 bp, Artificial sequence
  synthetic polynucleotide sequence
tctcagacgtgccagagca

SEQ ID NO: 33845 - DNA, 18 bp, Artificial sequence
  synthetic polynucleotide sequence
gctacaggcagcgtgcaa

SEQ ID NO: 33846 - DNA, 20 bp, Artificial sequence
  synthetic polynucleotide sequence
gatcaccaagtaccagggca

SEQ ID NO: 33847 - DNA, 21 bp, Artificial sequence
  synthetic polynucleotide sequence
aggaacacgggtcagaggaga

SEQ ID NO: 33848 - DNA, 22 bp, Artificial sequence
  synthetic polynucleotide sequence
caattcctgtggtcagcacaga

SEQ ID NO: 33849 - DNA, 21 bp, Artificial sequence
  synthetic polynucleotide sequence
gacacagcagaggagcagaga

SEQ ID NO: 33850 - DNA, 21 bp, Artificial sequence
  synthetic polynucleotide sequence
cagcagccaaactatccccca

SEQ ID NO: 33851 - DNA, 21 bp, Artificial sequence
  synthetic polynucleotide sequence
ctcgctcatcaatggggacga

SEQ ID NO: 33852 - DNA, 21 bp, Artificial sequence
  synthetic polynucleotide sequence
tgagcgcgatgaagaggctga

SEQ ID NO: 33853 - DNA, 20 bp, Artificial sequence
  synthetic polynucleotide sequence
tgtgacaccgaccagtggga

SEQ ID NO: 33854 - DNA, 19 bp, Artificial sequence
  synthetic polynucleotide sequence
tttggcagtgaggcctgca

SEQ ID NO: 33855 - DNA, 20 bp, Artificial sequence
  synthetic polynucleotide sequence
cttcaggcagcgctgcccaa

SEQ ID NO: 33856 - DNA, 20 bp, Artificial sequence
  synthetic polynucleotide sequence
gtcatggtaaggccccagca

SEQ ID NO: 33857 - DNA, 22 bp, Artificial sequence
  synthetic polynucleotide sequence
ggaaatggtgaaggccgtgcaa

SEQ ID NO: 33858 - DNA, 19 bp, Artificial sequence
  synthetic polynucleotide sequence
tggaagagcagggtcctca

SEQ ID NO: 33859 - DNA, 21 bp, Artificial sequence
  synthetic polynucleotide sequence
acaacggcaagaggaccagca

SEQ ID NO: 33860 - DNA, 21 bp, Artificial sequence
  synthetic polynucleotide sequence
gcttcaggtcactcaggtcga

SEQ ID NO: 33861 - DNA, 20 bp, Artificial sequence
  synthetic polynucleotide sequence
gtgtccgaagcctggcagca

SEQ ID NO: 33862 - DNA, 21 bp, Artificial sequence
  synthetic polynucleotide sequence
acaaagttctgcagccgggga

SEQ ID NO: 33863 - DNA, 21 bp, Artificial sequence
  synthetic polynucleotide sequence
tagtggacagcatcacaggca

SEQ ID NO: 33864 - DNA, 18 bp, Artificial sequence
  synthetic polynucleotide sequence
tccaggccggaccctcca

SEQ ID NO: 33865 - DNA, 21 bp, Artificial sequence
  synthetic polynucleotide sequence
tggctgccgacgtcactggaa

SEQ ID NO: 33866 - DNA, 22 bp, Artificial sequence
  synthetic polynucleotide sequence
aaagtcagcacttcgatcccga

SEQ ID NO: 33867 - DNA, 22 bp, Artificial sequence
  synthetic polynucleotide sequence
gcaatgaccgacttcagacgca

SEQ ID NO: 33868 - DNA, 22 bp, Artificial sequence
  synthetic polynucleotide sequence
aatggacagcaagggaatggca

SEQ ID NO: 33869 - DNA, 21 bp, Artificial sequence
  synthetic polynucleotide sequence
gctcccctggaaaaggtacga

SEQ ID NO: 33870 - DNA, 19 bp, Artificial sequence
  synthetic polynucleotide sequence
caccaggtaagccgggcca

SEQ ID NO: 33871 - DNA, 21 bp, Artificial sequence
  synthetic polynucleotide sequence
ccacctgaaggaacagctgca

SEQ ID NO: 33872 - DNA, 21 bp, Artificial sequence
  synthetic polynucleotide sequence
gatatcccaggagtacaccca

SEQ ID NO: 33873 - DNA, 21 bp, Artificial sequence
  synthetic polynucleotide sequence
aacagaaaccctgagccgcaa

SEQ ID NO: 33874 - DNA, 25 bp, Artificial sequence
  synthetic polynucleotide sequence
aaggagaaggctagaagagggaaga

SEQ ID NO: 33875 - DNA, 20 bp, Artificial sequence
  synthetic polynucleotide sequence
ctgtcacctctgagcccaca

SEQ ID NO: 33876 - DNA, 18 bp, Artificial sequence
  synthetic polynucleotide sequence
tcaagggctgtgggcaca

SEQ ID NO: 33877 - DNA, 19 bp, Artificial sequence
  synthetic polynucleotide sequence
ccccctccaggcacaggaa

SEQ ID NO: 33878 - DNA, 18 bp, Artificial sequence
  synthetic polynucleotide sequence
gccgcagtccaggtcgca

SEQ ID NO: 33879 - DNA, 19 bp, Artificial sequence
  synthetic polynucleotide sequence
tgtcctgggacaagcgtca

SEQ ID NO: 33880 - DNA, 20 bp, Artificial sequence
  synthetic polynucleotide sequence
atccatgatgccacagtcca

SEQ ID NO: 33881 - DNA, 20 bp, Artificial sequence
  synthetic polynucleotide sequence
ctgcagtggactcagaggga

SEQ ID NO: 33882 - DNA, 18 bp, Artificial sequence
  synthetic polynucleotide sequence
cgggaggccatgtcacca

SEQ ID NO: 33883 - DNA, 20 bp, Artificial sequence
  synthetic polynucleotide sequence
cccctgcagtggaaccagca

SEQ ID NO: 33884 - DNA, 20 bp, Artificial sequence
  synthetic polynucleotide sequence
gcgccactcataggtcagca

SEQ ID NO: 33885 - DNA, 20 bp, Artificial sequence
  synthetic polynucleotide sequence
tccagatgtcaaccatgcca

SEQ ID NO: 33886 - DNA, 19 bp, Artificial sequence
  synthetic polynucleotide sequence
cagcagacatggcactgga

SEQ ID NO: 33887 - DNA, 21 bp, Artificial sequence
  synthetic polynucleotide sequence
ccttgcaggtctggatcacca

SEQ ID NO: 33888 - DNA, 18 bp, Artificial sequence
  synthetic polynucleotide sequence
tgacgtgggcctggcgga

SEQ ID NO: 33889 - DNA, 20 bp, Artificial sequence
  synthetic polynucleotide sequence
atctctcagtgcacccccaa

SEQ ID NO: 33890 - DNA, 18 bp, Artificial sequence
  synthetic polynucleotide sequence
cggcatacgccatggaga

SEQ ID NO: 33891 - DNA, 18 bp, Artificial sequence
  synthetic polynucleotide sequence
cacccccagcagcaagga

SEQ ID NO: 33892 - DNA, 18 bp, Artificial sequence
  synthetic polynucleotide sequence
cccatcacacgcacccca

SEQ ID NO: 33893 - DNA, 22 bp, Artificial sequence
  synthetic polynucleotide sequence
tcaaggggctgagtgaatacca

SEQ ID NO: 33894 - DNA, 22 bp, Artificial sequence
  synthetic polynucleotide sequence
atctaagtccagcccatgggta

SEQ ID NO: 33895 - DNA, 20 bp, Artificial sequence
  synthetic polynucleotide sequence
tatcaggcaggggagagtga

SEQ ID NO: 33896 - DNA, 18 bp, Artificial sequence
  synthetic polynucleotide sequence
attctcacgaagggccca

SEQ ID NO: 33897 - DNA, 18 bp, Artificial sequence
  synthetic polynucleotide sequence
agcaggtgcgcaaggtga

SEQ ID NO: 33898 - DNA, 20 bp, Artificial sequence
  synthetic polynucleotide sequence
ggagaagctctgacgtccca

SEQ ID NO: 33899 - DNA, 21 bp, Artificial sequence
  synthetic polynucleotide sequence
ccaaggtttccagccccagga

SEQ ID NO: 33900 - DNA, 21 bp, Artificial sequence
  synthetic polynucleotide sequence
ttctccacaccagtctgccca

SEQ ID NO: 33901 - DNA, 20 bp, Artificial sequence
  synthetic polynucleotide sequence
gacgtccgactgtacccaga

SEQ ID NO: 33902 - DNA, 18 bp, Artificial sequence
  synthetic polynucleotide sequence
aagcagccgcaccgggca

SEQ ID NO: 33903 - DNA, 19 bp, Artificial sequence
  synthetic polynucleotide sequence
ggagaggctgccctaggga

SEQ ID NO: 33904 - DNA, 20 bp, Artificial sequence
  synthetic polynucleotide sequence
gttctgagaatgcaccacca

SEQ ID NO: 33905 - DNA, 19 bp, Artificial sequence
  synthetic polynucleotide sequence
cactcagccccagagagca

SEQ ID NO: 33906 - DNA, 18 bp, Artificial sequence
  synthetic polynucleotide sequence
agacggccagcacctgca

SEQ ID NO: 33907 - DNA, 21 bp, Artificial sequence
  synthetic polynucleotide sequence
cacggagcagattctgaggga

SEQ ID NO: 33908 - DNA, 21 bp, Artificial sequence
  synthetic polynucleotide sequence
accccggggaacacgtaagca

SEQ ID NO: 33909 - DNA, 21 bp, Artificial sequence
  synthetic polynucleotide sequence
tgaggagcctgaggaagagca

SEQ ID NO: 33910 - DNA, 19 bp, Artificial sequence
  synthetic polynucleotide sequence
ccatcccccactggtgcca

SEQ ID NO: 33911 - DNA, 22 bp, Artificial sequence
  synthetic polynucleotide sequence
gagctggcggaaacattggcaa

SEQ ID NO: 33912 - DNA, 21 bp, Artificial sequence
  synthetic polynucleotide sequence
gtcagataccgatcccagcca

SEQ ID NO: 33913 - DNA, 20 bp, Artificial sequence
  synthetic polynucleotide sequence
gggcagtaggagtagagcca

SEQ ID NO: 33914 - DNA, 22 bp, Artificial sequence
  synthetic polynucleotide sequence
ctgcaaggaaccatctgaagca

SEQ ID NO: 33915 - DNA, 20 bp, Artificial sequence
  synthetic polynucleotide sequence
gcaggagaccgtactcccca

SEQ ID NO: 33916 - DNA, 18 bp, Artificial sequence
  synthetic polynucleotide sequence
tctcaccgagggtggaca

SEQ ID NO: 33917 - DNA, 20 bp, Artificial sequence
  synthetic polynucleotide sequence
tctgggggctgagcatgtca

SEQ ID NO: 33918 - DNA, 21 bp, Artificial sequence
  synthetic polynucleotide sequence
ccatccccccataggttacca

SEQ ID NO: 33919 - DNA, 18 bp, Artificial sequence
  synthetic polynucleotide sequence
gtgttgccacaccaccca

SEQ ID NO: 33920 - DNA, 19 bp, Artificial sequence
  synthetic polynucleotide sequence
tccctgaggtggaagcaga

SEQ ID NO: 33921 - DNA, 21 bp, Artificial sequence
  synthetic polynucleotide sequence
gcctggagagggctctagcta

SEQ ID NO: 33922 - DNA, 18 bp, Artificial sequence
  synthetic polynucleotide sequence
ggtgatcctccccccgga

SEQ ID NO: 33923 - DNA, 21 bp, Artificial sequence
  synthetic polynucleotide sequence
gactacgcgctctggaagaca

SEQ ID NO: 33924 - DNA, 19 bp, Artificial sequence
  synthetic polynucleotide sequence
gctgacagctccgcctcca

SEQ ID NO: 33925 - DNA, 20 bp, Artificial sequence
  synthetic polynucleotide sequence
ctggagaagagacaggcgga

SEQ ID NO: 33926 - DNA, 18 bp, Artificial sequence
  synthetic polynucleotide sequence
atgggagcactgggagca

SEQ ID NO: 33927 - DNA, 21 bp, Artificial sequence
  synthetic polynucleotide sequence
aggcttgcagcagacccagca

SEQ ID NO: 33928 - DNA, 21 bp, Artificial sequence
  synthetic polynucleotide sequence
tgtgaaggatgcccatacgga

SEQ ID NO: 33929 - DNA, 20 bp, Artificial sequence
  synthetic polynucleotide sequence
tgatgcgggcaagggtcaga

SEQ ID NO: 33930 - DNA, 19 bp, Artificial sequence
  synthetic polynucleotide sequence
tgcactgaaggcacgtgga

SEQ ID NO: 33931 - DNA, 20 bp, Artificial sequence
  synthetic polynucleotide sequence
atgggagtggtgcataggga

SEQ ID NO: 33932 - DNA, 18 bp, Artificial sequence
  synthetic polynucleotide sequence
ctccatggcaaccaggca

SEQ ID NO: 33933 - DNA, 21 bp, Artificial sequence
  synthetic polynucleotide sequence
atgtcaccagccaacccctca

SEQ ID NO: 33934 - DNA, 21 bp, Artificial sequence
  synthetic polynucleotide sequence
cacaaggcctggagttggaga

SEQ ID NO: 33935 - DNA, 19 bp, Artificial sequence
  synthetic polynucleotide sequence
gtgtgcacccggaagcgca

SEQ ID NO: 33936 - DNA, 20 bp, Artificial sequence
  synthetic polynucleotide sequence
ggcaggatagtcagcgggca

SEQ ID NO: 33937 - DNA, 20 bp, Artificial sequence
  synthetic polynucleotide sequence
ctggccagcctacccaacca

SEQ ID NO: 33938 - DNA, 19 bp, Artificial sequence
  synthetic polynucleotide sequence
ctgggccctcatcgcgaca

SEQ ID NO: 33939 - DNA, 20 bp, Artificial sequence
  synthetic polynucleotide sequence
caggagcaggagctacagga

SEQ ID NO: 33940 - DNA, 18 bp, Artificial sequence
  synthetic polynucleotide sequence
caccacttggggaggcca

SEQ ID NO: 33941 - DNA, 22 bp, Artificial sequence
  synthetic polynucleotide sequence
aaactgcgtggacattgccaca

SEQ ID NO: 33942 - DNA, 22 bp, Artificial sequence
  synthetic polynucleotide sequence
ataggagagtgacaaggcctca

SEQ ID NO: 33943 - DNA, 18 bp, Artificial sequence
  synthetic polynucleotide sequence
acccaccaccgcccccaa

SEQ ID NO: 33944 - DNA, 20 bp, Artificial sequence
  synthetic polynucleotide sequence
ctgacttgtccgcgccagga

SEQ ID NO: 33945 - DNA, 19 bp, Artificial sequence
  synthetic polynucleotide sequence
ggggcagagaagcaaggaa

SEQ ID NO: 33946 - DNA, 18 bp, Artificial sequence
  synthetic polynucleotide sequence
gcaataaggcaagggcca

SEQ ID NO: 33947 - DNA, 21 bp, Artificial sequence
  synthetic polynucleotide sequence
tcggctcacgcagcttcagga

SEQ ID NO: 33948 - DNA, 21 bp, Artificial sequence
  synthetic polynucleotide sequence
agtgctgcaaaaagctgggca

SEQ ID NO: 33949 - DNA, 20 bp, Artificial sequence
  synthetic polynucleotide sequence
gaagcttacgggaggctgga

SEQ ID NO: 33950 - DNA, 18 bp, Artificial sequence
  synthetic polynucleotide sequence
agggccaccagcatggga

SEQ ID NO: 33951 - DNA, 18 bp, Artificial sequence
  synthetic polynucleotide sequence
tcagcagggggtcagcaa

SEQ ID NO: 33952 - DNA, 18 bp, Artificial sequence
  synthetic polynucleotide sequence
actacgcatggccaggca

SEQ ID NO: 33953 - DNA, 18 bp, Artificial sequence
  synthetic polynucleotide sequence
agacgcggaaggagcaca

SEQ ID NO: 33954 - DNA, 20 bp, Artificial sequence
  synthetic polynucleotide sequence
taggaactgagggcacacca

SEQ ID NO: 33955 - DNA, 21 bp, Artificial sequence
  synthetic polynucleotide sequence
agcctcctcctcaacccacca

SEQ ID NO: 33956 - DNA, 19 bp, Artificial sequence
  synthetic polynucleotide sequence
ggggaagttgtgcgggcca

SEQ ID NO: 33957 - DNA, 20 bp, Artificial sequence
  synthetic polynucleotide sequence
ctacctgagccggcagagca

SEQ ID NO: 33958 - DNA, 19 bp, Artificial sequence
  synthetic polynucleotide sequence
gtgggcgggctttgaggca

SEQ ID NO: 33959 - DNA, 19 bp, Artificial sequence
  synthetic polynucleotide sequence
tcccaggccattagtgcca

SEQ ID NO: 33960 - DNA, 21 bp, Artificial sequence
  synthetic polynucleotide sequence
agttgtcctggaagtgcgcaa

SEQ ID NO: 33961 - DNA, 21 bp, Artificial sequence
  synthetic polynucleotide sequence
tgtcaatggcaccgatcagga

SEQ ID NO: 33962 - DNA, 19 bp, Artificial sequence
  synthetic polynucleotide sequence
cctccagcacctgctgcca

SEQ ID NO: 33963 - DNA, 21 bp, Artificial sequence
  synthetic polynucleotide sequence
aaaagagcagtgatggaccca

SEQ ID NO: 33964 - DNA, 20 bp, Artificial sequence
  synthetic polynucleotide sequence
gtgggtaggggaggctgtca

SEQ ID NO: 33965 - DNA, 21 bp, Artificial sequence
  synthetic polynucleotide sequence
tgaggaacatgcagctgccaa

SEQ ID NO: 33966 - DNA, 20 bp, Artificial sequence
  synthetic polynucleotide sequence
ctcgactggaatgggatcca

SEQ ID NO: 33967 - DNA, 21 bp, Artificial sequence
  synthetic polynucleotide sequence
acttccgaaaggagctggtga

SEQ ID NO: 33968 - DNA, 21 bp, Artificial sequence
  synthetic polynucleotide sequence
ccaaggcttgctgaaggcgca

SEQ ID NO: 33969 - DNA, 21 bp, Artificial sequence
  synthetic polynucleotide sequence
ccggagaccctacccaactga

SEQ ID NO: 33970 - DNA, 21 bp, Artificial sequence
  synthetic polynucleotide sequence
gtggagcaaggacatctggca

SEQ ID NO: 33971 - DNA, 21 bp, Artificial sequence
  synthetic polynucleotide sequence
atccgagacaatctgctggga

SEQ ID NO: 33972 - DNA, 20 bp, Artificial sequence
  synthetic polynucleotide sequence
gggataacttgggcagggga

SEQ ID NO: 33973 - DNA, 19 bp, Artificial sequence
  synthetic polynucleotide sequence
tccaccacctccaatgcaa

SEQ ID NO: 33974 - DNA, 21 bp, Artificial sequence
  synthetic polynucleotide sequence
cctgactttccaaagggcgga

SEQ ID NO: 33975 - DNA, 20 bp, Artificial sequence
  synthetic polynucleotide sequence
tctccggccgaacaagcaga

SEQ ID NO: 33976 - DNA, 19 bp, Artificial sequence
  synthetic polynucleotide sequence
tcctgcaaggatcgtccca

SEQ ID NO: 33977 - DNA, 19 bp, Artificial sequence
  synthetic polynucleotide sequence
cgcgcgagggaggaagaga

SEQ ID NO: 33978 - DNA, 20 bp, Artificial sequence
  synthetic polynucleotide sequence
gatgccgggcatggtgctga

SEQ ID NO: 33979 - DNA, 20 bp, Artificial sequence
  synthetic polynucleotide sequence
ctcaacctcttgctacccca

SEQ ID NO: 33980 - DNA, 18 bp, Artificial sequence
  synthetic polynucleotide sequence
cgacacctgtcccagcga

SEQ ID NO: 33981 - DNA, 21 bp, Artificial sequence
  synthetic polynucleotide sequence
ccactgtacctgccgacggaa

SEQ ID NO: 33982 - DNA, 20 bp, Artificial sequence
  synthetic polynucleotide sequence
ggtccgggagttgcagtgga

SEQ ID NO: 33983 - DNA, 18 bp, Artificial sequence
  synthetic polynucleotide sequence
accaccaccccttcgaga

SEQ ID NO: 33984 - DNA, 18 bp, Artificial sequence
  synthetic polynucleotide sequence
gtccaatgggggagtgga

SEQ ID NO: 33985 - DNA, 18 bp, Artificial sequence
  synthetic polynucleotide sequence
cagaaccggtgtccccaa

SEQ ID NO: 33986 - DNA, 18 bp, Artificial sequence
  synthetic polynucleotide sequence
gctgggctgctgagacca

SEQ ID NO: 33987 - DNA, 19 bp, Artificial sequence
  synthetic polynucleotide sequence
gggaggtggaggttggaga

SEQ ID NO: 33988 - DNA, 22 bp, Artificial sequence
  synthetic polynucleotide sequence
cattatcaccacccagtagcca

SEQ ID NO: 33989 - DNA, 20 bp, Artificial sequence
  synthetic polynucleotide sequence
aaccactggctggctcccaa

SEQ ID NO: 33990 - DNA, 23 bp, Artificial sequence
  synthetic polynucleotide sequence
cttctcaccaaaaaggaccccga

SEQ ID NO: 33991 - DNA, 20 bp, Artificial sequence
  synthetic polynucleotide sequence
ccagtgtcagaatggcgcca

SEQ ID NO: 33992 - DNA, 21 bp, Artificial sequence
  synthetic polynucleotide sequence
tagccaaaggttcctggggca

SEQ ID NO: 33993 - DNA, 18 bp, Artificial sequence
  synthetic polynucleotide sequence
tggagcagcctgtgacca

SEQ ID NO: 33994 - DNA, 18 bp, Artificial sequence
  synthetic polynucleotide sequence
caggagccattcacggca

SEQ ID NO: 33995 - DNA, 20 bp, Artificial sequence
  synthetic polynucleotide sequence
gccgcaactgctccacggaa

SEQ ID NO: 33996 - DNA, 20 bp, Artificial sequence
  synthetic polynucleotide sequence
gcctccgacagctgaaccca

SEQ ID NO: 33997 - DNA, 22 bp, Artificial sequence
  synthetic polynucleotide sequence
taccgcgagtaccaaaaccgga

SEQ ID NO: 33998 - DNA, 20 bp, Artificial sequence
  synthetic polynucleotide sequence
tatgggcgtcgtcagggtca

SEQ ID NO: 33999 - DNA, 18 bp, Artificial sequence
  synthetic polynucleotide sequence
tgccagccaccaaggaca

SEQ ID NO: 34000 - DNA, 18 bp, Artificial sequence
  synthetic polynucleotide sequence
aagcaaggcctccaggca

SEQ ID NO: 34001 - DNA, 21 bp, Artificial sequence
  synthetic polynucleotide sequence
agttggaggctcaggaaccta

SEQ ID NO: 34002 - DNA, 20 bp, Artificial sequence
  synthetic polynucleotide sequence
tcacaagaggcagtggtgga

SEQ ID NO: 34003 - DNA, 21 bp, Artificial sequence
  synthetic polynucleotide sequence
agaggctcaatctcaccccga

SEQ ID NO: 34004 - DNA, 22 bp, Artificial sequence
  synthetic polynucleotide sequence
gcaatcttcgacaagccgtgca

SEQ ID NO: 34005 - DNA, 22 bp, Artificial sequence
  synthetic polynucleotide sequence
taaatgcagcttcctggggcaa

SEQ ID NO: 34006 - DNA, 20 bp, Artificial sequence
  synthetic polynucleotide sequence
gctaggagttgcagggctga

SEQ ID NO: 34007 - DNA, 20 bp, Artificial sequence
  synthetic polynucleotide sequence
ccaaagtcgcgttccccgga

SEQ ID NO: 34008 - DNA, 22 bp, Artificial sequence
  synthetic polynucleotide sequence
atcgtagaaggaagcggagcca

SEQ ID NO: 34009 - DNA, 21 bp, Artificial sequence
  synthetic polynucleotide sequence
agtgtagcttcccccagcaca

SEQ ID NO: 34010 - DNA, 20 bp, Artificial sequence
  synthetic polynucleotide sequence
ctggaacagccacgccctca

SEQ ID NO: 34011 - DNA, 18 bp, Artificial sequence
  synthetic polynucleotide sequence
cgcggtcttcgccaagca

SEQ ID NO: 34012 - DNA, 18 bp, Artificial sequence
  synthetic polynucleotide sequence
tgacgaggtcgatgggca

SEQ ID NO: 34013 - DNA, 21 bp, Artificial sequence
  synthetic polynucleotide sequence
tcattaacgcccggagacgca

SEQ ID NO: 34014 - DNA, 20 bp, Artificial sequence
  synthetic polynucleotide sequence
cgtctcggtatagcccccga

SEQ ID NO: 34015 - DNA, 20 bp, Artificial sequence
  synthetic polynucleotide sequence
gtctggaagatgtgaccgca

SEQ ID NO: 34016 - DNA, 20 bp, Artificial sequence
  synthetic polynucleotide sequence
atgttcggggagtagcagca

SEQ ID NO: 34017 - DNA, 20 bp, Artificial sequence
  synthetic polynucleotide sequence
ctccactcccgagatccaga

SEQ ID NO: 34018 - DNA, 18 bp, Artificial sequence
  synthetic polynucleotide sequence
ggacttggctgacacgca

SEQ ID NO: 34019 - DNA, 20 bp, Artificial sequence
  synthetic polynucleotide sequence
gtctgccgagaagccagtca

SEQ ID NO: 34020 - DNA, 21 bp, Artificial sequence
  synthetic polynucleotide sequence
agagaggggcacatgatgaga

SEQ ID NO: 34021 - DNA, 18 bp, Artificial sequence
  synthetic polynucleotide sequence
gggagcaaagccagggca

SEQ ID NO: 34022 - DNA, 19 bp, Artificial sequence
  synthetic polynucleotide sequence
ccgtcgtagaatcgcagca

SEQ ID NO: 34023 - DNA, 21 bp, Artificial sequence
  synthetic polynucleotide sequence
ctcggctccgcagatatgaga

SEQ ID NO: 34024 - DNA, 20 bp, Artificial sequence
  synthetic polynucleotide sequence
catcctcagggtcctgccca

SEQ ID NO: 34025 - DNA, 21 bp, Artificial sequence
  synthetic polynucleotide sequence
gagggtaaagggtggacagca

SEQ ID NO: 34026 - DNA, 19 bp, Artificial sequence
  synthetic polynucleotide sequence
ttgctggagggtggctgca

SEQ ID NO: 34027 - DNA, 18 bp, Artificial sequence
  synthetic polynucleotide sequence
tcacccacctcagccaga

SEQ ID NO: 34028 - DNA, 20 bp, Artificial sequence
  synthetic polynucleotide sequence
ctggctcaggctgacaggta

SEQ ID NO: 34029 - DNA, 20 bp, Artificial sequence
  synthetic polynucleotide sequence
aagagaggctccacccgaga

SEQ ID NO: 34030 - DNA, 25 bp, Artificial sequence
  synthetic polynucleotide sequence
cagcatcaaggcaaacacagcaaca

SEQ ID NO: 34031 - DNA, 21 bp, Artificial sequence
  synthetic polynucleotide sequence
atcctggtcctagagccccaa

SEQ ID NO: 34032 - DNA, 21 bp, Artificial sequence
  synthetic polynucleotide sequence
acaggtacacaggacgctgga

SEQ ID NO: 34033 - DNA, 20 bp, Artificial sequence
  synthetic polynucleotide sequence
tactcacaatggcctgagga

SEQ ID NO: 34034 - DNA, 18 bp, Artificial sequence
  synthetic polynucleotide sequence
tcgcagtcactggcccca

SEQ ID NO: 34035 - DNA, 18 bp, Artificial sequence
  synthetic polynucleotide sequence
caggttgaagcagcccga

SEQ ID NO: 34036 - DNA, 18 bp, Artificial sequence
  synthetic polynucleotide sequence
ggttccgaacgtcaggca

SEQ ID NO: 34037 - DNA, 21 bp, Artificial sequence
  synthetic polynucleotide sequence
gcgccaagatgtcggaccaca

SEQ ID NO: 34038 - DNA, 21 bp, Artificial sequence
  synthetic polynucleotide sequence
tggcggtaaagtcctgggcga

SEQ ID NO: 34039 - DNA, 18 bp, Artificial sequence
  synthetic polynucleotide sequence
cgagcctctggcagggca

SEQ ID NO: 34040 - DNA, 18 bp, Artificial sequence
  synthetic polynucleotide sequence
tcccaggcgtagctccca

SEQ ID NO: 34041 - DNA, 18 bp, Artificial sequence
  synthetic polynucleotide sequence
gagccccggaacccacca

SEQ ID NO: 34042 - DNA, 20 bp, Artificial sequence
  synthetic polynucleotide sequence
ctggcatgatgggtggggca

SEQ ID NO: 34043 - DNA, 19 bp, Artificial sequence
  synthetic polynucleotide sequence
tcctgagactcaccgtcca

SEQ ID NO: 34044 - DNA, 18 bp, Artificial sequence
  synthetic polynucleotide sequence
ctgcccacatgtcccaca

SEQ ID NO: 34045 - DNA, 18 bp, Artificial sequence
  synthetic polynucleotide sequence
tggccacgggacaacaca

SEQ ID NO: 34046 - DNA, 20 bp, Artificial sequence
  synthetic polynucleotide sequence
aagtgccaccagccatagga

SEQ ID NO: 34047 - DNA, 19 bp, Artificial sequence
  synthetic polynucleotide sequence
gagtgatgaagtcgggcca

SEQ ID NO: 34048 - DNA, 18 bp, Artificial sequence
  synthetic polynucleotide sequence
gtcaccgcagtccaacca

SEQ ID NO: 34049 - DNA, 20 bp, Artificial sequence
  synthetic polynucleotide sequence
atcacggagggatcccctga

SEQ ID NO: 34050 - DNA, 20 bp, Artificial sequence
  synthetic polynucleotide sequence
cgcccctcgacgtgatcaga

SEQ ID NO: 34051 - DNA, 18 bp, Artificial sequence
  synthetic polynucleotide sequence
tgaaaggaggggaggcaa

SEQ ID NO: 34052 - DNA, 18 bp, Artificial sequence
  synthetic polynucleotide sequence
atccagccatctgcggca

SEQ ID NO: 34053 - DNA, 18 bp, Artificial sequence
  synthetic polynucleotide sequence
cgtgtcctccgccagaca

SEQ ID NO: 34054 - DNA, 18 bp, Artificial sequence
  synthetic polynucleotide sequence
cctcgtaggcacggcgga

SEQ ID NO: 34055 - DNA, 18 bp, Artificial sequence
  synthetic polynucleotide sequence
cgaggctccatccagcaa

SEQ ID NO: 34056 - DNA, 18 bp, Artificial sequence
  synthetic polynucleotide sequence
gcacgccacactccagca

SEQ ID NO: 34057 - DNA, 20 bp, Artificial sequence
  synthetic polynucleotide sequence
agagctcaggcccaagtgga

SEQ ID NO: 34058 - DNA, 20 bp, Artificial sequence
  synthetic polynucleotide sequence
cacccggatctccagaccca

SEQ ID NO: 34059 - DNA, 22 bp, Artificial sequence
  synthetic polynucleotide sequence
actacctgcaggtcaaaggtga

SEQ ID NO: 34060 - DNA, 21 bp, Artificial sequence
  synthetic polynucleotide sequence
cccagagacccactgaatcca

SEQ ID NO: 34061 - DNA, 21 bp, Artificial sequence
  synthetic polynucleotide sequence
tcatgcacgccgatgctcaga

SEQ ID NO: 34062 - DNA, 21 bp, Artificial sequence
  synthetic polynucleotide sequence
agtcgcacatcagggtcctca

SEQ ID NO: 34063 - DNA, 21 bp, Artificial sequence
  synthetic polynucleotide sequence
tgtccggcgaattgagggtga

SEQ ID NO: 34064 - DNA, 20 bp, Artificial sequence
  synthetic polynucleotide sequence
tgtcatcccaacccctccca

SEQ ID NO: 34065 - DNA, 22 bp, Artificial sequence
  synthetic polynucleotide sequence
aaggaacactgcctcatgggga

SEQ ID NO: 34066 - DNA, 20 bp, Artificial sequence
  synthetic polynucleotide sequence
ctgtgagccagcctggtcga

SEQ ID NO: 34067 - DNA, 22 bp, Artificial sequence
  synthetic polynucleotide sequence
tcaagcccaggagttacacaga

SEQ ID NO: 34068 - DNA, 19 bp, Artificial sequence
  synthetic polynucleotide sequence
tgtgtgccctcccgaacca

SEQ ID NO: 34069 - DNA, 22 bp, Artificial sequence
  synthetic polynucleotide sequence
aagagaaaaagcccacccccaa

SEQ ID NO: 34070 - DNA, 18 bp, Artificial sequence
  synthetic polynucleotide sequence
ggactcctggctcgggca

SEQ ID NO: 34071 - DNA, 21 bp, Artificial sequence
  synthetic polynucleotide sequence
ccttctcatggatgccaggga

SEQ ID NO: 34072 - DNA, 21 bp, Artificial sequence
  synthetic polynucleotide sequence
aggctgagtgatacggggcca

SEQ ID NO: 34073 - DNA, 21 bp, Artificial sequence
  synthetic polynucleotide sequence
ctgcattcaagggagggtcca

SEQ ID NO: 34074 - DNA, 23 bp, Artificial sequence
  synthetic polynucleotide sequence
caaaactcagaccactcaccaga

SEQ ID NO: 34075 - DNA, 21 bp, Artificial sequence
  synthetic polynucleotide sequence
tggagacacctgggagtcgca

SEQ ID NO: 34076 - DNA, 21 bp, Artificial sequence
  synthetic polynucleotide sequence
tgttttccagcagggcagcca

SEQ ID NO: 34077 - DNA, 20 bp, Artificial sequence
  synthetic polynucleotide sequence
acggagcggtggtgtggcca

SEQ ID NO: 34078 - DNA, 20 bp, Artificial sequence
  synthetic polynucleotide sequence
aaacaaggcctggtccggca

SEQ ID NO: 34079 - DNA, 19 bp, Artificial sequence
  synthetic polynucleotide sequence
cacaaggcagcccgcacga

SEQ ID NO: 34080 - DNA, 22 bp, Artificial sequence
  synthetic polynucleotide sequence
aggatgtagtctgccaggagca

SEQ ID NO: 34081 - DNA, 22 bp, Artificial sequence
  synthetic polynucleotide sequence
atcttctggctctaccaccaca

SEQ ID NO: 34082 - DNA, 22 bp, Artificial sequence
  synthetic polynucleotide sequence
aagtgaccagtcagcactccta

SEQ ID NO: 34083 - DNA, 22 bp, Artificial sequence
  synthetic polynucleotide sequence
agcaccacccagattgcatgca

SEQ ID NO: 34084 - DNA, 21 bp, Artificial sequence
  synthetic polynucleotide sequence
ccctaaggagtagaggcggca

SEQ ID NO: 34085 - DNA, 20 bp, Artificial sequence
  synthetic polynucleotide sequence
cctgagggatgccctgtcca

SEQ ID NO: 34086 - DNA, 20 bp, Artificial sequence
  synthetic polynucleotide sequence
cttcctcagcgcagccagca

SEQ ID NO: 34087 - DNA, 20 bp, Artificial sequence
  synthetic polynucleotide sequence
cagtacctggatccggccca

SEQ ID NO: 34088 - DNA, 19 bp, Artificial sequence
  synthetic polynucleotide sequence
caggagggctgtgtcccga

SEQ ID NO: 34089 - DNA, 22 bp, Artificial sequence
  synthetic polynucleotide sequence
agaagagttacccagtgcccaa

SEQ ID NO: 34090 - DNA, 21 bp, Artificial sequence
  synthetic polynucleotide sequence
catagcggccgtaatctcgca

SEQ ID NO: 34091 - DNA, 21 bp, Artificial sequence
  synthetic polynucleotide sequence
ggcttctgaaacctgggggga

SEQ ID NO: 34092 - DNA, 20 bp, Artificial sequence
  synthetic polynucleotide sequence
cacctgcagtcggcggtcca

SEQ ID NO: 34093 - DNA, 18 bp, Artificial sequence
  synthetic polynucleotide sequence
ccctggcagcaaagacca

SEQ ID NO: 34094 - DNA, 18 bp, Artificial sequence
  synthetic polynucleotide sequence
ggtgggtcagccatcaca

SEQ ID NO: 34095 - DNA, 20 bp, Artificial sequence
  synthetic polynucleotide sequence
ggcatcagtctgcaggacca

SEQ ID NO: 34096 - DNA, 20 bp, Artificial sequence
  synthetic polynucleotide sequence
tcaggtcatacaagggccaa

SEQ ID NO: 34097 - DNA, 21 bp, Artificial sequence
  synthetic polynucleotide sequence
accaggccgcacattgcagca

SEQ ID NO: 34098 - DNA, 22 bp, Artificial sequence
  synthetic polynucleotide sequence
ccaacacacaaccctgctccta

SEQ ID NO: 34099 - DNA, 21 bp, Artificial sequence
  synthetic polynucleotide sequence
tgtaccgccagagtctgtgga

SEQ ID NO: 34100 - DNA, 22 bp, Artificial sequence
  synthetic polynucleotide sequence
aaagagctgagccaggaagtca

SEQ ID NO: 34101 - DNA, 21 bp, Artificial sequence
  synthetic polynucleotide sequence
tgccggggagaacatgcacca

SEQ ID NO: 34102 - DNA, 18 bp, Artificial sequence
  synthetic polynucleotide sequence
cccctcccggtctcagca

SEQ ID NO: 34103 - DNA, 20 bp, Artificial sequence
  synthetic polynucleotide sequence
ggtcacctgcctagacccaa

SEQ ID NO: 34104 - DNA, 18 bp, Artificial sequence
  synthetic polynucleotide sequence
tccggacctcctgcagga

SEQ ID NO: 34105 - DNA, 23 bp, Artificial sequence
  synthetic polynucleotide sequence
aaaaaggacctatggagactgga

SEQ ID NO: 34106 - DNA, 19 bp, Artificial sequence
  synthetic polynucleotide sequence
tacgagctccacagctcca

SEQ ID NO: 34107 - DNA, 22 bp, Artificial sequence
  synthetic polynucleotide sequence
tccagactggaaaacccacaga

SEQ ID NO: 34108 - DNA, 18 bp, Artificial sequence
  synthetic polynucleotide sequence
gctgatcacagcggtcca

SEQ ID NO: 34109 - DNA, 20 bp, Artificial sequence
  synthetic polynucleotide sequence
cctctccaccttccggcaga

SEQ ID NO: 34110 - DNA, 20 bp, Artificial sequence
  synthetic polynucleotide sequence
catcctgcttgcccacgcca

SEQ ID NO: 34111 - DNA, 19 bp, Artificial sequence
  synthetic polynucleotide sequence
cctcagtgccatcccccga

SEQ ID NO: 34112 - DNA, 20 bp, Artificial sequence
  synthetic polynucleotide sequence
gcggtgcaccaatagcccca

SEQ ID NO: 34113 - DNA, 18 bp, Artificial sequence
  synthetic polynucleotide sequence
cgcagaggaagtcagcca

SEQ ID NO: 34114 - DNA, 22 bp, Artificial sequence
  synthetic polynucleotide sequence
aggtgagctagaggtggaacca

SEQ ID NO: 34115 - DNA, 20 bp, Artificial sequence
  synthetic polynucleotide sequence
gcctcagcccttcaacgaca

SEQ ID NO: 34116 - DNA, 25 bp, Artificial sequence
  synthetic polynucleotide sequence
aaggaaaaaacgctgagcgctggaa

SEQ ID NO: 34117 - DNA, 21 bp, Artificial sequence
  synthetic polynucleotide sequence
cgtcagcgagcacaggagaga

SEQ ID NO: 34118 - DNA, 20 bp, Artificial sequence
  synthetic polynucleotide sequence
tggcttaaggcgaggctcca

SEQ ID NO: 34119 - DNA, 18 bp, Artificial sequence
  synthetic polynucleotide sequence
aagtcatcccagccccaa

SEQ ID NO: 34120 - DNA, 20 bp, Artificial sequence
  synthetic polynucleotide sequence
ccgacagaggtcagctcgga

SEQ ID NO: 34121 - DNA, 20 bp, Artificial sequence
  synthetic polynucleotide sequence
aactggatggcagaagcaga

SEQ ID NO: 34122 - DNA, 22 bp, Artificial sequence
  synthetic polynucleotide sequence
tagggtgacagagtaggaggca

SEQ ID NO: 34123 - DNA, 20 bp, Artificial sequence
  synthetic polynucleotide sequence
gatgaccaagagggtggaca

SEQ ID NO: 34124 - DNA, 18 bp, Artificial sequence
  synthetic polynucleotide sequence
agctcggtggacgtgaca

SEQ ID NO: 34125 - DNA, 18 bp, Artificial sequence
  synthetic polynucleotide sequence
ggtcagcgcagaggagga

SEQ ID NO: 34126 - DNA, 18 bp, Artificial sequence
  synthetic polynucleotide sequence
gtggcagctgcggaacca

SEQ ID NO: 34127 - DNA, 20 bp, Artificial sequence
  synthetic polynucleotide sequence
attcgccagccaaagtagga

SEQ ID NO: 34128 - DNA, 19 bp, Artificial sequence
  synthetic polynucleotide sequence
gcagcaagaaacagcagca

SEQ ID NO: 34129 - DNA, 22 bp, Artificial sequence
  synthetic polynucleotide sequence
aaacgctgacctggaacaagga

SEQ ID NO: 34130 - DNA, 21 bp, Artificial sequence
  synthetic polynucleotide sequence
agtgccaggggtttaaaggga

SEQ ID NO: 34131 - DNA, 20 bp, Artificial sequence
  synthetic polynucleotide sequence
gtgacaggcatcatcaccca

SEQ ID NO: 34132 - DNA, 18 bp, Artificial sequence
  synthetic polynucleotide sequence
gtcccagttgccagggaa

SEQ ID NO: 34133 - DNA, 19 bp, Artificial sequence
  synthetic polynucleotide sequence
ggaccaacctagctgggca

SEQ ID NO: 34134 - DNA, 18 bp, Artificial sequence
  synthetic polynucleotide sequence
catccgacctgtgcacca

SEQ ID NO: 34135 - DNA, 21 bp, Artificial sequence
  synthetic polynucleotide sequence
accacccatgccaaggagcga

SEQ ID NO: 34136 - DNA, 21 bp, Artificial sequence
  synthetic polynucleotide sequence
acttgttggcacaggcgagca

SEQ ID NO: 34137 - DNA, 18 bp, Artificial sequence
  synthetic polynucleotide sequence
gaatgagctgcaccgcca

SEQ ID NO: 34138 - DNA, 21 bp, Artificial sequence
  synthetic polynucleotide sequence
ctatctgactccgcacagaca

SEQ ID NO: 34139 - DNA, 20 bp, Artificial sequence
  synthetic polynucleotide sequence
gaagatggctccgtgggcca

SEQ ID NO: 34140 - DNA, 19 bp, Artificial sequence
  synthetic polynucleotide sequence
gccgcccagcttgcactca

SEQ ID NO: 34141 - DNA, 20 bp, Artificial sequence
  synthetic polynucleotide sequence
tgagcctgtccaggtggaga

SEQ ID NO: 34142 - DNA, 20 bp, Artificial sequence
  synthetic polynucleotide sequence
accgctgaggacctctacca

SEQ ID NO: 34143 - DNA, 18 bp, Artificial sequence
  synthetic polynucleotide sequence
cccaggcagcaagtgcaa

SEQ ID NO: 34144 - DNA, 18 bp, Artificial sequence
  synthetic polynucleotide sequence
atgccaccattggccaca

SEQ ID NO: 34145 - DNA, 21 bp, Artificial sequence
  synthetic polynucleotide sequence
agaagggcacggtcatgggta

SEQ ID NO: 34146 - DNA, 20 bp, Artificial sequence
  synthetic polynucleotide sequence
ctgcaggaggaagaagggga

SEQ ID NO: 34147 - DNA, 21 bp, Artificial sequence
  synthetic polynucleotide sequence
aagtcaacgagtctgcccaga

SEQ ID NO: 34148 - DNA, 21 bp, Artificial sequence
  synthetic polynucleotide sequence
agcaggccgaagaggcttcca

SEQ ID NO: 34149 - DNA, 20 bp, Artificial sequence
  synthetic polynucleotide sequence
tactcgctccacctgcccaa

SEQ ID NO: 34150 - DNA, 20 bp, Artificial sequence
  synthetic polynucleotide sequence
cgtcatggccagcgaggtga

SEQ ID NO: 34151 - DNA, 20 bp, Artificial sequence
  synthetic polynucleotide sequence
gtgagcatggacctggtgca

SEQ ID NO: 34152 - DNA, 21 bp, Artificial sequence
  synthetic polynucleotide sequence
ggccggccaacaacatgagca

SEQ ID NO: 34153 - DNA, 19 bp, Artificial sequence
  synthetic polynucleotide sequence
gggaccggccctctatgga

SEQ ID NO: 34154 - DNA, 22 bp, Artificial sequence
  synthetic polynucleotide sequence
aacaaggcaacaagcagagcca

SEQ ID NO: 34155 - DNA, 20 bp, Artificial sequence
  synthetic polynucleotide sequence
gcagcccggccattggagca

SEQ ID NO: 34156 - DNA, 21 bp, Artificial sequence
  synthetic polynucleotide sequence
gcagagattctggaacagcca

SEQ ID NO: 34157 - DNA, 21 bp, Artificial sequence
  synthetic polynucleotide sequence
tcttggtggccctcatggaga

SEQ ID NO: 34158 - DNA, 21 bp, Artificial sequence
  synthetic polynucleotide sequence
tctggtaccctgcaaagtcca

SEQ ID NO: 34159 - DNA, 19 bp, Artificial sequence
  synthetic polynucleotide sequence
ttcagctgcagcaccgtca

SEQ ID NO: 34160 - DNA, 21 bp, Artificial sequence
  synthetic polynucleotide sequence
gaactccagactgagggtgga

SEQ ID NO: 34161 - DNA, 19 bp, Artificial sequence
  synthetic polynucleotide sequence
cgctggagctgctggggaa

SEQ ID NO: 34162 - DNA, 22 bp, Artificial sequence
  synthetic polynucleotide sequence
ggtacagaacgggaaaggcaga

SEQ ID NO: 34163 - DNA, 20 bp, Artificial sequence
  synthetic polynucleotide sequence
cctgttcgtggggacggcaa

SEQ ID NO: 34164 - DNA, 21 bp, Artificial sequence
  synthetic polynucleotide sequence
atctgcagcaccatctcgcca

SEQ ID NO: 34165 - DNA, 22 bp, Artificial sequence
  synthetic polynucleotide sequence
ttgagcaacattggcagcctga

SEQ ID NO: 34166 - DNA, 19 bp, Artificial sequence
  synthetic polynucleotide sequence
ttctcccagggaagcacca

SEQ ID NO: 34167 - DNA, 21 bp, Artificial sequence
  synthetic polynucleotide sequence
gggggagaactatgaccggca

SEQ ID NO: 34168 - DNA, 19 bp, Artificial sequence
  synthetic polynucleotide sequence
tggaggtggcgatacggta

SEQ ID NO: 34169 - DNA, 18 bp, Artificial sequence
  synthetic polynucleotide sequence
ccccctgagctgaggaca

SEQ ID NO: 34170 - DNA, 18 bp, Artificial sequence
  synthetic polynucleotide sequence
ggatcaccaagcaggcca

SEQ ID NO: 34171 - DNA, 20 bp, Artificial sequence
  synthetic polynucleotide sequence
aaggaccatgggagcggcga

SEQ ID NO: 34172 - DNA, 20 bp, Artificial sequence
  synthetic polynucleotide sequence
caccaggcccgtcctggaca

SEQ ID NO: 34173 - DNA, 18 bp, Artificial sequence
  synthetic polynucleotide sequence
gcgactccccgtgcgcaa

SEQ ID NO: 34174 - DNA, 21 bp, Artificial sequence
  synthetic polynucleotide sequence
gagaaggaggagtgagaccca

SEQ ID NO: 34175 - DNA, 20 bp, Artificial sequence
  synthetic polynucleotide sequence
atctggaagtggagcccgga

SEQ ID NO: 34176 - DNA, 20 bp, Artificial sequence
  synthetic polynucleotide sequence
aaccactcccaggagggtga

SEQ ID NO: 34177 - DNA, 20 bp, Artificial sequence
  synthetic polynucleotide sequence
ctactccttggcccccacca

SEQ ID NO: 34178 - DNA, 18 bp, Artificial sequence
  synthetic polynucleotide sequence
gggctgacctcctgggca

SEQ ID NO: 34179 - DNA, 19 bp, Artificial sequence
  synthetic polynucleotide sequence
ggaggcaagggaggaggaa

SEQ ID NO: 34180 - DNA, 18 bp, Artificial sequence
  synthetic polynucleotide sequence
tgacagaaggcgtgggga

SEQ ID NO: 34181 - DNA, 22 bp, Artificial sequence
  synthetic polynucleotide sequence
gccagaatacgatgcaaagcca

SEQ ID NO: 34182 - DNA, 21 bp, Artificial sequence
  synthetic polynucleotide sequence
ctgacactggtaacggggaca

SEQ ID NO: 34183 - DNA, 20 bp, Artificial sequence
  synthetic polynucleotide sequence
gctggatgcaactgggggca

SEQ ID NO: 34184 - DNA, 20 bp, Artificial sequence
  synthetic polynucleotide sequence
ctcatggagaaggggccgga

SEQ ID NO: 34185 - DNA, 23 bp, Artificial sequence
  synthetic polynucleotide sequence
gtaaaccctgaaacaaccccaga

SEQ ID NO: 34186 - DNA, 21 bp, Artificial sequence
  synthetic polynucleotide sequence
ccttgagccgaagcagcctca

SEQ ID NO: 34187 - DNA, 18 bp, Artificial sequence
  synthetic polynucleotide sequence
ccgcaagggtgtgagcca

SEQ ID NO: 34188 - DNA, 18 bp, Artificial sequence
  synthetic polynucleotide sequence
acctgcagctggggagca

SEQ ID NO: 34189 - DNA, 18 bp, Artificial sequence
  synthetic polynucleotide sequence
gcagcaagagtgccctga

SEQ ID NO: 34190 - DNA, 19 bp, Artificial sequence
  synthetic polynucleotide sequence
cgggtcaaggctagaccca

SEQ ID NO: 34191 - DNA, 20 bp, Artificial sequence
  synthetic polynucleotide sequence
ctctacgatggctggaccga

SEQ ID NO: 34192 - DNA, 20 bp, Artificial sequence
  synthetic polynucleotide sequence
cccatacactgcctgcagca

SEQ ID NO: 34193 - DNA, 19 bp, Artificial sequence
  synthetic polynucleotide sequence
tggcaacggaagaacagga

SEQ ID NO: 34194 - DNA, 21 bp, Artificial sequence
  synthetic polynucleotide sequence
tccaggttggctacaacacca

SEQ ID NO: 34195 - DNA, 18 bp, Artificial sequence
  synthetic polynucleotide sequence
gaacatcgagcacccgga

SEQ ID NO: 34196 - DNA, 18 bp, Artificial sequence
  synthetic polynucleotide sequence
tctggatcgagaggcgca

SEQ ID NO: 34197 - DNA, 20 bp, Artificial sequence
  synthetic polynucleotide sequence
atcgctacctagctgccaca

SEQ ID NO: 34198 - DNA, 20 bp, Artificial sequence
  synthetic polynucleotide sequence
tggaccatggcatcacgcca

SEQ ID NO: 34199 - DNA, 22 bp, Artificial sequence
  synthetic polynucleotide sequence
caaaaggcaagtgaggtctgga

SEQ ID NO: 34200 - DNA, 21 bp, Artificial sequence
  synthetic polynucleotide sequence
ccttgggttgggcatacagca

SEQ ID NO: 34201 - DNA, 20 bp, Artificial sequence
  synthetic polynucleotide sequence
gttccctcataccccagaca

SEQ ID NO: 34202 - DNA, 18 bp, Artificial sequence
  synthetic polynucleotide sequence
ggtcccgtccactgagga

SEQ ID NO: 34203 - DNA, 20 bp, Artificial sequence
  synthetic polynucleotide sequence
gtgccctgtgacagcaccga

SEQ ID NO: 34204 - DNA, 19 bp, Artificial sequence
  synthetic polynucleotide sequence
ccggcgcagctgaagagca

SEQ ID NO: 34205 - DNA, 20 bp, Artificial sequence
  synthetic polynucleotide sequence
tctgggcccgtacaaaggaa

SEQ ID NO: 34206 - DNA, 21 bp, Artificial sequence
  synthetic polynucleotide sequence
accaggtggcaagggtgtgga

SEQ ID NO: 34207 - DNA, 18 bp, Artificial sequence
  synthetic polynucleotide sequence
actccatgggaggcgcca

SEQ ID NO: 34208 - DNA, 20 bp, Artificial sequence
  synthetic polynucleotide sequence
gagggacaagtttggcagca

SEQ ID NO: 34209 - DNA, 22 bp, Artificial sequence
  synthetic polynucleotide sequence
accatttgcaggcagctcagga

SEQ ID NO: 34210 - DNA, 20 bp, Artificial sequence
  synthetic polynucleotide sequence
cttgctcacgggtccacaga

SEQ ID NO: 34211 - DNA, 18 bp, Artificial sequence
  synthetic polynucleotide sequence
cctggcaggcaaccccaa

SEQ ID NO: 34212 - DNA, 18 bp, Artificial sequence
  synthetic polynucleotide sequence
acgggatgaggatgggga

SEQ ID NO: 34213 - DNA, 18 bp, Artificial sequence
  synthetic polynucleotide sequence
tcaggaagcgccgaggga

SEQ ID NO: 34214 - DNA, 17 bp, Artificial sequence
  synthetic polynucleotide sequence
aggggtgcagccagaca

SEQ ID NO: 34215 - DNA, 20 bp, Artificial sequence
  synthetic polynucleotide sequence
cacagcaagggacccgagca

SEQ ID NO: 34216 - DNA, 18 bp, Artificial sequence
  synthetic polynucleotide sequence
agcaggagtcgggcccca

SEQ ID NO: 34217 - DNA, 18 bp, Artificial sequence
  synthetic polynucleotide sequence
acgtgtacgcagagccca

SEQ ID NO: 34218 - DNA, 19 bp, Artificial sequence
  synthetic polynucleotide sequence
ggctgtagaggggtcggga

SEQ ID NO: 34219 - DNA, 20 bp, Artificial sequence
  synthetic polynucleotide sequence
gcagtcactgggtcaccaga

SEQ ID NO: 34220 - DNA, 22 bp, Artificial sequence
  synthetic polynucleotide sequence
atatgtacaccagacccagaca

SEQ ID NO: 34221 - DNA, 18 bp, Artificial sequence
  synthetic polynucleotide sequence
cacgggagaacccagcaa

SEQ ID NO: 34222 - DNA, 18 bp, Artificial sequence
  synthetic polynucleotide sequence
ttgtgcccaccaagccca

SEQ ID NO: 34223 - DNA, 18 bp, Artificial sequence
  synthetic polynucleotide sequence
gctgtgtgcggaccagga

SEQ ID NO: 34224 - DNA, 18 bp, Artificial sequence
  synthetic polynucleotide sequence
cccggtgaatggtcagga

SEQ ID NO: 34225 - DNA, 23 bp, Artificial sequence
  synthetic polynucleotide sequence
gagcctcaaacagaacatcagca

SEQ ID NO: 34226 - DNA, 20 bp, Artificial sequence
  synthetic polynucleotide sequence
ccaccaaaccaaccagtgga

SEQ ID NO: 34227 - DNA, 20 bp, Artificial sequence
  synthetic polynucleotide sequence
cacaggctgtcagctgcaga

SEQ ID NO: 34228 - DNA, 19 bp, Artificial sequence
  synthetic polynucleotide sequence
cagcacgagctttgagcca

SEQ ID NO: 34229 - DNA, 21 bp, Artificial sequence
  synthetic polynucleotide sequence
tggcatctgcaggatcagcca

SEQ ID NO: 34230 - DNA, 21 bp, Artificial sequence
  synthetic polynucleotide sequence
catagctgtgtggccagcaca

SEQ ID NO: 34231 - DNA, 21 bp, Artificial sequence
  synthetic polynucleotide sequence
tgccctcaacaaccaccgcga

SEQ ID NO: 34232 - DNA, 21 bp, Artificial sequence
  synthetic polynucleotide sequence
tcggcgttgacactgcaccca

SEQ ID NO: 34233 - DNA, 18 bp, Artificial sequence
  synthetic polynucleotide sequence
cgaggcctcagagggcaa

SEQ ID NO: 34234 - DNA, 18 bp, Artificial sequence
  synthetic polynucleotide sequence
ttcccatcaggcaggaca

SEQ ID NO: 34235 - DNA, 18 bp, Artificial sequence
  synthetic polynucleotide sequence
ctgacacccccatcccaa

SEQ ID NO: 34236 - DNA, 20 bp, Artificial sequence
  synthetic polynucleotide sequence
gacacagaggcgttccagga

SEQ ID NO: 34237 - DNA, 21 bp, Artificial sequence
  synthetic polynucleotide sequence
tggcgaatcagctgctggcca

SEQ ID NO: 34238 - DNA, 20 bp, Artificial sequence
  synthetic polynucleotide sequence
tccctaccgtcagctgagga

SEQ ID NO: 34239 - DNA, 19 bp, Artificial sequence
  synthetic polynucleotide sequence
gggagcagaacggacacca

SEQ ID NO: 34240 - DNA, 18 bp, Artificial sequence
  synthetic polynucleotide sequence
cttcggaccatccaggca

SEQ ID NO: 34241 - DNA, 20 bp, Artificial sequence
  synthetic polynucleotide sequence
caggccaagtgcaccacaca

SEQ ID NO: 34242 - DNA, 21 bp, Artificial sequence
  synthetic polynucleotide sequence
gctgccatgcgtgcaagagaa

SEQ ID NO: 34243 - DNA, 19 bp, Artificial sequence
  synthetic polynucleotide sequence
cagctcaggtccccagcca

SEQ ID NO: 34244 - DNA, 19 bp, Artificial sequence
  synthetic polynucleotide sequence
ttacctgcagctgtgggga

SEQ ID NO: 34245 - DNA, 21 bp, Artificial sequence
  synthetic polynucleotide sequence
agagctggaaggaggaggaga

SEQ ID NO: 34246 - DNA, 20 bp, Artificial sequence
  synthetic polynucleotide sequence
ggagaggtagtcggggtgca

SEQ ID NO: 34247 - DNA, 18 bp, Artificial sequence
  synthetic polynucleotide sequence
gagccacaacacccagca

SEQ ID NO: 34248 - DNA, 18 bp, Artificial sequence
  synthetic polynucleotide sequence
caccagcgccttcccaga

SEQ ID NO: 34249 - DNA, 21 bp, Artificial sequence
  synthetic polynucleotide sequence
gcagcatgctcagtgggaaca

SEQ ID NO: 34250 - DNA, 21 bp, Artificial sequence
  synthetic polynucleotide sequence
aggaaatggcacttgcaggga

SEQ ID NO: 34251 - DNA, 22 bp, Artificial sequence
  synthetic polynucleotide sequence
aagttgtcagcaggagagagca

SEQ ID NO: 34252 - DNA, 22 bp, Artificial sequence
  synthetic polynucleotide sequence
aaactccgctagtctgacagga

SEQ ID NO: 34253 - DNA, 21 bp, Artificial sequence
  synthetic polynucleotide sequence
tcctccactctgcgctcacca

SEQ ID NO: 34254 - DNA, 18 bp, Artificial sequence
  synthetic polynucleotide sequence
cacgctcagctcccccca

SEQ ID NO: 34255 - DNA, 18 bp, Artificial sequence
  synthetic polynucleotide sequence
tgaacgcttcaccagcca

SEQ ID NO: 34256 - DNA, 18 bp, Artificial sequence
  synthetic polynucleotide sequence
cagagcgcccaggaagca

SEQ ID NO: 34257 - DNA, 18 bp, Artificial sequence
  synthetic polynucleotide sequence
agtccatccgcaacgaca

SEQ ID NO: 34258 - DNA, 18 bp, Artificial sequence
  synthetic polynucleotide sequence
ccaagtggcccaggtcca

SEQ ID NO: 34259 - DNA, 22 bp, Artificial sequence
  synthetic polynucleotide sequence
agatcatccagcagaggaagca

SEQ ID NO: 34260 - DNA, 21 bp, Artificial sequence
  synthetic polynucleotide sequence
gccatagcgaccctctcagca

SEQ ID NO: 34261 - DNA, 21 bp, Artificial sequence
  synthetic polynucleotide sequence
ccggaacagtccgtgatgcaa

SEQ ID NO: 34262 - DNA, 20 bp, Artificial sequence
  synthetic polynucleotide sequence
catgtggtcgcccacacgca

SEQ ID NO: 34263 - DNA, 21 bp, Artificial sequence
  synthetic polynucleotide sequence
agtcttggtggccaaaccaca

SEQ ID NO: 34264 - DNA, 20 bp, Artificial sequence
  synthetic polynucleotide sequence
gcccgagtcagcctggtcca

SEQ ID NO: 34265 - DNA, 19 bp, Artificial sequence
  synthetic polynucleotide sequence
tcggagcaagttcccggaa

SEQ ID NO: 34266 - DNA, 19 bp, Artificial sequence
  synthetic polynucleotide sequence
ggctccagcaccagtggca

SEQ ID NO: 34267 - DNA, 18 bp, Artificial sequence
  synthetic polynucleotide sequence
ccggggcagacgtccgta

SEQ ID NO: 34268 - DNA, 20 bp, Artificial sequence
  synthetic polynucleotide sequence
actcgatctcgatgcccgga

SEQ ID NO: 34269 - DNA, 18 bp, Artificial sequence
  synthetic polynucleotide sequence
ataatccgcccacgtcga

SEQ ID NO: 34270 - DNA, 18 bp, Artificial sequence
  synthetic polynucleotide sequence
gggtcccacaggagctga

SEQ ID NO: 34271 - DNA, 20 bp, Artificial sequence
  synthetic polynucleotide sequence
gtggtctcgatgagcccgga

SEQ ID NO: 34272 - DNA, 20 bp, Artificial sequence
  synthetic polynucleotide sequence
atggctggagatgaggggca

SEQ ID NO: 34273 - DNA, 22 bp, Artificial sequence
  synthetic polynucleotide sequence
caatggaaaggcctctcaagga

SEQ ID NO: 34274 - DNA, 21 bp, Artificial sequence
  synthetic polynucleotide sequence
tagtccgtaactccagggtga

SEQ ID NO: 34275 - DNA, 21 bp, Artificial sequence
  synthetic polynucleotide sequence
ctacgccatcattcaggcaga

SEQ ID NO: 34276 - DNA, 23 bp, Artificial sequence
  synthetic polynucleotide sequence
ataaaggtgacatagcagaccca

SEQ ID NO: 34277 - DNA, 21 bp, Artificial sequence
  synthetic polynucleotide sequence
gcctgcgagacaccttgagca

SEQ ID NO: 34278 - DNA, 23 bp, Artificial sequence
  synthetic polynucleotide sequence
taaaatgggcagtgacaaaggga

SEQ ID NO: 34279 - DNA, 20 bp, Artificial sequence
  synthetic polynucleotide sequence
gcccgagacctgggccacaa

SEQ ID NO: 34280 - DNA, 20 bp, Artificial sequence
  synthetic polynucleotide sequence
caggtcctcgaaggcgtcca

SEQ ID NO: 34281 - DNA, 20 bp, Artificial sequence
  synthetic polynucleotide sequence
gagcaagctgtccaagccca

SEQ ID NO: 34282 - DNA, 21 bp, Artificial sequence
  synthetic polynucleotide sequence
gtccagagaccctgcaatcca

SEQ ID NO: 34283 - DNA, 20 bp, Artificial sequence
  synthetic polynucleotide sequence
ccagggaccgtggagacaca

SEQ ID NO: 34284 - DNA, 21 bp, Artificial sequence
  synthetic polynucleotide sequence
tgtggaaacacacggcctgga

SEQ ID NO: 34285 - DNA, 18 bp, Artificial sequence
  synthetic polynucleotide sequence
caaggggcctggagcaga

SEQ ID NO: 34286 - DNA, 19 bp, Artificial sequence
  synthetic polynucleotide sequence
ggccagctccaagtcggta

SEQ ID NO: 34287 - DNA, 21 bp, Artificial sequence
  synthetic polynucleotide sequence
tggggaatctccgagcctgga

SEQ ID NO: 34288 - DNA, 21 bp, Artificial sequence
  synthetic polynucleotide sequence
tcctcctccttgcacagagga

SEQ ID NO: 34289 - DNA, 19 bp, Artificial sequence
  synthetic polynucleotide sequence
tttctgccgctggacgcaa

SEQ ID NO: 34290 - DNA, 21 bp, Artificial sequence
  synthetic polynucleotide sequence
ttcctctgaacaatcccgcca

SEQ ID NO: 34291 - DNA, 21 bp, Artificial sequence
  synthetic polynucleotide sequence
actggcttcgagaacacagca

SEQ ID NO: 34292 - DNA, 20 bp, Artificial sequence
  synthetic polynucleotide sequence
aatcaggtggctggtgggga

SEQ ID NO: 34293 - DNA, 21 bp, Artificial sequence
  synthetic polynucleotide sequence
tgtggatgtcgactcggggaa

SEQ ID NO: 34294 - DNA, 20 bp, Artificial sequence
  synthetic polynucleotide sequence
catctccccccactgcagca

SEQ ID NO: 34295 - DNA, 19 bp, Artificial sequence
  synthetic polynucleotide sequence
ctggcggatgcggtcgtga

SEQ ID NO: 34296 - DNA, 21 bp, Artificial sequence
  synthetic polynucleotide sequence
ctaatcccatgccagaaccga

SEQ ID NO: 34297 - DNA, 19 bp, Artificial sequence
  synthetic polynucleotide sequence
gacggcaggatatgcgaca

SEQ ID NO: 34298 - DNA, 18 bp, Artificial sequence
  synthetic polynucleotide sequence
aactggtgatgagccgca

SEQ ID NO: 34299 - DNA, 20 bp, Artificial sequence
  synthetic polynucleotide sequence
gtcctggctgtcgaaaacca

SEQ ID NO: 34300 - DNA, 21 bp, Artificial sequence
  synthetic polynucleotide sequence
ggtccctgaaccaactaagca

SEQ ID NO: 34301 - DNA, 18 bp, Artificial sequence
  synthetic polynucleotide sequence
cgggatgtatcagcccca

SEQ ID NO: 34302 - DNA, 20 bp, Artificial sequence
  synthetic polynucleotide sequence
gtgtgccaggggtagaagga

SEQ ID NO: 34303 - DNA, 21 bp, Artificial sequence
  synthetic polynucleotide sequence
gggtgtactgggtaggcccaa

SEQ ID NO: 34304 - DNA, 21 bp, Artificial sequence
  synthetic polynucleotide sequence
ggtttggcacccttgaggaca

SEQ ID NO: 34305 - DNA, 21 bp, Artificial sequence
  synthetic polynucleotide sequence
agactggacagccactgccaa

SEQ ID NO: 34306 - DNA, 22 bp, Artificial sequence
  synthetic polynucleotide sequence
tatctagcaccataccccacga

SEQ ID NO: 34307 - DNA, 20 bp, Artificial sequence
  synthetic polynucleotide sequence
gaaccgggaccatgaggaca

SEQ ID NO: 34308 - DNA, 20 bp, Artificial sequence
  synthetic polynucleotide sequence
gaagcagcctggtcaccaga

SEQ ID NO: 34309 - DNA, 21 bp, Artificial sequence
  synthetic polynucleotide sequence
gcttcacgccacaaacgtgca

SEQ ID NO: 34310 - DNA, 22 bp, Artificial sequence
  synthetic polynucleotide sequence
aatgtcacagtctgggatgcca

SEQ ID NO: 34311 - DNA, 20 bp, Artificial sequence
  synthetic polynucleotide sequence
ccgccaccagctgttgcaga

SEQ ID NO: 34312 - DNA, 18 bp, Artificial sequence
  synthetic polynucleotide sequence
ggcagccggagcacagga

SEQ ID NO: 34313 - DNA, 21 bp, Artificial sequence
  synthetic polynucleotide sequence
gttagagaacgtcgcggagga

SEQ ID NO: 34314 - DNA, 18 bp, Artificial sequence
  synthetic polynucleotide sequence
ctcggctccgcgcggaga

SEQ ID NO: 34315 - DNA, 20 bp, Artificial sequence
  synthetic polynucleotide sequence
ggcatccggcatcacgggca

SEQ ID NO: 34316 - DNA, 20 bp, Artificial sequence
  synthetic polynucleotide sequence
gaggagcactgtccactgga

SEQ ID NO: 34317 - DNA, 19 bp, Artificial sequence
  synthetic polynucleotide sequence
ctgggacccccggccggaa

SEQ ID NO: 34318 - DNA, 20 bp, Artificial sequence
  synthetic polynucleotide sequence
tccccaatgcagagagccga

SEQ ID NO: 34319 - DNA, 20 bp, Artificial sequence
  synthetic polynucleotide sequence
ggcaggacccgcagagcaca

SEQ ID NO: 34320 - DNA, 20 bp, Artificial sequence
  synthetic polynucleotide sequence
gcggataccgcgactccgaa

SEQ ID NO: 34321 - DNA, 18 bp, Artificial sequence
  synthetic polynucleotide sequence
gagaacagcaacgcgcaa

SEQ ID NO: 34322 - DNA, 19 bp, Artificial sequence
  synthetic polynucleotide sequence
gagagcagagacccgtgga

SEQ ID NO: 34323 - DNA, 18 bp, Artificial sequence
  synthetic polynucleotide sequence
actgcctgcccgaaccaa

SEQ ID NO: 34324 - DNA, 20 bp, Artificial sequence
  synthetic polynucleotide sequence
gtgttcctcccatgagtcca

SEQ ID NO: 34325 - DNA, 19 bp, Artificial sequence
  synthetic polynucleotide sequence
ctgctccccacctcagaga

SEQ ID NO: 34326 - DNA, 20 bp, Artificial sequence
  synthetic polynucleotide sequence
cttaagggagggcttgcaga

SEQ ID NO: 34327 - DNA, 20 bp, Artificial sequence
  synthetic polynucleotide sequence
caactgccctcaaggtggca

SEQ ID NO: 34328 - DNA, 22 bp, Artificial sequence
  synthetic polynucleotide sequence
aagcagctggtccaagactgca

SEQ ID NO: 34329 - DNA, 18 bp, Artificial sequence
  synthetic polynucleotide sequence
tcaccgactccacaggga

SEQ ID NO: 34330 - DNA, 18 bp, Artificial sequence
  synthetic polynucleotide sequence
agagccaggctgggacga

SEQ ID NO: 34331 - DNA, 21 bp, Artificial sequence
  synthetic polynucleotide sequence
ccatcaagcagacacgcagca

SEQ ID NO: 34332 - DNA, 21 bp, Artificial sequence
  synthetic polynucleotide sequence
atggggagggagatctctcca

SEQ ID NO: 34333 - DNA, 21 bp, Artificial sequence
  synthetic polynucleotide sequence
ctgggcgtacagtgtgaagga

SEQ ID NO: 34334 - DNA, 22 bp, Artificial sequence
  synthetic polynucleotide sequence
caatttcggccctccatcagca

SEQ ID NO: 34335 - DNA, 20 bp, Artificial sequence
  synthetic polynucleotide sequence
gtggaggtcttcacggacca

SEQ ID NO: 34336 - DNA, 18 bp, Artificial sequence
  synthetic polynucleotide sequence
ccccgcagtgacccacga

SEQ ID NO: 34337 - DNA, 18 bp, Artificial sequence
  synthetic polynucleotide sequence
gagcatccaggagggcaa

SEQ ID NO: 34338 - DNA, 19 bp, Artificial sequence
  synthetic polynucleotide sequence
cctctgcaggaccatggga

SEQ ID NO: 34339 - DNA, 20 bp, Artificial sequence
  synthetic polynucleotide sequence
caatggatgctgcccagaga

SEQ ID NO: 34340 - DNA, 19 bp, Artificial sequence
  synthetic polynucleotide sequence
cctccatgcagatcccaca

SEQ ID NO: 34341 - DNA, 21 bp, Artificial sequence
  synthetic polynucleotide sequence
ccttccaggcaagccaggaca

SEQ ID NO: 34342 - DNA, 20 bp, Artificial sequence
  synthetic polynucleotide sequence
atcacacggcattctggaca

SEQ ID NO: 34343 - DNA, 21 bp, Artificial sequence
  synthetic polynucleotide sequence
acagcaactggacaagggtga

SEQ ID NO: 34344 - DNA, 21 bp, Artificial sequence
  synthetic polynucleotide sequence
ggggacagtcagtgacgtaga

SEQ ID NO: 34345 - DNA, 18 bp, Artificial sequence
  synthetic polynucleotide sequence
tgcagaccttgcacccca

SEQ ID NO: 34346 - DNA, 19 bp, Artificial sequence
  synthetic polynucleotide sequence
cctccatgcagatgccaca

SEQ ID NO: 34347 - DNA, 22 bp, Artificial sequence
  synthetic polynucleotide sequence
accaagtccctggcaatggaca

SEQ ID NO: 34348 - DNA, 19 bp, Artificial sequence
  synthetic polynucleotide sequence
cagctcagccaccgtgcca

SEQ ID NO: 34349 - DNA, 21 bp, Artificial sequence
  synthetic polynucleotide sequence
ggatcggcatcctgacagtga

SEQ ID NO: 34350 - DNA, 22 bp, Artificial sequence
  synthetic polynucleotide sequence
ataagcaggtggagcattggga

SEQ ID NO: 34351 - DNA, 20 bp, Artificial sequence
  synthetic polynucleotide sequence
acccgccagccataaaacca

SEQ ID NO: 34352 - DNA, 18 bp, Artificial sequence
  synthetic polynucleotide sequence
ctcctggccacctcccca

SEQ ID NO: 34353 - DNA, 20 bp, Artificial sequence
  synthetic polynucleotide sequence
gggcatagcacagctcacga

SEQ ID NO: 34354 - DNA, 18 bp, Artificial sequence
  synthetic polynucleotide sequence
tggacacctccccctgga

SEQ ID NO: 34355 - DNA, 20 bp, Artificial sequence
  synthetic polynucleotide sequence
gatgaggagtggcaaagtga

SEQ ID NO: 34356 - DNA, 18 bp, Artificial sequence
  synthetic polynucleotide sequence
cgggagccaggattctca

SEQ ID NO: 34357 - DNA, 18 bp, Artificial sequence
  synthetic polynucleotide sequence
tccgggagacacggagga

SEQ ID NO: 34358 - DNA, 18 bp, Artificial sequence
  synthetic polynucleotide sequence
gagcgctggaggatgtga

SEQ ID NO: 34359 - DNA, 20 bp, Artificial sequence
  synthetic polynucleotide sequence
ctacttccagcaaccccaga

SEQ ID NO: 34360 - DNA, 18 bp, Artificial sequence
  synthetic polynucleotide sequence
gccaaggcccactgagga

SEQ ID NO: 34361 - DNA, 18 bp, Artificial sequence
  synthetic polynucleotide sequence
tccagaccaccggaggca

SEQ ID NO: 34362 - DNA, 18 bp, Artificial sequence
  synthetic polynucleotide sequence
ctggaatggcagctggca

SEQ ID NO: 34363 - DNA, 21 bp, Artificial sequence
  synthetic polynucleotide sequence
agtcactgctgcatccacaga

SEQ ID NO: 34364 - DNA, 21 bp, Artificial sequence
  synthetic polynucleotide sequence
gtgactgaggagggtgtgaga

SEQ ID NO: 34365 - DNA, 21 bp, Artificial sequence
  synthetic polynucleotide sequence
ctgggaaatcgccactggaga

SEQ ID NO: 34366 - DNA, 18 bp, Artificial sequence
  synthetic polynucleotide sequence
gggatcatgggcccggca

SEQ ID NO: 34367 - DNA, 20 bp, Artificial sequence
  synthetic polynucleotide sequence
cccgtccaactccagctcca

SEQ ID NO: 34368 - DNA, 20 bp, Artificial sequence
  synthetic polynucleotide sequence
ctcggactgcaggtcctcca

SEQ ID NO: 34369 - DNA, 20 bp, Artificial sequence
  synthetic polynucleotide sequence
cggctcaacaaggctcagga

SEQ ID NO: 34370 - DNA, 20 bp, Artificial sequence
  synthetic polynucleotide sequence
caggagtctgcataacccca

SEQ ID NO: 34371 - DNA, 21 bp, Artificial sequence
  synthetic polynucleotide sequence
agaccaggagaaaaaccctga

SEQ ID NO: 34372 - DNA, 21 bp, Artificial sequence
  synthetic polynucleotide sequence
gagcaagtccagttcgaagga

SEQ ID NO: 34373 - DNA, 19 bp, Artificial sequence
  synthetic polynucleotide sequence
tctagcgcaccaccactga

SEQ ID NO: 34374 - DNA, 22 bp, Artificial sequence
  synthetic polynucleotide sequence
atggtgtgaagctggagctgga

SEQ ID NO: 34375 - DNA, 19 bp, Artificial sequence
  synthetic polynucleotide sequence
cccttactaggggcaggca

SEQ ID NO: 34376 - DNA, 21 bp, Artificial sequence
  synthetic polynucleotide sequence
aaaggtagagccagccagaga

SEQ ID NO: 34377 - DNA, 23 bp, Artificial sequence
  synthetic polynucleotide sequence
cataaacacggaagattcgcgga

SEQ ID NO: 34378 - DNA, 19 bp, Artificial sequence
  synthetic polynucleotide sequence
ccctgcaacttcccccgca

SEQ ID NO: 34379 - DNA, 19 bp, Artificial sequence
  synthetic polynucleotide sequence
cggcctcagaagtccagca

SEQ ID NO: 34380 - DNA, 18 bp, Artificial sequence
  synthetic polynucleotide sequence
tcccagccactcgaggga

SEQ ID NO: 34381 - DNA, 21 bp, Artificial sequence
  synthetic polynucleotide sequence
ccctgatgacggagctgagca

SEQ ID NO: 34382 - DNA, 21 bp, Artificial sequence
  synthetic polynucleotide sequence
ctctccagtctccacacacca

SEQ ID NO: 34383 - DNA, 20 bp, Artificial sequence
  synthetic polynucleotide sequence
gcacaccaggacaaccccca

SEQ ID NO: 34384 - DNA, 20 bp, Artificial sequence
  synthetic polynucleotide sequence
acacgctgacagctcctgga

SEQ ID NO: 34385 - DNA, 21 bp, Artificial sequence
  synthetic polynucleotide sequence
tgaaaacccggaccttgcaga

SEQ ID NO: 34386 - DNA, 21 bp, Artificial sequence
  synthetic polynucleotide sequence
tcaataccatcggcctgagga

SEQ ID NO: 34387 - DNA, 18 bp, Artificial sequence
  synthetic polynucleotide sequence
gaacccgtacgctgcaca

SEQ ID NO: 34388 - DNA, 18 bp, Artificial sequence
  synthetic polynucleotide sequence
gagagcgggcagagagca

SEQ ID NO: 34389 - DNA, 20 bp, Artificial sequence
  synthetic polynucleotide sequence
ccattgccatcccaggggga

SEQ ID NO: 34390 - DNA, 23 bp, Artificial sequence
  synthetic polynucleotide sequence
cggctaaagcaaccatcgccgca

SEQ ID NO: 34391 - DNA, 21 bp, Artificial sequence
  synthetic polynucleotide sequence
gaggcgtgacaaggaccacaa

SEQ ID NO: 34392 - DNA, 22 bp, Artificial sequence
  synthetic polynucleotide sequence
gtcaaccatgtcagcaacagca

SEQ ID NO: 34393 - DNA, 20 bp, Artificial sequence
  synthetic polynucleotide sequence
atccagtgcacattgcagga

SEQ ID NO: 34394 - DNA, 18 bp, Artificial sequence
  synthetic polynucleotide sequence
gcaggatgaaggccgtga

SEQ ID NO: 34395 - DNA, 21 bp, Artificial sequence
  synthetic polynucleotide sequence
ctcagccctcagagaagccta

SEQ ID NO: 34396 - DNA, 20 bp, Artificial sequence
  synthetic polynucleotide sequence
ccaggggatgcaggtggtga

SEQ ID NO: 34397 - DNA, 22 bp, Artificial sequence
  synthetic polynucleotide sequence
aagtgccagagtagagtgtgca

SEQ ID NO: 34398 - DNA, 22 bp, Artificial sequence
  synthetic polynucleotide sequence
ataaccctcagctcgaagagca

SEQ ID NO: 34399 - DNA, 18 bp, Artificial sequence
  synthetic polynucleotide sequence
atggccgctacaagccaa

SEQ ID NO: 34400 - DNA, 20 bp, Artificial sequence
  synthetic polynucleotide sequence
gaaacgatgaagagggcaca

SEQ ID NO: 34401 - DNA, 19 bp, Artificial sequence
  synthetic polynucleotide sequence
cggccaactgtgccaccca

SEQ ID NO: 34402 - DNA, 19 bp, Artificial sequence
  synthetic polynucleotide sequence
tcagccagggtgcgtagga

SEQ ID NO: 34403 - DNA, 21 bp, Artificial sequence
  synthetic polynucleotide sequence
cataggacacgaaatcaccca

SEQ ID NO: 34404 - DNA, 18 bp, Artificial sequence
  synthetic polynucleotide sequence
acctgccaggtcccagga

SEQ ID NO: 34405 - DNA, 21 bp, Artificial sequence
  synthetic polynucleotide sequence
tcacgcacggctttgacgaca

SEQ ID NO: 34406 - DNA, 19 bp, Artificial sequence
  synthetic polynucleotide sequence
cgtctgccaggtcccagga

SEQ ID NO: 34407 - DNA, 23 bp, Artificial sequence
  synthetic polynucleotide sequence
ccaaatactgtgcagccgcagaa

SEQ ID NO: 34408 - DNA, 21 bp, Artificial sequence
  synthetic polynucleotide sequence
tcaagccactgagaagccaca

SEQ ID NO: 34409 - DNA, 19 bp, Artificial sequence
  synthetic polynucleotide sequence
gcccaggtattggagggga

SEQ ID NO: 34410 - DNA, 21 bp, Artificial sequence
  synthetic polynucleotide sequence
tgagctagctgaacatcacca

SEQ ID NO: 34411 - DNA, 21 bp, Artificial sequence
  synthetic polynucleotide sequence
ttgggttggaggtgacaggga

SEQ ID NO: 34412 - DNA, 20 bp, Artificial sequence
  synthetic polynucleotide sequence
ccacttcggcatgccaggaa

SEQ ID NO: 34413 - DNA, 18 bp, Artificial sequence
  synthetic polynucleotide sequence
tctcgccactggcaggga

SEQ ID NO: 34414 - DNA, 18 bp, Artificial sequence
  synthetic polynucleotide sequence
tctcgggaccccagacca

SEQ ID NO: 34415 - DNA, 20 bp, Artificial sequence
  synthetic polynucleotide sequence
ctagtgatccaaaggccgta

SEQ ID NO: 34416 - DNA, 22 bp, Artificial sequence
  synthetic polynucleotide sequence
tccatacagggactgaatgcca

SEQ ID NO: 34417 - DNA, 22 bp, Artificial sequence
  synthetic polynucleotide sequence
ctgagaggctccgagaaatgca

SEQ ID NO: 34418 - DNA, 21 bp, Artificial sequence
  synthetic polynucleotide sequence
acccacatcaggaaccccgca

SEQ ID NO: 34419 - DNA, 19 bp, Artificial sequence
  synthetic polynucleotide sequence
cctggctaccccaagcaca

SEQ ID NO: 34420 - DNA, 20 bp, Artificial sequence
  synthetic polynucleotide sequence
ctcagggatcccttcccaga

SEQ ID NO: 34421 - DNA, 20 bp, Artificial sequence
  synthetic polynucleotide sequence
gggctggagcactccagcaa

SEQ ID NO: 34422 - DNA, 20 bp, Artificial sequence
  synthetic polynucleotide sequence
gagctgctggatgccacgga

SEQ ID NO: 34423 - DNA, 18 bp, Artificial sequence
  synthetic polynucleotide sequence
ccaatgaccccactgcca

SEQ ID NO: 34424 - DNA, 18 bp, Artificial sequence
  synthetic polynucleotide sequence
tagagcggtgtgggggca

SEQ ID NO: 34425 - DNA, 18 bp, Artificial sequence
  synthetic polynucleotide sequence
ggcgctacgatgaccaca

SEQ ID NO: 34426 - DNA, 18 bp, Artificial sequence
  synthetic polynucleotide sequence
ccagctcgccatccagca

SEQ ID NO: 34427 - DNA, 18 bp, Artificial sequence
  synthetic polynucleotide sequence
ctggcgcctcaaccagca

SEQ ID NO: 34428 - DNA, 18 bp, Artificial sequence
  synthetic polynucleotide sequence
atgcccgtacctgaggga

SEQ ID NO: 34429 - DNA, 18 bp, Artificial sequence
  synthetic polynucleotide sequence
accccaagccactgacca

SEQ ID NO: 34430 - DNA, 18 bp, Artificial sequence
  synthetic polynucleotide sequence
tgcaggtccacgacggca

SEQ ID NO: 34431 - DNA, 18 bp, Artificial sequence
  synthetic polynucleotide sequence
caggaattcggcccagca

SEQ ID NO: 34432 - DNA, 18 bp, Artificial sequence
  synthetic polynucleotide sequence
cagtgcccctctcagcca

SEQ ID NO: 34433 - DNA, 20 bp, Artificial sequence
  synthetic polynucleotide sequence
cgggcgctcatgcacctgaa

SEQ ID NO: 34434 - DNA, 20 bp, Artificial sequence
  synthetic polynucleotide sequence
gcacacgaacagcctgtcga

SEQ ID NO: 34435 - DNA, 20 bp, Artificial sequence
  synthetic polynucleotide sequence
gaggtggagcggcggaagga

SEQ ID NO: 34436 - DNA, 19 bp, Artificial sequence
  synthetic polynucleotide sequence
caggggatgaccacggcca

SEQ ID NO: 34437 - DNA, 18 bp, Artificial sequence
  synthetic polynucleotide sequence
ggtgttccaggaccggca

SEQ ID NO: 34438 - DNA, 18 bp, Artificial sequence
  synthetic polynucleotide sequence
acgagaacacggcgtcca

SEQ ID NO: 34439 - DNA, 21 bp, Artificial sequence
  synthetic polynucleotide sequence
ctgaccaagaaggagtcgcca

SEQ ID NO: 34440 - DNA, 20 bp, Artificial sequence
  synthetic polynucleotide sequence
agtggggctggtgtagcaga

SEQ ID NO: 34441 - DNA, 21 bp, Artificial sequence
  synthetic polynucleotide sequence
gacaaagggttcccgcagaga

SEQ ID NO: 34442 - DNA, 25 bp, Artificial sequence
  synthetic polynucleotide sequence
tactggaaagcagcatcaacacgga

SEQ ID NO: 34443 - DNA, 18 bp, Artificial sequence
  synthetic polynucleotide sequence
ccaaagctcccacctcca

SEQ ID NO: 34444 - DNA, 18 bp, Artificial sequence
  synthetic polynucleotide sequence
gacgagtcatctggcgca

SEQ ID NO: 34445 - DNA, 18 bp, Artificial sequence
  synthetic polynucleotide sequence
ggcgcaaatccctcagga

SEQ ID NO: 34446 - DNA, 18 bp, Artificial sequence
  synthetic polynucleotide sequence
tgcggcatccacgcctga

SEQ ID NO: 34447 - DNA, 21 bp, Artificial sequence
  synthetic polynucleotide sequence
gggcaaagagatccccctgca

SEQ ID NO: 34448 - DNA, 20 bp, Artificial sequence
  synthetic polynucleotide sequence
cgagacctgtcccaggcgca

SEQ ID NO: 34449 - DNA, 20 bp, Artificial sequence
  synthetic polynucleotide sequence
caggccaaggtattggagga

SEQ ID NO: 34450 - DNA, 19 bp, Artificial sequence
  synthetic polynucleotide sequence
catcaaggcaccagggtca

SEQ ID NO: 34451 - DNA, 20 bp, Artificial sequence
  synthetic polynucleotide sequence
gcagatggtggatccccgga

SEQ ID NO: 34452 - DNA, 21 bp, Artificial sequence
  synthetic polynucleotide sequence
ccagtagaagcggtcctggca

SEQ ID NO: 34453 - DNA, 20 bp, Artificial sequence
  synthetic polynucleotide sequence
atgtcccaggtgggaaagga

SEQ ID NO: 34454 - DNA, 19 bp, Artificial sequence
  synthetic polynucleotide sequence
cggcccactgtatccagga

SEQ ID NO: 34455 - DNA, 18 bp, Artificial sequence
  synthetic polynucleotide sequence
tcagcgcagcttggagca

SEQ ID NO: 34456 - DNA, 18 bp, Artificial sequence
  synthetic polynucleotide sequence
cccaaggcacctggcaca

SEQ ID NO: 34457 - DNA, 18 bp, Artificial sequence
  synthetic polynucleotide sequence
ccgagcagattccagcca

SEQ ID NO: 34458 - DNA, 18 bp, Artificial sequence
  synthetic polynucleotide sequence
ttcgaggcagggagcaga

SEQ ID NO: 34459 - DNA, 20 bp, Artificial sequence
  synthetic polynucleotide sequence
cttacgggaacgtccagaca

SEQ ID NO: 34460 - DNA, 18 bp, Artificial sequence
  synthetic polynucleotide sequence
gtcagctgcagccctgca

SEQ ID NO: 34461 - DNA, 18 bp, Artificial sequence
  synthetic polynucleotide sequence
ggagaaggccaaacccca

SEQ ID NO: 34462 - DNA, 18 bp, Artificial sequence
  synthetic polynucleotide sequence
agaatgcagggaccgcca

SEQ ID NO: 34463 - DNA, 21 bp, Artificial sequence
  synthetic polynucleotide sequence
cagccactgcagatagagaca

SEQ ID NO: 34464 - DNA, 18 bp, Artificial sequence
  synthetic polynucleotide sequence
ggctgccagaaaagccca

SEQ ID NO: 34465 - DNA, 22 bp, Artificial sequence
  synthetic polynucleotide sequence
agccaaagaagctgctaacaga

SEQ ID NO: 34466 - DNA, 22 bp, Artificial sequence
  synthetic polynucleotide sequence
acacagttacaggcaaacgaca

SEQ ID NO: 34467 - DNA, 18 bp, Artificial sequence
  synthetic polynucleotide sequence
cacctgcacccaccgcaa

SEQ ID NO: 34468 - DNA, 19 bp, Artificial sequence
  synthetic polynucleotide sequence
gggatgatccacagctgca

SEQ ID NO: 34469 - DNA, 18 bp, Artificial sequence
  synthetic polynucleotide sequence
cagcaaaggcggcaagga

SEQ ID NO: 34470 - DNA, 22 bp, Artificial sequence
  synthetic polynucleotide sequence
cctgaactcttcaccaagcaga

SEQ ID NO: 34471 - DNA, 20 bp, Artificial sequence
  synthetic polynucleotide sequence
caccctgccaccctcaacca

SEQ ID NO: 34472 - DNA, 18 bp, Artificial sequence
  synthetic polynucleotide sequence
gcaccacctgagccccca

SEQ ID NO: 34473 - DNA, 18 bp, Artificial sequence
  synthetic polynucleotide sequence
gctggagctggagcacca

SEQ ID NO: 34474 - DNA, 18 bp, Artificial sequence
  synthetic polynucleotide sequence
ctcggtgagcatgagcga

SEQ ID NO: 34475 - DNA, 22 bp, Artificial sequence
  synthetic polynucleotide sequence
gaatttttagcgggagagggca

SEQ ID NO: 34476 - DNA, 20 bp, Artificial sequence
  synthetic polynucleotide sequence
tgtgccaacataggggccca

SEQ ID NO: 34477 - DNA, 20 bp, Artificial sequence
  synthetic polynucleotide sequence
atgttgcctgagggagagga

SEQ ID NO: 34478 - DNA, 21 bp, Artificial sequence
  synthetic polynucleotide sequence
ggacctgcagacatgactgga

SEQ ID NO: 34479 - DNA, 21 bp, Artificial sequence
  synthetic polynucleotide sequence
cagtgatgtcagctggcccaa

SEQ ID NO: 34480 - DNA, 22 bp, Artificial sequence
  synthetic polynucleotide sequence
attctttgggaacgggacacca

SEQ ID NO: 34481 - DNA, 23 bp, Artificial sequence
  synthetic polynucleotide sequence
aaaatacggcagagaattcccca

SEQ ID NO: 34482 - DNA, 18 bp, Artificial sequence
  synthetic polynucleotide sequence
cgtgcagctccagggcca

SEQ ID NO: 34483 - DNA, 20 bp, Artificial sequence
  synthetic polynucleotide sequence
gtgcacgtctacatccacca

SEQ ID NO: 34484 - DNA, 20 bp, Artificial sequence
  synthetic polynucleotide sequence
cttggtgtcgatgaggccga

SEQ ID NO: 34485 - DNA, 23 bp, Artificial sequence
  synthetic polynucleotide sequence
aaatatgagtatcggtggcagga

SEQ ID NO: 34486 - DNA, 20 bp, Artificial sequence
  synthetic polynucleotide sequence
gacccggtcgaagtggtgga

SEQ ID NO: 34487 - DNA, 22 bp, Artificial sequence
  synthetic polynucleotide sequence
cgaaggcctcatcaacgacgaa

SEQ ID NO: 34488 - DNA, 21 bp, Artificial sequence
  synthetic polynucleotide sequence
ccaccagactgaactcgcgga

SEQ ID NO: 34489 - DNA, 20 bp, Artificial sequence
  synthetic polynucleotide sequence
gaaccacctgaaggccaaga

SEQ ID NO: 34490 - DNA, 20 bp, Artificial sequence
  synthetic polynucleotide sequence
tcagaagacatgcagcacca

SEQ ID NO: 34491 - DNA, 19 bp, Artificial sequence
  synthetic polynucleotide sequence
ggccaaggagggtcccaga

SEQ ID NO: 34492 - DNA, 19 bp, Artificial sequence
  synthetic polynucleotide sequence
ggcaggcgcagcagatcca

SEQ ID NO: 34493 - DNA, 20 bp, Artificial sequence
  synthetic polynucleotide sequence
gaccaggtggcctgtaggaa

SEQ ID NO: 34494 - DNA, 18 bp, Artificial sequence
  synthetic polynucleotide sequence
gaagggctggatcaggca

SEQ ID NO: 34495 - DNA, 18 bp, Artificial sequence
  synthetic polynucleotide sequence
cctgcaaccgcctgcgaa

SEQ ID NO: 34496 - DNA, 18 bp, Artificial sequence
  synthetic polynucleotide sequence
ctgcccacagcagcccca

SEQ ID NO: 34497 - DNA, 21 bp, Artificial sequence
  synthetic polynucleotide sequence
ttccagtgtcagaagcaagca

SEQ ID NO: 34498 - DNA, 23 bp, Artificial sequence
  synthetic polynucleotide sequence
gcatagctcacagcttcaagaga

SEQ ID NO: 34499 - DNA, 21 bp, Artificial sequence
  synthetic polynucleotide sequence
ggaacggcccactgtgactga

SEQ ID NO: 34500 - DNA, 21 bp, Artificial sequence
  synthetic polynucleotide sequence
agcaacaggtggaatgcccca

SEQ ID NO: 34501 - DNA, 20 bp, Artificial sequence
  synthetic polynucleotide sequence
aagaggaggcagcaatggaa

SEQ ID NO: 34502 - DNA, 20 bp, Artificial sequence
  synthetic polynucleotide sequence
tctgtactgcaggcagagga

SEQ ID NO: 34503 - DNA, 22 bp, Artificial sequence
  synthetic polynucleotide sequence
gtaagcaaggagggaggtggaa

SEQ ID NO: 34504 - DNA, 23 bp, Artificial sequence
  synthetic polynucleotide sequence
caaaagaaaccactgggaccaga

SEQ ID NO: 34505 - DNA, 21 bp, Artificial sequence
  synthetic polynucleotide sequence
cgaggtacagaagacgctgca

SEQ ID NO: 34506 - DNA, 20 bp, Artificial sequence
  synthetic polynucleotide sequence
ggcctcgaagaggttgcaca

SEQ ID NO: 34507 - DNA, 18 bp, Artificial sequence
  synthetic polynucleotide sequence
gcgcccaccctcatggga

SEQ ID NO: 34508 - DNA, 20 bp, Artificial sequence
  synthetic polynucleotide sequence
ccagccagcacggctaacca

SEQ ID NO: 34509 - DNA, 21 bp, Artificial sequence
  synthetic polynucleotide sequence
agagagcctggatgagctgca

SEQ ID NO: 34510 - DNA, 21 bp, Artificial sequence
  synthetic polynucleotide sequence
tgtcggctagaatgtccagca

SEQ ID NO: 34511 - DNA, 21 bp, Artificial sequence
  synthetic polynucleotide sequence
atggaagagtgccggtgctga

SEQ ID NO: 34512 - DNA, 20 bp, Artificial sequence
  synthetic polynucleotide sequence
gcactatggtgggcaggcga

SEQ ID NO: 34513 - DNA, 21 bp, Artificial sequence
  synthetic polynucleotide sequence
caccagtgaagaggagcagga

SEQ ID NO: 34514 - DNA, 20 bp, Artificial sequence
  synthetic polynucleotide sequence
tcaaaggcgcctgtcaccca

SEQ ID NO: 34515 - DNA, 21 bp, Artificial sequence
  synthetic polynucleotide sequence
cacgtggctgagaaggagaca

SEQ ID NO: 34516 - DNA, 19 bp, Artificial sequence
  synthetic polynucleotide sequence
ttcttcacccagcgcagga

SEQ ID NO: 34517 - DNA, 18 bp, Artificial sequence
  synthetic polynucleotide sequence
ggcagcacagcaaaagca

SEQ ID NO: 34518 - DNA, 18 bp, Artificial sequence
  synthetic polynucleotide sequence
gcaggacggggatccaca

SEQ ID NO: 34519 - DNA, 22 bp, Artificial sequence
  synthetic polynucleotide sequence
gaattccagtagctctgccaga

SEQ ID NO: 34520 - DNA, 18 bp, Artificial sequence
  synthetic polynucleotide sequence
caagaagcggcctgggca

SEQ ID NO: 34521 - DNA, 21 bp, Artificial sequence
  synthetic polynucleotide sequence
agacagtgctggggaagagga

SEQ ID NO: 34522 - DNA, 21 bp, Artificial sequence
  synthetic polynucleotide sequence
acttcaccttccaccgcacca

SEQ ID NO: 34523 - DNA, 20 bp, Artificial sequence
  synthetic polynucleotide sequence
ctactagtcacacctggcca

SEQ ID NO: 34524 - DNA, 22 bp, Artificial sequence
  synthetic polynucleotide sequence
catagaacccgacttgaagcca

SEQ ID NO: 34525 - DNA, 21 bp, Artificial sequence
  synthetic polynucleotide sequence
tacagtacccaggaggcggaa

SEQ ID NO: 34526 - DNA, 21 bp, Artificial sequence
  synthetic polynucleotide sequence
gaagctccaagtgagggagga

SEQ ID NO: 34527 - DNA, 18 bp, Artificial sequence
  synthetic polynucleotide sequence
gcgccacatctcctgaga

SEQ ID NO: 34528 - DNA, 20 bp, Artificial sequence
  synthetic polynucleotide sequence
tccgatggtactcaggagga

SEQ ID NO: 34529 - DNA, 22 bp, Artificial sequence
  synthetic polynucleotide sequence
acctcgtggacagcaatctgca

SEQ ID NO: 34530 - DNA, 21 bp, Artificial sequence
  synthetic polynucleotide sequence
gggttctctgcagagcgacca

SEQ ID NO: 34531 - DNA, 22 bp, Artificial sequence
  synthetic polynucleotide sequence
aggaccacggggaaattgccaa

SEQ ID NO: 34532 - DNA, 23 bp, Artificial sequence
  synthetic polynucleotide sequence
gataagggatgcattcgaaccca

SEQ ID NO: 34533 - DNA, 23 bp, Artificial sequence
  synthetic polynucleotide sequence
cacaggaagctggaaagatgaca

SEQ ID NO: 34534 - DNA, 20 bp, Artificial sequence
  synthetic polynucleotide sequence
agtccccagtccatgaaaca

SEQ ID NO: 34535 - DNA, 21 bp, Artificial sequence
  synthetic polynucleotide sequence
caaatgcgggacgatgatcga

SEQ ID NO: 34536 - DNA, 20 bp, Artificial sequence
  synthetic polynucleotide sequence
catggccaaggcctccgcca

SEQ ID NO: 34537 - DNA, 22 bp, Artificial sequence
  synthetic polynucleotide sequence
aatatcgtggcgagtggaagga

SEQ ID NO: 34538 - DNA, 22 bp, Artificial sequence
  synthetic polynucleotide sequence
tcgaatgaagactccgacgcca

SEQ ID NO: 34539 - DNA, 21 bp, Artificial sequence
  synthetic polynucleotide sequence
ccccagcggaagccaatacga

SEQ ID NO: 34540 - DNA, 22 bp, Artificial sequence
  synthetic polynucleotide sequence
catagccgtcgcagtaatgcca

SEQ ID NO: 34541 - DNA, 20 bp, Artificial sequence
  synthetic polynucleotide sequence
ctaggaggcacatacaccca

SEQ ID NO: 34542 - DNA, 18 bp, Artificial sequence
  synthetic polynucleotide sequence
ctcgaagacggcagcgga

SEQ ID NO: 34543 - DNA, 22 bp, Artificial sequence
  synthetic polynucleotide sequence
tagggtctcacagaagagagga

SEQ ID NO: 34544 - DNA, 21 bp, Artificial sequence
  synthetic polynucleotide sequence
aggtaaagccagggtgaacca

SEQ ID NO: 34545 - DNA, 20 bp, Artificial sequence
  synthetic polynucleotide sequence
ctacacatcagcccagcaga

SEQ ID NO: 34546 - DNA, 22 bp, Artificial sequence
  synthetic polynucleotide sequence
agaaaacggtcttgggcagaga

SEQ ID NO: 34547 - DNA, 19 bp, Artificial sequence
  synthetic polynucleotide sequence
tcagggacagccagatcca

SEQ ID NO: 34548 - DNA, 19 bp, Artificial sequence
  synthetic polynucleotide sequence
ctgccgagttcgtccggga

SEQ ID NO: 34549 - DNA, 18 bp, Artificial sequence
  synthetic polynucleotide sequence
gcacttgcccaaagccca

SEQ ID NO: 34550 - DNA, 20 bp, Artificial sequence
  synthetic polynucleotide sequence
gtcctcaggtaccatgcgga

SEQ ID NO: 34551 - DNA, 18 bp, Artificial sequence
  synthetic polynucleotide sequence
tggtgtgcggggcagcga

SEQ ID NO: 34552 - DNA, 21 bp, Artificial sequence
  synthetic polynucleotide sequence
atgacgccaatgtcgctggca

SEQ ID NO: 34553 - DNA, 20 bp, Artificial sequence
  synthetic polynucleotide sequence
cacgagtgctatcaccccaa

SEQ ID NO: 34554 - DNA, 18 bp, Artificial sequence
  synthetic polynucleotide sequence
ccagcctcaatcacccca

SEQ ID NO: 34555 - DNA, 18 bp, Artificial sequence
  synthetic polynucleotide sequence
atcagtgggcggatgaca

SEQ ID NO: 34556 - DNA, 20 bp, Artificial sequence
  synthetic polynucleotide sequence
caaacagaagccagttccga

SEQ ID NO: 34557 - DNA, 20 bp, Artificial sequence
  synthetic polynucleotide sequence
ctaccgcgtacagcctcgaa

SEQ ID NO: 34558 - DNA, 20 bp, Artificial sequence
  synthetic polynucleotide sequence
ggcctgcacactctgcgcca

SEQ ID NO: 34559 - DNA, 19 bp, Artificial sequence
  synthetic polynucleotide sequence
tgaggccgttgtacaacca

SEQ ID NO: 34560 - DNA, 20 bp, Artificial sequence
  synthetic polynucleotide sequence
atatcagccaatccagcaca

SEQ ID NO: 34561 - DNA, 21 bp, Artificial sequence
  synthetic polynucleotide sequence
tgatgctccagacgatcacca

SEQ ID NO: 34562 - DNA, 20 bp, Artificial sequence
  synthetic polynucleotide sequence
ggagcccccaaacagcagga

SEQ ID NO: 34563 - DNA, 22 bp, Artificial sequence
  synthetic polynucleotide sequence
tggagttgcagcacagacccaa

SEQ ID NO: 34564 - DNA, 21 bp, Artificial sequence
  synthetic polynucleotide sequence
tcacgtctcctccagcaacca

SEQ ID NO: 34565 - DNA, 20 bp, Artificial sequence
  synthetic polynucleotide sequence
cacgtcaccaccagtgtcga

SEQ ID NO: 34566 - DNA, 20 bp, Artificial sequence
  synthetic polynucleotide sequence
cagcagaggcggtcacggca

SEQ ID NO: 34567 - DNA, 18 bp, Artificial sequence
  synthetic polynucleotide sequence
gcaccctccggaaaggca

SEQ ID NO: 34568 - DNA, 18 bp, Artificial sequence
  synthetic polynucleotide sequence
tcactgggctccagggga

SEQ ID NO: 34569 - DNA, 18 bp, Artificial sequence
  synthetic polynucleotide sequence
cggaagtcggcaaagcca

SEQ ID NO: 34570 - DNA, 18 bp, Artificial sequence
  synthetic polynucleotide sequence
gcaaggggcttccatgga

SEQ ID NO: 34571 - DNA, 22 bp, Artificial sequence
  synthetic polynucleotide sequence
gccagaaagagagaccatgcca

SEQ ID NO: 34572 - DNA, 18 bp, Artificial sequence
  synthetic polynucleotide sequence
ccaagcacccctgggcca

SEQ ID NO: 34573 - DNA, 22 bp, Artificial sequence
  synthetic polynucleotide sequence
gaaacaccagagacgaaacgga

SEQ ID NO: 34574 - DNA, 21 bp, Artificial sequence
  synthetic polynucleotide sequence
ccaactgcaggtccatgccca

SEQ ID NO: 34575 - DNA, 23 bp, Artificial sequence
  synthetic polynucleotide sequence
gaaatgtccacgtcacaaccaga

SEQ ID NO: 34576 - DNA, 21 bp, Artificial sequence
  synthetic polynucleotide sequence
ctacaagtgactcagccggca

SEQ ID NO: 34577 - DNA, 20 bp, Artificial sequence
  synthetic polynucleotide sequence
ctcccaacacggagtcagga

SEQ ID NO: 34578 - DNA, 18 bp, Artificial sequence
  synthetic polynucleotide sequence
ccaatgaagagcacgcca

SEQ ID NO: 34579 - DNA, 18 bp, Artificial sequence
  synthetic polynucleotide sequence
acctggaccaggaaccga

SEQ ID NO: 34580 - DNA, 20 bp, Artificial sequence
  synthetic polynucleotide sequence
ctgcatagatggtggaggca

SEQ ID NO: 34581 - DNA, 18 bp, Artificial sequence
  synthetic polynucleotide sequence
ctagggtggagaccgcca

SEQ ID NO: 34582 - DNA, 20 bp, Artificial sequence
  synthetic polynucleotide sequence
gtctggaagtgagggccaca

SEQ ID NO: 34583 - DNA, 20 bp, Artificial sequence
  synthetic polynucleotide sequence
agcagtcactctccgcgaca

SEQ ID NO: 34584 - DNA, 18 bp, Artificial sequence
  synthetic polynucleotide sequence
gccctggggagtagccga

SEQ ID NO: 34585 - DNA, 21 bp, Artificial sequence
  synthetic polynucleotide sequence
tcccgagcaaaggcccagtga

SEQ ID NO: 34586 - DNA, 20 bp, Artificial sequence
  synthetic polynucleotide sequence
gtagaactccaccagcagca

SEQ ID NO: 34587 - DNA, 18 bp, Artificial sequence
  synthetic polynucleotide sequence
cgagcctctgaagcgcaa

SEQ ID NO: 34588 - DNA, 18 bp, Artificial sequence
  synthetic polynucleotide sequence
accgatcaccatcccgga

SEQ ID NO: 34589 - DNA, 18 bp, Artificial sequence
  synthetic polynucleotide sequence
ctcctagcgaagccccga

SEQ ID NO: 34590 - DNA, 21 bp, Artificial sequence
  synthetic polynucleotide sequence
gtatatgggacagggtacaca

SEQ ID NO: 34591 - DNA, 18 bp, Artificial sequence
  synthetic polynucleotide sequence
tgggcgctacctggagca

SEQ ID NO: 34592 - DNA, 18 bp, Artificial sequence
  synthetic polynucleotide sequence
tgacatccagcacgcaca

SEQ ID NO: 34593 - DNA, 22 bp, Artificial sequence
  synthetic polynucleotide sequence
aaaaacgccacctatgtcccca

SEQ ID NO: 34594 - DNA, 20 bp, Artificial sequence
  synthetic polynucleotide sequence
caccagcacggcgtctacca

SEQ ID NO: 34595 - DNA, 20 bp, Artificial sequence
  synthetic polynucleotide sequence
ccggcagctgctacagtgca

SEQ ID NO: 34596 - DNA, 20 bp, Artificial sequence
  synthetic polynucleotide sequence
tccaacaccagagggtccca

SEQ ID NO: 34597 - DNA, 22 bp, Artificial sequence
  synthetic polynucleotide sequence
agatggagcagaacaatggcca

SEQ ID NO: 34598 - DNA, 21 bp, Artificial sequence
  synthetic polynucleotide sequence
cagccaagtggatggtaccca

SEQ ID NO: 34599 - DNA, 22 bp, Artificial sequence
  synthetic polynucleotide sequence
attcacctccatcaagcccaga

SEQ ID NO: 34600 - DNA, 22 bp, Artificial sequence
  synthetic polynucleotide sequence
tctatcattcccccatggagga

SEQ ID NO: 34601 - DNA, 21 bp, Artificial sequence
  synthetic polynucleotide sequence
catgagaggaggagctgcaga

SEQ ID NO: 34602 - DNA, 21 bp, Artificial sequence
  synthetic polynucleotide sequence
ttgctccctgagactgagcca

SEQ ID NO: 34603 - DNA, 18 bp, Artificial sequence
  synthetic polynucleotide sequence
gccgagtccccgagctca

SEQ ID NO: 34604 - DNA, 21 bp, Artificial sequence
  synthetic polynucleotide sequence
atcctcacgtgggaggtagca

SEQ ID NO: 34605 - DNA, 18 bp, Artificial sequence
  synthetic polynucleotide sequence
tgctcaacacggtgcaga

SEQ ID NO: 34606 - DNA, 19 bp, Artificial sequence
  synthetic polynucleotide sequence
cacagtgcatacggacgca

SEQ ID NO: 34607 - DNA, 18 bp, Artificial sequence
  synthetic polynucleotide sequence
acctcatccctgagggca

SEQ ID NO: 34608 - DNA, 18 bp, Artificial sequence
  synthetic polynucleotide sequence
acagctccacacagccca

SEQ ID NO: 34609 - DNA, 20 bp, Artificial sequence
  synthetic polynucleotide sequence
aacggaagcactgggggaga

SEQ ID NO: 34610 - DNA, 20 bp, Artificial sequence
  synthetic polynucleotide sequence
ctgagttgccgggtgacaca

SEQ ID NO: 34611 - DNA, 20 bp, Artificial sequence
  synthetic polynucleotide sequence
agccctgaggagatccgcca

SEQ ID NO: 34612 - DNA, 19 bp, Artificial sequence
  synthetic polynucleotide sequence
cccctagtgccacgtggca

SEQ ID NO: 34613 - DNA, 21 bp, Artificial sequence
  synthetic polynucleotide sequence
tcctgacagctgggtccctga

SEQ ID NO: 34614 - DNA, 20 bp, Artificial sequence
  synthetic polynucleotide sequence
ccagggacaccatggtcaga

SEQ ID NO: 34615 - DNA, 20 bp, Artificial sequence
  synthetic polynucleotide sequence
gtggtgaccttccacgccaa

SEQ ID NO: 34616 - DNA, 18 bp, Artificial sequence
  synthetic polynucleotide sequence
gagaccgcgatgggcgca

SEQ ID NO: 34617 - DNA, 21 bp, Artificial sequence
  synthetic polynucleotide sequence
ctgcgggagaagttctgggaa

SEQ ID NO: 34618 - DNA, 18 bp, Artificial sequence
  synthetic polynucleotide sequence
ctcgggtgtccagggcca

SEQ ID NO: 34619 - DNA, 21 bp, Artificial sequence
  synthetic polynucleotide sequence
gccaggaaaggacgcgtcgaa

SEQ ID NO: 34620 - DNA, 20 bp, Artificial sequence
  synthetic polynucleotide sequence
atccttgcgagactccccca

SEQ ID NO: 34621 - DNA, 20 bp, Artificial sequence
  synthetic polynucleotide sequence
tccactactcccaagggcaa

SEQ ID NO: 34622 - DNA, 20 bp, Artificial sequence
  synthetic polynucleotide sequence
gtgtccaggctggacaacga

SEQ ID NO: 34623 - DNA, 20 bp, Artificial sequence
  synthetic polynucleotide sequence
caggtgaagaacccacctga

SEQ ID NO: 34624 - DNA, 19 bp, Artificial sequence
  synthetic polynucleotide sequence
gccagagccaggaagtgga

SEQ ID NO: 34625 - DNA, 21 bp, Artificial sequence
  synthetic polynucleotide sequence
cacagcaggcacatttcggga

SEQ ID NO: 34626 - DNA, 22 bp, Artificial sequence
  synthetic polynucleotide sequence
cacagcacagctgaatgtccca

SEQ ID NO: 34627 - DNA, 18 bp, Artificial sequence
  synthetic polynucleotide sequence
acctatcaggcgtgggca

SEQ ID NO: 34628 - DNA, 20 bp, Artificial sequence
  synthetic polynucleotide sequence
tgacaaggacaatggaccca

SEQ ID NO: 34629 - DNA, 19 bp, Artificial sequence
  synthetic polynucleotide sequence
gaccaacgcctctgcccca

SEQ ID NO: 34630 - DNA, 18 bp, Artificial sequence
  synthetic polynucleotide sequence
catctgcggggaggcgga

SEQ ID NO: 34631 - DNA, 20 bp, Artificial sequence
  synthetic polynucleotide sequence
aggagccccacaccaagaca

SEQ ID NO: 34632 - DNA, 21 bp, Artificial sequence
  synthetic polynucleotide sequence
ctgtccaagcgttccacctca

SEQ ID NO: 34633 - DNA, 18 bp, Artificial sequence
  synthetic polynucleotide sequence
acagctgggcaggaggaa

SEQ ID NO: 34634 - DNA, 21 bp, Artificial sequence
  synthetic polynucleotide sequence
gagtagacgatgaggaagcca

SEQ ID NO: 34635 - DNA, 18 bp, Artificial sequence
  synthetic polynucleotide sequence
gacgactcccgaacccaa

SEQ ID NO: 34636 - DNA, 18 bp, Artificial sequence
  synthetic polynucleotide sequence
tccacccagagctcgaca

SEQ ID NO: 34637 - DNA, 20 bp, Artificial sequence
  synthetic polynucleotide sequence
taccatggcagctgtcccca

SEQ ID NO: 34638 - DNA, 21 bp, Artificial sequence
  synthetic polynucleotide sequence
aggatagacaggacggcccca

SEQ ID NO: 34639 - DNA, 19 bp, Artificial sequence
  synthetic polynucleotide sequence
cagggccagagcactcaga

SEQ ID NO: 34640 - DNA, 20 bp, Artificial sequence
  synthetic polynucleotide sequence
ctttgagaccctcctctcga

SEQ ID NO: 34641 - DNA, 18 bp, Artificial sequence
  synthetic polynucleotide sequence
cggcaggttcgaagggaa

SEQ ID NO: 34642 - DNA, 19 bp, Artificial sequence
  synthetic polynucleotide sequence
tctgcagcatcaagtgcaa

SEQ ID NO: 34643 - DNA, 20 bp, Artificial sequence
  synthetic polynucleotide sequence
cgccctcaaccacctccaga

SEQ ID NO: 34644 - DNA, 20 bp, Artificial sequence
  synthetic polynucleotide sequence
tatccgccggaccagctcca

SEQ ID NO: 34645 - DNA, 19 bp, Artificial sequence
  synthetic polynucleotide sequence
gcagcacccgagtggcgaa

SEQ ID NO: 34646 - DNA, 20 bp, Artificial sequence
  synthetic polynucleotide sequence
tcgccagacgagctcgacca

SEQ ID NO: 34647 - DNA, 22 bp, Artificial sequence
  synthetic polynucleotide sequence
ttcagggagtttggggaaagca

SEQ ID NO: 34648 - DNA, 19 bp, Artificial sequence
  synthetic polynucleotide sequence
ccgcttggcagcactggga

SEQ ID NO: 34649 - DNA, 18 bp, Artificial sequence
  synthetic polynucleotide sequence
gtgtcaccggcccaggca

SEQ ID NO: 34650 - DNA, 18 bp, Artificial sequence
  synthetic polynucleotide sequence
gctgggagctcctccgca

SEQ ID NO: 34651 - DNA, 21 bp, Artificial sequence
  synthetic polynucleotide sequence
tcaaccacgtcatcctggcca

SEQ ID NO: 34652 - DNA, 18 bp, Artificial sequence
  synthetic polynucleotide sequence
ccctgagcggctcccaca

SEQ ID NO: 34653 - DNA, 18 bp, Artificial sequence
  synthetic polynucleotide sequence
ctgccaccgccccacaca

SEQ ID NO: 34654 - DNA, 21 bp, Artificial sequence
  synthetic polynucleotide sequence
cgtacagcctggtcagcggta

SEQ ID NO: 34655 - DNA, 20 bp, Artificial sequence
  synthetic polynucleotide sequence
taacagcagtgccaacccca

SEQ ID NO: 34656 - DNA, 19 bp, Artificial sequence
  synthetic polynucleotide sequence
gggtgccctgacggaagca

SEQ ID NO: 34657 - DNA, 20 bp, Artificial sequence
  synthetic polynucleotide sequence
taacagcagtgccaacccca

SEQ ID NO: 34658 - DNA, 21 bp, Artificial sequence
  synthetic polynucleotide sequence
atctgcttcccgacagctcca

SEQ ID NO: 34659 - DNA, 22 bp, Artificial sequence
  synthetic polynucleotide sequence
ctaaacagtagtgccaacccca

SEQ ID NO: 34660 - DNA, 21 bp, Artificial sequence
  synthetic polynucleotide sequence
atctgcttcccgacagctcca

SEQ ID NO: 34661 - DNA, 20 bp, Artificial sequence
  synthetic polynucleotide sequence
cttctacgtggctgccccca

SEQ ID NO: 34662 - DNA, 21 bp, Artificial sequence
  synthetic polynucleotide sequence
actccaatcccaggtgctgca

SEQ ID NO: 34663 - DNA, 20 bp, Artificial sequence
  synthetic polynucleotide sequence
ctcctgatccaccaagacca

SEQ ID NO: 34664 - DNA, 22 bp, Artificial sequence
  synthetic polynucleotide sequence
cagcacaggtggtctcttagca

SEQ ID NO: 34665 - DNA, 20 bp, Artificial sequence
  synthetic polynucleotide sequence
ccagtcctccgagatcccca

SEQ ID NO: 34666 - DNA, 19 bp, Artificial sequence
  synthetic polynucleotide sequence
cggggcaggatggtgagga

SEQ ID NO: 34667 - DNA, 21 bp, Artificial sequence
  synthetic polynucleotide sequence
gacccgagaacctcacagaga

SEQ ID NO: 34668 - DNA, 21 bp, Artificial sequence
  synthetic polynucleotide sequence
atgtctggggtcacgctgaga

SEQ ID NO: 34669 - DNA, 20 bp, Artificial sequence
  synthetic polynucleotide sequence
tacgactcggactggacaga

SEQ ID NO: 34670 - DNA, 18 bp, Artificial sequence
  synthetic polynucleotide sequence
ggctgtccacaccaggca

SEQ ID NO: 34671 - DNA, 20 bp, Artificial sequence
  synthetic polynucleotide sequence
cagcttcctcgggccacaca

SEQ ID NO: 34672 - DNA, 21 bp, Artificial sequence
  synthetic polynucleotide sequence
gattctgtgcctccaggacca

SEQ ID NO: 34673 - DNA, 19 bp, Artificial sequence
  synthetic polynucleotide sequence
gctcgggaccccagtgcta

SEQ ID NO: 34674 - DNA, 21 bp, Artificial sequence
  synthetic polynucleotide sequence
gtccatacaccagcaggtcga

SEQ ID NO: 34675 - DNA, 20 bp, Artificial sequence
  synthetic polynucleotide sequence
ctcgccctctacaagaagca

SEQ ID NO: 34676 - DNA, 20 bp, Artificial sequence
  synthetic polynucleotide sequence
atcaccagggggcttgagga

SEQ ID NO: 34677 - DNA, 19 bp, Artificial sequence
  synthetic polynucleotide sequence
ctgagctccgggaagggga

SEQ ID NO: 34678 - DNA, 19 bp, Artificial sequence
  synthetic polynucleotide sequence
gggtcctgggagtgcagca

SEQ ID NO: 34679 - DNA, 20 bp, Artificial sequence
  synthetic polynucleotide sequence
gagggctcggcaacacagca

SEQ ID NO: 34680 - DNA, 21 bp, Artificial sequence
  synthetic polynucleotide sequence
ggtctgtcagcagctccagga

SEQ ID NO: 34681 - DNA, 20 bp, Artificial sequence
  synthetic polynucleotide sequence
gttcagcgatacccaggcca

SEQ ID NO: 34682 - DNA, 20 bp, Artificial sequence
  synthetic polynucleotide sequence
gctggcgtggtggacaagga

SEQ ID NO: 34683 - DNA, 18 bp, Artificial sequence
  synthetic polynucleotide sequence
cacgggctgtgaacacca

SEQ ID NO: 34684 - DNA, 18 bp, Artificial sequence
  synthetic polynucleotide sequence
tccagagcctcacagcca

SEQ ID NO: 34685 - DNA, 22 bp, Artificial sequence
  synthetic polynucleotide sequence
agctcaggaggatgggtactga

SEQ ID NO: 34686 - DNA, 18 bp, Artificial sequence
  synthetic polynucleotide sequence
cggccctcgccatctgga

SEQ ID NO: 34687 - DNA, 20 bp, Artificial sequence
  synthetic polynucleotide sequence
ggcatgccaggccctgtgca

SEQ ID NO: 34688 - DNA, 20 bp, Artificial sequence
  synthetic polynucleotide sequence
gtcgtcaagagctgggggaa

SEQ ID NO: 34689 - DNA, 21 bp, Artificial sequence
  synthetic polynucleotide sequence
cattggccgtgacatccccaa

SEQ ID NO: 34690 - DNA, 22 bp, Artificial sequence
  synthetic polynucleotide sequence
gaaagcacgtaccacaaaggga

SEQ ID NO: 34691 - DNA, 19 bp, Artificial sequence
  synthetic polynucleotide sequence
gcctcacagcccagaccca

SEQ ID NO: 34692 - DNA, 21 bp, Artificial sequence
  synthetic polynucleotide sequence
ttcccattggccgacatgaca

SEQ ID NO: 34693 - DNA, 20 bp, Artificial sequence
  synthetic polynucleotide sequence
tcaaagctcaggatgaggca

SEQ ID NO: 34694 - DNA, 18 bp, Artificial sequence
  synthetic polynucleotide sequence
aggtccttcaccacgcga

SEQ ID NO: 34695 - DNA, 21 bp, Artificial sequence
  synthetic polynucleotide sequence
tccaggacatcgccagcctca

SEQ ID NO: 34696 - DNA, 19 bp, Artificial sequence
  synthetic polynucleotide sequence
ctcctgggctgctgcagca

SEQ ID NO: 34697 - DNA, 19 bp, Artificial sequence
  synthetic polynucleotide sequence
ctctagggcgccccagcaa

SEQ ID NO: 34698 - DNA, 21 bp, Artificial sequence
  synthetic polynucleotide sequence
acctgggtagccagtatgcga

SEQ ID NO: 34699 - DNA, 18 bp, Artificial sequence
  synthetic polynucleotide sequence
accctgtggggacacgaa

SEQ ID NO: 34700 - DNA, 18 bp, Artificial sequence
  synthetic polynucleotide sequence
aatggccagcaccttgga

SEQ ID NO: 34701 - DNA, 20 bp, Artificial sequence
  synthetic polynucleotide sequence
gtggcagaggccataaagga

SEQ ID NO: 34702 - DNA, 21 bp, Artificial sequence
  synthetic polynucleotide sequence
gactaggatcaacacgaccca

SEQ ID NO: 34703 - DNA, 21 bp, Artificial sequence
  synthetic polynucleotide sequence
caaccgctctatggaccccaa

SEQ ID NO: 34704 - DNA, 21 bp, Artificial sequence
  synthetic polynucleotide sequence
atctctacaacaaggcggcca

SEQ ID NO: 34705 - DNA, 22 bp, Artificial sequence
  synthetic polynucleotide sequence
agatcaaactgggggctacaca

SEQ ID NO: 34706 - DNA, 20 bp, Artificial sequence
  synthetic polynucleotide sequence
gtctctgcgaggcagaggca

SEQ ID NO: 34707 - DNA, 18 bp, Artificial sequence
  synthetic polynucleotide sequence
cgccccagaattcaccaa

SEQ ID NO: 34708 - DNA, 18 bp, Artificial sequence
  synthetic polynucleotide sequence
ctcacgagtggaggccga

SEQ ID NO: 34709 - DNA, 22 bp, Artificial sequence
  synthetic polynucleotide sequence
agctgacccatatgccagtgga

SEQ ID NO: 34710 - DNA, 21 bp, Artificial sequence
  synthetic polynucleotide sequence
acctgaatctcctggacccga

SEQ ID NO: 34711 - DNA, 19 bp, Artificial sequence
  synthetic polynucleotide sequence
gctggatcatcgccacaga

SEQ ID NO: 34712 - DNA, 18 bp, Artificial sequence
  synthetic polynucleotide sequence
tgagggtccccacaggca

SEQ ID NO: 34713 - DNA, 22 bp, Artificial sequence
  synthetic polynucleotide sequence
agtatccagcgctcattgggaa

SEQ ID NO: 34714 - DNA, 20 bp, Artificial sequence
  synthetic polynucleotide sequence
tgtcgcctcctactggccaa

SEQ ID NO: 34715 - DNA, 18 bp, Artificial sequence
  synthetic polynucleotide sequence
tgccagccgccagtggaa

SEQ ID NO: 34716 - DNA, 18 bp, Artificial sequence
  synthetic polynucleotide sequence
gcttgccaagcagcgtga

SEQ ID NO: 34717 - DNA, 21 bp, Artificial sequence
  synthetic polynucleotide sequence
cgcatccgctaccatggcaga

SEQ ID NO: 34718 - DNA, 20 bp, Artificial sequence
  synthetic polynucleotide sequence
gaacgatggtccggctgcga

SEQ ID NO: 34719 - DNA, 18 bp, Artificial sequence
  synthetic polynucleotide sequence
gcggacacgggtgcagca

SEQ ID NO: 34720 - DNA, 18 bp, Artificial sequence
  synthetic polynucleotide sequence
ccagctgcacgtaggcga

SEQ ID NO: 34721 - DNA, 20 bp, Artificial sequence
  synthetic polynucleotide sequence
gtgggagggctgaacacaca

SEQ ID NO: 34722 - DNA, 18 bp, Artificial sequence
  synthetic polynucleotide sequence
tgacctggcggtggagca

SEQ ID NO: 34723 - DNA, 22 bp, Artificial sequence
  synthetic polynucleotide sequence
ggatagtccgctacactaagga

SEQ ID NO: 34724 - DNA, 18 bp, Artificial sequence
  synthetic polynucleotide sequence
gcacagcacccttgggca

SEQ ID NO: 34725 - DNA, 22 bp, Artificial sequence
  synthetic polynucleotide sequence
tggaggaggccattgagaagca

SEQ ID NO: 34726 - DNA, 18 bp, Artificial sequence
  synthetic polynucleotide sequence
ccaccgccggctctgaca

SEQ ID NO: 34727 - DNA, 19 bp, Artificial sequence
  synthetic polynucleotide sequence
ccggggaacagaacacaca

SEQ ID NO: 34728 - DNA, 18 bp, Artificial sequence
  synthetic polynucleotide sequence
atgcccagcttcaaggca

SEQ ID NO: 34729 - DNA, 20 bp, Artificial sequence
  synthetic polynucleotide sequence
tgggagcgactgctacggaa

SEQ ID NO: 34730 - DNA, 20 bp, Artificial sequence
  synthetic polynucleotide sequence
ctaatgctggtccccacgga

SEQ ID NO: 34731 - DNA, 20 bp, Artificial sequence
  synthetic polynucleotide sequence
ccggtgacggagactgccca

SEQ ID NO: 34732 - DNA, 22 bp, Artificial sequence
  synthetic polynucleotide sequence
gttgaagcagaaacctgtccca

SEQ ID NO: 34733 - DNA, 18 bp, Artificial sequence
  synthetic polynucleotide sequence
gggcaaggctcgcgggaa

SEQ ID NO: 34734 - DNA, 21 bp, Artificial sequence
  synthetic polynucleotide sequence
ttcggcgaaggatgacctgca

SEQ ID NO: 34735 - DNA, 19 bp, Artificial sequence
  synthetic polynucleotide sequence
tgctggtgcagtgagagca

SEQ ID NO: 34736 - DNA, 20 bp, Artificial sequence
  synthetic polynucleotide sequence
aacgtccagtggacaatgca

SEQ ID NO: 34737 - DNA, 18 bp, Artificial sequence
  synthetic polynucleotide sequence
gtggaacccggggcagca

SEQ ID NO: 34738 - DNA, 19 bp, Artificial sequence
  synthetic polynucleotide sequence
cgaccccgcctcttcacca

SEQ ID NO: 34739 - DNA, 20 bp, Artificial sequence
  synthetic polynucleotide sequence
agagcgtgggcacggatgga

SEQ ID NO: 34740 - DNA, 20 bp, Artificial sequence
  synthetic polynucleotide sequence
gtctgagtccacccaggcca

SEQ ID NO: 34741 - DNA, 21 bp, Artificial sequence
  synthetic polynucleotide sequence
agaggtgacctatgaggcaga

SEQ ID NO: 34742 - DNA, 19 bp, Artificial sequence
  synthetic polynucleotide sequence
gggcgtgcgtcctcagaga

SEQ ID NO: 34743 - DNA, 21 bp, Artificial sequence
  synthetic polynucleotide sequence
ttgggaaaactgaccccggta

SEQ ID NO: 34744 - DNA, 21 bp, Artificial sequence
  synthetic polynucleotide sequence
tgtcccaaggctgtccatcca

SEQ ID NO: 34745 - DNA, 21 bp, Artificial sequence
  synthetic polynucleotide sequence
caagaccaagacgagagccga

SEQ ID NO: 34746 - DNA, 20 bp, Artificial sequence
  synthetic polynucleotide sequence
ctgggccagcttgacggtca

SEQ ID NO: 34747 - DNA, 18 bp, Artificial sequence
  synthetic polynucleotide sequence
agcaagagagcggcctca

SEQ ID NO: 34748 - DNA, 19 bp, Artificial sequence
  synthetic polynucleotide sequence
tcctgctgggcttctagca

SEQ ID NO: 34749 - DNA, 20 bp, Artificial sequence
  synthetic polynucleotide sequence
atgagcaagtggacgagcaa

SEQ ID NO: 34750 - DNA, 19 bp, Artificial sequence
  synthetic polynucleotide sequence
gagcttgaagccggtcaga

SEQ ID NO: 34751 - DNA, 20 bp, Artificial sequence
  synthetic polynucleotide sequence
cctcggccagatcctgtgca

SEQ ID NO: 34752 - DNA, 22 bp, Artificial sequence
  synthetic polynucleotide sequence
gataccgtccatgaggatacca

SEQ ID NO: 34753 - DNA, 21 bp, Artificial sequence
  synthetic polynucleotide sequence
ccttccacaccgacaacccta

SEQ ID NO: 34754 - DNA, 18 bp, Artificial sequence
  synthetic polynucleotide sequence
tgcacctgggctggggca

SEQ ID NO: 34755 - DNA, 21 bp, Artificial sequence
  synthetic polynucleotide sequence
agtggacctgagaggactgca

SEQ ID NO: 34756 - DNA, 22 bp, Artificial sequence
  synthetic polynucleotide sequence
caaaggcaaagctgtggtgcca

SEQ ID NO: 34757 - DNA, 21 bp, Artificial sequence
  synthetic polynucleotide sequence
tggtgactcagtccgcagcta

SEQ ID NO: 34758 - DNA, 23 bp, Artificial sequence
  synthetic polynucleotide sequence
aaatataccagctgtacaggcca

SEQ ID NO: 34759 - DNA, 21 bp, Artificial sequence
  synthetic polynucleotide sequence
ccctcaagcaacggatcccca

SEQ ID NO: 34760 - DNA, 21 bp, Artificial sequence
  synthetic polynucleotide sequence
tctgctgcagtagagacgcca

SEQ ID NO: 34761 - DNA, 21 bp, Artificial sequence
  synthetic polynucleotide sequence
ggcagagattgccaatgccaa

SEQ ID NO: 34762 - DNA, 21 bp, Artificial sequence
  synthetic polynucleotide sequence
ggtccacataaggcaaggcaa

SEQ ID NO: 34763 - DNA, 21 bp, Artificial sequence
  synthetic polynucleotide sequence
cctggcagagagttatgccca

SEQ ID NO: 34764 - DNA, 22 bp, Artificial sequence
  synthetic polynucleotide sequence
gtaagcactgagtccaggagca

SEQ ID NO: 34765 - DNA, 22 bp, Artificial sequence
  synthetic polynucleotide sequence
aacatccccgtctacaaggaca

SEQ ID NO: 34766 - DNA, 18 bp, Artificial sequence
  synthetic polynucleotide sequence
tccccagcagcgggctca

SEQ ID NO: 34767 - DNA, 20 bp, Artificial sequence
  synthetic polynucleotide sequence
gtccctaactccagactcca

SEQ ID NO: 34768 - DNA, 21 bp, Artificial sequence
  synthetic polynucleotide sequence
ttggggggcagattactggca

SEQ ID NO: 34769 - DNA, 18 bp, Artificial sequence
  synthetic polynucleotide sequence
cactctcccgccccccaa

SEQ ID NO: 34770 - DNA, 20 bp, Artificial sequence
  synthetic polynucleotide sequence
aagccatatgggccccctga

SEQ ID NO: 34771 - DNA, 18 bp, Artificial sequence
  synthetic polynucleotide sequence
ggcagctcaggcagcaga

SEQ ID NO: 34772 - DNA, 19 bp, Artificial sequence
  synthetic polynucleotide sequence
gtgaggaagggaggcagga

SEQ ID NO: 34773 - DNA, 23 bp, Artificial sequence
  synthetic polynucleotide sequence
gaaaaacgtggaatcgacgagga

SEQ ID NO: 34774 - DNA, 18 bp, Artificial sequence
  synthetic polynucleotide sequence
gtccacgcagggctcgga

SEQ ID NO: 34775 - DNA, 20 bp, Artificial sequence
  synthetic polynucleotide sequence
ctggcccgggattatgccaa

SEQ ID NO: 34776 - DNA, 20 bp, Artificial sequence
  synthetic polynucleotide sequence
atgtggtgagctggacagga

SEQ ID NO: 34777 - DNA, 18 bp, Artificial sequence
  synthetic polynucleotide sequence
cgccaggcttatgcacga

SEQ ID NO: 34778 - DNA, 18 bp, Artificial sequence
  synthetic polynucleotide sequence
ctatgggcatcgccagca

SEQ ID NO: 34779 - DNA, 20 bp, Artificial sequence
  synthetic polynucleotide sequence
tacatgacccgggagcagga

SEQ ID NO: 34780 - DNA, 20 bp, Artificial sequence
  synthetic polynucleotide sequence
gatggtcgagctggtccgca

SEQ ID NO: 34781 - DNA, 21 bp, Artificial sequence
  synthetic polynucleotide sequence
ccgaatctcagggctcggaca

SEQ ID NO: 34782 - DNA, 20 bp, Artificial sequence
  synthetic polynucleotide sequence
ccccaggaccactactccga

SEQ ID NO: 34783 - DNA, 20 bp, Artificial sequence
  synthetic polynucleotide sequence
atccagaccaaggcaggtga

SEQ ID NO: 34784 - DNA, 19 bp, Artificial sequence
  synthetic polynucleotide sequence
ttaccgtcacctcacacca

SEQ ID NO: 34785 - DNA, 20 bp, Artificial sequence
  synthetic polynucleotide sequence
ctctggcagggattggggaa

SEQ ID NO: 34786 - DNA, 21 bp, Artificial sequence
  synthetic polynucleotide sequence
gtactgagaagcaagccacca

SEQ ID NO: 34787 - DNA, 21 bp, Artificial sequence
  synthetic polynucleotide sequence
tcgcagcacagacagcaggca

SEQ ID NO: 34788 - DNA, 21 bp, Artificial sequence
  synthetic polynucleotide sequence
gatcagtccgtgcatggcaga

SEQ ID NO: 34789 - DNA, 18 bp, Artificial sequence
  synthetic polynucleotide sequence
gtcgagtgcggctcagca

SEQ ID NO: 34790 - DNA, 18 bp, Artificial sequence
  synthetic polynucleotide sequence
tgccacgcacaacggtga

SEQ ID NO: 34791 - DNA, 21 bp, Artificial sequence
  synthetic polynucleotide sequence
ggcgcgatgtgaagagacgaa

SEQ ID NO: 34792 - DNA, 18 bp, Artificial sequence
  synthetic polynucleotide sequence
cgcttcacaccacgcgga

SEQ ID NO: 34793 - DNA, 20 bp, Artificial sequence
  synthetic polynucleotide sequence
tcgaaaggacaaagcccaca

SEQ ID NO: 34794 - DNA, 18 bp, Artificial sequence
  synthetic polynucleotide sequence
ctcaattcccagccccca

SEQ ID NO: 34795 - DNA, 19 bp, Artificial sequence
  synthetic polynucleotide sequence
tgcccaacagtcatggaga

SEQ ID NO: 34796 - DNA, 22 bp, Artificial sequence
  synthetic polynucleotide sequence
gaaaaagccagcaagacccaga

SEQ ID NO: 34797 - DNA, 21 bp, Artificial sequence
  synthetic polynucleotide sequence
tcagcagtgcacagttgggga

SEQ ID NO: 34798 - DNA, 22 bp, Artificial sequence
  synthetic polynucleotide sequence
aactcaacggactctccaggta

SEQ ID NO: 34799 - DNA, 20 bp, Artificial sequence
  synthetic polynucleotide sequence
cagctcgcgggttcagggaa

SEQ ID NO: 34800 - DNA, 20 bp, Artificial sequence
  synthetic polynucleotide sequence
cttcaggttccaacggcaga

SEQ ID NO: 34801 - DNA, 20 bp, Artificial sequence
  synthetic polynucleotide sequence
cacagcggactcggaagaca

SEQ ID NO: 34802 - DNA, 18 bp, Artificial sequence
  synthetic polynucleotide sequence
gatacccgtgtgggcgca

SEQ ID NO: 34803 - DNA, 18 bp, Artificial sequence
  synthetic polynucleotide sequence
actcgagcccacagggga

SEQ ID NO: 34804 - DNA, 18 bp, Artificial sequence
  synthetic polynucleotide sequence
ccgcaaacagcaaccaca

SEQ ID NO: 34805 - DNA, 20 bp, Artificial sequence
  synthetic polynucleotide sequence
gccgtgagagacgcagccaa

SEQ ID NO: 34806 - DNA, 21 bp, Artificial sequence
  synthetic polynucleotide sequence
agagcctgcagtagaggtgca

SEQ ID NO: 34807 - DNA, 22 bp, Artificial sequence
  synthetic polynucleotide sequence
aaggatcaggctgctgagggaa

SEQ ID NO: 34808 - DNA, 21 bp, Artificial sequence
  synthetic polynucleotide sequence
aagctgcagaatggcgactga

SEQ ID NO: 34809 - DNA, 21 bp, Artificial sequence
  synthetic polynucleotide sequence
ggctggaaaccgtagggagca

SEQ ID NO: 34810 - DNA, 19 bp, Artificial sequence
  synthetic polynucleotide sequence
tggaagacgggctccctca

SEQ ID NO: 34811 - DNA, 21 bp, Artificial sequence
  synthetic polynucleotide sequence
ggtgacctacgaggaggcaca

SEQ ID NO: 34812 - DNA, 22 bp, Artificial sequence
  synthetic polynucleotide sequence
ggtaccccacatgaacttgcga

SEQ ID NO: 34813 - DNA, 18 bp, Artificial sequence
  synthetic polynucleotide sequence
gcatggggagctgggcga

SEQ ID NO: 34814 - DNA, 21 bp, Artificial sequence
  synthetic polynucleotide sequence
tcttggtctccacatccacca

SEQ ID NO: 34815 - DNA, 20 bp, Artificial sequence
  synthetic polynucleotide sequence
aacatgccgcccgcggtgga

SEQ ID NO: 34816 - DNA, 20 bp, Artificial sequence
  synthetic polynucleotide sequence
cctctgcacctcggacacga

SEQ ID NO: 34817 - DNA, 22 bp, Artificial sequence
  synthetic polynucleotide sequence
gaaaccaggctaccttgacaga

SEQ ID NO: 34818 - DNA, 20 bp, Artificial sequence
  synthetic polynucleotide sequence
actgctcctctgaagcccca

SEQ ID NO: 34819 - DNA, 18 bp, Artificial sequence
  synthetic polynucleotide sequence
gttggagcggcactcgga

SEQ ID NO: 34820 - DNA, 21 bp, Artificial sequence
  synthetic polynucleotide sequence
gaaagatccgtccaatgacca

SEQ ID NO: 34821 - DNA, 18 bp, Artificial sequence
  synthetic polynucleotide sequence
acctgaacctgcgctgga

SEQ ID NO: 34822 - DNA, 20 bp, Artificial sequence
  synthetic polynucleotide sequence
cgagggttgacaccagctga

SEQ ID NO: 34823 - DNA, 22 bp, Artificial sequence
  synthetic polynucleotide sequence
tccagtggacaaaagaggggaa

SEQ ID NO: 34824 - DNA, 20 bp, Artificial sequence
  synthetic polynucleotide sequence
gccacaagtcaccagctcca

SEQ ID NO: 34825 - DNA, 20 bp, Artificial sequence
  synthetic polynucleotide sequence
tggtgaagtcaccaggccta

SEQ ID NO: 34826 - DNA, 22 bp, Artificial sequence
  synthetic polynucleotide sequence
ccaagaaatcggagcgtctgca

SEQ ID NO: 34827 - DNA, 18 bp, Artificial sequence
  synthetic polynucleotide sequence
ccgcctggtcacgcgcaa

SEQ ID NO: 34828 - DNA, 19 bp, Artificial sequence
  synthetic polynucleotide sequence
tgaaggtcaggatgcccca

SEQ ID NO: 34829 - DNA, 20 bp, Artificial sequence
  synthetic polynucleotide sequence
ggccaccaagaagaaaggca

SEQ ID NO: 34830 - DNA, 21 bp, Artificial sequence
  synthetic polynucleotide sequence
cgaacaggaagaggtactgca

SEQ ID NO: 34831 - DNA, 20 bp, Artificial sequence
  synthetic polynucleotide sequence
gtatcagggtccaccagaca

SEQ ID NO: 34832 - DNA, 18 bp, Artificial sequence
  synthetic polynucleotide sequence
gacaaacagcagccacca

SEQ ID NO: 34833 - DNA, 21 bp, Artificial sequence
  synthetic polynucleotide sequence
gaagcaaggaagagcaggaga

SEQ ID NO: 34834 - DNA, 19 bp, Artificial sequence
  synthetic polynucleotide sequence
caagactgatgcctcccca

SEQ ID NO: 34835 - DNA, 21 bp, Artificial sequence
  synthetic polynucleotide sequence
agcggccagagactgctgcta

SEQ ID NO: 34836 - DNA, 20 bp, Artificial sequence
  synthetic polynucleotide sequence
caacagctgcggtgggtgca

SEQ ID NO: 34837 - DNA, 21 bp, Artificial sequence
  synthetic polynucleotide sequence
cgcaagccagtggaggagcta

SEQ ID NO: 34838 - DNA, 22 bp, Artificial sequence
  synthetic polynucleotide sequence
tgaatcatgagggatctggcca

SEQ ID NO: 34839 - DNA, 20 bp, Artificial sequence
  synthetic polynucleotide sequence
gaccggctgggaaagcacga

SEQ ID NO: 34840 - DNA, 21 bp, Artificial sequence
  synthetic polynucleotide sequence
gtcctcggtgacaaagctgca

SEQ ID NO: 34841 - DNA, 20 bp, Artificial sequence
  synthetic polynucleotide sequence
cttccgcatggtccacccta

SEQ ID NO: 34842 - DNA, 21 bp, Artificial sequence
  synthetic polynucleotide sequence
atatcctcaaccaaggcagca

SEQ ID NO: 34843 - DNA, 21 bp, Artificial sequence
  synthetic polynucleotide sequence
actttagccagtgtagcccca

SEQ ID NO: 34844 - DNA, 21 bp, Artificial sequence
  synthetic polynucleotide sequence
tctcaaggatcagtggctgca

SEQ ID NO: 34845 - DNA, 18 bp, Artificial sequence
  synthetic polynucleotide sequence
caccaaccgcacaaagga

SEQ ID NO: 34846 - DNA, 18 bp, Artificial sequence
  synthetic polynucleotide sequence
gctccatggagtggggga

SEQ ID NO: 34847 - DNA, 22 bp, Artificial sequence
  synthetic polynucleotide sequence
aaaagggcccaagaagcagcaa

SEQ ID NO: 34848 - DNA, 20 bp, Artificial sequence
  synthetic polynucleotide sequence
tggagtcctgagctccacca

SEQ ID NO: 34849 - DNA, 20 bp, Artificial sequence
  synthetic polynucleotide sequence
agagccaatgaaaggcccta

SEQ ID NO: 34850 - DNA, 21 bp, Artificial sequence
  synthetic polynucleotide sequence
ccccagagagggtaccacaca

SEQ ID NO: 34851 - DNA, 19 bp, Artificial sequence
  synthetic polynucleotide sequence
cccccgccatcctaccaga

SEQ ID NO: 34852 - DNA, 20 bp, Artificial sequence
  synthetic polynucleotide sequence
tccagatcgcagctccgtca

SEQ ID NO: 34853 - DNA, 19 bp, Artificial sequence
  synthetic polynucleotide sequence
gacctgccccctcaaggca

SEQ ID NO: 34854 - DNA, 19 bp, Artificial sequence
  synthetic polynucleotide sequence
gaggtggcatggcgtggga

SEQ ID NO: 34855 - DNA, 21 bp, Artificial sequence
  synthetic polynucleotide sequence
cagccgagaagaaccacacca

SEQ ID NO: 34856 - DNA, 20 bp, Artificial sequence
  synthetic polynucleotide sequence
atggatggcttggcacccga

SEQ ID NO: 34857 - DNA, 20 bp, Artificial sequence
  synthetic polynucleotide sequence
cccagccaataccaccacca

SEQ ID NO: 34858 - DNA, 20 bp, Artificial sequence
  synthetic polynucleotide sequence
tgacagggccagtggcagca

SEQ ID NO: 34859 - DNA, 18 bp, Artificial sequence
  synthetic polynucleotide sequence
ctcatccccaccactgca

SEQ ID NO: 34860 - DNA, 22 bp, Artificial sequence
  synthetic polynucleotide sequence
tacagagcagacaactgttcca

SEQ ID NO: 34861 - DNA, 20 bp, Artificial sequence
  synthetic polynucleotide sequence
gagtcaccggacctatgcaa

SEQ ID NO: 34862 - DNA, 21 bp, Artificial sequence
  synthetic polynucleotide sequence
ccagcaaggtgagaatcagca

SEQ ID NO: 34863 - DNA, 18 bp, Artificial sequence
  synthetic polynucleotide sequence
atggaacaggccatgcca

SEQ ID NO: 34864 - DNA, 20 bp, Artificial sequence
  synthetic polynucleotide sequence
tgctaaggctcatcagggca

SEQ ID NO: 34865 - DNA, 20 bp, Artificial sequence
  synthetic polynucleotide sequence
ccctgggagcaatagctgga

SEQ ID NO: 34866 - DNA, 25 bp, Artificial sequence
  synthetic polynucleotide sequence
tggcaccccaaaattgagaaaggca

SEQ ID NO: 34867 - DNA, 21 bp, Artificial sequence
  synthetic polynucleotide sequence
actgctatacagccaaagcca

SEQ ID NO: 34868 - DNA, 18 bp, Artificial sequence
  synthetic polynucleotide sequence
gccagcacactcacccca

SEQ ID NO: 34869 - DNA, 20 bp, Artificial sequence
  synthetic polynucleotide sequence
tgtctgtcaacccggctgca

SEQ ID NO: 34870 - DNA, 21 bp, Artificial sequence
  synthetic polynucleotide sequence
tgtttccactgcagcacagca

SEQ ID NO: 34871 - DNA, 21 bp, Artificial sequence
  synthetic polynucleotide sequence
acagcatggtagccctgagga

SEQ ID NO: 34872 - DNA, 22 bp, Artificial sequence
  synthetic polynucleotide sequence
aataagagctccagcacagtga

SEQ ID NO: 34873 - DNA, 21 bp, Artificial sequence
  synthetic polynucleotide sequence
atctctctccgtggcagcaga

SEQ ID NO: 34874 - DNA, 21 bp, Artificial sequence
  synthetic polynucleotide sequence
atgcgatgccaaactccagga

SEQ ID NO: 34875 - DNA, 21 bp, Artificial sequence
  synthetic polynucleotide sequence
gagcaaagttccctggaccca

SEQ ID NO: 34876 - DNA, 21 bp, Artificial sequence
  synthetic polynucleotide sequence
tcagcaatcccgaggtagcaa

SEQ ID NO: 34877 - DNA, 20 bp, Artificial sequence
  synthetic polynucleotide sequence
atggcccatgaaaggagaga

SEQ ID NO: 34878 - DNA, 19 bp, Artificial sequence
  synthetic polynucleotide sequence
ctgaggcgtcggggtggta

SEQ ID NO: 34879 - DNA, 21 bp, Artificial sequence
  synthetic polynucleotide sequence
agaggacagggacagaggtga

SEQ ID NO: 34880 - DNA, 22 bp, Artificial sequence
  synthetic polynucleotide sequence
caaatcagaggagggaagggga

SEQ ID NO: 34881 - DNA, 18 bp, Artificial sequence
  synthetic polynucleotide sequence
caagcagtcgcagcggaa

SEQ ID NO: 34882 - DNA, 18 bp, Artificial sequence
  synthetic polynucleotide sequence
aactggaagccagccgga

SEQ ID NO: 34883 - DNA, 21 bp, Artificial sequence
  synthetic polynucleotide sequence
agaagggcaccaaagtcagga

SEQ ID NO: 34884 - DNA, 21 bp, Artificial sequence
  synthetic polynucleotide sequence
tctggctgtagacaggtggca

SEQ ID NO: 34885 - DNA, 21 bp, Artificial sequence
  synthetic polynucleotide sequence
gatggccagagacaggttgga

SEQ ID NO: 34886 - DNA, 22 bp, Artificial sequence
  synthetic polynucleotide sequence
aatctggatgaggagagcctca

SEQ ID NO: 34887 - DNA, 18 bp, Artificial sequence
  synthetic polynucleotide sequence
gcagcctgccacaggcga

SEQ ID NO: 34888 - DNA, 21 bp, Artificial sequence
  synthetic polynucleotide sequence
tgtttgctcggacaaggccga

SEQ ID NO: 34889 - DNA, 24 bp, Artificial sequence
  synthetic polynucleotide sequence
gacttgccagaggtgaaataggaa

SEQ ID NO: 34890 - DNA, 22 bp, Artificial sequence
  synthetic polynucleotide sequence
ggaattccccacagcacaagca

SEQ ID NO: 34891 - DNA, 18 bp, Artificial sequence
  synthetic polynucleotide sequence
cctcaaccaggtggcgaa

SEQ ID NO: 34892 - DNA, 18 bp, Artificial sequence
  synthetic polynucleotide sequence
ccagccagtgtcggagca

SEQ ID NO: 34893 - DNA, 18 bp, Artificial sequence
  synthetic polynucleotide sequence
aaggactgcatgcggcga

SEQ ID NO: 34894 - DNA, 20 bp, Artificial sequence
  synthetic polynucleotide sequence
ctgggcgacacataggacca

SEQ ID NO: 34895 - DNA, 21 bp, Artificial sequence
  synthetic polynucleotide sequence
ctctcactgcctacggaccaa

SEQ ID NO: 34896 - DNA, 18 bp, Artificial sequence
  synthetic polynucleotide sequence
ccccgtagagctcggcca

SEQ ID NO: 34897 - DNA, 19 bp, Artificial sequence
  synthetic polynucleotide sequence
cggggactgccttacacca

SEQ ID NO: 34898 - DNA, 18 bp, Artificial sequence
  synthetic polynucleotide sequence
cataagccgctgctggga

SEQ ID NO: 34899 - DNA, 21 bp, Artificial sequence
  synthetic polynucleotide sequence
ccagcacccatcccaaggaga

SEQ ID NO: 34900 - DNA, 21 bp, Artificial sequence
  synthetic polynucleotide sequence
aatggtaacggtgatggggga

SEQ ID NO: 34901 - DNA, 22 bp, Artificial sequence
  synthetic polynucleotide sequence
tcatgtacagcagcaactccga

SEQ ID NO: 34902 - DNA, 19 bp, Artificial sequence
  synthetic polynucleotide sequence
tcactgtcacaggagcaga

SEQ ID NO: 34903 - DNA, 21 bp, Artificial sequence
  synthetic polynucleotide sequence
atccacgccacagtccacaga

SEQ ID NO: 34904 - DNA, 18 bp, Artificial sequence
  synthetic polynucleotide sequence
ggcactgtggcgcgtgga

SEQ ID NO: 34905 - DNA, 19 bp, Artificial sequence
  synthetic polynucleotide sequence
ggaaggggccagctagaca

SEQ ID NO: 34906 - DNA, 19 bp, Artificial sequence
  synthetic polynucleotide sequence
cgggccttgggatagagga

SEQ ID NO: 34907 - DNA, 21 bp, Artificial sequence
  synthetic polynucleotide sequence
gtggtggagaagaaggaccca

SEQ ID NO: 34908 - DNA, 23 bp, Artificial sequence
  synthetic polynucleotide sequence
tgactattagaggccagaggaga

SEQ ID NO: 34909 - DNA, 20 bp, Artificial sequence
  synthetic polynucleotide sequence
acgtcccagcatcccatcga

SEQ ID NO: 34910 - DNA, 19 bp, Artificial sequence
  synthetic polynucleotide sequence
ccctttgcagggcagccga

SEQ ID NO: 34911 - DNA, 19 bp, Artificial sequence
  synthetic polynucleotide sequence
gtgcatggggaaccatgaa

SEQ ID NO: 34912 - DNA, 18 bp, Artificial sequence
  synthetic polynucleotide sequence
ccagcatagcacgctcca

SEQ ID NO: 34913 - DNA, 22 bp, Artificial sequence
  synthetic polynucleotide sequence
ggaagccaacctcatggacaca

SEQ ID NO: 34914 - DNA, 21 bp, Artificial sequence
  synthetic polynucleotide sequence
ccatgtccctggactgaggaa

SEQ ID NO: 34915 - DNA, 22 bp, Artificial sequence
  synthetic polynucleotide sequence
gtctgagtgaagatagcaggga

SEQ ID NO: 34916 - DNA, 20 bp, Artificial sequence
  synthetic polynucleotide sequence
gtaaggcactggcgggcaga

SEQ ID NO: 34917 - DNA, 21 bp, Artificial sequence
  synthetic polynucleotide sequence
ccgagaccattcacgccgaca

SEQ ID NO: 34918 - DNA, 20 bp, Artificial sequence
  synthetic polynucleotide sequence
gttcaggaactcgtggccca

SEQ ID NO: 34919 - DNA, 22 bp, Artificial sequence
  synthetic polynucleotide sequence
aagccacacagggatcctgaga

SEQ ID NO: 34920 - DNA, 18 bp, Artificial sequence
  synthetic polynucleotide sequence
ggcccaggtccatcagga

SEQ ID NO: 34921 - DNA, 20 bp, Artificial sequence
  synthetic polynucleotide sequence
ctaacacccctgcagtacca

SEQ ID NO: 34922 - DNA, 20 bp, Artificial sequence
  synthetic polynucleotide sequence
tggaatgaaggccaacctga

SEQ ID NO: 34923 - DNA, 20 bp, Artificial sequence
  synthetic polynucleotide sequence
actgggggaagcacagtgca

SEQ ID NO: 34924 - DNA, 20 bp, Artificial sequence
  synthetic polynucleotide sequence
gagtccaaggtgcccaggaa

SEQ ID NO: 34925 - DNA, 18 bp, Artificial sequence
  synthetic polynucleotide sequence
ccacagcatggagagcca

SEQ ID NO: 34926 - DNA, 18 bp, Artificial sequence
  synthetic polynucleotide sequence
attcagggggcaggcaga

SEQ ID NO: 34927 - DNA, 18 bp, Artificial sequence
  synthetic polynucleotide sequence
tgagagctgccagcacga

SEQ ID NO: 34928 - DNA, 18 bp, Artificial sequence
  synthetic polynucleotide sequence
ccagtgcagccacaagca

SEQ ID NO: 34929 - DNA, 22 bp, Artificial sequence
  synthetic polynucleotide sequence
agcaaaccccagaggttcagca

SEQ ID NO: 34930 - DNA, 21 bp, Artificial sequence
  synthetic polynucleotide sequence
acccacagcggtctactacca

SEQ ID NO: 34931 - DNA, 19 bp, Artificial sequence
  synthetic polynucleotide sequence
ccagctcaccccagggaca

SEQ ID NO: 34932 - DNA, 21 bp, Artificial sequence
  synthetic polynucleotide sequence
gaagaggaacacagtgcccca

SEQ ID NO: 34933 - DNA, 18 bp, Artificial sequence
  synthetic polynucleotide sequence
cgcgccaaggcaaagaga

SEQ ID NO: 34934 - DNA, 18 bp, Artificial sequence
  synthetic polynucleotide sequence
gggccgtgtagagtccca

SEQ ID NO: 34935 - DNA, 20 bp, Artificial sequence
  synthetic polynucleotide sequence
tattcgccgccgccaagaca

SEQ ID NO: 34936 - DNA, 20 bp, Artificial sequence
  synthetic polynucleotide sequence
ctgacggaacttgcgctcca

SEQ ID NO: 34937 - DNA, 20 bp, Artificial sequence
  synthetic polynucleotide sequence
acctgcgcggactcctgcaa

SEQ ID NO: 34938 - DNA, 20 bp, Artificial sequence
  synthetic polynucleotide sequence
tgcacacacagtccttggca

SEQ ID NO: 34939 - DNA, 19 bp, Artificial sequence
  synthetic polynucleotide sequence
ggagagaggccaggaccaa

SEQ ID NO: 34940 - DNA, 18 bp, Artificial sequence
  synthetic polynucleotide sequence
gcgcaggatctcacggca

SEQ ID NO: 34941 - DNA, 18 bp, Artificial sequence
  synthetic polynucleotide sequence
ctcacagccagcagccaa

SEQ ID NO: 34942 - DNA, 18 bp, Artificial sequence
  synthetic polynucleotide sequence
ggcaagttgggtcggcga

SEQ ID NO: 34943 - DNA, 18 bp, Artificial sequence
  synthetic polynucleotide sequence
gccatgcagggaatgcca

SEQ ID NO: 34944 - DNA, 19 bp, Artificial sequence
  synthetic polynucleotide sequence
tttgcagacctgacgagca

SEQ ID NO: 34945 - DNA, 21 bp, Artificial sequence
  synthetic polynucleotide sequence
ggcatggaaggcagcacacca

SEQ ID NO: 34946 - DNA, 22 bp, Artificial sequence
  synthetic polynucleotide sequence
aatgacaatatcgccgggctga

SEQ ID NO: 34947 - DNA, 22 bp, Artificial sequence
  synthetic polynucleotide sequence
ccaatcctctggaatggccaga

SEQ ID NO: 34948 - DNA, 21 bp, Artificial sequence
  synthetic polynucleotide sequence
gtggcccagcaactgttcaga

SEQ ID NO: 34949 - DNA, 20 bp, Artificial sequence
  synthetic polynucleotide sequence
gtggatgacagcttcagcca

SEQ ID NO: 34950 - DNA, 20 bp, Artificial sequence
  synthetic polynucleotide sequence
gaggtcgccaactagcagga

SEQ ID NO: 34951 - DNA, 21 bp, Artificial sequence
  synthetic polynucleotide sequence
tgctgctaccctcatcacaca

SEQ ID NO: 34952 - DNA, 19 bp, Artificial sequence
  synthetic polynucleotide sequence
tgacgaggtaggccagtga

SEQ ID NO: 34953 - DNA, 21 bp, Artificial sequence
  synthetic polynucleotide sequence
ccattggggtggggtcagaga

SEQ ID NO: 34954 - DNA, 20 bp, Artificial sequence
  synthetic polynucleotide sequence
cttgttgaggatccgggcca

SEQ ID NO: 34955 - DNA, 25 bp, Artificial sequence
  synthetic polynucleotide sequence
agagcagctcctagcagcatcaaca

SEQ ID NO: 34956 - DNA, 25 bp, Artificial sequence
  synthetic polynucleotide sequence
ttacaggatgggagaaggaaaggca

SEQ ID NO: 34957 - DNA, 18 bp, Artificial sequence
  synthetic polynucleotide sequence
cttcccaagtgccgccaa

SEQ ID NO: 34958 - DNA, 21 bp, Artificial sequence
  synthetic polynucleotide sequence
ttggtctgtgaaggaggcaca

SEQ ID NO: 34959 - DNA, 22 bp, Artificial sequence
  synthetic polynucleotide sequence
attgggtcacaatgatcccgca

SEQ ID NO: 34960 - DNA, 22 bp, Artificial sequence
  synthetic polynucleotide sequence
ggatttcagctcctggaccaca

SEQ ID NO: 34961 - DNA, 21 bp, Artificial sequence
  synthetic polynucleotide sequence
ttaagtcccaggacggtggaa

SEQ ID NO: 34962 - DNA, 20 bp, Artificial sequence
  synthetic polynucleotide sequence
ggactgggatctcagcagca

SEQ ID NO: 34963 - DNA, 20 bp, Artificial sequence
  synthetic polynucleotide sequence
cagaccctccattgccacca

SEQ ID NO: 34964 - DNA, 22 bp, Artificial sequence
  synthetic polynucleotide sequence
aaatccacgcctagaagaacca

SEQ ID NO: 34965 - DNA, 22 bp, Artificial sequence
  synthetic polynucleotide sequence
aaggggcagacacagatcccta

SEQ ID NO: 34966 - DNA, 18 bp, Artificial sequence
  synthetic polynucleotide sequence
cctcctcctcccgagcca

SEQ ID NO: 34967 - DNA, 21 bp, Artificial sequence
  synthetic polynucleotide sequence
atgccgggactctgcaaagga

SEQ ID NO: 34968 - DNA, 21 bp, Artificial sequence
  synthetic polynucleotide sequence
cgggaacaggggctgaagaga

SEQ ID NO: 34969 - DNA, 21 bp, Artificial sequence
  synthetic polynucleotide sequence
gagaactgagggaactgcaca

SEQ ID NO: 34970 - DNA, 20 bp, Artificial sequence
  synthetic polynucleotide sequence
gtggtattgcagcaggccaa

SEQ ID NO: 34971 - DNA, 22 bp, Artificial sequence
  synthetic polynucleotide sequence
tacagtgcttcacggagacaca

SEQ ID NO: 34972 - DNA, 22 bp, Artificial sequence
  synthetic polynucleotide sequence
gaaatgagcatgttggcaccca

SEQ ID NO: 34973 - DNA, 20 bp, Artificial sequence
  synthetic polynucleotide sequence
ggaagcccagctcctcctga

SEQ ID NO: 34974 - DNA, 19 bp, Artificial sequence
  synthetic polynucleotide sequence
tctgtccagctcaaaccca

SEQ ID NO: 34975 - DNA, 25 bp, Artificial sequence
  synthetic polynucleotide sequence
gcaggagcagcaaaatctcactgca

SEQ ID NO: 34976 - DNA, 19 bp, Artificial sequence
  synthetic polynucleotide sequence
cccagtgcagggggaggca

SEQ ID NO: 34977 - DNA, 21 bp, Artificial sequence
  synthetic polynucleotide sequence
ctgaagaagccagctctgcca

SEQ ID NO: 34978 - DNA, 21 bp, Artificial sequence
  synthetic polynucleotide sequence
cagggctggcagaacaaagca

SEQ ID NO: 34979 - DNA, 19 bp, Artificial sequence
  synthetic polynucleotide sequence
catcatcgcgggctgccca

SEQ ID NO: 34980 - DNA, 21 bp, Artificial sequence
  synthetic polynucleotide sequence
gaggaaaacacggtggctgga

SEQ ID NO: 34981 - DNA, 20 bp, Artificial sequence
  synthetic polynucleotide sequence
ggggaggagaccatggctga

SEQ ID NO: 34982 - DNA, 20 bp, Artificial sequence
  synthetic polynucleotide sequence
gttacccgtgcccgtgagca

SEQ ID NO: 34983 - DNA, 20 bp, Artificial sequence
  synthetic polynucleotide sequence
acgaggcgcccaccagaaca

SEQ ID NO: 34984 - DNA, 20 bp, Artificial sequence
  synthetic polynucleotide sequence
gagtccacggctcaggctga

SEQ ID NO: 34985 - DNA, 18 bp, Artificial sequence
  synthetic polynucleotide sequence
aaaggtggcgctgcagga

SEQ ID NO: 34986 - DNA, 18 bp, Artificial sequence
  synthetic polynucleotide sequence
cgagcatcaatggccgca

SEQ ID NO: 34987 - DNA, 21 bp, Artificial sequence
  synthetic polynucleotide sequence
gcgggactccatcgtcagaga

SEQ ID NO: 34988 - DNA, 21 bp, Artificial sequence
  synthetic polynucleotide sequence
actgctatctggagggaggca

SEQ ID NO: 34989 - DNA, 20 bp, Artificial sequence
  synthetic polynucleotide sequence
tgatcaaggaaggagcagca

SEQ ID NO: 34990 - DNA, 18 bp, Artificial sequence
  synthetic polynucleotide sequence
atggggccaacacctcca

SEQ ID NO: 34991 - DNA, 20 bp, Artificial sequence
  synthetic polynucleotide sequence
cagaccacgttgatgagcga

SEQ ID NO: 34992 - DNA, 20 bp, Artificial sequence
  synthetic polynucleotide sequence
ggatcttccagccacaacca

SEQ ID NO: 34993 - DNA, 19 bp, Artificial sequence
  synthetic polynucleotide sequence
ccagcctgctgaaggagga

SEQ ID NO: 34994 - DNA, 18 bp, Artificial sequence
  synthetic polynucleotide sequence
cacgatggggtcggagga

SEQ ID NO: 34995 - DNA, 19 bp, Artificial sequence
  synthetic polynucleotide sequence
ggccttgtccacaggggga

SEQ ID NO: 34996 - DNA, 22 bp, Artificial sequence
  synthetic polynucleotide sequence
caaacagcgcttcagataggca

SEQ ID NO: 34997 - DNA, 21 bp, Artificial sequence
  synthetic polynucleotide sequence
cacacccggaccagaaaccaa

SEQ ID NO: 34998 - DNA, 18 bp, Artificial sequence
  synthetic polynucleotide sequence
cctgccaggtgagccgca

SEQ ID NO: 34999 - DNA, 22 bp, Artificial sequence
  synthetic polynucleotide sequence
cacatcagaaagcccgtgagaa

SEQ ID NO: 35000 - DNA, 22 bp, Artificial sequence
  synthetic polynucleotide sequence
ggcctcaacagaaccatcaaca

SEQ ID NO: 35001 - DNA, 20 bp, Artificial sequence
  synthetic polynucleotide sequence
tgggaaacatgcaccgagca

SEQ ID NO: 35002 - DNA, 19 bp, Artificial sequence
  synthetic polynucleotide sequence
ctctgccgctcctggagga

SEQ ID NO: 35003 - DNA, 21 bp, Artificial sequence
  synthetic polynucleotide sequence
agtggagcagcgttacatgga

SEQ ID NO: 35004 - DNA, 20 bp, Artificial sequence
  synthetic polynucleotide sequence
tgcgaaggactggaaggtga

SEQ ID NO: 35005 - DNA, 21 bp, Artificial sequence
  synthetic polynucleotide sequence
gcacagatggaagaggctcca

SEQ ID NO: 35006 - DNA, 21 bp, Artificial sequence
  synthetic polynucleotide sequence
ctgctgatcactccaagggga

SEQ ID NO: 35007 - DNA, 19 bp, Artificial sequence
  synthetic polynucleotide sequence
ctcaccagcgagtgaagca

SEQ ID NO: 35008 - DNA, 21 bp, Artificial sequence
  synthetic polynucleotide sequence
aaactggagagaccagtccca

SEQ ID NO: 35009 - DNA, 18 bp, Artificial sequence
  synthetic polynucleotide sequence
agcctggctgaccaggaa

SEQ ID NO: 35010 - DNA, 20 bp, Artificial sequence
  synthetic polynucleotide sequence
caggtagcagcgtctccaga

SEQ ID NO: 35011 - DNA, 23 bp, Artificial sequence
  synthetic polynucleotide sequence
taaaacggaagacctgtcaagca

SEQ ID NO: 35012 - DNA, 21 bp, Artificial sequence
  synthetic polynucleotide sequence
agacagcagaggtcggatgca

SEQ ID NO: 35013 - DNA, 19 bp, Artificial sequence
  synthetic polynucleotide sequence
gagagactcggctgcagga

SEQ ID NO: 35014 - DNA, 18 bp, Artificial sequence
  synthetic polynucleotide sequence
ccgatggcaccggaagga

SEQ ID NO: 35015 - DNA, 21 bp, Artificial sequence
  synthetic polynucleotide sequence
tcactggcgctgtacgaggaa

SEQ ID NO: 35016 - DNA, 21 bp, Artificial sequence
  synthetic polynucleotide sequence
tcacctcgactagaagcacca

SEQ ID NO: 35017 - DNA, 20 bp, Artificial sequence
  synthetic polynucleotide sequence
agtcaggccaccagcaggaa

SEQ ID NO: 35018 - DNA, 20 bp, Artificial sequence
  synthetic polynucleotide sequence
agaaggcactgtcgcacgca

SEQ ID NO: 35019 - DNA, 21 bp, Artificial sequence
  synthetic polynucleotide sequence
tctcctacaggtacgccccaa

SEQ ID NO: 35020 - DNA, 21 bp, Artificial sequence
  synthetic polynucleotide sequence
tctagaggagtttggcaggca

SEQ ID NO: 35021 - DNA, 21 bp, Artificial sequence
  synthetic polynucleotide sequence
tacgtcatggataccaggcca

SEQ ID NO: 35022 - DNA, 20 bp, Artificial sequence
  synthetic polynucleotide sequence
aagccatcccgagctctcca

SEQ ID NO: 35023 - DNA, 21 bp, Artificial sequence
  synthetic polynucleotide sequence
catagccaacactccccagga

SEQ ID NO: 35024 - DNA, 21 bp, Artificial sequence
  synthetic polynucleotide sequence
gctcaaatcctccaccccgga

SEQ ID NO: 35025 - DNA, 20 bp, Artificial sequence
  synthetic polynucleotide sequence
gcaccctatccagggaagga

SEQ ID NO: 35026 - DNA, 20 bp, Artificial sequence
  synthetic polynucleotide sequence
tatggccctaaggctgccca

SEQ ID NO: 35027 - DNA, 20 bp, Artificial sequence
  synthetic polynucleotide sequence
agggctggaaagcgtggcta

SEQ ID NO: 35028 - DNA, 19 bp, Artificial sequence
  synthetic polynucleotide sequence
ttactgagccatcggtcca

SEQ ID NO: 35029 - DNA, 22 bp, Artificial sequence
  synthetic polynucleotide sequence
tgaaacctgaccgcaaacccaa

SEQ ID NO: 35030 - DNA, 22 bp, Artificial sequence
  synthetic polynucleotide sequence
caggccaatgaagttcagagga

SEQ ID NO: 35031 - DNA, 20 bp, Artificial sequence
  synthetic polynucleotide sequence
gaaaggcctggggcagaaga

SEQ ID NO: 35032 - DNA, 20 bp, Artificial sequence
  synthetic polynucleotide sequence
cgctggggggaaggggagaa

SEQ ID NO: 35033 - DNA, 20 bp, Artificial sequence
  synthetic polynucleotide sequence
cggctcacactgcgagggta

SEQ ID NO: 35034 - DNA, 21 bp, Artificial sequence
  synthetic polynucleotide sequence
catcgagagctctgacaggca

SEQ ID NO: 35035 - DNA, 19 bp, Artificial sequence
  synthetic polynucleotide sequence
ctgcgagagcacaaggaca

SEQ ID NO: 35036 - DNA, 20 bp, Artificial sequence
  synthetic polynucleotide sequence
gactggccagcagagtagga

SEQ ID NO: 35037 - DNA, 19 bp, Artificial sequence
  synthetic polynucleotide sequence
ctcacaccaggcctccgga

SEQ ID NO: 35038 - DNA, 20 bp, Artificial sequence
  synthetic polynucleotide sequence
agtgaatgtgctcgagccca

SEQ ID NO: 35039 - DNA, 20 bp, Artificial sequence
  synthetic polynucleotide sequence
tatgcagcagattgtgggca

SEQ ID NO: 35040 - DNA, 21 bp, Artificial sequence
  synthetic polynucleotide sequence
gcttcaaaggcggtcagtcca

SEQ ID NO: 35041 - DNA, 19 bp, Artificial sequence
  synthetic polynucleotide sequence
gctgcagagcccatagcca

SEQ ID NO: 35042 - DNA, 18 bp, Artificial sequence
  synthetic polynucleotide sequence
ggcccaggtagtcacgga

SEQ ID NO: 35043 - DNA, 18 bp, Artificial sequence
  synthetic polynucleotide sequence
agttcagcgcatccccga

SEQ ID NO: 35044 - DNA, 20 bp, Artificial sequence
  synthetic polynucleotide sequence
ctcatctggctgaggaagga

SEQ ID NO: 35045 - DNA, 21 bp, Artificial sequence
  synthetic polynucleotide sequence
gccgcgtccatactagcacca

SEQ ID NO: 35046 - DNA, 18 bp, Artificial sequence
  synthetic polynucleotide sequence
tgctgccccccagctcca

SEQ ID NO: 35047 - DNA, 22 bp, Artificial sequence
  synthetic polynucleotide sequence
taccctagggataacagcgcaa

SEQ ID NO: 35048 - DNA, 21 bp, Artificial sequence
  synthetic polynucleotide sequence
cccctaatagcggtgacacca

SEQ ID NO: 35049 - DNA, 20 bp, Artificial sequence
  synthetic polynucleotide sequence
cctgcctgtgaagaggcgaa

SEQ ID NO: 35050 - DNA, 20 bp, Artificial sequence
  synthetic polynucleotide sequence
tccgaggtcaccccaaccaa

SEQ ID NO: 35051 - DNA, 25 bp, Artificial sequence
  synthetic polynucleotide sequence
acccaagaacagctgaaagagcaca

SEQ ID NO: 35052 - DNA, 20 bp, Artificial sequence
  synthetic polynucleotide sequence
ccagctatcaccaggctcca

SEQ ID NO: 35053 - DNA, 18 bp, Artificial sequence
  synthetic polynucleotide sequence
ggccaggaggaaagccaa

SEQ ID NO: 35054 - DNA, 19 bp, Artificial sequence
  synthetic polynucleotide sequence
gcagatcacgctgaaggca

SEQ ID NO: 35055 - DNA, 19 bp, Artificial sequence
  synthetic polynucleotide sequence
gtggtgaccaggaggcaga

SEQ ID NO: 35056 - DNA, 18 bp, Artificial sequence
  synthetic polynucleotide sequence
gtggtggggaggccagca

SEQ ID NO: 35057 - DNA, 20 bp, Artificial sequence
  synthetic polynucleotide sequence
caccagccagaagtcctcca

SEQ ID NO: 35058 - DNA, 20 bp, Artificial sequence
  synthetic polynucleotide sequence
gggctgctcatgggagccga

SEQ ID NO: 35059 - DNA, 20 bp, Artificial sequence
  synthetic polynucleotide sequence
aaaggctgtccacaggcaga

SEQ ID NO: 35060 - DNA, 18 bp, Artificial sequence
  synthetic polynucleotide sequence
ctatccggctgaggggca

SEQ ID NO: 35061 - DNA, 21 bp, Artificial sequence
  synthetic polynucleotide sequence
cgtgtggagtgagagcgagga

SEQ ID NO: 35062 - DNA, 20 bp, Artificial sequence
  synthetic polynucleotide sequence
atctgcatccggaagcccca

SEQ ID NO: 35063 - DNA, 19 bp, Artificial sequence
  synthetic polynucleotide sequence
gatgcgctgccccctgaga

SEQ ID NO: 35064 - DNA, 20 bp, Artificial sequence
  synthetic polynucleotide sequence
agtgactagctctccccgga

SEQ ID NO: 35065 - DNA, 21 bp, Artificial sequence
  synthetic polynucleotide sequence
gacccataacaacagccacca

SEQ ID NO: 35066 - DNA, 20 bp, Artificial sequence
  synthetic polynucleotide sequence
ggagacgtgagtatccggga

SEQ ID NO: 35067 - DNA, 20 bp, Artificial sequence
  synthetic polynucleotide sequence
agtgggaagctgcaggtcca

SEQ ID NO: 35068 - DNA, 20 bp, Artificial sequence
  synthetic polynucleotide sequence
atgccgctgagcaaggcgta

SEQ ID NO: 35069 - DNA, 21 bp, Artificial sequence
  synthetic polynucleotide sequence
gtctcccagattgcagctgca

SEQ ID NO: 35070 - DNA, 22 bp, Artificial sequence
  synthetic polynucleotide sequence
aaaaggcctgcactgcaagaga

SEQ ID NO: 35071 - DNA, 21 bp, Artificial sequence
  synthetic polynucleotide sequence
ctggagaggttcaagaggcga

SEQ ID NO: 35072 - DNA, 22 bp, Artificial sequence
  synthetic polynucleotide sequence
aatgtgtgaagcactgcaggga

SEQ ID NO: 35073 - DNA, 20 bp, Artificial sequence
  synthetic polynucleotide sequence
gtccacgacgtggagacaca

SEQ ID NO: 35074 - DNA, 19 bp, Artificial sequence
  synthetic polynucleotide sequence
cggcactgacagacagcca

SEQ ID NO: 35075 - DNA, 21 bp, Artificial sequence
  synthetic polynucleotide sequence
ttccacagcagctcagacgca

SEQ ID NO: 35076 - DNA, 21 bp, Artificial sequence
  synthetic polynucleotide sequence
gatgtgctggaactcgcagga

SEQ ID NO: 35077 - DNA, 22 bp, Artificial sequence
  synthetic polynucleotide sequence
tgcagacagtgagtcaaccaca

SEQ ID NO: 35078 - DNA, 18 bp, Artificial sequence
  synthetic polynucleotide sequence
gccagtgggaggccctga

SEQ ID NO: 35079 - DNA, 21 bp, Artificial sequence
  synthetic polynucleotide sequence
tacccaacaacagccacggaa

SEQ ID NO: 35080 - DNA, 22 bp, Artificial sequence
  synthetic polynucleotide sequence
tgaagacagagcaggtgtagca

SEQ ID NO: 35081 - DNA, 22 bp, Artificial sequence
  synthetic polynucleotide sequence
caaatggccagcacaatcccca

SEQ ID NO: 35082 - DNA, 19 bp, Artificial sequence
  synthetic polynucleotide sequence
gctcccaggctggtagcca

SEQ ID NO: 35083 - DNA, 20 bp, Artificial sequence
  synthetic polynucleotide sequence
aactgctgaaggtaccggca

SEQ ID NO: 35084 - DNA, 20 bp, Artificial sequence
  synthetic polynucleotide sequence
gtgtggtgctgacaggcaca

SEQ ID NO: 35085 - DNA, 18 bp, Artificial sequence
  synthetic polynucleotide sequence
tgaagcccccaacagcca

SEQ ID NO: 35086 - DNA, 18 bp, Artificial sequence
  synthetic polynucleotide sequence
tcagccgcaggaggagga

SEQ ID NO: 35087 - DNA, 21 bp, Artificial sequence
  synthetic polynucleotide sequence
ctactgcagtgagtgaggcga

SEQ ID NO: 35088 - DNA, 18 bp, Artificial sequence
  synthetic polynucleotide sequence
cctccagggcctggacca

SEQ ID NO: 35089 - DNA, 21 bp, Artificial sequence
  synthetic polynucleotide sequence
ctactgaaggctccgagacca

SEQ ID NO: 35090 - DNA, 21 bp, Artificial sequence
  synthetic polynucleotide sequence
cagagcccatgatggatgcca

SEQ ID NO: 35091 - DNA, 20 bp, Artificial sequence
  synthetic polynucleotide sequence
gctcccacgggctatgaaga

SEQ ID NO: 35092 - DNA, 20 bp, Artificial sequence
  synthetic polynucleotide sequence
acgcactggccctggtgaca

SEQ ID NO: 35093 - DNA, 18 bp, Artificial sequence
  synthetic polynucleotide sequence
cttgagcctcacgacgca

SEQ ID NO: 35094 - DNA, 18 bp, Artificial sequence
  synthetic polynucleotide sequence
agagcgcgatcaccgaga

SEQ ID NO: 35095 - DNA, 20 bp, Artificial sequence
  synthetic polynucleotide sequence
ccattcacctgcccagccga

SEQ ID NO: 35096 - DNA, 20 bp, Artificial sequence
  synthetic polynucleotide sequence
ggtcatgccctccggacaga

SEQ ID NO: 35097 - DNA, 20 bp, Artificial sequence
  synthetic polynucleotide sequence
cttctgccctgaggaccaga

SEQ ID NO: 35098 - DNA, 18 bp, Artificial sequence
  synthetic polynucleotide sequence
gcttgcactgcaccgaca

SEQ ID NO: 35099 - DNA, 18 bp, Artificial sequence
  synthetic polynucleotide sequence
caggcccacagaacagca

SEQ ID NO: 35100 - DNA, 18 bp, Artificial sequence
  synthetic polynucleotide sequence
ggagcaggtcttcacgca

SEQ ID NO: 35101 - DNA, 20 bp, Artificial sequence
  synthetic polynucleotide sequence
cagagaccacagctgtccca

SEQ ID NO: 35102 - DNA, 20 bp, Artificial sequence
  synthetic polynucleotide sequence
tctggtggagctgaggcgga

SEQ ID NO: 35103 - DNA, 20 bp, Artificial sequence
  synthetic polynucleotide sequence
ctccagctgacacgtatcca

SEQ ID NO: 35104 - DNA, 19 bp, Artificial sequence
  synthetic polynucleotide sequence
tgcagtggtaggagcagca

SEQ ID NO: 35105 - DNA, 21 bp, Artificial sequence
  synthetic polynucleotide sequence
agcatgaggcccagctgctga

SEQ ID NO: 35106 - DNA, 19 bp, Artificial sequence
  synthetic polynucleotide sequence
gctctggcaaggcgcggta

SEQ ID NO: 35107 - DNA, 20 bp, Artificial sequence
  synthetic polynucleotide sequence
ctgcagggcgtctaccagga

SEQ ID NO: 35108 - DNA, 19 bp, Artificial sequence
  synthetic polynucleotide sequence
gtccacctcgtccaccgca

SEQ ID NO: 35109 - DNA, 21 bp, Artificial sequence
  synthetic polynucleotide sequence
gagagcgaggatacctgccta

SEQ ID NO: 35110 - DNA, 21 bp, Artificial sequence
  synthetic polynucleotide sequence
ccttgaacaactcccagggca

SEQ ID NO: 35111 - DNA, 18 bp, Artificial sequence
  synthetic polynucleotide sequence
gcgagtctctgggcccca

SEQ ID NO: 35112 - DNA, 18 bp, Artificial sequence
  synthetic polynucleotide sequence
aaggctcgggggtgggga

SEQ ID NO: 35113 - DNA, 21 bp, Artificial sequence
  synthetic polynucleotide sequence
gtgacttcaacgcaggagcca

SEQ ID NO: 35114 - DNA, 19 bp, Artificial sequence
  synthetic polynucleotide sequence
tcctctgtagacgcccaca

SEQ ID NO: 35115 - DNA, 21 bp, Artificial sequence
  synthetic polynucleotide sequence
tgtgtgctgtcgggaagccaa

SEQ ID NO: 35116 - DNA, 21 bp, Artificial sequence
  synthetic polynucleotide sequence
ggtaagccatgccagctgcca

SEQ ID NO: 35117 - DNA, 18 bp, Artificial sequence
  synthetic polynucleotide sequence
gcgcccccctgtgaagga

SEQ ID NO: 35118 - DNA, 19 bp, Artificial sequence
  synthetic polynucleotide sequence
ggccgagccagcttgctca

SEQ ID NO: 35119 - DNA, 21 bp, Artificial sequence
  synthetic polynucleotide sequence
atgtgtggaggggtgatacca

SEQ ID NO: 35120 - DNA, 22 bp, Artificial sequence
  synthetic polynucleotide sequence
atcatcaagcacctgaacggca

SEQ ID NO: 35121 - DNA, 18 bp, Artificial sequence
  synthetic polynucleotide sequence
cagaaaggccagccgcaa

SEQ ID NO: 35122 - DNA, 18 bp, Artificial sequence
  synthetic polynucleotide sequence
cggacgggaactcccaca

SEQ ID NO: 35123 - DNA, 19 bp, Artificial sequence
  synthetic polynucleotide sequence
cttcacactccacccacga

SEQ ID NO: 35124 - DNA, 19 bp, Artificial sequence
  synthetic polynucleotide sequence
tctccaccacgaagccgta

SEQ ID NO: 35125 - DNA, 22 bp, Artificial sequence
  synthetic polynucleotide sequence
agaagccttgccagaaacgtca

SEQ ID NO: 35126 - DNA, 19 bp, Artificial sequence
  synthetic polynucleotide sequence
ttccagaggtcagcatcca

SEQ ID NO: 35127 - DNA, 18 bp, Artificial sequence
  synthetic polynucleotide sequence
cccaggctcgaatggaga

SEQ ID NO: 35128 - DNA, 18 bp, Artificial sequence
  synthetic polynucleotide sequence
cgcaggggtcatccagga

SEQ ID NO: 35129 - DNA, 18 bp, Artificial sequence
  synthetic polynucleotide sequence
cgaagcaggccctgacca

SEQ ID NO: 35130 - DNA, 18 bp, Artificial sequence
  synthetic polynucleotide sequence
gactcggctgtccaggga

SEQ ID NO: 35131 - DNA, 18 bp, Artificial sequence
  synthetic polynucleotide sequence
gctgaacaaggggcagga

SEQ ID NO: 35132 - DNA, 18 bp, Artificial sequence
  synthetic polynucleotide sequence
gcccagctgagagggaca

SEQ ID NO: 35133 - DNA, 20 bp, Artificial sequence
  synthetic polynucleotide sequence
caccacagaggctctcagca

SEQ ID NO: 35134 - DNA, 18 bp, Artificial sequence
  synthetic polynucleotide sequence
acacgaggttccgcacca

SEQ ID NO: 35135 - DNA, 18 bp, Artificial sequence
  synthetic polynucleotide sequence
ccagcaaacgtctcgcca

SEQ ID NO: 35136 - DNA, 20 bp, Artificial sequence
  synthetic polynucleotide sequence
tgctcttgaagcagccagga

SEQ ID NO: 35137 - DNA, 18 bp, Artificial sequence
  synthetic polynucleotide sequence
cagcagcagtgtgagcga

SEQ ID NO: 35138 - DNA, 20 bp, Artificial sequence
  synthetic polynucleotide sequence
gaccaagacacgccttgtga

SEQ ID NO: 35139 - DNA, 20 bp, Artificial sequence
  synthetic polynucleotide sequence
cacatccagaagctggagga

SEQ ID NO: 35140 - DNA, 20 bp, Artificial sequence
  synthetic polynucleotide sequence
cgctcagaggagaggcctga

SEQ ID NO: 35141 - DNA, 20 bp, Artificial sequence
  synthetic polynucleotide sequence
gagcagctgcagcaggagca

SEQ ID NO: 35142 - DNA, 20 bp, Artificial sequence
  synthetic polynucleotide sequence
agtcgtccgtggagacagca

SEQ ID NO: 35143 - DNA, 18 bp, Artificial sequence
  synthetic polynucleotide sequence
gcgactggaacagctgca

SEQ ID NO: 35144 - DNA, 21 bp, Artificial sequence
  synthetic polynucleotide sequence
tctcgctctgaatcagaacga

SEQ ID NO: 35145 - DNA, 20 bp, Artificial sequence
  synthetic polynucleotide sequence
ccactgtgcgggagatagca

SEQ ID NO: 35146 - DNA, 20 bp, Artificial sequence
  synthetic polynucleotide sequence
gcagaaccacaccctcggga

SEQ ID NO: 35147 - DNA, 20 bp, Artificial sequence
  synthetic polynucleotide sequence
agctggaggaggagcagaga

SEQ ID NO: 35148 - DNA, 18 bp, Artificial sequence
  synthetic polynucleotide sequence
ctgcacgtcgccgtcgga

SEQ ID NO: 35149 - DNA, 18 bp, Artificial sequence
  synthetic polynucleotide sequence
ccaggcccagaccccaca

SEQ ID NO: 35150 - DNA, 19 bp, Artificial sequence
  synthetic polynucleotide sequence
gcggccaggaggacagtga

SEQ ID NO: 35151 - DNA, 18 bp, Artificial sequence
  synthetic polynucleotide sequence
gccgccgtgatctggcca

SEQ ID NO: 35152 - DNA, 22 bp, Artificial sequence
  synthetic polynucleotide sequence
ttgacgtaggtgaagatggcca

SEQ ID NO: 35153 - DNA, 18 bp, Artificial sequence
  synthetic polynucleotide sequence
cctgcaaggcacagcaca

SEQ ID NO: 35154 - DNA, 18 bp, Artificial sequence
  synthetic polynucleotide sequence
acaggggaacgcttggga

SEQ ID NO: 35155 - DNA, 18 bp, Artificial sequence
  synthetic polynucleotide sequence
ggaaaaccaggcccgaga

SEQ ID NO: 35156 - DNA, 18 bp, Artificial sequence
  synthetic polynucleotide sequence
ggtctgcgaactgcacca

SEQ ID NO: 35157 - DNA, 18 bp, Artificial sequence
  synthetic polynucleotide sequence
ggagccatggaatgccaa

SEQ ID NO: 35158 - DNA, 18 bp, Artificial sequence
  synthetic polynucleotide sequence
tgcctggggaatgaccca

SEQ ID NO: 35159 - DNA, 20 bp, Artificial sequence
  synthetic polynucleotide sequence
catctcagacctgagccgga

SEQ ID NO: 35160 - DNA, 22 bp, Artificial sequence
  synthetic polynucleotide sequence
ctattctcagtgacaggggaca

SEQ ID NO: 35161 - DNA, 21 bp, Artificial sequence
  synthetic polynucleotide sequence
atcatcgaaccagtgccacca

SEQ ID NO: 35162 - DNA, 21 bp, Artificial sequence
  synthetic polynucleotide sequence
ccatccctggcgatcactgca

SEQ ID NO: 35163 - DNA, 21 bp, Artificial sequence
  synthetic polynucleotide sequence
acggcccgcatcctcaagaca

SEQ ID NO: 35164 - DNA, 19 bp, Artificial sequence
  synthetic polynucleotide sequence
cgggtggcctctgacagca

SEQ ID NO: 35165 - DNA, 22 bp, Artificial sequence
  synthetic polynucleotide sequence
cagaaagccgacaagaagacca

SEQ ID NO: 35166 - DNA, 22 bp, Artificial sequence
  synthetic polynucleotide sequence
gaagacgcggaagtagtagcca

SEQ ID NO: 35167 - DNA, 18 bp, Artificial sequence
  synthetic polynucleotide sequence
tggagcgctaccacccaa

SEQ ID NO: 35168 - DNA, 19 bp, Artificial sequence
  synthetic polynucleotide sequence
ccgaggtgctgagtccaca

SEQ ID NO: 35169 - DNA, 20 bp, Artificial sequence
  synthetic polynucleotide sequence
ggagccagggaccgtgacaa

SEQ ID NO: 35170 - DNA, 23 bp, Artificial sequence
  synthetic polynucleotide sequence
cctggaggcactgaaaagaggga

SEQ ID NO: 35171 - DNA, 20 bp, Artificial sequence
  synthetic polynucleotide sequence
agcagcgactctgaggagga

SEQ ID NO: 35172 - DNA, 18 bp, Artificial sequence
  synthetic polynucleotide sequence
accctcttggcagcagga

SEQ ID NO: 35173 - DNA, 21 bp, Artificial sequence
  synthetic polynucleotide sequence
ggtgctggacacgctgaccaa

SEQ ID NO: 35174 - DNA, 19 bp, Artificial sequence
  synthetic polynucleotide sequence
ttcggccagttctaggcga

SEQ ID NO: 35175 - DNA, 18 bp, Artificial sequence
  synthetic polynucleotide sequence
gctgaatccccaggacca

SEQ ID NO: 35176 - DNA, 19 bp, Artificial sequence
  synthetic polynucleotide sequence
gtgaggaggagcgtggaga

SEQ ID NO: 35177 - DNA, 20 bp, Artificial sequence
  synthetic polynucleotide sequence
tgtgccagaagccaaggcca

SEQ ID NO: 35178 - DNA, 20 bp, Artificial sequence
  synthetic polynucleotide sequence
ctccttctcaggcaggccca

SEQ ID NO: 35179 - DNA, 18 bp, Artificial sequence
  synthetic polynucleotide sequence
ggagcgcaagaggcggaa

SEQ ID NO: 35180 - DNA, 17 bp, Artificial sequence
  synthetic polynucleotide sequence
ccccaccagggcttgca

SEQ ID NO: 35181 - DNA, 18 bp, Artificial sequence
  synthetic polynucleotide sequence
tctcacgctcagggacca

SEQ ID NO: 35182 - DNA, 18 bp, Artificial sequence
  synthetic polynucleotide sequence
cggcctggagggagtgga

SEQ ID NO: 35183 - DNA, 21 bp, Artificial sequence
  synthetic polynucleotide sequence
gtggctgtgaacgtcgaagca

SEQ ID NO: 35184 - DNA, 21 bp, Artificial sequence
  synthetic polynucleotide sequence
aagtgctgatggtgggagaga

SEQ ID NO: 35185 - DNA, 19 bp, Artificial sequence
  synthetic polynucleotide sequence
cagaagcgactgatcccca

SEQ ID NO: 35186 - DNA, 18 bp, Artificial sequence
  synthetic polynucleotide sequence
cttggcaaggcgagtcca

SEQ ID NO: 35187 - DNA, 21 bp, Artificial sequence
  synthetic polynucleotide sequence
caaggagggaccaatgagcaa

SEQ ID NO: 35188 - DNA, 20 bp, Artificial sequence
  synthetic polynucleotide sequence
gtaggccatggcgtactcaa

SEQ ID NO: 35189 - DNA, 19 bp, Artificial sequence
  synthetic polynucleotide sequence
tggaggcattgggatggga

SEQ ID NO: 35190 - DNA, 20 bp, Artificial sequence
  synthetic polynucleotide sequence
accacggtacagctctccca

SEQ ID NO: 35191 - DNA, 23 bp, Artificial sequence
  synthetic polynucleotide sequence
gaaattatgtgggcgcgaatgga

SEQ ID NO: 35192 - DNA, 20 bp, Artificial sequence
  synthetic polynucleotide sequence
tcatagtcagggcagctcga

SEQ ID NO: 35193 - DNA, 18 bp, Artificial sequence
  synthetic polynucleotide sequence
cgaccaaccccaaccaga

SEQ ID NO: 35194 - DNA, 18 bp, Artificial sequence
  synthetic polynucleotide sequence
agcagctctgtcccggca

SEQ ID NO: 35195 - DNA, 22 bp, Artificial sequence
  synthetic polynucleotide sequence
aacggctaaggaaggaggagca

SEQ ID NO: 35196 - DNA, 18 bp, Artificial sequence
  synthetic polynucleotide sequence
caccacttcctccacgca

SEQ ID NO: 35197 - DNA, 18 bp, Artificial sequence
  synthetic polynucleotide sequence
ttacccgaacccaggcca

SEQ ID NO: 35198 - DNA, 18 bp, Artificial sequence
  synthetic polynucleotide sequence
cagggccagtgcttcaca

SEQ ID NO: 35199 - DNA, 18 bp, Artificial sequence
  synthetic polynucleotide sequence
caagaaccgcctgcagca

SEQ ID NO: 35200 - DNA, 18 bp, Artificial sequence
  synthetic polynucleotide sequence
cggcatagcgagcagaga

SEQ ID NO: 35201 - DNA, 20 bp, Artificial sequence
  synthetic polynucleotide sequence
gaaagcaacgtgccctggca

SEQ ID NO: 35202 - DNA, 20 bp, Artificial sequence
  synthetic polynucleotide sequence
catctctggaggcacgggca

SEQ ID NO: 35203 - DNA, 21 bp, Artificial sequence
  synthetic polynucleotide sequence
gaagggagcccacaagtacga

SEQ ID NO: 35204 - DNA, 20 bp, Artificial sequence
  synthetic polynucleotide sequence
caggtcctggagcctaagga

SEQ ID NO: 35205 - DNA, 18 bp, Artificial sequence
  synthetic polynucleotide sequence
ggaaagacgtggagggca

SEQ ID NO: 35206 - DNA, 18 bp, Artificial sequence
  synthetic polynucleotide sequence
gggacaatgcagcggaca

SEQ ID NO: 35207 - DNA, 19 bp, Artificial sequence
  synthetic polynucleotide sequence
tggagagagccaggcacca

SEQ ID NO: 35208 - DNA, 20 bp, Artificial sequence
  synthetic polynucleotide sequence
gcatccagcaacgcctggga

SEQ ID NO: 35209 - DNA, 18 bp, Artificial sequence
  synthetic polynucleotide sequence
ggaagcccgcaatgcaga

SEQ ID NO: 35210 - DNA, 18 bp, Artificial sequence
  synthetic polynucleotide sequence
tcccacccttcagggcca

SEQ ID NO: 35211 - DNA, 22 bp, Artificial sequence
  synthetic polynucleotide sequence
aaatcgagatccagctgagcca

SEQ ID NO: 35212 - DNA, 20 bp, Artificial sequence
  synthetic polynucleotide sequence
gagggcatcatccaggtgga

SEQ ID NO: 35213 - DNA, 25 bp, Artificial sequence
  synthetic polynucleotide sequence
gaggtggaaagtgaacagaagcaca

SEQ ID NO: 35214 - DNA, 20 bp, Artificial sequence
  synthetic polynucleotide sequence
ccaagtcctgcagcctgaga

SEQ ID NO: 35215 - DNA, 18 bp, Artificial sequence
  synthetic polynucleotide sequence
ggcagagatcgagcggaa

SEQ ID NO: 35216 - DNA, 18 bp, Artificial sequence
  synthetic polynucleotide sequence
tctgcagcgagtccacca

SEQ ID NO: 35217 - DNA, 18 bp, Artificial sequence
  synthetic polynucleotide sequence
tgccaccctggagaccaa

SEQ ID NO: 35218 - DNA, 18 bp, Artificial sequence
  synthetic polynucleotide sequence
tcctcctgctccagcaca

SEQ ID NO: 35219 - DNA, 20 bp, Artificial sequence
  synthetic polynucleotide sequence
cagcaggaaggccacagaga

SEQ ID NO: 35220 - DNA, 18 bp, Artificial sequence
  synthetic polynucleotide sequence
cggcattgaaggcacgga

SEQ ID NO: 35221 - DNA, 19 bp, Artificial sequence
  synthetic polynucleotide sequence
gccaggaggacctcaagga

SEQ ID NO: 35222 - DNA, 18 bp, Artificial sequence
  synthetic polynucleotide sequence
tggacacgctcactggca

SEQ ID NO: 35223 - DNA, 18 bp, Artificial sequence
  synthetic polynucleotide sequence
gcccaagcagctgaagga

SEQ ID NO: 35224 - DNA, 20 bp, Artificial sequence
  synthetic polynucleotide sequence
atccttccacagctccgaga

SEQ ID NO: 35225 - DNA, 21 bp, Artificial sequence
  synthetic polynucleotide sequence
tctgggcacaaatcccaccaa

SEQ ID NO: 35226 - DNA, 20 bp, Artificial sequence
  synthetic polynucleotide sequence
atggcggagttcagcaccca

SEQ ID NO: 35227 - DNA, 20 bp, Artificial sequence
  synthetic polynucleotide sequence
cacggacccagaggagacca

SEQ ID NO: 35228 - DNA, 21 bp, Artificial sequence
  synthetic polynucleotide sequence
tgtagtccaggttgccgcaca

SEQ ID NO: 35229 - DNA, 18 bp, Artificial sequence
  synthetic polynucleotide sequence
atgaggctccaggcccca

SEQ ID NO: 35230 - DNA, 20 bp, Artificial sequence
  synthetic polynucleotide sequence
atctgtaaaccgatccccca

SEQ ID NO: 35231 - DNA, 19 bp, Artificial sequence
  synthetic polynucleotide sequence
ctcagcgtgcaacatccaa

SEQ ID NO: 35232 - DNA, 20 bp, Artificial sequence
  synthetic polynucleotide sequence
cttccctagagaagcaagca

SEQ ID NO: 35233 - DNA, 18 bp, Artificial sequence
  synthetic polynucleotide sequence
cggaccctgaggaaacca

SEQ ID NO: 35234 - DNA, 18 bp, Artificial sequence
  synthetic polynucleotide sequence
ccgcctgcgtggtcagca

SEQ ID NO: 35235 - DNA, 22 bp, Artificial sequence
  synthetic polynucleotide sequence
aggacacaggcacctatgagga

SEQ ID NO: 35236 - DNA, 18 bp, Artificial sequence
  synthetic polynucleotide sequence
gtggccagcacgtggcga

SEQ ID NO: 35237 - DNA, 20 bp, Artificial sequence
  synthetic polynucleotide sequence
aacaaggagcagggcaccta

SEQ ID NO: 35238 - DNA, 18 bp, Artificial sequence
  synthetic polynucleotide sequence
ctcccagggtggcaagga

SEQ ID NO: 35239 - DNA, 21 bp, Artificial sequence
  synthetic polynucleotide sequence
ggagaagctgagcggtaccga

SEQ ID NO: 35240 - DNA, 20 bp, Artificial sequence
  synthetic polynucleotide sequence
gtcagcctgggacatcagca

SEQ ID NO: 35241 - DNA, 20 bp, Artificial sequence
  synthetic polynucleotide sequence
ctgaagtcgcggcgtgtgga

SEQ ID NO: 35242 - DNA, 21 bp, Artificial sequence
  synthetic polynucleotide sequence
ttctctccaagggtggtgaga

SEQ ID NO: 35243 - DNA, 22 bp, Artificial sequence
  synthetic polynucleotide sequence
aggtgagtgtcccagaggagga

SEQ ID NO: 35244 - DNA, 18 bp, Artificial sequence
  synthetic polynucleotide sequence
acatgcggaaggcactca

SEQ ID NO: 35245 - DNA, 19 bp, Artificial sequence
  synthetic polynucleotide sequence
cgggagctgctcaccacca

SEQ ID NO: 35246 - DNA, 21 bp, Artificial sequence
  synthetic polynucleotide sequence
tgaggatgcgggtgaactcca

SEQ ID NO: 35247 - DNA, 20 bp, Artificial sequence
  synthetic polynucleotide sequence
accagcgccgtgatgatgca

SEQ ID NO: 35248 - DNA, 21 bp, Artificial sequence
  synthetic polynucleotide sequence
gaaacgaggtccacaacgcca

SEQ ID NO: 35249 - DNA, 18 bp, Artificial sequence
  synthetic polynucleotide sequence
gcccatgggcaatgccaa

SEQ ID NO: 35250 - DNA, 18 bp, Artificial sequence
  synthetic polynucleotide sequence
acacctggcactggagca

SEQ ID NO: 35251 - DNA, 21 bp, Artificial sequence
  synthetic polynucleotide sequence
tgcagccatcgagactccgca

SEQ ID NO: 35252 - DNA, 22 bp, Artificial sequence
  synthetic polynucleotide sequence
atgaagaggatcccgtcacaga

SEQ ID NO: 35253 - DNA, 22 bp, Artificial sequence
  synthetic polynucleotide sequence
agctcttcgaccggatcacaga

SEQ ID NO: 35254 - DNA, 21 bp, Artificial sequence
  synthetic polynucleotide sequence
gcttgaggtccaggtgcagga

SEQ ID NO: 35255 - DNA, 21 bp, Artificial sequence
  synthetic polynucleotide sequence
cagcgtcatgaaccagctgga

SEQ ID NO: 35256 - DNA, 21 bp, Artificial sequence
  synthetic polynucleotide sequence
atgcggtcaaacagctcccca

SEQ ID NO: 35257 - DNA, 20 bp, Artificial sequence
  synthetic polynucleotide sequence
ctgaggatgtgatcaccgga

SEQ ID NO: 35258 - DNA, 18 bp, Artificial sequence
  synthetic polynucleotide sequence
cacactgcgtggtcagca

SEQ ID NO: 35259 - DNA, 21 bp, Artificial sequence
  synthetic polynucleotide sequence
tgcagagactcaaggcccgca

SEQ ID NO: 35260 - DNA, 20 bp, Artificial sequence
  synthetic polynucleotide sequence
ctcgaccttctgccggacca

SEQ ID NO: 35261 - DNA, 20 bp, Artificial sequence
  synthetic polynucleotide sequence
gtggtcagcactgcacgaga

SEQ ID NO: 35262 - DNA, 18 bp, Artificial sequence
  synthetic polynucleotide sequence
tgatgcccacgtgggaca

SEQ ID NO: 35263 - DNA, 21 bp, Artificial sequence
  synthetic polynucleotide sequence
tgctaagccctctggaggaga

SEQ ID NO: 35264 - DNA, 19 bp, Artificial sequence
  synthetic polynucleotide sequence
ctgggcctgtggcagctca

SEQ ID NO: 35265 - DNA, 21 bp, Artificial sequence
  synthetic polynucleotide sequence
gctacaagccctccagagcca

SEQ ID NO: 35266 - DNA, 19 bp, Artificial sequence
  synthetic polynucleotide sequence
tccttgagacggctagcca

SEQ ID NO: 35267 - DNA, 21 bp, Artificial sequence
  synthetic polynucleotide sequence
tgtcgagggaaaagctgccca

SEQ ID NO: 35268 - DNA, 21 bp, Artificial sequence
  synthetic polynucleotide sequence
gtaaatggggagagtgggcca

SEQ ID NO: 35269 - DNA, 18 bp, Artificial sequence
  synthetic polynucleotide sequence
cacacagcgaggaagcca

SEQ ID NO: 35270 - DNA, 18 bp, Artificial sequence
  synthetic polynucleotide sequence
gcctcagccgagtcacca

SEQ ID NO: 35271 - DNA, 21 bp, Artificial sequence
  synthetic polynucleotide sequence
caccaagaagtcccaggccaa

SEQ ID NO: 35272 - DNA, 22 bp, Artificial sequence
  synthetic polynucleotide sequence
tcaatcacatgctcgctgacca

SEQ ID NO: 35273 - DNA, 18 bp, Artificial sequence
  synthetic polynucleotide sequence
catgtggaaggccagcca

SEQ ID NO: 35274 - DNA, 18 bp, Artificial sequence
  synthetic polynucleotide sequence
catcagagtggccacgga

SEQ ID NO: 35275 - DNA, 18 bp, Artificial sequence
  synthetic polynucleotide sequence
gctaaacctgaggcggca

SEQ ID NO: 35276 - DNA, 18 bp, Artificial sequence
  synthetic polynucleotide sequence
agggctgatactccggca

SEQ ID NO: 35277 - DNA, 21 bp, Artificial sequence
  synthetic polynucleotide sequence
caaccccagtcagagagcaga

SEQ ID NO: 35278 - DNA, 22 bp, Artificial sequence
  synthetic polynucleotide sequence
gatatgcccaccaatagggtca

SEQ ID NO: 35279 - DNA, 20 bp, Artificial sequence
  synthetic polynucleotide sequence
gacgctcaggacacagacga

SEQ ID NO: 35280 - DNA, 19 bp, Artificial sequence
  synthetic polynucleotide sequence
gtagtcgacccgtccacca

SEQ ID NO: 35281 - DNA, 19 bp, Artificial sequence
  synthetic polynucleotide sequence
cgaggagatgcgggaggaa

SEQ ID NO: 35282 - DNA, 18 bp, Artificial sequence
  synthetic polynucleotide sequence
cacacttgggcgtcagga

SEQ ID NO: 35283 - DNA, 18 bp, Artificial sequence
  synthetic polynucleotide sequence
gcaagggcttcgtcagga

SEQ ID NO: 35284 - DNA, 18 bp, Artificial sequence
  synthetic polynucleotide sequence
agcacagccccgaagcca

SEQ ID NO: 35285 - DNA, 21 bp, Artificial sequence
  synthetic polynucleotide sequence
cctctgtcctgacaacgagga

SEQ ID NO: 35286 - DNA, 21 bp, Artificial sequence
  synthetic polynucleotide sequence
ccaagatgccaggaggcctca

SEQ ID NO: 35287 - DNA, 18 bp, Artificial sequence
  synthetic polynucleotide sequence
tacccggcaccgtcggaa

SEQ ID NO: 35288 - DNA, 22 bp, Artificial sequence
  synthetic polynucleotide sequence
atgaaggtcagctagtggagga

SEQ ID NO: 35289 - DNA, 22 bp, Artificial sequence
  synthetic polynucleotide sequence
tacacgtctgcggagaaacaca

SEQ ID NO: 35290 - DNA, 20 bp, Artificial sequence
  synthetic polynucleotide sequence
aggaccagacgtcacagcga

SEQ ID NO: 35291 - DNA, 21 bp, Artificial sequence
  synthetic polynucleotide sequence
agacaggaaagactctcccca

SEQ ID NO: 35292 - DNA, 21 bp, Artificial sequence
  synthetic polynucleotide sequence
gtgaaatgaagcccaggccga

SEQ ID NO: 35293 - DNA, 20 bp, Artificial sequence
  synthetic polynucleotide sequence
catgaggaggaggtggagca

SEQ ID NO: 35294 - DNA, 20 bp, Artificial sequence
  synthetic polynucleotide sequence
gagcagtagcgtctggcaga

SEQ ID NO: 35295 - DNA, 19 bp, Artificial sequence
  synthetic polynucleotide sequence
cgtcctcaggacccaagga

SEQ ID NO: 35296 - DNA, 20 bp, Artificial sequence
  synthetic polynucleotide sequence
cagagagtctgcgtagcgca

SEQ ID NO: 35297 - DNA, 21 bp, Artificial sequence
  synthetic polynucleotide sequence
ttgtggctggtaaggacgaca

SEQ ID NO: 35298 - DNA, 20 bp, Artificial sequence
  synthetic polynucleotide sequence
atgcctccacagcgttccca

SEQ ID NO: 35299 - DNA, 20 bp, Artificial sequence
  synthetic polynucleotide sequence
cagatggaaagggcccgcca

SEQ ID NO: 35300 - DNA, 20 bp, Artificial sequence
  synthetic polynucleotide sequence
ctggaagtaggtggccgcga

SEQ ID NO: 35301 - DNA, 21 bp, Artificial sequence
  synthetic polynucleotide sequence
caagacagtggaggaggccaa

SEQ ID NO: 35302 - DNA, 20 bp, Artificial sequence
  synthetic polynucleotide sequence
tccgggtaggaaggctccga

SEQ ID NO: 35303 - DNA, 19 bp, Artificial sequence
  synthetic polynucleotide sequence
ccctgacaccactgaccca

SEQ ID NO: 35304 - DNA, 20 bp, Artificial sequence
  synthetic polynucleotide sequence
cagacacagaaggcaaccga

SEQ ID NO: 35305 - DNA, 18 bp, Artificial sequence
  synthetic polynucleotide sequence
gttcccagaagacgccca

SEQ ID NO: 35306 - DNA, 18 bp, Artificial sequence
  synthetic polynucleotide sequence
ccaggttgctgacgacga

SEQ ID NO: 35307 - DNA, 18 bp, Artificial sequence
  synthetic polynucleotide sequence
cagcaccgatgaggccaa

SEQ ID NO: 35308 - DNA, 20 bp, Artificial sequence
  synthetic polynucleotide sequence
acggtgtacaaggtgccaca

SEQ ID NO: 35309 - DNA, 22 bp, Artificial sequence
  synthetic polynucleotide sequence
aaagcggagaaatgccagcaga

SEQ ID NO: 35310 - DNA, 20 bp, Artificial sequence
  synthetic polynucleotide sequence
agccgagggcttggtgagga

SEQ ID NO: 35311 - DNA, 20 bp, Artificial sequence
  synthetic polynucleotide sequence
ccagtgcactccggtcccaa

SEQ ID NO: 35312 - DNA, 22 bp, Artificial sequence
  synthetic polynucleotide sequence
aaaagtggtcctgaaccgggaa

SEQ ID NO: 35313 - DNA, 22 bp, Artificial sequence
  synthetic polynucleotide sequence
agatgagcctcctcctgagaga

SEQ ID NO: 35314 - DNA, 18 bp, Artificial sequence
  synthetic polynucleotide sequence
agaaggtcacccaccgga

SEQ ID NO: 35315 - DNA, 18 bp, Artificial sequence
  synthetic polynucleotide sequence
gagttcagcgccaaccca

SEQ ID NO: 35316 - DNA, 20 bp, Artificial sequence
  synthetic polynucleotide sequence
atctgggaaggccacagaca

SEQ ID NO: 35317 - DNA, 20 bp, Artificial sequence
  synthetic polynucleotide sequence
aaggttcgaggcctcaagga

SEQ ID NO: 35318 - DNA, 18 bp, Artificial sequence
  synthetic polynucleotide sequence
ggacgggtctctgccaca

SEQ ID NO: 35319 - DNA, 18 bp, Artificial sequence
  synthetic polynucleotide sequence
ggaaaccctgaccccgaa

SEQ ID NO: 35320 - DNA, 20 bp, Artificial sequence
  synthetic polynucleotide sequence
ctgctccaccttcaccgaga

SEQ ID NO: 35321 - DNA, 18 bp, Artificial sequence
  synthetic polynucleotide sequence
gcccatcagggtcaagca

SEQ ID NO: 35322 - DNA, 20 bp, Artificial sequence
  synthetic polynucleotide sequence
ctggtccaggaagtagccca

SEQ ID NO: 35323 - DNA, 20 bp, Artificial sequence
  synthetic polynucleotide sequence
ctataaccagtccccagcca

SEQ ID NO: 35324 - DNA, 18 bp, Artificial sequence
  synthetic polynucleotide sequence
aggttggccagctgagga

SEQ ID NO: 35325 - DNA, 18 bp, Artificial sequence
  synthetic polynucleotide sequence
agaaggcctccaaacgca

SEQ ID NO: 35326 - DNA, 21 bp, Artificial sequence
  synthetic polynucleotide sequence
gtagtctacaggctccccaga

SEQ ID NO: 35327 - DNA, 19 bp, Artificial sequence
  synthetic polynucleotide sequence
taacagggttgccacacca

SEQ ID NO: 35328 - DNA, 19 bp, Artificial sequence
  synthetic polynucleotide sequence
taaaggaccgtctgccaga

SEQ ID NO: 35329 - DNA, 21 bp, Artificial sequence
  synthetic polynucleotide sequence
ccagccccaacgactaccgaa

SEQ ID NO: 35330 - DNA, 21 bp, Artificial sequence
  synthetic polynucleotide sequence
tgaagctgggtctgagacgga

SEQ ID NO: 35331 - DNA, 22 bp, Artificial sequence
  synthetic polynucleotide sequence
gctaccaacaaaaccgggcaga

SEQ ID NO: 35332 - DNA, 20 bp, Artificial sequence
  synthetic polynucleotide sequence
tggccttcgggaacaccgca

SEQ ID NO: 35333 - DNA, 21 bp, Artificial sequence
  synthetic polynucleotide sequence
ccagagctttgggaccacgca

SEQ ID NO: 35334 - DNA, 20 bp, Artificial sequence
  synthetic polynucleotide sequence
tggggccaagactaggacca

SEQ ID NO: 35335 - DNA, 20 bp, Artificial sequence
  synthetic polynucleotide sequence
cccaggagatgacacaggga

SEQ ID NO: 35336 - DNA, 25 bp, Artificial sequence
  synthetic polynucleotide sequence
ggtgcagctacacggaaatggaaca

SEQ ID NO: 35337 - DNA, 21 bp, Artificial sequence
  synthetic polynucleotide sequence
catcaaggcagcaaaggagga

SEQ ID NO: 35338 - DNA, 21 bp, Artificial sequence
  synthetic polynucleotide sequence
atcacagctgactccagagca

SEQ ID NO: 35339 - DNA, 20 bp, Artificial sequence
  synthetic polynucleotide sequence
ctcagtacgtcctggcctga

SEQ ID NO: 35340 - DNA, 18 bp, Artificial sequence
  synthetic polynucleotide sequence
ttccccatgggtctcgga

SEQ ID NO: 35341 - DNA, 20 bp, Artificial sequence
  synthetic polynucleotide sequence
caggctcacaggctgtgcca

SEQ ID NO: 35342 - DNA, 20 bp, Artificial sequence
  synthetic polynucleotide sequence
acgcgcttcctgaggaagga

SEQ ID NO: 35343 - DNA, 20 bp, Artificial sequence
  synthetic polynucleotide sequence
caagcagaggccgcgggaca

SEQ ID NO: 35344 - DNA, 20 bp, Artificial sequence
  synthetic polynucleotide sequence
tcgccctcgcccagctggaa

SEQ ID NO: 35345 - DNA, 22 bp, Artificial sequence
  synthetic polynucleotide sequence
gattcgacagctcacccaggaa

SEQ ID NO: 35346 - DNA, 22 bp, Artificial sequence
  synthetic polynucleotide sequence
taaaacgatccagggcagacga

SEQ ID NO: 35347 - DNA, 18 bp, Artificial sequence
  synthetic polynucleotide sequence
cacagccccacaactgga

SEQ ID NO: 35348 - DNA, 18 bp, Artificial sequence
  synthetic polynucleotide sequence
tgcaggcatcacagcgca

SEQ ID NO: 35349 - DNA, 21 bp, Artificial sequence
  synthetic polynucleotide sequence
gggcctgcaggtgaaagagga

SEQ ID NO: 35350 - DNA, 21 bp, Artificial sequence
  synthetic polynucleotide sequence
tgtggggaaagatctggtcca

SEQ ID NO: 35351 - DNA, 20 bp, Artificial sequence
  synthetic polynucleotide sequence
ggagagaggaaggcgctcca

SEQ ID NO: 35352 - DNA, 20 bp, Artificial sequence
  synthetic polynucleotide sequence
agcaccgctgctactcgcca

SEQ ID NO: 35353 - DNA, 18 bp, Artificial sequence
  synthetic polynucleotide sequence
agcgagcgagccccagga

SEQ ID NO: 35354 - DNA, 20 bp, Artificial sequence
  synthetic polynucleotide sequence
ctgcgttccgccagggccaa

SEQ ID NO: 35355 - DNA, 21 bp, Artificial sequence
  synthetic polynucleotide sequence
ccctactcagtgccctgccaa

SEQ ID NO: 35356 - DNA, 20 bp, Artificial sequence
  synthetic polynucleotide sequence
gtgggaagtggggctgctga

SEQ ID NO: 35357 - DNA, 22 bp, Artificial sequence
  synthetic polynucleotide sequence
aaccacagctgcacactggaga

SEQ ID NO: 35358 - DNA, 21 bp, Artificial sequence
  synthetic polynucleotide sequence
gatcccggaagacctctgaga

SEQ ID NO: 35359 - DNA, 21 bp, Artificial sequence
  synthetic polynucleotide sequence
tcgccgccacagctttaggaa

SEQ ID NO: 35360 - DNA, 22 bp, Artificial sequence
  synthetic polynucleotide sequence
agcttcctccaggaagtcagga

SEQ ID NO: 35361 - DNA, 20 bp, Artificial sequence
  synthetic polynucleotide sequence
aagcttgggaaatgaagcca

SEQ ID NO: 35362 - DNA, 21 bp, Artificial sequence
  synthetic polynucleotide sequence
taacgatccaacatctgagca

SEQ ID NO: 35363 - DNA, 20 bp, Artificial sequence
  synthetic polynucleotide sequence
tcacgagaggagaggctgga

SEQ ID NO: 35364 - DNA, 20 bp, Artificial sequence
  synthetic polynucleotide sequence
gactagagggccacaggaga

SEQ ID NO: 35365 - DNA, 22 bp, Artificial sequence
  synthetic polynucleotide sequence
tgatatcaaccctgaggcagca

SEQ ID NO: 35366 - DNA, 22 bp, Artificial sequence
  synthetic polynucleotide sequence
accatttctgccaccagcccaa

SEQ ID NO: 35367 - DNA, 22 bp, Artificial sequence
  synthetic polynucleotide sequence
agctgaaagagaagggcaggca

SEQ ID NO: 35368 - DNA, 21 bp, Artificial sequence
  synthetic polynucleotide sequence
tccccaccactatcctcggca

SEQ ID NO: 35369 - DNA, 20 bp, Artificial sequence
  synthetic polynucleotide sequence
agtaaccggccagccttgca

SEQ ID NO: 35370 - DNA, 21 bp, Artificial sequence
  synthetic polynucleotide sequence
tcatctgccatctgcgagaga

SEQ ID NO: 35371 - DNA, 22 bp, Artificial sequence
  synthetic polynucleotide sequence
tgatgaggagataggaggtcca

SEQ ID NO: 35372 - DNA, 22 bp, Artificial sequence
  synthetic polynucleotide sequence
catacactcatgaagccaggga

SEQ ID NO: 35373 - DNA, 20 bp, Artificial sequence
  synthetic polynucleotide sequence
ctgccgcccaaggagagcaa

SEQ ID NO: 35374 - DNA, 22 bp, Artificial sequence
  synthetic polynucleotide sequence
atcagaacgctgcaagagtcca

SEQ ID NO: 35375 - DNA, 20 bp, Artificial sequence
  synthetic polynucleotide sequence
gcagaggcacctggtggaga

SEQ ID NO: 35376 - DNA, 23 bp, Artificial sequence
  synthetic polynucleotide sequence
gaaattctggggcaacagacaga

SEQ ID NO: 35377 - DNA, 22 bp, Artificial sequence
  synthetic polynucleotide sequence
agatgacaactcactgcaggca

SEQ ID NO: 35378 - DNA, 22 bp, Artificial sequence
  synthetic polynucleotide sequence
cataggccatgaagaggtgaga

SEQ ID NO: 35379 - DNA, 21 bp, Artificial sequence
  synthetic polynucleotide sequence
atatgccatggttgagggaga

SEQ ID NO: 35380 - DNA, 21 bp, Artificial sequence
  synthetic polynucleotide sequence
agtcgcagtgcatcaactcca

SEQ ID NO: 35381 - DNA, 21 bp, Artificial sequence
  synthetic polynucleotide sequence
aagagcagcagaaaggccgta

SEQ ID NO: 35382 - DNA, 18 bp, Artificial sequence
  synthetic polynucleotide sequence
ggcggcggggtcatcaca

SEQ ID NO: 35383 - DNA, 18 bp, Artificial sequence
  synthetic polynucleotide sequence
ggacggagagcgcgagga

SEQ ID NO: 35384 - DNA, 19 bp, Artificial sequence
  synthetic polynucleotide sequence
tgcagtcacggtcagtgca

SEQ ID NO: 35385 - DNA, 21 bp, Artificial sequence
  synthetic polynucleotide sequence
ttgggccttcgacctgaccaa

SEQ ID NO: 35386 - DNA, 21 bp, Artificial sequence
  synthetic polynucleotide sequence
tcatccccacactccacgtca

SEQ ID NO: 35387 - DNA, 21 bp, Artificial sequence
  synthetic polynucleotide sequence
tggaggttggcgagctagcaa

SEQ ID NO: 35388 - DNA, 21 bp, Artificial sequence
  synthetic polynucleotide sequence
ccttcggtaaggtgccagaca

SEQ ID NO: 35389 - DNA, 19 bp, Artificial sequence
  synthetic polynucleotide sequence
tccccatcgagtacccaga

SEQ ID NO: 35390 - DNA, 21 bp, Artificial sequence
  synthetic polynucleotide sequence
aactctttcacgacgcccaga

SEQ ID NO: 35391 - DNA, 20 bp, Artificial sequence
  synthetic polynucleotide sequence
ccagcccttcaccggcgaga

SEQ ID NO: 35392 - DNA, 21 bp, Artificial sequence
  synthetic polynucleotide sequence
gagccacaatactggtgcaga

SEQ ID NO: 35393 - DNA, 21 bp, Artificial sequence
  synthetic polynucleotide sequence
ccaaggcatgccagagggaga

SEQ ID NO: 35394 - DNA, 20 bp, Artificial sequence
  synthetic polynucleotide sequence
tctgggctgcagttccagga

SEQ ID NO: 35395 - DNA, 19 bp, Artificial sequence
  synthetic polynucleotide sequence
tcagccaggatctacccca

SEQ ID NO: 35396 - DNA, 20 bp, Artificial sequence
  synthetic polynucleotide sequence
gaagctgtcactgagccgga

SEQ ID NO: 35397 - DNA, 21 bp, Artificial sequence
  synthetic polynucleotide sequence
agcccagtgcccagaaaccaa

SEQ ID NO: 35398 - DNA, 21 bp, Artificial sequence
  synthetic polynucleotide sequence
tgtagaaaaacgggcctcgga

SEQ ID NO: 35399 - DNA, 21 bp, Artificial sequence
  synthetic polynucleotide sequence
ttgggagcctagcactgcaga

SEQ ID NO: 35400 - DNA, 20 bp, Artificial sequence
  synthetic polynucleotide sequence
cagcagcatccagcgcctca

SEQ ID NO: 35401 - DNA, 19 bp, Artificial sequence
  synthetic polynucleotide sequence
cgaagccacctctcgcaga

SEQ ID NO: 35402 - DNA, 18 bp, Artificial sequence
  synthetic polynucleotide sequence
tcctgcgaccctccacca

SEQ ID NO: 35403 - DNA, 21 bp, Artificial sequence
  synthetic polynucleotide sequence
actggccctgaatcaagggaa

SEQ ID NO: 35404 - DNA, 18 bp, Artificial sequence
  synthetic polynucleotide sequence
ctccgagggtccctgcca

SEQ ID NO: 35405 - DNA, 21 bp, Artificial sequence
  synthetic polynucleotide sequence
gcttcccagcctaccactgga

SEQ ID NO: 35406 - DNA, 21 bp, Artificial sequence
  synthetic polynucleotide sequence
tgggagggagtatgaggggga

SEQ ID NO: 35407 - DNA, 20 bp, Artificial sequence
  synthetic polynucleotide sequence
ctgcacaaaatgccgggcga

SEQ ID NO: 35408 - DNA, 20 bp, Artificial sequence
  synthetic polynucleotide sequence
tcagcctgggactgcggcaa

SEQ ID NO: 35409 - DNA, 21 bp, Artificial sequence
  synthetic polynucleotide sequence
caggtccaacaggatgaccca

SEQ ID NO: 35410 - DNA, 20 bp, Artificial sequence
  synthetic polynucleotide sequence
cagaggccggctcagggaga

SEQ ID NO: 35411 - DNA, 19 bp, Artificial sequence
  synthetic polynucleotide sequence
cgtcggaagcccctggaca

SEQ ID NO: 35412 - DNA, 20 bp, Artificial sequence
  synthetic polynucleotide sequence
ggtgcacatgtcggccgcga

SEQ ID NO: 35413 - DNA, 21 bp, Artificial sequence
  synthetic polynucleotide sequence
gatcaagtccatgctgccgga

SEQ ID NO: 35414 - DNA, 21 bp, Artificial sequence
  synthetic polynucleotide sequence
cgtcagttctcagagccacga

SEQ ID NO: 35415 - DNA, 18 bp, Artificial sequence
  synthetic polynucleotide sequence
cacgcccatctgccccca

SEQ ID NO: 35416 - DNA, 20 bp, Artificial sequence
  synthetic polynucleotide sequence
tgggcgaggctctcaaacca

SEQ ID NO: 35417 - DNA, 21 bp, Artificial sequence
  synthetic polynucleotide sequence
aggtggttgtggaggcagaga

SEQ ID NO: 35418 - DNA, 21 bp, Artificial sequence
  synthetic polynucleotide sequence
agttggggtcctgaagcctca

SEQ ID NO: 35419 - DNA, 18 bp, Artificial sequence
  synthetic polynucleotide sequence
ggaggaagcagcagggaa

SEQ ID NO: 35420 - DNA, 18 bp, Artificial sequence
  synthetic polynucleotide sequence
gatgtccgcactggagca

SEQ ID NO: 35421 - DNA, 21 bp, Artificial sequence
  synthetic polynucleotide sequence
gtggccaaagagggtcaagga

SEQ ID NO: 35422 - DNA, 20 bp, Artificial sequence
  synthetic polynucleotide sequence
tctggtgcctggccaatgga

SEQ ID NO: 35423 - DNA, 21 bp, Artificial sequence
  synthetic polynucleotide sequence
ggattcggactcggacagtga

SEQ ID NO: 35424 - DNA, 22 bp, Artificial sequence
  synthetic polynucleotide sequence
atctccatctgacagcactgga

SEQ ID NO: 35425 - DNA, 18 bp, Artificial sequence
  synthetic polynucleotide sequence
gcatccagggacgcagga

SEQ ID NO: 35426 - DNA, 20 bp, Artificial sequence
  synthetic polynucleotide sequence
caagggaggagtggtagcga

SEQ ID NO: 35427 - DNA, 20 bp, Artificial sequence
  synthetic polynucleotide sequence
gaaggtgctcagcagggaga

SEQ ID NO: 35428 - DNA, 19 bp, Artificial sequence
  synthetic polynucleotide sequence
ctcttccacacagagccca

SEQ ID NO: 35429 - DNA, 18 bp, Artificial sequence
  synthetic polynucleotide sequence
gacctcactcggcaggca

SEQ ID NO: 35430 - DNA, 19 bp, Artificial sequence
  synthetic polynucleotide sequence
ggcagcagctcataggcca

SEQ ID NO: 35431 - DNA, 19 bp, Artificial sequence
  synthetic polynucleotide sequence
gcccctctaactgcagcca

SEQ ID NO: 35432 - DNA, 18 bp, Artificial sequence
  synthetic polynucleotide sequence
atgccagccaaggggaca

SEQ ID NO: 35433 - DNA, 18 bp, Artificial sequence
  synthetic polynucleotide sequence
cctggtgtgcaacgccga

SEQ ID NO: 35434 - DNA, 18 bp, Artificial sequence
  synthetic polynucleotide sequence
ggtgatgacggccgagga

SEQ ID NO: 35435 - DNA, 19 bp, Artificial sequence
  synthetic polynucleotide sequence
gatccgccgctcccaggaa

SEQ ID NO: 35436 - DNA, 19 bp, Artificial sequence
  synthetic polynucleotide sequence
ctctgcaggtagcggcgga

SEQ ID NO: 35437 - DNA, 19 bp, Artificial sequence
  synthetic polynucleotide sequence
ccgatctggccacggacca

SEQ ID NO: 35438 - DNA, 19 bp, Artificial sequence
  synthetic polynucleotide sequence
tccagcttcaccctccaca

SEQ ID NO: 35439 - DNA, 18 bp, Artificial sequence
  synthetic polynucleotide sequence
ctcaacagccaccaccca

SEQ ID NO: 35440 - DNA, 18 bp, Artificial sequence
  synthetic polynucleotide sequence
cggtcaccatgctcagga

SEQ ID NO: 35441 - DNA, 22 bp, Artificial sequence
  synthetic polynucleotide sequence
atcaagaagtacacaggcacca

SEQ ID NO: 35442 - DNA, 20 bp, Artificial sequence
  synthetic polynucleotide sequence
caaacctccaccagaaccga

SEQ ID NO: 35443 - DNA, 18 bp, Artificial sequence
  synthetic polynucleotide sequence
ccaccagtcccaaaggca

SEQ ID NO: 35444 - DNA, 20 bp, Artificial sequence
  synthetic polynucleotide sequence
acacacagctgggtggaaga

SEQ ID NO: 35445 - DNA, 22 bp, Artificial sequence
  synthetic polynucleotide sequence
tggacagtggaaaccaagagca

SEQ ID NO: 35446 - DNA, 22 bp, Artificial sequence
  synthetic polynucleotide sequence
caagtgcaagaggagggcagaa

SEQ ID NO: 35447 - DNA, 18 bp, Artificial sequence
  synthetic polynucleotide sequence
caacggggagtcccgcca

SEQ ID NO: 35448 - DNA, 22 bp, Artificial sequence
  synthetic polynucleotide sequence
aagcgggcagtacttgagcgta

SEQ ID NO: 35449 - DNA, 20 bp, Artificial sequence
  synthetic polynucleotide sequence
gagccggtgtcagccctgga

SEQ ID NO: 35450 - DNA, 20 bp, Artificial sequence
  synthetic polynucleotide sequence
aagagcacaggcgttcggga

SEQ ID NO: 35451 - DNA, 18 bp, Artificial sequence
  synthetic polynucleotide sequence
ggaggcctcaatgcagga

SEQ ID NO: 35452 - DNA, 23 bp, Artificial sequence
  synthetic polynucleotide sequence
agagagcaggtaactctagcaca

SEQ ID NO: 35453 - DNA, 19 bp, Artificial sequence
  synthetic polynucleotide sequence
cagtggctctgggggccaa

SEQ ID NO: 35454 - DNA, 18 bp, Artificial sequence
  synthetic polynucleotide sequence
cccagggcacgctccaca

SEQ ID NO: 35455 - DNA, 22 bp, Artificial sequence
  synthetic polynucleotide sequence
aaatgtgcacagatagaagcca

SEQ ID NO: 35456 - DNA, 22 bp, Artificial sequence
  synthetic polynucleotide sequence
tagaggctgatagagaacagca

SEQ ID NO: 35457 - DNA, 22 bp, Artificial sequence
  synthetic polynucleotide sequence
gaaccgcaaggagctgtcagaa

SEQ ID NO: 35458 - DNA, 20 bp, Artificial sequence
  synthetic polynucleotide sequence
catcgtctccaagcccagca

SEQ ID NO: 35459 - DNA, 19 bp, Artificial sequence
  synthetic polynucleotide sequence
cgccgccgccactcaagca

SEQ ID NO: 35460 - DNA, 20 bp, Artificial sequence
  synthetic polynucleotide sequence
ttcggcaaccccatgggcga

SEQ ID NO: 35461 - DNA, 19 bp, Artificial sequence
  synthetic polynucleotide sequence
tctgaccctggacagccta

SEQ ID NO: 35462 - DNA, 22 bp, Artificial sequence
  synthetic polynucleotide sequence
atagtacacccgtcacagtcca

SEQ ID NO: 35463 - DNA, 20 bp, Artificial sequence
  synthetic polynucleotide sequence
gaggaggagggggaagacga

SEQ ID NO: 35464 - DNA, 20 bp, Artificial sequence
  synthetic polynucleotide sequence
caggcatctcggcgtgggca

SEQ ID NO: 35465 - DNA, 18 bp, Artificial sequence
  synthetic polynucleotide sequence
cgaacaggtggggaccaa

SEQ ID NO: 35466 - DNA, 18 bp, Artificial sequence
  synthetic polynucleotide sequence
gcattcccgggaatcaga

SEQ ID NO: 35467 - DNA, 19 bp, Artificial sequence
  synthetic polynucleotide sequence
tcaaagctgccctctgcca

SEQ ID NO: 35468 - DNA, 21 bp, Artificial sequence
  synthetic polynucleotide sequence
aagcaacatggtggtcagcca

SEQ ID NO: 35469 - DNA, 19 bp, Artificial sequence
  synthetic polynucleotide sequence
gtacatgggtccaaagcga

SEQ ID NO: 35470 - DNA, 19 bp, Artificial sequence
  synthetic polynucleotide sequence
tctcctcccaccagtccaa

SEQ ID NO: 35471 - DNA, 20 bp, Artificial sequence
  synthetic polynucleotide sequence
agaaagatgtgtccgggaga

SEQ ID NO: 35472 - DNA, 20 bp, Artificial sequence
  synthetic polynucleotide sequence
aactcaggcccagcttagca

SEQ ID NO: 35473 - DNA, 20 bp, Artificial sequence
  synthetic polynucleotide sequence
caggctcaggagatccgcaa

SEQ ID NO: 35474 - DNA, 20 bp, Artificial sequence
  synthetic polynucleotide sequence
ggccagcgcctcctcgtcaa

SEQ ID NO: 35475 - DNA, 20 bp, Artificial sequence
  synthetic polynucleotide sequence
gtccctcatcacaggaccca

SEQ ID NO: 35476 - DNA, 18 bp, Artificial sequence
  synthetic polynucleotide sequence
cggacaagcagaggcgga

SEQ ID NO: 35477 - DNA, 18 bp, Artificial sequence
  synthetic polynucleotide sequence
cagacatgcggccaagga

SEQ ID NO: 35478 - DNA, 18 bp, Artificial sequence
  synthetic polynucleotide sequence
atcctccagcacaggcga

SEQ ID NO: 35479 - DNA, 18 bp, Artificial sequence
  synthetic polynucleotide sequence
ccagctccaggccccaga

SEQ ID NO: 35480 - DNA, 21 bp, Artificial sequence
  synthetic polynucleotide sequence
gtgtacagctcctgaacccca

SEQ ID NO: 35481 - DNA, 20 bp, Artificial sequence
  synthetic polynucleotide sequence
gctcagtcataccgggcaga

SEQ ID NO: 35482 - DNA, 21 bp, Artificial sequence
  synthetic polynucleotide sequence
agtcctccaaccggttcagga

SEQ ID NO: 35483 - DNA, 22 bp, Artificial sequence
  synthetic polynucleotide sequence
aggaggcctcagagaagaacga

SEQ ID NO: 35484 - DNA, 23 bp, Artificial sequence
  synthetic polynucleotide sequence
caaatcccatcccaaaacctcca

SEQ ID NO: 35485 - DNA, 20 bp, Artificial sequence
  synthetic polynucleotide sequence
aggtgaaggaggctgaagga

SEQ ID NO: 35486 - DNA, 20 bp, Artificial sequence
  synthetic polynucleotide sequence
ctggcaatcatggagactga

SEQ ID NO: 35487 - DNA, 20 bp, Artificial sequence
  synthetic polynucleotide sequence
gtgaccattgatggcaggaa

SEQ ID NO: 35488 - DNA, 20 bp, Artificial sequence
  synthetic polynucleotide sequence
caaacggaagacacaaggca

SEQ ID NO: 35489 - DNA, 18 bp, Artificial sequence
  synthetic polynucleotide sequence
catggggaagccagccca

SEQ ID NO: 35490 - DNA, 18 bp, Artificial sequence
  synthetic polynucleotide sequence
ccccaagagaagagccga

SEQ ID NO: 35491 - DNA, 19 bp, Artificial sequence
  synthetic polynucleotide sequence
gcgacgcacagggctgcca

SEQ ID NO: 35492 - DNA, 20 bp, Artificial sequence
  synthetic polynucleotide sequence
cggatctggaggaagggaca

SEQ ID NO: 35493 - DNA, 21 bp, Artificial sequence
  synthetic polynucleotide sequence
tgcaggtgaccattgacggca

SEQ ID NO: 35494 - DNA, 21 bp, Artificial sequence
  synthetic polynucleotide sequence
atgcaaggcacctgaggctga

SEQ ID NO: 35495 - DNA, 20 bp, Artificial sequence
  synthetic polynucleotide sequence
tggagcctgtgcaccgccga

SEQ ID NO: 35496 - DNA, 20 bp, Artificial sequence
  synthetic polynucleotide sequence
tctgaggactggcccaggga

SEQ ID NO: 35497 - DNA, 20 bp, Artificial sequence
  synthetic polynucleotide sequence
gtgcacagacatgtctgaca

SEQ ID NO: 35498 - DNA, 21 bp, Artificial sequence
  synthetic polynucleotide sequence
caacaggcagagctcctacca

SEQ ID NO: 35499 - DNA, 19 bp, Artificial sequence
  synthetic polynucleotide sequence
gatggccgaacacgcccca

SEQ ID NO: 35500 - DNA, 21 bp, Artificial sequence
  synthetic polynucleotide sequence
ccagagaccaggagtagggca

SEQ ID NO: 35501 - DNA, 20 bp, Artificial sequence
  synthetic polynucleotide sequence
gaggaggacaacacggtgga

SEQ ID NO: 35502 - DNA, 20 bp, Artificial sequence
  synthetic polynucleotide sequence
gtgcaccacggcgaactcca

SEQ ID NO: 35503 - DNA, 21 bp, Artificial sequence
  synthetic polynucleotide sequence
atgagtacgtgggcaagcgga

SEQ ID NO: 35504 - DNA, 18 bp, Artificial sequence
  synthetic polynucleotide sequence
tccagggcggccttggca

SEQ ID NO: 35505 - DNA, 19 bp, Artificial sequence
  synthetic polynucleotide sequence
gctgtaccacctgccccca

SEQ ID NO: 35506 - DNA, 21 bp, Artificial sequence
  synthetic polynucleotide sequence
agcagcatggccatcagagga

SEQ ID NO: 35507 - DNA, 20 bp, Artificial sequence
  synthetic polynucleotide sequence
ctgcagttacggcctgagga

SEQ ID NO: 35508 - DNA, 18 bp, Artificial sequence
  synthetic polynucleotide sequence
agcgggtcaccttcagca

SEQ ID NO: 35509 - DNA, 20 bp, Artificial sequence
  synthetic polynucleotide sequence
cggcaggccaaccaagaaga

SEQ ID NO: 35510 - DNA, 22 bp, Artificial sequence
  synthetic polynucleotide sequence
aagatgacatggcagaagggga

SEQ ID NO: 35511 - DNA, 19 bp, Artificial sequence
  synthetic polynucleotide sequence
ggtgtggagggcaagggga

SEQ ID NO: 35512 - DNA, 19 bp, Artificial sequence
  synthetic polynucleotide sequence
ggaggtggtggtggagcga

SEQ ID NO: 35513 - DNA, 21 bp, Artificial sequence
  synthetic polynucleotide sequence
catatccctcacagcccccaa

SEQ ID NO: 35514 - DNA, 20 bp, Artificial sequence
  synthetic polynucleotide sequence
ggtgtcagggtagggtggca

SEQ ID NO: 35515 - DNA, 21 bp, Artificial sequence
  synthetic polynucleotide sequence
acctggaaaccctgagccaca

SEQ ID NO: 35516 - DNA, 21 bp, Artificial sequence
  synthetic polynucleotide sequence
actgccaccactcaatgcaga

SEQ ID NO: 35517 - DNA, 22 bp, Artificial sequence
  synthetic polynucleotide sequence
agcagtgactatccggcaccaa

SEQ ID NO: 35518 - DNA, 21 bp, Artificial sequence
  synthetic polynucleotide sequence
agtgatggtgtggacaaggca

SEQ ID NO: 35519 - DNA, 20 bp, Artificial sequence
  synthetic polynucleotide sequence
cagcatcaacccattagcca

SEQ ID NO: 35520 - DNA, 20 bp, Artificial sequence
  synthetic polynucleotide sequence
gacctgaacgcatctcagca

SEQ ID NO: 35521 - DNA, 20 bp, Artificial sequence
  synthetic polynucleotide sequence
gcagccacaagacgcagcga

SEQ ID NO: 35522 - DNA, 21 bp, Artificial sequence
  synthetic polynucleotide sequence
acaggtgtccagtgcaaggca

SEQ ID NO: 35523 - DNA, 18 bp, Artificial sequence
  synthetic polynucleotide sequence
ccccaacaccttcccaca

SEQ ID NO: 35524 - DNA, 18 bp, Artificial sequence
  synthetic polynucleotide sequence
gggcactccagcgtcaca

SEQ ID NO: 35525 - DNA, 19 bp, Artificial sequence
  synthetic polynucleotide sequence
ccaagaagcagcctccaca

SEQ ID NO: 35526 - DNA, 22 bp, Artificial sequence
  synthetic polynucleotide sequence
ccaaagacaactgcggaactca

SEQ ID NO: 35527 - DNA, 21 bp, Artificial sequence
  synthetic polynucleotide sequence
ccaggctcaacgaggtgctga

SEQ ID NO: 35528 - DNA, 20 bp, Artificial sequence
  synthetic polynucleotide sequence
attgtccacgtcaagggcca

SEQ ID NO: 35529 - DNA, 20 bp, Artificial sequence
  synthetic polynucleotide sequence
gcgtcaagtcactggccgga

SEQ ID NO: 35530 - DNA, 19 bp, Artificial sequence
  synthetic polynucleotide sequence
gctctcagcatgcgggcca

SEQ ID NO: 35531 - DNA, 21 bp, Artificial sequence
  synthetic polynucleotide sequence
aggcacagctggaaccaagca

SEQ ID NO: 35532 - DNA, 21 bp, Artificial sequence
  synthetic polynucleotide sequence
tgagaagctgcaggtggtgga

SEQ ID NO: 35533 - DNA, 20 bp, Artificial sequence
  synthetic polynucleotide sequence
cttcctggccaaccagcaga

SEQ ID NO: 35534 - DNA, 21 bp, Artificial sequence
  synthetic polynucleotide sequence
gttcctgagcgtgaaccagga

SEQ ID NO: 35535 - DNA, 21 bp, Artificial sequence
  synthetic polynucleotide sequence
cagggccatatggccatgaca

SEQ ID NO: 35536 - DNA, 22 bp, Artificial sequence
  synthetic polynucleotide sequence
cagcaggaagacgaggagtaga

SEQ ID NO: 35537 - DNA, 21 bp, Artificial sequence
  synthetic polynucleotide sequence
tcttccgcaccttcgatgcaa

SEQ ID NO: 35538 - DNA, 21 bp, Artificial sequence
  synthetic polynucleotide sequence
gtcgtacatgctgaaggccca

SEQ ID NO: 35539 - DNA, 19 bp, Artificial sequence
  synthetic polynucleotide sequence
ggcagtgagtcagaggcca

SEQ ID NO: 35540 - DNA, 20 bp, Artificial sequence
  synthetic polynucleotide sequence
catcacacacaatcacggca

SEQ ID NO: 35541 - DNA, 18 bp, Artificial sequence
  synthetic polynucleotide sequence
gctctccagaacccgcca

SEQ ID NO: 35542 - DNA, 20 bp, Artificial sequence
  synthetic polynucleotide sequence
tggccctgcagacataagga

SEQ ID NO: 35543 - DNA, 20 bp, Artificial sequence
  synthetic polynucleotide sequence
ctggggtcttcgacacagca

SEQ ID NO: 35544 - DNA, 19 bp, Artificial sequence
  synthetic polynucleotide sequence
tgctgtacactgagggcca

SEQ ID NO: 35545 - DNA, 20 bp, Artificial sequence
  synthetic polynucleotide sequence
gagaccaccatggaggagga

SEQ ID NO: 35546 - DNA, 18 bp, Artificial sequence
  synthetic polynucleotide sequence
tctcgcagatgccacgga

SEQ ID NO: 35547 - DNA, 21 bp, Artificial sequence
  synthetic polynucleotide sequence
cgtggagtcaaagagcaggca

SEQ ID NO: 35548 - DNA, 21 bp, Artificial sequence
  synthetic polynucleotide sequence
tgacccctgctccaaacgtga

SEQ ID NO: 35549 - DNA, 21 bp, Artificial sequence
  synthetic polynucleotide sequence
gagctgcagaaggactagcca

SEQ ID NO: 35550 - DNA, 22 bp, Artificial sequence
  synthetic polynucleotide sequence
taaaggagaagatgcaggggca

SEQ ID NO: 35551 - DNA, 21 bp, Artificial sequence
  synthetic polynucleotide sequence
agagcttacccctccagagca

SEQ ID NO: 35552 - DNA, 20 bp, Artificial sequence
  synthetic polynucleotide sequence
agtggctgcaacctccctca

SEQ ID NO: 35553 - DNA, 19 bp, Artificial sequence
  synthetic polynucleotide sequence
gtgacactccagaagccca

SEQ ID NO: 35554 - DNA, 18 bp, Artificial sequence
  synthetic polynucleotide sequence
cggagagcgctgtcagca

SEQ ID NO: 35555 - DNA, 20 bp, Artificial sequence
  synthetic polynucleotide sequence
caggagacagagctgagcca

SEQ ID NO: 35556 - DNA, 18 bp, Artificial sequence
  synthetic polynucleotide sequence
gaggccagcatggaacga

SEQ ID NO: 35557 - DNA, 22 bp, Artificial sequence
  synthetic polynucleotide sequence
tgtatagagaggctgcagcaga

SEQ ID NO: 35558 - DNA, 18 bp, Artificial sequence
  synthetic polynucleotide sequence
actgctggaacacggcca

SEQ ID NO: 35559 - DNA, 21 bp, Artificial sequence
  synthetic polynucleotide sequence
cataaatgggacgcgtctgga

SEQ ID NO: 35560 - DNA, 21 bp, Artificial sequence
  synthetic polynucleotide sequence
tcctgccgatactcatcccga

SEQ ID NO: 35561 - DNA, 20 bp, Artificial sequence
  synthetic polynucleotide sequence
cccaaccagcaccatgtcca

SEQ ID NO: 35562 - DNA, 20 bp, Artificial sequence
  synthetic polynucleotide sequence
cggtagcagctcagctccaa

SEQ ID NO: 35563 - DNA, 21 bp, Artificial sequence
  synthetic polynucleotide sequence
tcgcctaggatctgcacccaa

SEQ ID NO: 35564 - DNA, 21 bp, Artificial sequence
  synthetic polynucleotide sequence
ctccttaatcagagcccccca

SEQ ID NO: 35565 - DNA, 21 bp, Artificial sequence
  synthetic polynucleotide sequence
ccccgaacttctgggagagga

SEQ ID NO: 35566 - DNA, 20 bp, Artificial sequence
  synthetic polynucleotide sequence
cggagctgcacagacacgga

SEQ ID NO: 35567 - DNA, 20 bp, Artificial sequence
  synthetic polynucleotide sequence
tcaacctcgtggtcaccgca

SEQ ID NO: 35568 - DNA, 21 bp, Artificial sequence
  synthetic polynucleotide sequence
agctgcgaagaaccctcggga

SEQ ID NO: 35569 - DNA, 20 bp, Artificial sequence
  synthetic polynucleotide sequence
gggcccgtctaaactggaca

SEQ ID NO: 35570 - DNA, 18 bp, Artificial sequence
  synthetic polynucleotide sequence
cggagcgggcatccagca

SEQ ID NO: 35571 - DNA, 20 bp, Artificial sequence
  synthetic polynucleotide sequence
acggaagaccctgagcccaa

SEQ ID NO: 35572 - DNA, 19 bp, Artificial sequence
  synthetic polynucleotide sequence
tgcaggtacatggacggga

SEQ ID NO: 35573 - DNA, 18 bp, Artificial sequence
  synthetic polynucleotide sequence
acagccaggtccgggaca

SEQ ID NO: 35574 - DNA, 20 bp, Artificial sequence
  synthetic polynucleotide sequence
tcacaccacagagtcaggca

SEQ ID NO: 35575 - DNA, 18 bp, Artificial sequence
  synthetic polynucleotide sequence
ggagctcacaaggcggga

SEQ ID NO: 35576 - DNA, 18 bp, Artificial sequence
  synthetic polynucleotide sequence
tcatccgacagcagccga

SEQ ID NO: 35577 - DNA, 20 bp, Artificial sequence
  synthetic polynucleotide sequence
gagtggtggaaatgcaggaa

SEQ ID NO: 35578 - DNA, 19 bp, Artificial sequence
  synthetic polynucleotide sequence
tctgcttgatgcctggtga

SEQ ID NO: 35579 - DNA, 19 bp, Artificial sequence
  synthetic polynucleotide sequence
ggcagctacaacgggcaga

SEQ ID NO: 35580 - DNA, 18 bp, Artificial sequence
  synthetic polynucleotide sequence
cacatgcagcacgcggga

SEQ ID NO: 35581 - DNA, 21 bp, Artificial sequence
  synthetic polynucleotide sequence
cagccctgctatagaagggca

SEQ ID NO: 35582 - DNA, 18 bp, Artificial sequence
  synthetic polynucleotide sequence
tggaggatgcaagcgcca

SEQ ID NO: 35583 - DNA, 18 bp, Artificial sequence
  synthetic polynucleotide sequence
tgcagctgggccaggaga

SEQ ID NO: 35584 - DNA, 18 bp, Artificial sequence
  synthetic polynucleotide sequence
taggtggaaggcccgaga

SEQ ID NO: 35585 - DNA, 21 bp, Artificial sequence
  synthetic polynucleotide sequence
acgctacctatgccagccaga

SEQ ID NO: 35586 - DNA, 20 bp, Artificial sequence
  synthetic polynucleotide sequence
gctggccgtctgtggaggaa

SEQ ID NO: 35587 - DNA, 21 bp, Artificial sequence
  synthetic polynucleotide sequence
ggaggtgccaggcatagagga

SEQ ID NO: 35588 - DNA, 21 bp, Artificial sequence
  synthetic polynucleotide sequence
gcacatgagagggtccgagga

SEQ ID NO: 35589 - DNA, 18 bp, Artificial sequence
  synthetic polynucleotide sequence
gcgagggacatgcagaca

SEQ ID NO: 35590 - DNA, 18 bp, Artificial sequence
  synthetic polynucleotide sequence
gtgtccaagggcagccca

SEQ ID NO: 35591 - DNA, 18 bp, Artificial sequence
  synthetic polynucleotide sequence
aagctgccaaggaggcca

SEQ ID NO: 35592 - DNA, 18 bp, Artificial sequence
  synthetic polynucleotide sequence
cggcctcctctaccacca

SEQ ID NO: 35593 - DNA, 20 bp, Artificial sequence
  synthetic polynucleotide sequence
gctgacaagcgggacccaga

SEQ ID NO: 35594 - DNA, 21 bp, Artificial sequence
  synthetic polynucleotide sequence
agaggaggctgaagtgctgga

SEQ ID NO: 35595 - DNA, 20 bp, Artificial sequence
  synthetic polynucleotide sequence
aggcgggaactagagcccaa

SEQ ID NO: 35596 - DNA, 21 bp, Artificial sequence
  synthetic polynucleotide sequence
tccacctggacgtcaacagga

SEQ ID NO: 35597 - DNA, 20 bp, Artificial sequence
  synthetic polynucleotide sequence
atcccgcactgagacacaca

SEQ ID NO: 35598 - DNA, 21 bp, Artificial sequence
  synthetic polynucleotide sequence
actgtacactggacgtcagca

SEQ ID NO: 35599 - DNA, 20 bp, Artificial sequence
  synthetic polynucleotide sequence
ggcgaccaacacaggtggca

SEQ ID NO: 35600 - DNA, 19 bp, Artificial sequence
  synthetic polynucleotide sequence
gctcgggacccatggagga

SEQ ID NO: 35601 - DNA, 18 bp, Artificial sequence
  synthetic polynucleotide sequence
ccacaagctcctccgcaa

SEQ ID NO: 35602 - DNA, 19 bp, Artificial sequence
  synthetic polynucleotide sequence
ggattctgggagggaccca

SEQ ID NO: 35603 - DNA, 19 bp, Artificial sequence
  synthetic polynucleotide sequence
ggatgcctgtggaacccaa

SEQ ID NO: 35604 - DNA, 20 bp, Artificial sequence
  synthetic polynucleotide sequence
ggcctgataagccactccga

SEQ ID NO: 35605 - DNA, 21 bp, Artificial sequence
  synthetic polynucleotide sequence
tgccggaaacaccccaaacca

SEQ ID NO: 35606 - DNA, 19 bp, Artificial sequence
  synthetic polynucleotide sequence
gcgactggaaggctggcca

SEQ ID NO: 35607 - DNA, 19 bp, Artificial sequence
  synthetic polynucleotide sequence
ggccaagggctagacacca

SEQ ID NO: 35608 - DNA, 19 bp, Artificial sequence
  synthetic polynucleotide sequence
gagcgtacactggtgggga

SEQ ID NO: 35609 - DNA, 18 bp, Artificial sequence
  synthetic polynucleotide sequence
caaagcgcaggaagagca

SEQ ID NO: 35610 - DNA, 18 bp, Artificial sequence
  synthetic polynucleotide sequence
caggaaggcgtcgggcca

SEQ ID NO: 35611 - DNA, 18 bp, Artificial sequence
  synthetic polynucleotide sequence
tgtccagaggctcaccca

SEQ ID NO: 35612 - DNA, 18 bp, Artificial sequence
  synthetic polynucleotide sequence
acgacagggtccacccca

SEQ ID NO: 35613 - DNA, 18 bp, Artificial sequence
  synthetic polynucleotide sequence
acaaccagccctccgaca

SEQ ID NO: 35614 - DNA, 20 bp, Artificial sequence
  synthetic polynucleotide sequence
ctggtcatagcgctggcaga

SEQ ID NO: 35615 - DNA, 21 bp, Artificial sequence
  synthetic polynucleotide sequence
caccagccttgcacctgaaga

SEQ ID NO: 35616 - DNA, 20 bp, Artificial sequence
  synthetic polynucleotide sequence
ctgggcagtgtgatcccaga

SEQ ID NO: 35617 - DNA, 21 bp, Artificial sequence
  synthetic polynucleotide sequence
agacaagcccctgagtctcca

SEQ ID NO: 35618 - DNA, 21 bp, Artificial sequence
  synthetic polynucleotide sequence
ctcttggctacgaggagtcca

SEQ ID NO: 35619 - DNA, 19 bp, Artificial sequence
  synthetic polynucleotide sequence
gcacatccgggacgtgcga

SEQ ID NO: 35620 - DNA, 20 bp, Artificial sequence
  synthetic polynucleotide sequence
ctttctccaccaccagccga

SEQ ID NO: 35621 - DNA, 18 bp, Artificial sequence
  synthetic polynucleotide sequence
gccttgcgagacaaccca

SEQ ID NO: 35622 - DNA, 19 bp, Artificial sequence
  synthetic polynucleotide sequence
gctggaggaggttcccaga

SEQ ID NO: 35623 - DNA, 18 bp, Artificial sequence
  synthetic polynucleotide sequence
gaaaacaaggacgggcga

SEQ ID NO: 35624 - DNA, 20 bp, Artificial sequence
  synthetic polynucleotide sequence
tcgtagagcttgaaggccca

SEQ ID NO: 35625 - DNA, 18 bp, Artificial sequence
  synthetic polynucleotide sequence
ccgagagcagtgccagga

SEQ ID NO: 35626 - DNA, 21 bp, Artificial sequence
  synthetic polynucleotide sequence
aatcgtgcagtagaacgcaca

SEQ ID NO: 35627 - DNA, 20 bp, Artificial sequence
  synthetic polynucleotide sequence
ctcggccttcagtgccacca

SEQ ID NO: 35628 - DNA, 21 bp, Artificial sequence
  synthetic polynucleotide sequence
actttgcggtgacccatagca

SEQ ID NO: 35629 - DNA, 19 bp, Artificial sequence
  synthetic polynucleotide sequence
gccagaggcaaagaagcga

SEQ ID NO: 35630 - DNA, 18 bp, Artificial sequence
  synthetic polynucleotide sequence
acaaggcagttggcacca

SEQ ID NO: 35631 - DNA, 21 bp, Artificial sequence
  synthetic polynucleotide sequence
tacgatcagtccccaaaccga

SEQ ID NO: 35632 - DNA, 21 bp, Artificial sequence
  synthetic polynucleotide sequence
tgtccaaccccttatcaccca

SEQ ID NO: 35633 - DNA, 22 bp, Artificial sequence
  synthetic polynucleotide sequence
gctacccctgttggcaaaggaa

SEQ ID NO: 35634 - DNA, 21 bp, Artificial sequence
  synthetic polynucleotide sequence
ccattgccattcagcacccca

SEQ ID NO: 35635 - DNA, 20 bp, Artificial sequence
  synthetic polynucleotide sequence
tgcaggaaggtatggggcca

SEQ ID NO: 35636 - DNA, 23 bp, Artificial sequence
  synthetic polynucleotide sequence
taaaacaaggaacacccaccaga

SEQ ID NO: 35637 - DNA, 21 bp, Artificial sequence
  synthetic polynucleotide sequence
tcagagtggggaatgatggca

SEQ ID NO: 35638 - DNA, 22 bp, Artificial sequence
  synthetic polynucleotide sequence
tcaaggaaaggccaaatccgca

SEQ ID NO: 35639 - DNA, 20 bp, Artificial sequence
  synthetic polynucleotide sequence
ctgcggccctggaagaagca

SEQ ID NO: 35640 - DNA, 20 bp, Artificial sequence
  synthetic polynucleotide sequence
tattcgggcggctccacgta

SEQ ID NO: 35641 - DNA, 21 bp, Artificial sequence
  synthetic polynucleotide sequence
ggcaccgaaacctggtctgga

SEQ ID NO: 35642 - DNA, 22 bp, Artificial sequence
  synthetic polynucleotide sequence
aaccttgggcctggagtagaca

SEQ ID NO: 35643 - DNA, 21 bp, Artificial sequence
  synthetic polynucleotide sequence
ttcagcactgtcctcaagcaa

SEQ ID NO: 35644 - DNA, 20 bp, Artificial sequence
  synthetic polynucleotide sequence
gtaccggtaggtggcagtga

SEQ ID NO: 35645 - DNA, 21 bp, Artificial sequence
  synthetic polynucleotide sequence
cactctcctcaagatggcgga

SEQ ID NO: 35646 - DNA, 21 bp, Artificial sequence
  synthetic polynucleotide sequence
tagccgagggcatgtatccca

SEQ ID NO: 35647 - DNA, 18 bp, Artificial sequence
  synthetic polynucleotide sequence
aactggaccccacccaga

SEQ ID NO: 35648 - DNA, 20 bp, Artificial sequence
  synthetic polynucleotide sequence
gtcagagaggctgtacgaga

SEQ ID NO: 35649 - DNA, 21 bp, Artificial sequence
  synthetic polynucleotide sequence
gtaggggacaattcgcctgca

SEQ ID NO: 35650 - DNA, 18 bp, Artificial sequence
  synthetic polynucleotide sequence
acctggggcagtccccca

SEQ ID NO: 35651 - DNA, 18 bp, Artificial sequence
  synthetic polynucleotide sequence
ctctggagggctgcccca

SEQ ID NO: 35652 - DNA, 20 bp, Artificial sequence
  synthetic polynucleotide sequence
gtgagggatgcagtgcggga

SEQ ID NO: 35653 - DNA, 18 bp, Artificial sequence
  synthetic polynucleotide sequence
gcggcctcttcacacaca

SEQ ID NO: 35654 - DNA, 18 bp, Artificial sequence
  synthetic polynucleotide sequence
aggagtgcaggaagcgca

SEQ ID NO: 35655 - DNA, 18 bp, Artificial sequence
  synthetic polynucleotide sequence
ctgcgtaccaacccagca

SEQ ID NO: 35656 - DNA, 18 bp, Artificial sequence
  synthetic polynucleotide sequence
ctccggcctagacagcga

SEQ ID NO: 35657 - DNA, 20 bp, Artificial sequence
  synthetic polynucleotide sequence
tggagccatatgcagcccca

SEQ ID NO: 35658 - DNA, 19 bp, Artificial sequence
  synthetic polynucleotide sequence
cccgaatggtgaggggcca

SEQ ID NO: 35659 - DNA, 22 bp, Artificial sequence
  synthetic polynucleotide sequence
gcagaagcagaatgcactgaca

SEQ ID NO: 35660 - DNA, 21 bp, Artificial sequence
  synthetic polynucleotide sequence
ggctctccacgaagagaagga

SEQ ID NO: 35661 - DNA, 20 bp, Artificial sequence
  synthetic polynucleotide sequence
gatggaaagagataggcgca

SEQ ID NO: 35662 - DNA, 18 bp, Artificial sequence
  synthetic polynucleotide sequence
agcaggggtagatggcca

SEQ ID NO: 35663 - DNA, 18 bp, Artificial sequence
  synthetic polynucleotide sequence
gaagcccctcgccaccga

SEQ ID NO: 35664 - DNA, 20 bp, Artificial sequence
  synthetic polynucleotide sequence
gtggtcagcaagtgctccaa

SEQ ID NO: 35665 - DNA, 18 bp, Artificial sequence
  synthetic polynucleotide sequence
agcccgacgaccccctga

SEQ ID NO: 35666 - DNA, 20 bp, Artificial sequence
  synthetic polynucleotide sequence
cagccggcccatcttgacca

SEQ ID NO: 35667 - DNA, 18 bp, Artificial sequence
  synthetic polynucleotide sequence
cggcggtctccgaggcta

SEQ ID NO: 35668 - DNA, 20 bp, Artificial sequence
  synthetic polynucleotide sequence
ctgtgaagccaacgatgcca

SEQ ID NO: 35669 - DNA, 21 bp, Artificial sequence
  synthetic polynucleotide sequence
caggcgcctacaaatcgagga

SEQ ID NO: 35670 - DNA, 19 bp, Artificial sequence
  synthetic polynucleotide sequence
cccaccttccagtcgggca

SEQ ID NO: 35671 - DNA, 18 bp, Artificial sequence
  synthetic polynucleotide sequence
cagccagggcgtcaggga

SEQ ID NO: 35672 - DNA, 18 bp, Artificial sequence
  synthetic polynucleotide sequence
catcggagcattcgcgga

SEQ ID NO: 35673 - DNA, 18 bp, Artificial sequence
  synthetic polynucleotide sequence
gcccccattgagccccta

SEQ ID NO: 35674 - DNA, 18 bp, Artificial sequence
  synthetic polynucleotide sequence
ggctgggcacgtcgggca

SEQ ID NO: 35675 - DNA, 19 bp, Artificial sequence
  synthetic polynucleotide sequence
cagaaaggagagcgcgaca

SEQ ID NO: 35676 - DNA, 18 bp, Artificial sequence
  synthetic polynucleotide sequence
ccagggagcccgacagga

SEQ ID NO: 35677 - DNA, 20 bp, Artificial sequence
  synthetic polynucleotide sequence
ggcccgcttctaccggcaga

SEQ ID NO: 35678 - DNA, 20 bp, Artificial sequence
  synthetic polynucleotide sequence
gctgcgaagggcgagtcgca

SEQ ID NO: 35679 - DNA, 22 bp, Artificial sequence
  synthetic polynucleotide sequence
aagaccaacttcaaggcggtca

SEQ ID NO: 35680 - DNA, 22 bp, Artificial sequence
  synthetic polynucleotide sequence
ccatttccactgatcggcagga

SEQ ID NO: 35681 - DNA, 18 bp, Artificial sequence
  synthetic polynucleotide sequence
ttggcaagatggcgggga

SEQ ID NO: 35682 - DNA, 18 bp, Artificial sequence
  synthetic polynucleotide sequence
ggtgcacagtgttcggca

SEQ ID NO: 35683 - DNA, 18 bp, Artificial sequence
  synthetic polynucleotide sequence
caggcaagccagcagaga

SEQ ID NO: 35684 - DNA, 18 bp, Artificial sequence
  synthetic polynucleotide sequence
gtccgaggacagctccca

SEQ ID NO: 35685 - DNA, 20 bp, Artificial sequence
  synthetic polynucleotide sequence
ggggatagtggagctgccca

SEQ ID NO: 35686 - DNA, 19 bp, Artificial sequence
  synthetic polynucleotide sequence
ttctcttcccagcggcaga

SEQ ID NO: 35687 - DNA, 21 bp, Artificial sequence
  synthetic polynucleotide sequence
ggagcggatgcacatcacaga

SEQ ID NO: 35688 - DNA, 20 bp, Artificial sequence
  synthetic polynucleotide sequence
acagccagcggtaagtgcga

SEQ ID NO: 35689 - DNA, 18 bp, Artificial sequence
  synthetic polynucleotide sequence
tggcccggcctctcagca

SEQ ID NO: 35690 - DNA, 21 bp, Artificial sequence
  synthetic polynucleotide sequence
tgtcgctatactggcggcaca

SEQ ID NO: 35691 - DNA, 20 bp, Artificial sequence
  synthetic polynucleotide sequence
agctctgaggcgcctcagga

SEQ ID NO: 35692 - DNA, 20 bp, Artificial sequence
  synthetic polynucleotide sequence
tcaccatccaaggccgacca

SEQ ID NO: 35693 - DNA, 21 bp, Artificial sequence
  synthetic polynucleotide sequence
agtgaggaactcctgcctcca

SEQ ID NO: 35694 - DNA, 19 bp, Artificial sequence
  synthetic polynucleotide sequence
ccagtgctgctgggagcca

SEQ ID NO: 35695 - DNA, 20 bp, Artificial sequence
  synthetic polynucleotide sequence
gtggtggtggggactggaga

SEQ ID NO: 35696 - DNA, 21 bp, Artificial sequence
  synthetic polynucleotide sequence
aagttgaaggtggcacaggca

SEQ ID NO: 35697 - DNA, 21 bp, Artificial sequence
  synthetic polynucleotide sequence
tcccagacacccctctaccaa

SEQ ID NO: 35698 - DNA, 21 bp, Artificial sequence
  synthetic polynucleotide sequence
gaattccttcggctcttgaca

SEQ ID NO: 35699 - DNA, 21 bp, Artificial sequence
  synthetic polynucleotide sequence
gcggaaacggaaagggaagga

SEQ ID NO: 35700 - DNA, 20 bp, Artificial sequence
  synthetic polynucleotide sequence
gtacactgccgcagctgcca

SEQ ID NO: 35701 - DNA, 19 bp, Artificial sequence
  synthetic polynucleotide sequence
ctgggtctgtacgcgcgca

SEQ ID NO: 35702 - DNA, 18 bp, Artificial sequence
  synthetic polynucleotide sequence
ccgcagcagctccaggca

SEQ ID NO: 35703 - DNA, 21 bp, Artificial sequence
  synthetic polynucleotide sequence
aattgccccaggaacagcaga

SEQ ID NO: 35704 - DNA, 23 bp, Artificial sequence
  synthetic polynucleotide sequence
ctaaaagaaccttcagccggaca

SEQ ID NO: 35705 - DNA, 20 bp, Artificial sequence
  synthetic polynucleotide sequence
ccaagaagacgctggaggga

SEQ ID NO: 35706 - DNA, 20 bp, Artificial sequence
  synthetic polynucleotide sequence
gctctgcacccatggcagca

SEQ ID NO: 35707 - DNA, 18 bp, Artificial sequence
  synthetic polynucleotide sequence
ccgaggtcgcagcttcca

SEQ ID NO: 35708 - DNA, 18 bp, Artificial sequence
  synthetic polynucleotide sequence
gaacccagtggtcccgca

SEQ ID NO: 35709 - DNA, 21 bp, Artificial sequence
  synthetic polynucleotide sequence
ctgagtgcaaggaggaggaca

SEQ ID NO: 35710 - DNA, 21 bp, Artificial sequence
  synthetic polynucleotide sequence
tggcagaactgtaggccccca

SEQ ID NO: 35711 - DNA, 22 bp, Artificial sequence
  synthetic polynucleotide sequence
atgagaagaacccagactccca

SEQ ID NO: 35712 - DNA, 21 bp, Artificial sequence
  synthetic polynucleotide sequence
gattccatgatgggaaggcca

SEQ ID NO: 35713 - DNA, 18 bp, Artificial sequence
  synthetic polynucleotide sequence
cgcacggactgctggaga

SEQ ID NO: 35714 - DNA, 20 bp, Artificial sequence
  synthetic polynucleotide sequence
gaaccacatgagtccgctga

SEQ ID NO: 35715 - DNA, 18 bp, Artificial sequence
  synthetic polynucleotide sequence
gccgcaatgaagcttgga

SEQ ID NO: 35716 - DNA, 22 bp, Artificial sequence
  synthetic polynucleotide sequence
ttcagctcctacagctaccaca

SEQ ID NO: 35717 - DNA, 19 bp, Artificial sequence
  synthetic polynucleotide sequence
gagcccagctgaaacgaga

SEQ ID NO: 35718 - DNA, 19 bp, Artificial sequence
  synthetic polynucleotide sequence
tcttgcataggcccaacga

SEQ ID NO: 35719 - DNA, 20 bp, Artificial sequence
  synthetic polynucleotide sequence
cgtagtagccatggcggcca

SEQ ID NO: 35720 - DNA, 20 bp, Artificial sequence
  synthetic polynucleotide sequence
cagccttcggaaagccacga

SEQ ID NO: 35721 - DNA, 18 bp, Artificial sequence
  synthetic polynucleotide sequence
gaaactgcggctgcagca

SEQ ID NO: 35722 - DNA, 18 bp, Artificial sequence
  synthetic polynucleotide sequence
ccggctcccgagggctca

SEQ ID NO: 35723 - DNA, 18 bp, Artificial sequence
  synthetic polynucleotide sequence
cttccccgaacgcaagga

SEQ ID NO: 35724 - DNA, 18 bp, Artificial sequence
  synthetic polynucleotide sequence
gggcgcagtagtcccgca

SEQ ID NO: 35725 - DNA, 20 bp, Artificial sequence
  synthetic polynucleotide sequence
gatgcactggcacctagaca

SEQ ID NO: 35726 - DNA, 21 bp, Artificial sequence
  synthetic polynucleotide sequence
cacaggctggtagacagggta

SEQ ID NO: 35727 - DNA, 18 bp, Artificial sequence
  synthetic polynucleotide sequence
ctgcaggaggaaacgcca

SEQ ID NO: 35728 - DNA, 18 bp, Artificial sequence
  synthetic polynucleotide sequence
accaccacagtgggggca

SEQ ID NO: 35729 - DNA, 17 bp, Artificial sequence
  synthetic polynucleotide sequence
gttgacgcccccacgga

SEQ ID NO: 35730 - DNA, 18 bp, Artificial sequence
  synthetic polynucleotide sequence
gggaaaggggacgcagca

SEQ ID NO: 35731 - DNA, 18 bp, Artificial sequence
  synthetic polynucleotide sequence
cccgcccaagctgaccga

SEQ ID NO: 35732 - DNA, 22 bp, Artificial sequence
  synthetic polynucleotide sequence
tagaagctggcgatgcaaacca

SEQ ID NO: 35733 - DNA, 18 bp, Artificial sequence
  synthetic polynucleotide sequence
ggcaaagatgtggcagca

SEQ ID NO: 35734 - DNA, 20 bp, Artificial sequence
  synthetic polynucleotide sequence
ctgcctcttccacaccagca

SEQ ID NO: 35735 - DNA, 18 bp, Artificial sequence
  synthetic polynucleotide sequence
ggacctgcggaagaccca

SEQ ID NO: 35736 - DNA, 18 bp, Artificial sequence
  synthetic polynucleotide sequence
catctcctccacccggca

SEQ ID NO: 35737 - DNA, 19 bp, Artificial sequence
  synthetic polynucleotide sequence
tcctcagggatcacaccaa

SEQ ID NO: 35738 - DNA, 19 bp, Artificial sequence
  synthetic polynucleotide sequence
ccgtgagttgaagcgcaga

SEQ ID NO: 35739 - DNA, 22 bp, Artificial sequence
  synthetic polynucleotide sequence
atgtcagtggtactgaggcaga

SEQ ID NO: 35740 - DNA, 18 bp, Artificial sequence
  synthetic polynucleotide sequence
cctggtcggaaccctgga

SEQ ID NO: 35741 - DNA, 21 bp, Artificial sequence
  synthetic polynucleotide sequence
ctcgggcagagaaagagtgca

SEQ ID NO: 35742 - DNA, 18 bp, Artificial sequence
  synthetic polynucleotide sequence
cgaggctcccccttgcca

SEQ ID NO: 35743 - DNA, 19 bp, Artificial sequence
  synthetic polynucleotide sequence
ggggagaaggtcacgcaca

SEQ ID NO: 35744 - DNA, 18 bp, Artificial sequence
  synthetic polynucleotide sequence
tcgcacgctatcacccga

SEQ ID NO: 35745 - DNA, 18 bp, Artificial sequence
  synthetic polynucleotide sequence
agctgcgccaacggagga

SEQ ID NO: 35746 - DNA, 18 bp, Artificial sequence
  synthetic polynucleotide sequence
ctcggccgtaggtgggca

SEQ ID NO: 35747 - DNA, 19 bp, Artificial sequence
  synthetic polynucleotide sequence
cggaccacccgctatgaca

SEQ ID NO: 35748 - DNA, 18 bp, Artificial sequence
  synthetic polynucleotide sequence
acgatggcatccacggga

SEQ ID NO: 35749 - DNA, 20 bp, Artificial sequence
  synthetic polynucleotide sequence
ctccctgtgggagatcagca

SEQ ID NO: 35750 - DNA, 18 bp, Artificial sequence
  synthetic polynucleotide sequence
cggatcagaccctgcaca

SEQ ID NO: 35751 - DNA, 19 bp, Artificial sequence
  synthetic polynucleotide sequence
gcctgtgtgaacgcaccaa

SEQ ID NO: 35752 - DNA, 20 bp, Artificial sequence
  synthetic polynucleotide sequence
tccagctggctcacaagaga

SEQ ID NO: 35753 - DNA, 18 bp, Artificial sequence
  synthetic polynucleotide sequence
acacaggagccagcccca

SEQ ID NO: 35754 - DNA, 18 bp, Artificial sequence
  synthetic polynucleotide sequence
cggcctgaggagggctga

SEQ ID NO: 35755 - DNA, 18 bp, Artificial sequence
  synthetic polynucleotide sequence
gtccctgacacacgccaa

SEQ ID NO: 35756 - DNA, 18 bp, Artificial sequence
  synthetic polynucleotide sequence
cttgccaactcggaggca

SEQ ID NO: 35757 - DNA, 21 bp, Artificial sequence
  synthetic polynucleotide sequence
gacctaccgagccatgtacga

SEQ ID NO: 35758 - DNA, 21 bp, Artificial sequence
  synthetic polynucleotide sequence
actgtgccgtacatccagcca

SEQ ID NO: 35759 - DNA, 22 bp, Artificial sequence
  synthetic polynucleotide sequence
aagactaccaagaagcctccaa

SEQ ID NO: 35760 - DNA, 19 bp, Artificial sequence
  synthetic polynucleotide sequence
ccaggccattgaatcgaca

SEQ ID NO: 35761 - DNA, 20 bp, Artificial sequence
  synthetic polynucleotide sequence
gggaccactggcgtgaggaa

SEQ ID NO: 35762 - DNA, 20 bp, Artificial sequence
  synthetic polynucleotide sequence
gtccaccttgacgtgccgga

SEQ ID NO: 35763 - DNA, 19 bp, Artificial sequence
  synthetic polynucleotide sequence
cctgcaggacttccaccga

SEQ ID NO: 35764 - DNA, 20 bp, Artificial sequence
  synthetic polynucleotide sequence
catacagggtgaaggaggca

SEQ ID NO: 35765 - DNA, 20 bp, Artificial sequence
  synthetic polynucleotide sequence
accccaccacccattccgaa

SEQ ID NO: 35766 - DNA, 21 bp, Artificial sequence
  synthetic polynucleotide sequence
cagtgctgaagtctccccaca

SEQ ID NO: 35767 - DNA, 21 bp, Artificial sequence
  synthetic polynucleotide sequence
agggccagaccatcaagctca

SEQ ID NO: 35768 - DNA, 19 bp, Artificial sequence
  synthetic polynucleotide sequence
ggggagggatcagggtgga

SEQ ID NO: 35769 - DNA, 20 bp, Artificial sequence
  synthetic polynucleotide sequence
caactggtacctgcagcgga

SEQ ID NO: 35770 - DNA, 18 bp, Artificial sequence
  synthetic polynucleotide sequence
cctccacacccttgggga

SEQ ID NO: 35771 - DNA, 18 bp, Artificial sequence
  synthetic polynucleotide sequence
cctggtcccatggaacca

SEQ ID NO: 35772 - DNA, 18 bp, Artificial sequence
  synthetic polynucleotide sequence
ccgccgtgagatgaggga

SEQ ID NO: 35773 - DNA, 22 bp, Artificial sequence
  synthetic polynucleotide sequence
cagatttgctagaggaaggcga

SEQ ID NO: 35774 - DNA, 21 bp, Artificial sequence
  synthetic polynucleotide sequence
atccaacctgctccacacaga

SEQ ID NO: 35775 - DNA, 18 bp, Artificial sequence
  synthetic polynucleotide sequence
ccgcagcatgaatgggca

SEQ ID NO: 35776 - DNA, 19 bp, Artificial sequence
  synthetic polynucleotide sequence
cctcacagaggcctcagca

SEQ ID NO: 35777 - DNA, 20 bp, Artificial sequence
  synthetic polynucleotide sequence
caaagctccagcgtcaggca

SEQ ID NO: 35778 - DNA, 21 bp, Artificial sequence
  synthetic polynucleotide sequence
ccaaagtggctccatcaggca

SEQ ID NO: 35779 - DNA, 20 bp, Artificial sequence
  synthetic polynucleotide sequence
gcagtgccctactccaggga

SEQ ID NO: 35780 - DNA, 20 bp, Artificial sequence
  synthetic polynucleotide sequence
ccacagtcgagccttcagga

SEQ ID NO: 35781 - DNA, 18 bp, Artificial sequence
  synthetic polynucleotide sequence
gtcacagggacatcgcga

SEQ ID NO: 35782 - DNA, 20 bp, Artificial sequence
  synthetic polynucleotide sequence
atggaggtaagtcaaggcga

SEQ ID NO: 35783 - DNA, 21 bp, Artificial sequence
  synthetic polynucleotide sequence
gaatccccccacaacagcaga

SEQ ID NO: 35784 - DNA, 21 bp, Artificial sequence
  synthetic polynucleotide sequence
ctcctctcagagccaacacca

SEQ ID NO: 35785 - DNA, 18 bp, Artificial sequence
  synthetic polynucleotide sequence
aggcattgtcccaggcaa

SEQ ID NO: 35786 - DNA, 19 bp, Artificial sequence
  synthetic polynucleotide sequence
ctgcatcagtccagaggca

SEQ ID NO: 35787 - DNA, 19 bp, Artificial sequence
  synthetic polynucleotide sequence
gcctcctaccaggaagcca

SEQ ID NO: 35788 - DNA, 20 bp, Artificial sequence
  synthetic polynucleotide sequence
gggagtccttctggaagcga

SEQ ID NO: 35789 - DNA, 18 bp, Artificial sequence
  synthetic polynucleotide sequence
tcaccagcgtgggaagca

SEQ ID NO: 35790 - DNA, 21 bp, Artificial sequence
  synthetic polynucleotide sequence
ggctggtgtagtaggacggga

SEQ ID NO: 35791 - DNA, 21 bp, Artificial sequence
  synthetic polynucleotide sequence
gcagtgggagggaagaggaga

SEQ ID NO: 35792 - DNA, 20 bp, Artificial sequence
  synthetic polynucleotide sequence
tagcaccatctcccccctca

SEQ ID NO: 35793 - DNA, 20 bp, Artificial sequence
  synthetic polynucleotide sequence
accaacgtgacacaggagca

SEQ ID NO: 35794 - DNA, 19 bp, Artificial sequence
  synthetic polynucleotide sequence
gttaagaggcaggctcgca

SEQ ID NO: 35795 - DNA, 19 bp, Artificial sequence
  synthetic polynucleotide sequence
tccaggacacgaagggcaa

SEQ ID NO: 35796 - DNA, 18 bp, Artificial sequence
  synthetic polynucleotide sequence
cggggtctgcagtggcca

SEQ ID NO: 35797 - DNA, 18 bp, Artificial sequence
  synthetic polynucleotide sequence
gagtgcctcgcgtcggga

SEQ ID NO: 35798 - DNA, 21 bp, Artificial sequence
  synthetic polynucleotide sequence
ttcatgacctggtggccagca

SEQ ID NO: 35799 - DNA, 21 bp, Artificial sequence
  synthetic polynucleotide sequence
ttggacatctagcagggtgga

SEQ ID NO: 35800 - DNA, 22 bp, Artificial sequence
  synthetic polynucleotide sequence
caataggccttgaggtcaagca

SEQ ID NO: 35801 - DNA, 20 bp, Artificial sequence
  synthetic polynucleotide sequence
gctgcaggccgaatccagca

SEQ ID NO: 35802 - DNA, 20 bp, Artificial sequence
  synthetic polynucleotide sequence
cctgaaccacctggtgggca

SEQ ID NO: 35803 - DNA, 21 bp, Artificial sequence
  synthetic polynucleotide sequence
tggcaaggcagggaagaggaa

SEQ ID NO: 35804 - DNA, 20 bp, Artificial sequence
  synthetic polynucleotide sequence
atccaaggtcagatgtggca

SEQ ID NO: 35805 - DNA, 21 bp, Artificial sequence
  synthetic polynucleotide sequence
atcgggatctgaaaccagcca

SEQ ID NO: 35806 - DNA, 22 bp, Artificial sequence
  synthetic polynucleotide sequence
aactcatacagcaagcagccca

SEQ ID NO: 35807 - DNA, 21 bp, Artificial sequence
  synthetic polynucleotide sequence
tgtcaagggtgcatcagtcca

SEQ ID NO: 35808 - DNA, 21 bp, Artificial sequence
  synthetic polynucleotide sequence
gatgatctcggggggtaagca

SEQ ID NO: 35809 - DNA, 21 bp, Artificial sequence
  synthetic polynucleotide sequence
gcgactaaagcagtcacagga

SEQ ID NO: 35810 - DNA, 20 bp, Artificial sequence
  synthetic polynucleotide sequence
cagaggagagccgtcgggca

SEQ ID NO: 35811 - DNA, 21 bp, Artificial sequence
  synthetic polynucleotide sequence
cgaggcatggtccatccccaa

SEQ ID NO: 35812 - DNA, 19 bp, Artificial sequence
  synthetic polynucleotide sequence
tggctcggcagaagatgga

SEQ ID NO: 35813 - DNA, 19 bp, Artificial sequence
  synthetic polynucleotide sequence
gctcatcccggagaggaca

SEQ ID NO: 35814 - DNA, 20 bp, Artificial sequence
  synthetic polynucleotide sequence
catgtagtagggcgtcccca

SEQ ID NO: 35815 - DNA, 20 bp, Artificial sequence
  synthetic polynucleotide sequence
atgctggcgacctatccaga

SEQ ID NO: 35816 - DNA, 18 bp, Artificial sequence
  synthetic polynucleotide sequence
aaaaccggccaagcccaa

SEQ ID NO: 35817 - DNA, 20 bp, Artificial sequence
  synthetic polynucleotide sequence
aacaagctgggcctggacca

SEQ ID NO: 35818 - DNA, 19 bp, Artificial sequence
  synthetic polynucleotide sequence
cctggtccaggggtgcaga

SEQ ID NO: 35819 - DNA, 18 bp, Artificial sequence
  synthetic polynucleotide sequence
tcagtcccacagaggcca

SEQ ID NO: 35820 - DNA, 19 bp, Artificial sequence
  synthetic polynucleotide sequence
ggagatgggctgtcaggca

SEQ ID NO: 35821 - DNA, 21 bp, Artificial sequence
  synthetic polynucleotide sequence
tcgcctctgacacccaccaca

SEQ ID NO: 35822 - DNA, 21 bp, Artificial sequence
  synthetic polynucleotide sequence
tgaacatctcctgggcagcga

SEQ ID NO: 35823 - DNA, 18 bp, Artificial sequence
  synthetic polynucleotide sequence
gcggttcgtggacagcaa

SEQ ID NO: 35824 - DNA, 18 bp, Artificial sequence
  synthetic polynucleotide sequence
tggcgaaggggtcacaca

SEQ ID NO: 35825 - DNA, 18 bp, Artificial sequence
  synthetic polynucleotide sequence
gctggacgtgatggagca

SEQ ID NO: 35826 - DNA, 19 bp, Artificial sequence
  synthetic polynucleotide sequence
ggagcaatgacgtccagca

SEQ ID NO: 35827 - DNA, 20 bp, Artificial sequence
  synthetic polynucleotide sequence
cagagacagagagcgggaca

SEQ ID NO: 35828 - DNA, 18 bp, Artificial sequence
  synthetic polynucleotide sequence
gagagaaggccccacgga

SEQ ID NO: 35829 - DNA, 18 bp, Artificial sequence
  synthetic polynucleotide sequence
gccactcacttgccccaa

SEQ ID NO: 35830 - DNA, 18 bp, Artificial sequence
  synthetic polynucleotide sequence
tgcagggagatccagcca

SEQ ID NO: 35831 - DNA, 20 bp, Artificial sequence
  synthetic polynucleotide sequence
ctgccctgaatgtgacccaa

SEQ ID NO: 35832 - DNA, 18 bp, Artificial sequence
  synthetic polynucleotide sequence
ccacatctgggcaaggca

SEQ ID NO: 35833 - DNA, 21 bp, Artificial sequence
  synthetic polynucleotide sequence
ataggtggacgagatcagcaa

SEQ ID NO: 35834 - DNA, 22 bp, Artificial sequence
  synthetic polynucleotide sequence
atgatggtacacccaccaagca

SEQ ID NO: 35835 - DNA, 21 bp, Artificial sequence
  synthetic polynucleotide sequence
gctcttcccacctcacgccaa

SEQ ID NO: 35836 - DNA, 21 bp, Artificial sequence
  synthetic polynucleotide sequence
tgtgtgatagcaggacaccga

SEQ ID NO: 35837 - DNA, 21 bp, Artificial sequence
  synthetic polynucleotide sequence
gggaggaggaagatcagccca

SEQ ID NO: 35838 - DNA, 20 bp, Artificial sequence
  synthetic polynucleotide sequence
agtccttccccgtcaaggca

SEQ ID NO: 35839 - DNA, 22 bp, Artificial sequence
  synthetic polynucleotide sequence
caatccgttcgaaataccccca

SEQ ID NO: 35840 - DNA, 21 bp, Artificial sequence
  synthetic polynucleotide sequence
ttcaatgggtgggaagggcga

SEQ ID NO: 35841 - DNA, 18 bp, Artificial sequence
  synthetic polynucleotide sequence
gggccgccacaaacccca

SEQ ID NO: 35842 - DNA, 21 bp, Artificial sequence
  synthetic polynucleotide sequence
agcagcagtccaacaagcgga

SEQ ID NO: 35843 - DNA, 20 bp, Artificial sequence
  synthetic polynucleotide sequence
ggatggaggatgcaggccca

SEQ ID NO: 35844 - DNA, 20 bp, Artificial sequence
  synthetic polynucleotide sequence
tccctcagagactagcggca

SEQ ID NO: 35845 - DNA, 20 bp, Artificial sequence
  synthetic polynucleotide sequence
tagtaaccagctggcagcca

SEQ ID NO: 35846 - DNA, 20 bp, Artificial sequence
  synthetic polynucleotide sequence
gactaggcgacttcgaggga

SEQ ID NO: 35847 - DNA, 20 bp, Artificial sequence
  synthetic polynucleotide sequence
tatgcactctcagagggaca

SEQ ID NO: 35848 - DNA, 20 bp, Artificial sequence
  synthetic polynucleotide sequence
ctggacagctgtgatccaca

SEQ ID NO: 35849 - DNA, 20 bp, Artificial sequence
  synthetic polynucleotide sequence
cagcgtcaaacaaagcagga

SEQ ID NO: 35850 - DNA, 18 bp, Artificial sequence
  synthetic polynucleotide sequence
cagggcctgctcagggca

SEQ ID NO: 35851 - DNA, 21 bp, Artificial sequence
  synthetic polynucleotide sequence
ctccaacccagcacatccaga

SEQ ID NO: 35852 - DNA, 19 bp, Artificial sequence
  synthetic polynucleotide sequence
cctccagggttgccaggga

SEQ ID NO: 35853 - DNA, 21 bp, Artificial sequence
  synthetic polynucleotide sequence
ttcaccccatccaaaggccga

SEQ ID NO: 35854 - DNA, 21 bp, Artificial sequence
  synthetic polynucleotide sequence
tcaccagctgagactcctgga

SEQ ID NO: 35855 - DNA, 21 bp, Artificial sequence
  synthetic polynucleotide sequence
atgcacccaccattcagcaga

SEQ ID NO: 35856 - DNA, 22 bp, Artificial sequence
  synthetic polynucleotide sequence
agcagccagatcagagtagcca

SEQ ID NO: 35857 - DNA, 21 bp, Artificial sequence
  synthetic polynucleotide sequence
ccaacaggccacgggatgaca

SEQ ID NO: 35858 - DNA, 18 bp, Artificial sequence
  synthetic polynucleotide sequence
tccccccgaggctgcaga

SEQ ID NO: 35859 - DNA, 18 bp, Artificial sequence
  synthetic polynucleotide sequence
ccacgccaacctcgccca

SEQ ID NO: 35860 - DNA, 20 bp, Artificial sequence
  synthetic polynucleotide sequence
ctcatcgctccactggccca

SEQ ID NO: 35861 - DNA, 20 bp, Artificial sequence
  synthetic polynucleotide sequence
atcccccaccccacacacca

SEQ ID NO: 35862 - DNA, 22 bp, Artificial sequence
  synthetic polynucleotide sequence
agtgcaaacccttcccaaccca

SEQ ID NO: 35863 - DNA, 21 bp, Artificial sequence
  synthetic polynucleotide sequence
agctgaacgtgctgcctccga

SEQ ID NO: 35864 - DNA, 21 bp, Artificial sequence
  synthetic polynucleotide sequence
gcaagccatactcgagctgga

SEQ ID NO: 35865 - DNA, 23 bp, Artificial sequence
  synthetic polynucleotide sequence
cttgaagcaggaggtatctgcaa

SEQ ID NO: 35866 - DNA, 21 bp, Artificial sequence
  synthetic polynucleotide sequence
gggcgggtaactacagatcca

SEQ ID NO: 35867 - DNA, 19 bp, Artificial sequence
  synthetic polynucleotide sequence
cgaggagacgaggcccaca

SEQ ID NO: 35868 - DNA, 20 bp, Artificial sequence
  synthetic polynucleotide sequence
gctcctcgaaccctacccca

SEQ ID NO: 35869 - DNA, 18 bp, Artificial sequence
  synthetic polynucleotide sequence
acacgaaccgtccgccga

SEQ ID NO: 35870 - DNA, 18 bp, Artificial sequence
  synthetic polynucleotide sequence
atggggatctcgcagcga

SEQ ID NO: 35871 - DNA, 21 bp, Artificial sequence
  synthetic polynucleotide sequence
atgtctccaactgggccctca

SEQ ID NO: 35872 - DNA, 20 bp, Artificial sequence
  synthetic polynucleotide sequence
gtggagtgagtgggccctca

SEQ ID NO: 35873 - DNA, 21 bp, Artificial sequence
  synthetic polynucleotide sequence
ccttctacccaccctaccaca

SEQ ID NO: 35874 - DNA, 19 bp, Artificial sequence
  synthetic polynucleotide sequence
tgggggaggacttaaggga

SEQ ID NO: 35875 - DNA, 20 bp, Artificial sequence
  synthetic polynucleotide sequence
gcccctgaagacgaggtgaa

SEQ ID NO: 35876 - DNA, 20 bp, Artificial sequence
  synthetic polynucleotide sequence
gtcagccggctcaaaccgaa

SEQ ID NO: 35877 - DNA, 22 bp, Artificial sequence
  synthetic polynucleotide sequence
ctgggaagagatgatggtggca

SEQ ID NO: 35878 - DNA, 25 bp, Artificial sequence
  synthetic polynucleotide sequence
tcggcgttaaagagaaaggggagga

SEQ ID NO: 35879 - DNA, 20 bp, Artificial sequence
  synthetic polynucleotide sequence
gctgcgcatagcggaccaca

SEQ ID NO: 35880 - DNA, 20 bp, Artificial sequence
  synthetic polynucleotide sequence
ctgggctcaagcaggcggaa

SEQ ID NO: 35881 - DNA, 23 bp, Artificial sequence
  synthetic polynucleotide sequence
gtaacaggagaacccaaaccaga

SEQ ID NO: 35882 - DNA, 23 bp, Artificial sequence
  synthetic polynucleotide sequence
agaatacaggtactagctgcaga

SEQ ID NO: 35883 - DNA, 20 bp, Artificial sequence
  synthetic polynucleotide sequence
ctgggtcagggagtacacca

SEQ ID NO: 35884 - DNA, 19 bp, Artificial sequence
  synthetic polynucleotide sequence
cagccagtttcccaggaca

SEQ ID NO: 35885 - DNA, 18 bp, Artificial sequence
  synthetic polynucleotide sequence
ggagcgaagagccaagca

SEQ ID NO: 35886 - DNA, 20 bp, Artificial sequence
  synthetic polynucleotide sequence
cgaaagacaggctgtcacca

SEQ ID NO: 35887 - DNA, 21 bp, Artificial sequence
  synthetic polynucleotide sequence
ccaacaaactgccaccctgga

SEQ ID NO: 35888 - DNA, 22 bp, Artificial sequence
  synthetic polynucleotide sequence
gacagagcagtagtaggtgcca

SEQ ID NO: 35889 - DNA, 19 bp, Artificial sequence
  synthetic polynucleotide sequence
cgggacacccagatcagca

SEQ ID NO: 35890 - DNA, 18 bp, Artificial sequence
  synthetic polynucleotide sequence
accatcgcagtgtgggga

SEQ ID NO: 35891 - DNA, 20 bp, Artificial sequence
  synthetic polynucleotide sequence
cagcagcagattcagcccaa

SEQ ID NO: 35892 - DNA, 21 bp, Artificial sequence
  synthetic polynucleotide sequence
ttgggcagctgactagaagca

SEQ ID NO: 35893 - DNA, 18 bp, Artificial sequence
  synthetic polynucleotide sequence
cgtggagaaagccccaga

SEQ ID NO: 35894 - DNA, 18 bp, Artificial sequence
  synthetic polynucleotide sequence
atggcgggatctcaacca

SEQ ID NO: 35895 - DNA, 18 bp, Artificial sequence
  synthetic polynucleotide sequence
ccatcaagacggagccca

SEQ ID NO: 35896 - DNA, 18 bp, Artificial sequence
  synthetic polynucleotide sequence
atgagagccccgtgcgga

SEQ ID NO: 35897 - DNA, 21 bp, Artificial sequence
  synthetic polynucleotide sequence
tccgggtgcagggaaaggaga

SEQ ID NO: 35898 - DNA, 21 bp, Artificial sequence
  synthetic polynucleotide sequence
ggtccccagattccatgccca

SEQ ID NO: 35899 - DNA, 20 bp, Artificial sequence
  synthetic polynucleotide sequence
ctacaacagcttccccagca

SEQ ID NO: 35900 - DNA, 20 bp, Artificial sequence
  synthetic polynucleotide sequence
ctggagacggtgatgaggca

SEQ ID NO: 35901 - DNA, 19 bp, Artificial sequence
  synthetic polynucleotide sequence
ctctgcctcggtctgagga

SEQ ID NO: 35902 - DNA, 18 bp, Artificial sequence
  synthetic polynucleotide sequence
aatccgggccttggacca

SEQ ID NO: 35903 - DNA, 20 bp, Artificial sequence
  synthetic polynucleotide sequence
cttgagctggaggggacaga

SEQ ID NO: 35904 - DNA, 18 bp, Artificial sequence
  synthetic polynucleotide sequence
ttcatggccaaggcccga

SEQ ID NO: 35905 - DNA, 19 bp, Artificial sequence
  synthetic polynucleotide sequence
gccgcatgagctaccagga

SEQ ID NO: 35906 - DNA, 18 bp, Artificial sequence
  synthetic polynucleotide sequence
tcggctgagtccagggca

SEQ ID NO: 35907 - DNA, 22 bp, Artificial sequence
  synthetic polynucleotide sequence
cagatgccacagtcaacacaga

SEQ ID NO: 35908 - DNA, 22 bp, Artificial sequence
  synthetic polynucleotide sequence
cttaaagtagcaggtgagggca

SEQ ID NO: 35909 - DNA, 21 bp, Artificial sequence
  synthetic polynucleotide sequence
gtggctactacccagaaccca

SEQ ID NO: 35910 - DNA, 18 bp, Artificial sequence
  synthetic polynucleotide sequence
gacttcccaggccacgga

SEQ ID NO: 35911 - DNA, 19 bp, Artificial sequence
  synthetic polynucleotide sequence
tacttctcacacccagcca

SEQ ID NO: 35912 - DNA, 22 bp, Artificial sequence
  synthetic polynucleotide sequence
ccattgggattgaggaacccca

SEQ ID NO: 35913 - DNA, 21 bp, Artificial sequence
  synthetic polynucleotide sequence
taagagtatccagaacgccca

SEQ ID NO: 35914 - DNA, 20 bp, Artificial sequence
  synthetic polynucleotide sequence
ctctgaagattgacccccga

SEQ ID NO: 35915 - DNA, 21 bp, Artificial sequence
  synthetic polynucleotide sequence
cggaggacatggaaggaggca

SEQ ID NO: 35916 - DNA, 21 bp, Artificial sequence
  synthetic polynucleotide sequence
gtaggatggacgtcgtaggga

SEQ ID NO: 35917 - DNA, 18 bp, Artificial sequence
  synthetic polynucleotide sequence
acgagcacgaaccctcga

SEQ ID NO: 35918 - DNA, 18 bp, Artificial sequence
  synthetic polynucleotide sequence
gcagcttccctgcacaga

SEQ ID NO: 35919 - DNA, 21 bp, Artificial sequence
  synthetic polynucleotide sequence
ctccacgtccatcatccagca

SEQ ID NO: 35920 - DNA, 18 bp, Artificial sequence
  synthetic polynucleotide sequence
gcccgagccatccgagca

SEQ ID NO: 35921 - DNA, 23 bp, Artificial sequence
  synthetic polynucleotide sequence
gcaaatagacgagctccgagaca

SEQ ID NO: 35922 - DNA, 20 bp, Artificial sequence
  synthetic polynucleotide sequence
tgagagttagcagtgaggca

SEQ ID NO: 35923 - DNA, 19 bp, Artificial sequence
  synthetic polynucleotide sequence
cggcatggagactcagcca

SEQ ID NO: 35924 - DNA, 18 bp, Artificial sequence
  synthetic polynucleotide sequence
gcctccacttcagcccca

SEQ ID NO: 35925 - DNA, 21 bp, Artificial sequence
  synthetic polynucleotide sequence
gatgctgccagagagtgagga

SEQ ID NO: 35926 - DNA, 22 bp, Artificial sequence
  synthetic polynucleotide sequence
aacacacagtcatcatagggca

SEQ ID NO: 35927 - DNA, 21 bp, Artificial sequence
  synthetic polynucleotide sequence
gctggaggctgaaaactacga

SEQ ID NO: 35928 - DNA, 19 bp, Artificial sequence
  synthetic polynucleotide sequence
gccctcaggagaagctcca

SEQ ID NO: 35929 - DNA, 20 bp, Artificial sequence
  synthetic polynucleotide sequence
caggcccgagacaggctgga

SEQ ID NO: 35930 - DNA, 20 bp, Artificial sequence
  synthetic polynucleotide sequence
agcctgcacggccaagtgca

SEQ ID NO: 35931 - DNA, 18 bp, Artificial sequence
  synthetic polynucleotide sequence
cccaggtagatgcccgca

SEQ ID NO: 35932 - DNA, 18 bp, Artificial sequence
  synthetic polynucleotide sequence
cgcagcagggagtcagca

SEQ ID NO: 35933 - DNA, 19 bp, Artificial sequence
  synthetic polynucleotide sequence
gcagcgagaagcagaggga

SEQ ID NO: 35934 - DNA, 18 bp, Artificial sequence
  synthetic polynucleotide sequence
tggctcggctctcacgca

SEQ ID NO: 35935 - DNA, 18 bp, Artificial sequence
  synthetic polynucleotide sequence
gcccaagggagaagggca

SEQ ID NO: 35936 - DNA, 18 bp, Artificial sequence
  synthetic polynucleotide sequence
gccccgatgttcaccaga

SEQ ID NO: 35937 - DNA, 19 bp, Artificial sequence
  synthetic polynucleotide sequence
tgcaacccacgccaagcaa

SEQ ID NO: 35938 - DNA, 19 bp, Artificial sequence
  synthetic polynucleotide sequence
ccagcctgggacgtggaca

SEQ ID NO: 35939 - DNA, 20 bp, Artificial sequence
  synthetic polynucleotide sequence
gtcagagcggctgatacaga

SEQ ID NO: 35940 - DNA, 18 bp, Artificial sequence
  synthetic polynucleotide sequence
gggctccagggatgcaga

SEQ ID NO: 35941 - DNA, 22 bp, Artificial sequence
  synthetic polynucleotide sequence
aacaccttcaggagaagcagga

SEQ ID NO: 35942 - DNA, 19 bp, Artificial sequence
  synthetic polynucleotide sequence
tgaactagggcagctggta

SEQ ID NO: 35943 - DNA, 18 bp, Artificial sequence
  synthetic polynucleotide sequence
agtgccagccttgccaga

SEQ ID NO: 35944 - DNA, 18 bp, Artificial sequence
  synthetic polynucleotide sequence
agtttggccacaggggca

SEQ ID NO: 35945 - DNA, 22 bp, Artificial sequence
  synthetic polynucleotide sequence
agatgcgtgactgtcagaagca

SEQ ID NO: 35946 - DNA, 22 bp, Artificial sequence
  synthetic polynucleotide sequence
aactgcctctgtgacagacaga

SEQ ID NO: 35947 - DNA, 20 bp, Artificial sequence
  synthetic polynucleotide sequence
aaccagcagtgggcaaggga

SEQ ID NO: 35948 - DNA, 20 bp, Artificial sequence
  synthetic polynucleotide sequence
ggatagcaggcacagagcca

SEQ ID NO: 35949 - DNA, 22 bp, Artificial sequence
  synthetic polynucleotide sequence
attcagagaggctatgaaagga

SEQ ID NO: 35950 - DNA, 21 bp, Artificial sequence
  synthetic polynucleotide sequence
ccgtctgtggttattaagcca

SEQ ID NO: 35951 - DNA, 18 bp, Artificial sequence
  synthetic polynucleotide sequence
aagcccaacaggcccaga

SEQ ID NO: 35952 - DNA, 18 bp, Artificial sequence
  synthetic polynucleotide sequence
cattcagctgcaccggga

SEQ ID NO: 35953 - DNA, 19 bp, Artificial sequence
  synthetic polynucleotide sequence
ccagcctgggcaggaagca

SEQ ID NO: 35954 - DNA, 19 bp, Artificial sequence
  synthetic polynucleotide sequence
ggtgtgaaggcagggccca

SEQ ID NO: 35955 - DNA, 20 bp, Artificial sequence
  synthetic polynucleotide sequence
acctgccaagtgccgtgaca

SEQ ID NO: 35956 - DNA, 20 bp, Artificial sequence
  synthetic polynucleotide sequence
gtccagaatgaggtgggtca

SEQ ID NO: 35957 - DNA, 18 bp, Artificial sequence
  synthetic polynucleotide sequence
ccggcagattccaggaga

SEQ ID NO: 35958 - DNA, 18 bp, Artificial sequence
  synthetic polynucleotide sequence
cgttctccagcagccgca

SEQ ID NO: 35959 - DNA, 20 bp, Artificial sequence
  synthetic polynucleotide sequence
ggtgccggggcattgactca

SEQ ID NO: 35960 - DNA, 21 bp, Artificial sequence
  synthetic polynucleotide sequence
atccggataaaccgccaggca

SEQ ID NO: 35961 - DNA, 18 bp, Artificial sequence
  synthetic polynucleotide sequence
gctaccagcccgagcaca

SEQ ID NO: 35962 - DNA, 20 bp, Artificial sequence
  synthetic polynucleotide sequence
actgcacagactctccacga

SEQ ID NO: 35963 - DNA, 18 bp, Artificial sequence
  synthetic polynucleotide sequence
gtgtggcgagtgggccaa

SEQ ID NO: 35964 - DNA, 18 bp, Artificial sequence
  synthetic polynucleotide sequence
tgcatcacagtgcagcca

SEQ ID NO: 35965 - DNA, 18 bp, Artificial sequence
  synthetic polynucleotide sequence
gggaagccatggagcaga

SEQ ID NO: 35966 - DNA, 18 bp, Artificial sequence
  synthetic polynucleotide sequence
tgctgcagcgagtgggca

SEQ ID NO: 35967 - DNA, 22 bp, Artificial sequence
  synthetic polynucleotide sequence
aaggagctgaacaagcggctca

SEQ ID NO: 35968 - DNA, 21 bp, Artificial sequence
  synthetic polynucleotide sequence
agactcatgcccatcagagga

SEQ ID NO: 35969 - DNA, 20 bp, Artificial sequence
  synthetic polynucleotide sequence
ctccctccacccctagacaa

SEQ ID NO: 35970 - DNA, 21 bp, Artificial sequence
  synthetic polynucleotide sequence
tgggagtatcaggaagaggca

SEQ ID NO: 35971 - DNA, 21 bp, Artificial sequence
  synthetic polynucleotide sequence
ccatggcagggactcatcaga

SEQ ID NO: 35972 - DNA, 21 bp, Artificial sequence
  synthetic polynucleotide sequence
tccagggatcttcagaggcca

SEQ ID NO: 35973 - DNA, 20 bp, Artificial sequence
  synthetic polynucleotide sequence
ctggggagtggttaggagca

SEQ ID NO: 35974 - DNA, 21 bp, Artificial sequence
  synthetic polynucleotide sequence
ctgatcacagaacactcccca

SEQ ID NO: 35975 - DNA, 21 bp, Artificial sequence
  synthetic polynucleotide sequence
ctgctccaactcagagggcaa

SEQ ID NO: 35976 - DNA, 19 bp, Artificial sequence
  synthetic polynucleotide sequence
cactcccaagggctgccca

SEQ ID NO: 35977 - DNA, 21 bp, Artificial sequence
  synthetic polynucleotide sequence
tgctggtcaaccagaacccca

SEQ ID NO: 35978 - DNA, 19 bp, Artificial sequence
  synthetic polynucleotide sequence
ctctttcaccccgcgccga

SEQ ID NO: 35979 - DNA, 20 bp, Artificial sequence
  synthetic polynucleotide sequence
gagtcccctcagagcaccga

SEQ ID NO: 35980 - DNA, 22 bp, Artificial sequence
  synthetic polynucleotide sequence
aggtggcaaagctcttcgagga

SEQ ID NO: 35981 - DNA, 21 bp, Artificial sequence
  synthetic polynucleotide sequence
tgatgtctcaccagcccccaa

SEQ ID NO: 35982 - DNA, 19 bp, Artificial sequence
  synthetic polynucleotide sequence
gttggtctccggcacccca

SEQ ID NO: 35983 - DNA, 20 bp, Artificial sequence
  synthetic polynucleotide sequence
ccaccggcgatgacctgcaa

SEQ ID NO: 35984 - DNA, 21 bp, Artificial sequence
  synthetic polynucleotide sequence
ctggttccacagaactcccca

SEQ ID NO: 35985 - DNA, 20 bp, Artificial sequence
  synthetic polynucleotide sequence
accaaagagcccctccgtga

SEQ ID NO: 35986 - DNA, 20 bp, Artificial sequence
  synthetic polynucleotide sequence
atctgctgcacctcggagga

SEQ ID NO: 35987 - DNA, 18 bp, Artificial sequence
  synthetic polynucleotide sequence
cctacatggacggcacga

SEQ ID NO: 35988 - DNA, 18 bp, Artificial sequence
  synthetic polynucleotide sequence
ctgcatccacccagcaga

SEQ ID NO: 35989 - DNA, 20 bp, Artificial sequence
  synthetic polynucleotide sequence
gggagcagagcctgagacga

SEQ ID NO: 35990 - DNA, 18 bp, Artificial sequence
  synthetic polynucleotide sequence
tggcacggggattcacca

SEQ ID NO: 35991 - DNA, 21 bp, Artificial sequence
  synthetic polynucleotide sequence
tggtgatccgggctctggaga

SEQ ID NO: 35992 - DNA, 21 bp, Artificial sequence
  synthetic polynucleotide sequence
ggcctggaggtacaagctcca

SEQ ID NO: 35993 - DNA, 21 bp, Artificial sequence
  synthetic polynucleotide sequence
aagctacggatggaggagcga

SEQ ID NO: 35994 - DNA, 19 bp, Artificial sequence
  synthetic polynucleotide sequence
gtggggccctggctatcca

SEQ ID NO: 35995 - DNA, 22 bp, Artificial sequence
  synthetic polynucleotide sequence
agcagctcatggagatgcagca

SEQ ID NO: 35996 - DNA, 20 bp, Artificial sequence
  synthetic polynucleotide sequence
gctccctgggcaccatcgga

SEQ ID NO: 35997 - DNA, 18 bp, Artificial sequence
  synthetic polynucleotide sequence
gatggccaacgcgtccca

SEQ ID NO: 35998 - DNA, 22 bp, Artificial sequence
  synthetic polynucleotide sequence
ttgacaaggaagatgagcagca

SEQ ID NO: 35999 - DNA, 21 bp, Artificial sequence
  synthetic polynucleotide sequence
agtggcgactcaaccagctca

SEQ ID NO: 36000 - DNA, 19 bp, Artificial sequence
  synthetic polynucleotide sequence
cttgaggccctggcagcca

SEQ ID NO: 36001 - DNA, 21 bp, Artificial sequence
  synthetic polynucleotide sequence
gatctgggaagggttcggcaa

SEQ ID NO: 36002 - DNA, 21 bp, Artificial sequence
  synthetic polynucleotide sequence
gagcacctccatctcagagca

SEQ ID NO: 36003 - DNA, 20 bp, Artificial sequence
  synthetic polynucleotide sequence
ataaagcctggtgcagagca

SEQ ID NO: 36004 - DNA, 20 bp, Artificial sequence
  synthetic polynucleotide sequence
gtctgccatggagtacacca

SEQ ID NO: 36005 - DNA, 22 bp, Artificial sequence
  synthetic polynucleotide sequence
taacaacccgtccagtcagaga

SEQ ID NO: 36006 - DNA, 21 bp, Artificial sequence
  synthetic polynucleotide sequence
aggccatccccaagaagtcca

SEQ ID NO: 36007 - DNA, 18 bp, Artificial sequence
  synthetic polynucleotide sequence
cctcgccatggacagaca

SEQ ID NO: 36008 - DNA, 22 bp, Artificial sequence
  synthetic polynucleotide sequence
atctgtgtgctcacacagacga

SEQ ID NO: 36009 - DNA, 21 bp, Artificial sequence
  synthetic polynucleotide sequence
catgccccacaagaagaggaa

SEQ ID NO: 36010 - DNA, 22 bp, Artificial sequence
  synthetic polynucleotide sequence
caattcccaggcctttcacaga

SEQ ID NO: 36011 - DNA, 21 bp, Artificial sequence
  synthetic polynucleotide sequence
caacaagagcacccaaggcca

SEQ ID NO: 36012 - DNA, 22 bp, Artificial sequence
  synthetic polynucleotide sequence
aacagacacacagcctaacgga

SEQ ID NO: 36013 - DNA, 21 bp, Artificial sequence
  synthetic polynucleotide sequence
aggcgagaatgtcaccaggca

SEQ ID NO: 36014 - DNA, 21 bp, Artificial sequence
  synthetic polynucleotide sequence
acaagacaagcatcccagcca

SEQ ID NO: 36015 - DNA, 21 bp, Artificial sequence
  synthetic polynucleotide sequence
gagtctgaacctgctggggaa

SEQ ID NO: 36016 - DNA, 19 bp, Artificial sequence
  synthetic polynucleotide sequence
gccacagagaaggccccga

SEQ ID NO: 36017 - DNA, 21 bp, Artificial sequence
  synthetic polynucleotide sequence
tgacagaagaagctctgggga

SEQ ID NO: 36018 - DNA, 22 bp, Artificial sequence
  synthetic polynucleotide sequence
aacctcactaaggctgggagga

SEQ ID NO: 36019 - DNA, 21 bp, Artificial sequence
  synthetic polynucleotide sequence
aaccatgatcgagtgggggaa

SEQ ID NO: 36020 - DNA, 20 bp, Artificial sequence
  synthetic polynucleotide sequence
ataggcccagagatggtgca

SEQ ID NO: 36021 - DNA, 21 bp, Artificial sequence
  synthetic polynucleotide sequence
cagatgaaacctggtgggcca

SEQ ID NO: 36022 - DNA, 20 bp, Artificial sequence
  synthetic polynucleotide sequence
tatgtctcccagctgcacga

SEQ ID NO: 36023 - DNA, 20 bp, Artificial sequence
  synthetic polynucleotide sequence
tgctcaacaccccctcccaa

SEQ ID NO: 36024 - DNA, 20 bp, Artificial sequence
  synthetic polynucleotide sequence
ccaggcagaggcagtgggaa

SEQ ID NO: 36025 - DNA, 20 bp, Artificial sequence
  synthetic polynucleotide sequence
aggtggcccggctagagcca

SEQ ID NO: 36026 - DNA, 20 bp, Artificial sequence
  synthetic polynucleotide sequence
gcctcccactggcgagccaa

SEQ ID NO: 36027 - DNA, 20 bp, Artificial sequence
  synthetic polynucleotide sequence
gggaccctgcagagacgcta

SEQ ID NO: 36028 - DNA, 20 bp, Artificial sequence
  synthetic polynucleotide sequence
ggccacgctcatggaaacca

SEQ ID NO: 36029 - DNA, 18 bp, Artificial sequence
  synthetic polynucleotide sequence
tggaccagcccattggga

SEQ ID NO: 36030 - DNA, 18 bp, Artificial sequence
  synthetic polynucleotide sequence
cacggtgctgtgtcccca

SEQ ID NO: 36031 - DNA, 21 bp, Artificial sequence
  synthetic polynucleotide sequence
ctctggaggaccaccatgtca

SEQ ID NO: 36032 - DNA, 21 bp, Artificial sequence
  synthetic polynucleotide sequence
tcaaagccgccgatgaagtca

SEQ ID NO: 36033 - DNA, 20 bp, Artificial sequence
  synthetic polynucleotide sequence
tcagtgacacctgccccaga

SEQ ID NO: 36034 - DNA, 22 bp, Artificial sequence
  synthetic polynucleotide sequence
tagatgaaacctgccagtgcga

SEQ ID NO: 36035 - DNA, 22 bp, Artificial sequence
  synthetic polynucleotide sequence
tacatcggtcatggtggagaga

SEQ ID NO: 36036 - DNA, 22 bp, Artificial sequence
  synthetic polynucleotide sequence
tggatgacctccaggtactgga

SEQ ID NO: 36037 - DNA, 20 bp, Artificial sequence
  synthetic polynucleotide sequence
agccaaggctcccgaaacca

SEQ ID NO: 36038 - DNA, 19 bp, Artificial sequence
  synthetic polynucleotide sequence
ggcgcgagtagctgccgta

SEQ ID NO: 36039 - DNA, 22 bp, Artificial sequence
  synthetic polynucleotide sequence
agctggaaagcgaatcccacga

SEQ ID NO: 36040 - DNA, 20 bp, Artificial sequence
  synthetic polynucleotide sequence
acgcagtcgtacagcctcca

SEQ ID NO: 36041 - DNA, 20 bp, Artificial sequence
  synthetic polynucleotide sequence
gagaccaagcccactgagga

SEQ ID NO: 36042 - DNA, 19 bp, Artificial sequence
  synthetic polynucleotide sequence
ggagcgagatcgagtggga

SEQ ID NO: 36043 - DNA, 20 bp, Artificial sequence
  synthetic polynucleotide sequence
tgcacacgtcaggaggccca

SEQ ID NO: 36044 - DNA, 20 bp, Artificial sequence
  synthetic polynucleotide sequence
ctcaatcccggcgaggtcca

SEQ ID NO: 36045 - DNA, 18 bp, Artificial sequence
  synthetic polynucleotide sequence
gtgggaccagcctccaca

SEQ ID NO: 36046 - DNA, 18 bp, Artificial sequence
  synthetic polynucleotide sequence
aggacggggaccgccaca

SEQ ID NO: 36047 - DNA, 20 bp, Artificial sequence
  synthetic polynucleotide sequence
ggtctacaggaaggcgtgga

SEQ ID NO: 36048 - DNA, 25 bp, Artificial sequence
  synthetic polynucleotide sequence
cacactgtacacaagaacgaagcca

SEQ ID NO: 36049 - DNA, 21 bp, Artificial sequence
  synthetic polynucleotide sequence
cgtgggctccattgagacaga

SEQ ID NO: 36050 - DNA, 20 bp, Artificial sequence
  synthetic polynucleotide sequence
gagcagctccacacgctgaa

SEQ ID NO: 36051 - DNA, 21 bp, Artificial sequence
  synthetic polynucleotide sequence
ttcccagcaatgagtcaggga

SEQ ID NO: 36052 - DNA, 20 bp, Artificial sequence
  synthetic polynucleotide sequence
tcccggatcaagtgggcaga

SEQ ID NO: 36053 - DNA, 21 bp, Artificial sequence
  synthetic polynucleotide sequence
cagcaagaatgggtccaggga

SEQ ID NO: 36054 - DNA, 20 bp, Artificial sequence
  synthetic polynucleotide sequence
acaccacgaggtcctctcca

SEQ ID NO: 36055 - DNA, 21 bp, Artificial sequence
  synthetic polynucleotide sequence
atagcaggagtcggagtcgaa

SEQ ID NO: 36056 - DNA, 19 bp, Artificial sequence
  synthetic polynucleotide sequence
ctcactggggctccggtga

SEQ ID NO: 36057 - DNA, 19 bp, Artificial sequence
  synthetic polynucleotide sequence
ccctcctactccgcggcca

SEQ ID NO: 36058 - DNA, 20 bp, Artificial sequence
  synthetic polynucleotide sequence
aggcccaaggaacggcgcga

SEQ ID NO: 36059 - DNA, 18 bp, Artificial sequence
  synthetic polynucleotide sequence
gtacggcgccaacccaga

SEQ ID NO: 36060 - DNA, 18 bp, Artificial sequence
  synthetic polynucleotide sequence
gcttgaagcgtcgctcca

SEQ ID NO: 36061 - DNA, 18 bp, Artificial sequence
  synthetic polynucleotide sequence
acgccggcaagaagcgaa

SEQ ID NO: 36062 - DNA, 18 bp, Artificial sequence
  synthetic polynucleotide sequence
ggcggatgaggctggcca

SEQ ID NO: 36063 - DNA, 20 bp, Artificial sequence
  synthetic polynucleotide sequence
gaggaggacgaggaagacga

SEQ ID NO: 36064 - DNA, 19 bp, Artificial sequence
  synthetic polynucleotide sequence
ctgcacgagtctcgcagga

SEQ ID NO: 36065 - DNA, 21 bp, Artificial sequence
  synthetic polynucleotide sequence
cagagaggagcaggctgtgaa

SEQ ID NO: 36066 - DNA, 20 bp, Artificial sequence
  synthetic polynucleotide sequence
cacctcaaagcctcgtggca

SEQ ID NO: 36067 - DNA, 20 bp, Artificial sequence
  synthetic polynucleotide sequence
ctgaaactcacgtccacgca

SEQ ID NO: 36068 - DNA, 18 bp, Artificial sequence
  synthetic polynucleotide sequence
attgaggcccacgccgta

SEQ ID NO: 36069 - DNA, 21 bp, Artificial sequence
  synthetic polynucleotide sequence
cccacctggccaagaacctca

SEQ ID NO: 36070 - DNA, 20 bp, Artificial sequence
  synthetic polynucleotide sequence
tccaagtctcccagctccga

SEQ ID NO: 36071 - DNA, 20 bp, Artificial sequence
  synthetic polynucleotide sequence
gtgcgcgacgaccagagaca

SEQ ID NO: 36072 - DNA, 18 bp, Artificial sequence
  synthetic polynucleotide sequence
gcaggtggagagcgccca

SEQ ID NO: 36073 - DNA, 18 bp, Artificial sequence
  synthetic polynucleotide sequence
acgctgccgagatggcca

SEQ ID NO: 36074 - DNA, 18 bp, Artificial sequence
  synthetic polynucleotide sequence
tcgtcgtccgagttggga

SEQ ID NO: 36075 - DNA, 18 bp, Artificial sequence
  synthetic polynucleotide sequence
ctcggacgcggaggacga

SEQ ID NO: 36076 - DNA, 18 bp, Artificial sequence
  synthetic polynucleotide sequence
acgggctgaccagcgcca

SEQ ID NO: 36077 - DNA, 20 bp, Artificial sequence
  synthetic polynucleotide sequence
gctcagcctgggagcgcaca

SEQ ID NO: 36078 - DNA, 20 bp, Artificial sequence
  synthetic polynucleotide sequence
caggagcgtggggaagggga

SEQ ID NO: 36079 - DNA, 18 bp, Artificial sequence
  synthetic polynucleotide sequence
ggcttccctacgcggcca

SEQ ID NO: 36080 - DNA, 20 bp, Artificial sequence
  synthetic polynucleotide sequence
ctgggccttcacatcccaca

SEQ ID NO: 36081 - DNA, 20 bp, Artificial sequence
  synthetic polynucleotide sequence
aataccagacgacccccaga

SEQ ID NO: 36082 - DNA, 18 bp, Artificial sequence
  synthetic polynucleotide sequence
tgacggtcagcccagtca

SEQ ID NO: 36083 - DNA, 18 bp, Artificial sequence
  synthetic polynucleotide sequence
caccaatgggtggcacca

SEQ ID NO: 36084 - DNA, 18 bp, Artificial sequence
  synthetic polynucleotide sequence
tgaccacggcactgagca

SEQ ID NO: 36085 - DNA, 18 bp, Artificial sequence
  synthetic polynucleotide sequence
tggagcaccaagcggcca

SEQ ID NO: 36086 - DNA, 20 bp, Artificial sequence
  synthetic polynucleotide sequence
gtcacgagggttctccacca

SEQ ID NO: 36087 - DNA, 21 bp, Artificial sequence
  synthetic polynucleotide sequence
tcgctgcaggcacacgacaca

SEQ ID NO: 36088 - DNA, 21 bp, Artificial sequence
  synthetic polynucleotide sequence
gcaaaggctgcatccccgtca

SEQ ID NO: 36089 - DNA, 18 bp, Artificial sequence
  synthetic polynucleotide sequence
ccaccaaacgcccagcaa

SEQ ID NO: 36090 - DNA, 21 bp, Artificial sequence
  synthetic polynucleotide sequence
gatgttgaggaagaggagcga

SEQ ID NO: 36091 - DNA, 21 bp, Artificial sequence
  synthetic polynucleotide sequence
ttgcaaaagggtcttccggga

SEQ ID NO: 36092 - DNA, 21 bp, Artificial sequence
  synthetic polynucleotide sequence
tgagtggttgaggagagacga

SEQ ID NO: 36093 - DNA, 18 bp, Artificial sequence
  synthetic polynucleotide sequence
ggaagccggatgatggca

SEQ ID NO: 36094 - DNA, 21 bp, Artificial sequence
  synthetic polynucleotide sequence
tcgtgtctcaggagagaggga

SEQ ID NO: 36095 - DNA, 20 bp, Artificial sequence
  synthetic polynucleotide sequence
ggcgggaaatcgtgtgagca

SEQ ID NO: 36096 - DNA, 23 bp, Artificial sequence
  synthetic polynucleotide sequence
caaattgccacccaacaagccta

SEQ ID NO: 36097 - DNA, 19 bp, Artificial sequence
  synthetic polynucleotide sequence
gtgaccttggagcccacca

SEQ ID NO: 36098 - DNA, 18 bp, Artificial sequence
  synthetic polynucleotide sequence
agcagcagggaactggca

SEQ ID NO: 36099 - DNA, 19 bp, Artificial sequence
  synthetic polynucleotide sequence
ggcctggatacgggagaga

SEQ ID NO: 36100 - DNA, 18 bp, Artificial sequence
  synthetic polynucleotide sequence
caggagaaggcacgcaca

SEQ ID NO: 36101 - DNA, 21 bp, Artificial sequence
  synthetic polynucleotide sequence
gagcctggagattgggagcaa

SEQ ID NO: 36102 - DNA, 21 bp, Artificial sequence
  synthetic polynucleotide sequence
agaggcaagagatcgacagca

SEQ ID NO: 36103 - DNA, 20 bp, Artificial sequence
  synthetic polynucleotide sequence
gaggctgaagaggtgccgca

SEQ ID NO: 36104 - DNA, 20 bp, Artificial sequence
  synthetic polynucleotide sequence
atctcctgacaagccccgga

SEQ ID NO: 36105 - DNA, 20 bp, Artificial sequence
  synthetic polynucleotide sequence
cagctggccaggacaatgga

SEQ ID NO: 36106 - DNA, 20 bp, Artificial sequence
  synthetic polynucleotide sequence
aggcacttccaggccctcga

SEQ ID NO: 36107 - DNA, 19 bp, Artificial sequence
  synthetic polynucleotide sequence
cccagcacagaaggcccca

SEQ ID NO: 36108 - DNA, 22 bp, Artificial sequence
  synthetic polynucleotide sequence
aataaggatgcctcagggagca

SEQ ID NO: 36109 - DNA, 22 bp, Artificial sequence
  synthetic polynucleotide sequence
acgtgcgtaaacctctccgaca

SEQ ID NO: 36110 - DNA, 21 bp, Artificial sequence
  synthetic polynucleotide sequence
ggtacctcaagccctcacaca

SEQ ID NO: 36111 - DNA, 20 bp, Artificial sequence
  synthetic polynucleotide sequence
gcttggccaagaacccccca

SEQ ID NO: 36112 - DNA, 20 bp, Artificial sequence
  synthetic polynucleotide sequence
gtcgcagtcccacagcacca

SEQ ID NO: 36113 - DNA, 18 bp, Artificial sequence
  synthetic polynucleotide sequence
tggactgcagaaggcgga

SEQ ID NO: 36114 - DNA, 20 bp, Artificial sequence
  synthetic polynucleotide sequence
gcaggtagtacatggcggca

SEQ ID NO: 36115 - DNA, 21 bp, Artificial sequence
  synthetic polynucleotide sequence
cgaggccttgaaacatccgga

SEQ ID NO: 36116 - DNA, 21 bp, Artificial sequence
  synthetic polynucleotide sequence
agacgcgagatccttacagca

SEQ ID NO: 36117 - DNA, 18 bp, Artificial sequence
  synthetic polynucleotide sequence
ggcctggaaatcgagcca

SEQ ID NO: 36118 - DNA, 20 bp, Artificial sequence
  synthetic polynucleotide sequence
taggctgctgacccaacaga

SEQ ID NO: 36119 - DNA, 20 bp, Artificial sequence
  synthetic polynucleotide sequence
atcacacacccagcgctgga

SEQ ID NO: 36120 - DNA, 20 bp, Artificial sequence
  synthetic polynucleotide sequence
ccagagcctcagaaggtcga

SEQ ID NO: 36121 - DNA, 22 bp, Artificial sequence
  synthetic polynucleotide sequence
tacaagaccatgacacgcccaa

SEQ ID NO: 36122 - DNA, 22 bp, Artificial sequence
  synthetic polynucleotide sequence
gtaactcaagccctcacacaga

SEQ ID NO: 36123 - DNA, 20 bp, Artificial sequence
  synthetic polynucleotide sequence
cacacagaggagggagacca

SEQ ID NO: 36124 - DNA, 18 bp, Artificial sequence
  synthetic polynucleotide sequence
ctgcggccaagtgacaca

SEQ ID NO: 36125 - DNA, 20 bp, Artificial sequence
  synthetic polynucleotide sequence
cgcagcactcatcgcctgca

SEQ ID NO: 36126 - DNA, 20 bp, Artificial sequence
  synthetic polynucleotide sequence
gcacagtccgggtggctcaa

SEQ ID NO: 36127 - DNA, 20 bp, Artificial sequence
  synthetic polynucleotide sequence
aatggaggggctggcaggaa

SEQ ID NO: 36128 - DNA, 19 bp, Artificial sequence
  synthetic polynucleotide sequence
cagggccgctgtgtcacca

SEQ ID NO: 36129 - DNA, 18 bp, Artificial sequence
  synthetic polynucleotide sequence
tggggacagctccccaca

SEQ ID NO: 36130 - DNA, 18 bp, Artificial sequence
  synthetic polynucleotide sequence
gcaggaggattccgagca

SEQ ID NO: 36131 - DNA, 19 bp, Artificial sequence
  synthetic polynucleotide sequence
cggacctgtgtgaaggcca

SEQ ID NO: 36132 - DNA, 20 bp, Artificial sequence
  synthetic polynucleotide sequence
caagctactgatgcgagcca

SEQ ID NO: 36133 - DNA, 22 bp, Artificial sequence
  synthetic polynucleotide sequence
caaacaccctacaagtggcaga

SEQ ID NO: 36134 - DNA, 20 bp, Artificial sequence
  synthetic polynucleotide sequence
ctgtacccagacttccccga

SEQ ID NO: 36135 - DNA, 18 bp, Artificial sequence
  synthetic polynucleotide sequence
actccaagcctgggacca

SEQ ID NO: 36136 - DNA, 20 bp, Artificial sequence
  synthetic polynucleotide sequence
tctccacagaatcactgcca

SEQ ID NO: 36137 - DNA, 19 bp, Artificial sequence
  synthetic polynucleotide sequence
tgacctgaaagaccgacca

SEQ ID NO: 36138 - DNA, 18 bp, Artificial sequence
  synthetic polynucleotide sequence
cacgttcagcccctccca

SEQ ID NO: 36139 - DNA, 18 bp, Artificial sequence
  synthetic polynucleotide sequence
gctcatcggagccacgaa

SEQ ID NO: 36140 - DNA, 18 bp, Artificial sequence
  synthetic polynucleotide sequence
gcgggcactctccaccga

SEQ ID NO: 36141 - DNA, 18 bp, Artificial sequence
  synthetic polynucleotide sequence
ccaggacctgcggaggaa

SEQ ID NO: 36142 - DNA, 18 bp, Artificial sequence
  synthetic polynucleotide sequence
tggggcagcctcagccga

SEQ ID NO: 36143 - DNA, 20 bp, Artificial sequence
  synthetic polynucleotide sequence
atcaatgcctccacctcaga

SEQ ID NO: 36144 - DNA, 22 bp, Artificial sequence
  synthetic polynucleotide sequence
tatcatggcgacaagtggtcca

SEQ ID NO: 36145 - DNA, 21 bp, Artificial sequence
  synthetic polynucleotide sequence
acgctcatgggacccaccaga

SEQ ID NO: 36146 - DNA, 22 bp, Artificial sequence
  synthetic polynucleotide sequence
tgaaaccacagagtccgaacca

SEQ ID NO: 36147 - DNA, 20 bp, Artificial sequence
  synthetic polynucleotide sequence
tctggagtggcacgcacaga

SEQ ID NO: 36148 - DNA, 18 bp, Artificial sequence
  synthetic polynucleotide sequence
gccggcccacaacctcca

SEQ ID NO: 36149 - DNA, 21 bp, Artificial sequence
  synthetic polynucleotide sequence
acgattgatgggcccaacaga

SEQ ID NO: 36150 - DNA, 20 bp, Artificial sequence
  synthetic polynucleotide sequence
ccaaactgggctcggatgga

SEQ ID NO: 36151 - DNA, 20 bp, Artificial sequence
  synthetic polynucleotide sequence
aggactgagggcttcgagga

SEQ ID NO: 36152 - DNA, 21 bp, Artificial sequence
  synthetic polynucleotide sequence
catggacggcattgaagggca

SEQ ID NO: 36153 - DNA, 18 bp, Artificial sequence
  synthetic polynucleotide sequence
gaggttacggccaagcca

SEQ ID NO: 36154 - DNA, 18 bp, Artificial sequence
  synthetic polynucleotide sequence
catagtccacgcggtcca

SEQ ID NO: 36155 - DNA, 21 bp, Artificial sequence
  synthetic polynucleotide sequence
tcaccgggtcatcatggcaga

SEQ ID NO: 36156 - DNA, 22 bp, Artificial sequence
  synthetic polynucleotide sequence
tgatcacagtcactagcctcca

SEQ ID NO: 36157 - DNA, 18 bp, Artificial sequence
  synthetic polynucleotide sequence
tgtggtggtgccccggga

SEQ ID NO: 36158 - DNA, 21 bp, Artificial sequence
  synthetic polynucleotide sequence
tccacaacatggccgtcccca

SEQ ID NO: 36159 - DNA, 22 bp, Artificial sequence
  synthetic polynucleotide sequence
acaacattcacctggccaagga

SEQ ID NO: 36160 - DNA, 21 bp, Artificial sequence
  synthetic polynucleotide sequence
tacgtgatgacagcatcggga

SEQ ID NO: 36161 - DNA, 20 bp, Artificial sequence
  synthetic polynucleotide sequence
ctcaccaagcacacccgcaa

SEQ ID NO: 36162 - DNA, 18 bp, Artificial sequence
  synthetic polynucleotide sequence
cggtcgggtctcagggca

SEQ ID NO: 36163 - DNA, 25 bp, Artificial sequence
  synthetic polynucleotide sequence
agccagagtctgagatagagacaga

SEQ ID NO: 36164 - DNA, 22 bp, Artificial sequence
  synthetic polynucleotide sequence
atccagcaggaaatggctgaca

SEQ ID NO: 36165 - DNA, 18 bp, Artificial sequence
  synthetic polynucleotide sequence
ccaggaggaggtggagca

SEQ ID NO: 36166 - DNA, 18 bp, Artificial sequence
  synthetic polynucleotide sequence
atggtggagggcagcgta

SEQ ID NO: 36167 - DNA, 21 bp, Artificial sequence
  synthetic polynucleotide sequence
agagccccaacggtaaactga

SEQ ID NO: 36168 - DNA, 21 bp, Artificial sequence
  synthetic polynucleotide sequence
cgtcgctcatgaggtccagca

SEQ ID NO: 36169 - DNA, 21 bp, Artificial sequence
  synthetic polynucleotide sequence
acacagaagttgggcaagtca

SEQ ID NO: 36170 - DNA, 20 bp, Artificial sequence
  synthetic polynucleotide sequence
ctcatgcaggtgaggaacga

SEQ ID NO: 36171 - DNA, 18 bp, Artificial sequence
  synthetic polynucleotide sequence
gcacctggccttccagca

SEQ ID NO: 36172 - DNA, 18 bp, Artificial sequence
  synthetic polynucleotide sequence
tctgaggcgatggcagca

SEQ ID NO: 36173 - DNA, 20 bp, Artificial sequence
  synthetic polynucleotide sequence
ccaagcccaccctactccaa

SEQ ID NO: 36174 - DNA, 21 bp, Artificial sequence
  synthetic polynucleotide sequence
acaactgcatgagaccaggga

SEQ ID NO: 36175 - DNA, 18 bp, Artificial sequence
  synthetic polynucleotide sequence
cgctcaggaacctcggca

SEQ ID NO: 36176 - DNA, 18 bp, Artificial sequence
  synthetic polynucleotide sequence
ccagggggaggctggaga

SEQ ID NO: 36177 - DNA, 18 bp, Artificial sequence
  synthetic polynucleotide sequence
gctacggatgcagcagca

SEQ ID NO: 36178 - DNA, 20 bp, Artificial sequence
  synthetic polynucleotide sequence
ggcagtaggagaggggcaga

SEQ ID NO: 36179 - DNA, 21 bp, Artificial sequence
  synthetic polynucleotide sequence
ggagaatccgaatccgccgaa

SEQ ID NO: 36180 - DNA, 18 bp, Artificial sequence
  synthetic polynucleotide sequence
gtccccacggtagcgcca

SEQ ID NO: 36181 - DNA, 18 bp, Artificial sequence
  synthetic polynucleotide sequence
cagctgcgactctcccaa

SEQ ID NO: 36182 - DNA, 19 bp, Artificial sequence
  synthetic polynucleotide sequence
gtagctgagcggctggaga

SEQ ID NO: 36183 - DNA, 21 bp, Artificial sequence
  synthetic polynucleotide sequence
tggatgcctgaaggggccaga

SEQ ID NO: 36184 - DNA, 21 bp, Artificial sequence
  synthetic polynucleotide sequence
tcctccagtgctgagggctga

SEQ ID NO: 36185 - DNA, 21 bp, Artificial sequence
  synthetic polynucleotide sequence
ggacagcagcaactcggagga

SEQ ID NO: 36186 - DNA, 21 bp, Artificial sequence
  synthetic polynucleotide sequence
tcgtcctctgagagctgcaga

SEQ ID NO: 36187 - DNA, 20 bp, Artificial sequence
  synthetic polynucleotide sequence
cggcccctcacagaagcaga

SEQ ID NO: 36188 - DNA, 21 bp, Artificial sequence
  synthetic polynucleotide sequence
tcttcacagcgacttctgcca

SEQ ID NO: 36189 - DNA, 20 bp, Artificial sequence
  synthetic polynucleotide sequence
ctgaagaagaaggggcccga

SEQ ID NO: 36190 - DNA, 20 bp, Artificial sequence
  synthetic polynucleotide sequence
ttcacccggccgtcccagca

SEQ ID NO: 36191 - DNA, 20 bp, Artificial sequence
  synthetic polynucleotide sequence
cagaccctggagtgcaagga

SEQ ID NO: 36192 - DNA, 20 bp, Artificial sequence
  synthetic polynucleotide sequence
tgcattgaagtccccacaca

SEQ ID NO: 36193 - DNA, 18 bp, Artificial sequence
  synthetic polynucleotide sequence
ccctgaggagaaagcgca

SEQ ID NO: 36194 - DNA, 18 bp, Artificial sequence
  synthetic polynucleotide sequence
cgtagatgcagcgcagca

SEQ ID NO: 36195 - DNA, 18 bp, Artificial sequence
  synthetic polynucleotide sequence
gctgcagtgcatggccaa

SEQ ID NO: 36196 - DNA, 19 bp, Artificial sequence
  synthetic polynucleotide sequence
cggtcagggtggtcaagga

SEQ ID NO: 36197 - DNA, 22 bp, Artificial sequence
  synthetic polynucleotide sequence
agaggcaggaactcatccaaga

SEQ ID NO: 36198 - DNA, 20 bp, Artificial sequence
  synthetic polynucleotide sequence
gaagcagactgacgcaggga

SEQ ID NO: 36199 - DNA, 19 bp, Artificial sequence
  synthetic polynucleotide sequence
gcaagaagctgcggaggaa

SEQ ID NO: 36200 - DNA, 18 bp, Artificial sequence
  synthetic polynucleotide sequence
ctcgggcacggagcacga

SEQ ID NO: 36201 - DNA, 22 bp, Artificial sequence
  synthetic polynucleotide sequence
agcagacagtcctaaagcccca

SEQ ID NO: 36202 - DNA, 20 bp, Artificial sequence
  synthetic polynucleotide sequence
ctgccaacggtggtgtcgga

SEQ ID NO: 36203 - DNA, 22 bp, Artificial sequence
  synthetic polynucleotide sequence
caatacgtccagctgacccaga

SEQ ID NO: 36204 - DNA, 19 bp, Artificial sequence
  synthetic polynucleotide sequence
tcctaggactgcgacgtga

SEQ ID NO: 36205 - DNA, 18 bp, Artificial sequence
  synthetic polynucleotide sequence
gggccagagtacgaggca

SEQ ID NO: 36206 - DNA, 18 bp, Artificial sequence
  synthetic polynucleotide sequence
gggtgcctccggcgtcca

SEQ ID NO: 36207 - DNA, 21 bp, Artificial sequence
  synthetic polynucleotide sequence
gtgtaaaccagaggcgaccca

SEQ ID NO: 36208 - DNA, 22 bp, Artificial sequence
  synthetic polynucleotide sequence
agatttagcagaccccctccta

SEQ ID NO: 36209 - DNA, 19 bp, Artificial sequence
  synthetic polynucleotide sequence
ctgttgctcgggcagccca

SEQ ID NO: 36210 - DNA, 20 bp, Artificial sequence
  synthetic polynucleotide sequence
ctgggcgctggcgaaagtca

SEQ ID NO: 36211 - DNA, 20 bp, Artificial sequence
  synthetic polynucleotide sequence
catgagtacaaggcccagga

SEQ ID NO: 36212 - DNA, 19 bp, Artificial sequence
  synthetic polynucleotide sequence
tggcagtttccaagccaga

SEQ ID NO: 36213 - DNA, 21 bp, Artificial sequence
  synthetic polynucleotide sequence
agtcgcactccggattaccca

SEQ ID NO: 36214 - DNA, 21 bp, Artificial sequence
  synthetic polynucleotide sequence
agattggagtctgggcaagca

SEQ ID NO: 36215 - DNA, 19 bp, Artificial sequence
  synthetic polynucleotide sequence
gctgccaaggaggcagaga

SEQ ID NO: 36216 - DNA, 18 bp, Artificial sequence
  synthetic polynucleotide sequence
ccgcaactcgtgaatcca

SEQ ID NO: 36217 - DNA, 21 bp, Artificial sequence
  synthetic polynucleotide sequence
agcccgtggagaagctgagga

SEQ ID NO: 36218 - DNA, 22 bp, Artificial sequence
  synthetic polynucleotide sequence
atctttgaactgaccgtcccca

SEQ ID NO: 36219 - DNA, 18 bp, Artificial sequence
  synthetic polynucleotide sequence
gagatccacgggaaggca

SEQ ID NO: 36220 - DNA, 19 bp, Artificial sequence
  synthetic polynucleotide sequence
ggggccaacactgtaggca

SEQ ID NO: 36221 - DNA, 20 bp, Artificial sequence
  synthetic polynucleotide sequence
tacctcaacgagcagggaga

SEQ ID NO: 36222 - DNA, 20 bp, Artificial sequence
  synthetic polynucleotide sequence
tgtcatctggggagaaccga

SEQ ID NO: 36223 - DNA, 18 bp, Artificial sequence
  synthetic polynucleotide sequence
gctctggaacagcagcga

SEQ ID NO: 36224 - DNA, 19 bp, Artificial sequence
  synthetic polynucleotide sequence
ggcagcagtcagctcagca

SEQ ID NO: 36225 - DNA, 18 bp, Artificial sequence
  synthetic polynucleotide sequence
atgctcccacatccgaca

SEQ ID NO: 36226 - DNA, 18 bp, Artificial sequence
  synthetic polynucleotide sequence
ggtccacagccaacccca

SEQ ID NO: 36227 - DNA, 18 bp, Artificial sequence
  synthetic polynucleotide sequence
gcagcagttgccagagca

SEQ ID NO: 36228 - DNA, 18 bp, Artificial sequence
  synthetic polynucleotide sequence
gctggaacggatgggaga

SEQ ID NO: 36229 - DNA, 20 bp, Artificial sequence
  synthetic polynucleotide sequence
aagctggagaagctggagga

SEQ ID NO: 36230 - DNA, 18 bp, Artificial sequence
  synthetic polynucleotide sequence
gtccatgcccatggagga

SEQ ID NO: 36231 - DNA, 20 bp, Artificial sequence
  synthetic polynucleotide sequence
tctcgaatgctggcagccaa

SEQ ID NO: 36232 - DNA, 19 bp, Artificial sequence
  synthetic polynucleotide sequence
tggaagtgtggagtcacca

SEQ ID NO: 36233 - DNA, 21 bp, Artificial sequence
  synthetic polynucleotide sequence
ctatggactgacggaggagga

SEQ ID NO: 36234 - DNA, 21 bp, Artificial sequence
  synthetic polynucleotide sequence
caggagtggagaagtgcagca

SEQ ID NO: 36235 - DNA, 17 bp, Artificial sequence
  synthetic polynucleotide sequence
ctgtggggacgtcacca

SEQ ID NO: 36236 - DNA, 19 bp, Artificial sequence
  synthetic polynucleotide sequence
gttcgcagggtgactccaa

SEQ ID NO: 36237 - DNA, 20 bp, Artificial sequence
  synthetic polynucleotide sequence
cctaagccagaggacctgca

SEQ ID NO: 36238 - DNA, 21 bp, Artificial sequence
  synthetic polynucleotide sequence
gcactccagcttcaccaagca

SEQ ID NO: 36239 - DNA, 18 bp, Artificial sequence
  synthetic polynucleotide sequence
gacatcaccacaccccca

SEQ ID NO: 36240 - DNA, 18 bp, Artificial sequence
  synthetic polynucleotide sequence
gcaggaagccagcagaca

SEQ ID NO: 36241 - DNA, 18 bp, Artificial sequence
  synthetic polynucleotide sequence
gtgctgcgggatcagcaa

SEQ ID NO: 36242 - DNA, 18 bp, Artificial sequence
  synthetic polynucleotide sequence
ctgacgctcctgcaagga

SEQ ID NO: 36243 - DNA, 19 bp, Artificial sequence
  synthetic polynucleotide sequence
ggctcatcacccgcagcga

SEQ ID NO: 36244 - DNA, 20 bp, Artificial sequence
  synthetic polynucleotide sequence
gtctccagtcacagggtcca

SEQ ID NO: 36245 - DNA, 21 bp, Artificial sequence
  synthetic polynucleotide sequence
tcagcaaagggcaaacctgga

SEQ ID NO: 36246 - DNA, 20 bp, Artificial sequence
  synthetic polynucleotide sequence
gcccaggcactgctaacaca

SEQ ID NO: 36247 - DNA, 20 bp, Artificial sequence
  synthetic polynucleotide sequence
cacaggacccaactgcgaga

SEQ ID NO: 36248 - DNA, 20 bp, Artificial sequence
  synthetic polynucleotide sequence
cacaggcacactcgtagcca

SEQ ID NO: 36249 - DNA, 18 bp, Artificial sequence
  synthetic polynucleotide sequence
cccattgatcgacggcca

SEQ ID NO: 36250 - DNA, 19 bp, Artificial sequence
  synthetic polynucleotide sequence
cctcctcggagagaagcca

SEQ ID NO: 36251 - DNA, 19 bp, Artificial sequence
  synthetic polynucleotide sequence
tgcaacccggtgtacgaga

SEQ ID NO: 36252 - DNA, 18 bp, Artificial sequence
  synthetic polynucleotide sequence
ctggcacaatccagccca

SEQ ID NO: 36253 - DNA, 21 bp, Artificial sequence
  synthetic polynucleotide sequence
catgctaactcctccccagga

SEQ ID NO: 36254 - DNA, 18 bp, Artificial sequence
  synthetic polynucleotide sequence
ttcccagggctcaggaca

SEQ ID NO: 36255 - DNA, 20 bp, Artificial sequence
  synthetic polynucleotide sequence
gacggctgaagactgggaca

SEQ ID NO: 36256 - DNA, 20 bp, Artificial sequence
  synthetic polynucleotide sequence
agctccagtgggtaccccca

SEQ ID NO: 36257 - DNA, 20 bp, Artificial sequence
  synthetic polynucleotide sequence
cacagactgcgtcgacacga

SEQ ID NO: 36258 - DNA, 18 bp, Artificial sequence
  synthetic polynucleotide sequence
caccacgaacacagggca

SEQ ID NO: 36259 - DNA, 18 bp, Artificial sequence
  synthetic polynucleotide sequence
gccagagcagccaacaga

SEQ ID NO: 36260 - DNA, 18 bp, Artificial sequence
  synthetic polynucleotide sequence
ccatcactgcagacccca

SEQ ID NO: 36261 - DNA, 20 bp, Artificial sequence
  synthetic polynucleotide sequence
ggggcatccatccccaagca

SEQ ID NO: 36262 - DNA, 21 bp, Artificial sequence
  synthetic polynucleotide sequence
atgatccagaggtagccagca

SEQ ID NO: 36263 - DNA, 20 bp, Artificial sequence
  synthetic polynucleotide sequence
ctcccactgtaggcgcccta

SEQ ID NO: 36264 - DNA, 21 bp, Artificial sequence
  synthetic polynucleotide sequence
caggagagagattgaggggca

SEQ ID NO: 36265 - DNA, 22 bp, Artificial sequence
  synthetic polynucleotide sequence
tacctcagtcaaacagatggga

SEQ ID NO: 36266 - DNA, 22 bp, Artificial sequence
  synthetic polynucleotide sequence
gggtccacaacagaaaacacca

SEQ ID NO: 36267 - DNA, 20 bp, Artificial sequence
  synthetic polynucleotide sequence
gttcgagggggcagagggca

SEQ ID NO: 36268 - DNA, 20 bp, Artificial sequence
  synthetic polynucleotide sequence
ggaccatggatgtgggggaa

SEQ ID NO: 36269 - DNA, 19 bp, Artificial sequence
  synthetic polynucleotide sequence
cagcgccctacctggagga

SEQ ID NO: 36270 - DNA, 21 bp, Artificial sequence
  synthetic polynucleotide sequence
ctgacgtttccaacacgcgca

SEQ ID NO: 36271 - DNA, 18 bp, Artificial sequence
  synthetic polynucleotide sequence
agccacgtgctcagccaa

SEQ ID NO: 36272 - DNA, 18 bp, Artificial sequence
  synthetic polynucleotide sequence
tcgttctccgctggggca

SEQ ID NO: 36273 - DNA, 22 bp, Artificial sequence
  synthetic polynucleotide sequence
cagggtccaaagccaatgagaa

SEQ ID NO: 36274 - DNA, 20 bp, Artificial sequence
  synthetic polynucleotide sequence
tcagacttggcgggagcgca

SEQ ID NO: 36275 - DNA, 21 bp, Artificial sequence
  synthetic polynucleotide sequence
accccaagacgcccatggaga

SEQ ID NO: 36276 - DNA, 20 bp, Artificial sequence
  synthetic polynucleotide sequence
gctgtagacggggaagggca

SEQ ID NO: 36277 - DNA, 21 bp, Artificial sequence
  synthetic polynucleotide sequence
tagcagccctggtaatgggga

SEQ ID NO: 36278 - DNA, 20 bp, Artificial sequence
  synthetic polynucleotide sequence
agaggcctcaggtgtgagca

SEQ ID NO: 36279 - DNA, 21 bp, Artificial sequence
  synthetic polynucleotide sequence
gtccagcctgtactccaagga

SEQ ID NO: 36280 - DNA, 22 bp, Artificial sequence
  synthetic polynucleotide sequence
gaatgacctgacgaatccacca

SEQ ID NO: 36281 - DNA, 21 bp, Artificial sequence
  synthetic polynucleotide sequence
cgtctacagcaacgagctgca

SEQ ID NO: 36282 - DNA, 20 bp, Artificial sequence
  synthetic polynucleotide sequence
agcacgaagcccaggaccaa

SEQ ID NO: 36283 - DNA, 19 bp, Artificial sequence
  synthetic polynucleotide sequence
cctctgactccggaaggca

SEQ ID NO: 36284 - DNA, 18 bp, Artificial sequence
  synthetic polynucleotide sequence
tggtgccatggccaagga

SEQ ID NO: 36285 - DNA, 18 bp, Artificial sequence
  synthetic polynucleotide sequence
ccatcagcaccaagccca

SEQ ID NO: 36286 - DNA, 18 bp, Artificial sequence
  synthetic polynucleotide sequence
tcaggaggttgaggcgga

SEQ ID NO: 36287 - DNA, 18 bp, Artificial sequence
  synthetic polynucleotide sequence
agcccatgccccacccaa

SEQ ID NO: 36288 - DNA, 18 bp, Artificial sequence
  synthetic polynucleotide sequence
agggaactgggacgccca

SEQ ID NO: 36289 - DNA, 22 bp, Artificial sequence
  synthetic polynucleotide sequence
taccagcaccaacggcaacaga

SEQ ID NO: 36290 - DNA, 20 bp, Artificial sequence
  synthetic polynucleotide sequence
cgggcactcgtacaccgtga

SEQ ID NO: 36291 - DNA, 20 bp, Artificial sequence
  synthetic polynucleotide sequence
atgctggtgagcgagccaca

SEQ ID NO: 36292 - DNA, 19 bp, Artificial sequence
  synthetic polynucleotide sequence
caggtccccctcctcgaca

SEQ ID NO: 36293 - DNA, 19 bp, Artificial sequence
  synthetic polynucleotide sequence
gggaccccaaacctggaga

SEQ ID NO: 36294 - DNA, 21 bp, Artificial sequence
  synthetic polynucleotide sequence
ctcctcagatcagcggagaga

SEQ ID NO: 36295 - DNA, 18 bp, Artificial sequence
  synthetic polynucleotide sequence
agacctggccggagccaa

SEQ ID NO: 36296 - DNA, 19 bp, Artificial sequence
  synthetic polynucleotide sequence
ccaggctccagaactggga

SEQ ID NO: 36297 - DNA, 20 bp, Artificial sequence
  synthetic polynucleotide sequence
gtggtgtccaggaagaagca

SEQ ID NO: 36298 - DNA, 18 bp, Artificial sequence
  synthetic polynucleotide sequence
gttgccgaatgccagcca

SEQ ID NO: 36299 - DNA, 20 bp, Artificial sequence
  synthetic polynucleotide sequence
cagcttctggaggaagggaa

SEQ ID NO: 36300 - DNA, 20 bp, Artificial sequence
  synthetic polynucleotide sequence
gaaggccagttgtgaaggca

SEQ ID NO: 36301 - DNA, 21 bp, Artificial sequence
  synthetic polynucleotide sequence
ctatccgggagtccatggcaa

SEQ ID NO: 36302 - DNA, 22 bp, Artificial sequence
  synthetic polynucleotide sequence
gaaagtccaggacatctcagga

SEQ ID NO: 36303 - DNA, 20 bp, Artificial sequence
  synthetic polynucleotide sequence
ctcgtgcctgtgagcagaga

SEQ ID NO: 36304 - DNA, 18 bp, Artificial sequence
  synthetic polynucleotide sequence
catctggacggcagcaga

SEQ ID NO: 36305 - DNA, 21 bp, Artificial sequence
  synthetic polynucleotide sequence
gtattaccgctccctgaggga

SEQ ID NO: 36306 - DNA, 20 bp, Artificial sequence
  synthetic polynucleotide sequence
caagtgcccagggaaggcca

SEQ ID NO: 36307 - DNA, 22 bp, Artificial sequence
  synthetic polynucleotide sequence
caaagacaagccaaagtgcgga

SEQ ID NO: 36308 - DNA, 20 bp, Artificial sequence
  synthetic polynucleotide sequence
atcgaagctgaacggcagca

SEQ ID NO: 36309 - DNA, 20 bp, Artificial sequence
  synthetic polynucleotide sequence
gaccagagccagctcaccaa

SEQ ID NO: 36310 - DNA, 20 bp, Artificial sequence
  synthetic polynucleotide sequence
ctcaggtactcgcatgggca

SEQ ID NO: 36311 - DNA, 21 bp, Artificial sequence
  synthetic polynucleotide sequence
aactccctgagcctcaagaca

SEQ ID NO: 36312 - DNA, 20 bp, Artificial sequence
  synthetic polynucleotide sequence
aggagagggtggaagcggga

SEQ ID NO: 36313 - DNA, 19 bp, Artificial sequence
  synthetic polynucleotide sequence
tcctcaagccatggaccaa

SEQ ID NO: 36314 - DNA, 18 bp, Artificial sequence
  synthetic polynucleotide sequence
gcccttggaaggtgggga

SEQ ID NO: 36315 - DNA, 19 bp, Artificial sequence
  synthetic polynucleotide sequence
gcagcacagttggcgggca

SEQ ID NO: 36316 - DNA, 20 bp, Artificial sequence
  synthetic polynucleotide sequence
gggaggctgcacatctcgca

SEQ ID NO: 36317 - DNA, 20 bp, Artificial sequence
  synthetic polynucleotide sequence
atacgagatactccagccaa

SEQ ID NO: 36318 - DNA, 19 bp, Artificial sequence
  synthetic polynucleotide sequence
gtcagtcatccggaagcaa

SEQ ID NO: 36319 - DNA, 21 bp, Artificial sequence
  synthetic polynucleotide sequence
agaagatgcagccggtcacca

SEQ ID NO: 36320 - DNA, 21 bp, Artificial sequence
  synthetic polynucleotide sequence
actgaggaacacgggtcctga

SEQ ID NO: 36321 - DNA, 20 bp, Artificial sequence
  synthetic polynucleotide sequence
ggccccggtcactatggaca

SEQ ID NO: 36322 - DNA, 20 bp, Artificial sequence
  synthetic polynucleotide sequence
ccgggccacaacttctacca

SEQ ID NO: 36323 - DNA, 18 bp, Artificial sequence
  synthetic polynucleotide sequence
tcggcagccaaagcccca

SEQ ID NO: 36324 - DNA, 20 bp, Artificial sequence
  synthetic polynucleotide sequence
ctggagtgtgccagagtgca

SEQ ID NO: 36325 - DNA, 18 bp, Artificial sequence
  synthetic polynucleotide sequence
cctggaccggggaagtca

SEQ ID NO: 36326 - DNA, 18 bp, Artificial sequence
  synthetic polynucleotide sequence
cgcaggctccgaggggca

SEQ ID NO: 36327 - DNA, 18 bp, Artificial sequence
  synthetic polynucleotide sequence
aggtagccaccgagggca

SEQ ID NO: 36328 - DNA, 18 bp, Artificial sequence
  synthetic polynucleotide sequence
agcagccagacccttgca

SEQ ID NO: 36329 - DNA, 18 bp, Artificial sequence
  synthetic polynucleotide sequence
cctgcgcgtggacaccaa

SEQ ID NO: 36330 - DNA, 18 bp, Artificial sequence
  synthetic polynucleotide sequence
gccgaagcagcccttgga

SEQ ID NO: 36331 - DNA, 20 bp, Artificial sequence
  synthetic polynucleotide sequence
ctggacccagagcaaggaca

SEQ ID NO: 36332 - DNA, 18 bp, Artificial sequence
  synthetic polynucleotide sequence
tccacgtggaagacccca

SEQ ID NO: 36333 - DNA, 18 bp, Artificial sequence
  synthetic polynucleotide sequence
ggtcaacgccatgcacca

SEQ ID NO: 36334 - DNA, 18 bp, Artificial sequence
  synthetic polynucleotide sequence
aggccaacaaccccagca

SEQ ID NO: 36335 - DNA, 20 bp, Artificial sequence
  synthetic polynucleotide sequence
catggcatgaccagtggaga

SEQ ID NO: 36336 - DNA, 20 bp, Artificial sequence
  synthetic polynucleotide sequence
gtgactgtctggagggacga

SEQ ID NO: 36337 - DNA, 18 bp, Artificial sequence
  synthetic polynucleotide sequence
cattggccgccaccccca

SEQ ID NO: 36338 - DNA, 20 bp, Artificial sequence
  synthetic polynucleotide sequence
ctcttcccgagtcacccgca

SEQ ID NO: 36339 - DNA, 20 bp, Artificial sequence
  synthetic polynucleotide sequence
gacggagaacctgctggcca

SEQ ID NO: 36340 - DNA, 21 bp, Artificial sequence
  synthetic polynucleotide sequence
ggccgcggaagtagtgaagga

SEQ ID NO: 36341 - DNA, 22 bp, Artificial sequence
  synthetic polynucleotide sequence
gaaaagcaagccagggtcctca

SEQ ID NO: 36342 - DNA, 21 bp, Artificial sequence
  synthetic polynucleotide sequence
ccagtaggagtcgtcaggcca

SEQ ID NO: 36343 - DNA, 19 bp, Artificial sequence
  synthetic polynucleotide sequence
tgtcagcgctcctaaagca

SEQ ID NO: 36344 - DNA, 19 bp, Artificial sequence
  synthetic polynucleotide sequence
ggtgggggtagccaactga

SEQ ID NO: 36345 - DNA, 18 bp, Artificial sequence
  synthetic polynucleotide sequence
ctaccaggatggcacgca

SEQ ID NO: 36346 - DNA, 18 bp, Artificial sequence
  synthetic polynucleotide sequence
agtgggccagctcaccca

SEQ ID NO: 36347 - DNA, 21 bp, Artificial sequence
  synthetic polynucleotide sequence
aggacggagagaagctgggca

SEQ ID NO: 36348 - DNA, 21 bp, Artificial sequence
  synthetic polynucleotide sequence
tggcatcaaacctacccccca

SEQ ID NO: 36349 - DNA, 18 bp, Artificial sequence
  synthetic polynucleotide sequence
cgcctggaccacaaggga

SEQ ID NO: 36350 - DNA, 18 bp, Artificial sequence
  synthetic polynucleotide sequence
agccaggttctcaccgga

SEQ ID NO: 36351 - DNA, 18 bp, Artificial sequence
  synthetic polynucleotide sequence
gccacactccttcgccaa

SEQ ID NO: 36352 - DNA, 18 bp, Artificial sequence
  synthetic polynucleotide sequence
tcacgaggctcacctcca

SEQ ID NO: 36353 - DNA, 20 bp, Artificial sequence
  synthetic polynucleotide sequence
atccagcccagagacactga

SEQ ID NO: 36354 - DNA, 18 bp, Artificial sequence
  synthetic polynucleotide sequence
gcagggtcttcaagccga

SEQ ID NO: 36355 - DNA, 22 bp, Artificial sequence
  synthetic polynucleotide sequence
agtacaggtccagtgaaaccaa

SEQ ID NO: 36356 - DNA, 19 bp, Artificial sequence
  synthetic polynucleotide sequence
gctgtgaggtggcagagca

SEQ ID NO: 36357 - DNA, 22 bp, Artificial sequence
  synthetic polynucleotide sequence
gagctgcaaatgaccactacca

SEQ ID NO: 36358 - DNA, 22 bp, Artificial sequence
  synthetic polynucleotide sequence
tcaatgtcaacggcaagctgga

SEQ ID NO: 36359 - DNA, 19 bp, Artificial sequence
  synthetic polynucleotide sequence
caccgcaccatctacacca

SEQ ID NO: 36360 - DNA, 18 bp, Artificial sequence
  synthetic polynucleotide sequence
aggccaccaccatcacca

SEQ ID NO: 36361 - DNA, 22 bp, Artificial sequence
  synthetic polynucleotide sequence
aggtgaaactctctggcagcca

SEQ ID NO: 36362 - DNA, 21 bp, Artificial sequence
  synthetic polynucleotide sequence
agcaagtggggacccctggta

SEQ ID NO: 36363 - DNA, 18 bp, Artificial sequence
  synthetic polynucleotide sequence
gaagctggaagccgcaga

SEQ ID NO: 36364 - DNA, 19 bp, Artificial sequence
  synthetic polynucleotide sequence
gtacatggagccactgcca

SEQ ID NO: 36365 - DNA, 19 bp, Artificial sequence
  synthetic polynucleotide sequence
cccacgaagcctacaagca

SEQ ID NO: 36366 - DNA, 18 bp, Artificial sequence
  synthetic polynucleotide sequence
ccatccagcccttcagga

SEQ ID NO: 36367 - DNA, 21 bp, Artificial sequence
  synthetic polynucleotide sequence
cacaccaggatgacgcaccaa

SEQ ID NO: 36368 - DNA, 21 bp, Artificial sequence
  synthetic polynucleotide sequence
ggcctgaagaacagttcagca

SEQ ID NO: 36369 - DNA, 18 bp, Artificial sequence
  synthetic polynucleotide sequence
tgggcacctgcagcagga

SEQ ID NO: 36370 - DNA, 18 bp, Artificial sequence
  synthetic polynucleotide sequence
tggaggccgtgaggagga

SEQ ID NO: 36371 - DNA, 19 bp, Artificial sequence
  synthetic polynucleotide sequence
gggcgaacggtgcaggaga

SEQ ID NO: 36372 - DNA, 21 bp, Artificial sequence
  synthetic polynucleotide sequence
ccatggcaccaagctcctgca

SEQ ID NO: 36373 - DNA, 18 bp, Artificial sequence
  synthetic polynucleotide sequence
ctcaatgggagcagggga

SEQ ID NO: 36374 - DNA, 22 bp, Artificial sequence
  synthetic polynucleotide sequence
tcgatctgcagataccaggaca

SEQ ID NO: 36375 - DNA, 20 bp, Artificial sequence
  synthetic polynucleotide sequence
cttcgagttctcgcgggcca

SEQ ID NO: 36376 - DNA, 21 bp, Artificial sequence
  synthetic polynucleotide sequence
tcttgatgcgcgtgtaggaca

SEQ ID NO: 36377 - DNA, 18 bp, Artificial sequence
  synthetic polynucleotide sequence
gcccaacgtgcaggacca

SEQ ID NO: 36378 - DNA, 18 bp, Artificial sequence
  synthetic polynucleotide sequence
ggggatggtggatggaga

SEQ ID NO: 36379 - DNA, 19 bp, Artificial sequence
  synthetic polynucleotide sequence
tctacccccagcagcctga

SEQ ID NO: 36380 - DNA, 18 bp, Artificial sequence
  synthetic polynucleotide sequence
tccctgctgacgcgccca

SEQ ID NO: 36381 - DNA, 21 bp, Artificial sequence
  synthetic polynucleotide sequence
actgcaggtggcttccagcaa

SEQ ID NO: 36382 - DNA, 20 bp, Artificial sequence
  synthetic polynucleotide sequence
ggagatggcctgcatcagca

SEQ ID NO: 36383 - DNA, 21 bp, Artificial sequence
  synthetic polynucleotide sequence
ttccctgcccattgaagacca

SEQ ID NO: 36384 - DNA, 20 bp, Artificial sequence
  synthetic polynucleotide sequence
gtgtagcgaagaggcccgca

SEQ ID NO: 36385 - DNA, 21 bp, Artificial sequence
  synthetic polynucleotide sequence
gcaccaccgaaaccgctgtca

SEQ ID NO: 36386 - DNA, 21 bp, Artificial sequence
  synthetic polynucleotide sequence
tgttgaagcggcacagttgga

SEQ ID NO: 36387 - DNA, 20 bp, Artificial sequence
  synthetic polynucleotide sequence
acaggcgtcacggtcagaga

SEQ ID NO: 36388 - DNA, 20 bp, Artificial sequence
  synthetic polynucleotide sequence
gctgactgagcacagcgcaa

SEQ ID NO: 36389 - DNA, 20 bp, Artificial sequence
  synthetic polynucleotide sequence
tcgaccaggatgaggagaca

SEQ ID NO: 36390 - DNA, 20 bp, Artificial sequence
  synthetic polynucleotide sequence
atggggaaagtctgaagcga

SEQ ID NO: 36391 - DNA, 19 bp, Artificial sequence
  synthetic polynucleotide sequence
gagcggcagaccctcgtga

SEQ ID NO: 36392 - DNA, 22 bp, Artificial sequence
  synthetic polynucleotide sequence
tgaagagaagtctggcagctga

SEQ ID NO: 36393 - DNA, 20 bp, Artificial sequence
  synthetic polynucleotide sequence
ctggaagaggcgtggagtga

SEQ ID NO: 36394 - DNA, 18 bp, Artificial sequence
  synthetic polynucleotide sequence
ccaccgccaatgcccgga

SEQ ID NO: 36395 - DNA, 19 bp, Artificial sequence
  synthetic polynucleotide sequence
cagtaccccaaccagccca

SEQ ID NO: 36396 - DNA, 18 bp, Artificial sequence
  synthetic polynucleotide sequence
gagctgctcgatgacgga

SEQ ID NO: 36397 - DNA, 18 bp, Artificial sequence
  synthetic polynucleotide sequence
cctgcagatcacggacca

SEQ ID NO: 36398 - DNA, 20 bp, Artificial sequence
  synthetic polynucleotide sequence
gtggtccataaaggcgacca

SEQ ID NO: 36399 - DNA, 18 bp, Artificial sequence
  synthetic polynucleotide sequence
gtacccgtcccagcccca

SEQ ID NO: 36400 - DNA, 21 bp, Artificial sequence
  synthetic polynucleotide sequence
agttgaaggtactccccgaca

SEQ ID NO: 36401 - DNA, 19 bp, Artificial sequence
  synthetic polynucleotide sequence
tcagcaggccactacagga

SEQ ID NO: 36402 - DNA, 21 bp, Artificial sequence
  synthetic polynucleotide sequence
taacctccaacagtgacacca

SEQ ID NO: 36403 - DNA, 18 bp, Artificial sequence
  synthetic polynucleotide sequence
ccctcggtcaacacagca

SEQ ID NO: 36404 - DNA, 18 bp, Artificial sequence
  synthetic polynucleotide sequence
agcggttgagcgtggaga

SEQ ID NO: 36405 - DNA, 18 bp, Artificial sequence
  synthetic polynucleotide sequence
gtcaccggctgaccagga

SEQ ID NO: 36406 - DNA, 20 bp, Artificial sequence
  synthetic polynucleotide sequence
cagggaccttgagaaggcca

SEQ ID NO: 36407 - DNA, 18 bp, Artificial sequence
  synthetic polynucleotide sequence
ctgcccaaagccgaccaa

SEQ ID NO: 36408 - DNA, 20 bp, Artificial sequence
  synthetic polynucleotide sequence
ctgtgaccatagccagggca

SEQ ID NO: 36409 - DNA, 20 bp, Artificial sequence
  synthetic polynucleotide sequence
ctgcctgtcagcactgagca

SEQ ID NO: 36410 - DNA, 20 bp, Artificial sequence
  synthetic polynucleotide sequence
cagttctaccagggcaccca

SEQ ID NO: 36411 - DNA, 19 bp, Artificial sequence
  synthetic polynucleotide sequence
cacggcaaggagggcagca

SEQ ID NO: 36412 - DNA, 21 bp, Artificial sequence
  synthetic polynucleotide sequence
agacaaactcctgccggtcca

SEQ ID NO: 36413 - DNA, 21 bp, Artificial sequence
  synthetic polynucleotide sequence
ctctccagcaagcatcccaca

SEQ ID NO: 36414 - DNA, 21 bp, Artificial sequence
  synthetic polynucleotide sequence
tactactcctggcccactcga

SEQ ID NO: 36415 - DNA, 18 bp, Artificial sequence
  synthetic polynucleotide sequence
tcgcagcctggatcccca

SEQ ID NO: 36416 - DNA, 20 bp, Artificial sequence
  synthetic polynucleotide sequence
ctcctgccacgtagagctca

SEQ ID NO: 36417 - DNA, 19 bp, Artificial sequence
  synthetic polynucleotide sequence
ggagatggtccaggccaga

SEQ ID NO: 36418 - DNA, 18 bp, Artificial sequence
  synthetic polynucleotide sequence
tcagcttggccagcagga

SEQ ID NO: 36419 - DNA, 20 bp, Artificial sequence
  synthetic polynucleotide sequence
acgcagcgcatcttccagga

SEQ ID NO: 36420 - DNA, 18 bp, Artificial sequence
  synthetic polynucleotide sequence
gcggatgtcggcgccgaa

SEQ ID NO: 36421 - DNA, 22 bp, Artificial sequence
  synthetic polynucleotide sequence
aaacctcagccaagaccagaca

SEQ ID NO: 36422 - DNA, 21 bp, Artificial sequence
  synthetic polynucleotide sequence
cccatacaaccctgagtccca

SEQ ID NO: 36423 - DNA, 21 bp, Artificial sequence
  synthetic polynucleotide sequence
agacaaggatgcagctgccca

SEQ ID NO: 36424 - DNA, 22 bp, Artificial sequence
  synthetic polynucleotide sequence
aagatcccctgaatctcaggca

SEQ ID NO: 36425 - DNA, 22 bp, Artificial sequence
  synthetic polynucleotide sequence
tgcaggaccaggaagagaacca

SEQ ID NO: 36426 - DNA, 19 bp, Artificial sequence
  synthetic polynucleotide sequence
tgactccctcctccaccga

SEQ ID NO: 36427 - DNA, 19 bp, Artificial sequence
  synthetic polynucleotide sequence
caacggacagcgcccagga

SEQ ID NO: 36428 - DNA, 21 bp, Artificial sequence
  synthetic polynucleotide sequence
gggtcccacggtacttgagga

SEQ ID NO: 36429 - DNA, 20 bp, Artificial sequence
  synthetic polynucleotide sequence
ctgtcatggaccccaggcga

SEQ ID NO: 36430 - DNA, 21 bp, Artificial sequence
  synthetic polynucleotide sequence
tgttcactgccatcacgcgga

SEQ ID NO: 36431 - DNA, 20 bp, Artificial sequence
  synthetic polynucleotide sequence
cagctcccagagttggacca

SEQ ID NO: 36432 - DNA, 20 bp, Artificial sequence
  synthetic polynucleotide sequence
gtgagagtgcctctcgcaga

SEQ ID NO: 36433 - DNA, 21 bp, Artificial sequence
  synthetic polynucleotide sequence
acatggagggaaggcttccta

SEQ ID NO: 36434 - DNA, 20 bp, Artificial sequence
  synthetic polynucleotide sequence
actgctgcccagtggagtca

SEQ ID NO: 36435 - DNA, 22 bp, Artificial sequence
  synthetic polynucleotide sequence
accttacaaggtgggggacaga

SEQ ID NO: 36436 - DNA, 18 bp, Artificial sequence
  synthetic polynucleotide sequence
gggcgaggctggtcacca

SEQ ID NO: 36437 - DNA, 18 bp, Artificial sequence
  synthetic polynucleotide sequence
ggcggaggagctgtacca

SEQ ID NO: 36438 - DNA, 20 bp, Artificial sequence
  synthetic polynucleotide sequence
gcagtaggccaccacacaca

SEQ ID NO: 36439 - DNA, 20 bp, Artificial sequence
  synthetic polynucleotide sequence
agccgaggagctgtaccaga

SEQ ID NO: 36440 - DNA, 19 bp, Artificial sequence
  synthetic polynucleotide sequence
cttgcagtaggccaccaca

SEQ ID NO: 36441 - DNA, 20 bp, Artificial sequence
  synthetic polynucleotide sequence
cgtgtggaaccggcagcaga

SEQ ID NO: 36442 - DNA, 20 bp, Artificial sequence
  synthetic polynucleotide sequence
ctccttgacggagcccacca

SEQ ID NO: 36443 - DNA, 21 bp, Artificial sequence
  synthetic polynucleotide sequence
acgaagagccctgtggtccca

SEQ ID NO: 36444 - DNA, 20 bp, Artificial sequence
  synthetic polynucleotide sequence
tactaggaccgccaatgcca

SEQ ID NO: 36445 - DNA, 20 bp, Artificial sequence
  synthetic polynucleotide sequence
ctccaagccggacgacgaca

SEQ ID NO: 36446 - DNA, 18 bp, Artificial sequence
  synthetic polynucleotide sequence
gcgccatgtggccccgaa

SEQ ID NO: 36447 - DNA, 20 bp, Artificial sequence
  synthetic polynucleotide sequence
tgtctcacaggtcacagcca

SEQ ID NO: 36448 - DNA, 18 bp, Artificial sequence
  synthetic polynucleotide sequence
ctgtgtgggcgagaagca

SEQ ID NO: 36449 - DNA, 18 bp, Artificial sequence
  synthetic polynucleotide sequence
ctgcaagtgccaggacca

SEQ ID NO: 36450 - DNA, 18 bp, Artificial sequence
  synthetic polynucleotide sequence
gcagagtctgcaggccca

SEQ ID NO: 36451 - DNA, 21 bp, Artificial sequence
  synthetic polynucleotide sequence
gggctcgtccaaggacatgca

SEQ ID NO: 36452 - DNA, 21 bp, Artificial sequence
  synthetic polynucleotide sequence
ataggcagcctgtgtcaacca

SEQ ID NO: 36453 - DNA, 21 bp, Artificial sequence
  synthetic polynucleotide sequence
cgaaccacaggatggggccaa

SEQ ID NO: 36454 - DNA, 20 bp, Artificial sequence
  synthetic polynucleotide sequence
cttgtcaccccgggtgcaca

SEQ ID NO: 36455 - DNA, 18 bp, Artificial sequence
  synthetic polynucleotide sequence
ctgcagggtcagggccca

SEQ ID NO: 36456 - DNA, 21 bp, Artificial sequence
  synthetic polynucleotide sequence
cgtcggaaaaccgctctgcca

SEQ ID NO: 36457 - DNA, 20 bp, Artificial sequence
  synthetic polynucleotide sequence
ggcgagcctctggccctgaa

SEQ ID NO: 36458 - DNA, 18 bp, Artificial sequence
  synthetic polynucleotide sequence
ccgtgcccagggtaggca

SEQ ID NO: 36459 - DNA, 21 bp, Artificial sequence
  synthetic polynucleotide sequence
cgtgtgcacatactgggagga

SEQ ID NO: 36460 - DNA, 18 bp, Artificial sequence
  synthetic polynucleotide sequence
cgttgccgctgccgcaga

SEQ ID NO: 36461 - DNA, 18 bp, Artificial sequence
  synthetic polynucleotide sequence
gacagcatgggccgcgga

SEQ ID NO: 36462 - DNA, 18 bp, Artificial sequence
  synthetic polynucleotide sequence
gcagctgcctcctccgga

SEQ ID NO: 36463 - DNA, 19 bp, Artificial sequence
  synthetic polynucleotide sequence
ggtgggaagcaccgagaga

SEQ ID NO: 36464 - DNA, 18 bp, Artificial sequence
  synthetic polynucleotide sequence
cgcgtggagagagctgga

SEQ ID NO: 36465 - DNA, 18 bp, Artificial sequence
  synthetic polynucleotide sequence
accgaagaggaggccaca

SEQ ID NO: 36466 - DNA, 18 bp, Artificial sequence
  synthetic polynucleotide sequence
cacagggctcctcgagga

SEQ ID NO: 36467 - DNA, 20 bp, Artificial sequence
  synthetic polynucleotide sequence
gctcacagcccttccccaga

SEQ ID NO: 36468 - DNA, 20 bp, Artificial sequence
  synthetic polynucleotide sequence
cacgaggtagagcaggccca

SEQ ID NO: 36469 - DNA, 20 bp, Artificial sequence
  synthetic polynucleotide sequence
gtcgacacacatgctgtcca

SEQ ID NO: 36470 - DNA, 22 bp, Artificial sequence
  synthetic polynucleotide sequence
caaacaccgacatcagcaggca

SEQ ID NO: 36471 - DNA, 20 bp, Artificial sequence
  synthetic polynucleotide sequence
cagagcccttggaccccgaa

SEQ ID NO: 36472 - DNA, 18 bp, Artificial sequence
  synthetic polynucleotide sequence
ggcgggtggcgagaacca

SEQ ID NO: 36473 - DNA, 17 bp, Artificial sequence
  synthetic polynucleotide sequence
cctggcacggaggccaa

SEQ ID NO: 36474 - DNA, 17 bp, Artificial sequence
  synthetic polynucleotide sequence
agcagccaacgggcaca

SEQ ID NO: 36475 - DNA, 21 bp, Artificial sequence
  synthetic polynucleotide sequence
agaagaggaaagcccccgaca

SEQ ID NO: 36476 - DNA, 19 bp, Artificial sequence
  synthetic polynucleotide sequence
gctcggctcacaggggtca

SEQ ID NO: 36477 - DNA, 18 bp, Artificial sequence
  synthetic polynucleotide sequence
taacgtgggcacggacga

SEQ ID NO: 36478 - DNA, 18 bp, Artificial sequence
  synthetic polynucleotide sequence
cgcttcgagtgaagcgca

SEQ ID NO: 36479 - DNA, 18 bp, Artificial sequence
  synthetic polynucleotide sequence
cagccaatgacaggccca

SEQ ID NO: 36480 - DNA, 20 bp, Artificial sequence
  synthetic polynucleotide sequence
gaagctggaggaagtcacca

SEQ ID NO: 36481 - DNA, 22 bp, Artificial sequence
  synthetic polynucleotide sequence
agaaggaaagtcgagaggctca

SEQ ID NO: 36482 - DNA, 21 bp, Artificial sequence
  synthetic polynucleotide sequence
tctctgtccagcagataggca

SEQ ID NO: 36483 - DNA, 19 bp, Artificial sequence
  synthetic polynucleotide sequence
tcaggaggctccacacaca

SEQ ID NO: 36484 - DNA, 20 bp, Artificial sequence
  synthetic polynucleotide sequence
aagccaggtagggaagcaga

SEQ ID NO: 36485 - DNA, 18 bp, Artificial sequence
  synthetic polynucleotide sequence
ccacgaagcaggaaggga

SEQ ID NO: 36486 - DNA, 18 bp, Artificial sequence
  synthetic polynucleotide sequence
acaggggccaccagggca

SEQ ID NO: 36487 - DNA, 18 bp, Artificial sequence
  synthetic polynucleotide sequence
gtgcggccaaagtcggca

SEQ ID NO: 36488 - DNA, 18 bp, Artificial sequence
  synthetic polynucleotide sequence
tcgcactgatgccacgga

SEQ ID NO: 36489 - DNA, 18 bp, Artificial sequence
  synthetic polynucleotide sequence
catcctggcggcagagca

SEQ ID NO: 36490 - DNA, 18 bp, Artificial sequence
  synthetic polynucleotide sequence
ggctgcagctggatgaca

SEQ ID NO: 36491 - DNA, 22 bp, Artificial sequence
  synthetic polynucleotide sequence
ccaacattgccacaggagagca

SEQ ID NO: 36492 - DNA, 22 bp, Artificial sequence
  synthetic polynucleotide sequence
tgtagggacatctcgatcagca

SEQ ID NO: 36493 - DNA, 20 bp, Artificial sequence
  synthetic polynucleotide sequence
tctccagcccaacaggcaga

SEQ ID NO: 36494 - DNA, 20 bp, Artificial sequence
  synthetic polynucleotide sequence
cagcctcccgccgtctgcaa

SEQ ID NO: 36495 - DNA, 21 bp, Artificial sequence
  synthetic polynucleotide sequence
gggaaagcacgtcctccccaa

SEQ ID NO: 36496 - DNA, 21 bp, Artificial sequence
  synthetic polynucleotide sequence
gacaaccaggaagacgacgca

SEQ ID NO: 36497 - DNA, 20 bp, Artificial sequence
  synthetic polynucleotide sequence
ccggcaccaaagaaggcaca

SEQ ID NO: 36498 - DNA, 20 bp, Artificial sequence
  synthetic polynucleotide sequence
ctgtgctgaggacatggcga

SEQ ID NO: 36499 - DNA, 22 bp, Artificial sequence
  synthetic polynucleotide sequence
caaagctgcgaaacctgtggga

SEQ ID NO: 36500 - DNA, 19 bp, Artificial sequence
  synthetic polynucleotide sequence
ttgggatctcgtggggcca

SEQ ID NO: 36501 - DNA, 21 bp, Artificial sequence
  synthetic polynucleotide sequence
agaccaacttcacctgcccca

SEQ ID NO: 36502 - DNA, 21 bp, Artificial sequence
  synthetic polynucleotide sequence
atatccgtgtggctacagcca

SEQ ID NO: 36503 - DNA, 21 bp, Artificial sequence
  synthetic polynucleotide sequence
ggtctaccccaccaagaagca

SEQ ID NO: 36504 - DNA, 18 bp, Artificial sequence
  synthetic polynucleotide sequence
ttcgcgggccccactgga

SEQ ID NO: 36505 - DNA, 19 bp, Artificial sequence
  synthetic polynucleotide sequence
tgaccaagaccgactgcca

SEQ ID NO: 36506 - DNA, 20 bp, Artificial sequence
  synthetic polynucleotide sequence
ctcccagtcacggtaactca

SEQ ID NO: 36507 - DNA, 22 bp, Artificial sequence
  synthetic polynucleotide sequence
gcaaagtgaacccagagccgaa

SEQ ID NO: 36508 - DNA, 20 bp, Artificial sequence
  synthetic polynucleotide sequence
ccacaggcgatacaaccgga

SEQ ID NO: 36509 - DNA, 21 bp, Artificial sequence
  synthetic polynucleotide sequence
tcacagaggaagggcaagaga

SEQ ID NO: 36510 - DNA, 21 bp, Artificial sequence
  synthetic polynucleotide sequence
tctttgcattaacccgcgcca

SEQ ID NO: 36511 - DNA, 22 bp, Artificial sequence
  synthetic polynucleotide sequence
gaagaacttgcctggcacacaa

SEQ ID NO: 36512 - DNA, 20 bp, Artificial sequence
  synthetic polynucleotide sequence
atgaggccgcacgttgagga

SEQ ID NO: 36513 - DNA, 21 bp, Artificial sequence
  synthetic polynucleotide sequence
atgcacgctttccaaggcaga

SEQ ID NO: 36514 - DNA, 21 bp, Artificial sequence
  synthetic polynucleotide sequence
aagagcccacattcctggcca

SEQ ID NO: 36515 - DNA, 22 bp, Artificial sequence
  synthetic polynucleotide sequence
tcaaggaagaaggagcgacaga

SEQ ID NO: 36516 - DNA, 19 bp, Artificial sequence
  synthetic polynucleotide sequence
taccagctccccaacctga

SEQ ID NO: 36517 - DNA, 21 bp, Artificial sequence
  synthetic polynucleotide sequence
ctgtgaactggctgaggagga

SEQ ID NO: 36518 - DNA, 19 bp, Artificial sequence
  synthetic polynucleotide sequence
cacagggctcgctgctgga

SEQ ID NO: 36519 - DNA, 20 bp, Artificial sequence
  synthetic polynucleotide sequence
tgtgcagcacctggagggaa

SEQ ID NO: 36520 - DNA, 22 bp, Artificial sequence
  synthetic polynucleotide sequence
attccactacagggtgcatcca

SEQ ID NO: 36521 - DNA, 22 bp, Artificial sequence
  synthetic polynucleotide sequence
acaaaaccacctcttccccaga

SEQ ID NO: 36522 - DNA, 20 bp, Artificial sequence
  synthetic polynucleotide sequence
gttcacgcggtctggaggga

SEQ ID NO: 36523 - DNA, 18 bp, Artificial sequence
  synthetic polynucleotide sequence
tgtgcgggagatgaacga

SEQ ID NO: 36524 - DNA, 18 bp, Artificial sequence
  synthetic polynucleotide sequence
ctgctccacccagcggta

SEQ ID NO: 36525 - DNA, 21 bp, Artificial sequence
  synthetic polynucleotide sequence
ttgagaagatccgcccacaca

SEQ ID NO: 36526 - DNA, 20 bp, Artificial sequence
  synthetic polynucleotide sequence
atgggcggccacagtgccca

SEQ ID NO: 36527 - DNA, 22 bp, Artificial sequence
  synthetic polynucleotide sequence
aaacccaagaacgccatcacca

SEQ ID NO: 36528 - DNA, 21 bp, Artificial sequence
  synthetic polynucleotide sequence
gtagtgccttgacgaagcgga

SEQ ID NO: 36529 - DNA, 20 bp, Artificial sequence
  synthetic polynucleotide sequence
ctgaactcgcacaggagcta

SEQ ID NO: 36530 - DNA, 21 bp, Artificial sequence
  synthetic polynucleotide sequence
ggcaaaaagggtctgccggga

SEQ ID NO: 36531 - DNA, 22 bp, Artificial sequence
  synthetic polynucleotide sequence
tgaaactggggtgctcaaagga

SEQ ID NO: 36532 - DNA, 21 bp, Artificial sequence
  synthetic polynucleotide sequence
cattggccactccatctgcca

SEQ ID NO: 36533 - DNA, 21 bp, Artificial sequence
  synthetic polynucleotide sequence
tgttccaccccaacatccaca

SEQ ID NO: 36534 - DNA, 19 bp, Artificial sequence
  synthetic polynucleotide sequence
gccatggtgaggtccccga

SEQ ID NO: 36535 - DNA, 20 bp, Artificial sequence
  synthetic polynucleotide sequence
ctggcagaggcatatggcaa

SEQ ID NO: 36536 - DNA, 22 bp, Artificial sequence
  synthetic polynucleotide sequence
taaatagtccaccaccctggca

SEQ ID NO: 36537 - DNA, 18 bp, Artificial sequence
  synthetic polynucleotide sequence
atgcgcagttcggcagca

SEQ ID NO: 36538 - DNA, 20 bp, Artificial sequence
  synthetic polynucleotide sequence
gcagagctggtccatccaga

SEQ ID NO: 36539 - DNA, 19 bp, Artificial sequence
  synthetic polynucleotide sequence
cgcacagaccagaacccaa

SEQ ID NO: 36540 - DNA, 18 bp, Artificial sequence
  synthetic polynucleotide sequence
gcaggagaggggttccga

SEQ ID NO: 36541 - DNA, 18 bp, Artificial sequence
  synthetic polynucleotide sequence
cgtgcaccgctacggcca

SEQ ID NO: 36542 - DNA, 20 bp, Artificial sequence
  synthetic polynucleotide sequence
gagagggtcataactgggca

SEQ ID NO: 36543 - DNA, 21 bp, Artificial sequence
  synthetic polynucleotide sequence
gtcaaggagatggccagccta

SEQ ID NO: 36544 - DNA, 21 bp, Artificial sequence
  synthetic polynucleotide sequence
ggtgaagaggacatgctccca

SEQ ID NO: 36545 - DNA, 21 bp, Artificial sequence
  synthetic polynucleotide sequence
ggaccgtactcctggacacca

SEQ ID NO: 36546 - DNA, 22 bp, Artificial sequence
  synthetic polynucleotide sequence
ttcaacaaagtggggtggctca

SEQ ID NO: 36547 - DNA, 20 bp, Artificial sequence
  synthetic polynucleotide sequence
aacgcgatgtaaggaagcca

SEQ ID NO: 36548 - DNA, 18 bp, Artificial sequence
  synthetic polynucleotide sequence
gtatccaccgccagccca

SEQ ID NO: 36549 - DNA, 18 bp, Artificial sequence
  synthetic polynucleotide sequence
gcgaaactgcaccagcga

SEQ ID NO: 36550 - DNA, 18 bp, Artificial sequence
  synthetic polynucleotide sequence
cgcccacgcaagtccaca

SEQ ID NO: 36551 - DNA, 21 bp, Artificial sequence
  synthetic polynucleotide sequence
gtggacacgcatgtgcacaga

SEQ ID NO: 36552 - DNA, 20 bp, Artificial sequence
  synthetic polynucleotide sequence
cacagctccctaggcagcca

SEQ ID NO: 36553 - DNA, 20 bp, Artificial sequence
  synthetic polynucleotide sequence
tagcctcacctgcatagcaa

SEQ ID NO: 36554 - DNA, 18 bp, Artificial sequence
  synthetic polynucleotide sequence
gccacgtcattggaggca

SEQ ID NO: 36555 - DNA, 21 bp, Artificial sequence
  synthetic polynucleotide sequence
ggagggcaagagggtgaggaa

SEQ ID NO: 36556 - DNA, 18 bp, Artificial sequence
  synthetic polynucleotide sequence
tgcccttgcagcgccgca

SEQ ID NO: 36557 - DNA, 18 bp, Artificial sequence
  synthetic polynucleotide sequence
ccacatcctgaaggcgga

SEQ ID NO: 36558 - DNA, 18 bp, Artificial sequence
  synthetic polynucleotide sequence
cctccgcgttgcccagca

SEQ ID NO: 36559 - DNA, 18 bp, Artificial sequence
  synthetic polynucleotide sequence
cgacccgcgacgggcaca

SEQ ID NO: 36560 - DNA, 18 bp, Artificial sequence
  synthetic polynucleotide sequence
gcaggctcacgaagacca

SEQ ID NO: 36561 - DNA, 21 bp, Artificial sequence
  synthetic polynucleotide sequence
cgtgcagctgctgaaacgaca

SEQ ID NO: 36562 - DNA, 22 bp, Artificial sequence
  synthetic polynucleotide sequence
cagaagcagctgcccttgacaa

SEQ ID NO: 36563 - DNA, 20 bp, Artificial sequence
  synthetic polynucleotide sequence
tgcaaccagaccagtgggca

SEQ ID NO: 36564 - DNA, 18 bp, Artificial sequence
  synthetic polynucleotide sequence
gcagggcatcctggggga

SEQ ID NO: 36565 - DNA, 18 bp, Artificial sequence
  synthetic polynucleotide sequence
actgccagaacggaggga

SEQ ID NO: 36566 - DNA, 18 bp, Artificial sequence
  synthetic polynucleotide sequence
gccagagtcggagccgca

SEQ ID NO: 36567 - DNA, 18 bp, Artificial sequence
  synthetic polynucleotide sequence
acgaccggtgcaacgaga

SEQ ID NO: 36568 - DNA, 18 bp, Artificial sequence
  synthetic polynucleotide sequence
gcacacgttggggtagca

SEQ ID NO: 36569 - DNA, 20 bp, Artificial sequence
  synthetic polynucleotide sequence
gacgctgtctaccccaggga

SEQ ID NO: 36570 - DNA, 21 bp, Artificial sequence
  synthetic polynucleotide sequence
tgctgctctgcacgcacgtca

SEQ ID NO: 36571 - DNA, 20 bp, Artificial sequence
  synthetic polynucleotide sequence
actgaaggaggcgtccgaga

SEQ ID NO: 36572 - DNA, 20 bp, Artificial sequence
  synthetic polynucleotide sequence
ccctcggtgcagacgccgaa

SEQ ID NO: 36573 - DNA, 19 bp, Artificial sequence
  synthetic polynucleotide sequence
cgagagccccacatgagga

SEQ ID NO: 36574 - DNA, 22 bp, Artificial sequence
  synthetic polynucleotide sequence
gaatgtccaggtagaccggaga

SEQ ID NO: 36575 - DNA, 18 bp, Artificial sequence
  synthetic polynucleotide sequence
agacctggccaccaggaa

SEQ ID NO: 36576 - DNA, 18 bp, Artificial sequence
  synthetic polynucleotide sequence
tcaggaggcatccagcga

SEQ ID NO: 36577 - DNA, 21 bp, Artificial sequence
  synthetic polynucleotide sequence
agcccagctgaggaaacagga

SEQ ID NO: 36578 - DNA, 22 bp, Artificial sequence
  synthetic polynucleotide sequence
tgaaaagccctgctgtgacaga

SEQ ID NO: 36579 - DNA, 21 bp, Artificial sequence
  synthetic polynucleotide sequence
tcttctacgtcagctccacca

SEQ ID NO: 36580 - DNA, 18 bp, Artificial sequence
  synthetic polynucleotide sequence
tcctcctgcgccgccaca

SEQ ID NO: 36581 - DNA, 20 bp, Artificial sequence
  synthetic polynucleotide sequence
catgaagcggttacccccga

SEQ ID NO: 36582 - DNA, 20 bp, Artificial sequence
  synthetic polynucleotide sequence
ggggatccccaaagcctgaa

SEQ ID NO: 36583 - DNA, 18 bp, Artificial sequence
  synthetic polynucleotide sequence
gcagtgcctgaaagccca

SEQ ID NO: 36584 - DNA, 18 bp, Artificial sequence
  synthetic polynucleotide sequence
gcacgccagtcctgcaca

SEQ ID NO: 36585 - DNA, 20 bp, Artificial sequence
  synthetic polynucleotide sequence
atccctgcgagcccagggca

SEQ ID NO: 36586 - DNA, 20 bp, Artificial sequence
  synthetic polynucleotide sequence
aacacgtcgcctgcgtccaa

SEQ ID NO: 36587 - DNA, 18 bp, Artificial sequence
  synthetic polynucleotide sequence
gatgcactcgtggccgaa

SEQ ID NO: 36588 - DNA, 18 bp, Artificial sequence
  synthetic polynucleotide sequence
cttctggcgacagcggca

SEQ ID NO: 36589 - DNA, 19 bp, Artificial sequence
  synthetic polynucleotide sequence
cggagctcatgtgccagga

SEQ ID NO: 36590 - DNA, 18 bp, Artificial sequence
  synthetic polynucleotide sequence
ggctaacgtggctgggga

SEQ ID NO: 36591 - DNA, 20 bp, Artificial sequence
  synthetic polynucleotide sequence
gaagacgggcttgcgggtga

SEQ ID NO: 36592 - DNA, 18 bp, Artificial sequence
  synthetic polynucleotide sequence
agggtccaggggcacgga

SEQ ID NO: 36593 - DNA, 18 bp, Artificial sequence
  synthetic polynucleotide sequence
tctccacgccccaggaca

SEQ ID NO: 36594 - DNA, 18 bp, Artificial sequence
  synthetic polynucleotide sequence
caaggccaaggacgggca

SEQ ID NO: 36595 - DNA, 19 bp, Artificial sequence
  synthetic polynucleotide sequence
ggagatggaggaggagcga

SEQ ID NO: 36596 - DNA, 18 bp, Artificial sequence
  synthetic polynucleotide sequence
cggtgtaggcagggtgca

SEQ ID NO: 36597 - DNA, 21 bp, Artificial sequence
  synthetic polynucleotide sequence
gagccagatagctgggagaca

SEQ ID NO: 36598 - DNA, 19 bp, Artificial sequence
  synthetic polynucleotide sequence
tccagcttctgagcctcca

SEQ ID NO: 36599 - DNA, 21 bp, Artificial sequence
  synthetic polynucleotide sequence
cgccccacagcttcaaaggca

SEQ ID NO: 36600 - DNA, 22 bp, Artificial sequence
  synthetic polynucleotide sequence
atcttcagacccttcatcccca

SEQ ID NO: 36601 - DNA, 21 bp, Artificial sequence
  synthetic polynucleotide sequence
ctggcaaccacactccagcaa

SEQ ID NO: 36602 - DNA, 20 bp, Artificial sequence
  synthetic polynucleotide sequence
tggacatgggagcaggctga

SEQ ID NO: 36603 - DNA, 19 bp, Artificial sequence
  synthetic polynucleotide sequence
ggagcggagtggggtggta

SEQ ID NO: 36604 - DNA, 19 bp, Artificial sequence
  synthetic polynucleotide sequence
ctctggaggccgcactgga

SEQ ID NO: 36605 - DNA, 22 bp, Artificial sequence
  synthetic polynucleotide sequence
gaagggaagctcacccacaaga

SEQ ID NO: 36606 - DNA, 20 bp, Artificial sequence
  synthetic polynucleotide sequence
ccaggatggcgttccaccaa

SEQ ID NO: 36607 - DNA, 21 bp, Artificial sequence
  synthetic polynucleotide sequence
gcctgagctcatggacgtgca

SEQ ID NO: 36608 - DNA, 20 bp, Artificial sequence
  synthetic polynucleotide sequence
gtagctgtcgtcgggccaca

SEQ ID NO: 36609 - DNA, 21 bp, Artificial sequence
  synthetic polynucleotide sequence
tgtacgaagaggcgggagtca

SEQ ID NO: 36610 - DNA, 20 bp, Artificial sequence
  synthetic polynucleotide sequence
atcctccagcagctccgtga

SEQ ID NO: 36611 - DNA, 18 bp, Artificial sequence
  synthetic polynucleotide sequence
aagcccgtgcacgccgaa

SEQ ID NO: 36612 - DNA, 18 bp, Artificial sequence
  synthetic polynucleotide sequence
ctggcgaggatggggcca

SEQ ID NO: 36613 - DNA, 19 bp, Artificial sequence
  synthetic polynucleotide sequence
cccaacctgtggaaatgca

SEQ ID NO: 36614 - DNA, 21 bp, Artificial sequence
  synthetic polynucleotide sequence
tggacgccattgagactagga

SEQ ID NO: 36615 - DNA, 23 bp, Artificial sequence
  synthetic polynucleotide sequence
ctatactcagcaacagaatggga

SEQ ID NO: 36616 - DNA, 20 bp, Artificial sequence
  synthetic polynucleotide sequence
ggctaagcaggcagggaaga

SEQ ID NO: 36617 - DNA, 19 bp, Artificial sequence
  synthetic polynucleotide sequence
gtggaggagggtgagctca

SEQ ID NO: 36618 - DNA, 18 bp, Artificial sequence
  synthetic polynucleotide sequence
cgccgagggtcttgggga

SEQ ID NO: 36619 - DNA, 18 bp, Artificial sequence
  synthetic polynucleotide sequence
ccaggagtcggagtcgga

SEQ ID NO: 36620 - DNA, 20 bp, Artificial sequence
  synthetic polynucleotide sequence
atgacctccagggagttgga

SEQ ID NO: 36621 - DNA, 18 bp, Artificial sequence
  synthetic polynucleotide sequence
ctgtggaggccggcgcaa

SEQ ID NO: 36622 - DNA, 22 bp, Artificial sequence
  synthetic polynucleotide sequence
gaattctccaggaaggtaggca

SEQ ID NO: 36623 - DNA, 20 bp, Artificial sequence
  synthetic polynucleotide sequence
gagccactcgtgccacgcca

SEQ ID NO: 36624 - DNA, 20 bp, Artificial sequence
  synthetic polynucleotide sequence
gaagcccagcagcccgtcga

SEQ ID NO: 36625 - DNA, 21 bp, Artificial sequence
  synthetic polynucleotide sequence
agagagtcagcactggaacca

SEQ ID NO: 36626 - DNA, 20 bp, Artificial sequence
  synthetic polynucleotide sequence
gtttgggggaagagggtcca

SEQ ID NO: 36627 - DNA, 21 bp, Artificial sequence
  synthetic polynucleotide sequence
gcctcgaccctatggagcaga

SEQ ID NO: 36628 - DNA, 19 bp, Artificial sequence
  synthetic polynucleotide sequence
gcccaggtgctgcagtcca

SEQ ID NO: 36629 - DNA, 20 bp, Artificial sequence
  synthetic polynucleotide sequence
cacccccacagttctacgaa

SEQ ID NO: 36630 - DNA, 18 bp, Artificial sequence
  synthetic polynucleotide sequence
tggaccatcccatcagca

SEQ ID NO: 36631 - DNA, 21 bp, Artificial sequence
  synthetic polynucleotide sequence
ccatgtggaaccaggagagga

SEQ ID NO: 36632 - DNA, 20 bp, Artificial sequence
  synthetic polynucleotide sequence
gtgctcatgggagaggcgga

SEQ ID NO: 36633 - DNA, 18 bp, Artificial sequence
  synthetic polynucleotide sequence
tgagcaccggctacccca

SEQ ID NO: 36634 - DNA, 20 bp, Artificial sequence
  synthetic polynucleotide sequence
aactccatcctgacgaccca

SEQ ID NO: 36635 - DNA, 21 bp, Artificial sequence
  synthetic polynucleotide sequence
aggcccacgagtctacaggaa

SEQ ID NO: 36636 - DNA, 21 bp, Artificial sequence
  synthetic polynucleotide sequence
cctgaacccggttgtagagga

SEQ ID NO: 36637 - DNA, 20 bp, Artificial sequence
  synthetic polynucleotide sequence
agagcgaggaggaggtgcta

SEQ ID NO: 36638 - DNA, 19 bp, Artificial sequence
  synthetic polynucleotide sequence
ttactccagcctcctcaca

SEQ ID NO: 36639 - DNA, 22 bp, Artificial sequence
  synthetic polynucleotide sequence
gctacaaaggggacattgccga

SEQ ID NO: 36640 - DNA, 22 bp, Artificial sequence
  synthetic polynucleotide sequence
taggaatagaccctggcgtcca

SEQ ID NO: 36641 - DNA, 22 bp, Artificial sequence
  synthetic polynucleotide sequence
tatcatctgccgcctaaagcca

SEQ ID NO: 36642 - DNA, 21 bp, Artificial sequence
  synthetic polynucleotide sequence
tacccatacagcagcagccta

SEQ ID NO: 36643 - DNA, 20 bp, Artificial sequence
  synthetic polynucleotide sequence
tcccgaggagccagtcagaa

SEQ ID NO: 36644 - DNA, 20 bp, Artificial sequence
  synthetic polynucleotide sequence
cccggagagctgtggctgca

SEQ ID NO: 36645 - DNA, 19 bp, Artificial sequence
  synthetic polynucleotide sequence
gtgcgacccggctgaccaa

SEQ ID NO: 36646 - DNA, 21 bp, Artificial sequence
  synthetic polynucleotide sequence
gcggatcatacacaggccgca

SEQ ID NO: 36647 - DNA, 22 bp, Artificial sequence
  synthetic polynucleotide sequence
ccaaatcacgctgcagatccca

SEQ ID NO: 36648 - DNA, 18 bp, Artificial sequence
  synthetic polynucleotide sequence
ccaccatcccccctggga

SEQ ID NO: 36649 - DNA, 25 bp, Artificial sequence
  synthetic polynucleotide sequence
atgccagacaagaagtggtggagaa

SEQ ID NO: 36650 - DNA, 25 bp, Artificial sequence
  synthetic polynucleotide sequence
aactgacatgaaggcaggcagtcaa

SEQ ID NO: 36651 - DNA, 20 bp, Artificial sequence
  synthetic polynucleotide sequence
cccagcggccagccttggaa

SEQ ID NO: 36652 - DNA, 23 bp, Artificial sequence
  synthetic polynucleotide sequence
gatgccgaggaaacctatcagaa

SEQ ID NO: 36653 - DNA, 22 bp, Artificial sequence
  synthetic polynucleotide sequence
taccggggaaactcagacccaa

SEQ ID NO: 36654 - DNA, 19 bp, Artificial sequence
  synthetic polynucleotide sequence
cagtggctgaccccctgga

SEQ ID NO: 36655 - DNA, 20 bp, Artificial sequence
  synthetic polynucleotide sequence
aaggccagctatgcagagca

SEQ ID NO: 36656 - DNA, 18 bp, Artificial sequence
  synthetic polynucleotide sequence
cgggtctcagcatcagca

SEQ ID NO: 36657 - DNA, 18 bp, Artificial sequence
  synthetic polynucleotide sequence
gtcccagccctgcaacca

SEQ ID NO: 36658 - DNA, 18 bp, Artificial sequence
  synthetic polynucleotide sequence
gccaccatctgggaggga

SEQ ID NO: 36659 - DNA, 20 bp, Artificial sequence
  synthetic polynucleotide sequence
tccggcgagaggctgagcca

SEQ ID NO: 36660 - DNA, 20 bp, Artificial sequence
  synthetic polynucleotide sequence
cgaagctggtgcggctggca

SEQ ID NO: 36661 - DNA, 19 bp, Artificial sequence
  synthetic polynucleotide sequence
gaggcagaggtgacacgga

SEQ ID NO: 36662 - DNA, 22 bp, Artificial sequence
  synthetic polynucleotide sequence
aatgagctaggagttcgaggga

SEQ ID NO: 36663 - DNA, 22 bp, Artificial sequence
  synthetic polynucleotide sequence
atggcactcagcagacaatcca

SEQ ID NO: 36664 - DNA, 21 bp, Artificial sequence
  synthetic polynucleotide sequence
tgggaccgtcaactgacacaa

SEQ ID NO: 36665 - DNA, 18 bp, Artificial sequence
  synthetic polynucleotide sequence
cccaccgcaacaagccca

SEQ ID NO: 36666 - DNA, 20 bp, Artificial sequence
  synthetic polynucleotide sequence
cacactgccatgatgaccca

SEQ ID NO: 36667 - DNA, 19 bp, Artificial sequence
  synthetic polynucleotide sequence
tgtcacagcgatccaagga

SEQ ID NO: 36668 - DNA, 21 bp, Artificial sequence
  synthetic polynucleotide sequence
agtctggacagtacacgagca

SEQ ID NO: 36669 - DNA, 21 bp, Artificial sequence
  synthetic polynucleotide sequence
gtgtatgatcgccctggagca

SEQ ID NO: 36670 - DNA, 19 bp, Artificial sequence
  synthetic polynucleotide sequence
gtgaggcggatgcgagcca

SEQ ID NO: 36671 - DNA, 21 bp, Artificial sequence
  synthetic polynucleotide sequence
tgccccctcctcctcaaagca

SEQ ID NO: 36672 - DNA, 20 bp, Artificial sequence
  synthetic polynucleotide sequence
atctggggtgaagtggcgca

SEQ ID NO: 36673 - DNA, 18 bp, Artificial sequence
  synthetic polynucleotide sequence
aaacggacccgcagagca

SEQ ID NO: 36674 - DNA, 19 bp, Artificial sequence
  synthetic polynucleotide sequence
gacctggcacagctggaga

SEQ ID NO: 36675 - DNA, 18 bp, Artificial sequence
  synthetic polynucleotide sequence
tcctccacatcgacccca

SEQ ID NO: 36676 - DNA, 18 bp, Artificial sequence
  synthetic polynucleotide sequence
tctgagggacgctgacca

SEQ ID NO: 36677 - DNA, 21 bp, Artificial sequence
  synthetic polynucleotide sequence
cagagtgccaaccagagcaga

SEQ ID NO: 36678 - DNA, 21 bp, Artificial sequence
  synthetic polynucleotide sequence
atgtcaccggtgctacctgga

SEQ ID NO: 36679 - DNA, 18 bp, Artificial sequence
  synthetic polynucleotide sequence
ttgggcaagtggcagcca

SEQ ID NO: 36680 - DNA, 18 bp, Artificial sequence
  synthetic polynucleotide sequence
ggcacggaactgaaccca

SEQ ID NO: 36681 - DNA, 21 bp, Artificial sequence
  synthetic polynucleotide sequence
ccaccacaaccagttgtacca

SEQ ID NO: 36682 - DNA, 22 bp, Artificial sequence
  synthetic polynucleotide sequence
aaaaggatccaactgggcagga

SEQ ID NO: 36683 - DNA, 21 bp, Artificial sequence
  synthetic polynucleotide sequence
tgtgctggcatcctgaggaga

SEQ ID NO: 36684 - DNA, 22 bp, Artificial sequence
  synthetic polynucleotide sequence
tcatttcctgcaacggctccaa

SEQ ID NO: 36685 - DNA, 20 bp, Artificial sequence
  synthetic polynucleotide sequence
ggtgaccgagtgccactcca

SEQ ID NO: 36686 - DNA, 20 bp, Artificial sequence
  synthetic polynucleotide sequence
ggaagcatcccagtgccaga

SEQ ID NO: 36687 - DNA, 22 bp, Artificial sequence
  synthetic polynucleotide sequence
aaactaatggggacagtcagca

SEQ ID NO: 36688 - DNA, 18 bp, Artificial sequence
  synthetic polynucleotide sequence
tatccaatcccgcacgga

SEQ ID NO: 36689 - DNA, 21 bp, Artificial sequence
  synthetic polynucleotide sequence
ctacccagtccaaccagctga

SEQ ID NO: 36690 - DNA, 21 bp, Artificial sequence
  synthetic polynucleotide sequence
ctgttccccaaaaggcctgca

SEQ ID NO: 36691 - DNA, 18 bp, Artificial sequence
  synthetic polynucleotide sequence
accacaggggcctccaca

SEQ ID NO: 36692 - DNA, 19 bp, Artificial sequence
  synthetic polynucleotide sequence
gcagaggcaggattggaca

SEQ ID NO: 36693 - DNA, 21 bp, Artificial sequence
  synthetic polynucleotide sequence
caacaacatccaccgctgcca

SEQ ID NO: 36694 - DNA, 20 bp, Artificial sequence
  synthetic polynucleotide sequence
caggtggagcggtcacggca

SEQ ID NO: 36695 - DNA, 21 bp, Artificial sequence
  synthetic polynucleotide sequence
ctaccaccgccactttcacca

SEQ ID NO: 36696 - DNA, 21 bp, Artificial sequence
  synthetic polynucleotide sequence
ataagaccctccagatgacca

SEQ ID NO: 36697 - DNA, 18 bp, Artificial sequence
  synthetic polynucleotide sequence
tgtggcccacctgacaga

SEQ ID NO: 36698 - DNA, 18 bp, Artificial sequence
  synthetic polynucleotide sequence
tgtgcagctccagggaga

SEQ ID NO: 36699 - DNA, 21 bp, Artificial sequence
  synthetic polynucleotide sequence
cagccagctccaattcgagga

SEQ ID NO: 36700 - DNA, 20 bp, Artificial sequence
  synthetic polynucleotide sequence
cagccagaacacggagggga

SEQ ID NO: 36701 - DNA, 18 bp, Artificial sequence
  synthetic polynucleotide sequence
gcgcagtttgaagcagca

SEQ ID NO: 36702 - DNA, 19 bp, Artificial sequence
  synthetic polynucleotide sequence
caagcaaggagggtcacca

SEQ ID NO: 36703 - DNA, 20 bp, Artificial sequence
  synthetic polynucleotide sequence
caacaccagaccctcagcga

SEQ ID NO: 36704 - DNA, 18 bp, Artificial sequence
  synthetic polynucleotide sequence
actgggtaaggctgcgca

SEQ ID NO: 36705 - DNA, 21 bp, Artificial sequence
  synthetic polynucleotide sequence
cctgaagtcacatcggctgca

SEQ ID NO: 36706 - DNA, 21 bp, Artificial sequence
  synthetic polynucleotide sequence
gtgtgagaatgtgagcccgga

SEQ ID NO: 36707 - DNA, 18 bp, Artificial sequence
  synthetic polynucleotide sequence
ccttcccaccagcaacca

SEQ ID NO: 36708 - DNA, 18 bp, Artificial sequence
  synthetic polynucleotide sequence
cgaggtaggaatgggcca

SEQ ID NO: 36709 - DNA, 21 bp, Artificial sequence
  synthetic polynucleotide sequence
acccataagctacgaggagga

SEQ ID NO: 36710 - DNA, 19 bp, Artificial sequence
  synthetic polynucleotide sequence
gcccgccaggtgcaggcca

SEQ ID NO: 36711 - DNA, 19 bp, Artificial sequence
  synthetic polynucleotide sequence
tgccagttagtagcccaga

SEQ ID NO: 36712 - DNA, 20 bp, Artificial sequence
  synthetic polynucleotide sequence
taggtgggaaggcaaagaga

SEQ ID NO: 36713 - DNA, 18 bp, Artificial sequence
  synthetic polynucleotide sequence
agccaacgacgctcgcaa

SEQ ID NO: 36714 - DNA, 18 bp, Artificial sequence
  synthetic polynucleotide sequence
tgcccccagacacggtca

SEQ ID NO: 36715 - DNA, 20 bp, Artificial sequence
  synthetic polynucleotide sequence
cagcacagcatcaccgcgca

SEQ ID NO: 36716 - DNA, 22 bp, Artificial sequence
  synthetic polynucleotide sequence
aggaacatctggtggaacccca

SEQ ID NO: 36717 - DNA, 18 bp, Artificial sequence
  synthetic polynucleotide sequence
gcagacagggccaaagga

SEQ ID NO: 36718 - DNA, 20 bp, Artificial sequence
  synthetic polynucleotide sequence
ctcctgaggcatggtgagga

SEQ ID NO: 36719 - DNA, 19 bp, Artificial sequence
  synthetic polynucleotide sequence
gaggaggaggaactcccca

SEQ ID NO: 36720 - DNA, 18 bp, Artificial sequence
  synthetic polynucleotide sequence
ctgagaaggcccgaggca

SEQ ID NO: 36721 - DNA, 20 bp, Artificial sequence
  synthetic polynucleotide sequence
cctccctgctcacacaccca

SEQ ID NO: 36722 - DNA, 20 bp, Artificial sequence
  synthetic polynucleotide sequence
gggaggggtctctggaggca

SEQ ID NO: 36723 - DNA, 20 bp, Artificial sequence
  synthetic polynucleotide sequence
aaacctccccaccccagaca

SEQ ID NO: 36724 - DNA, 20 bp, Artificial sequence
  synthetic polynucleotide sequence
ctgtggtcctggggaggaga

SEQ ID NO: 36725 - DNA, 21 bp, Artificial sequence
  synthetic polynucleotide sequence
accagtacgcaacccagacca

SEQ ID NO: 36726 - DNA, 22 bp, Artificial sequence
  synthetic polynucleotide sequence
gtaattcggggcccttgacaga

SEQ ID NO: 36727 - DNA, 20 bp, Artificial sequence
  synthetic polynucleotide sequence
tccctgagcaagtgcgagga

SEQ ID NO: 36728 - DNA, 21 bp, Artificial sequence
  synthetic polynucleotide sequence
tcagaatggccacgctggaga

SEQ ID NO: 36729 - DNA, 22 bp, Artificial sequence
  synthetic polynucleotide sequence
cagcgccacctacatcaatgga

SEQ ID NO: 36730 - DNA, 21 bp, Artificial sequence
  synthetic polynucleotide sequence
gtggaactggtaaagcggcca

SEQ ID NO: 36731 - DNA, 20 bp, Artificial sequence
  synthetic polynucleotide sequence
gtctgagcgggaattggaca

SEQ ID NO: 36732 - DNA, 21 bp, Artificial sequence
  synthetic polynucleotide sequence
caggaggggagacacaggcta

SEQ ID NO: 36733 - DNA, 21 bp, Artificial sequence
  synthetic polynucleotide sequence
ttctccatcccagtgtccaca

SEQ ID NO: 36734 - DNA, 20 bp, Artificial sequence
  synthetic polynucleotide sequence
cttgccctcggtctggagca

SEQ ID NO: 36735 - DNA, 21 bp, Artificial sequence
  synthetic polynucleotide sequence
cactcaaggacccctacctga

SEQ ID NO: 36736 - DNA, 20 bp, Artificial sequence
  synthetic polynucleotide sequence
cgtctggcaccacacgtcca

SEQ ID NO: 36737 - DNA, 20 bp, Artificial sequence
  synthetic polynucleotide sequence
gccggatgggaccttaggga

SEQ ID NO: 36738 - DNA, 22 bp, Artificial sequence
  synthetic polynucleotide sequence
ctcaactgggacgaagggtaca

SEQ ID NO: 36739 - DNA, 21 bp, Artificial sequence
  synthetic polynucleotide sequence
actccctgcgagattacacca

SEQ ID NO: 36740 - DNA, 22 bp, Artificial sequence
  synthetic polynucleotide sequence
tcattcacaaaggcctccacga

SEQ ID NO: 36741 - DNA, 20 bp, Artificial sequence
  synthetic polynucleotide sequence
gactccacggaggagcagca

SEQ ID NO: 36742 - DNA, 20 bp, Artificial sequence
  synthetic polynucleotide sequence
cactgagaactggcgcccga

SEQ ID NO: 36743 - DNA, 21 bp, Artificial sequence
  synthetic polynucleotide sequence
ctgcagaacaaggtggtggca

SEQ ID NO: 36744 - DNA, 18 bp, Artificial sequence
  synthetic polynucleotide sequence
gccggtaggggtcgtgga

SEQ ID NO: 36745 - DNA, 22 bp, Artificial sequence
  synthetic polynucleotide sequence
atgtggcctgaccctaaactca

SEQ ID NO: 36746 - DNA, 22 bp, Artificial sequence
  synthetic polynucleotide sequence
tcatgtaggtcagagcctcaca

SEQ ID NO: 36747 - DNA, 21 bp, Artificial sequence
  synthetic polynucleotide sequence
tggagggcaaggaaccaagga

SEQ ID NO: 36748 - DNA, 21 bp, Artificial sequence
  synthetic polynucleotide sequence
catgtgggtcaaggcctcaca

SEQ ID NO: 36749 - DNA, 21 bp, Artificial sequence
  synthetic polynucleotide sequence
atctcgtcgatgcctgggaga

SEQ ID NO: 36750 - DNA, 20 bp, Artificial sequence
  synthetic polynucleotide sequence
tccaaggggcacacaaagga

SEQ ID NO: 36751 - DNA, 21 bp, Artificial sequence
  synthetic polynucleotide sequence
gggagattccacgatccgcca

SEQ ID NO: 36752 - DNA, 21 bp, Artificial sequence
  synthetic polynucleotide sequence
ttctgtcaatggcccgggtga

SEQ ID NO: 36753 - DNA, 20 bp, Artificial sequence
  synthetic polynucleotide sequence
cagccgactcctgtcacaga

SEQ ID NO: 36754 - DNA, 20 bp, Artificial sequence
  synthetic polynucleotide sequence
gttcctcagccagtcccaga

SEQ ID NO: 36755 - DNA, 21 bp, Artificial sequence
  synthetic polynucleotide sequence
ccccccagtctaccttggaga

SEQ ID NO: 36756 - DNA, 19 bp, Artificial sequence
  synthetic polynucleotide sequence
ccttgaagggcttggagca

SEQ ID NO: 36757 - DNA, 19 bp, Artificial sequence
  synthetic polynucleotide sequence
cacgctcagagctcagcca

SEQ ID NO: 36758 - DNA, 19 bp, Artificial sequence
  synthetic polynucleotide sequence
gggcacaccttctggacca

SEQ ID NO: 36759 - DNA, 20 bp, Artificial sequence
  synthetic polynucleotide sequence
caccaagaggaagccgtcca

SEQ ID NO: 36760 - DNA, 20 bp, Artificial sequence
  synthetic polynucleotide sequence
ttgccggtcaccagcagcga

SEQ ID NO: 36761 - DNA, 19 bp, Artificial sequence
  synthetic polynucleotide sequence
cctgcagagctgctgagga

SEQ ID NO: 36762 - DNA, 20 bp, Artificial sequence
  synthetic polynucleotide sequence
ctggcagtctaccacgctga

SEQ ID NO: 36763 - DNA, 22 bp, Artificial sequence
  synthetic polynucleotide sequence
atgagcaagcaactcagtccca

SEQ ID NO: 36764 - DNA, 21 bp, Artificial sequence
  synthetic polynucleotide sequence
ttgttgggagtggactgagca

SEQ ID NO: 36765 - DNA, 20 bp, Artificial sequence
  synthetic polynucleotide sequence
taccgaacccagtctcccca

SEQ ID NO: 36766 - DNA, 20 bp, Artificial sequence
  synthetic polynucleotide sequence
gttcaccgcggcgttgacca

SEQ ID NO: 36767 - DNA, 20 bp, Artificial sequence
  synthetic polynucleotide sequence
ccaccagaggcccgaagaga

SEQ ID NO: 36768 - DNA, 20 bp, Artificial sequence
  synthetic polynucleotide sequence
acttatggtgaccgggccca

SEQ ID NO: 36769 - DNA, 19 bp, Artificial sequence
  synthetic polynucleotide sequence
ctggatggagggctccgga

SEQ ID NO: 36770 - DNA, 20 bp, Artificial sequence
  synthetic polynucleotide sequence
acacagaggccatcggagga

SEQ ID NO: 36771 - DNA, 19 bp, Artificial sequence
  synthetic polynucleotide sequence
ctggagcaaggtgtggaca

SEQ ID NO: 36772 - DNA, 18 bp, Artificial sequence
  synthetic polynucleotide sequence
gcagctgcggatgccaca

SEQ ID NO: 36773 - DNA, 22 bp, Artificial sequence
  synthetic polynucleotide sequence
aaaagggcttcgcacaagccaa

SEQ ID NO: 36774 - DNA, 21 bp, Artificial sequence
  synthetic polynucleotide sequence
gaccacatccaatcctgggca

SEQ ID NO: 36775 - DNA, 18 bp, Artificial sequence
  synthetic polynucleotide sequence
agcacactccaggcagca

SEQ ID NO: 36776 - DNA, 18 bp, Artificial sequence
  synthetic polynucleotide sequence
ccccaagatgcactggca

SEQ ID NO: 36777 - DNA, 18 bp, Artificial sequence
  synthetic polynucleotide sequence
gatcttggacccagccga

SEQ ID NO: 36778 - DNA, 22 bp, Artificial sequence
  synthetic polynucleotide sequence
tgaagcagggagaggataacca

SEQ ID NO: 36779 - DNA, 20 bp, Artificial sequence
  synthetic polynucleotide sequence
agctacagcaatgcgggcga

SEQ ID NO: 36780 - DNA, 21 bp, Artificial sequence
  synthetic polynucleotide sequence
accagtgcttcaccagccgga

SEQ ID NO: 36781 - DNA, 19 bp, Artificial sequence
  synthetic polynucleotide sequence
gagaccatcccctccgaga

SEQ ID NO: 36782 - DNA, 19 bp, Artificial sequence
  synthetic polynucleotide sequence
cccaaccagtcctgcagga

SEQ ID NO: 36783 - DNA, 20 bp, Artificial sequence
  synthetic polynucleotide sequence
cagttccacagacccaacca

SEQ ID NO: 36784 - DNA, 19 bp, Artificial sequence
  synthetic polynucleotide sequence
cagagctctcgcactccca

SEQ ID NO: 36785 - DNA, 20 bp, Artificial sequence
  synthetic polynucleotide sequence
ccctcacccactgtcgaaga

SEQ ID NO: 36786 - DNA, 20 bp, Artificial sequence
  synthetic polynucleotide sequence
cagggaggtcctgggtcaca

SEQ ID NO: 36787 - DNA, 19 bp, Artificial sequence
  synthetic polynucleotide sequence
cctcccagacctctgccca

SEQ ID NO: 36788 - DNA, 21 bp, Artificial sequence
  synthetic polynucleotide sequence
gtctgaccacctcaaagccca

SEQ ID NO: 36789 - DNA, 20 bp, Artificial sequence
  synthetic polynucleotide sequence
catgcccctgcagacgggaa

SEQ ID NO: 36790 - DNA, 20 bp, Artificial sequence
  synthetic polynucleotide sequence
agggaagggtcatggctgga

SEQ ID NO: 36791 - DNA, 20 bp, Artificial sequence
  synthetic polynucleotide sequence
gacctggtacgtgaaggcca

SEQ ID NO: 36792 - DNA, 18 bp, Artificial sequence
  synthetic polynucleotide sequence
ccaacttcccaccgccca

SEQ ID NO: 36793 - DNA, 21 bp, Artificial sequence
  synthetic polynucleotide sequence
ggaagagggggaagacggaga

SEQ ID NO: 36794 - DNA, 21 bp, Artificial sequence
  synthetic polynucleotide sequence
ccaggtcagccagtgtcagca

SEQ ID NO: 36795 - DNA, 20 bp, Artificial sequence
  synthetic polynucleotide sequence
cacatccactcggacggcca

SEQ ID NO: 36796 - DNA, 20 bp, Artificial sequence
  synthetic polynucleotide sequence
gagtctggctgcgcagcgca

SEQ ID NO: 36797 - DNA, 18 bp, Artificial sequence
  synthetic polynucleotide sequence
gcctcaagtccccaagca

SEQ ID NO: 36798 - DNA, 18 bp, Artificial sequence
  synthetic polynucleotide sequence
gaagaggcccgatcccca

SEQ ID NO: 36799 - DNA, 20 bp, Artificial sequence
  synthetic polynucleotide sequence
gcctgggaggtaacgggaca

SEQ ID NO: 36800 - DNA, 22 bp, Artificial sequence
  synthetic polynucleotide sequence
aacacatcccaacagtgcagga

SEQ ID NO: 36801 - DNA, 20 bp, Artificial sequence
  synthetic polynucleotide sequence
tccaggaaggccttccagga

SEQ ID NO: 36802 - DNA, 20 bp, Artificial sequence
  synthetic polynucleotide sequence
ggccctacttccagggaaca

SEQ ID NO: 36803 - DNA, 22 bp, Artificial sequence
  synthetic polynucleotide sequence
gaatgcagaggttccaagacca

SEQ ID NO: 36804 - DNA, 19 bp, Artificial sequence
  synthetic polynucleotide sequence
tgttgcagccaaaggcaca

SEQ ID NO: 36805 - DNA, 20 bp, Artificial sequence
  synthetic polynucleotide sequence
ccatcagtctagcagcccca

SEQ ID NO: 36806 - DNA, 25 bp, Artificial sequence
  synthetic polynucleotide sequence
accctgcaaatcctgaaacctgcaa

SEQ ID NO: 36807 - DNA, 20 bp, Artificial sequence
  synthetic polynucleotide sequence
caggcagcctcgttacagca

SEQ ID NO: 36808 - DNA, 20 bp, Artificial sequence
  synthetic polynucleotide sequence
tccagtcctcctccagctca

SEQ ID NO: 36809 - DNA, 21 bp, Artificial sequence
  synthetic polynucleotide sequence
agacaacgaccagagcgggta

SEQ ID NO: 36810 - DNA, 19 bp, Artificial sequence
  synthetic polynucleotide sequence
ccgccgcagccatcaagga

SEQ ID NO: 36811 - DNA, 21 bp, Artificial sequence
  synthetic polynucleotide sequence
agacaacgaccagagcgggta

SEQ ID NO: 36812 - DNA, 20 bp, Artificial sequence
  synthetic polynucleotide sequence
tccgccgcagccatcaagga

SEQ ID NO: 36813 - DNA, 18 bp, Artificial sequence
  synthetic polynucleotide sequence
gacccctggaatgcagga

SEQ ID NO: 36814 - DNA, 18 bp, Artificial sequence
  synthetic polynucleotide sequence
tgtcggcagatccgggga

SEQ ID NO: 36815 - DNA, 20 bp, Artificial sequence
  synthetic polynucleotide sequence
cttgcgtccccacacccaga

SEQ ID NO: 36816 - DNA, 19 bp, Artificial sequence
  synthetic polynucleotide sequence
gtcacacagggaggcggca

SEQ ID NO: 36817 - DNA, 21 bp, Artificial sequence
  synthetic polynucleotide sequence
ccactacaacttcagggccca

SEQ ID NO: 36818 - DNA, 21 bp, Artificial sequence
  synthetic polynucleotide sequence
tgatttgggagcagtccagca

SEQ ID NO: 36819 - DNA, 18 bp, Artificial sequence
  synthetic polynucleotide sequence
ccacgctcagaaccagca

SEQ ID NO: 36820 - DNA, 18 bp, Artificial sequence
  synthetic polynucleotide sequence
cacagcgggcatcagaga

SEQ ID NO: 36821 - DNA, 21 bp, Artificial sequence
  synthetic polynucleotide sequence
cgagagcttgccaaactgaga

SEQ ID NO: 36822 - DNA, 18 bp, Artificial sequence
  synthetic polynucleotide sequence
tctcccgctcagccgaca

SEQ ID NO: 36823 - DNA, 19 bp, Artificial sequence
  synthetic polynucleotide sequence
gagccgagaagagcgagga

SEQ ID NO: 36824 - DNA, 18 bp, Artificial sequence
  synthetic polynucleotide sequence
gtagcggctcctccagga

SEQ ID NO: 36825 - DNA, 21 bp, Artificial sequence
  synthetic polynucleotide sequence
agggagccttaaatgcccaca

SEQ ID NO: 36826 - DNA, 23 bp, Artificial sequence
  synthetic polynucleotide sequence
caaacatcaactgagtgcccaga

SEQ ID NO: 36827 - DNA, 21 bp, Artificial sequence
  synthetic polynucleotide sequence
tcggcaaagtctccgccccaa

SEQ ID NO: 36828 - DNA, 21 bp, Artificial sequence
  synthetic polynucleotide sequence
acttgtagacccctggactca

SEQ ID NO: 36829 - DNA, 22 bp, Artificial sequence
  synthetic polynucleotide sequence
aaccgcagccctacttacagca

SEQ ID NO: 36830 - DNA, 22 bp, Artificial sequence
  synthetic polynucleotide sequence
atgcccatggtgaaagcaggga

SEQ ID NO: 36831 - DNA, 20 bp, Artificial sequence
  synthetic polynucleotide sequence
gaccctcagctgcgactcca

SEQ ID NO: 36832 - DNA, 20 bp, Artificial sequence
  synthetic polynucleotide sequence
agggtggccgtcccacagga

SEQ ID NO: 36833 - DNA, 21 bp, Artificial sequence
  synthetic polynucleotide sequence
gtctgattctgagccacccca

SEQ ID NO: 36834 - DNA, 20 bp, Artificial sequence
  synthetic polynucleotide sequence
cttctgctcaggatccagga

SEQ ID NO: 36835 - DNA, 21 bp, Artificial sequence
  synthetic polynucleotide sequence
gaggaactggaggaacaccga

SEQ ID NO: 36836 - DNA, 22 bp, Artificial sequence
  synthetic polynucleotide sequence
tagagcctcaggaaccagagaa

SEQ ID NO: 36837 - DNA, 21 bp, Artificial sequence
  synthetic polynucleotide sequence
gaatctgcagggaacatgcca

SEQ ID NO: 36838 - DNA, 21 bp, Artificial sequence
  synthetic polynucleotide sequence
ggtgctgatatgagaggggca

SEQ ID NO: 36839 - DNA, 20 bp, Artificial sequence
  synthetic polynucleotide sequence
gacccagatgtcctgccaga

SEQ ID NO: 36840 - DNA, 18 bp, Artificial sequence
  synthetic polynucleotide sequence
gcttccggaatggcagca

SEQ ID NO: 36841 - DNA, 20 bp, Artificial sequence
  synthetic polynucleotide sequence
gcccgaaaggttcctgcaga

SEQ ID NO: 36842 - DNA, 21 bp, Artificial sequence
  synthetic polynucleotide sequence
ggagcagttgaccacgatcca

SEQ ID NO: 36843 - DNA, 18 bp, Artificial sequence
  synthetic polynucleotide sequence
agctggaagggcgccgga

SEQ ID NO: 36844 - DNA, 21 bp, Artificial sequence
  synthetic polynucleotide sequence
ggaggccgagtcaatgatgga

SEQ ID NO: 36845 - DNA, 22 bp, Artificial sequence
  synthetic polynucleotide sequence
gataatgccgagctcaccctca

SEQ ID NO: 36846 - DNA, 20 bp, Artificial sequence
  synthetic polynucleotide sequence
ccaacgctcaccagtgccca

SEQ ID NO: 36847 - DNA, 21 bp, Artificial sequence
  synthetic polynucleotide sequence
cgctgcatctgaccaagccca

SEQ ID NO: 36848 - DNA, 19 bp, Artificial sequence
  synthetic polynucleotide sequence
tggagaggtacagcagcga

SEQ ID NO: 36849 - DNA, 20 bp, Artificial sequence
  synthetic polynucleotide sequence
aaggtgaggaagcggaggaa

SEQ ID NO: 36850 - DNA, 18 bp, Artificial sequence
  synthetic polynucleotide sequence
agggccaaggtctgggca

SEQ ID NO: 36851 - DNA, 19 bp, Artificial sequence
  synthetic polynucleotide sequence
ctcctgcggttcgcccaga

SEQ ID NO: 36852 - DNA, 19 bp, Artificial sequence
  synthetic polynucleotide sequence
gactggaggcgagagggga

SEQ ID NO: 36853 - DNA, 19 bp, Artificial sequence
  synthetic polynucleotide sequence
gccaggatcacctccgaga

SEQ ID NO: 36854 - DNA, 19 bp, Artificial sequence
  synthetic polynucleotide sequence
ggaggagaggctggaggga

SEQ ID NO: 36855 - DNA, 21 bp, Artificial sequence
  synthetic polynucleotide sequence
caccttcctctacttggacca

SEQ ID NO: 36856 - DNA, 18 bp, Artificial sequence
  synthetic polynucleotide sequence
cttcaatgcggtcccgga

SEQ ID NO: 36857 - DNA, 21 bp, Artificial sequence
  synthetic polynucleotide sequence
ggaacacgtcaggagaggcca

SEQ ID NO: 36858 - DNA, 21 bp, Artificial sequence
  synthetic polynucleotide sequence
ctgggatgctgcaactcgaga

SEQ ID NO: 36859 - DNA, 18 bp, Artificial sequence
  synthetic polynucleotide sequence
ggtgcacctcgcctggga

SEQ ID NO: 36860 - DNA, 22 bp, Artificial sequence
  synthetic polynucleotide sequence
gaaaggcagaagtgacctctca

SEQ ID NO: 36861 - DNA, 20 bp, Artificial sequence
  synthetic polynucleotide sequence
aagcagtacacatcccggga

SEQ ID NO: 36862 - DNA, 20 bp, Artificial sequence
  synthetic polynucleotide sequence
cgctcgtccaacactccaca

SEQ ID NO: 36863 - DNA, 22 bp, Artificial sequence
  synthetic polynucleotide sequence
ttgagtgctgaggagagacaga

SEQ ID NO: 36864 - DNA, 20 bp, Artificial sequence
  synthetic polynucleotide sequence
cctgatggtccatgcacgca

SEQ ID NO: 36865 - DNA, 19 bp, Artificial sequence
  synthetic polynucleotide sequence
ttggaggcacccccaagca

SEQ ID NO: 36866 - DNA, 20 bp, Artificial sequence
  synthetic polynucleotide sequence
tctcgttcgcaggatccaga

SEQ ID NO: 36867 - DNA, 18 bp, Artificial sequence
  synthetic polynucleotide sequence
ccatcctcaagacccgca

SEQ ID NO: 36868 - DNA, 18 bp, Artificial sequence
  synthetic polynucleotide sequence
tggcgtacacggcccaca

SEQ ID NO: 36869 - DNA, 18 bp, Artificial sequence
  synthetic polynucleotide sequence
ccggggtcagtaacccca

SEQ ID NO: 36870 - DNA, 20 bp, Artificial sequence
  synthetic polynucleotide sequence
gaagtctcccagggtacgga

SEQ ID NO: 36871 - DNA, 22 bp, Artificial sequence
  synthetic polynucleotide sequence
tcaagtgggcaggaactaacca

SEQ ID NO: 36872 - DNA, 19 bp, Artificial sequence
  synthetic polynucleotide sequence
tgggcaagcactctcccca

SEQ ID NO: 36873 - DNA, 18 bp, Artificial sequence
  synthetic polynucleotide sequence
ctcctcccactccaggga

SEQ ID NO: 36874 - DNA, 18 bp, Artificial sequence
  synthetic polynucleotide sequence
attcaatggcgccaccca

SEQ ID NO: 36875 - DNA, 18 bp, Artificial sequence
  synthetic polynucleotide sequence
cccatgcagaagccagga

SEQ ID NO: 36876 - DNA, 20 bp, Artificial sequence
  synthetic polynucleotide sequence
ggggaagaacaagttgggca

SEQ ID NO: 36877 - DNA, 18 bp, Artificial sequence
  synthetic polynucleotide sequence
caaccagcaggaaggcca

SEQ ID NO: 36878 - DNA, 18 bp, Artificial sequence
  synthetic polynucleotide sequence
gctcgttgaggaacggca

SEQ ID NO: 36879 - DNA, 19 bp, Artificial sequence
  synthetic polynucleotide sequence
gcggacctgagcacacaga

SEQ ID NO: 36880 - DNA, 18 bp, Artificial sequence
  synthetic polynucleotide sequence
cgaacagcagcctgggga

SEQ ID NO: 36881 - DNA, 18 bp, Artificial sequence
  synthetic polynucleotide sequence
cctggcagctgatgagga

SEQ ID NO: 36882 - DNA, 21 bp, Artificial sequence
  synthetic polynucleotide sequence
gacgacatagagggtcccaca

SEQ ID NO: 36883 - DNA, 18 bp, Artificial sequence
  synthetic polynucleotide sequence
tgcgcgcgagaagccgga

SEQ ID NO: 36884 - DNA, 18 bp, Artificial sequence
  synthetic polynucleotide sequence
gcgccgctgagtagggca

SEQ ID NO: 36885 - DNA, 18 bp, Artificial sequence
  synthetic polynucleotide sequence
catggatggcctccgcga

SEQ ID NO: 36886 - DNA, 20 bp, Artificial sequence
  synthetic polynucleotide sequence
cgcttcatctcctccagcga

SEQ ID NO: 36887 - DNA, 21 bp, Artificial sequence
  synthetic polynucleotide sequence
tgaagaggctggttggcgaga

SEQ ID NO: 36888 - DNA, 18 bp, Artificial sequence
  synthetic polynucleotide sequence
gggaagtgaggcggcgga

SEQ ID NO: 36889 - DNA, 21 bp, Artificial sequence
  synthetic polynucleotide sequence
tgaaggaccagcctgatgaga

SEQ ID NO: 36890 - DNA, 20 bp, Artificial sequence
  synthetic polynucleotide sequence
aggaggtcagacacctggga

SEQ ID NO: 36891 - DNA, 21 bp, Artificial sequence
  synthetic polynucleotide sequence
caggaggcctctcaagtacca

SEQ ID NO: 36892 - DNA, 21 bp, Artificial sequence
  synthetic polynucleotide sequence
aacaagagaggaaccggagca

SEQ ID NO: 36893 - DNA, 23 bp, Artificial sequence
  synthetic polynucleotide sequence
ggatgggctagtaaacttgacca

SEQ ID NO: 36894 - DNA, 19 bp, Artificial sequence
  synthetic polynucleotide sequence
gaaggcaaaccaggaggca

SEQ ID NO: 36895 - DNA, 21 bp, Artificial sequence
  synthetic polynucleotide sequence
atgcacagagaggcacaggca

SEQ ID NO: 36896 - DNA, 21 bp, Artificial sequence
  synthetic polynucleotide sequence
agagaccgaggtaagtgagca

SEQ ID NO: 36897 - DNA, 21 bp, Artificial sequence
  synthetic polynucleotide sequence
caccaacctcatgacacgcca

SEQ ID NO: 36898 - DNA, 18 bp, Artificial sequence
  synthetic polynucleotide sequence
tccgacaggcgctcccca

SEQ ID NO: 36899 - DNA, 20 bp, Artificial sequence
  synthetic polynucleotide sequence
gcgcagcgtatcaccaccga

SEQ ID NO: 36900 - DNA, 20 bp, Artificial sequence
  synthetic polynucleotide sequence
gggttgcgcagcaggtccga

SEQ ID NO: 36901 - DNA, 19 bp, Artificial sequence
  synthetic polynucleotide sequence
ctgtgccggtctcagggga

SEQ ID NO: 36902 - DNA, 20 bp, Artificial sequence
  synthetic polynucleotide sequence
gctggaactcgggctcctga

SEQ ID NO: 36903 - DNA, 19 bp, Artificial sequence
  synthetic polynucleotide sequence
ccgccgccacagattcgca

SEQ ID NO: 36904 - DNA, 20 bp, Artificial sequence
  synthetic polynucleotide sequence
tatggctcggtctgggccaa

SEQ ID NO: 36905 - DNA, 20 bp, Artificial sequence
  synthetic polynucleotide sequence
accggtgctgagaacctcca

SEQ ID NO: 36906 - DNA, 21 bp, Artificial sequence
  synthetic polynucleotide sequence
tccgatttgcagggcagccca

SEQ ID NO: 36907 - DNA, 21 bp, Artificial sequence
  synthetic polynucleotide sequence
agtctgagccaggttacacca

SEQ ID NO: 36908 - DNA, 20 bp, Artificial sequence
  synthetic polynucleotide sequence
gtctgcgcagctggaaggta

SEQ ID NO: 36909 - DNA, 21 bp, Artificial sequence
  synthetic polynucleotide sequence
tgggagcacaagaggcccaca

SEQ ID NO: 36910 - DNA, 20 bp, Artificial sequence
  synthetic polynucleotide sequence
ccaggctcagtctgggcaca

SEQ ID NO: 36911 - DNA, 18 bp, Artificial sequence
  synthetic polynucleotide sequence
ggaacaccaatgccagca

SEQ ID NO: 36912 - DNA, 20 bp, Artificial sequence
  synthetic polynucleotide sequence
aagagggtccctgatagcca

SEQ ID NO: 36913 - DNA, 20 bp, Artificial sequence
  synthetic polynucleotide sequence
caaccatcatccgcccccca

SEQ ID NO: 36914 - DNA, 22 bp, Artificial sequence
  synthetic polynucleotide sequence
aaaaacctggtcctggaagcca

SEQ ID NO: 36915 - DNA, 21 bp, Artificial sequence
  synthetic polynucleotide sequence
gaacaacgtgaccctgggcaa

SEQ ID NO: 36916 - DNA, 19 bp, Artificial sequence
  synthetic polynucleotide sequence
cagcagcgcctcctcacga

SEQ ID NO: 36917 - DNA, 21 bp, Artificial sequence
  synthetic polynucleotide sequence
cagagaaggaagtgacgcgca

SEQ ID NO: 36918 - DNA, 21 bp, Artificial sequence
  synthetic polynucleotide sequence
aaggcgtaaccagggttggca

SEQ ID NO: 36919 - DNA, 21 bp, Artificial sequence
  synthetic polynucleotide sequence
ttgaacaacatctgcggggga

SEQ ID NO: 36920 - DNA, 20 bp, Artificial sequence
  synthetic polynucleotide sequence
cggagaccttcaagagccga

SEQ ID NO: 36921 - DNA, 19 bp, Artificial sequence
  synthetic polynucleotide sequence
gaacgggaggtgagccgca

SEQ ID NO: 36922 - DNA, 21 bp, Artificial sequence
  synthetic polynucleotide sequence
acaagccgtaagtccagccca

SEQ ID NO: 36923 - DNA, 21 bp, Artificial sequence
  synthetic polynucleotide sequence
tgtggactggaaatccaagga

SEQ ID NO: 36924 - DNA, 19 bp, Artificial sequence
  synthetic polynucleotide sequence
gctatgacacccaggggca

SEQ ID NO: 36925 - DNA, 20 bp, Artificial sequence
  synthetic polynucleotide sequence
ctgccaacagctgaagccga

SEQ ID NO: 36926 - DNA, 20 bp, Artificial sequence
  synthetic polynucleotide sequence
agacgcagagtgtgcacgca

SEQ ID NO: 36927 - DNA, 21 bp, Artificial sequence
  synthetic polynucleotide sequence
tcttgctcccaacggctgtga

SEQ ID NO: 36928 - DNA, 22 bp, Artificial sequence
  synthetic polynucleotide sequence
aaagctgaccacacagacacca

SEQ ID NO: 36929 - DNA, 20 bp, Artificial sequence
  synthetic polynucleotide sequence
caacctgcgtaggatcacca

SEQ ID NO: 36930 - DNA, 20 bp, Artificial sequence
  synthetic polynucleotide sequence
atagcctaaggcgatgcaga

SEQ ID NO: 36931 - DNA, 20 bp, Artificial sequence
  synthetic polynucleotide sequence
tcccgagagaaggaccggaa

SEQ ID NO: 36932 - DNA, 21 bp, Artificial sequence
  synthetic polynucleotide sequence
catccaggaaggcgtagagga

SEQ ID NO: 36933 - DNA, 18 bp, Artificial sequence
  synthetic polynucleotide sequence
gcctcaagagtgtccgca

SEQ ID NO: 36934 - DNA, 18 bp, Artificial sequence
  synthetic polynucleotide sequence
tgggagtccagcagacga

SEQ ID NO: 36935 - DNA, 19 bp, Artificial sequence
  synthetic polynucleotide sequence
ccagctgccaccacctcca

SEQ ID NO: 36936 - DNA, 20 bp, Artificial sequence
  synthetic polynucleotide sequence
gtggaactcgccctgggaca

SEQ ID NO: 36937 - DNA, 18 bp, Artificial sequence
  synthetic polynucleotide sequence
ctgcagccttcagggcaa

SEQ ID NO: 36938 - DNA, 18 bp, Artificial sequence
  synthetic polynucleotide sequence
ggttgccatccaggcgga

SEQ ID NO: 36939 - DNA, 18 bp, Artificial sequence
  synthetic polynucleotide sequence
cgaagacggaggcaggca

SEQ ID NO: 36940 - DNA, 18 bp, Artificial sequence
  synthetic polynucleotide sequence
gggcaggaatgaatcgga

SEQ ID NO: 36941 - DNA, 20 bp, Artificial sequence
  synthetic polynucleotide sequence
ctgccatcctcaagatccca

SEQ ID NO: 36942 - DNA, 21 bp, Artificial sequence
  synthetic polynucleotide sequence
ccttagagaccgtcctgctga

SEQ ID NO: 36943 - DNA, 21 bp, Artificial sequence
  synthetic polynucleotide sequence
ttctgtgagactcccccggta

SEQ ID NO: 36944 - DNA, 21 bp, Artificial sequence
  synthetic polynucleotide sequence
acagatgtgaggtgagaggca

SEQ ID NO: 36945 - DNA, 22 bp, Artificial sequence
  synthetic polynucleotide sequence
agctgaggggaaacatcaggca

SEQ ID NO: 36946 - DNA, 19 bp, Artificial sequence
  synthetic polynucleotide sequence
gagcccagggtcctgtgga

SEQ ID NO: 36947 - DNA, 21 bp, Artificial sequence
  synthetic polynucleotide sequence
tctacgccatcgtcggaacca

SEQ ID NO: 36948 - DNA, 21 bp, Artificial sequence
  synthetic polynucleotide sequence
aacaaggaggtgtgaggagca

SEQ ID NO: 36949 - DNA, 21 bp, Artificial sequence
  synthetic polynucleotide sequence
ctggctactcaccggaaacca

SEQ ID NO: 36950 - DNA, 22 bp, Artificial sequence
  synthetic polynucleotide sequence
gtaaaaccactcgccttcgcca

SEQ ID NO: 36951 - DNA, 20 bp, Artificial sequence
  synthetic polynucleotide sequence
tgtgggctgtggtacccaga

SEQ ID NO: 36952 - DNA, 21 bp, Artificial sequence
  synthetic polynucleotide sequence
gtccacagaaaggaagggcca

SEQ ID NO: 36953 - DNA, 21 bp, Artificial sequence
  synthetic polynucleotide sequence
ccttccgcagagacaaccaca

SEQ ID NO: 36954 - DNA, 20 bp, Artificial sequence
  synthetic polynucleotide sequence
gtcttcccccgacctgagga

SEQ ID NO: 36955 - DNA, 19 bp, Artificial sequence
  synthetic polynucleotide sequence
cccgctctccagactccca

SEQ ID NO: 36956 - DNA, 22 bp, Artificial sequence
  synthetic polynucleotide sequence
acaaatagccacgtagcggtca

SEQ ID NO: 36957 - DNA, 19 bp, Artificial sequence
  synthetic polynucleotide sequence
ctgggctcctacgggcgta

SEQ ID NO: 36958 - DNA, 19 bp, Artificial sequence
  synthetic polynucleotide sequence
cagagggtcagtggccgga

SEQ ID NO: 36959 - DNA, 18 bp, Artificial sequence
  synthetic polynucleotide sequence
tcggggtagtggccgcca

SEQ ID NO: 36960 - DNA, 19 bp, Artificial sequence
  synthetic polynucleotide sequence
tggagccagccctaaggta

SEQ ID NO: 36961 - DNA, 19 bp, Artificial sequence
  synthetic polynucleotide sequence
catggggctctccaggcca

SEQ ID NO: 36962 - DNA, 21 bp, Artificial sequence
  synthetic polynucleotide sequence
ctgttgtgtcagcacaggcca

SEQ ID NO: 36963 - DNA, 19 bp, Artificial sequence
  synthetic polynucleotide sequence
tgccctactgtggacccaa

SEQ ID NO: 36964 - DNA, 19 bp, Artificial sequence
  synthetic polynucleotide sequence
gcacaggccagtttcagga

SEQ ID NO: 36965 - DNA, 21 bp, Artificial sequence
  synthetic polynucleotide sequence
ccctgcgctacaacgtgctca

SEQ ID NO: 36966 - DNA, 21 bp, Artificial sequence
  synthetic polynucleotide sequence
ggcgaggtggaaaatggccga

SEQ ID NO: 36967 - DNA, 21 bp, Artificial sequence
  synthetic polynucleotide sequence
tacaacgtgctcatgagccca

SEQ ID NO: 36968 - DNA, 21 bp, Artificial sequence
  synthetic polynucleotide sequence
tacataccaagcccacgccca

SEQ ID NO: 36969 - DNA, 20 bp, Artificial sequence
  synthetic polynucleotide sequence
accatctgccacccactgca

SEQ ID NO: 36970 - DNA, 21 bp, Artificial sequence
  synthetic polynucleotide sequence
cacacaccagcatcacaccca

SEQ ID NO: 36971 - DNA, 20 bp, Artificial sequence
  synthetic polynucleotide sequence
ccgaaggccggcacaagaca

SEQ ID NO: 36972 - DNA, 21 bp, Artificial sequence
  synthetic polynucleotide sequence
ttgggctaaggaagggggtga

SEQ ID NO: 36973 - DNA, 19 bp, Artificial sequence
  synthetic polynucleotide sequence
ccgacctgctgtccaccca

SEQ ID NO: 36974 - DNA, 20 bp, Artificial sequence
  synthetic polynucleotide sequence
cacgtagcggtcgtagccca

SEQ ID NO: 36975 - DNA, 22 bp, Artificial sequence
  synthetic polynucleotide sequence
cctacctcaagcccaagtcaga

SEQ ID NO: 36976 - DNA, 19 bp, Artificial sequence
  synthetic polynucleotide sequence
tcccaccaacagccctgca

SEQ ID NO: 36977 - DNA, 21 bp, Artificial sequence
  synthetic polynucleotide sequence
cacccaaagctgtgccactca

SEQ ID NO: 36978 - DNA, 21 bp, Artificial sequence
  synthetic polynucleotide sequence
gcatcacagaatggcaggcca

SEQ ID NO: 36979 - DNA, 21 bp, Artificial sequence
  synthetic polynucleotide sequence
cctcacacctcacagtggtca

SEQ ID NO: 36980 - DNA, 22 bp, Artificial sequence
  synthetic polynucleotide sequence
tacaacagggttcagcagagga

SEQ ID NO: 36981 - DNA, 21 bp, Artificial sequence
  synthetic polynucleotide sequence
gccatctgcagacccctgaga

SEQ ID NO: 36982 - DNA, 20 bp, Artificial sequence
  synthetic polynucleotide sequence
cactgtgccacagaacggca

SEQ ID NO: 36983 - DNA, 21 bp, Artificial sequence
  synthetic polynucleotide sequence
ccactcctccaaccagctcca

SEQ ID NO: 36984 - DNA, 20 bp, Artificial sequence
  synthetic polynucleotide sequence
agatgggaggcacaggtgga

SEQ ID NO: 36985 - DNA, 22 bp, Artificial sequence
  synthetic polynucleotide sequence
ttcactctgggcaccaatgcaa

SEQ ID NO: 36986 - DNA, 22 bp, Artificial sequence
  synthetic polynucleotide sequence
aacatttggatggcacagccca

SEQ ID NO: 36987 - DNA, 20 bp, Artificial sequence
  synthetic polynucleotide sequence
tgggaagcacaggagcgaga

SEQ ID NO: 36988 - DNA, 20 bp, Artificial sequence
  synthetic polynucleotide sequence
tgctaggatggcacccagga

SEQ ID NO: 36989 - DNA, 20 bp, Artificial sequence
  synthetic polynucleotide sequence
accctcatcatgacccgcga

SEQ ID NO: 36990 - DNA, 21 bp, Artificial sequence
  synthetic polynucleotide sequence
tcagcacgaggatgctcacga

SEQ ID NO: 36991 - DNA, 19 bp, Artificial sequence
  synthetic polynucleotide sequence
cctcaccatggtcaccgaa

SEQ ID NO: 36992 - DNA, 20 bp, Artificial sequence
  synthetic polynucleotide sequence
atccaggtggatgacactga

SEQ ID NO: 36993 - DNA, 19 bp, Artificial sequence
  synthetic polynucleotide sequence
gggccataggtgccacgca

SEQ ID NO: 36994 - DNA, 20 bp, Artificial sequence
  synthetic polynucleotide sequence
aggacagggggtatgtcgca

SEQ ID NO: 36995 - DNA, 23 bp, Artificial sequence
  synthetic polynucleotide sequence
ataaacaaaaggctggggttgga

SEQ ID NO: 36996 - DNA, 23 bp, Artificial sequence
  synthetic polynucleotide sequence
gataacaggtgccatgtcacaga

SEQ ID NO: 36997 - DNA, 21 bp, Artificial sequence
  synthetic polynucleotide sequence
tgttgtcactgccactcacca

SEQ ID NO: 36998 - DNA, 22 bp, Artificial sequence
  synthetic polynucleotide sequence
aatgagagggggatgctaagga

SEQ ID NO: 36999 - DNA, 21 bp, Artificial sequence
  synthetic polynucleotide sequence
ctggccaacaccctacagtca

SEQ ID NO: 37000 - DNA, 22 bp, Artificial sequence
  synthetic polynucleotide sequence
tgaaggccaccagttgtaagga

SEQ ID NO: 37001 - DNA, 20 bp, Artificial sequence
  synthetic polynucleotide sequence
caggtccctccacaccccta

SEQ ID NO: 37002 - DNA, 20 bp, Artificial sequence
  synthetic polynucleotide sequence
agatggccaggaagcggtca

SEQ ID NO: 37003 - DNA, 19 bp, Artificial sequence
  synthetic polynucleotide sequence
ggcccgagtgagctgagga

SEQ ID NO: 37004 - DNA, 19 bp, Artificial sequence
  synthetic polynucleotide sequence
ttgggcctcaggtacacga

SEQ ID NO: 37005 - DNA, 21 bp, Artificial sequence
  synthetic polynucleotide sequence
cactccactacccactcctga

SEQ ID NO: 37006 - DNA, 18 bp, Artificial sequence
  synthetic polynucleotide sequence
ccgagcaagccaggccca

SEQ ID NO: 37007 - DNA, 21 bp, Artificial sequence
  synthetic polynucleotide sequence
gcactgggatcagagactcca

SEQ ID NO: 37008 - DNA, 21 bp, Artificial sequence
  synthetic polynucleotide sequence
tagaactggaggaagcagcca

SEQ ID NO: 37009 - DNA, 20 bp, Artificial sequence
  synthetic polynucleotide sequence
acccagggccacgatttgca

SEQ ID NO: 37010 - DNA, 20 bp, Artificial sequence
  synthetic polynucleotide sequence
gtccgagtcctgggctcaca

SEQ ID NO: 37011 - DNA, 22 bp, Artificial sequence
  synthetic polynucleotide sequence
tatgccttcaagcactgggaga

SEQ ID NO: 37012 - DNA, 20 bp, Artificial sequence
  synthetic polynucleotide sequence
gtccgagtcctgggctcaca

SEQ ID NO: 37013 - DNA, 21 bp, Artificial sequence
  synthetic polynucleotide sequence
tgccccagctcccataactga

SEQ ID NO: 37014 - DNA, 19 bp, Artificial sequence
  synthetic polynucleotide sequence
ttctccgaccagctgcaga

SEQ ID NO: 37015 - DNA, 18 bp, Artificial sequence
  synthetic polynucleotide sequence
ggcggctccacacaccca

SEQ ID NO: 37016 - DNA, 22 bp, Artificial sequence
  synthetic polynucleotide sequence
tgtaatggacgacagatggcca

SEQ ID NO: 37017 - DNA, 21 bp, Artificial sequence
  synthetic polynucleotide sequence
cagctggatggcaaaaggcca

SEQ ID NO: 37018 - DNA, 21 bp, Artificial sequence
  synthetic polynucleotide sequence
agttgccaggtgtgggactca

SEQ ID NO: 37019 - DNA, 18 bp, Artificial sequence
  synthetic polynucleotide sequence
cctcccgccactcatgca

SEQ ID NO: 37020 - DNA, 18 bp, Artificial sequence
  synthetic polynucleotide sequence
acagccaggtgggagcca

SEQ ID NO: 37021 - DNA, 22 bp, Artificial sequence
  synthetic polynucleotide sequence
atgctccgcaaagcactgtcca

SEQ ID NO: 37022 - DNA, 21 bp, Artificial sequence
  synthetic polynucleotide sequence
tccatggaggtccctgaggca

SEQ ID NO: 37023 - DNA, 20 bp, Artificial sequence
  synthetic polynucleotide sequence
ctctacggtgacactgccaa

SEQ ID NO: 37024 - DNA, 19 bp, Artificial sequence
  synthetic polynucleotide sequence
tacggagtgcagcagggca

SEQ ID NO: 37025 - DNA, 21 bp, Artificial sequence
  synthetic polynucleotide sequence
acaggcagcatatccatggga

SEQ ID NO: 37026 - DNA, 20 bp, Artificial sequence
  synthetic polynucleotide sequence
atgtgaagcccacaggtcca

SEQ ID NO: 37027 - DNA, 20 bp, Artificial sequence
  synthetic polynucleotide sequence
ctgcagctccacctacgtca

SEQ ID NO: 37028 - DNA, 22 bp, Artificial sequence
  synthetic polynucleotide sequence
gatgctggagacgatgaagcca

SEQ ID NO: 37029 - DNA, 19 bp, Artificial sequence
  synthetic polynucleotide sequence
tggccatggggacaacaga

SEQ ID NO: 37030 - DNA, 22 bp, Artificial sequence
  synthetic polynucleotide sequence
agctcctatgatccaggaccca

SEQ ID NO: 37031 - DNA, 22 bp, Artificial sequence
  synthetic polynucleotide sequence
gataccccatcatcctgagcaa

SEQ ID NO: 37032 - DNA, 20 bp, Artificial sequence
  synthetic polynucleotide sequence
agcacaggccagcttgagga

SEQ ID NO: 37033 - DNA, 21 bp, Artificial sequence
  synthetic polynucleotide sequence
actcggccacaggaagacaca

SEQ ID NO: 37034 - DNA, 21 bp, Artificial sequence
  synthetic polynucleotide sequence
aacatgggggtcacaacccca

SEQ ID NO: 37035 - DNA, 20 bp, Artificial sequence
  synthetic polynucleotide sequence
ctcttcggaggggagaagca

SEQ ID NO: 37036 - DNA, 23 bp, Artificial sequence
  synthetic polynucleotide sequence
catgaggaagatggtcccacaga

SEQ ID NO: 37037 - DNA, 20 bp, Artificial sequence
  synthetic polynucleotide sequence
actggaccgctatgtggcca

SEQ ID NO: 37038 - DNA, 21 bp, Artificial sequence
  synthetic polynucleotide sequence
actactgagtccacaagccca

SEQ ID NO: 37039 - DNA, 20 bp, Artificial sequence
  synthetic polynucleotide sequence
gcttggccatggggacaaca

SEQ ID NO: 37040 - DNA, 21 bp, Artificial sequence
  synthetic polynucleotide sequence
gacccaacagccatgggtaca

SEQ ID NO: 37041 - DNA, 21 bp, Artificial sequence
  synthetic polynucleotide sequence
gcaacccactgaggtactcca

SEQ ID NO: 37042 - DNA, 22 bp, Artificial sequence
  synthetic polynucleotide sequence
gacagcctatgatccaggacca

SEQ ID NO: 37043 - DNA, 20 bp, Artificial sequence
  synthetic polynucleotide sequence
aacgtgcacagcccacctga

SEQ ID NO: 37044 - DNA, 21 bp, Artificial sequence
  synthetic polynucleotide sequence
gtccggcatacaccaaagcca

SEQ ID NO: 37045 - DNA, 23 bp, Artificial sequence
  synthetic polynucleotide sequence
gcaagaggaaggccttctcaaca

SEQ ID NO: 37046 - DNA, 20 bp, Artificial sequence
  synthetic polynucleotide sequence
atagctggaagcagggcgga

SEQ ID NO: 37047 - DNA, 19 bp, Artificial sequence
  synthetic polynucleotide sequence
tggctttggccacagcaga

SEQ ID NO: 37048 - DNA, 21 bp, Artificial sequence
  synthetic polynucleotide sequence
gagcacaagtgatgtccccca

SEQ ID NO: 37049 - DNA, 21 bp, Artificial sequence
  synthetic polynucleotide sequence
ttcacctgcaagatcctggca

SEQ ID NO: 37050 - DNA, 21 bp, Artificial sequence
  synthetic polynucleotide sequence
tgaatgccaggggtacaggca

SEQ ID NO: 37051 - DNA, 20 bp, Artificial sequence
  synthetic polynucleotide sequence
atttcagtcacggctcccaa

SEQ ID NO: 37052 - DNA, 21 bp, Artificial sequence
  synthetic polynucleotide sequence
atcacagcaatcagaccccca

SEQ ID NO: 37053 - DNA, 21 bp, Artificial sequence
  synthetic polynucleotide sequence
ccctactggacagcaccacca

SEQ ID NO: 37054 - DNA, 21 bp, Artificial sequence
  synthetic polynucleotide sequence
ccacatagcggtcatgagcca

SEQ ID NO: 37055 - DNA, 22 bp, Artificial sequence
  synthetic polynucleotide sequence
cagagccgtgatgacatcagga

SEQ ID NO: 37056 - DNA, 21 bp, Artificial sequence
  synthetic polynucleotide sequence
gatctgcaaacgtgctcccga

SEQ ID NO: 37057 - DNA, 20 bp, Artificial sequence
  synthetic polynucleotide sequence
tcagctgagggccggaccaa

SEQ ID NO: 37058 - DNA, 22 bp, Artificial sequence
  synthetic polynucleotide sequence
caaggtccacagtcgatgagga

SEQ ID NO: 37059 - DNA, 22 bp, Artificial sequence
  synthetic polynucleotide sequence
ccatccctaagatgctggccaa

SEQ ID NO: 37060 - DNA, 21 bp, Artificial sequence
  synthetic polynucleotide sequence
tgtagtgaagtgggcggctga

SEQ ID NO: 37061 - DNA, 20 bp, Artificial sequence
  synthetic polynucleotide sequence
caccagtgctctcccccaca

SEQ ID NO: 37062 - DNA, 22 bp, Artificial sequence
  synthetic polynucleotide sequence
aaagagaaaacgccgaccccta

SEQ ID NO: 37063 - DNA, 18 bp, Artificial sequence
  synthetic polynucleotide sequence
gccgccgagcagtctcca

SEQ ID NO: 37064 - DNA, 20 bp, Artificial sequence
  synthetic polynucleotide sequence
ctgaagccaccatgtcctga

SEQ ID NO: 37065 - DNA, 21 bp, Artificial sequence
  synthetic polynucleotide sequence
tctactcagggcaagcagaga

SEQ ID NO: 37066 - DNA, 21 bp, Artificial sequence
  synthetic polynucleotide sequence
gctctcaggcatatgggggga

SEQ ID NO: 37067 - DNA, 22 bp, Artificial sequence
  synthetic polynucleotide sequence
acaatccccaagatgctggtga

SEQ ID NO: 37068 - DNA, 22 bp, Artificial sequence
  synthetic polynucleotide sequence
tcatatgccatcacagccagga

SEQ ID NO: 37069 - DNA, 22 bp, Artificial sequence
  synthetic polynucleotide sequence
acaatccccaagatgctggtga

SEQ ID NO: 37070 - DNA, 21 bp, Artificial sequence
  synthetic polynucleotide sequence
tggtcaggaggaaggtgagga

SEQ ID NO: 37071 - DNA, 20 bp, Artificial sequence
  synthetic polynucleotide sequence
atgcggactgcctgacccaa

SEQ ID NO: 37072 - DNA, 19 bp, Artificial sequence
  synthetic polynucleotide sequence
gcggtgtagtgcaggggga

SEQ ID NO: 37073 - DNA, 20 bp, Artificial sequence
  synthetic polynucleotide sequence
cctcctgcactacaccgcca

SEQ ID NO: 37074 - DNA, 20 bp, Artificial sequence
  synthetic polynucleotide sequence
gccagcttcagcagagcaga

SEQ ID NO: 37075 - DNA, 20 bp, Artificial sequence
  synthetic polynucleotide sequence
ctgctcagacacacacctca

SEQ ID NO: 37076 - DNA, 22 bp, Artificial sequence
  synthetic polynucleotide sequence
tagaagaggagaaccacagcca

SEQ ID NO: 37077 - DNA, 21 bp, Artificial sequence
  synthetic polynucleotide sequence
cgcaaaccatgagatcccaca

SEQ ID NO: 37078 - DNA, 21 bp, Artificial sequence
  synthetic polynucleotide sequence
atgagtcctgtgagaccccca

SEQ ID NO: 37079 - DNA, 20 bp, Artificial sequence
  synthetic polynucleotide sequence
cttacagcccacatccccca

SEQ ID NO: 37080 - DNA, 19 bp, Artificial sequence
  synthetic polynucleotide sequence
ttgccgatgagcttcccca

SEQ ID NO: 37081 - DNA, 20 bp, Artificial sequence
  synthetic polynucleotide sequence
ctgctcagacacctccctca

SEQ ID NO: 37082 - DNA, 21 bp, Artificial sequence
  synthetic polynucleotide sequence
atctggaggatggtgacccca

SEQ ID NO: 37083 - DNA, 21 bp, Artificial sequence
  synthetic polynucleotide sequence
acattggggccaccatcctga

SEQ ID NO: 37084 - DNA, 21 bp, Artificial sequence
  synthetic polynucleotide sequence
gtcgggaaaaggtactggcca

SEQ ID NO: 37085 - DNA, 21 bp, Artificial sequence
  synthetic polynucleotide sequence
actctcaccttcacaccccca

SEQ ID NO: 37086 - DNA, 19 bp, Artificial sequence
  synthetic polynucleotide sequence
ggtgtagcggagggggtga

SEQ ID NO: 37087 - DNA, 18 bp, Artificial sequence
  synthetic polynucleotide sequence
ggccacatcccgacgcga

SEQ ID NO: 37088 - DNA, 20 bp, Artificial sequence
  synthetic polynucleotide sequence
gtgccccctgtacatcgcga

SEQ ID NO: 37089 - DNA, 20 bp, Artificial sequence
  synthetic polynucleotide sequence
cactcgtctccagacgccca

SEQ ID NO: 37090 - DNA, 21 bp, Artificial sequence
  synthetic polynucleotide sequence
caatggccatggctgctagca

SEQ ID NO: 37091 - DNA, 21 bp, Artificial sequence
  synthetic polynucleotide sequence
ccatcaaccgctgtgtagcca

SEQ ID NO: 37092 - DNA, 22 bp, Artificial sequence
  synthetic polynucleotide sequence
caaaaggtgagccgattcacca

SEQ ID NO: 37093 - DNA, 21 bp, Artificial sequence
  synthetic polynucleotide sequence
cctactcactgcggtggggaa

SEQ ID NO: 37094 - DNA, 21 bp, Artificial sequence
  synthetic polynucleotide sequence
acatctggatcaggcagccca

SEQ ID NO: 37095 - DNA, 18 bp, Artificial sequence
  synthetic polynucleotide sequence
tcgaccggctggtggcca

SEQ ID NO: 37096 - DNA, 21 bp, Artificial sequence
  synthetic polynucleotide sequence
aagtagcacgcggaacaggga

SEQ ID NO: 37097 - DNA, 18 bp, Artificial sequence
  synthetic polynucleotide sequence
caccatgagccaccacca

SEQ ID NO: 37098 - DNA, 19 bp, Artificial sequence
  synthetic polynucleotide sequence
cagcacagggctgaggtca

SEQ ID NO: 37099 - DNA, 20 bp, Artificial sequence
  synthetic polynucleotide sequence
ggcagggatggtgatagcca

SEQ ID NO: 37100 - DNA, 21 bp, Artificial sequence
  synthetic polynucleotide sequence
gagggacacagatagacgcca

SEQ ID NO: 37101 - DNA, 21 bp, Artificial sequence
  synthetic polynucleotide sequence
tccacagtcatgaggccccaa

SEQ ID NO: 37102 - DNA, 21 bp, Artificial sequence
  synthetic polynucleotide sequence
cacagaaggacaaccgagcca

SEQ ID NO: 37103 - DNA, 22 bp, Artificial sequence
  synthetic polynucleotide sequence
agcttgcctgctcagataccca

SEQ ID NO: 37104 - DNA, 22 bp, Artificial sequence
  synthetic polynucleotide sequence
tagaagagcagaaccaccgtga

SEQ ID NO: 37105 - DNA, 21 bp, Artificial sequence
  synthetic polynucleotide sequence
cggtccccaagatgctgcaga

SEQ ID NO: 37106 - DNA, 21 bp, Artificial sequence
  synthetic polynucleotide sequence
cagcatggcatgaaggtggga

SEQ ID NO: 37107 - DNA, 21 bp, Artificial sequence
  synthetic polynucleotide sequence
ctgtgattgggaacgggctca

SEQ ID NO: 37108 - DNA, 20 bp, Artificial sequence
  synthetic polynucleotide sequence
gtcataggccatggtcccca

SEQ ID NO: 37109 - DNA, 18 bp, Artificial sequence
  synthetic polynucleotide sequence
tgcgggccaggttcggca

SEQ ID NO: 37110 - DNA, 21 bp, Artificial sequence
  synthetic polynucleotide sequence
acagtttgagcagaggggcca

SEQ ID NO: 37111 - DNA, 22 bp, Artificial sequence
  synthetic polynucleotide sequence
gactctagactgcacacaccca

SEQ ID NO: 37112 - DNA, 22 bp, Artificial sequence
  synthetic polynucleotide sequence
gccacataccgatcatagcaca

SEQ ID NO: 37113 - DNA, 21 bp, Artificial sequence
  synthetic polynucleotide sequence
tcctggccgccatcttgagga

SEQ ID NO: 37114 - DNA, 21 bp, Artificial sequence
  synthetic polynucleotide sequence
acttgggggccatgtacgtga

SEQ ID NO: 37115 - DNA, 22 bp, Artificial sequence
  synthetic polynucleotide sequence
aatcaacgagaggagcaggaga

SEQ ID NO: 37116 - DNA, 21 bp, Artificial sequence
  synthetic polynucleotide sequence
tggagggcgcccttcaactga

SEQ ID NO: 37117 - DNA, 21 bp, Artificial sequence
  synthetic polynucleotide sequence
acgggacaatcctggggctca

SEQ ID NO: 37118 - DNA, 21 bp, Artificial sequence
  synthetic polynucleotide sequence
atctgggtcatgcagccagca

SEQ ID NO: 37119 - DNA, 20 bp, Artificial sequence
  synthetic polynucleotide sequence
gccactccacaccaggacaa

SEQ ID NO: 37120 - DNA, 21 bp, Artificial sequence
  synthetic polynucleotide sequence
tgtgatccctagacagaggca

SEQ ID NO: 37121 - DNA, 18 bp, Artificial sequence
  synthetic polynucleotide sequence
tctggggagggccgcaga

SEQ ID NO: 37122 - DNA, 19 bp, Artificial sequence
  synthetic polynucleotide sequence
gctcctcaggatggcggga

SEQ ID NO: 37123 - DNA, 21 bp, Artificial sequence
  synthetic polynucleotide sequence
tcctggcggccatcttgagga

SEQ ID NO: 37124 - DNA, 18 bp, Artificial sequence
  synthetic polynucleotide sequence
ctcctcagggtggcggga

SEQ ID NO: 37125 - DNA, 21 bp, Artificial sequence
  synthetic polynucleotide sequence
tgggcctcggaaagtctacca

SEQ ID NO: 37126 - DNA, 21 bp, Artificial sequence
  synthetic polynucleotide sequence
taggagaagatgcaggcacca

SEQ ID NO: 37127 - DNA, 19 bp, Artificial sequence
  synthetic polynucleotide sequence
gggcccaggagatcaggca

SEQ ID NO: 37128 - DNA, 22 bp, Artificial sequence
  synthetic polynucleotide sequence
ggaatcaggaaggtcacaccca

SEQ ID NO: 37129 - DNA, 21 bp, Artificial sequence
  synthetic polynucleotide sequence
tcatggtggccacatcctgga

SEQ ID NO: 37130 - DNA, 21 bp, Artificial sequence
  synthetic polynucleotide sequence
cagcaagggtgggatctcaca

SEQ ID NO: 37131 - DNA, 21 bp, Artificial sequence
  synthetic polynucleotide sequence
cagtgcccaagatggcagtca

SEQ ID NO: 37132 - DNA, 20 bp, Artificial sequence
  synthetic polynucleotide sequence
gaaccactggcccatgcaca

SEQ ID NO: 37133 - DNA, 21 bp, Artificial sequence
  synthetic polynucleotide sequence
caccctgatgagtcagcagga

SEQ ID NO: 37134 - DNA, 22 bp, Artificial sequence
  synthetic polynucleotide sequence
atcactagcaccagagtgacca

SEQ ID NO: 37135 - DNA, 18 bp, Artificial sequence
  synthetic polynucleotide sequence
ccaccccccagaccctca

SEQ ID NO: 37136 - DNA, 21 bp, Artificial sequence
  synthetic polynucleotide sequence
tgatgcgaagcactgaggcca

SEQ ID NO: 37137 - DNA, 21 bp, Artificial sequence
  synthetic polynucleotide sequence
ctctgctacaccaccacgaca

SEQ ID NO: 37138 - DNA, 20 bp, Artificial sequence
  synthetic polynucleotide sequence
ccagccagtggaagactgca

SEQ ID NO: 37139 - DNA, 21 bp, Artificial sequence
  synthetic polynucleotide sequence
agttggcagctgcatcctgga

SEQ ID NO: 37140 - DNA, 21 bp, Artificial sequence
  synthetic polynucleotide sequence
acaacttgagcagagcaggga

SEQ ID NO: 37141 - DNA, 20 bp, Artificial sequence
  synthetic polynucleotide sequence
ctggccctaggtgctacaga

SEQ ID NO: 37142 - DNA, 21 bp, Artificial sequence
  synthetic polynucleotide sequence
ttgagaagtgcaggcacctca

SEQ ID NO: 37143 - DNA, 20 bp, Artificial sequence
  synthetic polynucleotide sequence
gtgtcacgcctggacaccaa

SEQ ID NO: 37144 - DNA, 21 bp, Artificial sequence
  synthetic polynucleotide sequence
actgagtaatggagaggccga

SEQ ID NO: 37145 - DNA, 20 bp, Artificial sequence
  synthetic polynucleotide sequence
ctctgcagaggggaggcgaa

SEQ ID NO: 37146 - DNA, 21 bp, Artificial sequence
  synthetic polynucleotide sequence
ctgttcttggccggaagcaga

SEQ ID NO: 37147 - DNA, 21 bp, Artificial sequence
  synthetic polynucleotide sequence
actcccaacttcacacaccca

SEQ ID NO: 37148 - DNA, 21 bp, Artificial sequence
  synthetic polynucleotide sequence
catcactgcaagaagggcgca

SEQ ID NO: 37149 - DNA, 20 bp, Artificial sequence
  synthetic polynucleotide sequence
ctgaccgtgcttggaaacca

SEQ ID NO: 37150 - DNA, 22 bp, Artificial sequence
  synthetic polynucleotide sequence
tcataggacatcactgccagca

SEQ ID NO: 37151 - DNA, 19 bp, Artificial sequence
  synthetic polynucleotide sequence
gccctgcgatactcggcca

SEQ ID NO: 37152 - DNA, 19 bp, Artificial sequence
  synthetic polynucleotide sequence
tctgcacatgggcagctga

SEQ ID NO: 37153 - DNA, 21 bp, Artificial sequence
  synthetic polynucleotide sequence
agtgatggcctatgaccgcca

SEQ ID NO: 37154 - DNA, 19 bp, Artificial sequence
  synthetic polynucleotide sequence
tgatggagccactgaccca

SEQ ID NO: 37155 - DNA, 21 bp, Artificial sequence
  synthetic polynucleotide sequence
ccatgccctgggatccactga

SEQ ID NO: 37156 - DNA, 20 bp, Artificial sequence
  synthetic polynucleotide sequence
atgagcacagggacctcgca

SEQ ID NO: 37157 - DNA, 20 bp, Artificial sequence
  synthetic polynucleotide sequence
ctggcactgggctccactga

SEQ ID NO: 37158 - DNA, 22 bp, Artificial sequence
  synthetic polynucleotide sequence
aactagccaaaccactgagcca

SEQ ID NO: 37159 - DNA, 20 bp, Artificial sequence
  synthetic polynucleotide sequence
accaccagtgttgccccaca

SEQ ID NO: 37160 - DNA, 20 bp, Artificial sequence
  synthetic polynucleotide sequence
ggaggtgatgaggccgctga

SEQ ID NO: 37161 - DNA, 21 bp, Artificial sequence
  synthetic polynucleotide sequence
ccttctgtccccaccagcaga

SEQ ID NO: 37162 - DNA, 21 bp, Artificial sequence
  synthetic polynucleotide sequence
gaccacagtgagatgggagga

SEQ ID NO: 37163 - DNA, 21 bp, Artificial sequence
  synthetic polynucleotide sequence
ccctggggacaactgagtgca

SEQ ID NO: 37164 - DNA, 21 bp, Artificial sequence
  synthetic polynucleotide sequence
accactgactccactagccca

SEQ ID NO: 37165 - DNA, 22 bp, Artificial sequence
  synthetic polynucleotide sequence
gatacccaggcaaatgagctga

SEQ ID NO: 37166 - DNA, 19 bp, Artificial sequence
  synthetic polynucleotide sequence
gctcagtacagcccgggca

SEQ ID NO: 37167 - DNA, 20 bp, Artificial sequence
  synthetic polynucleotide sequence
tgtggacatcgcctagtgga

SEQ ID NO: 37168 - DNA, 19 bp, Artificial sequence
  synthetic polynucleotide sequence
gctcagtacagcccgggca

SEQ ID NO: 37169 - DNA, 21 bp, Artificial sequence
  synthetic polynucleotide sequence
actcccatctgcacacaccaa

SEQ ID NO: 37170 - DNA, 21 bp, Artificial sequence
  synthetic polynucleotide sequence
agaaacgagggtgcatgagga

SEQ ID NO: 37171 - DNA, 19 bp, Artificial sequence
  synthetic polynucleotide sequence
tcacgccttaaaaccccca

SEQ ID NO: 37172 - DNA, 21 bp, Artificial sequence
  synthetic polynucleotide sequence
tcagcgggttacaaatggcca

SEQ ID NO: 37173 - DNA, 21 bp, Artificial sequence
  synthetic polynucleotide sequence
atcaactccttggcacacaca

SEQ ID NO: 37174 - DNA, 20 bp, Artificial sequence
  synthetic polynucleotide sequence
aataggactcggccacagga

SEQ ID NO: 37175 - DNA, 21 bp, Artificial sequence
  synthetic polynucleotide sequence
caacctgtagcacccacctca

SEQ ID NO: 37176 - DNA, 21 bp, Artificial sequence
  synthetic polynucleotide sequence
ggttgagcattggggtgagga

SEQ ID NO: 37177 - DNA, 22 bp, Artificial sequence
  synthetic polynucleotide sequence
actatcccatccgcatgagcaa

SEQ ID NO: 37178 - DNA, 21 bp, Artificial sequence
  synthetic polynucleotide sequence
cactgtgccctcatagaccca

SEQ ID NO: 37179 - DNA, 20 bp, Artificial sequence
  synthetic polynucleotide sequence
cagaagcgctgctcctgaca

SEQ ID NO: 37180 - DNA, 22 bp, Artificial sequence
  synthetic polynucleotide sequence
tgggatagtggagaggaaagca

SEQ ID NO: 37181 - DNA, 23 bp, Artificial sequence
  synthetic polynucleotide sequence
catgaaatctgcagaagggagga

SEQ ID NO: 37182 - DNA, 23 bp, Artificial sequence
  synthetic polynucleotide sequence
gatggtgtagaagacagccagaa

SEQ ID NO: 37183 - DNA, 21 bp, Artificial sequence
  synthetic polynucleotide sequence
gctccccaacacaggacaaga

SEQ ID NO: 37184 - DNA, 20 bp, Artificial sequence
  synthetic polynucleotide sequence
ggaggctgtagatgagggga

SEQ ID NO: 37185 - DNA, 22 bp, Artificial sequence
  synthetic polynucleotide sequence
tcatctgcaccactctacccaa

SEQ ID NO: 37186 - DNA, 22 bp, Artificial sequence
  synthetic polynucleotide sequence
aacattcagctccaagcaggga

SEQ ID NO: 37187 - DNA, 21 bp, Artificial sequence
  synthetic polynucleotide sequence
tcaatcacagccccacccaca

SEQ ID NO: 37188 - DNA, 22 bp, Artificial sequence
  synthetic polynucleotide sequence
gaaatggacttgctgccagaca

SEQ ID NO: 37189 - DNA, 22 bp, Artificial sequence
  synthetic polynucleotide sequence
tacctggatacccagctccaca

SEQ ID NO: 37190 - DNA, 19 bp, Artificial sequence
  synthetic polynucleotide sequence
tgtgtggcacagccagcca

SEQ ID NO: 37191 - DNA, 22 bp, Artificial sequence
  synthetic polynucleotide sequence
aaggactccatgggagcagaca

SEQ ID NO: 37192 - DNA, 21 bp, Artificial sequence
  synthetic polynucleotide sequence
ctcctcacagcagccttcaca

SEQ ID NO: 37193 - DNA, 21 bp, Artificial sequence
  synthetic polynucleotide sequence
accacaagccagcccaggaca

SEQ ID NO: 37194 - DNA, 20 bp, Artificial sequence
  synthetic polynucleotide sequence
aggacccttgaacctcccca

SEQ ID NO: 37195 - DNA, 23 bp, Artificial sequence
  synthetic polynucleotide sequence
ccagctggccaaagacaagacca

SEQ ID NO: 37196 - DNA, 20 bp, Artificial sequence
  synthetic polynucleotide sequence
cctgatgccaggaggagaca

SEQ ID NO: 37197 - DNA, 20 bp, Artificial sequence
  synthetic polynucleotide sequence
gaaactggcctgtgcagaca

SEQ ID NO: 37198 - DNA, 18 bp, Artificial sequence
  synthetic polynucleotide sequence
tgtggaaggactggggca

SEQ ID NO: 37199 - DNA, 20 bp, Artificial sequence
  synthetic polynucleotide sequence
tgcggtgcacacgagatcga

SEQ ID NO: 37200 - DNA, 21 bp, Artificial sequence
  synthetic polynucleotide sequence
aaaagagtcccaccacagcca

SEQ ID NO: 37201 - DNA, 18 bp, Artificial sequence
  synthetic polynucleotide sequence
tgctgagggccggcgcaa

SEQ ID NO: 37202 - DNA, 21 bp, Artificial sequence
  synthetic polynucleotide sequence
ggttgagcatgggggtgagga

SEQ ID NO: 37203 - DNA, 21 bp, Artificial sequence
  synthetic polynucleotide sequence
accacacccctgagcaggaca

SEQ ID NO: 37204 - DNA, 21 bp, Artificial sequence
  synthetic polynucleotide sequence
ttctgtagggcccctgtgaca

SEQ ID NO: 37205 - DNA, 21 bp, Artificial sequence
  synthetic polynucleotide sequence
caaccacactggaaggttgga

SEQ ID NO: 37206 - DNA, 21 bp, Artificial sequence
  synthetic polynucleotide sequence
tccagacaacgccttcaggaa

SEQ ID NO: 37207 - DNA, 22 bp, Artificial sequence
  synthetic polynucleotide sequence
atctccagctcatacaccctca

SEQ ID NO: 37208 - DNA, 22 bp, Artificial sequence
  synthetic polynucleotide sequence
tagaaggaagcaccgaagagca

SEQ ID NO: 37209 - DNA, 21 bp, Artificial sequence
  synthetic polynucleotide sequence
gccacccactccgatatccca

SEQ ID NO: 37210 - DNA, 21 bp, Artificial sequence
  synthetic polynucleotide sequence
tcagggtaacaacagcctgca

SEQ ID NO: 37211 - DNA, 22 bp, Artificial sequence
  synthetic polynucleotide sequence
atctccagctcatacaccctca

SEQ ID NO: 37212 - DNA, 20 bp, Artificial sequence
  synthetic polynucleotide sequence
gaaggaagcaccgaagagca

SEQ ID NO: 37213 - DNA, 21 bp, Artificial sequence
  synthetic polynucleotide sequence
cccccatgctcaacccactca

SEQ ID NO: 37214 - DNA, 21 bp, Artificial sequence
  synthetic polynucleotide sequence
ccttcctgatcacagtcgcca

SEQ ID NO: 37215 - DNA, 21 bp, Artificial sequence
  synthetic polynucleotide sequence
caaccacactggatggtcgga

SEQ ID NO: 37216 - DNA, 21 bp, Artificial sequence
  synthetic polynucleotide sequence
ttccagacaacgccatcagga

SEQ ID NO: 37217 - DNA, 20 bp, Artificial sequence
  synthetic polynucleotide sequence
tgaggcacccaccatgctga

SEQ ID NO: 37218 - DNA, 21 bp, Artificial sequence
  synthetic polynucleotide sequence
gtaggatgcagtcaccaccga

SEQ ID NO: 37219 - DNA, 21 bp, Artificial sequence
  synthetic polynucleotide sequence
acaggtccactaaccacgaca

SEQ ID NO: 37220 - DNA, 22 bp, Artificial sequence
  synthetic polynucleotide sequence
acgacttaaggccacacaccga

SEQ ID NO: 37221 - DNA, 21 bp, Artificial sequence
  synthetic polynucleotide sequence
cctggaaaaaagccctggcca

SEQ ID NO: 37222 - DNA, 21 bp, Artificial sequence
  synthetic polynucleotide sequence
tacatgaacatggctgcccca

SEQ ID NO: 37223 - DNA, 20 bp, Artificial sequence
  synthetic polynucleotide sequence
ctcccacctgacagctgtca

SEQ ID NO: 37224 - DNA, 21 bp, Artificial sequence
  synthetic polynucleotide sequence
atgagggggttgagcatggga

SEQ ID NO: 37225 - DNA, 21 bp, Artificial sequence
  synthetic polynucleotide sequence
cattggtgggtaacacagcca

SEQ ID NO: 37226 - DNA, 21 bp, Artificial sequence
  synthetic polynucleotide sequence
gaaggcactcaactgagccca

SEQ ID NO: 37227 - DNA, 19 bp, Artificial sequence
  synthetic polynucleotide sequence
ggcaccacgaggtggacca

SEQ ID NO: 37228 - DNA, 20 bp, Artificial sequence
  synthetic polynucleotide sequence
cagcacaacacccaccgcca

SEQ ID NO: 37229 - DNA, 21 bp, Artificial sequence
  synthetic polynucleotide sequence
agacaggtctcgcaatggcca

SEQ ID NO: 37230 - DNA, 21 bp, Artificial sequence
  synthetic polynucleotide sequence
gacttcaccctcagcactgca

SEQ ID NO: 37231 - DNA, 21 bp, Artificial sequence
  synthetic polynucleotide sequence
gctcagaggaggccagacaca

SEQ ID NO: 37232 - DNA, 20 bp, Artificial sequence
  synthetic polynucleotide sequence
tgtggactgtggtaggcgca

SEQ ID NO: 37233 - DNA, 20 bp, Artificial sequence
  synthetic polynucleotide sequence
atgcgactgggttcaaccaa

SEQ ID NO: 37234 - DNA, 19 bp, Artificial sequence
  synthetic polynucleotide sequence
gaccgcctccctgtgagca

SEQ ID NO: 37235 - DNA, 21 bp, Artificial sequence
  synthetic polynucleotide sequence
tccgttcagtggagggccgaa

SEQ ID NO: 37236 - DNA, 21 bp, Artificial sequence
  synthetic polynucleotide sequence
ctgaagcctcctctgaaccca

SEQ ID NO: 37237 - DNA, 19 bp, Artificial sequence
  synthetic polynucleotide sequence
ccgctctgctgagggcaga

SEQ ID NO: 37238 - DNA, 19 bp, Artificial sequence
  synthetic polynucleotide sequence
tccactgaacccagcctca

SEQ ID NO: 37239 - DNA, 21 bp, Artificial sequence
  synthetic polynucleotide sequence
ggctccgacacctgagtccaa

SEQ ID NO: 37240 - DNA, 18 bp, Artificial sequence
  synthetic polynucleotide sequence
ccagggactggctggcca

SEQ ID NO: 37241 - DNA, 21 bp, Artificial sequence
  synthetic polynucleotide sequence
ttccactgccatgtcacccaa

SEQ ID NO: 37242 - DNA, 22 bp, Artificial sequence
  synthetic polynucleotide sequence
aaacctccaatcatggccacca

SEQ ID NO: 37243 - DNA, 20 bp, Artificial sequence
  synthetic polynucleotide sequence
tgagaccctgggctcaccaa

SEQ ID NO: 37244 - DNA, 22 bp, Artificial sequence
  synthetic polynucleotide sequence
tcataggccatcaccaacagga

SEQ ID NO: 37245 - DNA, 20 bp, Artificial sequence
  synthetic polynucleotide sequence
ggtggtgggcaatggcctca

SEQ ID NO: 37246 - DNA, 21 bp, Artificial sequence
  synthetic polynucleotide sequence
tgagtcagacagccttccaga

SEQ ID NO: 37247 - DNA, 20 bp, Artificial sequence
  synthetic polynucleotide sequence
catgagccagcaggtctgca

SEQ ID NO: 37248 - DNA, 23 bp, Artificial sequence
  synthetic polynucleotide sequence
gaaaggcaatcttaaggccagga

SEQ ID NO: 37249 - DNA, 20 bp, Artificial sequence
  synthetic polynucleotide sequence
taccaccagccaggctctga

SEQ ID NO: 37250 - DNA, 21 bp, Artificial sequence
  synthetic polynucleotide sequence
agtcacaggccatcactgtca

SEQ ID NO: 37251 - DNA, 20 bp, Artificial sequence
  synthetic polynucleotide sequence
cccatcactgagatccccca

SEQ ID NO: 37252 - DNA, 20 bp, Artificial sequence
  synthetic polynucleotide sequence
atagtgcaagggcttgcaga

SEQ ID NO: 37253 - DNA, 19 bp, Artificial sequence
  synthetic polynucleotide sequence
gatgggggtagcctggaca

SEQ ID NO: 37254 - DNA, 22 bp, Artificial sequence
  synthetic polynucleotide sequence
cagagagagcaagatgacagca

SEQ ID NO: 37255 - DNA, 22 bp, Artificial sequence
  synthetic polynucleotide sequence
aagcccctgcactacatgacca

SEQ ID NO: 37256 - DNA, 21 bp, Artificial sequence
  synthetic polynucleotide sequence
ctcactgcacaaatggcccca

SEQ ID NO: 37257 - DNA, 21 bp, Artificial sequence
  synthetic polynucleotide sequence
ccatctgtaagcccctgcaca

SEQ ID NO: 37258 - DNA, 22 bp, Artificial sequence
  synthetic polynucleotide sequence
aaaccactgttggcaaccacca

SEQ ID NO: 37259 - DNA, 18 bp, Artificial sequence
  synthetic polynucleotide sequence
catcactggggtccccca

SEQ ID NO: 37260 - DNA, 18 bp, Artificial sequence
  synthetic polynucleotide sequence
gccctctgcacctccgaa

SEQ ID NO: 37261 - DNA, 20 bp, Artificial sequence
  synthetic polynucleotide sequence
ccatggcatgggtcggggga

SEQ ID NO: 37262 - DNA, 22 bp, Artificial sequence
  synthetic polynucleotide sequence
caatgacattggggccacagaa

SEQ ID NO: 37263 - DNA, 18 bp, Artificial sequence
  synthetic polynucleotide sequence
caaaggctgcctcaccca

SEQ ID NO: 37264 - DNA, 18 bp, Artificial sequence
  synthetic polynucleotide sequence
cccaagcccctcctacca

SEQ ID NO: 37265 - DNA, 20 bp, Artificial sequence
  synthetic polynucleotide sequence
ctcgggaaaggcaaggagga

SEQ ID NO: 37266 - DNA, 22 bp, Artificial sequence
  synthetic polynucleotide sequence
atgaagatcatggacaccacga

SEQ ID NO: 37267 - DNA, 20 bp, Artificial sequence
  synthetic polynucleotide sequence
cgggtcctcaaactggccca

SEQ ID NO: 37268 - DNA, 22 bp, Artificial sequence
  synthetic polynucleotide sequence
actatgtaggacaccaggagca

SEQ ID NO: 37269 - DNA, 20 bp, Artificial sequence
  synthetic polynucleotide sequence
cccccaggtcctcaaactca

SEQ ID NO: 37270 - DNA, 19 bp, Artificial sequence
  synthetic polynucleotide sequence
gcctgagacctcagcgtca

SEQ ID NO: 37271 - DNA, 20 bp, Artificial sequence
  synthetic polynucleotide sequence
ctgaggtcacatccagggga

SEQ ID NO: 37272 - DNA, 18 bp, Artificial sequence
  synthetic polynucleotide sequence
ggagtgaagggccgggca

SEQ ID NO: 37273 - DNA, 20 bp, Artificial sequence
  synthetic polynucleotide sequence
gctctcaggcaaccctacca

SEQ ID NO: 37274 - DNA, 22 bp, Artificial sequence
  synthetic polynucleotide sequence
gcaatgtagcggtcatacgcca

SEQ ID NO: 37275 - DNA, 20 bp, Artificial sequence
  synthetic polynucleotide sequence
tgtggccccaacacactgga

SEQ ID NO: 37276 - DNA, 21 bp, Artificial sequence
  synthetic polynucleotide sequence
ggaggaaccagagcagggtca

SEQ ID NO: 37277 - DNA, 20 bp, Artificial sequence
  synthetic polynucleotide sequence
tgtccactccatagcgcaga

SEQ ID NO: 37278 - DNA, 21 bp, Artificial sequence
  synthetic polynucleotide sequence
gtgaaggtgtcagtgcaggca

SEQ ID NO: 37279 - DNA, 19 bp, Artificial sequence
  synthetic polynucleotide sequence
cagctgaagggcgccggaa

SEQ ID NO: 37280 - DNA, 22 bp, Artificial sequence
  synthetic polynucleotide sequence
ggattcagcaaaggggtgacca

SEQ ID NO: 37281 - DNA, 19 bp, Artificial sequence
  synthetic polynucleotide sequence
tgcctgtaccaacacccaa

SEQ ID NO: 37282 - DNA, 21 bp, Artificial sequence
  synthetic polynucleotide sequence
gtgtgatgtgggagaaggcca

SEQ ID NO: 37283 - DNA, 20 bp, Artificial sequence
  synthetic polynucleotide sequence
tgttcctccacagctcccaa

SEQ ID NO: 37284 - DNA, 22 bp, Artificial sequence
  synthetic polynucleotide sequence
aaagccatggctatgagcagca

SEQ ID NO: 37285 - DNA, 20 bp, Artificial sequence
  synthetic polynucleotide sequence
tgagggttgcatggcccaga

SEQ ID NO: 37286 - DNA, 22 bp, Artificial sequence
  synthetic polynucleotide sequence
gctatccacctcattgggacca

SEQ ID NO: 37287 - DNA, 19 bp, Artificial sequence
  synthetic polynucleotide sequence
tcgctccttcacacaccaa

SEQ ID NO: 37288 - DNA, 22 bp, Artificial sequence
  synthetic polynucleotide sequence
aacatcatctcactcccaccca

SEQ ID NO: 37289 - DNA, 21 bp, Artificial sequence
  synthetic polynucleotide sequence
tgctgccggtagcacatccaa

SEQ ID NO: 37290 - DNA, 21 bp, Artificial sequence
  synthetic polynucleotide sequence
agaacctactgaaaggccgca

SEQ ID NO: 37291 - DNA, 19 bp, Artificial sequence
  synthetic polynucleotide sequence
gatgcctgcctggcccaga

SEQ ID NO: 37292 - DNA, 23 bp, Artificial sequence
  synthetic polynucleotide sequence
gaaatgaggacgagcacaacaca

SEQ ID NO: 37293 - DNA, 20 bp, Artificial sequence
  synthetic polynucleotide sequence
gagctgtaggatggaggcca

SEQ ID NO: 37294 - DNA, 21 bp, Artificial sequence
  synthetic polynucleotide sequence
accgagaagagggcaaagaga

SEQ ID NO: 37295 - DNA, 22 bp, Artificial sequence
  synthetic polynucleotide sequence
acaatggtgggtaacagcctca

SEQ ID NO: 37296 - DNA, 22 bp, Artificial sequence
  synthetic polynucleotide sequence
gaatatctgggtaaggcagcca

SEQ ID NO: 37297 - DNA, 22 bp, Artificial sequence
  synthetic polynucleotide sequence
atcatgagccgaaggacatgca

SEQ ID NO: 37298 - DNA, 21 bp, Artificial sequence
  synthetic polynucleotide sequence
atgtaagagtccaggcaggca

SEQ ID NO: 37299 - DNA, 21 bp, Artificial sequence
  synthetic polynucleotide sequence
ccactgccacaacacccaaga

SEQ ID NO: 37300 - DNA, 21 bp, Artificial sequence
  synthetic polynucleotide sequence
agagtcatctcagcaccccca

SEQ ID NO: 37301 - DNA, 20 bp, Artificial sequence
  synthetic polynucleotide sequence
cccagactcgggaggtccaa

SEQ ID NO: 37302 - DNA, 21 bp, Artificial sequence
  synthetic polynucleotide sequence
caaggagggccagattagcca

SEQ ID NO: 37303 - DNA, 21 bp, Artificial sequence
  synthetic polynucleotide sequence
tcccagactccagaggtccaa

SEQ ID NO: 37304 - DNA, 22 bp, Artificial sequence
  synthetic polynucleotide sequence
tcaaggaaggccagattagcca

SEQ ID NO: 37305 - DNA, 21 bp, Artificial sequence
  synthetic polynucleotide sequence
ctacagaggctgcatcactca

SEQ ID NO: 37306 - DNA, 21 bp, Artificial sequence
  synthetic polynucleotide sequence
aaggcaagcggaggatgagga

SEQ ID NO: 37307 - DNA, 21 bp, Artificial sequence
  synthetic polynucleotide sequence
catcaagctggcctgcaccaa

SEQ ID NO: 37308 - DNA, 22 bp, Artificial sequence
  synthetic polynucleotide sequence
aggatgactgcataggaggcca

SEQ ID NO: 37309 - DNA, 21 bp, Artificial sequence
  synthetic polynucleotide sequence
gacgcagcaaagctcttgcca

SEQ ID NO: 37310 - DNA, 22 bp, Artificial sequence
  synthetic polynucleotide sequence
gagagggttgaacatgggagca

SEQ ID NO: 37311 - DNA, 19 bp, Artificial sequence
  synthetic polynucleotide sequence
cgcccgctgcactacacca

SEQ ID NO: 37312 - DNA, 22 bp, Artificial sequence
  synthetic polynucleotide sequence
atggtctggacagtggagtgca

SEQ ID NO: 37313 - DNA, 20 bp, Artificial sequence
  synthetic polynucleotide sequence
cagtcatgaacccccagcta

SEQ ID NO: 37314 - DNA, 22 bp, Artificial sequence
  synthetic polynucleotide sequence
aagaagcagacaagagacagca

SEQ ID NO: 37315 - DNA, 21 bp, Artificial sequence
  synthetic polynucleotide sequence
agtcatctgaggaccggcgta

SEQ ID NO: 37316 - DNA, 22 bp, Artificial sequence
  synthetic polynucleotide sequence
aaagggttcagcaaaggtggca

SEQ ID NO: 37317 - DNA, 22 bp, Artificial sequence
  synthetic polynucleotide sequence
agaaagcagtcagcagaaggca

SEQ ID NO: 37318 - DNA, 22 bp, Artificial sequence
  synthetic polynucleotide sequence
gaaaaggtcgtatcagggcgca

SEQ ID NO: 37319 - DNA, 21 bp, Artificial sequence
  synthetic polynucleotide sequence
atggccatcatgaaccagcga

SEQ ID NO: 37320 - DNA, 20 bp, Artificial sequence
  synthetic polynucleotide sequence
gccacagaacgggagctgga

SEQ ID NO: 37321 - DNA, 21 bp, Artificial sequence
  synthetic polynucleotide sequence
gtaggaatagcatgggtggga

SEQ ID NO: 37322 - DNA, 21 bp, Artificial sequence
  synthetic polynucleotide sequence
taggatgctaagaggacccca

SEQ ID NO: 37323 - DNA, 21 bp, Artificial sequence
  synthetic polynucleotide sequence
tcctcaagactgtaccgggaa

SEQ ID NO: 37324 - DNA, 20 bp, Artificial sequence
  synthetic polynucleotide sequence
gggagagacatgcccggcaa

SEQ ID NO: 37325 - DNA, 21 bp, Artificial sequence
  synthetic polynucleotide sequence
caagacagagccctccttgca

SEQ ID NO: 37326 - DNA, 21 bp, Artificial sequence
  synthetic polynucleotide sequence
catgatcaggaggactgagga

SEQ ID NO: 37327 - DNA, 21 bp, Artificial sequence
  synthetic polynucleotide sequence
ccatcatgggcaactgcacca

SEQ ID NO: 37328 - DNA, 20 bp, Artificial sequence
  synthetic polynucleotide sequence
agggacaggcccatgtcaga

SEQ ID NO: 37329 - DNA, 21 bp, Artificial sequence
  synthetic polynucleotide sequence
tggaggcagctcatcactgga

SEQ ID NO: 37330 - DNA, 21 bp, Artificial sequence
  synthetic polynucleotide sequence
aagcctgtaggaagcagccca

SEQ ID NO: 37331 - DNA, 21 bp, Artificial sequence
  synthetic polynucleotide sequence
atcacagcctccatgagccca

SEQ ID NO: 37332 - DNA, 21 bp, Artificial sequence
  synthetic polynucleotide sequence
ccctctggtctagcagcagga

SEQ ID NO: 37333 - DNA, 20 bp, Artificial sequence
  synthetic polynucleotide sequence
caatgcccacggtgctggga

SEQ ID NO: 37334 - DNA, 22 bp, Artificial sequence
  synthetic polynucleotide sequence
aatcccctcatcagaactccca

SEQ ID NO: 37335 - DNA, 22 bp, Artificial sequence
  synthetic polynucleotide sequence
agctacagacctcggagtgaca

SEQ ID NO: 37336 - DNA, 19 bp, Artificial sequence
  synthetic polynucleotide sequence
tgtcaatacccgcacacca

SEQ ID NO: 37337 - DNA, 21 bp, Artificial sequence
  synthetic polynucleotide sequence
catttgccacccattgcgcca

SEQ ID NO: 37338 - DNA, 22 bp, Artificial sequence
  synthetic polynucleotide sequence
atgaagagagagtccacaccca

SEQ ID NO: 37339 - DNA, 18 bp, Artificial sequence
  synthetic polynucleotide sequence
ctgtcacccactgcgcca

SEQ ID NO: 37340 - DNA, 18 bp, Artificial sequence
  synthetic polynucleotide sequence
gtccaggccaatggcgga

SEQ ID NO: 37341 - DNA, 21 bp, Artificial sequence
  synthetic polynucleotide sequence
ttccaagtcagagcgggccaa

SEQ ID NO: 37342 - DNA, 22 bp, Artificial sequence
  synthetic polynucleotide sequence
agcagcaggtagatgtcaccca

SEQ ID NO: 37343 - DNA, 22 bp, Artificial sequence
  synthetic polynucleotide sequence
gaatggcacaaggtcttcagca

SEQ ID NO: 37344 - DNA, 21 bp, Artificial sequence
  synthetic polynucleotide sequence
tggggttgagcacagggggta

SEQ ID NO: 37345 - DNA, 22 bp, Artificial sequence
  synthetic polynucleotide sequence
ttcaacacctgcacatcccaca

SEQ ID NO: 37346 - DNA, 21 bp, Artificial sequence
  synthetic polynucleotide sequence
tagggttgagcacaggaggga

SEQ ID NO: 37347 - DNA, 21 bp, Artificial sequence
  synthetic polynucleotide sequence
tccaccgtcctgacacctgca

SEQ ID NO: 37348 - DNA, 22 bp, Artificial sequence
  synthetic polynucleotide sequence
agaaagatgagcagggagtcca

SEQ ID NO: 37349 - DNA, 19 bp, Artificial sequence
  synthetic polynucleotide sequence
ctgcgcaccgtgctgtcca

SEQ ID NO: 37350 - DNA, 21 bp, Artificial sequence
  synthetic polynucleotide sequence
acagagaggccaatcatggga

SEQ ID NO: 37351 - DNA, 21 bp, Artificial sequence
  synthetic polynucleotide sequence
caaggtggagccaagtctcca

SEQ ID NO: 37352 - DNA, 21 bp, Artificial sequence
  synthetic polynucleotide sequence
agatgctgagcatggagggca

SEQ ID NO: 37353 - DNA, 20 bp, Artificial sequence
  synthetic polynucleotide sequence
cacccccttccagccagcaa

SEQ ID NO: 37354 - DNA, 20 bp, Artificial sequence
  synthetic polynucleotide sequence
tgatgcagagcaggctccca

SEQ ID NO: 37355 - DNA, 22 bp, Artificial sequence
  synthetic polynucleotide sequence
acgcctcaaagctctcaacaca

SEQ ID NO: 37356 - DNA, 25 bp, Artificial sequence
  synthetic polynucleotide sequence
cacaggaggcacaaataggtacaca

SEQ ID NO: 37357 - DNA, 20 bp, Artificial sequence
  synthetic polynucleotide sequence
ctgcaagccatgatggccaa

SEQ ID NO: 37358 - DNA, 22 bp, Artificial sequence
  synthetic polynucleotide sequence
attcggacaatggcaccatgga

SEQ ID NO: 37359 - DNA, 20 bp, Artificial sequence
  synthetic polynucleotide sequence
agcagtgaatgacctgggga

SEQ ID NO: 37360 - DNA, 21 bp, Artificial sequence
  synthetic polynucleotide sequence
ggtagtgcagtggatggcaga

SEQ ID NO: 37361 - DNA, 20 bp, Artificial sequence
  synthetic polynucleotide sequence
tgtgtccacgttgcccacca

SEQ ID NO: 37362 - DNA, 18 bp, Artificial sequence
  synthetic polynucleotide sequence
tggccacaggtccccgga

SEQ ID NO: 37363 - DNA, 19 bp, Artificial sequence
  synthetic polynucleotide sequence
gagcgactccgtgccctca

SEQ ID NO: 37364 - DNA, 21 bp, Artificial sequence
  synthetic polynucleotide sequence
agtggagaggcatgcttggca

SEQ ID NO: 37365 - DNA, 20 bp, Artificial sequence
  synthetic polynucleotide sequence
tcactgccctgatgcccaca

SEQ ID NO: 37366 - DNA, 19 bp, Artificial sequence
  synthetic polynucleotide sequence
tggtgaggagcgctgggta

SEQ ID NO: 37367 - DNA, 21 bp, Artificial sequence
  synthetic polynucleotide sequence
gcctcttccactccaccccaa

SEQ ID NO: 37368 - DNA, 21 bp, Artificial sequence
  synthetic polynucleotide sequence
atcttcccctaagacccctca

SEQ ID NO: 37369 - DNA, 20 bp, Artificial sequence
  synthetic polynucleotide sequence
tcagacctgcatctcccaca

SEQ ID NO: 37370 - DNA, 18 bp, Artificial sequence
  synthetic polynucleotide sequence
aacgtgggccacggggga

SEQ ID NO: 37371 - DNA, 22 bp, Artificial sequence
  synthetic polynucleotide sequence
atcttcacccaccagcttgtca

SEQ ID NO: 37372 - DNA, 22 bp, Artificial sequence
  synthetic polynucleotide sequence
aatcctgctacagtgaaggcca

SEQ ID NO: 37373 - DNA, 18 bp, Artificial sequence
  synthetic polynucleotide sequence
tgacactcagggctgcca

SEQ ID NO: 37374 - DNA, 19 bp, Artificial sequence
  synthetic polynucleotide sequence
tcagtagccagcttcacga

SEQ ID NO: 37375 - DNA, 20 bp, Artificial sequence
  synthetic polynucleotide sequence
tctggccgtcatcacccgaa

SEQ ID NO: 37376 - DNA, 22 bp, Artificial sequence
  synthetic polynucleotide sequence
aaacgaaacactgctcggagga

SEQ ID NO: 37377 - DNA, 21 bp, Artificial sequence
  synthetic polynucleotide sequence
ttgtcctctccacgtgcacca

SEQ ID NO: 37378 - DNA, 20 bp, Artificial sequence
  synthetic polynucleotide sequence
gtggtcaaaggccatcacca

SEQ ID NO: 37379 - DNA, 20 bp, Artificial sequence
  synthetic polynucleotide sequence
gagcacatgggcattgccca

SEQ ID NO: 37380 - DNA, 20 bp, Artificial sequence
  synthetic polynucleotide sequence
gcggaagactgcttggagga

SEQ ID NO: 37381 - DNA, 21 bp, Artificial sequence
  synthetic polynucleotide sequence
caccgtgtcatgacacacaca

SEQ ID NO: 37382 - DNA, 20 bp, Artificial sequence
  synthetic polynucleotide sequence
ggaatccagtcccatggcca

SEQ ID NO: 37383 - DNA, 23 bp, Artificial sequence
  synthetic polynucleotide sequence
caatatagcgccatcctcaccaa

SEQ ID NO: 37384 - DNA, 21 bp, Artificial sequence
  synthetic polynucleotide sequence
catgattcccacagaagggca

SEQ ID NO: 37385 - DNA, 21 bp, Artificial sequence
  synthetic polynucleotide sequence
tgtccacatccactatcccca

SEQ ID NO: 37386 - DNA, 21 bp, Artificial sequence
  synthetic polynucleotide sequence
tgtactggagagggttgcaga

SEQ ID NO: 37387 - DNA, 21 bp, Artificial sequence
  synthetic polynucleotide sequence
gtctacggccaccattcccaa

SEQ ID NO: 37388 - DNA, 21 bp, Artificial sequence
  synthetic polynucleotide sequence
tacaagctcctcaggacagca

SEQ ID NO: 37389 - DNA, 21 bp, Artificial sequence
  synthetic polynucleotide sequence
gtctacagccaccatccccaa

SEQ ID NO: 37390 - DNA, 22 bp, Artificial sequence
  synthetic polynucleotide sequence
accatgtacaggctcctcagga

SEQ ID NO: 37391 - DNA, 21 bp, Artificial sequence
  synthetic polynucleotide sequence
acacgcatcataccccacaca

SEQ ID NO: 37392 - DNA, 22 bp, Artificial sequence
  synthetic polynucleotide sequence
acatgagaaccacaagtgccga

SEQ ID NO: 37393 - DNA, 19 bp, Artificial sequence
  synthetic polynucleotide sequence
cggcctggttggggcagga

SEQ ID NO: 37394 - DNA, 24 bp, Artificial sequence
  synthetic polynucleotide sequence
aggttggaatggtcaaagaggaca

SEQ ID NO: 37395 - DNA, 21 bp, Artificial sequence
  synthetic polynucleotide sequence
cctaagcacgtgtggcgctca

SEQ ID NO: 37396 - DNA, 21 bp, Artificial sequence
  synthetic polynucleotide sequence
tggggttgagagagggtggga

SEQ ID NO: 37397 - DNA, 20 bp, Artificial sequence
  synthetic polynucleotide sequence
cgaggcccagtgattgccca

SEQ ID NO: 37398 - DNA, 21 bp, Artificial sequence
  synthetic polynucleotide sequence
ctggagtgtaggtggacagga

SEQ ID NO: 37399 - DNA, 18 bp, Artificial sequence
  synthetic polynucleotide sequence
ccgccatgctgcccctca

SEQ ID NO: 37400 - DNA, 21 bp, Artificial sequence
  synthetic polynucleotide sequence
ctcccaagatgctctcacgga

SEQ ID NO: 37401 - DNA, 21 bp, Artificial sequence
  synthetic polynucleotide sequence
actgcacccaaagcccttgca

SEQ ID NO: 37402 - DNA, 19 bp, Artificial sequence
  synthetic polynucleotide sequence
gcgccctatgacccctgga

SEQ ID NO: 37403 - DNA, 21 bp, Artificial sequence
  synthetic polynucleotide sequence
aggcttaaaaccctggggaca

SEQ ID NO: 37404 - DNA, 23 bp, Artificial sequence
  synthetic polynucleotide sequence
ggagatagaagttggccagcaga

SEQ ID NO: 37405 - DNA, 20 bp, Artificial sequence
  synthetic polynucleotide sequence
taaagcctgcctcgcccaga

SEQ ID NO: 37406 - DNA, 21 bp, Artificial sequence
  synthetic polynucleotide sequence
tgaggatggtggcataacgca

SEQ ID NO: 37407 - DNA, 20 bp, Artificial sequence
  synthetic polynucleotide sequence
accaaccctgtcatcgccaa

SEQ ID NO: 37408 - DNA, 20 bp, Artificial sequence
  synthetic polynucleotide sequence
gggatgaagttcccccggca

SEQ ID NO: 37409 - DNA, 20 bp, Artificial sequence
  synthetic polynucleotide sequence
ctcagcagatgctcggcaga

SEQ ID NO: 37410 - DNA, 20 bp, Artificial sequence
  synthetic polynucleotide sequence
tgttccccaaagcggtggga

SEQ ID NO: 37411 - DNA, 21 bp, Artificial sequence
  synthetic polynucleotide sequence
ctgcaccaccactctacccaa

SEQ ID NO: 37412 - DNA, 22 bp, Artificial sequence
  synthetic polynucleotide sequence
atcagcaatacacccctcagga

SEQ ID NO: 37413 - DNA, 21 bp, Artificial sequence
  synthetic polynucleotide sequence
cactctagcatcctgacccca

SEQ ID NO: 37414 - DNA, 21 bp, Artificial sequence
  synthetic polynucleotide sequence
acaaagagcccattcccacga

SEQ ID NO: 37415 - DNA, 20 bp, Artificial sequence
  synthetic polynucleotide sequence
gccatcctggcagccacaga

SEQ ID NO: 37416 - DNA, 22 bp, Artificial sequence
  synthetic polynucleotide sequence
gaacatctggaccaggcacaca

SEQ ID NO: 37417 - DNA, 25 bp, Artificial sequence
  synthetic polynucleotide sequence
ggaggtaaaaccatccctcaccaca

SEQ ID NO: 37418 - DNA, 21 bp, Artificial sequence
  synthetic polynucleotide sequence
agcatagggggcactaacaca

SEQ ID NO: 37419 - DNA, 21 bp, Artificial sequence
  synthetic polynucleotide sequence
cctgagcacatgtggctccca

SEQ ID NO: 37420 - DNA, 22 bp, Artificial sequence
  synthetic polynucleotide sequence
tgatgaaggacgttcagcagga

SEQ ID NO: 37421 - DNA, 21 bp, Artificial sequence
  synthetic polynucleotide sequence
acaccaccctcctgatgacca

SEQ ID NO: 37422 - DNA, 20 bp, Artificial sequence
  synthetic polynucleotide sequence
agggaagctgatgggcctga

SEQ ID NO: 37423 - DNA, 21 bp, Artificial sequence
  synthetic polynucleotide sequence
acaccaccctcctgatcacca

SEQ ID NO: 37424 - DNA, 20 bp, Artificial sequence
  synthetic polynucleotide sequence
ctggaggaagcaggctggga

SEQ ID NO: 37425 - DNA, 22 bp, Artificial sequence
  synthetic polynucleotide sequence
aagggtgagggagatatggcca

SEQ ID NO: 37426 - DNA, 19 bp, Artificial sequence
  synthetic polynucleotide sequence
ggggttcagagctggggga

SEQ ID NO: 37427 - DNA, 19 bp, Artificial sequence
  synthetic polynucleotide sequence
gcagccaaggccctgagca

SEQ ID NO: 37428 - DNA, 19 bp, Artificial sequence
  synthetic polynucleotide sequence
gggttgagggaagggggga

SEQ ID NO: 37429 - DNA, 22 bp, Artificial sequence
  synthetic polynucleotide sequence
gcaatgtccaaggctctgagca

SEQ ID NO: 37430 - DNA, 20 bp, Artificial sequence
  synthetic polynucleotide sequence
acacgtcctgacccagtcca

SEQ ID NO: 37431 - DNA, 20 bp, Artificial sequence
  synthetic polynucleotide sequence
tgcaacacgtgtgcctcgca

SEQ ID NO: 37432 - DNA, 21 bp, Artificial sequence
  synthetic polynucleotide sequence
tgagagggttcagcatgggga

SEQ ID NO: 37433 - DNA, 20 bp, Artificial sequence
  synthetic polynucleotide sequence
tgtgggatggggctgactga

SEQ ID NO: 37434 - DNA, 20 bp, Artificial sequence
  synthetic polynucleotide sequence
atcagagcaggacagagcca

SEQ ID NO: 37435 - DNA, 22 bp, Artificial sequence
  synthetic polynucleotide sequence
atggtgggcaaccttggactga

SEQ ID NO: 37436 - DNA, 21 bp, Artificial sequence
  synthetic polynucleotide sequence
ggtgatgcactcagctaggga

SEQ ID NO: 37437 - DNA, 21 bp, Artificial sequence
  synthetic polynucleotide sequence
agtccccaagatgctctccaa

SEQ ID NO: 37438 - DNA, 22 bp, Artificial sequence
  synthetic polynucleotide sequence
aaagaagcagtgaggccagtca

SEQ ID NO: 37439 - DNA, 21 bp, Artificial sequence
  synthetic polynucleotide sequence
atctctgtctccacaccccca

SEQ ID NO: 37440 - DNA, 21 bp, Artificial sequence
  synthetic polynucleotide sequence
acacgagaactgggtagagca

SEQ ID NO: 37441 - DNA, 21 bp, Artificial sequence
  synthetic polynucleotide sequence
acactcagcttcacacaccca

SEQ ID NO: 37442 - DNA, 20 bp, Artificial sequence
  synthetic polynucleotide sequence
ctatagtggaggggtcgaca

SEQ ID NO: 37443 - DNA, 20 bp, Artificial sequence
  synthetic polynucleotide sequence
atgcagccatctgcaaccca

SEQ ID NO: 37444 - DNA, 22 bp, Artificial sequence
  synthetic polynucleotide sequence
atgacagcctgaatgtgaggca

SEQ ID NO: 37445 - DNA, 20 bp, Artificial sequence
  synthetic polynucleotide sequence
ggcaaacctgagccaaggga

SEQ ID NO: 37446 - DNA, 20 bp, Artificial sequence
  synthetic polynucleotide sequence
cagggtggcactcacatgga

SEQ ID NO: 37447 - DNA, 20 bp, Artificial sequence
  synthetic polynucleotide sequence
ctcctgtctccacaccccca

SEQ ID NO: 37448 - DNA, 22 bp, Artificial sequence
  synthetic polynucleotide sequence
tcataggccattgatgccagga

SEQ ID NO: 37449 - DNA, 20 bp, Artificial sequence
  synthetic polynucleotide sequence
tctgactgggaacctgggga

SEQ ID NO: 37450 - DNA, 21 bp, Artificial sequence
  synthetic polynucleotide sequence
aacatctgagcagcacaggca

SEQ ID NO: 37451 - DNA, 22 bp, Artificial sequence
  synthetic polynucleotide sequence
aaacccctacactacaccacca

SEQ ID NO: 37452 - DNA, 21 bp, Artificial sequence
  synthetic polynucleotide sequence
gacagagccatgactgctgga

SEQ ID NO: 37453 - DNA, 21 bp, Artificial sequence
  synthetic polynucleotide sequence
ggacaaggccatctcctacga

SEQ ID NO: 37454 - DNA, 21 bp, Artificial sequence
  synthetic polynucleotide sequence
cctgctgcatggatagaggca

SEQ ID NO: 37455 - DNA, 22 bp, Artificial sequence
  synthetic polynucleotide sequence
tgcagcagtgtgcaaaccccta

SEQ ID NO: 37456 - DNA, 21 bp, Artificial sequence
  synthetic polynucleotide sequence
tccccagtgtggatggaggca

SEQ ID NO: 37457 - DNA, 22 bp, Artificial sequence
  synthetic polynucleotide sequence
agctatgccctggacactgaca

SEQ ID NO: 37458 - DNA, 18 bp, Artificial sequence
  synthetic polynucleotide sequence
ggacccctgccctggaca

SEQ ID NO: 37459 - DNA, 22 bp, Artificial sequence
  synthetic polynucleotide sequence
tcagacccctatatcagccaga

SEQ ID NO: 37460 - DNA, 18 bp, Artificial sequence
  synthetic polynucleotide sequence
gggaggcacaggtggaga

SEQ ID NO: 37461 - DNA, 21 bp, Artificial sequence
  synthetic polynucleotide sequence
atacagtggccatgtcacaga

SEQ ID NO: 37462 - DNA, 20 bp, Artificial sequence
  synthetic polynucleotide sequence
gaaaagcagcaggtggggga

SEQ ID NO: 37463 - DNA, 21 bp, Artificial sequence
  synthetic polynucleotide sequence
ttgtatgcatggggagtcgca

SEQ ID NO: 37464 - DNA, 18 bp, Artificial sequence
  synthetic polynucleotide sequence
gcggtgcccactggctga

SEQ ID NO: 37465 - DNA, 22 bp, Artificial sequence
  synthetic polynucleotide sequence
aaccccaaactgcataccccca

SEQ ID NO: 37466 - DNA, 22 bp, Artificial sequence
  synthetic polynucleotide sequence
agcagagggttgcaaatggcca

SEQ ID NO: 37467 - DNA, 25 bp, Artificial sequence
  synthetic polynucleotide sequence
atggtcaacacaagccatgtcagca

SEQ ID NO: 37468 - DNA, 25 bp, Artificial sequence
  synthetic polynucleotide sequence
taggagtaggaggagaggatgacaa

SEQ ID NO: 37469 - DNA, 22 bp, Artificial sequence
  synthetic polynucleotide sequence
ttgcaatcagtgtaaccacgga

SEQ ID NO: 37470 - DNA, 21 bp, Artificial sequence
  synthetic polynucleotide sequence
aatagccggatgcacagtcca

SEQ ID NO: 37471 - DNA, 20 bp, Artificial sequence
  synthetic polynucleotide sequence
atcatccacagtgaccccaa

SEQ ID NO: 37472 - DNA, 21 bp, Artificial sequence
  synthetic polynucleotide sequence
aatagccggatgcacagtcca

SEQ ID NO: 37473 - DNA, 22 bp, Artificial sequence
  synthetic polynucleotide sequence
cgaatgaggacatggaacagga

SEQ ID NO: 37474 - DNA, 22 bp, Artificial sequence
  synthetic polynucleotide sequence
gcaatcagaccaaggttccaca

SEQ ID NO: 37475 - DNA, 21 bp, Artificial sequence
  synthetic polynucleotide sequence
acatacggcagctcagtggaa

SEQ ID NO: 37476 - DNA, 20 bp, Artificial sequence
  synthetic polynucleotide sequence
tacaggtagctgggccgtga

SEQ ID NO: 37477 - DNA, 22 bp, Artificial sequence
  synthetic polynucleotide sequence
acctccaaactccacacaccca

SEQ ID NO: 37478 - DNA, 22 bp, Artificial sequence
  synthetic polynucleotide sequence
agcaagggactcacaatggcca

SEQ ID NO: 37479 - DNA, 20 bp, Artificial sequence
  synthetic polynucleotide sequence
ccgtcggcttcacacaccaa

SEQ ID NO: 37480 - DNA, 22 bp, Artificial sequence
  synthetic polynucleotide sequence
taatagcacaggcacagcaaga

SEQ ID NO: 37481 - DNA, 21 bp, Artificial sequence
  synthetic polynucleotide sequence
tctgatcaccgtggtggggaa

SEQ ID NO: 37482 - DNA, 21 bp, Artificial sequence
  synthetic polynucleotide sequence
caggcacagcaagaatccaca

SEQ ID NO: 37483 - DNA, 22 bp, Artificial sequence
  synthetic polynucleotide sequence
gagcaacgtcttcacacaccaa

SEQ ID NO: 37484 - DNA, 20 bp, Artificial sequence
  synthetic polynucleotide sequence
cataggccattgccgccaga

SEQ ID NO: 37485 - DNA, 21 bp, Artificial sequence
  synthetic polynucleotide sequence
tctggtcaccatggtggggaa

SEQ ID NO: 37486 - DNA, 21 bp, Artificial sequence
  synthetic polynucleotide sequence
tcataggccattgtcgccaga

SEQ ID NO: 37487 - DNA, 18 bp, Artificial sequence
  synthetic polynucleotide sequence
ctcggctccacaccccca

SEQ ID NO: 37488 - DNA, 20 bp, Artificial sequence
  synthetic polynucleotide sequence
cacacgcaccttccaagaca

SEQ ID NO: 37489 - DNA, 19 bp, Artificial sequence
  synthetic polynucleotide sequence
gcctcccacctcacagcca

SEQ ID NO: 37490 - DNA, 21 bp, Artificial sequence
  synthetic polynucleotide sequence
ctgtgtagaacacggtggcca

SEQ ID NO: 37491 - DNA, 19 bp, Artificial sequence
  synthetic polynucleotide sequence
tcccacctgcaaacaccca

SEQ ID NO: 37492 - DNA, 21 bp, Artificial sequence
  synthetic polynucleotide sequence
actcagtgatcaccagggcga

SEQ ID NO: 37493 - DNA, 22 bp, Artificial sequence
  synthetic polynucleotide sequence
caggaccaattcccaactgcaa

SEQ ID NO: 37494 - DNA, 22 bp, Artificial sequence
  synthetic polynucleotide sequence
aactcagtgatcactagggcga

SEQ ID NO: 37495 - DNA, 20 bp, Artificial sequence
  synthetic polynucleotide sequence
ctctcgccttcacacgccca

SEQ ID NO: 37496 - DNA, 21 bp, Artificial sequence
  synthetic polynucleotide sequence
acactgtagcgcagagggtca

SEQ ID NO: 37497 - DNA, 20 bp, Artificial sequence
  synthetic polynucleotide sequence
cgctcagcagaaggaaggca

SEQ ID NO: 37498 - DNA, 25 bp, Artificial sequence
  synthetic polynucleotide sequence
actgtggtatagaacacagccacca

SEQ ID NO: 37499 - DNA, 20 bp, Artificial sequence
  synthetic polynucleotide sequence
atggtcacggtggcagggaa

SEQ ID NO: 37500 - DNA, 22 bp, Artificial sequence
  synthetic polynucleotide sequence
gtaacactgcacaagacaggca

SEQ ID NO: 37501 - DNA, 21 bp, Artificial sequence
  synthetic polynucleotide sequence
ctcctccaacgttacccccaa

SEQ ID NO: 37502 - DNA, 22 bp, Artificial sequence
  synthetic polynucleotide sequence
ataaggcacagagatgagccga

SEQ ID NO: 37503 - DNA, 21 bp, Artificial sequence
  synthetic polynucleotide sequence
ggcaccacaaggccttctcca

SEQ ID NO: 37504 - DNA, 21 bp, Artificial sequence
  synthetic polynucleotide sequence
atcagggggttcaacatggga

SEQ ID NO: 37505 - DNA, 21 bp, Artificial sequence
  synthetic polynucleotide sequence
cctcccacctcactgcagtca

SEQ ID NO: 37506 - DNA, 21 bp, Artificial sequence
  synthetic polynucleotide sequence
atcagggggttcaacatggga

SEQ ID NO: 37507 - DNA, 22 bp, Artificial sequence
  synthetic polynucleotide sequence
gatactcgactccacacaccta

SEQ ID NO: 37508 - DNA, 21 bp, Artificial sequence
  synthetic polynucleotide sequence
gcaggggactacagatggcga

SEQ ID NO: 37509 - DNA, 21 bp, Artificial sequence
  synthetic polynucleotide sequence
tcagtgagcatgtcacccaga

SEQ ID NO: 37510 - DNA, 23 bp, Artificial sequence
  synthetic polynucleotide sequence
gaaggacaggctaaatgtagcca

SEQ ID NO: 37511 - DNA, 22 bp, Artificial sequence
  synthetic polynucleotide sequence
atgtggagctcacctaactgga

SEQ ID NO: 37512 - DNA, 21 bp, Artificial sequence
  synthetic polynucleotide sequence
atgacgggattcagcaaggga

SEQ ID NO: 37513 - DNA, 20 bp, Artificial sequence
  synthetic polynucleotide sequence
cagtgagcatgtcacccaga

SEQ ID NO: 37514 - DNA, 22 bp, Artificial sequence
  synthetic polynucleotide sequence
gaaatagcaaggagaggaggca

SEQ ID NO: 37515 - DNA, 21 bp, Artificial sequence
  synthetic polynucleotide sequence
tgtgactgatccacacctgca

SEQ ID NO: 37516 - DNA, 23 bp, Artificial sequence
  synthetic polynucleotide sequence
aaaaagttgaaccacacacccca

SEQ ID NO: 37517 - DNA, 21 bp, Artificial sequence
  synthetic polynucleotide sequence
ttctactgcaactgggcccaa

SEQ ID NO: 37518 - DNA, 22 bp, Artificial sequence
  synthetic polynucleotide sequence
tcaaaggccatcactgacagca

SEQ ID NO: 37519 - DNA, 21 bp, Artificial sequence
  synthetic polynucleotide sequence
ttggtgctgactgagaacaca

SEQ ID NO: 37520 - DNA, 20 bp, Artificial sequence
  synthetic polynucleotide sequence
gacacactcagtgcagccca

SEQ ID NO: 37521 - DNA, 21 bp, Artificial sequence
  synthetic polynucleotide sequence
gcccactccactacccaacca

SEQ ID NO: 37522 - DNA, 23 bp, Artificial sequence
  synthetic polynucleotide sequence
gaataggaagatgaccagtgcca

SEQ ID NO: 37523 - DNA, 18 bp, Artificial sequence
  synthetic polynucleotide sequence
tgcgcatcccctcggcca

SEQ ID NO: 37524 - DNA, 20 bp, Artificial sequence
  synthetic polynucleotide sequence
atcaatggcttggggccgga

SEQ ID NO: 37525 - DNA, 20 bp, Artificial sequence
  synthetic polynucleotide sequence
gaatgtcaccagggtcggca

SEQ ID NO: 37526 - DNA, 20 bp, Artificial sequence
  synthetic polynucleotide sequence
gctgctccagacggtgagga

SEQ ID NO: 37527 - DNA, 20 bp, Artificial sequence
  synthetic polynucleotide sequence
gcttaggcctccagctcgaa

SEQ ID NO: 37528 - DNA, 21 bp, Artificial sequence
  synthetic polynucleotide sequence
taggagaggacctgcatcaca

SEQ ID NO: 37529 - DNA, 21 bp, Artificial sequence
  synthetic polynucleotide sequence
actcccatctgcagacaccta

SEQ ID NO: 37530 - DNA, 22 bp, Artificial sequence
  synthetic polynucleotide sequence
atagcggtcataggacatggca

SEQ ID NO: 37531 - DNA, 18 bp, Artificial sequence
  synthetic polynucleotide sequence
cccacctccagaccccca

SEQ ID NO: 37532 - DNA, 22 bp, Artificial sequence
  synthetic polynucleotide sequence
tcataagacatggaggccagga

SEQ ID NO: 37533 - DNA, 19 bp, Artificial sequence
  synthetic polynucleotide sequence
ccccggctcaagacgccaa

SEQ ID NO: 37534 - DNA, 22 bp, Artificial sequence
  synthetic polynucleotide sequence
gcaacgtagcggtcataggaca

SEQ ID NO: 37535 - DNA, 22 bp, Artificial sequence
  synthetic polynucleotide sequence
gatccccacctgaaaacaccca

SEQ ID NO: 37536 - DNA, 20 bp, Artificial sequence
  synthetic polynucleotide sequence
tgcagatggccacatagcga

SEQ ID NO: 37537 - DNA, 22 bp, Artificial sequence
  synthetic polynucleotide sequence
aaacccctgcattacaccacca

SEQ ID NO: 37538 - DNA, 21 bp, Artificial sequence
  synthetic polynucleotide sequence
tgtctgtgcaagagagctgca

SEQ ID NO: 37539 - DNA, 21 bp, Artificial sequence
  synthetic polynucleotide sequence
gacaagtgacccacagtggca

SEQ ID NO: 37540 - DNA, 25 bp, Artificial sequence
  synthetic polynucleotide sequence
caaggaatctgggaatgcagacaga

SEQ ID NO: 37541 - DNA, 22 bp, Artificial sequence
  synthetic polynucleotide sequence
gagaatcccctcagcacagcaa

SEQ ID NO: 37542 - DNA, 22 bp, Artificial sequence
  synthetic polynucleotide sequence
gattcagcataggagcgacaga

SEQ ID NO: 37543 - DNA, 21 bp, Artificial sequence
  synthetic polynucleotide sequence
tactggggagaagtcagacca

SEQ ID NO: 37544 - DNA, 18 bp, Artificial sequence
  synthetic polynucleotide sequence
tggcacgggggccacaga

SEQ ID NO: 37545 - DNA, 20 bp, Artificial sequence
  synthetic polynucleotide sequence
tggactgcagcggtgactga

SEQ ID NO: 37546 - DNA, 18 bp, Artificial sequence
  synthetic polynucleotide sequence
ggtgtggaggcgggagca

SEQ ID NO: 37547 - DNA, 21 bp, Artificial sequence
  synthetic polynucleotide sequence
cagacacacgagccatcgtca

SEQ ID NO: 37548 - DNA, 20 bp, Artificial sequence
  synthetic polynucleotide sequence
tgcggcggcctccagctgaa

SEQ ID NO: 37549 - DNA, 18 bp, Artificial sequence
  synthetic polynucleotide sequence
cccatctccacaacccca

SEQ ID NO: 37550 - DNA, 20 bp, Artificial sequence
  synthetic polynucleotide sequence
atagcgaagagggttgcaga

SEQ ID NO: 37551 - DNA, 21 bp, Artificial sequence
  synthetic polynucleotide sequence
gatgccatccatgcagcggaa

SEQ ID NO: 37552 - DNA, 21 bp, Artificial sequence
  synthetic polynucleotide sequence
aacacagcaaggtgagcagca

SEQ ID NO: 37553 - DNA, 21 bp, Artificial sequence
  synthetic polynucleotide sequence
acccactgcactacacggtca

SEQ ID NO: 37554 - DNA, 21 bp, Artificial sequence
  synthetic polynucleotide sequence
tagtgaatgccagggagctca

SEQ ID NO: 37555 - DNA, 18 bp, Artificial sequence
  synthetic polynucleotide sequence
ggaggcttggctgggcca

SEQ ID NO: 37556 - DNA, 22 bp, Artificial sequence
  synthetic polynucleotide sequence
gcaagccaaactcagcacagga

SEQ ID NO: 37557 - DNA, 21 bp, Artificial sequence
  synthetic polynucleotide sequence
gaccaccacactctgtgccaa

SEQ ID NO: 37558 - DNA, 21 bp, Artificial sequence
  synthetic polynucleotide sequence
tgtccttgcaggccaagctca

SEQ ID NO: 37559 - DNA, 20 bp, Artificial sequence
  synthetic polynucleotide sequence
ggatccctacgtccagggga

SEQ ID NO: 37560 - DNA, 22 bp, Artificial sequence
  synthetic polynucleotide sequence
gtgcataggtgaagagagtgga

SEQ ID NO: 37561 - DNA, 19 bp, Artificial sequence
  synthetic polynucleotide sequence
gtgtcctggggcacctgca

SEQ ID NO: 37562 - DNA, 22 bp, Artificial sequence
  synthetic polynucleotide sequence
gcaatgaccatagaggaggcca

SEQ ID NO: 37563 - DNA, 20 bp, Artificial sequence
  synthetic polynucleotide sequence
ctgtggacactaactgggca

SEQ ID NO: 37564 - DNA, 22 bp, Artificial sequence
  synthetic polynucleotide sequence
agattccctaaaacgcctgcca

SEQ ID NO: 37565 - DNA, 22 bp, Artificial sequence
  synthetic polynucleotide sequence
atgagaccctgatgaatggcca

SEQ ID NO: 37566 - DNA, 21 bp, Artificial sequence
  synthetic polynucleotide sequence
aggtcagagccagtgagccca

SEQ ID NO: 37567 - DNA, 21 bp, Artificial sequence
  synthetic polynucleotide sequence
acttgcgggtctcacctcaca

SEQ ID NO: 37568 - DNA, 21 bp, Artificial sequence
  synthetic polynucleotide sequence
ccaaggccacgaccttcctga

SEQ ID NO: 37569 - DNA, 21 bp, Artificial sequence
  synthetic polynucleotide sequence
accccaccatcatgaccagca

SEQ ID NO: 37570 - DNA, 22 bp, Artificial sequence
  synthetic polynucleotide sequence
atggttgctatgacgcccagga

SEQ ID NO: 37571 - DNA, 21 bp, Artificial sequence
  synthetic polynucleotide sequence
accaaccagctctgtggcaca

SEQ ID NO: 37572 - DNA, 20 bp, Artificial sequence
  synthetic polynucleotide sequence
gtggcaaggatagcagcgta

SEQ ID NO: 37573 - DNA, 25 bp, Artificial sequence
  synthetic polynucleotide sequence
ctggtgaacatccagacacacaaca

SEQ ID NO: 37574 - DNA, 21 bp, Artificial sequence
  synthetic polynucleotide sequence
gatgccagaaccagcagtcca

SEQ ID NO: 37575 - DNA, 22 bp, Artificial sequence
  synthetic polynucleotide sequence
agctcaggggaagtacaaggca

SEQ ID NO: 37576 - DNA, 20 bp, Artificial sequence
  synthetic polynucleotide sequence
gttcagcatgggggtggcca

SEQ ID NO: 37577 - DNA, 22 bp, Artificial sequence
  synthetic polynucleotide sequence
caatctcatcagctcaggggaa

SEQ ID NO: 37578 - DNA, 20 bp, Artificial sequence
  synthetic polynucleotide sequence
gtgagttgcgggtggcagca

SEQ ID NO: 37579 - DNA, 21 bp, Artificial sequence
  synthetic polynucleotide sequence
ctcagttctgcagccacacca

SEQ ID NO: 37580 - DNA, 21 bp, Artificial sequence
  synthetic polynucleotide sequence
ccctactgaggagtctcccca

SEQ ID NO: 37581 - DNA, 18 bp, Artificial sequence
  synthetic polynucleotide sequence
cccacctccacaccccca

SEQ ID NO: 37582 - DNA, 21 bp, Artificial sequence
  synthetic polynucleotide sequence
tgtagtgcagggggtaacaga

SEQ ID NO: 37583 - DNA, 21 bp, Artificial sequence
  synthetic polynucleotide sequence
ttctggacacgctactcctga

SEQ ID NO: 37584 - DNA, 22 bp, Artificial sequence
  synthetic polynucleotide sequence
aggaaggtatcagagcaggcca

SEQ ID NO: 37585 - DNA, 21 bp, Artificial sequence
  synthetic polynucleotide sequence
cctccaccaagggcaagtaca

SEQ ID NO: 37586 - DNA, 22 bp, Artificial sequence
  synthetic polynucleotide sequence
gaatgggtcacagcagaactca

SEQ ID NO: 37587 - DNA, 22 bp, Artificial sequence
  synthetic polynucleotide sequence
tatgaaggctgcctgactcaga

SEQ ID NO: 37588 - DNA, 19 bp, Artificial sequence
  synthetic polynucleotide sequence
tcggtagtgcagggggtga

SEQ ID NO: 37589 - DNA, 20 bp, Artificial sequence
  synthetic polynucleotide sequence
cacaggctgcctcacccaga

SEQ ID NO: 37590 - DNA, 21 bp, Artificial sequence
  synthetic polynucleotide sequence
gtgtacctcagtgggtggcaa

SEQ ID NO: 37591 - DNA, 25 bp, Artificial sequence
  synthetic polynucleotide sequence
atgccatcagcaagtggaaagcaca

SEQ ID NO: 37592 - DNA, 22 bp, Artificial sequence
  synthetic polynucleotide sequence
aaacctgccccatagaacaaga

SEQ ID NO: 37593 - DNA, 20 bp, Artificial sequence
  synthetic polynucleotide sequence
acacaggctgcctcacccaa

SEQ ID NO: 37594 - DNA, 25 bp, Artificial sequence
  synthetic polynucleotide sequence
catccaggacactaacgatgaagga

SEQ ID NO: 37595 - DNA, 21 bp, Artificial sequence
  synthetic polynucleotide sequence
ctacgcagggtgcatgtcaca

SEQ ID NO: 37596 - DNA, 22 bp, Artificial sequence
  synthetic polynucleotide sequence
aagcaaagggtggcagatggca

SEQ ID NO: 37597 - DNA, 18 bp, Artificial sequence
  synthetic polynucleotide sequence
accagccgggactgcgga

SEQ ID NO: 37598 - DNA, 21 bp, Artificial sequence
  synthetic polynucleotide sequence
tgcaggtgagagttcagccca

SEQ ID NO: 37599 - DNA, 22 bp, Artificial sequence
  synthetic polynucleotide sequence
agatcatccagagttccggcaa

SEQ ID NO: 37600 - DNA, 21 bp, Artificial sequence
  synthetic polynucleotide sequence
aacagccgagtcatgcaccca

SEQ ID NO: 37601 - DNA, 19 bp, Artificial sequence
  synthetic polynucleotide sequence
gctggagccacggcccaca

SEQ ID NO: 37602 - DNA, 22 bp, Artificial sequence
  synthetic polynucleotide sequence
ggagggggagtatgtcacacaa

SEQ ID NO: 37603 - DNA, 21 bp, Artificial sequence
  synthetic polynucleotide sequence
cacactggaagcatgctgcga

SEQ ID NO: 37604 - DNA, 20 bp, Artificial sequence
  synthetic polynucleotide sequence
ggtgcaggagagctgcaaga

SEQ ID NO: 37605 - DNA, 20 bp, Artificial sequence
  synthetic polynucleotide sequence
tccacggagggcaggtccaa

SEQ ID NO: 37606 - DNA, 25 bp, Artificial sequence
  synthetic polynucleotide sequence
tgctcctgacccaaagaacagagaa

SEQ ID NO: 37607 - DNA, 20 bp, Artificial sequence
  synthetic polynucleotide sequence
agtagtgggcaacctgggca

SEQ ID NO: 37608 - DNA, 22 bp, Artificial sequence
  synthetic polynucleotide sequence
aaagagctggaccatgcactca

SEQ ID NO: 37609 - DNA, 23 bp, Artificial sequence
  synthetic polynucleotide sequence
ctccagcacccacatcaatgaga

SEQ ID NO: 37610 - DNA, 21 bp, Artificial sequence
  synthetic polynucleotide sequence
agccaagagatgggagctaca

SEQ ID NO: 37611 - DNA, 20 bp, Artificial sequence
  synthetic polynucleotide sequence
acgtggccatctgcagccca

SEQ ID NO: 37612 - DNA, 20 bp, Artificial sequence
  synthetic polynucleotide sequence
gaagacagcagccaccagca

SEQ ID NO: 37613 - DNA, 22 bp, Artificial sequence
  synthetic polynucleotide sequence
aacctgggcatgaccacactga

SEQ ID NO: 37614 - DNA, 21 bp, Artificial sequence
  synthetic polynucleotide sequence
ggtcatacgccattgcagcca

SEQ ID NO: 37615 - DNA, 21 bp, Artificial sequence
  synthetic polynucleotide sequence
tccccagcctgaccatcctca

SEQ ID NO: 37616 - DNA, 21 bp, Artificial sequence
  synthetic polynucleotide sequence
agaaacagccgagatgtggga

SEQ ID NO: 37617 - DNA, 21 bp, Artificial sequence
  synthetic polynucleotide sequence
acctccagcttcacactccca

SEQ ID NO: 37618 - DNA, 22 bp, Artificial sequence
  synthetic polynucleotide sequence
gctacgtagcgatcataggcca

SEQ ID NO: 37619 - DNA, 21 bp, Artificial sequence
  synthetic polynucleotide sequence
gataatccgcctggacctcca

SEQ ID NO: 37620 - DNA, 20 bp, Artificial sequence
  synthetic polynucleotide sequence
ctgggcaaagcagcccgtga

SEQ ID NO: 37621 - DNA, 21 bp, Artificial sequence
  synthetic polynucleotide sequence
aactggctgggagtaatgcca

SEQ ID NO: 37622 - DNA, 22 bp, Artificial sequence
  synthetic polynucleotide sequence
tggatcctcaggatggctgaga

SEQ ID NO: 37623 - DNA, 21 bp, Artificial sequence
  synthetic polynucleotide sequence
tgggcatcatcaccctcacca

SEQ ID NO: 37624 - DNA, 20 bp, Artificial sequence
  synthetic polynucleotide sequence
cctcccagttgggtggcaca

SEQ ID NO: 37625 - DNA, 21 bp, Artificial sequence
  synthetic polynucleotide sequence
gcagtgaccaaggtgactgaa

SEQ ID NO: 37626 - DNA, 22 bp, Artificial sequence
  synthetic polynucleotide sequence
ggcaatgacagtggagtaacca

SEQ ID NO: 37627 - DNA, 20 bp, Artificial sequence
  synthetic polynucleotide sequence
tcgctgagctgcaggcacca

SEQ ID NO: 37628 - DNA, 23 bp, Artificial sequence
  synthetic polynucleotide sequence
cttggtgaggacaatcatgccca

SEQ ID NO: 37629 - DNA, 21 bp, Artificial sequence
  synthetic polynucleotide sequence
ggaactcacaaggcggcctga

SEQ ID NO: 37630 - DNA, 19 bp, Artificial sequence
  synthetic polynucleotide sequence
ttgccagcaccttgggaca

SEQ ID NO: 37631 - DNA, 20 bp, Artificial sequence
  synthetic polynucleotide sequence
aggccaggccagatggaaga

SEQ ID NO: 37632 - DNA, 20 bp, Artificial sequence
  synthetic polynucleotide sequence
gggttgaggcgtgaccggaa

SEQ ID NO: 37633 - DNA, 20 bp, Artificial sequence
  synthetic polynucleotide sequence
ggcctcacagaccatcagga

SEQ ID NO: 37634 - DNA, 23 bp, Artificial sequence
  synthetic polynucleotide sequence
gatcaaacccaagttgcctacca

SEQ ID NO: 37635 - DNA, 21 bp, Artificial sequence
  synthetic polynucleotide sequence
ggtcccaaggactacaccaca

SEQ ID NO: 37636 - DNA, 21 bp, Artificial sequence
  synthetic polynucleotide sequence
gtctgcatcccaggaagagca

SEQ ID NO: 37637 - DNA, 20 bp, Artificial sequence
  synthetic polynucleotide sequence
gctccctgggatgcagacaa

SEQ ID NO: 37638 - DNA, 21 bp, Artificial sequence
  synthetic polynucleotide sequence
agacagccacataacggtcca

SEQ ID NO: 37639 - DNA, 20 bp, Artificial sequence
  synthetic polynucleotide sequence
catctgccccgcagtgctca

SEQ ID NO: 37640 - DNA, 21 bp, Artificial sequence
  synthetic polynucleotide sequence
agtgacagaggtcaggtggga

SEQ ID NO: 37641 - DNA, 22 bp, Artificial sequence
  synthetic polynucleotide sequence
aatgccatagcccatactgcca

SEQ ID NO: 37642 - DNA, 20 bp, Artificial sequence
  synthetic polynucleotide sequence
ctgtgaagcccaccacacca

SEQ ID NO: 37643 - DNA, 20 bp, Artificial sequence
  synthetic polynucleotide sequence
atgctgccattcgcaaccca

SEQ ID NO: 37644 - DNA, 21 bp, Artificial sequence
  synthetic polynucleotide sequence
gaaggagagggtgaaggtgca

SEQ ID NO: 37645 - DNA, 21 bp, Artificial sequence
  synthetic polynucleotide sequence
acctgcagctctcacctggga

SEQ ID NO: 37646 - DNA, 22 bp, Artificial sequence
  synthetic polynucleotide sequence
tcaacatgggagtgactaggga

SEQ ID NO: 37647 - DNA, 21 bp, Artificial sequence
  synthetic polynucleotide sequence
ctgtggggagagctacactca

SEQ ID NO: 37648 - DNA, 21 bp, Artificial sequence
  synthetic polynucleotide sequence
tgacacagcagtgaggtggga

SEQ ID NO: 37649 - DNA, 21 bp, Artificial sequence
  synthetic polynucleotide sequence
tggggacagctacactcagga

SEQ ID NO: 37650 - DNA, 22 bp, Artificial sequence
  synthetic polynucleotide sequence
aagaaaagagcgacggcagtga

SEQ ID NO: 37651 - DNA, 18 bp, Artificial sequence
  synthetic polynucleotide sequence
gaggcggtggggggccaa

SEQ ID NO: 37652 - DNA, 20 bp, Artificial sequence
  synthetic polynucleotide sequence
ggaggttgagacggacagga

SEQ ID NO: 37653 - DNA, 20 bp, Artificial sequence
  synthetic polynucleotide sequence
gggagtcacacgggctggca

SEQ ID NO: 37654 - DNA, 21 bp, Artificial sequence
  synthetic polynucleotide sequence
cgttttgtggcgcaccaggga

SEQ ID NO: 37655 - DNA, 19 bp, Artificial sequence
  synthetic polynucleotide sequence
gacccccatggtgcccaca

SEQ ID NO: 37656 - DNA, 20 bp, Artificial sequence
  synthetic polynucleotide sequence
gggacggtgctgcagacgca

SEQ ID NO: 37657 - DNA, 21 bp, Artificial sequence
  synthetic polynucleotide sequence
ggaagggtatcgggaaggcta

SEQ ID NO: 37658 - DNA, 22 bp, Artificial sequence
  synthetic polynucleotide sequence
gcaaaaccttggtagcacccga

SEQ ID NO: 37659 - DNA, 20 bp, Artificial sequence
  synthetic polynucleotide sequence
atcaggactggaggaagcca

SEQ ID NO: 37660 - DNA, 18 bp, Artificial sequence
  synthetic polynucleotide sequence
ggctgacgttgagccgca

SEQ ID NO: 37661 - DNA, 20 bp, Artificial sequence
  synthetic polynucleotide sequence
gtgggatcatgcaaagcaga

SEQ ID NO: 37662 - DNA, 21 bp, Artificial sequence
  synthetic polynucleotide sequence
gagtaagggagctaagtggca

SEQ ID NO: 37663 - DNA, 19 bp, Artificial sequence
  synthetic polynucleotide sequence
ccgaatatcgccccagaca

SEQ ID NO: 37664 - DNA, 21 bp, Artificial sequence
  synthetic polynucleotide sequence
caaaagcctctgaccagtcca

SEQ ID NO: 37665 - DNA, 21 bp, Artificial sequence
  synthetic polynucleotide sequence
cccatggaaagaacttcagga

SEQ ID NO: 37666 - DNA, 18 bp, Artificial sequence
  synthetic polynucleotide sequence
gttgcccactgcctcaca

SEQ ID NO: 37667 - DNA, 21 bp, Artificial sequence
  synthetic polynucleotide sequence
tgggtggatgtgagcagaaga

SEQ ID NO: 37668 - DNA, 22 bp, Artificial sequence
  synthetic polynucleotide sequence
caggggatagttcacagagcaa

SEQ ID NO: 37669 - DNA, 20 bp, Artificial sequence
  synthetic polynucleotide sequence
gtcttccccagacacagcaa

SEQ ID NO: 37670 - DNA, 18 bp, Artificial sequence
  synthetic polynucleotide sequence
caccggatgtggctacca

SEQ ID NO: 37671 - DNA, 18 bp, Artificial sequence
  synthetic polynucleotide sequence
cgtgggaggccaagagca

SEQ ID NO: 37672 - DNA, 20 bp, Artificial sequence
  synthetic polynucleotide sequence
gcatagacagacagccccca

SEQ ID NO: 37673 - DNA, 21 bp, Artificial sequence
  synthetic polynucleotide sequence
accgtctccagatacgaggga

SEQ ID NO: 37674 - DNA, 20 bp, Artificial sequence
  synthetic polynucleotide sequence
catcgtccaggtaggaacca

SEQ ID NO: 37675 - DNA, 22 bp, Artificial sequence
  synthetic polynucleotide sequence
acgttggagttgcccacagtga

SEQ ID NO: 37676 - DNA, 20 bp, Artificial sequence
  synthetic polynucleotide sequence
atgaagcaagccaactccca

SEQ ID NO: 37677 - DNA, 18 bp, Artificial sequence
  synthetic polynucleotide sequence
cccgcaagttcctcagca

SEQ ID NO: 37678 - DNA, 20 bp, Artificial sequence
  synthetic polynucleotide sequence
aaagacacgaaccccatgga

SEQ ID NO: 37679 - DNA, 21 bp, Artificial sequence
  synthetic polynucleotide sequence
accctttgagaccccggacca

SEQ ID NO: 37680 - DNA, 18 bp, Artificial sequence
  synthetic polynucleotide sequence
ctccgtggagctggggca

SEQ ID NO: 37681 - DNA, 20 bp, Artificial sequence
  synthetic polynucleotide sequence
ctgcttccgtcagaccgaga

SEQ ID NO: 37682 - DNA, 22 bp, Artificial sequence
  synthetic polynucleotide sequence
ttgagagtggatgtgagagcca

SEQ ID NO: 37683 - DNA, 21 bp, Artificial sequence
  synthetic polynucleotide sequence
ggtgacgggggaagtgacaga

SEQ ID NO: 37684 - DNA, 20 bp, Artificial sequence
  synthetic polynucleotide sequence
tctgtcgagcatcaccccca

SEQ ID NO: 37685 - DNA, 20 bp, Artificial sequence
  synthetic polynucleotide sequence
cagctctgacgggaagcaga

SEQ ID NO: 37686 - DNA, 18 bp, Artificial sequence
  synthetic polynucleotide sequence
cgttgagggtcagggcca

SEQ ID NO: 37687 - DNA, 19 bp, Artificial sequence
  synthetic polynucleotide sequence
gacgcagccaccgagcaga

SEQ ID NO: 37688 - DNA, 19 bp, Artificial sequence
  synthetic polynucleotide sequence
cagccatcgccctcctgga

SEQ ID NO: 37689 - DNA, 21 bp, Artificial sequence
  synthetic polynucleotide sequence
ttgggtagaactgggtggcaa

SEQ ID NO: 37690 - DNA, 19 bp, Artificial sequence
  synthetic polynucleotide sequence
tcagctgtaacccgatgca

SEQ ID NO: 37691 - DNA, 21 bp, Artificial sequence
  synthetic polynucleotide sequence
cagcccgcaaaaacaggtcca

SEQ ID NO: 37692 - DNA, 20 bp, Artificial sequence
  synthetic polynucleotide sequence
ctgtcccagtagctgccaga

SEQ ID NO: 37693 - DNA, 18 bp, Artificial sequence
  synthetic polynucleotide sequence
caaaagcgtggaggcgga

SEQ ID NO: 37694 - DNA, 18 bp, Artificial sequence
  synthetic polynucleotide sequence
gacgttgtggacgcagca

SEQ ID NO: 37695 - DNA, 21 bp, Artificial sequence
  synthetic polynucleotide sequence
taccgagctggaagcaagcca

SEQ ID NO: 37696 - DNA, 21 bp, Artificial sequence
  synthetic polynucleotide sequence
ctagactcagcatgacacgca

SEQ ID NO: 37697 - DNA, 20 bp, Artificial sequence
  synthetic polynucleotide sequence
cttagctggccccgcaccca

SEQ ID NO: 37698 - DNA, 20 bp, Artificial sequence
  synthetic polynucleotide sequence
gaggctcacacacgcgcaca

SEQ ID NO: 37699 - DNA, 20 bp, Artificial sequence
  synthetic polynucleotide sequence
atgcctgtggagctaaacga

SEQ ID NO: 37700 - DNA, 21 bp, Artificial sequence
  synthetic polynucleotide sequence
gcaacgagaaccatgcgctca

SEQ ID NO: 37701 - DNA, 20 bp, Artificial sequence
  synthetic polynucleotide sequence
aggtacctggaggaggggaa

SEQ ID NO: 37702 - DNA, 20 bp, Artificial sequence
  synthetic polynucleotide sequence
tctgccgcctgaagaagcga

SEQ ID NO: 37703 - DNA, 21 bp, Artificial sequence
  synthetic polynucleotide sequence
acaagctgccagggatcggaa

SEQ ID NO: 37704 - DNA, 20 bp, Artificial sequence
  synthetic polynucleotide sequence
tggggacgctaaccattgga

SEQ ID NO: 37705 - DNA, 23 bp, Artificial sequence
  synthetic polynucleotide sequence
ctaaaacgcccagataccacaga

SEQ ID NO: 37706 - DNA, 22 bp, Artificial sequence
  synthetic polynucleotide sequence
ctaacctgcgacaagagatgca

SEQ ID NO: 37707 - DNA, 20 bp, Artificial sequence
  synthetic polynucleotide sequence
cagtaccgccactccgcgca

SEQ ID NO: 37708 - DNA, 18 bp, Artificial sequence
  synthetic polynucleotide sequence
cagcacgtagggcgcgga

SEQ ID NO: 37709 - DNA, 21 bp, Artificial sequence
  synthetic polynucleotide sequence
tcatccgagactccccaacca

SEQ ID NO: 37710 - DNA, 21 bp, Artificial sequence
  synthetic polynucleotide sequence
agatgaggagtgtctgccgga

SEQ ID NO: 37711 - DNA, 21 bp, Artificial sequence
  synthetic polynucleotide sequence
gactcctctgacgctacccaa

SEQ ID NO: 37712 - DNA, 19 bp, Artificial sequence
  synthetic polynucleotide sequence
tcgttctggagccaaggga

SEQ ID NO: 37713 - DNA, 22 bp, Artificial sequence
  synthetic polynucleotide sequence
aacagatggcaaagcgaggcaa

SEQ ID NO: 37714 - DNA, 21 bp, Artificial sequence
  synthetic polynucleotide sequence
cattacaccccactcctccca

SEQ ID NO: 37715 - DNA, 21 bp, Artificial sequence
  synthetic polynucleotide sequence
tctccaagtgacctctcagca

SEQ ID NO: 37716 - DNA, 22 bp, Artificial sequence
  synthetic polynucleotide sequence
ccaacagacagtgacctccaga

SEQ ID NO: 37717 - DNA, 18 bp, Artificial sequence
  synthetic polynucleotide sequence
ccagatgatgcgggagca

SEQ ID NO: 37718 - DNA, 18 bp, Artificial sequence
  synthetic polynucleotide sequence
tgccccaggcaggaagga

SEQ ID NO: 37719 - DNA, 21 bp, Artificial sequence
  synthetic polynucleotide sequence
gagggccgatcatccaatcca

SEQ ID NO: 37720 - DNA, 22 bp, Artificial sequence
  synthetic polynucleotide sequence
catattatgccaagccccacca

SEQ ID NO: 37721 - DNA, 18 bp, Artificial sequence
  synthetic polynucleotide sequence
agagcagcgcctccccaa

SEQ ID NO: 37722 - DNA, 18 bp, Artificial sequence
  synthetic polynucleotide sequence
cagcagctgggccatgca

SEQ ID NO: 37723 - DNA, 20 bp, Artificial sequence
  synthetic polynucleotide sequence
aacccagtagaggcaccaca

SEQ ID NO: 37724 - DNA, 18 bp, Artificial sequence
  synthetic polynucleotide sequence
tctcggtcgggggaggca

SEQ ID NO: 37725 - DNA, 20 bp, Artificial sequence
  synthetic polynucleotide sequence
gccctcctcgacgtgaccaa

SEQ ID NO: 37726 - DNA, 20 bp, Artificial sequence
  synthetic polynucleotide sequence
ggtgaagtggcggccacaga

SEQ ID NO: 37727 - DNA, 20 bp, Artificial sequence
  synthetic polynucleotide sequence
caaggctctgccagcgccca

SEQ ID NO: 37728 - DNA, 20 bp, Artificial sequence
  synthetic polynucleotide sequence
gagaccgtacaggccctgca

SEQ ID NO: 37729 - DNA, 20 bp, Artificial sequence
  synthetic polynucleotide sequence
gaagccgccctggttgcaca

SEQ ID NO: 37730 - DNA, 25 bp, Artificial sequence
  synthetic polynucleotide sequence
atgaggaagtaagacaccaccacca

SEQ ID NO: 37731 - DNA, 22 bp, Artificial sequence
  synthetic polynucleotide sequence
caaaccagtcaaaccagggcaa

SEQ ID NO: 37732 - DNA, 21 bp, Artificial sequence
  synthetic polynucleotide sequence
gattctgcctgctcagccaca

SEQ ID NO: 37733 - DNA, 20 bp, Artificial sequence
  synthetic polynucleotide sequence
cttcggcagcagtccgcaca

SEQ ID NO: 37734 - DNA, 18 bp, Artificial sequence
  synthetic polynucleotide sequence
tccgggggcagcgacaga

SEQ ID NO: 37735 - DNA, 21 bp, Artificial sequence
  synthetic polynucleotide sequence
cagccactgacctgacagcaa

SEQ ID NO: 37736 - DNA, 21 bp, Artificial sequence
  synthetic polynucleotide sequence
tcaaggggagacccaaaacca

SEQ ID NO: 37737 - DNA, 21 bp, Artificial sequence
  synthetic polynucleotide sequence
ggaagcagcgcatggaggcaa

SEQ ID NO: 37738 - DNA, 22 bp, Artificial sequence
  synthetic polynucleotide sequence
aaatgtccagtcagaggcagca

SEQ ID NO: 37739 - DNA, 21 bp, Artificial sequence
  synthetic polynucleotide sequence
caagactcactcctggcagga

SEQ ID NO: 37740 - DNA, 18 bp, Artificial sequence
  synthetic polynucleotide sequence
accagcaggggacaacca

SEQ ID NO: 37741 - DNA, 20 bp, Artificial sequence
  synthetic polynucleotide sequence
cagcaggaggacaagcagga

SEQ ID NO: 37742 - DNA, 19 bp, Artificial sequence
  synthetic polynucleotide sequence
ccaggaagtcgtcagcgga

SEQ ID NO: 37743 - DNA, 22 bp, Artificial sequence
  synthetic polynucleotide sequence
caaaggacgtggaaatgcctga

SEQ ID NO: 37744 - DNA, 22 bp, Artificial sequence
  synthetic polynucleotide sequence
acatggaacaccgacaaggaca

SEQ ID NO: 37745 - DNA, 18 bp, Artificial sequence
  synthetic polynucleotide sequence
tcagtctggtggcccaga

SEQ ID NO: 37746 - DNA, 20 bp, Artificial sequence
  synthetic polynucleotide sequence
cagcactgacatacacccca

SEQ ID NO: 37747 - DNA, 21 bp, Artificial sequence
  synthetic polynucleotide sequence
ccatcctggcgatcgtggaga

SEQ ID NO: 37748 - DNA, 21 bp, Artificial sequence
  synthetic polynucleotide sequence
ttgcagactgtgaccacccga

SEQ ID NO: 37749 - DNA, 21 bp, Artificial sequence
  synthetic polynucleotide sequence
tcgcccagcacaccttccaga

SEQ ID NO: 37750 - DNA, 21 bp, Artificial sequence
  synthetic polynucleotide sequence
tgggggttgagacgatggcca

SEQ ID NO: 37751 - DNA, 21 bp, Artificial sequence
  synthetic polynucleotide sequence
cggtcaagaaccctacccgca

SEQ ID NO: 37752 - DNA, 20 bp, Artificial sequence
  synthetic polynucleotide sequence
catgcgggcgcttggccaca

SEQ ID NO: 37753 - DNA, 20 bp, Artificial sequence
  synthetic polynucleotide sequence
ccacgagctagagcggggaa

SEQ ID NO: 37754 - DNA, 23 bp, Artificial sequence
  synthetic polynucleotide sequence
ctaaagggaagacatacgaccca

SEQ ID NO: 37755 - DNA, 21 bp, Artificial sequence
  synthetic polynucleotide sequence
aggaagaggtgatctgaccca

SEQ ID NO: 37756 - DNA, 25 bp, Artificial sequence
  synthetic polynucleotide sequence
accacaaaacaaccaagggcacaga

SEQ ID NO: 37757 - DNA, 20 bp, Artificial sequence
  synthetic polynucleotide sequence
aagcagacctctgtcgccga

SEQ ID NO: 37758 - DNA, 20 bp, Artificial sequence
  synthetic polynucleotide sequence
gacagtccgtccaccctcga

SEQ ID NO: 37759 - DNA, 19 bp, Artificial sequence
  synthetic polynucleotide sequence
tcatcaggaaccgagcaga

SEQ ID NO: 37760 - DNA, 21 bp, Artificial sequence
  synthetic polynucleotide sequence
acgtactccacttgcagggca

SEQ ID NO: 37761 - DNA, 21 bp, Artificial sequence
  synthetic polynucleotide sequence
cagcaagacggtgtatgggga

SEQ ID NO: 37762 - DNA, 18 bp, Artificial sequence
  synthetic polynucleotide sequence
tcccccacgtcgccctca

SEQ ID NO: 37763 - DNA, 18 bp, Artificial sequence
  synthetic polynucleotide sequence
gcggcaggaggagaggca

SEQ ID NO: 37764 - DNA, 20 bp, Artificial sequence
  synthetic polynucleotide sequence
agcggcgaaggtcttcacca

SEQ ID NO: 37765 - DNA, 20 bp, Artificial sequence
  synthetic polynucleotide sequence
taccctctgcaccaggccta

SEQ ID NO: 37766 - DNA, 20 bp, Artificial sequence
  synthetic polynucleotide sequence
agcagcaggagcctcttgga

SEQ ID NO: 37767 - DNA, 21 bp, Artificial sequence
  synthetic polynucleotide sequence
tgcgccaggtacaagcagtca

SEQ ID NO: 37768 - DNA, 20 bp, Artificial sequence
  synthetic polynucleotide sequence
agaccaaaggcagaggggga

SEQ ID NO: 37769 - DNA, 19 bp, Artificial sequence
  synthetic polynucleotide sequence
gcaaccccgagaccagcga

SEQ ID NO: 37770 - DNA, 21 bp, Artificial sequence
  synthetic polynucleotide sequence
cccgatgatcaaggtgggcga

SEQ ID NO: 37771 - DNA, 22 bp, Artificial sequence
  synthetic polynucleotide sequence
gaaaaggagcgagaagaacgga

SEQ ID NO: 37772 - DNA, 22 bp, Artificial sequence
  synthetic polynucleotide sequence
caaggcaaccacagtcagagca

SEQ ID NO: 37773 - DNA, 20 bp, Artificial sequence
  synthetic polynucleotide sequence
tgggagtgggggaaagacga

SEQ ID NO: 37774 - DNA, 19 bp, Artificial sequence
  synthetic polynucleotide sequence
gagtccagcgagtcggcca

SEQ ID NO: 37775 - DNA, 20 bp, Artificial sequence
  synthetic polynucleotide sequence
cccagcagagtccagggcaa

SEQ ID NO: 37776 - DNA, 20 bp, Artificial sequence
  synthetic polynucleotide sequence
actgtctggggaaggtggca

SEQ ID NO: 37777 - DNA, 21 bp, Artificial sequence
  synthetic polynucleotide sequence
ctgctgaggaagaagtgggca

SEQ ID NO: 37778 - DNA, 21 bp, Artificial sequence
  synthetic polynucleotide sequence
gatgtgtcccgagcaaacaga

SEQ ID NO: 37779 - DNA, 20 bp, Artificial sequence
  synthetic polynucleotide sequence
gcgcaccacccgttgagcca

SEQ ID NO: 37780 - DNA, 21 bp, Artificial sequence
  synthetic polynucleotide sequence
gtaatccaagcagtcggcaga

SEQ ID NO: 37781 - DNA, 18 bp, Artificial sequence
  synthetic polynucleotide sequence
ttcccggaccaggggcca

SEQ ID NO: 37782 - DNA, 23 bp, Artificial sequence
  synthetic polynucleotide sequence
taaaacccaagcttgaagctcca

SEQ ID NO: 37783 - DNA, 18 bp, Artificial sequence
  synthetic polynucleotide sequence
gaccggggcgctgaggaa

SEQ ID NO: 37784 - DNA, 21 bp, Artificial sequence
  synthetic polynucleotide sequence
tgttcagtgcctgtgccacca

SEQ ID NO: 37785 - DNA, 20 bp, Artificial sequence
  synthetic polynucleotide sequence
gaccgctggtgagggtgaca

SEQ ID NO: 37786 - DNA, 25 bp, Artificial sequence
  synthetic polynucleotide sequence
gtcagaagaacatcctcacaaggga

SEQ ID NO: 37787 - DNA, 21 bp, Artificial sequence
  synthetic polynucleotide sequence
gagagacgcatgtcagggaga

SEQ ID NO: 37788 - DNA, 20 bp, Artificial sequence
  synthetic polynucleotide sequence
ccagcctcgaccacagccca

SEQ ID NO: 37789 - DNA, 19 bp, Artificial sequence
  synthetic polynucleotide sequence
gggggccatggtgtggaca

SEQ ID NO: 37790 - DNA, 20 bp, Artificial sequence
  synthetic polynucleotide sequence
actgaactcagcccgcacca

SEQ ID NO: 37791 - DNA, 21 bp, Artificial sequence
  synthetic polynucleotide sequence
cctctgcacgtactgcgggaa

SEQ ID NO: 37792 - DNA, 20 bp, Artificial sequence
  synthetic polynucleotide sequence
cttctgctgcacaccatgga

SEQ ID NO: 37793 - DNA, 18 bp, Artificial sequence
  synthetic polynucleotide sequence
tccgcacacacacaggca

SEQ ID NO: 37794 - DNA, 18 bp, Artificial sequence
  synthetic polynucleotide sequence
gctgctgcaccccatgga

SEQ ID NO: 37795 - DNA, 19 bp, Artificial sequence
  synthetic polynucleotide sequence
gcagcgctgctccctggaa

SEQ ID NO: 37796 - DNA, 18 bp, Artificial sequence
  synthetic polynucleotide sequence
gtaggtgtcgggccggga

SEQ ID NO: 37797 - DNA, 19 bp, Artificial sequence
  synthetic polynucleotide sequence
cctgtgactcaggccccaa

SEQ ID NO: 37798 - DNA, 20 bp, Artificial sequence
  synthetic polynucleotide sequence
tagctcaagaacagcccaca

SEQ ID NO: 37799 - DNA, 18 bp, Artificial sequence
  synthetic polynucleotide sequence
ccccaacagggtatggga

SEQ ID NO: 37800 - DNA, 18 bp, Artificial sequence
  synthetic polynucleotide sequence
gcaatggcaacactgcca

SEQ ID NO: 37801 - DNA, 18 bp, Artificial sequence
  synthetic polynucleotide sequence
atacggcgacctggcgaa

SEQ ID NO: 37802 - DNA, 18 bp, Artificial sequence
  synthetic polynucleotide sequence
gctgcatggtgaccacca

SEQ ID NO: 37803 - DNA, 21 bp, Artificial sequence
  synthetic polynucleotide sequence
tggtggtggccgtctacacca

SEQ ID NO: 37804 - DNA, 22 bp, Artificial sequence
  synthetic polynucleotide sequence
ccatggaagagctgtgtgcaga

SEQ ID NO: 37805 - DNA, 21 bp, Artificial sequence
  synthetic polynucleotide sequence
cccatggactgcaaactgaca

SEQ ID NO: 37806 - DNA, 22 bp, Artificial sequence
  synthetic polynucleotide sequence
aagcaggcgagattcgatccga

SEQ ID NO: 37807 - DNA, 20 bp, Artificial sequence
  synthetic polynucleotide sequence
tggctcggcaagtaccagga

SEQ ID NO: 37808 - DNA, 19 bp, Artificial sequence
  synthetic polynucleotide sequence
gtccccacatgcgggtgga

SEQ ID NO: 37809 - DNA, 20 bp, Artificial sequence
  synthetic polynucleotide sequence
ctgccagtgagtcaccgtca

SEQ ID NO: 37810 - DNA, 19 bp, Artificial sequence
  synthetic polynucleotide sequence
ccacccactctcacagcca

SEQ ID NO: 37811 - DNA, 19 bp, Artificial sequence
  synthetic polynucleotide sequence
ttagacaccccagtgctga

SEQ ID NO: 37812 - DNA, 22 bp, Artificial sequence
  synthetic polynucleotide sequence
atctccatcaagccaaagcgca

SEQ ID NO: 37813 - DNA, 22 bp, Artificial sequence
  synthetic polynucleotide sequence
aagagcccggatctatgcagaa

SEQ ID NO: 37814 - DNA, 21 bp, Artificial sequence
  synthetic polynucleotide sequence
tcctcaggctgcacacctgca

SEQ ID NO: 37815 - DNA, 18 bp, Artificial sequence
  synthetic polynucleotide sequence
cctggtcgacggaaggga

SEQ ID NO: 37816 - DNA, 19 bp, Artificial sequence
  synthetic polynucleotide sequence
ctgagccttcgacaccaga

SEQ ID NO: 37817 - DNA, 20 bp, Artificial sequence
  synthetic polynucleotide sequence
cacgccgaccctgcctgcga

SEQ ID NO: 37818 - DNA, 20 bp, Artificial sequence
  synthetic polynucleotide sequence
ggtggctatgggggaagcga

SEQ ID NO: 37819 - DNA, 18 bp, Artificial sequence
  synthetic polynucleotide sequence
gggccacctcttccacga

SEQ ID NO: 37820 - DNA, 18 bp, Artificial sequence
  synthetic polynucleotide sequence
agctgcgatggctcagga

SEQ ID NO: 37821 - DNA, 18 bp, Artificial sequence
  synthetic polynucleotide sequence
caaggtcaacaggcgcaa

SEQ ID NO: 37822 - DNA, 20 bp, Artificial sequence
  synthetic polynucleotide sequence
caccacgtagccaagctgga

SEQ ID NO: 37823 - DNA, 20 bp, Artificial sequence
  synthetic polynucleotide sequence
ctccgacctctactgcccca

SEQ ID NO: 37824 - DNA, 21 bp, Artificial sequence
  synthetic polynucleotide sequence
ggttgcactccgatgcaggca

SEQ ID NO: 37825 - DNA, 20 bp, Artificial sequence
  synthetic polynucleotide sequence
aacccagtgtaccccagcga

SEQ ID NO: 37826 - DNA, 20 bp, Artificial sequence
  synthetic polynucleotide sequence
cctatggagaaggcccccga

SEQ ID NO: 37827 - DNA, 18 bp, Artificial sequence
  synthetic polynucleotide sequence
cctggctggcaacgagca

SEQ ID NO: 37828 - DNA, 18 bp, Artificial sequence
  synthetic polynucleotide sequence
ccatgcctagcagtgcca

SEQ ID NO: 37829 - DNA, 20 bp, Artificial sequence
  synthetic polynucleotide sequence
cgtcgacacctccctgcaga

SEQ ID NO: 37830 - DNA, 21 bp, Artificial sequence
  synthetic polynucleotide sequence
ggaatgacgtagtcggcgaca

SEQ ID NO: 37831 - DNA, 18 bp, Artificial sequence
  synthetic polynucleotide sequence
tggccaaggctggaggga

SEQ ID NO: 37832 - DNA, 21 bp, Artificial sequence
  synthetic polynucleotide sequence
gaaggagtagtgaggccagca

SEQ ID NO: 37833 - DNA, 20 bp, Artificial sequence
  synthetic polynucleotide sequence
gggcctgcatcaccacctca

SEQ ID NO: 37834 - DNA, 20 bp, Artificial sequence
  synthetic polynucleotide sequence
ggaatccacatccagcgcca

SEQ ID NO: 37835 - DNA, 22 bp, Artificial sequence
  synthetic polynucleotide sequence
acctcagacgagtacctgcgaa

SEQ ID NO: 37836 - DNA, 19 bp, Artificial sequence
  synthetic polynucleotide sequence
cagcccagaatcagcacca

SEQ ID NO: 37837 - DNA, 21 bp, Artificial sequence
  synthetic polynucleotide sequence
aagggatcagtgagaggcaga

SEQ ID NO: 37838 - DNA, 18 bp, Artificial sequence
  synthetic polynucleotide sequence
acttgcaaggcacaggca

SEQ ID NO: 37839 - DNA, 20 bp, Artificial sequence
  synthetic polynucleotide sequence
acatagcccaggccacagca

SEQ ID NO: 37840 - DNA, 18 bp, Artificial sequence
  synthetic polynucleotide sequence
ggggcagtgtcggcagca

SEQ ID NO: 37841 - DNA, 21 bp, Artificial sequence
  synthetic polynucleotide sequence
cctctgcgcctggtaacacca

SEQ ID NO: 37842 - DNA, 22 bp, Artificial sequence
  synthetic polynucleotide sequence
gaaaatcctcatcgccaggcca

SEQ ID NO: 37843 - DNA, 21 bp, Artificial sequence
  synthetic polynucleotide sequence
ttcacatccccagctcctcca

SEQ ID NO: 37844 - DNA, 19 bp, Artificial sequence
  synthetic polynucleotide sequence
ctgagctgccagggtgcca

SEQ ID NO: 37845 - DNA, 22 bp, Artificial sequence
  synthetic polynucleotide sequence
caaagagtcagaccgaagctca

SEQ ID NO: 37846 - DNA, 22 bp, Artificial sequence
  synthetic polynucleotide sequence
agatttccctaaacggctggca

SEQ ID NO: 37847 - DNA, 18 bp, Artificial sequence
  synthetic polynucleotide sequence
gccacaccctcaacgcca

SEQ ID NO: 37848 - DNA, 18 bp, Artificial sequence
  synthetic polynucleotide sequence
gagcacggggtcaaggca

SEQ ID NO: 37849 - DNA, 18 bp, Artificial sequence
  synthetic polynucleotide sequence
tgccaacagctgcctgga

SEQ ID NO: 37850 - DNA, 20 bp, Artificial sequence
  synthetic polynucleotide sequence
ctgctatcctcaggcaggga

SEQ ID NO: 37851 - DNA, 18 bp, Artificial sequence
  synthetic polynucleotide sequence
cgctgccacaggcatcca

SEQ ID NO: 37852 - DNA, 18 bp, Artificial sequence
  synthetic polynucleotide sequence
agggcagcaggaagccga

SEQ ID NO: 37853 - DNA, 18 bp, Artificial sequence
  synthetic polynucleotide sequence
gctgttgcgcacggagga

SEQ ID NO: 37854 - DNA, 19 bp, Artificial sequence
  synthetic polynucleotide sequence
tgttgaggcagctgagaca

SEQ ID NO: 37855 - DNA, 18 bp, Artificial sequence
  synthetic polynucleotide sequence
gctggggcaagaaggcaa

SEQ ID NO: 37856 - DNA, 18 bp, Artificial sequence
  synthetic polynucleotide sequence
cgatggcagtgcggcaca

SEQ ID NO: 37857 - DNA, 19 bp, Artificial sequence
  synthetic polynucleotide sequence
ggcatccattgaggccaga

SEQ ID NO: 37858 - DNA, 19 bp, Artificial sequence
  synthetic polynucleotide sequence
cactcctgaagggacccga

SEQ ID NO: 37859 - DNA, 19 bp, Artificial sequence
  synthetic polynucleotide sequence
cctggaccctgacacggga

SEQ ID NO: 37860 - DNA, 21 bp, Artificial sequence
  synthetic polynucleotide sequence
tccgtgaagaacaggtcccca

SEQ ID NO: 37861 - DNA, 19 bp, Artificial sequence
  synthetic polynucleotide sequence
ctcttcgaccccaaggaca

SEQ ID NO: 37862 - DNA, 18 bp, Artificial sequence
  synthetic polynucleotide sequence
tcttccaggccccagcga

SEQ ID NO: 37863 - DNA, 19 bp, Artificial sequence
  synthetic polynucleotide sequence
tgcacggaaagatgagcca

SEQ ID NO: 37864 - DNA, 19 bp, Artificial sequence
  synthetic polynucleotide sequence
ggctcctcctgcagacaca

SEQ ID NO: 37865 - DNA, 18 bp, Artificial sequence
  synthetic polynucleotide sequence
ggaggccaccacaaccaa

SEQ ID NO: 37866 - DNA, 18 bp, Artificial sequence
  synthetic polynucleotide sequence
gtggcttgggtcaaggga

SEQ ID NO: 37867 - DNA, 22 bp, Artificial sequence
  synthetic polynucleotide sequence
aagtggagtaccgcatcagcaa

SEQ ID NO: 37868 - DNA, 20 bp, Artificial sequence
  synthetic polynucleotide sequence
ctctgcatagggaggccgga

SEQ ID NO: 37869 - DNA, 18 bp, Artificial sequence
  synthetic polynucleotide sequence
acaccgacaaccagcgca

SEQ ID NO: 37870 - DNA, 18 bp, Artificial sequence
  synthetic polynucleotide sequence
ccagggtgatgaggcgca

SEQ ID NO: 37871 - DNA, 19 bp, Artificial sequence
  synthetic polynucleotide sequence
gtcactggtgggggcgaga

SEQ ID NO: 37872 - DNA, 20 bp, Artificial sequence
  synthetic polynucleotide sequence
cacccacccaaccttgccca

SEQ ID NO: 37873 - DNA, 18 bp, Artificial sequence
  synthetic polynucleotide sequence
agagggcaaggccaagga

SEQ ID NO: 37874 - DNA, 18 bp, Artificial sequence
  synthetic polynucleotide sequence
tccaccacacccatccga

SEQ ID NO: 37875 - DNA, 19 bp, Artificial sequence
  synthetic polynucleotide sequence
tgggactacagagcaggca

SEQ ID NO: 37876 - DNA, 21 bp, Artificial sequence
  synthetic polynucleotide sequence
acttgtaccggagcccttgga

SEQ ID NO: 37877 - DNA, 18 bp, Artificial sequence
  synthetic polynucleotide sequence
gcccctcctcaagagcaa

SEQ ID NO: 37878 - DNA, 18 bp, Artificial sequence
  synthetic polynucleotide sequence
gttggaacaccggtggca

SEQ ID NO: 37879 - DNA, 22 bp, Artificial sequence
  synthetic polynucleotide sequence
ctccagaatccctccatgccaa

SEQ ID NO: 37880 - DNA, 20 bp, Artificial sequence
  synthetic polynucleotide sequence
ggcagccatggaagcgagga

SEQ ID NO: 37881 - DNA, 20 bp, Artificial sequence
  synthetic polynucleotide sequence
ctgcccctcctcaaaagcaa

SEQ ID NO: 37882 - DNA, 20 bp, Artificial sequence
  synthetic polynucleotide sequence
cagttggaacaccggtagca

SEQ ID NO: 37883 - DNA, 18 bp, Artificial sequence
  synthetic polynucleotide sequence
ccatgtgcaggggcagga

SEQ ID NO: 37884 - DNA, 20 bp, Artificial sequence
  synthetic polynucleotide sequence
gaacaagcgttctcccagca

SEQ ID NO: 37885 - DNA, 20 bp, Artificial sequence
  synthetic polynucleotide sequence
gcagctggctgatgcccaga

SEQ ID NO: 37886 - DNA, 21 bp, Artificial sequence
  synthetic polynucleotide sequence
ctcaagtaggcatcgcgctga

SEQ ID NO: 37887 - DNA, 21 bp, Artificial sequence
  synthetic polynucleotide sequence
tctatgtagggcgagcacaga

SEQ ID NO: 37888 - DNA, 20 bp, Artificial sequence
  synthetic polynucleotide sequence
tggcccgactaattgaccca

SEQ ID NO: 37889 - DNA, 21 bp, Artificial sequence
  synthetic polynucleotide sequence
tgaggaactggagcctgagga

SEQ ID NO: 37890 - DNA, 18 bp, Artificial sequence
  synthetic polynucleotide sequence
gctcccgaaccaggccca

SEQ ID NO: 37891 - DNA, 20 bp, Artificial sequence
  synthetic polynucleotide sequence
ggccacagccacgagtcaca

SEQ ID NO: 37892 - DNA, 20 bp, Artificial sequence
  synthetic polynucleotide sequence
cccctccctcaacacccaga

SEQ ID NO: 37893 - DNA, 20 bp, Artificial sequence
  synthetic polynucleotide sequence
gacggcattgactacagcca

SEQ ID NO: 37894 - DNA, 18 bp, Artificial sequence
  synthetic polynucleotide sequence
agcgctcgaaggcctcca

SEQ ID NO: 37895 - DNA, 21 bp, Artificial sequence
  synthetic polynucleotide sequence
agagggctctggaggtacaca

SEQ ID NO: 37896 - DNA, 22 bp, Artificial sequence
  synthetic polynucleotide sequence
ttcatcatccgaatggaccgga

SEQ ID NO: 37897 - DNA, 20 bp, Artificial sequence
  synthetic polynucleotide sequence
ctgagcaagaaaccccgaga

SEQ ID NO: 37898 - DNA, 21 bp, Artificial sequence
  synthetic polynucleotide sequence
atgtcactccactcgacccca

SEQ ID NO: 37899 - DNA, 21 bp, Artificial sequence
  synthetic polynucleotide sequence
agagccagtgcattgagggca

SEQ ID NO: 37900 - DNA, 20 bp, Artificial sequence
  synthetic polynucleotide sequence
tgcttcacgtgcgaggacca

SEQ ID NO: 37901 - DNA, 22 bp, Artificial sequence
  synthetic polynucleotide sequence
accttcctcacaccaccaccaa

SEQ ID NO: 37902 - DNA, 18 bp, Artificial sequence
  synthetic polynucleotide sequence
acactgccgcggtcccca

SEQ ID NO: 37903 - DNA, 20 bp, Artificial sequence
  synthetic polynucleotide sequence
acccagagctatcccaccga

SEQ ID NO: 37904 - DNA, 21 bp, Artificial sequence
  synthetic polynucleotide sequence
catagtcatacagggcccgga

SEQ ID NO: 37905 - DNA, 21 bp, Artificial sequence
  synthetic polynucleotide sequence
acagaggacaatcagccggaa

SEQ ID NO: 37906 - DNA, 18 bp, Artificial sequence
  synthetic polynucleotide sequence
gtggcagccttccgggga

SEQ ID NO: 37907 - DNA, 20 bp, Artificial sequence
  synthetic polynucleotide sequence
atcgggagcagcttccccaa

SEQ ID NO: 37908 - DNA, 19 bp, Artificial sequence
  synthetic polynucleotide sequence
ttggtcagaggtaggcaca

SEQ ID NO: 37909 - DNA, 21 bp, Artificial sequence
  synthetic polynucleotide sequence
gggccacaggttgaggaggaa

SEQ ID NO: 37910 - DNA, 20 bp, Artificial sequence
  synthetic polynucleotide sequence
ctgcggacgttggtgccaca

SEQ ID NO: 37911 - DNA, 21 bp, Artificial sequence
  synthetic polynucleotide sequence
agcagaagtgtggccacggga

SEQ ID NO: 37912 - DNA, 20 bp, Artificial sequence
  synthetic polynucleotide sequence
gtcacactctgccaggccca

SEQ ID NO: 37913 - DNA, 18 bp, Artificial sequence
  synthetic polynucleotide sequence
catgacccccaacaccca

SEQ ID NO: 37914 - DNA, 18 bp, Artificial sequence
  synthetic polynucleotide sequence
agtcgaagaccacgggca

SEQ ID NO: 37915 - DNA, 21 bp, Artificial sequence
  synthetic polynucleotide sequence
tgatgggcaagaacctgggga

SEQ ID NO: 37916 - DNA, 22 bp, Artificial sequence
  synthetic polynucleotide sequence
atgaaggtgcacttgaagccca

SEQ ID NO: 37917 - DNA, 18 bp, Artificial sequence
  synthetic polynucleotide sequence
cgaggccacgctgctcga

SEQ ID NO: 37918 - DNA, 20 bp, Artificial sequence
  synthetic polynucleotide sequence
ctccaccaggactctggcca

SEQ ID NO: 37919 - DNA, 18 bp, Artificial sequence
  synthetic polynucleotide sequence
gcgccagtcccttcccca

SEQ ID NO: 37920 - DNA, 20 bp, Artificial sequence
  synthetic polynucleotide sequence
cagccctgaatgccctggga

SEQ ID NO: 37921 - DNA, 19 bp, Artificial sequence
  synthetic polynucleotide sequence
ctgggctccagaaagctca

SEQ ID NO: 37922 - DNA, 22 bp, Artificial sequence
  synthetic polynucleotide sequence
ggaacagaactccacgtaccca

SEQ ID NO: 37923 - DNA, 19 bp, Artificial sequence
  synthetic polynucleotide sequence
tgaggcaaaagaacgccaa

SEQ ID NO: 37924 - DNA, 18 bp, Artificial sequence
  synthetic polynucleotide sequence
aacccccgtcggtatcca

SEQ ID NO: 37925 - DNA, 21 bp, Artificial sequence
  synthetic polynucleotide sequence
cgaggccaacatcccaaccca

SEQ ID NO: 37926 - DNA, 20 bp, Artificial sequence
  synthetic polynucleotide sequence
gccagggtcggcatctagga

SEQ ID NO: 37927 - DNA, 21 bp, Artificial sequence
  synthetic polynucleotide sequence
agaagagaaccagcccaccaa

SEQ ID NO: 37928 - DNA, 21 bp, Artificial sequence
  synthetic polynucleotide sequence
ttgaagacagtctgcccagca

SEQ ID NO: 37929 - DNA, 22 bp, Artificial sequence
  synthetic polynucleotide sequence
aagaagaccccactctcacaga

SEQ ID NO: 37930 - DNA, 21 bp, Artificial sequence
  synthetic polynucleotide sequence
aggtgtaggtggactccggaa

SEQ ID NO: 37931 - DNA, 20 bp, Artificial sequence
  synthetic polynucleotide sequence
actgggtgtgagcgcggaga

SEQ ID NO: 37932 - DNA, 20 bp, Artificial sequence
  synthetic polynucleotide sequence
cacaggagcagcctgaacca

SEQ ID NO: 37933 - DNA, 20 bp, Artificial sequence
  synthetic polynucleotide sequence
tccaggagcccactgaggaa

SEQ ID NO: 37934 - DNA, 21 bp, Artificial sequence
  synthetic polynucleotide sequence
tcaggaccatctccaggctca

SEQ ID NO: 37935 - DNA, 20 bp, Artificial sequence
  synthetic polynucleotide sequence
ccgagactcagccgtgggaa

SEQ ID NO: 37936 - DNA, 21 bp, Artificial sequence
  synthetic polynucleotide sequence
cacagatccaactggctggga

SEQ ID NO: 37937 - DNA, 24 bp, Artificial sequence
  synthetic polynucleotide sequence
agcttcaacaagaggaaccaccaa

SEQ ID NO: 37938 - DNA, 20 bp, Artificial sequence
  synthetic polynucleotide sequence
gccaggcctagcacttggaa

SEQ ID NO: 37939 - DNA, 21 bp, Artificial sequence
  synthetic polynucleotide sequence
gctcccggtgaatctcagcaa

SEQ ID NO: 37940 - DNA, 21 bp, Artificial sequence
  synthetic polynucleotide sequence
ccatctccacgctcactccga

SEQ ID NO: 37941 - DNA, 21 bp, Artificial sequence
  synthetic polynucleotide sequence
gaccaagagtcttcccagcca

SEQ ID NO: 37942 - DNA, 21 bp, Artificial sequence
  synthetic polynucleotide sequence
tcaggaccatctccaggtgca

SEQ ID NO: 37943 - DNA, 22 bp, Artificial sequence
  synthetic polynucleotide sequence
aaaaccacacatgcccacggaa

SEQ ID NO: 37944 - DNA, 21 bp, Artificial sequence
  synthetic polynucleotide sequence
tgtccgacagcaccttgtcca

SEQ ID NO: 37945 - DNA, 20 bp, Artificial sequence
  synthetic polynucleotide sequence
ggagctggagaagacagcca

SEQ ID NO: 37946 - DNA, 18 bp, Artificial sequence
  synthetic polynucleotide sequence
cgaactgagaagggccga

SEQ ID NO: 37947 - DNA, 21 bp, Artificial sequence
  synthetic polynucleotide sequence
caggagatcgaagccaacaga

SEQ ID NO: 37948 - DNA, 22 bp, Artificial sequence
  synthetic polynucleotide sequence
ccaagatcagaagtagagccca

SEQ ID NO: 37949 - DNA, 20 bp, Artificial sequence
  synthetic polynucleotide sequence
gatcaagctgcaaaagggga

SEQ ID NO: 37950 - DNA, 22 bp, Artificial sequence
  synthetic polynucleotide sequence
caattctcgaagaccaacctga

SEQ ID NO: 37951 - DNA, 21 bp, Artificial sequence
  synthetic polynucleotide sequence
gcagcagtactagcccaagca

SEQ ID NO: 37952 - DNA, 20 bp, Artificial sequence
  synthetic polynucleotide sequence
gtgggagatctcgagctgga

SEQ ID NO: 37953 - DNA, 21 bp, Artificial sequence
  synthetic polynucleotide sequence
ccaggggttaagtgggcacga

SEQ ID NO: 37954 - DNA, 20 bp, Artificial sequence
  synthetic polynucleotide sequence
gaggcaggtctcgtgaggga

SEQ ID NO: 37955 - DNA, 20 bp, Artificial sequence
  synthetic polynucleotide sequence
caggaggtggccattaagca

SEQ ID NO: 37956 - DNA, 19 bp, Artificial sequence
  synthetic polynucleotide sequence
cctgcagacactcacggca

SEQ ID NO: 37957 - DNA, 21 bp, Artificial sequence
  synthetic polynucleotide sequence
gtggagcggaagatggactca

SEQ ID NO: 37958 - DNA, 20 bp, Artificial sequence
  synthetic polynucleotide sequence
tgtaccaaccgacagggcca

SEQ ID NO: 37959 - DNA, 22 bp, Artificial sequence
  synthetic polynucleotide sequence
accagcactgaatgccaaggga

SEQ ID NO: 37960 - DNA, 21 bp, Artificial sequence
  synthetic polynucleotide sequence
actggtgcaggaacagggtca

SEQ ID NO: 37961 - DNA, 19 bp, Artificial sequence
  synthetic polynucleotide sequence
cagggaagggtgagaagca

SEQ ID NO: 37962 - DNA, 22 bp, Artificial sequence
  synthetic polynucleotide sequence
cacacgagatcagcaagaacga

SEQ ID NO: 37963 - DNA, 18 bp, Artificial sequence
  synthetic polynucleotide sequence
ccgggacatcaagagcga

SEQ ID NO: 37964 - DNA, 18 bp, Artificial sequence
  synthetic polynucleotide sequence
acctctggcccgtaggga

SEQ ID NO: 37965 - DNA, 21 bp, Artificial sequence
  synthetic polynucleotide sequence
ctccggaagcaacagagacga

SEQ ID NO: 37966 - DNA, 22 bp, Artificial sequence
  synthetic polynucleotide sequence
agaaactccatgaccacccaga

SEQ ID NO: 37967 - DNA, 21 bp, Artificial sequence
  synthetic polynucleotide sequence
tgcgagacttcctggagcgga

SEQ ID NO: 37968 - DNA, 21 bp, Artificial sequence
  synthetic polynucleotide sequence
ggtagagctggatcaggggca

SEQ ID NO: 37969 - DNA, 18 bp, Artificial sequence
  synthetic polynucleotide sequence
ggcagcccagcaaaacca

SEQ ID NO: 37970 - DNA, 18 bp, Artificial sequence
  synthetic polynucleotide sequence
tggcgggacagagtcaca

SEQ ID NO: 37971 - DNA, 21 bp, Artificial sequence
  synthetic polynucleotide sequence
gcaagaaatgcggaggctgca

SEQ ID NO: 37972 - DNA, 20 bp, Artificial sequence
  synthetic polynucleotide sequence
ctgaagggcctctgccagga

SEQ ID NO: 37973 - DNA, 20 bp, Artificial sequence
  synthetic polynucleotide sequence
taccaaccgagcaggacaga

SEQ ID NO: 37974 - DNA, 18 bp, Artificial sequence
  synthetic polynucleotide sequence
tccctgaatgagcaggca

SEQ ID NO: 37975 - DNA, 21 bp, Artificial sequence
  synthetic polynucleotide sequence
ggctcccccatgatgaaggca

SEQ ID NO: 37976 - DNA, 19 bp, Artificial sequence
  synthetic polynucleotide sequence
gtggaccctgcctcgctca

SEQ ID NO: 37977 - DNA, 21 bp, Artificial sequence
  synthetic polynucleotide sequence
gagggcacgtgtctgaaagga

SEQ ID NO: 37978 - DNA, 19 bp, Artificial sequence
  synthetic polynucleotide sequence
ctgccctgggttcccggaa

SEQ ID NO: 37979 - DNA, 21 bp, Artificial sequence
  synthetic polynucleotide sequence
ggaggaaggagtgaagcccca

SEQ ID NO: 37980 - DNA, 18 bp, Artificial sequence
  synthetic polynucleotide sequence
gcccctccccctgaagca

SEQ ID NO: 37981 - DNA, 21 bp, Artificial sequence
  synthetic polynucleotide sequence
cagccagccaaaccaacacca

SEQ ID NO: 37982 - DNA, 20 bp, Artificial sequence
  synthetic polynucleotide sequence
atggtggacagggctgccta

SEQ ID NO: 37983 - DNA, 18 bp, Artificial sequence
  synthetic polynucleotide sequence
gcaaccaggcagtgacca

SEQ ID NO: 37984 - DNA, 20 bp, Artificial sequence
  synthetic polynucleotide sequence
caagagccaagctgtgagga

SEQ ID NO: 37985 - DNA, 20 bp, Artificial sequence
  synthetic polynucleotide sequence
ggccaagtacctggcccaga

SEQ ID NO: 37986 - DNA, 20 bp, Artificial sequence
  synthetic polynucleotide sequence
aggttggaagcggctgcaga

SEQ ID NO: 37987 - DNA, 19 bp, Artificial sequence
  synthetic polynucleotide sequence
gccagtcgggatctcagca

SEQ ID NO: 37988 - DNA, 18 bp, Artificial sequence
  synthetic polynucleotide sequence
tgaccaccccagagcgca

SEQ ID NO: 37989 - DNA, 18 bp, Artificial sequence
  synthetic polynucleotide sequence
catccgccatctgccaga

SEQ ID NO: 37990 - DNA, 18 bp, Artificial sequence
  synthetic polynucleotide sequence
tggagggacacaccagca

SEQ ID NO: 37991 - DNA, 20 bp, Artificial sequence
  synthetic polynucleotide sequence
atgccagcagttcctacaga

SEQ ID NO: 37992 - DNA, 22 bp, Artificial sequence
  synthetic polynucleotide sequence
acatgtcgaccaacaccatgca

SEQ ID NO: 37993 - DNA, 21 bp, Artificial sequence
  synthetic polynucleotide sequence
acatgggctcaggtgtcagca

SEQ ID NO: 37994 - DNA, 21 bp, Artificial sequence
  synthetic polynucleotide sequence
tcattcaacgcgcacatccga

SEQ ID NO: 37995 - DNA, 22 bp, Artificial sequence
  synthetic polynucleotide sequence
tcaatggacggtcacagtgcta

SEQ ID NO: 37996 - DNA, 22 bp, Artificial sequence
  synthetic polynucleotide sequence
taagatgctaacccctgagcca

SEQ ID NO: 37997 - DNA, 21 bp, Artificial sequence
  synthetic polynucleotide sequence
tcagaacctgagcgatgccaa

SEQ ID NO: 37998 - DNA, 23 bp, Artificial sequence
  synthetic polynucleotide sequence
aaatatcacggaccagcttgtca

SEQ ID NO: 37999 - DNA, 18 bp, Artificial sequence
  synthetic polynucleotide sequence
ccccgtgcctcgacctca

SEQ ID NO: 38000 - DNA, 19 bp, Artificial sequence
  synthetic polynucleotide sequence
gtgtggacagcacggccca

SEQ ID NO: 38001 - DNA, 20 bp, Artificial sequence
  synthetic polynucleotide sequence
cccaggaagatgaggaccca

SEQ ID NO: 38002 - DNA, 20 bp, Artificial sequence
  synthetic polynucleotide sequence
gagggaggcctgtgtgcaca

SEQ ID NO: 38003 - DNA, 21 bp, Artificial sequence
  synthetic polynucleotide sequence
gaagaactcactgcagagcga

SEQ ID NO: 38004 - DNA, 18 bp, Artificial sequence
  synthetic polynucleotide sequence
atgtcaaggtcacgcgca

SEQ ID NO: 38005 - DNA, 20 bp, Artificial sequence
  synthetic polynucleotide sequence
ggcatcaagacgcgccggca

SEQ ID NO: 38006 - DNA, 20 bp, Artificial sequence
  synthetic polynucleotide sequence
aagtccagccggttgagcga

SEQ ID NO: 38007 - DNA, 21 bp, Artificial sequence
  synthetic polynucleotide sequence
tcggcatgtgatgaacaccca

SEQ ID NO: 38008 - DNA, 25 bp, Artificial sequence
  synthetic polynucleotide sequence
gaggaaggagagagactttccacaa

SEQ ID NO: 38009 - DNA, 19 bp, Artificial sequence
  synthetic polynucleotide sequence
cagctggtgtgggaggaca

SEQ ID NO: 38010 - DNA, 18 bp, Artificial sequence
  synthetic polynucleotide sequence
agtccggcaatgaaccca

SEQ ID NO: 38011 - DNA, 21 bp, Artificial sequence
  synthetic polynucleotide sequence
ggatggaggtggtgaacagga

SEQ ID NO: 38012 - DNA, 20 bp, Artificial sequence
  synthetic polynucleotide sequence
ctcccacttcccaaacacca

SEQ ID NO: 38013 - DNA, 18 bp, Artificial sequence
  synthetic polynucleotide sequence
gccaatgcccagtggcaa

SEQ ID NO: 38014 - DNA, 18 bp, Artificial sequence
  synthetic polynucleotide sequence
ttgggggacgctgaggga

SEQ ID NO: 38015 - DNA, 18 bp, Artificial sequence
  synthetic polynucleotide sequence
gccatcgagtggcagaga

SEQ ID NO: 38016 - DNA, 20 bp, Artificial sequence
  synthetic polynucleotide sequence
cacaggtgtagaagccgcca

SEQ ID NO: 38017 - DNA, 21 bp, Artificial sequence
  synthetic polynucleotide sequence
aagaggaactgcagcgcagga

SEQ ID NO: 38018 - DNA, 19 bp, Artificial sequence
  synthetic polynucleotide sequence
tggtgcaacacacaacgca

SEQ ID NO: 38019 - DNA, 22 bp, Artificial sequence
  synthetic polynucleotide sequence
ctaagtaaggcagagtggtcca

SEQ ID NO: 38020 - DNA, 20 bp, Artificial sequence
  synthetic polynucleotide sequence
cttctccaagctcccaacca

SEQ ID NO: 38021 - DNA, 20 bp, Artificial sequence
  synthetic polynucleotide sequence
tcaatcgaagctcgggcgga

SEQ ID NO: 38022 - DNA, 22 bp, Artificial sequence
  synthetic polynucleotide sequence
gctatcagacttggacgctgga

SEQ ID NO: 38023 - DNA, 18 bp, Artificial sequence
  synthetic polynucleotide sequence
ctggtgacggatgggaca

SEQ ID NO: 38024 - DNA, 20 bp, Artificial sequence
  synthetic polynucleotide sequence
ctggctgaggtcatggacca

SEQ ID NO: 38025 - DNA, 20 bp, Artificial sequence
  synthetic polynucleotide sequence
gtggaggtcacacctggaca

SEQ ID NO: 38026 - DNA, 18 bp, Artificial sequence
  synthetic polynucleotide sequence
cacaccttggagcagcca

SEQ ID NO: 38027 - DNA, 21 bp, Artificial sequence
  synthetic polynucleotide sequence
tctgggtggctggacaaagga

SEQ ID NO: 38028 - DNA, 22 bp, Artificial sequence
  synthetic polynucleotide sequence
atgggagatgggaagatggcca

SEQ ID NO: 38029 - DNA, 18 bp, Artificial sequence
  synthetic polynucleotide sequence
gcggctgtgctcgaggaa

SEQ ID NO: 38030 - DNA, 18 bp, Artificial sequence
  synthetic polynucleotide sequence
acctctgtggggccagca

SEQ ID NO: 38031 - DNA, 18 bp, Artificial sequence
  synthetic polynucleotide sequence
tcctggtgccccgtggca

SEQ ID NO: 38032 - DNA, 21 bp, Artificial sequence
  synthetic polynucleotide sequence
tgatacacagcctggacggca

SEQ ID NO: 38033 - DNA, 20 bp, Artificial sequence
  synthetic polynucleotide sequence
aatgtagcccgtctgcccga

SEQ ID NO: 38034 - DNA, 18 bp, Artificial sequence
  synthetic polynucleotide sequence
cggcgtgcagctgcagga

SEQ ID NO: 38035 - DNA, 18 bp, Artificial sequence
  synthetic polynucleotide sequence
cccaggggagagtgcaca

SEQ ID NO: 38036 - DNA, 20 bp, Artificial sequence
  synthetic polynucleotide sequence
gaaagaggccaggagggtca

SEQ ID NO: 38037 - DNA, 21 bp, Artificial sequence
  synthetic polynucleotide sequence
gcacaggagagagggcagaga

SEQ ID NO: 38038 - DNA, 21 bp, Artificial sequence
  synthetic polynucleotide sequence
atctcccctctcagaccctca

SEQ ID NO: 38039 - DNA, 20 bp, Artificial sequence
  synthetic polynucleotide sequence
cgcacgctgttccagcagca

SEQ ID NO: 38040 - DNA, 20 bp, Artificial sequence
  synthetic polynucleotide sequence
ccagaagtccacggtctcca

SEQ ID NO: 38041 - DNA, 21 bp, Artificial sequence
  synthetic polynucleotide sequence
cctggtaccacaccctccaga

SEQ ID NO: 38042 - DNA, 19 bp, Artificial sequence
  synthetic polynucleotide sequence
ggtccatggcgctgcagga

SEQ ID NO: 38043 - DNA, 20 bp, Artificial sequence
  synthetic polynucleotide sequence
aagatccccgagcgcatcca

SEQ ID NO: 38044 - DNA, 20 bp, Artificial sequence
  synthetic polynucleotide sequence
ccgagaaagtgggtgcggca

SEQ ID NO: 38045 - DNA, 22 bp, Artificial sequence
  synthetic polynucleotide sequence
aagcaggttctcccagcagaga

SEQ ID NO: 38046 - DNA, 20 bp, Artificial sequence
  synthetic polynucleotide sequence
cgcggccgtggacgatggaa

SEQ ID NO: 38047 - DNA, 21 bp, Artificial sequence
  synthetic polynucleotide sequence
cctcgggggctctacaaggaa

SEQ ID NO: 38048 - DNA, 21 bp, Artificial sequence
  synthetic polynucleotide sequence
accggagatctgccaccctga

SEQ ID NO: 38049 - DNA, 21 bp, Artificial sequence
  synthetic polynucleotide sequence
atgacagcagtgacctggtca

SEQ ID NO: 38050 - DNA, 20 bp, Artificial sequence
  synthetic polynucleotide sequence
cgggtaccaggatgtcggca

SEQ ID NO: 38051 - DNA, 21 bp, Artificial sequence
  synthetic polynucleotide sequence
ggcacggagaaacccctagga

SEQ ID NO: 38052 - DNA, 19 bp, Artificial sequence
  synthetic polynucleotide sequence
tgagccagacctcctggga

SEQ ID NO: 38053 - DNA, 18 bp, Artificial sequence
  synthetic polynucleotide sequence
cgggaagacgctggacca

SEQ ID NO: 38054 - DNA, 18 bp, Artificial sequence
  synthetic polynucleotide sequence
cgggcttgacggtgacga

SEQ ID NO: 38055 - DNA, 20 bp, Artificial sequence
  synthetic polynucleotide sequence
gtgaaccctgcaccaagcga

SEQ ID NO: 38056 - DNA, 20 bp, Artificial sequence
  synthetic polynucleotide sequence
gaggacggtgggaccctgaa

SEQ ID NO: 38057 - DNA, 22 bp, Artificial sequence
  synthetic polynucleotide sequence
tgatgccagccttgaagatgca

SEQ ID NO: 38058 - DNA, 20 bp, Artificial sequence
  synthetic polynucleotide sequence
acctgcacagatggcggcta

SEQ ID NO: 38059 - DNA, 18 bp, Artificial sequence
  synthetic polynucleotide sequence
caggctcgttgggaagca

SEQ ID NO: 38060 - DNA, 18 bp, Artificial sequence
  synthetic polynucleotide sequence
cggttccactcgcagcca

SEQ ID NO: 38061 - DNA, 21 bp, Artificial sequence
  synthetic polynucleotide sequence
ccagggacaagtggtgaagca

SEQ ID NO: 38062 - DNA, 23 bp, Artificial sequence
  synthetic polynucleotide sequence
caaatgcacagcctgtaaaccca

SEQ ID NO: 38063 - DNA, 21 bp, Artificial sequence
  synthetic polynucleotide sequence
agaccaccaccacctttccca

SEQ ID NO: 38064 - DNA, 19 bp, Artificial sequence
  synthetic polynucleotide sequence
taggtaggctgcaactcca

SEQ ID NO: 38065 - DNA, 19 bp, Artificial sequence
  synthetic polynucleotide sequence
ctgagcttgagcagaccga

SEQ ID NO: 38066 - DNA, 20 bp, Artificial sequence
  synthetic polynucleotide sequence
ggcagggctgttcttcgaga

SEQ ID NO: 38067 - DNA, 20 bp, Artificial sequence
  synthetic polynucleotide sequence
tacgtctcagggagacccaa

SEQ ID NO: 38068 - DNA, 18 bp, Artificial sequence
  synthetic polynucleotide sequence
atcccggtcccaagagga

SEQ ID NO: 38069 - DNA, 20 bp, Artificial sequence
  synthetic polynucleotide sequence
ctgactggcgactacgggca

SEQ ID NO: 38070 - DNA, 21 bp, Artificial sequence
  synthetic polynucleotide sequence
aggtgatgaggtgggtgggca

SEQ ID NO: 38071 - DNA, 22 bp, Artificial sequence
  synthetic polynucleotide sequence
aagagtgcagacagattaggga

SEQ ID NO: 38072 - DNA, 20 bp, Artificial sequence
  synthetic polynucleotide sequence
aaaccagcagctggggtgca

SEQ ID NO: 38073 - DNA, 20 bp, Artificial sequence
  synthetic polynucleotide sequence
ggcgagttcgtcaggggcaa

SEQ ID NO: 38074 - DNA, 21 bp, Artificial sequence
  synthetic polynucleotide sequence
caaagatggaggggtcggaca

SEQ ID NO: 38075 - DNA, 18 bp, Artificial sequence
  synthetic polynucleotide sequence
gccaccatctccaaggca

SEQ ID NO: 38076 - DNA, 18 bp, Artificial sequence
  synthetic polynucleotide sequence
acgcatcggcctaaggga

SEQ ID NO: 38077 - DNA, 22 bp, Artificial sequence
  synthetic polynucleotide sequence
gacagatgcagactcagtgcca

SEQ ID NO: 38078 - DNA, 22 bp, Artificial sequence
  synthetic polynucleotide sequence
ggcagaataactggcatccaca

SEQ ID NO: 38079 - DNA, 21 bp, Artificial sequence
  synthetic polynucleotide sequence
catccggacgtcaagtgccaa

SEQ ID NO: 38080 - DNA, 22 bp, Artificial sequence
  synthetic polynucleotide sequence
accacgaagtacttgggaggga

SEQ ID NO: 38081 - DNA, 19 bp, Artificial sequence
  synthetic polynucleotide sequence
ggccaatcctaaggccgaa

SEQ ID NO: 38082 - DNA, 18 bp, Artificial sequence
  synthetic polynucleotide sequence
agggtgacgaagtgggca

SEQ ID NO: 38083 - DNA, 21 bp, Artificial sequence
  synthetic polynucleotide sequence
gctgctgtggcatggcaccaa

SEQ ID NO: 38084 - DNA, 21 bp, Artificial sequence
  synthetic polynucleotide sequence
cacccaggaacatgtagccga

SEQ ID NO: 38085 - DNA, 17 bp, Artificial sequence
  synthetic polynucleotide sequence
cccacaggacctcccca

SEQ ID NO: 38086 - DNA, 17 bp, Artificial sequence
  synthetic polynucleotide sequence
cagggaaggtgccagca

SEQ ID NO: 38087 - DNA, 18 bp, Artificial sequence
  synthetic polynucleotide sequence
accatcccccagacccga

SEQ ID NO: 38088 - DNA, 18 bp, Artificial sequence
  synthetic polynucleotide sequence
tgcagacatggtcggaca

SEQ ID NO: 38089 - DNA, 22 bp, Artificial sequence
  synthetic polynucleotide sequence
ataaacaggacccccttgctca

SEQ ID NO: 38090 - DNA, 22 bp, Artificial sequence
  synthetic polynucleotide sequence
acaaccagaccattcctcagga

SEQ ID NO: 38091 - DNA, 18 bp, Artificial sequence
  synthetic polynucleotide sequence
caggcaacctgtgagcca

SEQ ID NO: 38092 - DNA, 18 bp, Artificial sequence
  synthetic polynucleotide sequence
acggatgtccctggcaga

SEQ ID NO: 38093 - DNA, 21 bp, Artificial sequence
  synthetic polynucleotide sequence
taaaggccaaaacagcaggga

SEQ ID NO: 38094 - DNA, 19 bp, Artificial sequence
  synthetic polynucleotide sequence
tttggccgagcaggactga

SEQ ID NO: 38095 - DNA, 20 bp, Artificial sequence
  synthetic polynucleotide sequence
ggtccaggccgatgtgggca

SEQ ID NO: 38096 - DNA, 20 bp, Artificial sequence
  synthetic polynucleotide sequence
ctgagaagctgcagcgggga

SEQ ID NO: 38097 - DNA, 18 bp, Artificial sequence
  synthetic polynucleotide sequence
cgggaggcatgaacgtga

SEQ ID NO: 38098 - DNA, 18 bp, Artificial sequence
  synthetic polynucleotide sequence
agccctccaggagcccca

SEQ ID NO: 38099 - DNA, 19 bp, Artificial sequence
  synthetic polynucleotide sequence
ccagccacatctcggagga

SEQ ID NO: 38100 - DNA, 18 bp, Artificial sequence
  synthetic polynucleotide sequence
ccagaaggcccatgagca

SEQ ID NO: 38101 - DNA, 20 bp, Artificial sequence
  synthetic polynucleotide sequence
aaccggagtctgcagctgga

SEQ ID NO: 38102 - DNA, 20 bp, Artificial sequence
  synthetic polynucleotide sequence
gggctggaagcgcttggcca

SEQ ID NO: 38103 - DNA, 20 bp, Artificial sequence
  synthetic polynucleotide sequence
caatggaccagcaggaccca

SEQ ID NO: 38104 - DNA, 20 bp, Artificial sequence
  synthetic polynucleotide sequence
gctgagcacttgcgccagca

SEQ ID NO: 38105 - DNA, 18 bp, Artificial sequence
  synthetic polynucleotide sequence
ccatcagcagaggagcca

SEQ ID NO: 38106 - DNA, 18 bp, Artificial sequence
  synthetic polynucleotide sequence
tcaccagccagcagcaga

SEQ ID NO: 38107 - DNA, 20 bp, Artificial sequence
  synthetic polynucleotide sequence
aacaacagaagaggcctgca

SEQ ID NO: 38108 - DNA, 21 bp, Artificial sequence
  synthetic polynucleotide sequence
tgcagcacctgaagttcacca

SEQ ID NO: 38109 - DNA, 23 bp, Artificial sequence
  synthetic polynucleotide sequence
gaagagaagaaggaagacacaga

SEQ ID NO: 38110 - DNA, 20 bp, Artificial sequence
  synthetic polynucleotide sequence
gccacaggtgtgctccaaca

SEQ ID NO: 38111 - DNA, 23 bp, Artificial sequence
  synthetic polynucleotide sequence
gatccgtcatcaaagggagtcaa

SEQ ID NO: 38112 - DNA, 20 bp, Artificial sequence
  synthetic polynucleotide sequence
cccaggcccccaagtctcaa

SEQ ID NO: 38113 - DNA, 21 bp, Artificial sequence
  synthetic polynucleotide sequence
gtataagtgccgggaagagga

SEQ ID NO: 38114 - DNA, 18 bp, Artificial sequence
  synthetic polynucleotide sequence
atgaggacagcccctgca

SEQ ID NO: 38115 - DNA, 21 bp, Artificial sequence
  synthetic polynucleotide sequence
atcctcaagtgtgcacaggga

SEQ ID NO: 38116 - DNA, 20 bp, Artificial sequence
  synthetic polynucleotide sequence
gcaggccagtgatgacagga

SEQ ID NO: 38117 - DNA, 20 bp, Artificial sequence
  synthetic polynucleotide sequence
tcctctccacagagcaagca

SEQ ID NO: 38118 - DNA, 21 bp, Artificial sequence
  synthetic polynucleotide sequence
atgaggagcagtgacaggcca

SEQ ID NO: 38119 - DNA, 19 bp, Artificial sequence
  synthetic polynucleotide sequence
tgcctgggagatagcccaa

SEQ ID NO: 38120 - DNA, 19 bp, Artificial sequence
  synthetic polynucleotide sequence
gcctccagctgctgaacca

SEQ ID NO: 38121 - DNA, 18 bp, Artificial sequence
  synthetic polynucleotide sequence
cgacatggcagtccccaa

SEQ ID NO: 38122 - DNA, 18 bp, Artificial sequence
  synthetic polynucleotide sequence
gcggaagaagctcccaca

SEQ ID NO: 38123 - DNA, 20 bp, Artificial sequence
  synthetic polynucleotide sequence
ggcgtcccagagaagggcaa

SEQ ID NO: 38124 - DNA, 20 bp, Artificial sequence
  synthetic polynucleotide sequence
atgttgaccacgccggtgga

SEQ ID NO: 38125 - DNA, 21 bp, Artificial sequence
  synthetic polynucleotide sequence
ccgggactacaagcaaggaga

SEQ ID NO: 38126 - DNA, 20 bp, Artificial sequence
  synthetic polynucleotide sequence
ggctgatggagctcaccgaa

SEQ ID NO: 38127 - DNA, 19 bp, Artificial sequence
  synthetic polynucleotide sequence
tcccagagtggtgtggaca

SEQ ID NO: 38128 - DNA, 21 bp, Artificial sequence
  synthetic polynucleotide sequence
aagacgtcagggtaggaagga

SEQ ID NO: 38129 - DNA, 18 bp, Artificial sequence
  synthetic polynucleotide sequence
accccatgaaccccacca

SEQ ID NO: 38130 - DNA, 18 bp, Artificial sequence
  synthetic polynucleotide sequence
ccccggtgagaggggaga

SEQ ID NO: 38131 - DNA, 25 bp, Artificial sequence
  synthetic polynucleotide sequence
tgggaaggagatggcatagagaaga

SEQ ID NO: 38132 - DNA, 20 bp, Artificial sequence
  synthetic polynucleotide sequence
gccagagaggcatcgaggca

SEQ ID NO: 38133 - DNA, 20 bp, Artificial sequence
  synthetic polynucleotide sequence
cacccaaccaaccagtccca

SEQ ID NO: 38134 - DNA, 20 bp, Artificial sequence
  synthetic polynucleotide sequence
ccgctgatggagtacgacga

SEQ ID NO: 38135 - DNA, 22 bp, Artificial sequence
  synthetic polynucleotide sequence
caaccaattccacaacccacca

SEQ ID NO: 38136 - DNA, 20 bp, Artificial sequence
  synthetic polynucleotide sequence
gaagctgggcataggcggca

SEQ ID NO: 38137 - DNA, 22 bp, Artificial sequence
  synthetic polynucleotide sequence
gaggcaccaaaaccaagaccaa

SEQ ID NO: 38138 - DNA, 22 bp, Artificial sequence
  synthetic polynucleotide sequence
tcagggaattggccacgtcaga

SEQ ID NO: 38139 - DNA, 18 bp, Artificial sequence
  synthetic polynucleotide sequence
ctggcagcgacaagagga

SEQ ID NO: 38140 - DNA, 18 bp, Artificial sequence
  synthetic polynucleotide sequence
ctgaaggcatccgtgcga

SEQ ID NO: 38141 - DNA, 18 bp, Artificial sequence
  synthetic polynucleotide sequence
cctggagcaggaagccaa

SEQ ID NO: 38142 - DNA, 18 bp, Artificial sequence
  synthetic polynucleotide sequence
gacaatgaggtgccccca

SEQ ID NO: 38143 - DNA, 21 bp, Artificial sequence
  synthetic polynucleotide sequence
atgacgatgagaaacgccgga

SEQ ID NO: 38144 - DNA, 21 bp, Artificial sequence
  synthetic polynucleotide sequence
gactggcttgaacctgaggga

SEQ ID NO: 38145 - DNA, 18 bp, Artificial sequence
  synthetic polynucleotide sequence
cacgagtcgatgcacgca

SEQ ID NO: 38146 - DNA, 18 bp, Artificial sequence
  synthetic polynucleotide sequence
tgggaaggccactgggaa

SEQ ID NO: 38147 - DNA, 21 bp, Artificial sequence
  synthetic polynucleotide sequence
ttgggccatgagagcaatgca

SEQ ID NO: 38148 - DNA, 19 bp, Artificial sequence
  synthetic polynucleotide sequence
tcaagcagaatggcctcca

SEQ ID NO: 38149 - DNA, 18 bp, Artificial sequence
  synthetic polynucleotide sequence
gcgttgggaactaggcca

SEQ ID NO: 38150 - DNA, 20 bp, Artificial sequence
  synthetic polynucleotide sequence
caatgtgtgcagcagaagga

SEQ ID NO: 38151 - DNA, 20 bp, Artificial sequence
  synthetic polynucleotide sequence
caccagcgagtgaggtccca

SEQ ID NO: 38152 - DNA, 18 bp, Artificial sequence
  synthetic polynucleotide sequence
tcctgggggtgggctgga

SEQ ID NO: 38153 - DNA, 23 bp, Artificial sequence
  synthetic polynucleotide sequence
cataggatggcagacagtaggaa

SEQ ID NO: 38154 - DNA, 22 bp, Artificial sequence
  synthetic polynucleotide sequence
ctaccacaatggcaatcaccca

SEQ ID NO: 38155 - DNA, 18 bp, Artificial sequence
  synthetic polynucleotide sequence
ctcgccctcaactcccaa

SEQ ID NO: 38156 - DNA, 18 bp, Artificial sequence
  synthetic polynucleotide sequence
gcactgatgccctgcgga

SEQ ID NO: 38157 - DNA, 19 bp, Artificial sequence
  synthetic polynucleotide sequence
ggagctcccaggaggagga

SEQ ID NO: 38158 - DNA, 21 bp, Artificial sequence
  synthetic polynucleotide sequence
atggagttgtcaggggacaca

SEQ ID NO: 38159 - DNA, 22 bp, Artificial sequence
  synthetic polynucleotide sequence
accaattcgcccaccacaccaa

SEQ ID NO: 38160 - DNA, 23 bp, Artificial sequence
  synthetic polynucleotide sequence
gataacatgacggagggtatcca

SEQ ID NO: 38161 - DNA, 18 bp, Artificial sequence
  synthetic polynucleotide sequence
gacccttcccgctgccca

SEQ ID NO: 38162 - DNA, 19 bp, Artificial sequence
  synthetic polynucleotide sequence
gctgccagggtctccagca

SEQ ID NO: 38163 - DNA, 18 bp, Artificial sequence
  synthetic polynucleotide sequence
cacagggtgacaaggcca

SEQ ID NO: 38164 - DNA, 20 bp, Artificial sequence
  synthetic polynucleotide sequence
ctgctgtacagaccccagca

SEQ ID NO: 38165 - DNA, 18 bp, Artificial sequence
  synthetic polynucleotide sequence
tcaaggacacccaggcca

SEQ ID NO: 38166 - DNA, 18 bp, Artificial sequence
  synthetic polynucleotide sequence
ccatgggtgaggtcacca

SEQ ID NO: 38167 - DNA, 18 bp, Artificial sequence
  synthetic polynucleotide sequence
tggaaggccgtgatgcca

SEQ ID NO: 38168 - DNA, 18 bp, Artificial sequence
  synthetic polynucleotide sequence
tctcagcctgcagggcca

SEQ ID NO: 38169 - DNA, 21 bp, Artificial sequence
  synthetic polynucleotide sequence
actgcagaggagaggaaccaa

SEQ ID NO: 38170 - DNA, 21 bp, Artificial sequence
  synthetic polynucleotide sequence
tgcttgtagggcaactcggga

SEQ ID NO: 38171 - DNA, 20 bp, Artificial sequence
  synthetic polynucleotide sequence
aaccacccatgaactcacca

SEQ ID NO: 38172 - DNA, 21 bp, Artificial sequence
  synthetic polynucleotide sequence
ctaatactggcagcagagcca

SEQ ID NO: 38173 - DNA, 21 bp, Artificial sequence
  synthetic polynucleotide sequence
cctcagcaccttaagccacca

SEQ ID NO: 38174 - DNA, 20 bp, Artificial sequence
  synthetic polynucleotide sequence
tccatgcatcagcaggcgga

SEQ ID NO: 38175 - DNA, 20 bp, Artificial sequence
  synthetic polynucleotide sequence
cggcagatgtcaggggcaca

SEQ ID NO: 38176 - DNA, 18 bp, Artificial sequence
  synthetic polynucleotide sequence
ccgtcaggggtggcgaga

SEQ ID NO: 38177 - DNA, 19 bp, Artificial sequence
  synthetic polynucleotide sequence
tcgcatcaacggctgggca

SEQ ID NO: 38178 - DNA, 20 bp, Artificial sequence
  synthetic polynucleotide sequence
cactgtccactcggacacca

SEQ ID NO: 38179 - DNA, 20 bp, Artificial sequence
  synthetic polynucleotide sequence
gtggaagctgctcaggcaga

SEQ ID NO: 38180 - DNA, 21 bp, Artificial sequence
  synthetic polynucleotide sequence
caagacatccaggtcacagca

SEQ ID NO: 38181 - DNA, 19 bp, Artificial sequence
  synthetic polynucleotide sequence
cctgcccctcaactaccca

SEQ ID NO: 38182 - DNA, 18 bp, Artificial sequence
  synthetic polynucleotide sequence
gcagctggatggaaggca

SEQ ID NO: 38183 - DNA, 21 bp, Artificial sequence
  synthetic polynucleotide sequence
tactcaggcagagtgtggcaa

SEQ ID NO: 38184 - DNA, 25 bp, Artificial sequence
  synthetic polynucleotide sequence
gcacacatagaaacatgagggggaa

SEQ ID NO: 38185 - DNA, 20 bp, Artificial sequence
  synthetic polynucleotide sequence
cagcccacgagtgacacaga

SEQ ID NO: 38186 - DNA, 20 bp, Artificial sequence
  synthetic polynucleotide sequence
gaggaggactgtggtggaga

SEQ ID NO: 38187 - DNA, 21 bp, Artificial sequence
  synthetic polynucleotide sequence
gacggataaggatgcggacca

SEQ ID NO: 38188 - DNA, 19 bp, Artificial sequence
  synthetic polynucleotide sequence
ttgccagcatctgcagcca

SEQ ID NO: 38189 - DNA, 20 bp, Artificial sequence
  synthetic polynucleotide sequence
gagaccagggcagtgaggaa

SEQ ID NO: 38190 - DNA, 18 bp, Artificial sequence
  synthetic polynucleotide sequence
ttccgctcggcgaaggca

SEQ ID NO: 38191 - DNA, 20 bp, Artificial sequence
  synthetic polynucleotide sequence
tccagaggcagtgaccagca

SEQ ID NO: 38192 - DNA, 22 bp, Artificial sequence
  synthetic polynucleotide sequence
caaaaccaccaagatggcagga

SEQ ID NO: 38193 - DNA, 19 bp, Artificial sequence
  synthetic polynucleotide sequence
cctcccctcaactccacca

SEQ ID NO: 38194 - DNA, 18 bp, Artificial sequence
  synthetic polynucleotide sequence
ggatcctgggcgagcaca

SEQ ID NO: 38195 - DNA, 18 bp, Artificial sequence
  synthetic polynucleotide sequence
ccagcagcagcatccaca

SEQ ID NO: 38196 - DNA, 18 bp, Artificial sequence
  synthetic polynucleotide sequence
ccgatccacctcactgca

SEQ ID NO: 38197 - DNA, 21 bp, Artificial sequence
  synthetic polynucleotide sequence
tgtgaccatctgcagccccaa

SEQ ID NO: 38198 - DNA, 20 bp, Artificial sequence
  synthetic polynucleotide sequence
cacggaaggcttggtgggca

SEQ ID NO: 38199 - DNA, 19 bp, Artificial sequence
  synthetic polynucleotide sequence
cagcgaggagagaggccaa

SEQ ID NO: 38200 - DNA, 18 bp, Artificial sequence
  synthetic polynucleotide sequence
ccaacactgtgagggcca

SEQ ID NO: 38201 - DNA, 20 bp, Artificial sequence
  synthetic polynucleotide sequence
cacatcccactcacccagga

SEQ ID NO: 38202 - DNA, 18 bp, Artificial sequence
  synthetic polynucleotide sequence
atgccagcaaccacgcca

SEQ ID NO: 38203 - DNA, 21 bp, Artificial sequence
  synthetic polynucleotide sequence
tcaacgacagcgattccgaca

SEQ ID NO: 38204 - DNA, 20 bp, Artificial sequence
  synthetic polynucleotide sequence
gcggtcagagtggcccagga

SEQ ID NO: 38205 - DNA, 20 bp, Artificial sequence
  synthetic polynucleotide sequence
agtcctgacctggccaagca

SEQ ID NO: 38206 - DNA, 20 bp, Artificial sequence
  synthetic polynucleotide sequence
gggaactgcactctgaggca

SEQ ID NO: 38207 - DNA, 19 bp, Artificial sequence
  synthetic polynucleotide sequence
gagaacggccaggccccaa

SEQ ID NO: 38208 - DNA, 20 bp, Artificial sequence
  synthetic polynucleotide sequence
ctctgctgcgagtaagacca

SEQ ID NO: 38209 - DNA, 19 bp, Artificial sequence
  synthetic polynucleotide sequence
caggcgctgtgggtccaga

SEQ ID NO: 38210 - DNA, 19 bp, Artificial sequence
  synthetic polynucleotide sequence
cttatgcgggccctcccca

SEQ ID NO: 38211 - DNA, 18 bp, Artificial sequence
  synthetic polynucleotide sequence
agggcacgtggtggcgaa

SEQ ID NO: 38212 - DNA, 18 bp, Artificial sequence
  synthetic polynucleotide sequence
taggcggtgtcgagggga

SEQ ID NO: 38213 - DNA, 20 bp, Artificial sequence
  synthetic polynucleotide sequence
gccaaaccacgacagcccaa

SEQ ID NO: 38214 - DNA, 20 bp, Artificial sequence
  synthetic polynucleotide sequence
gctgatcaggccctcctgga

SEQ ID NO: 38215 - DNA, 18 bp, Artificial sequence
  synthetic polynucleotide sequence
tggtggcgcagtgagcga

SEQ ID NO: 38216 - DNA, 18 bp, Artificial sequence
  synthetic polynucleotide sequence
cgccgtggtccttcacca

SEQ ID NO: 38217 - DNA, 20 bp, Artificial sequence
  synthetic polynucleotide sequence
ctcgcagcagaggagacaga

SEQ ID NO: 38218 - DNA, 20 bp, Artificial sequence
  synthetic polynucleotide sequence
tagaggtgggaccctgagga

SEQ ID NO: 38219 - DNA, 20 bp, Artificial sequence
  synthetic polynucleotide sequence
tcgcgcagcccgagtacaca

SEQ ID NO: 38220 - DNA, 18 bp, Artificial sequence
  synthetic polynucleotide sequence
gctctccgcgtgcaccga

SEQ ID NO: 38221 - DNA, 20 bp, Artificial sequence
  synthetic polynucleotide sequence
attgcaggcccagagaccga

SEQ ID NO: 38222 - DNA, 21 bp, Artificial sequence
  synthetic polynucleotide sequence
cctctgctgggagaatgacca

SEQ ID NO: 38223 - DNA, 20 bp, Artificial sequence
  synthetic polynucleotide sequence
tgaaagaccacggggagcca

SEQ ID NO: 38224 - DNA, 21 bp, Artificial sequence
  synthetic polynucleotide sequence
acagcagcagcgtgagaacca

SEQ ID NO: 38225 - DNA, 20 bp, Artificial sequence
  synthetic polynucleotide sequence
gtctgggaaccaggagggca

SEQ ID NO: 38226 - DNA, 20 bp, Artificial sequence
  synthetic polynucleotide sequence
cgacagcagctctgagcgca

SEQ ID NO: 38227 - DNA, 22 bp, Artificial sequence
  synthetic polynucleotide sequence
aaaatgagccacgacagcccaa

SEQ ID NO: 38228 - DNA, 20 bp, Artificial sequence
  synthetic polynucleotide sequence
gctgatcaggccctcctgga

SEQ ID NO: 38229 - DNA, 21 bp, Artificial sequence
  synthetic polynucleotide sequence
cgggacattcgagtgggagga

SEQ ID NO: 38230 - DNA, 19 bp, Artificial sequence
  synthetic polynucleotide sequence
gcctgagacctcctcccga

SEQ ID NO: 38231 - DNA, 19 bp, Artificial sequence
  synthetic polynucleotide sequence
cgcgacgcagccaagcaca

SEQ ID NO: 38232 - DNA, 20 bp, Artificial sequence
  synthetic polynucleotide sequence
accgagaggaggaagagcga

SEQ ID NO: 38233 - DNA, 20 bp, Artificial sequence
  synthetic polynucleotide sequence
ggacgtgagtggcaccggga

SEQ ID NO: 38234 - DNA, 20 bp, Artificial sequence
  synthetic polynucleotide sequence
acctggagcctccagtcaca

SEQ ID NO: 38235 - DNA, 21 bp, Artificial sequence
  synthetic polynucleotide sequence
tggacatgagcggcaccagga

SEQ ID NO: 38236 - DNA, 20 bp, Artificial sequence
  synthetic polynucleotide sequence
ctggggagggaagttgggga

SEQ ID NO: 38237 - DNA, 20 bp, Artificial sequence
  synthetic polynucleotide sequence
agtgcggctgtgcaggagga

SEQ ID NO: 38238 - DNA, 20 bp, Artificial sequence
  synthetic polynucleotide sequence
agagcctcccgtcagacaca

SEQ ID NO: 38239 - DNA, 19 bp, Artificial sequence
  synthetic polynucleotide sequence
cggctgtgcaggaggagca

SEQ ID NO: 38240 - DNA, 20 bp, Artificial sequence
  synthetic polynucleotide sequence
tctgagcctcctgtcagaca

SEQ ID NO: 38241 - DNA, 21 bp, Artificial sequence
  synthetic polynucleotide sequence
gggttagcgaggcaaatccca

SEQ ID NO: 38242 - DNA, 21 bp, Artificial sequence
  synthetic polynucleotide sequence
acacctccaatgggcaaagca

SEQ ID NO: 38243 - DNA, 20 bp, Artificial sequence
  synthetic polynucleotide sequence
gggcccctttccagggcaga

SEQ ID NO: 38244 - DNA, 20 bp, Artificial sequence
  synthetic polynucleotide sequence
ccggagcctccagtcagaca

SEQ ID NO: 38245 - DNA, 20 bp, Artificial sequence
  synthetic polynucleotide sequence
ggacgtaagcggcaccggga

SEQ ID NO: 38246 - DNA, 21 bp, Artificial sequence
  synthetic polynucleotide sequence
ccggtgtcctgaaccaagaga

SEQ ID NO: 38247 - DNA, 19 bp, Artificial sequence
  synthetic polynucleotide sequence
gacggtgactcgggccaga

SEQ ID NO: 38248 - DNA, 22 bp, Artificial sequence
  synthetic polynucleotide sequence
ccattgtccttgaccagcacca

SEQ ID NO: 38249 - DNA, 20 bp, Artificial sequence
  synthetic polynucleotide sequence
tgtctgacgggaggctcaga

SEQ ID NO: 38250 - DNA, 22 bp, Artificial sequence
  synthetic polynucleotide sequence
tgaacgggaagctattccgaga

SEQ ID NO: 38251 - DNA, 21 bp, Artificial sequence
  synthetic polynucleotide sequence
tgctgctgtgtaggaggagca

SEQ ID NO: 38252 - DNA, 19 bp, Artificial sequence
  synthetic polynucleotide sequence
ctgagcctcctgccaggca

SEQ ID NO: 38253 - DNA, 20 bp, Artificial sequence
  synthetic polynucleotide sequence
agcggctcccaaaatggcga

SEQ ID NO: 38254 - DNA, 21 bp, Artificial sequence
  synthetic polynucleotide sequence
agggtggagctcccatcagca

SEQ ID NO: 38255 - DNA, 21 bp, Artificial sequence
  synthetic polynucleotide sequence
agaacgacaatgcgcccgaga

SEQ ID NO: 38256 - DNA, 20 bp, Artificial sequence
  synthetic polynucleotide sequence
gtctctgtccaccgccacca

SEQ ID NO: 38257 - DNA, 18 bp, Artificial sequence
  synthetic polynucleotide sequence
cctgcttaaggccagcga

SEQ ID NO: 38258 - DNA, 18 bp, Artificial sequence
  synthetic polynucleotide sequence
gagactcgaggctgccga

SEQ ID NO: 38259 - DNA, 20 bp, Artificial sequence
  synthetic polynucleotide sequence
ctcaccacggactcgcggaa

SEQ ID NO: 38260 - DNA, 23 bp, Artificial sequence
  synthetic polynucleotide sequence
aaataccgaatcacctgacagca

SEQ ID NO: 38261 - DNA, 20 bp, Artificial sequence
  synthetic polynucleotide sequence
ccctccgccatacccaacga

SEQ ID NO: 38262 - DNA, 20 bp, Artificial sequence
  synthetic polynucleotide sequence
gtgggaataggtctgcagga

SEQ ID NO: 38263 - DNA, 20 bp, Artificial sequence
  synthetic polynucleotide sequence
ccctccgccaaacccaacga

SEQ ID NO: 38264 - DNA, 19 bp, Artificial sequence
  synthetic polynucleotide sequence
cctcccgaagcctgcagca

SEQ ID NO: 38265 - DNA, 21 bp, Artificial sequence
  synthetic polynucleotide sequence
tcaagctgagacgctggcaca

SEQ ID NO: 38266 - DNA, 19 bp, Artificial sequence
  synthetic polynucleotide sequence
gagtccgcggtgagggaga

SEQ ID NO: 38267 - DNA, 20 bp, Artificial sequence
  synthetic polynucleotide sequence
agactgaggcgctggcacaa

SEQ ID NO: 38268 - DNA, 20 bp, Artificial sequence
  synthetic polynucleotide sequence
aggtctgcaggaaagcccga

SEQ ID NO: 38269 - DNA, 20 bp, Artificial sequence
  synthetic polynucleotide sequence
ccctccgccaaacccaacga

SEQ ID NO: 38270 - DNA, 20 bp, Artificial sequence
  synthetic polynucleotide sequence
gtgggaataggtctgcagga

SEQ ID NO: 38271 - DNA, 20 bp, Artificial sequence
  synthetic polynucleotide sequence
gtgggcatggacggggtgca

SEQ ID NO: 38272 - DNA, 20 bp, Artificial sequence
  synthetic polynucleotide sequence
cgagagtccgcggtgaggga

SEQ ID NO: 38273 - DNA, 19 bp, Artificial sequence
  synthetic polynucleotide sequence
ccgtccaggaccatggcca

SEQ ID NO: 38274 - DNA, 21 bp, Artificial sequence
  synthetic polynucleotide sequence
ccgaaggcttcagactgccca

SEQ ID NO: 38275 - DNA, 21 bp, Artificial sequence
  synthetic polynucleotide sequence
ggtggtggcagtggacagaga

SEQ ID NO: 38276 - DNA, 20 bp, Artificial sequence
  synthetic polynucleotide sequence
gtgagcgtgacagtggccga

SEQ ID NO: 38277 - DNA, 19 bp, Artificial sequence
  synthetic polynucleotide sequence
cccaaccacagcgagggga

SEQ ID NO: 38278 - DNA, 20 bp, Artificial sequence
  synthetic polynucleotide sequence
acagcagatcctgaggggga

SEQ ID NO: 38279 - DNA, 20 bp, Artificial sequence
  synthetic polynucleotide sequence
ctaccacgtgctgcaggcca

SEQ ID NO: 38280 - DNA, 21 bp, Artificial sequence
  synthetic polynucleotide sequence
ggctgtcctccatcacgcaca

SEQ ID NO: 38281 - DNA, 20 bp, Artificial sequence
  synthetic polynucleotide sequence
tcagccaccgtcatgctgca

SEQ ID NO: 38282 - DNA, 19 bp, Artificial sequence
  synthetic polynucleotide sequence
cagtggcgggtctggagga

SEQ ID NO: 38283 - DNA, 20 bp, Artificial sequence
  synthetic polynucleotide sequence
ccccaactacagcgagggga

SEQ ID NO: 38284 - DNA, 21 bp, Artificial sequence
  synthetic polynucleotide sequence
ggccccagatgaatcaccgca

SEQ ID NO: 38285 - DNA, 21 bp, Artificial sequence
  synthetic polynucleotide sequence
cccccaactacagtcagggga

SEQ ID NO: 38286 - DNA, 21 bp, Artificial sequence
  synthetic polynucleotide sequence
atgggaagtcgactcgctgga

SEQ ID NO: 38287 - DNA, 21 bp, Artificial sequence
  synthetic polynucleotide sequence
gatactgccagacctcagcga

SEQ ID NO: 38288 - DNA, 21 bp, Artificial sequence
  synthetic polynucleotide sequence
ttggggggaactacaggtcca

SEQ ID NO: 38289 - DNA, 22 bp, Artificial sequence
  synthetic polynucleotide sequence
ggatttcagcgaccatcccaca

SEQ ID NO: 38290 - DNA, 22 bp, Artificial sequence
  synthetic polynucleotide sequence
atagctagaatcaccgcgagga

SEQ ID NO: 38291 - DNA, 20 bp, Artificial sequence
  synthetic polynucleotide sequence
atgggagctccaccctggga

SEQ ID NO: 38292 - DNA, 20 bp, Artificial sequence
  synthetic polynucleotide sequence
gtagtcgggcacgtgctgca

SEQ ID NO: 38293 - DNA, 18 bp, Artificial sequence
  synthetic polynucleotide sequence
cacctggcccaacaacca

SEQ ID NO: 38294 - DNA, 18 bp, Artificial sequence
  synthetic polynucleotide sequence
aatcccatggtgccggca

SEQ ID NO: 38295 - DNA, 22 bp, Artificial sequence
  synthetic polynucleotide sequence
atcatccattccagggaagcca

SEQ ID NO: 38296 - DNA, 21 bp, Artificial sequence
  synthetic polynucleotide sequence
ctaagtggggtggcatcgaga

SEQ ID NO: 38297 - DNA, 20 bp, Artificial sequence
  synthetic polynucleotide sequence
ggaatgccccggttcccaca

SEQ ID NO: 38298 - DNA, 20 bp, Artificial sequence
  synthetic polynucleotide sequence
tgcatgggctgatgagggga

SEQ ID NO: 38299 - DNA, 18 bp, Artificial sequence
  synthetic polynucleotide sequence
ggagccctccctaaggca

SEQ ID NO: 38300 - DNA, 18 bp, Artificial sequence
  synthetic polynucleotide sequence
tcagggggaggctgagca

SEQ ID NO: 38301 - DNA, 18 bp, Artificial sequence
  synthetic polynucleotide sequence
aggtacgccatctccgga

SEQ ID NO: 38302 - DNA, 18 bp, Artificial sequence
  synthetic polynucleotide sequence
aaggggatggcttgccga

SEQ ID NO: 38303 - DNA, 18 bp, Artificial sequence
  synthetic polynucleotide sequence
tgcgatgcccagcagcca

SEQ ID NO: 38304 - DNA, 21 bp, Artificial sequence
  synthetic polynucleotide sequence
gccaggggtagatgtaggcga

SEQ ID NO: 38305 - DNA, 18 bp, Artificial sequence
  synthetic polynucleotide sequence
ctaccaccgcagcgacga

SEQ ID NO: 38306 - DNA, 18 bp, Artificial sequence
  synthetic polynucleotide sequence
gtgtgtggtccttgccca

SEQ ID NO: 38307 - DNA, 18 bp, Artificial sequence
  synthetic polynucleotide sequence
ccaaggtgtggcaaccaa

SEQ ID NO: 38308 - DNA, 19 bp, Artificial sequence
  synthetic polynucleotide sequence
tctcgtagtccagggacca

SEQ ID NO: 38309 - DNA, 22 bp, Artificial sequence
  synthetic polynucleotide sequence
aagaagaagaggagctggagga

SEQ ID NO: 38310 - DNA, 22 bp, Artificial sequence
  synthetic polynucleotide sequence
agatgtatggggtcagctcaga

SEQ ID NO: 38311 - DNA, 20 bp, Artificial sequence
  synthetic polynucleotide sequence
gaggacgtggacattgacga

SEQ ID NO: 38312 - DNA, 18 bp, Artificial sequence
  synthetic polynucleotide sequence
accgtggacaggggagga

SEQ ID NO: 38313 - DNA, 21 bp, Artificial sequence
  synthetic polynucleotide sequence
ttctgccttccccgacacaga

SEQ ID NO: 38314 - DNA, 19 bp, Artificial sequence
  synthetic polynucleotide sequence
ttgaagcggctctgctcca

SEQ ID NO: 38315 - DNA, 18 bp, Artificial sequence
  synthetic polynucleotide sequence
tgtggccgagaccagcga

SEQ ID NO: 38316 - DNA, 18 bp, Artificial sequence
  synthetic polynucleotide sequence
cgagttggggtgggcaca

SEQ ID NO: 38317 - DNA, 18 bp, Artificial sequence
  synthetic polynucleotide sequence
gctgctcgagcccccaga

SEQ ID NO: 38318 - DNA, 18 bp, Artificial sequence
  synthetic polynucleotide sequence
gggagttgggcgcacgca

SEQ ID NO: 38319 - DNA, 18 bp, Artificial sequence
  synthetic polynucleotide sequence
gtgccacatctccaccca

SEQ ID NO: 38320 - DNA, 18 bp, Artificial sequence
  synthetic polynucleotide sequence
tgggtggggaaggagcca

SEQ ID NO: 38321 - DNA, 18 bp, Artificial sequence
  synthetic polynucleotide sequence
gcgccagcaaaatcagca

SEQ ID NO: 38322 - DNA, 18 bp, Artificial sequence
  synthetic polynucleotide sequence
gaaggagggtgcgatgca

SEQ ID NO: 38323 - DNA, 21 bp, Artificial sequence
  synthetic polynucleotide sequence
gcagtaacagcggcagctaca

SEQ ID NO: 38324 - DNA, 21 bp, Artificial sequence
  synthetic polynucleotide sequence
acagaaccaccttcagcgcga

SEQ ID NO: 38325 - DNA, 20 bp, Artificial sequence
  synthetic polynucleotide sequence
cctccaggacttggctcgca

SEQ ID NO: 38326 - DNA, 19 bp, Artificial sequence
  synthetic polynucleotide sequence
ttccattcgacggcggcga

SEQ ID NO: 38327 - DNA, 20 bp, Artificial sequence
  synthetic polynucleotide sequence
ggaggcactcaaggacctca

SEQ ID NO: 38328 - DNA, 18 bp, Artificial sequence
  synthetic polynucleotide sequence
cgaagccctcagaccgca

SEQ ID NO: 38329 - DNA, 21 bp, Artificial sequence
  synthetic polynucleotide sequence
gaaaagtcgcagcgagctgga

SEQ ID NO: 38330 - DNA, 19 bp, Artificial sequence
  synthetic polynucleotide sequence
tctcagcgctgcgactgga

SEQ ID NO: 38331 - DNA, 20 bp, Artificial sequence
  synthetic polynucleotide sequence
cagtcggagaccaggaagca

SEQ ID NO: 38332 - DNA, 18 bp, Artificial sequence
  synthetic polynucleotide sequence
acccgcgatgctgagaca

SEQ ID NO: 38333 - DNA, 21 bp, Artificial sequence
  synthetic polynucleotide sequence
gcaacgtgacccagggaagca

SEQ ID NO: 38334 - DNA, 20 bp, Artificial sequence
  synthetic polynucleotide sequence
gactgtctgaccaggcccga

SEQ ID NO: 38335 - DNA, 20 bp, Artificial sequence
  synthetic polynucleotide sequence
cgaggcgctcatcaggtcca

SEQ ID NO: 38336 - DNA, 20 bp, Artificial sequence
  synthetic polynucleotide sequence
tccgcagcagagagtccgga

SEQ ID NO: 38337 - DNA, 20 bp, Artificial sequence
  synthetic polynucleotide sequence
gccaagcaggcgcttcgcaa

SEQ ID NO: 38338 - DNA, 21 bp, Artificial sequence
  synthetic polynucleotide sequence
gaatcatccacgttcccgcca

SEQ ID NO: 38339 - DNA, 19 bp, Artificial sequence
  synthetic polynucleotide sequence
tagcagaggaggatgagca

SEQ ID NO: 38340 - DNA, 22 bp, Artificial sequence
  synthetic polynucleotide sequence
aagaccacacgctaatccagca

SEQ ID NO: 38341 - DNA, 18 bp, Artificial sequence
  synthetic polynucleotide sequence
acccacctgcccaaagca

SEQ ID NO: 38342 - DNA, 18 bp, Artificial sequence
  synthetic polynucleotide sequence
ggcactgcttgcaaggca

SEQ ID NO: 38343 - DNA, 20 bp, Artificial sequence
  synthetic polynucleotide sequence
gtggaggactccttgacaga

SEQ ID NO: 38344 - DNA, 19 bp, Artificial sequence
  synthetic polynucleotide sequence
ggggctacaatgtgccaca

SEQ ID NO: 38345 - DNA, 20 bp, Artificial sequence
  synthetic polynucleotide sequence
caagagccagagcgacccca

SEQ ID NO: 38346 - DNA, 18 bp, Artificial sequence
  synthetic polynucleotide sequence
tggaccccacgggctgga

SEQ ID NO: 38347 - DNA, 18 bp, Artificial sequence
  synthetic polynucleotide sequence
aggtgctggggcaaccaa

SEQ ID NO: 38348 - DNA, 18 bp, Artificial sequence
  synthetic polynucleotide sequence
tgaatggccaccgctgca

SEQ ID NO: 38349 - DNA, 20 bp, Artificial sequence
  synthetic polynucleotide sequence
aggcagctggccaagaggaa

SEQ ID NO: 38350 - DNA, 20 bp, Artificial sequence
  synthetic polynucleotide sequence
atcgccggaacttgccctga

SEQ ID NO: 38351 - DNA, 18 bp, Artificial sequence
  synthetic polynucleotide sequence
cggagacgcacacaggca

SEQ ID NO: 38352 - DNA, 20 bp, Artificial sequence
  synthetic polynucleotide sequence
ctcagaggtccagacaacca

SEQ ID NO: 38353 - DNA, 18 bp, Artificial sequence
  synthetic polynucleotide sequence
aggaggcaggcgacgaga

SEQ ID NO: 38354 - DNA, 18 bp, Artificial sequence
  synthetic polynucleotide sequence
ccgcaagaatccgtccca

SEQ ID NO: 38355 - DNA, 18 bp, Artificial sequence
  synthetic polynucleotide sequence
ctggcgggacatgcagca

SEQ ID NO: 38356 - DNA, 18 bp, Artificial sequence
  synthetic polynucleotide sequence
ctcagggtcctgcacgga

SEQ ID NO: 38357 - DNA, 19 bp, Artificial sequence
  synthetic polynucleotide sequence
ccgcctacatcctgggaca

SEQ ID NO: 38358 - DNA, 18 bp, Artificial sequence
  synthetic polynucleotide sequence
cgtggaggatgggggaca

SEQ ID NO: 38359 - DNA, 19 bp, Artificial sequence
  synthetic polynucleotide sequence
gtgacgggccaggaccaga

SEQ ID NO: 38360 - DNA, 19 bp, Artificial sequence
  synthetic polynucleotide sequence
gtcggcgtggtagtggcca

SEQ ID NO: 38361 - DNA, 18 bp, Artificial sequence
  synthetic polynucleotide sequence
atctcacacccacgccga

SEQ ID NO: 38362 - DNA, 18 bp, Artificial sequence
  synthetic polynucleotide sequence
tgcggacctgggatggca

SEQ ID NO: 38363 - DNA, 20 bp, Artificial sequence
  synthetic polynucleotide sequence
cagcaggatggacctggaga

SEQ ID NO: 38364 - DNA, 18 bp, Artificial sequence
  synthetic polynucleotide sequence
catcatgccactggggca

SEQ ID NO: 38365 - DNA, 19 bp, Artificial sequence
  synthetic polynucleotide sequence
cgtccacacagctccacca

SEQ ID NO: 38366 - DNA, 18 bp, Artificial sequence
  synthetic polynucleotide sequence
gacctcgtggcctcagca

SEQ ID NO: 38367 - DNA, 21 bp, Artificial sequence
  synthetic polynucleotide sequence
ggggtgatccgggtgaagcaa

SEQ ID NO: 38368 - DNA, 21 bp, Artificial sequence
  synthetic polynucleotide sequence
agccaggacggaatttggcca

SEQ ID NO: 38369 - DNA, 18 bp, Artificial sequence
  synthetic polynucleotide sequence
atggccaaagcacggaca

SEQ ID NO: 38370 - DNA, 18 bp, Artificial sequence
  synthetic polynucleotide sequence
ctgcagaagccctgagca

SEQ ID NO: 38371 - DNA, 18 bp, Artificial sequence
  synthetic polynucleotide sequence
agctgagtggcaggccca

SEQ ID NO: 38372 - DNA, 18 bp, Artificial sequence
  synthetic polynucleotide sequence
taagccagcaaggccaca

SEQ ID NO: 38373 - DNA, 20 bp, Artificial sequence
  synthetic polynucleotide sequence
gaaagaggggaagggccgga

SEQ ID NO: 38374 - DNA, 21 bp, Artificial sequence
  synthetic polynucleotide sequence
aggtggggaagtcttgccgga

SEQ ID NO: 38375 - DNA, 21 bp, Artificial sequence
  synthetic polynucleotide sequence
tccctggacactcacgccaga

SEQ ID NO: 38376 - DNA, 20 bp, Artificial sequence
  synthetic polynucleotide sequence
tctggaggttacgtcgggca

SEQ ID NO: 38377 - DNA, 22 bp, Artificial sequence
  synthetic polynucleotide sequence
atgaggagatcgccaagcacaa

SEQ ID NO: 38378 - DNA, 20 bp, Artificial sequence
  synthetic polynucleotide sequence
gacgtagggagccgctggca

SEQ ID NO: 38379 - DNA, 21 bp, Artificial sequence
  synthetic polynucleotide sequence
ccgggtggcacagacaaccaa

SEQ ID NO: 38380 - DNA, 20 bp, Artificial sequence
  synthetic polynucleotide sequence
tgtcttcccggccaagtgca

SEQ ID NO: 38381 - DNA, 21 bp, Artificial sequence
  synthetic polynucleotide sequence
ttcgaatacaggtgctgggga

SEQ ID NO: 38382 - DNA, 22 bp, Artificial sequence
  synthetic polynucleotide sequence
gaaagactccacatccccagca

SEQ ID NO: 38383 - DNA, 19 bp, Artificial sequence
  synthetic polynucleotide sequence
cctgaaggaggacccctca

SEQ ID NO: 38384 - DNA, 18 bp, Artificial sequence
  synthetic polynucleotide sequence
gctcagggacacagggca

SEQ ID NO: 38385 - DNA, 22 bp, Artificial sequence
  synthetic polynucleotide sequence
aatgaagctgagaccacatcca

SEQ ID NO: 38386 - DNA, 20 bp, Artificial sequence
  synthetic polynucleotide sequence
gtgtctgggctgcagacaga

SEQ ID NO: 38387 - DNA, 18 bp, Artificial sequence
  synthetic polynucleotide sequence
ggtggagattgccccaga

SEQ ID NO: 38388 - DNA, 19 bp, Artificial sequence
  synthetic polynucleotide sequence
tgtgaggacctgtgaggga

SEQ ID NO: 38389 - DNA, 19 bp, Artificial sequence
  synthetic polynucleotide sequence
ccacaccgtgaaagagcca

SEQ ID NO: 38390 - DNA, 18 bp, Artificial sequence
  synthetic polynucleotide sequence
tagtcccaggcgacccca

SEQ ID NO: 38391 - DNA, 24 bp, Artificial sequence
  synthetic polynucleotide sequence
cagttggcaggatgaggaacaaca

SEQ ID NO: 38392 - DNA, 20 bp, Artificial sequence
  synthetic polynucleotide sequence
cagggccgctggctgaccaa

SEQ ID NO: 38393 - DNA, 18 bp, Artificial sequence
  synthetic polynucleotide sequence
ggaggggccttcaccaca

SEQ ID NO: 38394 - DNA, 18 bp, Artificial sequence
  synthetic polynucleotide sequence
agcccaggaggcacagga

SEQ ID NO: 38395 - DNA, 18 bp, Artificial sequence
  synthetic polynucleotide sequence
accacagttggtgggcca

SEQ ID NO: 38396 - DNA, 18 bp, Artificial sequence
  synthetic polynucleotide sequence
cccacctccagagcccca

SEQ ID NO: 38397 - DNA, 20 bp, Artificial sequence
  synthetic polynucleotide sequence
ctgcaggccaaacacgggga

SEQ ID NO: 38398 - DNA, 18 bp, Artificial sequence
  synthetic polynucleotide sequence
taacctggcccgggccga

SEQ ID NO: 38399 - DNA, 19 bp, Artificial sequence
  synthetic polynucleotide sequence
gctgaagcaggccctctca

SEQ ID NO: 38400 - DNA, 20 bp, Artificial sequence
  synthetic polynucleotide sequence
atccgtcaacctctgcagga

SEQ ID NO: 38401 - DNA, 21 bp, Artificial sequence
  synthetic polynucleotide sequence
caactccagcgccaagaacca

SEQ ID NO: 38402 - DNA, 18 bp, Artificial sequence
  synthetic polynucleotide sequence
cagcagtcccagccccca

SEQ ID NO: 38403 - DNA, 19 bp, Artificial sequence
  synthetic polynucleotide sequence
cactccctgccagcgctca

SEQ ID NO: 38404 - DNA, 18 bp, Artificial sequence
  synthetic polynucleotide sequence
ttgctggggagcggggga

SEQ ID NO: 38405 - DNA, 21 bp, Artificial sequence
  synthetic polynucleotide sequence
ccagcagtcagttcaccagga

SEQ ID NO: 38406 - DNA, 21 bp, Artificial sequence
  synthetic polynucleotide sequence
gacacgtggcagagttacgca

SEQ ID NO: 38407 - DNA, 21 bp, Artificial sequence
  synthetic polynucleotide sequence
ggaccccaacgcagacactga

SEQ ID NO: 38408 - DNA, 19 bp, Artificial sequence
  synthetic polynucleotide sequence
ttcaccactgactgctgga

SEQ ID NO: 38409 - DNA, 20 bp, Artificial sequence
  synthetic polynucleotide sequence
gtgccaccaacgaggacaga

SEQ ID NO: 38410 - DNA, 18 bp, Artificial sequence
  synthetic polynucleotide sequence
cgcccgaatccttcacga

SEQ ID NO: 38411 - DNA, 18 bp, Artificial sequence
  synthetic polynucleotide sequence
tgaagtcccccaaggcca

SEQ ID NO: 38412 - DNA, 18 bp, Artificial sequence
  synthetic polynucleotide sequence
ctgagccacggatgggga

SEQ ID NO: 38413 - DNA, 20 bp, Artificial sequence
  synthetic polynucleotide sequence
atctccagacaggtggcaga

SEQ ID NO: 38414 - DNA, 18 bp, Artificial sequence
  synthetic polynucleotide sequence
ccagttgcaaccgaggca

SEQ ID NO: 38415 - DNA, 22 bp, Artificial sequence
  synthetic polynucleotide sequence
tcaatggcagcattccagagga

SEQ ID NO: 38416 - DNA, 22 bp, Artificial sequence
  synthetic polynucleotide sequence
gtaagcaggttcaccacaagca

SEQ ID NO: 38417 - DNA, 21 bp, Artificial sequence
  synthetic polynucleotide sequence
agtcccatctgaagtccggga

SEQ ID NO: 38418 - DNA, 19 bp, Artificial sequence
  synthetic polynucleotide sequence
tacgatgacagctgctgga

SEQ ID NO: 38419 - DNA, 18 bp, Artificial sequence
  synthetic polynucleotide sequence
cagccacccaaccaagca

SEQ ID NO: 38420 - DNA, 19 bp, Artificial sequence
  synthetic polynucleotide sequence
gtggaagtgcggtcacaga

SEQ ID NO: 38421 - DNA, 22 bp, Artificial sequence
  synthetic polynucleotide sequence
gagcataccggaaccaccaaca

SEQ ID NO: 38422 - DNA, 21 bp, Artificial sequence
  synthetic polynucleotide sequence
tgcagaaggcgataagctgca

SEQ ID NO: 38423 - DNA, 18 bp, Artificial sequence
  synthetic polynucleotide sequence
gttccccaaagcggcaga

SEQ ID NO: 38424 - DNA, 19 bp, Artificial sequence
  synthetic polynucleotide sequence
ggccctagtgccatccaga

SEQ ID NO: 38425 - DNA, 20 bp, Artificial sequence
  synthetic polynucleotide sequence
tacactcagagtgccccaga

SEQ ID NO: 38426 - DNA, 18 bp, Artificial sequence
  synthetic polynucleotide sequence
tccaggggctcatcagca

SEQ ID NO: 38427 - DNA, 18 bp, Artificial sequence
  synthetic polynucleotide sequence
tggggggatggcgacgca

SEQ ID NO: 38428 - DNA, 18 bp, Artificial sequence
  synthetic polynucleotide sequence
ccaaccccagggccagca

SEQ ID NO: 38429 - DNA, 18 bp, Artificial sequence
  synthetic polynucleotide sequence
accatagcctgggaggca

SEQ ID NO: 38430 - DNA, 18 bp, Artificial sequence
  synthetic polynucleotide sequence
cacgaattcctcccggga

SEQ ID NO: 38431 - DNA, 19 bp, Artificial sequence
  synthetic polynucleotide sequence
tgtgggagacatgggcaga

SEQ ID NO: 38432 - DNA, 19 bp, Artificial sequence
  synthetic polynucleotide sequence
tctccatcagaccctggca

SEQ ID NO: 38433 - DNA, 20 bp, Artificial sequence
  synthetic polynucleotide sequence
ctgggcagcaccatgctcaa

SEQ ID NO: 38434 - DNA, 20 bp, Artificial sequence
  synthetic polynucleotide sequence
ggcacgcgaagagggaggca

SEQ ID NO: 38435 - DNA, 20 bp, Artificial sequence
  synthetic polynucleotide sequence
ctctgggagacatgggcaga

SEQ ID NO: 38436 - DNA, 21 bp, Artificial sequence
  synthetic polynucleotide sequence
tgggtcatcaggtgcaggaga

SEQ ID NO: 38437 - DNA, 18 bp, Artificial sequence
  synthetic polynucleotide sequence
gccttgaagcccaaggca

SEQ ID NO: 38438 - DNA, 18 bp, Artificial sequence
  synthetic polynucleotide sequence
ccactttgccaggcagca

SEQ ID NO: 38439 - DNA, 18 bp, Artificial sequence
  synthetic polynucleotide sequence
agagccatggccaagcaa

SEQ ID NO: 38440 - DNA, 18 bp, Artificial sequence
  synthetic polynucleotide sequence
gggtctgggcagatggca

SEQ ID NO: 38441 - DNA, 21 bp, Artificial sequence
  synthetic polynucleotide sequence
ctggagcagacacggaaggaa

SEQ ID NO: 38442 - DNA, 21 bp, Artificial sequence
  synthetic polynucleotide sequence
cccagaattcagcagccacca

SEQ ID NO: 38443 - DNA, 19 bp, Artificial sequence
  synthetic polynucleotide sequence
gagacgacccggaaggaga

SEQ ID NO: 38444 - DNA, 20 bp, Artificial sequence
  synthetic polynucleotide sequence
ctcccagaactcagcagcca

SEQ ID NO: 38445 - DNA, 20 bp, Artificial sequence
  synthetic polynucleotide sequence
ctgtggaccgtgcaggagga

SEQ ID NO: 38446 - DNA, 20 bp, Artificial sequence
  synthetic polynucleotide sequence
atgccgttccgggaccggca

SEQ ID NO: 38447 - DNA, 20 bp, Artificial sequence
  synthetic polynucleotide sequence
cgggatgctgagacagggaa

SEQ ID NO: 38448 - DNA, 21 bp, Artificial sequence
  synthetic polynucleotide sequence
ttctcgagacactgccttgca

SEQ ID NO: 38449 - DNA, 18 bp, Artificial sequence
  synthetic polynucleotide sequence
gtcaccaggagcccacca

SEQ ID NO: 38450 - DNA, 18 bp, Artificial sequence
  synthetic polynucleotide sequence
gggagtggagaccgacca

SEQ ID NO: 38451 - DNA, 25 bp, Artificial sequence
  synthetic polynucleotide sequence
ggaggggctaggaacagatatcaca

SEQ ID NO: 38452 - DNA, 23 bp, Artificial sequence
  synthetic polynucleotide sequence
gatcaacagggcaaaagcaacca

SEQ ID NO: 38453 - DNA, 18 bp, Artificial sequence
  synthetic polynucleotide sequence
cggtactgcccctggaca

SEQ ID NO: 38454 - DNA, 20 bp, Artificial sequence
  synthetic polynucleotide sequence
agctccacgcctctgagaga

SEQ ID NO: 38455 - DNA, 18 bp, Artificial sequence
  synthetic polynucleotide sequence
cacgatgtggaccaccca

SEQ ID NO: 38456 - DNA, 19 bp, Artificial sequence
  synthetic polynucleotide sequence
gccaagatcaaggagccca

SEQ ID NO: 38457 - DNA, 22 bp, Artificial sequence
  synthetic polynucleotide sequence
atgattatcggacactgcgcca

SEQ ID NO: 38458 - DNA, 20 bp, Artificial sequence
  synthetic polynucleotide sequence
cagtactgcaggggtcggca

SEQ ID NO: 38459 - DNA, 22 bp, Artificial sequence
  synthetic polynucleotide sequence
accattatcgaacgctgcgcca

SEQ ID NO: 38460 - DNA, 18 bp, Artificial sequence
  synthetic polynucleotide sequence
caggtccaaggggcggca

SEQ ID NO: 38461 - DNA, 21 bp, Artificial sequence
  synthetic polynucleotide sequence
cgatctggaccatcccggcta

SEQ ID NO: 38462 - DNA, 20 bp, Artificial sequence
  synthetic polynucleotide sequence
gttgcactcaggctcggcga

SEQ ID NO: 38463 - DNA, 18 bp, Artificial sequence
  synthetic polynucleotide sequence
gcgtgttcgtgaacccca

SEQ ID NO: 38464 - DNA, 18 bp, Artificial sequence
  synthetic polynucleotide sequence
ccagccctgagatctgca

SEQ ID NO: 38465 - DNA, 20 bp, Artificial sequence
  synthetic polynucleotide sequence
ccccgcagtgcacacctaga

SEQ ID NO: 38466 - DNA, 20 bp, Artificial sequence
  synthetic polynucleotide sequence
agagggagtgaccgccacca

SEQ ID NO: 38467 - DNA, 18 bp, Artificial sequence
  synthetic polynucleotide sequence
gctgctgcaacaaccgca

SEQ ID NO: 38468 - DNA, 18 bp, Artificial sequence
  synthetic polynucleotide sequence
cgggtcacaggccgtgca

SEQ ID NO: 38469 - DNA, 20 bp, Artificial sequence
  synthetic polynucleotide sequence
atacagctgcacacctcgta

SEQ ID NO: 38470 - DNA, 19 bp, Artificial sequence
  synthetic polynucleotide sequence
tgtggagacaacaggcaca

SEQ ID NO: 38471 - DNA, 20 bp, Artificial sequence
  synthetic polynucleotide sequence
tacagttgcactcccaggaa

SEQ ID NO: 38472 - DNA, 18 bp, Artificial sequence
  synthetic polynucleotide sequence
gcatgtgcaggacctcca

SEQ ID NO: 38473 - DNA, 18 bp, Artificial sequence
  synthetic polynucleotide sequence
tgggtaccggatggccaa

SEQ ID NO: 38474 - DNA, 20 bp, Artificial sequence
  synthetic polynucleotide sequence
caggcagcagattctccaca

SEQ ID NO: 38475 - DNA, 19 bp, Artificial sequence
  synthetic polynucleotide sequence
tcagctaccaggtggccaa

SEQ ID NO: 38476 - DNA, 20 bp, Artificial sequence
  synthetic polynucleotide sequence
cagagcaggatcccgaagga

SEQ ID NO: 38477 - DNA, 18 bp, Artificial sequence
  synthetic polynucleotide sequence
agagagcggcagccagca

SEQ ID NO: 38478 - DNA, 18 bp, Artificial sequence
  synthetic polynucleotide sequence
cctctcggacgcacagga

SEQ ID NO: 38479 - DNA, 18 bp, Artificial sequence
  synthetic polynucleotide sequence
acccctcggatcacgtca

SEQ ID NO: 38480 - DNA, 18 bp, Artificial sequence
  synthetic polynucleotide sequence
caggccagagcaatgcca

SEQ ID NO: 38481 - DNA, 20 bp, Artificial sequence
  synthetic polynucleotide sequence
cctggtatgggcactgccca

SEQ ID NO: 38482 - DNA, 22 bp, Artificial sequence
  synthetic polynucleotide sequence
attctctagcaccaccactgga

SEQ ID NO: 38483 - DNA, 18 bp, Artificial sequence
  synthetic polynucleotide sequence
cccaatgcagtgggcaca

SEQ ID NO: 38484 - DNA, 21 bp, Artificial sequence
  synthetic polynucleotide sequence
taaaacagctccaaggtcaca

SEQ ID NO: 38485 - DNA, 20 bp, Artificial sequence
  synthetic polynucleotide sequence
gtgcacccactgcaaggaga

SEQ ID NO: 38486 - DNA, 20 bp, Artificial sequence
  synthetic polynucleotide sequence
gagtagggaagccgtgcaca

SEQ ID NO: 38487 - DNA, 20 bp, Artificial sequence
  synthetic polynucleotide sequence
gatgctgggcacaaactcaa

SEQ ID NO: 38488 - DNA, 19 bp, Artificial sequence
  synthetic polynucleotide sequence
ccttcccatcacgcgagaa

SEQ ID NO: 38489 - DNA, 20 bp, Artificial sequence
  synthetic polynucleotide sequence
gtcctagaggtggccaagga

SEQ ID NO: 38490 - DNA, 18 bp, Artificial sequence
  synthetic polynucleotide sequence
tcgtccaggatggcggca

SEQ ID NO: 38491 - DNA, 21 bp, Artificial sequence
  synthetic polynucleotide sequence
cagacggctcctgaagaagga

SEQ ID NO: 38492 - DNA, 20 bp, Artificial sequence
  synthetic polynucleotide sequence
ggcctcgcagctgagtcgca

SEQ ID NO: 38493 - DNA, 18 bp, Artificial sequence
  synthetic polynucleotide sequence
cgccatcaatgcacgcaa

SEQ ID NO: 38494 - DNA, 18 bp, Artificial sequence
  synthetic polynucleotide sequence
acaggtgccgtggagcca

SEQ ID NO: 38495 - DNA, 22 bp, Artificial sequence
  synthetic polynucleotide sequence
atctgggcaatgctggaaagga

SEQ ID NO: 38496 - DNA, 19 bp, Artificial sequence
  synthetic polynucleotide sequence
ttccagaagtgcctcccca

SEQ ID NO: 38497 - DNA, 18 bp, Artificial sequence
  synthetic polynucleotide sequence
cagcgagcaggtggcaga

SEQ ID NO: 38498 - DNA, 18 bp, Artificial sequence
  synthetic polynucleotide sequence
gtgacgtggaaacgccca

SEQ ID NO: 38499 - DNA, 20 bp, Artificial sequence
  synthetic polynucleotide sequence
agggttacgggacagatgca

SEQ ID NO: 38500 - DNA, 18 bp, Artificial sequence
  synthetic polynucleotide sequence
ctggggacgcaccagtca

SEQ ID NO: 38501 - DNA, 20 bp, Artificial sequence
  synthetic polynucleotide sequence
cccctcccacctctaccaca

SEQ ID NO: 38502 - DNA, 18 bp, Artificial sequence
  synthetic polynucleotide sequence
ctcaagggaacaccccca

SEQ ID NO: 38503 - DNA, 18 bp, Artificial sequence
  synthetic polynucleotide sequence
cacctgtaacgtggcgga

SEQ ID NO: 38504 - DNA, 19 bp, Artificial sequence
  synthetic polynucleotide sequence
tccagctctggagctacca

SEQ ID NO: 38505 - DNA, 19 bp, Artificial sequence
  synthetic polynucleotide sequence
ccaagccacattggaagca

SEQ ID NO: 38506 - DNA, 23 bp, Artificial sequence
  synthetic polynucleotide sequence
gcatatgatggaggtgagaagga

SEQ ID NO: 38507 - DNA, 19 bp, Artificial sequence
  synthetic polynucleotide sequence
tagcctctgaaccccagga

SEQ ID NO: 38508 - DNA, 18 bp, Artificial sequence
  synthetic polynucleotide sequence
agtgctggaggcaggcga

SEQ ID NO: 38509 - DNA, 21 bp, Artificial sequence
  synthetic polynucleotide sequence
ctgcaggaaaatcgcgaggga

SEQ ID NO: 38510 - DNA, 21 bp, Artificial sequence
  synthetic polynucleotide sequence
acagtcggcacaggtgtagca

SEQ ID NO: 38511 - DNA, 18 bp, Artificial sequence
  synthetic polynucleotide sequence
caggcggggcacagagga

SEQ ID NO: 38512 - DNA, 18 bp, Artificial sequence
  synthetic polynucleotide sequence
gtcggcacacacgaagca

SEQ ID NO: 38513 - DNA, 18 bp, Artificial sequence
  synthetic polynucleotide sequence
caagcccacggccagcaa

SEQ ID NO: 38514 - DNA, 18 bp, Artificial sequence
  synthetic polynucleotide sequence
caggccgcagtcactgca

SEQ ID NO: 38515 - DNA, 19 bp, Artificial sequence
  synthetic polynucleotide sequence
cccagccaagtgaccagga

SEQ ID NO: 38516 - DNA, 18 bp, Artificial sequence
  synthetic polynucleotide sequence
ggttacaatgggcgcaca

SEQ ID NO: 38517 - DNA, 18 bp, Artificial sequence
  synthetic polynucleotide sequence
tgcacccagctgtgccaa

SEQ ID NO: 38518 - DNA, 18 bp, Artificial sequence
  synthetic polynucleotide sequence
ctcgctcgcaatagggca

SEQ ID NO: 38519 - DNA, 22 bp, Artificial sequence
  synthetic polynucleotide sequence
tacaaggtgactctgggacaga

SEQ ID NO: 38520 - DNA, 18 bp, Artificial sequence
  synthetic polynucleotide sequence
ttgcccacagcgtggcga

SEQ ID NO: 38521 - DNA, 21 bp, Artificial sequence
  synthetic polynucleotide sequence
tgctgctgcagaggaaagcca

SEQ ID NO: 38522 - DNA, 21 bp, Artificial sequence
  synthetic polynucleotide sequence
gcaatgtcagcatcgccgcca

SEQ ID NO: 38523 - DNA, 21 bp, Artificial sequence
  synthetic polynucleotide sequence
gccggctatgtcggaagacga

SEQ ID NO: 38524 - DNA, 21 bp, Artificial sequence
  synthetic polynucleotide sequence
ggctgacagggagtgtgagga

SEQ ID NO: 38525 - DNA, 18 bp, Artificial sequence
  synthetic polynucleotide sequence
caaagtccaagcgccaca

SEQ ID NO: 38526 - DNA, 21 bp, Artificial sequence
  synthetic polynucleotide sequence
ccgatggctagtaagacccca

SEQ ID NO: 38527 - DNA, 22 bp, Artificial sequence
  synthetic polynucleotide sequence
atgactccagaccacttcccaa

SEQ ID NO: 38528 - DNA, 21 bp, Artificial sequence
  synthetic polynucleotide sequence
atatcctgaccccagaaggca

SEQ ID NO: 38529 - DNA, 20 bp, Artificial sequence
  synthetic polynucleotide sequence
accaggcctgggtgagtgga

SEQ ID NO: 38530 - DNA, 21 bp, Artificial sequence
  synthetic polynucleotide sequence
tcagaccactgaaggcagaca

SEQ ID NO: 38531 - DNA, 19 bp, Artificial sequence
  synthetic polynucleotide sequence
tcggagccatgtacgcgaa

SEQ ID NO: 38532 - DNA, 21 bp, Artificial sequence
  synthetic polynucleotide sequence
tgctttcccggggtcaggcaa

SEQ ID NO: 38533 - DNA, 23 bp, Artificial sequence
  synthetic polynucleotide sequence
ctaaagaggagatggtgagacga

SEQ ID NO: 38534 - DNA, 18 bp, Artificial sequence
  synthetic polynucleotide sequence
cagcaaggcagcaggcta

SEQ ID NO: 38535 - DNA, 19 bp, Artificial sequence
  synthetic polynucleotide sequence
tctaggatgtcccgaccca

SEQ ID NO: 38536 - DNA, 22 bp, Artificial sequence
  synthetic polynucleotide sequence
atctggtcagaacacgaggtga

SEQ ID NO: 38537 - DNA, 21 bp, Artificial sequence
  synthetic polynucleotide sequence
taaacagatcggagaggctca

SEQ ID NO: 38538 - DNA, 22 bp, Artificial sequence
  synthetic polynucleotide sequence
ctaaagcagatctggcctccga

SEQ ID NO: 38539 - DNA, 21 bp, Artificial sequence
  synthetic polynucleotide sequence
ggtgcgccttggaaaccaaca

SEQ ID NO: 38540 - DNA, 22 bp, Artificial sequence
  synthetic polynucleotide sequence
agacagacctgggatgcacaga

SEQ ID NO: 38541 - DNA, 21 bp, Artificial sequence
  synthetic polynucleotide sequence
gtcccagtgcccaacatgaca

SEQ ID NO: 38542 - DNA, 21 bp, Artificial sequence
  synthetic polynucleotide sequence
tcggatggtgatggacgggga

SEQ ID NO: 38543 - DNA, 21 bp, Artificial sequence
  synthetic polynucleotide sequence
ggggagtcagaggaggaggaa

SEQ ID NO: 38544 - DNA, 22 bp, Artificial sequence
  synthetic polynucleotide sequence
agaacgtggtgcaaggtagaca

SEQ ID NO: 38545 - DNA, 18 bp, Artificial sequence
  synthetic polynucleotide sequence
gacagcctcgggacgcca

SEQ ID NO: 38546 - DNA, 19 bp, Artificial sequence
  synthetic polynucleotide sequence
gtcggtctccaggcggtca

SEQ ID NO: 38547 - DNA, 20 bp, Artificial sequence
  synthetic polynucleotide sequence
gatagcatgggccatgagga

SEQ ID NO: 38548 - DNA, 19 bp, Artificial sequence
  synthetic polynucleotide sequence
tcctgagaccgagtcacca

SEQ ID NO: 38549 - DNA, 22 bp, Artificial sequence
  synthetic polynucleotide sequence
acatagagcaggactgcaggaa

SEQ ID NO: 38550 - DNA, 21 bp, Artificial sequence
  synthetic polynucleotide sequence
agaagcgcacacgcatgctga

SEQ ID NO: 38551 - DNA, 18 bp, Artificial sequence
  synthetic polynucleotide sequence
caaggccagcgaccagga

SEQ ID NO: 38552 - DNA, 18 bp, Artificial sequence
  synthetic polynucleotide sequence
gccaggctgggaagacca

SEQ ID NO: 38553 - DNA, 19 bp, Artificial sequence
  synthetic polynucleotide sequence
gggactcagacaccaccga

SEQ ID NO: 38554 - DNA, 18 bp, Artificial sequence
  synthetic polynucleotide sequence
gccagacccacagccaca

SEQ ID NO: 38555 - DNA, 19 bp, Artificial sequence
  synthetic polynucleotide sequence
cttacctctcgcggcgcca

SEQ ID NO: 38556 - DNA, 19 bp, Artificial sequence
  synthetic polynucleotide sequence
ttcagcagccgatctcgca

SEQ ID NO: 38557 - DNA, 21 bp, Artificial sequence
  synthetic polynucleotide sequence
tgctgaagggccaaacgcaca

SEQ ID NO: 38558 - DNA, 20 bp, Artificial sequence
  synthetic polynucleotide sequence
gctggaggcgcacgaagaga

SEQ ID NO: 38559 - DNA, 18 bp, Artificial sequence
  synthetic polynucleotide sequence
caccacgaccacaagcga

SEQ ID NO: 38560 - DNA, 20 bp, Artificial sequence
  synthetic polynucleotide sequence
tacaagaggaggtggcacca

SEQ ID NO: 38561 - DNA, 22 bp, Artificial sequence
  synthetic polynucleotide sequence
aatccctgaggccaaattccca

SEQ ID NO: 38562 - DNA, 21 bp, Artificial sequence
  synthetic polynucleotide sequence
tgatgcacagttgaccacgga

SEQ ID NO: 38563 - DNA, 20 bp, Artificial sequence
  synthetic polynucleotide sequence
gctgggctagaggatgagga

SEQ ID NO: 38564 - DNA, 19 bp, Artificial sequence
  synthetic polynucleotide sequence
caagtggatcagccaggga

SEQ ID NO: 38565 - DNA, 18 bp, Artificial sequence
  synthetic polynucleotide sequence
cggcagtgccacctgcca

SEQ ID NO: 38566 - DNA, 18 bp, Artificial sequence
  synthetic polynucleotide sequence
ggaacacggccaccgcga

SEQ ID NO: 38567 - DNA, 18 bp, Artificial sequence
  synthetic polynucleotide sequence
gctggagctgctgaacga

SEQ ID NO: 38568 - DNA, 19 bp, Artificial sequence
  synthetic polynucleotide sequence
gcatccaggactcgcggta

SEQ ID NO: 38569 - DNA, 18 bp, Artificial sequence
  synthetic polynucleotide sequence
gagcggcagtgagggcaa

SEQ ID NO: 38570 - DNA, 19 bp, Artificial sequence
  synthetic polynucleotide sequence
ggtcaccgacaagaaggca

SEQ ID NO: 38571 - DNA, 20 bp, Artificial sequence
  synthetic polynucleotide sequence
gtcggcctgcaaggaagaca

SEQ ID NO: 38572 - DNA, 20 bp, Artificial sequence
  synthetic polynucleotide sequence
aggacggcgggagatctcaa

SEQ ID NO: 38573 - DNA, 22 bp, Artificial sequence
  synthetic polynucleotide sequence
atgagatgctgcacctacccaa

SEQ ID NO: 38574 - DNA, 21 bp, Artificial sequence
  synthetic polynucleotide sequence
atccgctcagaagggttggga

SEQ ID NO: 38575 - DNA, 18 bp, Artificial sequence
  synthetic polynucleotide sequence
cccctgatccatgaccga

SEQ ID NO: 38576 - DNA, 19 bp, Artificial sequence
  synthetic polynucleotide sequence
ggatgccgtactggaggca

SEQ ID NO: 38577 - DNA, 19 bp, Artificial sequence
  synthetic polynucleotide sequence
ggccgctaaagtgtgacga

SEQ ID NO: 38578 - DNA, 18 bp, Artificial sequence
  synthetic polynucleotide sequence
gcctggtaacacgtgcca

SEQ ID NO: 38579 - DNA, 19 bp, Artificial sequence
  synthetic polynucleotide sequence
gccctcttggacgaggaca

SEQ ID NO: 38580 - DNA, 18 bp, Artificial sequence
  synthetic polynucleotide sequence
gggcatctggatccacca

SEQ ID NO: 38581 - DNA, 18 bp, Artificial sequence
  synthetic polynucleotide sequence
gactcacctggcccagga

SEQ ID NO: 38582 - DNA, 18 bp, Artificial sequence
  synthetic polynucleotide sequence
tgccactgtgctccacca

SEQ ID NO: 38583 - DNA, 20 bp, Artificial sequence
  synthetic polynucleotide sequence
aacatccggaatgaggagga

SEQ ID NO: 38584 - DNA, 18 bp, Artificial sequence
  synthetic polynucleotide sequence
ctcaagcacagcgtgcca

SEQ ID NO: 38585 - DNA, 18 bp, Artificial sequence
  synthetic polynucleotide sequence
gagcccccagttcaccca

SEQ ID NO: 38586 - DNA, 18 bp, Artificial sequence
  synthetic polynucleotide sequence
cctgcagctgggtgcaca

SEQ ID NO: 38587 - DNA, 19 bp, Artificial sequence
  synthetic polynucleotide sequence
gagggcctcagcgaccaca

SEQ ID NO: 38588 - DNA, 18 bp, Artificial sequence
  synthetic polynucleotide sequence
ctgcagcagccctggcca

SEQ ID NO: 38589 - DNA, 18 bp, Artificial sequence
  synthetic polynucleotide sequence
cagcacaggtggtgccaa

SEQ ID NO: 38590 - DNA, 18 bp, Artificial sequence
  synthetic polynucleotide sequence
ggtgtctggcgagggaca

SEQ ID NO: 38591 - DNA, 20 bp, Artificial sequence
  synthetic polynucleotide sequence
atcaatgcagcacgacctca

SEQ ID NO: 38592 - DNA, 20 bp, Artificial sequence
  synthetic polynucleotide sequence
ccagcttcacatccaagcca

SEQ ID NO: 38593 - DNA, 21 bp, Artificial sequence
  synthetic polynucleotide sequence
accacaactggggccatcgga

SEQ ID NO: 38594 - DNA, 23 bp, Artificial sequence
  synthetic polynucleotide sequence
cataaaatcctgcctcacagcca

SEQ ID NO: 38595 - DNA, 23 bp, Artificial sequence
  synthetic polynucleotide sequence
gtcaacaaagggaggagagagga

SEQ ID NO: 38596 - DNA, 20 bp, Artificial sequence
  synthetic polynucleotide sequence
tgcggggcacatggtgggca

SEQ ID NO: 38597 - DNA, 20 bp, Artificial sequence
  synthetic polynucleotide sequence
caggcatcaggatgtagcca

SEQ ID NO: 38598 - DNA, 18 bp, Artificial sequence
  synthetic polynucleotide sequence
cgggaacagggaagcgga

SEQ ID NO: 38599 - DNA, 25 bp, Artificial sequence
  synthetic polynucleotide sequence
gcagaagaagagatggagacagaga

SEQ ID NO: 38600 - DNA, 21 bp, Artificial sequence
  synthetic polynucleotide sequence
aatcgatgaagtcggccagca

SEQ ID NO: 38601 - DNA, 18 bp, Artificial sequence
  synthetic polynucleotide sequence
gcaggccatgctgagcca

SEQ ID NO: 38602 - DNA, 21 bp, Artificial sequence
  synthetic polynucleotide sequence
caaagaagctggagagcacga

SEQ ID NO: 38603 - DNA, 20 bp, Artificial sequence
  synthetic polynucleotide sequence
tggaagtgagatcctcgcca

SEQ ID NO: 38604 - DNA, 18 bp, Artificial sequence
  synthetic polynucleotide sequence
tgaggaattggccagcga

SEQ ID NO: 38605 - DNA, 18 bp, Artificial sequence
  synthetic polynucleotide sequence
cgtgggaggctacccaga

SEQ ID NO: 38606 - DNA, 20 bp, Artificial sequence
  synthetic polynucleotide sequence
caggacctcgcggttaagga

SEQ ID NO: 38607 - DNA, 20 bp, Artificial sequence
  synthetic polynucleotide sequence
gacctaccaggtgccctcca

SEQ ID NO: 38608 - DNA, 20 bp, Artificial sequence
  synthetic polynucleotide sequence
cccgccgctggtcctcagaa

SEQ ID NO: 38609 - DNA, 19 bp, Artificial sequence
  synthetic polynucleotide sequence
ctcgggaccagcagccgaa

SEQ ID NO: 38610 - DNA, 20 bp, Artificial sequence
  synthetic polynucleotide sequence
tgtcactactgcctgcccca

SEQ ID NO: 38611 - DNA, 20 bp, Artificial sequence
  synthetic polynucleotide sequence
gcgacctcacccggaagaga

SEQ ID NO: 38612 - DNA, 20 bp, Artificial sequence
  synthetic polynucleotide sequence
gtcgcccccaggaatggaca

SEQ ID NO: 38613 - DNA, 21 bp, Artificial sequence
  synthetic polynucleotide sequence
ccagcctcggatcctcaagca

SEQ ID NO: 38614 - DNA, 20 bp, Artificial sequence
  synthetic polynucleotide sequence
aactcgcacatgtccggcca

SEQ ID NO: 38615 - DNA, 18 bp, Artificial sequence
  synthetic polynucleotide sequence
cagcgggtcctacgagga

SEQ ID NO: 38616 - DNA, 20 bp, Artificial sequence
  synthetic polynucleotide sequence
gatctggaacacagcagcca

SEQ ID NO: 38617 - DNA, 20 bp, Artificial sequence
  synthetic polynucleotide sequence
gaggaagaccgcaggaagga

SEQ ID NO: 38618 - DNA, 18 bp, Artificial sequence
  synthetic polynucleotide sequence
acgtcataggtggcccca

SEQ ID NO: 38619 - DNA, 22 bp, Artificial sequence
  synthetic polynucleotide sequence
atgtcatacagcgcaagaggga

SEQ ID NO: 38620 - DNA, 20 bp, Artificial sequence
  synthetic polynucleotide sequence
gttctgctgggcgtcgcgaa

SEQ ID NO: 38621 - DNA, 20 bp, Artificial sequence
  synthetic polynucleotide sequence
ctgttggacagacaacacga

SEQ ID NO: 38622 - DNA, 20 bp, Artificial sequence
  synthetic polynucleotide sequence
accaggatcacccagacaga

SEQ ID NO: 38623 - DNA, 20 bp, Artificial sequence
  synthetic polynucleotide sequence
tggatgcccatgtggagaga

SEQ ID NO: 38624 - DNA, 18 bp, Artificial sequence
  synthetic polynucleotide sequence
gttccgggacagcaggca

SEQ ID NO: 38625 - DNA, 20 bp, Artificial sequence
  synthetic polynucleotide sequence
gcgcaggcacccaacagcca

SEQ ID NO: 38626 - DNA, 20 bp, Artificial sequence
  synthetic polynucleotide sequence
ggagggaacttctcccggca

SEQ ID NO: 38627 - DNA, 19 bp, Artificial sequence
  synthetic polynucleotide sequence
tccgatctctgaagcagca

SEQ ID NO: 38628 - DNA, 21 bp, Artificial sequence
  synthetic polynucleotide sequence
gacacaagacctccaagtcca

SEQ ID NO: 38629 - DNA, 18 bp, Artificial sequence
  synthetic polynucleotide sequence
ggaggaggtctgccccaa

SEQ ID NO: 38630 - DNA, 18 bp, Artificial sequence
  synthetic polynucleotide sequence
cccacaatcccagggcca

SEQ ID NO: 38631 - DNA, 18 bp, Artificial sequence
  synthetic polynucleotide sequence
agggaacctggctgacca

SEQ ID NO: 38632 - DNA, 18 bp, Artificial sequence
  synthetic polynucleotide sequence
gagcagagagagggccca

SEQ ID NO: 38633 - DNA, 19 bp, Artificial sequence
  synthetic polynucleotide sequence
cctgcctactccaccacca

SEQ ID NO: 38634 - DNA, 19 bp, Artificial sequence
  synthetic polynucleotide sequence
ttacgacacagtgggcaca

SEQ ID NO: 38635 - DNA, 20 bp, Artificial sequence
  synthetic polynucleotide sequence
aactgggcaagtggtgagga

SEQ ID NO: 38636 - DNA, 18 bp, Artificial sequence
  synthetic polynucleotide sequence
gcatatcaccagcccgga

SEQ ID NO: 38637 - DNA, 20 bp, Artificial sequence
  synthetic polynucleotide sequence
ggccgagaggacagaaagca

SEQ ID NO: 38638 - DNA, 20 bp, Artificial sequence
  synthetic polynucleotide sequence
cagctcctggacggaggcga

SEQ ID NO: 38639 - DNA, 18 bp, Artificial sequence
  synthetic polynucleotide sequence
gaaagggcctgacccgga

SEQ ID NO: 38640 - DNA, 18 bp, Artificial sequence
  synthetic polynucleotide sequence
gtgaccaggccaacgcca

SEQ ID NO: 38641 - DNA, 18 bp, Artificial sequence
  synthetic polynucleotide sequence
gggctaggcatggacgaa

SEQ ID NO: 38642 - DNA, 19 bp, Artificial sequence
  synthetic polynucleotide sequence
cccgatgactctgcaacca

SEQ ID NO: 38643 - DNA, 19 bp, Artificial sequence
  synthetic polynucleotide sequence
caaggccctggagcagcta

SEQ ID NO: 38644 - DNA, 20 bp, Artificial sequence
  synthetic polynucleotide sequence
caaagcgagctaacagccca

SEQ ID NO: 38645 - DNA, 18 bp, Artificial sequence
  synthetic polynucleotide sequence
gctccaagacccagccaa

SEQ ID NO: 38646 - DNA, 18 bp, Artificial sequence
  synthetic polynucleotide sequence
agtcgccgctcctcacca

SEQ ID NO: 38647 - DNA, 20 bp, Artificial sequence
  synthetic polynucleotide sequence
cttggagatggcctgacaga

SEQ ID NO: 38648 - DNA, 21 bp, Artificial sequence
  synthetic polynucleotide sequence
gagaaagtccacaggcctgca

SEQ ID NO: 38649 - DNA, 18 bp, Artificial sequence
  synthetic polynucleotide sequence
cccgctataacctgggca

SEQ ID NO: 38650 - DNA, 18 bp, Artificial sequence
  synthetic polynucleotide sequence
aacgcagggtgctccaga

SEQ ID NO: 38651 - DNA, 20 bp, Artificial sequence
  synthetic polynucleotide sequence
aacctgggcgcctacagaga

SEQ ID NO: 38652 - DNA, 20 bp, Artificial sequence
  synthetic polynucleotide sequence
ggtccatcagagagagcgca

SEQ ID NO: 38653 - DNA, 19 bp, Artificial sequence
  synthetic polynucleotide sequence
gcccttctgacccacagca

SEQ ID NO: 38654 - DNA, 19 bp, Artificial sequence
  synthetic polynucleotide sequence
gtcctcagccaggagagga

SEQ ID NO: 38655 - DNA, 23 bp, Artificial sequence
  synthetic polynucleotide sequence
gaatatgggatgtgaaggcagca

SEQ ID NO: 38656 - DNA, 19 bp, Artificial sequence
  synthetic polynucleotide sequence
cagtcaaccgccccggtca

SEQ ID NO: 38657 - DNA, 18 bp, Artificial sequence
  synthetic polynucleotide sequence
cactgccccactgcccaa

SEQ ID NO: 38658 - DNA, 18 bp, Artificial sequence
  synthetic polynucleotide sequence
cggggcttgcaggtccaa

SEQ ID NO: 38659 - DNA, 18 bp, Artificial sequence
  synthetic polynucleotide sequence
cagccaggtcccgcctca

SEQ ID NO: 38660 - DNA, 20 bp, Artificial sequence
  synthetic polynucleotide sequence
cttcacacacaggcactgca

SEQ ID NO: 38661 - DNA, 20 bp, Artificial sequence
  synthetic polynucleotide sequence
ggaggcgaccccaatgagga

SEQ ID NO: 38662 - DNA, 21 bp, Artificial sequence
  synthetic polynucleotide sequence
acgtaaccttccccgtgcgca

SEQ ID NO: 38663 - DNA, 25 bp, Artificial sequence
  synthetic polynucleotide sequence
tcaacagtaagcagcacctccaaga

SEQ ID NO: 38664 - DNA, 20 bp, Artificial sequence
  synthetic polynucleotide sequence
gcctctaggaggcctcagga

SEQ ID NO: 38665 - DNA, 21 bp, Artificial sequence
  synthetic polynucleotide sequence
cctggcatccaaagcagctga

SEQ ID NO: 38666 - DNA, 19 bp, Artificial sequence
  synthetic polynucleotide sequence
ttgacagttcgctccacca

SEQ ID NO: 38667 - DNA, 22 bp, Artificial sequence
  synthetic polynucleotide sequence
atgtggaacacgtgctcatcga

SEQ ID NO: 38668 - DNA, 18 bp, Artificial sequence
  synthetic polynucleotide sequence
ctgcccccagggctgtga

SEQ ID NO: 38669 - DNA, 20 bp, Artificial sequence
  synthetic polynucleotide sequence
atccatgtcggggaggcaga

SEQ ID NO: 38670 - DNA, 20 bp, Artificial sequence
  synthetic polynucleotide sequence
tgactagcaccggacccaga

SEQ ID NO: 38671 - DNA, 21 bp, Artificial sequence
  synthetic polynucleotide sequence
gctccctgaaggtgtggacca

SEQ ID NO: 38672 - DNA, 21 bp, Artificial sequence
  synthetic polynucleotide sequence
atctcctcacagacacccgca

SEQ ID NO: 38673 - DNA, 21 bp, Artificial sequence
  synthetic polynucleotide sequence
tggtggggagtcataccagga

SEQ ID NO: 38674 - DNA, 22 bp, Artificial sequence
  synthetic polynucleotide sequence
tgaagatggtatggagagggca

SEQ ID NO: 38675 - DNA, 18 bp, Artificial sequence
  synthetic polynucleotide sequence
gtccagcgcttggagcca

SEQ ID NO: 38676 - DNA, 20 bp, Artificial sequence
  synthetic polynucleotide sequence
gtgtgtgcagacggactcca

SEQ ID NO: 38677 - DNA, 22 bp, Artificial sequence
  synthetic polynucleotide sequence
atggagctggagaggcaagaga

SEQ ID NO: 38678 - DNA, 21 bp, Artificial sequence
  synthetic polynucleotide sequence
tcacagcagccacgttcagga

SEQ ID NO: 38679 - DNA, 18 bp, Artificial sequence
  synthetic polynucleotide sequence
cccagccaccatcagcaa

SEQ ID NO: 38680 - DNA, 18 bp, Artificial sequence
  synthetic polynucleotide sequence
acggtggccaggtagcca

SEQ ID NO: 38681 - DNA, 18 bp, Artificial sequence
  synthetic polynucleotide sequence
agcagggtgggagcccaa

SEQ ID NO: 38682 - DNA, 20 bp, Artificial sequence
  synthetic polynucleotide sequence
gaccagagccctcttacgca

SEQ ID NO: 38683 - DNA, 18 bp, Artificial sequence
  synthetic polynucleotide sequence
cacagatgcgcacgcaca

SEQ ID NO: 38684 - DNA, 19 bp, Artificial sequence
  synthetic polynucleotide sequence
ccatgaccatggggacaca

SEQ ID NO: 38685 - DNA, 19 bp, Artificial sequence
  synthetic polynucleotide sequence
cggacgggacctgtcagga

SEQ ID NO: 38686 - DNA, 19 bp, Artificial sequence
  synthetic polynucleotide sequence
cccacctcagctggcgtga

SEQ ID NO: 38687 - DNA, 19 bp, Artificial sequence
  synthetic polynucleotide sequence
tggcgcgaagaaatgctca

SEQ ID NO: 38688 - DNA, 20 bp, Artificial sequence
  synthetic polynucleotide sequence
cagctctgccgacagccaca

SEQ ID NO: 38689 - DNA, 19 bp, Artificial sequence
  synthetic polynucleotide sequence
gggaccagcgcatcgacga

SEQ ID NO: 38690 - DNA, 18 bp, Artificial sequence
  synthetic polynucleotide sequence
tgtccggccccgtgagca

SEQ ID NO: 38691 - DNA, 22 bp, Artificial sequence
  synthetic polynucleotide sequence
gtaacgcccagtgatgtccgaa

SEQ ID NO: 38692 - DNA, 23 bp, Artificial sequence
  synthetic polynucleotide sequence
gaatattcatctgcccggacaca

SEQ ID NO: 38693 - DNA, 18 bp, Artificial sequence
  synthetic polynucleotide sequence
acctcagcgccgatgaca

SEQ ID NO: 38694 - DNA, 18 bp, Artificial sequence
  synthetic polynucleotide sequence
ggctggttgggccggtca

SEQ ID NO: 38695 - DNA, 20 bp, Artificial sequence
  synthetic polynucleotide sequence
ccccagatcaaggaggggaa

SEQ ID NO: 38696 - DNA, 20 bp, Artificial sequence
  synthetic polynucleotide sequence
agtcggcaggttcagctcca

SEQ ID NO: 38697 - DNA, 20 bp, Artificial sequence
  synthetic polynucleotide sequence
ctgcgagagcctcaaggaca

SEQ ID NO: 38698 - DNA, 18 bp, Artificial sequence
  synthetic polynucleotide sequence
cgtgggctgcaatgagca

SEQ ID NO: 38699 - DNA, 20 bp, Artificial sequence
  synthetic polynucleotide sequence
gtggctgccagtggtgagga

SEQ ID NO: 38700 - DNA, 21 bp, Artificial sequence
  synthetic polynucleotide sequence
gacatcataggagcgcctcca

SEQ ID NO: 38701 - DNA, 19 bp, Artificial sequence
  synthetic polynucleotide sequence
ggcgtctgcaaagtcagca

SEQ ID NO: 38702 - DNA, 19 bp, Artificial sequence
  synthetic polynucleotide sequence
tccggcttccaatgagaca

SEQ ID NO: 38703 - DNA, 18 bp, Artificial sequence
  synthetic polynucleotide sequence
accattgcacaggctcca

SEQ ID NO: 38704 - DNA, 21 bp, Artificial sequence
  synthetic polynucleotide sequence
acataagcaggaagagctcca

SEQ ID NO: 38705 - DNA, 21 bp, Artificial sequence
  synthetic polynucleotide sequence
gtgaggctggagtgtacacca

SEQ ID NO: 38706 - DNA, 18 bp, Artificial sequence
  synthetic polynucleotide sequence
gttcccgaagtcccacca

SEQ ID NO: 38707 - DNA, 19 bp, Artificial sequence
  synthetic polynucleotide sequence
tgggctctacctccaggaa

SEQ ID NO: 38708 - DNA, 20 bp, Artificial sequence
  synthetic polynucleotide sequence
gtgtggtacatgggggagga

SEQ ID NO: 38709 - DNA, 21 bp, Artificial sequence
  synthetic polynucleotide sequence
agaagcctcaggaaagcccaa

SEQ ID NO: 38710 - DNA, 20 bp, Artificial sequence
  synthetic polynucleotide sequence
gagatgtgcatgcgggccca

SEQ ID NO: 38711 - DNA, 20 bp, Artificial sequence
  synthetic polynucleotide sequence
ggactcaggtccaccagcca

SEQ ID NO: 38712 - DNA, 21 bp, Artificial sequence
  synthetic polynucleotide sequence
cctgggcatcttggcagcaga

SEQ ID NO: 38713 - DNA, 20 bp, Artificial sequence
  synthetic polynucleotide sequence
agtgctgccatgagacgtga

SEQ ID NO: 38714 - DNA, 20 bp, Artificial sequence
  synthetic polynucleotide sequence
gtttgcacccgtgacgacca

SEQ ID NO: 38715 - DNA, 21 bp, Artificial sequence
  synthetic polynucleotide sequence
tgtgacggcaaggaggtgaca

SEQ ID NO: 38716 - DNA, 19 bp, Artificial sequence
  synthetic polynucleotide sequence
gccgagtccactgctccca

SEQ ID NO: 38717 - DNA, 20 bp, Artificial sequence
  synthetic polynucleotide sequence
gcccagcatcaccagcctga

SEQ ID NO: 38718 - DNA, 20 bp, Artificial sequence
  synthetic polynucleotide sequence
ggtcagcatggacagtggga

SEQ ID NO: 38719 - DNA, 18 bp, Artificial sequence
  synthetic polynucleotide sequence
ctgagggttgccaggcca

SEQ ID NO: 38720 - DNA, 19 bp, Artificial sequence
  synthetic polynucleotide sequence
gaggaaggtggcagaggga

SEQ ID NO: 38721 - DNA, 18 bp, Artificial sequence
  synthetic polynucleotide sequence
catccaggctcagcggga

SEQ ID NO: 38722 - DNA, 18 bp, Artificial sequence
  synthetic polynucleotide sequence
gaggatgacacggtgcca

SEQ ID NO: 38723 - DNA, 20 bp, Artificial sequence
  synthetic polynucleotide sequence
ctactgccgggcgctggaga

SEQ ID NO: 38724 - DNA, 18 bp, Artificial sequence
  synthetic polynucleotide sequence
agcagccggtgcagcgca

SEQ ID NO: 38725 - DNA, 18 bp, Artificial sequence
  synthetic polynucleotide sequence
ccgccatgacctggagca

SEQ ID NO: 38726 - DNA, 18 bp, Artificial sequence
  synthetic polynucleotide sequence
ccgtgcacccgaagacca

SEQ ID NO: 38727 - DNA, 21 bp, Artificial sequence
  synthetic polynucleotide sequence
cctgcaggtccttcccacaga

SEQ ID NO: 38728 - DNA, 21 bp, Artificial sequence
  synthetic polynucleotide sequence
atgagaggccagtgtaggtca

SEQ ID NO: 38729 - DNA, 21 bp, Artificial sequence
  synthetic polynucleotide sequence
aagccacttccaagggctgca

SEQ ID NO: 38730 - DNA, 19 bp, Artificial sequence
  synthetic polynucleotide sequence
gcaccgcctccagtgctga

SEQ ID NO: 38731 - DNA, 18 bp, Artificial sequence
  synthetic polynucleotide sequence
cgagctgcctgtggagga

SEQ ID NO: 38732 - DNA, 20 bp, Artificial sequence
  synthetic polynucleotide sequence
agagtgagcaggtgtgacca

SEQ ID NO: 38733 - DNA, 19 bp, Artificial sequence
  synthetic polynucleotide sequence
tggagaagacgggctcgta

SEQ ID NO: 38734 - DNA, 18 bp, Artificial sequence
  synthetic polynucleotide sequence
cccatgaagctgatgcca

SEQ ID NO: 38735 - DNA, 19 bp, Artificial sequence
  synthetic polynucleotide sequence
cctgcccactaagcccaga

SEQ ID NO: 38736 - DNA, 18 bp, Artificial sequence
  synthetic polynucleotide sequence
acagccacggtcgagcca

SEQ ID NO: 38737 - DNA, 20 bp, Artificial sequence
  synthetic polynucleotide sequence
ggccacagtgacgtggtcaa

SEQ ID NO: 38738 - DNA, 19 bp, Artificial sequence
  synthetic polynucleotide sequence
cagcaggggagggagggca

SEQ ID NO: 38739 - DNA, 20 bp, Artificial sequence
  synthetic polynucleotide sequence
cacctatcacccctcaccca

SEQ ID NO: 38740 - DNA, 22 bp, Artificial sequence
  synthetic polynucleotide sequence
cccctggagaaactcacaacca

SEQ ID NO: 38741 - DNA, 18 bp, Artificial sequence
  synthetic polynucleotide sequence
cacggagcatgcccacga

SEQ ID NO: 38742 - DNA, 20 bp, Artificial sequence
  synthetic polynucleotide sequence
caaggacagcccacagtcca

SEQ ID NO: 38743 - DNA, 18 bp, Artificial sequence
  synthetic polynucleotide sequence
gcctcaagcttgggacga

SEQ ID NO: 38744 - DNA, 20 bp, Artificial sequence
  synthetic polynucleotide sequence
caaagctatgacccacccca

SEQ ID NO: 38745 - DNA, 21 bp, Artificial sequence
  synthetic polynucleotide sequence
tgcgtcacctgaccagagtga

SEQ ID NO: 38746 - DNA, 22 bp, Artificial sequence
  synthetic polynucleotide sequence
aacagaacgccagatcagtcca

SEQ ID NO: 38747 - DNA, 20 bp, Artificial sequence
  synthetic polynucleotide sequence
gcgtcccacaatcctgagga

SEQ ID NO: 38748 - DNA, 18 bp, Artificial sequence
  synthetic polynucleotide sequence
cctcccaggatggtgcca

SEQ ID NO: 38749 - DNA, 21 bp, Artificial sequence
  synthetic polynucleotide sequence
ccggaagcagagtgtggagga

SEQ ID NO: 38750 - DNA, 21 bp, Artificial sequence
  synthetic polynucleotide sequence
gtcttcgccacgctgtagaca

SEQ ID NO: 38751 - DNA, 18 bp, Artificial sequence
  synthetic polynucleotide sequence
tggtccgagccgtggaga

SEQ ID NO: 38752 - DNA, 18 bp, Artificial sequence
  synthetic polynucleotide sequence
cctgggacacgcagtcga

SEQ ID NO: 38753 - DNA, 18 bp, Artificial sequence
  synthetic polynucleotide sequence
aggacgggcctgaaagca

SEQ ID NO: 38754 - DNA, 19 bp, Artificial sequence
  synthetic polynucleotide sequence
gaaggctgatcgaccgtga

SEQ ID NO: 38755 - DNA, 20 bp, Artificial sequence
  synthetic polynucleotide sequence
tgtggagggtgtcgacgtga

SEQ ID NO: 38756 - DNA, 20 bp, Artificial sequence
  synthetic polynucleotide sequence
acatggatgagtgccgcgca

SEQ ID NO: 38757 - DNA, 20 bp, Artificial sequence
  synthetic polynucleotide sequence
atgtggcagatcccacagga

SEQ ID NO: 38758 - DNA, 20 bp, Artificial sequence
  synthetic polynucleotide sequence
gaaacgctgtgagctcgaca

SEQ ID NO: 38759 - DNA, 19 bp, Artificial sequence
  synthetic polynucleotide sequence
gacccaagcgatctggaga

SEQ ID NO: 38760 - DNA, 19 bp, Artificial sequence
  synthetic polynucleotide sequence
caggaagatgcagaggcca

SEQ ID NO: 38761 - DNA, 20 bp, Artificial sequence
  synthetic polynucleotide sequence
agagtccaggcgacgcggga

SEQ ID NO: 38762 - DNA, 20 bp, Artificial sequence
  synthetic polynucleotide sequence
cagcagcaccagagccacca

SEQ ID NO: 38763 - DNA, 18 bp, Artificial sequence
  synthetic polynucleotide sequence
cctgctggcctcaccaga

SEQ ID NO: 38764 - DNA, 18 bp, Artificial sequence
  synthetic polynucleotide sequence
gctgtcccaggctgcaca

SEQ ID NO: 38765 - DNA, 21 bp, Artificial sequence
  synthetic polynucleotide sequence
agattggcaccaagctcacca

SEQ ID NO: 38766 - DNA, 20 bp, Artificial sequence
  synthetic polynucleotide sequence
gtcactgaagcggatgagga

SEQ ID NO: 38767 - DNA, 21 bp, Artificial sequence
  synthetic polynucleotide sequence
aagagccgacgaacagaacca

SEQ ID NO: 38768 - DNA, 21 bp, Artificial sequence
  synthetic polynucleotide sequence
gaagattcgcccatcagccca

SEQ ID NO: 38769 - DNA, 21 bp, Artificial sequence
  synthetic polynucleotide sequence
aaccggccaagcaaacaggaa

SEQ ID NO: 38770 - DNA, 20 bp, Artificial sequence
  synthetic polynucleotide sequence
tctccagctcttccacggca

SEQ ID NO: 38771 - DNA, 21 bp, Artificial sequence
  synthetic polynucleotide sequence
tctgctgctgccatcaccaca

SEQ ID NO: 38772 - DNA, 19 bp, Artificial sequence
  synthetic polynucleotide sequence
gagtaggcagtggggggga

SEQ ID NO: 38773 - DNA, 21 bp, Artificial sequence
  synthetic polynucleotide sequence
ttggaggtcggcgatatggaa

SEQ ID NO: 38774 - DNA, 21 bp, Artificial sequence
  synthetic polynucleotide sequence
ttctggaaggccctcatagca

SEQ ID NO: 38775 - DNA, 21 bp, Artificial sequence
  synthetic polynucleotide sequence
gtctcgacccaatgctcagga

SEQ ID NO: 38776 - DNA, 19 bp, Artificial sequence
  synthetic polynucleotide sequence
cccggcggatcaacaggga

SEQ ID NO: 38777 - DNA, 18 bp, Artificial sequence
  synthetic polynucleotide sequence
acacctccagttggcgca

SEQ ID NO: 38778 - DNA, 18 bp, Artificial sequence
  synthetic polynucleotide sequence
gcatgggctgaacgacca

SEQ ID NO: 38779 - DNA, 18 bp, Artificial sequence
  synthetic polynucleotide sequence
gccaagtgagcccaccaa

SEQ ID NO: 38780 - DNA, 18 bp, Artificial sequence
  synthetic polynucleotide sequence
cctccttgagcagcagca

SEQ ID NO: 38781 - DNA, 21 bp, Artificial sequence
  synthetic polynucleotide sequence
cagtaatgcccagtcacagca

SEQ ID NO: 38782 - DNA, 22 bp, Artificial sequence
  synthetic polynucleotide sequence
gtggaggagacaccactacaga

SEQ ID NO: 38783 - DNA, 23 bp, Artificial sequence
  synthetic polynucleotide sequence
gcacgttcaatggaggagagcca

SEQ ID NO: 38784 - DNA, 23 bp, Artificial sequence
  synthetic polynucleotide sequence
gacaacagttcgctggcagaaca

SEQ ID NO: 38785 - DNA, 18 bp, Artificial sequence
  synthetic polynucleotide sequence
caatcagcccgagcccca

SEQ ID NO: 38786 - DNA, 18 bp, Artificial sequence
  synthetic polynucleotide sequence
gctgggggatggtggaga

SEQ ID NO: 38787 - DNA, 19 bp, Artificial sequence
  synthetic polynucleotide sequence
cggacagctcctctggcaa

SEQ ID NO: 38788 - DNA, 21 bp, Artificial sequence
  synthetic polynucleotide sequence
gtacccaggaactgacttgga

SEQ ID NO: 38789 - DNA, 18 bp, Artificial sequence
  synthetic polynucleotide sequence
agaggagccaccgtggga

SEQ ID NO: 38790 - DNA, 20 bp, Artificial sequence
  synthetic polynucleotide sequence
cgatgatcgggaattgagca

SEQ ID NO: 38791 - DNA, 18 bp, Artificial sequence
  synthetic polynucleotide sequence
agaaccacaccgtcggca

SEQ ID NO: 38792 - DNA, 18 bp, Artificial sequence
  synthetic polynucleotide sequence
ggcaggcttgggacagga

SEQ ID NO: 38793 - DNA, 20 bp, Artificial sequence
  synthetic polynucleotide sequence
gttccgagatgaggacagca

SEQ ID NO: 38794 - DNA, 18 bp, Artificial sequence
  synthetic polynucleotide sequence
gcaggtcacgaggtccca

SEQ ID NO: 38795 - DNA, 19 bp, Artificial sequence
  synthetic polynucleotide sequence
gcgggagtgatgaagacga

SEQ ID NO: 38796 - DNA, 18 bp, Artificial sequence
  synthetic polynucleotide sequence
caacccccttcactggca

SEQ ID NO: 38797 - DNA, 18 bp, Artificial sequence
  synthetic polynucleotide sequence
ccagatggacagtgggca

SEQ ID NO: 38798 - DNA, 20 bp, Artificial sequence
  synthetic polynucleotide sequence
gacttgaggtgggacaggga

SEQ ID NO: 38799 - DNA, 20 bp, Artificial sequence
  synthetic polynucleotide sequence
ctccctacagcccaacagca

SEQ ID NO: 38800 - DNA, 18 bp, Artificial sequence
  synthetic polynucleotide sequence
cggtctcgatggaagcca

SEQ ID NO: 38801 - DNA, 20 bp, Artificial sequence
  synthetic polynucleotide sequence
ctgctggacagaggtggaga

SEQ ID NO: 38802 - DNA, 19 bp, Artificial sequence
  synthetic polynucleotide sequence
ccccagtgtagtccagcca

SEQ ID NO: 38803 - DNA, 18 bp, Artificial sequence
  synthetic polynucleotide sequence
cctgctgcacccaaacca

SEQ ID NO: 38804 - DNA, 20 bp, Artificial sequence
  synthetic polynucleotide sequence
ctgctccactgtagaccgga

SEQ ID NO: 38805 - DNA, 23 bp, Artificial sequence
  synthetic polynucleotide sequence
caaagtgaaccgtgtgaggcaca

SEQ ID NO: 38806 - DNA, 22 bp, Artificial sequence
  synthetic polynucleotide sequence
agctgaagacatggacatcgca

SEQ ID NO: 38807 - DNA, 18 bp, Artificial sequence
  synthetic polynucleotide sequence
acctcctgggcctcccca

SEQ ID NO: 38808 - DNA, 19 bp, Artificial sequence
  synthetic polynucleotide sequence
ggggcttcaccccctacca

SEQ ID NO: 38809 - DNA, 21 bp, Artificial sequence
  synthetic polynucleotide sequence
ccatgtgggtcccatcgcaga

SEQ ID NO: 38810 - DNA, 21 bp, Artificial sequence
  synthetic polynucleotide sequence
ctcttgcaggaaggtaggcca

SEQ ID NO: 38811 - DNA, 18 bp, Artificial sequence
  synthetic polynucleotide sequence
ggcaagcagcaggacgaa

SEQ ID NO: 38812 - DNA, 18 bp, Artificial sequence
  synthetic polynucleotide sequence
tgtgtgacaggccaggca

SEQ ID NO: 38813 - DNA, 21 bp, Artificial sequence
  synthetic polynucleotide sequence
gtgcaccatccaggagaagga

SEQ ID NO: 38814 - DNA, 18 bp, Artificial sequence
  synthetic polynucleotide sequence
gaaggggccacccaccaa

SEQ ID NO: 38815 - DNA, 20 bp, Artificial sequence
  synthetic polynucleotide sequence
ctggcacagtccagctcaca

SEQ ID NO: 38816 - DNA, 22 bp, Artificial sequence
  synthetic polynucleotide sequence
tccaatagtagcaccaggctga

SEQ ID NO: 38817 - DNA, 18 bp, Artificial sequence
  synthetic polynucleotide sequence
ccacggaacccacaggga

SEQ ID NO: 38818 - DNA, 21 bp, Artificial sequence
  synthetic polynucleotide sequence
aataaggaaggttctggccaa

SEQ ID NO: 38819 - DNA, 20 bp, Artificial sequence
  synthetic polynucleotide sequence
aaggctaggctgatggcaga

SEQ ID NO: 38820 - DNA, 18 bp, Artificial sequence
  synthetic polynucleotide sequence
aaggcttcgcacggggca

SEQ ID NO: 38821 - DNA, 18 bp, Artificial sequence
  synthetic polynucleotide sequence
gagcaaggcttcggggaa

SEQ ID NO: 38822 - DNA, 18 bp, Artificial sequence
  synthetic polynucleotide sequence
ggtaggacagcagccgca

SEQ ID NO: 38823 - DNA, 20 bp, Artificial sequence
  synthetic polynucleotide sequence
gggggcatggccatcctcca

SEQ ID NO: 38824 - DNA, 18 bp, Artificial sequence
  synthetic polynucleotide sequence
ccgcagggccctggacca

SEQ ID NO: 38825 - DNA, 18 bp, Artificial sequence
  synthetic polynucleotide sequence
ggcgacgggaagcacaga

SEQ ID NO: 38826 - DNA, 18 bp, Artificial sequence
  synthetic polynucleotide sequence
gtcccatcacgactgcca

SEQ ID NO: 38827 - DNA, 22 bp, Artificial sequence
  synthetic polynucleotide sequence
atcacattctcagcggcaagga

SEQ ID NO: 38828 - DNA, 20 bp, Artificial sequence
  synthetic polynucleotide sequence
atgcactaggaaaggaccca

SEQ ID NO: 38829 - DNA, 18 bp, Artificial sequence
  synthetic polynucleotide sequence
atcctcgacgacccgaga

SEQ ID NO: 38830 - DNA, 18 bp, Artificial sequence
  synthetic polynucleotide sequence
ccgagagcagcgtcagca

SEQ ID NO: 38831 - DNA, 20 bp, Artificial sequence
  synthetic polynucleotide sequence
aggtagccggttcaacccca

SEQ ID NO: 38832 - DNA, 21 bp, Artificial sequence
  synthetic polynucleotide sequence
tgctgtcccagttcaggagca

SEQ ID NO: 38833 - DNA, 18 bp, Artificial sequence
  synthetic polynucleotide sequence
tctggcaccggaagcaga

SEQ ID NO: 38834 - DNA, 18 bp, Artificial sequence
  synthetic polynucleotide sequence
ggggttgcaccaccagga

SEQ ID NO: 38835 - DNA, 18 bp, Artificial sequence
  synthetic polynucleotide sequence
acccatcgtgtacggcca

SEQ ID NO: 38836 - DNA, 18 bp, Artificial sequence
  synthetic polynucleotide sequence
ccgtagagccggaaggca

SEQ ID NO: 38837 - DNA, 18 bp, Artificial sequence
  synthetic polynucleotide sequence
gccggtcaagctcaagga

SEQ ID NO: 38838 - DNA, 18 bp, Artificial sequence
  synthetic polynucleotide sequence
gcaccatctgcagcgtga

SEQ ID NO: 38839 - DNA, 18 bp, Artificial sequence
  synthetic polynucleotide sequence
gctgctggaacgcggcca

SEQ ID NO: 38840 - DNA, 18 bp, Artificial sequence
  synthetic polynucleotide sequence
tggcctggagggctccga

SEQ ID NO: 38841 - DNA, 18 bp, Artificial sequence
  synthetic polynucleotide sequence
ccgcatcaaggccgtgga

SEQ ID NO: 38842 - DNA, 18 bp, Artificial sequence
  synthetic polynucleotide sequence
tgggcgttccagccggga

SEQ ID NO: 38843 - DNA, 20 bp, Artificial sequence
  synthetic polynucleotide sequence
aggccctggagactgagaca

SEQ ID NO: 38844 - DNA, 19 bp, Artificial sequence
  synthetic polynucleotide sequence
ccagcctgactgtccagga

SEQ ID NO: 38845 - DNA, 20 bp, Artificial sequence
  synthetic polynucleotide sequence
gagacagcgtctggagacca

SEQ ID NO: 38846 - DNA, 20 bp, Artificial sequence
  synthetic polynucleotide sequence
aagtctgcatcagggaggga

SEQ ID NO: 38847 - DNA, 21 bp, Artificial sequence
  synthetic polynucleotide sequence
ctgccggaaaacttggacgca

SEQ ID NO: 38848 - DNA, 20 bp, Artificial sequence
  synthetic polynucleotide sequence
tcgggggcaaggcacctgca

SEQ ID NO: 38849 - DNA, 21 bp, Artificial sequence
  synthetic polynucleotide sequence
acagtgacgatgaggagccca

SEQ ID NO: 38850 - DNA, 21 bp, Artificial sequence
  synthetic polynucleotide sequence
cctctgctggcacctgaagca

SEQ ID NO: 38851 - DNA, 20 bp, Artificial sequence
  synthetic polynucleotide sequence
cagcctccacccaacaccca

SEQ ID NO: 38852 - DNA, 19 bp, Artificial sequence
  synthetic polynucleotide sequence
gatccctccccctgcagca

SEQ ID NO: 38853 - DNA, 18 bp, Artificial sequence
  synthetic polynucleotide sequence
ccgcggctaccccatgca

SEQ ID NO: 38854 - DNA, 20 bp, Artificial sequence
  synthetic polynucleotide sequence
ctgttgcaggtggaggcgca

SEQ ID NO: 38855 - DNA, 18 bp, Artificial sequence
  synthetic polynucleotide sequence
gccatgccacggaaagga

SEQ ID NO: 38856 - DNA, 23 bp, Artificial sequence
  synthetic polynucleotide sequence
caacacctgaggaccaaactaca

SEQ ID NO: 38857 - DNA, 18 bp, Artificial sequence
  synthetic polynucleotide sequence
gcacgagaagcgcaagca

SEQ ID NO: 38858 - DNA, 18 bp, Artificial sequence
  synthetic polynucleotide sequence
ggtcgatcttgagcgcca

SEQ ID NO: 38859 - DNA, 19 bp, Artificial sequence
  synthetic polynucleotide sequence
cccgcctaccccgtcggca

SEQ ID NO: 38860 - DNA, 25 bp, Artificial sequence
  synthetic polynucleotide sequence
tgaccccaatccaaagcagtgccaa

SEQ ID NO: 38861 - DNA, 21 bp, Artificial sequence
  synthetic polynucleotide sequence
tctcccaccagagtcaggaca

SEQ ID NO: 38862 - DNA, 19 bp, Artificial sequence
  synthetic polynucleotide sequence
tgaaatggcgtgctgggca

SEQ ID NO: 38863 - DNA, 21 bp, Artificial sequence
  synthetic polynucleotide sequence
acctgcaggagtcggagagca

SEQ ID NO: 38864 - DNA, 21 bp, Artificial sequence
  synthetic polynucleotide sequence
gcacgtgactgggaaagggca

SEQ ID NO: 38865 - DNA, 21 bp, Artificial sequence
  synthetic polynucleotide sequence
tctaaagagacgggggccaca

SEQ ID NO: 38866 - DNA, 19 bp, Artificial sequence
  synthetic polynucleotide sequence
tcagaccccagtgaggcca

SEQ ID NO: 38867 - DNA, 19 bp, Artificial sequence
  synthetic polynucleotide sequence
tggaacaactcacagcaca

SEQ ID NO: 38868 - DNA, 19 bp, Artificial sequence
  synthetic polynucleotide sequence
ccacacaagagacacgcga

SEQ ID NO: 38869 - DNA, 18 bp, Artificial sequence
  synthetic polynucleotide sequence
gccccacgattaccccaa

SEQ ID NO: 38870 - DNA, 19 bp, Artificial sequence
  synthetic polynucleotide sequence
ccagatccgtggatgagca

SEQ ID NO: 38871 - DNA, 20 bp, Artificial sequence
  synthetic polynucleotide sequence
gaggatgccacgctggagaa

SEQ ID NO: 38872 - DNA, 20 bp, Artificial sequence
  synthetic polynucleotide sequence
aagctggtaccaggcgctga

SEQ ID NO: 38873 - DNA, 20 bp, Artificial sequence
  synthetic polynucleotide sequence
cacggcctaccactacgcca

SEQ ID NO: 38874 - DNA, 19 bp, Artificial sequence
  synthetic polynucleotide sequence
ccccatcctccacgctgca

SEQ ID NO: 38875 - DNA, 21 bp, Artificial sequence
  synthetic polynucleotide sequence
tcctgtgggatcaccaggaga

SEQ ID NO: 38876 - DNA, 22 bp, Artificial sequence
  synthetic polynucleotide sequence
atggtggtaaaccagcacccca

SEQ ID NO: 38877 - DNA, 18 bp, Artificial sequence
  synthetic polynucleotide sequence
gccacaaggacaccagca

SEQ ID NO: 38878 - DNA, 20 bp, Artificial sequence
  synthetic polynucleotide sequence
attgtccaggctgaagcaca

SEQ ID NO: 38879 - DNA, 21 bp, Artificial sequence
  synthetic polynucleotide sequence
tgactcatccccgccaaccaa

SEQ ID NO: 38880 - DNA, 21 bp, Artificial sequence
  synthetic polynucleotide sequence
ggtgggaacactttgccccga

SEQ ID NO: 38881 - DNA, 20 bp, Artificial sequence
  synthetic polynucleotide sequence
tcctccaagtccctgcccaa

SEQ ID NO: 38882 - DNA, 19 bp, Artificial sequence
  synthetic polynucleotide sequence
tccagccaacaccagagga

SEQ ID NO: 38883 - DNA, 18 bp, Artificial sequence
  synthetic polynucleotide sequence
gaggcagctgtcacggga

SEQ ID NO: 38884 - DNA, 18 bp, Artificial sequence
  synthetic polynucleotide sequence
gggattcaacatggcgca

SEQ ID NO: 38885 - DNA, 19 bp, Artificial sequence
  synthetic polynucleotide sequence
gccccaggcgaaagtccca

SEQ ID NO: 38886 - DNA, 21 bp, Artificial sequence
  synthetic polynucleotide sequence
tctttcaaggcctgggtcaga

SEQ ID NO: 38887 - DNA, 20 bp, Artificial sequence
  synthetic polynucleotide sequence
ctggacgctgccggggagga

SEQ ID NO: 38888 - DNA, 20 bp, Artificial sequence
  synthetic polynucleotide sequence
tcggcggacgaactccggga

SEQ ID NO: 38889 - DNA, 18 bp, Artificial sequence
  synthetic polynucleotide sequence
tcggcaacaagccaccca

SEQ ID NO: 38890 - DNA, 18 bp, Artificial sequence
  synthetic polynucleotide sequence
cgatctcagtggccagca

SEQ ID NO: 38891 - DNA, 22 bp, Artificial sequence
  synthetic polynucleotide sequence
aaggtggtgcagatcgtggaga

SEQ ID NO: 38892 - DNA, 21 bp, Artificial sequence
  synthetic polynucleotide sequence
catccaccatctgctccacca

SEQ ID NO: 38893 - DNA, 19 bp, Artificial sequence
  synthetic polynucleotide sequence
gggaaggtgtggaccccca

SEQ ID NO: 38894 - DNA, 19 bp, Artificial sequence
  synthetic polynucleotide sequence
ggggtaggtgagtccccga

SEQ ID NO: 38895 - DNA, 18 bp, Artificial sequence
  synthetic polynucleotide sequence
cagtatcccgcaccccaa

SEQ ID NO: 38896 - DNA, 23 bp, Artificial sequence
  synthetic polynucleotide sequence
gaaaaaccgagacgagtgtagga

SEQ ID NO: 38897 - DNA, 22 bp, Artificial sequence
  synthetic polynucleotide sequence
aagaccctcctgccaaaaggaa

SEQ ID NO: 38898 - DNA, 21 bp, Artificial sequence
  synthetic polynucleotide sequence
caaccgaagtcacactgggca

SEQ ID NO: 38899 - DNA, 18 bp, Artificial sequence
  synthetic polynucleotide sequence
acatctggccaccagcca

SEQ ID NO: 38900 - DNA, 18 bp, Artificial sequence
  synthetic polynucleotide sequence
gctcccagtgggaaggca

SEQ ID NO: 38901 - DNA, 20 bp, Artificial sequence
  synthetic polynucleotide sequence
ctctcgaagatcctgagcga

SEQ ID NO: 38902 - DNA, 18 bp, Artificial sequence
  synthetic polynucleotide sequence
aggggcccagcacgagga

SEQ ID NO: 38903 - DNA, 19 bp, Artificial sequence
  synthetic polynucleotide sequence
ggctgaaaaggaacgagca

SEQ ID NO: 38904 - DNA, 20 bp, Artificial sequence
  synthetic polynucleotide sequence
gcagaagttgaacacgctca

SEQ ID NO: 38905 - DNA, 19 bp, Artificial sequence
  synthetic polynucleotide sequence
ggcatcggaaatggaacca

SEQ ID NO: 38906 - DNA, 22 bp, Artificial sequence
  synthetic polynucleotide sequence
ggtgtagtagcaggataggcca

SEQ ID NO: 38907 - DNA, 18 bp, Artificial sequence
  synthetic polynucleotide sequence
ctcccagatgcgcaagga

SEQ ID NO: 38908 - DNA, 18 bp, Artificial sequence
  synthetic polynucleotide sequence
agacgtcggcatcccgca

SEQ ID NO: 38909 - DNA, 18 bp, Artificial sequence
  synthetic polynucleotide sequence
ctcctggaaatccggcca

SEQ ID NO: 38910 - DNA, 18 bp, Artificial sequence
  synthetic polynucleotide sequence
cgggccacctggaaggta

SEQ ID NO: 38911 - DNA, 19 bp, Artificial sequence
  synthetic polynucleotide sequence
ccctcctgggagaaccaga

SEQ ID NO: 38912 - DNA, 20 bp, Artificial sequence
  synthetic polynucleotide sequence
ctgaggcctgtgatgccaga

SEQ ID NO: 38913 - DNA, 21 bp, Artificial sequence
  synthetic polynucleotide sequence
caagtacatccgtgcccccaa

SEQ ID NO: 38914 - DNA, 20 bp, Artificial sequence
  synthetic polynucleotide sequence
tcctgcagctcgatgaccca

SEQ ID NO: 38915 - DNA, 20 bp, Artificial sequence
  synthetic polynucleotide sequence
gccccaccctcctacagcaa

SEQ ID NO: 38916 - DNA, 20 bp, Artificial sequence
  synthetic polynucleotide sequence
tcagctcatgggtcagggga

SEQ ID NO: 38917 - DNA, 18 bp, Artificial sequence
  synthetic polynucleotide sequence
gggcgatgtccatccaca

SEQ ID NO: 38918 - DNA, 18 bp, Artificial sequence
  synthetic polynucleotide sequence
ggtcacagcgaaccgcca

SEQ ID NO: 38919 - DNA, 21 bp, Artificial sequence
  synthetic polynucleotide sequence
ctcatgcaggcaggtaccaga

SEQ ID NO: 38920 - DNA, 21 bp, Artificial sequence
  synthetic polynucleotide sequence
tagacatggaacctgagccca

SEQ ID NO: 38921 - DNA, 21 bp, Artificial sequence
  synthetic polynucleotide sequence
agggacattgccagctccaga

SEQ ID NO: 38922 - DNA, 21 bp, Artificial sequence
  synthetic polynucleotide sequence
tgttactgggccgcagtgaga

SEQ ID NO: 38923 - DNA, 22 bp, Artificial sequence
  synthetic polynucleotide sequence
aacgtgctgcagaactggggaa

SEQ ID NO: 38924 - DNA, 23 bp, Artificial sequence
  synthetic polynucleotide sequence
ataaacaagcagtgtccacagca

SEQ ID NO: 38925 - DNA, 20 bp, Artificial sequence
  synthetic polynucleotide sequence
cgtgggaggcctactgtcca

SEQ ID NO: 38926 - DNA, 21 bp, Artificial sequence
  synthetic polynucleotide sequence
tcagcttcatcccaaggccca

SEQ ID NO: 38927 - DNA, 21 bp, Artificial sequence
  synthetic polynucleotide sequence
gtaggagcatggcttggagca

SEQ ID NO: 38928 - DNA, 20 bp, Artificial sequence
  synthetic polynucleotide sequence
acagtaccaagccccctgca

SEQ ID NO: 38929 - DNA, 21 bp, Artificial sequence
  synthetic polynucleotide sequence
agagagagacgcctttaccca

SEQ ID NO: 38930 - DNA, 20 bp, Artificial sequence
  synthetic polynucleotide sequence
tatcgccagtgtcgcagcca

SEQ ID NO: 38931 - DNA, 18 bp, Artificial sequence
  synthetic polynucleotide sequence
tccccgtcctgccgggaa

SEQ ID NO: 38932 - DNA, 22 bp, Artificial sequence
  synthetic polynucleotide sequence
ccaagcagacctaagagggtga

SEQ ID NO: 38933 - DNA, 18 bp, Artificial sequence
  synthetic polynucleotide sequence
cagcgtggccgctagtca

SEQ ID NO: 38934 - DNA, 21 bp, Artificial sequence
  synthetic polynucleotide sequence
agaatcgggatgtacacacca

SEQ ID NO: 38935 - DNA, 21 bp, Artificial sequence
  synthetic polynucleotide sequence
ggggagtaagtggccacagca

SEQ ID NO: 38936 - DNA, 20 bp, Artificial sequence
  synthetic polynucleotide sequence
tgttgagcacgaagaggaca

SEQ ID NO: 38937 - DNA, 21 bp, Artificial sequence
  synthetic polynucleotide sequence
gctcgccttacctgagagcca

SEQ ID NO: 38938 - DNA, 21 bp, Artificial sequence
  synthetic polynucleotide sequence
gcagcaggcggtataagagga

SEQ ID NO: 38939 - DNA, 22 bp, Artificial sequence
  synthetic polynucleotide sequence
aaacggacatgctcatcgacca

SEQ ID NO: 38940 - DNA, 21 bp, Artificial sequence
  synthetic polynucleotide sequence
tctgaaggatgaccagcccca

SEQ ID NO: 38941 - DNA, 20 bp, Artificial sequence
  synthetic polynucleotide sequence
ccgaggaggaagaggagcca

SEQ ID NO: 38942 - DNA, 22 bp, Artificial sequence
  synthetic polynucleotide sequence
accatgagatgcctgcgaagga

SEQ ID NO: 38943 - DNA, 21 bp, Artificial sequence
  synthetic polynucleotide sequence
ttcaccgtcgccattgccaga

SEQ ID NO: 38944 - DNA, 21 bp, Artificial sequence
  synthetic polynucleotide sequence
gtatggatggagtcgagtgga

SEQ ID NO: 38945 - DNA, 18 bp, Artificial sequence
  synthetic polynucleotide sequence
gtgctcctgaacacggca

SEQ ID NO: 38946 - DNA, 18 bp, Artificial sequence
  synthetic polynucleotide sequence
accatggtgaccgcagca

SEQ ID NO: 38947 - DNA, 19 bp, Artificial sequence
  synthetic polynucleotide sequence
gccaccactgagagcacca

SEQ ID NO: 38948 - DNA, 18 bp, Artificial sequence
  synthetic polynucleotide sequence
cggtgctggactggagca

SEQ ID NO: 38949 - DNA, 21 bp, Artificial sequence
  synthetic polynucleotide sequence
agtgctgccagtgagagtcga

SEQ ID NO: 38950 - DNA, 21 bp, Artificial sequence
  synthetic polynucleotide sequence
cactcgtaggccctgaaagca

SEQ ID NO: 38951 - DNA, 18 bp, Artificial sequence
  synthetic polynucleotide sequence
ctggtgaacctgccgaca

SEQ ID NO: 38952 - DNA, 20 bp, Artificial sequence
  synthetic polynucleotide sequence
gtggaaggttcgggtgagga

SEQ ID NO: 38953 - DNA, 21 bp, Artificial sequence
  synthetic polynucleotide sequence
ctcatccggacccctatggaa

SEQ ID NO: 38954 - DNA, 21 bp, Artificial sequence
  synthetic polynucleotide sequence
gtatgtactgccgctggagga

SEQ ID NO: 38955 - DNA, 20 bp, Artificial sequence
  synthetic polynucleotide sequence
gaggactccccaccaggaca

SEQ ID NO: 38956 - DNA, 21 bp, Artificial sequence
  synthetic polynucleotide sequence
ccaggagccagtaagtcagga

SEQ ID NO: 38957 - DNA, 22 bp, Artificial sequence
  synthetic polynucleotide sequence
caatggaaccaccgtgctggaa

SEQ ID NO: 38958 - DNA, 20 bp, Artificial sequence
  synthetic polynucleotide sequence
tacaccgagaagctcaagga

SEQ ID NO: 38959 - DNA, 21 bp, Artificial sequence
  synthetic polynucleotide sequence
gtgaagatggagaagcctcga

SEQ ID NO: 38960 - DNA, 18 bp, Artificial sequence
  synthetic polynucleotide sequence
aagcacaaggggctgcca

SEQ ID NO: 38961 - DNA, 19 bp, Artificial sequence
  synthetic polynucleotide sequence
ggctgcactagcacagcca

SEQ ID NO: 38962 - DNA, 19 bp, Artificial sequence
  synthetic polynucleotide sequence
cagagatcgatgcccaaga

SEQ ID NO: 38963 - DNA, 18 bp, Artificial sequence
  synthetic polynucleotide sequence
ggcgagacatggcacgca

SEQ ID NO: 38964 - DNA, 18 bp, Artificial sequence
  synthetic polynucleotide sequence
aggcagatagcagggcca

SEQ ID NO: 38965 - DNA, 21 bp, Artificial sequence
  synthetic polynucleotide sequence
agctgaatccggaatggcgca

SEQ ID NO: 38966 - DNA, 20 bp, Artificial sequence
  synthetic polynucleotide sequence
ccagccacaggttcaggtga

SEQ ID NO: 38967 - DNA, 22 bp, Artificial sequence
  synthetic polynucleotide sequence
atcccagctccccaatcaacca

SEQ ID NO: 38968 - DNA, 21 bp, Artificial sequence
  synthetic polynucleotide sequence
agtgtgagagggtgaactgga

SEQ ID NO: 38969 - DNA, 21 bp, Artificial sequence
  synthetic polynucleotide sequence
cagacagcaggtgggaactga

SEQ ID NO: 38970 - DNA, 21 bp, Artificial sequence
  synthetic polynucleotide sequence
gtacattccaccagctcagga

SEQ ID NO: 38971 - DNA, 18 bp, Artificial sequence
  synthetic polynucleotide sequence
tcagtgtgagcagcggga

SEQ ID NO: 38972 - DNA, 18 bp, Artificial sequence
  synthetic polynucleotide sequence
ggggtctctcgagggaca

SEQ ID NO: 38973 - DNA, 21 bp, Artificial sequence
  synthetic polynucleotide sequence
caaccccaaactacagacgca

SEQ ID NO: 38974 - DNA, 21 bp, Artificial sequence
  synthetic polynucleotide sequence
ccagaaaaacgaagctgagca

SEQ ID NO: 38975 - DNA, 20 bp, Artificial sequence
  synthetic polynucleotide sequence
cctggcagactggctgcaga

SEQ ID NO: 38976 - DNA, 21 bp, Artificial sequence
  synthetic polynucleotide sequence
tgcccaagacgtacgtggcca

SEQ ID NO: 38977 - DNA, 21 bp, Artificial sequence
  synthetic polynucleotide sequence
agtcaagtctgccagtgacca

SEQ ID NO: 38978 - DNA, 21 bp, Artificial sequence
  synthetic polynucleotide sequence
catagggcagggttcagagga

SEQ ID NO: 38979 - DNA, 21 bp, Artificial sequence
  synthetic polynucleotide sequence
gggatctacctcaagaggcca

SEQ ID NO: 38980 - DNA, 18 bp, Artificial sequence
  synthetic polynucleotide sequence
cgcaaccgggcaacagca

SEQ ID NO: 38981 - DNA, 20 bp, Artificial sequence
  synthetic polynucleotide sequence
aaggagcccaagaatgcaca

SEQ ID NO: 38982 - DNA, 19 bp, Artificial sequence
  synthetic polynucleotide sequence
ggcattccagagccaagca

SEQ ID NO: 38983 - DNA, 21 bp, Artificial sequence
  synthetic polynucleotide sequence
ctggaccgagccattgaggaa

SEQ ID NO: 38984 - DNA, 21 bp, Artificial sequence
  synthetic polynucleotide sequence
tcaatgtggaagagctggcca

SEQ ID NO: 38985 - DNA, 18 bp, Artificial sequence
  synthetic polynucleotide sequence
caagccccagaccaagga

SEQ ID NO: 38986 - DNA, 18 bp, Artificial sequence
  synthetic polynucleotide sequence
ccacgcagacttcagcca

SEQ ID NO: 38987 - DNA, 18 bp, Artificial sequence
  synthetic polynucleotide sequence
acagtgggcaacacggga

SEQ ID NO: 38988 - DNA, 19 bp, Artificial sequence
  synthetic polynucleotide sequence
tgccacacagtagcctgca

SEQ ID NO: 38989 - DNA, 20 bp, Artificial sequence
  synthetic polynucleotide sequence
gtgcggatgaactccaagga

SEQ ID NO: 38990 - DNA, 18 bp, Artificial sequence
  synthetic polynucleotide sequence
tgaaggcagacaagggca

SEQ ID NO: 38991 - DNA, 18 bp, Artificial sequence
  synthetic polynucleotide sequence
cgacagcctgcaccagca

SEQ ID NO: 38992 - DNA, 20 bp, Artificial sequence
  synthetic polynucleotide sequence
ctccccagtaccattcagca

SEQ ID NO: 38993 - DNA, 18 bp, Artificial sequence
  synthetic polynucleotide sequence
atcaaccgcacgcaggca

SEQ ID NO: 38994 - DNA, 18 bp, Artificial sequence
  synthetic polynucleotide sequence
cgtgcggtagatgacgca

SEQ ID NO: 38995 - DNA, 21 bp, Artificial sequence
  synthetic polynucleotide sequence
gtgctccattaccagcagaca

SEQ ID NO: 38996 - DNA, 20 bp, Artificial sequence
  synthetic polynucleotide sequence
gtgcatgaacagggtaggca

SEQ ID NO: 38997 - DNA, 20 bp, Artificial sequence
  synthetic polynucleotide sequence
tgggtcactggacccaccaa

SEQ ID NO: 38998 - DNA, 22 bp, Artificial sequence
  synthetic polynucleotide sequence
caaagggacacaaatgccagca

SEQ ID NO: 38999 - DNA, 18 bp, Artificial sequence
  synthetic polynucleotide sequence
acccctggtatgagcgca

SEQ ID NO: 39000 - DNA, 18 bp, Artificial sequence
  synthetic polynucleotide sequence
tgtcagccaggatgggca

SEQ ID NO: 39001 - DNA, 19 bp, Artificial sequence
  synthetic polynucleotide sequence
cagcatccaggcagccgga

SEQ ID NO: 39002 - DNA, 21 bp, Artificial sequence
  synthetic polynucleotide sequence
tctaggatgaaggggtccaca

SEQ ID NO: 39003 - DNA, 18 bp, Artificial sequence
  synthetic polynucleotide sequence
gattgagggacgagggca

SEQ ID NO: 39004 - DNA, 18 bp, Artificial sequence
  synthetic polynucleotide sequence
gaggcaacagcctgcgga

SEQ ID NO: 39005 - DNA, 20 bp, Artificial sequence
  synthetic polynucleotide sequence
cagcacaaggccgccttcca

SEQ ID NO: 39006 - DNA, 21 bp, Artificial sequence
  synthetic polynucleotide sequence
tgtgtccagctcaactcggca

SEQ ID NO: 39007 - DNA, 18 bp, Artificial sequence
  synthetic polynucleotide sequence
ccagcagcacaaccacca

SEQ ID NO: 39008 - DNA, 18 bp, Artificial sequence
  synthetic polynucleotide sequence
tgagcacagcgacagcca

SEQ ID NO: 39009 - DNA, 20 bp, Artificial sequence
  synthetic polynucleotide sequence
ccgaccctcactggaagaga

SEQ ID NO: 39010 - DNA, 19 bp, Artificial sequence
  synthetic polynucleotide sequence
gtagcaaggaccaggccaa

SEQ ID NO: 39011 - DNA, 20 bp, Artificial sequence
  synthetic polynucleotide sequence
gtctctccagagtgccagca

SEQ ID NO: 39012 - DNA, 18 bp, Artificial sequence
  synthetic polynucleotide sequence
cagggtcgagggtgcaca

SEQ ID NO: 39013 - DNA, 20 bp, Artificial sequence
  synthetic polynucleotide sequence
atgcccacccattacggcga

SEQ ID NO: 39014 - DNA, 20 bp, Artificial sequence
  synthetic polynucleotide sequence
atgctgaattcccgccccca

SEQ ID NO: 39015 - DNA, 18 bp, Artificial sequence
  synthetic polynucleotide sequence
taacgccagccagtggga

SEQ ID NO: 39016 - DNA, 18 bp, Artificial sequence
  synthetic polynucleotide sequence
gcaggtgcgagcagcgga

SEQ ID NO: 39017 - DNA, 21 bp, Artificial sequence
  synthetic polynucleotide sequence
ccaagatgccgcccaaaggaa

SEQ ID NO: 39018 - DNA, 21 bp, Artificial sequence
  synthetic polynucleotide sequence
gtcagcactgtcactcccaga

SEQ ID NO: 39019 - DNA, 18 bp, Artificial sequence
  synthetic polynucleotide sequence
gggcatcgcgcacagaga

SEQ ID NO: 39020 - DNA, 18 bp, Artificial sequence
  synthetic polynucleotide sequence
tggacacctctggggcca

SEQ ID NO: 39021 - DNA, 21 bp, Artificial sequence
  synthetic polynucleotide sequence
gggacaaatgcatggggccca

SEQ ID NO: 39022 - DNA, 20 bp, Artificial sequence
  synthetic polynucleotide sequence
ctctgtagcacagccccgca

SEQ ID NO: 39023 - DNA, 18 bp, Artificial sequence
  synthetic polynucleotide sequence
ccaagtttggccagcgga

SEQ ID NO: 39024 - DNA, 20 bp, Artificial sequence
  synthetic polynucleotide sequence
gatggtagctccgagtccca

SEQ ID NO: 39025 - DNA, 21 bp, Artificial sequence
  synthetic polynucleotide sequence
agcatccctctacaaggtgca

SEQ ID NO: 39026 - DNA, 18 bp, Artificial sequence
  synthetic polynucleotide sequence
agcagcatcatcagggca

SEQ ID NO: 39027 - DNA, 21 bp, Artificial sequence
  synthetic polynucleotide sequence
ggagaacgatggggaggagga

SEQ ID NO: 39028 - DNA, 19 bp, Artificial sequence
  synthetic polynucleotide sequence
cggatcgaactccccggga

SEQ ID NO: 39029 - DNA, 23 bp, Artificial sequence
  synthetic polynucleotide sequence
gaaaagccatgaaagttccccca

SEQ ID NO: 39030 - DNA, 20 bp, Artificial sequence
  synthetic polynucleotide sequence
ctcagggttcacagtcgaga

SEQ ID NO: 39031 - DNA, 21 bp, Artificial sequence
  synthetic polynucleotide sequence
gccatccggagtgctgaagga

SEQ ID NO: 39032 - DNA, 20 bp, Artificial sequence
  synthetic polynucleotide sequence
ctccggatggacagtagaga

SEQ ID NO: 39033 - DNA, 18 bp, Artificial sequence
  synthetic polynucleotide sequence
agcaggctccagtggcaa

SEQ ID NO: 39034 - DNA, 20 bp, Artificial sequence
  synthetic polynucleotide sequence
caggaataggcgagccctca

SEQ ID NO: 39035 - DNA, 22 bp, Artificial sequence
  synthetic polynucleotide sequence
aatggaaggatgagaagcggga

SEQ ID NO: 39036 - DNA, 19 bp, Artificial sequence
  synthetic polynucleotide sequence
tgtggttgccaaggaagca

SEQ ID NO: 39037 - DNA, 21 bp, Artificial sequence
  synthetic polynucleotide sequence
ctacagcctccattgccacga

SEQ ID NO: 39038 - DNA, 21 bp, Artificial sequence
  synthetic polynucleotide sequence
cctgccatcctgtccagacga

SEQ ID NO: 39039 - DNA, 20 bp, Artificial sequence
  synthetic polynucleotide sequence
tgggtggaggcgcacacgga

SEQ ID NO: 39040 - DNA, 20 bp, Artificial sequence
  synthetic polynucleotide sequence
ccctctggcgaccatcagga

SEQ ID NO: 39041 - DNA, 20 bp, Artificial sequence
  synthetic polynucleotide sequence
cacagcaggtccttggacca

SEQ ID NO: 39042 - DNA, 18 bp, Artificial sequence
  synthetic polynucleotide sequence
ggtggggacacaagccca

SEQ ID NO: 39043 - DNA, 18 bp, Artificial sequence
  synthetic polynucleotide sequence
agggggcagcatggccca

SEQ ID NO: 39044 - DNA, 21 bp, Artificial sequence
  synthetic polynucleotide sequence
agcaaggcatctcagcgtgca

SEQ ID NO: 39045 - DNA, 18 bp, Artificial sequence
  synthetic polynucleotide sequence
ggaccaccacccccagga

SEQ ID NO: 39046 - DNA, 21 bp, Artificial sequence
  synthetic polynucleotide sequence
acaccagcatcatgagtccca

SEQ ID NO: 39047 - DNA, 18 bp, Artificial sequence
  synthetic polynucleotide sequence
ctacctggcccctgggga

SEQ ID NO: 39048 - DNA, 20 bp, Artificial sequence
  synthetic polynucleotide sequence
gcccccacagctgtcagtga

SEQ ID NO: 39049 - DNA, 22 bp, Artificial sequence
  synthetic polynucleotide sequence
tgaaccgggatcttacaggaga

SEQ ID NO: 39050 - DNA, 21 bp, Artificial sequence
  synthetic polynucleotide sequence
tggtcacctcgtgtcggcgaa

SEQ ID NO: 39051 - DNA, 21 bp, Artificial sequence
  synthetic polynucleotide sequence
gaaggacggtgagaaaggcca

SEQ ID NO: 39052 - DNA, 19 bp, Artificial sequence
  synthetic polynucleotide sequence
tctgcagtaggggtaagca

SEQ ID NO: 39053 - DNA, 19 bp, Artificial sequence
  synthetic polynucleotide sequence
tccagtcagtcaagaccaa

SEQ ID NO: 39054 - DNA, 20 bp, Artificial sequence
  synthetic polynucleotide sequence
tataggcacacatctgggga

SEQ ID NO: 39055 - DNA, 19 bp, Artificial sequence
  synthetic polynucleotide sequence
tgagggaaggctggagaga

SEQ ID NO: 39056 - DNA, 22 bp, Artificial sequence
  synthetic polynucleotide sequence
atcagcagaatgtctcggacca

SEQ ID NO: 39057 - DNA, 20 bp, Artificial sequence
  synthetic polynucleotide sequence
tcgcagcacaacttccccca

SEQ ID NO: 39058 - DNA, 20 bp, Artificial sequence
  synthetic polynucleotide sequence
cagcgccgcgtatacagcca

SEQ ID NO: 39059 - DNA, 20 bp, Artificial sequence
  synthetic polynucleotide sequence
gcggcctatggctccaccaa

SEQ ID NO: 39060 - DNA, 19 bp, Artificial sequence
  synthetic polynucleotide sequence
gtggttccgggagcgcaga

SEQ ID NO: 39061 - DNA, 19 bp, Artificial sequence
  synthetic polynucleotide sequence
catgacccgctgcggcaga

SEQ ID NO: 39062 - DNA, 21 bp, Artificial sequence
  synthetic polynucleotide sequence
tgaagatctgggaggcaggca

SEQ ID NO: 39063 - DNA, 21 bp, Artificial sequence
  synthetic polynucleotide sequence
tggagatgcccacgttcccca

SEQ ID NO: 39064 - DNA, 21 bp, Artificial sequence
  synthetic polynucleotide sequence
gtaggggacagttcggatgca

SEQ ID NO: 39065 - DNA, 21 bp, Artificial sequence
  synthetic polynucleotide sequence
cctacagcgtctaccgggaca

SEQ ID NO: 39066 - DNA, 18 bp, Artificial sequence
  synthetic polynucleotide sequence
gcacgcgttgaggcccga

SEQ ID NO: 39067 - DNA, 22 bp, Artificial sequence
  synthetic polynucleotide sequence
aaccccctgtcatcacagagca

SEQ ID NO: 39068 - DNA, 20 bp, Artificial sequence
  synthetic polynucleotide sequence
gttgagactggagcccggga

SEQ ID NO: 39069 - DNA, 19 bp, Artificial sequence
  synthetic polynucleotide sequence
ccggctactcgtacggcaa

SEQ ID NO: 39070 - DNA, 18 bp, Artificial sequence
  synthetic polynucleotide sequence
gatggagctgggtggcga

SEQ ID NO: 39071 - DNA, 22 bp, Artificial sequence
  synthetic polynucleotide sequence
tgtacagattgccctaccccaa

SEQ ID NO: 39072 - DNA, 21 bp, Artificial sequence
  synthetic polynucleotide sequence
tcatcacgagcttcaggggga

SEQ ID NO: 39073 - DNA, 19 bp, Artificial sequence
  synthetic polynucleotide sequence
ttgcatcatcatgggccca

SEQ ID NO: 39074 - DNA, 23 bp, Artificial sequence
  synthetic polynucleotide sequence
gtaaacatccatcccgatcacca

SEQ ID NO: 39075 - DNA, 20 bp, Artificial sequence
  synthetic polynucleotide sequence
gtcagccagggcagatggaa

SEQ ID NO: 39076 - DNA, 22 bp, Artificial sequence
  synthetic polynucleotide sequence
cacagctgaggaatcagcagga

SEQ ID NO: 39077 - DNA, 18 bp, Artificial sequence
  synthetic polynucleotide sequence
tgcccagtcccaagccaa

SEQ ID NO: 39078 - DNA, 19 bp, Artificial sequence
  synthetic polynucleotide sequence
ggttaacactggccacgca

SEQ ID NO: 39079 - DNA, 20 bp, Artificial sequence
  synthetic polynucleotide sequence
actgagctgccgtgccacca

SEQ ID NO: 39080 - DNA, 20 bp, Artificial sequence
  synthetic polynucleotide sequence
atgcagcggcacacggggca

SEQ ID NO: 39081 - DNA, 21 bp, Artificial sequence
  synthetic polynucleotide sequence
ggagccacagcaggaaggcaa

SEQ ID NO: 39082 - DNA, 19 bp, Artificial sequence
  synthetic polynucleotide sequence
ttcctggcagagtctccca

SEQ ID NO: 39083 - DNA, 18 bp, Artificial sequence
  synthetic polynucleotide sequence
ggtcaccgtgctgaacga

SEQ ID NO: 39084 - DNA, 18 bp, Artificial sequence
  synthetic polynucleotide sequence
tgtggaccctcagggaca

SEQ ID NO: 39085 - DNA, 21 bp, Artificial sequence
  synthetic polynucleotide sequence
tgcccgacaacaagctcgcca

SEQ ID NO: 39086 - DNA, 19 bp, Artificial sequence
  synthetic polynucleotide sequence
ttctcaggccacccaagca

SEQ ID NO: 39087 - DNA, 20 bp, Artificial sequence
  synthetic polynucleotide sequence
ctggccgaggtgctgagaga

SEQ ID NO: 39088 - DNA, 22 bp, Artificial sequence
  synthetic polynucleotide sequence
cctagcgtgagatacatgggca

SEQ ID NO: 39089 - DNA, 21 bp, Artificial sequence
  synthetic polynucleotide sequence
agaatgcagtcctggagccca

SEQ ID NO: 39090 - DNA, 22 bp, Artificial sequence
  synthetic polynucleotide sequence
tcatcagtgggaatcagcacca

SEQ ID NO: 39091 - DNA, 18 bp, Artificial sequence
  synthetic polynucleotide sequence
gcggcaaggaggaggcaa

SEQ ID NO: 39092 - DNA, 18 bp, Artificial sequence
  synthetic polynucleotide sequence
catccaggcttcgaggga

SEQ ID NO: 39093 - DNA, 20 bp, Artificial sequence
  synthetic polynucleotide sequence
aagtgtgaggcactcccgga

SEQ ID NO: 39094 - DNA, 20 bp, Artificial sequence
  synthetic polynucleotide sequence
gttcagtggaccaggaggca

SEQ ID NO: 39095 - DNA, 18 bp, Artificial sequence
  synthetic polynucleotide sequence
ccgaggcggggcttcgaa

SEQ ID NO: 39096 - DNA, 21 bp, Artificial sequence
  synthetic polynucleotide sequence
caccaggcacagaagtgtcca

SEQ ID NO: 39097 - DNA, 19 bp, Artificial sequence
  synthetic polynucleotide sequence
ccatcctaccaccacggga

SEQ ID NO: 39098 - DNA, 18 bp, Artificial sequence
  synthetic polynucleotide sequence
aaggcccgacactgggca

SEQ ID NO: 39099 - DNA, 18 bp, Artificial sequence
  synthetic polynucleotide sequence
agtgggacccaacagcga

SEQ ID NO: 39100 - DNA, 18 bp, Artificial sequence
  synthetic polynucleotide sequence
gcaccaggaaggtggcga

SEQ ID NO: 39101 - DNA, 20 bp, Artificial sequence
  synthetic polynucleotide sequence
ctggagtctcacgaggacca

SEQ ID NO: 39102 - DNA, 18 bp, Artificial sequence
  synthetic polynucleotide sequence
tccccgaagcaacgcaca

SEQ ID NO: 39103 - DNA, 18 bp, Artificial sequence
  synthetic polynucleotide sequence
aaggtgactgcccagcca

SEQ ID NO: 39104 - DNA, 18 bp, Artificial sequence
  synthetic polynucleotide sequence
accgaaggctgctgagga

SEQ ID NO: 39105 - DNA, 25 bp, Artificial sequence
  synthetic polynucleotide sequence
gagagaaggaaagggtaggaaacca

SEQ ID NO: 39106 - DNA, 23 bp, Artificial sequence
  synthetic polynucleotide sequence
ggagaataggagctgcaaagcca

SEQ ID NO: 39107 - DNA, 20 bp, Artificial sequence
  synthetic polynucleotide sequence
gtggagtctggggtcgccaa

SEQ ID NO: 39108 - DNA, 20 bp, Artificial sequence
  synthetic polynucleotide sequence
cttcacggagagagcctcca

SEQ ID NO: 39109 - DNA, 18 bp, Artificial sequence
  synthetic polynucleotide sequence
ccggacaggccgtcggaa

SEQ ID NO: 39110 - DNA, 18 bp, Artificial sequence
  synthetic polynucleotide sequence
ctgccccctcgagtgcca

SEQ ID NO: 39111 - DNA, 19 bp, Artificial sequence
  synthetic polynucleotide sequence
tgaggagctacgtcgggca

SEQ ID NO: 39112 - DNA, 21 bp, Artificial sequence
  synthetic polynucleotide sequence
gtcagcacaatgatggcagca

SEQ ID NO: 39113 - DNA, 20 bp, Artificial sequence
  synthetic polynucleotide sequence
cagacagctcgtcaggccca

SEQ ID NO: 39114 - DNA, 22 bp, Artificial sequence
  synthetic polynucleotide sequence
ttcatggcaaagttcacccgga

SEQ ID NO: 39115 - DNA, 20 bp, Artificial sequence
  synthetic polynucleotide sequence
atgctggagccagaccccaa

SEQ ID NO: 39116 - DNA, 20 bp, Artificial sequence
  synthetic polynucleotide sequence
aactgcagggtggtgagcca

SEQ ID NO: 39117 - DNA, 21 bp, Artificial sequence
  synthetic polynucleotide sequence
cgtcagcaacttcgacgagga

SEQ ID NO: 39118 - DNA, 21 bp, Artificial sequence
  synthetic polynucleotide sequence
ccacgaagtcgaagtccagga

SEQ ID NO: 39119 - DNA, 19 bp, Artificial sequence
  synthetic polynucleotide sequence
tggagcgctctgatggaca

SEQ ID NO: 39120 - DNA, 20 bp, Artificial sequence
  synthetic polynucleotide sequence
gttctcgaggtggagtcaga

SEQ ID NO: 39121 - DNA, 21 bp, Artificial sequence
  synthetic polynucleotide sequence
tcctccagaagtgcccggaga

SEQ ID NO: 39122 - DNA, 20 bp, Artificial sequence
  synthetic polynucleotide sequence
ctgttggcgggcagtgagga

SEQ ID NO: 39123 - DNA, 18 bp, Artificial sequence
  synthetic polynucleotide sequence
agggcagagcgaggacga

SEQ ID NO: 39124 - DNA, 18 bp, Artificial sequence
  synthetic polynucleotide sequence
ccaagaccagcccgctga

SEQ ID NO: 39125 - DNA, 20 bp, Artificial sequence
  synthetic polynucleotide sequence
cttgatgccagcaacccaga

SEQ ID NO: 39126 - DNA, 18 bp, Artificial sequence
  synthetic polynucleotide sequence
tgctgcagcacccccgca

SEQ ID NO: 39127 - DNA, 22 bp, Artificial sequence
  synthetic polynucleotide sequence
tgcagtacctgagctcccagga

SEQ ID NO: 39128 - DNA, 18 bp, Artificial sequence
  synthetic polynucleotide sequence
tctggttggggctgcgga

SEQ ID NO: 39129 - DNA, 18 bp, Artificial sequence
  synthetic polynucleotide sequence
ggccattagtgcaggcga

SEQ ID NO: 39130 - DNA, 19 bp, Artificial sequence
  synthetic polynucleotide sequence
ccgtgtgtgcccacagaga

SEQ ID NO: 39131 - DNA, 18 bp, Artificial sequence
  synthetic polynucleotide sequence
cacgaaggtggtgagcca

SEQ ID NO: 39132 - DNA, 18 bp, Artificial sequence
  synthetic polynucleotide sequence
tacagcaggtctcgggca

SEQ ID NO: 39133 - DNA, 19 bp, Artificial sequence
  synthetic polynucleotide sequence
ggactgtcgaagtccccca

SEQ ID NO: 39134 - DNA, 18 bp, Artificial sequence
  synthetic polynucleotide sequence
gctccacaaggatgggga

SEQ ID NO: 39135 - DNA, 18 bp, Artificial sequence
  synthetic polynucleotide sequence
ttcgtcaacggaggccaa

SEQ ID NO: 39136 - DNA, 18 bp, Artificial sequence
  synthetic polynucleotide sequence
tccagacagcgtccagca

SEQ ID NO: 39137 - DNA, 18 bp, Artificial sequence
  synthetic polynucleotide sequence
gtgctgccatggccacga

SEQ ID NO: 39138 - DNA, 18 bp, Artificial sequence
  synthetic polynucleotide sequence
attgacgcactgccagga

SEQ ID NO: 39139 - DNA, 18 bp, Artificial sequence
  synthetic polynucleotide sequence
cctcctgggaggcgagga

SEQ ID NO: 39140 - DNA, 19 bp, Artificial sequence
  synthetic polynucleotide sequence
tgtcagggaagggatacca

SEQ ID NO: 39141 - DNA, 21 bp, Artificial sequence
  synthetic polynucleotide sequence
ggaaaggcaccaatgcccaga

SEQ ID NO: 39142 - DNA, 22 bp, Artificial sequence
  synthetic polynucleotide sequence
attgctggaatgcccaagtcca

SEQ ID NO: 39143 - DNA, 18 bp, Artificial sequence
  synthetic polynucleotide sequence
ggctggtggaagccacga

SEQ ID NO: 39144 - DNA, 18 bp, Artificial sequence
  synthetic polynucleotide sequence
gtaccatcgccgtcacca

SEQ ID NO: 39145 - DNA, 21 bp, Artificial sequence
  synthetic polynucleotide sequence
caaaatcatccagcgggcgga

SEQ ID NO: 39146 - DNA, 18 bp, Artificial sequence
  synthetic polynucleotide sequence
cctggtcactgcgggcga

SEQ ID NO: 39147 - DNA, 20 bp, Artificial sequence
  synthetic polynucleotide sequence
ctggacaacccgtacaccca

SEQ ID NO: 39148 - DNA, 18 bp, Artificial sequence
  synthetic polynucleotide sequence
ggcagcgttgcggtcgca

SEQ ID NO: 39149 - DNA, 17 bp, Artificial sequence
  synthetic polynucleotide sequence
ggcagaggatcccccaa

SEQ ID NO: 39150 - DNA, 18 bp, Artificial sequence
  synthetic polynucleotide sequence
gcaaaacaggtggcagca

SEQ ID NO: 39151 - DNA, 21 bp, Artificial sequence
  synthetic polynucleotide sequence
tgattccaatccagggcggga

SEQ ID NO: 39152 - DNA, 20 bp, Artificial sequence
  synthetic polynucleotide sequence
ccacctagtccgcagtgaca

SEQ ID NO: 39153 - DNA, 22 bp, Artificial sequence
  synthetic polynucleotide sequence
tgatcgagaagatgacaggcaa

SEQ ID NO: 39154 - DNA, 18 bp, Artificial sequence
  synthetic polynucleotide sequence
agtctggtccaccggcca

SEQ ID NO: 39155 - DNA, 22 bp, Artificial sequence
  synthetic polynucleotide sequence
gagtgtgacaagcagacatgca

SEQ ID NO: 39156 - DNA, 19 bp, Artificial sequence
  synthetic polynucleotide sequence
ggggccctggcagtagaca

SEQ ID NO: 39157 - DNA, 18 bp, Artificial sequence
  synthetic polynucleotide sequence
tgcggaggcttcagcaga

SEQ ID NO: 39158 - DNA, 19 bp, Artificial sequence
  synthetic polynucleotide sequence
cctgggttagctgcaggca

SEQ ID NO: 39159 - DNA, 20 bp, Artificial sequence
  synthetic polynucleotide sequence
gctcatgcccagacctacga

SEQ ID NO: 39160 - DNA, 20 bp, Artificial sequence
  synthetic polynucleotide sequence
ccacaggcacatcacgtgca

SEQ ID NO: 39161 - DNA, 18 bp, Artificial sequence
  synthetic polynucleotide sequence
ggtcaggaaccaggccaa

SEQ ID NO: 39162 - DNA, 18 bp, Artificial sequence
  synthetic polynucleotide sequence
ttggggagcccatccaga

SEQ ID NO: 39163 - DNA, 18 bp, Artificial sequence
  synthetic polynucleotide sequence
cactcgtgctgcccccga

SEQ ID NO: 39164 - DNA, 19 bp, Artificial sequence
  synthetic polynucleotide sequence
gtggcggcggcagtagtca

SEQ ID NO: 39165 - DNA, 21 bp, Artificial sequence
  synthetic polynucleotide sequence
gcttgactccatgcccagcca

SEQ ID NO: 39166 - DNA, 22 bp, Artificial sequence
  synthetic polynucleotide sequence
gatagggagtagtcgaaggaga

SEQ ID NO: 39167 - DNA, 20 bp, Artificial sequence
  synthetic polynucleotide sequence
gcgcagccaggaaggctaca

SEQ ID NO: 39168 - DNA, 22 bp, Artificial sequence
  synthetic polynucleotide sequence
aaagcagcacgctgatctgaca

SEQ ID NO: 39169 - DNA, 18 bp, Artificial sequence
  synthetic polynucleotide sequence
actgcctggaccgaggaa

SEQ ID NO: 39170 - DNA, 18 bp, Artificial sequence
  synthetic polynucleotide sequence
gtgcagcacaatggggga

SEQ ID NO: 39171 - DNA, 21 bp, Artificial sequence
  synthetic polynucleotide sequence
gggctgcaacattcgcacaca

SEQ ID NO: 39172 - DNA, 20 bp, Artificial sequence
  synthetic polynucleotide sequence
cgagcttccggtcacaggca

SEQ ID NO: 39173 - DNA, 18 bp, Artificial sequence
  synthetic polynucleotide sequence
ggccaaggaactgggcaa

SEQ ID NO: 39174 - DNA, 18 bp, Artificial sequence
  synthetic polynucleotide sequence
cccagagggcgttgacca

SEQ ID NO: 39175 - DNA, 20 bp, Artificial sequence
  synthetic polynucleotide sequence
gcaggtacggcaaagagcaa

SEQ ID NO: 39176 - DNA, 18 bp, Artificial sequence
  synthetic polynucleotide sequence
atccatgcatccagggca

SEQ ID NO: 39177 - DNA, 20 bp, Artificial sequence
  synthetic polynucleotide sequence
gagccggtgcagtacacaca

SEQ ID NO: 39178 - DNA, 19 bp, Artificial sequence
  synthetic polynucleotide sequence
ggctgcttgcacaaggaca

SEQ ID NO: 39179 - DNA, 22 bp, Artificial sequence
  synthetic polynucleotide sequence
ctaacacactacccacagcaga

SEQ ID NO: 39180 - DNA, 21 bp, Artificial sequence
  synthetic polynucleotide sequence
gatgcagctgatcggtaggca

SEQ ID NO: 39181 - DNA, 20 bp, Artificial sequence
  synthetic polynucleotide sequence
tgtcatgtgctgccccccaa

SEQ ID NO: 39182 - DNA, 22 bp, Artificial sequence
  synthetic polynucleotide sequence
acaagctgaacacctcgtagca

SEQ ID NO: 39183 - DNA, 20 bp, Artificial sequence
  synthetic polynucleotide sequence
tggcagacaggcatgtgtga

SEQ ID NO: 39184 - DNA, 22 bp, Artificial sequence
  synthetic polynucleotide sequence
acaaatagatccagggatgcca

SEQ ID NO: 39185 - DNA, 22 bp, Artificial sequence
  synthetic polynucleotide sequence
gaattggcaccagggagagaca

SEQ ID NO: 39186 - DNA, 20 bp, Artificial sequence
  synthetic polynucleotide sequence
gggccacctggcagatggaa

SEQ ID NO: 39187 - DNA, 20 bp, Artificial sequence
  synthetic polynucleotide sequence
gacagacacatggctgtgca

SEQ ID NO: 39188 - DNA, 18 bp, Artificial sequence
  synthetic polynucleotide sequence
ggggcaggttccaggcca

SEQ ID NO: 39189 - DNA, 21 bp, Artificial sequence
  synthetic polynucleotide sequence
ctattcccaggaagaagcaca

SEQ ID NO: 39190 - DNA, 22 bp, Artificial sequence
  synthetic polynucleotide sequence
agctgctgacagtgagtgcaga

SEQ ID NO: 39191 - DNA, 18 bp, Artificial sequence
  synthetic polynucleotide sequence
tatgcagccgctgccaga

SEQ ID NO: 39192 - DNA, 20 bp, Artificial sequence
  synthetic polynucleotide sequence
ctgaggctcttgcagaggca

SEQ ID NO: 39193 - DNA, 21 bp, Artificial sequence
  synthetic polynucleotide sequence
tctctcatccgctgaacccca

SEQ ID NO: 39194 - DNA, 19 bp, Artificial sequence
  synthetic polynucleotide sequence
gcgcagagggcctcagaga

SEQ ID NO: 39195 - DNA, 18 bp, Artificial sequence
  synthetic polynucleotide sequence
ccatccagccgctgcaca

SEQ ID NO: 39196 - DNA, 18 bp, Artificial sequence
  synthetic polynucleotide sequence
gcggccatcgttcagaca

SEQ ID NO: 39197 - DNA, 18 bp, Artificial sequence
  synthetic polynucleotide sequence
ggtgatcagcgccacaca

SEQ ID NO: 39198 - DNA, 20 bp, Artificial sequence
  synthetic polynucleotide sequence
aacggatcttcagcaaggca

SEQ ID NO: 39199 - DNA, 20 bp, Artificial sequence
  synthetic polynucleotide sequence
caggaccctgagctatcgga

SEQ ID NO: 39200 - DNA, 20 bp, Artificial sequence
  synthetic polynucleotide sequence
cgaggtaacggcttcgggaa

SEQ ID NO: 39201 - DNA, 20 bp, Artificial sequence
  synthetic polynucleotide sequence
acaccctgcggaacagccga

SEQ ID NO: 39202 - DNA, 20 bp, Artificial sequence
  synthetic polynucleotide sequence
tcccgatgatgcccaccaca

SEQ ID NO: 39203 - DNA, 19 bp, Artificial sequence
  synthetic polynucleotide sequence
ggcaagaggtgggcagaca

SEQ ID NO: 39204 - DNA, 20 bp, Artificial sequence
  synthetic polynucleotide sequence
ggaacattgtaggagggcca

SEQ ID NO: 39205 - DNA, 18 bp, Artificial sequence
  synthetic polynucleotide sequence
caaagcctgcaaccccca

SEQ ID NO: 39206 - DNA, 18 bp, Artificial sequence
  synthetic polynucleotide sequence
catgggagcgctgacgca

SEQ ID NO: 39207 - DNA, 19 bp, Artificial sequence
  synthetic polynucleotide sequence
ggaagggacggactgcaga

SEQ ID NO: 39208 - DNA, 18 bp, Artificial sequence
  synthetic polynucleotide sequence
tccaggggctccatgaga

SEQ ID NO: 39209 - DNA, 20 bp, Artificial sequence
  synthetic polynucleotide sequence
gtgcctgcacagtgagagca

SEQ ID NO: 39210 - DNA, 18 bp, Artificial sequence
  synthetic polynucleotide sequence
ggaagggcttctcaggca

SEQ ID NO: 39211 - DNA, 21 bp, Artificial sequence
  synthetic polynucleotide sequence
aggaggcggaactgacggaga

SEQ ID NO: 39212 - DNA, 19 bp, Artificial sequence
  synthetic polynucleotide sequence
caggacctgctgctgccca

SEQ ID NO: 39213 - DNA, 18 bp, Artificial sequence
  synthetic polynucleotide sequence
gaaaggccaacaccgcca

SEQ ID NO: 39214 - DNA, 18 bp, Artificial sequence
  synthetic polynucleotide sequence
acaccagaggccagggca

SEQ ID NO: 39215 - DNA, 19 bp, Artificial sequence
  synthetic polynucleotide sequence
cagggccgcttccaggaca

SEQ ID NO: 39216 - DNA, 20 bp, Artificial sequence
  synthetic polynucleotide sequence
ctgccccgaaatgaccctga

SEQ ID NO: 39217 - DNA, 21 bp, Artificial sequence
  synthetic polynucleotide sequence
ctcccagaaccactctcagca

SEQ ID NO: 39218 - DNA, 19 bp, Artificial sequence
  synthetic polynucleotide sequence
ccagcgggggttgaagcca

SEQ ID NO: 39219 - DNA, 20 bp, Artificial sequence
  synthetic polynucleotide sequence
acagcacggcaggagaccaa

SEQ ID NO: 39220 - DNA, 19 bp, Artificial sequence
  synthetic polynucleotide sequence
tgcatgcaggtccaaggca

SEQ ID NO: 39221 - DNA, 21 bp, Artificial sequence
  synthetic polynucleotide sequence
tgtgggacaagaactgcccca

SEQ ID NO: 39222 - DNA, 20 bp, Artificial sequence
  synthetic polynucleotide sequence
atggcagctgtccagaggca

SEQ ID NO: 39223 - DNA, 18 bp, Artificial sequence
  synthetic polynucleotide sequence
tgaggaggagcccaagga

SEQ ID NO: 39224 - DNA, 20 bp, Artificial sequence
  synthetic polynucleotide sequence
ctctctcgcacgaggaagga

SEQ ID NO: 39225 - DNA, 20 bp, Artificial sequence
  synthetic polynucleotide sequence
ctccctctacgacgtcagca

SEQ ID NO: 39226 - DNA, 18 bp, Artificial sequence
  synthetic polynucleotide sequence
gatgagggcaccacggca

SEQ ID NO: 39227 - DNA, 21 bp, Artificial sequence
  synthetic polynucleotide sequence
tgtgtccgaggccacaagaga

SEQ ID NO: 39228 - DNA, 19 bp, Artificial sequence
  synthetic polynucleotide sequence
tcagatacaggcagcgaca

SEQ ID NO: 39229 - DNA, 20 bp, Artificial sequence
  synthetic polynucleotide sequence
cggcctcccatacctgacga

SEQ ID NO: 39230 - DNA, 20 bp, Artificial sequence
  synthetic polynucleotide sequence
gcagtcctgcacgcccacca

SEQ ID NO: 39231 - DNA, 22 bp, Artificial sequence
  synthetic polynucleotide sequence
gtaaacctacctgagctggcca

SEQ ID NO: 39232 - DNA, 21 bp, Artificial sequence
  synthetic polynucleotide sequence
catgccgatatccaggctgca

SEQ ID NO: 39233 - DNA, 21 bp, Artificial sequence
  synthetic polynucleotide sequence
tcaagaatgcccagcccccta

SEQ ID NO: 39234 - DNA, 21 bp, Artificial sequence
  synthetic polynucleotide sequence
cctccggcacaattccctgca

SEQ ID NO: 39235 - DNA, 21 bp, Artificial sequence
  synthetic polynucleotide sequence
caacctcacggagaacctgca

SEQ ID NO: 39236 - DNA, 19 bp, Artificial sequence
  synthetic polynucleotide sequence
ccgatgaagtcccccgcga

SEQ ID NO: 39237 - DNA, 21 bp, Artificial sequence
  synthetic polynucleotide sequence
tgcccagcctgcagtgtggaa

SEQ ID NO: 39238 - DNA, 21 bp, Artificial sequence
  synthetic polynucleotide sequence
gggtgaggatcgcttgggaga

SEQ ID NO: 39239 - DNA, 20 bp, Artificial sequence
  synthetic polynucleotide sequence
caagcccagagaccccgaca

SEQ ID NO: 39240 - DNA, 21 bp, Artificial sequence
  synthetic polynucleotide sequence
ctgggcaaaaatcgctgggca

SEQ ID NO: 39241 - DNA, 21 bp, Artificial sequence
  synthetic polynucleotide sequence
tgactgctgggatggagcaca

SEQ ID NO: 39242 - DNA, 20 bp, Artificial sequence
  synthetic polynucleotide sequence
gttgggcagtggagcagtga

SEQ ID NO: 39243 - DNA, 21 bp, Artificial sequence
  synthetic polynucleotide sequence
ctgggaaagcgtgacagtgaa

SEQ ID NO: 39244 - DNA, 20 bp, Artificial sequence
  synthetic polynucleotide sequence
gtagccgaagtcctcgggca

SEQ ID NO: 39245 - DNA, 18 bp, Artificial sequence
  synthetic polynucleotide sequence
ggctgagagcaacgccaa

SEQ ID NO: 39246 - DNA, 18 bp, Artificial sequence
  synthetic polynucleotide sequence
tgagggggaagtggacca

SEQ ID NO: 39247 - DNA, 21 bp, Artificial sequence
  synthetic polynucleotide sequence
acgtggtggacaatgcccgga

SEQ ID NO: 39248 - DNA, 21 bp, Artificial sequence
  synthetic polynucleotide sequence
gtatggttgtcacgcagggca

SEQ ID NO: 39249 - DNA, 20 bp, Artificial sequence
  synthetic polynucleotide sequence
aagggagccgaggtgacgta

SEQ ID NO: 39250 - DNA, 20 bp, Artificial sequence
  synthetic polynucleotide sequence
tcccagggattgccagtcca

SEQ ID NO: 39251 - DNA, 22 bp, Artificial sequence
  synthetic polynucleotide sequence
atcaagacccaggctacatgca

SEQ ID NO: 39252 - DNA, 20 bp, Artificial sequence
  synthetic polynucleotide sequence
gtggggcacagcttccgtga

SEQ ID NO: 39253 - DNA, 18 bp, Artificial sequence
  synthetic polynucleotide sequence
tcaccgagttcgccgaca

SEQ ID NO: 39254 - DNA, 18 bp, Artificial sequence
  synthetic polynucleotide sequence
tgtccaggatgccagcca

SEQ ID NO: 39255 - DNA, 20 bp, Artificial sequence
  synthetic polynucleotide sequence
gaagaccctgcctacctgca

SEQ ID NO: 39256 - DNA, 21 bp, Artificial sequence
  synthetic polynucleotide sequence
ctctccactgaagtcaccaca

SEQ ID NO: 39257 - DNA, 21 bp, Artificial sequence
  synthetic polynucleotide sequence
ccggaatccgttcaagcccca

SEQ ID NO: 39258 - DNA, 20 bp, Artificial sequence
  synthetic polynucleotide sequence
tccagacggctggccgtgaa

SEQ ID NO: 39259 - DNA, 20 bp, Artificial sequence
  synthetic polynucleotide sequence
ctcttgccaaggtcaagcca

SEQ ID NO: 39260 - DNA, 18 bp, Artificial sequence
  synthetic polynucleotide sequence
ctgaccggaaggctcgca

SEQ ID NO: 39261 - DNA, 21 bp, Artificial sequence
  synthetic polynucleotide sequence
accgagaaccactgcgcacca

SEQ ID NO: 39262 - DNA, 20 bp, Artificial sequence
  synthetic polynucleotide sequence
gtggcacttgagggcctgga

SEQ ID NO: 39263 - DNA, 19 bp, Artificial sequence
  synthetic polynucleotide sequence
ttcaactgcaccatccgga

SEQ ID NO: 39264 - DNA, 19 bp, Artificial sequence
  synthetic polynucleotide sequence
cttcggcgtcgctgggaga

SEQ ID NO: 39265 - DNA, 20 bp, Artificial sequence
  synthetic polynucleotide sequence
gagagggagagcctgccaga

SEQ ID NO: 39266 - DNA, 20 bp, Artificial sequence
  synthetic polynucleotide sequence
acctaagtgagggctggcga

SEQ ID NO: 39267 - DNA, 18 bp, Artificial sequence
  synthetic polynucleotide sequence
atcaccaggggcggccga

SEQ ID NO: 39268 - DNA, 19 bp, Artificial sequence
  synthetic polynucleotide sequence
tcttcccagccagtaggca

SEQ ID NO: 39269 - DNA, 21 bp, Artificial sequence
  synthetic polynucleotide sequence
accgccaagcacagaggagga

SEQ ID NO: 39270 - DNA, 19 bp, Artificial sequence
  synthetic polynucleotide sequence
gacccctgagagcccgaca

SEQ ID NO: 39271 - DNA, 21 bp, Artificial sequence
  synthetic polynucleotide sequence
aggccaccatcatccggcaca

SEQ ID NO: 39272 - DNA, 21 bp, Artificial sequence
  synthetic polynucleotide sequence
agggcccacaagtcctaggga

SEQ ID NO: 39273 - DNA, 20 bp, Artificial sequence
  synthetic polynucleotide sequence
ctggaaaggttgcaaaggga

SEQ ID NO: 39274 - DNA, 18 bp, Artificial sequence
  synthetic polynucleotide sequence
tggctgatcccagggcca

SEQ ID NO: 39275 - DNA, 19 bp, Artificial sequence
  synthetic polynucleotide sequence
ggtggtgccccccaatgca

SEQ ID NO: 39276 - DNA, 18 bp, Artificial sequence
  synthetic polynucleotide sequence
ccggcgctgtagcaggga

SEQ ID NO: 39277 - DNA, 20 bp, Artificial sequence
  synthetic polynucleotide sequence
ccgtgccctaccagtaccca

SEQ ID NO: 39278 - DNA, 19 bp, Artificial sequence
  synthetic polynucleotide sequence
gtggctgctcctgccagca

SEQ ID NO: 39279 - DNA, 20 bp, Artificial sequence
  synthetic polynucleotide sequence
acctcccagctggatgccaa

SEQ ID NO: 39280 - DNA, 18 bp, Artificial sequence
  synthetic polynucleotide sequence
accccgggagagtgccga

SEQ ID NO: 39281 - DNA, 19 bp, Artificial sequence
  synthetic polynucleotide sequence
cagggcagccgggtgagga

SEQ ID NO: 39282 - DNA, 20 bp, Artificial sequence
  synthetic polynucleotide sequence
acggagagctgaggacagga

SEQ ID NO: 39283 - DNA, 21 bp, Artificial sequence
  synthetic polynucleotide sequence
tcgtcgccaccattgccgcaa

SEQ ID NO: 39284 - DNA, 21 bp, Artificial sequence
  synthetic polynucleotide sequence
gtctgatctagcaggctggca

SEQ ID NO: 39285 - DNA, 20 bp, Artificial sequence
  synthetic polynucleotide sequence
gacaccatagggctcccaga

SEQ ID NO: 39286 - DNA, 20 bp, Artificial sequence
  synthetic polynucleotide sequence
caggctgtcacagcacacga

SEQ ID NO: 39287 - DNA, 18 bp, Artificial sequence
  synthetic polynucleotide sequence
ccctcccaacttcaccca

SEQ ID NO: 39288 - DNA, 18 bp, Artificial sequence
  synthetic polynucleotide sequence
gcagctggaacatgggca

SEQ ID NO: 39289 - DNA, 20 bp, Artificial sequence
  synthetic polynucleotide sequence
gtggcacaggaggacagcaa

SEQ ID NO: 39290 - DNA, 20 bp, Artificial sequence
  synthetic polynucleotide sequence
gagagctgacagctgaggga

SEQ ID NO: 39291 - DNA, 20 bp, Artificial sequence
  synthetic polynucleotide sequence
ctcttcagcaagcctcgcca

SEQ ID NO: 39292 - DNA, 20 bp, Artificial sequence
  synthetic polynucleotide sequence
gacggcctgcctccaaagca

SEQ ID NO: 39293 - DNA, 21 bp, Artificial sequence
  synthetic polynucleotide sequence
cctgctcagcagccatggcaa

SEQ ID NO: 39294 - DNA, 20 bp, Artificial sequence
  synthetic polynucleotide sequence
gcagcgcgtacttggccaca

SEQ ID NO: 39295 - DNA, 21 bp, Artificial sequence
  synthetic polynucleotide sequence
ttgtggtagagcctggggaca

SEQ ID NO: 39296 - DNA, 20 bp, Artificial sequence
  synthetic polynucleotide sequence
tgggcgtggcagatgaggca

SEQ ID NO: 39297 - DNA, 21 bp, Artificial sequence
  synthetic polynucleotide sequence
gccctacagaagctgaaggca

SEQ ID NO: 39298 - DNA, 20 bp, Artificial sequence
  synthetic polynucleotide sequence
ccctccagggaaggcgtgga

SEQ ID NO: 39299 - DNA, 25 bp, Artificial sequence
  synthetic polynucleotide sequence
gaaggaaaagtgaagtggctggaca

SEQ ID NO: 39300 - DNA, 20 bp, Artificial sequence
  synthetic polynucleotide sequence
atcccaaagcggtggccaca

SEQ ID NO: 39301 - DNA, 21 bp, Artificial sequence
  synthetic polynucleotide sequence
ccaccccaggcgctatagaca

SEQ ID NO: 39302 - DNA, 21 bp, Artificial sequence
  synthetic polynucleotide sequence
ccacggtcaggtagatgcgga

SEQ ID NO: 39303 - DNA, 19 bp, Artificial sequence
  synthetic polynucleotide sequence
tctcaactccagcagggca

SEQ ID NO: 39304 - DNA, 23 bp, Artificial sequence
  synthetic polynucleotide sequence
aataaatgcgcacacagtcagca

SEQ ID NO: 39305 - DNA, 19 bp, Artificial sequence
  synthetic polynucleotide sequence
ttgagaacttggccgcgga

SEQ ID NO: 39306 - DNA, 19 bp, Artificial sequence
  synthetic polynucleotide sequence
tcgtgaccgtctggggaca

SEQ ID NO: 39307 - DNA, 19 bp, Artificial sequence
  synthetic polynucleotide sequence
gagcccggcaccttctcca

SEQ ID NO: 39308 - DNA, 21 bp, Artificial sequence
  synthetic polynucleotide sequence
atgaactcgtagctggcccga

SEQ ID NO: 39309 - DNA, 19 bp, Artificial sequence
  synthetic polynucleotide sequence
gacctcaccaagcgcccga

SEQ ID NO: 39310 - DNA, 20 bp, Artificial sequence
  synthetic polynucleotide sequence
caggcccaggtaatccccca

SEQ ID NO: 39311 - DNA, 20 bp, Artificial sequence
  synthetic polynucleotide sequence
gtgaacatggggggggagca

SEQ ID NO: 39312 - DNA, 19 bp, Artificial sequence
  synthetic polynucleotide sequence
ttggacacagcctggcaga

SEQ ID NO: 39313 - DNA, 20 bp, Artificial sequence
  synthetic polynucleotide sequence
ctcctcaggcggacagacca

SEQ ID NO: 39314 - DNA, 20 bp, Artificial sequence
  synthetic polynucleotide sequence
gaggagcagcccacggtgga

SEQ ID NO: 39315 - DNA, 22 bp, Artificial sequence
  synthetic polynucleotide sequence
atgggaagcgaaaggccaagga

SEQ ID NO: 39316 - DNA, 20 bp, Artificial sequence
  synthetic polynucleotide sequence
ctccctgacctcctgcagca

SEQ ID NO: 39317 - DNA, 20 bp, Artificial sequence
  synthetic polynucleotide sequence
ctggagcatgtgacacggga

SEQ ID NO: 39318 - DNA, 20 bp, Artificial sequence
  synthetic polynucleotide sequence
aggcgcagaagaccgtcaga

SEQ ID NO: 39319 - DNA, 21 bp, Artificial sequence
  synthetic polynucleotide sequence
gtccagaccaggtctctggaa

SEQ ID NO: 39320 - DNA, 21 bp, Artificial sequence
  synthetic polynucleotide sequence
tgcttccacatcggcagggga

SEQ ID NO: 39321 - DNA, 20 bp, Artificial sequence
  synthetic polynucleotide sequence
ggcagccaattccacagcca

SEQ ID NO: 39322 - DNA, 22 bp, Artificial sequence
  synthetic polynucleotide sequence
gaaactcagaggttgcagggga

SEQ ID NO: 39323 - DNA, 18 bp, Artificial sequence
  synthetic polynucleotide sequence
catcctgggtgcacacca

SEQ ID NO: 39324 - DNA, 19 bp, Artificial sequence
  synthetic polynucleotide sequence
gtcagtgatgacggcagga

SEQ ID NO: 39325 - DNA, 21 bp, Artificial sequence
  synthetic polynucleotide sequence
aggtcaaggagagcccctgga

SEQ ID NO: 39326 - DNA, 19 bp, Artificial sequence
  synthetic polynucleotide sequence
tggaatgccctgcaggtga

SEQ ID NO: 39327 - DNA, 22 bp, Artificial sequence
  synthetic polynucleotide sequence
gaaaggcagctcatcatgcaga

SEQ ID NO: 39328 - DNA, 22 bp, Artificial sequence
  synthetic polynucleotide sequence
aatggaacaatcgggaccagga

SEQ ID NO: 39329 - DNA, 21 bp, Artificial sequence
  synthetic polynucleotide sequence
agggtgctgcacctcacacca

SEQ ID NO: 39330 - DNA, 21 bp, Artificial sequence
  synthetic polynucleotide sequence
aatgcaccactgtgtccacca

SEQ ID NO: 39331 - DNA, 20 bp, Artificial sequence
  synthetic polynucleotide sequence
gactcagcagctccagacca

SEQ ID NO: 39332 - DNA, 18 bp, Artificial sequence
  synthetic polynucleotide sequence
cgcctgccatcaccccca

SEQ ID NO: 39333 - DNA, 18 bp, Artificial sequence
  synthetic polynucleotide sequence
ccgccgccaggtggagga

SEQ ID NO: 39334 - DNA, 18 bp, Artificial sequence
  synthetic polynucleotide sequence
cccacgagccacgtgaca

SEQ ID NO: 39335 - DNA, 20 bp, Artificial sequence
  synthetic polynucleotide sequence
ggccagttccaagccaggga

SEQ ID NO: 39336 - DNA, 19 bp, Artificial sequence
  synthetic polynucleotide sequence
ccctggaggctggagacca

SEQ ID NO: 39337 - DNA, 19 bp, Artificial sequence
  synthetic polynucleotide sequence
ggcaagaggaggctgagga

SEQ ID NO: 39338 - DNA, 20 bp, Artificial sequence
  synthetic polynucleotide sequence
gtcattgaagagcaccccca

SEQ ID NO: 39339 - DNA, 20 bp, Artificial sequence
  synthetic polynucleotide sequence
aacaagcagcagattgggga

SEQ ID NO: 39340 - DNA, 18 bp, Artificial sequence
  synthetic polynucleotide sequence
tgcaatcagcttccggca

SEQ ID NO: 39341 - DNA, 20 bp, Artificial sequence
  synthetic polynucleotide sequence
ctgcagtgggtcaagacgga

SEQ ID NO: 39342 - DNA, 18 bp, Artificial sequence
  synthetic polynucleotide sequence
ctgccgcaggtctggaga

SEQ ID NO: 39343 - DNA, 19 bp, Artificial sequence
  synthetic polynucleotide sequence
tctccaacacaggcaccaa

SEQ ID NO: 39344 - DNA, 20 bp, Artificial sequence
  synthetic polynucleotide sequence
agaagacactcctgcctgca

SEQ ID NO: 39345 - DNA, 18 bp, Artificial sequence
  synthetic polynucleotide sequence
tgcggacaccccgtacca

SEQ ID NO: 39346 - DNA, 18 bp, Artificial sequence
  synthetic polynucleotide sequence
caggtcaactgccgcaga

SEQ ID NO: 39347 - DNA, 20 bp, Artificial sequence
  synthetic polynucleotide sequence
gtgatgatcacagctgccaa

SEQ ID NO: 39348 - DNA, 22 bp, Artificial sequence
  synthetic polynucleotide sequence
gctgagcgagtgaggtattgga

SEQ ID NO: 39349 - DNA, 20 bp, Artificial sequence
  synthetic polynucleotide sequence
ggctactacaccagggccca

SEQ ID NO: 39350 - DNA, 19 bp, Artificial sequence
  synthetic polynucleotide sequence
tgtagcgcaggaaccgaca

SEQ ID NO: 39351 - DNA, 20 bp, Artificial sequence
  synthetic polynucleotide sequence
taagtcaagcggaagccaga

SEQ ID NO: 39352 - DNA, 20 bp, Artificial sequence
  synthetic polynucleotide sequence
aggactcaatgctccccaga

SEQ ID NO: 39353 - DNA, 18 bp, Artificial sequence
  synthetic polynucleotide sequence
atgtgcccaccgtggaca

SEQ ID NO: 39354 - DNA, 18 bp, Artificial sequence
  synthetic polynucleotide sequence
gtggtgtggccgcagaga

SEQ ID NO: 39355 - DNA, 21 bp, Artificial sequence
  synthetic polynucleotide sequence
catcaactggccctggagtga

SEQ ID NO: 39356 - DNA, 19 bp, Artificial sequence
  synthetic polynucleotide sequence
cttggctgccgaacgggga

SEQ ID NO: 39357 - DNA, 18 bp, Artificial sequence
  synthetic polynucleotide sequence
aggcagactgcggcctca

SEQ ID NO: 39358 - DNA, 22 bp, Artificial sequence
  synthetic polynucleotide sequence
caaacagcatgcagtacatgga

SEQ ID NO: 39359 - DNA, 20 bp, Artificial sequence
  synthetic polynucleotide sequence
cccgactggagccgggtcaa

SEQ ID NO: 39360 - DNA, 20 bp, Artificial sequence
  synthetic polynucleotide sequence
agcagccgtgcccacttcca

SEQ ID NO: 39361 - DNA, 21 bp, Artificial sequence
  synthetic polynucleotide sequence
caaagtccaggaagccaggaa

SEQ ID NO: 39362 - DNA, 18 bp, Artificial sequence
  synthetic polynucleotide sequence
ctatgcagcaggccacca

SEQ ID NO: 39363 - DNA, 21 bp, Artificial sequence
  synthetic polynucleotide sequence
tctggccaacacagcttgcca

SEQ ID NO: 39364 - DNA, 21 bp, Artificial sequence
  synthetic polynucleotide sequence
ccttcggtgatcccctccaga

SEQ ID NO: 39365 - DNA, 21 bp, Artificial sequence
  synthetic polynucleotide sequence
tccccccgttccagagactca

SEQ ID NO: 39366 - DNA, 19 bp, Artificial sequence
  synthetic polynucleotide sequence
tggccaggaagatcagaga

SEQ ID NO: 39367 - DNA, 18 bp, Artificial sequence
  synthetic polynucleotide sequence
gggccgccctgatgtcga

SEQ ID NO: 39368 - DNA, 20 bp, Artificial sequence
  synthetic polynucleotide sequence
ggtgacattgtgccgcccca

SEQ ID NO: 39369 - DNA, 19 bp, Artificial sequence
  synthetic polynucleotide sequence
gcgccgccatggtgtccaa

SEQ ID NO: 39370 - DNA, 21 bp, Artificial sequence
  synthetic polynucleotide sequence
gtagccgatgacaaagccgga

SEQ ID NO: 39371 - DNA, 20 bp, Artificial sequence
  synthetic polynucleotide sequence
caaacacgctgctctgagca

SEQ ID NO: 39372 - DNA, 18 bp, Artificial sequence
  synthetic polynucleotide sequence
accagcaatcacgtccga

SEQ ID NO: 39373 - DNA, 19 bp, Artificial sequence
  synthetic polynucleotide sequence
gcggtcacctacacagcga

SEQ ID NO: 39374 - DNA, 18 bp, Artificial sequence
  synthetic polynucleotide sequence
gcacaacgcaggtgacca

SEQ ID NO: 39375 - DNA, 18 bp, Artificial sequence
  synthetic polynucleotide sequence
cacgcagtaccgcagcca

SEQ ID NO: 39376 - DNA, 18 bp, Artificial sequence
  synthetic polynucleotide sequence
aggccaggtaggcagcga

SEQ ID NO: 39377 - DNA, 20 bp, Artificial sequence
  synthetic polynucleotide sequence
tggagggccaagagtgtcca

SEQ ID NO: 39378 - DNA, 20 bp, Artificial sequence
  synthetic polynucleotide sequence
aaccacttggcccgagcaga

SEQ ID NO: 39379 - DNA, 19 bp, Artificial sequence
  synthetic polynucleotide sequence
ggtgcgccgaactgtccga

SEQ ID NO: 39380 - DNA, 20 bp, Artificial sequence
  synthetic polynucleotide sequence
gggcttacacagggcaagga

SEQ ID NO: 39381 - DNA, 22 bp, Artificial sequence
  synthetic polynucleotide sequence
agtaccctgccaatcaaggaca

SEQ ID NO: 39382 - DNA, 21 bp, Artificial sequence
  synthetic polynucleotide sequence
tgtaggctgtggacggtcaga

SEQ ID NO: 39383 - DNA, 22 bp, Artificial sequence
  synthetic polynucleotide sequence
atctgaccaatgcaggatggca

SEQ ID NO: 39384 - DNA, 21 bp, Artificial sequence
  synthetic polynucleotide sequence
agtccagcacgcttcaggtca

SEQ ID NO: 39385 - DNA, 22 bp, Artificial sequence
  synthetic polynucleotide sequence
caaaaggaaggtgaaccacgga

SEQ ID NO: 39386 - DNA, 22 bp, Artificial sequence
  synthetic polynucleotide sequence
gtttccactgacaacatcagca

SEQ ID NO: 39387 - DNA, 19 bp, Artificial sequence
  synthetic polynucleotide sequence
cagctacccacccccacca

SEQ ID NO: 39388 - DNA, 20 bp, Artificial sequence
  synthetic polynucleotide sequence
atggtacccctgcagctcca

SEQ ID NO: 39389 - DNA, 22 bp, Artificial sequence
  synthetic polynucleotide sequence
aaactgtccgccaggattggaa

SEQ ID NO: 39390 - DNA, 22 bp, Artificial sequence
  synthetic polynucleotide sequence
ggtaaaaggtctagaccgccca

SEQ ID NO: 39391 - DNA, 19 bp, Artificial sequence
  synthetic polynucleotide sequence
ttgaggtgaagactcggga

SEQ ID NO: 39392 - DNA, 21 bp, Artificial sequence
  synthetic polynucleotide sequence
tcaccctcacatccaggtcca

SEQ ID NO: 39393 - DNA, 19 bp, Artificial sequence
  synthetic polynucleotide sequence
ctgccagacaagagctgga

SEQ ID NO: 39394 - DNA, 22 bp, Artificial sequence
  synthetic polynucleotide sequence
aacagaatctgaaccacagcca

SEQ ID NO: 39395 - DNA, 19 bp, Artificial sequence
  synthetic polynucleotide sequence
gaggtccagctgtccagca

SEQ ID NO: 39396 - DNA, 18 bp, Artificial sequence
  synthetic polynucleotide sequence
tgggatcagagccagcga

SEQ ID NO: 39397 - DNA, 22 bp, Artificial sequence
  synthetic polynucleotide sequence
atcagaaactcagccctggaca

SEQ ID NO: 39398 - DNA, 20 bp, Artificial sequence
  synthetic polynucleotide sequence
ctccaggctagctgggtcga

SEQ ID NO: 39399 - DNA, 21 bp, Artificial sequence
  synthetic polynucleotide sequence
cagaatctcggcgaaggagca

SEQ ID NO: 39400 - DNA, 20 bp, Artificial sequence
  synthetic polynucleotide sequence
atgctgcaggcaggtcggca

SEQ ID NO: 39401 - DNA, 20 bp, Artificial sequence
  synthetic polynucleotide sequence
cccaccagcctccctacaga

SEQ ID NO: 39402 - DNA, 22 bp, Artificial sequence
  synthetic polynucleotide sequence
acaatgaggaccaggatgagga

SEQ ID NO: 39403 - DNA, 18 bp, Artificial sequence
  synthetic polynucleotide sequence
tgacggtcacaggcacca

SEQ ID NO: 39404 - DNA, 18 bp, Artificial sequence
  synthetic polynucleotide sequence
cacagggttggccacaga

SEQ ID NO: 39405 - DNA, 20 bp, Artificial sequence
  synthetic polynucleotide sequence
gccccgatgatcaccccaga

SEQ ID NO: 39406 - DNA, 21 bp, Artificial sequence
  synthetic polynucleotide sequence
tgtacttgatggccaggggga

SEQ ID NO: 39407 - DNA, 20 bp, Artificial sequence
  synthetic polynucleotide sequence
aggctcaactcactggccca

SEQ ID NO: 39408 - DNA, 20 bp, Artificial sequence
  synthetic polynucleotide sequence
ctctcgtagcggctgaggga

SEQ ID NO: 39409 - DNA, 19 bp, Artificial sequence
  synthetic polynucleotide sequence
ggagggacccaagtgacca

SEQ ID NO: 39410 - DNA, 18 bp, Artificial sequence
  synthetic polynucleotide sequence
tgtccacctgcaccgaca

SEQ ID NO: 39411 - DNA, 18 bp, Artificial sequence
  synthetic polynucleotide sequence
ccaaactgccatgcccca

SEQ ID NO: 39412 - DNA, 19 bp, Artificial sequence
  synthetic polynucleotide sequence
cagtcagtggctccaccga

SEQ ID NO: 39413 - DNA, 18 bp, Artificial sequence
  synthetic polynucleotide sequence
cccacgatgccaacgaga

SEQ ID NO: 39414 - DNA, 18 bp, Artificial sequence
  synthetic polynucleotide sequence
cagggcctcatacacgca

SEQ ID NO: 39415 - DNA, 20 bp, Artificial sequence
  synthetic polynucleotide sequence
tgaaagccaccgaggagcca

SEQ ID NO: 39416 - DNA, 21 bp, Artificial sequence
  synthetic polynucleotide sequence
ggtacttgacggcgatgggga

SEQ ID NO: 39417 - DNA, 18 bp, Artificial sequence
  synthetic polynucleotide sequence
gcgagctccggaaagaga

SEQ ID NO: 39418 - DNA, 20 bp, Artificial sequence
  synthetic polynucleotide sequence
gaagccacctgactcaggga

SEQ ID NO: 39419 - DNA, 20 bp, Artificial sequence
  synthetic polynucleotide sequence
gggaatctccgaccccgaca

SEQ ID NO: 39420 - DNA, 20 bp, Artificial sequence
  synthetic polynucleotide sequence
gtcgatgaaggcctgcgcga

SEQ ID NO: 39421 - DNA, 23 bp, Artificial sequence
  synthetic polynucleotide sequence
cggggtaaggtaaagtcagcaga

SEQ ID NO: 39422 - DNA, 21 bp, Artificial sequence
  synthetic polynucleotide sequence
taagggacaagagggcagcaa

SEQ ID NO: 39423 - DNA, 21 bp, Artificial sequence
  synthetic polynucleotide sequence
gcttcagggtgcacagtggaa

SEQ ID NO: 39424 - DNA, 22 bp, Artificial sequence
  synthetic polynucleotide sequence
atccgtagatcctgaagggcca

SEQ ID NO: 39425 - DNA, 18 bp, Artificial sequence
  synthetic polynucleotide sequence
ggacacccgatcccagca

SEQ ID NO: 39426 - DNA, 22 bp, Artificial sequence
  synthetic polynucleotide sequence
tgagtagcacactcgacttcca

SEQ ID NO: 39427 - DNA, 21 bp, Artificial sequence
  synthetic polynucleotide sequence
catgggtaccacactggcaga

SEQ ID NO: 39428 - DNA, 19 bp, Artificial sequence
  synthetic polynucleotide sequence
ggaccttcaggctcaggga

SEQ ID NO: 39429 - DNA, 20 bp, Artificial sequence
  synthetic polynucleotide sequence
cagagcaagcctcactgcca

SEQ ID NO: 39430 - DNA, 20 bp, Artificial sequence
  synthetic polynucleotide sequence
cagggaaaagggctggggaa

SEQ ID NO: 39431 - DNA, 21 bp, Artificial sequence
  synthetic polynucleotide sequence
cggagtccacacagagggaga

SEQ ID NO: 39432 - DNA, 21 bp, Artificial sequence
  synthetic polynucleotide sequence
gcagtatgaggaacccgggca

SEQ ID NO: 39433 - DNA, 18 bp, Artificial sequence
  synthetic polynucleotide sequence
gggaattccaggaggcca

SEQ ID NO: 39434 - DNA, 19 bp, Artificial sequence
  synthetic polynucleotide sequence
gggtagacatgctgggcca

SEQ ID NO: 39435 - DNA, 19 bp, Artificial sequence
  synthetic polynucleotide sequence
ccctggaggagaggatcga

SEQ ID NO: 39436 - DNA, 18 bp, Artificial sequence
  synthetic polynucleotide sequence
tgtcccagccctcgggga

SEQ ID NO: 39437 - DNA, 18 bp, Artificial sequence
  synthetic polynucleotide sequence
acgtggatgggaccctca

SEQ ID NO: 39438 - DNA, 18 bp, Artificial sequence
  synthetic polynucleotide sequence
agtccgatccgcctacca

SEQ ID NO: 39439 - DNA, 22 bp, Artificial sequence
  synthetic polynucleotide sequence
gttagccaccagaaaactggga

SEQ ID NO: 39440 - DNA, 21 bp, Artificial sequence
  synthetic polynucleotide sequence
cctggcctagcttgaaggaga

SEQ ID NO: 39441 - DNA, 19 bp, Artificial sequence
  synthetic polynucleotide sequence
caccaaacgaatggctgca

SEQ ID NO: 39442 - DNA, 18 bp, Artificial sequence
  synthetic polynucleotide sequence
accgtgtagatggccgca

SEQ ID NO: 39443 - DNA, 18 bp, Artificial sequence
  synthetic polynucleotide sequence
ggagctggaacgagccaa

SEQ ID NO: 39444 - DNA, 18 bp, Artificial sequence
  synthetic polynucleotide sequence
tggagcgagtggccagca

SEQ ID NO: 39445 - DNA, 23 bp, Artificial sequence
  synthetic polynucleotide sequence
aaaatactgcacttggacggaca

SEQ ID NO: 39446 - DNA, 20 bp, Artificial sequence
  synthetic polynucleotide sequence
gcagggaggcagagctggta

SEQ ID NO: 39447 - DNA, 18 bp, Artificial sequence
  synthetic polynucleotide sequence
cctgcggcaacagttcga

SEQ ID NO: 39448 - DNA, 18 bp, Artificial sequence
  synthetic polynucleotide sequence
acgcttgtggcaccagca

SEQ ID NO: 39449 - DNA, 18 bp, Artificial sequence
  synthetic polynucleotide sequence
gaccttcggaccccagga

SEQ ID NO: 39450 - DNA, 18 bp, Artificial sequence
  synthetic polynucleotide sequence
catcaccgacttccggca

SEQ ID NO: 39451 - DNA, 19 bp, Artificial sequence
  synthetic polynucleotide sequence
ggggagaggagaaacgcca

SEQ ID NO: 39452 - DNA, 22 bp, Artificial sequence
  synthetic polynucleotide sequence
cgaaaccactggatgtcagaca

SEQ ID NO: 39453 - DNA, 21 bp, Artificial sequence
  synthetic polynucleotide sequence
ccccttctacgacgagagcga

SEQ ID NO: 39454 - DNA, 21 bp, Artificial sequence
  synthetic polynucleotide sequence
cagagatccaaaggtgccgca

SEQ ID NO: 39455 - DNA, 21 bp, Artificial sequence
  synthetic polynucleotide sequence
gtcaccagaagtccatcccca

SEQ ID NO: 39456 - DNA, 22 bp, Artificial sequence
  synthetic polynucleotide sequence
tgatccataaccacccagtcca

SEQ ID NO: 39457 - DNA, 19 bp, Artificial sequence
  synthetic polynucleotide sequence
ctacacctggccacacaca

SEQ ID NO: 39458 - DNA, 20 bp, Artificial sequence
  synthetic polynucleotide sequence
atactcatgaccaggccaca

SEQ ID NO: 39459 - DNA, 19 bp, Artificial sequence
  synthetic polynucleotide sequence
ccttcgccacgcctgagga

SEQ ID NO: 39460 - DNA, 20 bp, Artificial sequence
  synthetic polynucleotide sequence
gtcacacagcgctgccagga

SEQ ID NO: 39461 - DNA, 19 bp, Artificial sequence
  synthetic polynucleotide sequence
gaccacccgaccctgtgca

SEQ ID NO: 39462 - DNA, 19 bp, Artificial sequence
  synthetic polynucleotide sequence
tccaaggatgaacgcgaga

SEQ ID NO: 39463 - DNA, 20 bp, Artificial sequence
  synthetic polynucleotide sequence
atctgggaagggactcgaga

SEQ ID NO: 39464 - DNA, 19 bp, Artificial sequence
  synthetic polynucleotide sequence
ggcagcctccacttggaca

SEQ ID NO: 39465 - DNA, 21 bp, Artificial sequence
  synthetic polynucleotide sequence
ggctggagaggcaggaagcaa

SEQ ID NO: 39466 - DNA, 22 bp, Artificial sequence
  synthetic polynucleotide sequence
gcatcagagggatcaagtcgca

SEQ ID NO: 39467 - DNA, 25 bp, Artificial sequence
  synthetic polynucleotide sequence
aaatggaggaaaggaaatgcccgga

SEQ ID NO: 39468 - DNA, 20 bp, Artificial sequence
  synthetic polynucleotide sequence
gcacagggatagcccaggaa

SEQ ID NO: 39469 - DNA, 22 bp, Artificial sequence
  synthetic polynucleotide sequence
atgaggtcctagaggagtggca

SEQ ID NO: 39470 - DNA, 20 bp, Artificial sequence
  synthetic polynucleotide sequence
tagagctctcaacgctccca

SEQ ID NO: 39471 - DNA, 20 bp, Artificial sequence
  synthetic polynucleotide sequence
aggacagcccaggtgaggta

SEQ ID NO: 39472 - DNA, 21 bp, Artificial sequence
  synthetic polynucleotide sequence
atctggttaagagtggcccca

SEQ ID NO: 39473 - DNA, 21 bp, Artificial sequence
  synthetic polynucleotide sequence
aggaggaggaatgggaggcca

SEQ ID NO: 39474 - DNA, 20 bp, Artificial sequence
  synthetic polynucleotide sequence
cagggagaggtactgcccca

SEQ ID NO: 39475 - DNA, 21 bp, Artificial sequence
  synthetic polynucleotide sequence
gagtgggagaacactgaggca

SEQ ID NO: 39476 - DNA, 20 bp, Artificial sequence
  synthetic polynucleotide sequence
gcacggtggcctgaggtgca

SEQ ID NO: 39477 - DNA, 20 bp, Artificial sequence
  synthetic polynucleotide sequence
agaacaggacccgggatgga

SEQ ID NO: 39478 - DNA, 22 bp, Artificial sequence
  synthetic polynucleotide sequence
gaagctgcaaatggccaccaca

SEQ ID NO: 39479 - DNA, 22 bp, Artificial sequence
  synthetic polynucleotide sequence
agctaagtctcgctccaggaga

SEQ ID NO: 39480 - DNA, 21 bp, Artificial sequence
  synthetic polynucleotide sequence
tgatcggctctgagatcgcca

SEQ ID NO: 39481 - DNA, 19 bp, Artificial sequence
  synthetic polynucleotide sequence
ctgcccaggacatggcgga

SEQ ID NO: 39482 - DNA, 18 bp, Artificial sequence
  synthetic polynucleotide sequence
tgttctcccgggcggcca

SEQ ID NO: 39483 - DNA, 18 bp, Artificial sequence
  synthetic polynucleotide sequence
ggaggctgtgagcccaga

SEQ ID NO: 39484 - DNA, 20 bp, Artificial sequence
  synthetic polynucleotide sequence
ctcctcagacactggcacca

SEQ ID NO: 39485 - DNA, 18 bp, Artificial sequence
  synthetic polynucleotide sequence
aggcccatccaagccaga

SEQ ID NO: 39486 - DNA, 20 bp, Artificial sequence
  synthetic polynucleotide sequence
atctgagaatccacgcctca

SEQ ID NO: 39487 - DNA, 22 bp, Artificial sequence
  synthetic polynucleotide sequence
catagagaatgtgacacggaca

SEQ ID NO: 39488 - DNA, 20 bp, Artificial sequence
  synthetic polynucleotide sequence
atctgctagccacagctcga

SEQ ID NO: 39489 - DNA, 21 bp, Artificial sequence
  synthetic polynucleotide sequence
gctgctctctaccagccgaga

SEQ ID NO: 39490 - DNA, 21 bp, Artificial sequence
  synthetic polynucleotide sequence
ccatctcaccagcctcctcca

SEQ ID NO: 39491 - DNA, 21 bp, Artificial sequence
  synthetic polynucleotide sequence
aacgtgagctacaggaaggca

SEQ ID NO: 39492 - DNA, 18 bp, Artificial sequence
  synthetic polynucleotide sequence
cccagcttctgcagcaca

SEQ ID NO: 39493 - DNA, 20 bp, Artificial sequence
  synthetic polynucleotide sequence
catcactgcccaccccacca

SEQ ID NO: 39494 - DNA, 20 bp, Artificial sequence
  synthetic polynucleotide sequence
ccccacagttgaaggcccca

SEQ ID NO: 39495 - DNA, 18 bp, Artificial sequence
  synthetic polynucleotide sequence
ggaggagtgccagcgcca

SEQ ID NO: 39496 - DNA, 19 bp, Artificial sequence
  synthetic polynucleotide sequence
ggtgctcagcaagggggca

SEQ ID NO: 39497 - DNA, 20 bp, Artificial sequence
  synthetic polynucleotide sequence
gctgtgaggctggagggaga

SEQ ID NO: 39498 - DNA, 20 bp, Artificial sequence
  synthetic polynucleotide sequence
atctggaagccatgtcacca

SEQ ID NO: 39499 - DNA, 19 bp, Artificial sequence
  synthetic polynucleotide sequence
ccaacgccaaaaccagaga

SEQ ID NO: 39500 - DNA, 18 bp, Artificial sequence
  synthetic polynucleotide sequence
gaggcctccgtccaccca

SEQ ID NO: 39501 - DNA, 20 bp, Artificial sequence
  synthetic polynucleotide sequence
aatgagagccgccgtgcaga

SEQ ID NO: 39502 - DNA, 21 bp, Artificial sequence
  synthetic polynucleotide sequence
tcctctccgtcagcacagcca

SEQ ID NO: 39503 - DNA, 20 bp, Artificial sequence
  synthetic polynucleotide sequence
aaggaccagcagatcgagga

SEQ ID NO: 39504 - DNA, 18 bp, Artificial sequence
  synthetic polynucleotide sequence
ggggcatgtaaccggaca

SEQ ID NO: 39505 - DNA, 21 bp, Artificial sequence
  synthetic polynucleotide sequence
gaaacagcaagaaaccccaca

SEQ ID NO: 39506 - DNA, 20 bp, Artificial sequence
  synthetic polynucleotide sequence
caaagtagcctggagcagca

SEQ ID NO: 39507 - DNA, 21 bp, Artificial sequence
  synthetic polynucleotide sequence
atcaagaggtgcccaagccaa

SEQ ID NO: 39508 - DNA, 18 bp, Artificial sequence
  synthetic polynucleotide sequence
ggtgggtcatgggcccca

SEQ ID NO: 39509 - DNA, 21 bp, Artificial sequence
  synthetic polynucleotide sequence
aaggatgatcaggagcagcaa

SEQ ID NO: 39510 - DNA, 20 bp, Artificial sequence
  synthetic polynucleotide sequence
atgaagcagtaccgcagtca

SEQ ID NO: 39511 - DNA, 18 bp, Artificial sequence
  synthetic polynucleotide sequence
ccctcccgatggtgacca

SEQ ID NO: 39512 - DNA, 18 bp, Artificial sequence
  synthetic polynucleotide sequence
gaggagtgcctcccgcca

SEQ ID NO: 39513 - DNA, 18 bp, Artificial sequence
  synthetic polynucleotide sequence
tcccaaaccaccaagcca

SEQ ID NO: 39514 - DNA, 21 bp, Artificial sequence
  synthetic polynucleotide sequence
cacagtgcacacaacacgaga

SEQ ID NO: 39515 - DNA, 20 bp, Artificial sequence
  synthetic polynucleotide sequence
tgtgccaagttctcccccga

SEQ ID NO: 39516 - DNA, 20 bp, Artificial sequence
  synthetic polynucleotide sequence
cagcggcaatgcacgtccca

SEQ ID NO: 39517 - DNA, 21 bp, Artificial sequence
  synthetic polynucleotide sequence
aagggtgaagaggcctgtgga

SEQ ID NO: 39518 - DNA, 23 bp, Artificial sequence
  synthetic polynucleotide sequence
ctaaagcatcagtcacagcgaga

SEQ ID NO: 39519 - DNA, 18 bp, Artificial sequence
  synthetic polynucleotide sequence
tcggaggagccagcgcga

SEQ ID NO: 39520 - DNA, 18 bp, Artificial sequence
  synthetic polynucleotide sequence
gctgcagatcctgcacca

SEQ ID NO: 39521 - DNA, 21 bp, Artificial sequence
  synthetic polynucleotide sequence
atcgccgggaatcagctcaca

SEQ ID NO: 39522 - DNA, 19 bp, Artificial sequence
  synthetic polynucleotide sequence
gggcgtggagtcgaaggca

SEQ ID NO: 39523 - DNA, 20 bp, Artificial sequence
  synthetic polynucleotide sequence
tcagctaacccggctgccca

SEQ ID NO: 39524 - DNA, 20 bp, Artificial sequence
  synthetic polynucleotide sequence
cagttggtccaggccggcca

SEQ ID NO: 39525 - DNA, 18 bp, Artificial sequence
  synthetic polynucleotide sequence
gccgagcagtcaaagcca

SEQ ID NO: 39526 - DNA, 20 bp, Artificial sequence
  synthetic polynucleotide sequence
gtacacatccttggcaggga

SEQ ID NO: 39527 - DNA, 21 bp, Artificial sequence
  synthetic polynucleotide sequence
gcatatgcctcccagagagga

SEQ ID NO: 39528 - DNA, 21 bp, Artificial sequence
  synthetic polynucleotide sequence
gggatccattcacagggagca

SEQ ID NO: 39529 - DNA, 18 bp, Artificial sequence
  synthetic polynucleotide sequence
gccagcaaatccaagcca

SEQ ID NO: 39530 - DNA, 20 bp, Artificial sequence
  synthetic polynucleotide sequence
cttacggctcagatcagcaa

SEQ ID NO: 39531 - DNA, 18 bp, Artificial sequence
  synthetic polynucleotide sequence
ccatgctgaaggacggga

SEQ ID NO: 39532 - DNA, 19 bp, Artificial sequence
  synthetic polynucleotide sequence
ccttcaggtcaggcaggca

SEQ ID NO: 39533 - DNA, 20 bp, Artificial sequence
  synthetic polynucleotide sequence
caggagttctggcccggaca

SEQ ID NO: 39534 - DNA, 21 bp, Artificial sequence
  synthetic polynucleotide sequence
gagtcttcaggagagaggcga

SEQ ID NO: 39535 - DNA, 21 bp, Artificial sequence
  synthetic polynucleotide sequence
tggagacggaggacaggagca

SEQ ID NO: 39536 - DNA, 20 bp, Artificial sequence
  synthetic polynucleotide sequence
gttggagtactgggcccgca

SEQ ID NO: 39537 - DNA, 18 bp, Artificial sequence
  synthetic polynucleotide sequence
ccaaaaaccaggcctgga

SEQ ID NO: 39538 - DNA, 21 bp, Artificial sequence
  synthetic polynucleotide sequence
aaacaagtgagccacacagga

SEQ ID NO: 39539 - DNA, 20 bp, Artificial sequence
  synthetic polynucleotide sequence
agacagtgggcacaggggaa

SEQ ID NO: 39540 - DNA, 21 bp, Artificial sequence
  synthetic polynucleotide sequence
ctgccacactcgagttgacca

SEQ ID NO: 39541 - DNA, 20 bp, Artificial sequence
  synthetic polynucleotide sequence
gaagagccaacctgtcgcaa

SEQ ID NO: 39542 - DNA, 20 bp, Artificial sequence
  synthetic polynucleotide sequence
cacagctgggtgtacaggga

SEQ ID NO: 39543 - DNA, 18 bp, Artificial sequence
  synthetic polynucleotide sequence
caaccatgaccggccaga

SEQ ID NO: 39544 - DNA, 19 bp, Artificial sequence
  synthetic polynucleotide sequence
cacaggctcatggtgcaca

SEQ ID NO: 39545 - DNA, 21 bp, Artificial sequence
  synthetic polynucleotide sequence
tcagaatcaaccaaacagcca

SEQ ID NO: 39546 - DNA, 19 bp, Artificial sequence
  synthetic polynucleotide sequence
ggaagctggcaaacaccca

SEQ ID NO: 39547 - DNA, 20 bp, Artificial sequence
  synthetic polynucleotide sequence
gagctggccaaggagacaga

SEQ ID NO: 39548 - DNA, 18 bp, Artificial sequence
  synthetic polynucleotide sequence
agatctccaggcacggca

SEQ ID NO: 39549 - DNA, 18 bp, Artificial sequence
  synthetic polynucleotide sequence
cttcccagagtgcccgca

SEQ ID NO: 39550 - DNA, 21 bp, Artificial sequence
  synthetic polynucleotide sequence
gtggcactgaagtcagggaca

SEQ ID NO: 39551 - DNA, 20 bp, Artificial sequence
  synthetic polynucleotide sequence
aagctgagtcaccatcccca

SEQ ID NO: 39552 - DNA, 20 bp, Artificial sequence
  synthetic polynucleotide sequence
cagaaggaggttcaggctca

SEQ ID NO: 39553 - DNA, 18 bp, Artificial sequence
  synthetic polynucleotide sequence
cgggatcacacggctgca

SEQ ID NO: 39554 - DNA, 18 bp, Artificial sequence
  synthetic polynucleotide sequence
tgccacacctctggggga

SEQ ID NO: 39555 - DNA, 18 bp, Artificial sequence
  synthetic polynucleotide sequence
gggagcggcactggagga

SEQ ID NO: 39556 - DNA, 20 bp, Artificial sequence
  synthetic polynucleotide sequence
gtgcccactggaagcctgca

SEQ ID NO: 39557 - DNA, 21 bp, Artificial sequence
  synthetic polynucleotide sequence
aaggacgatgccatcaccgca

SEQ ID NO: 39558 - DNA, 18 bp, Artificial sequence
  synthetic polynucleotide sequence
ggcaggggggttggagga

SEQ ID NO: 39559 - DNA, 20 bp, Artificial sequence
  synthetic polynucleotide sequence
cagctacctggaaccaggga

SEQ ID NO: 39560 - DNA, 18 bp, Artificial sequence
  synthetic polynucleotide sequence
tgcgcacagtgtccagca

SEQ ID NO: 39561 - DNA, 20 bp, Artificial sequence
  synthetic polynucleotide sequence
gaccaaccaccctgcaccaa

SEQ ID NO: 39562 - DNA, 21 bp, Artificial sequence
  synthetic polynucleotide sequence
gggtgagaacctatcaccgga

SEQ ID NO: 39563 - DNA, 18 bp, Artificial sequence
  synthetic polynucleotide sequence
atgccgtgatcaccagga

SEQ ID NO: 39564 - DNA, 20 bp, Artificial sequence
  synthetic polynucleotide sequence
ctgagagcacatcactggca

SEQ ID NO: 39565 - DNA, 18 bp, Artificial sequence
  synthetic polynucleotide sequence
aaggccttggtgaaggca

SEQ ID NO: 39566 - DNA, 19 bp, Artificial sequence
  synthetic polynucleotide sequence
ctgagcgcaacagtaggca

SEQ ID NO: 39567 - DNA, 21 bp, Artificial sequence
  synthetic polynucleotide sequence
catcagccgtgagcatgccaa

SEQ ID NO: 39568 - DNA, 20 bp, Artificial sequence
  synthetic polynucleotide sequence
ccactcgccctcatccgaca

SEQ ID NO: 39569 - DNA, 18 bp, Artificial sequence
  synthetic polynucleotide sequence
gcagcagcttagccggga

SEQ ID NO: 39570 - DNA, 20 bp, Artificial sequence
  synthetic polynucleotide sequence
tacctgctccctgaacacca

SEQ ID NO: 39571 - DNA, 18 bp, Artificial sequence
  synthetic polynucleotide sequence
cccacaacagccaaagca

SEQ ID NO: 39572 - DNA, 20 bp, Artificial sequence
  synthetic polynucleotide sequence
gccacacttctcacagggca

SEQ ID NO: 39573 - DNA, 21 bp, Artificial sequence
  synthetic polynucleotide sequence
agacctgacccgctacagaga

SEQ ID NO: 39574 - DNA, 21 bp, Artificial sequence
  synthetic polynucleotide sequence
atacatgacccgacacagtca

SEQ ID NO: 39575 - DNA, 21 bp, Artificial sequence
  synthetic polynucleotide sequence
acctgacgagggatggagaga

SEQ ID NO: 39576 - DNA, 21 bp, Artificial sequence
  synthetic polynucleotide sequence
atcctgagcaagctcactgca

SEQ ID NO: 39577 - DNA, 18 bp, Artificial sequence
  synthetic polynucleotide sequence
gagccctggccaaaacca

SEQ ID NO: 39578 - DNA, 18 bp, Artificial sequence
  synthetic polynucleotide sequence
cagtgggagtgggcagca

SEQ ID NO: 39579 - DNA, 20 bp, Artificial sequence
  synthetic polynucleotide sequence
agccccaggcaacagtggga

SEQ ID NO: 39580 - DNA, 20 bp, Artificial sequence
  synthetic polynucleotide sequence
ggtgaccttggggaaggcca

SEQ ID NO: 39581 - DNA, 20 bp, Artificial sequence
  synthetic polynucleotide sequence
attctgggcgatacagagca

SEQ ID NO: 39582 - DNA, 21 bp, Artificial sequence
  synthetic polynucleotide sequence
ccaagcagtactgagagggca

SEQ ID NO: 39583 - DNA, 20 bp, Artificial sequence
  synthetic polynucleotide sequence
ccccgctacagcagatgaca

SEQ ID NO: 39584 - DNA, 19 bp, Artificial sequence
  synthetic polynucleotide sequence
ctgacgaccttcccgacca

SEQ ID NO: 39585 - DNA, 22 bp, Artificial sequence
  synthetic polynucleotide sequence
cccgagacagagtcaccaacca

SEQ ID NO: 39586 - DNA, 19 bp, Artificial sequence
  synthetic polynucleotide sequence
cacacacatgggctaccga

SEQ ID NO: 39587 - DNA, 18 bp, Artificial sequence
  synthetic polynucleotide sequence
gatccccctggggaacca

SEQ ID NO: 39588 - DNA, 18 bp, Artificial sequence
  synthetic polynucleotide sequence
gccaatgcccttgacaca

SEQ ID NO: 39589 - DNA, 20 bp, Artificial sequence
  synthetic polynucleotide sequence
ggcgataaggaaccagcgaa

SEQ ID NO: 39590 - DNA, 18 bp, Artificial sequence
  synthetic polynucleotide sequence
cggaacctcgagcgcgga

SEQ ID NO: 39591 - DNA, 21 bp, Artificial sequence
  synthetic polynucleotide sequence
caccaaccccaggaagaggaa

SEQ ID NO: 39592 - DNA, 23 bp, Artificial sequence
  synthetic polynucleotide sequence
aaaattcccacaaagtgcctgca

SEQ ID NO: 39593 - DNA, 18 bp, Artificial sequence
  synthetic polynucleotide sequence
gcatggagatccccacca

SEQ ID NO: 39594 - DNA, 18 bp, Artificial sequence
  synthetic polynucleotide sequence
ctggcatctgacgcagca

SEQ ID NO: 39595 - DNA, 18 bp, Artificial sequence
  synthetic polynucleotide sequence
atgccagggcatgaggca

SEQ ID NO: 39596 - DNA, 20 bp, Artificial sequence
  synthetic polynucleotide sequence
ctgatacacgaacccctgga

SEQ ID NO: 39597 - DNA, 21 bp, Artificial sequence
  synthetic polynucleotide sequence
gagtgagtactcggagctgga

SEQ ID NO: 39598 - DNA, 22 bp, Artificial sequence
  synthetic polynucleotide sequence
caatggtttcaggacgcagaga

SEQ ID NO: 39599 - DNA, 19 bp, Artificial sequence
  synthetic polynucleotide sequence
gtgcagaggacgaacagga

SEQ ID NO: 39600 - DNA, 22 bp, Artificial sequence
  synthetic polynucleotide sequence
tagcaagctacgaacactggca

SEQ ID NO: 39601 - DNA, 18 bp, Artificial sequence
  synthetic polynucleotide sequence
gacaccctccgccaagca

SEQ ID NO: 39602 - DNA, 18 bp, Artificial sequence
  synthetic polynucleotide sequence
tgacgacgtgctcaggga

SEQ ID NO: 39603 - DNA, 20 bp, Artificial sequence
  synthetic polynucleotide sequence
accagaagcgaatcaccaca

SEQ ID NO: 39604 - DNA, 18 bp, Artificial sequence
  synthetic polynucleotide sequence
acaggggcacacatcgca

SEQ ID NO: 39605 - DNA, 18 bp, Artificial sequence
  synthetic polynucleotide sequence
gtgatccagccaggccga

SEQ ID NO: 39606 - DNA, 21 bp, Artificial sequence
  synthetic polynucleotide sequence
ttgacctgagtgacaacagca

SEQ ID NO: 39607 - DNA, 18 bp, Artificial sequence
  synthetic polynucleotide sequence
gccttccagggctgacca

SEQ ID NO: 39608 - DNA, 20 bp, Artificial sequence
  synthetic polynucleotide sequence
tggagtccacctcgaatcca

SEQ ID NO: 39609 - DNA, 18 bp, Artificial sequence
  synthetic polynucleotide sequence
aaagtgcggccacaagga

SEQ ID NO: 39610 - DNA, 18 bp, Artificial sequence
  synthetic polynucleotide sequence
ggtccagcggtggccgca

SEQ ID NO: 39611 - DNA, 18 bp, Artificial sequence
  synthetic polynucleotide sequence
gcgtccggctggcaggga

SEQ ID NO: 39612 - DNA, 20 bp, Artificial sequence
  synthetic polynucleotide sequence
tcagcacagcccccgcagca

SEQ ID NO: 39613 - DNA, 20 bp, Artificial sequence
  synthetic polynucleotide sequence
aacctccaaagcagcaacca

SEQ ID NO: 39614 - DNA, 18 bp, Artificial sequence
  synthetic polynucleotide sequence
cccagcattcatcgagca

SEQ ID NO: 39615 - DNA, 21 bp, Artificial sequence
  synthetic polynucleotide sequence
agccaaaaacccagtgcccca

SEQ ID NO: 39616 - DNA, 21 bp, Artificial sequence
  synthetic polynucleotide sequence
gtagaagccgagctgctgtga

SEQ ID NO: 39617 - DNA, 18 bp, Artificial sequence
  synthetic polynucleotide sequence
gcattggtgagccaggca

SEQ ID NO: 39618 - DNA, 18 bp, Artificial sequence
  synthetic polynucleotide sequence
cctttcacgaggcgagca

SEQ ID NO: 39619 - DNA, 21 bp, Artificial sequence
  synthetic polynucleotide sequence
acggcagattccactacggca

SEQ ID NO: 39620 - DNA, 21 bp, Artificial sequence
  synthetic polynucleotide sequence
ttctgatagtacacggggcca

SEQ ID NO: 39621 - DNA, 18 bp, Artificial sequence
  synthetic polynucleotide sequence
accatgccccatccagga

SEQ ID NO: 39622 - DNA, 20 bp, Artificial sequence
  synthetic polynucleotide sequence
ctctgcaccagtagcctgca

SEQ ID NO: 39623 - DNA, 21 bp, Artificial sequence
  synthetic polynucleotide sequence
ttggcaagctactcatccgca

SEQ ID NO: 39624 - DNA, 21 bp, Artificial sequence
  synthetic polynucleotide sequence
tcctactgtctccaaggccca

SEQ ID NO: 39625 - DNA, 21 bp, Artificial sequence
  synthetic polynucleotide sequence
gccacacactcttcagcggca

SEQ ID NO: 39626 - DNA, 21 bp, Artificial sequence
  synthetic polynucleotide sequence
ttctgctcatccggggaagca

SEQ ID NO: 39627 - DNA, 25 bp, Artificial sequence
  synthetic polynucleotide sequence
gaagacaaacatccacgaaccagga

SEQ ID NO: 39628 - DNA, 20 bp, Artificial sequence
  synthetic polynucleotide sequence
ggaggctgggaagtccaaga

SEQ ID NO: 39629 - DNA, 22 bp, Artificial sequence
  synthetic polynucleotide sequence
acgcttcgagacttagggagca

SEQ ID NO: 39630 - DNA, 21 bp, Artificial sequence
  synthetic polynucleotide sequence
tgctaaatccaacagcctcaa

SEQ ID NO: 39631 - DNA, 20 bp, Artificial sequence
  synthetic polynucleotide sequence
ctacgaggagccatgaggca

SEQ ID NO: 39632 - DNA, 21 bp, Artificial sequence
  synthetic polynucleotide sequence
acgccgccaatcagggttcca

SEQ ID NO: 39633 - DNA, 21 bp, Artificial sequence
  synthetic polynucleotide sequence
cctctacatggacaccggcga

SEQ ID NO: 39634 - DNA, 19 bp, Artificial sequence
  synthetic polynucleotide sequence
ttggcagctcctcactgga

SEQ ID NO: 39635 - DNA, 21 bp, Artificial sequence
  synthetic polynucleotide sequence
cgtgcacaacatcacccgcaa

SEQ ID NO: 39636 - DNA, 21 bp, Artificial sequence
  synthetic polynucleotide sequence
gggacacgactctgcagtaga

SEQ ID NO: 39637 - DNA, 21 bp, Artificial sequence
  synthetic polynucleotide sequence
gctgagcgactttccccagga

SEQ ID NO: 39638 - DNA, 21 bp, Artificial sequence
  synthetic polynucleotide sequence
ttgaccttggagtccaggcga

SEQ ID NO: 39639 - DNA, 20 bp, Artificial sequence
  synthetic polynucleotide sequence
ccttcccacccctcagaaca

SEQ ID NO: 39640 - DNA, 20 bp, Artificial sequence
  synthetic polynucleotide sequence
aggcccacccagaccctcca

SEQ ID NO: 39641 - DNA, 18 bp, Artificial sequence
  synthetic polynucleotide sequence
acccctgcacccgggaga

SEQ ID NO: 39642 - DNA, 18 bp, Artificial sequence
  synthetic polynucleotide sequence
tgaggctccaggggccga

SEQ ID NO: 39643 - DNA, 21 bp, Artificial sequence
  synthetic polynucleotide sequence
cctctcaaacccctgccagca

SEQ ID NO: 39644 - DNA, 21 bp, Artificial sequence
  synthetic polynucleotide sequence
ctgctgccaaacactgagcca

SEQ ID NO: 39645 - DNA, 18 bp, Artificial sequence
  synthetic polynucleotide sequence
aggccgacctggagcaca

SEQ ID NO: 39646 - DNA, 19 bp, Artificial sequence
  synthetic polynucleotide sequence
gcgtctggctcttctcgga

SEQ ID NO: 39647 - DNA, 21 bp, Artificial sequence
  synthetic polynucleotide sequence
tgccagacacagagggccaca

SEQ ID NO: 39648 - DNA, 21 bp, Artificial sequence
  synthetic polynucleotide sequence
aacaatctccacaggccccga

SEQ ID NO: 39649 - DNA, 21 bp, Artificial sequence
  synthetic polynucleotide sequence
ggagcagggggagaacaccta

SEQ ID NO: 39650 - DNA, 21 bp, Artificial sequence
  synthetic polynucleotide sequence
catctgcaaagggtcccagga

SEQ ID NO: 39651 - DNA, 21 bp, Artificial sequence
  synthetic polynucleotide sequence
cctgccgaagacactgtccca

SEQ ID NO: 39652 - DNA, 21 bp, Artificial sequence
  synthetic polynucleotide sequence
cgtcctctccatagggccaca

SEQ ID NO: 39653 - DNA, 19 bp, Artificial sequence
  synthetic polynucleotide sequence
gacggtaacggggcagaga

SEQ ID NO: 39654 - DNA, 19 bp, Artificial sequence
  synthetic polynucleotide sequence
caaggggatgactaggcaa

SEQ ID NO: 39655 - DNA, 20 bp, Artificial sequence
  synthetic polynucleotide sequence
aggaccagcgctcagatcca

SEQ ID NO: 39656 - DNA, 19 bp, Artificial sequence
  synthetic polynucleotide sequence
tggaaggtgagtgcgggca

SEQ ID NO: 39657 - DNA, 19 bp, Artificial sequence
  synthetic polynucleotide sequence
ggcctcaaacccaaggaca

SEQ ID NO: 39658 - DNA, 20 bp, Artificial sequence
  synthetic polynucleotide sequence
tgagaggaggtagagggcga

SEQ ID NO: 39659 - DNA, 20 bp, Artificial sequence
  synthetic polynucleotide sequence
ctagctgagcaggacccaga

SEQ ID NO: 39660 - DNA, 18 bp, Artificial sequence
  synthetic polynucleotide sequence
tggaccactggctcacga

SEQ ID NO: 39661 - DNA, 20 bp, Artificial sequence
  synthetic polynucleotide sequence
gtgaaccatccagatgccaa

SEQ ID NO: 39662 - DNA, 21 bp, Artificial sequence
  synthetic polynucleotide sequence
taaaagtgctcaggtcccaca

SEQ ID NO: 39663 - DNA, 19 bp, Artificial sequence
  synthetic polynucleotide sequence
gaggttctccgcatccaga

SEQ ID NO: 39664 - DNA, 20 bp, Artificial sequence
  synthetic polynucleotide sequence
tgcctatgagcagcttccca

SEQ ID NO: 39665 - DNA, 20 bp, Artificial sequence
  synthetic polynucleotide sequence
gaggaccctccaggatcaga

SEQ ID NO: 39666 - DNA, 20 bp, Artificial sequence
  synthetic polynucleotide sequence
cccatggtacacagaagcca

SEQ ID NO: 39667 - DNA, 21 bp, Artificial sequence
  synthetic polynucleotide sequence
agttctgaggatagtcgggga

SEQ ID NO: 39668 - DNA, 20 bp, Artificial sequence
  synthetic polynucleotide sequence
tggggcccacagtaatgcca

SEQ ID NO: 39669 - DNA, 20 bp, Artificial sequence
  synthetic polynucleotide sequence
gtccagccttcaggagcaca

SEQ ID NO: 39670 - DNA, 20 bp, Artificial sequence
  synthetic polynucleotide sequence
gaccaccgccttgcgctgca

SEQ ID NO: 39671 - DNA, 19 bp, Artificial sequence
  synthetic polynucleotide sequence
cagaacgcgtgctctgaga

SEQ ID NO: 39672 - DNA, 18 bp, Artificial sequence
  synthetic polynucleotide sequence
attggcagccacctgcaa

SEQ ID NO: 39673 - DNA, 21 bp, Artificial sequence
  synthetic polynucleotide sequence
tctggccactgaacagaccta

SEQ ID NO: 39674 - DNA, 21 bp, Artificial sequence
  synthetic polynucleotide sequence
acctggaacaccccctcctca

SEQ ID NO: 39675 - DNA, 22 bp, Artificial sequence
  synthetic polynucleotide sequence
gatgaacacccagtctgcacaa

SEQ ID NO: 39676 - DNA, 20 bp, Artificial sequence
  synthetic polynucleotide sequence
gcccgaagaatccactgcca

SEQ ID NO: 39677 - DNA, 18 bp, Artificial sequence
  synthetic polynucleotide sequence
agctggcgcagttccaca

SEQ ID NO: 39678 - DNA, 18 bp, Artificial sequence
  synthetic polynucleotide sequence
tccgtgcatccccacaga

SEQ ID NO: 39679 - DNA, 20 bp, Artificial sequence
  synthetic polynucleotide sequence
ggtgaccgcctccttcgcaa

SEQ ID NO: 39680 - DNA, 19 bp, Artificial sequence
  synthetic polynucleotide sequence
tccaccattgaccgaggca

SEQ ID NO: 39681 - DNA, 20 bp, Artificial sequence
  synthetic polynucleotide sequence
cagcaaaccaccttcacgga

SEQ ID NO: 39682 - DNA, 19 bp, Artificial sequence
  synthetic polynucleotide sequence
ttaaggaggcgctgatcca

SEQ ID NO: 39683 - DNA, 21 bp, Artificial sequence
  synthetic polynucleotide sequence
catacctcgcacttcaagcaa

SEQ ID NO: 39684 - DNA, 22 bp, Artificial sequence
  synthetic polynucleotide sequence
caagagctgacaagtcaggtca

SEQ ID NO: 39685 - DNA, 19 bp, Artificial sequence
  synthetic polynucleotide sequence
caacgtgggcgcttgggga

SEQ ID NO: 39686 - DNA, 21 bp, Artificial sequence
  synthetic polynucleotide sequence
ccgtgtccctgagcatgacga

SEQ ID NO: 39687 - DNA, 20 bp, Artificial sequence
  synthetic polynucleotide sequence
catggagccgaggtaccaca

SEQ ID NO: 39688 - DNA, 20 bp, Artificial sequence
  synthetic polynucleotide sequence
ctggggactttaccccacca

SEQ ID NO: 39689 - DNA, 20 bp, Artificial sequence
  synthetic polynucleotide sequence
tgctacagggagagcggcaa

SEQ ID NO: 39690 - DNA, 20 bp, Artificial sequence
  synthetic polynucleotide sequence
gtggtctccagaagcgccca

SEQ ID NO: 39691 - DNA, 20 bp, Artificial sequence
  synthetic polynucleotide sequence
gcaaagtgggcccttgggga

SEQ ID NO: 39692 - DNA, 20 bp, Artificial sequence
  synthetic polynucleotide sequence
ccaccaggcagctctgtgga

SEQ ID NO: 39693 - DNA, 20 bp, Artificial sequence
  synthetic polynucleotide sequence
atgggcaagtggtgccgcca

SEQ ID NO: 39694 - DNA, 20 bp, Artificial sequence
  synthetic polynucleotide sequence
gtggtctccagaagtgccca

SEQ ID NO: 39695 - DNA, 21 bp, Artificial sequence
  synthetic polynucleotide sequence
cccatggacaccttacaccga

SEQ ID NO: 39696 - DNA, 20 bp, Artificial sequence
  synthetic polynucleotide sequence
ggcggagaggcataggtcaa

SEQ ID NO: 39697 - DNA, 21 bp, Artificial sequence
  synthetic polynucleotide sequence
gcacaacacagaccacctcca

SEQ ID NO: 39698 - DNA, 20 bp, Artificial sequence
  synthetic polynucleotide sequence
cagctccttgaagggcagca

SEQ ID NO: 39699 - DNA, 20 bp, Artificial sequence
  synthetic polynucleotide sequence
caccttcaagcaacgccgca

SEQ ID NO: 39700 - DNA, 20 bp, Artificial sequence
  synthetic polynucleotide sequence
ttgagggcctcgaagcggga

SEQ ID NO: 39701 - DNA, 21 bp, Artificial sequence
  synthetic polynucleotide sequence
ccatgccacctgagtcaagga

SEQ ID NO: 39702 - DNA, 20 bp, Artificial sequence
  synthetic polynucleotide sequence
gcacaagctgctggagcgga

SEQ ID NO: 39703 - DNA, 20 bp, Artificial sequence
  synthetic polynucleotide sequence
acacactggcggggagaaga

SEQ ID NO: 39704 - DNA, 21 bp, Artificial sequence
  synthetic polynucleotide sequence
aagggggaagctccaaacaca

SEQ ID NO: 39705 - DNA, 20 bp, Artificial sequence
  synthetic polynucleotide sequence
aagtggttggaggaggcgga

SEQ ID NO: 39706 - DNA, 20 bp, Artificial sequence
  synthetic polynucleotide sequence
cagagcccccttgacgctca

SEQ ID NO: 39707 - DNA, 20 bp, Artificial sequence
  synthetic polynucleotide sequence
ccgacgtcggacgacctgga

SEQ ID NO: 39708 - DNA, 21 bp, Artificial sequence
  synthetic polynucleotide sequence
gcgagaacacgttgccgtaga

SEQ ID NO: 39709 - DNA, 20 bp, Artificial sequence
  synthetic polynucleotide sequence
tgcacagggccgcaagcgca

SEQ ID NO: 39710 - DNA, 20 bp, Artificial sequence
  synthetic polynucleotide sequence
aggagatctcctgcgcggca

SEQ ID NO: 39711 - DNA, 22 bp, Artificial sequence
  synthetic polynucleotide sequence
tgaaaagagagggtcaggggga

SEQ ID NO: 39712 - DNA, 20 bp, Artificial sequence
  synthetic polynucleotide sequence
caaagacccccaccccaaca

SEQ ID NO: 39713 - DNA, 20 bp, Artificial sequence
  synthetic polynucleotide sequence
cgcgctggccaacctcaaga

SEQ ID NO: 39714 - DNA, 20 bp, Artificial sequence
  synthetic polynucleotide sequence
ctcgagccatgcctgcagga

SEQ ID NO: 39715 - DNA, 19 bp, Artificial sequence
  synthetic polynucleotide sequence
gaggccgcctaccgagaga

SEQ ID NO: 39716 - DNA, 21 bp, Artificial sequence
  synthetic polynucleotide sequence
cagatgaaggacgtggctgga

SEQ ID NO: 39717 - DNA, 21 bp, Artificial sequence
  synthetic polynucleotide sequence
ataaccgcagcaagatgggca

SEQ ID NO: 39718 - DNA, 19 bp, Artificial sequence
  synthetic polynucleotide sequence
gagccccagtcccaggtga

SEQ ID NO: 39719 - DNA, 18 bp, Artificial sequence
  synthetic polynucleotide sequence
gacccccaccgtcagcca

SEQ ID NO: 39720 - DNA, 21 bp, Artificial sequence
  synthetic polynucleotide sequence
gtctagcttctcgaaccggca

SEQ ID NO: 39721 - DNA, 20 bp, Artificial sequence
  synthetic polynucleotide sequence
tacagagggccccgcgtaca

SEQ ID NO: 39722 - DNA, 20 bp, Artificial sequence
  synthetic polynucleotide sequence
agccatccaccgctcaagca

SEQ ID NO: 39723 - DNA, 22 bp, Artificial sequence
  synthetic polynucleotide sequence
aagaggagcaggtctatgagca

SEQ ID NO: 39724 - DNA, 19 bp, Artificial sequence
  synthetic polynucleotide sequence
tggaaacccagcgtggcca

SEQ ID NO: 39725 - DNA, 22 bp, Artificial sequence
  synthetic polynucleotide sequence
tcaaacggctgaaacctggcta

SEQ ID NO: 39726 - DNA, 21 bp, Artificial sequence
  synthetic polynucleotide sequence
atggctctggcagcatcagga

SEQ ID NO: 39727 - DNA, 21 bp, Artificial sequence
  synthetic polynucleotide sequence
ccaaggagccaatgaatccca

SEQ ID NO: 39728 - DNA, 21 bp, Artificial sequence
  synthetic polynucleotide sequence
caagtctgagggagggtacca

SEQ ID NO: 39729 - DNA, 18 bp, Artificial sequence
  synthetic polynucleotide sequence
tcccttcaaggacggcga

SEQ ID NO: 39730 - DNA, 18 bp, Artificial sequence
  synthetic polynucleotide sequence
gccctggagacttggcaa

SEQ ID NO: 39731 - DNA, 21 bp, Artificial sequence
  synthetic polynucleotide sequence
ggagctcacggaattcgccaa

SEQ ID NO: 39732 - DNA, 22 bp, Artificial sequence
  synthetic polynucleotide sequence
atcacagaagacagcatggcga

SEQ ID NO: 39733 - DNA, 19 bp, Artificial sequence
  synthetic polynucleotide sequence
gggtggaggctatccagga

SEQ ID NO: 39734 - DNA, 18 bp, Artificial sequence
  synthetic polynucleotide sequence
gttgccgcaggtcagcca

SEQ ID NO: 39735 - DNA, 18 bp, Artificial sequence
  synthetic polynucleotide sequence
aagcaaaggcgagggcga

SEQ ID NO: 39736 - DNA, 18 bp, Artificial sequence
  synthetic polynucleotide sequence
acagcctccacggagcga

SEQ ID NO: 39737 - DNA, 18 bp, Artificial sequence
  synthetic polynucleotide sequence
actgtggtgccaccacca

SEQ ID NO: 39738 - DNA, 20 bp, Artificial sequence
  synthetic polynucleotide sequence
ctcgtgtccaccagtgagga

SEQ ID NO: 39739 - DNA, 20 bp, Artificial sequence
  synthetic polynucleotide sequence
cgaggcctgccatggacgaa

SEQ ID NO: 39740 - DNA, 20 bp, Artificial sequence
  synthetic polynucleotide sequence
ggaccagcggctcatctgca

SEQ ID NO: 39741 - DNA, 19 bp, Artificial sequence
  synthetic polynucleotide sequence
gaaggaagcacccacagca

SEQ ID NO: 39742 - DNA, 22 bp, Artificial sequence
  synthetic polynucleotide sequence
aagattctgaagacaccaccca

SEQ ID NO: 39743 - DNA, 20 bp, Artificial sequence
  synthetic polynucleotide sequence
cctgtaacagtgcgagacca

SEQ ID NO: 39744 - DNA, 18 bp, Artificial sequence
  synthetic polynucleotide sequence
atgcagcggagttcagca

SEQ ID NO: 39745 - DNA, 21 bp, Artificial sequence
  synthetic polynucleotide sequence
cgcagcaggtagaccagctca

SEQ ID NO: 39746 - DNA, 20 bp, Artificial sequence
  synthetic polynucleotide sequence
ctggaagccactgtgctgga

SEQ ID NO: 39747 - DNA, 18 bp, Artificial sequence
  synthetic polynucleotide sequence
ctgggggcccactgcaga

SEQ ID NO: 39748 - DNA, 20 bp, Artificial sequence
  synthetic polynucleotide sequence
ccaaagccttccgagctcga

SEQ ID NO: 39749 - DNA, 18 bp, Artificial sequence
  synthetic polynucleotide sequence
gccattccccacccccca

SEQ ID NO: 39750 - DNA, 20 bp, Artificial sequence
  synthetic polynucleotide sequence
ggactccaacaccgtggcca

SEQ ID NO: 39751 - DNA, 20 bp, Artificial sequence
  synthetic polynucleotide sequence
gtctaccccaatgacctgca

SEQ ID NO: 39752 - DNA, 22 bp, Artificial sequence
  synthetic polynucleotide sequence
cgattgtaccgattgggagcca

SEQ ID NO: 39753 - DNA, 21 bp, Artificial sequence
  synthetic polynucleotide sequence
cactggacgagttcaggcaga

SEQ ID NO: 39754 - DNA, 20 bp, Artificial sequence
  synthetic polynucleotide sequence
tgtgcacctggactgctgca

SEQ ID NO: 39755 - DNA, 21 bp, Artificial sequence
  synthetic polynucleotide sequence
gatcccgacgcagaacacaca

SEQ ID NO: 39756 - DNA, 19 bp, Artificial sequence
  synthetic polynucleotide sequence
ttggctgcatagaggggga

SEQ ID NO: 39757 - DNA, 20 bp, Artificial sequence
  synthetic polynucleotide sequence
tgcccagtgggatgggccaa

SEQ ID NO: 39758 - DNA, 23 bp, Artificial sequence
  synthetic polynucleotide sequence
ataaagcagacatgatggcacca

SEQ ID NO: 39759 - DNA, 20 bp, Artificial sequence
  synthetic polynucleotide sequence
ctcccgcacttccacaggaa

SEQ ID NO: 39760 - DNA, 19 bp, Artificial sequence
  synthetic polynucleotide sequence
ggcagccagtcgttcccca

SEQ ID NO: 39761 - DNA, 18 bp, Artificial sequence
  synthetic polynucleotide sequence
cttgggcacagaccggaa

SEQ ID NO: 39762 - DNA, 18 bp, Artificial sequence
  synthetic polynucleotide sequence
gtccccagggtggacaca

SEQ ID NO: 39763 - DNA, 18 bp, Artificial sequence
  synthetic polynucleotide sequence
cgcccaatctcagaggca

SEQ ID NO: 39764 - DNA, 18 bp, Artificial sequence
  synthetic polynucleotide sequence
gcctcagccccaatcaga

SEQ ID NO: 39765 - DNA, 21 bp, Artificial sequence
  synthetic polynucleotide sequence
agccacgcttcactggggaca

SEQ ID NO: 39766 - DNA, 21 bp, Artificial sequence
  synthetic polynucleotide sequence
tcctgttcagcctccggacca

SEQ ID NO: 39767 - DNA, 21 bp, Artificial sequence
  synthetic polynucleotide sequence
cagccagaggaacctgagtca

SEQ ID NO: 39768 - DNA, 19 bp, Artificial sequence
  synthetic polynucleotide sequence
tcaacacaccgctcaccta

SEQ ID NO: 39769 - DNA, 18 bp, Artificial sequence
  synthetic polynucleotide sequence
gcaagcccttgggccgca

SEQ ID NO: 39770 - DNA, 21 bp, Artificial sequence
  synthetic polynucleotide sequence
tgtgtgaagtcaccaccctga

SEQ ID NO: 39771 - DNA, 18 bp, Artificial sequence
  synthetic polynucleotide sequence
catgatccagggcggaga

SEQ ID NO: 39772 - DNA, 18 bp, Artificial sequence
  synthetic polynucleotide sequence
tcatcggggaagcgctca

SEQ ID NO: 39773 - DNA, 20 bp, Artificial sequence
  synthetic polynucleotide sequence
catgaccgtccactcaccaa

SEQ ID NO: 39774 - DNA, 21 bp, Artificial sequence
  synthetic polynucleotide sequence
caatcagcgatctcaaccaca

SEQ ID NO: 39775 - DNA, 21 bp, Artificial sequence
  synthetic polynucleotide sequence
cacgactgggaaacctctcca

SEQ ID NO: 39776 - DNA, 21 bp, Artificial sequence
  synthetic polynucleotide sequence
atgctcagtaaaccctcccga

SEQ ID NO: 39777 - DNA, 18 bp, Artificial sequence
  synthetic polynucleotide sequence
cggctggccgcatccaga

SEQ ID NO: 39778 - DNA, 19 bp, Artificial sequence
  synthetic polynucleotide sequence
ggacttgcccccagtgcca

SEQ ID NO: 39779 - DNA, 19 bp, Artificial sequence
  synthetic polynucleotide sequence
caccaaccacaatggcaca

SEQ ID NO: 39780 - DNA, 18 bp, Artificial sequence
  synthetic polynucleotide sequence
acaggacacctggcccca

SEQ ID NO: 39781 - DNA, 20 bp, Artificial sequence
  synthetic polynucleotide sequence
atggccaacagagggaagga

SEQ ID NO: 39782 - DNA, 19 bp, Artificial sequence
  synthetic polynucleotide sequence
tgggaatcagctctccaca

SEQ ID NO: 39783 - DNA, 22 bp, Artificial sequence
  synthetic polynucleotide sequence
ttgaaattcacgggggctggaa

SEQ ID NO: 39784 - DNA, 19 bp, Artificial sequence
  synthetic polynucleotide sequence
gccctgacacactcggcca

SEQ ID NO: 39785 - DNA, 20 bp, Artificial sequence
  synthetic polynucleotide sequence
aaggtagccccggagaccaa

SEQ ID NO: 39786 - DNA, 21 bp, Artificial sequence
  synthetic polynucleotide sequence
ttggacatggggacagtggca

SEQ ID NO: 39787 - DNA, 20 bp, Artificial sequence
  synthetic polynucleotide sequence
cccaacttccgctggcccaa

SEQ ID NO: 39788 - DNA, 25 bp, Artificial sequence
  synthetic polynucleotide sequence
aaatgcaatcgcagatgccagcaga

SEQ ID NO: 39789 - DNA, 20 bp, Artificial sequence
  synthetic polynucleotide sequence
ctggagaccactttaggcga

SEQ ID NO: 39790 - DNA, 20 bp, Artificial sequence
  synthetic polynucleotide sequence
cacggccagtccctgtagga

SEQ ID NO: 39791 - DNA, 21 bp, Artificial sequence
  synthetic polynucleotide sequence
gcgccgctgagaatctgaaga

SEQ ID NO: 39792 - DNA, 21 bp, Artificial sequence
  synthetic polynucleotide sequence
gcagatccaatgcatcaccca

SEQ ID NO: 39793 - DNA, 20 bp, Artificial sequence
  synthetic polynucleotide sequence
gccaggcctcagataaccca

SEQ ID NO: 39794 - DNA, 21 bp, Artificial sequence
  synthetic polynucleotide sequence
ggaagaaggaccagcactgga

SEQ ID NO: 39795 - DNA, 22 bp, Artificial sequence
  synthetic polynucleotide sequence
tcgaagacgcagatcaggggaa

SEQ ID NO: 39796 - DNA, 20 bp, Artificial sequence
  synthetic polynucleotide sequence
aacaggcccgcacagtgaga

SEQ ID NO: 39797 - DNA, 18 bp, Artificial sequence
  synthetic polynucleotide sequence
atgggccttggaggagga

SEQ ID NO: 39798 - DNA, 18 bp, Artificial sequence
  synthetic polynucleotide sequence
ccacaagctccaggcgga

SEQ ID NO: 39799 - DNA, 22 bp, Artificial sequence
  synthetic polynucleotide sequence
aagcagtgaagaaggaggcaga

SEQ ID NO: 39800 - DNA, 20 bp, Artificial sequence
  synthetic polynucleotide sequence
cacatggactaagtcgggga

SEQ ID NO: 39801 - DNA, 20 bp, Artificial sequence
  synthetic polynucleotide sequence
tggtggaagctctcaggcaa

SEQ ID NO: 39802 - DNA, 21 bp, Artificial sequence
  synthetic polynucleotide sequence
ttcgaagaagtagctgtggca

SEQ ID NO: 39803 - DNA, 21 bp, Artificial sequence
  synthetic polynucleotide sequence
agtcaagtcactggaggagga

SEQ ID NO: 39804 - DNA, 18 bp, Artificial sequence
  synthetic polynucleotide sequence
ttgctacgaaccagggca

SEQ ID NO: 39805 - DNA, 18 bp, Artificial sequence
  synthetic polynucleotide sequence
gcagcatggttgcccaca

SEQ ID NO: 39806 - DNA, 18 bp, Artificial sequence
  synthetic polynucleotide sequence
gcactggtgctgaggcca

SEQ ID NO: 39807 - DNA, 21 bp, Artificial sequence
  synthetic polynucleotide sequence
tctcacatggactgctggaga

SEQ ID NO: 39808 - DNA, 20 bp, Artificial sequence
  synthetic polynucleotide sequence
cctggtggggtacgacgtca

SEQ ID NO: 39809 - DNA, 20 bp, Artificial sequence
  synthetic polynucleotide sequence
gtggccctgatacgagggaa

SEQ ID NO: 39810 - DNA, 18 bp, Artificial sequence
  synthetic polynucleotide sequence
ccccaatggctctggaga

SEQ ID NO: 39811 - DNA, 20 bp, Artificial sequence
  synthetic polynucleotide sequence
cctgagaacacgcccgccaa

SEQ ID NO: 39812 - DNA, 22 bp, Artificial sequence
  synthetic polynucleotide sequence
catacagcttccccaaaaggca

SEQ ID NO: 39813 - DNA, 22 bp, Artificial sequence
  synthetic polynucleotide sequence
aggatgttgtaccgggaccaga

SEQ ID NO: 39814 - DNA, 22 bp, Artificial sequence
  synthetic polynucleotide sequence
tcatacactcgtacctcaggga

SEQ ID NO: 39815 - DNA, 21 bp, Artificial sequence
  synthetic polynucleotide sequence
ctggtcctcaccacagatgga

SEQ ID NO: 39816 - DNA, 20 bp, Artificial sequence
  synthetic polynucleotide sequence
tccccaggcaccaaaaggca

SEQ ID NO: 39817 - DNA, 18 bp, Artificial sequence
  synthetic polynucleotide sequence
acaagacgcacccgtcca

SEQ ID NO: 39818 - DNA, 18 bp, Artificial sequence
  synthetic polynucleotide sequence
agggcctctgggagtcga

SEQ ID NO: 39819 - DNA, 21 bp, Artificial sequence
  synthetic polynucleotide sequence
caaagctggcccagatgctga

SEQ ID NO: 39820 - DNA, 20 bp, Artificial sequence
  synthetic polynucleotide sequence
ggccctgactgtgcaaggga

SEQ ID NO: 39821 - DNA, 21 bp, Artificial sequence
  synthetic polynucleotide sequence
cctgggctgcagaatcgctga

SEQ ID NO: 39822 - DNA, 18 bp, Artificial sequence
  synthetic polynucleotide sequence
cagtccagccctccccca

SEQ ID NO: 39823 - DNA, 20 bp, Artificial sequence
  synthetic polynucleotide sequence
ggccctggaagaaagcggga

SEQ ID NO: 39824 - DNA, 22 bp, Artificial sequence
  synthetic polynucleotide sequence
aataatcgctgccgtgaacaca

SEQ ID NO: 39825 - DNA, 20 bp, Artificial sequence
  synthetic polynucleotide sequence
ctgcagtaccaaggagccca

SEQ ID NO: 39826 - DNA, 18 bp, Artificial sequence
  synthetic polynucleotide sequence
accaggaacctcccagca

SEQ ID NO: 39827 - DNA, 20 bp, Artificial sequence
  synthetic polynucleotide sequence
gagtgtggacgagaccctca

SEQ ID NO: 39828 - DNA, 18 bp, Artificial sequence
  synthetic polynucleotide sequence
cctccagggttcaggcca

SEQ ID NO: 39829 - DNA, 21 bp, Artificial sequence
  synthetic polynucleotide sequence
tacgaggatgtcgtccaggaa

SEQ ID NO: 39830 - DNA, 21 bp, Artificial sequence
  synthetic polynucleotide sequence
gcttctggtgggaaacctcca

SEQ ID NO: 39831 - DNA, 20 bp, Artificial sequence
  synthetic polynucleotide sequence
agcagccatcgtggatgaga

SEQ ID NO: 39832 - DNA, 20 bp, Artificial sequence
  synthetic polynucleotide sequence
tttcaccccagcctaagaca

SEQ ID NO: 39833 - DNA, 20 bp, Artificial sequence
  synthetic polynucleotide sequence
gtggacatcgcccccacgaa

SEQ ID NO: 39834 - DNA, 19 bp, Artificial sequence
  synthetic polynucleotide sequence
gcctcggtgaccagggaca

SEQ ID NO: 39835 - DNA, 20 bp, Artificial sequence
  synthetic polynucleotide sequence
cgtgacaaccgagcccgaga

SEQ ID NO: 39836 - DNA, 18 bp, Artificial sequence
  synthetic polynucleotide sequence
tggatgagcggcggccca

SEQ ID NO: 39837 - DNA, 20 bp, Artificial sequence
  synthetic polynucleotide sequence
ctcagcaggcacacaaagca

SEQ ID NO: 39838 - DNA, 19 bp, Artificial sequence
  synthetic polynucleotide sequence
tgtggaggagacagtgcca

SEQ ID NO: 39839 - DNA, 19 bp, Artificial sequence
  synthetic polynucleotide sequence
gggagaggcgagccttgga

SEQ ID NO: 39840 - DNA, 21 bp, Artificial sequence
  synthetic polynucleotide sequence
atgactctgatgagggcacca

SEQ ID NO: 39841 - DNA, 19 bp, Artificial sequence
  synthetic polynucleotide sequence
gcagcgggacctcaaccca

SEQ ID NO: 39842 - DNA, 18 bp, Artificial sequence
  synthetic polynucleotide sequence
tcggtcagggcctcgcga

SEQ ID NO: 39843 - DNA, 21 bp, Artificial sequence
  synthetic polynucleotide sequence
gcaagcccaacgacgaaggga

SEQ ID NO: 39844 - DNA, 19 bp, Artificial sequence
  synthetic polynucleotide sequence
gcggcaccactctccacca

SEQ ID NO: 39845 - DNA, 21 bp, Artificial sequence
  synthetic polynucleotide sequence
acctggcagacgtcgagcaga

SEQ ID NO: 39846 - DNA, 20 bp, Artificial sequence
  synthetic polynucleotide sequence
cccgaagtagttccgcggca

SEQ ID NO: 39847 - DNA, 18 bp, Artificial sequence
  synthetic polynucleotide sequence
gatcgacgggcgcctgga

SEQ ID NO: 39848 - DNA, 18 bp, Artificial sequence
  synthetic polynucleotide sequence
aggggcttggctggcgga

SEQ ID NO: 39849 - DNA, 21 bp, Artificial sequence
  synthetic polynucleotide sequence
acgtggatgagctcctggaca

SEQ ID NO: 39850 - DNA, 21 bp, Artificial sequence
  synthetic polynucleotide sequence
gatcttgtccagcaggccaga

SEQ ID NO: 39851 - DNA, 20 bp, Artificial sequence
  synthetic polynucleotide sequence
gcggcgacaccagcagggaa

SEQ ID NO: 39852 - DNA, 20 bp, Artificial sequence
  synthetic polynucleotide sequence
gcagccgtagagctgaccca

SEQ ID NO: 39853 - DNA, 21 bp, Artificial sequence
  synthetic polynucleotide sequence
aagatacccaggtcccggaga

SEQ ID NO: 39854 - DNA, 22 bp, Artificial sequence
  synthetic polynucleotide sequence
ttgatcctggaagagctcctga

SEQ ID NO: 39855 - DNA, 20 bp, Artificial sequence
  synthetic polynucleotide sequence
atcagccaggagaggacaca

SEQ ID NO: 39856 - DNA, 18 bp, Artificial sequence
  synthetic polynucleotide sequence
gcagggggtgtggaagca

SEQ ID NO: 39857 - DNA, 20 bp, Artificial sequence
  synthetic polynucleotide sequence
cgacgcctcttggcccggaa

SEQ ID NO: 39858 - DNA, 20 bp, Artificial sequence
  synthetic polynucleotide sequence
agcggcgcaaggagctggga

SEQ ID NO: 39859 - DNA, 19 bp, Artificial sequence
  synthetic polynucleotide sequence
cggtggaggctcccgtgga

SEQ ID NO: 39860 - DNA, 19 bp, Artificial sequence
  synthetic polynucleotide sequence
cacccgcagcaccagggca

SEQ ID NO: 39861 - DNA, 21 bp, Artificial sequence
  synthetic polynucleotide sequence
aacttcaccgtacagcagcaa

SEQ ID NO: 39862 - DNA, 19 bp, Artificial sequence
  synthetic polynucleotide sequence
ggagatacggcaacagcca

SEQ ID NO: 39863 - DNA, 20 bp, Artificial sequence
  synthetic polynucleotide sequence
ggagtcaacccagcccacca

SEQ ID NO: 39864 - DNA, 20 bp, Artificial sequence
  synthetic polynucleotide sequence
gcttcccagacagaccagca

SEQ ID NO: 39865 - DNA, 20 bp, Artificial sequence
  synthetic polynucleotide sequence
ctacctccgtctcagccgca

SEQ ID NO: 39866 - DNA, 20 bp, Artificial sequence
  synthetic polynucleotide sequence
cccagctcctccagtaccga

SEQ ID NO: 39867 - DNA, 22 bp, Artificial sequence
  synthetic polynucleotide sequence
gcaacagcagcaaggagaggaa

SEQ ID NO: 39868 - DNA, 19 bp, Artificial sequence
  synthetic polynucleotide sequence
gctgtcccagaggtgccca

SEQ ID NO: 39869 - DNA, 21 bp, Artificial sequence
  synthetic polynucleotide sequence
cctacacaccaccttcgctga

SEQ ID NO: 39870 - DNA, 18 bp, Artificial sequence
  synthetic polynucleotide sequence
gctcccgaagctccccca

SEQ ID NO: 39871 - DNA, 18 bp, Artificial sequence
  synthetic polynucleotide sequence
agaggagcagcgggacca

SEQ ID NO: 39872 - DNA, 19 bp, Artificial sequence
  synthetic polynucleotide sequence
ggggtgcagagatggagga

SEQ ID NO: 39873 - DNA, 21 bp, Artificial sequence
  synthetic polynucleotide sequence
tgtcgacgaggagctgagcaa

SEQ ID NO: 39874 - DNA, 21 bp, Artificial sequence
  synthetic polynucleotide sequence
gcctcggtgtcactacaggca

SEQ ID NO: 39875 - DNA, 20 bp, Artificial sequence
  synthetic polynucleotide sequence
ctggccaggatgaagccaca

SEQ ID NO: 39876 - DNA, 21 bp, Artificial sequence
  synthetic polynucleotide sequence
acttactgtcagccagctgca

SEQ ID NO: 39877 - DNA, 20 bp, Artificial sequence
  synthetic polynucleotide sequence
cgtcgggagcgagagagaca

SEQ ID NO: 39878 - DNA, 19 bp, Artificial sequence
  synthetic polynucleotide sequence
gcctccctgaaggccgaga

SEQ ID NO: 39879 - DNA, 20 bp, Artificial sequence
  synthetic polynucleotide sequence
ctggtcaaatacggggctga

SEQ ID NO: 39880 - DNA, 18 bp, Artificial sequence
  synthetic polynucleotide sequence
cctgtccgctcccaggga

SEQ ID NO: 39881 - DNA, 22 bp, Artificial sequence
  synthetic polynucleotide sequence
gatacctgaccacctacaacca

SEQ ID NO: 39882 - DNA, 20 bp, Artificial sequence
  synthetic polynucleotide sequence
ggtggcctccatgcagctga

SEQ ID NO: 39883 - DNA, 20 bp, Artificial sequence
  synthetic polynucleotide sequence
gcctgggccagacatgacca

SEQ ID NO: 39884 - DNA, 21 bp, Artificial sequence
  synthetic polynucleotide sequence
cagtgtccggtgcatgaggaa

SEQ ID NO: 39885 - DNA, 21 bp, Artificial sequence
  synthetic polynucleotide sequence
ccgtgccggataagcatcaca

SEQ ID NO: 39886 - DNA, 21 bp, Artificial sequence
  synthetic polynucleotide sequence
gtcggaagacaatccaagcca

SEQ ID NO: 39887 - DNA, 20 bp, Artificial sequence
  synthetic polynucleotide sequence
aggctgcgccctgagaggca

SEQ ID NO: 39888 - DNA, 20 bp, Artificial sequence
  synthetic polynucleotide sequence
caccgacaggagtagcccca

SEQ ID NO: 39889 - DNA, 22 bp, Artificial sequence
  synthetic polynucleotide sequence
gaaatcgacttcaggccgacca

SEQ ID NO: 39890 - DNA, 21 bp, Artificial sequence
  synthetic polynucleotide sequence
tcttccaggtgtcgaacgtca

SEQ ID NO: 39891 - DNA, 20 bp, Artificial sequence
  synthetic polynucleotide sequence
agagcgaacagtgacaggga

SEQ ID NO: 39892 - DNA, 21 bp, Artificial sequence
  synthetic polynucleotide sequence
ggaatgacagggggtaagtca

SEQ ID NO: 39893 - DNA, 18 bp, Artificial sequence
  synthetic polynucleotide sequence
tttcccgccgcccgtcga

SEQ ID NO: 39894 - DNA, 21 bp, Artificial sequence
  synthetic polynucleotide sequence
agcaggaagggcggtactgga

SEQ ID NO: 39895 - DNA, 20 bp, Artificial sequence
  synthetic polynucleotide sequence
gtacttggcccgcaacccaa

SEQ ID NO: 39896 - DNA, 21 bp, Artificial sequence
  synthetic polynucleotide sequence
ttatgtccagaagggagggca

SEQ ID NO: 39897 - DNA, 21 bp, Artificial sequence
  synthetic polynucleotide sequence
aagcccagatagaggtcacca

SEQ ID NO: 39898 - DNA, 20 bp, Artificial sequence
  synthetic polynucleotide sequence
gagacagacttcggccccca

SEQ ID NO: 39899 - DNA, 20 bp, Artificial sequence
  synthetic polynucleotide sequence
ccagaggaaggtgccacgga

SEQ ID NO: 39900 - DNA, 19 bp, Artificial sequence
  synthetic polynucleotide sequence
ggcctggcccagccccgaa

SEQ ID NO: 39901 - DNA, 18 bp, Artificial sequence
  synthetic polynucleotide sequence
cgccgatgaaaccgacca

SEQ ID NO: 39902 - DNA, 19 bp, Artificial sequence
  synthetic polynucleotide sequence
tccaaggtcagtcgaacca

SEQ ID NO: 39903 - DNA, 21 bp, Artificial sequence
  synthetic polynucleotide sequence
tcaccaacctgacagtcctca

SEQ ID NO: 39904 - DNA, 20 bp, Artificial sequence
  synthetic polynucleotide sequence
caggccctcgatgacctcga

SEQ ID NO: 39905 - DNA, 18 bp, Artificial sequence
  synthetic polynucleotide sequence
agcaggctcccagccaca

SEQ ID NO: 39906 - DNA, 21 bp, Artificial sequence
  synthetic polynucleotide sequence
acaacaggagtcaagtccaca

SEQ ID NO: 39907 - DNA, 20 bp, Artificial sequence
  synthetic polynucleotide sequence
ctcagcggcttaggagcaga

SEQ ID NO: 39908 - DNA, 20 bp, Artificial sequence
  synthetic polynucleotide sequence
gaaacctgctgcacactcca

SEQ ID NO: 39909 - DNA, 18 bp, Artificial sequence
  synthetic polynucleotide sequence
atgaggagctgagcccca

SEQ ID NO: 39910 - DNA, 18 bp, Artificial sequence
  synthetic polynucleotide sequence
tccacaggggacagtgca

SEQ ID NO: 39911 - DNA, 22 bp, Artificial sequence
  synthetic polynucleotide sequence
ataactggtgccatgaccggaa

SEQ ID NO: 39912 - DNA, 21 bp, Artificial sequence
  synthetic polynucleotide sequence
aagtagtctggggtacgacga

SEQ ID NO: 39913 - DNA, 18 bp, Artificial sequence
  synthetic polynucleotide sequence
ttccacatgagggcccaa

SEQ ID NO: 39914 - DNA, 18 bp, Artificial sequence
  synthetic polynucleotide sequence
agcagcctggttcccaca

SEQ ID NO: 39915 - DNA, 18 bp, Artificial sequence
  synthetic polynucleotide sequence
tatgccatccgcgaggca

SEQ ID NO: 39916 - DNA, 20 bp, Artificial sequence
  synthetic polynucleotide sequence
ctgcccacagacctcagaca

SEQ ID NO: 39917 - DNA, 21 bp, Artificial sequence
  synthetic polynucleotide sequence
cctgagacagatctcccagga

SEQ ID NO: 39918 - DNA, 19 bp, Artificial sequence
  synthetic polynucleotide sequence
gcagcagcacgtcgtacca

SEQ ID NO: 39919 - DNA, 22 bp, Artificial sequence
  synthetic polynucleotide sequence
aaccctagaagcatcgcgggaa

SEQ ID NO: 39920 - DNA, 21 bp, Artificial sequence
  synthetic polynucleotide sequence
ggtgccaggctgtgtgaagga

SEQ ID NO: 39921 - DNA, 18 bp, Artificial sequence
  synthetic polynucleotide sequence
agccgagttccaccccca

SEQ ID NO: 39922 - DNA, 18 bp, Artificial sequence
  synthetic polynucleotide sequence
tgcctgtcacacagggca

SEQ ID NO: 39923 - DNA, 18 bp, Artificial sequence
  synthetic polynucleotide sequence
cgggctgtgctcaagcca

SEQ ID NO: 39924 - DNA, 18 bp, Artificial sequence
  synthetic polynucleotide sequence
gccaggccgtgtgcagga

SEQ ID NO: 39925 - DNA, 19 bp, Artificial sequence
  synthetic polynucleotide sequence
gagagcaggccggtggaga

SEQ ID NO: 39926 - DNA, 21 bp, Artificial sequence
  synthetic polynucleotide sequence
gctatccgaaccgttccagca

SEQ ID NO: 39927 - DNA, 21 bp, Artificial sequence
  synthetic polynucleotide sequence
gcagggggagagaagacagga

SEQ ID NO: 39928 - DNA, 21 bp, Artificial sequence
  synthetic polynucleotide sequence
tggtgatgtagcgggagtgga

SEQ ID NO: 39929 - DNA, 20 bp, Artificial sequence
  synthetic polynucleotide sequence
caggacctgaagcgctgcaa

SEQ ID NO: 39930 - DNA, 20 bp, Artificial sequence
  synthetic polynucleotide sequence
tcaccgtccctgagcaggga

SEQ ID NO: 39931 - DNA, 21 bp, Artificial sequence
  synthetic polynucleotide sequence
cgacgcccaacacctgtccaa

SEQ ID NO: 39932 - DNA, 22 bp, Artificial sequence
  synthetic polynucleotide sequence
ttcatcttcagcaggcagccta

SEQ ID NO: 39933 - DNA, 19 bp, Artificial sequence
  synthetic polynucleotide sequence
tcaggttgcagaaagggca

SEQ ID NO: 39934 - DNA, 22 bp, Artificial sequence
  synthetic polynucleotide sequence
taccagtgctacaatggtcgga

SEQ ID NO: 39935 - DNA, 20 bp, Artificial sequence
  synthetic polynucleotide sequence
agccctccgtggccaagaga

SEQ ID NO: 39936 - DNA, 20 bp, Artificial sequence
  synthetic polynucleotide sequence
gccatagacccggtgcagga

SEQ ID NO: 39937 - DNA, 21 bp, Artificial sequence
  synthetic polynucleotide sequence
tggccaaagactcacagtcca

SEQ ID NO: 39938 - DNA, 18 bp, Artificial sequence
  synthetic polynucleotide sequence
gccggaagaggggttcca

SEQ ID NO: 39939 - DNA, 19 bp, Artificial sequence
  synthetic polynucleotide sequence
gttccgagcccctccacca

SEQ ID NO: 39940 - DNA, 20 bp, Artificial sequence
  synthetic polynucleotide sequence
ctccgacttcctccgcagca

SEQ ID NO: 39941 - DNA, 19 bp, Artificial sequence
  synthetic polynucleotide sequence
tcaggtggcagaaagagca

SEQ ID NO: 39942 - DNA, 21 bp, Artificial sequence
  synthetic polynucleotide sequence
accaacgccacaatagccgga

SEQ ID NO: 39943 - DNA, 18 bp, Artificial sequence
  synthetic polynucleotide sequence
ggcatgctccccagcgga

SEQ ID NO: 39944 - DNA, 19 bp, Artificial sequence
  synthetic polynucleotide sequence
gcatctctgcgaggcggca

SEQ ID NO: 39945 - DNA, 21 bp, Artificial sequence
  synthetic polynucleotide sequence
cttctgagaggcaaccatgaa

SEQ ID NO: 39946 - DNA, 20 bp, Artificial sequence
  synthetic polynucleotide sequence
taaaagtgcagcaagaggca

SEQ ID NO: 39947 - DNA, 21 bp, Artificial sequence
  synthetic polynucleotide sequence
tacaggaagagccaagccaca

SEQ ID NO: 39948 - DNA, 21 bp, Artificial sequence
  synthetic polynucleotide sequence
ggaagccagtaggggtgtgga

SEQ ID NO: 39949 - DNA, 23 bp, Artificial sequence
  synthetic polynucleotide sequence
agagtacaaaagtgccaagcaga

SEQ ID NO: 39950 - DNA, 22 bp, Artificial sequence
  synthetic polynucleotide sequence
ctcaaaggagaaagcacaggaa

SEQ ID NO: 39951 - DNA, 18 bp, Artificial sequence
  synthetic polynucleotide sequence
tgccggagctgcgccaca

SEQ ID NO: 39952 - DNA, 18 bp, Artificial sequence
  synthetic polynucleotide sequence
actgggaggtccccagga

SEQ ID NO: 39953 - DNA, 18 bp, Artificial sequence
  synthetic polynucleotide sequence
gagtcgccagatcacgca

SEQ ID NO: 39954 - DNA, 21 bp, Artificial sequence
  synthetic polynucleotide sequence
cagaccagaggaggtcacaca

SEQ ID NO: 39955 - DNA, 21 bp, Artificial sequence
  synthetic polynucleotide sequence
gtgtggccttgacactcggaa

SEQ ID NO: 39956 - DNA, 21 bp, Artificial sequence
  synthetic polynucleotide sequence
ctgcaagctcgtggatggaga

SEQ ID NO: 39957 - DNA, 20 bp, Artificial sequence
  synthetic polynucleotide sequence
gcctgagagcacagacagca

SEQ ID NO: 39958 - DNA, 21 bp, Artificial sequence
  synthetic polynucleotide sequence
tcatgcccctcagcttccaca

SEQ ID NO: 39959 - DNA, 22 bp, Artificial sequence
  synthetic polynucleotide sequence
aggtgtacacgctcaacgagga

SEQ ID NO: 39960 - DNA, 20 bp, Artificial sequence
  synthetic polynucleotide sequence
cgtcgctctcagccctgaca

SEQ ID NO: 39961 - DNA, 19 bp, Artificial sequence
  synthetic polynucleotide sequence
gatacgcggcggcgagtga

SEQ ID NO: 39962 - DNA, 18 bp, Artificial sequence
  synthetic polynucleotide sequence
ccgtcggactctgcccga

SEQ ID NO: 39963 - DNA, 21 bp, Artificial sequence
  synthetic polynucleotide sequence
cggagcctcaagacaccggaa

SEQ ID NO: 39964 - DNA, 20 bp, Artificial sequence
  synthetic polynucleotide sequence
tccgaagcgtctcagtggga

SEQ ID NO: 39965 - DNA, 20 bp, Artificial sequence
  synthetic polynucleotide sequence
gctacgaggtggctcacgga

SEQ ID NO: 39966 - DNA, 21 bp, Artificial sequence
  synthetic polynucleotide sequence
gcttgacgttgggatgaggca

SEQ ID NO: 39967 - DNA, 25 bp, Artificial sequence
  synthetic polynucleotide sequence
ctccagaaacgtgccctaaacacaa

SEQ ID NO: 39968 - DNA, 20 bp, Artificial sequence
  synthetic polynucleotide sequence
aggggcttctgggaggacga

SEQ ID NO: 39969 - DNA, 20 bp, Artificial sequence
  synthetic polynucleotide sequence
accatcgaacggaatcagga

SEQ ID NO: 39970 - DNA, 18 bp, Artificial sequence
  synthetic polynucleotide sequence
tcggggactgatagccca

SEQ ID NO: 39971 - DNA, 19 bp, Artificial sequence
  synthetic polynucleotide sequence
caggccaccttccacggga

SEQ ID NO: 39972 - DNA, 20 bp, Artificial sequence
  synthetic polynucleotide sequence
gggtatcggaggaggcgtga

SEQ ID NO: 39973 - DNA, 18 bp, Artificial sequence
  synthetic polynucleotide sequence
gtgactcagaaggcgcca

SEQ ID NO: 39974 - DNA, 18 bp, Artificial sequence
  synthetic polynucleotide sequence
cccacacactggaaccca

SEQ ID NO: 39975 - DNA, 20 bp, Artificial sequence
  synthetic polynucleotide sequence
agcagtgccaacacggagga

SEQ ID NO: 39976 - DNA, 21 bp, Artificial sequence
  synthetic polynucleotide sequence
cccacagaatccaatggagca

SEQ ID NO: 39977 - DNA, 19 bp, Artificial sequence
  synthetic polynucleotide sequence
ggcagagcactgtccccaa

SEQ ID NO: 39978 - DNA, 20 bp, Artificial sequence
  synthetic polynucleotide sequence
ctgctccagcagactggaca

SEQ ID NO: 39979 - DNA, 20 bp, Artificial sequence
  synthetic polynucleotide sequence
gtgcaagccgaatactggca

SEQ ID NO: 39980 - DNA, 21 bp, Artificial sequence
  synthetic polynucleotide sequence
actccgaatctacagggtcca

SEQ ID NO: 39981 - DNA, 18 bp, Artificial sequence
  synthetic polynucleotide sequence
gaccatcccaatgccaca

SEQ ID NO: 39982 - DNA, 20 bp, Artificial sequence
  synthetic polynucleotide sequence
gagataccggccattggaca

SEQ ID NO: 39983 - DNA, 21 bp, Artificial sequence
  synthetic polynucleotide sequence
atcctgacggcaacagatgga

SEQ ID NO: 39984 - DNA, 19 bp, Artificial sequence
  synthetic polynucleotide sequence
tgggtcataggccagctca

SEQ ID NO: 39985 - DNA, 21 bp, Artificial sequence
  synthetic polynucleotide sequence
ggccgaggagataaccagcca

SEQ ID NO: 39986 - DNA, 21 bp, Artificial sequence
  synthetic polynucleotide sequence
ttcatgaggaggcccagtcca

SEQ ID NO: 39987 - DNA, 20 bp, Artificial sequence
  synthetic polynucleotide sequence
caatgccacaccagagcaga

SEQ ID NO: 39988 - DNA, 18 bp, Artificial sequence
  synthetic polynucleotide sequence
cccactccgagaaggcca

SEQ ID NO: 39989 - DNA, 21 bp, Artificial sequence
  synthetic polynucleotide sequence
aacaggactccccaagcggaa

SEQ ID NO: 39990 - DNA, 20 bp, Artificial sequence
  synthetic polynucleotide sequence
ctgcattggcccggagcaca

SEQ ID NO: 39991 - DNA, 20 bp, Artificial sequence
  synthetic polynucleotide sequence
gaacgccgacggcttctcca

SEQ ID NO: 39992 - DNA, 18 bp, Artificial sequence
  synthetic polynucleotide sequence
ctgccacagcagcgggga

SEQ ID NO: 39993 - DNA, 18 bp, Artificial sequence
  synthetic polynucleotide sequence
aggctgagcgcaggagga

SEQ ID NO: 39994 - DNA, 18 bp, Artificial sequence
  synthetic polynucleotide sequence
cggaggatccagaggcca

SEQ ID NO: 39995 - DNA, 20 bp, Artificial sequence
  synthetic polynucleotide sequence
ctgctggccaacgcagggca

SEQ ID NO: 39996 - DNA, 20 bp, Artificial sequence
  synthetic polynucleotide sequence
ttcgggcccaacctcaggca

SEQ ID NO: 39997 - DNA, 19 bp, Artificial sequence
  synthetic polynucleotide sequence
gcgctgaagctgccgcaga

SEQ ID NO: 39998 - DNA, 19 bp, Artificial sequence
  synthetic polynucleotide sequence
caggtaggtcagcggcgga

SEQ ID NO: 39999 - DNA, 20 bp, Artificial sequence
  synthetic polynucleotide sequence
tcagatcaaggaccggccca

SEQ ID NO: 40000 - DNA, 20 bp, Artificial sequence
  synthetic polynucleotide sequence
ctcggcctcccgaaattcca

SEQ ID NO: 40001 - DNA, 20 bp, Artificial sequence
  synthetic polynucleotide sequence
tcagtacccacgaggcccca

SEQ ID NO: 40002 - DNA, 20 bp, Artificial sequence
  synthetic polynucleotide sequence
gacagaggctcaccactcca

SEQ ID NO: 40003 - DNA, 20 bp, Artificial sequence
  synthetic polynucleotide sequence
gtccccgctgaacctccaga

SEQ ID NO: 40004 - DNA, 18 bp, Artificial sequence
  synthetic polynucleotide sequence
gcaggaagagggcgggga

SEQ ID NO: 40005 - DNA, 18 bp, Artificial sequence
  synthetic polynucleotide sequence
gccgggtacgtgcggcca

SEQ ID NO: 40006 - DNA, 18 bp, Artificial sequence
  synthetic polynucleotide sequence
gcaacgaggcgtgcacca

SEQ ID NO: 40007 - DNA, 21 bp, Artificial sequence
  synthetic polynucleotide sequence
acatctgctactggaggccga

SEQ ID NO: 40008 - DNA, 20 bp, Artificial sequence
  synthetic polynucleotide sequence
gatccaccgccttctccgca

SEQ ID NO: 40009 - DNA, 19 bp, Artificial sequence
  synthetic polynucleotide sequence
ggtggcaagcacctcggga

SEQ ID NO: 40010 - DNA, 18 bp, Artificial sequence
  synthetic polynucleotide sequence
cctccgtctccaggggca

SEQ ID NO: 40011 - DNA, 18 bp, Artificial sequence
  synthetic polynucleotide sequence
ctctgccaccctccagga

SEQ ID NO: 40012 - DNA, 18 bp, Artificial sequence
  synthetic polynucleotide sequence
cgatgaggtgctgcagga

SEQ ID NO: 40013 - DNA, 20 bp, Artificial sequence
  synthetic polynucleotide sequence
agtcaggcagcccaagagga

SEQ ID NO: 40014 - DNA, 20 bp, Artificial sequence
  synthetic polynucleotide sequence
cctcagacggtgatgagcca

SEQ ID NO: 40015 - DNA, 20 bp, Artificial sequence
  synthetic polynucleotide sequence
cacacacgtgggctgagcaa

SEQ ID NO: 40016 - DNA, 20 bp, Artificial sequence
  synthetic polynucleotide sequence
agttagggcaagggacggga

SEQ ID NO: 40017 - DNA, 20 bp, Artificial sequence
  synthetic polynucleotide sequence
ctgcatggccaccctggaga

SEQ ID NO: 40018 - DNA, 21 bp, Artificial sequence
  synthetic polynucleotide sequence
ctgctccagcagagagtacca

SEQ ID NO: 40019 - DNA, 21 bp, Artificial sequence
  synthetic polynucleotide sequence
tggagaacctgctgcgccaca

SEQ ID NO: 40020 - DNA, 21 bp, Artificial sequence
  synthetic polynucleotide sequence
ccaggtcataggaggccctga

SEQ ID NO: 40021 - DNA, 20 bp, Artificial sequence
  synthetic polynucleotide sequence
agtcaggcagcccaagagga

SEQ ID NO: 40022 - DNA, 20 bp, Artificial sequence
  synthetic polynucleotide sequence
tctcagatggccatgagcca

SEQ ID NO: 40023 - DNA, 20 bp, Artificial sequence
  synthetic polynucleotide sequence
ctcaccccacttcaggctga

SEQ ID NO: 40024 - DNA, 19 bp, Artificial sequence
  synthetic polynucleotide sequence
ctcagtgggcgacgtgcca

SEQ ID NO: 40025 - DNA, 21 bp, Artificial sequence
  synthetic polynucleotide sequence
aagtaagggagcccaacagga

SEQ ID NO: 40026 - DNA, 19 bp, Artificial sequence
  synthetic polynucleotide sequence
caggccttccccgcaagca

SEQ ID NO: 40027 - DNA, 21 bp, Artificial sequence
  synthetic polynucleotide sequence
tagggacttaaggcaccccaa

SEQ ID NO: 40028 - DNA, 22 bp, Artificial sequence
  synthetic polynucleotide sequence
aataggcaggcattcaacagca

SEQ ID NO: 40029 - DNA, 22 bp, Artificial sequence
  synthetic polynucleotide sequence
catacctgggccacatgaggaa

SEQ ID NO: 40030 - DNA, 20 bp, Artificial sequence
  synthetic polynucleotide sequence
gaggcagcgcagcttgagga

SEQ ID NO: 40031 - DNA, 22 bp, Artificial sequence
  synthetic polynucleotide sequence
catacctgggccacatgaggaa

SEQ ID NO: 40032 - DNA, 21 bp, Artificial sequence
  synthetic polynucleotide sequence
ggaggcagcacagcttgagga

SEQ ID NO: 40033 - DNA, 19 bp, Artificial sequence
  synthetic polynucleotide sequence
ggggtgtcacgctgaccca

SEQ ID NO: 40034 - DNA, 21 bp, Artificial sequence
  synthetic polynucleotide sequence
cgcagcaggttctcaagggca

SEQ ID NO: 40035 - DNA, 22 bp, Artificial sequence
  synthetic polynucleotide sequence
tggggctgagctgatgaacaca

SEQ ID NO: 40036 - DNA, 20 bp, Artificial sequence
  synthetic polynucleotide sequence
cataggaggccctgatgcca

SEQ ID NO: 40037 - DNA, 20 bp, Artificial sequence
  synthetic polynucleotide sequence
ctcagagcaggacccagaga

SEQ ID NO: 40038 - DNA, 18 bp, Artificial sequence
  synthetic polynucleotide sequence
cggcttctggacagggaa

SEQ ID NO: 40039 - DNA, 20 bp, Artificial sequence
  synthetic polynucleotide sequence
cccgcacaaggaggcagcaa

SEQ ID NO: 40040 - DNA, 20 bp, Artificial sequence
  synthetic polynucleotide sequence
gaggtgggggaccttgagga

SEQ ID NO: 40041 - DNA, 20 bp, Artificial sequence
  synthetic polynucleotide sequence
gcaagtcccgaagtgcccga

SEQ ID NO: 40042 - DNA, 20 bp, Artificial sequence
  synthetic polynucleotide sequence
gaggtgggggaccttgagga

SEQ ID NO: 40043 - DNA, 21 bp, Artificial sequence
  synthetic polynucleotide sequence
acgcccacaaggaggaaacca

SEQ ID NO: 40044 - DNA, 19 bp, Artificial sequence
  synthetic polynucleotide sequence
gaggtgggggaccttggga

SEQ ID NO: 40045 - DNA, 21 bp, Artificial sequence
  synthetic polynucleotide sequence
cccacctcctggaaagccaca

SEQ ID NO: 40046 - DNA, 18 bp, Artificial sequence
  synthetic polynucleotide sequence
ggcctgcccccttgagga

SEQ ID NO: 40047 - DNA, 18 bp, Artificial sequence
  synthetic polynucleotide sequence
ccttctggcagcaagcca

SEQ ID NO: 40048 - DNA, 18 bp, Artificial sequence
  synthetic polynucleotide sequence
gccgagccagggtaccca

SEQ ID NO: 40049 - DNA, 18 bp, Artificial sequence
  synthetic polynucleotide sequence
ccaggacgatgcagccaa

SEQ ID NO: 40050 - DNA, 21 bp, Artificial sequence
  synthetic polynucleotide sequence
tgtgcaggatagtagccacca

SEQ ID NO: 40051 - DNA, 19 bp, Artificial sequence
  synthetic polynucleotide sequence
ctgctcagcaccctggcca

SEQ ID NO: 40052 - DNA, 20 bp, Artificial sequence
  synthetic polynucleotide sequence
tctccctgcctgaggactga

SEQ ID NO: 40053 - DNA, 18 bp, Artificial sequence
  synthetic polynucleotide sequence
ccctggtcaggaggtgga

SEQ ID NO: 40054 - DNA, 20 bp, Artificial sequence
  synthetic polynucleotide sequence
aacttccaaggagcgggcta

SEQ ID NO: 40055 - DNA, 18 bp, Artificial sequence
  synthetic polynucleotide sequence
tgctgaccggctcgagga

SEQ ID NO: 40056 - DNA, 18 bp, Artificial sequence
  synthetic polynucleotide sequence
aaggctgcaccctgagga

SEQ ID NO: 40057 - DNA, 21 bp, Artificial sequence
  synthetic polynucleotide sequence
tgcagcacacgtacctgccca

SEQ ID NO: 40058 - DNA, 20 bp, Artificial sequence
  synthetic polynucleotide sequence
gctcgacctggactccacca

SEQ ID NO: 40059 - DNA, 18 bp, Artificial sequence
  synthetic polynucleotide sequence
ggggatgtacacccccaa

SEQ ID NO: 40060 - DNA, 18 bp, Artificial sequence
  synthetic polynucleotide sequence
gtgaggtgctcagggcca

SEQ ID NO: 40061 - DNA, 20 bp, Artificial sequence
  synthetic polynucleotide sequence
tggccacgaagcgcttccga

SEQ ID NO: 40062 - DNA, 19 bp, Artificial sequence
  synthetic polynucleotide sequence
cgacaccagagggcgcgca

SEQ ID NO: 40063 - DNA, 18 bp, Artificial sequence
  synthetic polynucleotide sequence
tcgaccgagagatcgcca

SEQ ID NO: 40064 - DNA, 18 bp, Artificial sequence
  synthetic polynucleotide sequence
gagcccatacttgcgcga

SEQ ID NO: 40065 - DNA, 21 bp, Artificial sequence
  synthetic polynucleotide sequence
agaggttcacagcctccagca

SEQ ID NO: 40066 - DNA, 20 bp, Artificial sequence
  synthetic polynucleotide sequence
catgggcagcatgggatgca

SEQ ID NO: 40067 - DNA, 18 bp, Artificial sequence
  synthetic polynucleotide sequence
ggaagcctcgaacccaca

SEQ ID NO: 40068 - DNA, 20 bp, Artificial sequence
  synthetic polynucleotide sequence
caagacgtcagtctggggca

SEQ ID NO: 40069 - DNA, 18 bp, Artificial sequence
  synthetic polynucleotide sequence
ttcgaacctccagcggca

SEQ ID NO: 40070 - DNA, 20 bp, Artificial sequence
  synthetic polynucleotide sequence
tccgactctgaggtgggaga

SEQ ID NO: 40071 - DNA, 22 bp, Artificial sequence
  synthetic polynucleotide sequence
gttaaagcggaaacccagccaa

SEQ ID NO: 40072 - DNA, 20 bp, Artificial sequence
  synthetic polynucleotide sequence
agtctggcccaagactggga

SEQ ID NO: 40073 - DNA, 18 bp, Artificial sequence
  synthetic polynucleotide sequence
cggtgttgcaggcgagca

SEQ ID NO: 40074 - DNA, 20 bp, Artificial sequence
  synthetic polynucleotide sequence
gaatggagtcactgagggca

SEQ ID NO: 40075 - DNA, 21 bp, Artificial sequence
  synthetic polynucleotide sequence
cgcagagtgcgaaagggtgaa

SEQ ID NO: 40076 - DNA, 20 bp, Artificial sequence
  synthetic polynucleotide sequence
actcccacgaacctcccaca

SEQ ID NO: 40077 - DNA, 21 bp, Artificial sequence
  synthetic polynucleotide sequence
aaccccgacagaccctaccaa

SEQ ID NO: 40078 - DNA, 20 bp, Artificial sequence
  synthetic polynucleotide sequence
gcacgaccacagtagccgca

SEQ ID NO: 40079 - DNA, 18 bp, Artificial sequence
  synthetic polynucleotide sequence
ggacaaggggcatcccaa

SEQ ID NO: 40080 - DNA, 18 bp, Artificial sequence
  synthetic polynucleotide sequence
agtgcagacccagtggca

SEQ ID NO: 40081 - DNA, 18 bp, Artificial sequence
  synthetic polynucleotide sequence
gcagaactggtgcgccaa

SEQ ID NO: 40082 - DNA, 18 bp, Artificial sequence
  synthetic polynucleotide sequence
gtggcgctccctgaagga

SEQ ID NO: 40083 - DNA, 21 bp, Artificial sequence
  synthetic polynucleotide sequence
gaagctctacgtctgcaggga

SEQ ID NO: 40084 - DNA, 21 bp, Artificial sequence
  synthetic polynucleotide sequence
gtgtcctctggtgagtgagga

SEQ ID NO: 40085 - DNA, 21 bp, Artificial sequence
  synthetic polynucleotide sequence
aacaaggaggactgggaccca

SEQ ID NO: 40086 - DNA, 23 bp, Artificial sequence
  synthetic polynucleotide sequence
gataaaaaggcccctgaacgaga

SEQ ID NO: 40087 - DNA, 18 bp, Artificial sequence
  synthetic polynucleotide sequence
cggcgtgctgaaaacaga

SEQ ID NO: 40088 - DNA, 18 bp, Artificial sequence
  synthetic polynucleotide sequence
ggcttccagccagcggga

SEQ ID NO: 40089 - DNA, 18 bp, Artificial sequence
  synthetic polynucleotide sequence
ggccacatgaacatcgca

SEQ ID NO: 40090 - DNA, 18 bp, Artificial sequence
  synthetic polynucleotide sequence
acgccttcaccaagcgga

SEQ ID NO: 40091 - DNA, 18 bp, Artificial sequence
  synthetic polynucleotide sequence
ccggactcgcgaagagga

SEQ ID NO: 40092 - DNA, 18 bp, Artificial sequence
  synthetic polynucleotide sequence
ggcgaccgatacccggga

SEQ ID NO: 40093 - DNA, 18 bp, Artificial sequence
  synthetic polynucleotide sequence
ccacaaggcggaaggcaa

SEQ ID NO: 40094 - DNA, 18 bp, Artificial sequence
  synthetic polynucleotide sequence
gtgccaggctgcaggtga

SEQ ID NO: 40095 - DNA, 20 bp, Artificial sequence
  synthetic polynucleotide sequence
ccagctaccactggcaggaa

SEQ ID NO: 40096 - DNA, 21 bp, Artificial sequence
  synthetic polynucleotide sequence
atggttggaaggaccatcaca

SEQ ID NO: 40097 - DNA, 18 bp, Artificial sequence
  synthetic polynucleotide sequence
ctacgtgagggaggccca

SEQ ID NO: 40098 - DNA, 19 bp, Artificial sequence
  synthetic polynucleotide sequence
ccgacacacagcaggagca

SEQ ID NO: 40099 - DNA, 21 bp, Artificial sequence
  synthetic polynucleotide sequence
ctgatggtggtggaggaacga

SEQ ID NO: 40100 - DNA, 19 bp, Artificial sequence
  synthetic polynucleotide sequence
tcctggacagctctggaga

SEQ ID NO: 40101 - DNA, 22 bp, Artificial sequence
  synthetic polynucleotide sequence
gaaacatggccatacggagtca

SEQ ID NO: 40102 - DNA, 21 bp, Artificial sequence
  synthetic polynucleotide sequence
ttcagctaagggggcaccaca

SEQ ID NO: 40103 - DNA, 22 bp, Artificial sequence
  synthetic polynucleotide sequence
caaaccacatcctcaggatcca

SEQ ID NO: 40104 - DNA, 20 bp, Artificial sequence
  synthetic polynucleotide sequence
tgcaaacgctgctgctgcca

SEQ ID NO: 40105 - DNA, 18 bp, Artificial sequence
  synthetic polynucleotide sequence
cctggagaacgtgccaca

SEQ ID NO: 40106 - DNA, 18 bp, Artificial sequence
  synthetic polynucleotide sequence
tcatgaggtccagcggga

SEQ ID NO: 40107 - DNA, 19 bp, Artificial sequence
  synthetic polynucleotide sequence
catcagaggaggtggcgaa

SEQ ID NO: 40108 - DNA, 20 bp, Artificial sequence
  synthetic polynucleotide sequence
cagccactaagaggcctcca

SEQ ID NO: 40109 - DNA, 19 bp, Artificial sequence
  synthetic polynucleotide sequence
gcctccagtggcacgctga

SEQ ID NO: 40110 - DNA, 20 bp, Artificial sequence
  synthetic polynucleotide sequence
ctcctgcaagcacccctcca

SEQ ID NO: 40111 - DNA, 20 bp, Artificial sequence
  synthetic polynucleotide sequence
tggcgagtacgaggagagca

SEQ ID NO: 40112 - DNA, 19 bp, Artificial sequence
  synthetic polynucleotide sequence
gctctgacagcgtcaccca

SEQ ID NO: 40113 - DNA, 19 bp, Artificial sequence
  synthetic polynucleotide sequence
cttcccagcagcgtccgga

SEQ ID NO: 40114 - DNA, 21 bp, Artificial sequence
  synthetic polynucleotide sequence
acatctggttcaaggccgcca

SEQ ID NO: 40115 - DNA, 20 bp, Artificial sequence
  synthetic polynucleotide sequence
atctccaactacggcaccca

SEQ ID NO: 40116 - DNA, 18 bp, Artificial sequence
  synthetic polynucleotide sequence
ggccttggcttcggcaga

SEQ ID NO: 40117 - DNA, 19 bp, Artificial sequence
  synthetic polynucleotide sequence
ggaggtgctacaggggcaa

SEQ ID NO: 40118 - DNA, 18 bp, Artificial sequence
  synthetic polynucleotide sequence
agcgacccgagcctgtga

SEQ ID NO: 40119 - DNA, 20 bp, Artificial sequence
  synthetic polynucleotide sequence
aagccatggagtcggaccca

SEQ ID NO: 40120 - DNA, 21 bp, Artificial sequence
  synthetic polynucleotide sequence
ccgcaccaataggtagcggca

SEQ ID NO: 40121 - DNA, 18 bp, Artificial sequence
  synthetic polynucleotide sequence
gacaccaactccccgcaa

SEQ ID NO: 40122 - DNA, 20 bp, Artificial sequence
  synthetic polynucleotide sequence
gtcgggagtaacttcaggca

SEQ ID NO: 40123 - DNA, 19 bp, Artificial sequence
  synthetic polynucleotide sequence
caccccaacagggaggcca

SEQ ID NO: 40124 - DNA, 20 bp, Artificial sequence
  synthetic polynucleotide sequence
gaggagactgcccctgtgga

SEQ ID NO: 40125 - DNA, 22 bp, Artificial sequence
  synthetic polynucleotide sequence
catagatgaggagcgtcaggga

SEQ ID NO: 40126 - DNA, 21 bp, Artificial sequence
  synthetic polynucleotide sequence
ctggttcccatcaccagcaga

SEQ ID NO: 40127 - DNA, 20 bp, Artificial sequence
  synthetic polynucleotide sequence
ctgggactctacggcgagga

SEQ ID NO: 40128 - DNA, 21 bp, Artificial sequence
  synthetic polynucleotide sequence
tgaccaaactgaggggtggga

SEQ ID NO: 40129 - DNA, 19 bp, Artificial sequence
  synthetic polynucleotide sequence
cctccacctggccagcgaa

SEQ ID NO: 40130 - DNA, 19 bp, Artificial sequence
  synthetic polynucleotide sequence
tctgcaaagccaggtccga

SEQ ID NO: 40131 - DNA, 20 bp, Artificial sequence
  synthetic polynucleotide sequence
tcgtcaggcccgagacaaga

SEQ ID NO: 40132 - DNA, 20 bp, Artificial sequence
  synthetic polynucleotide sequence
ggagaatggagccccctcca

SEQ ID NO: 40133 - DNA, 21 bp, Artificial sequence
  synthetic polynucleotide sequence
actctgcaaccctctcccgaa

SEQ ID NO: 40134 - DNA, 21 bp, Artificial sequence
  synthetic polynucleotide sequence
acgaatagtctccaggcggca

SEQ ID NO: 40135 - DNA, 18 bp, Artificial sequence
  synthetic polynucleotide sequence
cctggctggagtgggaga

SEQ ID NO: 40136 - DNA, 18 bp, Artificial sequence
  synthetic polynucleotide sequence
ggcatccaattcacggca

SEQ ID NO: 40137 - DNA, 19 bp, Artificial sequence
  synthetic polynucleotide sequence
tggagagtgagcttcggaa

SEQ ID NO: 40138 - DNA, 21 bp, Artificial sequence
  synthetic polynucleotide sequence
actggcaataagcaagccgca

SEQ ID NO: 40139 - DNA, 20 bp, Artificial sequence
  synthetic polynucleotide sequence
tccgagccctgaggtcaaga

SEQ ID NO: 40140 - DNA, 21 bp, Artificial sequence
  synthetic polynucleotide sequence
tcaactgtgagacggctggaa

SEQ ID NO: 40141 - DNA, 22 bp, Artificial sequence
  synthetic polynucleotide sequence
tccagagacaacaggccatgga

SEQ ID NO: 40142 - DNA, 19 bp, Artificial sequence
  synthetic polynucleotide sequence
gctgaccccagcctctcca

SEQ ID NO: 40143 - DNA, 19 bp, Artificial sequence
  synthetic polynucleotide sequence
ggcaccttcggcaaagtga

SEQ ID NO: 40144 - DNA, 20 bp, Artificial sequence
  synthetic polynucleotide sequence
ctaccacatcaaggctccga

SEQ ID NO: 40145 - DNA, 20 bp, Artificial sequence
  synthetic polynucleotide sequence
tccacaactgcagagagcca

SEQ ID NO: 40146 - DNA, 18 bp, Artificial sequence
  synthetic polynucleotide sequence
gtgtgactgcccaggcga

SEQ ID NO: 40147 - DNA, 19 bp, Artificial sequence
  synthetic polynucleotide sequence
ctgaacaaggacacgggga

SEQ ID NO: 40148 - DNA, 18 bp, Artificial sequence
  synthetic polynucleotide sequence
gggttgcgctgagcacca

SEQ ID NO: 40149 - DNA, 20 bp, Artificial sequence
  synthetic polynucleotide sequence
tggtctgaaggaggcaagga

SEQ ID NO: 40150 - DNA, 21 bp, Artificial sequence
  synthetic polynucleotide sequence
tgccaagctgactggtaacca

SEQ ID NO: 40151 - DNA, 20 bp, Artificial sequence
  synthetic polynucleotide sequence
tgagtacctggcccctgaga

SEQ ID NO: 40152 - DNA, 20 bp, Artificial sequence
  synthetic polynucleotide sequence
agagctgaagtgggaaggga

SEQ ID NO: 40153 - DNA, 23 bp, Artificial sequence
  synthetic polynucleotide sequence
caaggctatatccaggtcacaga

SEQ ID NO: 40154 - DNA, 18 bp, Artificial sequence
  synthetic polynucleotide sequence
ggggatagccagctgcca

SEQ ID NO: 40155 - DNA, 22 bp, Artificial sequence
  synthetic polynucleotide sequence
cacatactgaacgagaagcgca

SEQ ID NO: 40156 - DNA, 20 bp, Artificial sequence
  synthetic polynucleotide sequence
cccacccggcacgtactcca

SEQ ID NO: 40157 - DNA, 20 bp, Artificial sequence
  synthetic polynucleotide sequence
tggaagcagaggttcaccga

SEQ ID NO: 40158 - DNA, 20 bp, Artificial sequence
  synthetic polynucleotide sequence
ctctccacctgtgagcacca

SEQ ID NO: 40159 - DNA, 20 bp, Artificial sequence
  synthetic polynucleotide sequence
acctgtgaggcccaagacca

SEQ ID NO: 40160 - DNA, 20 bp, Artificial sequence
  synthetic polynucleotide sequence
aggaggagcggaagatccca

SEQ ID NO: 40161 - DNA, 22 bp, Artificial sequence
  synthetic polynucleotide sequence
caaacctacaaccacctggaca

SEQ ID NO: 40162 - DNA, 20 bp, Artificial sequence
  synthetic polynucleotide sequence
ctcccgagcaatcctgtcga

SEQ ID NO: 40163 - DNA, 18 bp, Artificial sequence
  synthetic polynucleotide sequence
ggggcatcgaccgagaca

SEQ ID NO: 40164 - DNA, 20 bp, Artificial sequence
  synthetic polynucleotide sequence
ctgaccgacgttgtagcaca

SEQ ID NO: 40165 - DNA, 18 bp, Artificial sequence
  synthetic polynucleotide sequence
gggagagcctggggacga

SEQ ID NO: 40166 - DNA, 18 bp, Artificial sequence
  synthetic polynucleotide sequence
ggggccggttcagcagca

SEQ ID NO: 40167 - DNA, 19 bp, Artificial sequence
  synthetic polynucleotide sequence
gggaaccaggaggtcgaga

SEQ ID NO: 40168 - DNA, 22 bp, Artificial sequence
  synthetic polynucleotide sequence
tccaactgcataagctgaggca

SEQ ID NO: 40169 - DNA, 19 bp, Artificial sequence
  synthetic polynucleotide sequence
tggtcaaagatggggagca

SEQ ID NO: 40170 - DNA, 18 bp, Artificial sequence
  synthetic polynucleotide sequence
taaggccagttcgccgaa

SEQ ID NO: 40171 - DNA, 19 bp, Artificial sequence
  synthetic polynucleotide sequence
gatgacgtggagtgcacca

SEQ ID NO: 40172 - DNA, 20 bp, Artificial sequence
  synthetic polynucleotide sequence
ccatgacgaagtacagccga

SEQ ID NO: 40173 - DNA, 21 bp, Artificial sequence
  synthetic polynucleotide sequence
tccagactacatcgcccccga

SEQ ID NO: 40174 - DNA, 20 bp, Artificial sequence
  synthetic polynucleotide sequence
aagggtgcctgcccagccaa

SEQ ID NO: 40175 - DNA, 18 bp, Artificial sequence
  synthetic polynucleotide sequence
aagcggaggttggagcca

SEQ ID NO: 40176 - DNA, 20 bp, Artificial sequence
  synthetic polynucleotide sequence
gagaagccagcgaatgcaga

SEQ ID NO: 40177 - DNA, 21 bp, Artificial sequence
  synthetic polynucleotide sequence
tcacgccctaataaggagcga

SEQ ID NO: 40178 - DNA, 21 bp, Artificial sequence
  synthetic polynucleotide sequence
ggactgggcttaaggaaggga

SEQ ID NO: 40179 - DNA, 18 bp, Artificial sequence
  synthetic polynucleotide sequence
ggccgacaatgaggacga

SEQ ID NO: 40180 - DNA, 18 bp, Artificial sequence
  synthetic polynucleotide sequence
gcgatgccacacagccca

SEQ ID NO: 40181 - DNA, 18 bp, Artificial sequence
  synthetic polynucleotide sequence
gtccaggacgcctgcaca

SEQ ID NO: 40182 - DNA, 18 bp, Artificial sequence
  synthetic polynucleotide sequence
accagcgtgcagtccaca

SEQ ID NO: 40183 - DNA, 18 bp, Artificial sequence
  synthetic polynucleotide sequence
ggtgtcaccacggccaca

SEQ ID NO: 40184 - DNA, 22 bp, Artificial sequence
  synthetic polynucleotide sequence
tggagccaggtagggtagacca

SEQ ID NO: 40185 - DNA, 20 bp, Artificial sequence
  synthetic polynucleotide sequence
gaaggattacggccaggaga

SEQ ID NO: 40186 - DNA, 20 bp, Artificial sequence
  synthetic polynucleotide sequence
atgagcactccaagagccca

SEQ ID NO: 40187 - DNA, 19 bp, Artificial sequence
  synthetic polynucleotide sequence
taggagatgccaagacgaa

SEQ ID NO: 40188 - DNA, 19 bp, Artificial sequence
  synthetic polynucleotide sequence
ggcgactgaccaatcagca

SEQ ID NO: 40189 - DNA, 19 bp, Artificial sequence
  synthetic polynucleotide sequence
cctacgacgagcagacgca

SEQ ID NO: 40190 - DNA, 20 bp, Artificial sequence
  synthetic polynucleotide sequence
gagacaagcttgaaggggca

SEQ ID NO: 40191 - DNA, 18 bp, Artificial sequence
  synthetic polynucleotide sequence
tcaccgacaacccggaca

SEQ ID NO: 40192 - DNA, 18 bp, Artificial sequence
  synthetic polynucleotide sequence
gggaggctttgacggaca

SEQ ID NO: 40193 - DNA, 18 bp, Artificial sequence
  synthetic polynucleotide sequence
ccttccagcccatcacca

SEQ ID NO: 40194 - DNA, 18 bp, Artificial sequence
  synthetic polynucleotide sequence
ccttgggaatgacgggca

SEQ ID NO: 40195 - DNA, 20 bp, Artificial sequence
  synthetic polynucleotide sequence
ggagccacatctcagctgga

SEQ ID NO: 40196 - DNA, 18 bp, Artificial sequence
  synthetic polynucleotide sequence
ccagctctcggaggtcca

SEQ ID NO: 40197 - DNA, 22 bp, Artificial sequence
  synthetic polynucleotide sequence
atctgtggtaggaactccagca

SEQ ID NO: 40198 - DNA, 22 bp, Artificial sequence
  synthetic polynucleotide sequence
aaatgtgccactgaggctcaca

SEQ ID NO: 40199 - DNA, 20 bp, Artificial sequence
  synthetic polynucleotide sequence
atgacggtaggggaaagcca

SEQ ID NO: 40200 - DNA, 20 bp, Artificial sequence
  synthetic polynucleotide sequence
gtcctcgccacccttcacca

SEQ ID NO: 40201 - DNA, 20 bp, Artificial sequence
  synthetic polynucleotide sequence
tacagggacctcaagccaga

SEQ ID NO: 40202 - DNA, 18 bp, Artificial sequence
  synthetic polynucleotide sequence
gtgggctgccagtcagga

SEQ ID NO: 40203 - DNA, 22 bp, Artificial sequence
  synthetic polynucleotide sequence
gaggagctccagaacaagtgca

SEQ ID NO: 40204 - DNA, 20 bp, Artificial sequence
  synthetic polynucleotide sequence
ccggtggacctcaagaggca

SEQ ID NO: 40205 - DNA, 22 bp, Artificial sequence
  synthetic polynucleotide sequence
gctaagccagggaaaacaccga

SEQ ID NO: 40206 - DNA, 21 bp, Artificial sequence
  synthetic polynucleotide sequence
tcaggcattaaggggtcagga

SEQ ID NO: 40207 - DNA, 19 bp, Artificial sequence
  synthetic polynucleotide sequence
cgccggaagaagcgccaga

SEQ ID NO: 40208 - DNA, 21 bp, Artificial sequence
  synthetic polynucleotide sequence
gccccatggtgaaactgggca

SEQ ID NO: 40209 - DNA, 18 bp, Artificial sequence
  synthetic polynucleotide sequence
ctggacgtggcatgacga

SEQ ID NO: 40210 - DNA, 20 bp, Artificial sequence
  synthetic polynucleotide sequence
tgcaggtactcgatggcaca

SEQ ID NO: 40211 - DNA, 21 bp, Artificial sequence
  synthetic polynucleotide sequence
ccaaacggcttctagagggca

SEQ ID NO: 40212 - DNA, 20 bp, Artificial sequence
  synthetic polynucleotide sequence
agggatggaagtcccgacca

SEQ ID NO: 40213 - DNA, 20 bp, Artificial sequence
  synthetic polynucleotide sequence
cttcggtcggaggagggcaa

SEQ ID NO: 40214 - DNA, 20 bp, Artificial sequence
  synthetic polynucleotide sequence
ccgccttccagggggaagca

SEQ ID NO: 40215 - DNA, 21 bp, Artificial sequence
  synthetic polynucleotide sequence
ggtgtcagtgaagctccgcaa

SEQ ID NO: 40216 - DNA, 20 bp, Artificial sequence
  synthetic polynucleotide sequence
aaggggttgtagcaggccga

SEQ ID NO: 40217 - DNA, 21 bp, Artificial sequence
  synthetic polynucleotide sequence
cgctgcaaaccagaccatgga

SEQ ID NO: 40218 - DNA, 22 bp, Artificial sequence
  synthetic polynucleotide sequence
aaaggacagccacagagatcca

SEQ ID NO: 40219 - DNA, 18 bp, Artificial sequence
  synthetic polynucleotide sequence
agccagagccggagcaga

SEQ ID NO: 40220 - DNA, 18 bp, Artificial sequence
  synthetic polynucleotide sequence
gtacctggggcggcagca

SEQ ID NO: 40221 - DNA, 18 bp, Artificial sequence
  synthetic polynucleotide sequence
ggctgcaccggatccaca

SEQ ID NO: 40222 - DNA, 18 bp, Artificial sequence
  synthetic polynucleotide sequence
cctccggtgcctgcagga

SEQ ID NO: 40223 - DNA, 19 bp, Artificial sequence
  synthetic polynucleotide sequence
cggggccacgaatcctcca

SEQ ID NO: 40224 - DNA, 18 bp, Artificial sequence
  synthetic polynucleotide sequence
cctgccgctcaggctcca

SEQ ID NO: 40225 - DNA, 18 bp, Artificial sequence
  synthetic polynucleotide sequence
gcctgcaagtgaagcgga

SEQ ID NO: 40226 - DNA, 18 bp, Artificial sequence
  synthetic polynucleotide sequence
ccagtgcgtgtacgggga

SEQ ID NO: 40227 - DNA, 18 bp, Artificial sequence
  synthetic polynucleotide sequence
cttccaccccaccacaca

SEQ ID NO: 40228 - DNA, 18 bp, Artificial sequence
  synthetic polynucleotide sequence
cagcccagctcagagcca

SEQ ID NO: 40229 - DNA, 18 bp, Artificial sequence
  synthetic polynucleotide sequence
catccatgtgcacggcaa

SEQ ID NO: 40230 - DNA, 19 bp, Artificial sequence
  synthetic polynucleotide sequence
gggcccgtagagaacacga

SEQ ID NO: 40231 - DNA, 20 bp, Artificial sequence
  synthetic polynucleotide sequence
gtggctccagagaaagcaga

SEQ ID NO: 40232 - DNA, 20 bp, Artificial sequence
  synthetic polynucleotide sequence
ggaggaagagatgggagcca

SEQ ID NO: 40233 - DNA, 19 bp, Artificial sequence
  synthetic polynucleotide sequence
gctacggactcctgcacga

SEQ ID NO: 40234 - DNA, 18 bp, Artificial sequence
  synthetic polynucleotide sequence
ccggacaatccctgcaca

SEQ ID NO: 40235 - DNA, 22 bp, Artificial sequence
  synthetic polynucleotide sequence
aatgaggacctacagggcagaa

SEQ ID NO: 40236 - DNA, 20 bp, Artificial sequence
  synthetic polynucleotide sequence
ctggtccacagcggtccgca

SEQ ID NO: 40237 - DNA, 18 bp, Artificial sequence
  synthetic polynucleotide sequence
catgacctgcatccggga

SEQ ID NO: 40238 - DNA, 20 bp, Artificial sequence
  synthetic polynucleotide sequence
atctgcaggcagaatgcaga

SEQ ID NO: 40239 - DNA, 20 bp, Artificial sequence
  synthetic polynucleotide sequence
gcgccggagctgaaacacga

SEQ ID NO: 40240 - DNA, 22 bp, Artificial sequence
  synthetic polynucleotide sequence
attctgaagagatgctccccca

SEQ ID NO: 40241 - DNA, 18 bp, Artificial sequence
  synthetic polynucleotide sequence
cacccaggcggcgaacca

SEQ ID NO: 40242 - DNA, 19 bp, Artificial sequence
  synthetic polynucleotide sequence
gtcctgcgcccctctccaa

SEQ ID NO: 40243 - DNA, 20 bp, Artificial sequence
  synthetic polynucleotide sequence
cagtcagtggaacaagccga

SEQ ID NO: 40244 - DNA, 18 bp, Artificial sequence
  synthetic polynucleotide sequence
cccagcatgtagccgcca

SEQ ID NO: 40245 - DNA, 20 bp, Artificial sequence
  synthetic polynucleotide sequence
gagagtgggcagtacgtgga

SEQ ID NO: 40246 - DNA, 20 bp, Artificial sequence
  synthetic polynucleotide sequence
cccataggcgggcgggtaga

SEQ ID NO: 40247 - DNA, 18 bp, Artificial sequence
  synthetic polynucleotide sequence
cctggaagcggatggaga

SEQ ID NO: 40248 - DNA, 18 bp, Artificial sequence
  synthetic polynucleotide sequence
cgctgtcagcacccagga

SEQ ID NO: 40249 - DNA, 20 bp, Artificial sequence
  synthetic polynucleotide sequence
gagggaaaggaaggggcaca

SEQ ID NO: 40250 - DNA, 20 bp, Artificial sequence
  synthetic polynucleotide sequence
tctcgcagcagagaggggaa

SEQ ID NO: 40251 - DNA, 20 bp, Artificial sequence
  synthetic polynucleotide sequence
ctcggtatgaactgcgggaa

SEQ ID NO: 40252 - DNA, 19 bp, Artificial sequence
  synthetic polynucleotide sequence
gatgcctacagccacacca

SEQ ID NO: 40253 - DNA, 20 bp, Artificial sequence
  synthetic polynucleotide sequence
ccgccgtgccctggagaaca

SEQ ID NO: 40254 - DNA, 20 bp, Artificial sequence
  synthetic polynucleotide sequence
ggcgatggaagaggttgcca

SEQ ID NO: 40255 - DNA, 19 bp, Artificial sequence
  synthetic polynucleotide sequence
cgccaggcaaccaagcgca

SEQ ID NO: 40256 - DNA, 20 bp, Artificial sequence
  synthetic polynucleotide sequence
gcctgccccagtgctagaga

SEQ ID NO: 40257 - DNA, 18 bp, Artificial sequence
  synthetic polynucleotide sequence
ggaaacgcaagcaccaca

SEQ ID NO: 40258 - DNA, 20 bp, Artificial sequence
  synthetic polynucleotide sequence
aagtccatggagcagcggta

SEQ ID NO: 40259 - DNA, 17 bp, Artificial sequence
  synthetic polynucleotide sequence
caccaccccaagcccca

SEQ ID NO: 40260 - DNA, 22 bp, Artificial sequence
  synthetic polynucleotide sequence
gaggagggaagagaaatggaca

SEQ ID NO: 40261 - DNA, 21 bp, Artificial sequence
  synthetic polynucleotide sequence
tggttcaaggcggtccctgga

SEQ ID NO: 40262 - DNA, 20 bp, Artificial sequence
  synthetic polynucleotide sequence
ggtggggaagaagtcgcgca

SEQ ID NO: 40263 - DNA, 21 bp, Artificial sequence
  synthetic polynucleotide sequence
gaagttgcgcaacctcaccaa

SEQ ID NO: 40264 - DNA, 20 bp, Artificial sequence
  synthetic polynucleotide sequence
agcacgtggccatgctccca

SEQ ID NO: 40265 - DNA, 20 bp, Artificial sequence
  synthetic polynucleotide sequence
gaccaaagaggcgttggaga

SEQ ID NO: 40266 - DNA, 20 bp, Artificial sequence
  synthetic polynucleotide sequence
atggatgcaccaagcacaga

SEQ ID NO: 40267 - DNA, 19 bp, Artificial sequence
  synthetic polynucleotide sequence
gaggaggtgactcagcgca

SEQ ID NO: 40268 - DNA, 18 bp, Artificial sequence
  synthetic polynucleotide sequence
tgcaccatgccaggcaga

SEQ ID NO: 40269 - DNA, 22 bp, Artificial sequence
  synthetic polynucleotide sequence
aaccgcagagctaagcaacgga

SEQ ID NO: 40270 - DNA, 22 bp, Artificial sequence
  synthetic polynucleotide sequence
aagaataggggcaagcagtgga

SEQ ID NO: 40271 - DNA, 19 bp, Artificial sequence
  synthetic polynucleotide sequence
ctgggatcggagccgcaca

SEQ ID NO: 40272 - DNA, 19 bp, Artificial sequence
  synthetic polynucleotide sequence
ggaggaggatcagcgggca

SEQ ID NO: 40273 - DNA, 21 bp, Artificial sequence
  synthetic polynucleotide sequence
aatctggagttgtcgacacca

SEQ ID NO: 40274 - DNA, 18 bp, Artificial sequence
  synthetic polynucleotide sequence
catctggaaggccaccca

SEQ ID NO: 40275 - DNA, 22 bp, Artificial sequence
  synthetic polynucleotide sequence
accatagccatcgtggagcaca

SEQ ID NO: 40276 - DNA, 21 bp, Artificial sequence
  synthetic polynucleotide sequence
ctcagctcaacctggtcagca

SEQ ID NO: 40277 - DNA, 20 bp, Artificial sequence
  synthetic polynucleotide sequence
ccccacccaggtacctcaga

SEQ ID NO: 40278 - DNA, 21 bp, Artificial sequence
  synthetic polynucleotide sequence
agatggacctttgaaggccga

SEQ ID NO: 40279 - DNA, 23 bp, Artificial sequence
  synthetic polynucleotide sequence
cttttcccaagaactgagagaga

SEQ ID NO: 40280 - DNA, 20 bp, Artificial sequence
  synthetic polynucleotide sequence
cctactcctcccaaccccca

SEQ ID NO: 40281 - DNA, 21 bp, Artificial sequence
  synthetic polynucleotide sequence
tcggcagaaaagggaagcgga

SEQ ID NO: 40282 - DNA, 18 bp, Artificial sequence
  synthetic polynucleotide sequence
tggggacctagggggcga

SEQ ID NO: 40283 - DNA, 18 bp, Artificial sequence
  synthetic polynucleotide sequence
gccgaagcgagaaggcaa

SEQ ID NO: 40284 - DNA, 20 bp, Artificial sequence
  synthetic polynucleotide sequence
gaggtgggaagacctgagga

SEQ ID NO: 40285 - DNA, 20 bp, Artificial sequence
  synthetic polynucleotide sequence
gtcacctccagggcagtgaa

SEQ ID NO: 40286 - DNA, 23 bp, Artificial sequence
  synthetic polynucleotide sequence
cttcctggaaagactgcagtaca

SEQ ID NO: 40287 - DNA, 21 bp, Artificial sequence
  synthetic polynucleotide sequence
gatggaagtgtggtcaccaga

SEQ ID NO: 40288 - DNA, 20 bp, Artificial sequence
  synthetic polynucleotide sequence
gaccttggtgacaaggacca

SEQ ID NO: 40289 - DNA, 21 bp, Artificial sequence
  synthetic polynucleotide sequence
tgcgacccagaaacagaccga

SEQ ID NO: 40290 - DNA, 18 bp, Artificial sequence
  synthetic polynucleotide sequence
ccgatgggccaaggcgca

SEQ ID NO: 40291 - DNA, 21 bp, Artificial sequence
  synthetic polynucleotide sequence
tggggttgcacagtgccagca

SEQ ID NO: 40292 - DNA, 22 bp, Artificial sequence
  synthetic polynucleotide sequence
tgtacacaagaggcattgggga

SEQ ID NO: 40293 - DNA, 20 bp, Artificial sequence
  synthetic polynucleotide sequence
gggtacagccaaagaccgga

SEQ ID NO: 40294 - DNA, 20 bp, Artificial sequence
  synthetic polynucleotide sequence
acacagattcactcagcgca

SEQ ID NO: 40295 - DNA, 19 bp, Artificial sequence
  synthetic polynucleotide sequence
cggaccctgcagaagcaga

SEQ ID NO: 40296 - DNA, 18 bp, Artificial sequence
  synthetic polynucleotide sequence
ggagtggggtgaaggcca

SEQ ID NO: 40297 - DNA, 20 bp, Artificial sequence
  synthetic polynucleotide sequence
cacactgcgctacaggagga

SEQ ID NO: 40298 - DNA, 18 bp, Artificial sequence
  synthetic polynucleotide sequence
cgggatctgtgccgccga

SEQ ID NO: 40299 - DNA, 22 bp, Artificial sequence
  synthetic polynucleotide sequence
atgggaaggaaggtgctgagga

SEQ ID NO: 40300 - DNA, 18 bp, Artificial sequence
  synthetic polynucleotide sequence
gacccatggccctcccga

SEQ ID NO: 40301 - DNA, 22 bp, Artificial sequence
  synthetic polynucleotide sequence
accttccagtgacgctgacaga

SEQ ID NO: 40302 - DNA, 21 bp, Artificial sequence
  synthetic polynucleotide sequence
ttcctggcagccatcaagtga

SEQ ID NO: 40303 - DNA, 20 bp, Artificial sequence
  synthetic polynucleotide sequence
gcactgggggactggatgca

SEQ ID NO: 40304 - DNA, 19 bp, Artificial sequence
  synthetic polynucleotide sequence
cgctgtcggaggtcccaca

SEQ ID NO: 40305 - DNA, 21 bp, Artificial sequence
  synthetic polynucleotide sequence
cgatgctgagcgagagaagga

SEQ ID NO: 40306 - DNA, 21 bp, Artificial sequence
  synthetic polynucleotide sequence
ttcgctgccagaagtatccca

SEQ ID NO: 40307 - DNA, 21 bp, Artificial sequence
  synthetic polynucleotide sequence
gaaagctggcaaggagagcga

SEQ ID NO: 40308 - DNA, 21 bp, Artificial sequence
  synthetic polynucleotide sequence
tctccagctcaccctcactca

SEQ ID NO: 40309 - DNA, 20 bp, Artificial sequence
  synthetic polynucleotide sequence
ctcctcggagaagggacaga

SEQ ID NO: 40310 - DNA, 18 bp, Artificial sequence
  synthetic polynucleotide sequence
tctacgaccaccgcgtga

SEQ ID NO: 40311 - DNA, 21 bp, Artificial sequence
  synthetic polynucleotide sequence
atgatggagaaggcgcgggaa

SEQ ID NO: 40312 - DNA, 19 bp, Artificial sequence
  synthetic polynucleotide sequence
gcacggtactccagccgca

SEQ ID NO: 40313 - DNA, 19 bp, Artificial sequence
  synthetic polynucleotide sequence
gggagacgagtgaaggcga

SEQ ID NO: 40314 - DNA, 18 bp, Artificial sequence
  synthetic polynucleotide sequence
gcagcagcctgttgagca

SEQ ID NO: 40315 - DNA, 20 bp, Artificial sequence
  synthetic polynucleotide sequence
caagccctacccggccagca

SEQ ID NO: 40316 - DNA, 25 bp, Artificial sequence
  synthetic polynucleotide sequence
atcgggacatgaaaagggaagcaca

SEQ ID NO: 40317 - DNA, 20 bp, Artificial sequence
  synthetic polynucleotide sequence
agcaacgtggatgggcggta

SEQ ID NO: 40318 - DNA, 21 bp, Artificial sequence
  synthetic polynucleotide sequence
ctgtagtagctcagcagggca

SEQ ID NO: 40319 - DNA, 18 bp, Artificial sequence
  synthetic polynucleotide sequence
ccaatgaagtggaccgca

SEQ ID NO: 40320 - DNA, 18 bp, Artificial sequence
  synthetic polynucleotide sequence
tgccacaagtgtcagcca

SEQ ID NO: 40321 - DNA, 21 bp, Artificial sequence
  synthetic polynucleotide sequence
tgagagtgtgcgtggagagga

SEQ ID NO: 40322 - DNA, 22 bp, Artificial sequence
  synthetic polynucleotide sequence
tgatccgcacctgctatagaga

SEQ ID NO: 40323 - DNA, 18 bp, Artificial sequence
  synthetic polynucleotide sequence
ggtgggcgacgtgaagga

SEQ ID NO: 40324 - DNA, 18 bp, Artificial sequence
  synthetic polynucleotide sequence
tggctccagctgacagca

SEQ ID NO: 40325 - DNA, 21 bp, Artificial sequence
  synthetic polynucleotide sequence
tgatgctgcaaagagggccca

SEQ ID NO: 40326 - DNA, 21 bp, Artificial sequence
  synthetic polynucleotide sequence
atgcggcctccaacatctcca

SEQ ID NO: 40327 - DNA, 19 bp, Artificial sequence
  synthetic polynucleotide sequence
ggacggcattccccaccca

SEQ ID NO: 40328 - DNA, 19 bp, Artificial sequence
  synthetic polynucleotide sequence
tcctccaacatcacccaca

SEQ ID NO: 40329 - DNA, 21 bp, Artificial sequence
  synthetic polynucleotide sequence
atctcgtatctgccaccgaga

SEQ ID NO: 40330 - DNA, 20 bp, Artificial sequence
  synthetic polynucleotide sequence
gctgtggcagtgtgggagga

SEQ ID NO: 40331 - DNA, 21 bp, Artificial sequence
  synthetic polynucleotide sequence
aaccgccccctaagaagagga

SEQ ID NO: 40332 - DNA, 21 bp, Artificial sequence
  synthetic polynucleotide sequence
agctccggtacatctcccgca

SEQ ID NO: 40333 - DNA, 18 bp, Artificial sequence
  synthetic polynucleotide sequence
caccgcctgcccctggaa

SEQ ID NO: 40334 - DNA, 22 bp, Artificial sequence
  synthetic polynucleotide sequence
ggaagaggaggaatgcttgcca

SEQ ID NO: 40335 - DNA, 21 bp, Artificial sequence
  synthetic polynucleotide sequence
caatgggactgcctcgaccaa

SEQ ID NO: 40336 - DNA, 20 bp, Artificial sequence
  synthetic polynucleotide sequence
gaggaaggctgctgtcccga

SEQ ID NO: 40337 - DNA, 21 bp, Artificial sequence
  synthetic polynucleotide sequence
gcaccacaagcagccacacca

SEQ ID NO: 40338 - DNA, 22 bp, Artificial sequence
  synthetic polynucleotide sequence
aactcagaggctgaaagcagga

SEQ ID NO: 40339 - DNA, 20 bp, Artificial sequence
  synthetic polynucleotide sequence
cgggagaaccagcaccccaa

SEQ ID NO: 40340 - DNA, 19 bp, Artificial sequence
  synthetic polynucleotide sequence
tctccttaaagcggccgga

SEQ ID NO: 40341 - DNA, 18 bp, Artificial sequence
  synthetic polynucleotide sequence
gagccacgctggcagaga

SEQ ID NO: 40342 - DNA, 18 bp, Artificial sequence
  synthetic polynucleotide sequence
aagaggccagcgtggcaa

SEQ ID NO: 40343 - DNA, 21 bp, Artificial sequence
  synthetic polynucleotide sequence
accctccaccacctcctccaa

SEQ ID NO: 40344 - DNA, 21 bp, Artificial sequence
  synthetic polynucleotide sequence
ggtccacctggtaagcctcca

SEQ ID NO: 40345 - DNA, 20 bp, Artificial sequence
  synthetic polynucleotide sequence
gctgagagggtggagcaaga

SEQ ID NO: 40346 - DNA, 22 bp, Artificial sequence
  synthetic polynucleotide sequence
aagacgagaccaagttgagcca

SEQ ID NO: 40347 - DNA, 21 bp, Artificial sequence
  synthetic polynucleotide sequence
cctacacctccagcatgccca

SEQ ID NO: 40348 - DNA, 20 bp, Artificial sequence
  synthetic polynucleotide sequence
ggaccccaggctgttccaga

SEQ ID NO: 40349 - DNA, 20 bp, Artificial sequence
  synthetic polynucleotide sequence
cacccacggctcttcaccca

SEQ ID NO: 40350 - DNA, 20 bp, Artificial sequence
  synthetic polynucleotide sequence
cgtgggtgaagaggcatgga

SEQ ID NO: 40351 - DNA, 21 bp, Artificial sequence
  synthetic polynucleotide sequence
aggttctgctggaggacgcca

SEQ ID NO: 40352 - DNA, 21 bp, Artificial sequence
  synthetic polynucleotide sequence
atctcaggcacgctgtagtca

SEQ ID NO: 40353 - DNA, 20 bp, Artificial sequence
  synthetic polynucleotide sequence
agctccagatggactccgca

SEQ ID NO: 40354 - DNA, 20 bp, Artificial sequence
  synthetic polynucleotide sequence
ggtcgaagaaggggcctgga

SEQ ID NO: 40355 - DNA, 20 bp, Artificial sequence
  synthetic polynucleotide sequence
agggaggacgtcgtcgtcga

SEQ ID NO: 40356 - DNA, 20 bp, Artificial sequence
  synthetic polynucleotide sequence
gtccatccggagctccggga

SEQ ID NO: 40357 - DNA, 20 bp, Artificial sequence
  synthetic polynucleotide sequence
tctccacgccccatcttcga

SEQ ID NO: 40358 - DNA, 18 bp, Artificial sequence
  synthetic polynucleotide sequence
acggagggcgctctggga

SEQ ID NO: 40359 - DNA, 21 bp, Artificial sequence
  synthetic polynucleotide sequence
ctcatcttggccccagagaca

SEQ ID NO: 40360 - DNA, 21 bp, Artificial sequence
  synthetic polynucleotide sequence
gtactggatctgcacagggga

SEQ ID NO: 40361 - DNA, 21 bp, Artificial sequence
  synthetic polynucleotide sequence
cagagacagtgctgcagctga

SEQ ID NO: 40362 - DNA, 21 bp, Artificial sequence
  synthetic polynucleotide sequence
gtactggatctgcacagggga

SEQ ID NO: 40363 - DNA, 19 bp, Artificial sequence
  synthetic polynucleotide sequence
gccaggccgcgtgaaggaa

SEQ ID NO: 40364 - DNA, 18 bp, Artificial sequence
  synthetic polynucleotide sequence
ctcctgagggcagggcga

SEQ ID NO: 40365 - DNA, 21 bp, Artificial sequence
  synthetic polynucleotide sequence
ttggtggggagtcaatgcaga

SEQ ID NO: 40366 - DNA, 20 bp, Artificial sequence
  synthetic polynucleotide sequence
catccttgggcgggcaggta

SEQ ID NO: 40367 - DNA, 21 bp, Artificial sequence
  synthetic polynucleotide sequence
atctcagcctccagcagctca

SEQ ID NO: 40368 - DNA, 18 bp, Artificial sequence
  synthetic polynucleotide sequence
gaggtggaggcccggaga

SEQ ID NO: 40369 - DNA, 19 bp, Artificial sequence
  synthetic polynucleotide sequence
gcccatgccaccccatgca

SEQ ID NO: 40370 - DNA, 20 bp, Artificial sequence
  synthetic polynucleotide sequence
aatcggaggtcgaggaggga

SEQ ID NO: 40371 - DNA, 22 bp, Artificial sequence
  synthetic polynucleotide sequence
gttacctcccagaccaaaggga

SEQ ID NO: 40372 - DNA, 20 bp, Artificial sequence
  synthetic polynucleotide sequence
gggcacacgtggctaatcca

SEQ ID NO: 40373 - DNA, 21 bp, Artificial sequence
  synthetic polynucleotide sequence
ccaagtgtgaggccgactcca

SEQ ID NO: 40374 - DNA, 20 bp, Artificial sequence
  synthetic polynucleotide sequence
gggaactcctcgtcgcaaca

SEQ ID NO: 40375 - DNA, 20 bp, Artificial sequence
  synthetic polynucleotide sequence
ctgcactcagcgacgccgaa

SEQ ID NO: 40376 - DNA, 19 bp, Artificial sequence
  synthetic polynucleotide sequence
gccacgtcgtccggagaga

SEQ ID NO: 40377 - DNA, 20 bp, Artificial sequence
  synthetic polynucleotide sequence
atcaccgccatcctccccca

SEQ ID NO: 40378 - DNA, 25 bp, Artificial sequence
  synthetic polynucleotide sequence
acagaaggaaatcggggtagagaga

SEQ ID NO: 40379 - DNA, 20 bp, Artificial sequence
  synthetic polynucleotide sequence
gagatgacgtcctgccccga

SEQ ID NO: 40380 - DNA, 19 bp, Artificial sequence
  synthetic polynucleotide sequence
gagctgcgggtgggatcca

SEQ ID NO: 40381 - DNA, 18 bp, Artificial sequence
  synthetic polynucleotide sequence
tccagttcagggccagga

SEQ ID NO: 40382 - DNA, 18 bp, Artificial sequence
  synthetic polynucleotide sequence
ggacaatggacgagggca

SEQ ID NO: 40383 - DNA, 18 bp, Artificial sequence
  synthetic polynucleotide sequence
gcagccgcctcccagcta

SEQ ID NO: 40384 - DNA, 19 bp, Artificial sequence
  synthetic polynucleotide sequence
gagtcggtccagctgggga

SEQ ID NO: 40385 - DNA, 22 bp, Artificial sequence
  synthetic polynucleotide sequence
tccatgccaagaccagtgtcca

SEQ ID NO: 40386 - DNA, 20 bp, Artificial sequence
  synthetic polynucleotide sequence
cccttgccaggggatgagca

SEQ ID NO: 40387 - DNA, 20 bp, Artificial sequence
  synthetic polynucleotide sequence
attaagggtgtggctgggaa

SEQ ID NO: 40388 - DNA, 21 bp, Artificial sequence
  synthetic polynucleotide sequence
gtccagcttcccctacaacca

SEQ ID NO: 40389 - DNA, 21 bp, Artificial sequence
  synthetic polynucleotide sequence
tgctgcctctgctgagccaca

SEQ ID NO: 40390 - DNA, 21 bp, Artificial sequence
  synthetic polynucleotide sequence
ccagagagcagtgctgaggga

SEQ ID NO: 40391 - DNA, 20 bp, Artificial sequence
  synthetic polynucleotide sequence
tgtgtcccagtcccaggaga

SEQ ID NO: 40392 - DNA, 20 bp, Artificial sequence
  synthetic polynucleotide sequence
gagctggccctcgtagacca

SEQ ID NO: 40393 - DNA, 21 bp, Artificial sequence
  synthetic polynucleotide sequence
gtagtgccagtggaccaagca

SEQ ID NO: 40394 - DNA, 20 bp, Artificial sequence
  synthetic polynucleotide sequence
ctgggcaataagggaaggca

SEQ ID NO: 40395 - DNA, 21 bp, Artificial sequence
  synthetic polynucleotide sequence
cactggccaagtgaacctgca

SEQ ID NO: 40396 - DNA, 22 bp, Artificial sequence
  synthetic polynucleotide sequence
cacaggcaccataggaatggca

SEQ ID NO: 40397 - DNA, 20 bp, Artificial sequence
  synthetic polynucleotide sequence
ggagggcgtggacgagtgga

SEQ ID NO: 40398 - DNA, 20 bp, Artificial sequence
  synthetic polynucleotide sequence
tgtcgccagcgcagatacca

SEQ ID NO: 40399 - DNA, 20 bp, Artificial sequence
  synthetic polynucleotide sequence
tgacccccaagcctccaaca

SEQ ID NO: 40400 - DNA, 22 bp, Artificial sequence
  synthetic polynucleotide sequence
cccagagctctagacacaggca

SEQ ID NO: 40401 - DNA, 21 bp, Artificial sequence
  synthetic polynucleotide sequence
ctcttcactcccggcaaccta

SEQ ID NO: 40402 - DNA, 20 bp, Artificial sequence
  synthetic polynucleotide sequence
taatccagtcagaaggccca

SEQ ID NO: 40403 - DNA, 20 bp, Artificial sequence
  synthetic polynucleotide sequence
gccgggcagaagggaatcca

SEQ ID NO: 40404 - DNA, 25 bp, Artificial sequence
  synthetic polynucleotide sequence
cacacacactcacacacagatcaga

SEQ ID NO: 40405 - DNA, 19 bp, Artificial sequence
  synthetic polynucleotide sequence
gggggtgaaggcacccaga

SEQ ID NO: 40406 - DNA, 22 bp, Artificial sequence
  synthetic polynucleotide sequence
gggacatgacagcataagcgaa

SEQ ID NO: 40407 - DNA, 18 bp, Artificial sequence
  synthetic polynucleotide sequence
gcaacgttggtgcaggca

SEQ ID NO: 40408 - DNA, 18 bp, Artificial sequence
  synthetic polynucleotide sequence
ccacaccgttgcgggaca

SEQ ID NO: 40409 - DNA, 18 bp, Artificial sequence
  synthetic polynucleotide sequence
ggcagggccagtgagaga

SEQ ID NO: 40410 - DNA, 19 bp, Artificial sequence
  synthetic polynucleotide sequence
ggactgaggacgcagacca

SEQ ID NO: 40411 - DNA, 20 bp, Artificial sequence
  synthetic polynucleotide sequence
ccgcaggaatgagagagcca

SEQ ID NO: 40412 - DNA, 19 bp, Artificial sequence
  synthetic polynucleotide sequence
ctcggagcaggacgaggta

SEQ ID NO: 40413 - DNA, 18 bp, Artificial sequence
  synthetic polynucleotide sequence
ggaggccgccatcgagca

SEQ ID NO: 40414 - DNA, 18 bp, Artificial sequence
  synthetic polynucleotide sequence
tggggttgcggggcctga

SEQ ID NO: 40415 - DNA, 20 bp, Artificial sequence
  synthetic polynucleotide sequence
gactacccagacgagctgca

SEQ ID NO: 40416 - DNA, 19 bp, Artificial sequence
  synthetic polynucleotide sequence
cctccctcaaggaagccca

SEQ ID NO: 40417 - DNA, 20 bp, Artificial sequence
  synthetic polynucleotide sequence
gcaccgtcggcagaagcgga

SEQ ID NO: 40418 - DNA, 20 bp, Artificial sequence
  synthetic polynucleotide sequence
agaggagcctgccatctcca

SEQ ID NO: 40419 - DNA, 19 bp, Artificial sequence
  synthetic polynucleotide sequence
ggcacagctgaggagcaca

SEQ ID NO: 40420 - DNA, 20 bp, Artificial sequence
  synthetic polynucleotide sequence
ctgacaaggctgagagccca

SEQ ID NO: 40421 - DNA, 20 bp, Artificial sequence
  synthetic polynucleotide sequence
ggtgccgactacccagacga

SEQ ID NO: 40422 - DNA, 20 bp, Artificial sequence
  synthetic polynucleotide sequence
gcctccctcgaggaagccca

SEQ ID NO: 40423 - DNA, 18 bp, Artificial sequence
  synthetic polynucleotide sequence
tgcccaaggcgggaagga

SEQ ID NO: 40424 - DNA, 18 bp, Artificial sequence
  synthetic polynucleotide sequence
ccgattgggccgaccaca

SEQ ID NO: 40425 - DNA, 19 bp, Artificial sequence
  synthetic polynucleotide sequence
gaaggtgcctgtgcagaca

SEQ ID NO: 40426 - DNA, 18 bp, Artificial sequence
  synthetic polynucleotide sequence
ccagcctgagatccagca

SEQ ID NO: 40427 - DNA, 20 bp, Artificial sequence
  synthetic polynucleotide sequence
gtgagccctcctgctaagca

SEQ ID NO: 40428 - DNA, 22 bp, Artificial sequence
  synthetic polynucleotide sequence
acatcctcacatagaccccaga

SEQ ID NO: 40429 - DNA, 18 bp, Artificial sequence
  synthetic polynucleotide sequence
cgaggagggcaagaagga

SEQ ID NO: 40430 - DNA, 18 bp, Artificial sequence
  synthetic polynucleotide sequence
ggcacagccctcacccca

SEQ ID NO: 40431 - DNA, 20 bp, Artificial sequence
  synthetic polynucleotide sequence
ggtgctgactacccagacga

SEQ ID NO: 40432 - DNA, 19 bp, Artificial sequence
  synthetic polynucleotide sequence
cctccctcaaggaagccca

SEQ ID NO: 40433 - DNA, 23 bp, Artificial sequence
  synthetic polynucleotide sequence
cggcctctaagagctgagagaca

SEQ ID NO: 40434 - DNA, 20 bp, Artificial sequence
  synthetic polynucleotide sequence
cagggtgctgccagaatcca

SEQ ID NO: 40435 - DNA, 22 bp, Artificial sequence
  synthetic polynucleotide sequence
ggaatcagcccaacgatcaaga

SEQ ID NO: 40436 - DNA, 21 bp, Artificial sequence
  synthetic polynucleotide sequence
ggattcgtcggacacactgca

SEQ ID NO: 40437 - DNA, 18 bp, Artificial sequence
  synthetic polynucleotide sequence
cctgtgccagatgacgga

SEQ ID NO: 40438 - DNA, 19 bp, Artificial sequence
  synthetic polynucleotide sequence
ccaggcctcttcaggacca

SEQ ID NO: 40439 - DNA, 20 bp, Artificial sequence
  synthetic polynucleotide sequence
caagaaaacagtggccgaca

SEQ ID NO: 40440 - DNA, 20 bp, Artificial sequence
  synthetic polynucleotide sequence
gatgacagtagcaacggcca

SEQ ID NO: 40441 - DNA, 18 bp, Artificial sequence
  synthetic polynucleotide sequence
attgtgagctggggccga

SEQ ID NO: 40442 - DNA, 18 bp, Artificial sequence
  synthetic polynucleotide sequence
ctgaccagccagccagca

SEQ ID NO: 40443 - DNA, 20 bp, Artificial sequence
  synthetic polynucleotide sequence
agtggacgcggaggaaggga

SEQ ID NO: 40444 - DNA, 20 bp, Artificial sequence
  synthetic polynucleotide sequence
cacccacgtggcggtgacca

SEQ ID NO: 40445 - DNA, 20 bp, Artificial sequence
  synthetic polynucleotide sequence
gccctcctaaagctcaggga

SEQ ID NO: 40446 - DNA, 20 bp, Artificial sequence
  synthetic polynucleotide sequence
ccagccgattacccagcaca

SEQ ID NO: 40447 - DNA, 18 bp, Artificial sequence
  synthetic polynucleotide sequence
cagaagagcgaggcccca

SEQ ID NO: 40448 - DNA, 18 bp, Artificial sequence
  synthetic polynucleotide sequence
gcagtgggagtgccagga

SEQ ID NO: 40449 - DNA, 21 bp, Artificial sequence
  synthetic polynucleotide sequence
ggcatcagctccctccagaca

SEQ ID NO: 40450 - DNA, 20 bp, Artificial sequence
  synthetic polynucleotide sequence
tacacaccatccccggcaga

SEQ ID NO: 40451 - DNA, 18 bp, Artificial sequence
  synthetic polynucleotide sequence
gcttgggggacccaggaa

SEQ ID NO: 40452 - DNA, 18 bp, Artificial sequence
  synthetic polynucleotide sequence
ccagggcacgtctcacca

SEQ ID NO: 40453 - DNA, 18 bp, Artificial sequence
  synthetic polynucleotide sequence
aggggggatggaggcgga

SEQ ID NO: 40454 - DNA, 20 bp, Artificial sequence
  synthetic polynucleotide sequence
gccgcagtgagaatccacca

SEQ ID NO: 40455 - DNA, 19 bp, Artificial sequence
  synthetic polynucleotide sequence
ggcccctggtgtgcaggaa

SEQ ID NO: 40456 - DNA, 19 bp, Artificial sequence
  synthetic polynucleotide sequence
cgccgaaccacgtcccaga

SEQ ID NO: 40457 - DNA, 20 bp, Artificial sequence
  synthetic polynucleotide sequence
tagccaacctgccctaccaa

SEQ ID NO: 40458 - DNA, 20 bp, Artificial sequence
  synthetic polynucleotide sequence
tataggcatcgcgacactga

SEQ ID NO: 40459 - DNA, 18 bp, Artificial sequence
  synthetic polynucleotide sequence
caacctctgtggcagcca

SEQ ID NO: 40460 - DNA, 18 bp, Artificial sequence
  synthetic polynucleotide sequence
atggggagaggaggccca

SEQ ID NO: 40461 - DNA, 20 bp, Artificial sequence
  synthetic polynucleotide sequence
attgagcggctggccaagga

SEQ ID NO: 40462 - DNA, 21 bp, Artificial sequence
  synthetic polynucleotide sequence
atctcacccatggactggtca

SEQ ID NO: 40463 - DNA, 20 bp, Artificial sequence
  synthetic polynucleotide sequence
ccctagctccccaggtcaga

SEQ ID NO: 40464 - DNA, 21 bp, Artificial sequence
  synthetic polynucleotide sequence
gaaaaccgcccagaatcccca

SEQ ID NO: 40465 - DNA, 18 bp, Artificial sequence
  synthetic polynucleotide sequence
gctgagcagcccagccaa

SEQ ID NO: 40466 - DNA, 18 bp, Artificial sequence
  synthetic polynucleotide sequence
gccggcagaagaaggtga

SEQ ID NO: 40467 - DNA, 21 bp, Artificial sequence
  synthetic polynucleotide sequence
gcagatgtgtccagggagcaa

SEQ ID NO: 40468 - DNA, 21 bp, Artificial sequence
  synthetic polynucleotide sequence
ctagagggcactcatccacca

SEQ ID NO: 40469 - DNA, 20 bp, Artificial sequence
  synthetic polynucleotide sequence
aagccctgcacaagaccaga

SEQ ID NO: 40470 - DNA, 18 bp, Artificial sequence
  synthetic polynucleotide sequence
gaccctcacccaagccga

SEQ ID NO: 40471 - DNA, 21 bp, Artificial sequence
  synthetic polynucleotide sequence
ggggtcagcggcatcaacgta

SEQ ID NO: 40472 - DNA, 21 bp, Artificial sequence
  synthetic polynucleotide sequence
ttctcgaagaacactcgggca

SEQ ID NO: 40473 - DNA, 21 bp, Artificial sequence
  synthetic polynucleotide sequence
cgcctggattaacccacccca

SEQ ID NO: 40474 - DNA, 21 bp, Artificial sequence
  synthetic polynucleotide sequence
agatgtccccaagtgccctga

SEQ ID NO: 40475 - DNA, 20 bp, Artificial sequence
  synthetic polynucleotide sequence
cccagaactgaggaggggca

SEQ ID NO: 40476 - DNA, 25 bp, Artificial sequence
  synthetic polynucleotide sequence
aagcccagatcatctgcaaaccaca

SEQ ID NO: 40477 - DNA, 18 bp, Artificial sequence
  synthetic polynucleotide sequence
agcccgtgctgatcgaga

SEQ ID NO: 40478 - DNA, 18 bp, Artificial sequence
  synthetic polynucleotide sequence
caagggcttatgggccga

SEQ ID NO: 40479 - DNA, 18 bp, Artificial sequence
  synthetic polynucleotide sequence
acgcggagaaccagggca

SEQ ID NO: 40480 - DNA, 18 bp, Artificial sequence
  synthetic polynucleotide sequence
tatagggcagcggcagga

SEQ ID NO: 40481 - DNA, 18 bp, Artificial sequence
  synthetic polynucleotide sequence
cccgatgtcaagggagca

SEQ ID NO: 40482 - DNA, 18 bp, Artificial sequence
  synthetic polynucleotide sequence
ccagcaggtcatcacgga

SEQ ID NO: 40483 - DNA, 18 bp, Artificial sequence
  synthetic polynucleotide sequence
agtgctggaccgcgcgca

SEQ ID NO: 40484 - DNA, 18 bp, Artificial sequence
  synthetic polynucleotide sequence
ccccgctggcgttgcaca

SEQ ID NO: 40485 - DNA, 21 bp, Artificial sequence
  synthetic polynucleotide sequence
ctcgtgccagtgactacagca

SEQ ID NO: 40486 - DNA, 19 bp, Artificial sequence
  synthetic polynucleotide sequence
tgatgcgagtgatccagga

SEQ ID NO: 40487 - DNA, 20 bp, Artificial sequence
  synthetic polynucleotide sequence
aagtccaaggaggccgagga

SEQ ID NO: 40488 - DNA, 20 bp, Artificial sequence
  synthetic polynucleotide sequence
atccccttccagagtggcca

SEQ ID NO: 40489 - DNA, 22 bp, Artificial sequence
  synthetic polynucleotide sequence
tgcaccaccatttccagcagca

SEQ ID NO: 40490 - DNA, 18 bp, Artificial sequence
  synthetic polynucleotide sequence
cggccagctcggtggtga

SEQ ID NO: 40491 - DNA, 20 bp, Artificial sequence
  synthetic polynucleotide sequence
ccccgccacgcattacacca

SEQ ID NO: 40492 - DNA, 20 bp, Artificial sequence
  synthetic polynucleotide sequence
agccaagttgatgcgcgcga

SEQ ID NO: 40493 - DNA, 18 bp, Artificial sequence
  synthetic polynucleotide sequence
cttcgactccagcaggca

SEQ ID NO: 40494 - DNA, 21 bp, Artificial sequence
  synthetic polynucleotide sequence
tcaaccagcatacgaagtgga

SEQ ID NO: 40495 - DNA, 19 bp, Artificial sequence
  synthetic polynucleotide sequence
gaagccaggagaacgagga

SEQ ID NO: 40496 - DNA, 19 bp, Artificial sequence
  synthetic polynucleotide sequence
gtgacaggcacaaacagca

SEQ ID NO: 40497 - DNA, 22 bp, Artificial sequence
  synthetic polynucleotide sequence
gagcgagtgtccaatgaggaga

SEQ ID NO: 40498 - DNA, 20 bp, Artificial sequence
  synthetic polynucleotide sequence
gggccggtagatctggaaga

SEQ ID NO: 40499 - DNA, 18 bp, Artificial sequence
  synthetic polynucleotide sequence
ccagggtaaagcgaccca

SEQ ID NO: 40500 - DNA, 18 bp, Artificial sequence
  synthetic polynucleotide sequence
gggtcactgcggatgcca

SEQ ID NO: 40501 - DNA, 21 bp, Artificial sequence
  synthetic polynucleotide sequence
acacaagctaccagtggtgga

SEQ ID NO: 40502 - DNA, 18 bp, Artificial sequence
  synthetic polynucleotide sequence
gcggctggcactccctga

SEQ ID NO: 40503 - DNA, 21 bp, Artificial sequence
  synthetic polynucleotide sequence
gcatccgcagttacccagtca

SEQ ID NO: 40504 - DNA, 21 bp, Artificial sequence
  synthetic polynucleotide sequence
tggtgggttagagtccgcgaa

SEQ ID NO: 40505 - DNA, 21 bp, Artificial sequence
  synthetic polynucleotide sequence
cgagtctaacccacgggcaca

SEQ ID NO: 40506 - DNA, 22 bp, Artificial sequence
  synthetic polynucleotide sequence
aacagagcaagcatagagccca

SEQ ID NO: 40507 - DNA, 21 bp, Artificial sequence
  synthetic polynucleotide sequence
gattgaagccctgccacccaa

SEQ ID NO: 40508 - DNA, 20 bp, Artificial sequence
  synthetic polynucleotide sequence
gtccagtgtatgcaggccca

SEQ ID NO: 40509 - DNA, 20 bp, Artificial sequence
  synthetic polynucleotide sequence
aaccccagggagaagaagga

SEQ ID NO: 40510 - DNA, 18 bp, Artificial sequence
  synthetic polynucleotide sequence
ccctcggactgaccggga

SEQ ID NO: 40511 - DNA, 22 bp, Artificial sequence
  synthetic polynucleotide sequence
ctgagccactcagaactcacca

SEQ ID NO: 40512 - DNA, 21 bp, Artificial sequence
  synthetic polynucleotide sequence
tgaaagaggcaggcacaagca

SEQ ID NO: 40513 - DNA, 21 bp, Artificial sequence
  synthetic polynucleotide sequence
ccctatgtctcacaggttgca

SEQ ID NO: 40514 - DNA, 20 bp, Artificial sequence
  synthetic polynucleotide sequence
gattcagggtgaatgggtca

SEQ ID NO: 40515 - DNA, 21 bp, Artificial sequence
  synthetic polynucleotide sequence
gccctacatctccagcagcaa

SEQ ID NO: 40516 - DNA, 20 bp, Artificial sequence
  synthetic polynucleotide sequence
tcacagggaggctctgacca

SEQ ID NO: 40517 - DNA, 21 bp, Artificial sequence
  synthetic polynucleotide sequence
gtagaaactgaggaggcagga

SEQ ID NO: 40518 - DNA, 22 bp, Artificial sequence
  synthetic polynucleotide sequence
tgatgtcactctctgaaggaca

SEQ ID NO: 40519 - DNA, 20 bp, Artificial sequence
  synthetic polynucleotide sequence
gtccgcaagccatacaccaa

SEQ ID NO: 40520 - DNA, 21 bp, Artificial sequence
  synthetic polynucleotide sequence
agtgcagtcatacgggctcca

SEQ ID NO: 40521 - DNA, 18 bp, Artificial sequence
  synthetic polynucleotide sequence
tggccaggccctggacca

SEQ ID NO: 40522 - DNA, 18 bp, Artificial sequence
  synthetic polynucleotide sequence
ggggagaggccctctgca

SEQ ID NO: 40523 - DNA, 18 bp, Artificial sequence
  synthetic polynucleotide sequence
gcgcaatcagagcttgca

SEQ ID NO: 40524 - DNA, 22 bp, Artificial sequence
  synthetic polynucleotide sequence
gatacaagacgagacacaggca

SEQ ID NO: 40525 - DNA, 18 bp, Artificial sequence
  synthetic polynucleotide sequence
gagccccgtccgtgggaa

SEQ ID NO: 40526 - DNA, 21 bp, Artificial sequence
  synthetic polynucleotide sequence
tgtaccagctgagctgtagga

SEQ ID NO: 40527 - DNA, 18 bp, Artificial sequence
  synthetic polynucleotide sequence
gtgaatgacggtgcgcaa

SEQ ID NO: 40528 - DNA, 18 bp, Artificial sequence
  synthetic polynucleotide sequence
gccgatggcacagcccca

SEQ ID NO: 40529 - DNA, 22 bp, Artificial sequence
  synthetic polynucleotide sequence
tatcagagtgaccctagtggaa

SEQ ID NO: 40530 - DNA, 19 bp, Artificial sequence
  synthetic polynucleotide sequence
tgacacagctgcagcgcta

SEQ ID NO: 40531 - DNA, 21 bp, Artificial sequence
  synthetic polynucleotide sequence
acagtggagagtgtgacccaa

SEQ ID NO: 40532 - DNA, 21 bp, Artificial sequence
  synthetic polynucleotide sequence
caaaggtcccagatgggtcca

SEQ ID NO: 40533 - DNA, 20 bp, Artificial sequence
  synthetic polynucleotide sequence
caggtacagagggcacgcta

SEQ ID NO: 40534 - DNA, 20 bp, Artificial sequence
  synthetic polynucleotide sequence
acaacaaccaagaggcctca

SEQ ID NO: 40535 - DNA, 18 bp, Artificial sequence
  synthetic polynucleotide sequence
tgccaagtcagtgcgcga

SEQ ID NO: 40536 - DNA, 19 bp, Artificial sequence
  synthetic polynucleotide sequence
ttgccacctgactgaacca

SEQ ID NO: 40537 - DNA, 20 bp, Artificial sequence
  synthetic polynucleotide sequence
agcgggaagctcggtggcaa

SEQ ID NO: 40538 - DNA, 20 bp, Artificial sequence
  synthetic polynucleotide sequence
gtccgtctggggagaagaca

SEQ ID NO: 40539 - DNA, 18 bp, Artificial sequence
  synthetic polynucleotide sequence
gaggctcagcaagtgcca

SEQ ID NO: 40540 - DNA, 18 bp, Artificial sequence
  synthetic polynucleotide sequence
agcggaacatgctccaca

SEQ ID NO: 40541 - DNA, 18 bp, Artificial sequence
  synthetic polynucleotide sequence
agaccggttccagccgaa

SEQ ID NO: 40542 - DNA, 18 bp, Artificial sequence
  synthetic polynucleotide sequence
agctcagtgtccgcagca

SEQ ID NO: 40543 - DNA, 21 bp, Artificial sequence
  synthetic polynucleotide sequence
gatgggagcatgtgtcacgca

SEQ ID NO: 40544 - DNA, 18 bp, Artificial sequence
  synthetic polynucleotide sequence
tcacctcccctggcccca

SEQ ID NO: 40545 - DNA, 20 bp, Artificial sequence
  synthetic polynucleotide sequence
cacgtgagagggcagtggaa

SEQ ID NO: 40546 - DNA, 21 bp, Artificial sequence
  synthetic polynucleotide sequence
cgaacactgaaggttggcaga

SEQ ID NO: 40547 - DNA, 20 bp, Artificial sequence
  synthetic polynucleotide sequence
gttgaaggaaggtcggcaga

SEQ ID NO: 40548 - DNA, 18 bp, Artificial sequence
  synthetic polynucleotide sequence
tcaccatggggcagccga

SEQ ID NO: 40549 - DNA, 22 bp, Artificial sequence
  synthetic polynucleotide sequence
ttgatgaggagcttctgggaga

SEQ ID NO: 40550 - DNA, 22 bp, Artificial sequence
  synthetic polynucleotide sequence
ataaccgaggaagctctctcca

SEQ ID NO: 40551 - DNA, 21 bp, Artificial sequence
  synthetic polynucleotide sequence
ggaaccggatttcaggggcca

SEQ ID NO: 40552 - DNA, 20 bp, Artificial sequence
  synthetic polynucleotide sequence
gtagatggctcgacgggcca

SEQ ID NO: 40553 - DNA, 20 bp, Artificial sequence
  synthetic polynucleotide sequence
actggtccacacagcagcca

SEQ ID NO: 40554 - DNA, 22 bp, Artificial sequence
  synthetic polynucleotide sequence
accatcataccccccataggca

SEQ ID NO: 40555 - DNA, 18 bp, Artificial sequence
  synthetic polynucleotide sequence
aagccatcgcagctggca

SEQ ID NO: 40556 - DNA, 18 bp, Artificial sequence
  synthetic polynucleotide sequence
tcacacctgtaccggcca

SEQ ID NO: 40557 - DNA, 22 bp, Artificial sequence
  synthetic polynucleotide sequence
atcttagccctgaagaggccta

SEQ ID NO: 40558 - DNA, 20 bp, Artificial sequence
  synthetic polynucleotide sequence
ctggtgcagcaggtcactga

SEQ ID NO: 40559 - DNA, 21 bp, Artificial sequence
  synthetic polynucleotide sequence
atgcagcatataagccaggca

SEQ ID NO: 40560 - DNA, 18 bp, Artificial sequence
  synthetic polynucleotide sequence
cgatggtccacaccggca

SEQ ID NO: 40561 - DNA, 22 bp, Artificial sequence
  synthetic polynucleotide sequence
aaagtggatgatctgaggggga

SEQ ID NO: 40562 - DNA, 21 bp, Artificial sequence
  synthetic polynucleotide sequence
tgtcatccatcagcaccccta

SEQ ID NO: 40563 - DNA, 20 bp, Artificial sequence
  synthetic polynucleotide sequence
catgatgcaggtggaagaga

SEQ ID NO: 40564 - DNA, 20 bp, Artificial sequence
  synthetic polynucleotide sequence
taactcgaatgaagcacgca

SEQ ID NO: 40565 - DNA, 18 bp, Artificial sequence
  synthetic polynucleotide sequence
ggatgccatcggcaccaa

SEQ ID NO: 40566 - DNA, 20 bp, Artificial sequence
  synthetic polynucleotide sequence
ctggttcagaagctccagca

SEQ ID NO: 40567 - DNA, 18 bp, Artificial sequence
  synthetic polynucleotide sequence
ggaacacggactgggcaa

SEQ ID NO: 40568 - DNA, 22 bp, Artificial sequence
  synthetic polynucleotide sequence
atctaggacttgaaggtcagca

SEQ ID NO: 40569 - DNA, 18 bp, Artificial sequence
  synthetic polynucleotide sequence
acgcggacatcggaggca

SEQ ID NO: 40570 - DNA, 18 bp, Artificial sequence
  synthetic polynucleotide sequence
ccacagccaggtgggcca

SEQ ID NO: 40571 - DNA, 23 bp, Artificial sequence
  synthetic polynucleotide sequence
aaaattgaattcccaccccccaa

SEQ ID NO: 40572 - DNA, 20 bp, Artificial sequence
  synthetic polynucleotide sequence
ctcctggcatgagctcagca

SEQ ID NO: 40573 - DNA, 21 bp, Artificial sequence
  synthetic polynucleotide sequence
tgttgggcagatcgtgggtga

SEQ ID NO: 40574 - DNA, 19 bp, Artificial sequence
  synthetic polynucleotide sequence
tcccagggtcctcatgaga

SEQ ID NO: 40575 - DNA, 19 bp, Artificial sequence
  synthetic polynucleotide sequence
gtcctaaccatgccggaga

SEQ ID NO: 40576 - DNA, 18 bp, Artificial sequence
  synthetic polynucleotide sequence
ctgccacaggttccacca

SEQ ID NO: 40577 - DNA, 20 bp, Artificial sequence
  synthetic polynucleotide sequence
tgggcatgctcagctggaca

SEQ ID NO: 40578 - DNA, 19 bp, Artificial sequence
  synthetic polynucleotide sequence
tacaatctcatcccggcca

SEQ ID NO: 40579 - DNA, 20 bp, Artificial sequence
  synthetic polynucleotide sequence
atcatgctcaacaccccaga

SEQ ID NO: 40580 - DNA, 18 bp, Artificial sequence
  synthetic polynucleotide sequence
gctagcctgagccacgca

SEQ ID NO: 40581 - DNA, 19 bp, Artificial sequence
  synthetic polynucleotide sequence
tgtccaaaaggcggagtca

SEQ ID NO: 40582 - DNA, 18 bp, Artificial sequence
  synthetic polynucleotide sequence
gtcagtcgcgcacgctca

SEQ ID NO: 40583 - DNA, 18 bp, Artificial sequence
  synthetic polynucleotide sequence
acctgggtgcagccccga

SEQ ID NO: 40584 - DNA, 18 bp, Artificial sequence
  synthetic polynucleotide sequence
gggcctggtgctccacca

SEQ ID NO: 40585 - DNA, 18 bp, Artificial sequence
  synthetic polynucleotide sequence
ccaggggccacctacaga

SEQ ID NO: 40586 - DNA, 18 bp, Artificial sequence
  synthetic polynucleotide sequence
ggaactccagcacggcca

SEQ ID NO: 40587 - DNA, 18 bp, Artificial sequence
  synthetic polynucleotide sequence
ggctgcaatgctgcgcca

SEQ ID NO: 40588 - DNA, 20 bp, Artificial sequence
  synthetic polynucleotide sequence
cacagtgagcagtccagcca

SEQ ID NO: 40589 - DNA, 18 bp, Artificial sequence
  synthetic polynucleotide sequence
aaggcccctcagcacaca

SEQ ID NO: 40590 - DNA, 20 bp, Artificial sequence
  synthetic polynucleotide sequence
atgagtgagcgcttgaggga

SEQ ID NO: 40591 - DNA, 21 bp, Artificial sequence
  synthetic polynucleotide sequence
gccaggcggaatcagcagaca

SEQ ID NO: 40592 - DNA, 20 bp, Artificial sequence
  synthetic polynucleotide sequence
gttgggatccacacctggga

SEQ ID NO: 40593 - DNA, 22 bp, Artificial sequence
  synthetic polynucleotide sequence
aaagaatgccccagtggagcta

SEQ ID NO: 40594 - DNA, 21 bp, Artificial sequence
  synthetic polynucleotide sequence
tgtagttcagggaagggctga

SEQ ID NO: 40595 - DNA, 22 bp, Artificial sequence
  synthetic polynucleotide sequence
atgaggagctggaagatgcaga

SEQ ID NO: 40596 - DNA, 20 bp, Artificial sequence
  synthetic polynucleotide sequence
caatcggtgacccagggcca

SEQ ID NO: 40597 - DNA, 20 bp, Artificial sequence
  synthetic polynucleotide sequence
ccagatgtcagcctgcagga

SEQ ID NO: 40598 - DNA, 18 bp, Artificial sequence
  synthetic polynucleotide sequence
gtgcagggcgaccacgga

SEQ ID NO: 40599 - DNA, 18 bp, Artificial sequence
  synthetic polynucleotide sequence
ggctgcctgccaaggaca

SEQ ID NO: 40600 - DNA, 18 bp, Artificial sequence
  synthetic polynucleotide sequence
atgcacccagcgatctca

SEQ ID NO: 40601 - DNA, 18 bp, Artificial sequence
  synthetic polynucleotide sequence
aggcccacaaagaggcca

SEQ ID NO: 40602 - DNA, 21 bp, Artificial sequence
  synthetic polynucleotide sequence
gagccgaactccacaatctca

SEQ ID NO: 40603 - DNA, 18 bp, Artificial sequence
  synthetic polynucleotide sequence
agcagccaagcagcccca

SEQ ID NO: 40604 - DNA, 18 bp, Artificial sequence
  synthetic polynucleotide sequence
ccatgaccatcagccgga

SEQ ID NO: 40605 - DNA, 20 bp, Artificial sequence
  synthetic polynucleotide sequence
gaaggtgctggagagggtga

SEQ ID NO: 40606 - DNA, 18 bp, Artificial sequence
  synthetic polynucleotide sequence
atgcaccaaggcccggta

SEQ ID NO: 40607 - DNA, 20 bp, Artificial sequence
  synthetic polynucleotide sequence
agccgcagaccctggtgcaa

SEQ ID NO: 40608 - DNA, 20 bp, Artificial sequence
  synthetic polynucleotide sequence
ggtgtccaagcgtgcacaca

SEQ ID NO: 40609 - DNA, 22 bp, Artificial sequence
  synthetic polynucleotide sequence
tctactgctgagagatgaccga

SEQ ID NO: 40610 - DNA, 20 bp, Artificial sequence
  synthetic polynucleotide sequence
tatcaggcctatcaccagca

SEQ ID NO: 40611 - DNA, 20 bp, Artificial sequence
  synthetic polynucleotide sequence
cacccacacaccagtcggca

SEQ ID NO: 40612 - DNA, 18 bp, Artificial sequence
  synthetic polynucleotide sequence
agcgagctcctgggggca

SEQ ID NO: 40613 - DNA, 18 bp, Artificial sequence
  synthetic polynucleotide sequence
cctcagaatccaccggca

SEQ ID NO: 40614 - DNA, 18 bp, Artificial sequence
  synthetic polynucleotide sequence
caatggacaacacgccga

SEQ ID NO: 40615 - DNA, 19 bp, Artificial sequence
  synthetic polynucleotide sequence
tccgggaggaggtatcaca

SEQ ID NO: 40616 - DNA, 20 bp, Artificial sequence
  synthetic polynucleotide sequence
cagggggaagaccactgcca

SEQ ID NO: 40617 - DNA, 21 bp, Artificial sequence
  synthetic polynucleotide sequence
gtacggccttcagcagtcaca

SEQ ID NO: 40618 - DNA, 20 bp, Artificial sequence
  synthetic polynucleotide sequence
gagaggctcatcctgcccca

SEQ ID NO: 40619 - DNA, 20 bp, Artificial sequence
  synthetic polynucleotide sequence
catctggcagccacccagga

SEQ ID NO: 40620 - DNA, 19 bp, Artificial sequence
  synthetic polynucleotide sequence
tccggagccattggcagga

SEQ ID NO: 40621 - DNA, 20 bp, Artificial sequence
  synthetic polynucleotide sequence
cagaggaccgagaggaggca

SEQ ID NO: 40622 - DNA, 20 bp, Artificial sequence
  synthetic polynucleotide sequence
tggccaagggtcaccgggga

SEQ ID NO: 40623 - DNA, 21 bp, Artificial sequence
  synthetic polynucleotide sequence
tgggaccagaaggagccgcaa

SEQ ID NO: 40624 - DNA, 19 bp, Artificial sequence
  synthetic polynucleotide sequence
tcctctaccaaagccacca

SEQ ID NO: 40625 - DNA, 18 bp, Artificial sequence
  synthetic polynucleotide sequence
gacgcagccaacagctga

SEQ ID NO: 40626 - DNA, 21 bp, Artificial sequence
  synthetic polynucleotide sequence
gaaagcatcagcaggaggaca

SEQ ID NO: 40627 - DNA, 21 bp, Artificial sequence
  synthetic polynucleotide sequence
gagtgcgggaaagtggacaca

SEQ ID NO: 40628 - DNA, 21 bp, Artificial sequence
  synthetic polynucleotide sequence
tggtaggtcctgggactgcca

SEQ ID NO: 40629 - DNA, 18 bp, Artificial sequence
  synthetic polynucleotide sequence
ggccagaggccacaggca

SEQ ID NO: 40630 - DNA, 18 bp, Artificial sequence
  synthetic polynucleotide sequence
gcacatgctggactcgga

SEQ ID NO: 40631 - DNA, 18 bp, Artificial sequence
  synthetic polynucleotide sequence
ccatcgcagtgcaggaga

SEQ ID NO: 40632 - DNA, 19 bp, Artificial sequence
  synthetic polynucleotide sequence
tcctctccacagtccacca

SEQ ID NO: 40633 - DNA, 22 bp, Artificial sequence
  synthetic polynucleotide sequence
aaagaccgcagtagaggactca

SEQ ID NO: 40634 - DNA, 21 bp, Artificial sequence
  synthetic polynucleotide sequence
ttgagcctcaaatgcctcgca

SEQ ID NO: 40635 - DNA, 18 bp, Artificial sequence
  synthetic polynucleotide sequence
ccaacacagtgcccgaca

SEQ ID NO: 40636 - DNA, 18 bp, Artificial sequence
  synthetic polynucleotide sequence
ccgtgcacaccatccaca

SEQ ID NO: 40637 - DNA, 20 bp, Artificial sequence
  synthetic polynucleotide sequence
tgagaagtgagccagcccta

SEQ ID NO: 40638 - DNA, 21 bp, Artificial sequence
  synthetic polynucleotide sequence
cattgcttgagacagctggga

SEQ ID NO: 40639 - DNA, 19 bp, Artificial sequence
  synthetic polynucleotide sequence
tcaagaagccgggctccaa

SEQ ID NO: 40640 - DNA, 20 bp, Artificial sequence
  synthetic polynucleotide sequence
atcctttgacgacgccccca

SEQ ID NO: 40641 - DNA, 18 bp, Artificial sequence
  synthetic polynucleotide sequence
caacctgcattggaccca

SEQ ID NO: 40642 - DNA, 20 bp, Artificial sequence
  synthetic polynucleotide sequence
tgagactccaggcataccca

SEQ ID NO: 40643 - DNA, 20 bp, Artificial sequence
  synthetic polynucleotide sequence
ccaccatcagccactctgca

SEQ ID NO: 40644 - DNA, 22 bp, Artificial sequence
  synthetic polynucleotide sequence
atgaagctcaatgagggcctga

SEQ ID NO: 40645 - DNA, 20 bp, Artificial sequence
  synthetic polynucleotide sequence
gagtccgggagtcctgcaga

SEQ ID NO: 40646 - DNA, 20 bp, Artificial sequence
  synthetic polynucleotide sequence
cctctttgccaggaccggca

SEQ ID NO: 40647 - DNA, 18 bp, Artificial sequence
  synthetic polynucleotide sequence
tggccaggtcaccactga

SEQ ID NO: 40648 - DNA, 18 bp, Artificial sequence
  synthetic polynucleotide sequence
ggaaggtgcgacggctga

SEQ ID NO: 40649 - DNA, 18 bp, Artificial sequence
  synthetic polynucleotide sequence
ccgccctgaaggaacgaa

SEQ ID NO: 40650 - DNA, 18 bp, Artificial sequence
  synthetic polynucleotide sequence
gagggctcctggtcacca

SEQ ID NO: 40651 - DNA, 20 bp, Artificial sequence
  synthetic polynucleotide sequence
tgtgctggcgatcctcacca

SEQ ID NO: 40652 - DNA, 19 bp, Artificial sequence
  synthetic polynucleotide sequence
tcaagccgttggctggaga

SEQ ID NO: 40653 - DNA, 18 bp, Artificial sequence
  synthetic polynucleotide sequence
gatggggccatctccaca

SEQ ID NO: 40654 - DNA, 18 bp, Artificial sequence
  synthetic polynucleotide sequence
ccaggatggacagcagca

SEQ ID NO: 40655 - DNA, 21 bp, Artificial sequence
  synthetic polynucleotide sequence
gaagaccagccgcgtatcaga

SEQ ID NO: 40656 - DNA, 20 bp, Artificial sequence
  synthetic polynucleotide sequence
ggctgcagtgagagtggcca

SEQ ID NO: 40657 - DNA, 18 bp, Artificial sequence
  synthetic polynucleotide sequence
gctctgcgtgccccccaa

SEQ ID NO: 40658 - DNA, 20 bp, Artificial sequence
  synthetic polynucleotide sequence
cattcctaggctgcccccca

SEQ ID NO: 40659 - DNA, 21 bp, Artificial sequence
  synthetic polynucleotide sequence
aactgagcacacccgaacaca

SEQ ID NO: 40660 - DNA, 21 bp, Artificial sequence
  synthetic polynucleotide sequence
tgaaggtcaggttcgaaggca

SEQ ID NO: 40661 - DNA, 20 bp, Artificial sequence
  synthetic polynucleotide sequence
cacaggcctggtgctcaaga

SEQ ID NO: 40662 - DNA, 20 bp, Artificial sequence
  synthetic polynucleotide sequence
tgtgacgcaggggaggtaga

SEQ ID NO: 40663 - DNA, 21 bp, Artificial sequence
  synthetic polynucleotide sequence
tacgcttacctcaccgacaca

SEQ ID NO: 40664 - DNA, 22 bp, Artificial sequence
  synthetic polynucleotide sequence
atcatgccgtacagacagagga

SEQ ID NO: 40665 - DNA, 21 bp, Artificial sequence
  synthetic polynucleotide sequence
tggatgacccgaagccccaca

SEQ ID NO: 40666 - DNA, 21 bp, Artificial sequence
  synthetic polynucleotide sequence
actgggagatgtagaagggca

SEQ ID NO: 40667 - DNA, 20 bp, Artificial sequence
  synthetic polynucleotide sequence
attcccagtcagaggcgcta

SEQ ID NO: 40668 - DNA, 22 bp, Artificial sequence
  synthetic polynucleotide sequence
ggattgcaagttccgccactga

SEQ ID NO: 40669 - DNA, 22 bp, Artificial sequence
  synthetic polynucleotide sequence
ttcattaccaactcggcccaga

SEQ ID NO: 40670 - DNA, 22 bp, Artificial sequence
  synthetic polynucleotide sequence
atgagaatagccgtgacctcca

SEQ ID NO: 40671 - DNA, 21 bp, Artificial sequence
  synthetic polynucleotide sequence
cagcaaaaagcccacccagga

SEQ ID NO: 40672 - DNA, 20 bp, Artificial sequence
  synthetic polynucleotide sequence
cgtctccacggacagcagaa

SEQ ID NO: 40673 - DNA, 18 bp, Artificial sequence
  synthetic polynucleotide sequence
gccacagcaacaccagca

SEQ ID NO: 40674 - DNA, 18 bp, Artificial sequence
  synthetic polynucleotide sequence
tgcggcagcccaccacga

SEQ ID NO: 40675 - DNA, 20 bp, Artificial sequence
  synthetic polynucleotide sequence
cggctcctacagctaccgga

SEQ ID NO: 40676 - DNA, 19 bp, Artificial sequence
  synthetic polynucleotide sequence
ggctgtacagcagcgcgta

SEQ ID NO: 40677 - DNA, 18 bp, Artificial sequence
  synthetic polynucleotide sequence
cgtggagatggtgggcca

SEQ ID NO: 40678 - DNA, 18 bp, Artificial sequence
  synthetic polynucleotide sequence
ggcgaagcagttggcgca

SEQ ID NO: 40679 - DNA, 19 bp, Artificial sequence
  synthetic polynucleotide sequence
gaggagacggaccacctca

SEQ ID NO: 40680 - DNA, 20 bp, Artificial sequence
  synthetic polynucleotide sequence
caggaggcctaaggatggca

SEQ ID NO: 40681 - DNA, 18 bp, Artificial sequence
  synthetic polynucleotide sequence
gggccagtacaccgtcca

SEQ ID NO: 40682 - DNA, 18 bp, Artificial sequence
  synthetic polynucleotide sequence
ggtggccaggttgcagga

SEQ ID NO: 40683 - DNA, 18 bp, Artificial sequence
  synthetic polynucleotide sequence
gaccggctgaacagccca

SEQ ID NO: 40684 - DNA, 17 bp, Artificial sequence
  synthetic polynucleotide sequence
gtgacagccagcccaca

SEQ ID NO: 40685 - DNA, 20 bp, Artificial sequence
  synthetic polynucleotide sequence
ccggaacgacatggagacca

SEQ ID NO: 40686 - DNA, 18 bp, Artificial sequence
  synthetic polynucleotide sequence
tgtaggtcacggagcgga

SEQ ID NO: 40687 - DNA, 21 bp, Artificial sequence
  synthetic polynucleotide sequence
caagcgactcaagagcaggca

SEQ ID NO: 40688 - DNA, 20 bp, Artificial sequence
  synthetic polynucleotide sequence
cagcacgccatacaccgcca

SEQ ID NO: 40689 - DNA, 20 bp, Artificial sequence
  synthetic polynucleotide sequence
ggagtcgccaccggagagaa

SEQ ID NO: 40690 - DNA, 20 bp, Artificial sequence
  synthetic polynucleotide sequence
ttgtgaacggggcaggggga

SEQ ID NO: 40691 - DNA, 18 bp, Artificial sequence
  synthetic polynucleotide sequence
cacaacctgccagacgga

SEQ ID NO: 40692 - DNA, 20 bp, Artificial sequence
  synthetic polynucleotide sequence
ctggccaaaagcagaaacga

SEQ ID NO: 40693 - DNA, 20 bp, Artificial sequence
  synthetic polynucleotide sequence
ctggcagaaggaggcagaga

SEQ ID NO: 40694 - DNA, 18 bp, Artificial sequence
  synthetic polynucleotide sequence
gacaggacaggagcccga

SEQ ID NO: 40695 - DNA, 18 bp, Artificial sequence
  synthetic polynucleotide sequence
gcgcaccggagaggacga

SEQ ID NO: 40696 - DNA, 18 bp, Artificial sequence
  synthetic polynucleotide sequence
gcgtagaagcggaaggca

SEQ ID NO: 40697 - DNA, 20 bp, Artificial sequence
  synthetic polynucleotide sequence
gacgaccactctcccacaga

SEQ ID NO: 40698 - DNA, 18 bp, Artificial sequence
  synthetic polynucleotide sequence
aggaggaggcggtcacca

SEQ ID NO: 40699 - DNA, 18 bp, Artificial sequence
  synthetic polynucleotide sequence
gggacagttggcatgcca

SEQ ID NO: 40700 - DNA, 18 bp, Artificial sequence
  synthetic polynucleotide sequence
gccccacgactgagccca

SEQ ID NO: 40701 - DNA, 21 bp, Artificial sequence
  synthetic polynucleotide sequence
tgtggcagaacagctccgtga

SEQ ID NO: 40702 - DNA, 20 bp, Artificial sequence
  synthetic polynucleotide sequence
tagcgggggaggataaggca

SEQ ID NO: 40703 - DNA, 19 bp, Artificial sequence
  synthetic polynucleotide sequence
ccggagtactggaagccga

SEQ ID NO: 40704 - DNA, 18 bp, Artificial sequence
  synthetic polynucleotide sequence
gatggtcgctccacagca

SEQ ID NO: 40705 - DNA, 20 bp, Artificial sequence
  synthetic polynucleotide sequence
tgcctactggaagccaagca

SEQ ID NO: 40706 - DNA, 19 bp, Artificial sequence
  synthetic polynucleotide sequence
catctagtccggagcggga

SEQ ID NO: 40707 - DNA, 22 bp, Artificial sequence
  synthetic polynucleotide sequence
aatggctgcgtaagaagctgca

SEQ ID NO: 40708 - DNA, 20 bp, Artificial sequence
  synthetic polynucleotide sequence
gggaaccagcatctctggga

SEQ ID NO: 40709 - DNA, 18 bp, Artificial sequence
  synthetic polynucleotide sequence
caacaggacgtgggccaa

SEQ ID NO: 40710 - DNA, 18 bp, Artificial sequence
  synthetic polynucleotide sequence
ggacgccagggacacgga

SEQ ID NO: 40711 - DNA, 18 bp, Artificial sequence
  synthetic polynucleotide sequence
tggcggccagcacacgca

SEQ ID NO: 40712 - DNA, 20 bp, Artificial sequence
  synthetic polynucleotide sequence
ctcgtggaaagagtgtggca

SEQ ID NO: 40713 - DNA, 22 bp, Artificial sequence
  synthetic polynucleotide sequence
atgacaaggggaagtccatcca

SEQ ID NO: 40714 - DNA, 21 bp, Artificial sequence
  synthetic polynucleotide sequence
ggagttaggggacacctccga

SEQ ID NO: 40715 - DNA, 18 bp, Artificial sequence
  synthetic polynucleotide sequence
catgaccagcctccagca

SEQ ID NO: 40716 - DNA, 18 bp, Artificial sequence
  synthetic polynucleotide sequence
gtctcgtctgcccaagca

SEQ ID NO: 40717 - DNA, 18 bp, Artificial sequence
  synthetic polynucleotide sequence
tacagaccccctccgcaa

SEQ ID NO: 40718 - DNA, 20 bp, Artificial sequence
  synthetic polynucleotide sequence
gggctggtgagcgtaggaga

SEQ ID NO: 40719 - DNA, 18 bp, Artificial sequence
  synthetic polynucleotide sequence
agctcatggccaagggca

SEQ ID NO: 40720 - DNA, 20 bp, Artificial sequence
  synthetic polynucleotide sequence
gataagcctggctaacccga

SEQ ID NO: 40721 - DNA, 19 bp, Artificial sequence
  synthetic polynucleotide sequence
cccctcagcaccaagcaga

SEQ ID NO: 40722 - DNA, 18 bp, Artificial sequence
  synthetic polynucleotide sequence
tgaggcccagggcagaca

SEQ ID NO: 40723 - DNA, 20 bp, Artificial sequence
  synthetic polynucleotide sequence
ctggagctgagtgcaagcaa

SEQ ID NO: 40724 - DNA, 19 bp, Artificial sequence
  synthetic polynucleotide sequence
cccaggcctggaactggta

SEQ ID NO: 40725 - DNA, 21 bp, Artificial sequence
  synthetic polynucleotide sequence
gcctgtgccggatcatggaca

SEQ ID NO: 40726 - DNA, 20 bp, Artificial sequence
  synthetic polynucleotide sequence
ctccaggttccgctgcagga

SEQ ID NO: 40727 - DNA, 21 bp, Artificial sequence
  synthetic polynucleotide sequence
gtgcaccaccatccaaccaga

SEQ ID NO: 40728 - DNA, 20 bp, Artificial sequence
  synthetic polynucleotide sequence
gagctctcccaaggcctgca

SEQ ID NO: 40729 - DNA, 21 bp, Artificial sequence
  synthetic polynucleotide sequence
gagctccaccccctaatcaga

SEQ ID NO: 40730 - DNA, 22 bp, Artificial sequence
  synthetic polynucleotide sequence
caaagcaagtgcaaccagcaca

SEQ ID NO: 40731 - DNA, 18 bp, Artificial sequence
  synthetic polynucleotide sequence
ccaacgccacgctcagca

SEQ ID NO: 40732 - DNA, 18 bp, Artificial sequence
  synthetic polynucleotide sequence
gccagtccacaacggtga

SEQ ID NO: 40733 - DNA, 19 bp, Artificial sequence
  synthetic polynucleotide sequence
ttgcagagcactccaacca

SEQ ID NO: 40734 - DNA, 20 bp, Artificial sequence
  synthetic polynucleotide sequence
acagggaacttctccaggca

SEQ ID NO: 40735 - DNA, 22 bp, Artificial sequence
  synthetic polynucleotide sequence
tccaaaccctgctcaccagcaa

SEQ ID NO: 40736 - DNA, 21 bp, Artificial sequence
  synthetic polynucleotide sequence
tgctttgggactggagccaca

SEQ ID NO: 40737 - DNA, 18 bp, Artificial sequence
  synthetic polynucleotide sequence
gccaaaggggagccgtca

SEQ ID NO: 40738 - DNA, 18 bp, Artificial sequence
  synthetic polynucleotide sequence
ccgtgaggaccgtagcca

SEQ ID NO: 40739 - DNA, 19 bp, Artificial sequence
  synthetic polynucleotide sequence
gcaagaggaaagggcacga

SEQ ID NO: 40740 - DNA, 19 bp, Artificial sequence
  synthetic polynucleotide sequence
gttggagtacaaggcggga

SEQ ID NO: 40741 - DNA, 18 bp, Artificial sequence
  synthetic polynucleotide sequence
aaccaccaaggacccgca

SEQ ID NO: 40742 - DNA, 20 bp, Artificial sequence
  synthetic polynucleotide sequence
tgaagggggagaaggtgtca

SEQ ID NO: 40743 - DNA, 21 bp, Artificial sequence
  synthetic polynucleotide sequence
gacgagcaatcagcactggca

SEQ ID NO: 40744 - DNA, 20 bp, Artificial sequence
  synthetic polynucleotide sequence
agcgacagctctgagcagga

SEQ ID NO: 40745 - DNA, 18 bp, Artificial sequence
  synthetic polynucleotide sequence
ggtccgtcgccataccaa

SEQ ID NO: 40746 - DNA, 18 bp, Artificial sequence
  synthetic polynucleotide sequence
gcctcagcatcatgggca

SEQ ID NO: 40747 - DNA, 20 bp, Artificial sequence
  synthetic polynucleotide sequence
cccagctggtacgatccaca

SEQ ID NO: 40748 - DNA, 23 bp, Artificial sequence
  synthetic polynucleotide sequence
cagtgaacacagcagccagaaca

SEQ ID NO: 40749 - DNA, 19 bp, Artificial sequence
  synthetic polynucleotide sequence
tggagtccctgaatcacca

SEQ ID NO: 40750 - DNA, 21 bp, Artificial sequence
  synthetic polynucleotide sequence
tctaccagagagaaggtgcca

SEQ ID NO: 40751 - DNA, 21 bp, Artificial sequence
  synthetic polynucleotide sequence
agtgatcccagcatgtggaca

SEQ ID NO: 40752 - DNA, 21 bp, Artificial sequence
  synthetic polynucleotide sequence
tagaggggagagagcctgtga

SEQ ID NO: 40753 - DNA, 18 bp, Artificial sequence
  synthetic polynucleotide sequence
aggtgctggacatcccga

SEQ ID NO: 40754 - DNA, 20 bp, Artificial sequence
  synthetic polynucleotide sequence
ctggcagagagtctgcacca

SEQ ID NO: 40755 - DNA, 20 bp, Artificial sequence
  synthetic polynucleotide sequence
atggcctccaagtggtacca

SEQ ID NO: 40756 - DNA, 22 bp, Artificial sequence
  synthetic polynucleotide sequence
tgtagaggatgttggcaacaga

SEQ ID NO: 40757 - DNA, 20 bp, Artificial sequence
  synthetic polynucleotide sequence
gagcaggtcctgcagcgcca

SEQ ID NO: 40758 - DNA, 20 bp, Artificial sequence
  synthetic polynucleotide sequence
ccgaggaccaggtcctggga

SEQ ID NO: 40759 - DNA, 21 bp, Artificial sequence
  synthetic polynucleotide sequence
agaggactgcaccatcgccta

SEQ ID NO: 40760 - DNA, 20 bp, Artificial sequence
  synthetic polynucleotide sequence
gtcggaggagtcatcgggca

SEQ ID NO: 40761 - DNA, 18 bp, Artificial sequence
  synthetic polynucleotide sequence
gcctggcctgaccatgga

SEQ ID NO: 40762 - DNA, 19 bp, Artificial sequence
  synthetic polynucleotide sequence
tccagcactgcaatggaca

SEQ ID NO: 40763 - DNA, 21 bp, Artificial sequence
  synthetic polynucleotide sequence
aagagtgggactgaggagcga

SEQ ID NO: 40764 - DNA, 20 bp, Artificial sequence
  synthetic polynucleotide sequence
agtggacgatgatgggggca

SEQ ID NO: 40765 - DNA, 18 bp, Artificial sequence
  synthetic polynucleotide sequence
tgtgaccaactgcgggga

SEQ ID NO: 40766 - DNA, 18 bp, Artificial sequence
  synthetic polynucleotide sequence
aagctgaggacaccccca

SEQ ID NO: 40767 - DNA, 21 bp, Artificial sequence
  synthetic polynucleotide sequence
agcgccggtcagtaaagcaca

SEQ ID NO: 40768 - DNA, 19 bp, Artificial sequence
  synthetic polynucleotide sequence
cgtccggccaatccctgca

SEQ ID NO: 40769 - DNA, 21 bp, Artificial sequence
  synthetic polynucleotide sequence
tggtccattgcagtgcaggca

SEQ ID NO: 40770 - DNA, 21 bp, Artificial sequence
  synthetic polynucleotide sequence
tcatgcgtgacaccgtctgga

SEQ ID NO: 40771 - DNA, 18 bp, Artificial sequence
  synthetic polynucleotide sequence
agtcagggaaccacccca

SEQ ID NO: 40772 - DNA, 20 bp, Artificial sequence
  synthetic polynucleotide sequence
ctgcaccaccttgtagcaga

SEQ ID NO: 40773 - DNA, 20 bp, Artificial sequence
  synthetic polynucleotide sequence
aagtcacagcggagagcaga

SEQ ID NO: 40774 - DNA, 18 bp, Artificial sequence
  synthetic polynucleotide sequence
ccacgtgatggccaagga

SEQ ID NO: 40775 - DNA, 18 bp, Artificial sequence
  synthetic polynucleotide sequence
caccagctggccagacca

SEQ ID NO: 40776 - DNA, 18 bp, Artificial sequence
  synthetic polynucleotide sequence
gtgcgcccaacaccagca

SEQ ID NO: 40777 - DNA, 22 bp, Artificial sequence
  synthetic polynucleotide sequence
aggaggatgagcaggacacaga

SEQ ID NO: 40778 - DNA, 18 bp, Artificial sequence
  synthetic polynucleotide sequence
gctggacgcctctccaca

SEQ ID NO: 40779 - DNA, 19 bp, Artificial sequence
  synthetic polynucleotide sequence
gggagcatggagaggagca

SEQ ID NO: 40780 - DNA, 18 bp, Artificial sequence
  synthetic polynucleotide sequence
acccaggccttgagggga

SEQ ID NO: 40781 - DNA, 18 bp, Artificial sequence
  synthetic polynucleotide sequence
aggccagggtcatccaga

SEQ ID NO: 40782 - DNA, 18 bp, Artificial sequence
  synthetic polynucleotide sequence
cctccgtcagcatcacga

SEQ ID NO: 40783 - DNA, 18 bp, Artificial sequence
  synthetic polynucleotide sequence
agaccctgccacgagcaa

SEQ ID NO: 40784 - DNA, 18 bp, Artificial sequence
  synthetic polynucleotide sequence
gtaacgtgtgcctgccga

SEQ ID NO: 40785 - DNA, 18 bp, Artificial sequence
  synthetic polynucleotide sequence
gatcccaagaggcccgaa

SEQ ID NO: 40786 - DNA, 20 bp, Artificial sequence
  synthetic polynucleotide sequence
gagaaggatgaggcacacga

SEQ ID NO: 40787 - DNA, 19 bp, Artificial sequence
  synthetic polynucleotide sequence
gggtcccctgccacagaca

SEQ ID NO: 40788 - DNA, 21 bp, Artificial sequence
  synthetic polynucleotide sequence
gtagtggaattggcgcacaga

SEQ ID NO: 40789 - DNA, 20 bp, Artificial sequence
  synthetic polynucleotide sequence
cagcgaatggcacagaagga

SEQ ID NO: 40790 - DNA, 18 bp, Artificial sequence
  synthetic polynucleotide sequence
atgacagcgcgaggctca

SEQ ID NO: 40791 - DNA, 20 bp, Artificial sequence
  synthetic polynucleotide sequence
caagagagaagccggagcca

SEQ ID NO: 40792 - DNA, 18 bp, Artificial sequence
  synthetic polynucleotide sequence
cccacagtgaacggggca

SEQ ID NO: 40793 - DNA, 18 bp, Artificial sequence
  synthetic polynucleotide sequence
cgatggggagagcagcaa

SEQ ID NO: 40794 - DNA, 20 bp, Artificial sequence
  synthetic polynucleotide sequence
gtggacacaactgggcagga

SEQ ID NO: 40795 - DNA, 20 bp, Artificial sequence
  synthetic polynucleotide sequence
gtgcctaccaagcagagcca

SEQ ID NO: 40796 - DNA, 18 bp, Artificial sequence
  synthetic polynucleotide sequence
gggcatggtcatagggca

SEQ ID NO: 40797 - DNA, 20 bp, Artificial sequence
  synthetic polynucleotide sequence
tggaaggcggcacagaggca

SEQ ID NO: 40798 - DNA, 20 bp, Artificial sequence
  synthetic polynucleotide sequence
tgtgggaagggcgggatgga

SEQ ID NO: 40799 - DNA, 21 bp, Artificial sequence
  synthetic polynucleotide sequence
gtgcccacagcaaatgctgca

SEQ ID NO: 40800 - DNA, 20 bp, Artificial sequence
  synthetic polynucleotide sequence
ctgtccgtcccacgccagca

SEQ ID NO: 40801 - DNA, 20 bp, Artificial sequence
  synthetic polynucleotide sequence
ggccagaggacaacaagcca

SEQ ID NO: 40802 - DNA, 21 bp, Artificial sequence
  synthetic polynucleotide sequence
aggaaccccatgctctggcca

SEQ ID NO: 40803 - DNA, 21 bp, Artificial sequence
  synthetic polynucleotide sequence
ttgtccactgcagtgcaggaa

SEQ ID NO: 40804 - DNA, 22 bp, Artificial sequence
  synthetic polynucleotide sequence
atccatacgaagctggcagaca

SEQ ID NO: 40805 - DNA, 20 bp, Artificial sequence
  synthetic polynucleotide sequence
cagttcacagactggccgga

SEQ ID NO: 40806 - DNA, 18 bp, Artificial sequence
  synthetic polynucleotide sequence
ccacgccttcataccgca

SEQ ID NO: 40807 - DNA, 19 bp, Artificial sequence
  synthetic polynucleotide sequence
tcaccagctggcctgacca

SEQ ID NO: 40808 - DNA, 20 bp, Artificial sequence
  synthetic polynucleotide sequence
agtggaccactatgggccca

SEQ ID NO: 40809 - DNA, 19 bp, Artificial sequence
  synthetic polynucleotide sequence
ggtgtcagccgctacacca

SEQ ID NO: 40810 - DNA, 18 bp, Artificial sequence
  synthetic polynucleotide sequence
ctgcaatcccactgggca

SEQ ID NO: 40811 - DNA, 19 bp, Artificial sequence
  synthetic polynucleotide sequence
ggaggagtgacggcaggaa

SEQ ID NO: 40812 - DNA, 18 bp, Artificial sequence
  synthetic polynucleotide sequence
tcaggcaatgctgcacca

SEQ ID NO: 40813 - DNA, 18 bp, Artificial sequence
  synthetic polynucleotide sequence
gcgggacaagttgcgcaa

SEQ ID NO: 40814 - DNA, 18 bp, Artificial sequence
  synthetic polynucleotide sequence
ccacctggccctcgcgga

SEQ ID NO: 40815 - DNA, 18 bp, Artificial sequence
  synthetic polynucleotide sequence
ttggacgcgcgaccggca

SEQ ID NO: 40816 - DNA, 20 bp, Artificial sequence
  synthetic polynucleotide sequence
gtccagctcatcatgcacca

SEQ ID NO: 40817 - DNA, 21 bp, Artificial sequence
  synthetic polynucleotide sequence
gacgagcaagacacacacaga

SEQ ID NO: 40818 - DNA, 18 bp, Artificial sequence
  synthetic polynucleotide sequence
gcatgagagcactgggca

SEQ ID NO: 40819 - DNA, 21 bp, Artificial sequence
  synthetic polynucleotide sequence
gccccagatgagaccacccta

SEQ ID NO: 40820 - DNA, 18 bp, Artificial sequence
  synthetic polynucleotide sequence
ccttggggtagggccgga

SEQ ID NO: 40821 - DNA, 21 bp, Artificial sequence
  synthetic polynucleotide sequence
agattgaccctgctacgggaa

SEQ ID NO: 40822 - DNA, 19 bp, Artificial sequence
  synthetic polynucleotide sequence
ttcagtcgtgctcaccaca

SEQ ID NO: 40823 - DNA, 22 bp, Artificial sequence
  synthetic polynucleotide sequence
tgatccttgacgaggagagaga

SEQ ID NO: 40824 - DNA, 18 bp, Artificial sequence
  synthetic polynucleotide sequence
cccatggtggagagggca

SEQ ID NO: 40825 - DNA, 18 bp, Artificial sequence
  synthetic polynucleotide sequence
ggccgacgccgtactgga

SEQ ID NO: 40826 - DNA, 18 bp, Artificial sequence
  synthetic polynucleotide sequence
aactccccagcgtgcaga

SEQ ID NO: 40827 - DNA, 21 bp, Artificial sequence
  synthetic polynucleotide sequence
tgaagagcgccagattgcaca

SEQ ID NO: 40828 - DNA, 19 bp, Artificial sequence
  synthetic polynucleotide sequence
tcccatggtggagagggca

SEQ ID NO: 40829 - DNA, 20 bp, Artificial sequence
  synthetic polynucleotide sequence
agagttcccgacaggtgcca

SEQ ID NO: 40830 - DNA, 20 bp, Artificial sequence
  synthetic polynucleotide sequence
gcagttggccccctgcacaa

SEQ ID NO: 40831 - DNA, 19 bp, Artificial sequence
  synthetic polynucleotide sequence
cagcccgtcacccacctca

SEQ ID NO: 40832 - DNA, 19 bp, Artificial sequence
  synthetic polynucleotide sequence
tcatatcgaacgacgcgga

SEQ ID NO: 40833 - DNA, 21 bp, Artificial sequence
  synthetic polynucleotide sequence
aggcgaggaggaggatgcaga

SEQ ID NO: 40834 - DNA, 20 bp, Artificial sequence
  synthetic polynucleotide sequence
gtcgtacacttcagccacca

SEQ ID NO: 40835 - DNA, 21 bp, Artificial sequence
  synthetic polynucleotide sequence
ccatgaacgacggtccccaca

SEQ ID NO: 40836 - DNA, 19 bp, Artificial sequence
  synthetic polynucleotide sequence
gttgcgatgtggggccgga

SEQ ID NO: 40837 - DNA, 21 bp, Artificial sequence
  synthetic polynucleotide sequence
aacacggtcgacctgaagaca

SEQ ID NO: 40838 - DNA, 20 bp, Artificial sequence
  synthetic polynucleotide sequence
ataaggcactgtgaggacca

SEQ ID NO: 40839 - DNA, 22 bp, Artificial sequence
  synthetic polynucleotide sequence
gaaagatacagaggtccgcaga

SEQ ID NO: 40840 - DNA, 21 bp, Artificial sequence
  synthetic polynucleotide sequence
ggctgaacgtctccagtggca

SEQ ID NO: 40841 - DNA, 20 bp, Artificial sequence
  synthetic polynucleotide sequence
accattgcgctgcccgcgca

SEQ ID NO: 40842 - DNA, 20 bp, Artificial sequence
  synthetic polynucleotide sequence
caaggaggtgccctcgggca

SEQ ID NO: 40843 - DNA, 21 bp, Artificial sequence
  synthetic polynucleotide sequence
taccgcaatgccatcaccgta

SEQ ID NO: 40844 - DNA, 18 bp, Artificial sequence
  synthetic polynucleotide sequence
cccccaccacgtcgctca

SEQ ID NO: 40845 - DNA, 18 bp, Artificial sequence
  synthetic polynucleotide sequence
tcggcaccctccccacca

SEQ ID NO: 40846 - DNA, 20 bp, Artificial sequence
  synthetic polynucleotide sequence
tatcatgccagtcccccgca

SEQ ID NO: 40847 - DNA, 20 bp, Artificial sequence
  synthetic polynucleotide sequence
gacgctgcagcaggtcaaca

SEQ ID NO: 40848 - DNA, 20 bp, Artificial sequence
  synthetic polynucleotide sequence
ccaggatgtagcggcaggca

SEQ ID NO: 40849 - DNA, 21 bp, Artificial sequence
  synthetic polynucleotide sequence
cagcttgtcacaagagaggca

SEQ ID NO: 40850 - DNA, 20 bp, Artificial sequence
  synthetic polynucleotide sequence
gtgaatgacgcgagctcgca

SEQ ID NO: 40851 - DNA, 22 bp, Artificial sequence
  synthetic polynucleotide sequence
atcaccgatgtgggagaacaga

SEQ ID NO: 40852 - DNA, 20 bp, Artificial sequence
  synthetic polynucleotide sequence
cggtaagtccgctcaaggca

SEQ ID NO: 40853 - DNA, 22 bp, Artificial sequence
  synthetic polynucleotide sequence
tcaaaaggtgtgtggaagggca

SEQ ID NO: 40854 - DNA, 20 bp, Artificial sequence
  synthetic polynucleotide sequence
tgagaacgaggtcccctgga

SEQ ID NO: 40855 - DNA, 21 bp, Artificial sequence
  synthetic polynucleotide sequence
ccaagatcccctgggcaagca

SEQ ID NO: 40856 - DNA, 19 bp, Artificial sequence
  synthetic polynucleotide sequence
ccgaactgtggcccctgca

SEQ ID NO: 40857 - DNA, 19 bp, Artificial sequence
  synthetic polynucleotide sequence
cgaggaggatgagctggga

SEQ ID NO: 40858 - DNA, 18 bp, Artificial sequence
  synthetic polynucleotide sequence
ctccagcagccatcagca

SEQ ID NO: 40859 - DNA, 18 bp, Artificial sequence
  synthetic polynucleotide sequence
agcaacccagagcccaca

SEQ ID NO: 40860 - DNA, 18 bp, Artificial sequence
  synthetic polynucleotide sequence
tggcgagctcctagggca

SEQ ID NO: 40861 - DNA, 18 bp, Artificial sequence
  synthetic polynucleotide sequence
ccccacccacgctgcaca

SEQ ID NO: 40862 - DNA, 18 bp, Artificial sequence
  synthetic polynucleotide sequence
ccgggaccagtgtgagga

SEQ ID NO: 40863 - DNA, 18 bp, Artificial sequence
  synthetic polynucleotide sequence
ggcgattcagtgggcaga

SEQ ID NO: 40864 - DNA, 20 bp, Artificial sequence
  synthetic polynucleotide sequence
gtcagctgaagcagtcacga

SEQ ID NO: 40865 - DNA, 20 bp, Artificial sequence
  synthetic polynucleotide sequence
gcaggaggatggagtcgcga

SEQ ID NO: 40866 - DNA, 21 bp, Artificial sequence
  synthetic polynucleotide sequence
tgtccagggagtagatgagga

SEQ ID NO: 40867 - DNA, 18 bp, Artificial sequence
  synthetic polynucleotide sequence
ccacggtgtcgcaactga

SEQ ID NO: 40868 - DNA, 18 bp, Artificial sequence
  synthetic polynucleotide sequence
atccatgaggaccccgga

SEQ ID NO: 40869 - DNA, 18 bp, Artificial sequence
  synthetic polynucleotide sequence
ctgtccccagggtccaca

SEQ ID NO: 40870 - DNA, 18 bp, Artificial sequence
  synthetic polynucleotide sequence
cgccgactcactggcaca

SEQ ID NO: 40871 - DNA, 18 bp, Artificial sequence
  synthetic polynucleotide sequence
ccgcacggagtggtcgga

SEQ ID NO: 40872 - DNA, 18 bp, Artificial sequence
  synthetic polynucleotide sequence
tcggaccggtcctcggga

SEQ ID NO: 40873 - DNA, 20 bp, Artificial sequence
  synthetic polynucleotide sequence
ctgtgacgcctcaggacaga

SEQ ID NO: 40874 - DNA, 18 bp, Artificial sequence
  synthetic polynucleotide sequence
cagtcaggtgggccacga

SEQ ID NO: 40875 - DNA, 25 bp, Artificial sequence
  synthetic polynucleotide sequence
gagcgctggatgaaagaagactgca

SEQ ID NO: 40876 - DNA, 20 bp, Artificial sequence
  synthetic polynucleotide sequence
gacagggagccgggggacaa

SEQ ID NO: 40877 - DNA, 21 bp, Artificial sequence
  synthetic polynucleotide sequence
ccaccatggatctgaggagga

SEQ ID NO: 40878 - DNA, 21 bp, Artificial sequence
  synthetic polynucleotide sequence
tgtagagggtggagttggcga

SEQ ID NO: 40879 - DNA, 19 bp, Artificial sequence
  synthetic polynucleotide sequence
ggaggggaaagacgcctca

SEQ ID NO: 40880 - DNA, 18 bp, Artificial sequence
  synthetic polynucleotide sequence
tggcgaagagcacccgga

SEQ ID NO: 40881 - DNA, 18 bp, Artificial sequence
  synthetic polynucleotide sequence
gcgcaagcgccgctacca

SEQ ID NO: 40882 - DNA, 21 bp, Artificial sequence
  synthetic polynucleotide sequence
gggcaaacaggacgcgtgaca

SEQ ID NO: 40883 - DNA, 18 bp, Artificial sequence
  synthetic polynucleotide sequence
cgccattcgtgaacggca

SEQ ID NO: 40884 - DNA, 19 bp, Artificial sequence
  synthetic polynucleotide sequence
gcttgaggcagaaggcaca

SEQ ID NO: 40885 - DNA, 20 bp, Artificial sequence
  synthetic polynucleotide sequence
accactcgaccctgctcgaa

SEQ ID NO: 40886 - DNA, 20 bp, Artificial sequence
  synthetic polynucleotide sequence
gcaggactgttggccaagga

SEQ ID NO: 40887 - DNA, 19 bp, Artificial sequence
  synthetic polynucleotide sequence
tcagaagccaggttcccaa

SEQ ID NO: 40888 - DNA, 18 bp, Artificial sequence
  synthetic polynucleotide sequence
gcacatgggcttgggaga

SEQ ID NO: 40889 - DNA, 20 bp, Artificial sequence
  synthetic polynucleotide sequence
ctcagtcggcagccaagcca

SEQ ID NO: 40890 - DNA, 20 bp, Artificial sequence
  synthetic polynucleotide sequence
ggaccttcccgtacagagca

SEQ ID NO: 40891 - DNA, 18 bp, Artificial sequence
  synthetic polynucleotide sequence
agaacagcacccaggcca

SEQ ID NO: 40892 - DNA, 18 bp, Artificial sequence
  synthetic polynucleotide sequence
gcagctcccgtgtgcgga

SEQ ID NO: 40893 - DNA, 22 bp, Artificial sequence
  synthetic polynucleotide sequence
cgaacacgagagctacagtcca

SEQ ID NO: 40894 - DNA, 18 bp, Artificial sequence
  synthetic polynucleotide sequence
ctgggctggagggggtca

SEQ ID NO: 40895 - DNA, 21 bp, Artificial sequence
  synthetic polynucleotide sequence
aagcctacgtcgacatccaca

SEQ ID NO: 40896 - DNA, 20 bp, Artificial sequence
  synthetic polynucleotide sequence
catcttggccgtccccagca

SEQ ID NO: 40897 - DNA, 22 bp, Artificial sequence
  synthetic polynucleotide sequence
ccagtcgcgtaagacaacagca

SEQ ID NO: 40898 - DNA, 20 bp, Artificial sequence
  synthetic polynucleotide sequence
caggtgcaggggctggagga

SEQ ID NO: 40899 - DNA, 18 bp, Artificial sequence
  synthetic polynucleotide sequence
ccccaaggagtggaccaa

SEQ ID NO: 40900 - DNA, 18 bp, Artificial sequence
  synthetic polynucleotide sequence
aggtcggagggctccaca

SEQ ID NO: 40901 - DNA, 20 bp, Artificial sequence
  synthetic polynucleotide sequence
gagaagctgctccctcgaca

SEQ ID NO: 40902 - DNA, 18 bp, Artificial sequence
  synthetic polynucleotide sequence
gccacgccattcacagca

SEQ ID NO: 40903 - DNA, 19 bp, Artificial sequence
  synthetic polynucleotide sequence
ccaagagagtggacgcgga

SEQ ID NO: 40904 - DNA, 18 bp, Artificial sequence
  synthetic polynucleotide sequence
ggaaggctccacacccca

SEQ ID NO: 40905 - DNA, 21 bp, Artificial sequence
  synthetic polynucleotide sequence
gacgcagaataagccacgaca

SEQ ID NO: 40906 - DNA, 21 bp, Artificial sequence
  synthetic polynucleotide sequence
gaggcctcacataagatggca

SEQ ID NO: 40907 - DNA, 18 bp, Artificial sequence
  synthetic polynucleotide sequence
accgtgagtgcacaggca

SEQ ID NO: 40908 - DNA, 18 bp, Artificial sequence
  synthetic polynucleotide sequence
gcagagatcgcaggccca

SEQ ID NO: 40909 - DNA, 21 bp, Artificial sequence
  synthetic polynucleotide sequence
ccaaccgtcacgcaactgcca

SEQ ID NO: 40910 - DNA, 21 bp, Artificial sequence
  synthetic polynucleotide sequence
gtctgcgtagccactgtagca

SEQ ID NO: 40911 - DNA, 22 bp, Artificial sequence
  synthetic polynucleotide sequence
tgcatctgaccagcctgactca

SEQ ID NO: 40912 - DNA, 20 bp, Artificial sequence
  synthetic polynucleotide sequence
gctgacttccccagcctgga

SEQ ID NO: 40913 - DNA, 22 bp, Artificial sequence
  synthetic polynucleotide sequence
aagatggtggcctgaaagtgga

SEQ ID NO: 40914 - DNA, 20 bp, Artificial sequence
  synthetic polynucleotide sequence
tcctgaactcgctgcagcca

SEQ ID NO: 40915 - DNA, 21 bp, Artificial sequence
  synthetic polynucleotide sequence
agacatcctcacaccaccaga

SEQ ID NO: 40916 - DNA, 21 bp, Artificial sequence
  synthetic polynucleotide sequence
gctcccatcacacctcctcca

SEQ ID NO: 40917 - DNA, 18 bp, Artificial sequence
  synthetic polynucleotide sequence
cctcagcgctgcggggaa

SEQ ID NO: 40918 - DNA, 19 bp, Artificial sequence
  synthetic polynucleotide sequence
gaactccagcagcgccgga

SEQ ID NO: 40919 - DNA, 18 bp, Artificial sequence
  synthetic polynucleotide sequence
tggcccgccttgaccaca

SEQ ID NO: 40920 - DNA, 20 bp, Artificial sequence
  synthetic polynucleotide sequence
caggttgaggtagtggcgca

SEQ ID NO: 40921 - DNA, 20 bp, Artificial sequence
  synthetic polynucleotide sequence
ctcagagacccaaggcacca

SEQ ID NO: 40922 - DNA, 18 bp, Artificial sequence
  synthetic polynucleotide sequence
gggccgtgagataagcga

SEQ ID NO: 40923 - DNA, 19 bp, Artificial sequence
  synthetic polynucleotide sequence
caaggaggagccagagcca

SEQ ID NO: 40924 - DNA, 20 bp, Artificial sequence
  synthetic polynucleotide sequence
gtctgcaggtcacctccaga

SEQ ID NO: 40925 - DNA, 19 bp, Artificial sequence
  synthetic polynucleotide sequence
catcgaccatctccagcca

SEQ ID NO: 40926 - DNA, 18 bp, Artificial sequence
  synthetic polynucleotide sequence
tggccatgccgtacccga

SEQ ID NO: 40927 - DNA, 22 bp, Artificial sequence
  synthetic polynucleotide sequence
atggcacctacagagatgccaa

SEQ ID NO: 40928 - DNA, 20 bp, Artificial sequence
  synthetic polynucleotide sequence
ctggtgggagaaccggcgca

SEQ ID NO: 40929 - DNA, 18 bp, Artificial sequence
  synthetic polynucleotide sequence
tcagcaccctcaatccca

SEQ ID NO: 40930 - DNA, 20 bp, Artificial sequence
  synthetic polynucleotide sequence
taaggcacgagcaagttcca

SEQ ID NO: 40931 - DNA, 20 bp, Artificial sequence
  synthetic polynucleotide sequence
ctacagccacttccctcgca

SEQ ID NO: 40932 - DNA, 21 bp, Artificial sequence
  synthetic polynucleotide sequence
agatgagatggagcacgggta

SEQ ID NO: 40933 - DNA, 18 bp, Artificial sequence
  synthetic polynucleotide sequence
acgaggaagaccacgcca

SEQ ID NO: 40934 - DNA, 18 bp, Artificial sequence
  synthetic polynucleotide sequence
accgccttctccacgcca

SEQ ID NO: 40935 - DNA, 20 bp, Artificial sequence
  synthetic polynucleotide sequence
aagagagcccacagacgcca

SEQ ID NO: 40936 - DNA, 20 bp, Artificial sequence
  synthetic polynucleotide sequence
gtgaagctctcagccaccga

SEQ ID NO: 40937 - DNA, 21 bp, Artificial sequence
  synthetic polynucleotide sequence
accgctcgtctacaccccaga

SEQ ID NO: 40938 - DNA, 19 bp, Artificial sequence
  synthetic polynucleotide sequence
cccccagccagttgtcgga

SEQ ID NO: 40939 - DNA, 22 bp, Artificial sequence
  synthetic polynucleotide sequence
ttgaagacagtggaccagcaca

SEQ ID NO: 40940 - DNA, 21 bp, Artificial sequence
  synthetic polynucleotide sequence
caagggccttcaagtaccgga

SEQ ID NO: 40941 - DNA, 20 bp, Artificial sequence
  synthetic polynucleotide sequence
ctggacaggctgctcacaga

SEQ ID NO: 40942 - DNA, 18 bp, Artificial sequence
  synthetic polynucleotide sequence
ccggtcacatgagaggca

SEQ ID NO: 40943 - DNA, 22 bp, Artificial sequence
  synthetic polynucleotide sequence
aagcagaatccccacagcgaga

SEQ ID NO: 40944 - DNA, 22 bp, Artificial sequence
  synthetic polynucleotide sequence
attcaccaggggaatgagacca

SEQ ID NO: 40945 - DNA, 22 bp, Artificial sequence
  synthetic polynucleotide sequence
aagccccttccgtgaaacccaa

SEQ ID NO: 40946 - DNA, 21 bp, Artificial sequence
  synthetic polynucleotide sequence
cgagtgacaaagggagcggga

SEQ ID NO: 40947 - DNA, 18 bp, Artificial sequence
  synthetic polynucleotide sequence
cgctagccacttcgagca

SEQ ID NO: 40948 - DNA, 18 bp, Artificial sequence
  synthetic polynucleotide sequence
acgtcccacacgggcaca

SEQ ID NO: 40949 - DNA, 21 bp, Artificial sequence
  synthetic polynucleotide sequence
ccaggggtgaggaagaggaga

SEQ ID NO: 40950 - DNA, 21 bp, Artificial sequence
  synthetic polynucleotide sequence
ggctggagaagtcaaccccga

SEQ ID NO: 40951 - DNA, 20 bp, Artificial sequence
  synthetic polynucleotide sequence
gtggagaagcgcttcccgga

SEQ ID NO: 40952 - DNA, 21 bp, Artificial sequence
  synthetic polynucleotide sequence
gtgtgattcccacagaggcca

SEQ ID NO: 40953 - DNA, 21 bp, Artificial sequence
  synthetic polynucleotide sequence
gtcagcacgagagacagccaa

SEQ ID NO: 40954 - DNA, 21 bp, Artificial sequence
  synthetic polynucleotide sequence
tcgagcacctcatctggccga

SEQ ID NO: 40955 - DNA, 21 bp, Artificial sequence
  synthetic polynucleotide sequence
accagcgctcaagacggagga

SEQ ID NO: 40956 - DNA, 20 bp, Artificial sequence
  synthetic polynucleotide sequence
caccgagaactcccgggtca

SEQ ID NO: 40957 - DNA, 21 bp, Artificial sequence
  synthetic polynucleotide sequence
gagcagccaaggccaaagcta

SEQ ID NO: 40958 - DNA, 20 bp, Artificial sequence
  synthetic polynucleotide sequence
tacttcgaaccccaagggca

SEQ ID NO: 40959 - DNA, 21 bp, Artificial sequence
  synthetic polynucleotide sequence
ccagtcccaaccacgtcgtca

SEQ ID NO: 40960 - DNA, 21 bp, Artificial sequence
  synthetic polynucleotide sequence
gtgcagctgaaatggagggga

SEQ ID NO: 40961 - DNA, 21 bp, Artificial sequence
  synthetic polynucleotide sequence
aaccggggcaagagacaagca

SEQ ID NO: 40962 - DNA, 19 bp, Artificial sequence
  synthetic polynucleotide sequence
cgggtgatgccctcaggga

SEQ ID NO: 40963 - DNA, 19 bp, Artificial sequence
  synthetic polynucleotide sequence
ggagagaggaccccgccta

SEQ ID NO: 40964 - DNA, 18 bp, Artificial sequence
  synthetic polynucleotide sequence
gtacacggcctgggggga

SEQ ID NO: 40965 - DNA, 20 bp, Artificial sequence
  synthetic polynucleotide sequence
ggaagcatgtgcaggagaca

SEQ ID NO: 40966 - DNA, 18 bp, Artificial sequence
  synthetic polynucleotide sequence
gcagggagacgcaaggaa

SEQ ID NO: 40967 - DNA, 19 bp, Artificial sequence
  synthetic polynucleotide sequence
cccgcgacgacgagtacga

SEQ ID NO: 40968 - DNA, 22 bp, Artificial sequence
  synthetic polynucleotide sequence
caataaggcacctacagctcca

SEQ ID NO: 40969 - DNA, 21 bp, Artificial sequence
  synthetic polynucleotide sequence
catcgccaagcacctgaccta

SEQ ID NO: 40970 - DNA, 18 bp, Artificial sequence
  synthetic polynucleotide sequence
cagtgggcacagcccgca

SEQ ID NO: 40971 - DNA, 21 bp, Artificial sequence
  synthetic polynucleotide sequence
gcagcttgggaactgccacca

SEQ ID NO: 40972 - DNA, 19 bp, Artificial sequence
  synthetic polynucleotide sequence
tccatgaccctgacaagca

SEQ ID NO: 40973 - DNA, 21 bp, Artificial sequence
  synthetic polynucleotide sequence
ccaacccacgtgcaggtcaca

SEQ ID NO: 40974 - DNA, 20 bp, Artificial sequence
  synthetic polynucleotide sequence
tagcaatccaggtagctcga

SEQ ID NO: 40975 - DNA, 20 bp, Artificial sequence
  synthetic polynucleotide sequence
ctcagcatccagggcgccaa

SEQ ID NO: 40976 - DNA, 21 bp, Artificial sequence
  synthetic polynucleotide sequence
cgatgtagtcctgcaggcgga

SEQ ID NO: 40977 - DNA, 20 bp, Artificial sequence
  synthetic polynucleotide sequence
gctgcccagactaaagccca

SEQ ID NO: 40978 - DNA, 21 bp, Artificial sequence
  synthetic polynucleotide sequence
gattgtggtccaggatggcga

SEQ ID NO: 40979 - DNA, 21 bp, Artificial sequence
  synthetic polynucleotide sequence
gtactaccacctgacccacga

SEQ ID NO: 40980 - DNA, 21 bp, Artificial sequence
  synthetic polynucleotide sequence
aggtctccatgatccgcacca

SEQ ID NO: 40981 - DNA, 18 bp, Artificial sequence
  synthetic polynucleotide sequence
ggaggaagcagcccccca

SEQ ID NO: 40982 - DNA, 21 bp, Artificial sequence
  synthetic polynucleotide sequence
gaagtcaacacccacggtgga

SEQ ID NO: 40983 - DNA, 20 bp, Artificial sequence
  synthetic polynucleotide sequence
gtgcagaaggagcaggccga

SEQ ID NO: 40984 - DNA, 20 bp, Artificial sequence
  synthetic polynucleotide sequence
gagcaagatgtcccgggcca

SEQ ID NO: 40985 - DNA, 22 bp, Artificial sequence
  synthetic polynucleotide sequence
agctggttgacagatgcaagga

SEQ ID NO: 40986 - DNA, 19 bp, Artificial sequence
  synthetic polynucleotide sequence
tcttggcagcctcaaggaa

SEQ ID NO: 40987 - DNA, 21 bp, Artificial sequence
  synthetic polynucleotide sequence
actcctcgcacatctccacca

SEQ ID NO: 40988 - DNA, 20 bp, Artificial sequence
  synthetic polynucleotide sequence
ctgccctgcagtgtcccaga

SEQ ID NO: 40989 - DNA, 21 bp, Artificial sequence
  synthetic polynucleotide sequence
ttcggccaaactgaaccacca

SEQ ID NO: 40990 - DNA, 21 bp, Artificial sequence
  synthetic polynucleotide sequence
ttgttcagagccacagctgca

SEQ ID NO: 40991 - DNA, 21 bp, Artificial sequence
  synthetic polynucleotide sequence
ctgttcgaggatgcctgcaca

SEQ ID NO: 40992 - DNA, 21 bp, Artificial sequence
  synthetic polynucleotide sequence
ccttggccatgagcacgaaga

SEQ ID NO: 40993 - DNA, 20 bp, Artificial sequence
  synthetic polynucleotide sequence
catgacgatggcagctgaga

SEQ ID NO: 40994 - DNA, 20 bp, Artificial sequence
  synthetic polynucleotide sequence
tggacttctcagcaccacca

SEQ ID NO: 40995 - DNA, 22 bp, Artificial sequence
  synthetic polynucleotide sequence
tggacaacaccacagccaagga

SEQ ID NO: 40996 - DNA, 18 bp, Artificial sequence
  synthetic polynucleotide sequence
cccccagaggctgctcca

SEQ ID NO: 40997 - DNA, 22 bp, Artificial sequence
  synthetic polynucleotide sequence
agaaggaagagtgcagtcccaa

SEQ ID NO: 40998 - DNA, 19 bp, Artificial sequence
  synthetic polynucleotide sequence
ggccggcacatcctgctca

SEQ ID NO: 40999 - DNA, 20 bp, Artificial sequence
  synthetic polynucleotide sequence
atgcagaatctgtgggagca

SEQ ID NO: 41000 - DNA, 22 bp, Artificial sequence
  synthetic polynucleotide sequence
tccagaagaacagcaccctcca

SEQ ID NO: 41001 - DNA, 22 bp, Artificial sequence
  synthetic polynucleotide sequence
gagatgcaaaggactacgccga

SEQ ID NO: 41002 - DNA, 22 bp, Artificial sequence
  synthetic polynucleotide sequence
aggttggcgtcagtggatggaa

SEQ ID NO: 41003 - DNA, 21 bp, Artificial sequence
  synthetic polynucleotide sequence
tgaggatccagaactaacgca

SEQ ID NO: 41004 - DNA, 20 bp, Artificial sequence
  synthetic polynucleotide sequence
gaccggagtgacttccacca

SEQ ID NO: 41005 - DNA, 20 bp, Artificial sequence
  synthetic polynucleotide sequence
gaactgcgcagcctagagga

SEQ ID NO: 41006 - DNA, 19 bp, Artificial sequence
  synthetic polynucleotide sequence
gtggaagtccacacgtcga

SEQ ID NO: 41007 - DNA, 21 bp, Artificial sequence
  synthetic polynucleotide sequence
ctcagccctggactctaccaa

SEQ ID NO: 41008 - DNA, 18 bp, Artificial sequence
  synthetic polynucleotide sequence
ctgcccagagtgatggca

SEQ ID NO: 41009 - DNA, 19 bp, Artificial sequence
  synthetic polynucleotide sequence
ggctgaccgagatccacga

SEQ ID NO: 41010 - DNA, 19 bp, Artificial sequence
  synthetic polynucleotide sequence
cgctcatgggcagagtcca

SEQ ID NO: 41011 - DNA, 20 bp, Artificial sequence
  synthetic polynucleotide sequence
gaagccatagcactcgcaga

SEQ ID NO: 41012 - DNA, 20 bp, Artificial sequence
  synthetic polynucleotide sequence
gatccgtagaggcatgacca

SEQ ID NO: 41013 - DNA, 18 bp, Artificial sequence
  synthetic polynucleotide sequence
gaacggcaagctcgggaa

SEQ ID NO: 41014 - DNA, 22 bp, Artificial sequence
  synthetic polynucleotide sequence
ggatttgtgtcttctccacaca

SEQ ID NO: 41015 - DNA, 21 bp, Artificial sequence
  synthetic polynucleotide sequence
gagggcagacaataggaggca

SEQ ID NO: 41016 - DNA, 20 bp, Artificial sequence
  synthetic polynucleotide sequence
attgcctaccaaggcaacca

SEQ ID NO: 41017 - DNA, 21 bp, Artificial sequence
  synthetic polynucleotide sequence
cagccagaggtggaaacagga

SEQ ID NO: 41018 - DNA, 19 bp, Artificial sequence
  synthetic polynucleotide sequence
ggctcactgcccaagggga

SEQ ID NO: 41019 - DNA, 22 bp, Artificial sequence
  synthetic polynucleotide sequence
gatatgggatacggcagggcaa

SEQ ID NO: 41020 - DNA, 21 bp, Artificial sequence
  synthetic polynucleotide sequence
gaattggaatgctggcgggca

SEQ ID NO: 41021 - DNA, 20 bp, Artificial sequence
  synthetic polynucleotide sequence
agcctgtccacgacctcaca

SEQ ID NO: 41022 - DNA, 20 bp, Artificial sequence
  synthetic polynucleotide sequence
tgccgggcatcctctaacca

SEQ ID NO: 41023 - DNA, 21 bp, Artificial sequence
  synthetic polynucleotide sequence
ggtcaaggagccacaattgga

SEQ ID NO: 41024 - DNA, 21 bp, Artificial sequence
  synthetic polynucleotide sequence
gcaacggaaggattcctcaca

SEQ ID NO: 41025 - DNA, 19 bp, Artificial sequence
  synthetic polynucleotide sequence
ggggttgggaaatcaagca

SEQ ID NO: 41026 - DNA, 18 bp, Artificial sequence
  synthetic polynucleotide sequence
gctgcagctgagcctcga

SEQ ID NO: 41027 - DNA, 21 bp, Artificial sequence
  synthetic polynucleotide sequence
cagtagccagagtccttccca

SEQ ID NO: 41028 - DNA, 21 bp, Artificial sequence
  synthetic polynucleotide sequence
ttctccactaggaaccgggca

SEQ ID NO: 41029 - DNA, 19 bp, Artificial sequence
  synthetic polynucleotide sequence
tccgcaaaagcatggtcga

SEQ ID NO: 41030 - DNA, 21 bp, Artificial sequence
  synthetic polynucleotide sequence
tcagggctaagttggagggca

SEQ ID NO: 41031 - DNA, 19 bp, Artificial sequence
  synthetic polynucleotide sequence
gtccagcggggcagtgtca

SEQ ID NO: 41032 - DNA, 20 bp, Artificial sequence
  synthetic polynucleotide sequence
gggaagcggccagcgcagaa

SEQ ID NO: 41033 - DNA, 20 bp, Artificial sequence
  synthetic polynucleotide sequence
atggagaaagacgccctcca

SEQ ID NO: 41034 - DNA, 20 bp, Artificial sequence
  synthetic polynucleotide sequence
caaaggtcagtgctgccaca

SEQ ID NO: 41035 - DNA, 21 bp, Artificial sequence
  synthetic polynucleotide sequence
caggcagctacatcaccacga

SEQ ID NO: 41036 - DNA, 21 bp, Artificial sequence
  synthetic polynucleotide sequence
acgtggaggtgatggtgcgga

SEQ ID NO: 41037 - DNA, 20 bp, Artificial sequence
  synthetic polynucleotide sequence
ctctgagggagaacgaggca

SEQ ID NO: 41038 - DNA, 18 bp, Artificial sequence
  synthetic polynucleotide sequence
cttggccgacactgacca

SEQ ID NO: 41039 - DNA, 19 bp, Artificial sequence
  synthetic polynucleotide sequence
ggacaccgctgggcaggaa

SEQ ID NO: 41040 - DNA, 20 bp, Artificial sequence
  synthetic polynucleotide sequence
ctcagtgagccaggccctga

SEQ ID NO: 41041 - DNA, 21 bp, Artificial sequence
  synthetic polynucleotide sequence
accaggggaaggatgtgctca

SEQ ID NO: 41042 - DNA, 21 bp, Artificial sequence
  synthetic polynucleotide sequence
atgtgagatggggcttcacga

SEQ ID NO: 41043 - DNA, 19 bp, Artificial sequence
  synthetic polynucleotide sequence
gggactccaccgtgggcaa

SEQ ID NO: 41044 - DNA, 21 bp, Artificial sequence
  synthetic polynucleotide sequence
gcaggcgggagaagaagtcca

SEQ ID NO: 41045 - DNA, 20 bp, Artificial sequence
  synthetic polynucleotide sequence
ctgatccgccgcttcaccga

SEQ ID NO: 41046 - DNA, 20 bp, Artificial sequence
  synthetic polynucleotide sequence
cctgtagtaggcgcgagtga

SEQ ID NO: 41047 - DNA, 19 bp, Artificial sequence
  synthetic polynucleotide sequence
ccggaccatcaccaccgca

SEQ ID NO: 41048 - DNA, 20 bp, Artificial sequence
  synthetic polynucleotide sequence
ctgatgacaccacccgctca

SEQ ID NO: 41049 - DNA, 20 bp, Artificial sequence
  synthetic polynucleotide sequence
ctgatgacacgttcacccca

SEQ ID NO: 41050 - DNA, 18 bp, Artificial sequence
  synthetic polynucleotide sequence
cggtaccgctcctgccca

SEQ ID NO: 41051 - DNA, 21 bp, Artificial sequence
  synthetic polynucleotide sequence
gaagacgagcgggtcatctca

SEQ ID NO: 41052 - DNA, 19 bp, Artificial sequence
  synthetic polynucleotide sequence
tgcagcagtgatggcagga

SEQ ID NO: 41053 - DNA, 21 bp, Artificial sequence
  synthetic polynucleotide sequence
aagtgtgacctggaggacgaa

SEQ ID NO: 41054 - DNA, 20 bp, Artificial sequence
  synthetic polynucleotide sequence
ctcgcagatgacatccacca

SEQ ID NO: 41055 - DNA, 19 bp, Artificial sequence
  synthetic polynucleotide sequence
ggagggaaggtaccaggga

SEQ ID NO: 41056 - DNA, 19 bp, Artificial sequence
  synthetic polynucleotide sequence
ccctccacgaaacgacaca

SEQ ID NO: 41057 - DNA, 21 bp, Artificial sequence
  synthetic polynucleotide sequence
caggcccaacattcagccaca

SEQ ID NO: 41058 - DNA, 20 bp, Artificial sequence
  synthetic polynucleotide sequence
cctttgccccgtgagcacca

SEQ ID NO: 41059 - DNA, 20 bp, Artificial sequence
  synthetic polynucleotide sequence
cccacagtgaaggtggccga

SEQ ID NO: 41060 - DNA, 19 bp, Artificial sequence
  synthetic polynucleotide sequence
cgcaccaggccttgctgga

SEQ ID NO: 41061 - DNA, 21 bp, Artificial sequence
  synthetic polynucleotide sequence
atgagcccacaatggacagga

SEQ ID NO: 41062 - DNA, 20 bp, Artificial sequence
  synthetic polynucleotide sequence
tactctggccagtgagagca

SEQ ID NO: 41063 - DNA, 19 bp, Artificial sequence
  synthetic polynucleotide sequence
ttcacggagctggccagga

SEQ ID NO: 41064 - DNA, 20 bp, Artificial sequence
  synthetic polynucleotide sequence
taaggtactggggagcggga

SEQ ID NO: 41065 - DNA, 19 bp, Artificial sequence
  synthetic polynucleotide sequence
ttcacggagctggccagga

SEQ ID NO: 41066 - DNA, 20 bp, Artificial sequence
  synthetic polynucleotide sequence
taaggcaatggggagcggga

SEQ ID NO: 41067 - DNA, 20 bp, Artificial sequence
  synthetic polynucleotide sequence
ccggtgcacctggtggacaa

SEQ ID NO: 41068 - DNA, 20 bp, Artificial sequence
  synthetic polynucleotide sequence
ggagtaggaaccgccgtgca

SEQ ID NO: 41069 - DNA, 20 bp, Artificial sequence
  synthetic polynucleotide sequence
agatctggaggcccaaccga

SEQ ID NO: 41070 - DNA, 20 bp, Artificial sequence
  synthetic polynucleotide sequence
gatggtgacgggcagtggaa

SEQ ID NO: 41071 - DNA, 22 bp, Artificial sequence
  synthetic polynucleotide sequence
ttcgaggagtcaggcaacagaa

SEQ ID NO: 41072 - DNA, 21 bp, Artificial sequence
  synthetic polynucleotide sequence
gggaggagaactggtatggca

SEQ ID NO: 41073 - DNA, 21 bp, Artificial sequence
  synthetic polynucleotide sequence
acaagagtgacctgcagagca

SEQ ID NO: 41074 - DNA, 20 bp, Artificial sequence
  synthetic polynucleotide sequence
agcgagggtgtcaaaggcca

SEQ ID NO: 41075 - DNA, 20 bp, Artificial sequence
  synthetic polynucleotide sequence
gacccggacgagcagtacga

SEQ ID NO: 41076 - DNA, 20 bp, Artificial sequence
  synthetic polynucleotide sequence
catggtgaagtcgacgccga

SEQ ID NO: 41077 - DNA, 20 bp, Artificial sequence
  synthetic polynucleotide sequence
tcccaggagagctttgccca

SEQ ID NO: 41078 - DNA, 21 bp, Artificial sequence
  synthetic polynucleotide sequence
atgttgtgacccaaggcggca

SEQ ID NO: 41079 - DNA, 22 bp, Artificial sequence
  synthetic polynucleotide sequence
acaagaaggacctggatgcaga

SEQ ID NO: 41080 - DNA, 21 bp, Artificial sequence
  synthetic polynucleotide sequence
tctcaaggcagcatctccgta

SEQ ID NO: 41081 - DNA, 20 bp, Artificial sequence
  synthetic polynucleotide sequence
acaggcgagaacgtggagga

SEQ ID NO: 41082 - DNA, 18 bp, Artificial sequence
  synthetic polynucleotide sequence
gcactccgaggctgccga

SEQ ID NO: 41083 - DNA, 19 bp, Artificial sequence
  synthetic polynucleotide sequence
cccacacaaccaaccagga

SEQ ID NO: 41084 - DNA, 19 bp, Artificial sequence
  synthetic polynucleotide sequence
agtgagagggacccatgca

SEQ ID NO: 41085 - DNA, 19 bp, Artificial sequence
  synthetic polynucleotide sequence
ggcaaccccaggccagcaa

SEQ ID NO: 41086 - DNA, 20 bp, Artificial sequence
  synthetic polynucleotide sequence
gggtgaggaaggccgctcca

SEQ ID NO: 41087 - DNA, 19 bp, Artificial sequence
  synthetic polynucleotide sequence
tccaggaagcacaagccta

SEQ ID NO: 41088 - DNA, 20 bp, Artificial sequence
  synthetic polynucleotide sequence
ggtttcggcctggagcacca

SEQ ID NO: 41089 - DNA, 19 bp, Artificial sequence
  synthetic polynucleotide sequence
ccatcgaggagggggagca

SEQ ID NO: 41090 - DNA, 20 bp, Artificial sequence
  synthetic polynucleotide sequence
tccattccgggtagagccga

SEQ ID NO: 41091 - DNA, 21 bp, Artificial sequence
  synthetic polynucleotide sequence
tcaggagcaaacagtcagcga

SEQ ID NO: 41092 - DNA, 21 bp, Artificial sequence
  synthetic polynucleotide sequence
cctccacgagacaggcagcaa

SEQ ID NO: 41093 - DNA, 21 bp, Artificial sequence
  synthetic polynucleotide sequence
tggagcaggcgttccagacga

SEQ ID NO: 41094 - DNA, 18 bp, Artificial sequence
  synthetic polynucleotide sequence
gaggccttggcccggtca

SEQ ID NO: 41095 - DNA, 20 bp, Artificial sequence
  synthetic polynucleotide sequence
ggggccagcatcctctccaa

SEQ ID NO: 41096 - DNA, 19 bp, Artificial sequence
  synthetic polynucleotide sequence
ccaggacatcaccccgcca

SEQ ID NO: 41097 - DNA, 21 bp, Artificial sequence
  synthetic polynucleotide sequence
gtcaggaacggtttcggacga

SEQ ID NO: 41098 - DNA, 22 bp, Artificial sequence
  synthetic polynucleotide sequence
atgttgcgaatccagttccgga

SEQ ID NO: 41099 - DNA, 21 bp, Artificial sequence
  synthetic polynucleotide sequence
cagcgtactacagaggagcca

SEQ ID NO: 41100 - DNA, 19 bp, Artificial sequence
  synthetic polynucleotide sequence
ttcgacatcggaagaggca

SEQ ID NO: 41101 - DNA, 18 bp, Artificial sequence
  synthetic polynucleotide sequence
acggcaggtcaggagcga

SEQ ID NO: 41102 - DNA, 23 bp, Artificial sequence
  synthetic polynucleotide sequence
taaaagtaagcaggcagcagtca

SEQ ID NO: 41103 - DNA, 21 bp, Artificial sequence
  synthetic polynucleotide sequence
ctggtgcatggagaatgggga

SEQ ID NO: 41104 - DNA, 22 bp, Artificial sequence
  synthetic polynucleotide sequence
caatggtgtgacccaacatgca

SEQ ID NO: 41105 - DNA, 19 bp, Artificial sequence
  synthetic polynucleotide sequence
gagaggtgagcccagcgca

SEQ ID NO: 41106 - DNA, 18 bp, Artificial sequence
  synthetic polynucleotide sequence
gcagctcctccccgtcca

SEQ ID NO: 41107 - DNA, 20 bp, Artificial sequence
  synthetic polynucleotide sequence
tgggtcactccagatgccaa

SEQ ID NO: 41108 - DNA, 22 bp, Artificial sequence
  synthetic polynucleotide sequence
accactaggggacacataggca

SEQ ID NO: 41109 - DNA, 19 bp, Artificial sequence
  synthetic polynucleotide sequence
gcaaggcccagctcccaga

SEQ ID NO: 41110 - DNA, 18 bp, Artificial sequence
  synthetic polynucleotide sequence
gggtctcagcctggcgga

SEQ ID NO: 41111 - DNA, 19 bp, Artificial sequence
  synthetic polynucleotide sequence
gcggagagagaggtgccca

SEQ ID NO: 41112 - DNA, 21 bp, Artificial sequence
  synthetic polynucleotide sequence
catagaatctgtcccccgcca

SEQ ID NO: 41113 - DNA, 20 bp, Artificial sequence
  synthetic polynucleotide sequence
gacagtgctatcacccggga

SEQ ID NO: 41114 - DNA, 20 bp, Artificial sequence
  synthetic polynucleotide sequence
tatggagaaggagcacagca

SEQ ID NO: 41115 - DNA, 18 bp, Artificial sequence
  synthetic polynucleotide sequence
accggacctgcatagcca

SEQ ID NO: 41116 - DNA, 20 bp, Artificial sequence
  synthetic polynucleotide sequence
gaacaccatgcagagtggga

SEQ ID NO: 41117 - DNA, 22 bp, Artificial sequence
  synthetic polynucleotide sequence
tgatgactggagaggatggcta

SEQ ID NO: 41118 - DNA, 19 bp, Artificial sequence
  synthetic polynucleotide sequence
cctgggagaggtctggcca

SEQ ID NO: 41119 - DNA, 20 bp, Artificial sequence
  synthetic polynucleotide sequence
tgcaacaaccgcctccagca

SEQ ID NO: 41120 - DNA, 22 bp, Artificial sequence
  synthetic polynucleotide sequence
aggacgctgctaactgaaggca

SEQ ID NO: 41121 - DNA, 21 bp, Artificial sequence
  synthetic polynucleotide sequence
ctgaatcccatgctgggcaga

SEQ ID NO: 41122 - DNA, 19 bp, Artificial sequence
  synthetic polynucleotide sequence
ttagggaagccaggaccca

SEQ ID NO: 41123 - DNA, 18 bp, Artificial sequence
  synthetic polynucleotide sequence
cagcaatcctgacggcga

SEQ ID NO: 41124 - DNA, 18 bp, Artificial sequence
  synthetic polynucleotide sequence
gccagccaattggtccaa

SEQ ID NO: 41125 - DNA, 21 bp, Artificial sequence
  synthetic polynucleotide sequence
cgccctgaccctgtacaagca

SEQ ID NO: 41126 - DNA, 21 bp, Artificial sequence
  synthetic polynucleotide sequence
gacgaaatacaggggcaggga

SEQ ID NO: 41127 - DNA, 21 bp, Artificial sequence
  synthetic polynucleotide sequence
tcaggccagagatcccatgca

SEQ ID NO: 41128 - DNA, 19 bp, Artificial sequence
  synthetic polynucleotide sequence
tggtaccatcagcagccga

SEQ ID NO: 41129 - DNA, 19 bp, Artificial sequence
  synthetic polynucleotide sequence
tggaagctctcaacaggga

SEQ ID NO: 41130 - DNA, 22 bp, Artificial sequence
  synthetic polynucleotide sequence
acctgcagctaagtaccgtgga

SEQ ID NO: 41131 - DNA, 20 bp, Artificial sequence
  synthetic polynucleotide sequence
cgtcacctgccaccgaggca

SEQ ID NO: 41132 - DNA, 20 bp, Artificial sequence
  synthetic polynucleotide sequence
ggtccaggcggtcgtcagga

SEQ ID NO: 41133 - DNA, 22 bp, Artificial sequence
  synthetic polynucleotide sequence
aaggagaagaagctgactccca

SEQ ID NO: 41134 - DNA, 18 bp, Artificial sequence
  synthetic polynucleotide sequence
tgagcgccgagcactcca

SEQ ID NO: 41135 - DNA, 18 bp, Artificial sequence
  synthetic polynucleotide sequence
ggtgggcaccaagctgga

SEQ ID NO: 41136 - DNA, 19 bp, Artificial sequence
  synthetic polynucleotide sequence
gggtaggtgatgggagcca

SEQ ID NO: 41137 - DNA, 21 bp, Artificial sequence
  synthetic polynucleotide sequence
actctcctacccccaaactga

SEQ ID NO: 41138 - DNA, 20 bp, Artificial sequence
  synthetic polynucleotide sequence
cttgtcgtcgcggaggtcca

SEQ ID NO: 41139 - DNA, 18 bp, Artificial sequence
  synthetic polynucleotide sequence
caggccaacagggacaca

SEQ ID NO: 41140 - DNA, 18 bp, Artificial sequence
  synthetic polynucleotide sequence
tgggcacagcatgggcca

SEQ ID NO: 41141 - DNA, 23 bp, Artificial sequence
  synthetic polynucleotide sequence
caatacacaggaacctgaggaga

SEQ ID NO: 41142 - DNA, 18 bp, Artificial sequence
  synthetic polynucleotide sequence
ggagcccctctgactgca

SEQ ID NO: 41143 - DNA, 20 bp, Artificial sequence
  synthetic polynucleotide sequence
ctcaagccactgtgccggaa

SEQ ID NO: 41144 - DNA, 20 bp, Artificial sequence
  synthetic polynucleotide sequence
ctggggctggctagcaggca

SEQ ID NO: 41145 - DNA, 21 bp, Artificial sequence
  synthetic polynucleotide sequence
tactcctgtagcctccagaca

SEQ ID NO: 41146 - DNA, 21 bp, Artificial sequence
  synthetic polynucleotide sequence
cctctgagggatctggagcga

SEQ ID NO: 41147 - DNA, 19 bp, Artificial sequence
  synthetic polynucleotide sequence
ggggcgatcaagatcagga

SEQ ID NO: 41148 - DNA, 21 bp, Artificial sequence
  synthetic polynucleotide sequence
gttttagcaagagcacgctga

SEQ ID NO: 41149 - DNA, 22 bp, Artificial sequence
  synthetic polynucleotide sequence
agctgagagctttggggaggaa

SEQ ID NO: 41150 - DNA, 21 bp, Artificial sequence
  synthetic polynucleotide sequence
ttctccagtgaggcttccaga

SEQ ID NO: 41151 - DNA, 18 bp, Artificial sequence
  synthetic polynucleotide sequence
ccctgggcttcccagaga

SEQ ID NO: 41152 - DNA, 18 bp, Artificial sequence
  synthetic polynucleotide sequence
ggaggaagttggcagcca

SEQ ID NO: 41153 - DNA, 20 bp, Artificial sequence
  synthetic polynucleotide sequence
aaccctgacagagcagtgga

SEQ ID NO: 41154 - DNA, 20 bp, Artificial sequence
  synthetic polynucleotide sequence
ctgaagactgaggagcccca

SEQ ID NO: 41155 - DNA, 19 bp, Artificial sequence
  synthetic polynucleotide sequence
ccagggacagacttgccaa

SEQ ID NO: 41156 - DNA, 18 bp, Artificial sequence
  synthetic polynucleotide sequence
ctgtggctccagccagca

SEQ ID NO: 41157 - DNA, 20 bp, Artificial sequence
  synthetic polynucleotide sequence
ccgaactgggaagacccaga

SEQ ID NO: 41158 - DNA, 21 bp, Artificial sequence
  synthetic polynucleotide sequence
agagaccatacctctcagcca

SEQ ID NO: 41159 - DNA, 20 bp, Artificial sequence
  synthetic polynucleotide sequence
gcagaagtagcagcagccca

SEQ ID NO: 41160 - DNA, 18 bp, Artificial sequence
  synthetic polynucleotide sequence
tggacaagccaaggcgga

SEQ ID NO: 41161 - DNA, 20 bp, Artificial sequence
  synthetic polynucleotide sequence
aggacccggattcccaacca

SEQ ID NO: 41162 - DNA, 20 bp, Artificial sequence
  synthetic polynucleotide sequence
cgcctcagacaagcgaggca

SEQ ID NO: 41163 - DNA, 21 bp, Artificial sequence
  synthetic polynucleotide sequence
tgtgtgatagccgcactagga

SEQ ID NO: 41164 - DNA, 22 bp, Artificial sequence
  synthetic polynucleotide sequence
acaaatgaggtgaagggagcca

SEQ ID NO: 41165 - DNA, 22 bp, Artificial sequence
  synthetic polynucleotide sequence
tgaaaccctccgagcttagcaa

SEQ ID NO: 41166 - DNA, 19 bp, Artificial sequence
  synthetic polynucleotide sequence
taagggcactccaccccca

SEQ ID NO: 41167 - DNA, 18 bp, Artificial sequence
  synthetic polynucleotide sequence
gaagaccctggcccggga

SEQ ID NO: 41168 - DNA, 20 bp, Artificial sequence
  synthetic polynucleotide sequence
aaagctccaggagcgtccga

SEQ ID NO: 41169 - DNA, 19 bp, Artificial sequence
  synthetic polynucleotide sequence
cctcctgtgacgcacagca

SEQ ID NO: 41170 - DNA, 20 bp, Artificial sequence
  synthetic polynucleotide sequence
tctagacgagggcttgacca

SEQ ID NO: 41171 - DNA, 21 bp, Artificial sequence
  synthetic polynucleotide sequence
gccgaccaggagcactacaga

SEQ ID NO: 41172 - DNA, 18 bp, Artificial sequence
  synthetic polynucleotide sequence
ggcaggggtgattgcaca

SEQ ID NO: 41173 - DNA, 18 bp, Artificial sequence
  synthetic polynucleotide sequence
agctgtgccgtgcccgaa

SEQ ID NO: 41174 - DNA, 18 bp, Artificial sequence
  synthetic polynucleotide sequence
accagccggttagcccca

SEQ ID NO: 41175 - DNA, 18 bp, Artificial sequence
  synthetic polynucleotide sequence
gcgatcagagcctgacca

SEQ ID NO: 41176 - DNA, 18 bp, Artificial sequence
  synthetic polynucleotide sequence
atgggggtggactgcaca

SEQ ID NO: 41177 - DNA, 18 bp, Artificial sequence
  synthetic polynucleotide sequence
caggccgtcttcgaccca

SEQ ID NO: 41178 - DNA, 18 bp, Artificial sequence
  synthetic polynucleotide sequence
cgtggtagctgcgcagga

SEQ ID NO: 41179 - DNA, 20 bp, Artificial sequence
  synthetic polynucleotide sequence
taactggccaggccctggaa

SEQ ID NO: 41180 - DNA, 21 bp, Artificial sequence
  synthetic polynucleotide sequence
tgagacacagagaccctggca

SEQ ID NO: 41181 - DNA, 18 bp, Artificial sequence
  synthetic polynucleotide sequence
gcagagcatggaggagca

SEQ ID NO: 41182 - DNA, 20 bp, Artificial sequence
  synthetic polynucleotide sequence
ctgctggaaggcgtacagca

SEQ ID NO: 41183 - DNA, 22 bp, Artificial sequence
  synthetic polynucleotide sequence
aagcgatacagatcgcacagca

SEQ ID NO: 41184 - DNA, 18 bp, Artificial sequence
  synthetic polynucleotide sequence
cagttgccaccacagcca

SEQ ID NO: 41185 - DNA, 18 bp, Artificial sequence
  synthetic polynucleotide sequence
ctggcagttcgccaccaa

SEQ ID NO: 41186 - DNA, 18 bp, Artificial sequence
  synthetic polynucleotide sequence
cctgagccagtgatcgca

SEQ ID NO: 41187 - DNA, 18 bp, Artificial sequence
  synthetic polynucleotide sequence
ccaccctcagtccctgca

SEQ ID NO: 41188 - DNA, 21 bp, Artificial sequence
  synthetic polynucleotide sequence
gcgagtcacgtgtccaccaga

SEQ ID NO: 41189 - DNA, 22 bp, Artificial sequence
  synthetic polynucleotide sequence
agctgaaggacacagcagtgga

SEQ ID NO: 41190 - DNA, 22 bp, Artificial sequence
  synthetic polynucleotide sequence
gtaatggaaggacatggccaca

SEQ ID NO: 41191 - DNA, 18 bp, Artificial sequence
  synthetic polynucleotide sequence
caaagagagcgggcacca

SEQ ID NO: 41192 - DNA, 19 bp, Artificial sequence
  synthetic polynucleotide sequence
gacccaatccgagtggaca

SEQ ID NO: 41193 - DNA, 18 bp, Artificial sequence
  synthetic polynucleotide sequence
ttccgaggagaggcacga

SEQ ID NO: 41194 - DNA, 22 bp, Artificial sequence
  synthetic polynucleotide sequence
tgaaactgtactggcagaggga

SEQ ID NO: 41195 - DNA, 20 bp, Artificial sequence
  synthetic polynucleotide sequence
cacagtcttgccaggaggaa

SEQ ID NO: 41196 - DNA, 20 bp, Artificial sequence
  synthetic polynucleotide sequence
ctggggtctccatctcacga

SEQ ID NO: 41197 - DNA, 18 bp, Artificial sequence
  synthetic polynucleotide sequence
gagacgcgttcaccacca

SEQ ID NO: 41198 - DNA, 18 bp, Artificial sequence
  synthetic polynucleotide sequence
cggctgcatccaaggaga

SEQ ID NO: 41199 - DNA, 20 bp, Artificial sequence
  synthetic polynucleotide sequence
cagctctgacctcagccaga

SEQ ID NO: 41200 - DNA, 18 bp, Artificial sequence
  synthetic polynucleotide sequence
tgaccctcagctcgtgga

SEQ ID NO: 41201 - DNA, 21 bp, Artificial sequence
  synthetic polynucleotide sequence
cgagatgctcagccagcccaa

SEQ ID NO: 41202 - DNA, 21 bp, Artificial sequence
  synthetic polynucleotide sequence
gcacagcatcttcgacagaga

SEQ ID NO: 41203 - DNA, 20 bp, Artificial sequence
  synthetic polynucleotide sequence
gtggtggcgtgggcaagtca

SEQ ID NO: 41204 - DNA, 20 bp, Artificial sequence
  synthetic polynucleotide sequence
gaacccctccccacttcgga

SEQ ID NO: 41205 - DNA, 20 bp, Artificial sequence
  synthetic polynucleotide sequence
caactgccgaattcagggaa

SEQ ID NO: 41206 - DNA, 18 bp, Artificial sequence
  synthetic polynucleotide sequence
cccacgacgagcagtgga

SEQ ID NO: 41207 - DNA, 20 bp, Artificial sequence
  synthetic polynucleotide sequence
cccatgctgctgcagaggga

SEQ ID NO: 41208 - DNA, 20 bp, Artificial sequence
  synthetic polynucleotide sequence
agttcccaccggagccagga

SEQ ID NO: 41209 - DNA, 21 bp, Artificial sequence
  synthetic polynucleotide sequence
ggcagtgccgagagacacaca

SEQ ID NO: 41210 - DNA, 19 bp, Artificial sequence
  synthetic polynucleotide sequence
tacctcccaaccaagacca

SEQ ID NO: 41211 - DNA, 21 bp, Artificial sequence
  synthetic polynucleotide sequence
aacactccagagactaccgca

SEQ ID NO: 41212 - DNA, 21 bp, Artificial sequence
  synthetic polynucleotide sequence
ctggtagagtgggatgaggca

SEQ ID NO: 41213 - DNA, 19 bp, Artificial sequence
  synthetic polynucleotide sequence
ttcctgacccagttacgga

SEQ ID NO: 41214 - DNA, 23 bp, Artificial sequence
  synthetic polynucleotide sequence
caaaaggacgacatggcaagaga

SEQ ID NO: 41215 - DNA, 19 bp, Artificial sequence
  synthetic polynucleotide sequence
cctcacagtcatccccgga

SEQ ID NO: 41216 - DNA, 19 bp, Artificial sequence
  synthetic polynucleotide sequence
tgcagagccctgagacaga

SEQ ID NO: 41217 - DNA, 21 bp, Artificial sequence
  synthetic polynucleotide sequence
gagctgcgactatgccagcaa

SEQ ID NO: 41218 - DNA, 21 bp, Artificial sequence
  synthetic polynucleotide sequence
aaggccacaacgttaggggca

SEQ ID NO: 41219 - DNA, 18 bp, Artificial sequence
  synthetic polynucleotide sequence
acccatcaactggcagca

SEQ ID NO: 41220 - DNA, 19 bp, Artificial sequence
  synthetic polynucleotide sequence
gacatgaggcaacatggga

SEQ ID NO: 41221 - DNA, 23 bp, Artificial sequence
  synthetic polynucleotide sequence
caaaaggccaatccagatggcaa

SEQ ID NO: 41222 - DNA, 18 bp, Artificial sequence
  synthetic polynucleotide sequence
tggggcaggcctgcctca

SEQ ID NO: 41223 - DNA, 21 bp, Artificial sequence
  synthetic polynucleotide sequence
acgactcgcagggggaaagga

SEQ ID NO: 41224 - DNA, 20 bp, Artificial sequence
  synthetic polynucleotide sequence
cttctccaggcgccctagca

SEQ ID NO: 41225 - DNA, 18 bp, Artificial sequence
  synthetic polynucleotide sequence
acttcaggagctgcccca

SEQ ID NO: 41226 - DNA, 18 bp, Artificial sequence
  synthetic polynucleotide sequence
gggtcaccgtgatgggga

SEQ ID NO: 41227 - DNA, 19 bp, Artificial sequence
  synthetic polynucleotide sequence
ttgagactcaccagatcca

SEQ ID NO: 41228 - DNA, 18 bp, Artificial sequence
  synthetic polynucleotide sequence
tgaggcagatgggggcta

SEQ ID NO: 41229 - DNA, 18 bp, Artificial sequence
  synthetic polynucleotide sequence
caccggcatccacaggca

SEQ ID NO: 41230 - DNA, 18 bp, Artificial sequence
  synthetic polynucleotide sequence
ccaggccagccatggcga

SEQ ID NO: 41231 - DNA, 20 bp, Artificial sequence
  synthetic polynucleotide sequence
cgccccaccagaagttgtca

SEQ ID NO: 41232 - DNA, 18 bp, Artificial sequence
  synthetic polynucleotide sequence
tcctcatccgggagagca

SEQ ID NO: 41233 - DNA, 18 bp, Artificial sequence
  synthetic polynucleotide sequence
aatggaaggagcgaggca

SEQ ID NO: 41234 - DNA, 18 bp, Artificial sequence
  synthetic polynucleotide sequence
tccgcatgaggaggcgga

SEQ ID NO: 41235 - DNA, 19 bp, Artificial sequence
  synthetic polynucleotide sequence
tgaccccatccagagggaa

SEQ ID NO: 41236 - DNA, 18 bp, Artificial sequence
  synthetic polynucleotide sequence
ggccatgagccggagaca

SEQ ID NO: 41237 - DNA, 20 bp, Artificial sequence
  synthetic polynucleotide sequence
cccagatgtcctgcagcaga

SEQ ID NO: 41238 - DNA, 18 bp, Artificial sequence
  synthetic polynucleotide sequence
tgagcaggatgagcccca

SEQ ID NO: 41239 - DNA, 21 bp, Artificial sequence
  synthetic polynucleotide sequence
aacacagtcagtcggaaccca

SEQ ID NO: 41240 - DNA, 21 bp, Artificial sequence
  synthetic polynucleotide sequence
ttccactgactgacatcccga

SEQ ID NO: 41241 - DNA, 20 bp, Artificial sequence
  synthetic polynucleotide sequence
gagcaggagcaggaggccaa

SEQ ID NO: 41242 - DNA, 20 bp, Artificial sequence
  synthetic polynucleotide sequence
cgtccccttcgtcaccagca

SEQ ID NO: 41243 - DNA, 22 bp, Artificial sequence
  synthetic polynucleotide sequence
cacagccatactgctaggacca

SEQ ID NO: 41244 - DNA, 20 bp, Artificial sequence
  synthetic polynucleotide sequence
ggtgtgcaaactgccaggca

SEQ ID NO: 41245 - DNA, 20 bp, Artificial sequence
  synthetic polynucleotide sequence
tgccggcgaccgtgtcagaa

SEQ ID NO: 41246 - DNA, 20 bp, Artificial sequence
  synthetic polynucleotide sequence
gccgtcgtagcagtgcggca

SEQ ID NO: 41247 - DNA, 20 bp, Artificial sequence
  synthetic polynucleotide sequence
tcctggagcccgaaggacaa

SEQ ID NO: 41248 - DNA, 20 bp, Artificial sequence
  synthetic polynucleotide sequence
tggctcgaactgacgcggca

SEQ ID NO: 41249 - DNA, 20 bp, Artificial sequence
  synthetic polynucleotide sequence
tgacacgtctgaccccgaga

SEQ ID NO: 41250 - DNA, 19 bp, Artificial sequence
  synthetic polynucleotide sequence
tcactcttgagcagaccca

SEQ ID NO: 41251 - DNA, 21 bp, Artificial sequence
  synthetic polynucleotide sequence
gggggccattgacgtaagcga

SEQ ID NO: 41252 - DNA, 22 bp, Artificial sequence
  synthetic polynucleotide sequence
atcctcaaagtggtaccgcgca

SEQ ID NO: 41253 - DNA, 20 bp, Artificial sequence
  synthetic polynucleotide sequence
ggttcaggaggcgttgggaa

SEQ ID NO: 41254 - DNA, 21 bp, Artificial sequence
  synthetic polynucleotide sequence
ctgtccctgcagtatccagga

SEQ ID NO: 41255 - DNA, 20 bp, Artificial sequence
  synthetic polynucleotide sequence
gacccggtgacagcgtgaga

SEQ ID NO: 41256 - DNA, 20 bp, Artificial sequence
  synthetic polynucleotide sequence
tccaacgcctcctgagccaa

SEQ ID NO: 41257 - DNA, 18 bp, Artificial sequence
  synthetic polynucleotide sequence
gaagcggcacatcgggaa

SEQ ID NO: 41258 - DNA, 18 bp, Artificial sequence
  synthetic polynucleotide sequence
cctcagcctgcaccacga

SEQ ID NO: 41259 - DNA, 20 bp, Artificial sequence
  synthetic polynucleotide sequence
agcacacccaagaccccaga

SEQ ID NO: 41260 - DNA, 19 bp, Artificial sequence
  synthetic polynucleotide sequence
ctggaggaggagcgggaga

SEQ ID NO: 41261 - DNA, 20 bp, Artificial sequence
  synthetic polynucleotide sequence
cagagtggtggcatcaagca

SEQ ID NO: 41262 - DNA, 23 bp, Artificial sequence
  synthetic polynucleotide sequence
cataagagcacatatcaggacca

SEQ ID NO: 41263 - DNA, 21 bp, Artificial sequence
  synthetic polynucleotide sequence
gaccggcaccttcatcgagaa

SEQ ID NO: 41264 - DNA, 18 bp, Artificial sequence
  synthetic polynucleotide sequence
tgcccgccgtgtccagga

SEQ ID NO: 41265 - DNA, 18 bp, Artificial sequence
  synthetic polynucleotide sequence
ggtgggcaacaaggtgga

SEQ ID NO: 41266 - DNA, 18 bp, Artificial sequence
  synthetic polynucleotide sequence
cgtctccatgaaggggca

SEQ ID NO: 41267 - DNA, 21 bp, Artificial sequence
  synthetic polynucleotide sequence
agaaggcagagctctggctca

SEQ ID NO: 41268 - DNA, 19 bp, Artificial sequence
  synthetic polynucleotide sequence
ttgcctgacgatctcagca

SEQ ID NO: 41269 - DNA, 20 bp, Artificial sequence
  synthetic polynucleotide sequence
ctgcgaggcattcctgacca

SEQ ID NO: 41270 - DNA, 21 bp, Artificial sequence
  synthetic polynucleotide sequence
ggctcagctccccattgcaca

SEQ ID NO: 41271 - DNA, 20 bp, Artificial sequence
  synthetic polynucleotide sequence
tcgcacgatcctccgacaca

SEQ ID NO: 41272 - DNA, 19 bp, Artificial sequence
  synthetic polynucleotide sequence
tgggactgatagggggcga

SEQ ID NO: 41273 - DNA, 20 bp, Artificial sequence
  synthetic polynucleotide sequence
ctgatcccacaccctgacca

SEQ ID NO: 41274 - DNA, 18 bp, Artificial sequence
  synthetic polynucleotide sequence
gtggtgacatcccgcaga

SEQ ID NO: 41275 - DNA, 20 bp, Artificial sequence
  synthetic polynucleotide sequence
accagaacaggaaggcccaa

SEQ ID NO: 41276 - DNA, 22 bp, Artificial sequence
  synthetic polynucleotide sequence
caaaggcagatctcagtgacga

SEQ ID NO: 41277 - DNA, 21 bp, Artificial sequence
  synthetic polynucleotide sequence
gcacctggaagaagtccagga

SEQ ID NO: 41278 - DNA, 21 bp, Artificial sequence
  synthetic polynucleotide sequence
gtgccttaacagagcctggca

SEQ ID NO: 41279 - DNA, 18 bp, Artificial sequence
  synthetic polynucleotide sequence
catggccctgggtggaca

SEQ ID NO: 41280 - DNA, 19 bp, Artificial sequence
  synthetic polynucleotide sequence
gggagctgcttgaacacga

SEQ ID NO: 41281 - DNA, 20 bp, Artificial sequence
  synthetic polynucleotide sequence
gactacgtgttccacgggga

SEQ ID NO: 41282 - DNA, 18 bp, Artificial sequence
  synthetic polynucleotide sequence
tgtccagccccatgacca

SEQ ID NO: 41283 - DNA, 18 bp, Artificial sequence
  synthetic polynucleotide sequence
ggccacagttgtgccaca

SEQ ID NO: 41284 - DNA, 18 bp, Artificial sequence
  synthetic polynucleotide sequence
gagagtgagccgtgccga

SEQ ID NO: 41285 - DNA, 20 bp, Artificial sequence
  synthetic polynucleotide sequence
gagtgcgtggaggagacgga

SEQ ID NO: 41286 - DNA, 18 bp, Artificial sequence
  synthetic polynucleotide sequence
gcggcggcagttgggaca

SEQ ID NO: 41287 - DNA, 18 bp, Artificial sequence
  synthetic polynucleotide sequence
gaccctgaaccggaccca

SEQ ID NO: 41288 - DNA, 18 bp, Artificial sequence
  synthetic polynucleotide sequence
gtctccgcagatgaggca

SEQ ID NO: 41289 - DNA, 21 bp, Artificial sequence
  synthetic polynucleotide sequence
gtgaactggccaccaagtgca

SEQ ID NO: 41290 - DNA, 20 bp, Artificial sequence
  synthetic polynucleotide sequence
caggcaggcggccttcagca

SEQ ID NO: 41291 - DNA, 18 bp, Artificial sequence
  synthetic polynucleotide sequence
agggagctgaaagggcca

SEQ ID NO: 41292 - DNA, 18 bp, Artificial sequence
  synthetic polynucleotide sequence
gaggcattggggtgggga

SEQ ID NO: 41293 - DNA, 18 bp, Artificial sequence
  synthetic polynucleotide sequence
ggagcaccaggagaccca

SEQ ID NO: 41294 - DNA, 18 bp, Artificial sequence
  synthetic polynucleotide sequence
ggggcagggccttggaga

SEQ ID NO: 41295 - DNA, 20 bp, Artificial sequence
  synthetic polynucleotide sequence
tggaccatgagtaccaacca

SEQ ID NO: 41296 - DNA, 21 bp, Artificial sequence
  synthetic polynucleotide sequence
aagagcatccagcaacaacca

SEQ ID NO: 41297 - DNA, 18 bp, Artificial sequence
  synthetic polynucleotide sequence
ggaaactaggccggtgca

SEQ ID NO: 41298 - DNA, 18 bp, Artificial sequence
  synthetic polynucleotide sequence
aaccccttggccatgaca

SEQ ID NO: 41299 - DNA, 21 bp, Artificial sequence
  synthetic polynucleotide sequence
tcaggactttcaacccaggca

SEQ ID NO: 41300 - DNA, 21 bp, Artificial sequence
  synthetic polynucleotide sequence
cattggctaggacagaacgga

SEQ ID NO: 41301 - DNA, 18 bp, Artificial sequence
  synthetic polynucleotide sequence
agggaagggcaaaaccca

SEQ ID NO: 41302 - DNA, 18 bp, Artificial sequence
  synthetic polynucleotide sequence
ggctcaactggcagcgca

SEQ ID NO: 41303 - DNA, 18 bp, Artificial sequence
  synthetic polynucleotide sequence
ccacaaacagccaggcaa

SEQ ID NO: 41304 - DNA, 18 bp, Artificial sequence
  synthetic polynucleotide sequence
atcggctcaccctgcaga

SEQ ID NO: 41305 - DNA, 18 bp, Artificial sequence
  synthetic polynucleotide sequence
cgctgtacatccaggcca

SEQ ID NO: 41306 - DNA, 19 bp, Artificial sequence
  synthetic polynucleotide sequence
gacgggtggtagacggtga

SEQ ID NO: 41307 - DNA, 20 bp, Artificial sequence
  synthetic polynucleotide sequence
ggcggctcgcacgtcatgca

SEQ ID NO: 41308 - DNA, 20 bp, Artificial sequence
  synthetic polynucleotide sequence
ctcaccttccgcagcgcaga

SEQ ID NO: 41309 - DNA, 21 bp, Artificial sequence
  synthetic polynucleotide sequence
catccacaggaccaagggcaa

SEQ ID NO: 41310 - DNA, 21 bp, Artificial sequence
  synthetic polynucleotide sequence
agctccacttgtccccacgga

SEQ ID NO: 41311 - DNA, 21 bp, Artificial sequence
  synthetic polynucleotide sequence
ggcccagacagtgtatcggca

SEQ ID NO: 41312 - DNA, 20 bp, Artificial sequence
  synthetic polynucleotide sequence
acgatccaggtctgcgagca

SEQ ID NO: 41313 - DNA, 20 bp, Artificial sequence
  synthetic polynucleotide sequence
aagctcagtggacccagcaa

SEQ ID NO: 41314 - DNA, 18 bp, Artificial sequence
  synthetic polynucleotide sequence
gctcgggcacctaaccca

SEQ ID NO: 41315 - DNA, 19 bp, Artificial sequence
  synthetic polynucleotide sequence
ccactccagcctctccgca

SEQ ID NO: 41316 - DNA, 20 bp, Artificial sequence
  synthetic polynucleotide sequence
cccaactctctgagcggcga

SEQ ID NO: 41317 - DNA, 20 bp, Artificial sequence
  synthetic polynucleotide sequence
atcccggccaagaactgcta

SEQ ID NO: 41318 - DNA, 18 bp, Artificial sequence
  synthetic polynucleotide sequence
ggtagacctcgccgcgga

SEQ ID NO: 41319 - DNA, 21 bp, Artificial sequence
  synthetic polynucleotide sequence
tgtcggccaagaagaacacca

SEQ ID NO: 41320 - DNA, 20 bp, Artificial sequence
  synthetic polynucleotide sequence
catctccttgacgcggcgca

SEQ ID NO: 41321 - DNA, 20 bp, Artificial sequence
  synthetic polynucleotide sequence
actgctgctacagagggaca

SEQ ID NO: 41322 - DNA, 20 bp, Artificial sequence
  synthetic polynucleotide sequence
cttctcgagcaaggtgcaga

SEQ ID NO: 41323 - DNA, 20 bp, Artificial sequence
  synthetic polynucleotide sequence
tggacaaccacaggtgccga

SEQ ID NO: 41324 - DNA, 20 bp, Artificial sequence
  synthetic polynucleotide sequence
cttcttcaccacccggcaca

SEQ ID NO: 41325 - DNA, 21 bp, Artificial sequence
  synthetic polynucleotide sequence
acatccacagatcggctcaca

SEQ ID NO: 41326 - DNA, 21 bp, Artificial sequence
  synthetic polynucleotide sequence
tccttctgcacgaacgcctga

SEQ ID NO: 41327 - DNA, 21 bp, Artificial sequence
  synthetic polynucleotide sequence
caaccgccttcccaatggaca

SEQ ID NO: 41328 - DNA, 20 bp, Artificial sequence
  synthetic polynucleotide sequence
atgggggcggtgtacaggta

SEQ ID NO: 41329 - DNA, 21 bp, Artificial sequence
  synthetic polynucleotide sequence
tcacctcgtccatgaaccgca

SEQ ID NO: 41330 - DNA, 21 bp, Artificial sequence
  synthetic polynucleotide sequence
tcccctcctcgatgaaggcca

SEQ ID NO: 41331 - DNA, 20 bp, Artificial sequence
  synthetic polynucleotide sequence
ctagagtctgcaccagcgga

SEQ ID NO: 41332 - DNA, 18 bp, Artificial sequence
  synthetic polynucleotide sequence
cgatagcggaggtgccga

SEQ ID NO: 41333 - DNA, 20 bp, Artificial sequence
  synthetic polynucleotide sequence
gatggttctcagccgcccca

SEQ ID NO: 41334 - DNA, 20 bp, Artificial sequence
  synthetic polynucleotide sequence
cagcccacctatcacagcca

SEQ ID NO: 41335 - DNA, 20 bp, Artificial sequence
  synthetic polynucleotide sequence
gacctcgaccagaaccagga

SEQ ID NO: 41336 - DNA, 20 bp, Artificial sequence
  synthetic polynucleotide sequence
gacactcaactgacaggcga

SEQ ID NO: 41337 - DNA, 18 bp, Artificial sequence
  synthetic polynucleotide sequence
gagggccaccaccagcca

SEQ ID NO: 41338 - DNA, 20 bp, Artificial sequence
  synthetic polynucleotide sequence
ctacaacatccacaccagca

SEQ ID NO: 41339 - DNA, 19 bp, Artificial sequence
  synthetic polynucleotide sequence
ggccaagggcgatgcagga

SEQ ID NO: 41340 - DNA, 19 bp, Artificial sequence
  synthetic polynucleotide sequence
ctgggtccaggcatggcga

SEQ ID NO: 41341 - DNA, 20 bp, Artificial sequence
  synthetic polynucleotide sequence
tggatggccaacaccacgga

SEQ ID NO: 41342 - DNA, 20 bp, Artificial sequence
  synthetic polynucleotide sequence
actatccaggagagcaggca

SEQ ID NO: 41343 - DNA, 20 bp, Artificial sequence
  synthetic polynucleotide sequence
gggacctggattggacggga

SEQ ID NO: 41344 - DNA, 20 bp, Artificial sequence
  synthetic polynucleotide sequence
cctcatccaatcagggcgga

SEQ ID NO: 41345 - DNA, 21 bp, Artificial sequence
  synthetic polynucleotide sequence
tcggaacctcagagacgccca

SEQ ID NO: 41346 - DNA, 19 bp, Artificial sequence
  synthetic polynucleotide sequence
tggccgagcattccacgta

SEQ ID NO: 41347 - DNA, 20 bp, Artificial sequence
  synthetic polynucleotide sequence
atccaagacagcctccccca

SEQ ID NO: 41348 - DNA, 22 bp, Artificial sequence
  synthetic polynucleotide sequence
atgtgctgataaaggggtcgga

SEQ ID NO: 41349 - DNA, 20 bp, Artificial sequence
  synthetic polynucleotide sequence
gtcgtggccaacaaagctga

SEQ ID NO: 41350 - DNA, 21 bp, Artificial sequence
  synthetic polynucleotide sequence
acgtggaaggcgctgtagaca

SEQ ID NO: 41351 - DNA, 22 bp, Artificial sequence
  synthetic polynucleotide sequence
gcaacaagctggacatggctca

SEQ ID NO: 41352 - DNA, 20 bp, Artificial sequence
  synthetic polynucleotide sequence
gatgaagaggggccgggtca

SEQ ID NO: 41353 - DNA, 21 bp, Artificial sequence
  synthetic polynucleotide sequence
tcattgaggccctgctgcgaa

SEQ ID NO: 41354 - DNA, 22 bp, Artificial sequence
  synthetic polynucleotide sequence
tcatcatccaacagcttccgca

SEQ ID NO: 41355 - DNA, 18 bp, Artificial sequence
  synthetic polynucleotide sequence
ctgtcaccaacgtccgca

SEQ ID NO: 41356 - DNA, 18 bp, Artificial sequence
  synthetic polynucleotide sequence
tcgggcaatcagcgggta

SEQ ID NO: 41357 - DNA, 20 bp, Artificial sequence
  synthetic polynucleotide sequence
gtgactgagagccctgccaa

SEQ ID NO: 41358 - DNA, 21 bp, Artificial sequence
  synthetic polynucleotide sequence
tgttctgggccctgctaccaa

SEQ ID NO: 41359 - DNA, 20 bp, Artificial sequence
  synthetic polynucleotide sequence
acaccgtgaggaagaaggga

SEQ ID NO: 41360 - DNA, 18 bp, Artificial sequence
  synthetic polynucleotide sequence
tccatgaggtggagggga

SEQ ID NO: 41361 - DNA, 21 bp, Artificial sequence
  synthetic polynucleotide sequence
aagcggatacacaaggacgga

SEQ ID NO: 41362 - DNA, 22 bp, Artificial sequence
  synthetic polynucleotide sequence
aagttcagggatggagaaggca

SEQ ID NO: 41363 - DNA, 22 bp, Artificial sequence
  synthetic polynucleotide sequence
aaaggatgaaccagactcccca

SEQ ID NO: 41364 - DNA, 21 bp, Artificial sequence
  synthetic polynucleotide sequence
aggagcctctgcagtagcgga

SEQ ID NO: 41365 - DNA, 19 bp, Artificial sequence
  synthetic polynucleotide sequence
gtgcggccactgctgagca

SEQ ID NO: 41366 - DNA, 18 bp, Artificial sequence
  synthetic polynucleotide sequence
ctgccctgcacctccgca

SEQ ID NO: 41367 - DNA, 21 bp, Artificial sequence
  synthetic polynucleotide sequence
tgaagtcacaacttgccagga

SEQ ID NO: 41368 - DNA, 19 bp, Artificial sequence
  synthetic polynucleotide sequence
ttcaggaattcgagccaca

SEQ ID NO: 41369 - DNA, 21 bp, Artificial sequence
  synthetic polynucleotide sequence
gcttcgactacccctcggaca

SEQ ID NO: 41370 - DNA, 20 bp, Artificial sequence
  synthetic polynucleotide sequence
gtgaagtaggaagtgggcga

SEQ ID NO: 41371 - DNA, 21 bp, Artificial sequence
  synthetic polynucleotide sequence
acggtgggaatggcagaagga

SEQ ID NO: 41372 - DNA, 19 bp, Artificial sequence
  synthetic polynucleotide sequence
tcttagaggcagcccctga

SEQ ID NO: 41373 - DNA, 21 bp, Artificial sequence
  synthetic polynucleotide sequence
cgagaagtcccactacccgga

SEQ ID NO: 41374 - DNA, 20 bp, Artificial sequence
  synthetic polynucleotide sequence
ctgcagcttcatggaggaca

SEQ ID NO: 41375 - DNA, 21 bp, Artificial sequence
  synthetic polynucleotide sequence
agccaaggtgcacctacctga

SEQ ID NO: 41376 - DNA, 20 bp, Artificial sequence
  synthetic polynucleotide sequence
gtctcggagctgccacggca

SEQ ID NO: 41377 - DNA, 20 bp, Artificial sequence
  synthetic polynucleotide sequence
ctcagccttccagacccaga

SEQ ID NO: 41378 - DNA, 21 bp, Artificial sequence
  synthetic polynucleotide sequence
ctcagacagaaggcgttcaca

SEQ ID NO: 41379 - DNA, 21 bp, Artificial sequence
  synthetic polynucleotide sequence
gcagagcccagcagaaggaga

SEQ ID NO: 41380 - DNA, 21 bp, Artificial sequence
  synthetic polynucleotide sequence
agctctgctaagcccacctga

SEQ ID NO: 41381 - DNA, 21 bp, Artificial sequence
  synthetic polynucleotide sequence
tcaggagagaggccctatcca

SEQ ID NO: 41382 - DNA, 20 bp, Artificial sequence
  synthetic polynucleotide sequence
tcccacactcgctacactga

SEQ ID NO: 41383 - DNA, 20 bp, Artificial sequence
  synthetic polynucleotide sequence
aacccaaatctcagtgggca

SEQ ID NO: 41384 - DNA, 20 bp, Artificial sequence
  synthetic polynucleotide sequence
gatcatcagcaactgaccca

SEQ ID NO: 41385 - DNA, 21 bp, Artificial sequence
  synthetic polynucleotide sequence
atgtcaccagcgtggacccta

SEQ ID NO: 41386 - DNA, 20 bp, Artificial sequence
  synthetic polynucleotide sequence
tgggacccatctgctgagga

SEQ ID NO: 41387 - DNA, 22 bp, Artificial sequence
  synthetic polynucleotide sequence
gacaccacagcgaaagatcaca

SEQ ID NO: 41388 - DNA, 20 bp, Artificial sequence
  synthetic polynucleotide sequence
gtggaggaggaacacccgga

SEQ ID NO: 41389 - DNA, 22 bp, Artificial sequence
  synthetic polynucleotide sequence
attgtgacagtgacaagggtga

SEQ ID NO: 41390 - DNA, 18 bp, Artificial sequence
  synthetic polynucleotide sequence
tgcggcatgtaacgagca

SEQ ID NO: 41391 - DNA, 20 bp, Artificial sequence
  synthetic polynucleotide sequence
gggagccctgttcacaggaa

SEQ ID NO: 41392 - DNA, 19 bp, Artificial sequence
  synthetic polynucleotide sequence
tggctcatgagaaccagca

SEQ ID NO: 41393 - DNA, 22 bp, Artificial sequence
  synthetic polynucleotide sequence
ccaattacagcacgagagagca

SEQ ID NO: 41394 - DNA, 20 bp, Artificial sequence
  synthetic polynucleotide sequence
tgcatacctcatggccgcga

SEQ ID NO: 41395 - DNA, 18 bp, Artificial sequence
  synthetic polynucleotide sequence
tgggtcaccaagggccca

SEQ ID NO: 41396 - DNA, 18 bp, Artificial sequence
  synthetic polynucleotide sequence
cagcttgggtggcaagga

SEQ ID NO: 41397 - DNA, 21 bp, Artificial sequence
  synthetic polynucleotide sequence
tgccgagcgtactggaagaca

SEQ ID NO: 41398 - DNA, 20 bp, Artificial sequence
  synthetic polynucleotide sequence
ccggggtccaaagtctgcga

SEQ ID NO: 41399 - DNA, 19 bp, Artificial sequence
  synthetic polynucleotide sequence
cagcaccgacggatggcca

SEQ ID NO: 41400 - DNA, 20 bp, Artificial sequence
  synthetic polynucleotide sequence
ctgaggtccggatcccggaa

SEQ ID NO: 41401 - DNA, 20 bp, Artificial sequence
  synthetic polynucleotide sequence
agacggccagcagtcacaga

SEQ ID NO: 41402 - DNA, 20 bp, Artificial sequence
  synthetic polynucleotide sequence
cggaggtcagggtcccggaa

SEQ ID NO: 41403 - DNA, 21 bp, Artificial sequence
  synthetic polynucleotide sequence
gtcaataatgccacggcccga

SEQ ID NO: 41404 - DNA, 20 bp, Artificial sequence
  synthetic polynucleotide sequence
cgaagatgtgcgccccggta

SEQ ID NO: 41405 - DNA, 21 bp, Artificial sequence
  synthetic polynucleotide sequence
tcacagacagaacctgagcca

SEQ ID NO: 41406 - DNA, 21 bp, Artificial sequence
  synthetic polynucleotide sequence
gcctggacactgactgctgca

SEQ ID NO: 41407 - DNA, 18 bp, Artificial sequence
  synthetic polynucleotide sequence
caacagccaggctcacca

SEQ ID NO: 41408 - DNA, 19 bp, Artificial sequence
  synthetic polynucleotide sequence
tggtgtaaggcctgaccca

SEQ ID NO: 41409 - DNA, 18 bp, Artificial sequence
  synthetic polynucleotide sequence
cgccactgtcacagccaa

SEQ ID NO: 41410 - DNA, 18 bp, Artificial sequence
  synthetic polynucleotide sequence
tggccacttgaccaggga

SEQ ID NO: 41411 - DNA, 18 bp, Artificial sequence
  synthetic polynucleotide sequence
aatcagccgaggcgagca

SEQ ID NO: 41412 - DNA, 18 bp, Artificial sequence
  synthetic polynucleotide sequence
ctggtagccggtgggaga

SEQ ID NO: 41413 - DNA, 20 bp, Artificial sequence
  synthetic polynucleotide sequence
caggcggggccactaaccaa

SEQ ID NO: 41414 - DNA, 20 bp, Artificial sequence
  synthetic polynucleotide sequence
tagctggttcagaagagcga

SEQ ID NO: 41415 - DNA, 20 bp, Artificial sequence
  synthetic polynucleotide sequence
ctggaaaaccaggaccgaca

SEQ ID NO: 41416 - DNA, 21 bp, Artificial sequence
  synthetic polynucleotide sequence
catcccgagactcaaaggcca

SEQ ID NO: 41417 - DNA, 20 bp, Artificial sequence
  synthetic polynucleotide sequence
ttcaggcgccctccggagga

SEQ ID NO: 41418 - DNA, 20 bp, Artificial sequence
  synthetic polynucleotide sequence
tccgtgggagaccgcctgaa

SEQ ID NO: 41419 - DNA, 21 bp, Artificial sequence
  synthetic polynucleotide sequence
tggtggagatgtcgcgcccaa

SEQ ID NO: 41420 - DNA, 19 bp, Artificial sequence
  synthetic polynucleotide sequence
ttcaccacgtcacactcga

SEQ ID NO: 41421 - DNA, 20 bp, Artificial sequence
  synthetic polynucleotide sequence
gagaccagcctaggaagcga

SEQ ID NO: 41422 - DNA, 19 bp, Artificial sequence
  synthetic polynucleotide sequence
ggtcaggagaaggagcgca

SEQ ID NO: 41423 - DNA, 20 bp, Artificial sequence
  synthetic polynucleotide sequence
agcgcaatcaccggaccaca

SEQ ID NO: 41424 - DNA, 22 bp, Artificial sequence
  synthetic polynucleotide sequence
tatgcatagacgtggggaagca

SEQ ID NO: 41425 - DNA, 22 bp, Artificial sequence
  synthetic polynucleotide sequence
aagtgggtttgcaaggagacca

SEQ ID NO: 41426 - DNA, 20 bp, Artificial sequence
  synthetic polynucleotide sequence
gttcctcgtacactggggga

SEQ ID NO: 41427 - DNA, 21 bp, Artificial sequence
  synthetic polynucleotide sequence
gattggcaacctggaccccaa

SEQ ID NO: 41428 - DNA, 20 bp, Artificial sequence
  synthetic polynucleotide sequence
cctcgaggctgtccctccaa

SEQ ID NO: 41429 - DNA, 23 bp, Artificial sequence
  synthetic polynucleotide sequence
ggtgcgacctcagactaatgaca

SEQ ID NO: 41430 - DNA, 23 bp, Artificial sequence
  synthetic polynucleotide sequence
ggtaggcacaattatcaccccca

SEQ ID NO: 41431 - DNA, 21 bp, Artificial sequence
  synthetic polynucleotide sequence
ccagcccctacagtccagcaa

SEQ ID NO: 41432 - DNA, 20 bp, Artificial sequence
  synthetic polynucleotide sequence
ggctgccttcacaagcccca

SEQ ID NO: 41433 - DNA, 20 bp, Artificial sequence
  synthetic polynucleotide sequence
atcccaggcagccagaggaa

SEQ ID NO: 41434 - DNA, 20 bp, Artificial sequence
  synthetic polynucleotide sequence
cttctgctgcaggaggagga

SEQ ID NO: 41435 - DNA, 21 bp, Artificial sequence
  synthetic polynucleotide sequence
ggcgctggaatccaactgcca

SEQ ID NO: 41436 - DNA, 20 bp, Artificial sequence
  synthetic polynucleotide sequence
tggggggtaaagaggctgga

SEQ ID NO: 41437 - DNA, 21 bp, Artificial sequence
  synthetic polynucleotide sequence
cactggagctgcatacgcaca

SEQ ID NO: 41438 - DNA, 18 bp, Artificial sequence
  synthetic polynucleotide sequence
caggtgccgctgcggtga

SEQ ID NO: 41439 - DNA, 21 bp, Artificial sequence
  synthetic polynucleotide sequence
cagatgcagagctccagagga

SEQ ID NO: 41440 - DNA, 22 bp, Artificial sequence
  synthetic polynucleotide sequence
gaaacagatggagcagagctga

SEQ ID NO: 41441 - DNA, 19 bp, Artificial sequence
  synthetic polynucleotide sequence
tacaggaccaccacctcca

SEQ ID NO: 41442 - DNA, 22 bp, Artificial sequence
  synthetic polynucleotide sequence
aaaaagagagggtggagcagga

SEQ ID NO: 41443 - DNA, 18 bp, Artificial sequence
  synthetic polynucleotide sequence
ccgcaaaccaagggccaa

SEQ ID NO: 41444 - DNA, 18 bp, Artificial sequence
  synthetic polynucleotide sequence
cgccatgagcgagactca

SEQ ID NO: 41445 - DNA, 21 bp, Artificial sequence
  synthetic polynucleotide sequence
aaggcagctcaacaccacaca

SEQ ID NO: 41446 - DNA, 20 bp, Artificial sequence
  synthetic polynucleotide sequence
ctttccatcaggcagctcca

SEQ ID NO: 41447 - DNA, 20 bp, Artificial sequence
  synthetic polynucleotide sequence
gtcaaggaccgggagactca

SEQ ID NO: 41448 - DNA, 19 bp, Artificial sequence
  synthetic polynucleotide sequence
cctgcatgatccacacgga

SEQ ID NO: 41449 - DNA, 19 bp, Artificial sequence
  synthetic polynucleotide sequence
gaccacagcctgcccgcaa

SEQ ID NO: 41450 - DNA, 20 bp, Artificial sequence
  synthetic polynucleotide sequence
ctggggcttgcactccacca

SEQ ID NO: 41451 - DNA, 21 bp, Artificial sequence
  synthetic polynucleotide sequence
ggggcccagattgcagatgga

SEQ ID NO: 41452 - DNA, 22 bp, Artificial sequence
  synthetic polynucleotide sequence
acatagccaaaccctttgccga

SEQ ID NO: 41453 - DNA, 18 bp, Artificial sequence
  synthetic polynucleotide sequence
accggccacctatgacca

SEQ ID NO: 41454 - DNA, 18 bp, Artificial sequence
  synthetic polynucleotide sequence
gcgcctggtactgcacga

SEQ ID NO: 41455 - DNA, 21 bp, Artificial sequence
  synthetic polynucleotide sequence
ctggcggcaagaattcgacca

SEQ ID NO: 41456 - DNA, 19 bp, Artificial sequence
  synthetic polynucleotide sequence
tgctagaggcactgagcta

SEQ ID NO: 41457 - DNA, 18 bp, Artificial sequence
  synthetic polynucleotide sequence
tcaggagctgctgccaca

SEQ ID NO: 41458 - DNA, 19 bp, Artificial sequence
  synthetic polynucleotide sequence
ccctctccaacagtgggga

SEQ ID NO: 41459 - DNA, 25 bp, Artificial sequence
  synthetic polynucleotide sequence
aagcaacggtcaaatctccaagcga

SEQ ID NO: 41460 - DNA, 21 bp, Artificial sequence
  synthetic polynucleotide sequence
aaagaccatccaggacccaca

SEQ ID NO: 41461 - DNA, 22 bp, Artificial sequence
  synthetic polynucleotide sequence
aagaagaaggggaagccagaga

SEQ ID NO: 41462 - DNA, 21 bp, Artificial sequence
  synthetic polynucleotide sequence
acctcattgcccagatcccca

SEQ ID NO: 41463 - DNA, 21 bp, Artificial sequence
  synthetic polynucleotide sequence
acgtctcagggacacagggaa

SEQ ID NO: 41464 - DNA, 21 bp, Artificial sequence
  synthetic polynucleotide sequence
gatactgaagggcagaggcca

SEQ ID NO: 41465 - DNA, 20 bp, Artificial sequence
  synthetic polynucleotide sequence
aagttcgcccgcagctcaca

SEQ ID NO: 41466 - DNA, 21 bp, Artificial sequence
  synthetic polynucleotide sequence
ccagatgatcgggactgagca

SEQ ID NO: 41467 - DNA, 21 bp, Artificial sequence
  synthetic polynucleotide sequence
tgacccagagaaagaggtgga

SEQ ID NO: 41468 - DNA, 21 bp, Artificial sequence
  synthetic polynucleotide sequence
acagacatggcagccactgca

SEQ ID NO: 41469 - DNA, 18 bp, Artificial sequence
  synthetic polynucleotide sequence
acagccacgatcgccaca

SEQ ID NO: 41470 - DNA, 18 bp, Artificial sequence
  synthetic polynucleotide sequence
gggacctgaatggcagca

SEQ ID NO: 41471 - DNA, 21 bp, Artificial sequence
  synthetic polynucleotide sequence
ggtatgcgacacacgggccaa

SEQ ID NO: 41472 - DNA, 21 bp, Artificial sequence
  synthetic polynucleotide sequence
ttcatgactcccacagcagga

SEQ ID NO: 41473 - DNA, 22 bp, Artificial sequence
  synthetic polynucleotide sequence
acatcaacgtggaagccagcaa

SEQ ID NO: 41474 - DNA, 21 bp, Artificial sequence
  synthetic polynucleotide sequence
tcacattcgatgaccggacca

SEQ ID NO: 41475 - DNA, 18 bp, Artificial sequence
  synthetic polynucleotide sequence
gcccaagcgcaagaagca

SEQ ID NO: 41476 - DNA, 18 bp, Artificial sequence
  synthetic polynucleotide sequence
gcctcaatgggagccgta

SEQ ID NO: 41477 - DNA, 20 bp, Artificial sequence
  synthetic polynucleotide sequence
gaccggcccaagtgaggaga

SEQ ID NO: 41478 - DNA, 20 bp, Artificial sequence
  synthetic polynucleotide sequence
gcatgccatcaggagtccga

SEQ ID NO: 41479 - DNA, 21 bp, Artificial sequence
  synthetic polynucleotide sequence
ctagcagcaggtacgaaagga

SEQ ID NO: 41480 - DNA, 20 bp, Artificial sequence
  synthetic polynucleotide sequence
gtaccttggcgccactggga

SEQ ID NO: 41481 - DNA, 21 bp, Artificial sequence
  synthetic polynucleotide sequence
atctcaacctcgacaggcgaa

SEQ ID NO: 41482 - DNA, 21 bp, Artificial sequence
  synthetic polynucleotide sequence
tgtcccatcaaatcctggcca

SEQ ID NO: 41483 - DNA, 21 bp, Artificial sequence
  synthetic polynucleotide sequence
ctccctcaatggagcacacca

SEQ ID NO: 41484 - DNA, 21 bp, Artificial sequence
  synthetic polynucleotide sequence
gcatagctgacgttgcaggca

SEQ ID NO: 41485 - DNA, 21 bp, Artificial sequence
  synthetic polynucleotide sequence
catgatgggaccccttaccca

SEQ ID NO: 41486 - DNA, 21 bp, Artificial sequence
  synthetic polynucleotide sequence
aggcacaggggtgtactggga

SEQ ID NO: 41487 - DNA, 21 bp, Artificial sequence
  synthetic polynucleotide sequence
ccagccaacatgatgggccca

SEQ ID NO: 41488 - DNA, 21 bp, Artificial sequence
  synthetic polynucleotide sequence
gtctggggagaggtatcagca

SEQ ID NO: 41489 - DNA, 18 bp, Artificial sequence
  synthetic polynucleotide sequence
gcggagctcagatgcaca

SEQ ID NO: 41490 - DNA, 18 bp, Artificial sequence
  synthetic polynucleotide sequence
cgccaacggtcactggga

SEQ ID NO: 41491 - DNA, 21 bp, Artificial sequence
  synthetic polynucleotide sequence
ttgtgacagggttggcagaca

SEQ ID NO: 41492 - DNA, 18 bp, Artificial sequence
  synthetic polynucleotide sequence
cggcttcctccagggcca

SEQ ID NO: 41493 - DNA, 21 bp, Artificial sequence
  synthetic polynucleotide sequence
gccgcgacagttacagcagca

SEQ ID NO: 41494 - DNA, 20 bp, Artificial sequence
  synthetic polynucleotide sequence
gaatcacgctggggagggca

SEQ ID NO: 41495 - DNA, 19 bp, Artificial sequence
  synthetic polynucleotide sequence
cctacagcggcgaccacga

SEQ ID NO: 41496 - DNA, 21 bp, Artificial sequence
  synthetic polynucleotide sequence
ccgtttccatgggcagaggga

SEQ ID NO: 41497 - DNA, 20 bp, Artificial sequence
  synthetic polynucleotide sequence
ggtgaggcccttggtagaga

SEQ ID NO: 41498 - DNA, 20 bp, Artificial sequence
  synthetic polynucleotide sequence
cgtggcaggtgcttccacca

SEQ ID NO: 41499 - DNA, 18 bp, Artificial sequence
  synthetic polynucleotide sequence
ccccgaaatgccagtcga

SEQ ID NO: 41500 - DNA, 18 bp, Artificial sequence
  synthetic polynucleotide sequence
ggtcaccgtcctgcacga

SEQ ID NO: 41501 - DNA, 23 bp, Artificial sequence
  synthetic polynucleotide sequence
aaaaaccactagcacattccgca

SEQ ID NO: 41502 - DNA, 21 bp, Artificial sequence
  synthetic polynucleotide sequence
catcaccttcccaggtgacca

SEQ ID NO: 41503 - DNA, 20 bp, Artificial sequence
  synthetic polynucleotide sequence
ctgcagatgctctccggaga

SEQ ID NO: 41504 - DNA, 18 bp, Artificial sequence
  synthetic polynucleotide sequence
tggagacctgggtgagca

SEQ ID NO: 41505 - DNA, 18 bp, Artificial sequence
  synthetic polynucleotide sequence
gatgagcgccacagccaa

SEQ ID NO: 41506 - DNA, 19 bp, Artificial sequence
  synthetic polynucleotide sequence
gcaggagtactgcacggca

SEQ ID NO: 41507 - DNA, 21 bp, Artificial sequence
  synthetic polynucleotide sequence
ggacgctcagcaccttccgaa

SEQ ID NO: 41508 - DNA, 18 bp, Artificial sequence
  synthetic polynucleotide sequence
tccagccccggttgggga

SEQ ID NO: 41509 - DNA, 19 bp, Artificial sequence
  synthetic polynucleotide sequence
agaacagaggctggaccca

SEQ ID NO: 41510 - DNA, 19 bp, Artificial sequence
  synthetic polynucleotide sequence
gcataaagctgcagccaca

SEQ ID NO: 41511 - DNA, 18 bp, Artificial sequence
  synthetic polynucleotide sequence
gcggtggggacgtagcaa

SEQ ID NO: 41512 - DNA, 18 bp, Artificial sequence
  synthetic polynucleotide sequence
gactggttgccggaccca

SEQ ID NO: 41513 - DNA, 20 bp, Artificial sequence
  synthetic polynucleotide sequence
aagacctgctcctcccgaga

SEQ ID NO: 41514 - DNA, 21 bp, Artificial sequence
  synthetic polynucleotide sequence
gggacagttaaggcggcaaga

SEQ ID NO: 41515 - DNA, 21 bp, Artificial sequence
  synthetic polynucleotide sequence
tctgcccaacactgtacctca

SEQ ID NO: 41516 - DNA, 18 bp, Artificial sequence
  synthetic polynucleotide sequence
gcatgcagtgaagcggga

SEQ ID NO: 41517 - DNA, 21 bp, Artificial sequence
  synthetic polynucleotide sequence
agcacacttcatcgcacggga

SEQ ID NO: 41518 - DNA, 20 bp, Artificial sequence
  synthetic polynucleotide sequence
atgggagatggctggggtca

SEQ ID NO: 41519 - DNA, 19 bp, Artificial sequence
  synthetic polynucleotide sequence
cgcttaccccagagcagca

SEQ ID NO: 41520 - DNA, 18 bp, Artificial sequence
  synthetic polynucleotide sequence
acccctgcagcaggagga

SEQ ID NO: 41521 - DNA, 21 bp, Artificial sequence
  synthetic polynucleotide sequence
gtgccatctgcaggaaccaca

SEQ ID NO: 41522 - DNA, 20 bp, Artificial sequence
  synthetic polynucleotide sequence
ccagcgagagatgcagtgga

SEQ ID NO: 41523 - DNA, 22 bp, Artificial sequence
  synthetic polynucleotide sequence
aatcgggaagagaacacgggaa

SEQ ID NO: 41524 - DNA, 22 bp, Artificial sequence
  synthetic polynucleotide sequence
caatgtaaggtcctcagccgga

SEQ ID NO: 41525 - DNA, 21 bp, Artificial sequence
  synthetic polynucleotide sequence
atcagtgggcacagtaccaca

SEQ ID NO: 41526 - DNA, 21 bp, Artificial sequence
  synthetic polynucleotide sequence
atacaggagcctatggtgcca

SEQ ID NO: 41527 - DNA, 18 bp, Artificial sequence
  synthetic polynucleotide sequence
agcagatgccaggctcca

SEQ ID NO: 41528 - DNA, 18 bp, Artificial sequence
  synthetic polynucleotide sequence
ccatcccactggcggaga

SEQ ID NO: 41529 - DNA, 21 bp, Artificial sequence
  synthetic polynucleotide sequence
agcgcgaatagaactccacga

SEQ ID NO: 41530 - DNA, 18 bp, Artificial sequence
  synthetic polynucleotide sequence
gtcccgcacttcgccgga

SEQ ID NO: 41531 - DNA, 20 bp, Artificial sequence
  synthetic polynucleotide sequence
acgtctgcagccaagacgca

SEQ ID NO: 41532 - DNA, 19 bp, Artificial sequence
  synthetic polynucleotide sequence
gagacggcgggagtggcaa

SEQ ID NO: 41533 - DNA, 21 bp, Artificial sequence
  synthetic polynucleotide sequence
cagcctgtcactccacacaca

SEQ ID NO: 41534 - DNA, 22 bp, Artificial sequence
  synthetic polynucleotide sequence
aaagcaggcaaacacgtcgtca

SEQ ID NO: 41535 - DNA, 20 bp, Artificial sequence
  synthetic polynucleotide sequence
ggcatgggcaccaactacca

SEQ ID NO: 41536 - DNA, 18 bp, Artificial sequence
  synthetic polynucleotide sequence
tggcccccgctggacaca

SEQ ID NO: 41537 - DNA, 19 bp, Artificial sequence
  synthetic polynucleotide sequence
tcgatggccaggtggtcca

SEQ ID NO: 41538 - DNA, 21 bp, Artificial sequence
  synthetic polynucleotide sequence
ggataacgttcactcccgcca

SEQ ID NO: 41539 - DNA, 22 bp, Artificial sequence
  synthetic polynucleotide sequence
tgtacccaaaagcagtgcagga

SEQ ID NO: 41540 - DNA, 19 bp, Artificial sequence
  synthetic polynucleotide sequence
cccgtagcccagttcccca

SEQ ID NO: 41541 - DNA, 22 bp, Artificial sequence
  synthetic polynucleotide sequence
gcaagggaagccacagaactga

SEQ ID NO: 41542 - DNA, 21 bp, Artificial sequence
  synthetic polynucleotide sequence
ccttgactgcatctgagccca

SEQ ID NO: 41543 - DNA, 19 bp, Artificial sequence
  synthetic polynucleotide sequence
gccttggagcacccacaga

SEQ ID NO: 41544 - DNA, 18 bp, Artificial sequence
  synthetic polynucleotide sequence
gtgaggggctggagcaga

SEQ ID NO: 41545 - DNA, 21 bp, Artificial sequence
  synthetic polynucleotide sequence
ggctgcgagcactatgacaga

SEQ ID NO: 41546 - DNA, 19 bp, Artificial sequence
  synthetic polynucleotide sequence
tatcatgacacaagcggca

SEQ ID NO: 41547 - DNA, 20 bp, Artificial sequence
  synthetic polynucleotide sequence
atgacccttggacagcagga

SEQ ID NO: 41548 - DNA, 22 bp, Artificial sequence
  synthetic polynucleotide sequence
atgccaacacaggtcatcagca

SEQ ID NO: 41549 - DNA, 21 bp, Artificial sequence
  synthetic polynucleotide sequence
ctacctaggaaaccccgcaga

SEQ ID NO: 41550 - DNA, 21 bp, Artificial sequence
  synthetic polynucleotide sequence
aaggcagtgaactcctcccga

SEQ ID NO: 41551 - DNA, 20 bp, Artificial sequence
  synthetic polynucleotide sequence
caggtgggatccaactgcaa

SEQ ID NO: 41552 - DNA, 18 bp, Artificial sequence
  synthetic polynucleotide sequence
agcgcctcctcttgtgca

SEQ ID NO: 41553 - DNA, 19 bp, Artificial sequence
  synthetic polynucleotide sequence
cgatggccactcgagagga

SEQ ID NO: 41554 - DNA, 18 bp, Artificial sequence
  synthetic polynucleotide sequence
gatcccggaagtcccgga

SEQ ID NO: 41555 - DNA, 21 bp, Artificial sequence
  synthetic polynucleotide sequence
actctgaaccagcctccacca

SEQ ID NO: 41556 - DNA, 22 bp, Artificial sequence
  synthetic polynucleotide sequence
aataagaggtggtggaggctga

SEQ ID NO: 41557 - DNA, 21 bp, Artificial sequence
  synthetic polynucleotide sequence
ctacagaggtgaagggggaga

SEQ ID NO: 41558 - DNA, 20 bp, Artificial sequence
  synthetic polynucleotide sequence
ccttcactcctccaggggga

SEQ ID NO: 41559 - DNA, 22 bp, Artificial sequence
  synthetic polynucleotide sequence
gggagattcaaaggaggctgga

SEQ ID NO: 41560 - DNA, 20 bp, Artificial sequence
  synthetic polynucleotide sequence
tgcctgcggctcgaagggaa

SEQ ID NO: 41561 - DNA, 21 bp, Artificial sequence
  synthetic polynucleotide sequence
cagagggagtgagcaagagga

SEQ ID NO: 41562 - DNA, 25 bp, Artificial sequence
  synthetic polynucleotide sequence
cttggatcacagaaggagcagagca

SEQ ID NO: 41563 - DNA, 22 bp, Artificial sequence
  synthetic polynucleotide sequence
gcaagctgggaatggtgaggaa

SEQ ID NO: 41564 - DNA, 21 bp, Artificial sequence
  synthetic polynucleotide sequence
accaggactgagacttcgcca

SEQ ID NO: 41565 - DNA, 18 bp, Artificial sequence
  synthetic polynucleotide sequence
caccctggcacagtccaa

SEQ ID NO: 41566 - DNA, 21 bp, Artificial sequence
  synthetic polynucleotide sequence
cattacgagcttgggcagaga

SEQ ID NO: 41567 - DNA, 18 bp, Artificial sequence
  synthetic polynucleotide sequence
acctacgcagtgcaccca

SEQ ID NO: 41568 - DNA, 18 bp, Artificial sequence
  synthetic polynucleotide sequence
gctccaggccctcagcca

SEQ ID NO: 41569 - DNA, 18 bp, Artificial sequence
  synthetic polynucleotide sequence
atacctggccgtggcgga

SEQ ID NO: 41570 - DNA, 18 bp, Artificial sequence
  synthetic polynucleotide sequence
gcgggcactttcagccca

SEQ ID NO: 41571 - DNA, 22 bp, Artificial sequence
  synthetic polynucleotide sequence
aatctggggaggcacatacaca

SEQ ID NO: 41572 - DNA, 22 bp, Artificial sequence
  synthetic polynucleotide sequence
ctacctcaggtgaagaggccaa

SEQ ID NO: 41573 - DNA, 22 bp, Artificial sequence
  synthetic polynucleotide sequence
tggagcagaagtgcacacagga

SEQ ID NO: 41574 - DNA, 22 bp, Artificial sequence
  synthetic polynucleotide sequence
ggtagagaagcttggcatccca

SEQ ID NO: 41575 - DNA, 18 bp, Artificial sequence
  synthetic polynucleotide sequence
cccaggttgggatgccaa

SEQ ID NO: 41576 - DNA, 18 bp, Artificial sequence
  synthetic polynucleotide sequence
aggcttgggaaggaccca

SEQ ID NO: 41577 - DNA, 20 bp, Artificial sequence
  synthetic polynucleotide sequence
catccgctactcgccgctga

SEQ ID NO: 41578 - DNA, 20 bp, Artificial sequence
  synthetic polynucleotide sequence
caaggttgaggaggcgtgga

SEQ ID NO: 41579 - DNA, 20 bp, Artificial sequence
  synthetic polynucleotide sequence
cttgtcccacccccacagca

SEQ ID NO: 41580 - DNA, 20 bp, Artificial sequence
  synthetic polynucleotide sequence
ctgtgggcagcccttgcaga

SEQ ID NO: 41581 - DNA, 22 bp, Artificial sequence
  synthetic polynucleotide sequence
ccagcactcagaacaacagcaa

SEQ ID NO: 41582 - DNA, 20 bp, Artificial sequence
  synthetic polynucleotide sequence
gggcagctcctccgatgcca

SEQ ID NO: 41583 - DNA, 20 bp, Artificial sequence
  synthetic polynucleotide sequence
atcagcctcatcccaccaga

SEQ ID NO: 41584 - DNA, 18 bp, Artificial sequence
  synthetic polynucleotide sequence
ccatgggcacctcaggga

SEQ ID NO: 41585 - DNA, 20 bp, Artificial sequence
  synthetic polynucleotide sequence
tatcaactctgacagcccga

SEQ ID NO: 41586 - DNA, 21 bp, Artificial sequence
  synthetic polynucleotide sequence
gtccagagcaagtgcaaggca

SEQ ID NO: 41587 - DNA, 21 bp, Artificial sequence
  synthetic polynucleotide sequence
ggatgggaaagggtgcagcaa

SEQ ID NO: 41588 - DNA, 19 bp, Artificial sequence
  synthetic polynucleotide sequence
tgagacgattcagccctga

SEQ ID NO: 41589 - DNA, 20 bp, Artificial sequence
  synthetic polynucleotide sequence
ggaggcatggaggacgcaca

SEQ ID NO: 41590 - DNA, 19 bp, Artificial sequence
  synthetic polynucleotide sequence
ccgtggaagatgcgggcca

SEQ ID NO: 41591 - DNA, 21 bp, Artificial sequence
  synthetic polynucleotide sequence
agaacgactggatggaggaga

SEQ ID NO: 41592 - DNA, 22 bp, Artificial sequence
  synthetic polynucleotide sequence
agtaatagagacggcaccagga

SEQ ID NO: 41593 - DNA, 21 bp, Artificial sequence
  synthetic polynucleotide sequence
ctccctacacaaaaggctcca

SEQ ID NO: 41594 - DNA, 18 bp, Artificial sequence
  synthetic polynucleotide sequence
ccgaagtgcacaagggca

SEQ ID NO: 41595 - DNA, 21 bp, Artificial sequence
  synthetic polynucleotide sequence
tgctgtcagagaagctccgca

SEQ ID NO: 41596 - DNA, 19 bp, Artificial sequence
  synthetic polynucleotide sequence
ggtgtccaggaggctgcca

SEQ ID NO: 41597 - DNA, 21 bp, Artificial sequence
  synthetic polynucleotide sequence
gatgaagaagcagaggggcca

SEQ ID NO: 41598 - DNA, 19 bp, Artificial sequence
  synthetic polynucleotide sequence
tttagtgacccgtaccgca

SEQ ID NO: 41599 - DNA, 21 bp, Artificial sequence
  synthetic polynucleotide sequence
agcccctaatccgcagccaga

SEQ ID NO: 41600 - DNA, 20 bp, Artificial sequence
  synthetic polynucleotide sequence
tgtccacgtctgagggcaca

SEQ ID NO: 41601 - DNA, 20 bp, Artificial sequence
  synthetic polynucleotide sequence
cgaccggttcctgcacgaga

SEQ ID NO: 41602 - DNA, 20 bp, Artificial sequence
  synthetic polynucleotide sequence
aggccaccagtccgatgaca

SEQ ID NO: 41603 - DNA, 19 bp, Artificial sequence
  synthetic polynucleotide sequence
ccaagcaaggacgacgaca

SEQ ID NO: 41604 - DNA, 19 bp, Artificial sequence
  synthetic polynucleotide sequence
gtgccttaggaacagcgga

SEQ ID NO: 41605 - DNA, 18 bp, Artificial sequence
  synthetic polynucleotide sequence
gccgctggcactggagca

SEQ ID NO: 41606 - DNA, 20 bp, Artificial sequence
  synthetic polynucleotide sequence
cttgaggtcaggctcacaca

SEQ ID NO: 41607 - DNA, 18 bp, Artificial sequence
  synthetic polynucleotide sequence
ctgcccagaaggcaccaa

SEQ ID NO: 41608 - DNA, 20 bp, Artificial sequence
  synthetic polynucleotide sequence
gacccactactccagtgcca

SEQ ID NO: 41609 - DNA, 18 bp, Artificial sequence
  synthetic polynucleotide sequence
aactgccctctgcacgga

SEQ ID NO: 41610 - DNA, 21 bp, Artificial sequence
  synthetic polynucleotide sequence
ccccactgagcacagacacca

SEQ ID NO: 41611 - DNA, 18 bp, Artificial sequence
  synthetic polynucleotide sequence
aactgccctctccacgga

SEQ ID NO: 41612 - DNA, 18 bp, Artificial sequence
  synthetic polynucleotide sequence
gccgcttctggcaagcca

SEQ ID NO: 41613 - DNA, 20 bp, Artificial sequence
  synthetic polynucleotide sequence
gaaacggagcccacctggca

SEQ ID NO: 41614 - DNA, 20 bp, Artificial sequence
  synthetic polynucleotide sequence
gggtcgtgcaggccaatcca

SEQ ID NO: 41615 - DNA, 22 bp, Artificial sequence
  synthetic polynucleotide sequence
agcagtgacagcatgggagaga

SEQ ID NO: 41616 - DNA, 18 bp, Artificial sequence
  synthetic polynucleotide sequence
ggaattggcgcctgctga

SEQ ID NO: 41617 - DNA, 18 bp, Artificial sequence
  synthetic polynucleotide sequence
acctggcatccgtcgaca

SEQ ID NO: 41618 - DNA, 21 bp, Artificial sequence
  synthetic polynucleotide sequence
cctcagggtactccatcagca

SEQ ID NO: 41619 - DNA, 21 bp, Artificial sequence
  synthetic polynucleotide sequence
cgccctacgaggacctggaga

SEQ ID NO: 41620 - DNA, 18 bp, Artificial sequence
  synthetic polynucleotide sequence
atggtcgcgaggcaggta

SEQ ID NO: 41621 - DNA, 21 bp, Artificial sequence
  synthetic polynucleotide sequence
aagtccagagagagcagacca

SEQ ID NO: 41622 - DNA, 18 bp, Artificial sequence
  synthetic polynucleotide sequence
gttgccggcacctcccca

SEQ ID NO: 41623 - DNA, 20 bp, Artificial sequence
  synthetic polynucleotide sequence
ctaccgctgccgcacgtcga

SEQ ID NO: 41624 - DNA, 20 bp, Artificial sequence
  synthetic polynucleotide sequence
gaggtggcatccacactgga

SEQ ID NO: 41625 - DNA, 21 bp, Artificial sequence
  synthetic polynucleotide sequence
caagcctgacagcagagagga

SEQ ID NO: 41626 - DNA, 20 bp, Artificial sequence
  synthetic polynucleotide sequence
cagcagctggaagctccaga

SEQ ID NO: 41627 - DNA, 18 bp, Artificial sequence
  synthetic polynucleotide sequence
cccgaccagggttcccaa

SEQ ID NO: 41628 - DNA, 20 bp, Artificial sequence
  synthetic polynucleotide sequence
gagtcagggagatcacccca

SEQ ID NO: 41629 - DNA, 20 bp, Artificial sequence
  synthetic polynucleotide sequence
ctccatcgcagaccgaggca

SEQ ID NO: 41630 - DNA, 21 bp, Artificial sequence
  synthetic polynucleotide sequence
acagtcgaacaccacagcgca

SEQ ID NO: 41631 - DNA, 20 bp, Artificial sequence
  synthetic polynucleotide sequence
cttaccagtccaccacggca

SEQ ID NO: 41632 - DNA, 20 bp, Artificial sequence
  synthetic polynucleotide sequence
ctggccaaaaggggttgcca

SEQ ID NO: 41633 - DNA, 18 bp, Artificial sequence
  synthetic polynucleotide sequence
ccgagtggagccaaccca

SEQ ID NO: 41634 - DNA, 19 bp, Artificial sequence
  synthetic polynucleotide sequence
gctggaggaatccgaagca

SEQ ID NO: 41635 - DNA, 19 bp, Artificial sequence
  synthetic polynucleotide sequence
ttggctacctgagccgaga

SEQ ID NO: 41636 - DNA, 18 bp, Artificial sequence
  synthetic polynucleotide sequence
ctcgcacatggctaggca

SEQ ID NO: 41637 - DNA, 22 bp, Artificial sequence
  synthetic polynucleotide sequence
agctcgcagtacagactctgca

SEQ ID NO: 41638 - DNA, 20 bp, Artificial sequence
  synthetic polynucleotide sequence
tggcagatggctcctcacca

SEQ ID NO: 41639 - DNA, 18 bp, Artificial sequence
  synthetic polynucleotide sequence
gacgcttctggcgacgaa

SEQ ID NO: 41640 - DNA, 18 bp, Artificial sequence
  synthetic polynucleotide sequence
agctggtcccactgggca

SEQ ID NO: 41641 - DNA, 18 bp, Artificial sequence
  synthetic polynucleotide sequence
tcatcccagcggtgggaa

SEQ ID NO: 41642 - DNA, 20 bp, Artificial sequence
  synthetic polynucleotide sequence
ctgaccacactgcatcacca

SEQ ID NO: 41643 - DNA, 18 bp, Artificial sequence
  synthetic polynucleotide sequence
ctgagtcactgccggcaa

SEQ ID NO: 41644 - DNA, 19 bp, Artificial sequence
  synthetic polynucleotide sequence
gggacaggaaggtcagcca

SEQ ID NO: 41645 - DNA, 21 bp, Artificial sequence
  synthetic polynucleotide sequence
tcctggctagacaagtccaca

SEQ ID NO: 41646 - DNA, 20 bp, Artificial sequence
  synthetic polynucleotide sequence
gatggtagatccccaaggca

SEQ ID NO: 41647 - DNA, 18 bp, Artificial sequence
  synthetic polynucleotide sequence
gtatccacgcagagcgca

SEQ ID NO: 41648 - DNA, 18 bp, Artificial sequence
  synthetic polynucleotide sequence
ggtaggggaagcgagcca

SEQ ID NO: 41649 - DNA, 22 bp, Artificial sequence
  synthetic polynucleotide sequence
acctaccgacaccaagcaacca

SEQ ID NO: 41650 - DNA, 20 bp, Artificial sequence
  synthetic polynucleotide sequence
agcacaaagccttcccccca

SEQ ID NO: 41651 - DNA, 20 bp, Artificial sequence
  synthetic polynucleotide sequence
gggtggtgaaggaacaggca

SEQ ID NO: 41652 - DNA, 22 bp, Artificial sequence
  synthetic polynucleotide sequence
aacaaacccatctgcccagtga

SEQ ID NO: 41653 - DNA, 21 bp, Artificial sequence
  synthetic polynucleotide sequence
atccccaagaaccatgcctga

SEQ ID NO: 41654 - DNA, 21 bp, Artificial sequence
  synthetic polynucleotide sequence
tgcatcatgtccagcccccca

SEQ ID NO: 41655 - DNA, 20 bp, Artificial sequence
  synthetic polynucleotide sequence
atgcaggtggtccagaagga

SEQ ID NO: 41656 - DNA, 18 bp, Artificial sequence
  synthetic polynucleotide sequence
ccttctgaaccaccccca

SEQ ID NO: 41657 - DNA, 20 bp, Artificial sequence
  synthetic polynucleotide sequence
ctgcttccctgaggaggaga

SEQ ID NO: 41658 - DNA, 20 bp, Artificial sequence
  synthetic polynucleotide sequence
agaggagtagctgaccggga

SEQ ID NO: 41659 - DNA, 20 bp, Artificial sequence
  synthetic polynucleotide sequence
gtgccagagcgtcacctcca

SEQ ID NO: 41660 - DNA, 18 bp, Artificial sequence
  synthetic polynucleotide sequence
gtggtctcggcgcgcaca

SEQ ID NO: 41661 - DNA, 23 bp, Artificial sequence
  synthetic polynucleotide sequence
ctagtgtcaaaagccaaggcaga

SEQ ID NO: 41662 - DNA, 20 bp, Artificial sequence
  synthetic polynucleotide sequence
cagtggtccagtccaccaca

SEQ ID NO: 41663 - DNA, 18 bp, Artificial sequence
  synthetic polynucleotide sequence
gccaggtgtgaagcagca

SEQ ID NO: 41664 - DNA, 18 bp, Artificial sequence
  synthetic polynucleotide sequence
tggtgcctcgcaggcaga

SEQ ID NO: 41665 - DNA, 22 bp, Artificial sequence
  synthetic polynucleotide sequence
aatccaccgaagaggagcacaa

SEQ ID NO: 41666 - DNA, 20 bp, Artificial sequence
  synthetic polynucleotide sequence
ggtcggcagatgtgcaggaa

SEQ ID NO: 41667 - DNA, 18 bp, Artificial sequence
  synthetic polynucleotide sequence
caagcaccaaccacggga

SEQ ID NO: 41668 - DNA, 19 bp, Artificial sequence
  synthetic polynucleotide sequence
gggatcacttgcagaggca

SEQ ID NO: 41669 - DNA, 21 bp, Artificial sequence
  synthetic polynucleotide sequence
cgcaaagcaacacgtgcagga

SEQ ID NO: 41670 - DNA, 20 bp, Artificial sequence
  synthetic polynucleotide sequence
ctcgcagtccagggcgtaga

SEQ ID NO: 41671 - DNA, 20 bp, Artificial sequence
  synthetic polynucleotide sequence
gtgtaaggagcatcacggga

SEQ ID NO: 41672 - DNA, 21 bp, Artificial sequence
  synthetic polynucleotide sequence
gcaagtggacagagccctgga

SEQ ID NO: 41673 - DNA, 21 bp, Artificial sequence
  synthetic polynucleotide sequence
gaaacagttgggtcagagcga

SEQ ID NO: 41674 - DNA, 20 bp, Artificial sequence
  synthetic polynucleotide sequence
cccacgcccaccatctcaca

SEQ ID NO: 41675 - DNA, 20 bp, Artificial sequence
  synthetic polynucleotide sequence
aagcagagcagcagacagca

SEQ ID NO: 41676 - DNA, 18 bp, Artificial sequence
  synthetic polynucleotide sequence
cgagtgcttccccagcca

SEQ ID NO: 41677 - DNA, 19 bp, Artificial sequence
  synthetic polynucleotide sequence
gaccgacggagcccagcaa

SEQ ID NO: 41678 - DNA, 21 bp, Artificial sequence
  synthetic polynucleotide sequence
agcgggactgaatgggctcga

SEQ ID NO: 41679 - DNA, 20 bp, Artificial sequence
  synthetic polynucleotide sequence
ctcaccaaagatgctcagca

SEQ ID NO: 41680 - DNA, 18 bp, Artificial sequence
  synthetic polynucleotide sequence
caatgctgggagcaggca

SEQ ID NO: 41681 - DNA, 19 bp, Artificial sequence
  synthetic polynucleotide sequence
ggagtcgaaaaccacccga

SEQ ID NO: 41682 - DNA, 19 bp, Artificial sequence
  synthetic polynucleotide sequence
gacagaggcttgaagcgga

SEQ ID NO: 41683 - DNA, 18 bp, Artificial sequence
  synthetic polynucleotide sequence
gaaggggttggcactgca

SEQ ID NO: 41684 - DNA, 19 bp, Artificial sequence
  synthetic polynucleotide sequence
gcagcaatgagggagctca

SEQ ID NO: 41685 - DNA, 18 bp, Artificial sequence
  synthetic polynucleotide sequence
gcagcacctggacagcca

SEQ ID NO: 41686 - DNA, 18 bp, Artificial sequence
  synthetic polynucleotide sequence
agcaggcctaaccgcaga

SEQ ID NO: 41687 - DNA, 21 bp, Artificial sequence
  synthetic polynucleotide sequence
aggaacccgtctacctggaga

SEQ ID NO: 41688 - DNA, 22 bp, Artificial sequence
  synthetic polynucleotide sequence
tccaggtcagtcaggtcagaca

SEQ ID NO: 41689 - DNA, 18 bp, Artificial sequence
  synthetic polynucleotide sequence
cttcggccgcggctccaa

SEQ ID NO: 41690 - DNA, 21 bp, Artificial sequence
  synthetic polynucleotide sequence
tccacttccaacactggccca

SEQ ID NO: 41691 - DNA, 20 bp, Artificial sequence
  synthetic polynucleotide sequence
gttcacatccaggaggggca

SEQ ID NO: 41692 - DNA, 21 bp, Artificial sequence
  synthetic polynucleotide sequence
accagacagcatctctggaga

SEQ ID NO: 41693 - DNA, 20 bp, Artificial sequence
  synthetic polynucleotide sequence
gtgtaccccaagtaccccaa

SEQ ID NO: 41694 - DNA, 18 bp, Artificial sequence
  synthetic polynucleotide sequence
ggagctccgcggcttcga

SEQ ID NO: 41695 - DNA, 18 bp, Artificial sequence
  synthetic polynucleotide sequence
ctgccggatgactgcaca

SEQ ID NO: 41696 - DNA, 18 bp, Artificial sequence
  synthetic polynucleotide sequence
gggttctcaggaccccca

SEQ ID NO: 41697 - DNA, 21 bp, Artificial sequence
  synthetic polynucleotide sequence
ggacctgggagtctgcagaga

SEQ ID NO: 41698 - DNA, 21 bp, Artificial sequence
  synthetic polynucleotide sequence
acttgcggtctacgaagagga

SEQ ID NO: 41699 - DNA, 21 bp, Artificial sequence
  synthetic polynucleotide sequence
gcaagttacagcgagtgggga

SEQ ID NO: 41700 - DNA, 21 bp, Artificial sequence
  synthetic polynucleotide sequence
aaggagccaaaaatgggcgca

SEQ ID NO: 41701 - DNA, 22 bp, Artificial sequence
  synthetic polynucleotide sequence
gcaaggaatctgtgaaccgaca

SEQ ID NO: 41702 - DNA, 20 bp, Artificial sequence
  synthetic polynucleotide sequence
aatggacgccagggctcgca

SEQ ID NO: 41703 - DNA, 23 bp, Artificial sequence
  synthetic polynucleotide sequence
gaataggaaggagcaagctgaga

SEQ ID NO: 41704 - DNA, 21 bp, Artificial sequence
  synthetic polynucleotide sequence
gattccttgcacacgcccaca

SEQ ID NO: 41705 - DNA, 20 bp, Artificial sequence
  synthetic polynucleotide sequence
cctggatgcagccactgcca

SEQ ID NO: 41706 - DNA, 19 bp, Artificial sequence
  synthetic polynucleotide sequence
gacacaggccagcctggga

SEQ ID NO: 41707 - DNA, 22 bp, Artificial sequence
  synthetic polynucleotide sequence
atgagcaaagaggaggtcgaca

SEQ ID NO: 41708 - DNA, 20 bp, Artificial sequence
  synthetic polynucleotide sequence
agatgaagcccacgctgcca

SEQ ID NO: 41709 - DNA, 18 bp, Artificial sequence
  synthetic polynucleotide sequence
ccatcagaagtgccggca

SEQ ID NO: 41710 - DNA, 20 bp, Artificial sequence
  synthetic polynucleotide sequence
gaagactgcgttcaccagca

SEQ ID NO: 41711 - DNA, 22 bp, Artificial sequence
  synthetic polynucleotide sequence
gataagaaagccagccgccaca

SEQ ID NO: 41712 - DNA, 19 bp, Artificial sequence
  synthetic polynucleotide sequence
ttgtccagcattcccggga

SEQ ID NO: 41713 - DNA, 18 bp, Artificial sequence
  synthetic polynucleotide sequence
agcggcagcaggaagcga

SEQ ID NO: 41714 - DNA, 20 bp, Artificial sequence
  synthetic polynucleotide sequence
aaagcagatggggcatacga

SEQ ID NO: 41715 - DNA, 22 bp, Artificial sequence
  synthetic polynucleotide sequence
taaactgaccagcctggagaca

SEQ ID NO: 41716 - DNA, 18 bp, Artificial sequence
  synthetic polynucleotide sequence
ccagccagcaccccacca

SEQ ID NO: 41717 - DNA, 20 bp, Artificial sequence
  synthetic polynucleotide sequence
ctggagagctggctcaccca

SEQ ID NO: 41718 - DNA, 20 bp, Artificial sequence
  synthetic polynucleotide sequence
gagcgacgtgtagcgccgca

SEQ ID NO: 41719 - DNA, 18 bp, Artificial sequence
  synthetic polynucleotide sequence
caagctgaccctgcagca

SEQ ID NO: 41720 - DNA, 18 bp, Artificial sequence
  synthetic polynucleotide sequence
tcaggtcccggatcacca

SEQ ID NO: 41721 - DNA, 21 bp, Artificial sequence
  synthetic polynucleotide sequence
gagtgagccttcccagaagca

SEQ ID NO: 41722 - DNA, 22 bp, Artificial sequence
  synthetic polynucleotide sequence
atctggcttgacacgaatccca

SEQ ID NO: 41723 - DNA, 20 bp, Artificial sequence
  synthetic polynucleotide sequence
cggccctccctcatgacaca

SEQ ID NO: 41724 - DNA, 20 bp, Artificial sequence
  synthetic polynucleotide sequence
ggggagtgactggggtagga

SEQ ID NO: 41725 - DNA, 18 bp, Artificial sequence
  synthetic polynucleotide sequence
agtgggcaggctccacca

SEQ ID NO: 41726 - DNA, 20 bp, Artificial sequence
  synthetic polynucleotide sequence
aaccttgaggactgggcaga

SEQ ID NO: 41727 - DNA, 21 bp, Artificial sequence
  synthetic polynucleotide sequence
tcccactctccctcaagccaa

SEQ ID NO: 41728 - DNA, 21 bp, Artificial sequence
  synthetic polynucleotide sequence
gtccaagccatgcatcgacca

SEQ ID NO: 41729 - DNA, 21 bp, Artificial sequence
  synthetic polynucleotide sequence
cccactcctactccaacccca

SEQ ID NO: 41730 - DNA, 20 bp, Artificial sequence
  synthetic polynucleotide sequence
gtctgggctagcctggagca

SEQ ID NO: 41731 - DNA, 19 bp, Artificial sequence
  synthetic polynucleotide sequence
cagccccagcatggagcca

SEQ ID NO: 41732 - DNA, 20 bp, Artificial sequence
  synthetic polynucleotide sequence
agtgtccaccaggaagccca

SEQ ID NO: 41733 - DNA, 18 bp, Artificial sequence
  synthetic polynucleotide sequence
tggagcgtgacgtggaca

SEQ ID NO: 41734 - DNA, 19 bp, Artificial sequence
  synthetic polynucleotide sequence
ccatcggggtgtagccaga

SEQ ID NO: 41735 - DNA, 21 bp, Artificial sequence
  synthetic polynucleotide sequence
agcgcaaaccgtggatgtgca

SEQ ID NO: 41736 - DNA, 18 bp, Artificial sequence
  synthetic polynucleotide sequence
tcccgcgctgccagtcga

SEQ ID NO: 41737 - DNA, 22 bp, Artificial sequence
  synthetic polynucleotide sequence
aatgagagctcaagacccagga

SEQ ID NO: 41738 - DNA, 20 bp, Artificial sequence
  synthetic polynucleotide sequence
gcgacatggacatccctcca

SEQ ID NO: 41739 - DNA, 23 bp, Artificial sequence
  synthetic polynucleotide sequence
cataatacagcctagcagacgga

SEQ ID NO: 41740 - DNA, 20 bp, Artificial sequence
  synthetic polynucleotide sequence
ctaaacgacctgtgcggcga

SEQ ID NO: 41741 - DNA, 20 bp, Artificial sequence
  synthetic polynucleotide sequence
cgccagtgtcagcgacagca

SEQ ID NO: 41742 - DNA, 21 bp, Artificial sequence
  synthetic polynucleotide sequence
gcagagagaagagctggggta

SEQ ID NO: 41743 - DNA, 18 bp, Artificial sequence
  synthetic polynucleotide sequence
ccaagcctcggaagagca

SEQ ID NO: 41744 - DNA, 18 bp, Artificial sequence
  synthetic polynucleotide sequence
cgcaggatgacacgctga

SEQ ID NO: 41745 - DNA, 19 bp, Artificial sequence
  synthetic polynucleotide sequence
cagccacctctccccacca

SEQ ID NO: 41746 - DNA, 21 bp, Artificial sequence
  synthetic polynucleotide sequence
ctggactcggatgatacggca

SEQ ID NO: 41747 - DNA, 20 bp, Artificial sequence
  synthetic polynucleotide sequence
agtccagtcgcccccagaga

SEQ ID NO: 41748 - DNA, 20 bp, Artificial sequence
  synthetic polynucleotide sequence
cctcagcttggggagacaga

SEQ ID NO: 41749 - DNA, 21 bp, Artificial sequence
  synthetic polynucleotide sequence
ctacattcagcaccagggcca

SEQ ID NO: 41750 - DNA, 22 bp, Artificial sequence
  synthetic polynucleotide sequence
ctttacagacccacgacaggga

SEQ ID NO: 41751 - DNA, 18 bp, Artificial sequence
  synthetic polynucleotide sequence
cgtggagatccaggccaa

SEQ ID NO: 41752 - DNA, 18 bp, Artificial sequence
  synthetic polynucleotide sequence
tcccagtcctccacagca

SEQ ID NO: 41753 - DNA, 20 bp, Artificial sequence
  synthetic polynucleotide sequence
ctggccatgtcctacgagga

SEQ ID NO: 41754 - DNA, 19 bp, Artificial sequence
  synthetic polynucleotide sequence
ccagtgtgtagccaggcca

SEQ ID NO: 41755 - DNA, 22 bp, Artificial sequence
  synthetic polynucleotide sequence
tatgacctgcagacaggacaga

SEQ ID NO: 41756 - DNA, 19 bp, Artificial sequence
  synthetic polynucleotide sequence
cacccagagcttcccctca

SEQ ID NO: 41757 - DNA, 21 bp, Artificial sequence
  synthetic polynucleotide sequence
tgtgtacagacttggcgagga

SEQ ID NO: 41758 - DNA, 21 bp, Artificial sequence
  synthetic polynucleotide sequence
tcacatgtgacacagagggga

SEQ ID NO: 41759 - DNA, 21 bp, Artificial sequence
  synthetic polynucleotide sequence
tggaccagactcggtgcctga

SEQ ID NO: 41760 - DNA, 22 bp, Artificial sequence
  synthetic polynucleotide sequence
aatccatcagcagacacagcga

SEQ ID NO: 41761 - DNA, 21 bp, Artificial sequence
  synthetic polynucleotide sequence
agatactggcagagctgccaa

SEQ ID NO: 41762 - DNA, 20 bp, Artificial sequence
  synthetic polynucleotide sequence
tgtgtctgaggcaccggcca

SEQ ID NO: 41763 - DNA, 22 bp, Artificial sequence
  synthetic polynucleotide sequence
tcatggagcagaaactggggaa

SEQ ID NO: 41764 - DNA, 21 bp, Artificial sequence
  synthetic polynucleotide sequence
actgccagattcccctgcaga

SEQ ID NO: 41765 - DNA, 19 bp, Artificial sequence
  synthetic polynucleotide sequence
tgacttccgcactcgagaa

SEQ ID NO: 41766 - DNA, 18 bp, Artificial sequence
  synthetic polynucleotide sequence
cccttcagccagggacca

SEQ ID NO: 41767 - DNA, 21 bp, Artificial sequence
  synthetic polynucleotide sequence
tggaagacccagaaggcgtga

SEQ ID NO: 41768 - DNA, 18 bp, Artificial sequence
  synthetic polynucleotide sequence
gccgagactgcccctcca

SEQ ID NO: 41769 - DNA, 18 bp, Artificial sequence
  synthetic polynucleotide sequence
atgacgcccagctgcaca

SEQ ID NO: 41770 - DNA, 18 bp, Artificial sequence
  synthetic polynucleotide sequence
tcccagcctctgccagga

SEQ ID NO: 41771 - DNA, 18 bp, Artificial sequence
  synthetic polynucleotide sequence
ccgagaaggacaaggcca

SEQ ID NO: 41772 - DNA, 19 bp, Artificial sequence
  synthetic polynucleotide sequence
cgctcacagagtccggaca

SEQ ID NO: 41773 - DNA, 18 bp, Artificial sequence
  synthetic polynucleotide sequence
gcctcacggtggagcaga

SEQ ID NO: 41774 - DNA, 21 bp, Artificial sequence
  synthetic polynucleotide sequence
tgggttcctgaatgttcctga

SEQ ID NO: 41775 - DNA, 21 bp, Artificial sequence
  synthetic polynucleotide sequence
ctgcccacctagaactcagga

SEQ ID NO: 41776 - DNA, 20 bp, Artificial sequence
  synthetic polynucleotide sequence
ccggttcagcagctccacca

SEQ ID NO: 41777 - DNA, 20 bp, Artificial sequence
  synthetic polynucleotide sequence
gacgaggatgaacctgcaga

SEQ ID NO: 41778 - DNA, 18 bp, Artificial sequence
  synthetic polynucleotide sequence
gcggctgaggcttgggca

SEQ ID NO: 41779 - DNA, 20 bp, Artificial sequence
  synthetic polynucleotide sequence
tcctggaaaccagaggccca

SEQ ID NO: 41780 - DNA, 20 bp, Artificial sequence
  synthetic polynucleotide sequence
tgaggcaggagcagctgcaa

SEQ ID NO: 41781 - DNA, 22 bp, Artificial sequence
  synthetic polynucleotide sequence
atcactcaacctaccctccaca

SEQ ID NO: 41782 - DNA, 19 bp, Artificial sequence
  synthetic polynucleotide sequence
tgcaggtaaatgagcgtga

SEQ ID NO: 41783 - DNA, 21 bp, Artificial sequence
  synthetic polynucleotide sequence
ggcgaggctcatctacgagga

SEQ ID NO: 41784 - DNA, 18 bp, Artificial sequence
  synthetic polynucleotide sequence
gcagctgcgcgtcgtcga

SEQ ID NO: 41785 - DNA, 22 bp, Artificial sequence
  synthetic polynucleotide sequence
agcacagctgtggtcagaagca

SEQ ID NO: 41786 - DNA, 21 bp, Artificial sequence
  synthetic polynucleotide sequence
gaagtcttcacaggccagcca

SEQ ID NO: 41787 - DNA, 22 bp, Artificial sequence
  synthetic polynucleotide sequence
atgggatcagagcggatggaga

SEQ ID NO: 41788 - DNA, 20 bp, Artificial sequence
  synthetic polynucleotide sequence
agcatgcgttggacccgcga

SEQ ID NO: 41789 - DNA, 21 bp, Artificial sequence
  synthetic polynucleotide sequence
aaccatatggccgacagccaa

SEQ ID NO: 41790 - DNA, 21 bp, Artificial sequence
  synthetic polynucleotide sequence
gtgagaggttgcaagcctgca

SEQ ID NO: 41791 - DNA, 20 bp, Artificial sequence
  synthetic polynucleotide sequence
gaaccccctctacctccaga

SEQ ID NO: 41792 - DNA, 20 bp, Artificial sequence
  synthetic polynucleotide sequence
atgttctccgacaggcacca

SEQ ID NO: 41793 - DNA, 20 bp, Artificial sequence
  synthetic polynucleotide sequence
cagggaagagacaagccgga

SEQ ID NO: 41794 - DNA, 18 bp, Artificial sequence
  synthetic polynucleotide sequence
agctggacgggttgacca

SEQ ID NO: 41795 - DNA, 21 bp, Artificial sequence
  synthetic polynucleotide sequence
ctcctccagaagccagactca

SEQ ID NO: 41796 - DNA, 19 bp, Artificial sequence
  synthetic polynucleotide sequence
tgtccagggaatcacgcca

SEQ ID NO: 41797 - DNA, 21 bp, Artificial sequence
  synthetic polynucleotide sequence
atccaacccttggatcagcga

SEQ ID NO: 41798 - DNA, 20 bp, Artificial sequence
  synthetic polynucleotide sequence
tagaaactggtcccgcccca

SEQ ID NO: 41799 - DNA, 21 bp, Artificial sequence
  synthetic polynucleotide sequence
ggttttggcatggacgaggca

SEQ ID NO: 41800 - DNA, 19 bp, Artificial sequence
  synthetic polynucleotide sequence
ttcaggtcctccactgcca

SEQ ID NO: 41801 - DNA, 21 bp, Artificial sequence
  synthetic polynucleotide sequence
ccctgtaccgagagctggtca

SEQ ID NO: 41802 - DNA, 18 bp, Artificial sequence
  synthetic polynucleotide sequence
ggtgtgcctgacgggcca

SEQ ID NO: 41803 - DNA, 20 bp, Artificial sequence
  synthetic polynucleotide sequence
gctgtcccaaagccagagga

SEQ ID NO: 41804 - DNA, 20 bp, Artificial sequence
  synthetic polynucleotide sequence
tggcagcaagtggaggggaa

SEQ ID NO: 41805 - DNA, 20 bp, Artificial sequence
  synthetic polynucleotide sequence
caccatctgcccctcaccca

SEQ ID NO: 41806 - DNA, 20 bp, Artificial sequence
  synthetic polynucleotide sequence
acttgggtgagagcctggca

SEQ ID NO: 41807 - DNA, 20 bp, Artificial sequence
  synthetic polynucleotide sequence
agaggcttggggtagggcca

SEQ ID NO: 41808 - DNA, 20 bp, Artificial sequence
  synthetic polynucleotide sequence
cctactggccagcacgcaca

SEQ ID NO: 41809 - DNA, 19 bp, Artificial sequence
  synthetic polynucleotide sequence
gctgcaggtcaaccgggca

SEQ ID NO: 41810 - DNA, 21 bp, Artificial sequence
  synthetic polynucleotide sequence
cctctgtgatggcagcaagga

SEQ ID NO: 41811 - DNA, 21 bp, Artificial sequence
  synthetic polynucleotide sequence
atgtggggtccataacctcca

SEQ ID NO: 41812 - DNA, 19 bp, Artificial sequence
  synthetic polynucleotide sequence
cccagtgcagctgcctgca

SEQ ID NO: 41813 - DNA, 21 bp, Artificial sequence
  synthetic polynucleotide sequence
ttccacctgtcaccctagcaa

SEQ ID NO: 41814 - DNA, 19 bp, Artificial sequence
  synthetic polynucleotide sequence
ttccagagcatggatgcca

SEQ ID NO: 41815 - DNA, 20 bp, Artificial sequence
  synthetic polynucleotide sequence
cctcacctgtccccaagcca

SEQ ID NO: 41816 - DNA, 21 bp, Artificial sequence
  synthetic polynucleotide sequence
gccccagaatacaccgtgcca

SEQ ID NO: 41817 - DNA, 20 bp, Artificial sequence
  synthetic polynucleotide sequence
gcagccacaggccgtgtgga

SEQ ID NO: 41818 - DNA, 20 bp, Artificial sequence
  synthetic polynucleotide sequence
caggaccctcggagtgggca

SEQ ID NO: 41819 - DNA, 19 bp, Artificial sequence
  synthetic polynucleotide sequence
ggctggcaccgcatagcca

SEQ ID NO: 41820 - DNA, 22 bp, Artificial sequence
  synthetic polynucleotide sequence
aagttgtcaatccacggcagca

SEQ ID NO: 41821 - DNA, 18 bp, Artificial sequence
  synthetic polynucleotide sequence
tcacaggcaacctcgcca

SEQ ID NO: 41822 - DNA, 18 bp, Artificial sequence
  synthetic polynucleotide sequence
agccgaagatgtgggcga

SEQ ID NO: 41823 - DNA, 19 bp, Artificial sequence
  synthetic polynucleotide sequence
gctcggcacacctggccaa

SEQ ID NO: 41824 - DNA, 18 bp, Artificial sequence
  synthetic polynucleotide sequence
agccgcactggtcccgca

SEQ ID NO: 41825 - DNA, 21 bp, Artificial sequence
  synthetic polynucleotide sequence
tgcccgaaaagtcccgaggaa

SEQ ID NO: 41826 - DNA, 20 bp, Artificial sequence
  synthetic polynucleotide sequence
tctgaggcttccacacagca

SEQ ID NO: 41827 - DNA, 18 bp, Artificial sequence
  synthetic polynucleotide sequence
ccccgtgccctcacccaa

SEQ ID NO: 41828 - DNA, 21 bp, Artificial sequence
  synthetic polynucleotide sequence
agaagacagcgaacagcacga

SEQ ID NO: 41829 - DNA, 20 bp, Artificial sequence
  synthetic polynucleotide sequence
ctactccctggctgccagca

SEQ ID NO: 41830 - DNA, 20 bp, Artificial sequence
  synthetic polynucleotide sequence
agccaagaagccagctgcca

SEQ ID NO: 41831 - DNA, 20 bp, Artificial sequence
  synthetic polynucleotide sequence
tcaagtcggccaagatctga

SEQ ID NO: 41832 - DNA, 19 bp, Artificial sequence
  synthetic polynucleotide sequence
gaccttccccaagacagca

SEQ ID NO: 41833 - DNA, 18 bp, Artificial sequence
  synthetic polynucleotide sequence
acatccctgaggacccca

SEQ ID NO: 41834 - DNA, 20 bp, Artificial sequence
  synthetic polynucleotide sequence
caagggtaccgaggaagcca

SEQ ID NO: 41835 - DNA, 18 bp, Artificial sequence
  synthetic polynucleotide sequence
tcagcgtggtgacagcca

SEQ ID NO: 41836 - DNA, 18 bp, Artificial sequence
  synthetic polynucleotide sequence
ccgacggagatcagccca

SEQ ID NO: 41837 - DNA, 19 bp, Artificial sequence
  synthetic polynucleotide sequence
tgtagacacagccgggcaa

SEQ ID NO: 41838 - DNA, 21 bp, Artificial sequence
  synthetic polynucleotide sequence
ctgcattccaagattctgcca

SEQ ID NO: 41839 - DNA, 20 bp, Artificial sequence
  synthetic polynucleotide sequence
atgggaaaacccgggtgcca

SEQ ID NO: 41840 - DNA, 19 bp, Artificial sequence
  synthetic polynucleotide sequence
gcaccccaggactctgcca

SEQ ID NO: 41841 - DNA, 21 bp, Artificial sequence
  synthetic polynucleotide sequence
actggcactcctaatagccca

SEQ ID NO: 41842 - DNA, 21 bp, Artificial sequence
  synthetic polynucleotide sequence
tctccctgaggtaagcaagca

SEQ ID NO: 41843 - DNA, 18 bp, Artificial sequence
  synthetic polynucleotide sequence
gccaccacacagaaggca

SEQ ID NO: 41844 - DNA, 18 bp, Artificial sequence
  synthetic polynucleotide sequence
tggcaaagaacgctggga

SEQ ID NO: 41845 - DNA, 20 bp, Artificial sequence
  synthetic polynucleotide sequence
cgacggcgcgtgtggcaaga

SEQ ID NO: 41846 - DNA, 20 bp, Artificial sequence
  synthetic polynucleotide sequence
ccacctcaatgtcggccaca

SEQ ID NO: 41847 - DNA, 19 bp, Artificial sequence
  synthetic polynucleotide sequence
tcaaagcggatggggccca

SEQ ID NO: 41848 - DNA, 19 bp, Artificial sequence
  synthetic polynucleotide sequence
gcgatctgagccaggccca

SEQ ID NO: 41849 - DNA, 20 bp, Artificial sequence
  synthetic polynucleotide sequence
atgttcacctccagccccga

SEQ ID NO: 41850 - DNA, 19 bp, Artificial sequence
  synthetic polynucleotide sequence
gtcggccagctggtacgca

SEQ ID NO: 41851 - DNA, 19 bp, Artificial sequence
  synthetic polynucleotide sequence
gtctccggggacgagagca

SEQ ID NO: 41852 - DNA, 20 bp, Artificial sequence
  synthetic polynucleotide sequence
ccagacgggacagtcgtgga

SEQ ID NO: 41853 - DNA, 20 bp, Artificial sequence
  synthetic polynucleotide sequence
ctggccaagatgaagcagga

SEQ ID NO: 41854 - DNA, 17 bp, Artificial sequence
  synthetic polynucleotide sequence
tgcggacctggaggcca

SEQ ID NO: 41855 - DNA, 18 bp, Artificial sequence
  synthetic polynucleotide sequence
accacaggggccaggaga

SEQ ID NO: 41856 - DNA, 18 bp, Artificial sequence
  synthetic polynucleotide sequence
cctggaagacggcgtgga

SEQ ID NO: 41857 - DNA, 18 bp, Artificial sequence
  synthetic polynucleotide sequence
gcctgcgaacagatccga

SEQ ID NO: 41858 - DNA, 18 bp, Artificial sequence
  synthetic polynucleotide sequence
tcagagcgctgagagcca

SEQ ID NO: 41859 - DNA, 19 bp, Artificial sequence
  synthetic polynucleotide sequence
cactggccaagcagatcca

SEQ ID NO: 41860 - DNA, 18 bp, Artificial sequence
  synthetic polynucleotide sequence
ggttgagcacagcccgga

SEQ ID NO: 41861 - DNA, 22 bp, Artificial sequence
  synthetic polynucleotide sequence
tacaagcccacagtgtacgaga

SEQ ID NO: 41862 - DNA, 18 bp, Artificial sequence
  synthetic polynucleotide sequence
gcacaggggtacagggca

SEQ ID NO: 41863 - DNA, 21 bp, Artificial sequence
  synthetic polynucleotide sequence
gactacaaccagctgaggcca

SEQ ID NO: 41864 - DNA, 22 bp, Artificial sequence
  synthetic polynucleotide sequence
aggacataaggcacgtgaggca

SEQ ID NO: 41865 - DNA, 20 bp, Artificial sequence
  synthetic polynucleotide sequence
gtgcccaccgtcttcgacca

SEQ ID NO: 41866 - DNA, 22 bp, Artificial sequence
  synthetic polynucleotide sequence
agataaaggcctcagacggtca

SEQ ID NO: 41867 - DNA, 21 bp, Artificial sequence
  synthetic polynucleotide sequence
agctcctcaagctctggagga

SEQ ID NO: 41868 - DNA, 22 bp, Artificial sequence
  synthetic polynucleotide sequence
caaatcgtcgaagcacagtcca

SEQ ID NO: 41869 - DNA, 20 bp, Artificial sequence
  synthetic polynucleotide sequence
ccaaggccgacctgcccgaa

SEQ ID NO: 41870 - DNA, 19 bp, Artificial sequence
  synthetic polynucleotide sequence
gctgggccagcacaggaga

SEQ ID NO: 41871 - DNA, 20 bp, Artificial sequence
  synthetic polynucleotide sequence
ggcggcccgtgagactccaa

SEQ ID NO: 41872 - DNA, 20 bp, Artificial sequence
  synthetic polynucleotide sequence
gggctcacgacactgaagca

SEQ ID NO: 41873 - DNA, 20 bp, Artificial sequence
  synthetic polynucleotide sequence
taccggcccactgcgctgga

SEQ ID NO: 41874 - DNA, 22 bp, Artificial sequence
  synthetic polynucleotide sequence
caaagggaacgaagtcggtcaa

SEQ ID NO: 41875 - DNA, 18 bp, Artificial sequence
  synthetic polynucleotide sequence
agggtccgcagcccgaga

SEQ ID NO: 41876 - DNA, 20 bp, Artificial sequence
  synthetic polynucleotide sequence
cttgtgggcacatcagggta

SEQ ID NO: 41877 - DNA, 18 bp, Artificial sequence
  synthetic polynucleotide sequence
gcctggcaacgcgcagca

SEQ ID NO: 41878 - DNA, 20 bp, Artificial sequence
  synthetic polynucleotide sequence
gccagcctccttcgcaggaa

SEQ ID NO: 41879 - DNA, 22 bp, Artificial sequence
  synthetic polynucleotide sequence
atggaggagacatcagagggca

SEQ ID NO: 41880 - DNA, 21 bp, Artificial sequence
  synthetic polynucleotide sequence
ggggaaacacaggctgctgga

SEQ ID NO: 41881 - DNA, 21 bp, Artificial sequence
  synthetic polynucleotide sequence
gtgtcagtgaatgggcagcca

SEQ ID NO: 41882 - DNA, 21 bp, Artificial sequence
  synthetic polynucleotide sequence
tgggcagtctagagctgggca

SEQ ID NO: 41883 - DNA, 18 bp, Artificial sequence
  synthetic polynucleotide sequence
ctgacacccttggccaca

SEQ ID NO: 41884 - DNA, 18 bp, Artificial sequence
  synthetic polynucleotide sequence
cctgtgcggcacacagca

SEQ ID NO: 41885 - DNA, 22 bp, Artificial sequence
  synthetic polynucleotide sequence
gtcagcgtgaacagaaggccaa

SEQ ID NO: 41886 - DNA, 20 bp, Artificial sequence
  synthetic polynucleotide sequence
agggcaggacccggtaggga

SEQ ID NO: 41887 - DNA, 18 bp, Artificial sequence
  synthetic polynucleotide sequence
tcaacaagagccaggcca

SEQ ID NO: 41888 - DNA, 18 bp, Artificial sequence
  synthetic polynucleotide sequence
gcgggttctcggagagca

SEQ ID NO: 41889 - DNA, 20 bp, Artificial sequence
  synthetic polynucleotide sequence
acccacagctcaggaaccca

SEQ ID NO: 41890 - DNA, 21 bp, Artificial sequence
  synthetic polynucleotide sequence
acatcttctaagaggcgccga

SEQ ID NO: 41891 - DNA, 19 bp, Artificial sequence
  synthetic polynucleotide sequence
ggttgggaaagtctgccca

SEQ ID NO: 41892 - DNA, 22 bp, Artificial sequence
  synthetic polynucleotide sequence
tccagcattctctgccaagaca

SEQ ID NO: 41893 - DNA, 21 bp, Artificial sequence
  synthetic polynucleotide sequence
ggttggggagatgctgcggaa

SEQ ID NO: 41894 - DNA, 21 bp, Artificial sequence
  synthetic polynucleotide sequence
gaatcggggcacactctcaga

SEQ ID NO: 41895 - DNA, 21 bp, Artificial sequence
  synthetic polynucleotide sequence
gcacagcagctcagcctggaa

SEQ ID NO: 41896 - DNA, 21 bp, Artificial sequence
  synthetic polynucleotide sequence
cagaaggaagagcaagcgcaa

SEQ ID NO: 41897 - DNA, 20 bp, Artificial sequence
  synthetic polynucleotide sequence
tccagggaggttccaagaca

SEQ ID NO: 41898 - DNA, 18 bp, Artificial sequence
  synthetic polynucleotide sequence
ggcctggatctggcacga

SEQ ID NO: 41899 - DNA, 21 bp, Artificial sequence
  synthetic polynucleotide sequence
catggacccttcaagtggaca

SEQ ID NO: 41900 - DNA, 20 bp, Artificial sequence
  synthetic polynucleotide sequence
tagtgaagtcacagcctgca

SEQ ID NO: 41901 - DNA, 21 bp, Artificial sequence
  synthetic polynucleotide sequence
agtcctagtggcatgcagaca

SEQ ID NO: 41902 - DNA, 21 bp, Artificial sequence
  synthetic polynucleotide sequence
tctgcaaaggagacacggcga

SEQ ID NO: 41903 - DNA, 21 bp, Artificial sequence
  synthetic polynucleotide sequence
ggagagaccagacggaatcca

SEQ ID NO: 41904 - DNA, 21 bp, Artificial sequence
  synthetic polynucleotide sequence
aaggcagcttggaaacccaca

SEQ ID NO: 41905 - DNA, 20 bp, Artificial sequence
  synthetic polynucleotide sequence
cgggagctgctcacagacca

SEQ ID NO: 41906 - DNA, 20 bp, Artificial sequence
  synthetic polynucleotide sequence
agagcaggatccatgggcca

SEQ ID NO: 41907 - DNA, 18 bp, Artificial sequence
  synthetic polynucleotide sequence
aggagcaggagatgggca

SEQ ID NO: 41908 - DNA, 20 bp, Artificial sequence
  synthetic polynucleotide sequence
caccttctctgcgtcggaga

SEQ ID NO: 41909 - DNA, 20 bp, Artificial sequence
  synthetic polynucleotide sequence
ggaggtgaacctgggcccaa

SEQ ID NO: 41910 - DNA, 21 bp, Artificial sequence
  synthetic polynucleotide sequence
gctcttcctgcaccaccagga

SEQ ID NO: 41911 - DNA, 23 bp, Artificial sequence
  synthetic polynucleotide sequence
cctgacaccagtagagaaatgca

SEQ ID NO: 41912 - DNA, 23 bp, Artificial sequence
  synthetic polynucleotide sequence
cctcccaaatcagagcttggaca

SEQ ID NO: 41913 - DNA, 21 bp, Artificial sequence
  synthetic polynucleotide sequence
aagggagaagaacgagccgga

SEQ ID NO: 41914 - DNA, 21 bp, Artificial sequence
  synthetic polynucleotide sequence
tgcttgctgaggaatcccgga

SEQ ID NO: 41915 - DNA, 20 bp, Artificial sequence
  synthetic polynucleotide sequence
tacgcggggtcacagaggta

SEQ ID NO: 41916 - DNA, 19 bp, Artificial sequence
  synthetic polynucleotide sequence
ccaaccacacggcctccca

SEQ ID NO: 41917 - DNA, 18 bp, Artificial sequence
  synthetic polynucleotide sequence
tcacgcctcagcagcaca

SEQ ID NO: 41918 - DNA, 22 bp, Artificial sequence
  synthetic polynucleotide sequence
acctgctccaactgtacccaca

SEQ ID NO: 41919 - DNA, 18 bp, Artificial sequence
  synthetic polynucleotide sequence
tcgacaggcaagccgaga

SEQ ID NO: 41920 - DNA, 19 bp, Artificial sequence
  synthetic polynucleotide sequence
gcgtcccactagctgagca

SEQ ID NO: 41921 - DNA, 21 bp, Artificial sequence
  synthetic polynucleotide sequence
ctatggccgcatggaccacaa

SEQ ID NO: 41922 - DNA, 19 bp, Artificial sequence
  synthetic polynucleotide sequence
gccactgaggaggtgggga

SEQ ID NO: 41923 - DNA, 21 bp, Artificial sequence
  synthetic polynucleotide sequence
ccaggctccaagacactgcca

SEQ ID NO: 41924 - DNA, 18 bp, Artificial sequence
  synthetic polynucleotide sequence
ccgctccatccgcccgta

SEQ ID NO: 41925 - DNA, 20 bp, Artificial sequence
  synthetic polynucleotide sequence
cagggggctgtgacagagga

SEQ ID NO: 41926 - DNA, 21 bp, Artificial sequence
  synthetic polynucleotide sequence
gctttgaccccagcatcccca

SEQ ID NO: 41927 - DNA, 18 bp, Artificial sequence
  synthetic polynucleotide sequence
ctgacagcaaacccccga

SEQ ID NO: 41928 - DNA, 18 bp, Artificial sequence
  synthetic polynucleotide sequence
tgacgcagggaggcagga

SEQ ID NO: 41929 - DNA, 19 bp, Artificial sequence
  synthetic polynucleotide sequence
cgtacctggagcccgagca

SEQ ID NO: 41930 - DNA, 19 bp, Artificial sequence
  synthetic polynucleotide sequence
gtccaggggccggtagaca

SEQ ID NO: 41931 - DNA, 18 bp, Artificial sequence
  synthetic polynucleotide sequence
cccagagccaggtggaga

SEQ ID NO: 41932 - DNA, 18 bp, Artificial sequence
  synthetic polynucleotide sequence
gctcgagggcaatgcgca

SEQ ID NO: 41933 - DNA, 20 bp, Artificial sequence
  synthetic polynucleotide sequence
ccggacattggggacacgca

SEQ ID NO: 41934 - DNA, 19 bp, Artificial sequence
  synthetic polynucleotide sequence
ttcgggctggtagtgggca

SEQ ID NO: 41935 - DNA, 18 bp, Artificial sequence
  synthetic polynucleotide sequence
ctgccagtgccccggaga

SEQ ID NO: 41936 - DNA, 21 bp, Artificial sequence
  synthetic polynucleotide sequence
tcagcataacctggatgggca

SEQ ID NO: 41937 - DNA, 23 bp, Artificial sequence
  synthetic polynucleotide sequence
gtaaagatgacatgcctgcacca

SEQ ID NO: 41938 - DNA, 21 bp, Artificial sequence
  synthetic polynucleotide sequence
tggtcgtgctccacggactga

SEQ ID NO: 41939 - DNA, 21 bp, Artificial sequence
  synthetic polynucleotide sequence
tgaccgcggttgaaatgggca

SEQ ID NO: 41940 - DNA, 20 bp, Artificial sequence
  synthetic polynucleotide sequence
tgtcaaccgatagccctgga

SEQ ID NO: 41941 - DNA, 18 bp, Artificial sequence
  synthetic polynucleotide sequence
ggcctggggacccagcaa

SEQ ID NO: 41942 - DNA, 21 bp, Artificial sequence
  synthetic polynucleotide sequence
agccagcataaggtcactgga

SEQ ID NO: 41943 - DNA, 20 bp, Artificial sequence
  synthetic polynucleotide sequence
tgactgatagggagagggca

SEQ ID NO: 41944 - DNA, 20 bp, Artificial sequence
  synthetic polynucleotide sequence
caaatggcccccctcaccca

SEQ ID NO: 41945 - DNA, 18 bp, Artificial sequence
  synthetic polynucleotide sequence
ccgaggaaaggatcggca

SEQ ID NO: 41946 - DNA, 18 bp, Artificial sequence
  synthetic polynucleotide sequence
gccccgagatggtatcca

SEQ ID NO: 41947 - DNA, 20 bp, Artificial sequence
  synthetic polynucleotide sequence
atcccagtgcctgagaccaa

SEQ ID NO: 41948 - DNA, 20 bp, Artificial sequence
  synthetic polynucleotide sequence
gtgatgaactcgtcccacca

SEQ ID NO: 41949 - DNA, 21 bp, Artificial sequence
  synthetic polynucleotide sequence
gacagaagcctgccttaacca

SEQ ID NO: 41950 - DNA, 21 bp, Artificial sequence
  synthetic polynucleotide sequence
ccgggtaaggctgaagaccca

SEQ ID NO: 41951 - DNA, 21 bp, Artificial sequence
  synthetic polynucleotide sequence
agggggctgagagacaaggca

SEQ ID NO: 41952 - DNA, 21 bp, Artificial sequence
  synthetic polynucleotide sequence
ttgtctccaacttgcacccca

SEQ ID NO: 41953 - DNA, 21 bp, Artificial sequence
  synthetic polynucleotide sequence
gggtgagtgtgaacgcccaga

SEQ ID NO: 41954 - DNA, 20 bp, Artificial sequence
  synthetic polynucleotide sequence
cagacgttgacgtcggagca

SEQ ID NO: 41955 - DNA, 21 bp, Artificial sequence
  synthetic polynucleotide sequence
cgtgactgagaccgctgagga

SEQ ID NO: 41956 - DNA, 19 bp, Artificial sequence
  synthetic polynucleotide sequence
cccagtgacaggctccgga

SEQ ID NO: 41957 - DNA, 19 bp, Artificial sequence
  synthetic polynucleotide sequence
gaagacccagaggagccca

SEQ ID NO: 41958 - DNA, 22 bp, Artificial sequence
  synthetic polynucleotide sequence
ccaacagaaccctcagagagca

SEQ ID NO: 41959 - DNA, 19 bp, Artificial sequence
  synthetic polynucleotide sequence
tgagaaggtcggcaaggca

SEQ ID NO: 41960 - DNA, 19 bp, Artificial sequence
  synthetic polynucleotide sequence
gtcgtggcagggcaggaca

SEQ ID NO: 41961 - DNA, 20 bp, Artificial sequence
  synthetic polynucleotide sequence
aaagggcagagaccagggca

SEQ ID NO: 41962 - DNA, 20 bp, Artificial sequence
  synthetic polynucleotide sequence
tggatgaggagcacttgcca

SEQ ID NO: 41963 - DNA, 21 bp, Artificial sequence
  synthetic polynucleotide sequence
tcgagtccgacgtactgacga

SEQ ID NO: 41964 - DNA, 21 bp, Artificial sequence
  synthetic polynucleotide sequence
atagtagcggtatgcagcaga

SEQ ID NO: 41965 - DNA, 22 bp, Artificial sequence
  synthetic polynucleotide sequence
aagacccaggtcaggattgaca

SEQ ID NO: 41966 - DNA, 20 bp, Artificial sequence
  synthetic polynucleotide sequence
gaagccttccccacctcgca

SEQ ID NO: 41967 - DNA, 21 bp, Artificial sequence
  synthetic polynucleotide sequence
ccactgcgagccattcaccca

SEQ ID NO: 41968 - DNA, 21 bp, Artificial sequence
  synthetic polynucleotide sequence
acattcaggtgggtgagggaa

SEQ ID NO: 41969 - DNA, 22 bp, Artificial sequence
  synthetic polynucleotide sequence
gaaacattcacagccccggtca

SEQ ID NO: 41970 - DNA, 21 bp, Artificial sequence
  synthetic polynucleotide sequence
aagtgctctgaaggctcccaa

SEQ ID NO: 41971 - DNA, 21 bp, Artificial sequence
  synthetic polynucleotide sequence
caggacagagacctccaacca

SEQ ID NO: 41972 - DNA, 19 bp, Artificial sequence
  synthetic polynucleotide sequence
tctcacacctgcccgctca

SEQ ID NO: 41973 - DNA, 18 bp, Artificial sequence
  synthetic polynucleotide sequence
gacaggcacacaggccca

SEQ ID NO: 41974 - DNA, 18 bp, Artificial sequence
  synthetic polynucleotide sequence
acaagaacaggcgaggca

SEQ ID NO: 41975 - DNA, 19 bp, Artificial sequence
  synthetic polynucleotide sequence
gcagcgccttacggggtca

SEQ ID NO: 41976 - DNA, 20 bp, Artificial sequence
  synthetic polynucleotide sequence
catagcctcgtgggccagga

SEQ ID NO: 41977 - DNA, 18 bp, Artificial sequence
  synthetic polynucleotide sequence
ctgcggggacttcgggca

SEQ ID NO: 41978 - DNA, 19 bp, Artificial sequence
  synthetic polynucleotide sequence
ttggctgtggcatgaacca

SEQ ID NO: 41979 - DNA, 21 bp, Artificial sequence
  synthetic polynucleotide sequence
gtgagtctggcaagtcggaga

SEQ ID NO: 41980 - DNA, 22 bp, Artificial sequence
  synthetic polynucleotide sequence
cataagcacgagcaaatcgcca

SEQ ID NO: 41981 - DNA, 18 bp, Artificial sequence
  synthetic polynucleotide sequence
tccagccagaaaacccca

SEQ ID NO: 41982 - DNA, 19 bp, Artificial sequence
  synthetic polynucleotide sequence
taggaagctctggagggca

SEQ ID NO: 41983 - DNA, 18 bp, Artificial sequence
  synthetic polynucleotide sequence
ctcggctgagggacccga

SEQ ID NO: 41984 - DNA, 21 bp, Artificial sequence
  synthetic polynucleotide sequence
cctgaaccactcccatcacca

SEQ ID NO: 41985 - DNA, 20 bp, Artificial sequence
  synthetic polynucleotide sequence
aagatctggcctcccacgga

SEQ ID NO: 41986 - DNA, 19 bp, Artificial sequence
  synthetic polynucleotide sequence
tcccagtgtaccagtgcga

SEQ ID NO: 41987 - DNA, 21 bp, Artificial sequence
  synthetic polynucleotide sequence
tgggcagtgtcaaaccgggaa

SEQ ID NO: 41988 - DNA, 21 bp, Artificial sequence
  synthetic polynucleotide sequence
tcaggtacacaaggcttccca

SEQ ID NO: 41989 - DNA, 21 bp, Artificial sequence
  synthetic polynucleotide sequence
accagcgggagatccaggtga

SEQ ID NO: 41990 - DNA, 21 bp, Artificial sequence
  synthetic polynucleotide sequence
gggactccacagaaagcccca

SEQ ID NO: 41991 - DNA, 20 bp, Artificial sequence
  synthetic polynucleotide sequence
cagcccgaaggagagacaca

SEQ ID NO: 41992 - DNA, 22 bp, Artificial sequence
  synthetic polynucleotide sequence
ggtagagtcctccacagaagca

SEQ ID NO: 41993 - DNA, 21 bp, Artificial sequence
  synthetic polynucleotide sequence
tcttaggcttgaccagacaga

SEQ ID NO: 41994 - DNA, 19 bp, Artificial sequence
  synthetic polynucleotide sequence
ccccttgagctcacaggca

SEQ ID NO: 41995 - DNA, 22 bp, Artificial sequence
  synthetic polynucleotide sequence
gcaaacggatcgtgcaagtgga

SEQ ID NO: 41996 - DNA, 21 bp, Artificial sequence
  synthetic polynucleotide sequence
tcacagcagcttatgccagga

SEQ ID NO: 41997 - DNA, 21 bp, Artificial sequence
  synthetic polynucleotide sequence
ccccttggaaggccatccaga

SEQ ID NO: 41998 - DNA, 20 bp, Artificial sequence
  synthetic polynucleotide sequence
tgttggtggctcagggagca

SEQ ID NO: 41999 - DNA, 18 bp, Artificial sequence
  synthetic polynucleotide sequence
atgcgcagacaccagcaa

SEQ ID NO: 42000 - DNA, 20 bp, Artificial sequence
  synthetic polynucleotide sequence
atccaggtgaactggaacca

SEQ ID NO: 42001 - DNA, 18 bp, Artificial sequence
  synthetic polynucleotide sequence
ccattgcaatgcgggcaa

SEQ ID NO: 42002 - DNA, 20 bp, Artificial sequence
  synthetic polynucleotide sequence
gcacccggaatctactccga

SEQ ID NO: 42003 - DNA, 18 bp, Artificial sequence
  synthetic polynucleotide sequence
agggcacccaactgcaga

SEQ ID NO: 42004 - DNA, 20 bp, Artificial sequence
  synthetic polynucleotide sequence
gtgggttaccctcacaggca

SEQ ID NO: 42005 - DNA, 20 bp, Artificial sequence
  synthetic polynucleotide sequence
acaactgccaccagagctca

SEQ ID NO: 42006 - DNA, 20 bp, Artificial sequence
  synthetic polynucleotide sequence
cactatagcggcactgggga

SEQ ID NO: 42007 - DNA, 23 bp, Artificial sequence
  synthetic polynucleotide sequence
taaaattcagcacatgcagccca

SEQ ID NO: 42008 - DNA, 21 bp, Artificial sequence
  synthetic polynucleotide sequence
cactggagaaaggctcgtgca

SEQ ID NO: 42009 - DNA, 22 bp, Artificial sequence
  synthetic polynucleotide sequence
aaaactcagcatgtgcagccca

SEQ ID NO: 42010 - DNA, 20 bp, Artificial sequence
  synthetic polynucleotide sequence
actggagaagggctcgtgca

SEQ ID NO: 42011 - DNA, 20 bp, Artificial sequence
  synthetic polynucleotide sequence
gagagcttagggtgggagga

SEQ ID NO: 42012 - DNA, 19 bp, Artificial sequence
  synthetic polynucleotide sequence
ggacctgcatgagaccaca

SEQ ID NO: 42013 - DNA, 20 bp, Artificial sequence
  synthetic polynucleotide sequence
cagacaaaccaaagagcgga

SEQ ID NO: 42014 - DNA, 20 bp, Artificial sequence
  synthetic polynucleotide sequence
taagcctctccagtgccaca

SEQ ID NO: 42015 - DNA, 18 bp, Artificial sequence
  synthetic polynucleotide sequence
tggctcaggctaccccaa

SEQ ID NO: 42016 - DNA, 18 bp, Artificial sequence
  synthetic polynucleotide sequence
tgcgccagctgaaccgga

SEQ ID NO: 42017 - DNA, 21 bp, Artificial sequence
  synthetic polynucleotide sequence
cctgttcaggagaaggagcca

SEQ ID NO: 42018 - DNA, 21 bp, Artificial sequence
  synthetic polynucleotide sequence
agaggatccacaggtgtggca

SEQ ID NO: 42019 - DNA, 19 bp, Artificial sequence
  synthetic polynucleotide sequence
ccgtacccgccacactgca

SEQ ID NO: 42020 - DNA, 21 bp, Artificial sequence
  synthetic polynucleotide sequence
tcttggtcgtcagtcccggaa

SEQ ID NO: 42021 - DNA, 18 bp, Artificial sequence
  synthetic polynucleotide sequence
cacctcggcgatccccga

SEQ ID NO: 42022 - DNA, 21 bp, Artificial sequence
  synthetic polynucleotide sequence
tccgtgaagggaacgtcctca

SEQ ID NO: 42023 - DNA, 18 bp, Artificial sequence
  synthetic polynucleotide sequence
ccacgtgcacagcgggaa

SEQ ID NO: 42024 - DNA, 21 bp, Artificial sequence
  synthetic polynucleotide sequence
ctgctcacagagggtgacaca

SEQ ID NO: 42025 - DNA, 19 bp, Artificial sequence
  synthetic polynucleotide sequence
tcagcactggcctgagaca

SEQ ID NO: 42026 - DNA, 20 bp, Artificial sequence
  synthetic polynucleotide sequence
gtcaggccagtatgccctca

SEQ ID NO: 42027 - DNA, 22 bp, Artificial sequence
  synthetic polynucleotide sequence
tatccagagacctatgtgccca

SEQ ID NO: 42028 - DNA, 21 bp, Artificial sequence
  synthetic polynucleotide sequence
catccgagtcgctgtagcaga

SEQ ID NO: 42029 - DNA, 22 bp, Artificial sequence
  synthetic polynucleotide sequence
gtaaactggacatgcggactga

SEQ ID NO: 42030 - DNA, 20 bp, Artificial sequence
  synthetic polynucleotide sequence
catccctgacgctgcgctca

SEQ ID NO: 42031 - DNA, 20 bp, Artificial sequence
  synthetic polynucleotide sequence
caaggactgcttccccgaga

SEQ ID NO: 42032 - DNA, 20 bp, Artificial sequence
  synthetic polynucleotide sequence
aaatcagcacagcatccgaa

SEQ ID NO: 42033 - DNA, 19 bp, Artificial sequence
  synthetic polynucleotide sequence
gtggacagcgacggggaga

SEQ ID NO: 42034 - DNA, 21 bp, Artificial sequence
  synthetic polynucleotide sequence
tgtggacgactgaggtgctga

SEQ ID NO: 42035 - DNA, 20 bp, Artificial sequence
  synthetic polynucleotide sequence
cccatgtgaaaggaagggga

SEQ ID NO: 42036 - DNA, 18 bp, Artificial sequence
  synthetic polynucleotide sequence
ataagaaggccaccggca

SEQ ID NO: 42037 - DNA, 21 bp, Artificial sequence
  synthetic polynucleotide sequence
ctcggctagcaactcagctga

SEQ ID NO: 42038 - DNA, 22 bp, Artificial sequence
  synthetic polynucleotide sequence
atacagatcacacactcccgga

SEQ ID NO: 42039 - DNA, 21 bp, Artificial sequence
  synthetic polynucleotide sequence
atcctcgacaggctccagaga

SEQ ID NO: 42040 - DNA, 21 bp, Artificial sequence
  synthetic polynucleotide sequence
tgaagtcgaggaggtgcgtga

SEQ ID NO: 42041 - DNA, 21 bp, Artificial sequence
  synthetic polynucleotide sequence
cacgacctgaggaaggtggaa

SEQ ID NO: 42042 - DNA, 20 bp, Artificial sequence
  synthetic polynucleotide sequence
ggtgtctggcaggacccgca

SEQ ID NO: 42043 - DNA, 22 bp, Artificial sequence
  synthetic polynucleotide sequence
aagtgggaagcgatgatgagga

SEQ ID NO: 42044 - DNA, 20 bp, Artificial sequence
  synthetic polynucleotide sequence
tcgctggattgaagacgcca

SEQ ID NO: 42045 - DNA, 21 bp, Artificial sequence
  synthetic polynucleotide sequence
cgggtgggagattgaacggga

SEQ ID NO: 42046 - DNA, 19 bp, Artificial sequence
  synthetic polynucleotide sequence
tttggaaggcctggcgaca

SEQ ID NO: 42047 - DNA, 21 bp, Artificial sequence
  synthetic polynucleotide sequence
cagcgccaacttcagagagca

SEQ ID NO: 42048 - DNA, 20 bp, Artificial sequence
  synthetic polynucleotide sequence
gtcgatgatggagcgctgca

SEQ ID NO: 42049 - DNA, 19 bp, Artificial sequence
  synthetic polynucleotide sequence
ttgcagagctttggggcca

SEQ ID NO: 42050 - DNA, 21 bp, Artificial sequence
  synthetic polynucleotide sequence
gctggagatctgtcaggacga

SEQ ID NO: 42051 - DNA, 20 bp, Artificial sequence
  synthetic polynucleotide sequence
taccttccgagccacccgaa

SEQ ID NO: 42052 - DNA, 20 bp, Artificial sequence
  synthetic polynucleotide sequence
ctgcaaagtcccgttccaga

SEQ ID NO: 42053 - DNA, 18 bp, Artificial sequence
  synthetic polynucleotide sequence
ggcgtgctcccgtgccaa

SEQ ID NO: 42054 - DNA, 19 bp, Artificial sequence
  synthetic polynucleotide sequence
ctgcgtggcctctgaggga

SEQ ID NO: 42055 - DNA, 20 bp, Artificial sequence
  synthetic polynucleotide sequence
gtgggcactgacatccgaga

SEQ ID NO: 42056 - DNA, 19 bp, Artificial sequence
  synthetic polynucleotide sequence
gccaggaggttcctcacca

SEQ ID NO: 42057 - DNA, 22 bp, Artificial sequence
  synthetic polynucleotide sequence
agaacttgaggagacagcagca

SEQ ID NO: 42058 - DNA, 20 bp, Artificial sequence
  synthetic polynucleotide sequence
aacacaggcctccgttccga

SEQ ID NO: 42059 - DNA, 19 bp, Artificial sequence
  synthetic polynucleotide sequence
tgaaaacacaggcccccca

SEQ ID NO: 42060 - DNA, 21 bp, Artificial sequence
  synthetic polynucleotide sequence
ggaacaggtggttgcagggca

SEQ ID NO: 42061 - DNA, 20 bp, Artificial sequence
  synthetic polynucleotide sequence
aaagcaggaagcagaggcaa

SEQ ID NO: 42062 - DNA, 20 bp, Artificial sequence
  synthetic polynucleotide sequence
aacagccatgggtcaacaca

SEQ ID NO: 42063 - DNA, 19 bp, Artificial sequence
  synthetic polynucleotide sequence
tatcggaatcccgctcaca

SEQ ID NO: 42064 - DNA, 22 bp, Artificial sequence
  synthetic polynucleotide sequence
ccattaggctgcaactggacca

SEQ ID NO: 42065 - DNA, 18 bp, Artificial sequence
  synthetic polynucleotide sequence
aagatcagccctcggcga

SEQ ID NO: 42066 - DNA, 18 bp, Artificial sequence
  synthetic polynucleotide sequence
agggcactgaggaggcca

SEQ ID NO: 42067 - DNA, 21 bp, Artificial sequence
  synthetic polynucleotide sequence
tcagagttgggagagactgga

SEQ ID NO: 42068 - DNA, 22 bp, Artificial sequence
  synthetic polynucleotide sequence
taagtgcaagccaggtctctga

SEQ ID NO: 42069 - DNA, 22 bp, Artificial sequence
  synthetic polynucleotide sequence
aatgcagggagaactcctggaa

SEQ ID NO: 42070 - DNA, 19 bp, Artificial sequence
  synthetic polynucleotide sequence
tggatggatggcccactga

SEQ ID NO: 42071 - DNA, 20 bp, Artificial sequence
  synthetic polynucleotide sequence
cacggcctgtcagcacgtca

SEQ ID NO: 42072 - DNA, 22 bp, Artificial sequence
  synthetic polynucleotide sequence
aatctggctaggatctccccaa

SEQ ID NO: 42073 - DNA, 21 bp, Artificial sequence
  synthetic polynucleotide sequence
ccagccaaagccggttctgca

SEQ ID NO: 42074 - DNA, 22 bp, Artificial sequence
  synthetic polynucleotide sequence
cgataagtgccatccacagcga

SEQ ID NO: 42075 - DNA, 21 bp, Artificial sequence
  synthetic polynucleotide sequence
agagcagtgcaggatgtggaa

SEQ ID NO: 42076 - DNA, 21 bp, Artificial sequence
  synthetic polynucleotide sequence
ttgaggcattgaacctggcca

SEQ ID NO: 42077 - DNA, 22 bp, Artificial sequence
  synthetic polynucleotide sequence
tcaagcagcaggagtattggca

SEQ ID NO: 42078 - DNA, 22 bp, Artificial sequence
  synthetic polynucleotide sequence
agcacaaggcaggatgaggtca

SEQ ID NO: 42079 - DNA, 22 bp, Artificial sequence
  synthetic polynucleotide sequence
atggaagaagatgacgcgccca

SEQ ID NO: 42080 - DNA, 21 bp, Artificial sequence
  synthetic polynucleotide sequence
ccagatcacagatgcccggga

SEQ ID NO: 42081 - DNA, 21 bp, Artificial sequence
  synthetic polynucleotide sequence
aaacttggccactcaagagca

SEQ ID NO: 42082 - DNA, 20 bp, Artificial sequence
  synthetic polynucleotide sequence
cccgacaggacttgcagaca

SEQ ID NO: 42083 - DNA, 22 bp, Artificial sequence
  synthetic polynucleotide sequence
agaatggacagtgatgggctca

SEQ ID NO: 42084 - DNA, 22 bp, Artificial sequence
  synthetic polynucleotide sequence
atgactgcaaggcgtgatcaca

SEQ ID NO: 42085 - DNA, 22 bp, Artificial sequence
  synthetic polynucleotide sequence
accagaagaactcaaggcagca

SEQ ID NO: 42086 - DNA, 18 bp, Artificial sequence
  synthetic polynucleotide sequence
tcgtactgccaccaccca

SEQ ID NO: 42087 - DNA, 20 bp, Artificial sequence
  synthetic polynucleotide sequence
tggccctcatcgaacgtgga

SEQ ID NO: 42088 - DNA, 19 bp, Artificial sequence
  synthetic polynucleotide sequence
tccgtcccctggtgagaca

SEQ ID NO: 42089 - DNA, 22 bp, Artificial sequence
  synthetic polynucleotide sequence
tacgggaacatcaccttgccca

SEQ ID NO: 42090 - DNA, 21 bp, Artificial sequence
  synthetic polynucleotide sequence
acaccacagactgaccgctga

SEQ ID NO: 42091 - DNA, 18 bp, Artificial sequence
  synthetic polynucleotide sequence
caccatcggaacccggaa

SEQ ID NO: 42092 - DNA, 18 bp, Artificial sequence
  synthetic polynucleotide sequence
gacgagccatgcgaggga

SEQ ID NO: 42093 - DNA, 20 bp, Artificial sequence
  synthetic polynucleotide sequence
ggagctgcacaacgcctgga

SEQ ID NO: 42094 - DNA, 21 bp, Artificial sequence
  synthetic polynucleotide sequence
agctccgccagctctctacga

SEQ ID NO: 42095 - DNA, 20 bp, Artificial sequence
  synthetic polynucleotide sequence
cacgcaggaaggccagagga

SEQ ID NO: 42096 - DNA, 20 bp, Artificial sequence
  synthetic polynucleotide sequence
acacagggcctcgtctcaga

SEQ ID NO: 42097 - DNA, 21 bp, Artificial sequence
  synthetic polynucleotide sequence
gggggaggagtcagacacaga

SEQ ID NO: 42098 - DNA, 21 bp, Artificial sequence
  synthetic polynucleotide sequence
tctcaatgtccactcggcaga

SEQ ID NO: 42099 - DNA, 20 bp, Artificial sequence
  synthetic polynucleotide sequence
agcgccaacttcctgcagca

SEQ ID NO: 42100 - DNA, 20 bp, Artificial sequence
  synthetic polynucleotide sequence
ctcagagagagacagggcca

SEQ ID NO: 42101 - DNA, 20 bp, Artificial sequence
  synthetic polynucleotide sequence
ccaccctgcctcagaaagga

SEQ ID NO: 42102 - DNA, 18 bp, Artificial sequence
  synthetic polynucleotide sequence
gggagctggggctaagga

SEQ ID NO: 42103 - DNA, 20 bp, Artificial sequence
  synthetic polynucleotide sequence
tcccccgaatcttccccaga

SEQ ID NO: 42104 - DNA, 20 bp, Artificial sequence
  synthetic polynucleotide sequence
aggggaggatgtagcgcgta

SEQ ID NO: 42105 - DNA, 21 bp, Artificial sequence
  synthetic polynucleotide sequence
agatctttcaggagcggcaga

SEQ ID NO: 42106 - DNA, 21 bp, Artificial sequence
  synthetic polynucleotide sequence
tactcagagaggacctgccca

SEQ ID NO: 42107 - DNA, 18 bp, Artificial sequence
  synthetic polynucleotide sequence
agtggcgaagaggccaga

SEQ ID NO: 42108 - DNA, 20 bp, Artificial sequence
  synthetic polynucleotide sequence
tccacttgtcactcccacca

SEQ ID NO: 42109 - DNA, 21 bp, Artificial sequence
  synthetic polynucleotide sequence
tgtcccatctgcctgcaccaa

SEQ ID NO: 42110 - DNA, 19 bp, Artificial sequence
  synthetic polynucleotide sequence
tggacaactgattgcccca

SEQ ID NO: 42111 - DNA, 22 bp, Artificial sequence
  synthetic polynucleotide sequence
atggggagagactttgccgaga

SEQ ID NO: 42112 - DNA, 21 bp, Artificial sequence
  synthetic polynucleotide sequence
atcttctgcccacagactgca

SEQ ID NO: 42113 - DNA, 21 bp, Artificial sequence
  synthetic polynucleotide sequence
ggcctcagaccaggaagagca

SEQ ID NO: 42114 - DNA, 21 bp, Artificial sequence
  synthetic polynucleotide sequence
atccagcaatcccactcctga

SEQ ID NO: 42115 - DNA, 21 bp, Artificial sequence
  synthetic polynucleotide sequence
tgagcaggagacgcgaaccaa

SEQ ID NO: 42116 - DNA, 20 bp, Artificial sequence
  synthetic polynucleotide sequence
acacggggcacttgagctca

SEQ ID NO: 42117 - DNA, 22 bp, Artificial sequence
  synthetic polynucleotide sequence
atcatggaggtgcagagagaga

SEQ ID NO: 42118 - DNA, 22 bp, Artificial sequence
  synthetic polynucleotide sequence
agcaaccacactaacacccgga

SEQ ID NO: 42119 - DNA, 19 bp, Artificial sequence
  synthetic polynucleotide sequence
cagtgctggcctcagggca

SEQ ID NO: 42120 - DNA, 21 bp, Artificial sequence
  synthetic polynucleotide sequence
tggtccttgaggcacagctga

SEQ ID NO: 42121 - DNA, 18 bp, Artificial sequence
  synthetic polynucleotide sequence
tgaggcggtggtggggca

SEQ ID NO: 42122 - DNA, 21 bp, Artificial sequence
  synthetic polynucleotide sequence
ccagggcgatgatgaaggtga

SEQ ID NO: 42123 - DNA, 22 bp, Artificial sequence
  synthetic polynucleotide sequence
aaggcactgaccgactacaaga

SEQ ID NO: 42124 - DNA, 20 bp, Artificial sequence
  synthetic polynucleotide sequence
ggtcagccagctcgtcctca

SEQ ID NO: 42125 - DNA, 19 bp, Artificial sequence
  synthetic polynucleotide sequence
gtggagtctcagcaggcaa

SEQ ID NO: 42126 - DNA, 18 bp, Artificial sequence
  synthetic polynucleotide sequence
ctgccagtcagcccacca

SEQ ID NO: 42127 - DNA, 22 bp, Artificial sequence
  synthetic polynucleotide sequence
aagccatggagccgtaagaaga

SEQ ID NO: 42128 - DNA, 21 bp, Artificial sequence
  synthetic polynucleotide sequence
ggaatgccaatgaccatggca

SEQ ID NO: 42129 - DNA, 20 bp, Artificial sequence
  synthetic polynucleotide sequence
caatcaggaagcaggcccta

SEQ ID NO: 42130 - DNA, 21 bp, Artificial sequence
  synthetic polynucleotide sequence
atcaacagtggcgttaccaga

SEQ ID NO: 42131 - DNA, 18 bp, Artificial sequence
  synthetic polynucleotide sequence
aacgagcccaggaggaca

SEQ ID NO: 42132 - DNA, 20 bp, Artificial sequence
  synthetic polynucleotide sequence
tacgcatgttacagcacgga

SEQ ID NO: 42133 - DNA, 20 bp, Artificial sequence
  synthetic polynucleotide sequence
gacaggctggcagagaggaa

SEQ ID NO: 42134 - DNA, 18 bp, Artificial sequence
  synthetic polynucleotide sequence
ggccaagctgaggaagga

SEQ ID NO: 42135 - DNA, 18 bp, Artificial sequence
  synthetic polynucleotide sequence
ggccgcgtgcacctgcca

SEQ ID NO: 42136 - DNA, 20 bp, Artificial sequence
  synthetic polynucleotide sequence
cactcggggtggggccggaa

SEQ ID NO: 42137 - DNA, 20 bp, Artificial sequence
  synthetic polynucleotide sequence
cacacggatgcctgctgcca

SEQ ID NO: 42138 - DNA, 20 bp, Artificial sequence
  synthetic polynucleotide sequence
cacagggggccattcgtcca

SEQ ID NO: 42139 - DNA, 21 bp, Artificial sequence
  synthetic polynucleotide sequence
gtgggagagaagcatggacca

SEQ ID NO: 42140 - DNA, 20 bp, Artificial sequence
  synthetic polynucleotide sequence
gggtaaagatggggggagca

SEQ ID NO: 42141 - DNA, 20 bp, Artificial sequence
  synthetic polynucleotide sequence
ccgaggaggccttgtcacca

SEQ ID NO: 42142 - DNA, 21 bp, Artificial sequence
  synthetic polynucleotide sequence
tctcggcagataaggctggca

SEQ ID NO: 42143 - DNA, 22 bp, Artificial sequence
  synthetic polynucleotide sequence
gcaataaggcccagatgaccaa

SEQ ID NO: 42144 - DNA, 21 bp, Artificial sequence
  synthetic polynucleotide sequence
tgttctgccagtcgtgcagca

SEQ ID NO: 42145 - DNA, 18 bp, Artificial sequence
  synthetic polynucleotide sequence
cctcgtggtccaggccca

SEQ ID NO: 42146 - DNA, 19 bp, Artificial sequence
  synthetic polynucleotide sequence
tgcagaagtagtccaggca

SEQ ID NO: 42147 - DNA, 22 bp, Artificial sequence
  synthetic polynucleotide sequence
aagcctgtggagaaggtgcaga

SEQ ID NO: 42148 - DNA, 18 bp, Artificial sequence
  synthetic polynucleotide sequence
cgttgggcagagggggca

SEQ ID NO: 42149 - DNA, 21 bp, Artificial sequence
  synthetic polynucleotide sequence
atccagtgccctacctgccaa

SEQ ID NO: 42150 - DNA, 20 bp, Artificial sequence
  synthetic polynucleotide sequence
tcgctggcccagtgacgcaa

SEQ ID NO: 42151 - DNA, 18 bp, Artificial sequence
  synthetic polynucleotide sequence
agcagcctggctcatcca

SEQ ID NO: 42152 - DNA, 21 bp, Artificial sequence
  synthetic polynucleotide sequence
ttgcagaactggtgtcacaca

SEQ ID NO: 42153 - DNA, 20 bp, Artificial sequence
  synthetic polynucleotide sequence
ctgaaggctcgggtcagaga

SEQ ID NO: 42154 - DNA, 18 bp, Artificial sequence
  synthetic polynucleotide sequence
agcactcctcgcagtgca

SEQ ID NO: 42155 - DNA, 21 bp, Artificial sequence
  synthetic polynucleotide sequence
cggaggagaggacagactgca

SEQ ID NO: 42156 - DNA, 20 bp, Artificial sequence
  synthetic polynucleotide sequence
agccaggtccaggtctagca

SEQ ID NO: 42157 - DNA, 22 bp, Artificial sequence
  synthetic polynucleotide sequence
atgtaagcacgccttccacaga

SEQ ID NO: 42158 - DNA, 18 bp, Artificial sequence
  synthetic polynucleotide sequence
ccaggaaggggcccctga

SEQ ID NO: 42159 - DNA, 19 bp, Artificial sequence
  synthetic polynucleotide sequence
cctgtggcgacccagcaca

SEQ ID NO: 42160 - DNA, 18 bp, Artificial sequence
  synthetic polynucleotide sequence
cgactgggcttgggggga

SEQ ID NO: 42161 - DNA, 21 bp, Artificial sequence
  synthetic polynucleotide sequence
gaaggagcaagaggagcggaa

SEQ ID NO: 42162 - DNA, 18 bp, Artificial sequence
  synthetic polynucleotide sequence
ggtagacggggtggcgca

SEQ ID NO: 42163 - DNA, 19 bp, Artificial sequence
  synthetic polynucleotide sequence
gcagtctacgcactcccca

SEQ ID NO: 42164 - DNA, 18 bp, Artificial sequence
  synthetic polynucleotide sequence
cacactcctgggcaagca

SEQ ID NO: 42165 - DNA, 20 bp, Artificial sequence
  synthetic polynucleotide sequence
aggcaggcgttccagagaga

SEQ ID NO: 42166 - DNA, 20 bp, Artificial sequence
  synthetic polynucleotide sequence
agcggcagagaggacaggca

SEQ ID NO: 42167 - DNA, 20 bp, Artificial sequence
  synthetic polynucleotide sequence
ctgcaggatgaggaagacga

SEQ ID NO: 42168 - DNA, 18 bp, Artificial sequence
  synthetic polynucleotide sequence
caccacatactgccggca

SEQ ID NO: 42169 - DNA, 20 bp, Artificial sequence
  synthetic polynucleotide sequence
acttaccctccatcagccca

SEQ ID NO: 42170 - DNA, 22 bp, Artificial sequence
  synthetic polynucleotide sequence
taagctgggatgataaggggga

SEQ ID NO: 42171 - DNA, 18 bp, Artificial sequence
  synthetic polynucleotide sequence
ggaccctgggaccgcaca

SEQ ID NO: 42172 - DNA, 21 bp, Artificial sequence
  synthetic polynucleotide sequence
ctccccagaagagtctctgca

SEQ ID NO: 42173 - DNA, 18 bp, Artificial sequence
  synthetic polynucleotide sequence
cccaggaccatgctgaca

SEQ ID NO: 42174 - DNA, 18 bp, Artificial sequence
  synthetic polynucleotide sequence
aggcctgtagcgccctca

SEQ ID NO: 42175 - DNA, 21 bp, Artificial sequence
  synthetic polynucleotide sequence
gaaggatgagttgggcgagca

SEQ ID NO: 42176 - DNA, 20 bp, Artificial sequence
  synthetic polynucleotide sequence
ctccttctccacacccccga

SEQ ID NO: 42177 - DNA, 21 bp, Artificial sequence
  synthetic polynucleotide sequence
agggtctggccacactagaga

SEQ ID NO: 42178 - DNA, 19 bp, Artificial sequence
  synthetic polynucleotide sequence
tgcaccatgtcatccccca

SEQ ID NO: 42179 - DNA, 18 bp, Artificial sequence
  synthetic polynucleotide sequence
agaaaccggagtccccca

SEQ ID NO: 42180 - DNA, 18 bp, Artificial sequence
  synthetic polynucleotide sequence
gaggcgtcaactgggcca

SEQ ID NO: 42181 - DNA, 20 bp, Artificial sequence
  synthetic polynucleotide sequence
gagcggctgggagatgccaa

SEQ ID NO: 42182 - DNA, 20 bp, Artificial sequence
  synthetic polynucleotide sequence
acacacagcgtctgctccga

SEQ ID NO: 42183 - DNA, 18 bp, Artificial sequence
  synthetic polynucleotide sequence
aactccaccccgccccca

SEQ ID NO: 42184 - DNA, 18 bp, Artificial sequence
  synthetic polynucleotide sequence
cacctgtaccccggcgga

SEQ ID NO: 42185 - DNA, 21 bp, Artificial sequence
  synthetic polynucleotide sequence
atccagagtagggctagcaga

SEQ ID NO: 42186 - DNA, 23 bp, Artificial sequence
  synthetic polynucleotide sequence
aaaattgaccgaagagccactga

SEQ ID NO: 42187 - DNA, 20 bp, Artificial sequence
  synthetic polynucleotide sequence
atgtggagctgggacgtgga

SEQ ID NO: 42188 - DNA, 20 bp, Artificial sequence
  synthetic polynucleotide sequence
tacattctccccagaccaca

SEQ ID NO: 42189 - DNA, 21 bp, Artificial sequence
  synthetic polynucleotide sequence
cagcaggcaagagtggagcaa

SEQ ID NO: 42190 - DNA, 18 bp, Artificial sequence
  synthetic polynucleotide sequence
cctgcagagcctgggcca

SEQ ID NO: 42191 - DNA, 18 bp, Artificial sequence
  synthetic polynucleotide sequence
ggctgccagcaagagaca

SEQ ID NO: 42192 - DNA, 21 bp, Artificial sequence
  synthetic polynucleotide sequence
cacagttctgcagagtggaca

SEQ ID NO: 42193 - DNA, 20 bp, Artificial sequence
  synthetic polynucleotide sequence
gtcatcgaggagctgagcca

SEQ ID NO: 42194 - DNA, 21 bp, Artificial sequence
  synthetic polynucleotide sequence
cagatggcgcagatgtcacca

SEQ ID NO: 42195 - DNA, 21 bp, Artificial sequence
  synthetic polynucleotide sequence
gtgagtgccctaccactgaga

SEQ ID NO: 42196 - DNA, 22 bp, Artificial sequence
  synthetic polynucleotide sequence
gaaaccagtgcgattgaagcca

SEQ ID NO: 42197 - DNA, 18 bp, Artificial sequence
  synthetic polynucleotide sequence
tcctcagggccaaggaga

SEQ ID NO: 42198 - DNA, 18 bp, Artificial sequence
  synthetic polynucleotide sequence
gctgaagtgggagcagca

SEQ ID NO: 42199 - DNA, 19 bp, Artificial sequence
  synthetic polynucleotide sequence
gccaaaggcagcaactgga

SEQ ID NO: 42200 - DNA, 20 bp, Artificial sequence
  synthetic polynucleotide sequence
atggagacgaagcgtatgca

SEQ ID NO: 42201 - DNA, 21 bp, Artificial sequence
  synthetic polynucleotide sequence
gtgggaaagacactccatcca

SEQ ID NO: 42202 - DNA, 19 bp, Artificial sequence
  synthetic polynucleotide sequence
tgccttcagcatcaccaca

SEQ ID NO: 42203 - DNA, 21 bp, Artificial sequence
  synthetic polynucleotide sequence
tacccaccaccttccagcaca

SEQ ID NO: 42204 - DNA, 21 bp, Artificial sequence
  synthetic polynucleotide sequence
tcatcctcgtctggcaaagga

SEQ ID NO: 42205 - DNA, 19 bp, Artificial sequence
  synthetic polynucleotide sequence
cagaccctcgccaaggaga

SEQ ID NO: 42206 - DNA, 18 bp, Artificial sequence
  synthetic polynucleotide sequence
gccacgatctgctggaca

SEQ ID NO: 42207 - DNA, 19 bp, Artificial sequence
  synthetic polynucleotide sequence
ggcgcttcctggagagcca

SEQ ID NO: 42208 - DNA, 20 bp, Artificial sequence
  synthetic polynucleotide sequence
gtagaagacctccagcgcga

SEQ ID NO: 42209 - DNA, 19 bp, Artificial sequence
  synthetic polynucleotide sequence
cgctcaggaagctccagca

SEQ ID NO: 42210 - DNA, 18 bp, Artificial sequence
  synthetic polynucleotide sequence
tgtctgcgccgagaagga

SEQ ID NO: 42211 - DNA, 18 bp, Artificial sequence
  synthetic polynucleotide sequence
ggatacggatgcgccaga

SEQ ID NO: 42212 - DNA, 18 bp, Artificial sequence
  synthetic polynucleotide sequence
catggaccccgtgacaga

SEQ ID NO: 42213 - DNA, 21 bp, Artificial sequence
  synthetic polynucleotide sequence
taaccaggtggtactggagga

SEQ ID NO: 42214 - DNA, 21 bp, Artificial sequence
  synthetic polynucleotide sequence
tcggacggtgagtgtagcaga

SEQ ID NO: 42215 - DNA, 20 bp, Artificial sequence
  synthetic polynucleotide sequence
agccagtacgctcctccaga

SEQ ID NO: 42216 - DNA, 19 bp, Artificial sequence
  synthetic polynucleotide sequence
gaaggaggaggtgggggca

SEQ ID NO: 42217 - DNA, 18 bp, Artificial sequence
  synthetic polynucleotide sequence
ggagctgcagcatgccaa

SEQ ID NO: 42218 - DNA, 20 bp, Artificial sequence
  synthetic polynucleotide sequence
gtgctggagggagatgacga

SEQ ID NO: 42219 - DNA, 21 bp, Artificial sequence
  synthetic polynucleotide sequence
agggaagtgaggttagggcga

SEQ ID NO: 42220 - DNA, 18 bp, Artificial sequence
  synthetic polynucleotide sequence
gagcgtttcccaagccca

SEQ ID NO: 42221 - DNA, 22 bp, Artificial sequence
  synthetic polynucleotide sequence
tagggaggtacgacttgggaga

SEQ ID NO: 42222 - DNA, 22 bp, Artificial sequence
  synthetic polynucleotide sequence
aaatccgatgaaaggcagctga

SEQ ID NO: 42223 - DNA, 18 bp, Artificial sequence
  synthetic polynucleotide sequence
ccctcaccctccccgaga

SEQ ID NO: 42224 - DNA, 20 bp, Artificial sequence
  synthetic polynucleotide sequence
cccactcgaacatggcccca

SEQ ID NO: 42225 - DNA, 22 bp, Artificial sequence
  synthetic polynucleotide sequence
ggtacctgcaaacagcactgga

SEQ ID NO: 42226 - DNA, 20 bp, Artificial sequence
  synthetic polynucleotide sequence
gcaacccctccctgtagcca

SEQ ID NO: 42227 - DNA, 21 bp, Artificial sequence
  synthetic polynucleotide sequence
cctacggacagtcccagccaa

SEQ ID NO: 42228 - DNA, 19 bp, Artificial sequence
  synthetic polynucleotide sequence
gccgcccatcagctctcga

SEQ ID NO: 42229 - DNA, 20 bp, Artificial sequence
  synthetic polynucleotide sequence
ccggtgagagagcggtctga

SEQ ID NO: 42230 - DNA, 18 bp, Artificial sequence
  synthetic polynucleotide sequence
tccgtgaagcgacccaca

SEQ ID NO: 42231 - DNA, 21 bp, Artificial sequence
  synthetic polynucleotide sequence
ctgggcagagctaacacctga

SEQ ID NO: 42232 - DNA, 20 bp, Artificial sequence
  synthetic polynucleotide sequence
gtaactcccagagcgctgca

SEQ ID NO: 42233 - DNA, 19 bp, Artificial sequence
  synthetic polynucleotide sequence
ttagcgcttggatgcagca

SEQ ID NO: 42234 - DNA, 22 bp, Artificial sequence
  synthetic polynucleotide sequence
ctaatctggccaagtagcggta

SEQ ID NO: 42235 - DNA, 20 bp, Artificial sequence
  synthetic polynucleotide sequence
ctgaagactgcccacccaga

SEQ ID NO: 42236 - DNA, 18 bp, Artificial sequence
  synthetic polynucleotide sequence
tgggctggcactgaggga

SEQ ID NO: 42237 - DNA, 21 bp, Artificial sequence
  synthetic polynucleotide sequence
tgacacacagaacgccccaga

SEQ ID NO: 42238 - DNA, 19 bp, Artificial sequence
  synthetic polynucleotide sequence
ggcctcgtccacctgcaga

SEQ ID NO: 42239 - DNA, 18 bp, Artificial sequence
  synthetic polynucleotide sequence
cgggaggtgatgtggcaa

SEQ ID NO: 42240 - DNA, 18 bp, Artificial sequence
  synthetic polynucleotide sequence
aggcacggcacattctga

SEQ ID NO: 42241 - DNA, 21 bp, Artificial sequence
  synthetic polynucleotide sequence
aagataccaaccatcacggca

SEQ ID NO: 42242 - DNA, 18 bp, Artificial sequence
  synthetic polynucleotide sequence
ccggtggcacagtcagga

SEQ ID NO: 42243 - DNA, 19 bp, Artificial sequence
  synthetic polynucleotide sequence
ggagcctgtgtagccagca

SEQ ID NO: 42244 - DNA, 18 bp, Artificial sequence
  synthetic polynucleotide sequence
aagcggcttggaccacga

SEQ ID NO: 42245 - DNA, 20 bp, Artificial sequence
  synthetic polynucleotide sequence
tgcgaggtctggcagccgga

SEQ ID NO: 42246 - DNA, 21 bp, Artificial sequence
  synthetic polynucleotide sequence
cacttcccagcaagagacgca

SEQ ID NO: 42247 - DNA, 20 bp, Artificial sequence
  synthetic polynucleotide sequence
gaatggcgacccgaagacga

SEQ ID NO: 42248 - DNA, 20 bp, Artificial sequence
  synthetic polynucleotide sequence
cttgaccacagggcgctgca

SEQ ID NO: 42249 - DNA, 20 bp, Artificial sequence
  synthetic polynucleotide sequence
cagtgaaaccagtgcgggca

SEQ ID NO: 42250 - DNA, 20 bp, Artificial sequence
  synthetic polynucleotide sequence
gccgcagcttcaccctgcaa

SEQ ID NO: 42251 - DNA, 21 bp, Artificial sequence
  synthetic polynucleotide sequence
tcagagacagaagagcagcga

SEQ ID NO: 42252 - DNA, 20 bp, Artificial sequence
  synthetic polynucleotide sequence
cttctacagcaccatcccca

SEQ ID NO: 42253 - DNA, 21 bp, Artificial sequence
  synthetic polynucleotide sequence
gcagcagctcaagcacctgga

SEQ ID NO: 42254 - DNA, 20 bp, Artificial sequence
  synthetic polynucleotide sequence
ctttccccagtggcatccaa

SEQ ID NO: 42255 - DNA, 22 bp, Artificial sequence
  synthetic polynucleotide sequence
tgcaagagctatgaagacgcca

SEQ ID NO: 42256 - DNA, 22 bp, Artificial sequence
  synthetic polynucleotide sequence
ccccacagtgtagcagtcacca

SEQ ID NO: 42257 - DNA, 18 bp, Artificial sequence
  synthetic polynucleotide sequence
gagcccgagcccagcaca

SEQ ID NO: 42258 - DNA, 18 bp, Artificial sequence
  synthetic polynucleotide sequence
cccactggcgaacgtcca

SEQ ID NO: 42259 - DNA, 20 bp, Artificial sequence
  synthetic polynucleotide sequence
ggacttgcccaggtcgcgca

SEQ ID NO: 42260 - DNA, 20 bp, Artificial sequence
  synthetic polynucleotide sequence
tccagcctccctacgaagca

SEQ ID NO: 42261 - DNA, 23 bp, Artificial sequence
  synthetic polynucleotide sequence
gataacgatgagagtcaccgcaa

SEQ ID NO: 42262 - DNA, 20 bp, Artificial sequence
  synthetic polynucleotide sequence
gtcgcagagctgagcccgga

SEQ ID NO: 42263 - DNA, 18 bp, Artificial sequence
  synthetic polynucleotide sequence
gggctcgccgccttggaa

SEQ ID NO: 42264 - DNA, 21 bp, Artificial sequence
  synthetic polynucleotide sequence
ttctgagaattccctggccca

SEQ ID NO: 42265 - DNA, 21 bp, Artificial sequence
  synthetic polynucleotide sequence
aacctcaacctggactgccga

SEQ ID NO: 42266 - DNA, 21 bp, Artificial sequence
  synthetic polynucleotide sequence
aacactccagggacacaggca

SEQ ID NO: 42267 - DNA, 20 bp, Artificial sequence
  synthetic polynucleotide sequence
taggggctcaggtacagcca

SEQ ID NO: 42268 - DNA, 21 bp, Artificial sequence
  synthetic polynucleotide sequence
tgaagaggaaccagaagccca

SEQ ID NO: 42269 - DNA, 21 bp, Artificial sequence
  synthetic polynucleotide sequence
ccaacgaacagagcgtcagca

SEQ ID NO: 42270 - DNA, 21 bp, Artificial sequence
  synthetic polynucleotide sequence
tcgagcagcacctcgtctgga

SEQ ID NO: 42271 - DNA, 20 bp, Artificial sequence
  synthetic polynucleotide sequence
ggcaccatgggctaatcaga

SEQ ID NO: 42272 - DNA, 22 bp, Artificial sequence
  synthetic polynucleotide sequence
cataatagcactgccagacaca

SEQ ID NO: 42273 - DNA, 22 bp, Artificial sequence
  synthetic polynucleotide sequence
ttgacaaggctgacacaggcaa

SEQ ID NO: 42274 - DNA, 22 bp, Artificial sequence
  synthetic polynucleotide sequence
caaatgcttgacgaggccctga

SEQ ID NO: 42275 - DNA, 20 bp, Artificial sequence
  synthetic polynucleotide sequence
atgctagactctggggccga

SEQ ID NO: 42276 - DNA, 22 bp, Artificial sequence
  synthetic polynucleotide sequence
tcaaagaaagggtcctggccta

SEQ ID NO: 42277 - DNA, 21 bp, Artificial sequence
  synthetic polynucleotide sequence
gcaaggaccccacagaacaca

SEQ ID NO: 42278 - DNA, 21 bp, Artificial sequence
  synthetic polynucleotide sequence
atgtggcaacctgccttccga

SEQ ID NO: 42279 - DNA, 21 bp, Artificial sequence
  synthetic polynucleotide sequence
gatttcttcagaggccccaca

SEQ ID NO: 42280 - DNA, 21 bp, Artificial sequence
  synthetic polynucleotide sequence
tgtgtcctcctcagaaccaga

SEQ ID NO: 42281 - DNA, 21 bp, Artificial sequence
  synthetic polynucleotide sequence
ctcctgggcaatcacagaaca

SEQ ID NO: 42282 - DNA, 20 bp, Artificial sequence
  synthetic polynucleotide sequence
tgccaagacccagctgacca

SEQ ID NO: 42283 - DNA, 19 bp, Artificial sequence
  synthetic polynucleotide sequence
ggacccacaggagcagcaa

SEQ ID NO: 42284 - DNA, 20 bp, Artificial sequence
  synthetic polynucleotide sequence
tgactccaggatctgccaca

SEQ ID NO: 42285 - DNA, 22 bp, Artificial sequence
  synthetic polynucleotide sequence
ccatccacttagaacgaggcga

SEQ ID NO: 42286 - DNA, 19 bp, Artificial sequence
  synthetic polynucleotide sequence
tcgggatgaaggcctcgca

SEQ ID NO: 42287 - DNA, 20 bp, Artificial sequence
  synthetic polynucleotide sequence
agcccacctccctcaccaca

SEQ ID NO: 42288 - DNA, 20 bp, Artificial sequence
  synthetic polynucleotide sequence
ccagcatcaggcttgggcga

SEQ ID NO: 42289 - DNA, 20 bp, Artificial sequence
  synthetic polynucleotide sequence
ctacacgtgggcccgaggaa

SEQ ID NO: 42290 - DNA, 18 bp, Artificial sequence
  synthetic polynucleotide sequence
ccatcctgggggcctcca

SEQ ID NO: 42291 - DNA, 22 bp, Artificial sequence
  synthetic polynucleotide sequence
caatctcatcaagggtggcgga

SEQ ID NO: 42292 - DNA, 21 bp, Artificial sequence
  synthetic polynucleotide sequence
cgaagttcaaccacgccccca

SEQ ID NO: 42293 - DNA, 18 bp, Artificial sequence
  synthetic polynucleotide sequence
ggccctgcgcagggccaa

SEQ ID NO: 42294 - DNA, 19 bp, Artificial sequence
  synthetic polynucleotide sequence
tgaacttggtgaagcccca

SEQ ID NO: 42295 - DNA, 21 bp, Artificial sequence
  synthetic polynucleotide sequence
acatggacatcgaggcgctga

SEQ ID NO: 42296 - DNA, 20 bp, Artificial sequence
  synthetic polynucleotide sequence
atttaaacctgggccgagga

SEQ ID NO: 42297 - DNA, 21 bp, Artificial sequence
  synthetic polynucleotide sequence
ttcagaacgaggagcatgtga

SEQ ID NO: 42298 - DNA, 18 bp, Artificial sequence
  synthetic polynucleotide sequence
aaggggccatgactggga

SEQ ID NO: 42299 - DNA, 21 bp, Artificial sequence
  synthetic polynucleotide sequence
gtgttggggagagtggagaca

SEQ ID NO: 42300 - DNA, 19 bp, Artificial sequence
  synthetic polynucleotide sequence
ttctccggatgccaaagga

SEQ ID NO: 42301 - DNA, 20 bp, Artificial sequence
  synthetic polynucleotide sequence
tcaagtgaggagacaggcca

SEQ ID NO: 42302 - DNA, 18 bp, Artificial sequence
  synthetic polynucleotide sequence
ggtgggcactgtgcggaa

SEQ ID NO: 42303 - DNA, 18 bp, Artificial sequence
  synthetic polynucleotide sequence
ccgagaggtgtaccggca

SEQ ID NO: 42304 - DNA, 18 bp, Artificial sequence
  synthetic polynucleotide sequence
gcccttggagcggacgta

SEQ ID NO: 42305 - DNA, 23 bp, Artificial sequence
  synthetic polynucleotide sequence
gcaggagattagggaggacaaga

SEQ ID NO: 42306 - DNA, 22 bp, Artificial sequence
  synthetic polynucleotide sequence
acctgaagtagtggcaccacca

SEQ ID NO: 42307 - DNA, 20 bp, Artificial sequence
  synthetic polynucleotide sequence
aagaacccgccgagcagtca

SEQ ID NO: 42308 - DNA, 20 bp, Artificial sequence
  synthetic polynucleotide sequence
ccaccaactcggggagctga

SEQ ID NO: 42309 - DNA, 21 bp, Artificial sequence
  synthetic polynucleotide sequence
ccttcgttacctcggaccgca

SEQ ID NO: 42310 - DNA, 19 bp, Artificial sequence
  synthetic polynucleotide sequence
cggatgggcatggagcgga

SEQ ID NO: 42311 - DNA, 22 bp, Artificial sequence
  synthetic polynucleotide sequence
aacggactgattcaccgcaaga

SEQ ID NO: 42312 - DNA, 20 bp, Artificial sequence
  synthetic polynucleotide sequence
tccgcacataggaggtggca

SEQ ID NO: 42313 - DNA, 21 bp, Artificial sequence
  synthetic polynucleotide sequence
gacctgcggcctaagaagaca

SEQ ID NO: 42314 - DNA, 21 bp, Artificial sequence
  synthetic polynucleotide sequence
ccttgaccgcgtacttccgca

SEQ ID NO: 42315 - DNA, 18 bp, Artificial sequence
  synthetic polynucleotide sequence
tgagcaagcccaggcaca

SEQ ID NO: 42316 - DNA, 18 bp, Artificial sequence
  synthetic polynucleotide sequence
cccgaatcatgtcccgca

SEQ ID NO: 42317 - DNA, 21 bp, Artificial sequence
  synthetic polynucleotide sequence
gtggcaagcatcagcctcaca

SEQ ID NO: 42318 - DNA, 19 bp, Artificial sequence
  synthetic polynucleotide sequence
tgtctgcccaccatagcca

SEQ ID NO: 42319 - DNA, 21 bp, Artificial sequence
  synthetic polynucleotide sequence
taccctgccaagcgcaagaga

SEQ ID NO: 42320 - DNA, 19 bp, Artificial sequence
  synthetic polynucleotide sequence
tcacggaatccatgcctga

SEQ ID NO: 42321 - DNA, 18 bp, Artificial sequence
  synthetic polynucleotide sequence
ctatcaccaccgcacgga

SEQ ID NO: 42322 - DNA, 18 bp, Artificial sequence
  synthetic polynucleotide sequence
acccagcggtgtgatgga

SEQ ID NO: 42323 - DNA, 22 bp, Artificial sequence
  synthetic polynucleotide sequence
tggagtgagcccaaaggttcga

SEQ ID NO: 42324 - DNA, 19 bp, Artificial sequence
  synthetic polynucleotide sequence
tcagattggggtaccccca

SEQ ID NO: 42325 - DNA, 22 bp, Artificial sequence
  synthetic polynucleotide sequence
aagaccatccctctgacagaca

SEQ ID NO: 42326 - DNA, 20 bp, Artificial sequence
  synthetic polynucleotide sequence
ccgatagccaggtgtgccca

SEQ ID NO: 42327 - DNA, 19 bp, Artificial sequence
  synthetic polynucleotide sequence
gtctccgagctcgcctgca

SEQ ID NO: 42328 - DNA, 20 bp, Artificial sequence
  synthetic polynucleotide sequence
ctcctgctggtgcagcacca

SEQ ID NO: 42329 - DNA, 18 bp, Artificial sequence
  synthetic polynucleotide sequence
cagccgcagaagccagga

SEQ ID NO: 42330 - DNA, 18 bp, Artificial sequence
  synthetic polynucleotide sequence
ggtggagatgtcccggga

SEQ ID NO: 42331 - DNA, 21 bp, Artificial sequence
  synthetic polynucleotide sequence
gaggagactgtgctggcaaca

SEQ ID NO: 42332 - DNA, 20 bp, Artificial sequence
  synthetic polynucleotide sequence
cgagttcatccaggcgagca

SEQ ID NO: 42333 - DNA, 20 bp, Artificial sequence
  synthetic polynucleotide sequence
cagagacgctgcaggggaca

SEQ ID NO: 42334 - DNA, 18 bp, Artificial sequence
  synthetic polynucleotide sequence
ctcccgagctgggcctca

SEQ ID NO: 42335 - DNA, 19 bp, Artificial sequence
  synthetic polynucleotide sequence
gagccggccgctagtctca

SEQ ID NO: 42336 - DNA, 18 bp, Artificial sequence
  synthetic polynucleotide sequence
ggggacgagggaccagga

SEQ ID NO: 42337 - DNA, 21 bp, Artificial sequence
  synthetic polynucleotide sequence
gggctgcaggaaaggctgtca

SEQ ID NO: 42338 - DNA, 20 bp, Artificial sequence
  synthetic polynucleotide sequence
ctgggacccagctgtcctca

SEQ ID NO: 42339 - DNA, 21 bp, Artificial sequence
  synthetic polynucleotide sequence
gagggccatatgacgtggcaa

SEQ ID NO: 42340 - DNA, 20 bp, Artificial sequence
  synthetic polynucleotide sequence
tggagaagcgctgctcggca

SEQ ID NO: 42341 - DNA, 21 bp, Artificial sequence
  synthetic polynucleotide sequence
gcctgcacacgtcaggaagca

SEQ ID NO: 42342 - DNA, 19 bp, Artificial sequence
  synthetic polynucleotide sequence
ctctcactgagccggggga

SEQ ID NO: 42343 - DNA, 22 bp, Artificial sequence
  synthetic polynucleotide sequence
agtagcactgagcacgttgaga

SEQ ID NO: 42344 - DNA, 21 bp, Artificial sequence
  synthetic polynucleotide sequence
cattactgaagacggcgccga

SEQ ID NO: 42345 - DNA, 21 bp, Artificial sequence
  synthetic polynucleotide sequence
tacaagcgcaagctagccaga

SEQ ID NO: 42346 - DNA, 19 bp, Artificial sequence
  synthetic polynucleotide sequence
cccgcaaagggcaggtgca

SEQ ID NO: 42347 - DNA, 21 bp, Artificial sequence
  synthetic polynucleotide sequence
tcctccaccccctgttgacca

SEQ ID NO: 42348 - DNA, 22 bp, Artificial sequence
  synthetic polynucleotide sequence
agtaccccaaaatgctcagcca

SEQ ID NO: 42349 - DNA, 18 bp, Artificial sequence
  synthetic polynucleotide sequence
gggagggggagcctgcga

SEQ ID NO: 42350 - DNA, 20 bp, Artificial sequence
  synthetic polynucleotide sequence
ggaacgctagacgcctccca

SEQ ID NO: 42351 - DNA, 20 bp, Artificial sequence
  synthetic polynucleotide sequence
acacggtgcgagtgggtgaa

SEQ ID NO: 42352 - DNA, 25 bp, Artificial sequence
  synthetic polynucleotide sequence
ttccaaacgcaagatcaggccaaca

SEQ ID NO: 42353 - DNA, 18 bp, Artificial sequence
  synthetic polynucleotide sequence
gcacgtggaattcgcgaa

SEQ ID NO: 42354 - DNA, 21 bp, Artificial sequence
  synthetic polynucleotide sequence
catcacagttggatgcaagca

SEQ ID NO: 42355 - DNA, 19 bp, Artificial sequence
  synthetic polynucleotide sequence
gacgacgtgaaggagcaga

SEQ ID NO: 42356 - DNA, 21 bp, Artificial sequence
  synthetic polynucleotide sequence
cttcaggaagatcaggagcaa

SEQ ID NO: 42357 - DNA, 18 bp, Artificial sequence
  synthetic polynucleotide sequence
ggcccagaggtgcaagga

SEQ ID NO: 42358 - DNA, 18 bp, Artificial sequence
  synthetic polynucleotide sequence
aagggctctgagggccga

SEQ ID NO: 42359 - DNA, 22 bp, Artificial sequence
  synthetic polynucleotide sequence
aatacagccaggtcctagccaa

SEQ ID NO: 42360 - DNA, 19 bp, Artificial sequence
  synthetic polynucleotide sequence
gtgctggcctcggacacga

SEQ ID NO: 42361 - DNA, 20 bp, Artificial sequence
  synthetic polynucleotide sequence
acgagaagcaccgtggctga

SEQ ID NO: 42362 - DNA, 21 bp, Artificial sequence
  synthetic polynucleotide sequence
tcggtgaacacggtgccctca

SEQ ID NO: 42363 - DNA, 19 bp, Artificial sequence
  synthetic polynucleotide sequence
gccaggagttgaggtggaa

SEQ ID NO: 42364 - DNA, 21 bp, Artificial sequence
  synthetic polynucleotide sequence
caaacgacaacgaaaacagga

SEQ ID NO: 42365 - DNA, 20 bp, Artificial sequence
  synthetic polynucleotide sequence
gtcaccccacatccaggcca

SEQ ID NO: 42366 - DNA, 19 bp, Artificial sequence
  synthetic polynucleotide sequence
ggcccagaccagagaggca

SEQ ID NO: 42367 - DNA, 21 bp, Artificial sequence
  synthetic polynucleotide sequence
gtggtggtgctaagaaaagga

SEQ ID NO: 42368 - DNA, 21 bp, Artificial sequence
  synthetic polynucleotide sequence
accacattcatcagaagggca

SEQ ID NO: 42369 - DNA, 21 bp, Artificial sequence
  synthetic polynucleotide sequence
catccgtccttggaagaggaa

SEQ ID NO: 42370 - DNA, 22 bp, Artificial sequence
  synthetic polynucleotide sequence
gcatggctgaaaaccgtggtga

SEQ ID NO: 42371 - DNA, 21 bp, Artificial sequence
  synthetic polynucleotide sequence
caccaggacccaaggaaccaa

SEQ ID NO: 42372 - DNA, 21 bp, Artificial sequence
  synthetic polynucleotide sequence
tcacgggtaagatccatgcca

SEQ ID NO: 42373 - DNA, 23 bp, Artificial sequence
  synthetic polynucleotide sequence
gtggggacaaagggaattccaca

SEQ ID NO: 42374 - DNA, 20 bp, Artificial sequence
  synthetic polynucleotide sequence
gaccgaggttagctccagca

SEQ ID NO: 42375 - DNA, 18 bp, Artificial sequence
  synthetic polynucleotide sequence
ggacctgaagcccagcaa

SEQ ID NO: 42376 - DNA, 18 bp, Artificial sequence
  synthetic polynucleotide sequence
agccctggcgcttcagca

SEQ ID NO: 42377 - DNA, 18 bp, Artificial sequence
  synthetic polynucleotide sequence
ccgtgggtggtcaacaga

SEQ ID NO: 42378 - DNA, 18 bp, Artificial sequence
  synthetic polynucleotide sequence
atgacagcacgggctcca

SEQ ID NO: 42379 - DNA, 21 bp, Artificial sequence
  synthetic polynucleotide sequence
aaacagacaggatgcaccaca

SEQ ID NO: 42380 - DNA, 21 bp, Artificial sequence
  synthetic polynucleotide sequence
tctccgctgagcaagagtaga

SEQ ID NO: 42381 - DNA, 19 bp, Artificial sequence
  synthetic polynucleotide sequence
cgcgacctcaagccggaga

SEQ ID NO: 42382 - DNA, 19 bp, Artificial sequence
  synthetic polynucleotide sequence
ggctccagaggtcgcagga

SEQ ID NO: 42383 - DNA, 20 bp, Artificial sequence
  synthetic polynucleotide sequence
aacacattaggcagtcgcca

SEQ ID NO: 42384 - DNA, 20 bp, Artificial sequence
  synthetic polynucleotide sequence
gtggagatgttcgagggcaa

SEQ ID NO: 42385 - DNA, 21 bp, Artificial sequence
  synthetic polynucleotide sequence
actcacagagaccagttgcca

SEQ ID NO: 42386 - DNA, 21 bp, Artificial sequence
  synthetic polynucleotide sequence
aagcagctacaggctctagga

SEQ ID NO: 42387 - DNA, 18 bp, Artificial sequence
  synthetic polynucleotide sequence
ctgactggagcaccccca

SEQ ID NO: 42388 - DNA, 19 bp, Artificial sequence
  synthetic polynucleotide sequence
tgtgtgaggtagggaggca

SEQ ID NO: 42389 - DNA, 20 bp, Artificial sequence
  synthetic polynucleotide sequence
tcagaggaggacgtgagcca

SEQ ID NO: 42390 - DNA, 18 bp, Artificial sequence
  synthetic polynucleotide sequence
ccaggacagacggcgcca

SEQ ID NO: 42391 - DNA, 21 bp, Artificial sequence
  synthetic polynucleotide sequence
tgtgccgcgatttgaacccaa

SEQ ID NO: 42392 - DNA, 19 bp, Artificial sequence
  synthetic polynucleotide sequence
tcaaagaggacagcaccca

SEQ ID NO: 42393 - DNA, 20 bp, Artificial sequence
  synthetic polynucleotide sequence
tgggaagagggagccagcca

SEQ ID NO: 42394 - DNA, 20 bp, Artificial sequence
  synthetic polynucleotide sequence
gatgaagcctccagccagca

SEQ ID NO: 42395 - DNA, 21 bp, Artificial sequence
  synthetic polynucleotide sequence
caagtccggctagtacgcgaa

SEQ ID NO: 42396 - DNA, 19 bp, Artificial sequence
  synthetic polynucleotide sequence
tgggaagaccaagtcctca

SEQ ID NO: 42397 - DNA, 18 bp, Artificial sequence
  synthetic polynucleotide sequence
ggccaagtccatccacca

SEQ ID NO: 42398 - DNA, 18 bp, Artificial sequence
  synthetic polynucleotide sequence
tctgggaatccaggcgga

SEQ ID NO: 42399 - DNA, 20 bp, Artificial sequence
  synthetic polynucleotide sequence
cacagacagaggcacgagga

SEQ ID NO: 42400 - DNA, 20 bp, Artificial sequence
  synthetic polynucleotide sequence
tcaggctgaccatggtggga

SEQ ID NO: 42401 - DNA, 19 bp, Artificial sequence
  synthetic polynucleotide sequence
cgtccggatctgggacaca

SEQ ID NO: 42402 - DNA, 18 bp, Artificial sequence
  synthetic polynucleotide sequence
gtacgtcatgacgcggca

SEQ ID NO: 42403 - DNA, 20 bp, Artificial sequence
  synthetic polynucleotide sequence
ggcgacctgacctacggaga

SEQ ID NO: 42404 - DNA, 19 bp, Artificial sequence
  synthetic polynucleotide sequence
ggagggcaggaaggggtca

SEQ ID NO: 42405 - DNA, 22 bp, Artificial sequence
  synthetic polynucleotide sequence
caaacgaggagttgctacggga

SEQ ID NO: 42406 - DNA, 19 bp, Artificial sequence
  synthetic polynucleotide sequence
ctctgaggagggggccgta

SEQ ID NO: 42407 - DNA, 20 bp, Artificial sequence
  synthetic polynucleotide sequence
tccagctgcagccactgaca

SEQ ID NO: 42408 - DNA, 20 bp, Artificial sequence
  synthetic polynucleotide sequence
cctggtgcctgggagaagga

SEQ ID NO: 42409 - DNA, 20 bp, Artificial sequence
  synthetic polynucleotide sequence
cttcacctgcacgcccggca

SEQ ID NO: 42410 - DNA, 20 bp, Artificial sequence
  synthetic polynucleotide sequence
caggcggtgcagggaatgca

SEQ ID NO: 42411 - DNA, 18 bp, Artificial sequence
  synthetic polynucleotide sequence
cacgacggcaagcaggca

SEQ ID NO: 42412 - DNA, 18 bp, Artificial sequence
  synthetic polynucleotide sequence
aaccgagaggtcgtggca

SEQ ID NO: 42413 - DNA, 20 bp, Artificial sequence
  synthetic polynucleotide sequence
cttcaccagccagcgagaca

SEQ ID NO: 42414 - DNA, 21 bp, Artificial sequence
  synthetic polynucleotide sequence
cgtcaggagagttctggagga

SEQ ID NO: 42415 - DNA, 22 bp, Artificial sequence
  synthetic polynucleotide sequence
ccaacgggacaacatcttccga

SEQ ID NO: 42416 - DNA, 22 bp, Artificial sequence
  synthetic polynucleotide sequence
gaattctgcagaatggcctcca

SEQ ID NO: 42417 - DNA, 20 bp, Artificial sequence
  synthetic polynucleotide sequence
cactccagggtcggatgcca

SEQ ID NO: 42418 - DNA, 23 bp, Artificial sequence
  synthetic polynucleotide sequence
gtggaacaggcaccagattccca

SEQ ID NO: 42419 - DNA, 18 bp, Artificial sequence
  synthetic polynucleotide sequence
tggagcaggaacccccta

SEQ ID NO: 42420 - DNA, 18 bp, Artificial sequence
  synthetic polynucleotide sequence
aatggccttccggaagca

SEQ ID NO: 42421 - DNA, 18 bp, Artificial sequence
  synthetic polynucleotide sequence
gcgtctcaacgtggacga

SEQ ID NO: 42422 - DNA, 18 bp, Artificial sequence
  synthetic polynucleotide sequence
tgggagggctcggtggga

SEQ ID NO: 42423 - DNA, 20 bp, Artificial sequence
  synthetic polynucleotide sequence
atgacagagcagcccggcta

SEQ ID NO: 42424 - DNA, 21 bp, Artificial sequence
  synthetic polynucleotide sequence
accaacaggaagccttcgcca

SEQ ID NO: 42425 - DNA, 21 bp, Artificial sequence
  synthetic polynucleotide sequence
gcagaagagcgtggaggagga

SEQ ID NO: 42426 - DNA, 21 bp, Artificial sequence
  synthetic polynucleotide sequence
tgctccctcacctggtccgaa

SEQ ID NO: 42427 - DNA, 20 bp, Artificial sequence
  synthetic polynucleotide sequence
caggagatcacagaggggga

SEQ ID NO: 42428 - DNA, 18 bp, Artificial sequence
  synthetic polynucleotide sequence
cggcgatgtagtcgcaga

SEQ ID NO: 42429 - DNA, 21 bp, Artificial sequence
  synthetic polynucleotide sequence
ctgtggaccgatacctgacca

SEQ ID NO: 42430 - DNA, 21 bp, Artificial sequence
  synthetic polynucleotide sequence
gtacacgtagcaccagtagga

SEQ ID NO: 42431 - DNA, 18 bp, Artificial sequence
  synthetic polynucleotide sequence
tgaccttgccaaggagca

SEQ ID NO: 42432 - DNA, 18 bp, Artificial sequence
  synthetic polynucleotide sequence
gctgtaggcatcggggca

SEQ ID NO: 42433 - DNA, 18 bp, Artificial sequence
  synthetic polynucleotide sequence
catcacggacccgcagca

SEQ ID NO: 42434 - DNA, 18 bp, Artificial sequence
  synthetic polynucleotide sequence
ggacgcgggtcccgctca

SEQ ID NO: 42435 - DNA, 20 bp, Artificial sequence
  synthetic polynucleotide sequence
caggaggtgcaggttccaga

SEQ ID NO: 42436 - DNA, 18 bp, Artificial sequence
  synthetic polynucleotide sequence
tatccatcgcaaggccca

SEQ ID NO: 42437 - DNA, 22 bp, Artificial sequence
  synthetic polynucleotide sequence
atgagccagctaaatcccctga

SEQ ID NO: 42438 - DNA, 21 bp, Artificial sequence
  synthetic polynucleotide sequence
gacctcttcagcacacaggga

SEQ ID NO: 42439 - DNA, 21 bp, Artificial sequence
  synthetic polynucleotide sequence
tgatttcacaggctgcaccca

SEQ ID NO: 42440 - DNA, 21 bp, Artificial sequence
  synthetic polynucleotide sequence
tctttctccagagcctgcaga

SEQ ID NO: 42441 - DNA, 21 bp, Artificial sequence
  synthetic polynucleotide sequence
agaggaagaggagcaggagga

SEQ ID NO: 42442 - DNA, 18 bp, Artificial sequence
  synthetic polynucleotide sequence
cgagcccctctctggcca

SEQ ID NO: 42443 - DNA, 20 bp, Artificial sequence
  synthetic polynucleotide sequence
cacctcctcacccgccaaga

SEQ ID NO: 42444 - DNA, 20 bp, Artificial sequence
  synthetic polynucleotide sequence
gcacaggatcacctctggga

SEQ ID NO: 42445 - DNA, 22 bp, Artificial sequence
  synthetic polynucleotide sequence
tgaaggaagctgtggatcggaa

SEQ ID NO: 42446 - DNA, 19 bp, Artificial sequence
  synthetic polynucleotide sequence
tagccatagcatctgccca

SEQ ID NO: 42447 - DNA, 22 bp, Artificial sequence
  synthetic polynucleotide sequence
ttcagaagagccaagagcagca

SEQ ID NO: 42448 - DNA, 20 bp, Artificial sequence
  synthetic polynucleotide sequence
ggtcttcagcaccccgtgga

SEQ ID NO: 42449 - DNA, 22 bp, Artificial sequence
  synthetic polynucleotide sequence
gaattgcagagccaagtgggga

SEQ ID NO: 42450 - DNA, 18 bp, Artificial sequence
  synthetic polynucleotide sequence
agcgagggtcccgggcta

SEQ ID NO: 42451 - DNA, 21 bp, Artificial sequence
  synthetic polynucleotide sequence
gtggacacgttcatggaggca

SEQ ID NO: 42452 - DNA, 18 bp, Artificial sequence
  synthetic polynucleotide sequence
ctgcctcagtccggggga

SEQ ID NO: 42453 - DNA, 18 bp, Artificial sequence
  synthetic polynucleotide sequence
aagtggccactgcagcca

SEQ ID NO: 42454 - DNA, 18 bp, Artificial sequence
  synthetic polynucleotide sequence
cctgggccatgtcacaca

SEQ ID NO: 42455 - DNA, 19 bp, Artificial sequence
  synthetic polynucleotide sequence
ccttcacaggacaccggga

SEQ ID NO: 42456 - DNA, 18 bp, Artificial sequence
  synthetic polynucleotide sequence
cccagccgtcacacagca

SEQ ID NO: 42457 - DNA, 20 bp, Artificial sequence
  synthetic polynucleotide sequence
aagagaaagggaggccggca

SEQ ID NO: 42458 - DNA, 19 bp, Artificial sequence
  synthetic polynucleotide sequence
tctcttgccacccaagcca

SEQ ID NO: 42459 - DNA, 21 bp, Artificial sequence
  synthetic polynucleotide sequence
cgattgccaaggaggacccaa

SEQ ID NO: 42460 - DNA, 20 bp, Artificial sequence
  synthetic polynucleotide sequence
tgtgacctcccctgactcga

SEQ ID NO: 42461 - DNA, 20 bp, Artificial sequence
  synthetic polynucleotide sequence
ggcaccgcactcttcgccca

SEQ ID NO: 42462 - DNA, 20 bp, Artificial sequence
  synthetic polynucleotide sequence
gaagccagcctcccgaagga

SEQ ID NO: 42463 - DNA, 22 bp, Artificial sequence
  synthetic polynucleotide sequence
gaagaggacatgacggaacaga

SEQ ID NO: 42464 - DNA, 21 bp, Artificial sequence
  synthetic polynucleotide sequence
gttagattcaggcaccaagca

SEQ ID NO: 42465 - DNA, 21 bp, Artificial sequence
  synthetic polynucleotide sequence
gtacctacctcggaccagtga

SEQ ID NO: 42466 - DNA, 22 bp, Artificial sequence
  synthetic polynucleotide sequence
caaaactccaacagcagccgta

SEQ ID NO: 42467 - DNA, 21 bp, Artificial sequence
  synthetic polynucleotide sequence
cagagctggcccaatgagaca

SEQ ID NO: 42468 - DNA, 20 bp, Artificial sequence
  synthetic polynucleotide sequence
tggcatatcagccacaggga

SEQ ID NO: 42469 - DNA, 20 bp, Artificial sequence
  synthetic polynucleotide sequence
gacaggcctgaaaccagaga

SEQ ID NO: 42470 - DNA, 20 bp, Artificial sequence
  synthetic polynucleotide sequence
ctgcattcccaccaactcga

SEQ ID NO: 42471 - DNA, 18 bp, Artificial sequence
  synthetic polynucleotide sequence
gcaaacggctacaccgga

SEQ ID NO: 42472 - DNA, 20 bp, Artificial sequence
  synthetic polynucleotide sequence
gttctgagggcaggacccta

SEQ ID NO: 42473 - DNA, 20 bp, Artificial sequence
  synthetic polynucleotide sequence
gaccaccggcatccagacca

SEQ ID NO: 42474 - DNA, 19 bp, Artificial sequence
  synthetic polynucleotide sequence
gacgacaccaggggcctca

SEQ ID NO: 42475 - DNA, 20 bp, Artificial sequence
  synthetic polynucleotide sequence
tactggaacctccacctcga

SEQ ID NO: 42476 - DNA, 18 bp, Artificial sequence
  synthetic polynucleotide sequence
gcgtcaagagagcgtcca

SEQ ID NO: 42477 - DNA, 22 bp, Artificial sequence
  synthetic polynucleotide sequence
gcattccggaaagcagctggta

SEQ ID NO: 42478 - DNA, 21 bp, Artificial sequence
  synthetic polynucleotide sequence
gaggggctcggataagatgga

SEQ ID NO: 42479 - DNA, 22 bp, Artificial sequence
  synthetic polynucleotide sequence
ccaactctccccaaaaagccga

SEQ ID NO: 42480 - DNA, 20 bp, Artificial sequence
  synthetic polynucleotide sequence
ctcaccctcgaagccctcca

SEQ ID NO: 42481 - DNA, 21 bp, Artificial sequence
  synthetic polynucleotide sequence
ttgccccaagactgtccagga

SEQ ID NO: 42482 - DNA, 21 bp, Artificial sequence
  synthetic polynucleotide sequence
tctcagggtacatgtccagga

SEQ ID NO: 42483 - DNA, 21 bp, Artificial sequence
  synthetic polynucleotide sequence
tcagcatatctcgagagggca

SEQ ID NO: 42484 - DNA, 21 bp, Artificial sequence
  synthetic polynucleotide sequence
ctatggtcatgggggagtgca

SEQ ID NO: 42485 - DNA, 20 bp, Artificial sequence
  synthetic polynucleotide sequence
gctaacctgcgggccagtca

SEQ ID NO: 42486 - DNA, 23 bp, Artificial sequence
  synthetic polynucleotide sequence
caaaaacagacgggagaaggtca

SEQ ID NO: 42487 - DNA, 20 bp, Artificial sequence
  synthetic polynucleotide sequence
aaggcggccatgggaaggaa

SEQ ID NO: 42488 - DNA, 20 bp, Artificial sequence
  synthetic polynucleotide sequence
tagactgcgggctccaagga

SEQ ID NO: 42489 - DNA, 20 bp, Artificial sequence
  synthetic polynucleotide sequence
gcagatgaggggccagagga

SEQ ID NO: 42490 - DNA, 20 bp, Artificial sequence
  synthetic polynucleotide sequence
gccactgagtactgcgggca

SEQ ID NO: 42491 - DNA, 20 bp, Artificial sequence
  synthetic polynucleotide sequence
ctgtggccatcatcccccga

SEQ ID NO: 42492 - DNA, 21 bp, Artificial sequence
  synthetic polynucleotide sequence
tgaaatccagggaggggtcca

SEQ ID NO: 42493 - DNA, 21 bp, Artificial sequence
  synthetic polynucleotide sequence
ggcgggagaatgccaacagga

SEQ ID NO: 42494 - DNA, 20 bp, Artificial sequence
  synthetic polynucleotide sequence
tgcagatgtgagtggcccca

SEQ ID NO: 42495 - DNA, 18 bp, Artificial sequence
  synthetic polynucleotide sequence
gcaaccgatggagacgca

SEQ ID NO: 42496 - DNA, 20 bp, Artificial sequence
  synthetic polynucleotide sequence
gttgacatcggctacaccca

SEQ ID NO: 42497 - DNA, 22 bp, Artificial sequence
  synthetic polynucleotide sequence
caattgcccagaagggttggaa

SEQ ID NO: 42498 - DNA, 21 bp, Artificial sequence
  synthetic polynucleotide sequence
ttcgtgcatggactccaagga

SEQ ID NO: 42499 - DNA, 21 bp, Artificial sequence
  synthetic polynucleotide sequence
ccaggaggtcaacaggtgcaa

SEQ ID NO: 42500 - DNA, 18 bp, Artificial sequence
  synthetic polynucleotide sequence
cgggcaggtgggcagaca

SEQ ID NO: 42501 - DNA, 20 bp, Artificial sequence
  synthetic polynucleotide sequence
tggaagatccactgggacca

SEQ ID NO: 42502 - DNA, 18 bp, Artificial sequence
  synthetic polynucleotide sequence
tctcggccaagcagccta

SEQ ID NO: 42503 - DNA, 20 bp, Artificial sequence
  synthetic polynucleotide sequence
tagacggtcctcctcgagca

SEQ ID NO: 42504 - DNA, 20 bp, Artificial sequence
  synthetic polynucleotide sequence
tccctcgaccccttgaacga

SEQ ID NO: 42505 - DNA, 23 bp, Artificial sequence
  synthetic polynucleotide sequence
caagatcacaaacccacacacaa

SEQ ID NO: 42506 - DNA, 25 bp, Artificial sequence
  synthetic polynucleotide sequence
ggtgaacaaggacgtgacatcagaa

SEQ ID NO: 42507 - DNA, 21 bp, Artificial sequence
  synthetic polynucleotide sequence
ccgttaccgagagaggcgcta

SEQ ID NO: 42508 - DNA, 18 bp, Artificial sequence
  synthetic polynucleotide sequence
tccccgcgcgatcgcgta

SEQ ID NO: 42509 - DNA, 19 bp, Artificial sequence
  synthetic polynucleotide sequence
gaggagctgcccacacaga

SEQ ID NO: 42510 - DNA, 19 bp, Artificial sequence
  synthetic polynucleotide sequence
ccaatatctggcggcagga

SEQ ID NO: 42511 - DNA, 18 bp, Artificial sequence
  synthetic polynucleotide sequence
ccgagccctgaatgcgaa

SEQ ID NO: 42512 - DNA, 18 bp, Artificial sequence
  synthetic polynucleotide sequence
cgaaccaggcctggcaga

SEQ ID NO: 42513 - DNA, 21 bp, Artificial sequence
  synthetic polynucleotide sequence
catcagaaaggagatccggga

SEQ ID NO: 42514 - DNA, 20 bp, Artificial sequence
  synthetic polynucleotide sequence
taccaagcgatgatccagca

SEQ ID NO: 42515 - DNA, 21 bp, Artificial sequence
  synthetic polynucleotide sequence
tgctcgaatcgcttccccaga

SEQ ID NO: 42516 - DNA, 19 bp, Artificial sequence
  synthetic polynucleotide sequence
gagggaaagcgcgggtgga

SEQ ID NO: 42517 - DNA, 20 bp, Artificial sequence
  synthetic polynucleotide sequence
tctgagaagaggccggcaga

SEQ ID NO: 42518 - DNA, 20 bp, Artificial sequence
  synthetic polynucleotide sequence
ctcagcaaagagggggccga

SEQ ID NO: 42519 - DNA, 21 bp, Artificial sequence
  synthetic polynucleotide sequence
atccctcccaaatcccaacca

SEQ ID NO: 42520 - DNA, 22 bp, Artificial sequence
  synthetic polynucleotide sequence
acaacacccgtaatctcagcga

SEQ ID NO: 42521 - DNA, 21 bp, Artificial sequence
  synthetic polynucleotide sequence
tgacaagcacgatgacctcca

SEQ ID NO: 42522 - DNA, 19 bp, Artificial sequence
  synthetic polynucleotide sequence
ctcctggaaggcagcccca

SEQ ID NO: 42523 - DNA, 20 bp, Artificial sequence
  synthetic polynucleotide sequence
acggcccttcaccctaagca

SEQ ID NO: 42524 - DNA, 20 bp, Artificial sequence
  synthetic polynucleotide sequence
gtggtttccggggagcagga

SEQ ID NO: 42525 - DNA, 20 bp, Artificial sequence
  synthetic polynucleotide sequence
cccacccagcaggactgcaa

SEQ ID NO: 42526 - DNA, 20 bp, Artificial sequence
  synthetic polynucleotide sequence
tagtcgagcattgcacacca

SEQ ID NO: 42527 - DNA, 20 bp, Artificial sequence
  synthetic polynucleotide sequence
gcccacttcagcatggccca

SEQ ID NO: 42528 - DNA, 19 bp, Artificial sequence
  synthetic polynucleotide sequence
gcgggcatctgggtgagca

SEQ ID NO: 42529 - DNA, 18 bp, Artificial sequence
  synthetic polynucleotide sequence
gaaaaccgacgaaggcca

SEQ ID NO: 42530 - DNA, 18 bp, Artificial sequence
  synthetic polynucleotide sequence
ccacagccatgagcagca

SEQ ID NO: 42531 - DNA, 21 bp, Artificial sequence
  synthetic polynucleotide sequence
caccaggctcagatcgaccaa

SEQ ID NO: 42532 - DNA, 19 bp, Artificial sequence
  synthetic polynucleotide sequence
ggagactgcggctgctgca

SEQ ID NO: 42533 - DNA, 20 bp, Artificial sequence
  synthetic polynucleotide sequence
agtcagaagaaggccatcca

SEQ ID NO: 42534 - DNA, 22 bp, Artificial sequence
  synthetic polynucleotide sequence
ccaacataggtcatcagccaca

SEQ ID NO: 42535 - DNA, 20 bp, Artificial sequence
  synthetic polynucleotide sequence
aaggccacccattcagggca

SEQ ID NO: 42536 - DNA, 22 bp, Artificial sequence
  synthetic polynucleotide sequence
tcaactaagaagaggcgcctga

SEQ ID NO: 42537 - DNA, 22 bp, Artificial sequence
  synthetic polynucleotide sequence
taaggaagcttggtgcagacga

SEQ ID NO: 42538 - DNA, 22 bp, Artificial sequence
  synthetic polynucleotide sequence
ttcaggaggaaaggagtcacca

SEQ ID NO: 42539 - DNA, 20 bp, Artificial sequence
  synthetic polynucleotide sequence
aggccaggctgttcacgcaa

SEQ ID NO: 42540 - DNA, 20 bp, Artificial sequence
  synthetic polynucleotide sequence
gctgcaggtgaggctgggta

SEQ ID NO: 42541 - DNA, 18 bp, Artificial sequence
  synthetic polynucleotide sequence
cctccgcctcaacggcaa

SEQ ID NO: 42542 - DNA, 18 bp, Artificial sequence
  synthetic polynucleotide sequence
agtcctcggccctcagca

SEQ ID NO: 42543 - DNA, 18 bp, Artificial sequence
  synthetic polynucleotide sequence
gcggctgctcacagagca

SEQ ID NO: 42544 - DNA, 18 bp, Artificial sequence
  synthetic polynucleotide sequence
tagcgttgagccgcagga

SEQ ID NO: 42545 - DNA, 25 bp, Artificial sequence
  synthetic polynucleotide sequence
caaagcacaaaatctctgggaggca

SEQ ID NO: 42546 - DNA, 20 bp, Artificial sequence
  synthetic polynucleotide sequence
gcaaagaacccaggaggcca

SEQ ID NO: 42547 - DNA, 20 bp, Artificial sequence
  synthetic polynucleotide sequence
tggggaggacacagtctgga

SEQ ID NO: 42548 - DNA, 20 bp, Artificial sequence
  synthetic polynucleotide sequence
ggcccagagaggtgaccgga

SEQ ID NO: 42549 - DNA, 21 bp, Artificial sequence
  synthetic polynucleotide sequence
tgaggaccctgagttcacaca

SEQ ID NO: 42550 - DNA, 19 bp, Artificial sequence
  synthetic polynucleotide sequence
ggggtctgagatgggggga

SEQ ID NO: 42551 - DNA, 19 bp, Artificial sequence
  synthetic polynucleotide sequence
ggatcccatgacacagcca

SEQ ID NO: 42552 - DNA, 19 bp, Artificial sequence
  synthetic polynucleotide sequence
tgcgaggtacacagcacca

SEQ ID NO: 42553 - DNA, 21 bp, Artificial sequence
  synthetic polynucleotide sequence
gaaggcaacgggaaggaagga

SEQ ID NO: 42554 - DNA, 19 bp, Artificial sequence
  synthetic polynucleotide sequence
ggaaggggagggcaaggga

SEQ ID NO: 42555 - DNA, 18 bp, Artificial sequence
  synthetic polynucleotide sequence
ggccatgctcctgaggaa

SEQ ID NO: 42556 - DNA, 18 bp, Artificial sequence
  synthetic polynucleotide sequence
ggcagacaagcctgcaca

SEQ ID NO: 42557 - DNA, 19 bp, Artificial sequence
  synthetic polynucleotide sequence
ccagccgggttctgcgcaa

SEQ ID NO: 42558 - DNA, 22 bp, Artificial sequence
  synthetic polynucleotide sequence
gaatccagaagctccttggcca

SEQ ID NO: 42559 - DNA, 21 bp, Artificial sequence
  synthetic polynucleotide sequence
gcatccctgcccgaatcctga

SEQ ID NO: 42560 - DNA, 21 bp, Artificial sequence
  synthetic polynucleotide sequence
gctttggccgatgctcagcaa

SEQ ID NO: 42561 - DNA, 18 bp, Artificial sequence
  synthetic polynucleotide sequence
gccggaactgtggccaca

SEQ ID NO: 42562 - DNA, 18 bp, Artificial sequence
  synthetic polynucleotide sequence
agctgtcgcacactcgca

SEQ ID NO: 42563 - DNA, 21 bp, Artificial sequence
  synthetic polynucleotide sequence
gccaacaaagcattgcaggga

SEQ ID NO: 42564 - DNA, 22 bp, Artificial sequence
  synthetic polynucleotide sequence
gcagtgcatgacaggaatcaca

SEQ ID NO: 42565 - DNA, 22 bp, Artificial sequence
  synthetic polynucleotide sequence
agaagccgcagagataacagca

SEQ ID NO: 42566 - DNA, 22 bp, Artificial sequence
  synthetic polynucleotide sequence
attcagacccaccaacagacca

SEQ ID NO: 42567 - DNA, 20 bp, Artificial sequence
  synthetic polynucleotide sequence
tcacccagcagcggtgccca

SEQ ID NO: 42568 - DNA, 22 bp, Artificial sequence
  synthetic polynucleotide sequence
ccagacaggaagctgctggaga

SEQ ID NO: 42569 - DNA, 20 bp, Artificial sequence
  synthetic polynucleotide sequence
gtatgcctcctccccaggga

SEQ ID NO: 42570 - DNA, 21 bp, Artificial sequence
  synthetic polynucleotide sequence
acagtgcctcccgtaacagga

SEQ ID NO: 42571 - DNA, 20 bp, Artificial sequence
  synthetic polynucleotide sequence
gactcccagcgcctgggaga

SEQ ID NO: 42572 - DNA, 20 bp, Artificial sequence
  synthetic polynucleotide sequence
aagctcgccagggacttgca

SEQ ID NO: 42573 - DNA, 22 bp, Artificial sequence
  synthetic polynucleotide sequence
tagagcctggatcagagtagca

SEQ ID NO: 42574 - DNA, 21 bp, Artificial sequence
  synthetic polynucleotide sequence
agtcctagaagcatgccagca

SEQ ID NO: 42575 - DNA, 18 bp, Artificial sequence
  synthetic polynucleotide sequence
ctagacgcgcatcgggaa

SEQ ID NO: 42576 - DNA, 18 bp, Artificial sequence
  synthetic polynucleotide sequence
tccgctccgcctcagaca

SEQ ID NO: 42577 - DNA, 20 bp, Artificial sequence
  synthetic polynucleotide sequence
acccttccagaccagcagca

SEQ ID NO: 42578 - DNA, 19 bp, Artificial sequence
  synthetic polynucleotide sequence
tccatcagcgtcaacacca

SEQ ID NO: 42579 - DNA, 18 bp, Artificial sequence
  synthetic polynucleotide sequence
ccttccccacgctgccaa

SEQ ID NO: 42580 - DNA, 20 bp, Artificial sequence
  synthetic polynucleotide sequence
ctgtaggggaaggcagctga

SEQ ID NO: 42581 - DNA, 21 bp, Artificial sequence
  synthetic polynucleotide sequence
tctccaaaccttcccacacca

SEQ ID NO: 42582 - DNA, 18 bp, Artificial sequence
  synthetic polynucleotide sequence
atgacgccccggtgccca

SEQ ID NO: 42583 - DNA, 21 bp, Artificial sequence
  synthetic polynucleotide sequence
cctggaggcatcaagtgggga

SEQ ID NO: 42584 - DNA, 19 bp, Artificial sequence
  synthetic polynucleotide sequence
cacggaggactggagggca

SEQ ID NO: 42585 - DNA, 22 bp, Artificial sequence
  synthetic polynucleotide sequence
aacaagtacatcgaccagggca

SEQ ID NO: 42586 - DNA, 20 bp, Artificial sequence
  synthetic polynucleotide sequence
agactccagggcgcggtgca

SEQ ID NO: 42587 - DNA, 18 bp, Artificial sequence
  synthetic polynucleotide sequence
cgtcactgcgctacgcca

SEQ ID NO: 42588 - DNA, 18 bp, Artificial sequence
  synthetic polynucleotide sequence
agcgggactcgtccagga

SEQ ID NO: 42589 - DNA, 20 bp, Artificial sequence
  synthetic polynucleotide sequence
gagcagcgcaacgagctgga

SEQ ID NO: 42590 - DNA, 19 bp, Artificial sequence
  synthetic polynucleotide sequence
tctccagcctcagacgtca

SEQ ID NO: 42591 - DNA, 21 bp, Artificial sequence
  synthetic polynucleotide sequence
catgcctcacagctaccccta

SEQ ID NO: 42592 - DNA, 22 bp, Artificial sequence
  synthetic polynucleotide sequence
acatacacagagctcacctgga

SEQ ID NO: 42593 - DNA, 18 bp, Artificial sequence
  synthetic polynucleotide sequence
tgagggggccacggctca

SEQ ID NO: 42594 - DNA, 20 bp, Artificial sequence
  synthetic polynucleotide sequence
ctgctacagccagctggtca

SEQ ID NO: 42595 - DNA, 21 bp, Artificial sequence
  synthetic polynucleotide sequence
gccgctcagagacagatggga

SEQ ID NO: 42596 - DNA, 22 bp, Artificial sequence
  synthetic polynucleotide sequence
tcatgaaccataggctccgaca

SEQ ID NO: 42597 - DNA, 19 bp, Artificial sequence
  synthetic polynucleotide sequence
gccaacgaggaccaggaga

SEQ ID NO: 42598 - DNA, 20 bp, Artificial sequence
  synthetic polynucleotide sequence
agaaggctttgggatcacca

SEQ ID NO: 42599 - DNA, 21 bp, Artificial sequence
  synthetic polynucleotide sequence
atgggggtggacaggatgtca

SEQ ID NO: 42600 - DNA, 21 bp, Artificial sequence
  synthetic polynucleotide sequence
tgattcccgcagtcgtccaca

SEQ ID NO: 42601 - DNA, 21 bp, Artificial sequence
  synthetic polynucleotide sequence
accccacatgcctgaaaagca

SEQ ID NO: 42602 - DNA, 22 bp, Artificial sequence
  synthetic polynucleotide sequence
tgtgaaagaccacacagtgcca

SEQ ID NO: 42603 - DNA, 18 bp, Artificial sequence
  synthetic polynucleotide sequence
cgctcaccacctggagca

SEQ ID NO: 42604 - DNA, 18 bp, Artificial sequence
  synthetic polynucleotide sequence
gaggacggggttgaggca

SEQ ID NO: 42605 - DNA, 20 bp, Artificial sequence
  synthetic polynucleotide sequence
tggcggacctgggactggca

SEQ ID NO: 42606 - DNA, 20 bp, Artificial sequence
  synthetic polynucleotide sequence
tgaggacagtggccgtcaga

SEQ ID NO: 42607 - DNA, 19 bp, Artificial sequence
  synthetic polynucleotide sequence
tggaggcctactgcaagca

SEQ ID NO: 42608 - DNA, 18 bp, Artificial sequence
  synthetic polynucleotide sequence
tgagcccgatggagcgca

SEQ ID NO: 42609 - DNA, 21 bp, Artificial sequence
  synthetic polynucleotide sequence
gcagcagggacggtttgccaa

SEQ ID NO: 42610 - DNA, 20 bp, Artificial sequence
  synthetic polynucleotide sequence
tgtcgatgggggtgtcacca

SEQ ID NO: 42611 - DNA, 18 bp, Artificial sequence
  synthetic polynucleotide sequence
tgggatgcctgcgagcca

SEQ ID NO: 42612 - DNA, 18 bp, Artificial sequence
  synthetic polynucleotide sequence
gcagcagcagcttggcaa

SEQ ID NO: 42613 - DNA, 20 bp, Artificial sequence
  synthetic polynucleotide sequence
ctcatccacagtgacctcca

SEQ ID NO: 42614 - DNA, 19 bp, Artificial sequence
  synthetic polynucleotide sequence
ttggcgtggaggaacggga

SEQ ID NO: 42615 - DNA, 21 bp, Artificial sequence
  synthetic polynucleotide sequence
gccagactccctacgtggaca

SEQ ID NO: 42616 - DNA, 21 bp, Artificial sequence
  synthetic polynucleotide sequence
ctctggatctaaggcccagca

SEQ ID NO: 42617 - DNA, 18 bp, Artificial sequence
  synthetic polynucleotide sequence
ccactagcaacgcgcaga

SEQ ID NO: 42618 - DNA, 18 bp, Artificial sequence
  synthetic polynucleotide sequence
tgggatgactccacgcca

SEQ ID NO: 42619 - DNA, 22 bp, Artificial sequence
  synthetic polynucleotide sequence
ctacacgcagtcagaaacggaa

SEQ ID NO: 42620 - DNA, 20 bp, Artificial sequence
  synthetic polynucleotide sequence
gacggcgacgttgaagccga

SEQ ID NO: 42621 - DNA, 21 bp, Artificial sequence
  synthetic polynucleotide sequence
ctctggcagtcaccaagcaga

SEQ ID NO: 42622 - DNA, 20 bp, Artificial sequence
  synthetic polynucleotide sequence
aagccaaccactgcgtccca

SEQ ID NO: 42623 - DNA, 21 bp, Artificial sequence
  synthetic polynucleotide sequence
tgatgaaggagctagacgaga

SEQ ID NO: 42624 - DNA, 20 bp, Artificial sequence
  synthetic polynucleotide sequence
tacaggccactgtgagagca

SEQ ID NO: 42625 - DNA, 21 bp, Artificial sequence
  synthetic polynucleotide sequence
atggaaaaggagttccctgga

SEQ ID NO: 42626 - DNA, 20 bp, Artificial sequence
  synthetic polynucleotide sequence
aaagaagctctggaagccca

SEQ ID NO: 42627 - DNA, 19 bp, Artificial sequence
  synthetic polynucleotide sequence
ggccggaaggatagcctca

SEQ ID NO: 42628 - DNA, 20 bp, Artificial sequence
  synthetic polynucleotide sequence
tctcatcaagagagcccaca

SEQ ID NO: 42629 - DNA, 22 bp, Artificial sequence
  synthetic polynucleotide sequence
agcaactgtggcctggaagaga

SEQ ID NO: 42630 - DNA, 18 bp, Artificial sequence
  synthetic polynucleotide sequence
cccggacaggcctctcca

SEQ ID NO: 42631 - DNA, 18 bp, Artificial sequence
  synthetic polynucleotide sequence
ggacacagggaaccggaa

SEQ ID NO: 42632 - DNA, 18 bp, Artificial sequence
  synthetic polynucleotide sequence
gccgcctatcaaggtcca

SEQ ID NO: 42633 - DNA, 20 bp, Artificial sequence
  synthetic polynucleotide sequence
cagcaggtggacttccagga

SEQ ID NO: 42634 - DNA, 18 bp, Artificial sequence
  synthetic polynucleotide sequence
gtctgggcagccctggaa

SEQ ID NO: 42635 - DNA, 20 bp, Artificial sequence
  synthetic polynucleotide sequence
gaaggagctggccacctgga

SEQ ID NO: 42636 - DNA, 22 bp, Artificial sequence
  synthetic polynucleotide sequence
agtactcgtggcagtagagaca

SEQ ID NO: 42637 - DNA, 20 bp, Artificial sequence
  synthetic polynucleotide sequence
ccctccaccctcaccctcca

SEQ ID NO: 42638 - DNA, 20 bp, Artificial sequence
  synthetic polynucleotide sequence
ctgggagggagaggagggca

SEQ ID NO: 42639 - DNA, 23 bp, Artificial sequence
  synthetic polynucleotide sequence
gatgagcaacactcaagctgaga

SEQ ID NO: 42640 - DNA, 22 bp, Artificial sequence
  synthetic polynucleotide sequence
caggcactaaggaagttgggga

SEQ ID NO: 42641 - DNA, 20 bp, Artificial sequence
  synthetic polynucleotide sequence
gcagggacacatgtgtggca

SEQ ID NO: 42642 - DNA, 23 bp, Artificial sequence
  synthetic polynucleotide sequence
cgacctgccatagcaaatcagca

SEQ ID NO: 42643 - DNA, 22 bp, Artificial sequence
  synthetic polynucleotide sequence
caggccgagccttataaaggga

SEQ ID NO: 42644 - DNA, 21 bp, Artificial sequence
  synthetic polynucleotide sequence
agctgggaagcatcacgagaa

SEQ ID NO: 42645 - DNA, 18 bp, Artificial sequence
  synthetic polynucleotide sequence
caatgatggagacggcga

SEQ ID NO: 42646 - DNA, 20 bp, Artificial sequence
  synthetic polynucleotide sequence
gtggcaggcagtagtaacca

SEQ ID NO: 42647 - DNA, 22 bp, Artificial sequence
  synthetic polynucleotide sequence
tcaaggtgctgatggagaagga

SEQ ID NO: 42648 - DNA, 21 bp, Artificial sequence
  synthetic polynucleotide sequence
tcactgaagtccacctgggca

SEQ ID NO: 42649 - DNA, 19 bp, Artificial sequence
  synthetic polynucleotide sequence
tcggacctcaccacgcgaa

SEQ ID NO: 42650 - DNA, 21 bp, Artificial sequence
  synthetic polynucleotide sequence
agaagtctgggagacgctgga

SEQ ID NO: 42651 - DNA, 19 bp, Artificial sequence
  synthetic polynucleotide sequence
cgtgccaaaaggaaaccca

SEQ ID NO: 42652 - DNA, 20 bp, Artificial sequence
  synthetic polynucleotide sequence
agcaactgtcagagctgcca

SEQ ID NO: 42653 - DNA, 18 bp, Artificial sequence
  synthetic polynucleotide sequence
actccggcaccaacccca

SEQ ID NO: 42654 - DNA, 18 bp, Artificial sequence
  synthetic polynucleotide sequence
agagtctccgctcgggca

SEQ ID NO: 42655 - DNA, 20 bp, Artificial sequence
  synthetic polynucleotide sequence
ctgcctctctacgccaagca

SEQ ID NO: 42656 - DNA, 18 bp, Artificial sequence
  synthetic polynucleotide sequence
cgtggcttgagcggacca

SEQ ID NO: 42657 - DNA, 20 bp, Artificial sequence
  synthetic polynucleotide sequence
gtccatggcactgctgcgga

SEQ ID NO: 42658 - DNA, 20 bp, Artificial sequence
  synthetic polynucleotide sequence
atgaccgggttcatggcgga

SEQ ID NO: 42659 - DNA, 19 bp, Artificial sequence
  synthetic polynucleotide sequence
cgtcgaggctcactccgga

SEQ ID NO: 42660 - DNA, 18 bp, Artificial sequence
  synthetic polynucleotide sequence
tggacaggggctcccgca

SEQ ID NO: 42661 - DNA, 18 bp, Artificial sequence
  synthetic polynucleotide sequence
ctgcggggaccacctcga

SEQ ID NO: 42662 - DNA, 18 bp, Artificial sequence
  synthetic polynucleotide sequence
gccagtcccaggaaggga

SEQ ID NO: 42663 - DNA, 22 bp, Artificial sequence
  synthetic polynucleotide sequence
atgtggagagcctactctgaca

SEQ ID NO: 42664 - DNA, 18 bp, Artificial sequence
  synthetic polynucleotide sequence
agttcccccgagcatgga

SEQ ID NO: 42665 - DNA, 20 bp, Artificial sequence
  synthetic polynucleotide sequence
atgatgctgccaaaagggga

SEQ ID NO: 42666 - DNA, 20 bp, Artificial sequence
  synthetic polynucleotide sequence
gcagcctgatcggccagcga

SEQ ID NO: 42667 - DNA, 20 bp, Artificial sequence
  synthetic polynucleotide sequence
aagaccccgaccgcttcaga

SEQ ID NO: 42668 - DNA, 20 bp, Artificial sequence
  synthetic polynucleotide sequence
ctgagagcagaggagcagga

SEQ ID NO: 42669 - DNA, 21 bp, Artificial sequence
  synthetic polynucleotide sequence
gggagtactggccaagtccaa

SEQ ID NO: 42670 - DNA, 21 bp, Artificial sequence
  synthetic polynucleotide sequence
cagtgcaataacacctgccca

SEQ ID NO: 42671 - DNA, 18 bp, Artificial sequence
  synthetic polynucleotide sequence
ccctgccctacctgccaa

SEQ ID NO: 42672 - DNA, 18 bp, Artificial sequence
  synthetic polynucleotide sequence
gggccaagaggttgacca

SEQ ID NO: 42673 - DNA, 19 bp, Artificial sequence
  synthetic polynucleotide sequence
tcaggcccaacttcagaga

SEQ ID NO: 42674 - DNA, 21 bp, Artificial sequence
  synthetic polynucleotide sequence
ttcaaggcaccagttcccgca

SEQ ID NO: 42675 - DNA, 20 bp, Artificial sequence
  synthetic polynucleotide sequence
cacccctggcctgagaagca

SEQ ID NO: 42676 - DNA, 21 bp, Artificial sequence
  synthetic polynucleotide sequence
ccatgcttgctccaccacaga

SEQ ID NO: 42677 - DNA, 19 bp, Artificial sequence
  synthetic polynucleotide sequence
tgaaaggacttggggctga

SEQ ID NO: 42678 - DNA, 22 bp, Artificial sequence
  synthetic polynucleotide sequence
cctatttcggccaacagaccca

SEQ ID NO: 42679 - DNA, 20 bp, Artificial sequence
  synthetic polynucleotide sequence
tgaccggtcatggcagggca

SEQ ID NO: 42680 - DNA, 20 bp, Artificial sequence
  synthetic polynucleotide sequence
atcatgtggccaggcccgga

SEQ ID NO: 42681 - DNA, 21 bp, Artificial sequence
  synthetic polynucleotide sequence
aggtggacattcccagggcca

SEQ ID NO: 42682 - DNA, 19 bp, Artificial sequence
  synthetic polynucleotide sequence
ggcgggtgaagtgggggta

SEQ ID NO: 42683 - DNA, 18 bp, Artificial sequence
  synthetic polynucleotide sequence
atgggtccccagccccga

SEQ ID NO: 42684 - DNA, 21 bp, Artificial sequence
  synthetic polynucleotide sequence
cattggccacctgttccacga

SEQ ID NO: 42685 - DNA, 20 bp, Artificial sequence
  synthetic polynucleotide sequence
ccggccatgagtaccaggga

SEQ ID NO: 42686 - DNA, 23 bp, Artificial sequence
  synthetic polynucleotide sequence
ataaatgctggtggaacagtcga

SEQ ID NO: 42687 - DNA, 21 bp, Artificial sequence
  synthetic polynucleotide sequence
tcttcctctgccacatcccca

SEQ ID NO: 42688 - DNA, 20 bp, Artificial sequence
  synthetic polynucleotide sequence
catccacagagagccgccga

SEQ ID NO: 42689 - DNA, 21 bp, Artificial sequence
  synthetic polynucleotide sequence
aggagttctgaggaggagaga

SEQ ID NO: 42690 - DNA, 23 bp, Artificial sequence
  synthetic polynucleotide sequence
gcctacagcttgaggagaagcca

SEQ ID NO: 42691 - DNA, 21 bp, Artificial sequence
  synthetic polynucleotide sequence
cgagcggactcacactggaga

SEQ ID NO: 42692 - DNA, 21 bp, Artificial sequence
  synthetic polynucleotide sequence
ttccacacaacagggtccaca

SEQ ID NO: 42693 - DNA, 20 bp, Artificial sequence
  synthetic polynucleotide sequence
gattcccggagcaggcgaca

SEQ ID NO: 42694 - DNA, 20 bp, Artificial sequence
  synthetic polynucleotide sequence
tggacaggccggtgagcaca

SEQ ID NO: 42695 - DNA, 18 bp, Artificial sequence
  synthetic polynucleotide sequence
cggcacagacacccccca

SEQ ID NO: 42696 - DNA, 18 bp, Artificial sequence
  synthetic polynucleotide sequence
ccagccccatccgctgca

SEQ ID NO: 42697 - DNA, 21 bp, Artificial sequence
  synthetic polynucleotide sequence
gtcagcccctacttccacaca

SEQ ID NO: 42698 - DNA, 20 bp, Artificial sequence
  synthetic polynucleotide sequence
cctgctccctgaagacccga

SEQ ID NO: 42699 - DNA, 21 bp, Artificial sequence
  synthetic polynucleotide sequence
ggctctatggacccagcagga

SEQ ID NO: 42700 - DNA, 20 bp, Artificial sequence
  synthetic polynucleotide sequence
gtctcagcagggctcgccca

SEQ ID NO: 42701 - DNA, 21 bp, Artificial sequence
  synthetic polynucleotide sequence
tgcagactgggccgtgatgga

SEQ ID NO: 42702 - DNA, 22 bp, Artificial sequence
  synthetic polynucleotide sequence
tagattttcagagcaggcccca

SEQ ID NO: 42703 - DNA, 20 bp, Artificial sequence
  synthetic polynucleotide sequence
cagcagccccaagatcccca

SEQ ID NO: 42704 - DNA, 21 bp, Artificial sequence
  synthetic polynucleotide sequence
catgagagttgctgagcccca

SEQ ID NO: 42705 - DNA, 22 bp, Artificial sequence
  synthetic polynucleotide sequence
tgatgagaacgttcctgagcca

SEQ ID NO: 42706 - DNA, 21 bp, Artificial sequence
  synthetic polynucleotide sequence
tcctgtggtagcactggacca

SEQ ID NO: 42707 - DNA, 22 bp, Artificial sequence
  synthetic polynucleotide sequence
tgaacaggtgcaagtgtccaca

SEQ ID NO: 42708 - DNA, 22 bp, Artificial sequence
  synthetic polynucleotide sequence
atgaaaggcagctactagcgca

SEQ ID NO: 42709 - DNA, 20 bp, Artificial sequence
  synthetic polynucleotide sequence
gtggagccccttccatgcca

SEQ ID NO: 42710 - DNA, 19 bp, Artificial sequence
  synthetic polynucleotide sequence
tcggtcatactgaggcaca

SEQ ID NO: 42711 - DNA, 20 bp, Artificial sequence
  synthetic polynucleotide sequence
cattcccgcgcaaagccgca

SEQ ID NO: 42712 - DNA, 19 bp, Artificial sequence
  synthetic polynucleotide sequence
ggccactcccatccccaca

SEQ ID NO: 42713 - DNA, 19 bp, Artificial sequence
  synthetic polynucleotide sequence
ccctgggggtctcacacca

SEQ ID NO: 42714 - DNA, 19 bp, Artificial sequence
  synthetic polynucleotide sequence
tcctggcagagatggtcga

SEQ ID NO: 42715 - DNA, 20 bp, Artificial sequence
  synthetic polynucleotide sequence
ctctccgtgccaggacaaca

SEQ ID NO: 42716 - DNA, 21 bp, Artificial sequence
  synthetic polynucleotide sequence
cgccagtcagggtcataccaa

SEQ ID NO: 42717 - DNA, 22 bp, Artificial sequence
  synthetic polynucleotide sequence
tggagatgtgtggaaggaggaa

SEQ ID NO: 42718 - DNA, 20 bp, Artificial sequence
  synthetic polynucleotide sequence
cataagcaagtgggcctcca

SEQ ID NO: 42719 - DNA, 20 bp, Artificial sequence
  synthetic polynucleotide sequence
ggtccaagcaggcaagcaca

SEQ ID NO: 42720 - DNA, 21 bp, Artificial sequence
  synthetic polynucleotide sequence
ccacacatccccactgtgcca

SEQ ID NO: 42721 - DNA, 18 bp, Artificial sequence
  synthetic polynucleotide sequence
agcccgagaaccccctca

SEQ ID NO: 42722 - DNA, 18 bp, Artificial sequence
  synthetic polynucleotide sequence
gcgcctgaggaaggagca

SEQ ID NO: 42723 - DNA, 20 bp, Artificial sequence
  synthetic polynucleotide sequence
aaccaggaactggcaggcta

SEQ ID NO: 42724 - DNA, 18 bp, Artificial sequence
  synthetic polynucleotide sequence
gcatgctgaatccgcgga

SEQ ID NO: 42725 - DNA, 21 bp, Artificial sequence
  synthetic polynucleotide sequence
gacagagctcatcaagtggca

SEQ ID NO: 42726 - DNA, 20 bp, Artificial sequence
  synthetic polynucleotide sequence
atggtcctgaataggggcca

SEQ ID NO: 42727 - DNA, 18 bp, Artificial sequence
  synthetic polynucleotide sequence
atacccactggcggcaca

SEQ ID NO: 42728 - DNA, 19 bp, Artificial sequence
  synthetic polynucleotide sequence
gacggtagacgctacccca

SEQ ID NO: 42729 - DNA, 21 bp, Artificial sequence
  synthetic polynucleotide sequence
gtctggcagaaaggggactga

SEQ ID NO: 42730 - DNA, 20 bp, Artificial sequence
  synthetic polynucleotide sequence
gtctcatgcgccctgaagga

SEQ ID NO: 42731 - DNA, 18 bp, Artificial sequence
  synthetic polynucleotide sequence
ccaaggccccccagcaga

SEQ ID NO: 42732 - DNA, 21 bp, Artificial sequence
  synthetic polynucleotide sequence
aggtatggtctggggggccaa

SEQ ID NO: 42733 - DNA, 20 bp, Artificial sequence
  synthetic polynucleotide sequence
ctggataagagcgcaaggca

SEQ ID NO: 42734 - DNA, 22 bp, Artificial sequence
  synthetic polynucleotide sequence
ttgaacaggtgaatcacctcca

SEQ ID NO: 42735 - DNA, 21 bp, Artificial sequence
  synthetic polynucleotide sequence
tgccagcacagctgttgcaga

SEQ ID NO: 42736 - DNA, 21 bp, Artificial sequence
  synthetic polynucleotide sequence
tgaccgtgacaacagctggca

SEQ ID NO: 42737 - DNA, 21 bp, Artificial sequence
  synthetic polynucleotide sequence
catcgacaagagcgtaaggca

SEQ ID NO: 42738 - DNA, 20 bp, Artificial sequence
  synthetic polynucleotide sequence
gctcgggagaatctccgcca

SEQ ID NO: 42739 - DNA, 21 bp, Artificial sequence
  synthetic polynucleotide sequence
tagttcctgcaccacccagga

SEQ ID NO: 42740 - DNA, 19 bp, Artificial sequence
  synthetic polynucleotide sequence
cttggtgcagccccgctga

SEQ ID NO: 42741 - DNA, 18 bp, Artificial sequence
  synthetic polynucleotide sequence
ggtgggcacgagcaagca

SEQ ID NO: 42742 - DNA, 18 bp, Artificial sequence
  synthetic polynucleotide sequence
ggattccacgaggcgaga

SEQ ID NO: 42743 - DNA, 22 bp, Artificial sequence
  synthetic polynucleotide sequence
aagatcgacagacctgaagcca

SEQ ID NO: 42744 - DNA, 20 bp, Artificial sequence
  synthetic polynucleotide sequence
gtactgtgccatccagcgga

SEQ ID NO: 42745 - DNA, 20 bp, Artificial sequence
  synthetic polynucleotide sequence
caggaccagggttctggaca

SEQ ID NO: 42746 - DNA, 18 bp, Artificial sequence
  synthetic polynucleotide sequence
gcctccatgaaggggtga

SEQ ID NO: 42747 - DNA, 18 bp, Artificial sequence
  synthetic polynucleotide sequence
gggcgcaacatgaggaga

SEQ ID NO: 42748 - DNA, 19 bp, Artificial sequence
  synthetic polynucleotide sequence
gtcgtactcgaggaccgga

SEQ ID NO: 42749 - DNA, 21 bp, Artificial sequence
  synthetic polynucleotide sequence
acccagtggggacactccaga

SEQ ID NO: 42750 - DNA, 21 bp, Artificial sequence
  synthetic polynucleotide sequence
cactgaagccatgcagctgca

SEQ ID NO: 42751 - DNA, 22 bp, Artificial sequence
  synthetic polynucleotide sequence
tcaaagaggaagaaccccctga

SEQ ID NO: 42752 - DNA, 21 bp, Artificial sequence
  synthetic polynucleotide sequence
atcccaaacctagctgcccga

SEQ ID NO: 42753 - DNA, 19 bp, Artificial sequence
  synthetic polynucleotide sequence
gccacctcagagcagccca

SEQ ID NO: 42754 - DNA, 18 bp, Artificial sequence
  synthetic polynucleotide sequence
ccacgggtgtcacggcca

SEQ ID NO: 42755 - DNA, 21 bp, Artificial sequence
  synthetic polynucleotide sequence
gctcctggagagtaaccagca

SEQ ID NO: 42756 - DNA, 20 bp, Artificial sequence
  synthetic polynucleotide sequence
gttggggccgatgtactgga

SEQ ID NO: 42757 - DNA, 22 bp, Artificial sequence
  synthetic polynucleotide sequence
aataccgaggcttcacacagga

SEQ ID NO: 42758 - DNA, 20 bp, Artificial sequence
  synthetic polynucleotide sequence
gccatggaagcggtgcgaca

SEQ ID NO: 42759 - DNA, 19 bp, Artificial sequence
  synthetic polynucleotide sequence
ggagcgagggggaagggaa

SEQ ID NO: 42760 - DNA, 18 bp, Artificial sequence
  synthetic polynucleotide sequence
ggggcggcaactgcagga

SEQ ID NO: 42761 - DNA, 20 bp, Artificial sequence
  synthetic polynucleotide sequence
ctggcagcccaccaagcaca

SEQ ID NO: 42762 - DNA, 20 bp, Artificial sequence
  synthetic polynucleotide sequence
ctagatccactccccgggca

SEQ ID NO: 42763 - DNA, 20 bp, Artificial sequence
  synthetic polynucleotide sequence
actggcagtgaggaggctga

SEQ ID NO: 42764 - DNA, 18 bp, Artificial sequence
  synthetic polynucleotide sequence
atcgcgcccgctctccga

SEQ ID NO: 42765 - DNA, 20 bp, Artificial sequence
  synthetic polynucleotide sequence
cacattccagcagcaacaca

SEQ ID NO: 42766 - DNA, 20 bp, Artificial sequence
  synthetic polynucleotide sequence
ctgaaccagggtggctggta

SEQ ID NO: 42767 - DNA, 19 bp, Artificial sequence
  synthetic polynucleotide sequence
gccgccgactgcagtgaca

SEQ ID NO: 42768 - DNA, 22 bp, Artificial sequence
  synthetic polynucleotide sequence
aaaggggtgctctccaaaacca

SEQ ID NO: 42769 - DNA, 21 bp, Artificial sequence
  synthetic polynucleotide sequence
caaggagggagactgtggaga

SEQ ID NO: 42770 - DNA, 20 bp, Artificial sequence
  synthetic polynucleotide sequence
atcccatagcccaccacgca

SEQ ID NO: 42771 - DNA, 21 bp, Artificial sequence
  synthetic polynucleotide sequence
aatctaccagtgggtacgcga

SEQ ID NO: 42772 - DNA, 18 bp, Artificial sequence
  synthetic polynucleotide sequence
ggcaggacccatggccga

SEQ ID NO: 42773 - DNA, 18 bp, Artificial sequence
  synthetic polynucleotide sequence
cgctggaaggagaaccca

SEQ ID NO: 42774 - DNA, 19 bp, Artificial sequence
  synthetic polynucleotide sequence
gggaaggttcaggaagcga

SEQ ID NO: 42775 - DNA, 20 bp, Artificial sequence
  synthetic polynucleotide sequence
aggctggagactgcccagaa

SEQ ID NO: 42776 - DNA, 20 bp, Artificial sequence
  synthetic polynucleotide sequence
ggggattgtccccaaagcca

SEQ ID NO: 42777 - DNA, 20 bp, Artificial sequence
  synthetic polynucleotide sequence
taccagccacagcaaactga

SEQ ID NO: 42778 - DNA, 18 bp, Artificial sequence
  synthetic polynucleotide sequence
ccaggtcagccagctgga

SEQ ID NO: 42779 - DNA, 20 bp, Artificial sequence
  synthetic polynucleotide sequence
gggcggcatcactgtccaca

SEQ ID NO: 42780 - DNA, 21 bp, Artificial sequence
  synthetic polynucleotide sequence
gcttgaaggactctctgggca

SEQ ID NO: 42781 - DNA, 21 bp, Artificial sequence
  synthetic polynucleotide sequence
cagggcagcacatcagagaca

SEQ ID NO: 42782 - DNA, 19 bp, Artificial sequence
  synthetic polynucleotide sequence
tccacaaacagtcccagca

SEQ ID NO: 42783 - DNA, 22 bp, Artificial sequence
  synthetic polynucleotide sequence
acaaagagaccatacaccgtga

SEQ ID NO: 42784 - DNA, 20 bp, Artificial sequence
  synthetic polynucleotide sequence
aaggatgaaccgaagcctca

SEQ ID NO: 42785 - DNA, 19 bp, Artificial sequence
  synthetic polynucleotide sequence
tcctggactgcgtacacca

SEQ ID NO: 42786 - DNA, 20 bp, Artificial sequence
  synthetic polynucleotide sequence
ccacacagacctgcacggca

SEQ ID NO: 42787 - DNA, 21 bp, Artificial sequence
  synthetic polynucleotide sequence
cagaggagaacagtgtggcca

SEQ ID NO: 42788 - DNA, 21 bp, Artificial sequence
  synthetic polynucleotide sequence
cctttcccacagctgctgcca

SEQ ID NO: 42789 - DNA, 19 bp, Artificial sequence
  synthetic polynucleotide sequence
gggcggggtcctgggtaga

SEQ ID NO: 42790 - DNA, 20 bp, Artificial sequence
  synthetic polynucleotide sequence
acatggaggaagggcggcaa

SEQ ID NO: 42791 - DNA, 20 bp, Artificial sequence
  synthetic polynucleotide sequence
gcactgaagcagctcccgaa

SEQ ID NO: 42792 - DNA, 20 bp, Artificial sequence
  synthetic polynucleotide sequence
aatgccgtaggccgtcacga

SEQ ID NO: 42793 - DNA, 21 bp, Artificial sequence
  synthetic polynucleotide sequence
ttgcaagggaacagagaggga

SEQ ID NO: 42794 - DNA, 18 bp, Artificial sequence
  synthetic polynucleotide sequence
gtccccgtcctcccacca

SEQ ID NO: 42795 - DNA, 21 bp, Artificial sequence
  synthetic polynucleotide sequence
gaggggaatgtcatgggagga

SEQ ID NO: 42796 - DNA, 22 bp, Artificial sequence
  synthetic polynucleotide sequence
atcagggcatcatctgagacga

SEQ ID NO: 42797 - DNA, 18 bp, Artificial sequence
  synthetic polynucleotide sequence
ggggctccgtggggcaga

SEQ ID NO: 42798 - DNA, 20 bp, Artificial sequence
  synthetic polynucleotide sequence
tgggagaggtgagcgggcaa

SEQ ID NO: 42799 - DNA, 21 bp, Artificial sequence
  synthetic polynucleotide sequence
agccagcaaggaggccaacca

SEQ ID NO: 42800 - DNA, 21 bp, Artificial sequence
  synthetic polynucleotide sequence
gatgaaaggcgtgttgaccga

SEQ ID NO: 42801 - DNA, 20 bp, Artificial sequence
  synthetic polynucleotide sequence
caggactgcgggcacaccta

SEQ ID NO: 42802 - DNA, 21 bp, Artificial sequence
  synthetic polynucleotide sequence
catccatctagtcaagggcca

SEQ ID NO: 42803 - DNA, 22 bp, Artificial sequence
  synthetic polynucleotide sequence
aagaatcaagtccgtcgagaga

SEQ ID NO: 42804 - DNA, 20 bp, Artificial sequence
  synthetic polynucleotide sequence
tctccagcaagaacagtgca

SEQ ID NO: 42805 - DNA, 20 bp, Artificial sequence
  synthetic polynucleotide sequence
gagaaggggtctcgtcggaa

SEQ ID NO: 42806 - DNA, 19 bp, Artificial sequence
  synthetic polynucleotide sequence
tccgggaagaacaggagga

SEQ ID NO: 42807 - DNA, 22 bp, Artificial sequence
  synthetic polynucleotide sequence
ggaagaagcccgaggaaaggaa

SEQ ID NO: 42808 - DNA, 20 bp, Artificial sequence
  synthetic polynucleotide sequence
taggactgcagcctcagaca

SEQ ID NO: 42809 - DNA, 20 bp, Artificial sequence
  synthetic polynucleotide sequence
ccctgggggcatagaggaga

SEQ ID NO: 42810 - DNA, 22 bp, Artificial sequence
  synthetic polynucleotide sequence
aaatcctcggttccaaggacca

SEQ ID NO: 42811 - DNA, 23 bp, Artificial sequence
  synthetic polynucleotide sequence
caatatggacagaagcagtggca

SEQ ID NO: 42812 - DNA, 21 bp, Artificial sequence
  synthetic polynucleotide sequence
cagcgcttcaagccataccga

SEQ ID NO: 42813 - DNA, 22 bp, Artificial sequence
  synthetic polynucleotide sequence
aacatgcattggcccaagctga

SEQ ID NO: 42814 - DNA, 19 bp, Artificial sequence
  synthetic polynucleotide sequence
tgctaggaagaggtggcca

SEQ ID NO: 42815 - DNA, 19 bp, Artificial sequence
  synthetic polynucleotide sequence
cctgccgactaccagcgga

SEQ ID NO: 42816 - DNA, 22 bp, Artificial sequence
  synthetic polynucleotide sequence
ccaacaaaggaaggcacaggga

SEQ ID NO: 42817 - DNA, 18 bp, Artificial sequence
  synthetic polynucleotide sequence
ccgaagggcaacacagca

SEQ ID NO: 42818 - DNA, 18 bp, Artificial sequence
  synthetic polynucleotide sequence
gcaccgcagggttggaga

SEQ ID NO: 42819 - DNA, 21 bp, Artificial sequence
  synthetic polynucleotide sequence
aaggtgcacaggatctaccga

SEQ ID NO: 42820 - DNA, 20 bp, Artificial sequence
  synthetic polynucleotide sequence
cacagtggggtactcgggca

SEQ ID NO: 42821 - DNA, 21 bp, Artificial sequence
  synthetic polynucleotide sequence
ctaccaagacttcgaggcaga

SEQ ID NO: 42822 - DNA, 21 bp, Artificial sequence
  synthetic polynucleotide sequence
agacgtaggagcagggtgtga

SEQ ID NO: 42823 - DNA, 18 bp, Artificial sequence
  synthetic polynucleotide sequence
gccatccctacgccccga

SEQ ID NO: 42824 - DNA, 19 bp, Artificial sequence
  synthetic polynucleotide sequence
gacccgccgcatcctggta

SEQ ID NO: 42825 - DNA, 20 bp, Artificial sequence
  synthetic polynucleotide sequence
ccactcaggggccatcacga

SEQ ID NO: 42826 - DNA, 20 bp, Artificial sequence
  synthetic polynucleotide sequence
tgacatccccacggtgagca

SEQ ID NO: 42827 - DNA, 21 bp, Artificial sequence
  synthetic polynucleotide sequence
gcactgccagtcccaaggaga

SEQ ID NO: 42828 - DNA, 21 bp, Artificial sequence
  synthetic polynucleotide sequence
tgaagtagcccacacagacga

SEQ ID NO: 42829 - DNA, 22 bp, Artificial sequence
  synthetic polynucleotide sequence
taccatacccactacgcccaga

SEQ ID NO: 42830 - DNA, 21 bp, Artificial sequence
  synthetic polynucleotide sequence
aggtagtagagctcctcggca

SEQ ID NO: 42831 - DNA, 20 bp, Artificial sequence
  synthetic polynucleotide sequence
aatggctcaggtccgcacga

SEQ ID NO: 42832 - DNA, 18 bp, Artificial sequence
  synthetic polynucleotide sequence
cctcctccacaccgcgga

SEQ ID NO: 42833 - DNA, 18 bp, Artificial sequence
  synthetic polynucleotide sequence
cggtcacgggaatcccca

SEQ ID NO: 42834 - DNA, 19 bp, Artificial sequence
  synthetic polynucleotide sequence
tggcagatgacagggacca

SEQ ID NO: 42835 - DNA, 20 bp, Artificial sequence
  synthetic polynucleotide sequence
gtgactcacacagttgacga

SEQ ID NO: 42836 - DNA, 22 bp, Artificial sequence
  synthetic polynucleotide sequence
tagggagagatatcgggcctga

SEQ ID NO: 42837 - DNA, 18 bp, Artificial sequence
  synthetic polynucleotide sequence
ctgagcacgtggaagcca

SEQ ID NO: 42838 - DNA, 19 bp, Artificial sequence
  synthetic polynucleotide sequence
gcggaagacagagcggaca

SEQ ID NO: 42839 - DNA, 19 bp, Artificial sequence
  synthetic polynucleotide sequence
gctcccgggagaagctgca

SEQ ID NO: 42840 - DNA, 19 bp, Artificial sequence
  synthetic polynucleotide sequence
ttcatcaagcgaggctgga

SEQ ID NO: 42841 - DNA, 22 bp, Artificial sequence
  synthetic polynucleotide sequence
agtactcagagacggatgctga

SEQ ID NO: 42842 - DNA, 19 bp, Artificial sequence
  synthetic polynucleotide sequence
tctctggatccggaccaca

SEQ ID NO: 42843 - DNA, 18 bp, Artificial sequence
  synthetic polynucleotide sequence
cacacggaagcagcagga

SEQ ID NO: 42844 - DNA, 20 bp, Artificial sequence
  synthetic polynucleotide sequence
gtcggttgagcaccacccta

SEQ ID NO: 42845 - DNA, 22 bp, Artificial sequence
  synthetic polynucleotide sequence
aacaggccagatatcacagaca

SEQ ID NO: 42846 - DNA, 20 bp, Artificial sequence
  synthetic polynucleotide sequence
taagggcctctggaagctga

SEQ ID NO: 42847 - DNA, 21 bp, Artificial sequence
  synthetic polynucleotide sequence
agagcattggggagtcagcaa

SEQ ID NO: 42848 - DNA, 21 bp, Artificial sequence
  synthetic polynucleotide sequence
cgtgagctctccagtgacaga

SEQ ID NO: 42849 - DNA, 21 bp, Artificial sequence
  synthetic polynucleotide sequence
tgggactgaggccctaccaga

SEQ ID NO: 42850 - DNA, 20 bp, Artificial sequence
  synthetic polynucleotide sequence
caacatgtggaatccaggca

SEQ ID NO: 42851 - DNA, 24 bp, Artificial sequence
  synthetic polynucleotide sequence
ctacagtgaagacaactttgagga

SEQ ID NO: 42852 - DNA, 24 bp, Artificial sequence
  synthetic polynucleotide sequence
gtaggaaacaccttcttctggaga

SEQ ID NO: 42853 - DNA, 20 bp, Artificial sequence
  synthetic polynucleotide sequence
aacacccctgacactgcaga

SEQ ID NO: 42854 - DNA, 18 bp, Artificial sequence
  synthetic polynucleotide sequence
cacttgcccaagcctgga

SEQ ID NO: 42855 - DNA, 20 bp, Artificial sequence
  synthetic polynucleotide sequence
tcaccctcaccctggtcaca

SEQ ID NO: 42856 - DNA, 21 bp, Artificial sequence
  synthetic polynucleotide sequence
catggcagcctcataactgga

SEQ ID NO: 42857 - DNA, 23 bp, Artificial sequence
  synthetic polynucleotide sequence
gctcacagcagaataagccacca

SEQ ID NO: 42858 - DNA, 20 bp, Artificial sequence
  synthetic polynucleotide sequence
ccggtagcagcaaagggcca

SEQ ID NO: 42859 - DNA, 20 bp, Artificial sequence
  synthetic polynucleotide sequence
tgctaccaggccaatgccga

SEQ ID NO: 42860 - DNA, 21 bp, Artificial sequence
  synthetic polynucleotide sequence
ttggctgcaacagcttccgga

SEQ ID NO: 42861 - DNA, 21 bp, Artificial sequence
  synthetic polynucleotide sequence
tcacagccgaataagccacca

SEQ ID NO: 42862 - DNA, 20 bp, Artificial sequence
  synthetic polynucleotide sequence
cagctgggcagacaagagca

SEQ ID NO: 42863 - DNA, 21 bp, Artificial sequence
  synthetic polynucleotide sequence
gctgcaaactcctggaggaca

SEQ ID NO: 42864 - DNA, 20 bp, Artificial sequence
  synthetic polynucleotide sequence
ccatagcctctgcagcggca

SEQ ID NO: 42865 - DNA, 18 bp, Artificial sequence
  synthetic polynucleotide sequence
cccgcgactgaacaccga

SEQ ID NO: 42866 - DNA, 19 bp, Artificial sequence
  synthetic polynucleotide sequence
ccaataaggggcagccaga

SEQ ID NO: 42867 - DNA, 18 bp, Artificial sequence
  synthetic polynucleotide sequence
gggggatgcctgcctgga

SEQ ID NO: 42868 - DNA, 20 bp, Artificial sequence
  synthetic polynucleotide sequence
ctgtcacggagacattggca

SEQ ID NO: 42869 - DNA, 21 bp, Artificial sequence
  synthetic polynucleotide sequence
ccttgtggaggggctaaggaa

SEQ ID NO: 42870 - DNA, 20 bp, Artificial sequence
  synthetic polynucleotide sequence
gtgtgatagcgcctccagca

SEQ ID NO: 42871 - DNA, 18 bp, Artificial sequence
  synthetic polynucleotide sequence
actggacagcagcgtgga

SEQ ID NO: 42872 - DNA, 18 bp, Artificial sequence
  synthetic polynucleotide sequence
ctcggaggaagttgcgga

SEQ ID NO: 42873 - DNA, 19 bp, Artificial sequence
  synthetic polynucleotide sequence
cccaccgacctgagagaca

SEQ ID NO: 42874 - DNA, 18 bp, Artificial sequence
  synthetic polynucleotide sequence
atgtccaccagcatggca

SEQ ID NO: 42875 - DNA, 22 bp, Artificial sequence
  synthetic polynucleotide sequence
ccaagcccctgaaacacaagca

SEQ ID NO: 42876 - DNA, 20 bp, Artificial sequence
  synthetic polynucleotide sequence
agtatgtagcgggcggctga

SEQ ID NO: 42877 - DNA, 21 bp, Artificial sequence
  synthetic polynucleotide sequence
gatccgagtctcccaaggcaa

SEQ ID NO: 42878 - DNA, 21 bp, Artificial sequence
  synthetic polynucleotide sequence
tgaaagaggcgtgtaggggga

SEQ ID NO: 42879 - DNA, 20 bp, Artificial sequence
  synthetic polynucleotide sequence
cctgggcacagaggtaggaa

SEQ ID NO: 42880 - DNA, 21 bp, Artificial sequence
  synthetic polynucleotide sequence
tgccagagttccacagcctga

SEQ ID NO: 42881 - DNA, 20 bp, Artificial sequence
  synthetic polynucleotide sequence
ctggcaatcagggctgcgca

SEQ ID NO: 42882 - DNA, 21 bp, Artificial sequence
  synthetic polynucleotide sequence
gaatgacctggagctgcacca

SEQ ID NO: 42883 - DNA, 18 bp, Artificial sequence
  synthetic polynucleotide sequence
cagcacctcccaaaggca

SEQ ID NO: 42884 - DNA, 18 bp, Artificial sequence
  synthetic polynucleotide sequence
tccgaccctggggaacga

SEQ ID NO: 42885 - DNA, 21 bp, Artificial sequence
  synthetic polynucleotide sequence
gagtccagtgcatccctcaga

SEQ ID NO: 42886 - DNA, 21 bp, Artificial sequence
  synthetic polynucleotide sequence
taggaccactgcttccaccga

SEQ ID NO: 42887 - DNA, 18 bp, Artificial sequence
  synthetic polynucleotide sequence
ccccaagagcagtcccca

SEQ ID NO: 42888 - DNA, 18 bp, Artificial sequence
  synthetic polynucleotide sequence
gcctgaagaggtcggcga

SEQ ID NO: 42889 - DNA, 18 bp, Artificial sequence
  synthetic polynucleotide sequence
caggatgccaggcggcca

SEQ ID NO: 42890 - DNA, 18 bp, Artificial sequence
  synthetic polynucleotide sequence
gctccacgtgaggcccca

SEQ ID NO: 42891 - DNA, 18 bp, Artificial sequence
  synthetic polynucleotide sequence
caggagcagctgcagcaa

SEQ ID NO: 42892 - DNA, 19 bp, Artificial sequence
  synthetic polynucleotide sequence
ctcagcagggacctgagga

SEQ ID NO: 42893 - DNA, 22 bp, Artificial sequence
  synthetic polynucleotide sequence
gagcatcacaagatggaggcca

SEQ ID NO: 42894 - DNA, 20 bp, Artificial sequence
  synthetic polynucleotide sequence
agtggtagggatcgagcgca

SEQ ID NO: 42895 - DNA, 19 bp, Artificial sequence
  synthetic polynucleotide sequence
cgacacggagagagacgca

SEQ ID NO: 42896 - DNA, 20 bp, Artificial sequence
  synthetic polynucleotide sequence
gaaggtccaccaaccaagga

SEQ ID NO: 42897 - DNA, 20 bp, Artificial sequence
  synthetic polynucleotide sequence
gtggacaaagccaacagaga

SEQ ID NO: 42898 - DNA, 18 bp, Artificial sequence
  synthetic polynucleotide sequence
gccaggtattccgaggca

SEQ ID NO: 42899 - DNA, 18 bp, Artificial sequence
  synthetic polynucleotide sequence
gagcaaaggggatccgca

SEQ ID NO: 42900 - DNA, 18 bp, Artificial sequence
  synthetic polynucleotide sequence
tccatcccagccagcaga

SEQ ID NO: 42901 - DNA, 20 bp, Artificial sequence
  synthetic polynucleotide sequence
tgccaccctcaacgtcctca

SEQ ID NO: 42902 - DNA, 19 bp, Artificial sequence
  synthetic polynucleotide sequence
tctcagcatcaccgacaca

SEQ ID NO: 42903 - DNA, 18 bp, Artificial sequence
  synthetic polynucleotide sequence
ccatacctcgcccagcaa

SEQ ID NO: 42904 - DNA, 20 bp, Artificial sequence
  synthetic polynucleotide sequence
gagggagacgagcttcagca

SEQ ID NO: 42905 - DNA, 18 bp, Artificial sequence
  synthetic polynucleotide sequence
cgaggaggctggagagga

SEQ ID NO: 42906 - DNA, 21 bp, Artificial sequence
  synthetic polynucleotide sequence
gatgggatggcaaggtagtca

SEQ ID NO: 42907 - DNA, 18 bp, Artificial sequence
  synthetic polynucleotide sequence
tggacctgggcatcacca

SEQ ID NO: 42908 - DNA, 18 bp, Artificial sequence
  synthetic polynucleotide sequence
ggttgcccacagtgagca

SEQ ID NO: 42909 - DNA, 18 bp, Artificial sequence
  synthetic polynucleotide sequence
cggcgagatggctgggca

SEQ ID NO: 42910 - DNA, 20 bp, Artificial sequence
  synthetic polynucleotide sequence
ccggaagtggaggtcctcga

SEQ ID NO: 42911 - DNA, 21 bp, Artificial sequence
  synthetic polynucleotide sequence
cgaataggccgcatcctcaga

SEQ ID NO: 42912 - DNA, 22 bp, Artificial sequence
  synthetic polynucleotide sequence
aacatgacgaggaagagcagca

SEQ ID NO: 42913 - DNA, 23 bp, Artificial sequence
  synthetic polynucleotide sequence
gaacatcaggaaaacctgctgca

SEQ ID NO: 42914 - DNA, 20 bp, Artificial sequence
  synthetic polynucleotide sequence
cagagtgccagtgctgagca

SEQ ID NO: 42915 - DNA, 19 bp, Artificial sequence
  synthetic polynucleotide sequence
gggagaagttcgaccccga

SEQ ID NO: 42916 - DNA, 18 bp, Artificial sequence
  synthetic polynucleotide sequence
acccgcttggtgaaggca

SEQ ID NO: 42917 - DNA, 20 bp, Artificial sequence
  synthetic polynucleotide sequence
acaggccgaggagtcagcaa

SEQ ID NO: 42918 - DNA, 19 bp, Artificial sequence
  synthetic polynucleotide sequence
tacccatcgacctcgtcca

SEQ ID NO: 42919 - DNA, 18 bp, Artificial sequence
  synthetic polynucleotide sequence
agccatgcagcgtgacca

SEQ ID NO: 42920 - DNA, 18 bp, Artificial sequence
  synthetic polynucleotide sequence
acaacaccgaggagccga

SEQ ID NO: 42921 - DNA, 20 bp, Artificial sequence
  synthetic polynucleotide sequence
atgagcgtggcgcagagaga

SEQ ID NO: 42922 - DNA, 19 bp, Artificial sequence
  synthetic polynucleotide sequence
cggaggcctcagaaggcca

SEQ ID NO: 42923 - DNA, 18 bp, Artificial sequence
  synthetic polynucleotide sequence
ggaaccgcctcaagacga

SEQ ID NO: 42924 - DNA, 19 bp, Artificial sequence
  synthetic polynucleotide sequence
ccgtcacacagggtgacca

SEQ ID NO: 42925 - DNA, 20 bp, Artificial sequence
  synthetic polynucleotide sequence
aggaggtggcagagctagga

SEQ ID NO: 42926 - DNA, 20 bp, Artificial sequence
  synthetic polynucleotide sequence
atgctccccctccccaccca

SEQ ID NO: 42927 - DNA, 21 bp, Artificial sequence
  synthetic polynucleotide sequence
agaaggaacggcagcgacaca

SEQ ID NO: 42928 - DNA, 22 bp, Artificial sequence
  synthetic polynucleotide sequence
atcagggcaatgagtgaagcca

SEQ ID NO: 42929 - DNA, 22 bp, Artificial sequence
  synthetic polynucleotide sequence
tacgtccaggacttccacccaa

SEQ ID NO: 42930 - DNA, 22 bp, Artificial sequence
  synthetic polynucleotide sequence
gtaatccgtgaagaggccgtca

SEQ ID NO: 42931 - DNA, 18 bp, Artificial sequence
  synthetic polynucleotide sequence
ggctgggacgggatggga

SEQ ID NO: 42932 - DNA, 18 bp, Artificial sequence
  synthetic polynucleotide sequence
gcttgaggcgccgggaga

SEQ ID NO: 42933 - DNA, 21 bp, Artificial sequence
  synthetic polynucleotide sequence
gtgtgcagaactctgctggca

SEQ ID NO: 42934 - DNA, 19 bp, Artificial sequence
  synthetic polynucleotide sequence
tacaaccacagctcctcca

SEQ ID NO: 42935 - DNA, 21 bp, Artificial sequence
  synthetic polynucleotide sequence
catcagggaagtgggagctca

SEQ ID NO: 42936 - DNA, 19 bp, Artificial sequence
  synthetic polynucleotide sequence
ttgcccaaaaccagctcca

SEQ ID NO: 42937 - DNA, 21 bp, Artificial sequence
  synthetic polynucleotide sequence
agagctgtgggggaaagcaga

SEQ ID NO: 42938 - DNA, 20 bp, Artificial sequence
  synthetic polynucleotide sequence
tgtctcacgtggcgctgaca

SEQ ID NO: 42939 - DNA, 20 bp, Artificial sequence
  synthetic polynucleotide sequence
tctggagcagctggagggaa

SEQ ID NO: 42940 - DNA, 19 bp, Artificial sequence
  synthetic polynucleotide sequence
ggcgggtgagaagtgggca

SEQ ID NO: 42941 - DNA, 18 bp, Artificial sequence
  synthetic polynucleotide sequence
gcaagctgaggagcacca

SEQ ID NO: 42942 - DNA, 18 bp, Artificial sequence
  synthetic polynucleotide sequence
agggtccagtggctcgga

SEQ ID NO: 42943 - DNA, 18 bp, Artificial sequence
  synthetic polynucleotide sequence
gccccaggatcccacgca

SEQ ID NO: 42944 - DNA, 21 bp, Artificial sequence
  synthetic polynucleotide sequence
cctgagtctggaatcggggca

SEQ ID NO: 42945 - DNA, 22 bp, Artificial sequence
  synthetic polynucleotide sequence
ccagcaacagtcgataacagga

SEQ ID NO: 42946 - DNA, 20 bp, Artificial sequence
  synthetic polynucleotide sequence
cccacaaccacgctgggcga

SEQ ID NO: 42947 - DNA, 19 bp, Artificial sequence
  synthetic polynucleotide sequence
ggccacatgcgctcgcaca

SEQ ID NO: 42948 - DNA, 21 bp, Artificial sequence
  synthetic polynucleotide sequence
ctggaagtgcttgaaggccga

SEQ ID NO: 42949 - DNA, 19 bp, Artificial sequence
  synthetic polynucleotide sequence
gggagggagaggggtagca

SEQ ID NO: 42950 - DNA, 18 bp, Artificial sequence
  synthetic polynucleotide sequence
acggaggaggagcgccaa

SEQ ID NO: 42951 - DNA, 18 bp, Artificial sequence
  synthetic polynucleotide sequence
ggcgacactcagacggga

SEQ ID NO: 42952 - DNA, 18 bp, Artificial sequence
  synthetic polynucleotide sequence
gagaccaggtcccgtcca

SEQ ID NO: 42953 - DNA, 21 bp, Artificial sequence
  synthetic polynucleotide sequence
gcactcgcaactacatccaca

SEQ ID NO: 42954 - DNA, 20 bp, Artificial sequence
  synthetic polynucleotide sequence
gggcatcgcagtaggtgaca

SEQ ID NO: 42955 - DNA, 19 bp, Artificial sequence
  synthetic polynucleotide sequence
ggctacatcgagtccccca

SEQ ID NO: 42956 - DNA, 18 bp, Artificial sequence
  synthetic polynucleotide sequence
catcctcgatgggcagga

SEQ ID NO: 42957 - DNA, 20 bp, Artificial sequence
  synthetic polynucleotide sequence
caccctgggtacaagctcca

SEQ ID NO: 42958 - DNA, 20 bp, Artificial sequence
  synthetic polynucleotide sequence
ggaagcacccgtctcctcca

SEQ ID NO: 42959 - DNA, 21 bp, Artificial sequence
  synthetic polynucleotide sequence
agaaatccccaaaggctggca

SEQ ID NO: 42960 - DNA, 23 bp, Artificial sequence
  synthetic polynucleotide sequence
ctccaccacctcaaactgaccaa

SEQ ID NO: 42961 - DNA, 19 bp, Artificial sequence
  synthetic polynucleotide sequence
gccaagctcccaggagcca

SEQ ID NO: 42962 - DNA, 20 bp, Artificial sequence
  synthetic polynucleotide sequence
acgtgcagacagggtagcga

SEQ ID NO: 42963 - DNA, 21 bp, Artificial sequence
  synthetic polynucleotide sequence
ccagcagcctcttaaacccca

SEQ ID NO: 42964 - DNA, 22 bp, Artificial sequence
  synthetic polynucleotide sequence
cataccaatgcccatggaagga

SEQ ID NO: 42965 - DNA, 21 bp, Artificial sequence
  synthetic polynucleotide sequence
cagaccaaatcgagccgccaa

SEQ ID NO: 42966 - DNA, 22 bp, Artificial sequence
  synthetic polynucleotide sequence
gaaaactgcatcactggggaga

SEQ ID NO: 42967 - DNA, 20 bp, Artificial sequence
  synthetic polynucleotide sequence
ctgcagccccaccaaagaga

SEQ ID NO: 42968 - DNA, 20 bp, Artificial sequence
  synthetic polynucleotide sequence
cttcagtcatggccagagga

SEQ ID NO: 42969 - DNA, 20 bp, Artificial sequence
  synthetic polynucleotide sequence
tgctgaggatggagcctcca

SEQ ID NO: 42970 - DNA, 20 bp, Artificial sequence
  synthetic polynucleotide sequence
caggctccacggccactaca

SEQ ID NO: 42971 - DNA, 22 bp, Artificial sequence
  synthetic polynucleotide sequence
atgtaccttgacaacagctcca

SEQ ID NO: 42972 - DNA, 18 bp, Artificial sequence
  synthetic polynucleotide sequence
tcatcagctcccgagcca

SEQ ID NO: 42973 - DNA, 18 bp, Artificial sequence
  synthetic polynucleotide sequence
atgccatcgactcgggca

SEQ ID NO: 42974 - DNA, 22 bp, Artificial sequence
  synthetic polynucleotide sequence
cgatagatgagcagtgtgacca

SEQ ID NO: 42975 - DNA, 18 bp, Artificial sequence
  synthetic polynucleotide sequence
cactgtgcagggcagcaa

SEQ ID NO: 42976 - DNA, 20 bp, Artificial sequence
  synthetic polynucleotide sequence
gtaggatcaggaagacggca

SEQ ID NO: 42977 - DNA, 18 bp, Artificial sequence
  synthetic polynucleotide sequence
accctgccaatccagcaa

SEQ ID NO: 42978 - DNA, 22 bp, Artificial sequence
  synthetic polynucleotide sequence
tcattaccagttacaggagcca

SEQ ID NO: 42979 - DNA, 21 bp, Artificial sequence
  synthetic polynucleotide sequence
agcggactgtcaccatgcaca

SEQ ID NO: 42980 - DNA, 19 bp, Artificial sequence
  synthetic polynucleotide sequence
tctgcccgtccacctcaca

SEQ ID NO: 42981 - DNA, 21 bp, Artificial sequence
  synthetic polynucleotide sequence
tctccaacttccagcgagaga

SEQ ID NO: 42982 - DNA, 21 bp, Artificial sequence
  synthetic polynucleotide sequence
gtgtctcagctccggaaacca

SEQ ID NO: 42983 - DNA, 19 bp, Artificial sequence
  synthetic polynucleotide sequence
ggaaggagctggagaggca

SEQ ID NO: 42984 - DNA, 18 bp, Artificial sequence
  synthetic polynucleotide sequence
gggcctccagttgggcaa

SEQ ID NO: 42985 - DNA, 21 bp, Artificial sequence
  synthetic polynucleotide sequence
aacccatagaagaggagccca

SEQ ID NO: 42986 - DNA, 21 bp, Artificial sequence
  synthetic polynucleotide sequence
tgagcttctccaaacccagca

SEQ ID NO: 42987 - DNA, 21 bp, Artificial sequence
  synthetic polynucleotide sequence
ccacagtgtgtgagaggggaa

SEQ ID NO: 42988 - DNA, 20 bp, Artificial sequence
  synthetic polynucleotide sequence
ctctcacccagtagggtcca

SEQ ID NO: 42989 - DNA, 18 bp, Artificial sequence
  synthetic polynucleotide sequence
acagcactgggagcgtga

SEQ ID NO: 42990 - DNA, 18 bp, Artificial sequence
  synthetic polynucleotide sequence
cctcatgctgcccacgga

SEQ ID NO: 42991 - DNA, 18 bp, Artificial sequence
  synthetic polynucleotide sequence
cgccatcaggctcaacga

SEQ ID NO: 42992 - DNA, 18 bp, Artificial sequence
  synthetic polynucleotide sequence
cctcctccgtcagcagca

SEQ ID NO: 42993 - DNA, 21 bp, Artificial sequence
  synthetic polynucleotide sequence
ggttctgagcctgtaccgcga

SEQ ID NO: 42994 - DNA, 20 bp, Artificial sequence
  synthetic polynucleotide sequence
gcggcggtacaggtactcga

SEQ ID NO: 42995 - DNA, 20 bp, Artificial sequence
  synthetic polynucleotide sequence
ctctgtcaaggcacagccta

SEQ ID NO: 42996 - DNA, 18 bp, Artificial sequence
  synthetic polynucleotide sequence
ctcctgccatggaggcaa

SEQ ID NO: 42997 - DNA, 21 bp, Artificial sequence
  synthetic polynucleotide sequence
cgttggttctgacgaggcaca

SEQ ID NO: 42998 - DNA, 20 bp, Artificial sequence
  synthetic polynucleotide sequence
cttctgggaggaaggtgcca

SEQ ID NO: 42999 - DNA, 18 bp, Artificial sequence
  synthetic polynucleotide sequence
cggcgtggagagcggcaa

SEQ ID NO: 43000 - DNA, 18 bp, Artificial sequence
  synthetic polynucleotide sequence
tctgggcccctgggtcca

SEQ ID NO: 43001 - DNA, 20 bp, Artificial sequence
  synthetic polynucleotide sequence
aaactggacgggctctacga

SEQ ID NO: 43002 - DNA, 18 bp, Artificial sequence
  synthetic polynucleotide sequence
tccagcgataggcctgca

SEQ ID NO: 43003 - DNA, 21 bp, Artificial sequence
  synthetic polynucleotide sequence
cacggccaaagaagagatgga

SEQ ID NO: 43004 - DNA, 18 bp, Artificial sequence
  synthetic polynucleotide sequence
aacagggccgacatgcca

SEQ ID NO: 43005 - DNA, 18 bp, Artificial sequence
  synthetic polynucleotide sequence
cttgtcaccgagccacca

SEQ ID NO: 43006 - DNA, 18 bp, Artificial sequence
  synthetic polynucleotide sequence
gagtgagggctgcagcca

SEQ ID NO: 43007 - DNA, 21 bp, Artificial sequence
  synthetic polynucleotide sequence
tcagctcaagtggaagcccca

SEQ ID NO: 43008 - DNA, 20 bp, Artificial sequence
  synthetic polynucleotide sequence
attctgcccgtgcaggacga

SEQ ID NO: 43009 - DNA, 21 bp, Artificial sequence
  synthetic polynucleotide sequence
ggtacagctctgccatcgcca

SEQ ID NO: 43010 - DNA, 19 bp, Artificial sequence
  synthetic polynucleotide sequence
ctcacgcccggcttcagga

SEQ ID NO: 43011 - DNA, 18 bp, Artificial sequence
  synthetic polynucleotide sequence
ccgagagggagaaagcca

SEQ ID NO: 43012 - DNA, 18 bp, Artificial sequence
  synthetic polynucleotide sequence
ccaccagagcgctggcga

SEQ ID NO: 43013 - DNA, 19 bp, Artificial sequence
  synthetic polynucleotide sequence
tactcccaaagccacggaa

SEQ ID NO: 43014 - DNA, 19 bp, Artificial sequence
  synthetic polynucleotide sequence
gctccagcttcccgagcca

SEQ ID NO: 43015 - DNA, 21 bp, Artificial sequence
  synthetic polynucleotide sequence
tgacccatgcccttgaagcaa

SEQ ID NO: 43016 - DNA, 19 bp, Artificial sequence
  synthetic polynucleotide sequence
gatggcacgctgtcgccca

SEQ ID NO: 43017 - DNA, 21 bp, Artificial sequence
  synthetic polynucleotide sequence
cctgagagctgacaagggcca

SEQ ID NO: 43018 - DNA, 18 bp, Artificial sequence
  synthetic polynucleotide sequence
gcaggcgggtagacggga

SEQ ID NO: 43019 - DNA, 22 bp, Artificial sequence
  synthetic polynucleotide sequence
ttggggaaaaaccgagactcaa

SEQ ID NO: 43020 - DNA, 21 bp, Artificial sequence
  synthetic polynucleotide sequence
tcatcctcagacaggaaccca

SEQ ID NO: 43021 - DNA, 20 bp, Artificial sequence
  synthetic polynucleotide sequence
ggggcattggctgcaaagga

SEQ ID NO: 43022 - DNA, 20 bp, Artificial sequence
  synthetic polynucleotide sequence
ccagagggtgggaagaggca

SEQ ID NO: 43023 - DNA, 20 bp, Artificial sequence
  synthetic polynucleotide sequence
caaggccctgggcgtgaaga

SEQ ID NO: 43024 - DNA, 21 bp, Artificial sequence
  synthetic polynucleotide sequence
aacttctcaatggcggccaca

SEQ ID NO: 43025 - DNA, 22 bp, Artificial sequence
  synthetic polynucleotide sequence
gagatggccaagaagggatgca

SEQ ID NO: 43026 - DNA, 20 bp, Artificial sequence
  synthetic polynucleotide sequence
ggagcacgatggtggcagga

SEQ ID NO: 43027 - DNA, 21 bp, Artificial sequence
  synthetic polynucleotide sequence
tcttccagacaccctccagca

SEQ ID NO: 43028 - DNA, 18 bp, Artificial sequence
  synthetic polynucleotide sequence
tcccagccctgccgtgga

SEQ ID NO: 43029 - DNA, 18 bp, Artificial sequence
  synthetic polynucleotide sequence
gcggatgaacaagcggca

SEQ ID NO: 43030 - DNA, 18 bp, Artificial sequence
  synthetic polynucleotide sequence
tgctgccactgagcacca

SEQ ID NO: 43031 - DNA, 21 bp, Artificial sequence
  synthetic polynucleotide sequence
gaagaagatgaacaagcgcca

SEQ ID NO: 43032 - DNA, 18 bp, Artificial sequence
  synthetic polynucleotide sequence
cactcagcaccaccacga

SEQ ID NO: 43033 - DNA, 21 bp, Artificial sequence
  synthetic polynucleotide sequence
gccagtggaaggaggagcaga

SEQ ID NO: 43034 - DNA, 22 bp, Artificial sequence
  synthetic polynucleotide sequence
ttgaggcatcatcacaggtcca

SEQ ID NO: 43035 - DNA, 20 bp, Artificial sequence
  synthetic polynucleotide sequence
gactgcagaggagctggaga

SEQ ID NO: 43036 - DNA, 19 bp, Artificial sequence
  synthetic polynucleotide sequence
gactgacgaggcatccaca

SEQ ID NO: 43037 - DNA, 21 bp, Artificial sequence
  synthetic polynucleotide sequence
gaccaagatgggagagaggca

SEQ ID NO: 43038 - DNA, 19 bp, Artificial sequence
  synthetic polynucleotide sequence
ccgcaggacatagatgcca

SEQ ID NO: 43039 - DNA, 20 bp, Artificial sequence
  synthetic polynucleotide sequence
gtacgtgcgggaccaggtga

SEQ ID NO: 43040 - DNA, 20 bp, Artificial sequence
  synthetic polynucleotide sequence
acctgagaacgcagcctgga

SEQ ID NO: 43041 - DNA, 21 bp, Artificial sequence
  synthetic polynucleotide sequence
caaccccaagtgcctgaccaa

SEQ ID NO: 43042 - DNA, 22 bp, Artificial sequence
  synthetic polynucleotide sequence
ttcaggaaaaccccaaagccga

SEQ ID NO: 43043 - DNA, 21 bp, Artificial sequence
  synthetic polynucleotide sequence
atgtcctgacggctctgcaca

SEQ ID NO: 43044 - DNA, 21 bp, Artificial sequence
  synthetic polynucleotide sequence
gctgctatgagactggccgga

SEQ ID NO: 43045 - DNA, 21 bp, Artificial sequence
  synthetic polynucleotide sequence
caaccccaagtgcctgaccaa

SEQ ID NO: 43046 - DNA, 22 bp, Artificial sequence
  synthetic polynucleotide sequence
aaccccaaagccaatgtcccca

SEQ ID NO: 43047 - DNA, 20 bp, Artificial sequence
  synthetic polynucleotide sequence
cttgagccagggagagagca

SEQ ID NO: 43048 - DNA, 18 bp, Artificial sequence
  synthetic polynucleotide sequence
ccgaagttgcgctagcca

SEQ ID NO: 43049 - DNA, 20 bp, Artificial sequence
  synthetic polynucleotide sequence
gtgtcagagatggactgcca

SEQ ID NO: 43050 - DNA, 22 bp, Artificial sequence
  synthetic polynucleotide sequence
tcatgtagctcactcccagaga

SEQ ID NO: 43051 - DNA, 22 bp, Artificial sequence
  synthetic polynucleotide sequence
gaatgaacagtcccctaccaga

SEQ ID NO: 43052 - DNA, 18 bp, Artificial sequence
  synthetic polynucleotide sequence
gtcgggacacagtgggca

SEQ ID NO: 43053 - DNA, 19 bp, Artificial sequence
  synthetic polynucleotide sequence
ccagtgacagccctgggta

SEQ ID NO: 43054 - DNA, 19 bp, Artificial sequence
  synthetic polynucleotide sequence
ggtccaaccagcagaacca

SEQ ID NO: 43055 - DNA, 20 bp, Artificial sequence
  synthetic polynucleotide sequence
atgcgtcaagatctgaccca

SEQ ID NO: 43056 - DNA, 21 bp, Artificial sequence
  synthetic polynucleotide sequence
tcatccactggggcttgcaga

SEQ ID NO: 43057 - DNA, 20 bp, Artificial sequence
  synthetic polynucleotide sequence
ctccagcacccagagacgca

SEQ ID NO: 43058 - DNA, 21 bp, Artificial sequence
  synthetic polynucleotide sequence
cgtgccatcaacactgccgca

SEQ ID NO: 43059 - DNA, 20 bp, Artificial sequence
  synthetic polynucleotide sequence
aggagccagccgaagtgaga

SEQ ID NO: 43060 - DNA, 21 bp, Artificial sequence
  synthetic polynucleotide sequence
actgaggagggctggaactga

SEQ ID NO: 43061 - DNA, 20 bp, Artificial sequence
  synthetic polynucleotide sequence
gtcctgctccccgaatgcca

SEQ ID NO: 43062 - DNA, 20 bp, Artificial sequence
  synthetic polynucleotide sequence
gttgggatgatgcacgagga

SEQ ID NO: 43063 - DNA, 21 bp, Artificial sequence
  synthetic polynucleotide sequence
gtacagcccagtaacccggta

SEQ ID NO: 43064 - DNA, 22 bp, Artificial sequence
  synthetic polynucleotide sequence
tcaagttaggtacaggagccca

SEQ ID NO: 43065 - DNA, 20 bp, Artificial sequence
  synthetic polynucleotide sequence
gatgcgggtccggacaagca

SEQ ID NO: 43066 - DNA, 20 bp, Artificial sequence
  synthetic polynucleotide sequence
ggtgcagcagttcagggcca

SEQ ID NO: 43067 - DNA, 18 bp, Artificial sequence
  synthetic polynucleotide sequence
ccagatggcaggcgcaca

SEQ ID NO: 43068 - DNA, 19 bp, Artificial sequence
  synthetic polynucleotide sequence
gtagtgaccaggggaggga

SEQ ID NO: 43069 - DNA, 20 bp, Artificial sequence
  synthetic polynucleotide sequence
ctgtacgcagcacagcacca

SEQ ID NO: 43070 - DNA, 18 bp, Artificial sequence
  synthetic polynucleotide sequence
ggcagctcactggcagca

SEQ ID NO: 43071 - DNA, 21 bp, Artificial sequence
  synthetic polynucleotide sequence
actcagcctgcagcttcagca

SEQ ID NO: 43072 - DNA, 20 bp, Artificial sequence
  synthetic polynucleotide sequence
acagggagcagcgttggaga

SEQ ID NO: 43073 - DNA, 21 bp, Artificial sequence
  synthetic polynucleotide sequence
ctcaaccggtacatccccaca

SEQ ID NO: 43074 - DNA, 20 bp, Artificial sequence
  synthetic polynucleotide sequence
cgagcaggatcccggttcca

SEQ ID NO: 43075 - DNA, 21 bp, Artificial sequence
  synthetic polynucleotide sequence
gacagtacagcagctacccca

SEQ ID NO: 43076 - DNA, 22 bp, Artificial sequence
  synthetic polynucleotide sequence
aacaaaggcctccaactgggta

SEQ ID NO: 43077 - DNA, 20 bp, Artificial sequence
  synthetic polynucleotide sequence
gctgtgggacaaggagtgca

SEQ ID NO: 43078 - DNA, 18 bp, Artificial sequence
  synthetic polynucleotide sequence
gggccaactttgagccca

SEQ ID NO: 43079 - DNA, 19 bp, Artificial sequence
  synthetic polynucleotide sequence
gattgccatggcaacagca

SEQ ID NO: 43080 - DNA, 21 bp, Artificial sequence
  synthetic polynucleotide sequence
caccctcacacttgttcacca

SEQ ID NO: 43081 - DNA, 21 bp, Artificial sequence
  synthetic polynucleotide sequence
acacaagaagcggatccagga

SEQ ID NO: 43082 - DNA, 23 bp, Artificial sequence
  synthetic polynucleotide sequence
aaaataatcaacccggtgaccca

SEQ ID NO: 43083 - DNA, 21 bp, Artificial sequence
  synthetic polynucleotide sequence
aacggatgaagagtcccggaa

SEQ ID NO: 43084 - DNA, 22 bp, Artificial sequence
  synthetic polynucleotide sequence
ccaagagcccacaacaactgga

SEQ ID NO: 43085 - DNA, 18 bp, Artificial sequence
  synthetic polynucleotide sequence
ggagatccccaaggccaa

SEQ ID NO: 43086 - DNA, 21 bp, Artificial sequence
  synthetic polynucleotide sequence
ggaaactggtcatcaccacca

SEQ ID NO: 43087 - DNA, 19 bp, Artificial sequence
  synthetic polynucleotide sequence
tccatttgacacaccccca

SEQ ID NO: 43088 - DNA, 21 bp, Artificial sequence
  synthetic polynucleotide sequence
tgtgaggcccattccaggtca

SEQ ID NO: 43089 - DNA, 19 bp, Artificial sequence
  synthetic polynucleotide sequence
gcagctccaggttcaggga

SEQ ID NO: 43090 - DNA, 18 bp, Artificial sequence
  synthetic polynucleotide sequence
acagcggcacctgtacca

SEQ ID NO: 43091 - DNA, 22 bp, Artificial sequence
  synthetic polynucleotide sequence
ataaactgcgaggacagagcca

SEQ ID NO: 43092 - DNA, 21 bp, Artificial sequence
  synthetic polynucleotide sequence
atcatgggggaatgagcacga

SEQ ID NO: 43093 - DNA, 18 bp, Artificial sequence
  synthetic polynucleotide sequence
agctgaagccagcccaga

SEQ ID NO: 43094 - DNA, 18 bp, Artificial sequence
  synthetic polynucleotide sequence
gttcccaacagcagcgca

SEQ ID NO: 43095 - DNA, 18 bp, Artificial sequence
  synthetic polynucleotide sequence
cgagtccagatgcccaca

SEQ ID NO: 43096 - DNA, 19 bp, Artificial sequence
  synthetic polynucleotide sequence
cccaggaacaatgaggcca

SEQ ID NO: 43097 - DNA, 21 bp, Artificial sequence
  synthetic polynucleotide sequence
aaggtggacacatggaaggga

SEQ ID NO: 43098 - DNA, 19 bp, Artificial sequence
  synthetic polynucleotide sequence
ttgcggatgacatggccca

SEQ ID NO: 43099 - DNA, 18 bp, Artificial sequence
  synthetic polynucleotide sequence
gggacaacgagaagccca

SEQ ID NO: 43100 - DNA, 20 bp, Artificial sequence
  synthetic polynucleotide sequence
tcctcacagctgaaggcaca

SEQ ID NO: 43101 - DNA, 18 bp, Artificial sequence
  synthetic polynucleotide sequence
cagtgcctgggacaagca

SEQ ID NO: 43102 - DNA, 18 bp, Artificial sequence
  synthetic polynucleotide sequence
tagcggagctcatgggca

SEQ ID NO: 43103 - DNA, 21 bp, Artificial sequence
  synthetic polynucleotide sequence
atgctgtcaggaggaagcaca

SEQ ID NO: 43104 - DNA, 22 bp, Artificial sequence
  synthetic polynucleotide sequence
aatacagggtctgaaccacgga

SEQ ID NO: 43105 - DNA, 20 bp, Artificial sequence
  synthetic polynucleotide sequence
ggagggaatggaggaggcga

SEQ ID NO: 43106 - DNA, 19 bp, Artificial sequence
  synthetic polynucleotide sequence
ggaagctctggggcctcca

SEQ ID NO: 43107 - DNA, 21 bp, Artificial sequence
  synthetic polynucleotide sequence
cgaatacgtgagcccggagca

SEQ ID NO: 43108 - DNA, 22 bp, Artificial sequence
  synthetic polynucleotide sequence
acaatccaaacccagtcaggca

SEQ ID NO: 43109 - DNA, 21 bp, Artificial sequence
  synthetic polynucleotide sequence
agtgttggacagccggagtca

SEQ ID NO: 43110 - DNA, 20 bp, Artificial sequence
  synthetic polynucleotide sequence
caccagccattggaggggga

SEQ ID NO: 43111 - DNA, 18 bp, Artificial sequence
  synthetic polynucleotide sequence
gcgcatcccactcagtga

SEQ ID NO: 43112 - DNA, 18 bp, Artificial sequence
  synthetic polynucleotide sequence
gcttcgcgggcgcccaca

SEQ ID NO: 43113 - DNA, 18 bp, Artificial sequence
  synthetic polynucleotide sequence
ccacctgccttcagggga

SEQ ID NO: 43114 - DNA, 18 bp, Artificial sequence
  synthetic polynucleotide sequence
aggcctcagtgaacggca

SEQ ID NO: 43115 - DNA, 19 bp, Artificial sequence
  synthetic polynucleotide sequence
cccagatggatccccggca

SEQ ID NO: 43116 - DNA, 20 bp, Artificial sequence
  synthetic polynucleotide sequence
acgctccagctccctggcga

SEQ ID NO: 43117 - DNA, 19 bp, Artificial sequence
  synthetic polynucleotide sequence
caggccttcatcaccacca

SEQ ID NO: 43118 - DNA, 19 bp, Artificial sequence
  synthetic polynucleotide sequence
gatgtcgacaatggcagca

SEQ ID NO: 43119 - DNA, 21 bp, Artificial sequence
  synthetic polynucleotide sequence
agaagccccaggaggaagaca

SEQ ID NO: 43120 - DNA, 18 bp, Artificial sequence
  synthetic polynucleotide sequence
gacgggcctctgcgtcca

SEQ ID NO: 43121 - DNA, 18 bp, Artificial sequence
  synthetic polynucleotide sequence
gccagcggtacccagaca

SEQ ID NO: 43122 - DNA, 19 bp, Artificial sequence
  synthetic polynucleotide sequence
gccccactgccagatgcta

SEQ ID NO: 43123 - DNA, 21 bp, Artificial sequence
  synthetic polynucleotide sequence
gaaacggggatggcagtcaga

SEQ ID NO: 43124 - DNA, 20 bp, Artificial sequence
  synthetic polynucleotide sequence
agaaagtgggccctggagca

SEQ ID NO: 43125 - DNA, 19 bp, Artificial sequence
  synthetic polynucleotide sequence
gagggaactccccaggcca

SEQ ID NO: 43126 - DNA, 21 bp, Artificial sequence
  synthetic polynucleotide sequence
ggctttgatggcggccaccaa

SEQ ID NO: 43127 - DNA, 20 bp, Artificial sequence
  synthetic polynucleotide sequence
caaggaggactgcgtggaga

SEQ ID NO: 43128 - DNA, 20 bp, Artificial sequence
  synthetic polynucleotide sequence
catgaccagggctggcaaga

SEQ ID NO: 43129 - DNA, 19 bp, Artificial sequence
  synthetic polynucleotide sequence
ctgcacaaacagcatgcca

SEQ ID NO: 43130 - DNA, 19 bp, Artificial sequence
  synthetic polynucleotide sequence
cgtagaagccaccgctcca

SEQ ID NO: 43131 - DNA, 18 bp, Artificial sequence
  synthetic polynucleotide sequence
tcccatggcagccagcaa

SEQ ID NO: 43132 - DNA, 18 bp, Artificial sequence
  synthetic polynucleotide sequence
cctcacccccatcaggca

SEQ ID NO: 43133 - DNA, 18 bp, Artificial sequence
  synthetic polynucleotide sequence
ggcaattccagaggcgaa

SEQ ID NO: 43134 - DNA, 18 bp, Artificial sequence
  synthetic polynucleotide sequence
aacccatgttccaccgca

SEQ ID NO: 43135 - DNA, 21 bp, Artificial sequence
  synthetic polynucleotide sequence
ccccaaactctggtaccggga

SEQ ID NO: 43136 - DNA, 18 bp, Artificial sequence
  synthetic polynucleotide sequence
tccgcgactccaggggca

SEQ ID NO: 43137 - DNA, 18 bp, Artificial sequence
  synthetic polynucleotide sequence
acggacaaatggtcccca

SEQ ID NO: 43138 - DNA, 18 bp, Artificial sequence
  synthetic polynucleotide sequence
agtggctgaatgccccca

SEQ ID NO: 43139 - DNA, 18 bp, Artificial sequence
  synthetic polynucleotide sequence
gcaaagcccaggagcaca

SEQ ID NO: 43140 - DNA, 19 bp, Artificial sequence
  synthetic polynucleotide sequence
ctcaaccgtgactcagcca

SEQ ID NO: 43141 - DNA, 20 bp, Artificial sequence
  synthetic polynucleotide sequence
gggcagccttcaacggacca

SEQ ID NO: 43142 - DNA, 23 bp, Artificial sequence
  synthetic polynucleotide sequence
caaatcggatggcatcatcagga

SEQ ID NO: 43143 - DNA, 18 bp, Artificial sequence
  synthetic polynucleotide sequence
cggaaaccccatcaggca

SEQ ID NO: 43144 - DNA, 20 bp, Artificial sequence
  synthetic polynucleotide sequence
ctgtgcaggagtagaggcca

SEQ ID NO: 43145 - DNA, 18 bp, Artificial sequence
  synthetic polynucleotide sequence
gcgagtcttgcacacgga

SEQ ID NO: 43146 - DNA, 20 bp, Artificial sequence
  synthetic polynucleotide sequence
gcggaccacagtctgggaga

SEQ ID NO: 43147 - DNA, 18 bp, Artificial sequence
  synthetic polynucleotide sequence
tggacagccaggaccaga

SEQ ID NO: 43148 - DNA, 18 bp, Artificial sequence
  synthetic polynucleotide sequence
ctctcaatggggaggcca

SEQ ID NO: 43149 - DNA, 20 bp, Artificial sequence
  synthetic polynucleotide sequence
gtagccagctactgcccaga

SEQ ID NO: 43150 - DNA, 18 bp, Artificial sequence
  synthetic polynucleotide sequence
agcagcacggccagcaca

SEQ ID NO: 43151 - DNA, 19 bp, Artificial sequence
  synthetic polynucleotide sequence
ggccctgtcctgaaccaga

SEQ ID NO: 43152 - DNA, 18 bp, Artificial sequence
  synthetic polynucleotide sequence
gccgagttggagaaggca

SEQ ID NO: 43153 - DNA, 18 bp, Artificial sequence
  synthetic polynucleotide sequence
gcgtgttgaaggccgaga

SEQ ID NO: 43154 - DNA, 19 bp, Artificial sequence
  synthetic polynucleotide sequence
caggcactggtacacccca

SEQ ID NO: 43155 - DNA, 18 bp, Artificial sequence
  synthetic polynucleotide sequence
ggacacctccaccgagca

SEQ ID NO: 43156 - DNA, 18 bp, Artificial sequence
  synthetic polynucleotide sequence
gctctggagacggccaca

SEQ ID NO: 43157 - DNA, 18 bp, Artificial sequence
  synthetic polynucleotide sequence
gcctgagcacagtggcaa

SEQ ID NO: 43158 - DNA, 18 bp, Artificial sequence
  synthetic polynucleotide sequence
aggatgaggcagaggcca

SEQ ID NO: 43159 - DNA, 18 bp, Artificial sequence
  synthetic polynucleotide sequence
gcaacaaccccgaaccca

SEQ ID NO: 43160 - DNA, 19 bp, Artificial sequence
  synthetic polynucleotide sequence
ggggaccagcaagaccaca

SEQ ID NO: 43161 - DNA, 25 bp, Artificial sequence
  synthetic polynucleotide sequence
aggagagaggatcaatgccatagga

SEQ ID NO: 43162 - DNA, 20 bp, Artificial sequence
  synthetic polynucleotide sequence
agggccagcagagactccca

SEQ ID NO: 43163 - DNA, 21 bp, Artificial sequence
  synthetic polynucleotide sequence
agagctttggcaggggagaca

SEQ ID NO: 43164 - DNA, 19 bp, Artificial sequence
  synthetic polynucleotide sequence
gctgggctgcctcgagaca

SEQ ID NO: 43165 - DNA, 21 bp, Artificial sequence
  synthetic polynucleotide sequence
ggcttaggggactgcacagga

SEQ ID NO: 43166 - DNA, 19 bp, Artificial sequence
  synthetic polynucleotide sequence
cacggaggcccacgaacca

SEQ ID NO: 43167 - DNA, 20 bp, Artificial sequence
  synthetic polynucleotide sequence
catcccactcctcctggcca

SEQ ID NO: 43168 - DNA, 19 bp, Artificial sequence
  synthetic polynucleotide sequence
gggccaaactgcggaggga

SEQ ID NO: 43169 - DNA, 18 bp, Artificial sequence
  synthetic polynucleotide sequence
agaagaccctgcaggcca

SEQ ID NO: 43170 - DNA, 18 bp, Artificial sequence
  synthetic polynucleotide sequence
ggggaatgaggtggcgga

SEQ ID NO: 43171 - DNA, 21 bp, Artificial sequence
  synthetic polynucleotide sequence
acaaggagaacgtggagcaga

SEQ ID NO: 43172 - DNA, 19 bp, Artificial sequence
  synthetic polynucleotide sequence
cagtgctgagcctcgcgga

SEQ ID NO: 43173 - DNA, 18 bp, Artificial sequence
  synthetic polynucleotide sequence
aaggcggatcccaaagca

SEQ ID NO: 43174 - DNA, 19 bp, Artificial sequence
  synthetic polynucleotide sequence
ggtgcgcaggacagagtga

SEQ ID NO: 43175 - DNA, 22 bp, Artificial sequence
  synthetic polynucleotide sequence
tatggaggaaagagcacgcaga

SEQ ID NO: 43176 - DNA, 22 bp, Artificial sequence
  synthetic polynucleotide sequence
atcttgggcaacctcatgctca

SEQ ID NO: 43177 - DNA, 22 bp, Artificial sequence
  synthetic polynucleotide sequence
aaccaggaacagctgtcccaca

SEQ ID NO: 43178 - DNA, 21 bp, Artificial sequence
  synthetic polynucleotide sequence
tgatccacagctctgcctgga

SEQ ID NO: 43179 - DNA, 20 bp, Artificial sequence
  synthetic polynucleotide sequence
ggtggccgtcgccatagcaa

SEQ ID NO: 43180 - DNA, 20 bp, Artificial sequence
  synthetic polynucleotide sequence
gacgcctcagacccttgcca

SEQ ID NO: 43181 - DNA, 21 bp, Artificial sequence
  synthetic polynucleotide sequence
gcagcctcatacccctcagca

SEQ ID NO: 43182 - DNA, 20 bp, Artificial sequence
  synthetic polynucleotide sequence
cactcggaagcccctcacca

SEQ ID NO: 43183 - DNA, 20 bp, Artificial sequence
  synthetic polynucleotide sequence
ggagaacggtgagggtggca

SEQ ID NO: 43184 - DNA, 21 bp, Artificial sequence
  synthetic polynucleotide sequence
ttcgtccccttcaccacagca

SEQ ID NO: 43185 - DNA, 22 bp, Artificial sequence
  synthetic polynucleotide sequence
tacagctagacgaaccagacca

SEQ ID NO: 43186 - DNA, 19 bp, Artificial sequence
  synthetic polynucleotide sequence
tgccggaggatcaaggcca

SEQ ID NO: 43187 - DNA, 22 bp, Artificial sequence
  synthetic polynucleotide sequence
ttcagaagctcagaacgctgga

SEQ ID NO: 43188 - DNA, 21 bp, Artificial sequence
  synthetic polynucleotide sequence
aagtaacaggacaccctcgga

SEQ ID NO: 43189 - DNA, 21 bp, Artificial sequence
  synthetic polynucleotide sequence
gaagagaaagcccctgcccaa

SEQ ID NO: 43190 - DNA, 21 bp, Artificial sequence
  synthetic polynucleotide sequence
atgcaggggtgagtagctgca

SEQ ID NO: 43191 - DNA, 18 bp, Artificial sequence
  synthetic polynucleotide sequence
tggcctaccaggaggcga

SEQ ID NO: 43192 - DNA, 18 bp, Artificial sequence
  synthetic polynucleotide sequence
tcttggccagcaccggga

SEQ ID NO: 43193 - DNA, 18 bp, Artificial sequence
  synthetic polynucleotide sequence
gctgtcaatgcccaccaa

SEQ ID NO: 43194 - DNA, 19 bp, Artificial sequence
  synthetic polynucleotide sequence
tcctgataggccagctcca

SEQ ID NO: 43195 - DNA, 20 bp, Artificial sequence
  synthetic polynucleotide sequence
atggccacgaatagaccaga

SEQ ID NO: 43196 - DNA, 19 bp, Artificial sequence
  synthetic polynucleotide sequence
cagaatgcaatcaggccca

SEQ ID NO: 43197 - DNA, 22 bp, Artificial sequence
  synthetic polynucleotide sequence
agatccgggatcagttgaagga

SEQ ID NO: 43198 - DNA, 21 bp, Artificial sequence
  synthetic polynucleotide sequence
gcatccgtcgcaggttcagga

SEQ ID NO: 43199 - DNA, 22 bp, Artificial sequence
  synthetic polynucleotide sequence
acaagatggtcaaagctcgcca

SEQ ID NO: 43200 - DNA, 20 bp, Artificial sequence
  synthetic polynucleotide sequence
tgcagcgcctgtaaagctca

SEQ ID NO: 43201 - DNA, 22 bp, Artificial sequence
  synthetic polynucleotide sequence
actaccatgacacgaggatcca

SEQ ID NO: 43202 - DNA, 21 bp, Artificial sequence
  synthetic polynucleotide sequence
tctggaccccattgctgacca

SEQ ID NO: 43203 - DNA, 20 bp, Artificial sequence
  synthetic polynucleotide sequence
ccagcgccacatcccagaca

SEQ ID NO: 43204 - DNA, 20 bp, Artificial sequence
  synthetic polynucleotide sequence
agtccggcacagccgctgca

SEQ ID NO: 43205 - DNA, 22 bp, Artificial sequence
  synthetic polynucleotide sequence
caaagaagccagctaccaacca

SEQ ID NO: 43206 - DNA, 22 bp, Artificial sequence
  synthetic polynucleotide sequence
gtaaagacacacgtggacgcga

SEQ ID NO: 43207 - DNA, 20 bp, Artificial sequence
  synthetic polynucleotide sequence
gaaggaacgggagcggctga

SEQ ID NO: 43208 - DNA, 21 bp, Artificial sequence
  synthetic polynucleotide sequence
ctccacttccacaacacccca

SEQ ID NO: 43209 - DNA, 21 bp, Artificial sequence
  synthetic polynucleotide sequence
tgtggtgggaagtgacaagga

SEQ ID NO: 43210 - DNA, 21 bp, Artificial sequence
  synthetic polynucleotide sequence
acaaagtctcgaagcagggca

SEQ ID NO: 43211 - DNA, 18 bp, Artificial sequence
  synthetic polynucleotide sequence
gggcacagtgcatccaga

SEQ ID NO: 43212 - DNA, 18 bp, Artificial sequence
  synthetic polynucleotide sequence
ggacagcagggatgggga

SEQ ID NO: 43213 - DNA, 18 bp, Artificial sequence
  synthetic polynucleotide sequence
aagcagcaggaccgggaa

SEQ ID NO: 43214 - DNA, 20 bp, Artificial sequence
  synthetic polynucleotide sequence
gcagcttcacgaagtcgcaa

SEQ ID NO: 43215 - DNA, 20 bp, Artificial sequence
  synthetic polynucleotide sequence
aagaaactgcaccaggacga

SEQ ID NO: 43216 - DNA, 18 bp, Artificial sequence
  synthetic polynucleotide sequence
agccctgggactggagca

SEQ ID NO: 43217 - DNA, 21 bp, Artificial sequence
  synthetic polynucleotide sequence
actcacaccagaggaatgcca

SEQ ID NO: 43218 - DNA, 22 bp, Artificial sequence
  synthetic polynucleotide sequence
aacttcagcaacaccccaagga

SEQ ID NO: 43219 - DNA, 18 bp, Artificial sequence
  synthetic polynucleotide sequence
agcgcatccccaagacca

SEQ ID NO: 43220 - DNA, 18 bp, Artificial sequence
  synthetic polynucleotide sequence
catgatgggctgccagca

SEQ ID NO: 43221 - DNA, 20 bp, Artificial sequence
  synthetic polynucleotide sequence
tcggagacccatcactggca

SEQ ID NO: 43222 - DNA, 21 bp, Artificial sequence
  synthetic polynucleotide sequence
atggcaaaggaggtggtagga

SEQ ID NO: 43223 - DNA, 19 bp, Artificial sequence
  synthetic polynucleotide sequence
cgaccacctcgtgaacgaa

SEQ ID NO: 43224 - DNA, 18 bp, Artificial sequence
  synthetic polynucleotide sequence
cggcccattccacgtcca

SEQ ID NO: 43225 - DNA, 22 bp, Artificial sequence
  synthetic polynucleotide sequence
aagcagagttctggaggccaga

SEQ ID NO: 43226 - DNA, 22 bp, Artificial sequence
  synthetic polynucleotide sequence
gtaatacctggagccaccagca

SEQ ID NO: 43227 - DNA, 21 bp, Artificial sequence
  synthetic polynucleotide sequence
aacgagaacttgcccgccaga

SEQ ID NO: 43228 - DNA, 19 bp, Artificial sequence
  synthetic polynucleotide sequence
ggagccaccagcagctgga

SEQ ID NO: 43229 - DNA, 21 bp, Artificial sequence
  synthetic polynucleotide sequence
cccctgttcaagaccaccgaa

SEQ ID NO: 43230 - DNA, 18 bp, Artificial sequence
  synthetic polynucleotide sequence
aaggagtggccagcccca

SEQ ID NO: 43231 - DNA, 19 bp, Artificial sequence
  synthetic polynucleotide sequence
tgagtgaggagtgcgggga

SEQ ID NO: 43232 - DNA, 19 bp, Artificial sequence
  synthetic polynucleotide sequence
tcctgatggaatgcgcaca

SEQ ID NO: 43233 - DNA, 18 bp, Artificial sequence
  synthetic polynucleotide sequence
ggggacgatgttcaccga

SEQ ID NO: 43234 - DNA, 20 bp, Artificial sequence
  synthetic polynucleotide sequence
aagaacaagtggtgccacga

SEQ ID NO: 43235 - DNA, 21 bp, Artificial sequence
  synthetic polynucleotide sequence
agacccggaagatgatcagca

SEQ ID NO: 43236 - DNA, 20 bp, Artificial sequence
  synthetic polynucleotide sequence
gaagtcgcggttgcgcagga

SEQ ID NO: 43237 - DNA, 20 bp, Artificial sequence
  synthetic polynucleotide sequence
tccctacccctactccacca

SEQ ID NO: 43238 - DNA, 19 bp, Artificial sequence
  synthetic polynucleotide sequence
gttgtccacagcccgccga

SEQ ID NO: 43239 - DNA, 21 bp, Artificial sequence
  synthetic polynucleotide sequence
cctccagctcctccagtccaa

SEQ ID NO: 43240 - DNA, 20 bp, Artificial sequence
  synthetic polynucleotide sequence
tagaggagtacgcaggccca

SEQ ID NO: 43241 - DNA, 21 bp, Artificial sequence
  synthetic polynucleotide sequence
tcaccctgggtccaaaatcga

SEQ ID NO: 43242 - DNA, 21 bp, Artificial sequence
  synthetic polynucleotide sequence
cgattaagaggctggtcccca

SEQ ID NO: 43243 - DNA, 20 bp, Artificial sequence
  synthetic polynucleotide sequence
cacagcaagaacatcaccca

SEQ ID NO: 43244 - DNA, 22 bp, Artificial sequence
  synthetic polynucleotide sequence
ccaataaccagggtcctacaga

SEQ ID NO: 43245 - DNA, 21 bp, Artificial sequence
  synthetic polynucleotide sequence
aacagcggatccggatggcta

SEQ ID NO: 43246 - DNA, 20 bp, Artificial sequence
  synthetic polynucleotide sequence
tgccaacagccatggtccca

SEQ ID NO: 43247 - DNA, 20 bp, Artificial sequence
  synthetic polynucleotide sequence
gaggacttccacgtggacca

SEQ ID NO: 43248 - DNA, 18 bp, Artificial sequence
  synthetic polynucleotide sequence
gcagcacccagctggaca

SEQ ID NO: 43249 - DNA, 22 bp, Artificial sequence
  synthetic polynucleotide sequence
gaccacagacttggtggagaca

SEQ ID NO: 43250 - DNA, 20 bp, Artificial sequence
  synthetic polynucleotide sequence
ctgcctaagcagctcatgca

SEQ ID NO: 43251 - DNA, 18 bp, Artificial sequence
  synthetic polynucleotide sequence
cctgagaaaatggggcca

SEQ ID NO: 43252 - DNA, 20 bp, Artificial sequence
  synthetic polynucleotide sequence
ctgcccagtgactcctgaga

SEQ ID NO: 43253 - DNA, 18 bp, Artificial sequence
  synthetic polynucleotide sequence
gactccacatgacgggca

SEQ ID NO: 43254 - DNA, 18 bp, Artificial sequence
  synthetic polynucleotide sequence
ggctgcgatgaggggcga

SEQ ID NO: 43255 - DNA, 20 bp, Artificial sequence
  synthetic polynucleotide sequence
gccccccatctggaggagaa

SEQ ID NO: 43256 - DNA, 20 bp, Artificial sequence
  synthetic polynucleotide sequence
ggaggggctgaggagtgaca

SEQ ID NO: 43257 - DNA, 20 bp, Artificial sequence
  synthetic polynucleotide sequence
gaggaagccttcaccagcaa

SEQ ID NO: 43258 - DNA, 21 bp, Artificial sequence
  synthetic polynucleotide sequence
caagcacagccttatggacca

SEQ ID NO: 43259 - DNA, 18 bp, Artificial sequence
  synthetic polynucleotide sequence
ggatgaggctggcaccga

SEQ ID NO: 43260 - DNA, 18 bp, Artificial sequence
  synthetic polynucleotide sequence
aatcgcaggatgtggcga

SEQ ID NO: 43261 - DNA, 18 bp, Artificial sequence
  synthetic polynucleotide sequence
catgatgagccgcgagga

SEQ ID NO: 43262 - DNA, 18 bp, Artificial sequence
  synthetic polynucleotide sequence
cttggtaggggaccccca

SEQ ID NO: 43263 - DNA, 18 bp, Artificial sequence
  synthetic polynucleotide sequence
ctcacgcatcacccagga

SEQ ID NO: 43264 - DNA, 19 bp, Artificial sequence
  synthetic polynucleotide sequence
ggagccagctgtgtccaca

SEQ ID NO: 43265 - DNA, 20 bp, Artificial sequence
  synthetic polynucleotide sequence
ctgcagcacccaaactgaga

SEQ ID NO: 43266 - DNA, 20 bp, Artificial sequence
  synthetic polynucleotide sequence
agatcagatgctggaagcca

SEQ ID NO: 43267 - DNA, 21 bp, Artificial sequence
  synthetic polynucleotide sequence
atgtccccatgatgcaccaga

SEQ ID NO: 43268 - DNA, 21 bp, Artificial sequence
  synthetic polynucleotide sequence
tagggaggacaaagaaggcca

SEQ ID NO: 43269 - DNA, 21 bp, Artificial sequence
  synthetic polynucleotide sequence
gaagccacgacgaatgcacca

SEQ ID NO: 43270 - DNA, 20 bp, Artificial sequence
  synthetic polynucleotide sequence
ctcaatgtcatccggcagca

SEQ ID NO: 43271 - DNA, 22 bp, Artificial sequence
  synthetic polynucleotide sequence
aagtgcagctacaccttcccaa

SEQ ID NO: 43272 - DNA, 20 bp, Artificial sequence
  synthetic polynucleotide sequence
gaaggcatcactcatcccca

SEQ ID NO: 43273 - DNA, 21 bp, Artificial sequence
  synthetic polynucleotide sequence
tgcagatgaggtgcagagaca

SEQ ID NO: 43274 - DNA, 22 bp, Artificial sequence
  synthetic polynucleotide sequence
gatgagcaaactgaggcacaga

SEQ ID NO: 43275 - DNA, 20 bp, Artificial sequence
  synthetic polynucleotide sequence
gtggcctggagcagctcaga

SEQ ID NO: 43276 - DNA, 20 bp, Artificial sequence
  synthetic polynucleotide sequence
tccagggtgaaccgggggaa

SEQ ID NO: 43277 - DNA, 20 bp, Artificial sequence
  synthetic polynucleotide sequence
cttctgcccaacgacatcga

SEQ ID NO: 43278 - DNA, 20 bp, Artificial sequence
  synthetic polynucleotide sequence
ctccacctcaaaccggggca

SEQ ID NO: 43279 - DNA, 20 bp, Artificial sequence
  synthetic polynucleotide sequence
tcagcgcacacctgtacaga

SEQ ID NO: 43280 - DNA, 18 bp, Artificial sequence
  synthetic polynucleotide sequence
tccagcagctccaagcca

SEQ ID NO: 43281 - DNA, 20 bp, Artificial sequence
  synthetic polynucleotide sequence
cctctcaggcatgaccggga

SEQ ID NO: 43282 - DNA, 22 bp, Artificial sequence
  synthetic polynucleotide sequence
gaatcctactacagcggtggca

SEQ ID NO: 43283 - DNA, 21 bp, Artificial sequence
  synthetic polynucleotide sequence
acctctcaggcatgacctgga

SEQ ID NO: 43284 - DNA, 21 bp, Artificial sequence
  synthetic polynucleotide sequence
actactactacagcggtggca

SEQ ID NO: 43285 - DNA, 18 bp, Artificial sequence
  synthetic polynucleotide sequence
caccatggccaatgccaa

SEQ ID NO: 43286 - DNA, 18 bp, Artificial sequence
  synthetic polynucleotide sequence
ggatccgtgctcctggca

SEQ ID NO: 43287 - DNA, 21 bp, Artificial sequence
  synthetic polynucleotide sequence
agcgccgtagagaagtccaga

SEQ ID NO: 43288 - DNA, 20 bp, Artificial sequence
  synthetic polynucleotide sequence
gacagcattcaccagaacca

SEQ ID NO: 43289 - DNA, 21 bp, Artificial sequence
  synthetic polynucleotide sequence
agtcgccatgatgcatcagga

SEQ ID NO: 43290 - DNA, 19 bp, Artificial sequence
  synthetic polynucleotide sequence
tctcaggcagcagaacgta

SEQ ID NO: 43291 - DNA, 20 bp, Artificial sequence
  synthetic polynucleotide sequence
gtgcagcagaatggagccaa

SEQ ID NO: 43292 - DNA, 21 bp, Artificial sequence
  synthetic polynucleotide sequence
cggagaagagaacctgccaca

SEQ ID NO: 43293 - DNA, 20 bp, Artificial sequence
  synthetic polynucleotide sequence
acagcctggaccaagccaga

SEQ ID NO: 43294 - DNA, 21 bp, Artificial sequence
  synthetic polynucleotide sequence
tctccgctgacattgccgaca

SEQ ID NO: 43295 - DNA, 18 bp, Artificial sequence
  synthetic polynucleotide sequence
cgtggctgaaggcaccca

SEQ ID NO: 43296 - DNA, 18 bp, Artificial sequence
  synthetic polynucleotide sequence
gcagcacctctggggtga

SEQ ID NO: 43297 - DNA, 18 bp, Artificial sequence
  synthetic polynucleotide sequence
gaacgaggaaggcaccca

SEQ ID NO: 43298 - DNA, 19 bp, Artificial sequence
  synthetic polynucleotide sequence
cggtcgacagtgaagcgga

SEQ ID NO: 43299 - DNA, 20 bp, Artificial sequence
  synthetic polynucleotide sequence
gagaacctgggaatgaccga

SEQ ID NO: 43300 - DNA, 19 bp, Artificial sequence
  synthetic polynucleotide sequence
gctgtggatgaggaggcca

SEQ ID NO: 43301 - DNA, 18 bp, Artificial sequence
  synthetic polynucleotide sequence
gtcgacaagtgcccccaa

SEQ ID NO: 43302 - DNA, 18 bp, Artificial sequence
  synthetic polynucleotide sequence
tcggcagtgcaatcagca

SEQ ID NO: 43303 - DNA, 22 bp, Artificial sequence
  synthetic polynucleotide sequence
ccatgatgcaccaaacgaccga

SEQ ID NO: 43304 - DNA, 19 bp, Artificial sequence
  synthetic polynucleotide sequence
ttgtcacggggcagcacca

SEQ ID NO: 43305 - DNA, 18 bp, Artificial sequence
  synthetic polynucleotide sequence
aagctcgccaggtccaca

SEQ ID NO: 43306 - DNA, 20 bp, Artificial sequence
  synthetic polynucleotide sequence
aacagccttagggtccgaca

SEQ ID NO: 43307 - DNA, 20 bp, Artificial sequence
  synthetic polynucleotide sequence
gtgtcccaggtactggccaa

SEQ ID NO: 43308 - DNA, 18 bp, Artificial sequence
  synthetic polynucleotide sequence
gatgctgcacgccggaca

SEQ ID NO: 43309 - DNA, 21 bp, Artificial sequence
  synthetic polynucleotide sequence
cagcaccagacagtgctggaa

SEQ ID NO: 43310 - DNA, 21 bp, Artificial sequence
  synthetic polynucleotide sequence
cgaagaggaagggctgctgca

SEQ ID NO: 43311 - DNA, 18 bp, Artificial sequence
  synthetic polynucleotide sequence
ccaaggacgtggagcgca

SEQ ID NO: 43312 - DNA, 18 bp, Artificial sequence
  synthetic polynucleotide sequence
cgtgatggggcatgagga

SEQ ID NO: 43313 - DNA, 20 bp, Artificial sequence
  synthetic polynucleotide sequence
caaaatgtagccgtggccaa

SEQ ID NO: 43314 - DNA, 19 bp, Artificial sequence
  synthetic polynucleotide sequence
gagggccagataagtggca

SEQ ID NO: 43315 - DNA, 21 bp, Artificial sequence
  synthetic polynucleotide sequence
caggaaacctcagctggggaa

SEQ ID NO: 43316 - DNA, 20 bp, Artificial sequence
  synthetic polynucleotide sequence
gaaggtagagggcattggca

SEQ ID NO: 43317 - DNA, 18 bp, Artificial sequence
  synthetic polynucleotide sequence
ccaacccttggcagacga

SEQ ID NO: 43318 - DNA, 18 bp, Artificial sequence
  synthetic polynucleotide sequence
aacaggccctcaagccca

SEQ ID NO: 43319 - DNA, 21 bp, Artificial sequence
  synthetic polynucleotide sequence
tgtgaaagggacctccagcga

SEQ ID NO: 43320 - DNA, 21 bp, Artificial sequence
  synthetic polynucleotide sequence
gtctgtcaggaaacccgtgga

SEQ ID NO: 43321 - DNA, 20 bp, Artificial sequence
  synthetic polynucleotide sequence
gagctggacacctccatgga

SEQ ID NO: 43322 - DNA, 18 bp, Artificial sequence
  synthetic polynucleotide sequence
gtcccccaagtaccggga

SEQ ID NO: 43323 - DNA, 20 bp, Artificial sequence
  synthetic polynucleotide sequence
gatggccagatacctgccaa

SEQ ID NO: 43324 - DNA, 18 bp, Artificial sequence
  synthetic polynucleotide sequence
tcgtggctgagggggcca

SEQ ID NO: 43325 - DNA, 22 bp, Artificial sequence
  synthetic polynucleotide sequence
aacaccataagaccagcacaga

SEQ ID NO: 43326 - DNA, 20 bp, Artificial sequence
  synthetic polynucleotide sequence
tgacacccaacccactgcca

SEQ ID NO: 43327 - DNA, 20 bp, Artificial sequence
  synthetic polynucleotide sequence
taggacagggaccaagcaga

SEQ ID NO: 43328 - DNA, 18 bp, Artificial sequence
  synthetic polynucleotide sequence
tgtaggggtaacggccca

SEQ ID NO: 43329 - DNA, 19 bp, Artificial sequence
  synthetic polynucleotide sequence
ctaccttccgggcccagga

SEQ ID NO: 43330 - DNA, 20 bp, Artificial sequence
  synthetic polynucleotide sequence
gttccagatggccctgcgga

SEQ ID NO: 43331 - DNA, 21 bp, Artificial sequence
  synthetic polynucleotide sequence
ccggaaagtgctgcggaagga

SEQ ID NO: 43332 - DNA, 21 bp, Artificial sequence
  synthetic polynucleotide sequence
gatgttgtccagacgaccgga

SEQ ID NO: 43333 - DNA, 19 bp, Artificial sequence
  synthetic polynucleotide sequence
tgaatgctggcgatgagga

SEQ ID NO: 43334 - DNA, 23 bp, Artificial sequence
  synthetic polynucleotide sequence
aataagccatccaactgctgaga

SEQ ID NO: 43335 - DNA, 18 bp, Artificial sequence
  synthetic polynucleotide sequence
cagcaggaagaggcagca

SEQ ID NO: 43336 - DNA, 21 bp, Artificial sequence
  synthetic polynucleotide sequence
cctaactcatcagcacctgca

SEQ ID NO: 43337 - DNA, 18 bp, Artificial sequence
  synthetic polynucleotide sequence
ccccatccgaagaaccca

SEQ ID NO: 43338 - DNA, 18 bp, Artificial sequence
  synthetic polynucleotide sequence
gctggtgaagacgccaca

SEQ ID NO: 43339 - DNA, 18 bp, Artificial sequence
  synthetic polynucleotide sequence
gtcagatggtggccgaca

SEQ ID NO: 43340 - DNA, 18 bp, Artificial sequence
  synthetic polynucleotide sequence
gcagttaggcgtgcagca

SEQ ID NO: 43341 - DNA, 19 bp, Artificial sequence
  synthetic polynucleotide sequence
gcgagaggaggaaccacca

SEQ ID NO: 43342 - DNA, 18 bp, Artificial sequence
  synthetic polynucleotide sequence
ggttgctggacatcgcca

SEQ ID NO: 43343 - DNA, 20 bp, Artificial sequence
  synthetic polynucleotide sequence
gtgcctgaacccttaccgga

SEQ ID NO: 43344 - DNA, 20 bp, Artificial sequence
  synthetic polynucleotide sequence
tgcactccaggtcctcagga

SEQ ID NO: 43345 - DNA, 18 bp, Artificial sequence
  synthetic polynucleotide sequence
ctacgccatgaaggccga

SEQ ID NO: 43346 - DNA, 18 bp, Artificial sequence
  synthetic polynucleotide sequence
agcgctgtctcccagcaa

SEQ ID NO: 43347 - DNA, 18 bp, Artificial sequence
  synthetic polynucleotide sequence
gagagcccacgtgcagga

SEQ ID NO: 43348 - DNA, 18 bp, Artificial sequence
  synthetic polynucleotide sequence
gacggtgcaccaagccca

SEQ ID NO: 43349 - DNA, 19 bp, Artificial sequence
  synthetic polynucleotide sequence
ggaccctcagactcgccaa

SEQ ID NO: 43350 - DNA, 18 bp, Artificial sequence
  synthetic polynucleotide sequence
tactggtgcacaccccca

SEQ ID NO: 43351 - DNA, 18 bp, Artificial sequence
  synthetic polynucleotide sequence
gcccttcatggaagccca

SEQ ID NO: 43352 - DNA, 18 bp, Artificial sequence
  synthetic polynucleotide sequence
aggcaccatcacggggga

SEQ ID NO: 43353 - DNA, 20 bp, Artificial sequence
  synthetic polynucleotide sequence
caagaggttgacagcaggga

SEQ ID NO: 43354 - DNA, 22 bp, Artificial sequence
  synthetic polynucleotide sequence
ccaaggaggcacagtacttgga

SEQ ID NO: 43355 - DNA, 22 bp, Artificial sequence
  synthetic polynucleotide sequence
atcttgcaatgggagggatcga

SEQ ID NO: 43356 - DNA, 21 bp, Artificial sequence
  synthetic polynucleotide sequence
atagggaaaactgcaggcaca

SEQ ID NO: 43357 - DNA, 18 bp, Artificial sequence
  synthetic polynucleotide sequence
agaatccgggctgggaca

SEQ ID NO: 43358 - DNA, 18 bp, Artificial sequence
  synthetic polynucleotide sequence
tggccccacagcaacaga

SEQ ID NO: 43359 - DNA, 20 bp, Artificial sequence
  synthetic polynucleotide sequence
ctgacagcaaggaatgccaa

SEQ ID NO: 43360 - DNA, 21 bp, Artificial sequence
  synthetic polynucleotide sequence
atctagacagcgtacacccca

SEQ ID NO: 43361 - DNA, 21 bp, Artificial sequence
  synthetic polynucleotide sequence
ccgcatgttgcacaacccaca

SEQ ID NO: 43362 - DNA, 23 bp, Artificial sequence
  synthetic polynucleotide sequence
ggtgaatacggtggatgaggcaa

SEQ ID NO: 43363 - DNA, 20 bp, Artificial sequence
  synthetic polynucleotide sequence
aacgccagtctccactccca

SEQ ID NO: 43364 - DNA, 20 bp, Artificial sequence
  synthetic polynucleotide sequence
ggcaagcctgcagaggccga

SEQ ID NO: 43365 - DNA, 21 bp, Artificial sequence
  synthetic polynucleotide sequence
gactgctgaagaggatgggca

SEQ ID NO: 43366 - DNA, 21 bp, Artificial sequence
  synthetic polynucleotide sequence
ggctcaggtcctggtgaacga

SEQ ID NO: 43367 - DNA, 22 bp, Artificial sequence
  synthetic polynucleotide sequence
gacaagcgcatcatgctggaca

SEQ ID NO: 43368 - DNA, 20 bp, Artificial sequence
  synthetic polynucleotide sequence
gccctgagtactggcccaga

SEQ ID NO: 43369 - DNA, 19 bp, Artificial sequence
  synthetic polynucleotide sequence
cgtcgctggaaggggggaa

SEQ ID NO: 43370 - DNA, 21 bp, Artificial sequence
  synthetic polynucleotide sequence
ggtgggagtacatcagaggca

SEQ ID NO: 43371 - DNA, 18 bp, Artificial sequence
  synthetic polynucleotide sequence
aggtcccgaggaacgaca

SEQ ID NO: 43372 - DNA, 20 bp, Artificial sequence
  synthetic polynucleotide sequence
agcctagcagctcgtagcca

SEQ ID NO: 43373 - DNA, 20 bp, Artificial sequence
  synthetic polynucleotide sequence
ccaccaccaccgatgaacca

SEQ ID NO: 43374 - DNA, 21 bp, Artificial sequence
  synthetic polynucleotide sequence
tgatgcaggcgatagacccca

SEQ ID NO: 43375 - DNA, 20 bp, Artificial sequence
  synthetic polynucleotide sequence
catcaccctccaggagcaga

SEQ ID NO: 43376 - DNA, 18 bp, Artificial sequence
  synthetic polynucleotide sequence
agtgatgggtggagccga

SEQ ID NO: 43377 - DNA, 20 bp, Artificial sequence
  synthetic polynucleotide sequence
agaccaacctggcccggcga

SEQ ID NO: 43378 - DNA, 20 bp, Artificial sequence
  synthetic polynucleotide sequence
ccgggcggccgatcttcaca

SEQ ID NO: 43379 - DNA, 19 bp, Artificial sequence
  synthetic polynucleotide sequence
ccaaagccttccagcgaca

SEQ ID NO: 43380 - DNA, 19 bp, Artificial sequence
  synthetic polynucleotide sequence
ggcccacaaggagacagca

SEQ ID NO: 43381 - DNA, 18 bp, Artificial sequence
  synthetic polynucleotide sequence
cctggcaagcgagacaca

SEQ ID NO: 43382 - DNA, 18 bp, Artificial sequence
  synthetic polynucleotide sequence
gcttcagccaaggcagca

SEQ ID NO: 43383 - DNA, 19 bp, Artificial sequence
  synthetic polynucleotide sequence
ggggatgccagtaggacca

SEQ ID NO: 43384 - DNA, 18 bp, Artificial sequence
  synthetic polynucleotide sequence
gcgagttcagcccaggga

SEQ ID NO: 43385 - DNA, 18 bp, Artificial sequence
  synthetic polynucleotide sequence
agctcccaaggctggcaa

SEQ ID NO: 43386 - DNA, 18 bp, Artificial sequence
  synthetic polynucleotide sequence
ccttggccacacccacca

SEQ ID NO: 43387 - DNA, 21 bp, Artificial sequence
  synthetic polynucleotide sequence
gcttgcacaccatggccctca

SEQ ID NO: 43388 - DNA, 20 bp, Artificial sequence
  synthetic polynucleotide sequence
catgggggggcatcagtgga

SEQ ID NO: 43389 - DNA, 21 bp, Artificial sequence
  synthetic polynucleotide sequence
gaaccaacaccgcgactcgta

SEQ ID NO: 43390 - DNA, 18 bp, Artificial sequence
  synthetic polynucleotide sequence
gtcggctggcggtccaca

SEQ ID NO: 43391 - DNA, 18 bp, Artificial sequence
  synthetic polynucleotide sequence
cggccaagagggcgaaca

SEQ ID NO: 43392 - DNA, 20 bp, Artificial sequence
  synthetic polynucleotide sequence
ccccactctgatttgacgaa

SEQ ID NO: 43393 - DNA, 20 bp, Artificial sequence
  synthetic polynucleotide sequence
caccagccagggtgtcagca

SEQ ID NO: 43394 - DNA, 20 bp, Artificial sequence
  synthetic polynucleotide sequence
tggtggctgagaagtcccca

SEQ ID NO: 43395 - DNA, 17 bp, Artificial sequence
  synthetic polynucleotide sequence
ggcgcggacagtcgaga

SEQ ID NO: 43396 - DNA, 20 bp, Artificial sequence
  synthetic polynucleotide sequence
cccaattatcctcccagaca

SEQ ID NO: 43397 - DNA, 18 bp, Artificial sequence
  synthetic polynucleotide sequence
ccacgagggcctgaggaa

SEQ ID NO: 43398 - DNA, 21 bp, Artificial sequence
  synthetic polynucleotide sequence
tgaggacctctctaaggacca

SEQ ID NO: 43399 - DNA, 21 bp, Artificial sequence
  synthetic polynucleotide sequence
cgaggggacagaggacacgaa

SEQ ID NO: 43400 - DNA, 21 bp, Artificial sequence
  synthetic polynucleotide sequence
tgcaccgtcggaagggtcaga

SEQ ID NO: 43401 - DNA, 18 bp, Artificial sequence
  synthetic polynucleotide sequence
accaggaggccatggaca

SEQ ID NO: 43402 - DNA, 18 bp, Artificial sequence
  synthetic polynucleotide sequence
agccatggcctcgtcgaa

SEQ ID NO: 43403 - DNA, 19 bp, Artificial sequence
  synthetic polynucleotide sequence
gaggcaagaggaggaacga

SEQ ID NO: 43404 - DNA, 22 bp, Artificial sequence
  synthetic polynucleotide sequence
ttcataacctatgccaccacca

SEQ ID NO: 43405 - DNA, 19 bp, Artificial sequence
  synthetic polynucleotide sequence
tggtgaagcaggttcagga

SEQ ID NO: 43406 - DNA, 19 bp, Artificial sequence
  synthetic polynucleotide sequence
tcagacacagctgactgca

SEQ ID NO: 43407 - DNA, 18 bp, Artificial sequence
  synthetic polynucleotide sequence
ccgcccaatgccaccgaa

SEQ ID NO: 43408 - DNA, 20 bp, Artificial sequence
  synthetic polynucleotide sequence
caaactcgctggcacagaga

SEQ ID NO: 43409 - DNA, 20 bp, Artificial sequence
  synthetic polynucleotide sequence
tagacgagaccatccagcca

SEQ ID NO: 43410 - DNA, 18 bp, Artificial sequence
  synthetic polynucleotide sequence
aacggtcgcactcaagca

SEQ ID NO: 43411 - DNA, 18 bp, Artificial sequence
  synthetic polynucleotide sequence
tgaagccatcgtcacgga

SEQ ID NO: 43412 - DNA, 19 bp, Artificial sequence
  synthetic polynucleotide sequence
gcagccactcctctgcaca

SEQ ID NO: 43413 - DNA, 18 bp, Artificial sequence
  synthetic polynucleotide sequence
ccgcaaagtggatggaca

SEQ ID NO: 43414 - DNA, 22 bp, Artificial sequence
  synthetic polynucleotide sequence
ggtagtagagggagcaggggta

SEQ ID NO: 43415 - DNA, 19 bp, Artificial sequence
  synthetic polynucleotide sequence
cccgggaaaagctggccca

SEQ ID NO: 43416 - DNA, 20 bp, Artificial sequence
  synthetic polynucleotide sequence
tcagtagagggcagggcgta

SEQ ID NO: 43417 - DNA, 19 bp, Artificial sequence
  synthetic polynucleotide sequence
gccaggacgacgaggagca

SEQ ID NO: 43418 - DNA, 19 bp, Artificial sequence
  synthetic polynucleotide sequence
ttatgccgcccggaagcca

SEQ ID NO: 43419 - DNA, 20 bp, Artificial sequence
  synthetic polynucleotide sequence
aagaaggtgctgagcgggca

SEQ ID NO: 43420 - DNA, 21 bp, Artificial sequence
  synthetic polynucleotide sequence
acagcagaacagtacccagca

SEQ ID NO: 43421 - DNA, 20 bp, Artificial sequence
  synthetic polynucleotide sequence
ccctaagccccgtcccaaga

SEQ ID NO: 43422 - DNA, 20 bp, Artificial sequence
  synthetic polynucleotide sequence
ctcagggcgggtagcctgca

SEQ ID NO: 43423 - DNA, 19 bp, Artificial sequence
  synthetic polynucleotide sequence
cttggcagctcacatggaa

SEQ ID NO: 43424 - DNA, 18 bp, Artificial sequence
  synthetic polynucleotide sequence
ggtgacgctggtccctga

SEQ ID NO: 43425 - DNA, 22 bp, Artificial sequence
  synthetic polynucleotide sequence
atcaggcacagagactgactga

SEQ ID NO: 43426 - DNA, 19 bp, Artificial sequence
  synthetic polynucleotide sequence
ttgtgacagcgtcgtggga

SEQ ID NO: 43427 - DNA, 18 bp, Artificial sequence
  synthetic polynucleotide sequence
ggccctccagggcttcca

SEQ ID NO: 43428 - DNA, 18 bp, Artificial sequence
  synthetic polynucleotide sequence
gccgcctgctctggcaca

SEQ ID NO: 43429 - DNA, 18 bp, Artificial sequence
  synthetic polynucleotide sequence
aggcagggacgggagaga

SEQ ID NO: 43430 - DNA, 18 bp, Artificial sequence
  synthetic polynucleotide sequence
ctccacgctctccaggga

SEQ ID NO: 43431 - DNA, 18 bp, Artificial sequence
  synthetic polynucleotide sequence
agaatggctgccgcgaga

SEQ ID NO: 43432 - DNA, 18 bp, Artificial sequence
  synthetic polynucleotide sequence
caacacaggcctggagca

SEQ ID NO: 43433 - DNA, 18 bp, Artificial sequence
  synthetic polynucleotide sequence
ttccaggccaagcccgca

SEQ ID NO: 43434 - DNA, 18 bp, Artificial sequence
  synthetic polynucleotide sequence
tagagcggcacctcgcca

SEQ ID NO: 43435 - DNA, 19 bp, Artificial sequence
  synthetic polynucleotide sequence
gcacacaggctggtggaca

SEQ ID NO: 43436 - DNA, 18 bp, Artificial sequence
  synthetic polynucleotide sequence
cagtcctctgacccgcca

SEQ ID NO: 43437 - DNA, 21 bp, Artificial sequence
  synthetic polynucleotide sequence
gaatgtcagcccaggttccca

SEQ ID NO: 43438 - DNA, 19 bp, Artificial sequence
  synthetic polynucleotide sequence
tgacgacggcattgaagga

SEQ ID NO: 43439 - DNA, 21 bp, Artificial sequence
  synthetic polynucleotide sequence
cccccacatcagtcaggcaga

SEQ ID NO: 43440 - DNA, 21 bp, Artificial sequence
  synthetic polynucleotide sequence
tgacacagttagccgcagcca

SEQ ID NO: 43441 - DNA, 18 bp, Artificial sequence
  synthetic polynucleotide sequence
ccccccttggtcggcaga

SEQ ID NO: 43442 - DNA, 21 bp, Artificial sequence
  synthetic polynucleotide sequence
tctgacctgcctcatcagcca

SEQ ID NO: 43443 - DNA, 20 bp, Artificial sequence
  synthetic polynucleotide sequence
gtcatggacaaggaaggcaa

SEQ ID NO: 43444 - DNA, 20 bp, Artificial sequence
  synthetic polynucleotide sequence
gaatcagagctgaggtccca

SEQ ID NO: 43445 - DNA, 18 bp, Artificial sequence
  synthetic polynucleotide sequence
cctggacagcgatggcaa

SEQ ID NO: 43446 - DNA, 18 bp, Artificial sequence
  synthetic polynucleotide sequence
cgatcgggggtagcacca

SEQ ID NO: 43447 - DNA, 20 bp, Artificial sequence
  synthetic polynucleotide sequence
cgcagccacgatgcggagga

SEQ ID NO: 43448 - DNA, 20 bp, Artificial sequence
  synthetic polynucleotide sequence
ggcagaggtgacgttgagca

SEQ ID NO: 43449 - DNA, 21 bp, Artificial sequence
  synthetic polynucleotide sequence
agaaggctgttgagagaagga

SEQ ID NO: 43450 - DNA, 18 bp, Artificial sequence
  synthetic polynucleotide sequence
aatgcgaatcacggccca

SEQ ID NO: 43451 - DNA, 20 bp, Artificial sequence
  synthetic polynucleotide sequence
gaagccacctgcaggacaga

SEQ ID NO: 43452 - DNA, 18 bp, Artificial sequence
  synthetic polynucleotide sequence
cccattggcgcagacgca

SEQ ID NO: 43453 - DNA, 18 bp, Artificial sequence
  synthetic polynucleotide sequence
atgtgctgccgacgggaa

SEQ ID NO: 43454 - DNA, 18 bp, Artificial sequence
  synthetic polynucleotide sequence
aagcgttgacaggggcca

SEQ ID NO: 43455 - DNA, 19 bp, Artificial sequence
  synthetic polynucleotide sequence
ctaagcatggatgccccaa

SEQ ID NO: 43456 - DNA, 18 bp, Artificial sequence
  synthetic polynucleotide sequence
gctgccagagggacccca

SEQ ID NO: 43457 - DNA, 21 bp, Artificial sequence
  synthetic polynucleotide sequence
tgagagccagtgaagatggca

SEQ ID NO: 43458 - DNA, 20 bp, Artificial sequence
  synthetic polynucleotide sequence
gcgtctccacagagtgccca

SEQ ID NO: 43459 - DNA, 19 bp, Artificial sequence
  synthetic polynucleotide sequence
gtgtcatcccgctgcccca

SEQ ID NO: 43460 - DNA, 20 bp, Artificial sequence
  synthetic polynucleotide sequence
gcatggatcagggcgcggta

SEQ ID NO: 43461 - DNA, 22 bp, Artificial sequence
  synthetic polynucleotide sequence
tcaaaggagcagacccaagcaa

SEQ ID NO: 43462 - DNA, 22 bp, Artificial sequence
  synthetic polynucleotide sequence
gaaaagtcagagcagctgggga

SEQ ID NO: 43463 - DNA, 18 bp, Artificial sequence
  synthetic polynucleotide sequence
gcgtcctcgtcacagcca

SEQ ID NO: 43464 - DNA, 18 bp, Artificial sequence
  synthetic polynucleotide sequence
gagtccgtgggaggcgca

SEQ ID NO: 43465 - DNA, 20 bp, Artificial sequence
  synthetic polynucleotide sequence
gacccagagttcacccagga

SEQ ID NO: 43466 - DNA, 18 bp, Artificial sequence
  synthetic polynucleotide sequence
aatgcacttgaggcccca

SEQ ID NO: 43467 - DNA, 22 bp, Artificial sequence
  synthetic polynucleotide sequence
attcccagctccgatgaacaca

SEQ ID NO: 43468 - DNA, 20 bp, Artificial sequence
  synthetic polynucleotide sequence
ggcaggaatcttcagggcca

SEQ ID NO: 43469 - DNA, 19 bp, Artificial sequence
  synthetic polynucleotide sequence
cggagactgggaagcccaa

SEQ ID NO: 43470 - DNA, 22 bp, Artificial sequence
  synthetic polynucleotide sequence
caaatccagtgataccaccaga

SEQ ID NO: 43471 - DNA, 20 bp, Artificial sequence
  synthetic polynucleotide sequence
tagccctccactcccagaca

SEQ ID NO: 43472 - DNA, 22 bp, Artificial sequence
  synthetic polynucleotide sequence
gaaacagccactgggtgatcca

SEQ ID NO: 43473 - DNA, 22 bp, Artificial sequence
  synthetic polynucleotide sequence
aaagccattcccactcagacca

SEQ ID NO: 43474 - DNA, 19 bp, Artificial sequence
  synthetic polynucleotide sequence
tgcacagggagtgtctgca

SEQ ID NO: 43475 - DNA, 20 bp, Artificial sequence
  synthetic polynucleotide sequence
ccccaaccatcgcaggctca

SEQ ID NO: 43476 - DNA, 22 bp, Artificial sequence
  synthetic polynucleotide sequence
aagttccaccccttagcagtca

SEQ ID NO: 43477 - DNA, 21 bp, Artificial sequence
  synthetic polynucleotide sequence
ctgagtacagcatgccctcca

SEQ ID NO: 43478 - DNA, 21 bp, Artificial sequence
  synthetic polynucleotide sequence
actagagaacaccagcaggga

SEQ ID NO: 43479 - DNA, 20 bp, Artificial sequence
  synthetic polynucleotide sequence
cagcaggctctacactggga

SEQ ID NO: 43480 - DNA, 18 bp, Artificial sequence
  synthetic polynucleotide sequence
tcgatgaaggtccaggca

SEQ ID NO: 43481 - DNA, 20 bp, Artificial sequence
  synthetic polynucleotide sequence
ctgggagctctacgaccgga

SEQ ID NO: 43482 - DNA, 18 bp, Artificial sequence
  synthetic polynucleotide sequence
ccagctggtcccgaagca

SEQ ID NO: 43483 - DNA, 19 bp, Artificial sequence
  synthetic polynucleotide sequence
gaggcgccatggacacgca

SEQ ID NO: 43484 - DNA, 20 bp, Artificial sequence
  synthetic polynucleotide sequence
cttccaccagagccagcgca

SEQ ID NO: 43485 - DNA, 21 bp, Artificial sequence
  synthetic polynucleotide sequence
caacctcgagaggctcagaga

SEQ ID NO: 43486 - DNA, 21 bp, Artificial sequence
  synthetic polynucleotide sequence
cattgtcgagggtgaccagga

SEQ ID NO: 43487 - DNA, 19 bp, Artificial sequence
  synthetic polynucleotide sequence
caccagcgggaccacgaga

SEQ ID NO: 43488 - DNA, 19 bp, Artificial sequence
  synthetic polynucleotide sequence
cgttgagctcccccaccca

SEQ ID NO: 43489 - DNA, 21 bp, Artificial sequence
  synthetic polynucleotide sequence
catcgagctcaacccagccaa

SEQ ID NO: 43490 - DNA, 20 bp, Artificial sequence
  synthetic polynucleotide sequence
atgcagatggcccgctcaca

SEQ ID NO: 43491 - DNA, 22 bp, Artificial sequence
  synthetic polynucleotide sequence
agatggacacttacacctcgga

SEQ ID NO: 43492 - DNA, 22 bp, Artificial sequence
  synthetic polynucleotide sequence
gtaacaatccactgcagcagca

SEQ ID NO: 43493 - DNA, 18 bp, Artificial sequence
  synthetic polynucleotide sequence
cccttggacactccggaa

SEQ ID NO: 43494 - DNA, 18 bp, Artificial sequence
  synthetic polynucleotide sequence
aagacaccgtgggagcca

SEQ ID NO: 43495 - DNA, 20 bp, Artificial sequence
  synthetic polynucleotide sequence
ggccagtgtcacgtacagca

SEQ ID NO: 43496 - DNA, 20 bp, Artificial sequence
  synthetic polynucleotide sequence
cgaagggtgatgtcggccga

SEQ ID NO: 43497 - DNA, 21 bp, Artificial sequence
  synthetic polynucleotide sequence
gctggagagcacagaagcaga

SEQ ID NO: 43498 - DNA, 18 bp, Artificial sequence
  synthetic polynucleotide sequence
ggccctgcagctgaacca

SEQ ID NO: 43499 - DNA, 18 bp, Artificial sequence
  synthetic polynucleotide sequence
gcagggaaaccggcgaga

SEQ ID NO: 43500 - DNA, 22 bp, Artificial sequence
  synthetic polynucleotide sequence
tgtaaccgtgatacagcacaca

SEQ ID NO: 43501 - DNA, 21 bp, Artificial sequence
  synthetic polynucleotide sequence
gacagcgagtcgataccagga

SEQ ID NO: 43502 - DNA, 22 bp, Artificial sequence
  synthetic polynucleotide sequence
aaggtgaaccaccatcccctga

SEQ ID NO: 43503 - DNA, 19 bp, Artificial sequence
  synthetic polynucleotide sequence
gccccagtcccgatgcaga

SEQ ID NO: 43504 - DNA, 20 bp, Artificial sequence
  synthetic polynucleotide sequence
gcggtgtcgtggaacaggga

SEQ ID NO: 43505 - DNA, 19 bp, Artificial sequence
  synthetic polynucleotide sequence
gtgactcggccccaccaga

SEQ ID NO: 43506 - DNA, 19 bp, Artificial sequence
  synthetic polynucleotide sequence
ctgccccagagaaggcgca

SEQ ID NO: 43507 - DNA, 21 bp, Artificial sequence
  synthetic polynucleotide sequence
ttgcgtgttccgcagaaacca

SEQ ID NO: 43508 - DNA, 21 bp, Artificial sequence
  synthetic polynucleotide sequence
agctggacagtgtcctcacca

SEQ ID NO: 43509 - DNA, 20 bp, Artificial sequence
  synthetic polynucleotide sequence
gaaaccaagtggtggccgga

SEQ ID NO: 43510 - DNA, 21 bp, Artificial sequence
  synthetic polynucleotide sequence
tgcaatcccagagcaacagga

SEQ ID NO: 43511 - DNA, 20 bp, Artificial sequence
  synthetic polynucleotide sequence
ctggccctgttgcggagaga

SEQ ID NO: 43512 - DNA, 19 bp, Artificial sequence
  synthetic polynucleotide sequence
ctggggaactctgccggca

SEQ ID NO: 43513 - DNA, 20 bp, Artificial sequence
  synthetic polynucleotide sequence
caccacccccatttcccaga

SEQ ID NO: 43514 - DNA, 20 bp, Artificial sequence
  synthetic polynucleotide sequence
ctagcacacagcctgccaca

SEQ ID NO: 43515 - DNA, 20 bp, Artificial sequence
  synthetic polynucleotide sequence
gaggagcagtactgtgggga

SEQ ID NO: 43516 - DNA, 20 bp, Artificial sequence
  synthetic polynucleotide sequence
ctggaggaggagccaaacca

SEQ ID NO: 43517 - DNA, 19 bp, Artificial sequence
  synthetic polynucleotide sequence
taccccctgccacctcaga

SEQ ID NO: 43518 - DNA, 20 bp, Artificial sequence
  synthetic polynucleotide sequence
tgaaccaggtggggctgtca

SEQ ID NO: 43519 - DNA, 19 bp, Artificial sequence
  synthetic polynucleotide sequence
gtgacaaaagccacacgca

SEQ ID NO: 43520 - DNA, 18 bp, Artificial sequence
  synthetic polynucleotide sequence
gtgaggcaactgcaggca

SEQ ID NO: 43521 - DNA, 22 bp, Artificial sequence
  synthetic polynucleotide sequence
aaatcaagtcccagcagagcga

SEQ ID NO: 43522 - DNA, 20 bp, Artificial sequence
  synthetic polynucleotide sequence
gttgcctgccaaggctcgca

SEQ ID NO: 43523 - DNA, 18 bp, Artificial sequence
  synthetic polynucleotide sequence
ccccgagaacctcagcaa

SEQ ID NO: 43524 - DNA, 18 bp, Artificial sequence
  synthetic polynucleotide sequence
tctcaggtggccacagca

SEQ ID NO: 43525 - DNA, 21 bp, Artificial sequence
  synthetic polynucleotide sequence
ggtcttcgtcaacaccacgga

SEQ ID NO: 43526 - DNA, 19 bp, Artificial sequence
  synthetic polynucleotide sequence
tcgtcccacacaaccagga

SEQ ID NO: 43527 - DNA, 18 bp, Artificial sequence
  synthetic polynucleotide sequence
ggtcaaagccagcgagca

SEQ ID NO: 43528 - DNA, 18 bp, Artificial sequence
  synthetic polynucleotide sequence
ccttcacctgaacccgca

SEQ ID NO: 43529 - DNA, 18 bp, Artificial sequence
  synthetic polynucleotide sequence
ccaggtacaatgccgcca

SEQ ID NO: 43530 - DNA, 18 bp, Artificial sequence
  synthetic polynucleotide sequence
gcctgcaggtcatccaca

SEQ ID NO: 43531 - DNA, 20 bp, Artificial sequence
  synthetic polynucleotide sequence
cctgcagaagaccctccgga

SEQ ID NO: 43532 - DNA, 20 bp, Artificial sequence
  synthetic polynucleotide sequence
ctccaggttacgaagggcca

SEQ ID NO: 43533 - DNA, 18 bp, Artificial sequence
  synthetic polynucleotide sequence
ggggagaccggatccaga

SEQ ID NO: 43534 - DNA, 19 bp, Artificial sequence
  synthetic polynucleotide sequence
gccttcctccccttcggta

SEQ ID NO: 43535 - DNA, 20 bp, Artificial sequence
  synthetic polynucleotide sequence
aggtgctccccaaagaggga

SEQ ID NO: 43536 - DNA, 21 bp, Artificial sequence
  synthetic polynucleotide sequence
tctggaggcggcttgatagga

SEQ ID NO: 43537 - DNA, 18 bp, Artificial sequence
  synthetic polynucleotide sequence
cttcgagcccgagaacga

SEQ ID NO: 43538 - DNA, 20 bp, Artificial sequence
  synthetic polynucleotide sequence
aagcacctccacgtagctga

SEQ ID NO: 43539 - DNA, 20 bp, Artificial sequence
  synthetic polynucleotide sequence
ccacaagcaggcagtccaga

SEQ ID NO: 43540 - DNA, 18 bp, Artificial sequence
  synthetic polynucleotide sequence
gtgtgggagagaccccca

SEQ ID NO: 43541 - DNA, 19 bp, Artificial sequence
  synthetic polynucleotide sequence
gccgccgcctggattacga

SEQ ID NO: 43542 - DNA, 21 bp, Artificial sequence
  synthetic polynucleotide sequence
ggggacactggatgcagctga

SEQ ID NO: 43543 - DNA, 22 bp, Artificial sequence
  synthetic polynucleotide sequence
gaatcagcagtacacatgccca

SEQ ID NO: 43544 - DNA, 21 bp, Artificial sequence
  synthetic polynucleotide sequence
tgaggttggaaggagaggtga

SEQ ID NO: 43545 - DNA, 18 bp, Artificial sequence
  synthetic polynucleotide sequence
cctgcgctgcctccacga

SEQ ID NO: 43546 - DNA, 18 bp, Artificial sequence
  synthetic polynucleotide sequence
gctgctcaggggtgggga

SEQ ID NO: 43547 - DNA, 20 bp, Artificial sequence
  synthetic polynucleotide sequence
gcacgaagtgcccagtggaa

SEQ ID NO: 43548 - DNA, 20 bp, Artificial sequence
  synthetic polynucleotide sequence
gggcaggtagctgaatgcca

SEQ ID NO: 43549 - DNA, 18 bp, Artificial sequence
  synthetic polynucleotide sequence
gcagagtcgcagagccaa

SEQ ID NO: 43550 - DNA, 18 bp, Artificial sequence
  synthetic polynucleotide sequence
ccttgagccctccacgga

SEQ ID NO: 43551 - DNA, 22 bp, Artificial sequence
  synthetic polynucleotide sequence
ggaagatcaggtaccagggcaa

SEQ ID NO: 43552 - DNA, 18 bp, Artificial sequence
  synthetic polynucleotide sequence
tggcgtcaccgtcgggca

SEQ ID NO: 43553 - DNA, 20 bp, Artificial sequence
  synthetic polynucleotide sequence
gtctcctccagcatcgccca

SEQ ID NO: 43554 - DNA, 20 bp, Artificial sequence
  synthetic polynucleotide sequence
ggaactgcggagtccaggga

SEQ ID NO: 43555 - DNA, 20 bp, Artificial sequence
  synthetic polynucleotide sequence
ctctgccaaaaccgcccgca

SEQ ID NO: 43556 - DNA, 21 bp, Artificial sequence
  synthetic polynucleotide sequence
ggtcatctctgggcccaagga

SEQ ID NO: 43557 - DNA, 20 bp, Artificial sequence
  synthetic polynucleotide sequence
ctgccccatagagagcgaga

SEQ ID NO: 43558 - DNA, 20 bp, Artificial sequence
  synthetic polynucleotide sequence
gacagcggagcttgccggga

SEQ ID NO: 43559 - DNA, 18 bp, Artificial sequence
  synthetic polynucleotide sequence
tggccctagcactcagca

SEQ ID NO: 43560 - DNA, 18 bp, Artificial sequence
  synthetic polynucleotide sequence
gcgagttgcagagcgaca

SEQ ID NO: 43561 - DNA, 20 bp, Artificial sequence
  synthetic polynucleotide sequence
tgccagctgaaggatgccca

SEQ ID NO: 43562 - DNA, 19 bp, Artificial sequence
  synthetic polynucleotide sequence
ggccaccaccactcagcca

SEQ ID NO: 43563 - DNA, 20 bp, Artificial sequence
  synthetic polynucleotide sequence
gatacaccgcggcctgctca

SEQ ID NO: 43564 - DNA, 19 bp, Artificial sequence
  synthetic polynucleotide sequence
tcagctggactggtgcaga

SEQ ID NO: 43565 - DNA, 18 bp, Artificial sequence
  synthetic polynucleotide sequence
gggcaaacaccgacccaa

SEQ ID NO: 43566 - DNA, 18 bp, Artificial sequence
  synthetic polynucleotide sequence
tgccggagcatcaaccca

SEQ ID NO: 43567 - DNA, 20 bp, Artificial sequence
  synthetic polynucleotide sequence
gccgactctgggatcgagga

SEQ ID NO: 43568 - DNA, 20 bp, Artificial sequence
  synthetic polynucleotide sequence
ccttcggaagacagggtgga

SEQ ID NO: 43569 - DNA, 22 bp, Artificial sequence
  synthetic polynucleotide sequence
gtcactgtaacagactgccaca

SEQ ID NO: 43570 - DNA, 20 bp, Artificial sequence
  synthetic polynucleotide sequence
ggactggagcagggggtgaa

SEQ ID NO: 43571 - DNA, 20 bp, Artificial sequence
  synthetic polynucleotide sequence
tgcaacgctgggtcatcgga

SEQ ID NO: 43572 - DNA, 21 bp, Artificial sequence
  synthetic polynucleotide sequence
gatgggggaaacaagcgtcca

SEQ ID NO: 43573 - DNA, 18 bp, Artificial sequence
  synthetic polynucleotide sequence
cccctcaccttcgcggga

SEQ ID NO: 43574 - DNA, 19 bp, Artificial sequence
  synthetic polynucleotide sequence
cttctccagggggacggca

SEQ ID NO: 43575 - DNA, 19 bp, Artificial sequence
  synthetic polynucleotide sequence
tgggacaccagagaaccca

SEQ ID NO: 43576 - DNA, 20 bp, Artificial sequence
  synthetic polynucleotide sequence
gaggttaaggaggggagcca

SEQ ID NO: 43577 - DNA, 18 bp, Artificial sequence
  synthetic polynucleotide sequence
cgggagagcacgaccaca

SEQ ID NO: 43578 - DNA, 18 bp, Artificial sequence
  synthetic polynucleotide sequence
ccgcagagatgatgggca

SEQ ID NO: 43579 - DNA, 21 bp, Artificial sequence
  synthetic polynucleotide sequence
gtatgtcctcaccggcatgca

SEQ ID NO: 43580 - DNA, 18 bp, Artificial sequence
  synthetic polynucleotide sequence
gctcactctcggcggcca

SEQ ID NO: 43581 - DNA, 18 bp, Artificial sequence
  synthetic polynucleotide sequence
gaaggcacgatccggaca

SEQ ID NO: 43582 - DNA, 19 bp, Artificial sequence
  synthetic polynucleotide sequence
ccactggctgctggagaca

SEQ ID NO: 43583 - DNA, 21 bp, Artificial sequence
  synthetic polynucleotide sequence
agtgcaacatcccctggccaa

SEQ ID NO: 43584 - DNA, 20 bp, Artificial sequence
  synthetic polynucleotide sequence
atctgataaggtggccgaca

SEQ ID NO: 43585 - DNA, 21 bp, Artificial sequence
  synthetic polynucleotide sequence
tgcctccacacagaaaggcca

SEQ ID NO: 43586 - DNA, 21 bp, Artificial sequence
  synthetic polynucleotide sequence
aactggttccccacaatccca

SEQ ID NO: 43587 - DNA, 19 bp, Artificial sequence
  synthetic polynucleotide sequence
cgcaccatcagcccggaca

SEQ ID NO: 43588 - DNA, 18 bp, Artificial sequence
  synthetic polynucleotide sequence
aggggaggccaccaccga

SEQ ID NO: 43589 - DNA, 21 bp, Artificial sequence
  synthetic polynucleotide sequence
tgatcagccctgggagtggaa

SEQ ID NO: 43590 - DNA, 21 bp, Artificial sequence
  synthetic polynucleotide sequence
ctcactgagccgcactaggta

SEQ ID NO: 43591 - DNA, 20 bp, Artificial sequence
  synthetic polynucleotide sequence
aagggtcaaagggatgcaga

SEQ ID NO: 43592 - DNA, 20 bp, Artificial sequence
  synthetic polynucleotide sequence
gactgtcaagcagctggaga

SEQ ID NO: 43593 - DNA, 21 bp, Artificial sequence
  synthetic polynucleotide sequence
tgtcccgaaccaaggaacaca

SEQ ID NO: 43594 - DNA, 20 bp, Artificial sequence
  synthetic polynucleotide sequence
gtccggatggccacagggta

SEQ ID NO: 43595 - DNA, 20 bp, Artificial sequence
  synthetic polynucleotide sequence
ggcaccaagctggtgaagga

SEQ ID NO: 43596 - DNA, 20 bp, Artificial sequence
  synthetic polynucleotide sequence
ccgtcgtcgcggtccaggaa

SEQ ID NO: 43597 - DNA, 18 bp, Artificial sequence
  synthetic polynucleotide sequence
ggggtcgtcctcacgcca

SEQ ID NO: 43598 - DNA, 20 bp, Artificial sequence
  synthetic polynucleotide sequence
atggtcccttccggcaagca

SEQ ID NO: 43599 - DNA, 22 bp, Artificial sequence
  synthetic polynucleotide sequence
ctccgcagctatcagacagaga

SEQ ID NO: 43600 - DNA, 20 bp, Artificial sequence
  synthetic polynucleotide sequence
cggatggagccgcctgtgga

SEQ ID NO: 43601 - DNA, 18 bp, Artificial sequence
  synthetic polynucleotide sequence
tggccctgcacccccaca

SEQ ID NO: 43602 - DNA, 21 bp, Artificial sequence
  synthetic polynucleotide sequence
ggtaagagggctgtggtggca

SEQ ID NO: 43603 - DNA, 18 bp, Artificial sequence
  synthetic polynucleotide sequence
tcgccctggctacaacga

SEQ ID NO: 43604 - DNA, 20 bp, Artificial sequence
  synthetic polynucleotide sequence
gaggctgaggataaggggca

SEQ ID NO: 43605 - DNA, 20 bp, Artificial sequence
  synthetic polynucleotide sequence
cagcatgccctacgaccgca

SEQ ID NO: 43606 - DNA, 21 bp, Artificial sequence
  synthetic polynucleotide sequence
caaagacgtccgtgtgcgaga

SEQ ID NO: 43607 - DNA, 20 bp, Artificial sequence
  synthetic polynucleotide sequence
gagggggcacttcacaggga

SEQ ID NO: 43608 - DNA, 22 bp, Artificial sequence
  synthetic polynucleotide sequence
tggagagaggaagtgatgagga

SEQ ID NO: 43609 - DNA, 20 bp, Artificial sequence
  synthetic polynucleotide sequence
ggacccgcccttcaactgca

SEQ ID NO: 43610 - DNA, 20 bp, Artificial sequence
  synthetic polynucleotide sequence
ggaacagcggctctggtcga

SEQ ID NO: 43611 - DNA, 21 bp, Artificial sequence
  synthetic polynucleotide sequence
gctctggctcaacaccggcaa

SEQ ID NO: 43612 - DNA, 22 bp, Artificial sequence
  synthetic polynucleotide sequence
agcttggtgaagatgcccacga

SEQ ID NO: 43613 - DNA, 18 bp, Artificial sequence
  synthetic polynucleotide sequence
tcgtgcagcacccggaga

SEQ ID NO: 43614 - DNA, 18 bp, Artificial sequence
  synthetic polynucleotide sequence
gcggaagcgagtcacaga

SEQ ID NO: 43615 - DNA, 21 bp, Artificial sequence
  synthetic polynucleotide sequence
ggatagagctgaccctgcaga

SEQ ID NO: 43616 - DNA, 20 bp, Artificial sequence
  synthetic polynucleotide sequence
cagagggaagagagaggcga

SEQ ID NO: 43617 - DNA, 18 bp, Artificial sequence
  synthetic polynucleotide sequence
cggacatcgtcaccacca

SEQ ID NO: 43618 - DNA, 20 bp, Artificial sequence
  synthetic polynucleotide sequence
ctgcagggagtactcccgga

SEQ ID NO: 43619 - DNA, 22 bp, Artificial sequence
  synthetic polynucleotide sequence
tgaatgacaaccccaacctgca

SEQ ID NO: 43620 - DNA, 22 bp, Artificial sequence
  synthetic polynucleotide sequence
aatgatgaaagaaggcccccca

SEQ ID NO: 43621 - DNA, 22 bp, Artificial sequence
  synthetic polynucleotide sequence
ccaagtgccgcaaacaagagaa

SEQ ID NO: 43622 - DNA, 21 bp, Artificial sequence
  synthetic polynucleotide sequence
aaggcatccgtaaggctccca

SEQ ID NO: 43623 - DNA, 18 bp, Artificial sequence
  synthetic polynucleotide sequence
cataggggccgccagcca

SEQ ID NO: 43624 - DNA, 20 bp, Artificial sequence
  synthetic polynucleotide sequence
gacaagggcgtcacgttgca

SEQ ID NO: 43625 - DNA, 20 bp, Artificial sequence
  synthetic polynucleotide sequence
cgtggagagggtgatgggca

SEQ ID NO: 43626 - DNA, 20 bp, Artificial sequence
  synthetic polynucleotide sequence
catgaccagagctgccccga

SEQ ID NO: 43627 - DNA, 18 bp, Artificial sequence
  synthetic polynucleotide sequence
ctgctgcccctgcacaca

SEQ ID NO: 43628 - DNA, 18 bp, Artificial sequence
  synthetic polynucleotide sequence
gcctgaagctcatgggca

SEQ ID NO: 43629 - DNA, 21 bp, Artificial sequence
  synthetic polynucleotide sequence
caaagaaacccctggccagca

SEQ ID NO: 43630 - DNA, 22 bp, Artificial sequence
  synthetic polynucleotide sequence
aaatccatagtggcactgcgga

SEQ ID NO: 43631 - DNA, 18 bp, Artificial sequence
  synthetic polynucleotide sequence
actggacgccatcaggga

SEQ ID NO: 43632 - DNA, 18 bp, Artificial sequence
  synthetic polynucleotide sequence
ggcggctgaactggagga

SEQ ID NO: 43633 - DNA, 20 bp, Artificial sequence
  synthetic polynucleotide sequence
gcgggaaccctacctcgaga

SEQ ID NO: 43634 - DNA, 18 bp, Artificial sequence
  synthetic polynucleotide sequence
tgagctcactggccacga

SEQ ID NO: 43635 - DNA, 20 bp, Artificial sequence
  synthetic polynucleotide sequence
gaaggagaacctggatcgca

SEQ ID NO: 43636 - DNA, 19 bp, Artificial sequence
  synthetic polynucleotide sequence
gcaggctctccagcagaca

SEQ ID NO: 43637 - DNA, 21 bp, Artificial sequence
  synthetic polynucleotide sequence
accccaaacccagtgatagca

SEQ ID NO: 43638 - DNA, 23 bp, Artificial sequence
  synthetic polynucleotide sequence
gaagagcaagaatatgcctggga

SEQ ID NO: 43639 - DNA, 18 bp, Artificial sequence
  synthetic polynucleotide sequence
tgcgtcgcagaaaggtga

SEQ ID NO: 43640 - DNA, 20 bp, Artificial sequence
  synthetic polynucleotide sequence
tacactggatacagaaccca

SEQ ID NO: 43641 - DNA, 18 bp, Artificial sequence
  synthetic polynucleotide sequence
ggccatccagtcatgcca

SEQ ID NO: 43642 - DNA, 20 bp, Artificial sequence
  synthetic polynucleotide sequence
ataggggatgttagcagcca

SEQ ID NO: 43643 - DNA, 19 bp, Artificial sequence
  synthetic polynucleotide sequence
ggctatgtccccaacccaa

SEQ ID NO: 43644 - DNA, 18 bp, Artificial sequence
  synthetic polynucleotide sequence
tgcagccgataagccaca

SEQ ID NO: 43645 - DNA, 23 bp, Artificial sequence
  synthetic polynucleotide sequence
gaaaaatacgatggtcaccagca

SEQ ID NO: 43646 - DNA, 18 bp, Artificial sequence
  synthetic polynucleotide sequence
tcgaggagtcgcttccca

SEQ ID NO: 43647 - DNA, 18 bp, Artificial sequence
  synthetic polynucleotide sequence
tgcacgcccacaagagca

SEQ ID NO: 43648 - DNA, 21 bp, Artificial sequence
  synthetic polynucleotide sequence
tgcatcatcacccagtcgaca

SEQ ID NO: 43649 - DNA, 19 bp, Artificial sequence
  synthetic polynucleotide sequence
ggcatgaagggcaccccca

SEQ ID NO: 43650 - DNA, 19 bp, Artificial sequence
  synthetic polynucleotide sequence
ctcccacttgaggcgccga

SEQ ID NO: 43651 - DNA, 18 bp, Artificial sequence
  synthetic polynucleotide sequence
ccctggaagccaaggaca

SEQ ID NO: 43652 - DNA, 18 bp, Artificial sequence
  synthetic polynucleotide sequence
gcatgcacaggccagcga

SEQ ID NO: 43653 - DNA, 19 bp, Artificial sequence
  synthetic polynucleotide sequence
gcagagtcgagggagcaca

SEQ ID NO: 43654 - DNA, 18 bp, Artificial sequence
  synthetic polynucleotide sequence
acaccaggaaggacccga

SEQ ID NO: 43655 - DNA, 18 bp, Artificial sequence
  synthetic polynucleotide sequence
ctcagaggtggacccgga

SEQ ID NO: 43656 - DNA, 19 bp, Artificial sequence
  synthetic polynucleotide sequence
ccgagatccgagacgtcca

SEQ ID NO: 43657 - DNA, 20 bp, Artificial sequence
  synthetic polynucleotide sequence
ctggcgtctacacctgccaa

SEQ ID NO: 43658 - DNA, 19 bp, Artificial sequence
  synthetic polynucleotide sequence
ggcatcctccagcaggaca

SEQ ID NO: 43659 - DNA, 18 bp, Artificial sequence
  synthetic polynucleotide sequence
catcctgcagctgccaga

SEQ ID NO: 43660 - DNA, 18 bp, Artificial sequence
  synthetic polynucleotide sequence
gatgatcagggccaggca

SEQ ID NO: 43661 - DNA, 19 bp, Artificial sequence
  synthetic polynucleotide sequence
gctggagcatgggggagga

SEQ ID NO: 43662 - DNA, 20 bp, Artificial sequence
  synthetic polynucleotide sequence
atgctggtgaccctgggaga

SEQ ID NO: 43663 - DNA, 18 bp, Artificial sequence
  synthetic polynucleotide sequence
ggaagggggattcaggga

SEQ ID NO: 43664 - DNA, 18 bp, Artificial sequence
  synthetic polynucleotide sequence
cccctgttcacaggccca

SEQ ID NO: 43665 - DNA, 21 bp, Artificial sequence
  synthetic polynucleotide sequence
tcgcctgcacagttgacagca

SEQ ID NO: 43666 - DNA, 18 bp, Artificial sequence
  synthetic polynucleotide sequence
ggtgaggacgaggggcca

SEQ ID NO: 43667 - DNA, 23 bp, Artificial sequence
  synthetic polynucleotide sequence
gagagagagagagagtacacgca

SEQ ID NO: 43668 - DNA, 25 bp, Artificial sequence
  synthetic polynucleotide sequence
gttctaggtaagaaagggcaaggga

SEQ ID NO: 43669 - DNA, 20 bp, Artificial sequence
  synthetic polynucleotide sequence
ctggaggggaacagcagcca

SEQ ID NO: 43670 - DNA, 21 bp, Artificial sequence
  synthetic polynucleotide sequence
gacagatacagagcagggcca

SEQ ID NO: 43671 - DNA, 18 bp, Artificial sequence
  synthetic polynucleotide sequence
ccaggaccacagcaccaa

SEQ ID NO: 43672 - DNA, 18 bp, Artificial sequence
  synthetic polynucleotide sequence
ggggaagccctggaacca

SEQ ID NO: 43673 - DNA, 21 bp, Artificial sequence
  synthetic polynucleotide sequence
agccagactgactctgaccca

SEQ ID NO: 43674 - DNA, 19 bp, Artificial sequence
  synthetic polynucleotide sequence
ttcctcctgcactgcccaa

SEQ ID NO: 43675 - DNA, 20 bp, Artificial sequence
  synthetic polynucleotide sequence
ggcccaacatcctcatccca

SEQ ID NO: 43676 - DNA, 20 bp, Artificial sequence
  synthetic polynucleotide sequence
gacacggaggtccctatcca

SEQ ID NO: 43677 - DNA, 20 bp, Artificial sequence
  synthetic polynucleotide sequence
acgatgggccctgaatgcca

SEQ ID NO: 43678 - DNA, 25 bp, Artificial sequence
  synthetic polynucleotide sequence
ggagtcaggataaggtcctacaaga

SEQ ID NO: 43679 - DNA, 19 bp, Artificial sequence
  synthetic polynucleotide sequence
gtcttccagcgcgaagaga

SEQ ID NO: 43680 - DNA, 18 bp, Artificial sequence
  synthetic polynucleotide sequence
cgcattcacgaacaccca

SEQ ID NO: 43681 - DNA, 17 bp, Artificial sequence
  synthetic polynucleotide sequence
cggcctcggagctcgga

SEQ ID NO: 43682 - DNA, 18 bp, Artificial sequence
  synthetic polynucleotide sequence
cgggaagaacaagggcca

SEQ ID NO: 43683 - DNA, 22 bp, Artificial sequence
  synthetic polynucleotide sequence
gacccatggaagcttccaagca

SEQ ID NO: 43684 - DNA, 20 bp, Artificial sequence
  synthetic polynucleotide sequence
gccccgcagaaaaagagcga

SEQ ID NO: 43685 - DNA, 18 bp, Artificial sequence
  synthetic polynucleotide sequence
ccgtccatgagcaccaca

SEQ ID NO: 43686 - DNA, 18 bp, Artificial sequence
  synthetic polynucleotide sequence
gcatccgacatccgggca

SEQ ID NO: 43687 - DNA, 22 bp, Artificial sequence
  synthetic polynucleotide sequence
ggaaccaagattcaaacccaga

SEQ ID NO: 43688 - DNA, 21 bp, Artificial sequence
  synthetic polynucleotide sequence
caagaaccacttgaactccca

SEQ ID NO: 43689 - DNA, 18 bp, Artificial sequence
  synthetic polynucleotide sequence
cccagagaagctgcagca

SEQ ID NO: 43690 - DNA, 18 bp, Artificial sequence
  synthetic polynucleotide sequence
gggcatcatgctcgggca

SEQ ID NO: 43691 - DNA, 21 bp, Artificial sequence
  synthetic polynucleotide sequence
tcatcagacagcaggagacca

SEQ ID NO: 43692 - DNA, 22 bp, Artificial sequence
  synthetic polynucleotide sequence
aagtgtgagccattacagccca

SEQ ID NO: 43693 - DNA, 22 bp, Artificial sequence
  synthetic polynucleotide sequence
aaaagccaatgttgccggccaa

SEQ ID NO: 43694 - DNA, 20 bp, Artificial sequence
  synthetic polynucleotide sequence
tggagacgagctgctaggca

SEQ ID NO: 43695 - DNA, 21 bp, Artificial sequence
  synthetic polynucleotide sequence
cagtggcagacttgggacgaa

SEQ ID NO: 43696 - DNA, 19 bp, Artificial sequence
  synthetic polynucleotide sequence
gggacaagaggctccccca

SEQ ID NO: 43697 - DNA, 18 bp, Artificial sequence
  synthetic polynucleotide sequence
ccaaaggagcgagccaca

SEQ ID NO: 43698 - DNA, 20 bp, Artificial sequence
  synthetic polynucleotide sequence
gtcctcagaccacgaaggga

SEQ ID NO: 43699 - DNA, 19 bp, Artificial sequence
  synthetic polynucleotide sequence
cgctgcatggccgacgaga

SEQ ID NO: 43700 - DNA, 21 bp, Artificial sequence
  synthetic polynucleotide sequence
acatactgctccacgtaccga

SEQ ID NO: 43701 - DNA, 20 bp, Artificial sequence
  synthetic polynucleotide sequence
gtggcaggccatctcggaga

SEQ ID NO: 43702 - DNA, 19 bp, Artificial sequence
  synthetic polynucleotide sequence
cccaggctctggctcagca

SEQ ID NO: 43703 - DNA, 18 bp, Artificial sequence
  synthetic polynucleotide sequence
tggcacccctatggcaca

SEQ ID NO: 43704 - DNA, 18 bp, Artificial sequence
  synthetic polynucleotide sequence
aaccactgggctggcaga

SEQ ID NO: 43705 - DNA, 21 bp, Artificial sequence
  synthetic polynucleotide sequence
tgcatggctacgcgtccacca

SEQ ID NO: 43706 - DNA, 20 bp, Artificial sequence
  synthetic polynucleotide sequence
gcttggacatggacccggga

SEQ ID NO: 43707 - DNA, 20 bp, Artificial sequence
  synthetic polynucleotide sequence
cgcagttgccggccaaagca

SEQ ID NO: 43708 - DNA, 20 bp, Artificial sequence
  synthetic polynucleotide sequence
aaacctgagcggggtagcca

SEQ ID NO: 43709 - DNA, 18 bp, Artificial sequence
  synthetic polynucleotide sequence
agcccacccgaaggagca

SEQ ID NO: 43710 - DNA, 18 bp, Artificial sequence
  synthetic polynucleotide sequence
ccgccatcagtagggcca

SEQ ID NO: 43711 - DNA, 20 bp, Artificial sequence
  synthetic polynucleotide sequence
ggagactcacaggagtggca

SEQ ID NO: 43712 - DNA, 21 bp, Artificial sequence
  synthetic polynucleotide sequence
gggatcagggacgtcatagca

SEQ ID NO: 43713 - DNA, 21 bp, Artificial sequence
  synthetic polynucleotide sequence
tgttggggaccactggagaca

SEQ ID NO: 43714 - DNA, 20 bp, Artificial sequence
  synthetic polynucleotide sequence
gtaaatggcctcccggctca

SEQ ID NO: 43715 - DNA, 19 bp, Artificial sequence
  synthetic polynucleotide sequence
ccaagcctggcaacacaga

SEQ ID NO: 43716 - DNA, 18 bp, Artificial sequence
  synthetic polynucleotide sequence
ctgagtgccccgacctga

SEQ ID NO: 43717 - DNA, 18 bp, Artificial sequence
  synthetic polynucleotide sequence
gcatccgcagcacagcca

SEQ ID NO: 43718 - DNA, 19 bp, Artificial sequence
  synthetic polynucleotide sequence
caagttggcagtcccacga

SEQ ID NO: 43719 - DNA, 21 bp, Artificial sequence
  synthetic polynucleotide sequence
atagagtggcaaaggagcaga

SEQ ID NO: 43720 - DNA, 21 bp, Artificial sequence
  synthetic polynucleotide sequence
tctgaatatacctcagcgcca

SEQ ID NO: 43721 - DNA, 18 bp, Artificial sequence
  synthetic polynucleotide sequence
cctgggcagttcaagcca

SEQ ID NO: 43722 - DNA, 18 bp, Artificial sequence
  synthetic polynucleotide sequence
gcgtgtagcagcgcagga

SEQ ID NO: 43723 - DNA, 18 bp, Artificial sequence
  synthetic polynucleotide sequence
gcatcctcgcagcaggga

SEQ ID NO: 43724 - DNA, 18 bp, Artificial sequence
  synthetic polynucleotide sequence
gctgcacaaggtcccgca

SEQ ID NO: 43725 - DNA, 21 bp, Artificial sequence
  synthetic polynucleotide sequence
aagtcctgaaccccacctgga

SEQ ID NO: 43726 - DNA, 21 bp, Artificial sequence
  synthetic polynucleotide sequence
atggcctccacattgaacgca

SEQ ID NO: 43727 - DNA, 18 bp, Artificial sequence
  synthetic polynucleotide sequence
cgatgagctgcaccgcaa

SEQ ID NO: 43728 - DNA, 18 bp, Artificial sequence
  synthetic polynucleotide sequence
gcctcttcacaccgggga

SEQ ID NO: 43729 - DNA, 20 bp, Artificial sequence
  synthetic polynucleotide sequence
gacgcagtacgtccgagaca

SEQ ID NO: 43730 - DNA, 18 bp, Artificial sequence
  synthetic polynucleotide sequence
gcgatgtacccagcgtga

SEQ ID NO: 43731 - DNA, 18 bp, Artificial sequence
  synthetic polynucleotide sequence
gcagtggaccccgaagga

SEQ ID NO: 43732 - DNA, 18 bp, Artificial sequence
  synthetic polynucleotide sequence
ctgcacagcgacttccga

SEQ ID NO: 43733 - DNA, 18 bp, Artificial sequence
  synthetic polynucleotide sequence
tgccagggctgcagagga

SEQ ID NO: 43734 - DNA, 18 bp, Artificial sequence
  synthetic polynucleotide sequence
gtccagcaccacctccga

SEQ ID NO: 43735 - DNA, 18 bp, Artificial sequence
  synthetic polynucleotide sequence
gagctgccccttcgcgga

SEQ ID NO: 43736 - DNA, 18 bp, Artificial sequence
  synthetic polynucleotide sequence
ccgcacagggctcgctca

SEQ ID NO: 43737 - DNA, 21 bp, Artificial sequence
  synthetic polynucleotide sequence
ctccccaaagtccagaccaga

SEQ ID NO: 43738 - DNA, 18 bp, Artificial sequence
  synthetic polynucleotide sequence
tggaggtgagggggccga

SEQ ID NO: 43739 - DNA, 20 bp, Artificial sequence
  synthetic polynucleotide sequence
actcatcatccagccccgca

SEQ ID NO: 43740 - DNA, 20 bp, Artificial sequence
  synthetic polynucleotide sequence
gttgcagtgggtccgctcca

SEQ ID NO: 43741 - DNA, 23 bp, Artificial sequence
  synthetic polynucleotide sequence
gctagcaaaagcggagagtgaga

SEQ ID NO: 43742 - DNA, 20 bp, Artificial sequence
  synthetic polynucleotide sequence
gccctacagggagtgagaga

SEQ ID NO: 43743 - DNA, 19 bp, Artificial sequence
  synthetic polynucleotide sequence
ccaggcctgatacccagca

SEQ ID NO: 43744 - DNA, 20 bp, Artificial sequence
  synthetic polynucleotide sequence
gtgaagctgccactgacaca

SEQ ID NO: 43745 - DNA, 19 bp, Artificial sequence
  synthetic polynucleotide sequence
ccgtgctgaggctgccaga

SEQ ID NO: 43746 - DNA, 21 bp, Artificial sequence
  synthetic polynucleotide sequence
agttccaagggctcctccaca

SEQ ID NO: 43747 - DNA, 22 bp, Artificial sequence
  synthetic polynucleotide sequence
aacccagagctgtgttaaggga

SEQ ID NO: 43748 - DNA, 22 bp, Artificial sequence
  synthetic polynucleotide sequence
cgaaggaacaccattgaactca

SEQ ID NO: 43749 - DNA, 18 bp, Artificial sequence
  synthetic polynucleotide sequence
gaaaactgcggcagagca

SEQ ID NO: 43750 - DNA, 18 bp, Artificial sequence
  synthetic polynucleotide sequence
cccttcaccagcccccaa

SEQ ID NO: 43751 - DNA, 21 bp, Artificial sequence
  synthetic polynucleotide sequence
cagtacacgagcaagaagcca

SEQ ID NO: 43752 - DNA, 21 bp, Artificial sequence
  synthetic polynucleotide sequence
gcaacaggaggatcagacaga

SEQ ID NO: 43753 - DNA, 19 bp, Artificial sequence
  synthetic polynucleotide sequence
gtccagcagaagccagaga

SEQ ID NO: 43754 - DNA, 19 bp, Artificial sequence
  synthetic polynucleotide sequence
gggaaccacaacttgggga

SEQ ID NO: 43755 - DNA, 21 bp, Artificial sequence
  synthetic polynucleotide sequence
agtgctccagtgaaagtggaa

SEQ ID NO: 43756 - DNA, 19 bp, Artificial sequence
  synthetic polynucleotide sequence
ttctcctacccaccagcca

SEQ ID NO: 43757 - DNA, 18 bp, Artificial sequence
  synthetic polynucleotide sequence
cggcctccataagaccca

SEQ ID NO: 43758 - DNA, 19 bp, Artificial sequence
  synthetic polynucleotide sequence
cgagggtgaacacagccca

SEQ ID NO: 43759 - DNA, 22 bp, Artificial sequence
  synthetic polynucleotide sequence
tccagccaagtgtcagtgcaga

SEQ ID NO: 43760 - DNA, 18 bp, Artificial sequence
  synthetic polynucleotide sequence
ggggcccagctctgcaga

SEQ ID NO: 43761 - DNA, 18 bp, Artificial sequence
  synthetic polynucleotide sequence
ctgggtggaccagcagca

SEQ ID NO: 43762 - DNA, 20 bp, Artificial sequence
  synthetic polynucleotide sequence
atgggccaggaagaacctga

SEQ ID NO: 43763 - DNA, 21 bp, Artificial sequence
  synthetic polynucleotide sequence
tgctccgggtgaatggggaga

SEQ ID NO: 43764 - DNA, 21 bp, Artificial sequence
  synthetic polynucleotide sequence
agacgcagcagttcctggaca

SEQ ID NO: 43765 - DNA, 20 bp, Artificial sequence
  synthetic polynucleotide sequence
tacctgggcaactggagcta

SEQ ID NO: 43766 - DNA, 19 bp, Artificial sequence
  synthetic polynucleotide sequence
caggcgcctcatacaacga

SEQ ID NO: 43767 - DNA, 20 bp, Artificial sequence
  synthetic polynucleotide sequence
ctccttaacaccgaacacca

SEQ ID NO: 43768 - DNA, 18 bp, Artificial sequence
  synthetic polynucleotide sequence
tcaggaggaggagggtca

SEQ ID NO: 43769 - DNA, 19 bp, Artificial sequence
  synthetic polynucleotide sequence
cggaaacggctgaagagca

SEQ ID NO: 43770 - DNA, 19 bp, Artificial sequence
  synthetic polynucleotide sequence
ctcatcagacgctaggcga

SEQ ID NO: 43771 - DNA, 20 bp, Artificial sequence
  synthetic polynucleotide sequence
gtgtccagactgcaggagga

SEQ ID NO: 43772 - DNA, 21 bp, Artificial sequence
  synthetic polynucleotide sequence
gtcagggacaggtaagaggca

SEQ ID NO: 43773 - DNA, 21 bp, Artificial sequence
  synthetic polynucleotide sequence
gtataacatccccagcgtcca

SEQ ID NO: 43774 - DNA, 20 bp, Artificial sequence
  synthetic polynucleotide sequence
cgcggtgagatgtacagcca

SEQ ID NO: 43775 - DNA, 21 bp, Artificial sequence
  synthetic polynucleotide sequence
acagcttcaacacagggtcca

SEQ ID NO: 43776 - DNA, 19 bp, Artificial sequence
  synthetic polynucleotide sequence
gggagtgcactgcgaccca

SEQ ID NO: 43777 - DNA, 21 bp, Artificial sequence
  synthetic polynucleotide sequence
tctcagcaaatcctcccagca

SEQ ID NO: 43778 - DNA, 18 bp, Artificial sequence
  synthetic polynucleotide sequence
cccccagcagaaggggca

SEQ ID NO: 43779 - DNA, 18 bp, Artificial sequence
  synthetic polynucleotide sequence
aggagaacgggacctgca

SEQ ID NO: 43780 - DNA, 20 bp, Artificial sequence
  synthetic polynucleotide sequence
gtgagggacaggaggtggga

SEQ ID NO: 43781 - DNA, 22 bp, Artificial sequence
  synthetic polynucleotide sequence
atgggaggccttgggaaacaca

SEQ ID NO: 43782 - DNA, 22 bp, Artificial sequence
  synthetic polynucleotide sequence
atcttcgcaaagcttctgggca

SEQ ID NO: 43783 - DNA, 19 bp, Artificial sequence
  synthetic polynucleotide sequence
aagcagccaatgagtccca

SEQ ID NO: 43784 - DNA, 19 bp, Artificial sequence
  synthetic polynucleotide sequence
cagagcttcctggcaagga

SEQ ID NO: 43785 - DNA, 18 bp, Artificial sequence
  synthetic polynucleotide sequence
ggcgacgggagacaacca

SEQ ID NO: 43786 - DNA, 18 bp, Artificial sequence
  synthetic polynucleotide sequence
cagcatcaggagcagcga

SEQ ID NO: 43787 - DNA, 22 bp, Artificial sequence
  synthetic polynucleotide sequence
aaagagggacatccagctacca

SEQ ID NO: 43788 - DNA, 21 bp, Artificial sequence
  synthetic polynucleotide sequence
gtaaagccctgaatcctccca

SEQ ID NO: 43789 - DNA, 18 bp, Artificial sequence
  synthetic polynucleotide sequence
cctccagcggaagaagga

SEQ ID NO: 43790 - DNA, 21 bp, Artificial sequence
  synthetic polynucleotide sequence
gtgggtgtgccagagtacaca

SEQ ID NO: 43791 - DNA, 21 bp, Artificial sequence
  synthetic polynucleotide sequence
tggctgctcacctggagggaa

SEQ ID NO: 43792 - DNA, 21 bp, Artificial sequence
  synthetic polynucleotide sequence
agaggcatcatgccaagggca

SEQ ID NO: 43793 - DNA, 20 bp, Artificial sequence
  synthetic polynucleotide sequence
caggggtccagtgataccca

SEQ ID NO: 43794 - DNA, 20 bp, Artificial sequence
  synthetic polynucleotide sequence
gaggaagtccctctcccaga

SEQ ID NO: 43795 - DNA, 18 bp, Artificial sequence
  synthetic polynucleotide sequence
caggcatccggctaccca

SEQ ID NO: 43796 - DNA, 18 bp, Artificial sequence
  synthetic polynucleotide sequence
gcagcatggccaaggcca

SEQ ID NO: 43797 - DNA, 21 bp, Artificial sequence
  synthetic polynucleotide sequence
ttccacccaactgcaagagga

SEQ ID NO: 43798 - DNA, 21 bp, Artificial sequence
  synthetic polynucleotide sequence
tgaattgcggtggaaaggcca

SEQ ID NO: 43799 - DNA, 21 bp, Artificial sequence
  synthetic polynucleotide sequence
tctactccaggcaccaatgca

SEQ ID NO: 43800 - DNA, 18 bp, Artificial sequence
  synthetic polynucleotide sequence
ccctcctgggcacgtgca

SEQ ID NO: 43801 - DNA, 20 bp, Artificial sequence
  synthetic polynucleotide sequence
ccgccctgggaatgatgcca

SEQ ID NO: 43802 - DNA, 21 bp, Artificial sequence
  synthetic polynucleotide sequence
gatcctttcgccaggaccaca

SEQ ID NO: 43803 - DNA, 21 bp, Artificial sequence
  synthetic polynucleotide sequence
tgggggaccactgaagccaga

SEQ ID NO: 43804 - DNA, 20 bp, Artificial sequence
  synthetic polynucleotide sequence
agaagacacaggcggaggca

SEQ ID NO: 43805 - DNA, 18 bp, Artificial sequence
  synthetic polynucleotide sequence
gcccaccctcatgcagga

SEQ ID NO: 43806 - DNA, 20 bp, Artificial sequence
  synthetic polynucleotide sequence
aaggcaacaggtccagacca

SEQ ID NO: 43807 - DNA, 18 bp, Artificial sequence
  synthetic polynucleotide sequence
ggcggattgcaggaggaa

SEQ ID NO: 43808 - DNA, 20 bp, Artificial sequence
  synthetic polynucleotide sequence
gataagccacgctgaccaca

SEQ ID NO: 43809 - DNA, 18 bp, Artificial sequence
  synthetic polynucleotide sequence
ccgagatgccaccgggaa

SEQ ID NO: 43810 - DNA, 20 bp, Artificial sequence
  synthetic polynucleotide sequence
gtccttgcacagagcctgga

SEQ ID NO: 43811 - DNA, 19 bp, Artificial sequence
  synthetic polynucleotide sequence
gctccacgacgagctggaa

SEQ ID NO: 43812 - DNA, 20 bp, Artificial sequence
  synthetic polynucleotide sequence
atacacccttgatccagcca

SEQ ID NO: 43813 - DNA, 18 bp, Artificial sequence
  synthetic polynucleotide sequence
tgaaggaggagcaggcca

SEQ ID NO: 43814 - DNA, 18 bp, Artificial sequence
  synthetic polynucleotide sequence
cgcctacgaacacacgga

SEQ ID NO: 43815 - DNA, 18 bp, Artificial sequence
  synthetic polynucleotide sequence
ggtgaacccacatgggca

SEQ ID NO: 43816 - DNA, 18 bp, Artificial sequence
  synthetic polynucleotide sequence
cacaggcgaggttcacga

SEQ ID NO: 43817 - DNA, 18 bp, Artificial sequence
  synthetic polynucleotide sequence
tgaagccggagtgggaga

SEQ ID NO: 43818 - DNA, 18 bp, Artificial sequence
  synthetic polynucleotide sequence
gcccaggcatgttgagca

SEQ ID NO: 43819 - DNA, 21 bp, Artificial sequence
  synthetic polynucleotide sequence
agagcgagacagagaggcaca

SEQ ID NO: 43820 - DNA, 20 bp, Artificial sequence
  synthetic polynucleotide sequence
gtccggacgcatgttaagca

SEQ ID NO: 43821 - DNA, 19 bp, Artificial sequence
  synthetic polynucleotide sequence
gacaccgtccgcgacacca

SEQ ID NO: 43822 - DNA, 20 bp, Artificial sequence
  synthetic polynucleotide sequence
gttgtcgtccacctgggcca

SEQ ID NO: 43823 - DNA, 18 bp, Artificial sequence
  synthetic polynucleotide sequence
gacaagggaaggggccaa

SEQ ID NO: 43824 - DNA, 20 bp, Artificial sequence
  synthetic polynucleotide sequence
caggaacacatggacaggga

SEQ ID NO: 43825 - DNA, 18 bp, Artificial sequence
  synthetic polynucleotide sequence
ggaccctgtacagccgca

SEQ ID NO: 43826 - DNA, 18 bp, Artificial sequence
  synthetic polynucleotide sequence
ccggagattcgcagcaga

SEQ ID NO: 43827 - DNA, 22 bp, Artificial sequence
  synthetic polynucleotide sequence
caatcactggtacctccaccaa

SEQ ID NO: 43828 - DNA, 22 bp, Artificial sequence
  synthetic polynucleotide sequence
aaagccactgaagccagatcca

SEQ ID NO: 43829 - DNA, 19 bp, Artificial sequence
  synthetic polynucleotide sequence
ctcccctgcactctggcca

SEQ ID NO: 43830 - DNA, 20 bp, Artificial sequence
  synthetic polynucleotide sequence
gtgcaggctgaagaggggga

SEQ ID NO: 43831 - DNA, 22 bp, Artificial sequence
  synthetic polynucleotide sequence
caaagctcccaacacagagaca

SEQ ID NO: 43832 - DNA, 22 bp, Artificial sequence
  synthetic polynucleotide sequence
atgaccacagtgatgagcagca

SEQ ID NO: 43833 - DNA, 20 bp, Artificial sequence
  synthetic polynucleotide sequence
taaccccctctacaccctga

SEQ ID NO: 43834 - DNA, 22 bp, Artificial sequence
  synthetic polynucleotide sequence
aataacgttgactcccaggcca

SEQ ID NO: 43835 - DNA, 20 bp, Artificial sequence
  synthetic polynucleotide sequence
ctgcaggaggagtaccggaa

SEQ ID NO: 43836 - DNA, 22 bp, Artificial sequence
  synthetic polynucleotide sequence
acaatgaatagcagggtggcca

SEQ ID NO: 43837 - DNA, 22 bp, Artificial sequence
  synthetic polynucleotide sequence
gataatccatggacagggggca

SEQ ID NO: 43838 - DNA, 21 bp, Artificial sequence
  synthetic polynucleotide sequence
cgactccaagataggccgtga

SEQ ID NO: 43839 - DNA, 21 bp, Artificial sequence
  synthetic polynucleotide sequence
tgagtcaggacaagtcggcca

SEQ ID NO: 43840 - DNA, 21 bp, Artificial sequence
  synthetic polynucleotide sequence
gatgacgggtagcaacagcca

SEQ ID NO: 43841 - DNA, 18 bp, Artificial sequence
  synthetic polynucleotide sequence
tgcagaccgtgaacgcca

SEQ ID NO: 43842 - DNA, 18 bp, Artificial sequence
  synthetic polynucleotide sequence
cctgcacgatggcagcca

SEQ ID NO: 43843 - DNA, 18 bp, Artificial sequence
  synthetic polynucleotide sequence
tgcgtggcagctaccaca

SEQ ID NO: 43844 - DNA, 18 bp, Artificial sequence
  synthetic polynucleotide sequence
gcccactgtaccaggcca

SEQ ID NO: 43845 - DNA, 20 bp, Artificial sequence
  synthetic polynucleotide sequence
ctcctcacacgctccctgca

SEQ ID NO: 43846 - DNA, 21 bp, Artificial sequence
  synthetic polynucleotide sequence
gatcggcagcatggtagacga

SEQ ID NO: 43847 - DNA, 22 bp, Artificial sequence
  synthetic polynucleotide sequence
agcaatgtcagaggaacctcca

SEQ ID NO: 43848 - DNA, 22 bp, Artificial sequence
  synthetic polynucleotide sequence
agtgcccctgtgaaacagccaa

SEQ ID NO: 43849 - DNA, 19 bp, Artificial sequence
  synthetic polynucleotide sequence
tgacatggtagcccgacca

SEQ ID NO: 43850 - DNA, 20 bp, Artificial sequence
  synthetic polynucleotide sequence
aacaatacggagctgagcca

SEQ ID NO: 43851 - DNA, 21 bp, Artificial sequence
  synthetic polynucleotide sequence
ccatgactgttggcccaccca

SEQ ID NO: 43852 - DNA, 23 bp, Artificial sequence
  synthetic polynucleotide sequence
taaaacaaagcacagcacctcca

SEQ ID NO: 43853 - DNA, 19 bp, Artificial sequence
  synthetic polynucleotide sequence
gtggtgggcggcgaagaga

SEQ ID NO: 43854 - DNA, 21 bp, Artificial sequence
  synthetic polynucleotide sequence
acaggaggaaagaggcggtga

SEQ ID NO: 43855 - DNA, 21 bp, Artificial sequence
  synthetic polynucleotide sequence
gatcccagtagtgaccacaga

SEQ ID NO: 43856 - DNA, 20 bp, Artificial sequence
  synthetic polynucleotide sequence
atctaccagccgtcctgcga

SEQ ID NO: 43857 - DNA, 20 bp, Artificial sequence
  synthetic polynucleotide sequence
ctctcaggctacctccggga

SEQ ID NO: 43858 - DNA, 21 bp, Artificial sequence
  synthetic polynucleotide sequence
agaagcagaagaagtggggca

SEQ ID NO: 43859 - DNA, 18 bp, Artificial sequence
  synthetic polynucleotide sequence
agcccaggagtgccccga

SEQ ID NO: 43860 - DNA, 21 bp, Artificial sequence
  synthetic polynucleotide sequence
ggctgtcccaaagtagcccga

SEQ ID NO: 43861 - DNA, 18 bp, Artificial sequence
  synthetic polynucleotide sequence
gcaagagaggtgtccgca

SEQ ID NO: 43862 - DNA, 18 bp, Artificial sequence
  synthetic polynucleotide sequence
tagccaagggcagcagca

SEQ ID NO: 43863 - DNA, 18 bp, Artificial sequence
  synthetic polynucleotide sequence
gggcgtgcccgacaccaa

SEQ ID NO: 43864 - DNA, 19 bp, Artificial sequence
  synthetic polynucleotide sequence
cccaccatgccgtaggaga

SEQ ID NO: 43865 - DNA, 22 bp, Artificial sequence
  synthetic polynucleotide sequence
caatgggcctaacaggaacaga

SEQ ID NO: 43866 - DNA, 22 bp, Artificial sequence
  synthetic polynucleotide sequence
atctgactgaccgtctcaagga

SEQ ID NO: 43867 - DNA, 19 bp, Artificial sequence
  synthetic polynucleotide sequence
cgtggacgagcagcaggca

SEQ ID NO: 43868 - DNA, 20 bp, Artificial sequence
  synthetic polynucleotide sequence
ctggaagatgagggcgccga

SEQ ID NO: 43869 - DNA, 18 bp, Artificial sequence
  synthetic polynucleotide sequence
tcctcaacagggagccca

SEQ ID NO: 43870 - DNA, 21 bp, Artificial sequence
  synthetic polynucleotide sequence
gatgtagaccccagctgcaga

SEQ ID NO: 43871 - DNA, 18 bp, Artificial sequence
  synthetic polynucleotide sequence
gccccacctgtgcatcca

SEQ ID NO: 43872 - DNA, 21 bp, Artificial sequence
  synthetic polynucleotide sequence
ctcctgcgtacataacagcca

SEQ ID NO: 43873 - DNA, 20 bp, Artificial sequence
  synthetic polynucleotide sequence
tcacagacctgagcagcgca

SEQ ID NO: 43874 - DNA, 18 bp, Artificial sequence
  synthetic polynucleotide sequence
ccacctcagagccggcca

SEQ ID NO: 43875 - DNA, 19 bp, Artificial sequence
  synthetic polynucleotide sequence
tggatccctggcaagtgga

SEQ ID NO: 43876 - DNA, 21 bp, Artificial sequence
  synthetic polynucleotide sequence
ctgctcaacatcaggcctcca

SEQ ID NO: 43877 - DNA, 21 bp, Artificial sequence
  synthetic polynucleotide sequence
ggagcccagatatccagggaa

SEQ ID NO: 43878 - DNA, 21 bp, Artificial sequence
  synthetic polynucleotide sequence
tgctccctgaactgctcgaca

SEQ ID NO: 43879 - DNA, 21 bp, Artificial sequence
  synthetic polynucleotide sequence
aacgaagcaagctcaccacca

SEQ ID NO: 43880 - DNA, 22 bp, Artificial sequence
  synthetic polynucleotide sequence
taggagacagcagacacagcca

SEQ ID NO: 43881 - DNA, 21 bp, Artificial sequence
  synthetic polynucleotide sequence
cataggcatggtgggaggcta

SEQ ID NO: 43882 - DNA, 22 bp, Artificial sequence
  synthetic polynucleotide sequence
acaatgagtgctgaagagggga

SEQ ID NO: 43883 - DNA, 21 bp, Artificial sequence
  synthetic polynucleotide sequence
tcccccactggaaaggagtca

SEQ ID NO: 43884 - DNA, 21 bp, Artificial sequence
  synthetic polynucleotide sequence
agaggacaacaagcacagcca

SEQ ID NO: 43885 - DNA, 18 bp, Artificial sequence
  synthetic polynucleotide sequence
cagtgccgtgggtaccca

SEQ ID NO: 43886 - DNA, 19 bp, Artificial sequence
  synthetic polynucleotide sequence
tgtcagcagcttgaccaga

SEQ ID NO: 43887 - DNA, 22 bp, Artificial sequence
  synthetic polynucleotide sequence
caaattcaactgggacccggaa

SEQ ID NO: 43888 - DNA, 20 bp, Artificial sequence
  synthetic polynucleotide sequence
ctgttggctgccagccgaga

SEQ ID NO: 43889 - DNA, 20 bp, Artificial sequence
  synthetic polynucleotide sequence
aagcacaagactcgggagga

SEQ ID NO: 43890 - DNA, 18 bp, Artificial sequence
  synthetic polynucleotide sequence
tgtcgtcactgccagcca

SEQ ID NO: 43891 - DNA, 21 bp, Artificial sequence
  synthetic polynucleotide sequence
agcgacccttgatgaggaaga

SEQ ID NO: 43892 - DNA, 22 bp, Artificial sequence
  synthetic polynucleotide sequence
gaagacagaagtgcctctcaga

SEQ ID NO: 43893 - DNA, 21 bp, Artificial sequence
  synthetic polynucleotide sequence
cggcctccagaccttcaacca

SEQ ID NO: 43894 - DNA, 21 bp, Artificial sequence
  synthetic polynucleotide sequence
tctgagcctgtccaaacacca

SEQ ID NO: 43895 - DNA, 20 bp, Artificial sequence
  synthetic polynucleotide sequence
atgtgctcccccaagtggca

SEQ ID NO: 43896 - DNA, 19 bp, Artificial sequence
  synthetic polynucleotide sequence
tagggaacacagccaccga

SEQ ID NO: 43897 - DNA, 22 bp, Artificial sequence
  synthetic polynucleotide sequence
ttggaagatggctctggaggaa

SEQ ID NO: 43898 - DNA, 20 bp, Artificial sequence
  synthetic polynucleotide sequence
tgggggcagggagaaccaga

SEQ ID NO: 43899 - DNA, 20 bp, Artificial sequence
  synthetic polynucleotide sequence
cgtctacgccatcgccgaca

SEQ ID NO: 43900 - DNA, 19 bp, Artificial sequence
  synthetic polynucleotide sequence
gaacgggagcgcgtcagga

SEQ ID NO: 43901 - DNA, 18 bp, Artificial sequence
  synthetic polynucleotide sequence
ctggagggaccacgcgca

SEQ ID NO: 43902 - DNA, 22 bp, Artificial sequence
  synthetic polynucleotide sequence
ctaagttcaccgaagctgccga

SEQ ID NO: 43903 - DNA, 18 bp, Artificial sequence
  synthetic polynucleotide sequence
aggcgggaagctgggaca

SEQ ID NO: 43904 - DNA, 20 bp, Artificial sequence
  synthetic polynucleotide sequence
gtccacctcgttccacagga

SEQ ID NO: 43905 - DNA, 20 bp, Artificial sequence
  synthetic polynucleotide sequence
gacaccccagcttctaacca

SEQ ID NO: 43906 - DNA, 19 bp, Artificial sequence
  synthetic polynucleotide sequence
ccagcagagaagagggcga

SEQ ID NO: 43907 - DNA, 19 bp, Artificial sequence
  synthetic polynucleotide sequence
ggctactgcaggagcgtca

SEQ ID NO: 43908 - DNA, 20 bp, Artificial sequence
  synthetic polynucleotide sequence
aaaggaaagccacggagaca

SEQ ID NO: 43909 - DNA, 20 bp, Artificial sequence
  synthetic polynucleotide sequence
caccatcagtatcacggcca

SEQ ID NO: 43910 - DNA, 18 bp, Artificial sequence
  synthetic polynucleotide sequence
ggcccacggcactcagca

SEQ ID NO: 43911 - DNA, 18 bp, Artificial sequence
  synthetic polynucleotide sequence
atgaagcggtagccgcca

SEQ ID NO: 43912 - DNA, 20 bp, Artificial sequence
  synthetic polynucleotide sequence
aatgaggagcatggtgacca

SEQ ID NO: 43913 - DNA, 18 bp, Artificial sequence
  synthetic polynucleotide sequence
gacaagcgcgtcaccaga

SEQ ID NO: 43914 - DNA, 18 bp, Artificial sequence
  synthetic polynucleotide sequence
ccgcgatgatgagcgtga

SEQ ID NO: 43915 - DNA, 18 bp, Artificial sequence
  synthetic polynucleotide sequence
ccctcaacgaggcgacga

SEQ ID NO: 43916 - DNA, 18 bp, Artificial sequence
  synthetic polynucleotide sequence
tccccaggctggtcacca

SEQ ID NO: 43917 - DNA, 18 bp, Artificial sequence
  synthetic polynucleotide sequence
atggcgtggccaagcaca

SEQ ID NO: 43918 - DNA, 18 bp, Artificial sequence
  synthetic polynucleotide sequence
acgctgtggccgtgacca

SEQ ID NO: 43919 - DNA, 18 bp, Artificial sequence
  synthetic polynucleotide sequence
aggcgggtctggtcacca

SEQ ID NO: 43920 - DNA, 18 bp, Artificial sequence
  synthetic polynucleotide sequence
tgcgaagccggtcaagga

SEQ ID NO: 43921 - DNA, 21 bp, Artificial sequence
  synthetic polynucleotide sequence
gctggagaacaaccacatcga

SEQ ID NO: 43922 - DNA, 20 bp, Artificial sequence
  synthetic polynucleotide sequence
ggcgatgaagatggcggcca

SEQ ID NO: 43923 - DNA, 18 bp, Artificial sequence
  synthetic polynucleotide sequence
ccagaccatggggaagga

SEQ ID NO: 43924 - DNA, 21 bp, Artificial sequence
  synthetic polynucleotide sequence
caacagacacaacagagccca

SEQ ID NO: 43925 - DNA, 19 bp, Artificial sequence
  synthetic polynucleotide sequence
ctgaccagccgcgagagga

SEQ ID NO: 43926 - DNA, 20 bp, Artificial sequence
  synthetic polynucleotide sequence
gacccagaggcctgtgcaga

SEQ ID NO: 43927 - DNA, 20 bp, Artificial sequence
  synthetic polynucleotide sequence
tcaggggctcatcctgcaca

SEQ ID NO: 43928 - DNA, 20 bp, Artificial sequence
  synthetic polynucleotide sequence
ggctatgaaggcccccggga

SEQ ID NO: 43929 - DNA, 20 bp, Artificial sequence
  synthetic polynucleotide sequence
ggaggcatcataggtggcca

SEQ ID NO: 43930 - DNA, 20 bp, Artificial sequence
  synthetic polynucleotide sequence
gtgggagcgaaggcagcgca

SEQ ID NO: 43931 - DNA, 20 bp, Artificial sequence
  synthetic polynucleotide sequence
aagcctaacctgcctcacca

SEQ ID NO: 43932 - DNA, 20 bp, Artificial sequence
  synthetic polynucleotide sequence
atagaggagaggaggcagca

SEQ ID NO: 43933 - DNA, 18 bp, Artificial sequence
  synthetic polynucleotide sequence
ggagctgagcatgggcca

SEQ ID NO: 43934 - DNA, 18 bp, Artificial sequence
  synthetic polynucleotide sequence
gctgggatgtccacgaca

SEQ ID NO: 43935 - DNA, 21 bp, Artificial sequence
  synthetic polynucleotide sequence
ccagcttggggaaggaaagga

SEQ ID NO: 43936 - DNA, 20 bp, Artificial sequence
  synthetic polynucleotide sequence
accctgcatgggccctggaa

SEQ ID NO: 43937 - DNA, 21 bp, Artificial sequence
  synthetic polynucleotide sequence
ctgtgactctcctccaagcca

SEQ ID NO: 43938 - DNA, 21 bp, Artificial sequence
  synthetic polynucleotide sequence
ggagctcagcggtgtagagga

SEQ ID NO: 43939 - DNA, 18 bp, Artificial sequence
  synthetic polynucleotide sequence
cacacccagccaacagga

SEQ ID NO: 43940 - DNA, 21 bp, Artificial sequence
  synthetic polynucleotide sequence
cccgcactcagagttaggcca

SEQ ID NO: 43941 - DNA, 21 bp, Artificial sequence
  synthetic polynucleotide sequence
atggacaaggtcgggaggaga

SEQ ID NO: 43942 - DNA, 20 bp, Artificial sequence
  synthetic polynucleotide sequence
gtccacagagaacggcgcca

SEQ ID NO: 43943 - DNA, 21 bp, Artificial sequence
  synthetic polynucleotide sequence
tctccatgacccttaccggca

SEQ ID NO: 43944 - DNA, 19 bp, Artificial sequence
  synthetic polynucleotide sequence
ccaagcgcccctagagcca

SEQ ID NO: 43945 - DNA, 18 bp, Artificial sequence
  synthetic polynucleotide sequence
acgtggtcaccgacagca

SEQ ID NO: 43946 - DNA, 19 bp, Artificial sequence
  synthetic polynucleotide sequence
ggtcccagagttcggagca

SEQ ID NO: 43947 - DNA, 20 bp, Artificial sequence
  synthetic polynucleotide sequence
gcagaaggactgcctgggca

SEQ ID NO: 43948 - DNA, 18 bp, Artificial sequence
  synthetic polynucleotide sequence
cacaagtgggcggcggga

SEQ ID NO: 43949 - DNA, 18 bp, Artificial sequence
  synthetic polynucleotide sequence
ggtggcatcatcacgcca

SEQ ID NO: 43950 - DNA, 19 bp, Artificial sequence
  synthetic polynucleotide sequence
tcctcgatggtctcaggca

SEQ ID NO: 43951 - DNA, 19 bp, Artificial sequence
  synthetic polynucleotide sequence
cgcgcatgggactacggca

SEQ ID NO: 43952 - DNA, 18 bp, Artificial sequence
  synthetic polynucleotide sequence
cggccgacccagtcagca

SEQ ID NO: 43953 - DNA, 20 bp, Artificial sequence
  synthetic polynucleotide sequence
ggacattgccccggtcacga

SEQ ID NO: 43954 - DNA, 20 bp, Artificial sequence
  synthetic polynucleotide sequence
gtgccagtcctgaatggcaa

SEQ ID NO: 43955 - DNA, 20 bp, Artificial sequence
  synthetic polynucleotide sequence
cgagaccagtgcatcctcca

SEQ ID NO: 43956 - DNA, 21 bp, Artificial sequence
  synthetic polynucleotide sequence
gataatgagccaccgagcaga

SEQ ID NO: 43957 - DNA, 19 bp, Artificial sequence
  synthetic polynucleotide sequence
cggcttcctgactggagca

SEQ ID NO: 43958 - DNA, 18 bp, Artificial sequence
  synthetic polynucleotide sequence
ttggtgcaaaggccacca

SEQ ID NO: 43959 - DNA, 20 bp, Artificial sequence
  synthetic polynucleotide sequence
ctggggcccagtatctgcca

SEQ ID NO: 43960 - DNA, 18 bp, Artificial sequence
  synthetic polynucleotide sequence
ggaagacctcggccgcga

SEQ ID NO: 43961 - DNA, 18 bp, Artificial sequence
  synthetic polynucleotide sequence
ggaaggtgcccctcacca

SEQ ID NO: 43962 - DNA, 18 bp, Artificial sequence
  synthetic polynucleotide sequence
tgcaggaagctgaagcca

SEQ ID NO: 43963 - DNA, 20 bp, Artificial sequence
  synthetic polynucleotide sequence
gtctacgtgtacacagccga

SEQ ID NO: 43964 - DNA, 18 bp, Artificial sequence
  synthetic polynucleotide sequence
aggaagcggtcgtaggca

SEQ ID NO: 43965 - DNA, 18 bp, Artificial sequence
  synthetic polynucleotide sequence
ggagctgaccatgggcaa

SEQ ID NO: 43966 - DNA, 18 bp, Artificial sequence
  synthetic polynucleotide sequence
ccacaagcttggcaggca

SEQ ID NO: 43967 - DNA, 18 bp, Artificial sequence
  synthetic polynucleotide sequence
gtggctgtcactgcccaa

SEQ ID NO: 43968 - DNA, 18 bp, Artificial sequence
  synthetic polynucleotide sequence
ggacctgcttcatgggca

SEQ ID NO: 43969 - DNA, 20 bp, Artificial sequence
  synthetic polynucleotide sequence
gaatcagcccttgccagaga

SEQ ID NO: 43970 - DNA, 20 bp, Artificial sequence
  synthetic polynucleotide sequence
tccgtgaggctgtagaggga

SEQ ID NO: 43971 - DNA, 18 bp, Artificial sequence
  synthetic polynucleotide sequence
accgtcgagcaagccaga

SEQ ID NO: 43972 - DNA, 19 bp, Artificial sequence
  synthetic polynucleotide sequence
gcagacgctcctaagccca

SEQ ID NO: 43973 - DNA, 18 bp, Artificial sequence
  synthetic polynucleotide sequence
caggggcatcttcaccga

SEQ ID NO: 43974 - DNA, 18 bp, Artificial sequence
  synthetic polynucleotide sequence
cgatggtgcccaggacca

SEQ ID NO: 43975 - DNA, 18 bp, Artificial sequence
  synthetic polynucleotide sequence
gccagctcattgggacca

SEQ ID NO: 43976 - DNA, 19 bp, Artificial sequence
  synthetic polynucleotide sequence
cggatccggggataccaga

SEQ ID NO: 43977 - DNA, 21 bp, Artificial sequence
  synthetic polynucleotide sequence
gctgacatagactctgggcga

SEQ ID NO: 43978 - DNA, 21 bp, Artificial sequence
  synthetic polynucleotide sequence
tccagcctgtgctgaacagga

SEQ ID NO: 43979 - DNA, 19 bp, Artificial sequence
  synthetic polynucleotide sequence
ccgacgtccgaaggcagga

SEQ ID NO: 43980 - DNA, 20 bp, Artificial sequence
  synthetic polynucleotide sequence
tcaccaacctggtgagccca

SEQ ID NO: 43981 - DNA, 21 bp, Artificial sequence
  synthetic polynucleotide sequence
cagtgtcatagtggcccggaa

SEQ ID NO: 43982 - DNA, 21 bp, Artificial sequence
  synthetic polynucleotide sequence
agaggatgacgaagagcagca

SEQ ID NO: 43983 - DNA, 18 bp, Artificial sequence
  synthetic polynucleotide sequence
gcagcaactgcgacgcaa

SEQ ID NO: 43984 - DNA, 19 bp, Artificial sequence
  synthetic polynucleotide sequence
cgaaggccagcctcagaga

SEQ ID NO: 43985 - DNA, 18 bp, Artificial sequence
  synthetic polynucleotide sequence
gacaaggccttggggaca

SEQ ID NO: 43986 - DNA, 18 bp, Artificial sequence
  synthetic polynucleotide sequence
tgagagcgacagagccca

SEQ ID NO: 43987 - DNA, 21 bp, Artificial sequence
  synthetic polynucleotide sequence
tcagagactgtgcagcgtaca

SEQ ID NO: 43988 - DNA, 20 bp, Artificial sequence
  synthetic polynucleotide sequence
gctttggcaagacaggcgca

SEQ ID NO: 43989 - DNA, 18 bp, Artificial sequence
  synthetic polynucleotide sequence
accagggcctcacagcca

SEQ ID NO: 43990 - DNA, 19 bp, Artificial sequence
  synthetic polynucleotide sequence
ggtaccagttgcgcaggga

SEQ ID NO: 43991 - DNA, 18 bp, Artificial sequence
  synthetic polynucleotide sequence
accatggcatccagccga

SEQ ID NO: 43992 - DNA, 18 bp, Artificial sequence
  synthetic polynucleotide sequence
catccaggggctggcaca

SEQ ID NO: 43993 - DNA, 21 bp, Artificial sequence
  synthetic polynucleotide sequence
ctcctactcccaatccaagca

SEQ ID NO: 43994 - DNA, 18 bp, Artificial sequence
  synthetic polynucleotide sequence
tggcaatgtccacaggca

SEQ ID NO: 43995 - DNA, 18 bp, Artificial sequence
  synthetic polynucleotide sequence
gaagaagggccctcagca

SEQ ID NO: 43996 - DNA, 18 bp, Artificial sequence
  synthetic polynucleotide sequence
tcagggttggcaggagga

SEQ ID NO: 43997 - DNA, 20 bp, Artificial sequence
  synthetic polynucleotide sequence
tactgcgtgaagaaggacca

SEQ ID NO: 43998 - DNA, 18 bp, Artificial sequence
  synthetic polynucleotide sequence
caggattcggggcaggca

SEQ ID NO: 43999 - DNA, 20 bp, Artificial sequence
  synthetic polynucleotide sequence
aagcaggcaaagctgagtga

SEQ ID NO: 44000 - DNA, 20 bp, Artificial sequence
  synthetic polynucleotide sequence
gagtccatggtagaacccca

SEQ ID NO: 44001 - DNA, 21 bp, Artificial sequence
  synthetic polynucleotide sequence
ttggcagaccttcatcagaca

SEQ ID NO: 44002 - DNA, 18 bp, Artificial sequence
  synthetic polynucleotide sequence
gcattcgccgacgagtca

SEQ ID NO: 44003 - DNA, 20 bp, Artificial sequence
  synthetic polynucleotide sequence
aagccaaactgctgcagaca

SEQ ID NO: 44004 - DNA, 18 bp, Artificial sequence
  synthetic polynucleotide sequence
gtgcacgcttcagcccca

SEQ ID NO: 44005 - DNA, 21 bp, Artificial sequence
  synthetic polynucleotide sequence
ctctggattcaggagggacca

SEQ ID NO: 44006 - DNA, 22 bp, Artificial sequence
  synthetic polynucleotide sequence
aagatgcgctctccaatcccaa

SEQ ID NO: 44007 - DNA, 18 bp, Artificial sequence
  synthetic polynucleotide sequence
agctcagggtgagcccaa

SEQ ID NO: 44008 - DNA, 18 bp, Artificial sequence
  synthetic polynucleotide sequence
acaccagctccactgcca

SEQ ID NO: 44009 - DNA, 21 bp, Artificial sequence
  synthetic polynucleotide sequence
gctggaatggacaagcaggca

SEQ ID NO: 44010 - DNA, 22 bp, Artificial sequence
  synthetic polynucleotide sequence
ggatacccttcacgacagacca

SEQ ID NO: 44011 - DNA, 20 bp, Artificial sequence
  synthetic polynucleotide sequence
catgactcctggagaacgga

SEQ ID NO: 44012 - DNA, 18 bp, Artificial sequence
  synthetic polynucleotide sequence
ccagccaccaagatccga

SEQ ID NO: 44013 - DNA, 21 bp, Artificial sequence
  synthetic polynucleotide sequence
ctccagggcctcaacaaagga

SEQ ID NO: 44014 - DNA, 21 bp, Artificial sequence
  synthetic polynucleotide sequence
attgtccccgagagaagacca

SEQ ID NO: 44015 - DNA, 19 bp, Artificial sequence
  synthetic polynucleotide sequence
tgccggtctctacaaggga

SEQ ID NO: 44016 - DNA, 20 bp, Artificial sequence
  synthetic polynucleotide sequence
ctggagccgcgtcttcacca

SEQ ID NO: 44017 - DNA, 18 bp, Artificial sequence
  synthetic polynucleotide sequence
cacgactcggcagaccca

SEQ ID NO: 44018 - DNA, 18 bp, Artificial sequence
  synthetic polynucleotide sequence
gcagacccagcatggaca

SEQ ID NO: 44019 - DNA, 21 bp, Artificial sequence
  synthetic polynucleotide sequence
atccggacaatggtggaggca

SEQ ID NO: 44020 - DNA, 20 bp, Artificial sequence
  synthetic polynucleotide sequence
taacagctgtctcaggagca

SEQ ID NO: 44021 - DNA, 18 bp, Artificial sequence
  synthetic polynucleotide sequence
gctgcggaagacaggcca

SEQ ID NO: 44022 - DNA, 18 bp, Artificial sequence
  synthetic polynucleotide sequence
tagtgctgcagccaggca

SEQ ID NO: 44023 - DNA, 20 bp, Artificial sequence
  synthetic polynucleotide sequence
ctctggtcctggaggcagga

SEQ ID NO: 44024 - DNA, 20 bp, Artificial sequence
  synthetic polynucleotide sequence
aatcctgccagcccctgtga

SEQ ID NO: 44025 - DNA, 20 bp, Artificial sequence
  synthetic polynucleotide sequence
gcaaggagtgacacccgcca

SEQ ID NO: 44026 - DNA, 21 bp, Artificial sequence
  synthetic polynucleotide sequence
acaccagccatcatccctcca

SEQ ID NO: 44027 - DNA, 19 bp, Artificial sequence
  synthetic polynucleotide sequence
gcggaagtggtcaagcaga

SEQ ID NO: 44028 - DNA, 19 bp, Artificial sequence
  synthetic polynucleotide sequence
ctccagagaggacgtggga

SEQ ID NO: 44029 - DNA, 19 bp, Artificial sequence
  synthetic polynucleotide sequence
tggctactccatgcaggga

SEQ ID NO: 44030 - DNA, 18 bp, Artificial sequence
  synthetic polynucleotide sequence
tccataggagccagggca

SEQ ID NO: 44031 - DNA, 21 bp, Artificial sequence
  synthetic polynucleotide sequence
aggggacaagaggactgtgga

SEQ ID NO: 44032 - DNA, 18 bp, Artificial sequence
  synthetic polynucleotide sequence
agggcccctgccagacca

SEQ ID NO: 44033 - DNA, 21 bp, Artificial sequence
  synthetic polynucleotide sequence
tgcaggcgtcgtcgaagcaga

SEQ ID NO: 44034 - DNA, 19 bp, Artificial sequence
  synthetic polynucleotide sequence
ttgccaaattgccacgcca

SEQ ID NO: 44035 - DNA, 20 bp, Artificial sequence
  synthetic polynucleotide sequence
tggagccatgaccctctgca

SEQ ID NO: 44036 - DNA, 22 bp, Artificial sequence
  synthetic polynucleotide sequence
cgatgttccaaacagcccagga

SEQ ID NO: 44037 - DNA, 18 bp, Artificial sequence
  synthetic polynucleotide sequence
ggctccgggaagagggca

SEQ ID NO: 44038 - DNA, 21 bp, Artificial sequence
  synthetic polynucleotide sequence
atctgccggataagctgggca

SEQ ID NO: 44039 - DNA, 21 bp, Artificial sequence
  synthetic polynucleotide sequence
gcctcaccgactgcatggtga

SEQ ID NO: 44040 - DNA, 19 bp, Artificial sequence
  synthetic polynucleotide sequence
ccgcccagccagtttccga

SEQ ID NO: 44041 - DNA, 21 bp, Artificial sequence
  synthetic polynucleotide sequence
gggcaagaaccgagtccccaa

SEQ ID NO: 44042 - DNA, 20 bp, Artificial sequence
  synthetic polynucleotide sequence
cccaggagaatcgggctgca

SEQ ID NO: 44043 - DNA, 22 bp, Artificial sequence
  synthetic polynucleotide sequence
gcaatcacagcaaccaacccca

SEQ ID NO: 44044 - DNA, 20 bp, Artificial sequence
  synthetic polynucleotide sequence
atgaagcagacatgccccta

SEQ ID NO: 44045 - DNA, 18 bp, Artificial sequence
  synthetic polynucleotide sequence
acgctgccctgaggagca

SEQ ID NO: 44046 - DNA, 18 bp, Artificial sequence
  synthetic polynucleotide sequence
ccacctggtcatgaggca

SEQ ID NO: 44047 - DNA, 19 bp, Artificial sequence
  synthetic polynucleotide sequence
gccccactgcccttcgaga

SEQ ID NO: 44048 - DNA, 21 bp, Artificial sequence
  synthetic polynucleotide sequence
gtagagtcagcactgcagcca

SEQ ID NO: 44049 - DNA, 18 bp, Artificial sequence
  synthetic polynucleotide sequence
agtgtgacggcagtcgca

SEQ ID NO: 44050 - DNA, 18 bp, Artificial sequence
  synthetic polynucleotide sequence
agcacattggaccaggca

SEQ ID NO: 44051 - DNA, 25 bp, Artificial sequence
  synthetic polynucleotide sequence
gaagccaggaaatttccagggaaca

SEQ ID NO: 44052 - DNA, 23 bp, Artificial sequence
  synthetic polynucleotide sequence
ggaggaaggccactccatagaga

SEQ ID NO: 44053 - DNA, 21 bp, Artificial sequence
  synthetic polynucleotide sequence
gcaggcccaagataccgtgga

SEQ ID NO: 44054 - DNA, 21 bp, Artificial sequence
  synthetic polynucleotide sequence
ccttcagtagcgtgggggtca

SEQ ID NO: 44055 - DNA, 20 bp, Artificial sequence
  synthetic polynucleotide sequence
cccacccctgcacacagcca

SEQ ID NO: 44056 - DNA, 22 bp, Artificial sequence
  synthetic polynucleotide sequence
agaccaagaccagtgaccagca

SEQ ID NO: 44057 - DNA, 20 bp, Artificial sequence
  synthetic polynucleotide sequence
ctcagagcccctacctccca

SEQ ID NO: 44058 - DNA, 21 bp, Artificial sequence
  synthetic polynucleotide sequence
tcaatccattccagagcccca

SEQ ID NO: 44059 - DNA, 22 bp, Artificial sequence
  synthetic polynucleotide sequence
atgtcatacgaacccgtgtgca

SEQ ID NO: 44060 - DNA, 22 bp, Artificial sequence
  synthetic polynucleotide sequence
atggtggaaggtgtggctgaga

SEQ ID NO: 44061 - DNA, 21 bp, Artificial sequence
  synthetic polynucleotide sequence
tcccggatgcagatggatgga

SEQ ID NO: 44062 - DNA, 20 bp, Artificial sequence
  synthetic polynucleotide sequence
gttgatggtgaccccccgga

SEQ ID NO: 44063 - DNA, 21 bp, Artificial sequence
  synthetic polynucleotide sequence
tcacacttggagcagaaggca

SEQ ID NO: 44064 - DNA, 23 bp, Artificial sequence
  synthetic polynucleotide sequence
taaaaaggcattgccaccacgta

SEQ ID NO: 44065 - DNA, 19 bp, Artificial sequence
  synthetic polynucleotide sequence
gactgcaggcagacgggca

SEQ ID NO: 44066 - DNA, 18 bp, Artificial sequence
  synthetic polynucleotide sequence
gacagggaaggcgcggca

SEQ ID NO: 44067 - DNA, 18 bp, Artificial sequence
  synthetic polynucleotide sequence
ccttccccctcgccagca

SEQ ID NO: 44068 - DNA, 18 bp, Artificial sequence
  synthetic polynucleotide sequence
tctgacagcgtgcgggga

SEQ ID NO: 44069 - DNA, 18 bp, Artificial sequence
  synthetic polynucleotide sequence
gcgcggtaacctggccaa

SEQ ID NO: 44070 - DNA, 18 bp, Artificial sequence
  synthetic polynucleotide sequence
gcaccacccgatgccaga

SEQ ID NO: 44071 - DNA, 19 bp, Artificial sequence
  synthetic polynucleotide sequence
tgcagggacaacagaagca

SEQ ID NO: 44072 - DNA, 20 bp, Artificial sequence
  synthetic polynucleotide sequence
aatgggacctcgaaggccga

SEQ ID NO: 44073 - DNA, 22 bp, Artificial sequence
  synthetic polynucleotide sequence
tgcagccttcaacaacgtcgca

SEQ ID NO: 44074 - DNA, 21 bp, Artificial sequence
  synthetic polynucleotide sequence
ttgcaaactctggagcacgga

SEQ ID NO: 44075 - DNA, 19 bp, Artificial sequence
  synthetic polynucleotide sequence
gccaggaacagcctgggga

SEQ ID NO: 44076 - DNA, 21 bp, Artificial sequence
  synthetic polynucleotide sequence
acactaccagacaccaaggca

SEQ ID NO: 44077 - DNA, 18 bp, Artificial sequence
  synthetic polynucleotide sequence
acgatacggccaagggca

SEQ ID NO: 44078 - DNA, 20 bp, Artificial sequence
  synthetic polynucleotide sequence
cgtgtcgaaggggtaggaca

SEQ ID NO: 44079 - DNA, 19 bp, Artificial sequence
  synthetic polynucleotide sequence
gtgagggacggcgcccaca

SEQ ID NO: 44080 - DNA, 20 bp, Artificial sequence
  synthetic polynucleotide sequence
agccatgctgaggctcggga

SEQ ID NO: 44081 - DNA, 20 bp, Artificial sequence
  synthetic polynucleotide sequence
ggacactgacccgggtagga

SEQ ID NO: 44082 - DNA, 20 bp, Artificial sequence
  synthetic polynucleotide sequence
aagcagctgcatcctgcaca

SEQ ID NO: 44083 - DNA, 20 bp, Artificial sequence
  synthetic polynucleotide sequence
ctcctacccggtcacaggca

SEQ ID NO: 44084 - DNA, 21 bp, Artificial sequence
  synthetic polynucleotide sequence
acagcaggaaggtcacgcaca

SEQ ID NO: 44085 - DNA, 20 bp, Artificial sequence
  synthetic polynucleotide sequence
agcagggatccacacactga

SEQ ID NO: 44086 - DNA, 19 bp, Artificial sequence
  synthetic polynucleotide sequence
ggattgcactgagccagca

SEQ ID NO: 44087 - DNA, 19 bp, Artificial sequence
  synthetic polynucleotide sequence
tctgacgaagagctggaca

SEQ ID NO: 44088 - DNA, 18 bp, Artificial sequence
  synthetic polynucleotide sequence
tgaggctgtggaggctga

SEQ ID NO: 44089 - DNA, 20 bp, Artificial sequence
  synthetic polynucleotide sequence
ggaaccggtgggaagacaca

SEQ ID NO: 44090 - DNA, 21 bp, Artificial sequence
  synthetic polynucleotide sequence
caatcacaatggccgacagca

SEQ ID NO: 44091 - DNA, 19 bp, Artificial sequence
  synthetic polynucleotide sequence
tccgggagattgaggtgga

SEQ ID NO: 44092 - DNA, 21 bp, Artificial sequence
  synthetic polynucleotide sequence
acagcatcatggacagaggca

SEQ ID NO: 44093 - DNA, 20 bp, Artificial sequence
  synthetic polynucleotide sequence
tgctgctgccatgggaagga

SEQ ID NO: 44094 - DNA, 21 bp, Artificial sequence
  synthetic polynucleotide sequence
ttgcaaggacacacatgggca

SEQ ID NO: 44095 - DNA, 21 bp, Artificial sequence
  synthetic polynucleotide sequence
caccgaccccaacaacaacca

SEQ ID NO: 44096 - DNA, 21 bp, Artificial sequence
  synthetic polynucleotide sequence
tgagggtgtggaaggtgacga

SEQ ID NO: 44097 - DNA, 18 bp, Artificial sequence
  synthetic polynucleotide sequence
ccgagtgcaactgcagca

SEQ ID NO: 44098 - DNA, 18 bp, Artificial sequence
  synthetic polynucleotide sequence
atgcagaggccctgggca

SEQ ID NO: 44099 - DNA, 18 bp, Artificial sequence
  synthetic polynucleotide sequence
gggaaaatgtggccacca

SEQ ID NO: 44100 - DNA, 18 bp, Artificial sequence
  synthetic polynucleotide sequence
gaggccatgccaatgcga

SEQ ID NO: 44101 - DNA, 21 bp, Artificial sequence
  synthetic polynucleotide sequence
agtctttggccaccacagaga

SEQ ID NO: 44102 - DNA, 19 bp, Artificial sequence
  synthetic polynucleotide sequence
cgggcagttgtgaggggca

SEQ ID NO: 44103 - DNA, 20 bp, Artificial sequence
  synthetic polynucleotide sequence
ccaagcacagaacacctgga

SEQ ID NO: 44104 - DNA, 20 bp, Artificial sequence
  synthetic polynucleotide sequence
atagtacaccagggcagcca

SEQ ID NO: 44105 - DNA, 20 bp, Artificial sequence
  synthetic polynucleotide sequence
tactggccatggaccgcgaa

SEQ ID NO: 44106 - DNA, 20 bp, Artificial sequence
  synthetic polynucleotide sequence
ctgcgacaacacgccctcca

SEQ ID NO: 44107 - DNA, 20 bp, Artificial sequence
  synthetic polynucleotide sequence
ctgatgagcaatgagccgga

SEQ ID NO: 44108 - DNA, 18 bp, Artificial sequence
  synthetic polynucleotide sequence
ccacaggcgcggatgcaa

SEQ ID NO: 44109 - DNA, 20 bp, Artificial sequence
  synthetic polynucleotide sequence
cggcgacaggaagcagtgga

SEQ ID NO: 44110 - DNA, 20 bp, Artificial sequence
  synthetic polynucleotide sequence
catggaggtcaagcctccca

SEQ ID NO: 44111 - DNA, 20 bp, Artificial sequence
  synthetic polynucleotide sequence
ccccgtgggaaggagaggaa

SEQ ID NO: 44112 - DNA, 22 bp, Artificial sequence
  synthetic polynucleotide sequence
ttgatgaaggccaacacagcca

SEQ ID NO: 44113 - DNA, 20 bp, Artificial sequence
  synthetic polynucleotide sequence
caagtctgaactccacgcca

SEQ ID NO: 44114 - DNA, 18 bp, Artificial sequence
  synthetic polynucleotide sequence
gcagcagccaatgacgca

SEQ ID NO: 44115 - DNA, 18 bp, Artificial sequence
  synthetic polynucleotide sequence
cagagaccgcaggagcca

SEQ ID NO: 44116 - DNA, 18 bp, Artificial sequence
  synthetic polynucleotide sequence
tgcccggaacaggaagga

SEQ ID NO: 44117 - DNA, 19 bp, Artificial sequence
  synthetic polynucleotide sequence
gctccaccagtcctgggaa

SEQ ID NO: 44118 - DNA, 18 bp, Artificial sequence
  synthetic polynucleotide sequence
tctggggcacgtggcaca

SEQ ID NO: 44119 - DNA, 21 bp, Artificial sequence
  synthetic polynucleotide sequence
acctatgtggccggcagctca

SEQ ID NO: 44120 - DNA, 20 bp, Artificial sequence
  synthetic polynucleotide sequence
acagagcacgaagaggggga

SEQ ID NO: 44121 - DNA, 18 bp, Artificial sequence
  synthetic polynucleotide sequence
gggtgatctgggccgaca

SEQ ID NO: 44122 - DNA, 18 bp, Artificial sequence
  synthetic polynucleotide sequence
gaagaccacacgcaggca

SEQ ID NO: 44123 - DNA, 20 bp, Artificial sequence
  synthetic polynucleotide sequence
ctccacgagcatcttcgaga

SEQ ID NO: 44124 - DNA, 19 bp, Artificial sequence
  synthetic polynucleotide sequence
cagggtagctgctccagca

SEQ ID NO: 44125 - DNA, 20 bp, Artificial sequence
  synthetic polynucleotide sequence
agcttcaactgggcggccaa

SEQ ID NO: 44126 - DNA, 20 bp, Artificial sequence
  synthetic polynucleotide sequence
ctcgatgcggctgtacggga

SEQ ID NO: 44127 - DNA, 19 bp, Artificial sequence
  synthetic polynucleotide sequence
cggggatcctggccacaga

SEQ ID NO: 44128 - DNA, 21 bp, Artificial sequence
  synthetic polynucleotide sequence
gtctcaggaaggaacaggcca

SEQ ID NO: 44129 - DNA, 20 bp, Artificial sequence
  synthetic polynucleotide sequence
ctggtgggatcagaggacga

SEQ ID NO: 44130 - DNA, 19 bp, Artificial sequence
  synthetic polynucleotide sequence
gcacacccatggcaggcca

SEQ ID NO: 44131 - DNA, 19 bp, Artificial sequence
  synthetic polynucleotide sequence
gcacctggaatgggaccaa

SEQ ID NO: 44132 - DNA, 20 bp, Artificial sequence
  synthetic polynucleotide sequence
tggtctcaggaagacagcca

SEQ ID NO: 44133 - DNA, 21 bp, Artificial sequence
  synthetic polynucleotide sequence
aacagcccatctatgccacca

SEQ ID NO: 44134 - DNA, 21 bp, Artificial sequence
  synthetic polynucleotide sequence
aagccatccctccaaggccta

SEQ ID NO: 44135 - DNA, 18 bp, Artificial sequence
  synthetic polynucleotide sequence
aaattgggccaggcccga

SEQ ID NO: 44136 - DNA, 18 bp, Artificial sequence
  synthetic polynucleotide sequence
aaggccaggagcactcca

SEQ ID NO: 44137 - DNA, 21 bp, Artificial sequence
  synthetic polynucleotide sequence
aagagcccatctatgccacca

SEQ ID NO: 44138 - DNA, 21 bp, Artificial sequence
  synthetic polynucleotide sequence
aagccatccctccaaggccta

SEQ ID NO: 44139 - DNA, 18 bp, Artificial sequence
  synthetic polynucleotide sequence
cctggggacgctcaacca

SEQ ID NO: 44140 - DNA, 18 bp, Artificial sequence
  synthetic polynucleotide sequence
agaagggcagcaggacca

SEQ ID NO: 44141 - DNA, 19 bp, Artificial sequence
  synthetic polynucleotide sequence
gacgggctgtccagcctga

SEQ ID NO: 44142 - DNA, 18 bp, Artificial sequence
  synthetic polynucleotide sequence
gccgcaggggactaggca

SEQ ID NO: 44143 - DNA, 20 bp, Artificial sequence
  synthetic polynucleotide sequence
ctgctgtcaactccccagca

SEQ ID NO: 44144 - DNA, 18 bp, Artificial sequence
  synthetic polynucleotide sequence
cgaccaggagggatccga

SEQ ID NO: 44145 - DNA, 18 bp, Artificial sequence
  synthetic polynucleotide sequence
cgccttcgtcctcaccaa

SEQ ID NO: 44146 - DNA, 18 bp, Artificial sequence
  synthetic polynucleotide sequence
gtcccttggtctcgggca

SEQ ID NO: 44147 - DNA, 18 bp, Artificial sequence
  synthetic polynucleotide sequence
agggcgtggcgacaggca

SEQ ID NO: 44148 - DNA, 18 bp, Artificial sequence
  synthetic polynucleotide sequence
aagcggaggcaagccaga

SEQ ID NO: 44149 - DNA, 21 bp, Artificial sequence
  synthetic polynucleotide sequence
atccctccggcaaagatccca

SEQ ID NO: 44150 - DNA, 21 bp, Artificial sequence
  synthetic polynucleotide sequence
ccacgatactcaggtagggga

SEQ ID NO: 44151 - DNA, 22 bp, Artificial sequence
  synthetic polynucleotide sequence
cagaagaacacgttcggctgga

SEQ ID NO: 44152 - DNA, 20 bp, Artificial sequence
  synthetic polynucleotide sequence
cggctcgatgaagcgctcga

SEQ ID NO: 44153 - DNA, 20 bp, Artificial sequence
  synthetic polynucleotide sequence
gaggacccgtgtaactggca

SEQ ID NO: 44154 - DNA, 21 bp, Artificial sequence
  synthetic polynucleotide sequence
cttgataagcgggaaggcaga

SEQ ID NO: 44155 - DNA, 19 bp, Artificial sequence
  synthetic polynucleotide sequence
ggagaaccccagcgtccga

SEQ ID NO: 44156 - DNA, 19 bp, Artificial sequence
  synthetic polynucleotide sequence
tctaccccctccaccgaca

SEQ ID NO: 44157 - DNA, 18 bp, Artificial sequence
  synthetic polynucleotide sequence
acaaggcagccgacccca

SEQ ID NO: 44158 - DNA, 18 bp, Artificial sequence
  synthetic polynucleotide sequence
gatggccaggtgtgcaga

SEQ ID NO: 44159 - DNA, 18 bp, Artificial sequence
  synthetic polynucleotide sequence
gaccctccaggccgacga

SEQ ID NO: 44160 - DNA, 22 bp, Artificial sequence
  synthetic polynucleotide sequence
tacagaacggcagcaatggtca

SEQ ID NO: 44161 - DNA, 21 bp, Artificial sequence
  synthetic polynucleotide sequence
gcccatagccatgcccatgga

SEQ ID NO: 44162 - DNA, 21 bp, Artificial sequence
  synthetic polynucleotide sequence
gcattcatgcctccacccgca

SEQ ID NO: 44163 - DNA, 20 bp, Artificial sequence
  synthetic polynucleotide sequence
ctccagacaacaccacccca

SEQ ID NO: 44164 - DNA, 22 bp, Artificial sequence
  synthetic polynucleotide sequence
taaggcaggcctaatccagtca

SEQ ID NO: 44165 - DNA, 20 bp, Artificial sequence
  synthetic polynucleotide sequence
ctctacggcatctggagcaa

SEQ ID NO: 44166 - DNA, 20 bp, Artificial sequence
  synthetic polynucleotide sequence
gtggacatctggaggggcta

SEQ ID NO: 44167 - DNA, 21 bp, Artificial sequence
  synthetic polynucleotide sequence
cctccctctaagcggctgaca

SEQ ID NO: 44168 - DNA, 20 bp, Artificial sequence
  synthetic polynucleotide sequence
cagcaggcgctcacatgcca

SEQ ID NO: 44169 - DNA, 21 bp, Artificial sequence
  synthetic polynucleotide sequence
aagccacgctccagaacagca

SEQ ID NO: 44170 - DNA, 23 bp, Artificial sequence
  synthetic polynucleotide sequence
aaaatccgtacggatgagaagga

SEQ ID NO: 44171 - DNA, 21 bp, Artificial sequence
  synthetic polynucleotide sequence
atggtggaggagacagcagca

SEQ ID NO: 44172 - DNA, 21 bp, Artificial sequence
  synthetic polynucleotide sequence
ctgccacaaaagctccagcca

SEQ ID NO: 44173 - DNA, 18 bp, Artificial sequence
  synthetic polynucleotide sequence
cgcagagacagacgggga

SEQ ID NO: 44174 - DNA, 22 bp, Artificial sequence
  synthetic polynucleotide sequence
atgatgaagtagccgatgacca

SEQ ID NO: 44175 - DNA, 18 bp, Artificial sequence
  synthetic polynucleotide sequence
gcaacggcggccagggaa

SEQ ID NO: 44176 - DNA, 21 bp, Artificial sequence
  synthetic polynucleotide sequence
aagaagtcgccagtgccggta

SEQ ID NO: 44177 - DNA, 21 bp, Artificial sequence
  synthetic polynucleotide sequence
gcacctctgtcaccaacacca

SEQ ID NO: 44178 - DNA, 22 bp, Artificial sequence
  synthetic polynucleotide sequence
ccatggatgttgaaggaggcca

SEQ ID NO: 44179 - DNA, 18 bp, Artificial sequence
  synthetic polynucleotide sequence
cttggaggaggcgcagga

SEQ ID NO: 44180 - DNA, 18 bp, Artificial sequence
  synthetic polynucleotide sequence
ttgagtccgaggcaggga

SEQ ID NO: 44181 - DNA, 19 bp, Artificial sequence
  synthetic polynucleotide sequence
ggcacatccatcaccagca

SEQ ID NO: 44182 - DNA, 19 bp, Artificial sequence
  synthetic polynucleotide sequence
ggaccagcactgtgagcca

SEQ ID NO: 44183 - DNA, 20 bp, Artificial sequence
  synthetic polynucleotide sequence
tcttggggagccccaaggaa

SEQ ID NO: 44184 - DNA, 22 bp, Artificial sequence
  synthetic polynucleotide sequence
acaagcgtaactccagcacaca

SEQ ID NO: 44185 - DNA, 21 bp, Artificial sequence
  synthetic polynucleotide sequence
tggtcatggcggaagtgctca

SEQ ID NO: 44186 - DNA, 22 bp, Artificial sequence
  synthetic polynucleotide sequence
gtccacatactgcaccaggaca

SEQ ID NO: 44187 - DNA, 19 bp, Artificial sequence
  synthetic polynucleotide sequence
cgtggtgctgagccaggca

SEQ ID NO: 44188 - DNA, 20 bp, Artificial sequence
  synthetic polynucleotide sequence
tgagagcacggcgttgacca

SEQ ID NO: 44189 - DNA, 21 bp, Artificial sequence
  synthetic polynucleotide sequence
tcttgatggcccaggttacca

SEQ ID NO: 44190 - DNA, 19 bp, Artificial sequence
  synthetic polynucleotide sequence
ccccactggaacgctccca

SEQ ID NO: 44191 - DNA, 18 bp, Artificial sequence
  synthetic polynucleotide sequence
ggaccacatgcgggctca

SEQ ID NO: 44192 - DNA, 18 bp, Artificial sequence
  synthetic polynucleotide sequence
aagctctgacccagggca

SEQ ID NO: 44193 - DNA, 18 bp, Artificial sequence
  synthetic polynucleotide sequence
agctccccagccaccaca

SEQ ID NO: 44194 - DNA, 20 bp, Artificial sequence
  synthetic polynucleotide sequence
gagcccactgtgaagaggca

SEQ ID NO: 44195 - DNA, 21 bp, Artificial sequence
  synthetic polynucleotide sequence
gctgacagcacaactgcacca

SEQ ID NO: 44196 - DNA, 23 bp, Artificial sequence
  synthetic polynucleotide sequence
cataaccataggtccgaactgga

SEQ ID NO: 44197 - DNA, 18 bp, Artificial sequence
  synthetic polynucleotide sequence
gcgcctccctcaccgtca

SEQ ID NO: 44198 - DNA, 21 bp, Artificial sequence
  synthetic polynucleotide sequence
gacaaacaaggtgcccagcca

SEQ ID NO: 44199 - DNA, 19 bp, Artificial sequence
  synthetic polynucleotide sequence
caggagggggcagaaggca

SEQ ID NO: 44200 - DNA, 20 bp, Artificial sequence
  synthetic polynucleotide sequence
cccagcgtcatcatccccca

SEQ ID NO: 44201 - DNA, 21 bp, Artificial sequence
  synthetic polynucleotide sequence
cggcctccagaatcccatcga

SEQ ID NO: 44202 - DNA, 22 bp, Artificial sequence
  synthetic polynucleotide sequence
caatggagagagtgaggctgga

SEQ ID NO: 44203 - DNA, 18 bp, Artificial sequence
  synthetic polynucleotide sequence
cgtcggccgaaacgctga

SEQ ID NO: 44204 - DNA, 19 bp, Artificial sequence
  synthetic polynucleotide sequence
cccacccagagaactgcca

SEQ ID NO: 44205 - DNA, 21 bp, Artificial sequence
  synthetic polynucleotide sequence
tcctctacgttggaaaccaca

SEQ ID NO: 44206 - DNA, 19 bp, Artificial sequence
  synthetic polynucleotide sequence
gctgctatgaaagccccga

SEQ ID NO: 44207 - DNA, 20 bp, Artificial sequence
  synthetic polynucleotide sequence
caattcggccgtgaccacca

SEQ ID NO: 44208 - DNA, 20 bp, Artificial sequence
  synthetic polynucleotide sequence
caccacgccggcaatgaaca

SEQ ID NO: 44209 - DNA, 21 bp, Artificial sequence
  synthetic polynucleotide sequence
caacccagtcaccagcaccaa

SEQ ID NO: 44210 - DNA, 19 bp, Artificial sequence
  synthetic polynucleotide sequence
gctgtggtgacggggagga

SEQ ID NO: 44211 - DNA, 19 bp, Artificial sequence
  synthetic polynucleotide sequence
gtgaagagctccgccccca

SEQ ID NO: 44212 - DNA, 20 bp, Artificial sequence
  synthetic polynucleotide sequence
cgtacgccgtgacgctctga

SEQ ID NO: 44213 - DNA, 21 bp, Artificial sequence
  synthetic polynucleotide sequence
agtgatcgggaggagtgggaa

SEQ ID NO: 44214 - DNA, 20 bp, Artificial sequence
  synthetic polynucleotide sequence
tgttgtagagcaggacccca

SEQ ID NO: 44215 - DNA, 18 bp, Artificial sequence
  synthetic polynucleotide sequence
cgccggtgatcatagcca

SEQ ID NO: 44216 - DNA, 22 bp, Artificial sequence
  synthetic polynucleotide sequence
atcggagcctggtagtacagca

SEQ ID NO: 44217 - DNA, 20 bp, Artificial sequence
  synthetic polynucleotide sequence
accgtccacgtcctgggcaa

SEQ ID NO: 44218 - DNA, 22 bp, Artificial sequence
  synthetic polynucleotide sequence
gaaagagtgagtgcgatgccca

SEQ ID NO: 44219 - DNA, 21 bp, Artificial sequence
  synthetic polynucleotide sequence
cgaactctgagccgagtggaa

SEQ ID NO: 44220 - DNA, 22 bp, Artificial sequence
  synthetic polynucleotide sequence
aagtctgctgtgagcaaggaga

SEQ ID NO: 44221 - DNA, 20 bp, Artificial sequence
  synthetic polynucleotide sequence
ctgggactagcagatgtgga

SEQ ID NO: 44222 - DNA, 21 bp, Artificial sequence
  synthetic polynucleotide sequence
cacccaacagacagacagcca

SEQ ID NO: 44223 - DNA, 20 bp, Artificial sequence
  synthetic polynucleotide sequence
agtgaggattgtggccgcca

SEQ ID NO: 44224 - DNA, 19 bp, Artificial sequence
  synthetic polynucleotide sequence
tgtagagggcagacatcga

SEQ ID NO: 44225 - DNA, 20 bp, Artificial sequence
  synthetic polynucleotide sequence
aagaagctgacggccacgga

SEQ ID NO: 44226 - DNA, 21 bp, Artificial sequence
  synthetic polynucleotide sequence
cagatgtagaggctgagccca

SEQ ID NO: 44227 - DNA, 19 bp, Artificial sequence
  synthetic polynucleotide sequence
ggaaggccaggggtgctga

SEQ ID NO: 44228 - DNA, 21 bp, Artificial sequence
  synthetic polynucleotide sequence
cgcctgcgctgagtgaaacca

SEQ ID NO: 44229 - DNA, 18 bp, Artificial sequence
  synthetic polynucleotide sequence
tgagcgccaccacccgca

SEQ ID NO: 44230 - DNA, 19 bp, Artificial sequence
  synthetic polynucleotide sequence
cagcggacggtgtagccca

SEQ ID NO: 44231 - DNA, 21 bp, Artificial sequence
  synthetic polynucleotide sequence
aagaaagcaccctgtcctgga

SEQ ID NO: 44232 - DNA, 25 bp, Artificial sequence
  synthetic polynucleotide sequence
agagcccactgagaaaaggaaggca

SEQ ID NO: 44233 - DNA, 21 bp, Artificial sequence
  synthetic polynucleotide sequence
cctccaccaacagaagaccca

SEQ ID NO: 44234 - DNA, 20 bp, Artificial sequence
  synthetic polynucleotide sequence
gtccaaagggggcctcctga

SEQ ID NO: 44235 - DNA, 18 bp, Artificial sequence
  synthetic polynucleotide sequence
aggcccccgtgttgccca

SEQ ID NO: 44236 - DNA, 21 bp, Artificial sequence
  synthetic polynucleotide sequence
ctcggaatgtaggacagcgca

SEQ ID NO: 44237 - DNA, 19 bp, Artificial sequence
  synthetic polynucleotide sequence
cagacccccgtgttgccca

SEQ ID NO: 44238 - DNA, 19 bp, Artificial sequence
  synthetic polynucleotide sequence
gggccatcaccacctcgga

SEQ ID NO: 44239 - DNA, 20 bp, Artificial sequence
  synthetic polynucleotide sequence
ccggaacctcagctgtgaga

SEQ ID NO: 44240 - DNA, 19 bp, Artificial sequence
  synthetic polynucleotide sequence
cccaacccccgggctccca

SEQ ID NO: 44241 - DNA, 19 bp, Artificial sequence
  synthetic polynucleotide sequence
tggcacaggactcctggga

SEQ ID NO: 44242 - DNA, 21 bp, Artificial sequence
  synthetic polynucleotide sequence
ccaggatacccatgcagtgca

SEQ ID NO: 44243 - DNA, 18 bp, Artificial sequence
  synthetic polynucleotide sequence
cccgccacttcccagcca

SEQ ID NO: 44244 - DNA, 20 bp, Artificial sequence
  synthetic polynucleotide sequence
cagcgtgttgacacccggga

SEQ ID NO: 44245 - DNA, 21 bp, Artificial sequence
  synthetic polynucleotide sequence
agttccacgtcccagctgaga

SEQ ID NO: 44246 - DNA, 21 bp, Artificial sequence
  synthetic polynucleotide sequence
gggctgggatgatgagagcca

SEQ ID NO: 44247 - DNA, 20 bp, Artificial sequence
  synthetic polynucleotide sequence
tggtcagtgggccctacaca

SEQ ID NO: 44248 - DNA, 18 bp, Artificial sequence
  synthetic polynucleotide sequence
tggccgtcacggtggaga

SEQ ID NO: 44249 - DNA, 21 bp, Artificial sequence
  synthetic polynucleotide sequence
gcccatacgcgctcatcacca

SEQ ID NO: 44250 - DNA, 19 bp, Artificial sequence
  synthetic polynucleotide sequence
gcaggctaggacgtcggca

SEQ ID NO: 44251 - DNA, 20 bp, Artificial sequence
  synthetic polynucleotide sequence
gtgctaaggagacaggctca

SEQ ID NO: 44252 - DNA, 18 bp, Artificial sequence
  synthetic polynucleotide sequence
ggcagactcgaagcccca

SEQ ID NO: 44253 - DNA, 19 bp, Artificial sequence
  synthetic polynucleotide sequence
gggctgcccttcagcacca

SEQ ID NO: 44254 - DNA, 19 bp, Artificial sequence
  synthetic polynucleotide sequence
tcgtaggaggaagaaggca

SEQ ID NO: 44255 - DNA, 18 bp, Artificial sequence
  synthetic polynucleotide sequence
tgacaacgtgcagtccga

SEQ ID NO: 44256 - DNA, 22 bp, Artificial sequence
  synthetic polynucleotide sequence
aggtaaccacggtatgacgaca

SEQ ID NO: 44257 - DNA, 20 bp, Artificial sequence
  synthetic polynucleotide sequence
agggcggagatgctggacca

SEQ ID NO: 44258 - DNA, 20 bp, Artificial sequence
  synthetic polynucleotide sequence
ctcctcgatcaccgccagca

SEQ ID NO: 44259 - DNA, 21 bp, Artificial sequence
  synthetic polynucleotide sequence
agaaccaaggacacactccga

SEQ ID NO: 44260 - DNA, 22 bp, Artificial sequence
  synthetic polynucleotide sequence
aaaaccatcaccacagcaccaa

SEQ ID NO: 44261 - DNA, 22 bp, Artificial sequence
  synthetic polynucleotide sequence
aacaccaccttaacacagccaa

SEQ ID NO: 44262 - DNA, 20 bp, Artificial sequence
  synthetic polynucleotide sequence
agatgggaagaacagcagga

SEQ ID NO: 44263 - DNA, 21 bp, Artificial sequence
  synthetic polynucleotide sequence
ccacggagaaggagcctgcaa

SEQ ID NO: 44264 - DNA, 18 bp, Artificial sequence
  synthetic polynucleotide sequence
gctggtccctgaggccca

SEQ ID NO: 44265 - DNA, 21 bp, Artificial sequence
  synthetic polynucleotide sequence
gctggatgagaaccaggccaa

SEQ ID NO: 44266 - DNA, 20 bp, Artificial sequence
  synthetic polynucleotide sequence
attgcataggccgtccggga

SEQ ID NO: 44267 - DNA, 18 bp, Artificial sequence
  synthetic polynucleotide sequence
gcagtgtgaaggcggaga

SEQ ID NO: 44268 - DNA, 18 bp, Artificial sequence
  synthetic polynucleotide sequence
ggcggatagggaacagca

SEQ ID NO: 44269 - DNA, 21 bp, Artificial sequence
  synthetic polynucleotide sequence
aacgaacttcacagacagcga

SEQ ID NO: 44270 - DNA, 21 bp, Artificial sequence
  synthetic polynucleotide sequence
gagtaagaagccaggagagca

SEQ ID NO: 44271 - DNA, 22 bp, Artificial sequence
  synthetic polynucleotide sequence
tacacagaccgcaagttcacca

SEQ ID NO: 44272 - DNA, 21 bp, Artificial sequence
  synthetic polynucleotide sequence
atccgaagcagatggtgggca

SEQ ID NO: 44273 - DNA, 20 bp, Artificial sequence
  synthetic polynucleotide sequence
atctactgcagcatgcgcaa

SEQ ID NO: 44274 - DNA, 18 bp, Artificial sequence
  synthetic polynucleotide sequence
agatgaggcagcaggcca

SEQ ID NO: 44275 - DNA, 20 bp, Artificial sequence
  synthetic polynucleotide sequence
attcaggagcagcatgtgga

SEQ ID NO: 44276 - DNA, 21 bp, Artificial sequence
  synthetic polynucleotide sequence
caatcaggttagccacgccca

SEQ ID NO: 44277 - DNA, 18 bp, Artificial sequence
  synthetic polynucleotide sequence
ccagtggcaccacaagca

SEQ ID NO: 44278 - DNA, 18 bp, Artificial sequence
  synthetic polynucleotide sequence
gcaccaattgcgagccca

SEQ ID NO: 44279 - DNA, 20 bp, Artificial sequence
  synthetic polynucleotide sequence
cgtggtgctggctgagccca

SEQ ID NO: 44280 - DNA, 21 bp, Artificial sequence
  synthetic polynucleotide sequence
cgtccatgaccacgtagacca

SEQ ID NO: 44281 - DNA, 21 bp, Artificial sequence
  synthetic polynucleotide sequence
tgccacctaccactctggaga

SEQ ID NO: 44282 - DNA, 19 bp, Artificial sequence
  synthetic polynucleotide sequence
gtggagcagagcgtcccca

SEQ ID NO: 44283 - DNA, 20 bp, Artificial sequence
  synthetic polynucleotide sequence
ctcctgcatgagatccccca

SEQ ID NO: 44284 - DNA, 22 bp, Artificial sequence
  synthetic polynucleotide sequence
cgatgtagagaaagccgccaga

SEQ ID NO: 44285 - DNA, 18 bp, Artificial sequence
  synthetic polynucleotide sequence
gaagctgcagaacgggga

SEQ ID NO: 44286 - DNA, 18 bp, Artificial sequence
  synthetic polynucleotide sequence
gcggacacctttcagcca

SEQ ID NO: 44287 - DNA, 20 bp, Artificial sequence
  synthetic polynucleotide sequence
gtaccagctcacgatgggca

SEQ ID NO: 44288 - DNA, 21 bp, Artificial sequence
  synthetic polynucleotide sequence
gctgccacaccctctaacaca

SEQ ID NO: 44289 - DNA, 20 bp, Artificial sequence
  synthetic polynucleotide sequence
ctccccgtgaagatcatcga

SEQ ID NO: 44290 - DNA, 20 bp, Artificial sequence
  synthetic polynucleotide sequence
ctgctgctagtgcccaggga

SEQ ID NO: 44291 - DNA, 19 bp, Artificial sequence
  synthetic polynucleotide sequence
gagtcagcgaggagagcga

SEQ ID NO: 44292 - DNA, 18 bp, Artificial sequence
  synthetic polynucleotide sequence
ccacgttgtgcagcagga

SEQ ID NO: 44293 - DNA, 20 bp, Artificial sequence
  synthetic polynucleotide sequence
ggcggactaccagagaagga

SEQ ID NO: 44294 - DNA, 20 bp, Artificial sequence
  synthetic polynucleotide sequence
ctgagccctcggtgccgcaa

SEQ ID NO: 44295 - DNA, 20 bp, Artificial sequence
  synthetic polynucleotide sequence
cagcgctactctcgggagga

SEQ ID NO: 44296 - DNA, 22 bp, Artificial sequence
  synthetic polynucleotide sequence
agcagcaccaattgctaggcca

SEQ ID NO: 44297 - DNA, 19 bp, Artificial sequence
  synthetic polynucleotide sequence
ctcaatgcagggatgagca

SEQ ID NO: 44298 - DNA, 18 bp, Artificial sequence
  synthetic polynucleotide sequence
atgcctccagcaagtgca

SEQ ID NO: 44299 - DNA, 19 bp, Artificial sequence
  synthetic polynucleotide sequence
tgctttgggagcagcagca

SEQ ID NO: 44300 - DNA, 20 bp, Artificial sequence
  synthetic polynucleotide sequence
ccgctctaagccagcatgca

SEQ ID NO: 44301 - DNA, 18 bp, Artificial sequence
  synthetic polynucleotide sequence
ctgctcagcacccagcca

SEQ ID NO: 44302 - DNA, 18 bp, Artificial sequence
  synthetic polynucleotide sequence
cgtaggggaagcggagca

SEQ ID NO: 44303 - DNA, 20 bp, Artificial sequence
  synthetic polynucleotide sequence
ctgggagccatcatcggtga

SEQ ID NO: 44304 - DNA, 21 bp, Artificial sequence
  synthetic polynucleotide sequence
atagcaggaagtgagaaccca

SEQ ID NO: 44305 - DNA, 22 bp, Artificial sequence
  synthetic polynucleotide sequence
atgaatggaatgcccggagaga

SEQ ID NO: 44306 - DNA, 22 bp, Artificial sequence
  synthetic polynucleotide sequence
aggagaatcagcacctggagca

SEQ ID NO: 44307 - DNA, 21 bp, Artificial sequence
  synthetic polynucleotide sequence
catgccaataatgggcacgca

SEQ ID NO: 44308 - DNA, 22 bp, Artificial sequence
  synthetic polynucleotide sequence
tatccagtaccatgccagctga

SEQ ID NO: 44309 - DNA, 21 bp, Artificial sequence
  synthetic polynucleotide sequence
tggccattcagaccagccgaa

SEQ ID NO: 44310 - DNA, 20 bp, Artificial sequence
  synthetic polynucleotide sequence
ctggatcaggcctgccagca

SEQ ID NO: 44311 - DNA, 20 bp, Artificial sequence
  synthetic polynucleotide sequence
gtgggacccctgaaaggaga

SEQ ID NO: 44312 - DNA, 20 bp, Artificial sequence
  synthetic polynucleotide sequence
cggtcacctcagagccgcta

SEQ ID NO: 44313 - DNA, 19 bp, Artificial sequence
  synthetic polynucleotide sequence
ccgtgtacccctccaccca

SEQ ID NO: 44314 - DNA, 19 bp, Artificial sequence
  synthetic polynucleotide sequence
gcagccccacgttcaccca

SEQ ID NO: 44315 - DNA, 21 bp, Artificial sequence
  synthetic polynucleotide sequence
gcacgagtcagcacctacaca

SEQ ID NO: 44316 - DNA, 22 bp, Artificial sequence
  synthetic polynucleotide sequence
aaggtgaggtactggagaggga

SEQ ID NO: 44317 - DNA, 20 bp, Artificial sequence
  synthetic polynucleotide sequence
taggtacggtggcaaaagga

SEQ ID NO: 44318 - DNA, 19 bp, Artificial sequence
  synthetic polynucleotide sequence
tcagcacacatcgtgcaca

SEQ ID NO: 44319 - DNA, 20 bp, Artificial sequence
  synthetic polynucleotide sequence
ggtggtgagtcgggctacca

SEQ ID NO: 44320 - DNA, 22 bp, Artificial sequence
  synthetic polynucleotide sequence
atgatctgcacaatggccagga

SEQ ID NO: 44321 - DNA, 18 bp, Artificial sequence
  synthetic polynucleotide sequence
tccacaggcatcacggca

SEQ ID NO: 44322 - DNA, 19 bp, Artificial sequence
  synthetic polynucleotide sequence
gcagttcccaggctcagca

SEQ ID NO: 44323 - DNA, 19 bp, Artificial sequence
  synthetic polynucleotide sequence
catgcaaccccacggccca

SEQ ID NO: 44324 - DNA, 21 bp, Artificial sequence
  synthetic polynucleotide sequence
gagtgtgcggatgaaggcaga

SEQ ID NO: 44325 - DNA, 20 bp, Artificial sequence
  synthetic polynucleotide sequence
atcacacaggatccctagca

SEQ ID NO: 44326 - DNA, 22 bp, Artificial sequence
  synthetic polynucleotide sequence
accagaagcagcatctcaggca

SEQ ID NO: 44327 - DNA, 20 bp, Artificial sequence
  synthetic polynucleotide sequence
atcctggagaagctggagga

SEQ ID NO: 44328 - DNA, 21 bp, Artificial sequence
  synthetic polynucleotide sequence
gcagagagatgtccacgccca

SEQ ID NO: 44329 - DNA, 21 bp, Artificial sequence
  synthetic polynucleotide sequence
cagactcgcagggcaatgaca

SEQ ID NO: 44330 - DNA, 21 bp, Artificial sequence
  synthetic polynucleotide sequence
gacaggaaggctgtccatcca

SEQ ID NO: 44331 - DNA, 18 bp, Artificial sequence
  synthetic polynucleotide sequence
aaggcgttcggatgggca

SEQ ID NO: 44332 - DNA, 18 bp, Artificial sequence
  synthetic polynucleotide sequence
aagctgtcaccacggcca

SEQ ID NO: 44333 - DNA, 21 bp, Artificial sequence
  synthetic polynucleotide sequence
ctacaccgacttcatgggcca

SEQ ID NO: 44334 - DNA, 22 bp, Artificial sequence
  synthetic polynucleotide sequence
tagacgttgggaaacatggcca

SEQ ID NO: 44335 - DNA, 20 bp, Artificial sequence
  synthetic polynucleotide sequence
cgggcccagggttatgccaa

SEQ ID NO: 44336 - DNA, 19 bp, Artificial sequence
  synthetic polynucleotide sequence
taagatgtcctgggcccca

SEQ ID NO: 44337 - DNA, 21 bp, Artificial sequence
  synthetic polynucleotide sequence
atccccgtcacaaccatccga

SEQ ID NO: 44338 - DNA, 22 bp, Artificial sequence
  synthetic polynucleotide sequence
gaaaggaggagagagcaaagca

SEQ ID NO: 44339 - DNA, 19 bp, Artificial sequence
  synthetic polynucleotide sequence
gttggtgctcttgcaacca

SEQ ID NO: 44340 - DNA, 18 bp, Artificial sequence
  synthetic polynucleotide sequence
ggcaaagcaagctcccca

SEQ ID NO: 44341 - DNA, 21 bp, Artificial sequence
  synthetic polynucleotide sequence
agacatggagcaggcacggaa

SEQ ID NO: 44342 - DNA, 21 bp, Artificial sequence
  synthetic polynucleotide sequence
ccactccccctcagaacacca

SEQ ID NO: 44343 - DNA, 20 bp, Artificial sequence
  synthetic polynucleotide sequence
catcggcctaccactgggca

SEQ ID NO: 44344 - DNA, 19 bp, Artificial sequence
  synthetic polynucleotide sequence
cttccagtccagccgggca

SEQ ID NO: 44345 - DNA, 21 bp, Artificial sequence
  synthetic polynucleotide sequence
atcagagcctcacagacccca

SEQ ID NO: 44346 - DNA, 21 bp, Artificial sequence
  synthetic polynucleotide sequence
gtcagcaaagtcagcccggta

SEQ ID NO: 44347 - DNA, 18 bp, Artificial sequence
  synthetic polynucleotide sequence
tcacgtcgctcagcggca

SEQ ID NO: 44348 - DNA, 18 bp, Artificial sequence
  synthetic polynucleotide sequence
cgtggacttcaccaccca

SEQ ID NO: 44349 - DNA, 18 bp, Artificial sequence
  synthetic polynucleotide sequence
gctggacatgcatgccaa

SEQ ID NO: 44350 - DNA, 20 bp, Artificial sequence
  synthetic polynucleotide sequence
cacaggctggagcagactga

SEQ ID NO: 44351 - DNA, 19 bp, Artificial sequence
  synthetic polynucleotide sequence
ctgcgtaccccccgacaca

SEQ ID NO: 44352 - DNA, 21 bp, Artificial sequence
  synthetic polynucleotide sequence
ggggcagcaggatatagcgga

SEQ ID NO: 44353 - DNA, 21 bp, Artificial sequence
  synthetic polynucleotide sequence
ttgcacctggggaatgggaga

SEQ ID NO: 44354 - DNA, 21 bp, Artificial sequence
  synthetic polynucleotide sequence
ctgagtgaatggcctcagcca

SEQ ID NO: 44355 - DNA, 21 bp, Artificial sequence
  synthetic polynucleotide sequence
tcatcaaccccctgggagaga

SEQ ID NO: 44356 - DNA, 20 bp, Artificial sequence
  synthetic polynucleotide sequence
ggcgtgagtgacagagcgga

SEQ ID NO: 44357 - DNA, 21 bp, Artificial sequence
  synthetic polynucleotide sequence
ccaaggtgaagacgtggcgga

SEQ ID NO: 44358 - DNA, 19 bp, Artificial sequence
  synthetic polynucleotide sequence
ctggaagagccggggcaga

SEQ ID NO: 44359 - DNA, 20 bp, Artificial sequence
  synthetic polynucleotide sequence
tgccctagtaggcgtggaca

SEQ ID NO: 44360 - DNA, 18 bp, Artificial sequence
  synthetic polynucleotide sequence
gccgggatagcagcagca

SEQ ID NO: 44361 - DNA, 20 bp, Artificial sequence
  synthetic polynucleotide sequence
tcccaagctgcatgtgccca

SEQ ID NO: 44362 - DNA, 21 bp, Artificial sequence
  synthetic polynucleotide sequence
agccatgaggatgcccaccca

SEQ ID NO: 44363 - DNA, 21 bp, Artificial sequence
  synthetic polynucleotide sequence
tgaacctccaaaccccagcaa

SEQ ID NO: 44364 - DNA, 21 bp, Artificial sequence
  synthetic polynucleotide sequence
gatgaccacaagctgacccca

SEQ ID NO: 44365 - DNA, 19 bp, Artificial sequence
  synthetic polynucleotide sequence
ggggtcacagtgggccaga

SEQ ID NO: 44366 - DNA, 21 bp, Artificial sequence
  synthetic polynucleotide sequence
acatgcaggcacagtacagga

SEQ ID NO: 44367 - DNA, 20 bp, Artificial sequence
  synthetic polynucleotide sequence
ggtggcagcgctcagcagca

SEQ ID NO: 44368 - DNA, 20 bp, Artificial sequence
  synthetic polynucleotide sequence
gtggaccctggtcagaggca

SEQ ID NO: 44369 - DNA, 21 bp, Artificial sequence
  synthetic polynucleotide sequence
cggacctcaggcacatgcgaa

SEQ ID NO: 44370 - DNA, 21 bp, Artificial sequence
  synthetic polynucleotide sequence
agacactgcagaagaggccca

SEQ ID NO: 44371 - DNA, 21 bp, Artificial sequence
  synthetic polynucleotide sequence
tgctgaggacgctgagggaca

SEQ ID NO: 44372 - DNA, 22 bp, Artificial sequence
  synthetic polynucleotide sequence
aaggcgtattggaaagggccca

SEQ ID NO: 44373 - DNA, 18 bp, Artificial sequence
  synthetic polynucleotide sequence
tgagggggctcccggaga

SEQ ID NO: 44374 - DNA, 19 bp, Artificial sequence
  synthetic polynucleotide sequence
caccacagctgccagggca

SEQ ID NO: 44375 - DNA, 18 bp, Artificial sequence
  synthetic polynucleotide sequence
cccagaccctgaggccca

SEQ ID NO: 44376 - DNA, 21 bp, Artificial sequence
  synthetic polynucleotide sequence
aggccccaaagagcatgccca

SEQ ID NO: 44377 - DNA, 19 bp, Artificial sequence
  synthetic polynucleotide sequence
gggaccccgctccccaaca

SEQ ID NO: 44378 - DNA, 19 bp, Artificial sequence
  synthetic polynucleotide sequence
gcctcctgggctgcaggca

SEQ ID NO: 44379 - DNA, 21 bp, Artificial sequence
  synthetic polynucleotide sequence
gggccaggggtatctagagga

SEQ ID NO: 44380 - DNA, 21 bp, Artificial sequence
  synthetic polynucleotide sequence
aggtcccaagcacggagagga

SEQ ID NO: 44381 - DNA, 18 bp, Artificial sequence
  synthetic polynucleotide sequence
ccagcaactgtcccacga

SEQ ID NO: 44382 - DNA, 18 bp, Artificial sequence
  synthetic polynucleotide sequence
tgcgcaggctccaacaca

SEQ ID NO: 44383 - DNA, 20 bp, Artificial sequence
  synthetic polynucleotide sequence
acccccacagagtgtccaga

SEQ ID NO: 44384 - DNA, 19 bp, Artificial sequence
  synthetic polynucleotide sequence
ccacagacacgggcccaga

SEQ ID NO: 44385 - DNA, 21 bp, Artificial sequence
  synthetic polynucleotide sequence
acagctgtgacatgaccccaa

SEQ ID NO: 44386 - DNA, 21 bp, Artificial sequence
  synthetic polynucleotide sequence
cgtccaggagggtcttcacca

SEQ ID NO: 44387 - DNA, 21 bp, Artificial sequence
  synthetic polynucleotide sequence
acaatgccaggactgccagga

SEQ ID NO: 44388 - DNA, 21 bp, Artificial sequence
  synthetic polynucleotide sequence
catgccgtgaatgctgaggga

SEQ ID NO: 44389 - DNA, 20 bp, Artificial sequence
  synthetic polynucleotide sequence
ctggcacgcctgattcccga

SEQ ID NO: 44390 - DNA, 20 bp, Artificial sequence
  synthetic polynucleotide sequence
atgccggagactgaagacca

SEQ ID NO: 44391 - DNA, 20 bp, Artificial sequence
  synthetic polynucleotide sequence
tgctggtgtgtggaagcaga

SEQ ID NO: 44392 - DNA, 18 bp, Artificial sequence
  synthetic polynucleotide sequence
agcttgcgctcttgcgga

SEQ ID NO: 44393 - DNA, 18 bp, Artificial sequence
  synthetic polynucleotide sequence
ggaagcaagcgtcggaga

SEQ ID NO: 44394 - DNA, 18 bp, Artificial sequence
  synthetic polynucleotide sequence
gctgcaattggaggccca

SEQ ID NO: 44395 - DNA, 18 bp, Artificial sequence
  synthetic polynucleotide sequence
gcacagcatccaccagca

SEQ ID NO: 44396 - DNA, 18 bp, Artificial sequence
  synthetic polynucleotide sequence
ggctgccacggtgagaca

SEQ ID NO: 44397 - DNA, 20 bp, Artificial sequence
  synthetic polynucleotide sequence
aaggccgtcatctggacaga

SEQ ID NO: 44398 - DNA, 18 bp, Artificial sequence
  synthetic polynucleotide sequence
cgaaggccaaggtccaga

SEQ ID NO: 44399 - DNA, 21 bp, Artificial sequence
  synthetic polynucleotide sequence
ggtggaatcccatggcaagca

SEQ ID NO: 44400 - DNA, 21 bp, Artificial sequence
  synthetic polynucleotide sequence
tggctgggatggccatcacca

SEQ ID NO: 44401 - DNA, 20 bp, Artificial sequence
  synthetic polynucleotide sequence
caacgggggtggtctgcaca

SEQ ID NO: 44402 - DNA, 19 bp, Artificial sequence
  synthetic polynucleotide sequence
tccaccttgcatcaccaca

SEQ ID NO: 44403 - DNA, 21 bp, Artificial sequence
  synthetic polynucleotide sequence
gagttctcatacccagcgcca

SEQ ID NO: 44404 - DNA, 20 bp, Artificial sequence
  synthetic polynucleotide sequence
gggcagttccgagtccacca

SEQ ID NO: 44405 - DNA, 18 bp, Artificial sequence
  synthetic polynucleotide sequence
gctgtgcagatgacgcca

SEQ ID NO: 44406 - DNA, 18 bp, Artificial sequence
  synthetic polynucleotide sequence
tgtacccggggatgagga

SEQ ID NO: 44407 - DNA, 18 bp, Artificial sequence
  synthetic polynucleotide sequence
accccaaggcggtcacca

SEQ ID NO: 44408 - DNA, 18 bp, Artificial sequence
  synthetic polynucleotide sequence
actggctgtccaggccca

SEQ ID NO: 44409 - DNA, 18 bp, Artificial sequence
  synthetic polynucleotide sequence
cctagggctggacagcca

SEQ ID NO: 44410 - DNA, 18 bp, Artificial sequence
  synthetic polynucleotide sequence
ggtagcacatgacggcga

SEQ ID NO: 44411 - DNA, 18 bp, Artificial sequence
  synthetic polynucleotide sequence
ggagcgggggcactggaa

SEQ ID NO: 44412 - DNA, 18 bp, Artificial sequence
  synthetic polynucleotide sequence
ggagtgggtggggtggca

SEQ ID NO: 44413 - DNA, 20 bp, Artificial sequence
  synthetic polynucleotide sequence
atccagaggctctagcccaa

SEQ ID NO: 44414 - DNA, 18 bp, Artificial sequence
  synthetic polynucleotide sequence
aaccaagcagcagcccaa

SEQ ID NO: 44415 - DNA, 18 bp, Artificial sequence
  synthetic polynucleotide sequence
gaattcggcgaggcagca

SEQ ID NO: 44416 - DNA, 20 bp, Artificial sequence
  synthetic polynucleotide sequence
aggacactgatcccaaggca

SEQ ID NO: 44417 - DNA, 20 bp, Artificial sequence
  synthetic polynucleotide sequence
cagtggccttccccagcaca

SEQ ID NO: 44418 - DNA, 23 bp, Artificial sequence
  synthetic polynucleotide sequence
taaaagaccagaagacagacgga

SEQ ID NO: 44419 - DNA, 20 bp, Artificial sequence
  synthetic polynucleotide sequence
atgaccgtgaaggaggacca

SEQ ID NO: 44420 - DNA, 18 bp, Artificial sequence
  synthetic polynucleotide sequence
tggcctcagtgaaggcga

SEQ ID NO: 44421 - DNA, 20 bp, Artificial sequence
  synthetic polynucleotide sequence
gtcgtcttcacggagaccga

SEQ ID NO: 44422 - DNA, 20 bp, Artificial sequence
  synthetic polynucleotide sequence
accgcctccacggtcccgaa

SEQ ID NO: 44423 - DNA, 20 bp, Artificial sequence
  synthetic polynucleotide sequence
gtggtagaggtcagtcagga

SEQ ID NO: 44424 - DNA, 20 bp, Artificial sequence
  synthetic polynucleotide sequence
tagccagggatggtgaggga

SEQ ID NO: 44425 - DNA, 20 bp, Artificial sequence
  synthetic polynucleotide sequence
aagccactcacctacgacga

SEQ ID NO: 44426 - DNA, 18 bp, Artificial sequence
  synthetic polynucleotide sequence
gcgtgatgccataggcca

SEQ ID NO: 44427 - DNA, 21 bp, Artificial sequence
  synthetic polynucleotide sequence
cacccctctgacagacagcaa

SEQ ID NO: 44428 - DNA, 21 bp, Artificial sequence
  synthetic polynucleotide sequence
cagcctccatcgtgaacacca

SEQ ID NO: 44429 - DNA, 20 bp, Artificial sequence
  synthetic polynucleotide sequence
gggctccgtgtagcaaccca

SEQ ID NO: 44430 - DNA, 20 bp, Artificial sequence
  synthetic polynucleotide sequence
gggacccacacgatgctgaa

SEQ ID NO: 44431 - DNA, 18 bp, Artificial sequence
  synthetic polynucleotide sequence
gtcgcgctgatcgaagca

SEQ ID NO: 44432 - DNA, 20 bp, Artificial sequence
  synthetic polynucleotide sequence
cacccagcagatcctccaga

SEQ ID NO: 44433 - DNA, 22 bp, Artificial sequence
  synthetic polynucleotide sequence
tgggactcaaactgccagtgaa

SEQ ID NO: 44434 - DNA, 22 bp, Artificial sequence
  synthetic polynucleotide sequence
atcaagtctggaccatcccaca

SEQ ID NO: 44435 - DNA, 18 bp, Artificial sequence
  synthetic polynucleotide sequence
cctggaatcgaccaccca

SEQ ID NO: 44436 - DNA, 18 bp, Artificial sequence
  synthetic polynucleotide sequence
aggcgggtgatgtcagga

SEQ ID NO: 44437 - DNA, 21 bp, Artificial sequence
  synthetic polynucleotide sequence
accagccctcggagtatggca

SEQ ID NO: 44438 - DNA, 19 bp, Artificial sequence
  synthetic polynucleotide sequence
cctccagcgatggtcccca

SEQ ID NO: 44439 - DNA, 18 bp, Artificial sequence
  synthetic polynucleotide sequence
cagagcagggcgtgcaca

SEQ ID NO: 44440 - DNA, 18 bp, Artificial sequence
  synthetic polynucleotide sequence
gcacaacagagggccaca

SEQ ID NO: 44441 - DNA, 18 bp, Artificial sequence
  synthetic polynucleotide sequence
catccccctcaccagcca

SEQ ID NO: 44442 - DNA, 18 bp, Artificial sequence
  synthetic polynucleotide sequence
agagacgaagcgccagca

SEQ ID NO: 44443 - DNA, 19 bp, Artificial sequence
  synthetic polynucleotide sequence
ggaagggaggctctcacca

SEQ ID NO: 44444 - DNA, 18 bp, Artificial sequence
  synthetic polynucleotide sequence
agcactggcaggaaggga

SEQ ID NO: 44445 - DNA, 19 bp, Artificial sequence
  synthetic polynucleotide sequence
ggcgacacgtacacgctca

SEQ ID NO: 44446 - DNA, 18 bp, Artificial sequence
  synthetic polynucleotide sequence
ccagcaggaaggcccaga

SEQ ID NO: 44447 - DNA, 18 bp, Artificial sequence
  synthetic polynucleotide sequence
tgctccagaacacgggca

SEQ ID NO: 44448 - DNA, 19 bp, Artificial sequence
  synthetic polynucleotide sequence
gcagtagctgcagggcgta

SEQ ID NO: 44449 - DNA, 19 bp, Artificial sequence
  synthetic polynucleotide sequence
tcccatgcagtggagctca

SEQ ID NO: 44450 - DNA, 22 bp, Artificial sequence
  synthetic polynucleotide sequence
acaacatggccaatgccagaca

SEQ ID NO: 44451 - DNA, 19 bp, Artificial sequence
  synthetic polynucleotide sequence
gccagtgctctgagcagca

SEQ ID NO: 44452 - DNA, 18 bp, Artificial sequence
  synthetic polynucleotide sequence
tggtcacgatgaccgcga

SEQ ID NO: 44453 - DNA, 18 bp, Artificial sequence
  synthetic polynucleotide sequence
ggaggtggccaaggcaga

SEQ ID NO: 44454 - DNA, 18 bp, Artificial sequence
  synthetic polynucleotide sequence
gccagtgatgaaggccca

SEQ ID NO: 44455 - DNA, 20 bp, Artificial sequence
  synthetic polynucleotide sequence
gatccacaccggcacacgca

SEQ ID NO: 44456 - DNA, 21 bp, Artificial sequence
  synthetic polynucleotide sequence
caagcagggtcccaattgaca

SEQ ID NO: 44457 - DNA, 21 bp, Artificial sequence
  synthetic polynucleotide sequence
tcaccagcaacagtatcggga

SEQ ID NO: 44458 - DNA, 22 bp, Artificial sequence
  synthetic polynucleotide sequence
tacactgcaagtcccatcagca

SEQ ID NO: 44459 - DNA, 18 bp, Artificial sequence
  synthetic polynucleotide sequence
ccctggccatcatcggca

SEQ ID NO: 44460 - DNA, 18 bp, Artificial sequence
  synthetic polynucleotide sequence
tccagaaggagacggcga

SEQ ID NO: 44461 - DNA, 19 bp, Artificial sequence
  synthetic polynucleotide sequence
gccagggacactctgagca

SEQ ID NO: 44462 - DNA, 19 bp, Artificial sequence
  synthetic polynucleotide sequence
gagggcagagtagagggca

SEQ ID NO: 44463 - DNA, 21 bp, Artificial sequence
  synthetic polynucleotide sequence
tccgtgcagccctacagccaa

SEQ ID NO: 44464 - DNA, 21 bp, Artificial sequence
  synthetic polynucleotide sequence
gtagtcagcagagcctctgga

SEQ ID NO: 44465 - DNA, 20 bp, Artificial sequence
  synthetic polynucleotide sequence
ggccagggagcctctactca

SEQ ID NO: 44466 - DNA, 21 bp, Artificial sequence
  synthetic polynucleotide sequence
ggtgtcccagcctgagtagga

SEQ ID NO: 44467 - DNA, 18 bp, Artificial sequence
  synthetic polynucleotide sequence
ctggcaacacaagcccaa

SEQ ID NO: 44468 - DNA, 18 bp, Artificial sequence
  synthetic polynucleotide sequence
ccacctcggggtacacga

SEQ ID NO: 44469 - DNA, 19 bp, Artificial sequence
  synthetic polynucleotide sequence
cagctgtctgtgggagcca

SEQ ID NO: 44470 - DNA, 18 bp, Artificial sequence
  synthetic polynucleotide sequence
tgtagcacgccgtcacca

SEQ ID NO: 44471 - DNA, 18 bp, Artificial sequence
  synthetic polynucleotide sequence
ccatctaccacgcagcca

SEQ ID NO: 44472 - DNA, 19 bp, Artificial sequence
  synthetic polynucleotide sequence
cgatacagcagcaccccca

SEQ ID NO: 44473 - DNA, 18 bp, Artificial sequence
  synthetic polynucleotide sequence
ctgacacgttcgccagca

SEQ ID NO: 44474 - DNA, 18 bp, Artificial sequence
  synthetic polynucleotide sequence
caatgcccacgaaggcga

SEQ ID NO: 44475 - DNA, 18 bp, Artificial sequence
  synthetic polynucleotide sequence
tgcagcaggggatgagga

SEQ ID NO: 44476 - DNA, 18 bp, Artificial sequence
  synthetic polynucleotide sequence
agccgaagtgcgaggcca

SEQ ID NO: 44477 - DNA, 21 bp, Artificial sequence
  synthetic polynucleotide sequence
gatctcccgaagccacacaga

SEQ ID NO: 44478 - DNA, 21 bp, Artificial sequence
  synthetic polynucleotide sequence
caggtagaagaggagcaggca

SEQ ID NO: 44479 - DNA, 20 bp, Artificial sequence
  synthetic polynucleotide sequence
gatgctgctccggaggcaga

SEQ ID NO: 44480 - DNA, 21 bp, Artificial sequence
  synthetic polynucleotide sequence
ggtcgatggtgatgacaggca

SEQ ID NO: 44481 - DNA, 19 bp, Artificial sequence
  synthetic polynucleotide sequence
gacgcagatgccgggacca

SEQ ID NO: 44482 - DNA, 20 bp, Artificial sequence
  synthetic polynucleotide sequence
ctgggcatatctcggccaga

SEQ ID NO: 44483 - DNA, 18 bp, Artificial sequence
  synthetic polynucleotide sequence
gctggagcccattgacca

SEQ ID NO: 44484 - DNA, 18 bp, Artificial sequence
  synthetic polynucleotide sequence
ccttcagccactgcacca

SEQ ID NO: 44485 - DNA, 19 bp, Artificial sequence
  synthetic polynucleotide sequence
ccagtgacaccagcgagga

SEQ ID NO: 44486 - DNA, 18 bp, Artificial sequence
  synthetic polynucleotide sequence
tggccatggccagggaga

SEQ ID NO: 44487 - DNA, 20 bp, Artificial sequence
  synthetic polynucleotide sequence
aatggaaccagccctgccca

SEQ ID NO: 44488 - DNA, 18 bp, Artificial sequence
  synthetic polynucleotide sequence
ccgtggggctcaggtgga

SEQ ID NO: 44489 - DNA, 20 bp, Artificial sequence
  synthetic polynucleotide sequence
gagggtggccttaagaccca

SEQ ID NO: 44490 - DNA, 20 bp, Artificial sequence
  synthetic polynucleotide sequence
cctcgaccgaacctcaacca

SEQ ID NO: 44491 - DNA, 21 bp, Artificial sequence
  synthetic polynucleotide sequence
cgtgtcctcggaaaccaccaa

SEQ ID NO: 44492 - DNA, 19 bp, Artificial sequence
  synthetic polynucleotide sequence
gtggatggggaggcaggca

SEQ ID NO: 44493 - DNA, 21 bp, Artificial sequence
  synthetic polynucleotide sequence
cataccagccagctggagaca

SEQ ID NO: 44494 - DNA, 21 bp, Artificial sequence
  synthetic polynucleotide sequence
aactacacctgtgaagcccca

SEQ ID NO: 44495 - DNA, 22 bp, Artificial sequence
  synthetic polynucleotide sequence
ccaagagccactgagagaggaa

SEQ ID NO: 44496 - DNA, 18 bp, Artificial sequence
  synthetic polynucleotide sequence
ctccggctgccctccaga

SEQ ID NO: 44497 - DNA, 21 bp, Artificial sequence
  synthetic polynucleotide sequence
catggacatcgaggacgccaa

SEQ ID NO: 44498 - DNA, 20 bp, Artificial sequence
  synthetic polynucleotide sequence
ctcctccgtgagctccgaca

SEQ ID NO: 44499 - DNA, 19 bp, Artificial sequence
  synthetic polynucleotide sequence
ttgttgccagagcctgcaa

SEQ ID NO: 44500 - DNA, 21 bp, Artificial sequence
  synthetic polynucleotide sequence
aagaacacgaggagcagcgta

SEQ ID NO: 44501 - DNA, 22 bp, Artificial sequence
  synthetic polynucleotide sequence
tcgatccacaggctttgaggca

SEQ ID NO: 44502 - DNA, 22 bp, Artificial sequence
  synthetic polynucleotide sequence
tcatccatactgctagcagcca

SEQ ID NO: 44503 - DNA, 20 bp, Artificial sequence
  synthetic polynucleotide sequence
cttttgcagggaggaggcta

SEQ ID NO: 44504 - DNA, 22 bp, Artificial sequence
  synthetic polynucleotide sequence
aacagatccagttgccacacca

SEQ ID NO: 44505 - DNA, 22 bp, Artificial sequence
  synthetic polynucleotide sequence
gaagcaatggagctggccaaca

SEQ ID NO: 44506 - DNA, 21 bp, Artificial sequence
  synthetic polynucleotide sequence
ctgcaccaaccaacacctgga

SEQ ID NO: 44507 - DNA, 21 bp, Artificial sequence
  synthetic polynucleotide sequence
catggagcatgagggtcgtga

SEQ ID NO: 44508 - DNA, 20 bp, Artificial sequence
  synthetic polynucleotide sequence
gtcaggagttgggggtggga

SEQ ID NO: 44509 - DNA, 20 bp, Artificial sequence
  synthetic polynucleotide sequence
gacatccattggaacgggaa

SEQ ID NO: 44510 - DNA, 20 bp, Artificial sequence
  synthetic polynucleotide sequence
atatccaggtatggcagcca

SEQ ID NO: 44511 - DNA, 21 bp, Artificial sequence
  synthetic polynucleotide sequence
gtggaataggggagactccca

SEQ ID NO: 44512 - DNA, 21 bp, Artificial sequence
  synthetic polynucleotide sequence
aaattaagccaccaagctcca

SEQ ID NO: 44513 - DNA, 22 bp, Artificial sequence
  synthetic polynucleotide sequence
ctctgcaacaggaggtaccaca

SEQ ID NO: 44514 - DNA, 22 bp, Artificial sequence
  synthetic polynucleotide sequence
aagcccaagtagacccttccaa

SEQ ID NO: 44515 - DNA, 20 bp, Artificial sequence
  synthetic polynucleotide sequence
tggcataggggaaaccccca

SEQ ID NO: 44516 - DNA, 22 bp, Artificial sequence
  synthetic polynucleotide sequence
gaaaccaagccaccaagctcca

SEQ ID NO: 44517 - DNA, 21 bp, Artificial sequence
  synthetic polynucleotide sequence
ttccagcagtggcccttggaa

SEQ ID NO: 44518 - DNA, 21 bp, Artificial sequence
  synthetic polynucleotide sequence
acagcccagtgcaaacaggga

SEQ ID NO: 44519 - DNA, 19 bp, Artificial sequence
  synthetic polynucleotide sequence
ccccgcatagctaccacca

SEQ ID NO: 44520 - DNA, 19 bp, Artificial sequence
  synthetic polynucleotide sequence
ggggtagacttcggccaca

SEQ ID NO: 44521 - DNA, 20 bp, Artificial sequence
  synthetic polynucleotide sequence
atcacagcctcctacgccaa

SEQ ID NO: 44522 - DNA, 18 bp, Artificial sequence
  synthetic polynucleotide sequence
tggtgtgtgatgcccgca

SEQ ID NO: 44523 - DNA, 18 bp, Artificial sequence
  synthetic polynucleotide sequence
cccgaaggtcaccaagca

SEQ ID NO: 44524 - DNA, 18 bp, Artificial sequence
  synthetic polynucleotide sequence
ccagacaagcacacggga

SEQ ID NO: 44525 - DNA, 18 bp, Artificial sequence
  synthetic polynucleotide sequence
tcggctgggtgatcgaca

SEQ ID NO: 44526 - DNA, 20 bp, Artificial sequence
  synthetic polynucleotide sequence
caccttgtacaggagcccca

SEQ ID NO: 44527 - DNA, 21 bp, Artificial sequence
  synthetic polynucleotide sequence
tccgaagagaagctccggtca

SEQ ID NO: 44528 - DNA, 21 bp, Artificial sequence
  synthetic polynucleotide sequence
caataccttgcgtgacggcca

SEQ ID NO: 44529 - DNA, 21 bp, Artificial sequence
  synthetic polynucleotide sequence
agacccgggaaatgtgatgca

SEQ ID NO: 44530 - DNA, 21 bp, Artificial sequence
  synthetic polynucleotide sequence
gatggtccaggaatagtccca

SEQ ID NO: 44531 - DNA, 22 bp, Artificial sequence
  synthetic polynucleotide sequence
gaagtctccagccatgtcgaga

SEQ ID NO: 44532 - DNA, 20 bp, Artificial sequence
  synthetic polynucleotide sequence
gagtagcgtcaggtggagca

SEQ ID NO: 44533 - DNA, 22 bp, Artificial sequence
  synthetic polynucleotide sequence
caagtggcaggtaccaaggaga

SEQ ID NO: 44534 - DNA, 21 bp, Artificial sequence
  synthetic polynucleotide sequence
ccagcacttggaacacgggaa

SEQ ID NO: 44535 - DNA, 21 bp, Artificial sequence
  synthetic polynucleotide sequence
ggggactggtatgggaaggca

SEQ ID NO: 44536 - DNA, 20 bp, Artificial sequence
  synthetic polynucleotide sequence
agggaggccactgcaatcca

SEQ ID NO: 44537 - DNA, 21 bp, Artificial sequence
  synthetic polynucleotide sequence
agggggagtgatcaaggctga

SEQ ID NO: 44538 - DNA, 21 bp, Artificial sequence
  synthetic polynucleotide sequence
aaggtggtaatccgcagacca

SEQ ID NO: 44539 - DNA, 21 bp, Artificial sequence
  synthetic polynucleotide sequence
agggggagtgatcaaggctga

SEQ ID NO: 44540 - DNA, 22 bp, Artificial sequence
  synthetic polynucleotide sequence
caaactggagctcaacgtggca

SEQ ID NO: 44541 - DNA, 22 bp, Artificial sequence
  synthetic polynucleotide sequence
aaacctcgggtagagtacagca

SEQ ID NO: 44542 - DNA, 20 bp, Artificial sequence
  synthetic polynucleotide sequence
gggagcttccgagaacacca

SEQ ID NO: 44543 - DNA, 21 bp, Artificial sequence
  synthetic polynucleotide sequence
aggggaggacagaggacgcta

SEQ ID NO: 44544 - DNA, 22 bp, Artificial sequence
  synthetic polynucleotide sequence
ccaaacacgacagtcctctcca

SEQ ID NO: 44545 - DNA, 21 bp, Artificial sequence
  synthetic polynucleotide sequence
ggctcaaggtgtcccaggcaa

SEQ ID NO: 44546 - DNA, 21 bp, Artificial sequence
  synthetic polynucleotide sequence
gaacatccgacgcatcaccga

SEQ ID NO: 44547 - DNA, 20 bp, Artificial sequence
  synthetic polynucleotide sequence
accgtgacgaggaccgcgca

SEQ ID NO: 44548 - DNA, 21 bp, Artificial sequence
  synthetic polynucleotide sequence
ccgaggtactgatcacaggga

SEQ ID NO: 44549 - DNA, 18 bp, Artificial sequence
  synthetic polynucleotide sequence
gcggcctcagcagcgaga

SEQ ID NO: 44550 - DNA, 21 bp, Artificial sequence
  synthetic polynucleotide sequence
agaaaactgaacccaacccaa

SEQ ID NO: 44551 - DNA, 18 bp, Artificial sequence
  synthetic polynucleotide sequence
ggcagatcctcaacggca

SEQ ID NO: 44552 - DNA, 18 bp, Artificial sequence
  synthetic polynucleotide sequence
gcagatgccatgcaggca

SEQ ID NO: 44553 - DNA, 18 bp, Artificial sequence
  synthetic polynucleotide sequence
tggaccgctgaggagcaa

SEQ ID NO: 44554 - DNA, 18 bp, Artificial sequence
  synthetic polynucleotide sequence
acacctcgtacagccgca

SEQ ID NO: 44555 - DNA, 20 bp, Artificial sequence
  synthetic polynucleotide sequence
caggtggccactgacaagga

SEQ ID NO: 44556 - DNA, 18 bp, Artificial sequence
  synthetic polynucleotide sequence
agcgtcaccagctccaca

SEQ ID NO: 44557 - DNA, 21 bp, Artificial sequence
  synthetic polynucleotide sequence
tgtacgctaggatctcgccca

SEQ ID NO: 44558 - DNA, 18 bp, Artificial sequence
  synthetic polynucleotide sequence
ccagcagcagtcccggga

SEQ ID NO: 44559 - DNA, 22 bp, Artificial sequence
  synthetic polynucleotide sequence
gctagaaaagcaggccacacca

SEQ ID NO: 44560 - DNA, 20 bp, Artificial sequence
  synthetic polynucleotide sequence
gactaggcctgcgctgggaa

SEQ ID NO: 44561 - DNA, 22 bp, Artificial sequence
  synthetic polynucleotide sequence
ggcatccaaatgcaatgccaca

SEQ ID NO: 44562 - DNA, 22 bp, Artificial sequence
  synthetic polynucleotide sequence
ctcatacacatgacccacggga

SEQ ID NO: 44563 - DNA, 19 bp, Artificial sequence
  synthetic polynucleotide sequence
tccggagcacccttagcta

SEQ ID NO: 44564 - DNA, 21 bp, Artificial sequence
  synthetic polynucleotide sequence
tcacaacaatcccgtcgctca

SEQ ID NO: 44565 - DNA, 20 bp, Artificial sequence
  synthetic polynucleotide sequence
atgaagctgtgggtggagca

SEQ ID NO: 44566 - DNA, 19 bp, Artificial sequence
  synthetic polynucleotide sequence
gctattcaaccggaccgca

SEQ ID NO: 44567 - DNA, 18 bp, Artificial sequence
  synthetic polynucleotide sequence
cccccgggcatctcgaca

SEQ ID NO: 44568 - DNA, 21 bp, Artificial sequence
  synthetic polynucleotide sequence
ttgttgcaggagtggtgacca

SEQ ID NO: 44569 - DNA, 21 bp, Artificial sequence
  synthetic polynucleotide sequence
aagtggtcgaagtaggccaga

SEQ ID NO: 44570 - DNA, 19 bp, Artificial sequence
  synthetic polynucleotide sequence
tggtcagtatcagccacca

SEQ ID NO: 44571 - DNA, 21 bp, Artificial sequence
  synthetic polynucleotide sequence
caacctgaagctgctccgaga

SEQ ID NO: 44572 - DNA, 20 bp, Artificial sequence
  synthetic polynucleotide sequence
ggccagacctggcacgtaca

SEQ ID NO: 44573 - DNA, 18 bp, Artificial sequence
  synthetic polynucleotide sequence
gcgaggagaaacctgcca

SEQ ID NO: 44574 - DNA, 20 bp, Artificial sequence
  synthetic polynucleotide sequence
ggacctcacaaggagccaca

SEQ ID NO: 44575 - DNA, 22 bp, Artificial sequence
  synthetic polynucleotide sequence
agaaacctgagtgccagagtga

SEQ ID NO: 44576 - DNA, 20 bp, Artificial sequence
  synthetic polynucleotide sequence
tggggtgtcaacaggatcca

SEQ ID NO: 44577 - DNA, 18 bp, Artificial sequence
  synthetic polynucleotide sequence
gcccggagaaggaaagca

SEQ ID NO: 44578 - DNA, 18 bp, Artificial sequence
  synthetic polynucleotide sequence
gcttgaccagaggcccca

SEQ ID NO: 44579 - DNA, 22 bp, Artificial sequence
  synthetic polynucleotide sequence
gatgaccagagaggactggaga

SEQ ID NO: 44580 - DNA, 20 bp, Artificial sequence
  synthetic polynucleotide sequence
tctgcaggagcattgcccaa

SEQ ID NO: 44581 - DNA, 18 bp, Artificial sequence
  synthetic polynucleotide sequence
gcaaggagcccatgacca

SEQ ID NO: 44582 - DNA, 18 bp, Artificial sequence
  synthetic polynucleotide sequence
ctgcctccaccgtcacca

SEQ ID NO: 44583 - DNA, 21 bp, Artificial sequence
  synthetic polynucleotide sequence
gcctgctaagggcccatgtga

SEQ ID NO: 44584 - DNA, 21 bp, Artificial sequence
  synthetic polynucleotide sequence
tgacttctcacagcaagggca

SEQ ID NO: 44585 - DNA, 21 bp, Artificial sequence
  synthetic polynucleotide sequence
accactggaacctggagcgga

SEQ ID NO: 44586 - DNA, 20 bp, Artificial sequence
  synthetic polynucleotide sequence
gatgggggtggtgtccagga

SEQ ID NO: 44587 - DNA, 21 bp, Artificial sequence
  synthetic polynucleotide sequence
cccagtgcaaagctccggaga

SEQ ID NO: 44588 - DNA, 20 bp, Artificial sequence
  synthetic polynucleotide sequence
gaagcccccagtggctctca

SEQ ID NO: 44589 - DNA, 18 bp, Artificial sequence
  synthetic polynucleotide sequence
ccagcaacccaacagcca

SEQ ID NO: 44590 - DNA, 18 bp, Artificial sequence
  synthetic polynucleotide sequence
ggggcgtatcagctggca

SEQ ID NO: 44591 - DNA, 21 bp, Artificial sequence
  synthetic polynucleotide sequence
gagcagaataccgaaggcaga

SEQ ID NO: 44592 - DNA, 18 bp, Artificial sequence
  synthetic polynucleotide sequence
gcaacgcactgaagggga

SEQ ID NO: 44593 - DNA, 20 bp, Artificial sequence
  synthetic polynucleotide sequence
ggggagcggagtacaggaga

SEQ ID NO: 44594 - DNA, 18 bp, Artificial sequence
  synthetic polynucleotide sequence
acagcggatgcttgggga

SEQ ID NO: 44595 - DNA, 19 bp, Artificial sequence
  synthetic polynucleotide sequence
gtccacaggacagaagcca

SEQ ID NO: 44596 - DNA, 20 bp, Artificial sequence
  synthetic polynucleotide sequence
ctgtcgatgacactgacgca

SEQ ID NO: 44597 - DNA, 18 bp, Artificial sequence
  synthetic polynucleotide sequence
gcagtccaggacagccga

SEQ ID NO: 44598 - DNA, 18 bp, Artificial sequence
  synthetic polynucleotide sequence
actctgcaaatccggcca

SEQ ID NO: 44599 - DNA, 18 bp, Artificial sequence
  synthetic polynucleotide sequence
tcaacctggagcagcgca

SEQ ID NO: 44600 - DNA, 18 bp, Artificial sequence
  synthetic polynucleotide sequence
cgcggttgtaggcccaca

SEQ ID NO: 44601 - DNA, 18 bp, Artificial sequence
  synthetic polynucleotide sequence
cacactggacaacccgga

SEQ ID NO: 44602 - DNA, 18 bp, Artificial sequence
  synthetic polynucleotide sequence
ctctagccagcacgggca

SEQ ID NO: 44603 - DNA, 18 bp, Artificial sequence
  synthetic polynucleotide sequence
tccaggcttcctcccgaa

SEQ ID NO: 44604 - DNA, 18 bp, Artificial sequence
  synthetic polynucleotide sequence
gctgctgtcactcacgca

SEQ ID NO: 44605 - DNA, 22 bp, Artificial sequence
  synthetic polynucleotide sequence
agaagaactgatgaccacccca

SEQ ID NO: 44606 - DNA, 21 bp, Artificial sequence
  synthetic polynucleotide sequence
ctctccatctggacgatggca

SEQ ID NO: 44607 - DNA, 22 bp, Artificial sequence
  synthetic polynucleotide sequence
accagtgaccaacgggaacaca

SEQ ID NO: 44608 - DNA, 20 bp, Artificial sequence
  synthetic polynucleotide sequence
gtgcagagggtgtcccctga

SEQ ID NO: 44609 - DNA, 21 bp, Artificial sequence
  synthetic polynucleotide sequence
catatcccacagcctacccca

SEQ ID NO: 44610 - DNA, 21 bp, Artificial sequence
  synthetic polynucleotide sequence
ttgatgcctgcatgccaccca

SEQ ID NO: 44611 - DNA, 18 bp, Artificial sequence
  synthetic polynucleotide sequence
gggctggaggtctcggaa

SEQ ID NO: 44612 - DNA, 21 bp, Artificial sequence
  synthetic polynucleotide sequence
tgttgtcagtgatgagacgga

SEQ ID NO: 44613 - DNA, 18 bp, Artificial sequence
  synthetic polynucleotide sequence
gccttgatggcaccacca

SEQ ID NO: 44614 - DNA, 18 bp, Artificial sequence
  synthetic polynucleotide sequence
tttaagcccaggccacca

SEQ ID NO: 44615 - DNA, 20 bp, Artificial sequence
  synthetic polynucleotide sequence
tacgtggctaacctcacgga

SEQ ID NO: 44616 - DNA, 18 bp, Artificial sequence
  synthetic polynucleotide sequence
ggatcaccttcaccggga

SEQ ID NO: 44617 - DNA, 18 bp, Artificial sequence
  synthetic polynucleotide sequence
gcaacgagctccaggaca

SEQ ID NO: 44618 - DNA, 19 bp, Artificial sequence
  synthetic polynucleotide sequence
tgcgaatacactgtcgcaa

SEQ ID NO: 44619 - DNA, 20 bp, Artificial sequence
  synthetic polynucleotide sequence
gtcccaaggccttcctacca

SEQ ID NO: 44620 - DNA, 18 bp, Artificial sequence
  synthetic polynucleotide sequence
ctgggcccaccacctgca

SEQ ID NO: 44621 - DNA, 18 bp, Artificial sequence
  synthetic polynucleotide sequence
acgtgcagcacatccgca

SEQ ID NO: 44622 - DNA, 18 bp, Artificial sequence
  synthetic polynucleotide sequence
tgatggacagcacggcca

SEQ ID NO: 44623 - DNA, 20 bp, Artificial sequence
  synthetic polynucleotide sequence
ctggaggaccagtcagacca

SEQ ID NO: 44624 - DNA, 18 bp, Artificial sequence
  synthetic polynucleotide sequence
gcccaaccccagctccga

SEQ ID NO: 44625 - DNA, 20 bp, Artificial sequence
  synthetic polynucleotide sequence
caggtcagataccaggccca

SEQ ID NO: 44626 - DNA, 19 bp, Artificial sequence
  synthetic polynucleotide sequence
gggtagggccactcccaga

SEQ ID NO: 44627 - DNA, 18 bp, Artificial sequence
  synthetic polynucleotide sequence
ctcaccgttccccaacca

SEQ ID NO: 44628 - DNA, 18 bp, Artificial sequence
  synthetic polynucleotide sequence
ggttaggaggagcgggga

SEQ ID NO: 44629 - DNA, 18 bp, Artificial sequence
  synthetic polynucleotide sequence
cctgggcatccataccca

SEQ ID NO: 44630 - DNA, 20 bp, Artificial sequence
  synthetic polynucleotide sequence
ctggtggcataagcaaggca

SEQ ID NO: 44631 - DNA, 22 bp, Artificial sequence
  synthetic polynucleotide sequence
tctaccaccaatcagcaggaga

SEQ ID NO: 44632 - DNA, 19 bp, Artificial sequence
  synthetic polynucleotide sequence
gaggtctcggcgctgggaa

SEQ ID NO: 44633 - DNA, 20 bp, Artificial sequence
  synthetic polynucleotide sequence
agattccccagcgcctcaca

SEQ ID NO: 44634 - DNA, 20 bp, Artificial sequence
  synthetic polynucleotide sequence
gctcctccacctccacgtca

SEQ ID NO: 44635 - DNA, 20 bp, Artificial sequence
  synthetic polynucleotide sequence
tgagcgcagtcagagcagca

SEQ ID NO: 44636 - DNA, 18 bp, Artificial sequence
  synthetic polynucleotide sequence
tcgaccccctcctgccca

SEQ ID NO: 44637 - DNA, 19 bp, Artificial sequence
  synthetic polynucleotide sequence
gcccaggctgaggaagaga

SEQ ID NO: 44638 - DNA, 18 bp, Artificial sequence
  synthetic polynucleotide sequence
cggcaatacgctgaagca

SEQ ID NO: 44639 - DNA, 21 bp, Artificial sequence
  synthetic polynucleotide sequence
ctgcagaaacaacagcgccca

SEQ ID NO: 44640 - DNA, 22 bp, Artificial sequence
  synthetic polynucleotide sequence
tctagggtcaaaactcggctga

SEQ ID NO: 44641 - DNA, 18 bp, Artificial sequence
  synthetic polynucleotide sequence
ggtgctcgatcccaggca

SEQ ID NO: 44642 - DNA, 20 bp, Artificial sequence
  synthetic polynucleotide sequence
cttctagagcccgcagctca

SEQ ID NO: 44643 - DNA, 20 bp, Artificial sequence
  synthetic polynucleotide sequence
gaaaggagatgtggagggca

SEQ ID NO: 44644 - DNA, 19 bp, Artificial sequence
  synthetic polynucleotide sequence
gagcaagggctaccaagga

SEQ ID NO: 44645 - DNA, 20 bp, Artificial sequence
  synthetic polynucleotide sequence
tcggttctaagcccagagga

SEQ ID NO: 44646 - DNA, 18 bp, Artificial sequence
  synthetic polynucleotide sequence
actctgcgatggcaccga

SEQ ID NO: 44647 - DNA, 21 bp, Artificial sequence
  synthetic polynucleotide sequence
caagagagctctcccgagaga

SEQ ID NO: 44648 - DNA, 21 bp, Artificial sequence
  synthetic polynucleotide sequence
ggacgatagagccttccacga

SEQ ID NO: 44649 - DNA, 18 bp, Artificial sequence
  synthetic polynucleotide sequence
ggacctcacggccaccga

SEQ ID NO: 44650 - DNA, 20 bp, Artificial sequence
  synthetic polynucleotide sequence
gggactgcattactgcacga

SEQ ID NO: 44651 - DNA, 22 bp, Artificial sequence
  synthetic polynucleotide sequence
aagaagagagggcttgcaccaa

SEQ ID NO: 44652 - DNA, 22 bp, Artificial sequence
  synthetic polynucleotide sequence
tcatgacagtccttcagccaca

SEQ ID NO: 44653 - DNA, 21 bp, Artificial sequence
  synthetic polynucleotide sequence
gtgggctgcaagaaggagaca

SEQ ID NO: 44654 - DNA, 20 bp, Artificial sequence
  synthetic polynucleotide sequence
taggaacgtgacatccctga

SEQ ID NO: 44655 - DNA, 22 bp, Artificial sequence
  synthetic polynucleotide sequence
aaatggaggcagaggacactga

SEQ ID NO: 44656 - DNA, 22 bp, Artificial sequence
  synthetic polynucleotide sequence
atgctgtattgcggggaggaga

SEQ ID NO: 44657 - DNA, 21 bp, Artificial sequence
  synthetic polynucleotide sequence
agagaacccaaaaaggcggga

SEQ ID NO: 44658 - DNA, 20 bp, Artificial sequence
  synthetic polynucleotide sequence
tcaatggaggccagcctgca

SEQ ID NO: 44659 - DNA, 22 bp, Artificial sequence
  synthetic polynucleotide sequence
aaagggaagcccaagaaggaga

SEQ ID NO: 44660 - DNA, 20 bp, Artificial sequence
  synthetic polynucleotide sequence
caagagcacgaccacggcca

SEQ ID NO: 44661 - DNA, 22 bp, Artificial sequence
  synthetic polynucleotide sequence
caaaacagaaccagtgctgcca

SEQ ID NO: 44662 - DNA, 19 bp, Artificial sequence
  synthetic polynucleotide sequence
tggtctccaaaccacagca

SEQ ID NO: 44663 - DNA, 21 bp, Artificial sequence
  synthetic polynucleotide sequence
tcctgggggaagatgaggcca

SEQ ID NO: 44664 - DNA, 20 bp, Artificial sequence
  synthetic polynucleotide sequence
tctgtaaagggggcagcgca

SEQ ID NO: 44665 - DNA, 20 bp, Artificial sequence
  synthetic polynucleotide sequence
ccggagcctggtaccgtcga

SEQ ID NO: 44666 - DNA, 22 bp, Artificial sequence
  synthetic polynucleotide sequence
ggggatcacaatggagaacaca

SEQ ID NO: 44667 - DNA, 21 bp, Artificial sequence
  synthetic polynucleotide sequence
gcagaatgctggtcaggccca

SEQ ID NO: 44668 - DNA, 21 bp, Artificial sequence
  synthetic polynucleotide sequence
ccttcggatactgcagggcca

SEQ ID NO: 44669 - DNA, 18 bp, Artificial sequence
  synthetic polynucleotide sequence
ggaggaagctcgtcggaa

SEQ ID NO: 44670 - DNA, 18 bp, Artificial sequence
  synthetic polynucleotide sequence
tggcggatgacagggaga

SEQ ID NO: 44671 - DNA, 18 bp, Artificial sequence
  synthetic polynucleotide sequence
gccagcaaagaggagcca

SEQ ID NO: 44672 - DNA, 20 bp, Artificial sequence
  synthetic polynucleotide sequence
ctgggatgtcccgtacagga

SEQ ID NO: 44673 - DNA, 22 bp, Artificial sequence
  synthetic polynucleotide sequence
atcattcaacaccagccagcca

SEQ ID NO: 44674 - DNA, 21 bp, Artificial sequence
  synthetic polynucleotide sequence
aatcaatgccaaacccaccca

SEQ ID NO: 44675 - DNA, 20 bp, Artificial sequence
  synthetic polynucleotide sequence
aggaacccacagccttccca

SEQ ID NO: 44676 - DNA, 20 bp, Artificial sequence
  synthetic polynucleotide sequence
ctctccagtgggtgacccca

SEQ ID NO: 44677 - DNA, 20 bp, Artificial sequence
  synthetic polynucleotide sequence
caggacctggttccagccca

SEQ ID NO: 44678 - DNA, 20 bp, Artificial sequence
  synthetic polynucleotide sequence
cgggcagcgtagtggaacca

SEQ ID NO: 44679 - DNA, 21 bp, Artificial sequence
  synthetic polynucleotide sequence
agcagggacggagtcagccta

SEQ ID NO: 44680 - DNA, 20 bp, Artificial sequence
  synthetic polynucleotide sequence
gcccagcaccttcatggcga

SEQ ID NO: 44681 - DNA, 21 bp, Artificial sequence
  synthetic polynucleotide sequence
tgggaggcagcatcaggtcca

SEQ ID NO: 44682 - DNA, 22 bp, Artificial sequence
  synthetic polynucleotide sequence
acgttgagaatcaccgaggcca

SEQ ID NO: 44683 - DNA, 18 bp, Artificial sequence
  synthetic polynucleotide sequence
tcaagccccgccgcgaca

SEQ ID NO: 44684 - DNA, 21 bp, Artificial sequence
  synthetic polynucleotide sequence
ccgcgacgtagaagtacggga

SEQ ID NO: 44685 - DNA, 18 bp, Artificial sequence
  synthetic polynucleotide sequence
tgcggcccgaggctcgta

SEQ ID NO: 44686 - DNA, 22 bp, Artificial sequence
  synthetic polynucleotide sequence
aagtaggggaagttcatgcgca

SEQ ID NO: 44687 - DNA, 20 bp, Artificial sequence
  synthetic polynucleotide sequence
gggctgactggggaggagca

SEQ ID NO: 44688 - DNA, 20 bp, Artificial sequence
  synthetic polynucleotide sequence
catggagaccccatcacgca

SEQ ID NO: 44689 - DNA, 19 bp, Artificial sequence
  synthetic polynucleotide sequence
ccagcccgtggaggaggaa

SEQ ID NO: 44690 - DNA, 21 bp, Artificial sequence
  synthetic polynucleotide sequence
ttcagcacagctttcggggca

SEQ ID NO: 44691 - DNA, 20 bp, Artificial sequence
  synthetic polynucleotide sequence
caagaggctggtgtgaccga

SEQ ID NO: 44692 - DNA, 21 bp, Artificial sequence
  synthetic polynucleotide sequence
ggggagcttgggacaaaacga

SEQ ID NO: 44693 - DNA, 19 bp, Artificial sequence
  synthetic polynucleotide sequence
taccgggaccctctggtga

SEQ ID NO: 44694 - DNA, 21 bp, Artificial sequence
  synthetic polynucleotide sequence
tccacaggaggagctggtgga

SEQ ID NO: 44695 - DNA, 18 bp, Artificial sequence
  synthetic polynucleotide sequence
gcagccccgataggccaa

SEQ ID NO: 44696 - DNA, 20 bp, Artificial sequence
  synthetic polynucleotide sequence
ccacaacatactcagcccaa

SEQ ID NO: 44697 - DNA, 20 bp, Artificial sequence
  synthetic polynucleotide sequence
gcctgcaccaaagactggga

SEQ ID NO: 44698 - DNA, 20 bp, Artificial sequence
  synthetic polynucleotide sequence
accgagctccactcctggga

SEQ ID NO: 44699 - DNA, 18 bp, Artificial sequence
  synthetic polynucleotide sequence
ggcttccagccactggaa

SEQ ID NO: 44700 - DNA, 19 bp, Artificial sequence
  synthetic polynucleotide sequence
cagcagcagcagtcaagca

SEQ ID NO: 44701 - DNA, 22 bp, Artificial sequence
  synthetic polynucleotide sequence
agtacgactatcagcagccaca

SEQ ID NO: 44702 - DNA, 21 bp, Artificial sequence
  synthetic polynucleotide sequence
ggcaaaacaatgcacagaaca

SEQ ID NO: 44703 - DNA, 19 bp, Artificial sequence
  synthetic polynucleotide sequence
gccagccagctgcctcaca

SEQ ID NO: 44704 - DNA, 21 bp, Artificial sequence
  synthetic polynucleotide sequence
tcttgctgatccaagcgagga

SEQ ID NO: 44705 - DNA, 20 bp, Artificial sequence
  synthetic polynucleotide sequence
catgtcccggaacctgcgca

SEQ ID NO: 44706 - DNA, 20 bp, Artificial sequence
  synthetic polynucleotide sequence
gggatagaaggcggcgccga

SEQ ID NO: 44707 - DNA, 18 bp, Artificial sequence
  synthetic polynucleotide sequence
ctgcaggaatgggacgga

SEQ ID NO: 44708 - DNA, 19 bp, Artificial sequence
  synthetic polynucleotide sequence
cctcagcaacaccatcaca

SEQ ID NO: 44709 - DNA, 21 bp, Artificial sequence
  synthetic polynucleotide sequence
gaggaggagaccacgttcaga

SEQ ID NO: 44710 - DNA, 19 bp, Artificial sequence
  synthetic polynucleotide sequence
tcctccagatccagtccca

SEQ ID NO: 44711 - DNA, 20 bp, Artificial sequence
  synthetic polynucleotide sequence
cttcccaagcacatcctgga

SEQ ID NO: 44712 - DNA, 21 bp, Artificial sequence
  synthetic polynucleotide sequence
acagccccactaaggatcgga

SEQ ID NO: 44713 - DNA, 18 bp, Artificial sequence
  synthetic polynucleotide sequence
gggcccaggtgagacgga

SEQ ID NO: 44714 - DNA, 21 bp, Artificial sequence
  synthetic polynucleotide sequence
catagaaggtctcctggccca

SEQ ID NO: 44715 - DNA, 19 bp, Artificial sequence
  synthetic polynucleotide sequence
caggctgagcccgtggaga

SEQ ID NO: 44716 - DNA, 18 bp, Artificial sequence
  synthetic polynucleotide sequence
gcctctccgctcagggca

SEQ ID NO: 44717 - DNA, 18 bp, Artificial sequence
  synthetic polynucleotide sequence
aggggggcctggcagtga

SEQ ID NO: 44718 - DNA, 21 bp, Artificial sequence
  synthetic polynucleotide sequence
tcttcacccgcttcacactga

SEQ ID NO: 44719 - DNA, 22 bp, Artificial sequence
  synthetic polynucleotide sequence
cacaggtgacaacatccgggaa

SEQ ID NO: 44720 - DNA, 20 bp, Artificial sequence
  synthetic polynucleotide sequence
gaagatgttccacagggcga

SEQ ID NO: 44721 - DNA, 19 bp, Artificial sequence
  synthetic polynucleotide sequence
gcagtgcaggagggcaaca

SEQ ID NO: 44722 - DNA, 21 bp, Artificial sequence
  synthetic polynucleotide sequence
acatcaacacataggcaggca

SEQ ID NO: 44723 - DNA, 20 bp, Artificial sequence
  synthetic polynucleotide sequence
ggagtccatggaaccccaga

SEQ ID NO: 44724 - DNA, 22 bp, Artificial sequence
  synthetic polynucleotide sequence
aggcagacaaaggcaaaggaga

SEQ ID NO: 44725 - DNA, 21 bp, Artificial sequence
  synthetic polynucleotide sequence
ccagggcaagtctcatgggaa

SEQ ID NO: 44726 - DNA, 19 bp, Artificial sequence
  synthetic polynucleotide sequence
ctttgggagcacccggcca

SEQ ID NO: 44727 - DNA, 19 bp, Artificial sequence
  synthetic polynucleotide sequence
caaaggccggagccccaga

SEQ ID NO: 44728 - DNA, 21 bp, Artificial sequence
  synthetic polynucleotide sequence
tgaagtaggcgatgaggagga

SEQ ID NO: 44729 - DNA, 20 bp, Artificial sequence
  synthetic polynucleotide sequence
gccaagactgggaccaggaa

SEQ ID NO: 44730 - DNA, 20 bp, Artificial sequence
  synthetic polynucleotide sequence
atatgggaggtggtggggga

SEQ ID NO: 44731 - DNA, 21 bp, Artificial sequence
  synthetic polynucleotide sequence
agtctggagtgaagatggaca

SEQ ID NO: 44732 - DNA, 21 bp, Artificial sequence
  synthetic polynucleotide sequence
ggcttgaggttcaacagtgga

SEQ ID NO: 44733 - DNA, 18 bp, Artificial sequence
  synthetic polynucleotide sequence
ggccttctctaagcggca

SEQ ID NO: 44734 - DNA, 18 bp, Artificial sequence
  synthetic polynucleotide sequence
tgccacaggggtgacaga

SEQ ID NO: 44735 - DNA, 18 bp, Artificial sequence
  synthetic polynucleotide sequence
cagccagctggacagcaa

SEQ ID NO: 44736 - DNA, 18 bp, Artificial sequence
  synthetic polynucleotide sequence
aggcagcccttcagctca

SEQ ID NO: 44737 - DNA, 18 bp, Artificial sequence
  synthetic polynucleotide sequence
ccagtggagacatcggca

SEQ ID NO: 44738 - DNA, 18 bp, Artificial sequence
  synthetic polynucleotide sequence
tttcgccacgcccaggca

SEQ ID NO: 44739 - DNA, 18 bp, Artificial sequence
  synthetic polynucleotide sequence
gctcaaagacagcgccca

SEQ ID NO: 44740 - DNA, 18 bp, Artificial sequence
  synthetic polynucleotide sequence
tggccggacagcagagca

SEQ ID NO: 44741 - DNA, 20 bp, Artificial sequence
  synthetic polynucleotide sequence
ggagccataccgcactggca

SEQ ID NO: 44742 - DNA, 22 bp, Artificial sequence
  synthetic polynucleotide sequence
agctgggcacaaagagtagcca

SEQ ID NO: 44743 - DNA, 19 bp, Artificial sequence
  synthetic polynucleotide sequence
cccccacagcagaacccca

SEQ ID NO: 44744 - DNA, 19 bp, Artificial sequence
  synthetic polynucleotide sequence
gccaggagaagcagcccca

SEQ ID NO: 44745 - DNA, 18 bp, Artificial sequence
  synthetic polynucleotide sequence
gggtacatcgcctgcaca

SEQ ID NO: 44746 - DNA, 18 bp, Artificial sequence
  synthetic polynucleotide sequence
gttggctgcgctggacga

SEQ ID NO: 44747 - DNA, 21 bp, Artificial sequence
  synthetic polynucleotide sequence
ctgtcgctaccacctcacaga

SEQ ID NO: 44748 - DNA, 21 bp, Artificial sequence
  synthetic polynucleotide sequence
ggacatagcccagggtgagca

SEQ ID NO: 44749 - DNA, 20 bp, Artificial sequence
  synthetic polynucleotide sequence
aagactgacccagccaacca

SEQ ID NO: 44750 - DNA, 20 bp, Artificial sequence
  synthetic polynucleotide sequence
tgaagatggcagatacccca

SEQ ID NO: 44751 - DNA, 20 bp, Artificial sequence
  synthetic polynucleotide sequence
ctcgagtaccagctgaccga

SEQ ID NO: 44752 - DNA, 18 bp, Artificial sequence
  synthetic polynucleotide sequence
caatgtccacctggcgca

SEQ ID NO: 44753 - DNA, 20 bp, Artificial sequence
  synthetic polynucleotide sequence
gagcaggtcaaccccccaga

SEQ ID NO: 44754 - DNA, 21 bp, Artificial sequence
  synthetic polynucleotide sequence
gattgactgcaggtcctggaa

SEQ ID NO: 44755 - DNA, 20 bp, Artificial sequence
  synthetic polynucleotide sequence
gtccagggagaatcccacca

SEQ ID NO: 44756 - DNA, 20 bp, Artificial sequence
  synthetic polynucleotide sequence
gttgggaaggtggctgtgga

SEQ ID NO: 44757 - DNA, 20 bp, Artificial sequence
  synthetic polynucleotide sequence
cgcaccctatggtccaggga

SEQ ID NO: 44758 - DNA, 20 bp, Artificial sequence
  synthetic polynucleotide sequence
gtcgggaaggaggctgtgga

SEQ ID NO: 44759 - DNA, 20 bp, Artificial sequence
  synthetic polynucleotide sequence
ggtacgccaaagaagggaga

SEQ ID NO: 44760 - DNA, 20 bp, Artificial sequence
  synthetic polynucleotide sequence
ctggagacgtggagattgga

SEQ ID NO: 44761 - DNA, 19 bp, Artificial sequence
  synthetic polynucleotide sequence
cctcagaaccgacgccaga

SEQ ID NO: 44762 - DNA, 18 bp, Artificial sequence
  synthetic polynucleotide sequence
acctccaccaggggcaca

SEQ ID NO: 44763 - DNA, 21 bp, Artificial sequence
  synthetic polynucleotide sequence
tgctcagctgctggacgtgga

SEQ ID NO: 44764 - DNA, 19 bp, Artificial sequence
  synthetic polynucleotide sequence
tctgcacaaggctgcggta

SEQ ID NO: 44765 - DNA, 20 bp, Artificial sequence
  synthetic polynucleotide sequence
cgccagcagcatcaagcaga

SEQ ID NO: 44766 - DNA, 20 bp, Artificial sequence
  synthetic polynucleotide sequence
aaggccatgccgtcgctcca

SEQ ID NO: 44767 - DNA, 21 bp, Artificial sequence
  synthetic polynucleotide sequence
aagtggcagcagcatcaggga

SEQ ID NO: 44768 - DNA, 21 bp, Artificial sequence
  synthetic polynucleotide sequence
catcaacagacccagtgacca

SEQ ID NO: 44769 - DNA, 21 bp, Artificial sequence
  synthetic polynucleotide sequence
tgcatgggagccacatcgcaa

SEQ ID NO: 44770 - DNA, 18 bp, Artificial sequence
  synthetic polynucleotide sequence
gggtcagcacaggcccca

SEQ ID NO: 44771 - DNA, 18 bp, Artificial sequence
  synthetic polynucleotide sequence
tctggcaagcggtggaga

SEQ ID NO: 44772 - DNA, 18 bp, Artificial sequence
  synthetic polynucleotide sequence
tgaagccttggagcggga

SEQ ID NO: 44773 - DNA, 19 bp, Artificial sequence
  synthetic polynucleotide sequence
tgatgaagagcgacgagca

SEQ ID NO: 44774 - DNA, 18 bp, Artificial sequence
  synthetic polynucleotide sequence
ggcctgcagcaccttgca

SEQ ID NO: 44775 - DNA, 18 bp, Artificial sequence
  synthetic polynucleotide sequence
cgggtggacgtggacaca

SEQ ID NO: 44776 - DNA, 20 bp, Artificial sequence
  synthetic polynucleotide sequence
atgacagtacagttgggcca

SEQ ID NO: 44777 - DNA, 18 bp, Artificial sequence
  synthetic polynucleotide sequence
ccccaaaggcagaagcca

SEQ ID NO: 44778 - DNA, 22 bp, Artificial sequence
  synthetic polynucleotide sequence
tgcatgtacaagcagacaccca

SEQ ID NO: 44779 - DNA, 20 bp, Artificial sequence
  synthetic polynucleotide sequence
gcacactggaagtgggagca

SEQ ID NO: 44780 - DNA, 18 bp, Artificial sequence
  synthetic polynucleotide sequence
gcaggcatccatggcgca

SEQ ID NO: 44781 - DNA, 20 bp, Artificial sequence
  synthetic polynucleotide sequence
ctcctgtagccccaacacca

SEQ ID NO: 44782 - DNA, 18 bp, Artificial sequence
  synthetic polynucleotide sequence
acaagctggacaggcgca

SEQ ID NO: 44783 - DNA, 21 bp, Artificial sequence
  synthetic polynucleotide sequence
tctggagttgaagcctcagga

SEQ ID NO: 44784 - DNA, 22 bp, Artificial sequence
  synthetic polynucleotide sequence
caaagaggccagatccttcaca

SEQ ID NO: 44785 - DNA, 18 bp, Artificial sequence
  synthetic polynucleotide sequence
ggcccacctccagaccca

SEQ ID NO: 44786 - DNA, 18 bp, Artificial sequence
  synthetic polynucleotide sequence
acatcctgagcagccgga

SEQ ID NO: 44787 - DNA, 19 bp, Artificial sequence
  synthetic polynucleotide sequence
gggctcatctgcagaccca

SEQ ID NO: 44788 - DNA, 20 bp, Artificial sequence
  synthetic polynucleotide sequence
tgtgctacacagcagccaga

SEQ ID NO: 44789 - DNA, 22 bp, Artificial sequence
  synthetic polynucleotide sequence
tactgcgacaaggagtacacca

SEQ ID NO: 44790 - DNA, 20 bp, Artificial sequence
  synthetic polynucleotide sequence
tgcagtaaccagggcctgga

SEQ ID NO: 44791 - DNA, 18 bp, Artificial sequence
  synthetic polynucleotide sequence
cggagtggtggccagcca

SEQ ID NO: 44792 - DNA, 18 bp, Artificial sequence
  synthetic polynucleotide sequence
ccagggccatgtgacgga

SEQ ID NO: 44793 - DNA, 22 bp, Artificial sequence
  synthetic polynucleotide sequence
agatggtggacaagatggacca

SEQ ID NO: 44794 - DNA, 19 bp, Artificial sequence
  synthetic polynucleotide sequence
ctgggaggtgagggtgcca

SEQ ID NO: 44795 - DNA, 22 bp, Artificial sequence
  synthetic polynucleotide sequence
aagatgccagaggttatcccca

SEQ ID NO: 44796 - DNA, 20 bp, Artificial sequence
  synthetic polynucleotide sequence
gtggctcacggtgcagggta

SEQ ID NO: 44797 - DNA, 18 bp, Artificial sequence
  synthetic polynucleotide sequence
cagcaggcgttccaccaa

SEQ ID NO: 44798 - DNA, 18 bp, Artificial sequence
  synthetic polynucleotide sequence
ggcatgcctgtcccagca

SEQ ID NO: 44799 - DNA, 19 bp, Artificial sequence
  synthetic polynucleotide sequence
gtctcccgaagtggccgca

SEQ ID NO: 44800 - DNA, 21 bp, Artificial sequence
  synthetic polynucleotide sequence
atgctcaaccagggctgtgca

SEQ ID NO: 44801 - DNA, 21 bp, Artificial sequence
  synthetic polynucleotide sequence
ggatctggactgcagcctgga

SEQ ID NO: 44802 - DNA, 22 bp, Artificial sequence
  synthetic polynucleotide sequence
aacccccaaagtcaccaggtca

SEQ ID NO: 44803 - DNA, 18 bp, Artificial sequence
  synthetic polynucleotide sequence
ggctgggacttcagccaa

SEQ ID NO: 44804 - DNA, 20 bp, Artificial sequence
  synthetic polynucleotide sequence
gggcctgagactgtccgaga

SEQ ID NO: 44805 - DNA, 20 bp, Artificial sequence
  synthetic polynucleotide sequence
ctaaaggagggggaaagcca

SEQ ID NO: 44806 - DNA, 18 bp, Artificial sequence
  synthetic polynucleotide sequence
gcccagcacaccaaccca

SEQ ID NO: 44807 - DNA, 21 bp, Artificial sequence
  synthetic polynucleotide sequence
ggatcagaaggtggccctgga

SEQ ID NO: 44808 - DNA, 18 bp, Artificial sequence
  synthetic polynucleotide sequence
tggggagccaggggggta

SEQ ID NO: 44809 - DNA, 21 bp, Artificial sequence
  synthetic polynucleotide sequence
gcagaagcagcaggaaagaca

SEQ ID NO: 44810 - DNA, 18 bp, Artificial sequence
  synthetic polynucleotide sequence
gccactgttgccacacca

SEQ ID NO: 44811 - DNA, 21 bp, Artificial sequence
  synthetic polynucleotide sequence
cccagtatccaggctcaggga

SEQ ID NO: 44812 - DNA, 22 bp, Artificial sequence
  synthetic polynucleotide sequence
ggaagatggagacttgagggca

SEQ ID NO: 44813 - DNA, 18 bp, Artificial sequence
  synthetic polynucleotide sequence
caagcagggggtcaccga

SEQ ID NO: 44814 - DNA, 21 bp, Artificial sequence
  synthetic polynucleotide sequence
ctgaagccacaccttgtacca

SEQ ID NO: 44815 - DNA, 18 bp, Artificial sequence
  synthetic polynucleotide sequence
gcgaggctgtggtgagca

SEQ ID NO: 44816 - DNA, 18 bp, Artificial sequence
  synthetic polynucleotide sequence
ccccggaggtgaccgcga

SEQ ID NO: 44817 - DNA, 18 bp, Artificial sequence
  synthetic polynucleotide sequence
tgatgatgcccgcacgga

SEQ ID NO: 44818 - DNA, 18 bp, Artificial sequence
  synthetic polynucleotide sequence
gcacctccaccatgacca

SEQ ID NO: 44819 - DNA, 19 bp, Artificial sequence
  synthetic polynucleotide sequence
cggctaccactgcgagaca

SEQ ID NO: 44820 - DNA, 18 bp, Artificial sequence
  synthetic polynucleotide sequence
taggtgaccgcgtagcca

SEQ ID NO: 44821 - DNA, 19 bp, Artificial sequence
  synthetic polynucleotide sequence
tcgcccaggatgtcagtca

SEQ ID NO: 44822 - DNA, 21 bp, Artificial sequence
  synthetic polynucleotide sequence
tcactgacagtcacgtagcca

SEQ ID NO: 44823 - DNA, 21 bp, Artificial sequence
  synthetic polynucleotide sequence
acgggagcatcgccagaggaa

SEQ ID NO: 44824 - DNA, 21 bp, Artificial sequence
  synthetic polynucleotide sequence
gtgtcctcaagaagtgcccca

SEQ ID NO: 44825 - DNA, 20 bp, Artificial sequence
  synthetic polynucleotide sequence
gtcagaggacgaggagagca

SEQ ID NO: 44826 - DNA, 18 bp, Artificial sequence
  synthetic polynucleotide sequence
tggccgaatactgcacca

SEQ ID NO: 44827 - DNA, 21 bp, Artificial sequence
  synthetic polynucleotide sequence
ggagaaagtgacccaggccca

SEQ ID NO: 44828 - DNA, 21 bp, Artificial sequence
  synthetic polynucleotide sequence
gctcatcacccactgtcacca

SEQ ID NO: 44829 - DNA, 20 bp, Artificial sequence
  synthetic polynucleotide sequence
tccacagggaatgcagggca

SEQ ID NO: 44830 - DNA, 19 bp, Artificial sequence
  synthetic polynucleotide sequence
tcgcacagaggtagctgca

SEQ ID NO: 44831 - DNA, 20 bp, Artificial sequence
  synthetic polynucleotide sequence
tgtgccgtctcgcaagcaga

SEQ ID NO: 44832 - DNA, 21 bp, Artificial sequence
  synthetic polynucleotide sequence
agagactccgagaagccacca

SEQ ID NO: 44833 - DNA, 21 bp, Artificial sequence
  synthetic polynucleotide sequence
tgttccaggagggtctggcta

SEQ ID NO: 44834 - DNA, 21 bp, Artificial sequence
  synthetic polynucleotide sequence
tctgcactacaaccacgggca

SEQ ID NO: 44835 - DNA, 21 bp, Artificial sequence
  synthetic polynucleotide sequence
ctcccgatctccaagacgaca

SEQ ID NO: 44836 - DNA, 19 bp, Artificial sequence
  synthetic polynucleotide sequence
tgtggagtcaaaggaggca

SEQ ID NO: 44837 - DNA, 21 bp, Artificial sequence
  synthetic polynucleotide sequence
caccgatgaagacccacacga

SEQ ID NO: 44838 - DNA, 21 bp, Artificial sequence
  synthetic polynucleotide sequence
acaaacagggtgaggagggga

SEQ ID NO: 44839 - DNA, 21 bp, Artificial sequence
  synthetic polynucleotide sequence
agttccaccccaacggatcca

SEQ ID NO: 44840 - DNA, 19 bp, Artificial sequence
  synthetic polynucleotide sequence
tcactatcccacacagcca

SEQ ID NO: 44841 - DNA, 21 bp, Artificial sequence
  synthetic polynucleotide sequence
gacgccagtcctatagagcca

SEQ ID NO: 44842 - DNA, 21 bp, Artificial sequence
  synthetic polynucleotide sequence
gcttccaccagactgccgtga

SEQ ID NO: 44843 - DNA, 19 bp, Artificial sequence
  synthetic polynucleotide sequence
gcgagcacaaacgggggga

SEQ ID NO: 44844 - DNA, 22 bp, Artificial sequence
  synthetic polynucleotide sequence
aaatacccattctccggagcca

SEQ ID NO: 44845 - DNA, 20 bp, Artificial sequence
  synthetic polynucleotide sequence
gaagcccaagagccaggaga

SEQ ID NO: 44846 - DNA, 18 bp, Artificial sequence
  synthetic polynucleotide sequence
gggatctggccaggtgca

SEQ ID NO: 44847 - DNA, 18 bp, Artificial sequence
  synthetic polynucleotide sequence
cgcggtgcgcgaccggga

SEQ ID NO: 44848 - DNA, 20 bp, Artificial sequence
  synthetic polynucleotide sequence
gttctgtcagacagggcaga

SEQ ID NO: 44849 - DNA, 18 bp, Artificial sequence
  synthetic polynucleotide sequence
ccaggcatgatgggccca

SEQ ID NO: 44850 - DNA, 18 bp, Artificial sequence
  synthetic polynucleotide sequence
ggaggccgcattcccgga

SEQ ID NO: 44851 - DNA, 22 bp, Artificial sequence
  synthetic polynucleotide sequence
ggaacagactgcaacaaccaca

SEQ ID NO: 44852 - DNA, 21 bp, Artificial sequence
  synthetic polynucleotide sequence
ggagggtaatcagggacctga

SEQ ID NO: 44853 - DNA, 20 bp, Artificial sequence
  synthetic polynucleotide sequence
agtgggacctgctcctggaa

SEQ ID NO: 44854 - DNA, 20 bp, Artificial sequence
  synthetic polynucleotide sequence
gtcgagtcattccgggccga

SEQ ID NO: 44855 - DNA, 19 bp, Artificial sequence
  synthetic polynucleotide sequence
gctcagaggcttcagccca

SEQ ID NO: 44856 - DNA, 20 bp, Artificial sequence
  synthetic polynucleotide sequence
cagccaaccaaagacagcga

SEQ ID NO: 44857 - DNA, 21 bp, Artificial sequence
  synthetic polynucleotide sequence
ctgaggtacccaagagtggca

SEQ ID NO: 44858 - DNA, 18 bp, Artificial sequence
  synthetic polynucleotide sequence
ggttccgcaggaccacga

SEQ ID NO: 44859 - DNA, 20 bp, Artificial sequence
  synthetic polynucleotide sequence
ctgacatgctgaagaacgca

SEQ ID NO: 44860 - DNA, 18 bp, Artificial sequence
  synthetic polynucleotide sequence
tcctcggccagcccctga

SEQ ID NO: 44861 - DNA, 21 bp, Artificial sequence
  synthetic polynucleotide sequence
gccagggtcagaaagtgcaga

SEQ ID NO: 44862 - DNA, 20 bp, Artificial sequence
  synthetic polynucleotide sequence
gctcatagagccacacctga

SEQ ID NO: 44863 - DNA, 22 bp, Artificial sequence
  synthetic polynucleotide sequence
caatggactaacaggaaagcca

SEQ ID NO: 44864 - DNA, 20 bp, Artificial sequence
  synthetic polynucleotide sequence
tcacccagatgtccagacaa

SEQ ID NO: 44865 - DNA, 21 bp, Artificial sequence
  synthetic polynucleotide sequence
gtggcagacatgtccaaggaa

SEQ ID NO: 44866 - DNA, 20 bp, Artificial sequence
  synthetic polynucleotide sequence
ctagtcgccatctccacaca

SEQ ID NO: 44867 - DNA, 19 bp, Artificial sequence
  synthetic polynucleotide sequence
gcaaccccacctccaggca

SEQ ID NO: 44868 - DNA, 19 bp, Artificial sequence
  synthetic polynucleotide sequence
ctcattcccggaggcggca

SEQ ID NO: 44869 - DNA, 18 bp, Artificial sequence
  synthetic polynucleotide sequence
cgccgagggtgtgcagga

SEQ ID NO: 44870 - DNA, 21 bp, Artificial sequence
  synthetic polynucleotide sequence
gcttctcgaagggctgtcgca

SEQ ID NO: 44871 - DNA, 18 bp, Artificial sequence
  synthetic polynucleotide sequence
gaagcctggttcagccca

SEQ ID NO: 44872 - DNA, 21 bp, Artificial sequence
  synthetic polynucleotide sequence
gcaaaggacagatccacacca

SEQ ID NO: 44873 - DNA, 18 bp, Artificial sequence
  synthetic polynucleotide sequence
caggctctcgacagggca

SEQ ID NO: 44874 - DNA, 18 bp, Artificial sequence
  synthetic polynucleotide sequence
ctcagcagcagcatggca

SEQ ID NO: 44875 - DNA, 21 bp, Artificial sequence
  synthetic polynucleotide sequence
tggtgtgaagcccgggagcaa

SEQ ID NO: 44876 - DNA, 21 bp, Artificial sequence
  synthetic polynucleotide sequence
tcgtccagtcccaggtggtca

SEQ ID NO: 44877 - DNA, 19 bp, Artificial sequence
  synthetic polynucleotide sequence
cagcccaggatggcaccga

SEQ ID NO: 44878 - DNA, 21 bp, Artificial sequence
  synthetic polynucleotide sequence
tgcacaacctggtcggaagga

SEQ ID NO: 44879 - DNA, 21 bp, Artificial sequence
  synthetic polynucleotide sequence
atccacctgcgcacctaggaa

SEQ ID NO: 44880 - DNA, 22 bp, Artificial sequence
  synthetic polynucleotide sequence
gaaaatcagagcagtggtggca

SEQ ID NO: 44881 - DNA, 17 bp, Artificial sequence
  synthetic polynucleotide sequence
cgccgagccactggaga

SEQ ID NO: 44882 - DNA, 21 bp, Artificial sequence
  synthetic polynucleotide sequence
gtgacagaacaggcgatgaca

SEQ ID NO: 44883 - DNA, 20 bp, Artificial sequence
  synthetic polynucleotide sequence
gtgatgtgctggcggggaca

SEQ ID NO: 44884 - DNA, 21 bp, Artificial sequence
  synthetic polynucleotide sequence
acatcacacaggctttcggga

SEQ ID NO: 44885 - DNA, 22 bp, Artificial sequence
  synthetic polynucleotide sequence
ggatcgcttacacctgagacga

SEQ ID NO: 44886 - DNA, 20 bp, Artificial sequence
  synthetic polynucleotide sequence
tgctgagaacgcctcgggta

SEQ ID NO: 44887 - DNA, 21 bp, Artificial sequence
  synthetic polynucleotide sequence
ctggctgctgatggaagagga

SEQ ID NO: 44888 - DNA, 20 bp, Artificial sequence
  synthetic polynucleotide sequence
cttgggcacgcatttccaca

SEQ ID NO: 44889 - DNA, 21 bp, Artificial sequence
  synthetic polynucleotide sequence
agctctgaggacaacacggca

SEQ ID NO: 44890 - DNA, 18 bp, Artificial sequence
  synthetic polynucleotide sequence
ggtcgaaggcagcgcgga

SEQ ID NO: 44891 - DNA, 18 bp, Artificial sequence
  synthetic polynucleotide sequence
cgtggatcagcgtcgcca

SEQ ID NO: 44892 - DNA, 22 bp, Artificial sequence
  synthetic polynucleotide sequence
taagaagaggtgaaggctgcta

SEQ ID NO: 44893 - DNA, 19 bp, Artificial sequence
  synthetic polynucleotide sequence
cctcaccgcctcccagtga

SEQ ID NO: 44894 - DNA, 19 bp, Artificial sequence
  synthetic polynucleotide sequence
cctcccacagccctcctca

SEQ ID NO: 44895 - DNA, 21 bp, Artificial sequence
  synthetic polynucleotide sequence
tacccggcgccttaactcgaa

SEQ ID NO: 44896 - DNA, 18 bp, Artificial sequence
  synthetic polynucleotide sequence
tgaagcgcgcgcgtccca

SEQ ID NO: 44897 - DNA, 20 bp, Artificial sequence
  synthetic polynucleotide sequence
gggatggggaagccttggca

SEQ ID NO: 44898 - DNA, 22 bp, Artificial sequence
  synthetic polynucleotide sequence
agcacttaggaaccccaggtga

SEQ ID NO: 44899 - DNA, 22 bp, Artificial sequence
  synthetic polynucleotide sequence
atagaagagcagttggacacga

SEQ ID NO: 44900 - DNA, 18 bp, Artificial sequence
  synthetic polynucleotide sequence
ggaagctgggcatcagga

SEQ ID NO: 44901 - DNA, 20 bp, Artificial sequence
  synthetic polynucleotide sequence
cctacctaagccaggccaca

SEQ ID NO: 44902 - DNA, 21 bp, Artificial sequence
  synthetic polynucleotide sequence
ctccctgaagcaagacgtgca

SEQ ID NO: 44903 - DNA, 20 bp, Artificial sequence
  synthetic polynucleotide sequence
gtggaagcacgagcagccca

SEQ ID NO: 44904 - DNA, 21 bp, Artificial sequence
  synthetic polynucleotide sequence
agcgtctcagagtacccccca

SEQ ID NO: 44905 - DNA, 21 bp, Artificial sequence
  synthetic polynucleotide sequence
ccggagatgcctatgacgcca

SEQ ID NO: 44906 - DNA, 22 bp, Artificial sequence
  synthetic polynucleotide sequence
atgatgtccgggaagttagcca

SEQ ID NO: 44907 - DNA, 22 bp, Artificial sequence
  synthetic polynucleotide sequence
aagagcagaaactggctgctga

SEQ ID NO: 44908 - DNA, 18 bp, Artificial sequence
  synthetic polynucleotide sequence
accccagctcagccggca

SEQ ID NO: 44909 - DNA, 19 bp, Artificial sequence
  synthetic polynucleotide sequence
ggacagccctgaaagggaa

SEQ ID NO: 44910 - DNA, 21 bp, Artificial sequence
  synthetic polynucleotide sequence
caaagatcacgggagcagaca

SEQ ID NO: 44911 - DNA, 20 bp, Artificial sequence
  synthetic polynucleotide sequence
tggcctgagctccaactcca

SEQ ID NO: 44912 - DNA, 20 bp, Artificial sequence
  synthetic polynucleotide sequence
ctcgatgcgagctgaagcga

SEQ ID NO: 44913 - DNA, 20 bp, Artificial sequence
  synthetic polynucleotide sequence
cactgaatgccccgatccca

SEQ ID NO: 44914 - DNA, 21 bp, Artificial sequence
  synthetic polynucleotide sequence
ccaaacccgcagtccatcaga

SEQ ID NO: 44915 - DNA, 20 bp, Artificial sequence
  synthetic polynucleotide sequence
ggaggcttacatccagggca

SEQ ID NO: 44916 - DNA, 19 bp, Artificial sequence
  synthetic polynucleotide sequence
ctgggagctgctgtcgcca

SEQ ID NO: 44917 - DNA, 21 bp, Artificial sequence
  synthetic polynucleotide sequence
ttgccctctctaccaaaggca

SEQ ID NO: 44918 - DNA, 19 bp, Artificial sequence
  synthetic polynucleotide sequence
tggaaaatcgctggctgca

SEQ ID NO: 44919 - DNA, 20 bp, Artificial sequence
  synthetic polynucleotide sequence
ggacagcaaaatgcccgcca

SEQ ID NO: 44920 - DNA, 22 bp, Artificial sequence
  synthetic polynucleotide sequence
tgaactctcagctcaggacaca

SEQ ID NO: 44921 - DNA, 19 bp, Artificial sequence
  synthetic polynucleotide sequence
tggcatggacagtacgaca

SEQ ID NO: 44922 - DNA, 21 bp, Artificial sequence
  synthetic polynucleotide sequence
tggtcaagcaggtgcctggca

SEQ ID NO: 44923 - DNA, 20 bp, Artificial sequence
  synthetic polynucleotide sequence
gtgtcccagatgaggcagga

SEQ ID NO: 44924 - DNA, 21 bp, Artificial sequence
  synthetic polynucleotide sequence
gaaacactgaggggatccaga

SEQ ID NO: 44925 - DNA, 18 bp, Artificial sequence
  synthetic polynucleotide sequence
tcccccgctccctgggaa

SEQ ID NO: 44926 - DNA, 21 bp, Artificial sequence
  synthetic polynucleotide sequence
ttctgtgccagaggatgacca

SEQ ID NO: 44927 - DNA, 19 bp, Artificial sequence
  synthetic polynucleotide sequence
tggagggtgagctggctga

SEQ ID NO: 44928 - DNA, 21 bp, Artificial sequence
  synthetic polynucleotide sequence
tcttccttccgcagagccaca

SEQ ID NO: 44929 - DNA, 21 bp, Artificial sequence
  synthetic polynucleotide sequence
ccacacaggcacagaggcaga

SEQ ID NO: 44930 - DNA, 22 bp, Artificial sequence
  synthetic polynucleotide sequence
caggtacaaggatccagctgca

SEQ ID NO: 44931 - DNA, 20 bp, Artificial sequence
  synthetic polynucleotide sequence
tgaagccctcatcacgggca

SEQ ID NO: 44932 - DNA, 20 bp, Artificial sequence
  synthetic polynucleotide sequence
ccgcaggcaggcatctcgga

SEQ ID NO: 44933 - DNA, 21 bp, Artificial sequence
  synthetic polynucleotide sequence
cctatgaagccatcggggaga

SEQ ID NO: 44934 - DNA, 19 bp, Artificial sequence
  synthetic polynucleotide sequence
cgaaacccaccacgcggca

SEQ ID NO: 44935 - DNA, 18 bp, Artificial sequence
  synthetic polynucleotide sequence
ttgtggagaggcgacgga

SEQ ID NO: 44936 - DNA, 22 bp, Artificial sequence
  synthetic polynucleotide sequence
agatgtgagatgacagactgca

SEQ ID NO: 44937 - DNA, 21 bp, Artificial sequence
  synthetic polynucleotide sequence
gcccacgtttcagagcccaga

SEQ ID NO: 44938 - DNA, 21 bp, Artificial sequence
  synthetic polynucleotide sequence
aagtcgggcttcgtaggagca

SEQ ID NO: 44939 - DNA, 21 bp, Artificial sequence
  synthetic polynucleotide sequence
ctacaggccgaaacttcccaa

SEQ ID NO: 44940 - DNA, 20 bp, Artificial sequence
  synthetic polynucleotide sequence
tgccaggcagttctgcagca

SEQ ID NO: 44941 - DNA, 21 bp, Artificial sequence
  synthetic polynucleotide sequence
gtggtcagcgtcagaagagga

SEQ ID NO: 44942 - DNA, 19 bp, Artificial sequence
  synthetic polynucleotide sequence
cagggcctctgagagtcca

SEQ ID NO: 44943 - DNA, 19 bp, Artificial sequence
  synthetic polynucleotide sequence
gagcagctggagtcccgca

SEQ ID NO: 44944 - DNA, 20 bp, Artificial sequence
  synthetic polynucleotide sequence
gcggaggatgtgggaggtga

SEQ ID NO: 44945 - DNA, 19 bp, Artificial sequence
  synthetic polynucleotide sequence
tggcactcacaagggagca

SEQ ID NO: 44946 - DNA, 18 bp, Artificial sequence
  synthetic polynucleotide sequence
gctccaggtacaggcgga

SEQ ID NO: 44947 - DNA, 21 bp, Artificial sequence
  synthetic polynucleotide sequence
agagcacctccagaacaagga

SEQ ID NO: 44948 - DNA, 22 bp, Artificial sequence
  synthetic polynucleotide sequence
ggaacatgatccaccaggtcca

SEQ ID NO: 44949 - DNA, 18 bp, Artificial sequence
  synthetic polynucleotide sequence
gccgagagcccttcagca

SEQ ID NO: 44950 - DNA, 18 bp, Artificial sequence
  synthetic polynucleotide sequence
gccagtcatggaccacca

SEQ ID NO: 44951 - DNA, 20 bp, Artificial sequence
  synthetic polynucleotide sequence
gatggcctcgggacccacga

SEQ ID NO: 44952 - DNA, 19 bp, Artificial sequence
  synthetic polynucleotide sequence
gccgccacgtagtgctcca

SEQ ID NO: 44953 - DNA, 21 bp, Artificial sequence
  synthetic polynucleotide sequence
ccgctctacacgtcagcacca

SEQ ID NO: 44954 - DNA, 18 bp, Artificial sequence
  synthetic polynucleotide sequence
ggcagtccccagatggca

SEQ ID NO: 44955 - DNA, 18 bp, Artificial sequence
  synthetic polynucleotide sequence
cagccgtctgcccagcca

SEQ ID NO: 44956 - DNA, 20 bp, Artificial sequence
  synthetic polynucleotide sequence
tgacggtcttccgacagaga

SEQ ID NO: 44957 - DNA, 20 bp, Artificial sequence
  synthetic polynucleotide sequence
ctgcaagatgccgtggggca

SEQ ID NO: 44958 - DNA, 22 bp, Artificial sequence
  synthetic polynucleotide sequence
atctgatcgaggtgggaaagga

SEQ ID NO: 44959 - DNA, 22 bp, Artificial sequence
  synthetic polynucleotide sequence
tgatggaccgttatgaagcaga

SEQ ID NO: 44960 - DNA, 18 bp, Artificial sequence
  synthetic polynucleotide sequence
acgggtcatgggcgtcga

SEQ ID NO: 44961 - DNA, 21 bp, Artificial sequence
  synthetic polynucleotide sequence
acctagttgtcgccccagaga

SEQ ID NO: 44962 - DNA, 22 bp, Artificial sequence
  synthetic polynucleotide sequence
agcaatggtgagagtggaggga

SEQ ID NO: 44963 - DNA, 21 bp, Artificial sequence
  synthetic polynucleotide sequence
tgacctctccacaccctccaa

SEQ ID NO: 44964 - DNA, 21 bp, Artificial sequence
  synthetic polynucleotide sequence
gattcagctgctcggatggga

SEQ ID NO: 44965 - DNA, 22 bp, Artificial sequence
  synthetic polynucleotide sequence
atgaagagaggcatgttggaga

SEQ ID NO: 44966 - DNA, 18 bp, Artificial sequence
  synthetic polynucleotide sequence
gtgcggccaatgatgcaa

SEQ ID NO: 44967 - DNA, 18 bp, Artificial sequence
  synthetic polynucleotide sequence
gggagttgctggaagcca

SEQ ID NO: 44968 - DNA, 18 bp, Artificial sequence
  synthetic polynucleotide sequence
tcaatccccagcagtgga

SEQ ID NO: 44969 - DNA, 20 bp, Artificial sequence
  synthetic polynucleotide sequence
tcctccgggacggagatgga

SEQ ID NO: 44970 - DNA, 20 bp, Artificial sequence
  synthetic polynucleotide sequence
cttggaaggagagtggcgga

SEQ ID NO: 44971 - DNA, 20 bp, Artificial sequence
  synthetic polynucleotide sequence
gcgcgcctgcagatcaacga

SEQ ID NO: 44972 - DNA, 20 bp, Artificial sequence
  synthetic polynucleotide sequence
gatgcccaggtgcgaggcca

SEQ ID NO: 44973 - DNA, 19 bp, Artificial sequence
  synthetic polynucleotide sequence
cggggccggtggatctgga

SEQ ID NO: 44974 - DNA, 21 bp, Artificial sequence
  synthetic polynucleotide sequence
gcagctgcaacccaaacccaa

SEQ ID NO: 44975 - DNA, 21 bp, Artificial sequence
  synthetic polynucleotide sequence
catcaagctccgcctcagaga

SEQ ID NO: 44976 - DNA, 20 bp, Artificial sequence
  synthetic polynucleotide sequence
gagacagcgctgcactggaa

SEQ ID NO: 44977 - DNA, 19 bp, Artificial sequence
  synthetic polynucleotide sequence
tcctggccagttcacagga

SEQ ID NO: 44978 - DNA, 18 bp, Artificial sequence
  synthetic polynucleotide sequence
atccaggcttgggcacca

SEQ ID NO: 44979 - DNA, 18 bp, Artificial sequence
  synthetic polynucleotide sequence
gatcacactgctccggca

SEQ ID NO: 44980 - DNA, 20 bp, Artificial sequence
  synthetic polynucleotide sequence
atccacgtaggtgatgggga

SEQ ID NO: 44981 - DNA, 18 bp, Artificial sequence
  synthetic polynucleotide sequence
gcccggagaaatcggaga

SEQ ID NO: 44982 - DNA, 22 bp, Artificial sequence
  synthetic polynucleotide sequence
ctttctcagtgacagctccaca

SEQ ID NO: 44983 - DNA, 18 bp, Artificial sequence
  synthetic polynucleotide sequence
gccccagaacgaagacga

SEQ ID NO: 44984 - DNA, 18 bp, Artificial sequence
  synthetic polynucleotide sequence
tgggtcctccgggagaca

SEQ ID NO: 44985 - DNA, 22 bp, Artificial sequence
  synthetic polynucleotide sequence
accctgaaccacccaagcaaca

SEQ ID NO: 44986 - DNA, 21 bp, Artificial sequence
  synthetic polynucleotide sequence
caagcaccccactgctctcaa

SEQ ID NO: 44987 - DNA, 21 bp, Artificial sequence
  synthetic polynucleotide sequence
gaaccttacactgaccgggga

SEQ ID NO: 44988 - DNA, 22 bp, Artificial sequence
  synthetic polynucleotide sequence
ttgaggccaatgacaggaacca

SEQ ID NO: 44989 - DNA, 21 bp, Artificial sequence
  synthetic polynucleotide sequence
ccaggtgacagcctatgcaga

SEQ ID NO: 44990 - DNA, 20 bp, Artificial sequence
  synthetic polynucleotide sequence
gtgctattgccgaaccacca

SEQ ID NO: 44991 - DNA, 21 bp, Artificial sequence
  synthetic polynucleotide sequence
cggaagtcaccatcgagtgca

SEQ ID NO: 44992 - DNA, 21 bp, Artificial sequence
  synthetic polynucleotide sequence
cggtggtcatctcagagccca

SEQ ID NO: 44993 - DNA, 20 bp, Artificial sequence
  synthetic polynucleotide sequence
cagtgggtcccagatggaga

SEQ ID NO: 44994 - DNA, 19 bp, Artificial sequence
  synthetic polynucleotide sequence
ccctgagggcagtcacaca

SEQ ID NO: 44995 - DNA, 18 bp, Artificial sequence
  synthetic polynucleotide sequence
agccgaatgccgtaggca

SEQ ID NO: 44996 - DNA, 20 bp, Artificial sequence
  synthetic polynucleotide sequence
gatgcctccagaatccagga

SEQ ID NO: 44997 - DNA, 19 bp, Artificial sequence
  synthetic polynucleotide sequence
tcctcctaggcaacccaca

SEQ ID NO: 44998 - DNA, 20 bp, Artificial sequence
  synthetic polynucleotide sequence
ataagggagggctttcagga

SEQ ID NO: 44999 - DNA, 20 bp, Artificial sequence
  synthetic polynucleotide sequence
cctccgccaccaccaagaga

SEQ ID NO: 45000 - DNA, 21 bp, Artificial sequence
  synthetic polynucleotide sequence
ctgtgaagatgccccagtgga

SEQ ID NO: 45001 - DNA, 20 bp, Artificial sequence
  synthetic polynucleotide sequence
cttgcaggcccgagggagca

SEQ ID NO: 45002 - DNA, 20 bp, Artificial sequence
  synthetic polynucleotide sequence
ggcagaaggcggtgtctcaa

SEQ ID NO: 45003 - DNA, 18 bp, Artificial sequence
  synthetic polynucleotide sequence
atggccagtgcaccagca

SEQ ID NO: 45004 - DNA, 18 bp, Artificial sequence
  synthetic polynucleotide sequence
acaccgccactcctggga

SEQ ID NO: 45005 - DNA, 21 bp, Artificial sequence
  synthetic polynucleotide sequence
tgacgacctcatgctccagga

SEQ ID NO: 45006 - DNA, 19 bp, Artificial sequence
  synthetic polynucleotide sequence
ccccggagtaggtcgacga

SEQ ID NO: 45007 - DNA, 20 bp, Artificial sequence
  synthetic polynucleotide sequence
cctccaaggcaggaacggca

SEQ ID NO: 45008 - DNA, 20 bp, Artificial sequence
  synthetic polynucleotide sequence
acccacaggctgtgtcgcca

SEQ ID NO: 45009 - DNA, 18 bp, Artificial sequence
  synthetic polynucleotide sequence
acgacgccgatgtggaca

SEQ ID NO: 45010 - DNA, 18 bp, Artificial sequence
  synthetic polynucleotide sequence
cgtccagggctcccacca

SEQ ID NO: 45011 - DNA, 21 bp, Artificial sequence
  synthetic polynucleotide sequence
aggactaaggagttgggagca

SEQ ID NO: 45012 - DNA, 19 bp, Artificial sequence
  synthetic polynucleotide sequence
cagcgcgtcggcctgccca

SEQ ID NO: 45013 - DNA, 18 bp, Artificial sequence
  synthetic polynucleotide sequence
ctgcccacggtctcacca

SEQ ID NO: 45014 - DNA, 20 bp, Artificial sequence
  synthetic polynucleotide sequence
gagatggaggggaaggctga

SEQ ID NO: 45015 - DNA, 20 bp, Artificial sequence
  synthetic polynucleotide sequence
ggagcgagcctctacgacga

SEQ ID NO: 45016 - DNA, 18 bp, Artificial sequence
  synthetic polynucleotide sequence
gccgctgctgctggacga

SEQ ID NO: 45017 - DNA, 20 bp, Artificial sequence
  synthetic polynucleotide sequence
ggccaaggatgagcggagga

SEQ ID NO: 45018 - DNA, 21 bp, Artificial sequence
  synthetic polynucleotide sequence
ccttgtactctcccacgcgca

SEQ ID NO: 45019 - DNA, 25 bp, Artificial sequence
  synthetic polynucleotide sequence
cgactctcccaaaacaaatctccga

SEQ ID NO: 45020 - DNA, 20 bp, Artificial sequence
  synthetic polynucleotide sequence
tccgaggagagtgaagggga

SEQ ID NO: 45021 - DNA, 18 bp, Artificial sequence
  synthetic polynucleotide sequence
ccacaaacgctgagccca

SEQ ID NO: 45022 - DNA, 18 bp, Artificial sequence
  synthetic polynucleotide sequence
cagctgcgatcagaccga

SEQ ID NO: 45023 - DNA, 18 bp, Artificial sequence
  synthetic polynucleotide sequence
gaggtggaccgcacggaa

SEQ ID NO: 45024 - DNA, 18 bp, Artificial sequence
  synthetic polynucleotide sequence
agctggcgtcggacacca

SEQ ID NO: 45025 - DNA, 20 bp, Artificial sequence
  synthetic polynucleotide sequence
tcacagccccctaggagcca

SEQ ID NO: 45026 - DNA, 20 bp, Artificial sequence
  synthetic polynucleotide sequence
agccccgggacacgtgggaa

SEQ ID NO: 45027 - DNA, 18 bp, Artificial sequence
  synthetic polynucleotide sequence
acatgaacggctcgccca

SEQ ID NO: 45028 - DNA, 19 bp, Artificial sequence
  synthetic polynucleotide sequence
cctcggacttgaccaccga

SEQ ID NO: 45029 - DNA, 20 bp, Artificial sequence
  synthetic polynucleotide sequence
gaaatggctggcacacggga

SEQ ID NO: 45030 - DNA, 20 bp, Artificial sequence
  synthetic polynucleotide sequence
ggcgaggctgctcagagcca

SEQ ID NO: 45031 - DNA, 18 bp, Artificial sequence
  synthetic polynucleotide sequence
cgtgaacggctgggccaa

SEQ ID NO: 45032 - DNA, 18 bp, Artificial sequence
  synthetic polynucleotide sequence
tgtactgcaggccggcca

SEQ ID NO: 45033 - DNA, 21 bp, Artificial sequence
  synthetic polynucleotide sequence
ctctagagagcgccaacagga

SEQ ID NO: 45034 - DNA, 19 bp, Artificial sequence
  synthetic polynucleotide sequence
gggagggggctggtagaca

SEQ ID NO: 45035 - DNA, 21 bp, Artificial sequence
  synthetic polynucleotide sequence
cgacgacgagttcgaagacga

SEQ ID NO: 45036 - DNA, 18 bp, Artificial sequence
  synthetic polynucleotide sequence
gctcacctcgggcgtgca

SEQ ID NO: 45037 - DNA, 18 bp, Artificial sequence
  synthetic polynucleotide sequence
agcccaggccaaagcgca

SEQ ID NO: 45038 - DNA, 18 bp, Artificial sequence
  synthetic polynucleotide sequence
gcaggtgaggggagggca

SEQ ID NO: 45039 - DNA, 21 bp, Artificial sequence
  synthetic polynucleotide sequence
tgaagcacgagtctacaggga

SEQ ID NO: 45040 - DNA, 21 bp, Artificial sequence
  synthetic polynucleotide sequence
tgcatgtcggggaaggcctga

SEQ ID NO: 45041 - DNA, 18 bp, Artificial sequence
  synthetic polynucleotide sequence
aacactcctggccaccca

SEQ ID NO: 45042 - DNA, 18 bp, Artificial sequence
  synthetic polynucleotide sequence
tggccgtggcatcagcca

SEQ ID NO: 45043 - DNA, 18 bp, Artificial sequence
  synthetic polynucleotide sequence
caagacggagctgcagca

SEQ ID NO: 45044 - DNA, 18 bp, Artificial sequence
  synthetic polynucleotide sequence
cgaactcgtggacgtcga

SEQ ID NO: 45045 - DNA, 20 bp, Artificial sequence
  synthetic polynucleotide sequence
tacgactacaccgaccacca

SEQ ID NO: 45046 - DNA, 18 bp, Artificial sequence
  synthetic polynucleotide sequence
gggatggaagggacccca

SEQ ID NO: 45047 - DNA, 18 bp, Artificial sequence
  synthetic polynucleotide sequence
ccagatgcccaaccccaa

SEQ ID NO: 45048 - DNA, 18 bp, Artificial sequence
  synthetic polynucleotide sequence
agcgcaagtgtgcccgca

SEQ ID NO: 45049 - DNA, 21 bp, Artificial sequence
  synthetic polynucleotide sequence
ctgccagaaccaccaagcaca

SEQ ID NO: 45050 - DNA, 21 bp, Artificial sequence
  synthetic polynucleotide sequence
tggacaagtgtcgcagcagaa

SEQ ID NO: 45051 - DNA, 21 bp, Artificial sequence
  synthetic polynucleotide sequence
ggcagagcagagacacaccaa

SEQ ID NO: 45052 - DNA, 20 bp, Artificial sequence
  synthetic polynucleotide sequence
cttggcgcacagggtgaaca

SEQ ID NO: 45053 - DNA, 20 bp, Artificial sequence
  synthetic polynucleotide sequence
gatggtcgcagagatccaga

SEQ ID NO: 45054 - DNA, 20 bp, Artificial sequence
  synthetic polynucleotide sequence
gtctcggaggcccataagga

SEQ ID NO: 45055 - DNA, 21 bp, Artificial sequence
  synthetic polynucleotide sequence
cgacggctgatggaggaagga

SEQ ID NO: 45056 - DNA, 20 bp, Artificial sequence
  synthetic polynucleotide sequence
tccacaggtgggatgtggca

SEQ ID NO: 45057 - DNA, 20 bp, Artificial sequence
  synthetic polynucleotide sequence
atggcctgcacgtgtcccaa

SEQ ID NO: 45058 - DNA, 21 bp, Artificial sequence
  synthetic polynucleotide sequence
gcagcaaggacgtcttacgga

SEQ ID NO: 45059 - DNA, 18 bp, Artificial sequence
  synthetic polynucleotide sequence
caagttgcggcaggtgga

SEQ ID NO: 45060 - DNA, 20 bp, Artificial sequence
  synthetic polynucleotide sequence
tgagctgccactcttcagga

SEQ ID NO: 45061 - DNA, 19 bp, Artificial sequence
  synthetic polynucleotide sequence
ggactgggcaggttggcca

SEQ ID NO: 45062 - DNA, 21 bp, Artificial sequence
  synthetic polynucleotide sequence
aggaggagggagattctggca

SEQ ID NO: 45063 - DNA, 19 bp, Artificial sequence
  synthetic polynucleotide sequence
cggactcacacgggcgaga

SEQ ID NO: 45064 - DNA, 19 bp, Artificial sequence
  synthetic polynucleotide sequence
ccgcttaaccccggcctca

SEQ ID NO: 45065 - DNA, 21 bp, Artificial sequence
  synthetic polynucleotide sequence
acgccaagacgtcgcacctga

SEQ ID NO: 45066 - DNA, 19 bp, Artificial sequence
  synthetic polynucleotide sequence
gtctggaggtggcgctgca

SEQ ID NO: 45067 - DNA, 20 bp, Artificial sequence
  synthetic polynucleotide sequence
gcttcgcacctgaaggccca

SEQ ID NO: 45068 - DNA, 21 bp, Artificial sequence
  synthetic polynucleotide sequence
atgacgctccagctcatccga

SEQ ID NO: 45069 - DNA, 21 bp, Artificial sequence
  synthetic polynucleotide sequence
aaaagggcagcgacagtgaca

SEQ ID NO: 45070 - DNA, 20 bp, Artificial sequence
  synthetic polynucleotide sequence
actgacgccggagtcatgca

SEQ ID NO: 45071 - DNA, 21 bp, Artificial sequence
  synthetic polynucleotide sequence
cgaggagcaagaaccacctga

SEQ ID NO: 45072 - DNA, 19 bp, Artificial sequence
  synthetic polynucleotide sequence
ccccggaaggcagcttgga

SEQ ID NO: 45073 - DNA, 20 bp, Artificial sequence
  synthetic polynucleotide sequence
gctccgcctgaaaccgagga

SEQ ID NO: 45074 - DNA, 21 bp, Artificial sequence
  synthetic polynucleotide sequence
gattcaccaccagggcatcca

SEQ ID NO: 45075 - DNA, 20 bp, Artificial sequence
  synthetic polynucleotide sequence
caacaacgggatcttccaga

SEQ ID NO: 45076 - DNA, 18 bp, Artificial sequence
  synthetic polynucleotide sequence
tccggcacacgttgggga

SEQ ID NO: 45077 - DNA, 18 bp, Artificial sequence
  synthetic polynucleotide sequence
cacgacgggcgtcaagga

SEQ ID NO: 45078 - DNA, 18 bp, Artificial sequence
  synthetic polynucleotide sequence
cgtcatcgccacagtgca

SEQ ID NO: 45079 - DNA, 21 bp, Artificial sequence
  synthetic polynucleotide sequence
acatcaggtgtgccaagcaga

SEQ ID NO: 45080 - DNA, 22 bp, Artificial sequence
  synthetic polynucleotide sequence
cagaacagtgtagcctccaaga

SEQ ID NO: 45081 - DNA, 20 bp, Artificial sequence
  synthetic polynucleotide sequence
actggagagagcagggctga

SEQ ID NO: 45082 - DNA, 21 bp, Artificial sequence
  synthetic polynucleotide sequence
tggtccacgaaggcggtgtca

SEQ ID NO: 45083 - DNA, 21 bp, Artificial sequence
  synthetic polynucleotide sequence
ctgcgtgatcaagcaagacca

SEQ ID NO: 45084 - DNA, 20 bp, Artificial sequence
  synthetic polynucleotide sequence
cagcgcagcacttcccggaa

SEQ ID NO: 45085 - DNA, 21 bp, Artificial sequence
  synthetic polynucleotide sequence
ccgagcgaaatgccaagtaca

SEQ ID NO: 45086 - DNA, 20 bp, Artificial sequence
  synthetic polynucleotide sequence
gagacacctgtggcccacga

SEQ ID NO: 45087 - DNA, 21 bp, Artificial sequence
  synthetic polynucleotide sequence
acaggtgcagagctacatgga

SEQ ID NO: 45088 - DNA, 19 bp, Artificial sequence
  synthetic polynucleotide sequence
cgggcctcgtcacagctga

SEQ ID NO: 45089 - DNA, 21 bp, Artificial sequence
  synthetic polynucleotide sequence
actgtggactccagctagcaa

SEQ ID NO: 45090 - DNA, 20 bp, Artificial sequence
  synthetic polynucleotide sequence
tgccggatgccaagcttgca

SEQ ID NO: 45091 - DNA, 20 bp, Artificial sequence
  synthetic polynucleotide sequence
tctgcagccgaagagcagga

SEQ ID NO: 45092 - DNA, 20 bp, Artificial sequence
  synthetic polynucleotide sequence
gggagccagtccacggagca

SEQ ID NO: 45093 - DNA, 21 bp, Artificial sequence
  synthetic polynucleotide sequence
ccaggatcgtctcaagccaga

SEQ ID NO: 45094 - DNA, 19 bp, Artificial sequence
  synthetic polynucleotide sequence
ttcactgcgtggcgtagca

SEQ ID NO: 45095 - DNA, 19 bp, Artificial sequence
  synthetic polynucleotide sequence
gctcagcgagggatgccca

SEQ ID NO: 45096 - DNA, 20 bp, Artificial sequence
  synthetic polynucleotide sequence
ccaggtagtaggcgccctca

SEQ ID NO: 45097 - DNA, 18 bp, Artificial sequence
  synthetic polynucleotide sequence
agccaggcaccctaacca

SEQ ID NO: 45098 - DNA, 18 bp, Artificial sequence
  synthetic polynucleotide sequence
cccatgaccttgaccgga

SEQ ID NO: 45099 - DNA, 19 bp, Artificial sequence
  synthetic polynucleotide sequence
gcctccatcgacctgcaga

SEQ ID NO: 45100 - DNA, 18 bp, Artificial sequence
  synthetic polynucleotide sequence
ccggcagttggatcacca

SEQ ID NO: 45101 - DNA, 19 bp, Artificial sequence
  synthetic polynucleotide sequence
cgtgcggagacagagacca

SEQ ID NO: 45102 - DNA, 20 bp, Artificial sequence
  synthetic polynucleotide sequence
tccacctcctgagagagcca

SEQ ID NO: 45103 - DNA, 20 bp, Artificial sequence
  synthetic polynucleotide sequence
agctggcgactagaccccaa

SEQ ID NO: 45104 - DNA, 20 bp, Artificial sequence
  synthetic polynucleotide sequence
ggccagtctcccaagagcca

SEQ ID NO: 45105 - DNA, 20 bp, Artificial sequence
  synthetic polynucleotide sequence
agccaaagacgcagcccaca

SEQ ID NO: 45106 - DNA, 20 bp, Artificial sequence
  synthetic polynucleotide sequence
cttccccactctgccgcaga

SEQ ID NO: 45107 - DNA, 21 bp, Artificial sequence
  synthetic polynucleotide sequence
tggagctggcacaagcaggga

SEQ ID NO: 45108 - DNA, 21 bp, Artificial sequence
  synthetic polynucleotide sequence
tgatgttactgacacccggca

SEQ ID NO: 45109 - DNA, 21 bp, Artificial sequence
  synthetic polynucleotide sequence
atctgtagcccagtggaggaa

SEQ ID NO: 45110 - DNA, 19 bp, Artificial sequence
  synthetic polynucleotide sequence
tgacaaatcccactgccca

SEQ ID NO: 45111 - DNA, 21 bp, Artificial sequence
  synthetic polynucleotide sequence
cgagttcgggaagccatcaga

SEQ ID NO: 45112 - DNA, 22 bp, Artificial sequence
  synthetic polynucleotide sequence
cccagagcaacagtttcgccaa

SEQ ID NO: 45113 - DNA, 21 bp, Artificial sequence
  synthetic polynucleotide sequence
agatgatgccggagaccccaa

SEQ ID NO: 45114 - DNA, 22 bp, Artificial sequence
  synthetic polynucleotide sequence
aagttcctcctgtagcgaacca

SEQ ID NO: 45115 - DNA, 19 bp, Artificial sequence
  synthetic polynucleotide sequence
caacaatccagtgtccgca

SEQ ID NO: 45116 - DNA, 18 bp, Artificial sequence
  synthetic polynucleotide sequence
agcaggttgcgggtctga

SEQ ID NO: 45117 - DNA, 21 bp, Artificial sequence
  synthetic polynucleotide sequence
ggccaacgagatgatgccgga

SEQ ID NO: 45118 - DNA, 22 bp, Artificial sequence
  synthetic polynucleotide sequence
acgttcctcctgtagcgaacca

SEQ ID NO: 45119 - DNA, 21 bp, Artificial sequence
  synthetic polynucleotide sequence
ggccaacgagatgatgccgga

SEQ ID NO: 45120 - DNA, 22 bp, Artificial sequence
  synthetic polynucleotide sequence
aagttcctcctgtagcgaacca

SEQ ID NO: 45121 - DNA, 20 bp, Artificial sequence
  synthetic polynucleotide sequence
agcctcagcccctgaacaga

SEQ ID NO: 45122 - DNA, 21 bp, Artificial sequence
  synthetic polynucleotide sequence
ttctgcccaccatcctgtgga

SEQ ID NO: 45123 - DNA, 18 bp, Artificial sequence
  synthetic polynucleotide sequence
aagcgcctggaggcagga

SEQ ID NO: 45124 - DNA, 18 bp, Artificial sequence
  synthetic polynucleotide sequence
gctggtccagctggccga

SEQ ID NO: 45125 - DNA, 18 bp, Artificial sequence
  synthetic polynucleotide sequence
ggggaccaaaaaggggca

SEQ ID NO: 45126 - DNA, 18 bp, Artificial sequence
  synthetic polynucleotide sequence
tgggatggtccccagcca

SEQ ID NO: 45127 - DNA, 22 bp, Artificial sequence
  synthetic polynucleotide sequence
aaagaagagaaggggagcacga

SEQ ID NO: 45128 - DNA, 22 bp, Artificial sequence
  synthetic polynucleotide sequence
gaaacgcctgagaacagcctca

SEQ ID NO: 45129 - DNA, 20 bp, Artificial sequence
  synthetic polynucleotide sequence
cacccagaggccttgggtca

SEQ ID NO: 45130 - DNA, 20 bp, Artificial sequence
  synthetic polynucleotide sequence
atgtcagctctgggagggca

SEQ ID NO: 45131 - DNA, 18 bp, Artificial sequence
  synthetic polynucleotide sequence
gcaaaagccagcagcgga

SEQ ID NO: 45132 - DNA, 20 bp, Artificial sequence
  synthetic polynucleotide sequence
tactgacgagcttgaaggca

SEQ ID NO: 45133 - DNA, 21 bp, Artificial sequence
  synthetic polynucleotide sequence
ccaccttagcgcacccaccta

SEQ ID NO: 45134 - DNA, 19 bp, Artificial sequence
  synthetic polynucleotide sequence
taaggggatgtgaggcaga

SEQ ID NO: 45135 - DNA, 20 bp, Artificial sequence
  synthetic polynucleotide sequence
taagcagaaggactccacca

SEQ ID NO: 45136 - DNA, 21 bp, Artificial sequence
  synthetic polynucleotide sequence
gattggttctgccacccgcaa

SEQ ID NO: 45137 - DNA, 20 bp, Artificial sequence
  synthetic polynucleotide sequence
cagccgcagcagatctgcca

SEQ ID NO: 45138 - DNA, 20 bp, Artificial sequence
  synthetic polynucleotide sequence
tgaaccgggacaagagggca

SEQ ID NO: 45139 - DNA, 23 bp, Artificial sequence
  synthetic polynucleotide sequence
cataagatggagccacactcgta

SEQ ID NO: 45140 - DNA, 21 bp, Artificial sequence
  synthetic polynucleotide sequence
agtctgaggaggagggtctca

SEQ ID NO: 45141 - DNA, 20 bp, Artificial sequence
  synthetic polynucleotide sequence
gccaccaacacctgcaccca

SEQ ID NO: 45142 - DNA, 20 bp, Artificial sequence
  synthetic polynucleotide sequence
agatgggagagctgggtgga

SEQ ID NO: 45143 - DNA, 18 bp, Artificial sequence
  synthetic polynucleotide sequence
cttcacgggccacaagga

SEQ ID NO: 45144 - DNA, 18 bp, Artificial sequence
  synthetic polynucleotide sequence
ggcctgacggtctccaca

SEQ ID NO: 45145 - DNA, 21 bp, Artificial sequence
  synthetic polynucleotide sequence
ctggtgaggtggatgcacaga

SEQ ID NO: 45146 - DNA, 22 bp, Artificial sequence
  synthetic polynucleotide sequence
aaggccagcatctctaccagca

SEQ ID NO: 45147 - DNA, 21 bp, Artificial sequence
  synthetic polynucleotide sequence
gaagaagccagggtggttgga

SEQ ID NO: 45148 - DNA, 21 bp, Artificial sequence
  synthetic polynucleotide sequence
tgagctcccgaactcactgga

SEQ ID NO: 45149 - DNA, 22 bp, Artificial sequence
  synthetic polynucleotide sequence
agaaggaccagctcatcaccaa

SEQ ID NO: 45150 - DNA, 18 bp, Artificial sequence
  synthetic polynucleotide sequence
tggtggctgcgggcctga

SEQ ID NO: 45151 - DNA, 20 bp, Artificial sequence
  synthetic polynucleotide sequence
ctgcatcctcaccctcgcca

SEQ ID NO: 45152 - DNA, 18 bp, Artificial sequence
  synthetic polynucleotide sequence
gcaccctctggctccgga

SEQ ID NO: 45153 - DNA, 19 bp, Artificial sequence
  synthetic polynucleotide sequence
cagctgaggagctgccgca

SEQ ID NO: 45154 - DNA, 21 bp, Artificial sequence
  synthetic polynucleotide sequence
tccccaggcctactcagctca

SEQ ID NO: 45155 - DNA, 21 bp, Artificial sequence
  synthetic polynucleotide sequence
ggcagcccctcaatccaggaa

SEQ ID NO: 45156 - DNA, 18 bp, Artificial sequence
  synthetic polynucleotide sequence
ccctggcgccatctgcca

SEQ ID NO: 45157 - DNA, 23 bp, Artificial sequence
  synthetic polynucleotide sequence
caacagagacaggcaaatcagaa

SEQ ID NO: 45158 - DNA, 20 bp, Artificial sequence
  synthetic polynucleotide sequence
tgaaggggactgactgggga

SEQ ID NO: 45159 - DNA, 23 bp, Artificial sequence
  synthetic polynucleotide sequence
caacagagacaggcaaatcagaa

SEQ ID NO: 45160 - DNA, 20 bp, Artificial sequence
  synthetic polynucleotide sequence
tcggccagtgctgaggggga

SEQ ID NO: 45161 - DNA, 21 bp, Artificial sequence
  synthetic polynucleotide sequence
agagaagctggggcataggca

SEQ ID NO: 45162 - DNA, 19 bp, Artificial sequence
  synthetic polynucleotide sequence
gcagggacagccctggaca

SEQ ID NO: 45163 - DNA, 21 bp, Artificial sequence
  synthetic polynucleotide sequence
gcagctgcacctgaaagcgca

SEQ ID NO: 45164 - DNA, 21 bp, Artificial sequence
  synthetic polynucleotide sequence
acacactctgggaggtggaca

SEQ ID NO: 45165 - DNA, 20 bp, Artificial sequence
  synthetic polynucleotide sequence
cacgcgaagccagagcacca

SEQ ID NO: 45166 - DNA, 20 bp, Artificial sequence
  synthetic polynucleotide sequence
cttccctgcagcagagggga

SEQ ID NO: 45167 - DNA, 18 bp, Artificial sequence
  synthetic polynucleotide sequence
ggccgggacagccaagca

SEQ ID NO: 45168 - DNA, 21 bp, Artificial sequence
  synthetic polynucleotide sequence
tgctggtcactcccgctggaa

SEQ ID NO: 45169 - DNA, 21 bp, Artificial sequence
  synthetic polynucleotide sequence
gcggcagccctagacaagtca

SEQ ID NO: 45170 - DNA, 21 bp, Artificial sequence
  synthetic polynucleotide sequence
aagctgagatccagaccctga

SEQ ID NO: 45171 - DNA, 22 bp, Artificial sequence
  synthetic polynucleotide sequence
aactgcttggtggaacgaagca

SEQ ID NO: 45172 - DNA, 21 bp, Artificial sequence
  synthetic polynucleotide sequence
ttgatccaggagctcctgcca

SEQ ID NO: 45173 - DNA, 21 bp, Artificial sequence
  synthetic polynucleotide sequence
aggatgagggcaagtgggaca

SEQ ID NO: 45174 - DNA, 20 bp, Artificial sequence
  synthetic polynucleotide sequence
aggccacgcacttgtagcca

SEQ ID NO: 45175 - DNA, 21 bp, Artificial sequence
  synthetic polynucleotide sequence
gaagccactctacgacaccca

SEQ ID NO: 45176 - DNA, 20 bp, Artificial sequence
  synthetic polynucleotide sequence
atcgcccaggtcttcggaga

SEQ ID NO: 45177 - DNA, 20 bp, Artificial sequence
  synthetic polynucleotide sequence
tgtagggaggctgccatgca

SEQ ID NO: 45178 - DNA, 21 bp, Artificial sequence
  synthetic polynucleotide sequence
aaggccaccaatctcctccca

SEQ ID NO: 45179 - DNA, 18 bp, Artificial sequence
  synthetic polynucleotide sequence
cccaagtcccagggctga

SEQ ID NO: 45180 - DNA, 18 bp, Artificial sequence
  synthetic polynucleotide sequence
ttgggtcggcagcagcca

SEQ ID NO: 45181 - DNA, 20 bp, Artificial sequence
  synthetic polynucleotide sequence
gagacagcgagaaggcgcca

SEQ ID NO: 45182 - DNA, 22 bp, Artificial sequence
  synthetic polynucleotide sequence
agctgggaagtccaagatcaga

SEQ ID NO: 45183 - DNA, 19 bp, Artificial sequence
  synthetic polynucleotide sequence
cagaaggcccagaagcaca

SEQ ID NO: 45184 - DNA, 18 bp, Artificial sequence
  synthetic polynucleotide sequence
tgcgaggagtgaatggca

SEQ ID NO: 45185 - DNA, 20 bp, Artificial sequence
  synthetic polynucleotide sequence
gatgtcaggggcccaggaca

SEQ ID NO: 45186 - DNA, 19 bp, Artificial sequence
  synthetic polynucleotide sequence
cttgaggcctcctgggcca

SEQ ID NO: 45187 - DNA, 22 bp, Artificial sequence
  synthetic polynucleotide sequence
ggaagaatcgaggggatccaga

SEQ ID NO: 45188 - DNA, 21 bp, Artificial sequence
  synthetic polynucleotide sequence
catgcaagctgaggatgcaga

SEQ ID NO: 45189 - DNA, 20 bp, Artificial sequence
  synthetic polynucleotide sequence
gcccaccgcaagaccagcaa

SEQ ID NO: 45190 - DNA, 20 bp, Artificial sequence
  synthetic polynucleotide sequence
ggacaggatcctgcggtcca

SEQ ID NO: 45191 - DNA, 19 bp, Artificial sequence
  synthetic polynucleotide sequence
gccaaccccctgcacagca

SEQ ID NO: 45192 - DNA, 20 bp, Artificial sequence
  synthetic polynucleotide sequence
ctccttggagagctcgcaca

SEQ ID NO: 45193 - DNA, 22 bp, Artificial sequence
  synthetic polynucleotide sequence
aaacaggcccaagtgtcagtga

SEQ ID NO: 45194 - DNA, 20 bp, Artificial sequence
  synthetic polynucleotide sequence
tccactcaggacgatgccca

SEQ ID NO: 45195 - DNA, 21 bp, Artificial sequence
  synthetic polynucleotide sequence
tgaaccaagggcggcatgaca

SEQ ID NO: 45196 - DNA, 18 bp, Artificial sequence
  synthetic polynucleotide sequence
tgggagggctgggctcca

SEQ ID NO: 45197 - DNA, 22 bp, Artificial sequence
  synthetic polynucleotide sequence
catcgaacagctgaaggcccaa

SEQ ID NO: 45198 - DNA, 20 bp, Artificial sequence
  synthetic polynucleotide sequence
gtgcgcattcagcagaggca

SEQ ID NO: 45199 - DNA, 18 bp, Artificial sequence
  synthetic polynucleotide sequence
aggctggggaggaggaca

SEQ ID NO: 45200 - DNA, 18 bp, Artificial sequence
  synthetic polynucleotide sequence
agccacgtacacggccga

SEQ ID NO: 45201 - DNA, 20 bp, Artificial sequence
  synthetic polynucleotide sequence
gaggttgaaaaggctgcaga

SEQ ID NO: 45202 - DNA, 22 bp, Artificial sequence
  synthetic polynucleotide sequence
agatgaggggcactatctgaca

SEQ ID NO: 45203 - DNA, 20 bp, Artificial sequence
  synthetic polynucleotide sequence
gatggattacaagggccaga

SEQ ID NO: 45204 - DNA, 21 bp, Artificial sequence
  synthetic polynucleotide sequence
gccatggaggaagtgtcagca

SEQ ID NO: 45205 - DNA, 20 bp, Artificial sequence
  synthetic polynucleotide sequence
ggagaagcggtggtagcgga

SEQ ID NO: 45206 - DNA, 19 bp, Artificial sequence
  synthetic polynucleotide sequence
tcacagctgatccatccca

SEQ ID NO: 45207 - DNA, 18 bp, Artificial sequence
  synthetic polynucleotide sequence
ggctgcacgtctcgcgga

SEQ ID NO: 45208 - DNA, 21 bp, Artificial sequence
  synthetic polynucleotide sequence
tctttcagcagcagcttcgga

SEQ ID NO: 45209 - DNA, 19 bp, Artificial sequence
  synthetic polynucleotide sequence
gaggagagctggaccgaca

SEQ ID NO: 45210 - DNA, 19 bp, Artificial sequence
  synthetic polynucleotide sequence
ccacctaatgaagcggcca

SEQ ID NO: 45211 - DNA, 19 bp, Artificial sequence
  synthetic polynucleotide sequence
ggaagatcgaagggcagca

SEQ ID NO: 45212 - DNA, 18 bp, Artificial sequence
  synthetic polynucleotide sequence
gctccaacatggcaagca

SEQ ID NO: 45213 - DNA, 21 bp, Artificial sequence
  synthetic polynucleotide sequence
gttaagggaccagctctggga

SEQ ID NO: 45214 - DNA, 22 bp, Artificial sequence
  synthetic polynucleotide sequence
caatggccataacctcctcaca

SEQ ID NO: 45215 - DNA, 21 bp, Artificial sequence
  synthetic polynucleotide sequence
tcagcgagtatacccacagca

SEQ ID NO: 45216 - DNA, 19 bp, Artificial sequence
  synthetic polynucleotide sequence
ggtcccgagtccaagccca

SEQ ID NO: 45217 - DNA, 21 bp, Artificial sequence
  synthetic polynucleotide sequence
catacccttgcgccctaagca

SEQ ID NO: 45218 - DNA, 22 bp, Artificial sequence
  synthetic polynucleotide sequence
ctgcagcgcatggaacagaaga

SEQ ID NO: 45219 - DNA, 22 bp, Artificial sequence
  synthetic polynucleotide sequence
aaccaggccccgaaacaagaca

SEQ ID NO: 45220 - DNA, 20 bp, Artificial sequence
  synthetic polynucleotide sequence
cacgtcctccagcgcatgga

SEQ ID NO: 45221 - DNA, 22 bp, Artificial sequence
  synthetic polynucleotide sequence
ccaggaaggaggagaggaacca

SEQ ID NO: 45222 - DNA, 21 bp, Artificial sequence
  synthetic polynucleotide sequence
gtgctgcaggaaagggtggaa

SEQ ID NO: 45223 - DNA, 18 bp, Artificial sequence
  synthetic polynucleotide sequence
cggtggttccaagcgcaa

SEQ ID NO: 45224 - DNA, 18 bp, Artificial sequence
  synthetic polynucleotide sequence
aggggatgtgggcaggca

SEQ ID NO: 45225 - DNA, 21 bp, Artificial sequence
  synthetic polynucleotide sequence
cgcaagcaagaggaggagcga

SEQ ID NO: 45226 - DNA, 19 bp, Artificial sequence
  synthetic polynucleotide sequence
gctcaggggcgttcgagga

SEQ ID NO: 45227 - DNA, 22 bp, Artificial sequence
  synthetic polynucleotide sequence
agatcgctgaaaaggagcagga

SEQ ID NO: 45228 - DNA, 19 bp, Artificial sequence
  synthetic polynucleotide sequence
cgccgggagaggtcttcga

SEQ ID NO: 45229 - DNA, 20 bp, Artificial sequence
  synthetic polynucleotide sequence
tgcacgagagcaaagggaga

SEQ ID NO: 45230 - DNA, 18 bp, Artificial sequence
  synthetic polynucleotide sequence
cctgctgggactgccgca

SEQ ID NO: 45231 - DNA, 18 bp, Artificial sequence
  synthetic polynucleotide sequence
tatacgctggagcggcga

SEQ ID NO: 45232 - DNA, 18 bp, Artificial sequence
  synthetic polynucleotide sequence
tgggcagcagatggcaca

SEQ ID NO: 45233 - DNA, 19 bp, Artificial sequence
  synthetic polynucleotide sequence
gtgaaccccccacctccca

SEQ ID NO: 45234 - DNA, 19 bp, Artificial sequence
  synthetic polynucleotide sequence
gggatgactgctgggccca

SEQ ID NO: 45235 - DNA, 18 bp, Artificial sequence
  synthetic polynucleotide sequence
ggtgggcaacttacccga

SEQ ID NO: 45236 - DNA, 18 bp, Artificial sequence
  synthetic polynucleotide sequence
tccaatccccgagcagca

SEQ ID NO: 45237 - DNA, 19 bp, Artificial sequence
  synthetic polynucleotide sequence
ccttgcaccgggacgccga

SEQ ID NO: 45238 - DNA, 20 bp, Artificial sequence
  synthetic polynucleotide sequence
ctggctggggaaggcgagga

SEQ ID NO: 45239 - DNA, 20 bp, Artificial sequence
  synthetic polynucleotide sequence
tgtgccggcttatccgagca

SEQ ID NO: 45240 - DNA, 19 bp, Artificial sequence
  synthetic polynucleotide sequence
ctcacgacctggctcccca

SEQ ID NO: 45241 - DNA, 20 bp, Artificial sequence
  synthetic polynucleotide sequence
cttcaccctgacgtgccaca

SEQ ID NO: 45242 - DNA, 20 bp, Artificial sequence
  synthetic polynucleotide sequence
agtgaggagccgtaccacca

SEQ ID NO: 45243 - DNA, 20 bp, Artificial sequence
  synthetic polynucleotide sequence
tcagccaccgcctcttgaga

SEQ ID NO: 45244 - DNA, 22 bp, Artificial sequence
  synthetic polynucleotide sequence
acaaacctgaagaaacccggga

SEQ ID NO: 45245 - DNA, 22 bp, Artificial sequence
  synthetic polynucleotide sequence
aatgcccgaagagctcatctga

SEQ ID NO: 45246 - DNA, 21 bp, Artificial sequence
  synthetic polynucleotide sequence
tgatgggtcaatggccgcgta

SEQ ID NO: 45247 - DNA, 20 bp, Artificial sequence
  synthetic polynucleotide sequence
cacaccgagaaggtgctgca

SEQ ID NO: 45248 - DNA, 20 bp, Artificial sequence
  synthetic polynucleotide sequence
cgggccaatgagagcctcaa

SEQ ID NO: 45249 - DNA, 18 bp, Artificial sequence
  synthetic polynucleotide sequence
tgcactcgcacctgggca

SEQ ID NO: 45250 - DNA, 18 bp, Artificial sequence
  synthetic polynucleotide sequence
aaggcgaccacgggcaca

SEQ ID NO: 45251 - DNA, 20 bp, Artificial sequence
  synthetic polynucleotide sequence
ccgcatgcgcgcttcgacga

SEQ ID NO: 45252 - DNA, 21 bp, Artificial sequence
  synthetic polynucleotide sequence
tgaagtggctaccacgctcca

SEQ ID NO: 45253 - DNA, 18 bp, Artificial sequence
  synthetic polynucleotide sequence
cgtccatgccagacagca

SEQ ID NO: 45254 - DNA, 19 bp, Artificial sequence
  synthetic polynucleotide sequence
tgcagagaccggatgagga

SEQ ID NO: 45255 - DNA, 20 bp, Artificial sequence
  synthetic polynucleotide sequence
gccgagaacaacttcacgga

SEQ ID NO: 45256 - DNA, 19 bp, Artificial sequence
  synthetic polynucleotide sequence
ggagacctggtggccaaga

SEQ ID NO: 45257 - DNA, 18 bp, Artificial sequence
  synthetic polynucleotide sequence
cgaggcagggactcgcaa

SEQ ID NO: 45258 - DNA, 18 bp, Artificial sequence
  synthetic polynucleotide sequence
ctccacccaccacacgca

SEQ ID NO: 45259 - DNA, 22 bp, Artificial sequence
  synthetic polynucleotide sequence
acaagacaagctgggtcaagca

SEQ ID NO: 45260 - DNA, 22 bp, Artificial sequence
  synthetic polynucleotide sequence
gcaacactccatagcagctgga

SEQ ID NO: 45261 - DNA, 21 bp, Artificial sequence
  synthetic polynucleotide sequence
agagcatggactgaaggagca

SEQ ID NO: 45262 - DNA, 22 bp, Artificial sequence
  synthetic polynucleotide sequence
aagaattaccagtagccccgga

SEQ ID NO: 45263 - DNA, 21 bp, Artificial sequence
  synthetic polynucleotide sequence
gaacagaggccggaagacaga

SEQ ID NO: 45264 - DNA, 19 bp, Artificial sequence
  synthetic polynucleotide sequence
cccatcttcaccggcggca

SEQ ID NO: 45265 - DNA, 22 bp, Artificial sequence
  synthetic polynucleotide sequence
ggaaaggaaccgttctggacca

SEQ ID NO: 45266 - DNA, 21 bp, Artificial sequence
  synthetic polynucleotide sequence
tcagggaggacttcaagcgca

SEQ ID NO: 45267 - DNA, 20 bp, Artificial sequence
  synthetic polynucleotide sequence
tcagcctcaggtccaagcca

SEQ ID NO: 45268 - DNA, 21 bp, Artificial sequence
  synthetic polynucleotide sequence
ggggtgagaaggaggaagaga

SEQ ID NO: 45269 - DNA, 21 bp, Artificial sequence
  synthetic polynucleotide sequence
cagtggagcagtggaagggta

SEQ ID NO: 45270 - DNA, 21 bp, Artificial sequence
  synthetic polynucleotide sequence
cactgccttgccaatcaggga

SEQ ID NO: 45271 - DNA, 20 bp, Artificial sequence
  synthetic polynucleotide sequence
gctgactccctgggaagaga

SEQ ID NO: 45272 - DNA, 20 bp, Artificial sequence
  synthetic polynucleotide sequence
cagtcccacagacagggtca

SEQ ID NO: 45273 - DNA, 23 bp, Artificial sequence
  synthetic polynucleotide sequence
ggctacagactcctggaacagca

SEQ ID NO: 45274 - DNA, 17 bp, Artificial sequence
  synthetic polynucleotide sequence
gtggggaaaggcagcca

SEQ ID NO: 45275 - DNA, 20 bp, Artificial sequence
  synthetic polynucleotide sequence
agaacgccaaactgctctca

SEQ ID NO: 45276 - DNA, 20 bp, Artificial sequence
  synthetic polynucleotide sequence
gtggacatgtcactgccaca

SEQ ID NO: 45277 - DNA, 19 bp, Artificial sequence
  synthetic polynucleotide sequence
tgtggacagggaagtgcca

SEQ ID NO: 45278 - DNA, 19 bp, Artificial sequence
  synthetic polynucleotide sequence
gggccaagcagagctggca

SEQ ID NO: 45279 - DNA, 21 bp, Artificial sequence
  synthetic polynucleotide sequence
tcaagaggaagacagcccaga

SEQ ID NO: 45280 - DNA, 20 bp, Artificial sequence
  synthetic polynucleotide sequence
catgacagagcatgcaagga

SEQ ID NO: 45281 - DNA, 18 bp, Artificial sequence
  synthetic polynucleotide sequence
atcccctgccccatcaca

SEQ ID NO: 45282 - DNA, 22 bp, Artificial sequence
  synthetic polynucleotide sequence
agctctcggtacacaagtgaca

SEQ ID NO: 45283 - DNA, 21 bp, Artificial sequence
  synthetic polynucleotide sequence
aggggatctgctcagacgcca

SEQ ID NO: 45284 - DNA, 21 bp, Artificial sequence
  synthetic polynucleotide sequence
ggtaacctggtcactgccaca

SEQ ID NO: 45285 - DNA, 18 bp, Artificial sequence
  synthetic polynucleotide sequence
ccccagtgacaaagggca

SEQ ID NO: 45286 - DNA, 18 bp, Artificial sequence
  synthetic polynucleotide sequence
cttggagatgccgcgaca

SEQ ID NO: 45287 - DNA, 19 bp, Artificial sequence
  synthetic polynucleotide sequence
ctgaagaccactccagcga

SEQ ID NO: 45288 - DNA, 20 bp, Artificial sequence
  synthetic polynucleotide sequence
gaaccaccacctttgagcca

SEQ ID NO: 45289 - DNA, 18 bp, Artificial sequence
  synthetic polynucleotide sequence
ctgcggaggcaacagcaa

SEQ ID NO: 45290 - DNA, 19 bp, Artificial sequence
  synthetic polynucleotide sequence
ccctcagagcaatcccgaa

SEQ ID NO: 45291 - DNA, 21 bp, Artificial sequence
  synthetic polynucleotide sequence
agaaaaaccctccactgccca

SEQ ID NO: 45292 - DNA, 20 bp, Artificial sequence
  synthetic polynucleotide sequence
gcagtccacacacacctcca

SEQ ID NO: 45293 - DNA, 20 bp, Artificial sequence
  synthetic polynucleotide sequence
tccatgacccccgatgccaa

SEQ ID NO: 45294 - DNA, 19 bp, Artificial sequence
  synthetic polynucleotide sequence
ggaacttggcccggcagca

SEQ ID NO: 45295 - DNA, 20 bp, Artificial sequence
  synthetic polynucleotide sequence
gtctccaacgacctccacca

SEQ ID NO: 45296 - DNA, 18 bp, Artificial sequence
  synthetic polynucleotide sequence
cgccacagcaggagcaga

SEQ ID NO: 45297 - DNA, 20 bp, Artificial sequence
  synthetic polynucleotide sequence
gggtgacaccgggtctagga

SEQ ID NO: 45298 - DNA, 18 bp, Artificial sequence
  synthetic polynucleotide sequence
aatgccggagcccacaga

SEQ ID NO: 45299 - DNA, 21 bp, Artificial sequence
  synthetic polynucleotide sequence
actgggccatcactgcagaca

SEQ ID NO: 45300 - DNA, 20 bp, Artificial sequence
  synthetic polynucleotide sequence
aggaccacgacgaaagggca

SEQ ID NO: 45301 - DNA, 18 bp, Artificial sequence
  synthetic polynucleotide sequence
tcgtcctggccccgacca

SEQ ID NO: 45302 - DNA, 19 bp, Artificial sequence
  synthetic polynucleotide sequence
ctgccagcgtctcccagga

SEQ ID NO: 45303 - DNA, 21 bp, Artificial sequence
  synthetic polynucleotide sequence
catcgaggaagatggcaccaa

SEQ ID NO: 45304 - DNA, 21 bp, Artificial sequence
  synthetic polynucleotide sequence
ttgtcatctaggagccgctga

SEQ ID NO: 45305 - DNA, 19 bp, Artificial sequence
  synthetic polynucleotide sequence
tactgtgcccccagaccaa

SEQ ID NO: 45306 - DNA, 21 bp, Artificial sequence
  synthetic polynucleotide sequence
gggaagggacactcagagcca

SEQ ID NO: 45307 - DNA, 18 bp, Artificial sequence
  synthetic polynucleotide sequence
cagctccaacacagccca

SEQ ID NO: 45308 - DNA, 20 bp, Artificial sequence
  synthetic polynucleotide sequence
ctctgaagggtcaagcagga

SEQ ID NO: 45309 - DNA, 22 bp, Artificial sequence
  synthetic polynucleotide sequence
gaggatggctactaccggaaga

SEQ ID NO: 45310 - DNA, 21 bp, Artificial sequence
  synthetic polynucleotide sequence
gaagcccacgatgtcatcgca

SEQ ID NO: 45311 - DNA, 21 bp, Artificial sequence
  synthetic polynucleotide sequence
ttccagagacagcaagaccca

SEQ ID NO: 45312 - DNA, 20 bp, Artificial sequence
  synthetic polynucleotide sequence
agcactgtccaacactgcca

SEQ ID NO: 45313 - DNA, 18 bp, Artificial sequence
  synthetic polynucleotide sequence
aagggcatgcgaacccga

SEQ ID NO: 45314 - DNA, 18 bp, Artificial sequence
  synthetic polynucleotide sequence
ttccgaccactgggacca

SEQ ID NO: 45315 - DNA, 18 bp, Artificial sequence
  synthetic polynucleotide sequence
tcgggaccaagagcagga

SEQ ID NO: 45316 - DNA, 19 bp, Artificial sequence
  synthetic polynucleotide sequence
cgcagttatcagggacgca

SEQ ID NO: 45317 - DNA, 18 bp, Artificial sequence
  synthetic polynucleotide sequence
cgtggagaacgctgcaga

SEQ ID NO: 45318 - DNA, 19 bp, Artificial sequence
  synthetic polynucleotide sequence
ctccaagacatccgaagca

SEQ ID NO: 45319 - DNA, 20 bp, Artificial sequence
  synthetic polynucleotide sequence
gtcagctgccccaaaagtga

SEQ ID NO: 45320 - DNA, 22 bp, Artificial sequence
  synthetic polynucleotide sequence
atcttggaccacactcacctca

SEQ ID NO: 45321 - DNA, 20 bp, Artificial sequence
  synthetic polynucleotide sequence
cgagagggcatcgtggtgga

SEQ ID NO: 45322 - DNA, 22 bp, Artificial sequence
  synthetic polynucleotide sequence
caaacacagcactgaggcagga

SEQ ID NO: 45323 - DNA, 18 bp, Artificial sequence
  synthetic polynucleotide sequence
tggacagccaggactcca

SEQ ID NO: 45324 - DNA, 19 bp, Artificial sequence
  synthetic polynucleotide sequence
gtggggacaactggagtga

SEQ ID NO: 45325 - DNA, 19 bp, Artificial sequence
  synthetic polynucleotide sequence
tcgggcattcagaagctca

SEQ ID NO: 45326 - DNA, 18 bp, Artificial sequence
  synthetic polynucleotide sequence
ccctgcacctgctgggca

SEQ ID NO: 45327 - DNA, 21 bp, Artificial sequence
  synthetic polynucleotide sequence
gcacaaccaaggactactgca

SEQ ID NO: 45328 - DNA, 18 bp, Artificial sequence
  synthetic polynucleotide sequence
ggcagcttccccatggaa

SEQ ID NO: 45329 - DNA, 21 bp, Artificial sequence
  synthetic polynucleotide sequence
catcacgcccttcctgaccaa

SEQ ID NO: 45330 - DNA, 23 bp, Artificial sequence
  synthetic polynucleotide sequence
caaaatgtctccgaaacccagga

SEQ ID NO: 45331 - DNA, 18 bp, Artificial sequence
  synthetic polynucleotide sequence
tcctgtggggcccctgga

SEQ ID NO: 45332 - DNA, 19 bp, Artificial sequence
  synthetic polynucleotide sequence
cggcccggtgaatgcgaga

SEQ ID NO: 45333 - DNA, 18 bp, Artificial sequence
  synthetic polynucleotide sequence
cctccgtggacccagaca

SEQ ID NO: 45334 - DNA, 19 bp, Artificial sequence
  synthetic polynucleotide sequence
gacaccttgcaatccacca

SEQ ID NO: 45335 - DNA, 20 bp, Artificial sequence
  synthetic polynucleotide sequence
gtgtgacactagcgacgaca

SEQ ID NO: 45336 - DNA, 21 bp, Artificial sequence
  synthetic polynucleotide sequence
tgtttcccaccacagcaacca

SEQ ID NO: 45337 - DNA, 18 bp, Artificial sequence
  synthetic polynucleotide sequence
atgtcggaccccgaggga

SEQ ID NO: 45338 - DNA, 18 bp, Artificial sequence
  synthetic polynucleotide sequence
gtgcttcccgccacagca

SEQ ID NO: 45339 - DNA, 20 bp, Artificial sequence
  synthetic polynucleotide sequence
gcctctgtgcaccccaccca

SEQ ID NO: 45340 - DNA, 23 bp, Artificial sequence
  synthetic polynucleotide sequence
gggtctgatgggagaagggagaa

SEQ ID NO: 45341 - DNA, 19 bp, Artificial sequence
  synthetic polynucleotide sequence
ccagggcactgaggggcga

SEQ ID NO: 45342 - DNA, 23 bp, Artificial sequence
  synthetic polynucleotide sequence
ggcacacacagacacagaccaga

SEQ ID NO: 45343 - DNA, 18 bp, Artificial sequence
  synthetic polynucleotide sequence
ggagccctgccaccccaa

SEQ ID NO: 45344 - DNA, 21 bp, Artificial sequence
  synthetic polynucleotide sequence
tggagtgaccgttgaagggca

SEQ ID NO: 45345 - DNA, 18 bp, Artificial sequence
  synthetic polynucleotide sequence
ggagccctgccaccccaa

SEQ ID NO: 45346 - DNA, 21 bp, Artificial sequence
  synthetic polynucleotide sequence
actattgaagggcagggctca

SEQ ID NO: 45347 - DNA, 20 bp, Artificial sequence
  synthetic polynucleotide sequence
gagccatgtccacccccgaa

SEQ ID NO: 45348 - DNA, 19 bp, Artificial sequence
  synthetic polynucleotide sequence
ttgactggcagggtgggga

SEQ ID NO: 45349 - DNA, 20 bp, Artificial sequence
  synthetic polynucleotide sequence
agtgtccacagccctgccca

SEQ ID NO: 45350 - DNA, 20 bp, Artificial sequence
  synthetic polynucleotide sequence
ttggctggcagggtggggaa

SEQ ID NO: 45351 - DNA, 25 bp, Artificial sequence
  synthetic polynucleotide sequence
gtccaggtggagctaagaaaaggaa

SEQ ID NO: 45352 - DNA, 21 bp, Artificial sequence
  synthetic polynucleotide sequence
accaggtgacagacagacaca

SEQ ID NO: 45353 - DNA, 23 bp, Artificial sequence
  synthetic polynucleotide sequence
gagctttggaagaaggaccagca

SEQ ID NO: 45354 - DNA, 22 bp, Artificial sequence
  synthetic polynucleotide sequence
ccatgcccaggtgacagacaga

SEQ ID NO: 45355 - DNA, 20 bp, Artificial sequence
  synthetic polynucleotide sequence
agtgtccacagtcctgccca

SEQ ID NO: 45356 - DNA, 20 bp, Artificial sequence
  synthetic polynucleotide sequence
ttggctggcagggtggggaa

SEQ ID NO: 45357 - DNA, 23 bp, Artificial sequence
  synthetic polynucleotide sequence
gcagaagtatccacccaagagca

SEQ ID NO: 45358 - DNA, 21 bp, Artificial sequence
  synthetic polynucleotide sequence
agccagacagaggttagggaa

SEQ ID NO: 45359 - DNA, 21 bp, Artificial sequence
  synthetic polynucleotide sequence
ttcctgagcaaggatacacca

SEQ ID NO: 45360 - DNA, 20 bp, Artificial sequence
  synthetic polynucleotide sequence
ctggagtgaccgttgaagga

SEQ ID NO: 45361 - DNA, 21 bp, Artificial sequence
  synthetic polynucleotide sequence
gtgaagcagccttgtcagcca

SEQ ID NO: 45362 - DNA, 20 bp, Artificial sequence
  synthetic polynucleotide sequence
gcttgctgggctgagggaca

SEQ ID NO: 45363 - DNA, 21 bp, Artificial sequence
  synthetic polynucleotide sequence
ctccaatgacgacgaagggga

SEQ ID NO: 45364 - DNA, 18 bp, Artificial sequence
  synthetic polynucleotide sequence
gggaggggcagctctcca

SEQ ID NO: 45365 - DNA, 21 bp, Artificial sequence
  synthetic polynucleotide sequence
gcacgcctacaggtgtgagga

SEQ ID NO: 45366 - DNA, 20 bp, Artificial sequence
  synthetic polynucleotide sequence
atcacgttctgggccgagca

SEQ ID NO: 45367 - DNA, 20 bp, Artificial sequence
  synthetic polynucleotide sequence
ctgaagggagaagctgagca

SEQ ID NO: 45368 - DNA, 20 bp, Artificial sequence
  synthetic polynucleotide sequence
gaactaggcccacaagagca

SEQ ID NO: 45369 - DNA, 20 bp, Artificial sequence
  synthetic polynucleotide sequence
gtgcctgtgctcagcccaga

SEQ ID NO: 45370 - DNA, 19 bp, Artificial sequence
  synthetic polynucleotide sequence
gtcagcgcaggagccctca

SEQ ID NO: 45371 - DNA, 18 bp, Artificial sequence
  synthetic polynucleotide sequence
ggagcatgagggcaggaa

SEQ ID NO: 45372 - DNA, 18 bp, Artificial sequence
  synthetic polynucleotide sequence
tctccccgcagctcagca

SEQ ID NO: 45373 - DNA, 21 bp, Artificial sequence
  synthetic polynucleotide sequence
acatgtcccgggatagctgca

SEQ ID NO: 45374 - DNA, 20 bp, Artificial sequence
  synthetic polynucleotide sequence
ctgggcctcatactccagca

SEQ ID NO: 45375 - DNA, 21 bp, Artificial sequence
  synthetic polynucleotide sequence
tggccacatccctctgaagga

SEQ ID NO: 45376 - DNA, 21 bp, Artificial sequence
  synthetic polynucleotide sequence
tctcggccaagaggaatctga

SEQ ID NO: 45377 - DNA, 19 bp, Artificial sequence
  synthetic polynucleotide sequence
ggccactgtgagatccgaa

SEQ ID NO: 45378 - DNA, 18 bp, Artificial sequence
  synthetic polynucleotide sequence
ccttgagggaagccggca

SEQ ID NO: 45379 - DNA, 19 bp, Artificial sequence
  synthetic polynucleotide sequence
cgcggactgaagggcagga

SEQ ID NO: 45380 - DNA, 19 bp, Artificial sequence
  synthetic polynucleotide sequence
cgcacacacaggcggctca

SEQ ID NO: 45381 - DNA, 19 bp, Artificial sequence
  synthetic polynucleotide sequence
ggacacctggcacggcaca

SEQ ID NO: 45382 - DNA, 18 bp, Artificial sequence
  synthetic polynucleotide sequence
ctcccgagtctggccgca

SEQ ID NO: 45383 - DNA, 18 bp, Artificial sequence
  synthetic polynucleotide sequence
cccagagcaccgacggca

SEQ ID NO: 45384 - DNA, 18 bp, Artificial sequence
  synthetic polynucleotide sequence
caggtcccagccccacga

SEQ ID NO: 45385 - DNA, 20 bp, Artificial sequence
  synthetic polynucleotide sequence
ctggctctcagaggcagaga

SEQ ID NO: 45386 - DNA, 18 bp, Artificial sequence
  synthetic polynucleotide sequence
aagtcccgctggagagca

SEQ ID NO: 45387 - DNA, 19 bp, Artificial sequence
  synthetic polynucleotide sequence
gtgaggaggtcggagcaga

SEQ ID NO: 45388 - DNA, 18 bp, Artificial sequence
  synthetic polynucleotide sequence
agcagacttccacgggga

SEQ ID NO: 45389 - DNA, 18 bp, Artificial sequence
  synthetic polynucleotide sequence
tccagctcaagcgggaga

SEQ ID NO: 45390 - DNA, 18 bp, Artificial sequence
  synthetic polynucleotide sequence
cggaacttgtcccgcaga

SEQ ID NO: 45391 - DNA, 20 bp, Artificial sequence
  synthetic polynucleotide sequence
caggaagggaagagcaccga

SEQ ID NO: 45392 - DNA, 18 bp, Artificial sequence
  synthetic polynucleotide sequence
cgttcaagggctccagca

SEQ ID NO: 45393 - DNA, 18 bp, Artificial sequence
  synthetic polynucleotide sequence
ggttgcacggtcgacgaa

SEQ ID NO: 45394 - DNA, 18 bp, Artificial sequence
  synthetic polynucleotide sequence
gcttctccagcgcacaga

SEQ ID NO: 45395 - DNA, 20 bp, Artificial sequence
  synthetic polynucleotide sequence
gggtgaacatgccgaggcca

SEQ ID NO: 45396 - DNA, 20 bp, Artificial sequence
  synthetic polynucleotide sequence
cgtcggctgtggagctgaca

SEQ ID NO: 45397 - DNA, 20 bp, Artificial sequence
  synthetic polynucleotide sequence
tgatgaagggggaggacgga

SEQ ID NO: 45398 - DNA, 20 bp, Artificial sequence
  synthetic polynucleotide sequence
tgcaggatgtagctggccca

SEQ ID NO: 45399 - DNA, 19 bp, Artificial sequence
  synthetic polynucleotide sequence
tcaggccctccaagccaca

SEQ ID NO: 45400 - DNA, 20 bp, Artificial sequence
  synthetic polynucleotide sequence
tctgggtccacaagtcccca

SEQ ID NO: 45401 - DNA, 21 bp, Artificial sequence
  synthetic polynucleotide sequence
acgggagatgctgaagcggaa

SEQ ID NO: 45402 - DNA, 21 bp, Artificial sequence
  synthetic polynucleotide sequence
tctcgtcaaagggcctgtcca

SEQ ID NO: 45403 - DNA, 21 bp, Artificial sequence
  synthetic polynucleotide sequence
cccgactctcaggtgcaacca

SEQ ID NO: 45404 - DNA, 21 bp, Artificial sequence
  synthetic polynucleotide sequence
ccatgctgtagacaccctcca

SEQ ID NO: 45405 - DNA, 18 bp, Artificial sequence
  synthetic polynucleotide sequence
cgcgggcctggaagcaga

SEQ ID NO: 45406 - DNA, 21 bp, Artificial sequence
  synthetic polynucleotide sequence
gtgctggggcatgaagacgta

SEQ ID NO: 45407 - DNA, 19 bp, Artificial sequence
  synthetic polynucleotide sequence
tttagagccctgggagcga

SEQ ID NO: 45408 - DNA, 22 bp, Artificial sequence
  synthetic polynucleotide sequence
gaaaaattcccaagccaggcga

SEQ ID NO: 45409 - DNA, 21 bp, Artificial sequence
  synthetic polynucleotide sequence
gtgggtccaagaagccaacca

SEQ ID NO: 45410 - DNA, 18 bp, Artificial sequence
  synthetic polynucleotide sequence
ggccacgagagctgccca

SEQ ID NO: 45411 - DNA, 22 bp, Artificial sequence
  synthetic polynucleotide sequence
gagaaggaactggactcctcaa

SEQ ID NO: 45412 - DNA, 20 bp, Artificial sequence
  synthetic polynucleotide sequence
ggtcggagatgaagcggcga

SEQ ID NO: 45413 - DNA, 21 bp, Artificial sequence
  synthetic polynucleotide sequence
agtcagctgagatgcccacca

SEQ ID NO: 45414 - DNA, 18 bp, Artificial sequence
  synthetic polynucleotide sequence
gccccaggaggaagggga

SEQ ID NO: 45415 - DNA, 18 bp, Artificial sequence
  synthetic polynucleotide sequence
agcagctcgaggccagga

SEQ ID NO: 45416 - DNA, 18 bp, Artificial sequence
  synthetic polynucleotide sequence
gcagagccaagcacgcca

SEQ ID NO: 45417 - DNA, 20 bp, Artificial sequence
  synthetic polynucleotide sequence
gagatcatccaggagcggaa

SEQ ID NO: 45418 - DNA, 18 bp, Artificial sequence
  synthetic polynucleotide sequence
tccacatccacccaacca

SEQ ID NO: 45419 - DNA, 18 bp, Artificial sequence
  synthetic polynucleotide sequence
tacccacatctcccgcca

SEQ ID NO: 45420 - DNA, 18 bp, Artificial sequence
  synthetic polynucleotide sequence
caggagcctggtgagcca

SEQ ID NO: 45421 - DNA, 21 bp, Artificial sequence
  synthetic polynucleotide sequence
aggaacagtgggctggaggaa

SEQ ID NO: 45422 - DNA, 20 bp, Artificial sequence
  synthetic polynucleotide sequence
aaccatgagggagcggtgga

SEQ ID NO: 45423 - DNA, 20 bp, Artificial sequence
  synthetic polynucleotide sequence
atgcctggaagatctgcaga

SEQ ID NO: 45424 - DNA, 22 bp, Artificial sequence
  synthetic polynucleotide sequence
taacacccgaatgaggtccaga

SEQ ID NO: 45425 - DNA, 18 bp, Artificial sequence
  synthetic polynucleotide sequence
tgggatggtgaaccgcga

SEQ ID NO: 45426 - DNA, 18 bp, Artificial sequence
  synthetic polynucleotide sequence
ctcaggctccttccgcca

SEQ ID NO: 45427 - DNA, 20 bp, Artificial sequence
  synthetic polynucleotide sequence
tcaccccacgtggctgggca

SEQ ID NO: 45428 - DNA, 22 bp, Artificial sequence
  synthetic polynucleotide sequence
tgtgtgaaagacagctggggaa

SEQ ID NO: 45429 - DNA, 20 bp, Artificial sequence
  synthetic polynucleotide sequence
tgagcgggccagctgaagga

SEQ ID NO: 45430 - DNA, 22 bp, Artificial sequence
  synthetic polynucleotide sequence
ctctgcagcctcaacagacaca

SEQ ID NO: 45431 - DNA, 20 bp, Artificial sequence
  synthetic polynucleotide sequence
gaggaggaaagcctatgcca

SEQ ID NO: 45432 - DNA, 20 bp, Artificial sequence
  synthetic polynucleotide sequence
atcaacatgcccgttaacca

SEQ ID NO: 45433 - DNA, 20 bp, Artificial sequence
  synthetic polynucleotide sequence
cagctcaggaagcctggaga

SEQ ID NO: 45434 - DNA, 18 bp, Artificial sequence
  synthetic polynucleotide sequence
agctcgcagcccaaggaa

SEQ ID NO: 45435 - DNA, 18 bp, Artificial sequence
  synthetic polynucleotide sequence
cagggaggggagctggca

SEQ ID NO: 45436 - DNA, 20 bp, Artificial sequence
  synthetic polynucleotide sequence
ggctcagcacagttaggcca

SEQ ID NO: 45437 - DNA, 19 bp, Artificial sequence
  synthetic polynucleotide sequence
gggtcagctgatggggaca

SEQ ID NO: 45438 - DNA, 19 bp, Artificial sequence
  synthetic polynucleotide sequence
cagctgtcagagaggccca

SEQ ID NO: 45439 - DNA, 20 bp, Artificial sequence
  synthetic polynucleotide sequence
cagtggccacctatggagca

SEQ ID NO: 45440 - DNA, 20 bp, Artificial sequence
  synthetic polynucleotide sequence
tagcaggtcacaggtgagca

SEQ ID NO: 45441 - DNA, 18 bp, Artificial sequence
  synthetic polynucleotide sequence
gcttcggcctcaccccca

SEQ ID NO: 45442 - DNA, 20 bp, Artificial sequence
  synthetic polynucleotide sequence
gtagagccgcagctcctcga

SEQ ID NO: 45443 - DNA, 21 bp, Artificial sequence
  synthetic polynucleotide sequence
cccaggcagtatgtaccagaa

SEQ ID NO: 45444 - DNA, 19 bp, Artificial sequence
  synthetic polynucleotide sequence
cgaaagacaccaaggccca

SEQ ID NO: 45445 - DNA, 20 bp, Artificial sequence
  synthetic polynucleotide sequence
atgatgtaccctagcccgca

SEQ ID NO: 45446 - DNA, 18 bp, Artificial sequence
  synthetic polynucleotide sequence
tcaggaacacctggggga

SEQ ID NO: 45447 - DNA, 21 bp, Artificial sequence
  synthetic polynucleotide sequence
agccgggaactctgaacctca

SEQ ID NO: 45448 - DNA, 21 bp, Artificial sequence
  synthetic polynucleotide sequence
tcagtcggccaacactcctga

SEQ ID NO: 45449 - DNA, 18 bp, Artificial sequence
  synthetic polynucleotide sequence
cctgccacttccacggaa

SEQ ID NO: 45450 - DNA, 18 bp, Artificial sequence
  synthetic polynucleotide sequence
gcttcagctgcacgccca

SEQ ID NO: 45451 - DNA, 21 bp, Artificial sequence
  synthetic polynucleotide sequence
caccacacgagcgatgacgaa

SEQ ID NO: 45452 - DNA, 21 bp, Artificial sequence
  synthetic polynucleotide sequence
cggaagcccgctggtaaagca

SEQ ID NO: 45453 - DNA, 21 bp, Artificial sequence
  synthetic polynucleotide sequence
acaagcagcgcctcatggaga

SEQ ID NO: 45454 - DNA, 21 bp, Artificial sequence
  synthetic polynucleotide sequence
tgtagcagctcactctggaca

SEQ ID NO: 45455 - DNA, 18 bp, Artificial sequence
  synthetic polynucleotide sequence
tggagaacccagccgaga

SEQ ID NO: 45456 - DNA, 18 bp, Artificial sequence
  synthetic polynucleotide sequence
gcatgagggtaggcccga

SEQ ID NO: 45457 - DNA, 20 bp, Artificial sequence
  synthetic polynucleotide sequence
atcccccgtctgaggactga

SEQ ID NO: 45458 - DNA, 18 bp, Artificial sequence
  synthetic polynucleotide sequence
tccagagccggagccgga

SEQ ID NO: 45459 - DNA, 19 bp, Artificial sequence
  synthetic polynucleotide sequence
ggccctgacaacaatggga

SEQ ID NO: 45460 - DNA, 22 bp, Artificial sequence
  synthetic polynucleotide sequence
aagctgtctgtaagagccctca

SEQ ID NO: 45461 - DNA, 18 bp, Artificial sequence
  synthetic polynucleotide sequence
aggggcgtgaatcccaga

SEQ ID NO: 45462 - DNA, 20 bp, Artificial sequence
  synthetic polynucleotide sequence
gacattgatgagaggggcca

SEQ ID NO: 45463 - DNA, 20 bp, Artificial sequence
  synthetic polynucleotide sequence
cactgactcctcagacccca

SEQ ID NO: 45464 - DNA, 18 bp, Artificial sequence
  synthetic polynucleotide sequence
cataggccaccacgggga

SEQ ID NO: 45465 - DNA, 21 bp, Artificial sequence
  synthetic polynucleotide sequence
acatctactccccgagcagca

SEQ ID NO: 45466 - DNA, 21 bp, Artificial sequence
  synthetic polynucleotide sequence
tgaaaacctcgtgcagcagga

SEQ ID NO: 45467 - DNA, 22 bp, Artificial sequence
  synthetic polynucleotide sequence
tatgacggtcgaaccaaaccca

SEQ ID NO: 45468 - DNA, 21 bp, Artificial sequence
  synthetic polynucleotide sequence
acttccttggagctcaccaca

SEQ ID NO: 45469 - DNA, 18 bp, Artificial sequence
  synthetic polynucleotide sequence
agggaaggcgaatcccca

SEQ ID NO: 45470 - DNA, 18 bp, Artificial sequence
  synthetic polynucleotide sequence
acaaggcagaggctccca

SEQ ID NO: 45471 - DNA, 21 bp, Artificial sequence
  synthetic polynucleotide sequence
gtagaccctggagttaaggca

SEQ ID NO: 45472 - DNA, 20 bp, Artificial sequence
  synthetic polynucleotide sequence
gtcaaaagcccctgctctga

SEQ ID NO: 45473 - DNA, 21 bp, Artificial sequence
  synthetic polynucleotide sequence
acagagacctcctcctcccaa

SEQ ID NO: 45474 - DNA, 21 bp, Artificial sequence
  synthetic polynucleotide sequence
aagccacatggttgagggcca

SEQ ID NO: 45475 - DNA, 21 bp, Artificial sequence
  synthetic polynucleotide sequence
aagtgaaccggtatggccaga

SEQ ID NO: 45476 - DNA, 22 bp, Artificial sequence
  synthetic polynucleotide sequence
acaatgcagggcagttacgtca

SEQ ID NO: 45477 - DNA, 20 bp, Artificial sequence
  synthetic polynucleotide sequence
ctggctgcagaagcaacaga

SEQ ID NO: 45478 - DNA, 20 bp, Artificial sequence
  synthetic polynucleotide sequence
aggctggggagcagtactga

SEQ ID NO: 45479 - DNA, 21 bp, Artificial sequence
  synthetic polynucleotide sequence
agacgaagaccacatagccca

SEQ ID NO: 45480 - DNA, 21 bp, Artificial sequence
  synthetic polynucleotide sequence
gcatcttcatggggccagcca

SEQ ID NO: 45481 - DNA, 22 bp, Artificial sequence
  synthetic polynucleotide sequence
tacagtcgtgatgaggaccaca

SEQ ID NO: 45482 - DNA, 21 bp, Artificial sequence
  synthetic polynucleotide sequence
tacaggccccagtgcttgaga

SEQ ID NO: 45483 - DNA, 18 bp, Artificial sequence
  synthetic polynucleotide sequence
agcatggtggccgcacca

SEQ ID NO: 45484 - DNA, 18 bp, Artificial sequence
  synthetic polynucleotide sequence
ctgccgtgtccaccagca

SEQ ID NO: 45485 - DNA, 21 bp, Artificial sequence
  synthetic polynucleotide sequence
gcacactggacagttccagca

SEQ ID NO: 45486 - DNA, 21 bp, Artificial sequence
  synthetic polynucleotide sequence
tcttccacccttggcactgca

SEQ ID NO: 45487 - DNA, 20 bp, Artificial sequence
  synthetic polynucleotide sequence
tacatgaagtgctccagcga

SEQ ID NO: 45488 - DNA, 18 bp, Artificial sequence
  synthetic polynucleotide sequence
gccgttctgacacccaca

SEQ ID NO: 45489 - DNA, 18 bp, Artificial sequence
  synthetic polynucleotide sequence
ctgtcagtccagccgcca

SEQ ID NO: 45490 - DNA, 20 bp, Artificial sequence
  synthetic polynucleotide sequence
atcggttggaaggatcagga

SEQ ID NO: 45491 - DNA, 22 bp, Artificial sequence
  synthetic polynucleotide sequence
aatacaagcctacggagcgtca

SEQ ID NO: 45492 - DNA, 21 bp, Artificial sequence
  synthetic polynucleotide sequence
tggttcagcacttccagggca

SEQ ID NO: 45493 - DNA, 19 bp, Artificial sequence
  synthetic polynucleotide sequence
cggcgctggaatcctggca

SEQ ID NO: 45494 - DNA, 21 bp, Artificial sequence
  synthetic polynucleotide sequence
ttctcagcctcccagatgcga

SEQ ID NO: 45495 - DNA, 18 bp, Artificial sequence
  synthetic polynucleotide sequence
ccacccgttcgaagagga

SEQ ID NO: 45496 - DNA, 18 bp, Artificial sequence
  synthetic polynucleotide sequence
tggctcaggagacccgga

SEQ ID NO: 45497 - DNA, 21 bp, Artificial sequence
  synthetic polynucleotide sequence
agccaaccccagccaaacgga

SEQ ID NO: 45498 - DNA, 21 bp, Artificial sequence
  synthetic polynucleotide sequence
aggcttagcaggggaagggga

SEQ ID NO: 45499 - DNA, 18 bp, Artificial sequence
  synthetic polynucleotide sequence
cgggctccagtgggggga

SEQ ID NO: 45500 - DNA, 20 bp, Artificial sequence
  synthetic polynucleotide sequence
agaaagagggaggggggaca

SEQ ID NO: 45501 - DNA, 20 bp, Artificial sequence
  synthetic polynucleotide sequence
ctccaagtctggcaagagga

SEQ ID NO: 45502 - DNA, 21 bp, Artificial sequence
  synthetic polynucleotide sequence
ctcataggcgagtaggaccga

SEQ ID NO: 45503 - DNA, 20 bp, Artificial sequence
  synthetic polynucleotide sequence
ggccggcctagaaccagcaa

SEQ ID NO: 45504 - DNA, 20 bp, Artificial sequence
  synthetic polynucleotide sequence
ggagttacagccagctcgga

SEQ ID NO: 45505 - DNA, 20 bp, Artificial sequence
  synthetic polynucleotide sequence
tacccacaccagactcccca

SEQ ID NO: 45506 - DNA, 22 bp, Artificial sequence
  synthetic polynucleotide sequence
atcatagttccctcgaccagca

SEQ ID NO: 45507 - DNA, 18 bp, Artificial sequence
  synthetic polynucleotide sequence
ggccgtggaacaggccga

SEQ ID NO: 45508 - DNA, 19 bp, Artificial sequence
  synthetic polynucleotide sequence
tccacttggaggcagtcca

SEQ ID NO: 45509 - DNA, 21 bp, Artificial sequence
  synthetic polynucleotide sequence
gtctgaagacttgcggcgtga

SEQ ID NO: 45510 - DNA, 22 bp, Artificial sequence
  synthetic polynucleotide sequence
caatctgccgtccacaaatcca

SEQ ID NO: 45511 - DNA, 19 bp, Artificial sequence
  synthetic polynucleotide sequence
cagcagttgtggcacagca

SEQ ID NO: 45512 - DNA, 18 bp, Artificial sequence
  synthetic polynucleotide sequence
ccaggaagcccaagtgca

SEQ ID NO: 45513 - DNA, 22 bp, Artificial sequence
  synthetic polynucleotide sequence
taaagagtctcgacacaggcga

SEQ ID NO: 45514 - DNA, 19 bp, Artificial sequence
  synthetic polynucleotide sequence
tgaccgtcctctagagcca

SEQ ID NO: 45515 - DNA, 18 bp, Artificial sequence
  synthetic polynucleotide sequence
atccgcacgaaggtccaa

SEQ ID NO: 45516 - DNA, 18 bp, Artificial sequence
  synthetic polynucleotide sequence
cctggaccgagaccggga

SEQ ID NO: 45517 - DNA, 18 bp, Artificial sequence
  synthetic polynucleotide sequence
cctccacctcgtcgcaga

SEQ ID NO: 45518 - DNA, 19 bp, Artificial sequence
  synthetic polynucleotide sequence
ttctctcccgagacagcga

SEQ ID NO: 45519 - DNA, 19 bp, Artificial sequence
  synthetic polynucleotide sequence
gcagtcgcagccgcagcaa

SEQ ID NO: 45520 - DNA, 20 bp, Artificial sequence
  synthetic polynucleotide sequence
atctggactgggagcggtca

SEQ ID NO: 45521 - DNA, 18 bp, Artificial sequence
  synthetic polynucleotide sequence
gagccggagccggagcaa

SEQ ID NO: 45522 - DNA, 20 bp, Artificial sequence
  synthetic polynucleotide sequence
ggcgatccacagatgctgga

SEQ ID NO: 45523 - DNA, 22 bp, Artificial sequence
  synthetic polynucleotide sequence
tggaagcagatccaggtctcga

SEQ ID NO: 45524 - DNA, 20 bp, Artificial sequence
  synthetic polynucleotide sequence
ctccgcgacctggaacggga

SEQ ID NO: 45525 - DNA, 20 bp, Artificial sequence
  synthetic polynucleotide sequence
gagtgtggcgaaaagggaca

SEQ ID NO: 45526 - DNA, 18 bp, Artificial sequence
  synthetic polynucleotide sequence
cctgctgcgtgagcgaga

SEQ ID NO: 45527 - DNA, 21 bp, Artificial sequence
  synthetic polynucleotide sequence
agccgctctccctacagcaga

SEQ ID NO: 45528 - DNA, 20 bp, Artificial sequence
  synthetic polynucleotide sequence
tggaggttgatgcagagcga

SEQ ID NO: 45529 - DNA, 20 bp, Artificial sequence
  synthetic polynucleotide sequence
agctggcaggacctgaagga

SEQ ID NO: 45530 - DNA, 21 bp, Artificial sequence
  synthetic polynucleotide sequence
tcatccagtttacgcagggca

SEQ ID NO: 45531 - DNA, 18 bp, Artificial sequence
  synthetic polynucleotide sequence
tccgggaggacccagaca

SEQ ID NO: 45532 - DNA, 18 bp, Artificial sequence
  synthetic polynucleotide sequence
tagcggtggcagccccca

SEQ ID NO: 45533 - DNA, 20 bp, Artificial sequence
  synthetic polynucleotide sequence
tctcgcgatcagaggcgcaa

SEQ ID NO: 45534 - DNA, 21 bp, Artificial sequence
  synthetic polynucleotide sequence
tgcctcctggaagaatggcca

SEQ ID NO: 45535 - DNA, 18 bp, Artificial sequence
  synthetic polynucleotide sequence
gcagcagtacccagggca

SEQ ID NO: 45536 - DNA, 19 bp, Artificial sequence
  synthetic polynucleotide sequence
gacctggaccaccctgtga

SEQ ID NO: 45537 - DNA, 20 bp, Artificial sequence
  synthetic polynucleotide sequence
ggccagcagtactaccccga

SEQ ID NO: 45538 - DNA, 19 bp, Artificial sequence
  synthetic polynucleotide sequence
gcgtggactcctcgaagga

SEQ ID NO: 45539 - DNA, 19 bp, Artificial sequence
  synthetic polynucleotide sequence
cagtaggtgttgggcagga

SEQ ID NO: 45540 - DNA, 18 bp, Artificial sequence
  synthetic polynucleotide sequence
gcagtcagggggaccaca

SEQ ID NO: 45541 - DNA, 22 bp, Artificial sequence
  synthetic polynucleotide sequence
gtcagaggagcaaaagagggga

SEQ ID NO: 45542 - DNA, 20 bp, Artificial sequence
  synthetic polynucleotide sequence
taccagacccaggctgggca

SEQ ID NO: 45543 - DNA, 20 bp, Artificial sequence
  synthetic polynucleotide sequence
tggcgatcaggggatagtga

SEQ ID NO: 45544 - DNA, 18 bp, Artificial sequence
  synthetic polynucleotide sequence
ctctgaggcctggccgga

SEQ ID NO: 45545 - DNA, 21 bp, Artificial sequence
  synthetic polynucleotide sequence
gtgcaatgagacccccactga

SEQ ID NO: 45546 - DNA, 19 bp, Artificial sequence
  synthetic polynucleotide sequence
tcccaggagatgctgagga

SEQ ID NO: 45547 - DNA, 21 bp, Artificial sequence
  synthetic polynucleotide sequence
cattatgcccagtcccgcaga

SEQ ID NO: 45548 - DNA, 18 bp, Artificial sequence
  synthetic polynucleotide sequence
agccgggacccatcggga

SEQ ID NO: 45549 - DNA, 22 bp, Artificial sequence
  synthetic polynucleotide sequence
agattccaccaactccagcgaa

SEQ ID NO: 45550 - DNA, 19 bp, Artificial sequence
  synthetic polynucleotide sequence
ccgggggaactcttcggca

SEQ ID NO: 45551 - DNA, 18 bp, Artificial sequence
  synthetic polynucleotide sequence
gtcaatggagcccaccga

SEQ ID NO: 45552 - DNA, 18 bp, Artificial sequence
  synthetic polynucleotide sequence
agctggcggcacaggaca

SEQ ID NO: 45553 - DNA, 18 bp, Artificial sequence
  synthetic polynucleotide sequence
gccacaagcatggaccca

SEQ ID NO: 45554 - DNA, 18 bp, Artificial sequence
  synthetic polynucleotide sequence
agggggtcaggggacaca

SEQ ID NO: 45555 - DNA, 21 bp, Artificial sequence
  synthetic polynucleotide sequence
acacctgaagaggagcaggaa

SEQ ID NO: 45556 - DNA, 20 bp, Artificial sequence
  synthetic polynucleotide sequence
ggtggtggagcaagccgtga

SEQ ID NO: 45557 - DNA, 20 bp, Artificial sequence
  synthetic polynucleotide sequence
tccagggagcgatgtgagga

SEQ ID NO: 45558 - DNA, 20 bp, Artificial sequence
  synthetic polynucleotide sequence
aacacgggacctgctggcca

SEQ ID NO: 45559 - DNA, 18 bp, Artificial sequence
  synthetic polynucleotide sequence
gcagggctcaccaaacca

SEQ ID NO: 45560 - DNA, 18 bp, Artificial sequence
  synthetic polynucleotide sequence
ggggattcacaggaggca

SEQ ID NO: 45561 - DNA, 21 bp, Artificial sequence
  synthetic polynucleotide sequence
tgtaggcatggaagagagcca

SEQ ID NO: 45562 - DNA, 20 bp, Artificial sequence
  synthetic polynucleotide sequence
ctccaaggagggctccagaa

SEQ ID NO: 45563 - DNA, 21 bp, Artificial sequence
  synthetic polynucleotide sequence
aacaccacccatcaccagaca

SEQ ID NO: 45564 - DNA, 20 bp, Artificial sequence
  synthetic polynucleotide sequence
ctgtcgggaatggtgcgcca

SEQ ID NO: 45565 - DNA, 21 bp, Artificial sequence
  synthetic polynucleotide sequence
aggtgaggcagctgacagaga

SEQ ID NO: 45566 - DNA, 21 bp, Artificial sequence
  synthetic polynucleotide sequence
aagtctgggagctctccagga

SEQ ID NO: 45567 - DNA, 18 bp, Artificial sequence
  synthetic polynucleotide sequence
cggagccgctcagcagga

SEQ ID NO: 45568 - DNA, 18 bp, Artificial sequence
  synthetic polynucleotide sequence
agcaggccaacaagcaca

SEQ ID NO: 45569 - DNA, 18 bp, Artificial sequence
  synthetic polynucleotide sequence
cccatgggcggacgacca

SEQ ID NO: 45570 - DNA, 20 bp, Artificial sequence
  synthetic polynucleotide sequence
ctaggagttgatgaaggcca

SEQ ID NO: 45571 - DNA, 19 bp, Artificial sequence
  synthetic polynucleotide sequence
gcacctggacagggaggaa

SEQ ID NO: 45572 - DNA, 18 bp, Artificial sequence
  synthetic polynucleotide sequence
cgatggagggaagggtca

SEQ ID NO: 45573 - DNA, 20 bp, Artificial sequence
  synthetic polynucleotide sequence
aaaggcagctccaaacagca

SEQ ID NO: 45574 - DNA, 18 bp, Artificial sequence
  synthetic polynucleotide sequence
cgcggaggacttggccga

SEQ ID NO: 45575 - DNA, 22 bp, Artificial sequence
  synthetic polynucleotide sequence
acatgcaagaacagggtccaga

SEQ ID NO: 45576 - DNA, 19 bp, Artificial sequence
  synthetic polynucleotide sequence
cccgttccaagtgccccga

SEQ ID NO: 45577 - DNA, 22 bp, Artificial sequence
  synthetic polynucleotide sequence
ctaagcgagagcttcaagagca

SEQ ID NO: 45578 - DNA, 19 bp, Artificial sequence
  synthetic polynucleotide sequence
gtcctctgagctgggggga

SEQ ID NO: 45579 - DNA, 21 bp, Artificial sequence
  synthetic polynucleotide sequence
cacagacagccctcttgcaga

SEQ ID NO: 45580 - DNA, 18 bp, Artificial sequence
  synthetic polynucleotide sequence
cctccgcacatgcgcgga

SEQ ID NO: 45581 - DNA, 18 bp, Artificial sequence
  synthetic polynucleotide sequence
ggaccccagactccgtca

SEQ ID NO: 45582 - DNA, 20 bp, Artificial sequence
  synthetic polynucleotide sequence
gatcttcaggttccagggca

SEQ ID NO: 45583 - DNA, 20 bp, Artificial sequence
  synthetic polynucleotide sequence
tcatgccagagcccgctcaa

SEQ ID NO: 45584 - DNA, 22 bp, Artificial sequence
  synthetic polynucleotide sequence
gcaatgatgagcacgtagcaca

SEQ ID NO: 45585 - DNA, 18 bp, Artificial sequence
  synthetic polynucleotide sequence
ccccagcccttaaaggca

SEQ ID NO: 45586 - DNA, 19 bp, Artificial sequence
  synthetic polynucleotide sequence
cgctcaccttgaccaagca

SEQ ID NO: 45587 - DNA, 20 bp, Artificial sequence
  synthetic polynucleotide sequence
cgtgaccagccttgatgcca

SEQ ID NO: 45588 - DNA, 21 bp, Artificial sequence
  synthetic polynucleotide sequence
gaatcggcggaagttgtcgga

SEQ ID NO: 45589 - DNA, 20 bp, Artificial sequence
  synthetic polynucleotide sequence
ctacgccaacagctgtgcca

SEQ ID NO: 45590 - DNA, 20 bp, Artificial sequence
  synthetic polynucleotide sequence
tcagcgtccttggcaccaga

SEQ ID NO: 45591 - DNA, 21 bp, Artificial sequence
  synthetic polynucleotide sequence
gccccggccagaaagattcca

SEQ ID NO: 45592 - DNA, 20 bp, Artificial sequence
  synthetic polynucleotide sequence
ctcctgcagcagctcgtcga

SEQ ID NO: 45593 - DNA, 19 bp, Artificial sequence
  synthetic polynucleotide sequence
ctgcagcagcgccagacca

SEQ ID NO: 45594 - DNA, 21 bp, Artificial sequence
  synthetic polynucleotide sequence
cagccacagcaataccgctca

SEQ ID NO: 45595 - DNA, 22 bp, Artificial sequence
  synthetic polynucleotide sequence
aagagacccagggatgatgcta

SEQ ID NO: 45596 - DNA, 21 bp, Artificial sequence
  synthetic polynucleotide sequence
acatgaaaggtgggagggtga

SEQ ID NO: 45597 - DNA, 21 bp, Artificial sequence
  synthetic polynucleotide sequence
agagagacgcggaacagctca

SEQ ID NO: 45598 - DNA, 20 bp, Artificial sequence
  synthetic polynucleotide sequence
tgggggtaccatgaactgca

SEQ ID NO: 45599 - DNA, 21 bp, Artificial sequence
  synthetic polynucleotide sequence
gcagccgcaaaagaagcctca

SEQ ID NO: 45600 - DNA, 20 bp, Artificial sequence
  synthetic polynucleotide sequence
atgcaggaacgtgtctggca

SEQ ID NO: 45601 - DNA, 25 bp, Artificial sequence
  synthetic polynucleotide sequence
cacacaccaagtaccagtataggca

SEQ ID NO: 45602 - DNA, 22 bp, Artificial sequence
  synthetic polynucleotide sequence
tgaggggagtacatgctgaaca

SEQ ID NO: 45603 - DNA, 25 bp, Artificial sequence
  synthetic polynucleotide sequence
acacacacagacacaccaagtacca

SEQ ID NO: 45604 - DNA, 22 bp, Artificial sequence
  synthetic polynucleotide sequence
ggggagtacatgctgaacagga

SEQ ID NO: 45605 - DNA, 21 bp, Artificial sequence
  synthetic polynucleotide sequence
cagacgacagtcaggagctca

SEQ ID NO: 45606 - DNA, 21 bp, Artificial sequence
  synthetic polynucleotide sequence
atggctgcaagaacctctgga

SEQ ID NO: 45607 - DNA, 20 bp, Artificial sequence
  synthetic polynucleotide sequence
gagtgtgacgggaaggagga

SEQ ID NO: 45608 - DNA, 20 bp, Artificial sequence
  synthetic polynucleotide sequence
gagaccagccagttgggaga

SEQ ID NO: 45609 - DNA, 22 bp, Artificial sequence
  synthetic polynucleotide sequence
acatcctctccaacaagccaca

SEQ ID NO: 45610 - DNA, 21 bp, Artificial sequence
  synthetic polynucleotide sequence
agaggaagttaggggtgcaga

SEQ ID NO: 45611 - DNA, 21 bp, Artificial sequence
  synthetic polynucleotide sequence
cagtaaatcatggcaccagga

SEQ ID NO: 45612 - DNA, 18 bp, Artificial sequence
  synthetic polynucleotide sequence
gggtcagcacggacacga

SEQ ID NO: 45613 - DNA, 18 bp, Artificial sequence
  synthetic polynucleotide sequence
caactggctgcaagggca

SEQ ID NO: 45614 - DNA, 20 bp, Artificial sequence
  synthetic polynucleotide sequence
caagtccacctcatcgcaga

SEQ ID NO: 45615 - DNA, 21 bp, Artificial sequence
  synthetic polynucleotide sequence
gattcacctacgccccagtga

SEQ ID NO: 45616 - DNA, 21 bp, Artificial sequence
  synthetic polynucleotide sequence
tcatcacacacatgcagggca

SEQ ID NO: 45617 - DNA, 21 bp, Artificial sequence
  synthetic polynucleotide sequence
ggagagagtgagtgcatcgga

SEQ ID NO: 45618 - DNA, 20 bp, Artificial sequence
  synthetic polynucleotide sequence
ggtgaaggcggcctcctgga

SEQ ID NO: 45619 - DNA, 20 bp, Artificial sequence
  synthetic polynucleotide sequence
caaactgctgagcctgccaa

SEQ ID NO: 45620 - DNA, 18 bp, Artificial sequence
  synthetic polynucleotide sequence
cacagaggtggagggcca

SEQ ID NO: 45621 - DNA, 20 bp, Artificial sequence
  synthetic polynucleotide sequence
acagtgcaccagttgaggga

SEQ ID NO: 45622 - DNA, 20 bp, Artificial sequence
  synthetic polynucleotide sequence
gagtcgtacccagaatggca

SEQ ID NO: 45623 - DNA, 22 bp, Artificial sequence
  synthetic polynucleotide sequence
cactactatgggaatgccacca

SEQ ID NO: 45624 - DNA, 20 bp, Artificial sequence
  synthetic polynucleotide sequence
aatcaccaggcagcaacaga

SEQ ID NO: 45625 - DNA, 20 bp, Artificial sequence
  synthetic polynucleotide sequence
cagatgcgagaggcagagga

SEQ ID NO: 45626 - DNA, 18 bp, Artificial sequence
  synthetic polynucleotide sequence
aagcgcctgcagtagcca

SEQ ID NO: 45627 - DNA, 18 bp, Artificial sequence
  synthetic polynucleotide sequence
cctcccatccaagcgcaa

SEQ ID NO: 45628 - DNA, 20 bp, Artificial sequence
  synthetic polynucleotide sequence
tcatagagcagcgggtggta

SEQ ID NO: 45629 - DNA, 18 bp, Artificial sequence
  synthetic polynucleotide sequence
tcccatccgtgcggcaga

SEQ ID NO: 45630 - DNA, 18 bp, Artificial sequence
  synthetic polynucleotide sequence
tcaggcgctgcaccagga

SEQ ID NO: 45631 - DNA, 19 bp, Artificial sequence
  synthetic polynucleotide sequence
tttcgggaagccctgcaca

SEQ ID NO: 45632 - DNA, 21 bp, Artificial sequence
  synthetic polynucleotide sequence
gaaaagcgctcatggccctca

SEQ ID NO: 45633 - DNA, 21 bp, Artificial sequence
  synthetic polynucleotide sequence
gatcaaaggcttcgagcgcga

SEQ ID NO: 45634 - DNA, 20 bp, Artificial sequence
  synthetic polynucleotide sequence
tggcacggaggtgaagccca

SEQ ID NO: 45635 - DNA, 22 bp, Artificial sequence
  synthetic polynucleotide sequence
aaactgggaaggacagagtcca

SEQ ID NO: 45636 - DNA, 20 bp, Artificial sequence
  synthetic polynucleotide sequence
acaggcgtccatggccagaa

SEQ ID NO: 45637 - DNA, 20 bp, Artificial sequence
  synthetic polynucleotide sequence
atgtacctggcacacgagca

SEQ ID NO: 45638 - DNA, 18 bp, Artificial sequence
  synthetic polynucleotide sequence
acggatgggcgaacacga

SEQ ID NO: 45639 - DNA, 19 bp, Artificial sequence
  synthetic polynucleotide sequence
gcaagatgcagaagcccca

SEQ ID NO: 45640 - DNA, 18 bp, Artificial sequence
  synthetic polynucleotide sequence
cacacaactccaccgcga

SEQ ID NO: 45641 - DNA, 21 bp, Artificial sequence
  synthetic polynucleotide sequence
agagaaacccccaagctagga

SEQ ID NO: 45642 - DNA, 21 bp, Artificial sequence
  synthetic polynucleotide sequence
tgagagcgtcggtaacagcca

SEQ ID NO: 45643 - DNA, 22 bp, Artificial sequence
  synthetic polynucleotide sequence
gaaacggggtgatagtgaagca

SEQ ID NO: 45644 - DNA, 21 bp, Artificial sequence
  synthetic polynucleotide sequence
tgtgcagctgggataagggta

SEQ ID NO: 45645 - DNA, 21 bp, Artificial sequence
  synthetic polynucleotide sequence
gcaaccccattccagctgcca

SEQ ID NO: 45646 - DNA, 22 bp, Artificial sequence
  synthetic polynucleotide sequence
aaaggagggagattgcatcgca

SEQ ID NO: 45647 - DNA, 18 bp, Artificial sequence
  synthetic polynucleotide sequence
tgctgcaacggctgcaca

SEQ ID NO: 45648 - DNA, 18 bp, Artificial sequence
  synthetic polynucleotide sequence
cgcgaacggcgtgcagca

SEQ ID NO: 45649 - DNA, 23 bp, Artificial sequence
  synthetic polynucleotide sequence
cttggtgaacaaggacagaggca

SEQ ID NO: 45650 - DNA, 23 bp, Artificial sequence
  synthetic polynucleotide sequence
gcaatgaggcaggcacattcaca

SEQ ID NO: 45651 - DNA, 20 bp, Artificial sequence
  synthetic polynucleotide sequence
gcaccaggagacgcaactca

SEQ ID NO: 45652 - DNA, 19 bp, Artificial sequence
  synthetic polynucleotide sequence
tgaagagccagcctttcga

SEQ ID NO: 45653 - DNA, 21 bp, Artificial sequence
  synthetic polynucleotide sequence
gacgacttcgaatcgccgcaa

SEQ ID NO: 45654 - DNA, 20 bp, Artificial sequence
  synthetic polynucleotide sequence
ctcagagggcatggcgtgga

SEQ ID NO: 45655 - DNA, 20 bp, Artificial sequence
  synthetic polynucleotide sequence
ctggaggacattgcaaccta

SEQ ID NO: 45656 - DNA, 18 bp, Artificial sequence
  synthetic polynucleotide sequence
gccggtggacaagcggta

SEQ ID NO: 45657 - DNA, 18 bp, Artificial sequence
  synthetic polynucleotide sequence
ggcctatggcatcgacca

SEQ ID NO: 45658 - DNA, 19 bp, Artificial sequence
  synthetic polynucleotide sequence
cctgtgacccctcaggaca

SEQ ID NO: 45659 - DNA, 21 bp, Artificial sequence
  synthetic polynucleotide sequence
atggcaccaccctgcaaacga

SEQ ID NO: 45660 - DNA, 19 bp, Artificial sequence
  synthetic polynucleotide sequence
ggtcaaggtcacgggggca

SEQ ID NO: 45661 - DNA, 22 bp, Artificial sequence
  synthetic polynucleotide sequence
cagcgaaccaacagcgaagaca

SEQ ID NO: 45662 - DNA, 18 bp, Artificial sequence
  synthetic polynucleotide sequence
agccctggcgggtgtgga

SEQ ID NO: 45663 - DNA, 20 bp, Artificial sequence
  synthetic polynucleotide sequence
tggtgcatgagccgccacca

SEQ ID NO: 45664 - DNA, 20 bp, Artificial sequence
  synthetic polynucleotide sequence
cagggaggtgccatagcgca

SEQ ID NO: 45665 - DNA, 21 bp, Artificial sequence
  synthetic polynucleotide sequence
tgaagaatggtggcgggggaa

SEQ ID NO: 45666 - DNA, 20 bp, Artificial sequence
  synthetic polynucleotide sequence
tatctcgcggttccccacga

SEQ ID NO: 45667 - DNA, 21 bp, Artificial sequence
  synthetic polynucleotide sequence
catccactgtactgcgggaga

SEQ ID NO: 45668 - DNA, 20 bp, Artificial sequence
  synthetic polynucleotide sequence
cggctggcctaaccaagaga

SEQ ID NO: 45669 - DNA, 18 bp, Artificial sequence
  synthetic polynucleotide sequence
caaggggagagccatcca

SEQ ID NO: 45670 - DNA, 22 bp, Artificial sequence
  synthetic polynucleotide sequence
ggtaagacatcagtggaagcca

SEQ ID NO: 45671 - DNA, 18 bp, Artificial sequence
  synthetic polynucleotide sequence
gctgctgagcctcaagca

SEQ ID NO: 45672 - DNA, 18 bp, Artificial sequence
  synthetic polynucleotide sequence
ggctgattggaggagcca

SEQ ID NO: 45673 - DNA, 18 bp, Artificial sequence
  synthetic polynucleotide sequence
ccaccatccgcaaaccca

SEQ ID NO: 45674 - DNA, 18 bp, Artificial sequence
  synthetic polynucleotide sequence
acatcggcagttgcagca

SEQ ID NO: 45675 - DNA, 20 bp, Artificial sequence
  synthetic polynucleotide sequence
cagcacattacccacctgca

SEQ ID NO: 45676 - DNA, 21 bp, Artificial sequence
  synthetic polynucleotide sequence
ggaggcagagatctcagtgga

SEQ ID NO: 45677 - DNA, 21 bp, Artificial sequence
  synthetic polynucleotide sequence
gatcagcagggcctcatcaca

SEQ ID NO: 45678 - DNA, 20 bp, Artificial sequence
  synthetic polynucleotide sequence
tcctggaacttgggggagca

SEQ ID NO: 45679 - DNA, 20 bp, Artificial sequence
  synthetic polynucleotide sequence
ccctaagcccagaagagcga

SEQ ID NO: 45680 - DNA, 21 bp, Artificial sequence
  synthetic polynucleotide sequence
acacagacgccatcctctcca

SEQ ID NO: 45681 - DNA, 21 bp, Artificial sequence
  synthetic polynucleotide sequence
gagcagagtacgtccgtggaa

SEQ ID NO: 45682 - DNA, 20 bp, Artificial sequence
  synthetic polynucleotide sequence
gtcactaccaggcctcagga

SEQ ID NO: 45683 - DNA, 19 bp, Artificial sequence
  synthetic polynucleotide sequence
ccaggacaagctgccccca

SEQ ID NO: 45684 - DNA, 22 bp, Artificial sequence
  synthetic polynucleotide sequence
ggatgactggccaactagagga

SEQ ID NO: 45685 - DNA, 21 bp, Artificial sequence
  synthetic polynucleotide sequence
gcgcatggaagcaatggggga

SEQ ID NO: 45686 - DNA, 21 bp, Artificial sequence
  synthetic polynucleotide sequence
tgttcccgaagtctgtggcca

SEQ ID NO: 45687 - DNA, 18 bp, Artificial sequence
  synthetic polynucleotide sequence
tcctggctcccaaggcca

SEQ ID NO: 45688 - DNA, 18 bp, Artificial sequence
  synthetic polynucleotide sequence
acagctccgacagcgcca

SEQ ID NO: 45689 - DNA, 20 bp, Artificial sequence
  synthetic polynucleotide sequence
ctgaacagcatggctcccca

SEQ ID NO: 45690 - DNA, 20 bp, Artificial sequence
  synthetic polynucleotide sequence
tcatgctccacggagaggga

SEQ ID NO: 45691 - DNA, 18 bp, Artificial sequence
  synthetic polynucleotide sequence
cgtggtctccccaaggga

SEQ ID NO: 45692 - DNA, 18 bp, Artificial sequence
  synthetic polynucleotide sequence
tggccgacttgagcacga

SEQ ID NO: 45693 - DNA, 20 bp, Artificial sequence
  synthetic polynucleotide sequence
actgcgccattggtgggcaa

SEQ ID NO: 45694 - DNA, 22 bp, Artificial sequence
  synthetic polynucleotide sequence
gaaatccaggaaccacgtctca

SEQ ID NO: 45695 - DNA, 21 bp, Artificial sequence
  synthetic polynucleotide sequence
tagatacagccatggcaagca

SEQ ID NO: 45696 - DNA, 22 bp, Artificial sequence
  synthetic polynucleotide sequence
tacaggccatgtagctgagaga

SEQ ID NO: 45697 - DNA, 21 bp, Artificial sequence
  synthetic polynucleotide sequence
gacactagaggaggtgtggga

SEQ ID NO: 45698 - DNA, 18 bp, Artificial sequence
  synthetic polynucleotide sequence
ggcagcggagggagtgga

SEQ ID NO: 45699 - DNA, 22 bp, Artificial sequence
  synthetic polynucleotide sequence
gtacatcaagcgctacgaagga

SEQ ID NO: 45700 - DNA, 23 bp, Artificial sequence
  synthetic polynucleotide sequence
gtgaacatacaaagccacaagga

SEQ ID NO: 45701 - DNA, 22 bp, Artificial sequence
  synthetic polynucleotide sequence
agctggaggtgattgagaggga

SEQ ID NO: 45702 - DNA, 20 bp, Artificial sequence
  synthetic polynucleotide sequence
gagactctggcacactcgga

SEQ ID NO: 45703 - DNA, 18 bp, Artificial sequence
  synthetic polynucleotide sequence
ctggcttgcaggaaggca

SEQ ID NO: 45704 - DNA, 18 bp, Artificial sequence
  synthetic polynucleotide sequence
gcatcagggcttccagca

SEQ ID NO: 45705 - DNA, 21 bp, Artificial sequence
  synthetic polynucleotide sequence
ccacaacgcactctggaccga

SEQ ID NO: 45706 - DNA, 21 bp, Artificial sequence
  synthetic polynucleotide sequence
ggtgagcccttctgaacccca

SEQ ID NO: 45707 - DNA, 18 bp, Artificial sequence
  synthetic polynucleotide sequence
tccaggccaaaggaagca

SEQ ID NO: 45708 - DNA, 20 bp, Artificial sequence
  synthetic polynucleotide sequence
ctacagagcccactatccga

SEQ ID NO: 45709 - DNA, 21 bp, Artificial sequence
  synthetic polynucleotide sequence
cccaaaccttcagaaccagca

SEQ ID NO: 45710 - DNA, 20 bp, Artificial sequence
  synthetic polynucleotide sequence
agttgaggcctcggccaaca

SEQ ID NO: 45711 - DNA, 18 bp, Artificial sequence
  synthetic polynucleotide sequence
ccaagcgaggactgagca

SEQ ID NO: 45712 - DNA, 19 bp, Artificial sequence
  synthetic polynucleotide sequence
ccagccagacccagaagga

SEQ ID NO: 45713 - DNA, 22 bp, Artificial sequence
  synthetic polynucleotide sequence
ggtacaacgtgtcaaccaacga

SEQ ID NO: 45714 - DNA, 22 bp, Artificial sequence
  synthetic polynucleotide sequence
taagaccacgaccaacgtacga

SEQ ID NO: 45715 - DNA, 22 bp, Artificial sequence
  synthetic polynucleotide sequence
cagagtccgtgacagaggagaa

SEQ ID NO: 45716 - DNA, 19 bp, Artificial sequence
  synthetic polynucleotide sequence
ggcattgtcccacagcaca

SEQ ID NO: 45717 - DNA, 18 bp, Artificial sequence
  synthetic polynucleotide sequence
ggccgaagtgcagagcaa

SEQ ID NO: 45718 - DNA, 20 bp, Artificial sequence
  synthetic polynucleotide sequence
ctgttgaactgggaccagga

SEQ ID NO: 45719 - DNA, 18 bp, Artificial sequence
  synthetic polynucleotide sequence
gaccgtggaaagggacca

SEQ ID NO: 45720 - DNA, 18 bp, Artificial sequence
  synthetic polynucleotide sequence
tggaggaatcaggggcca

SEQ ID NO: 45721 - DNA, 22 bp, Artificial sequence
  synthetic polynucleotide sequence
tgagtaaaagagaacccagcca

SEQ ID NO: 45722 - DNA, 19 bp, Artificial sequence
  synthetic polynucleotide sequence
gggccatacccataaccga

SEQ ID NO: 45723 - DNA, 20 bp, Artificial sequence
  synthetic polynucleotide sequence
cagccacctctgatcagcca

SEQ ID NO: 45724 - DNA, 19 bp, Artificial sequence
  synthetic polynucleotide sequence
tggtccaactcagacagca

SEQ ID NO: 45725 - DNA, 22 bp, Artificial sequence
  synthetic polynucleotide sequence
tgatgcaggtgaaggtaggcaa

SEQ ID NO: 45726 - DNA, 22 bp, Artificial sequence
  synthetic polynucleotide sequence
ttcaggaaacccaggctttgga

SEQ ID NO: 45727 - DNA, 18 bp, Artificial sequence
  synthetic polynucleotide sequence
ccgggttgaccacgagga

SEQ ID NO: 45728 - DNA, 20 bp, Artificial sequence
  synthetic polynucleotide sequence
ctggagccttaagactgcca

SEQ ID NO: 45729 - DNA, 18 bp, Artificial sequence
  synthetic polynucleotide sequence
agcggaaccctgaagcca

SEQ ID NO: 45730 - DNA, 18 bp, Artificial sequence
  synthetic polynucleotide sequence
tccagcaggcttcggaca

SEQ ID NO: 45731 - DNA, 19 bp, Artificial sequence
  synthetic polynucleotide sequence
gaggaggtgaaggaggcca

SEQ ID NO: 45732 - DNA, 18 bp, Artificial sequence
  synthetic polynucleotide sequence
ccgaggtgcagaagctca

SEQ ID NO: 45733 - DNA, 21 bp, Artificial sequence
  synthetic polynucleotide sequence
ctactgggcacaatacacgca

SEQ ID NO: 45734 - DNA, 20 bp, Artificial sequence
  synthetic polynucleotide sequence
cttcctcaagcatggcagga

SEQ ID NO: 45735 - DNA, 20 bp, Artificial sequence
  synthetic polynucleotide sequence
tacgcaatgaggcgatccta

SEQ ID NO: 45736 - DNA, 21 bp, Artificial sequence
  synthetic polynucleotide sequence
atgtcacagccaacagagcca

SEQ ID NO: 45737 - DNA, 20 bp, Artificial sequence
  synthetic polynucleotide sequence
tccctgtgggacctgagaca

SEQ ID NO: 45738 - DNA, 21 bp, Artificial sequence
  synthetic polynucleotide sequence
atataaacctgccggctggca

SEQ ID NO: 45739 - DNA, 18 bp, Artificial sequence
  synthetic polynucleotide sequence
gccctcgtgctgagcaca

SEQ ID NO: 45740 - DNA, 18 bp, Artificial sequence
  synthetic polynucleotide sequence
tgcggctgatgcagggca

SEQ ID NO: 45741 - DNA, 20 bp, Artificial sequence
  synthetic polynucleotide sequence
gaggcacaaaataccgtcga

SEQ ID NO: 45742 - DNA, 20 bp, Artificial sequence
  synthetic polynucleotide sequence
gaatcactgagccaggctga

SEQ ID NO: 45743 - DNA, 21 bp, Artificial sequence
  synthetic polynucleotide sequence
tggggctgagcagggaagaca

SEQ ID NO: 45744 - DNA, 21 bp, Artificial sequence
  synthetic polynucleotide sequence
acttggcatgaggtcgcctga

SEQ ID NO: 45745 - DNA, 20 bp, Artificial sequence
  synthetic polynucleotide sequence
gatgaagaggaacctcccga

SEQ ID NO: 45746 - DNA, 19 bp, Artificial sequence
  synthetic polynucleotide sequence
tggtccccacagattcaca

SEQ ID NO: 45747 - DNA, 21 bp, Artificial sequence
  synthetic polynucleotide sequence
ctgccctcaacatagacccca

SEQ ID NO: 45748 - DNA, 21 bp, Artificial sequence
  synthetic polynucleotide sequence
gctgccgaacactgctctgca

SEQ ID NO: 45749 - DNA, 22 bp, Artificial sequence
  synthetic polynucleotide sequence
caatttcccgggaccatggcta

SEQ ID NO: 45750 - DNA, 18 bp, Artificial sequence
  synthetic polynucleotide sequence
gggtggtgagggtgccga

SEQ ID NO: 45751 - DNA, 18 bp, Artificial sequence
  synthetic polynucleotide sequence
ccccaggcactcagcgaa

SEQ ID NO: 45752 - DNA, 20 bp, Artificial sequence
  synthetic polynucleotide sequence
tgcaatcagacccacatcca

SEQ ID NO: 45753 - DNA, 21 bp, Artificial sequence
  synthetic polynucleotide sequence
gatccagaggagtgagggcaa

SEQ ID NO: 45754 - DNA, 21 bp, Artificial sequence
  synthetic polynucleotide sequence
tgttgctctcacactgcgcca

SEQ ID NO: 45755 - DNA, 18 bp, Artificial sequence
  synthetic polynucleotide sequence
acgacacctgccggacca

SEQ ID NO: 45756 - DNA, 18 bp, Artificial sequence
  synthetic polynucleotide sequence
gagggtgaccccagccga

SEQ ID NO: 45757 - DNA, 21 bp, Artificial sequence
  synthetic polynucleotide sequence
gtgtgtcaggagcagctgaca

SEQ ID NO: 45758 - DNA, 18 bp, Artificial sequence
  synthetic polynucleotide sequence
gggccagcgcctcttgga

SEQ ID NO: 45759 - DNA, 19 bp, Artificial sequence
  synthetic polynucleotide sequence
tggagatgaggggcagcca

SEQ ID NO: 45760 - DNA, 21 bp, Artificial sequence
  synthetic polynucleotide sequence
agtccgctcatcgatgacaca

SEQ ID NO: 45761 - DNA, 22 bp, Artificial sequence
  synthetic polynucleotide sequence
agaacagtgaagagctccgaga

SEQ ID NO: 45762 - DNA, 23 bp, Artificial sequence
  synthetic polynucleotide sequence
gaaatcaacagccgactcagaca

SEQ ID NO: 45763 - DNA, 21 bp, Artificial sequence
  synthetic polynucleotide sequence
agtttcacagctggccacaga

SEQ ID NO: 45764 - DNA, 22 bp, Artificial sequence
  synthetic polynucleotide sequence
aaagtcccactgctgtagccaa

SEQ ID NO: 45765 - DNA, 19 bp, Artificial sequence
  synthetic polynucleotide sequence
gagtcctcaccgtccgaga

SEQ ID NO: 45766 - DNA, 18 bp, Artificial sequence
  synthetic polynucleotide sequence
ccaagccgcaccacgaca

SEQ ID NO: 45767 - DNA, 21 bp, Artificial sequence
  synthetic polynucleotide sequence
gacgcggaaacagatggccaa

SEQ ID NO: 45768 - DNA, 20 bp, Artificial sequence
  synthetic polynucleotide sequence
gaccccaagttccctccgca

SEQ ID NO: 45769 - DNA, 18 bp, Artificial sequence
  synthetic polynucleotide sequence
ggagcccgtcaagaggca

SEQ ID NO: 45770 - DNA, 18 bp, Artificial sequence
  synthetic polynucleotide sequence
tccagctcctccagcgca

SEQ ID NO: 45771 - DNA, 22 bp, Artificial sequence
  synthetic polynucleotide sequence
agtacagaatggggcagagcaa

SEQ ID NO: 45772 - DNA, 19 bp, Artificial sequence
  synthetic polynucleotide sequence
ggacaggcggcttcagcca

SEQ ID NO: 45773 - DNA, 21 bp, Artificial sequence
  synthetic polynucleotide sequence
atgagctggattcccacacca

SEQ ID NO: 45774 - DNA, 20 bp, Artificial sequence
  synthetic polynucleotide sequence
accatggtccccaagtcgga

SEQ ID NO: 45775 - DNA, 20 bp, Artificial sequence
  synthetic polynucleotide sequence
gagagagcagccacctacca

SEQ ID NO: 45776 - DNA, 22 bp, Artificial sequence
  synthetic polynucleotide sequence
tatgggaccatcagataagcca

SEQ ID NO: 45777 - DNA, 21 bp, Artificial sequence
  synthetic polynucleotide sequence
gatcatgcagggtctggagca

SEQ ID NO: 45778 - DNA, 21 bp, Artificial sequence
  synthetic polynucleotide sequence
gataacgcaggtctccaccca

SEQ ID NO: 45779 - DNA, 20 bp, Artificial sequence
  synthetic polynucleotide sequence
ctcaggaggcagcagggaca

SEQ ID NO: 45780 - DNA, 20 bp, Artificial sequence
  synthetic polynucleotide sequence
ggtgcaggtgtgggtgagga

SEQ ID NO: 45781 - DNA, 19 bp, Artificial sequence
  synthetic polynucleotide sequence
cctccaggacgtgcaggca

SEQ ID NO: 45782 - DNA, 20 bp, Artificial sequence
  synthetic polynucleotide sequence
agctcaaaggtggggtcgca

SEQ ID NO: 45783 - DNA, 21 bp, Artificial sequence
  synthetic polynucleotide sequence
taggagtgaagccatgctgca

SEQ ID NO: 45784 - DNA, 21 bp, Artificial sequence
  synthetic polynucleotide sequence
cattacgacgcctatgctcca

SEQ ID NO: 45785 - DNA, 21 bp, Artificial sequence
  synthetic polynucleotide sequence
accccgaggcaaagagggcaa

SEQ ID NO: 45786 - DNA, 21 bp, Artificial sequence
  synthetic polynucleotide sequence
tgtccctcccagacttcagga

SEQ ID NO: 45787 - DNA, 21 bp, Artificial sequence
  synthetic polynucleotide sequence
tgtctgcctcccctagaacca

SEQ ID NO: 45788 - DNA, 19 bp, Artificial sequence
  synthetic polynucleotide sequence
tggagcaagtgtcccagga

SEQ ID NO: 45789 - DNA, 20 bp, Artificial sequence
  synthetic polynucleotide sequence
aaccacagcctccccagtga

SEQ ID NO: 45790 - DNA, 21 bp, Artificial sequence
  synthetic polynucleotide sequence
aacagaaaggtgggtagccga

SEQ ID NO: 45791 - DNA, 20 bp, Artificial sequence
  synthetic polynucleotide sequence
tccacagttgggacaccaga

SEQ ID NO: 45792 - DNA, 21 bp, Artificial sequence
  synthetic polynucleotide sequence
ccaaagaccaccagtcacaca

SEQ ID NO: 45793 - DNA, 18 bp, Artificial sequence
  synthetic polynucleotide sequence
aaggcccacagcagcaga

SEQ ID NO: 45794 - DNA, 20 bp, Artificial sequence
  synthetic polynucleotide sequence
gaaggtgaccacttgaccca

SEQ ID NO: 45795 - DNA, 21 bp, Artificial sequence
  synthetic polynucleotide sequence
tgtggaatcagacctccagga

SEQ ID NO: 45796 - DNA, 20 bp, Artificial sequence
  synthetic polynucleotide sequence
cagatacagaaccagcccca

SEQ ID NO: 45797 - DNA, 20 bp, Artificial sequence
  synthetic polynucleotide sequence
tacgacagcatcccgcagga

SEQ ID NO: 45798 - DNA, 21 bp, Artificial sequence
  synthetic polynucleotide sequence
cagcagcttccggatgagaca

SEQ ID NO: 45799 - DNA, 20 bp, Artificial sequence
  synthetic polynucleotide sequence
aaggtggtggtgcaggagga

SEQ ID NO: 45800 - DNA, 21 bp, Artificial sequence
  synthetic polynucleotide sequence
cataggaagccaggtggacca

SEQ ID NO: 45801 - DNA, 19 bp, Artificial sequence
  synthetic polynucleotide sequence
gattctcagccctcggtca

SEQ ID NO: 45802 - DNA, 21 bp, Artificial sequence
  synthetic polynucleotide sequence
gccagctgcttcaagacctca

SEQ ID NO: 45803 - DNA, 21 bp, Artificial sequence
  synthetic polynucleotide sequence
ctatctcagaagccccacgaa

SEQ ID NO: 45804 - DNA, 19 bp, Artificial sequence
  synthetic polynucleotide sequence
cagcacctgggcctcctga

SEQ ID NO: 45805 - DNA, 20 bp, Artificial sequence
  synthetic polynucleotide sequence
gtgctgaagcagctggcgga

SEQ ID NO: 45806 - DNA, 18 bp, Artificial sequence
  synthetic polynucleotide sequence
ccaggtgtgcctcgcgga

SEQ ID NO: 45807 - DNA, 20 bp, Artificial sequence
  synthetic polynucleotide sequence
cttcctggccgatcccctga

SEQ ID NO: 45808 - DNA, 21 bp, Artificial sequence
  synthetic polynucleotide sequence
agggaggcgttgaactcggga

SEQ ID NO: 45809 - DNA, 21 bp, Artificial sequence
  synthetic polynucleotide sequence
caacctgctgaagaccggaga

SEQ ID NO: 45810 - DNA, 20 bp, Artificial sequence
  synthetic polynucleotide sequence
cttggtcagagcagcttcca

SEQ ID NO: 45811 - DNA, 20 bp, Artificial sequence
  synthetic polynucleotide sequence
tcacagctcagccctagaga

SEQ ID NO: 45812 - DNA, 22 bp, Artificial sequence
  synthetic polynucleotide sequence
gcaagggacagcaaagactcca

SEQ ID NO: 45813 - DNA, 18 bp, Artificial sequence
  synthetic polynucleotide sequence
agcagaagcgtcccgcga

SEQ ID NO: 45814 - DNA, 18 bp, Artificial sequence
  synthetic polynucleotide sequence
cggagctgaagggctgca

SEQ ID NO: 45815 - DNA, 21 bp, Artificial sequence
  synthetic polynucleotide sequence
aggacgaggaagagtgggaca

SEQ ID NO: 45816 - DNA, 20 bp, Artificial sequence
  synthetic polynucleotide sequence
tccactcatgtaggccccca

SEQ ID NO: 45817 - DNA, 20 bp, Artificial sequence
  synthetic polynucleotide sequence
tcctggcctccgaagcagaa

SEQ ID NO: 45818 - DNA, 20 bp, Artificial sequence
  synthetic polynucleotide sequence
gagctgcagccaggattcga

SEQ ID NO: 45819 - DNA, 22 bp, Artificial sequence
  synthetic polynucleotide sequence
aaatccctgaagtcagcctcca

SEQ ID NO: 45820 - DNA, 20 bp, Artificial sequence
  synthetic polynucleotide sequence
tatcatagctgacgccacca

SEQ ID NO: 45821 - DNA, 21 bp, Artificial sequence
  synthetic polynucleotide sequence
aagtcactgtggggtcagcaa

SEQ ID NO: 45822 - DNA, 21 bp, Artificial sequence
  synthetic polynucleotide sequence
acatcactctccactcccaga

SEQ ID NO: 45823 - DNA, 20 bp, Artificial sequence
  synthetic polynucleotide sequence
tcagcttccggtcacccaca

SEQ ID NO: 45824 - DNA, 20 bp, Artificial sequence
  synthetic polynucleotide sequence
ggaggcagaagttgtgggca

SEQ ID NO: 45825 - DNA, 20 bp, Artificial sequence
  synthetic polynucleotide sequence
gagaccaaacagactccgca

SEQ ID NO: 45826 - DNA, 20 bp, Artificial sequence
  synthetic polynucleotide sequence
cacgccaactgggtaatcca

SEQ ID NO: 45827 - DNA, 22 bp, Artificial sequence
  synthetic polynucleotide sequence
agcagcagcatcacagtggaca

SEQ ID NO: 45828 - DNA, 21 bp, Artificial sequence
  synthetic polynucleotide sequence
ctcaaagcggggttctgacga

SEQ ID NO: 45829 - DNA, 20 bp, Artificial sequence
  synthetic polynucleotide sequence
gtgcgcccgattggacacca

SEQ ID NO: 45830 - DNA, 21 bp, Artificial sequence
  synthetic polynucleotide sequence
ttgcagcaagagacagaggca

SEQ ID NO: 45831 - DNA, 21 bp, Artificial sequence
  synthetic polynucleotide sequence
gaggaaatgccaggtcctgga

SEQ ID NO: 45832 - DNA, 21 bp, Artificial sequence
  synthetic polynucleotide sequence
accgagaagaaagtccgagga

SEQ ID NO: 45833 - DNA, 20 bp, Artificial sequence
  synthetic polynucleotide sequence
tgcaggcacctggcaagaga

SEQ ID NO: 45834 - DNA, 18 bp, Artificial sequence
  synthetic polynucleotide sequence
acgcaggggagcggctca

SEQ ID NO: 45835 - DNA, 20 bp, Artificial sequence
  synthetic polynucleotide sequence
ctctccgaggacaagcagga

SEQ ID NO: 45836 - DNA, 20 bp, Artificial sequence
  synthetic polynucleotide sequence
gtgtgtcaccagtgagcgca

SEQ ID NO: 45837 - DNA, 21 bp, Artificial sequence
  synthetic polynucleotide sequence
tcaaagccagccacatcctga

SEQ ID NO: 45838 - DNA, 18 bp, Artificial sequence
  synthetic polynucleotide sequence
ggaggacctcggggctga

SEQ ID NO: 45839 - DNA, 21 bp, Artificial sequence
  synthetic polynucleotide sequence
cacgtccatccactagagcca

SEQ ID NO: 45840 - DNA, 21 bp, Artificial sequence
  synthetic polynucleotide sequence
ctgtgggagtatgccgtgcaa

SEQ ID NO: 45841 - DNA, 19 bp, Artificial sequence
  synthetic polynucleotide sequence
ctgctctggccacacgcga

SEQ ID NO: 45842 - DNA, 21 bp, Artificial sequence
  synthetic polynucleotide sequence
agtgttgcaccccaaacagca

SEQ ID NO: 45843 - DNA, 20 bp, Artificial sequence
  synthetic polynucleotide sequence
attacccacagtgcacagca

SEQ ID NO: 45844 - DNA, 22 bp, Artificial sequence
  synthetic polynucleotide sequence
ctttagagctgaagacccagca

SEQ ID NO: 45845 - DNA, 20 bp, Artificial sequence
  synthetic polynucleotide sequence
gagggaaaggagagcccaga

SEQ ID NO: 45846 - DNA, 22 bp, Artificial sequence
  synthetic polynucleotide sequence
tagtcaataccagggaccagga

SEQ ID NO: 45847 - DNA, 21 bp, Artificial sequence
  synthetic polynucleotide sequence
acggcggagagtttggaagca

SEQ ID NO: 45848 - DNA, 22 bp, Artificial sequence
  synthetic polynucleotide sequence
atgggggctgacttgaacacca

SEQ ID NO: 45849 - DNA, 21 bp, Artificial sequence
  synthetic polynucleotide sequence
gggccccaaaggtcagacaga

SEQ ID NO: 45850 - DNA, 21 bp, Artificial sequence
  synthetic polynucleotide sequence
ttcccccaaagacatagggca

SEQ ID NO: 45851 - DNA, 18 bp, Artificial sequence
  synthetic polynucleotide sequence
gaaaacagccccagccaa

SEQ ID NO: 45852 - DNA, 22 bp, Artificial sequence
  synthetic polynucleotide sequence
gatcagtccatcagtaccacca

SEQ ID NO: 45853 - DNA, 21 bp, Artificial sequence
  synthetic polynucleotide sequence
atgcaaccatccagtggtgga

SEQ ID NO: 45854 - DNA, 22 bp, Artificial sequence
  synthetic polynucleotide sequence
ataagcaagaccccaaactgca

SEQ ID NO: 45855 - DNA, 20 bp, Artificial sequence
  synthetic polynucleotide sequence
gtggccttcaccagcaccga

SEQ ID NO: 45856 - DNA, 20 bp, Artificial sequence
  synthetic polynucleotide sequence
ccgggactccagcgtgagga

SEQ ID NO: 45857 - DNA, 19 bp, Artificial sequence
  synthetic polynucleotide sequence
cccttgcctgaggacagga

SEQ ID NO: 45858 - DNA, 18 bp, Artificial sequence
  synthetic polynucleotide sequence
tctgagggtgccagcgca

SEQ ID NO: 45859 - DNA, 19 bp, Artificial sequence
  synthetic polynucleotide sequence
tctcgagtagggcaggcaa

SEQ ID NO: 45860 - DNA, 21 bp, Artificial sequence
  synthetic polynucleotide sequence
gaatacccagtgaggcctcca

SEQ ID NO: 45861 - DNA, 19 bp, Artificial sequence
  synthetic polynucleotide sequence
ttggaaccaaggagcagga

SEQ ID NO: 45862 - DNA, 21 bp, Artificial sequence
  synthetic polynucleotide sequence
cataaccaccccaagcagaga

SEQ ID NO: 45863 - DNA, 21 bp, Artificial sequence
  synthetic polynucleotide sequence
gaagaagcgagacatccccga

SEQ ID NO: 45864 - DNA, 18 bp, Artificial sequence
  synthetic polynucleotide sequence
tcagggggctccgggtca

SEQ ID NO: 45865 - DNA, 19 bp, Artificial sequence
  synthetic polynucleotide sequence
gtggtgcaggtccgcgaga

SEQ ID NO: 45866 - DNA, 22 bp, Artificial sequence
  synthetic polynucleotide sequence
aagatgctcatgatccagccca

SEQ ID NO: 45867 - DNA, 21 bp, Artificial sequence
  synthetic polynucleotide sequence
agcaggccacacagcagctga

SEQ ID NO: 45868 - DNA, 19 bp, Artificial sequence
  synthetic polynucleotide sequence
ttggccaacttcctgagga

SEQ ID NO: 45869 - DNA, 18 bp, Artificial sequence
  synthetic polynucleotide sequence
tggagaagcaggccgaca

SEQ ID NO: 45870 - DNA, 18 bp, Artificial sequence
  synthetic polynucleotide sequence
gcagggacagcagaagca

SEQ ID NO: 45871 - DNA, 19 bp, Artificial sequence
  synthetic polynucleotide sequence
tgccagagcaagagctgga

SEQ ID NO: 45872 - DNA, 18 bp, Artificial sequence
  synthetic polynucleotide sequence
cctgctcagtgatggcca

SEQ ID NO: 45873 - DNA, 18 bp, Artificial sequence
  synthetic polynucleotide sequence
ggtgtgacaaaacggcca

SEQ ID NO: 45874 - DNA, 18 bp, Artificial sequence
  synthetic polynucleotide sequence
cccctcctgctcggagca

SEQ ID NO: 45875 - DNA, 21 bp, Artificial sequence
  synthetic polynucleotide sequence
gtggcaggaattgcagctgca

SEQ ID NO: 45876 - DNA, 21 bp, Artificial sequence
  synthetic polynucleotide sequence
gggaagatctggacagctgga

SEQ ID NO: 45877 - DNA, 20 bp, Artificial sequence
  synthetic polynucleotide sequence
cccgccactgggtccaagga

SEQ ID NO: 45878 - DNA, 20 bp, Artificial sequence
  synthetic polynucleotide sequence
ggaggtcagaagcacaggca

SEQ ID NO: 45879 - DNA, 25 bp, Artificial sequence
  synthetic polynucleotide sequence
gaggaacaaggagagagcatcaaca

SEQ ID NO: 45880 - DNA, 25 bp, Artificial sequence
  synthetic polynucleotide sequence
ccaacaacacagtactctgcaagga

SEQ ID NO: 45881 - DNA, 21 bp, Artificial sequence
  synthetic polynucleotide sequence
cgaagcaggctctgagcgaga

SEQ ID NO: 45882 - DNA, 20 bp, Artificial sequence
  synthetic polynucleotide sequence
gctctccacgagcatggcca

SEQ ID NO: 45883 - DNA, 21 bp, Artificial sequence
  synthetic polynucleotide sequence
tcgtagagagccagggagaga

SEQ ID NO: 45884 - DNA, 19 bp, Artificial sequence
  synthetic polynucleotide sequence
gacgccaagaccaccccca

SEQ ID NO: 45885 - DNA, 21 bp, Artificial sequence
  synthetic polynucleotide sequence
tggagagcgggaagccatcca

SEQ ID NO: 45886 - DNA, 19 bp, Artificial sequence
  synthetic polynucleotide sequence
ttcaccctgagtctccaca

SEQ ID NO: 45887 - DNA, 21 bp, Artificial sequence
  synthetic polynucleotide sequence
atgacctagagcagctcacga

SEQ ID NO: 45888 - DNA, 18 bp, Artificial sequence
  synthetic polynucleotide sequence
aatccgaaggtctgccga

SEQ ID NO: 45889 - DNA, 18 bp, Artificial sequence
  synthetic polynucleotide sequence
ggaacgtgggcaggagca

SEQ ID NO: 45890 - DNA, 20 bp, Artificial sequence
  synthetic polynucleotide sequence
tgctaggaggacgacggtga

SEQ ID NO: 45891 - DNA, 20 bp, Artificial sequence
  synthetic polynucleotide sequence
gagaacgtgctaggagccca

SEQ ID NO: 45892 - DNA, 18 bp, Artificial sequence
  synthetic polynucleotide sequence
caccggttggaggtgaca

SEQ ID NO: 45893 - DNA, 21 bp, Artificial sequence
  synthetic polynucleotide sequence
ccgagagctccagagagccaa

SEQ ID NO: 45894 - DNA, 20 bp, Artificial sequence
  synthetic polynucleotide sequence
cccgatgctgccagagacca

SEQ ID NO: 45895 - DNA, 20 bp, Artificial sequence
  synthetic polynucleotide sequence
acccccagtgaacagcgtca

SEQ ID NO: 45896 - DNA, 22 bp, Artificial sequence
  synthetic polynucleotide sequence
gaaaactgccagacactctgga

SEQ ID NO: 45897 - DNA, 19 bp, Artificial sequence
  synthetic polynucleotide sequence
tgacgaccttgccaaccta

SEQ ID NO: 45898 - DNA, 21 bp, Artificial sequence
  synthetic polynucleotide sequence
tcggccagactgcaacaacca

SEQ ID NO: 45899 - DNA, 18 bp, Artificial sequence
  synthetic polynucleotide sequence
aggaccctatgcgagcca

SEQ ID NO: 45900 - DNA, 18 bp, Artificial sequence
  synthetic polynucleotide sequence
aatcggtgacgatgggca

SEQ ID NO: 45901 - DNA, 20 bp, Artificial sequence
  synthetic polynucleotide sequence
gaggaccggctggacaggaa

SEQ ID NO: 45902 - DNA, 18 bp, Artificial sequence
  synthetic polynucleotide sequence
agcgggtcggggtgagga

SEQ ID NO: 45903 - DNA, 21 bp, Artificial sequence
  synthetic polynucleotide sequence
cccagtgtccagcagtatgga

SEQ ID NO: 45904 - DNA, 22 bp, Artificial sequence
  synthetic polynucleotide sequence
cataagcacaacgcacttcaga

SEQ ID NO: 45905 - DNA, 22 bp, Artificial sequence
  synthetic polynucleotide sequence
aatggacgtagcatcccagcaa

SEQ ID NO: 45906 - DNA, 22 bp, Artificial sequence
  synthetic polynucleotide sequence
attcaggacactcatcacggga

SEQ ID NO: 45907 - DNA, 22 bp, Artificial sequence
  synthetic polynucleotide sequence
acctgaagcaccaaacagggga

SEQ ID NO: 45908 - DNA, 19 bp, Artificial sequence
  synthetic polynucleotide sequence
tacgccttcaatgccacca

SEQ ID NO: 45909 - DNA, 22 bp, Artificial sequence
  synthetic polynucleotide sequence
ggaagcttcggcaggaaaagca

SEQ ID NO: 45910 - DNA, 20 bp, Artificial sequence
  synthetic polynucleotide sequence
tgcaatccgtgcacgggtca

SEQ ID NO: 45911 - DNA, 21 bp, Artificial sequence
  synthetic polynucleotide sequence
gatcctccaccatacctgcca

SEQ ID NO: 45912 - DNA, 20 bp, Artificial sequence
  synthetic polynucleotide sequence
gtcacgctgtcagcagctga

SEQ ID NO: 45913 - DNA, 20 bp, Artificial sequence
  synthetic polynucleotide sequence
agacccagtagctgcacaca

SEQ ID NO: 45914 - DNA, 18 bp, Artificial sequence
  synthetic polynucleotide sequence
ggcagcttctaggcgcaa

SEQ ID NO: 45915 - DNA, 22 bp, Artificial sequence
  synthetic polynucleotide sequence
tctacatcctgaaagggggcta

SEQ ID NO: 45916 - DNA, 21 bp, Artificial sequence
  synthetic polynucleotide sequence
caacgaagaccttccctggca

SEQ ID NO: 45917 - DNA, 18 bp, Artificial sequence
  synthetic polynucleotide sequence
gcgagcgaacgaccaaga

SEQ ID NO: 45918 - DNA, 18 bp, Artificial sequence
  synthetic polynucleotide sequence
gatgacagggctctcgaa

SEQ ID NO: 45919 - DNA, 20 bp, Artificial sequence
  synthetic polynucleotide sequence
cagcagcaacagcaaaggaa

SEQ ID NO: 45920 - DNA, 20 bp, Artificial sequence
  synthetic polynucleotide sequence
atcctttgggaacggagaca

SEQ ID NO: 45921 - DNA, 19 bp, Artificial sequence
  synthetic polynucleotide sequence
cccaactgccctggagtca

SEQ ID NO: 45922 - DNA, 18 bp, Artificial sequence
  synthetic polynucleotide sequence
acctccaatgccaacgca

SEQ ID NO: 45923 - DNA, 18 bp, Artificial sequence
  synthetic polynucleotide sequence
ggctgcttcaaacccgga

SEQ ID NO: 45924 - DNA, 20 bp, Artificial sequence
  synthetic polynucleotide sequence
caaaggcccaacgaagccta

SEQ ID NO: 45925 - DNA, 20 bp, Artificial sequence
  synthetic polynucleotide sequence
gtgcaccctccccatgctga

SEQ ID NO: 45926 - DNA, 23 bp, Artificial sequence
  synthetic polynucleotide sequence
taaaacccaaatggccaaggaga

SEQ ID NO: 45927 - DNA, 20 bp, Artificial sequence
  synthetic polynucleotide sequence
tgggcagcggtgaacaggaa

SEQ ID NO: 45928 - DNA, 21 bp, Artificial sequence
  synthetic polynucleotide sequence
ctgcgctgccgataaagagca

SEQ ID NO: 45929 - DNA, 18 bp, Artificial sequence
  synthetic polynucleotide sequence
gaaacctgctccagccca

SEQ ID NO: 45930 - DNA, 18 bp, Artificial sequence
  synthetic polynucleotide sequence
gcaggcaagtgctcagga

SEQ ID NO: 45931 - DNA, 18 bp, Artificial sequence
  synthetic polynucleotide sequence
gtgacagctccacggcca

SEQ ID NO: 45932 - DNA, 18 bp, Artificial sequence
  synthetic polynucleotide sequence
agtgccgtccatgcagga

SEQ ID NO: 45933 - DNA, 19 bp, Artificial sequence
  synthetic polynucleotide sequence
cccaggcccagctgtgaga

SEQ ID NO: 45934 - DNA, 20 bp, Artificial sequence
  synthetic polynucleotide sequence
gtccaccactccagcgctga

SEQ ID NO: 45935 - DNA, 20 bp, Artificial sequence
  synthetic polynucleotide sequence
agctgctgtgggagaaggca

SEQ ID NO: 45936 - DNA, 19 bp, Artificial sequence
  synthetic polynucleotide sequence
ttgtcagctgctcggccca

SEQ ID NO: 45937 - DNA, 21 bp, Artificial sequence
  synthetic polynucleotide sequence
acaccacgggttctcaggaga

SEQ ID NO: 45938 - DNA, 21 bp, Artificial sequence
  synthetic polynucleotide sequence
tgtgacaaggcaggtgctcca

SEQ ID NO: 45939 - DNA, 21 bp, Artificial sequence
  synthetic polynucleotide sequence
aaggagatgtgcctacgccaa

SEQ ID NO: 45940 - DNA, 22 bp, Artificial sequence
  synthetic polynucleotide sequence
aaaactgtaccacccgactcca

SEQ ID NO: 45941 - DNA, 19 bp, Artificial sequence
  synthetic polynucleotide sequence
caaggaggctgctcaggaa

SEQ ID NO: 45942 - DNA, 19 bp, Artificial sequence
  synthetic polynucleotide sequence
cgtgaagcaagtgaggcca

SEQ ID NO: 45943 - DNA, 18 bp, Artificial sequence
  synthetic polynucleotide sequence
ctccaacctcgtgcccaa

SEQ ID NO: 45944 - DNA, 18 bp, Artificial sequence
  synthetic polynucleotide sequence
cgatggccactgagcgga

SEQ ID NO: 45945 - DNA, 20 bp, Artificial sequence
  synthetic polynucleotide sequence
gttgcccgcaacgcaaagga

SEQ ID NO: 45946 - DNA, 21 bp, Artificial sequence
  synthetic polynucleotide sequence
ggtaccaggatccgtaggaca

SEQ ID NO: 45947 - DNA, 21 bp, Artificial sequence
  synthetic polynucleotide sequence
tcctggtaccagcacgtgcaa

SEQ ID NO: 45948 - DNA, 22 bp, Artificial sequence
  synthetic polynucleotide sequence
ttgaacgacgtgtgctcaacca

SEQ ID NO: 45949 - DNA, 21 bp, Artificial sequence
  synthetic polynucleotide sequence
cctgccagaggagaccatgga

SEQ ID NO: 45950 - DNA, 20 bp, Artificial sequence
  synthetic polynucleotide sequence
ctccgcatagtccgcatcga

SEQ ID NO: 45951 - DNA, 20 bp, Artificial sequence
  synthetic polynucleotide sequence
ctggctcgtaatgccaagga

SEQ ID NO: 45952 - DNA, 22 bp, Artificial sequence
  synthetic polynucleotide sequence
gtaaaccaggaaccataggcca

SEQ ID NO: 45953 - DNA, 21 bp, Artificial sequence
  synthetic polynucleotide sequence
agccatcatccaacaccgcca

SEQ ID NO: 45954 - DNA, 19 bp, Artificial sequence
  synthetic polynucleotide sequence
tcccagaaagacggtggca

SEQ ID NO: 45955 - DNA, 22 bp, Artificial sequence
  synthetic polynucleotide sequence
atgtggccagaaatcccaagga

SEQ ID NO: 45956 - DNA, 25 bp, Artificial sequence
  synthetic polynucleotide sequence
tgaggatcaggcataaaggaagcca

SEQ ID NO: 45957 - DNA, 20 bp, Artificial sequence
  synthetic polynucleotide sequence
cctgctccaggaacatggga

SEQ ID NO: 45958 - DNA, 20 bp, Artificial sequence
  synthetic polynucleotide sequence
atgccaggagccccagcaca

SEQ ID NO: 45959 - DNA, 22 bp, Artificial sequence
  synthetic polynucleotide sequence
ttcagttccaaggccaaggtga

SEQ ID NO: 45960 - DNA, 21 bp, Artificial sequence
  synthetic polynucleotide sequence
tctctcatgggcatccagcca

SEQ ID NO: 45961 - DNA, 19 bp, Artificial sequence
  synthetic polynucleotide sequence
cctacgaggagctgcagca

SEQ ID NO: 45962 - DNA, 18 bp, Artificial sequence
  synthetic polynucleotide sequence
cgcgacggtggtccagca

SEQ ID NO: 45963 - DNA, 21 bp, Artificial sequence
  synthetic polynucleotide sequence
cctggtgacgatggtggagca

SEQ ID NO: 45964 - DNA, 19 bp, Artificial sequence
  synthetic polynucleotide sequence
gggcctcagcgttgcagca

SEQ ID NO: 45965 - DNA, 20 bp, Artificial sequence
  synthetic polynucleotide sequence
ccagagcaccttccaagcca

SEQ ID NO: 45966 - DNA, 20 bp, Artificial sequence
  synthetic polynucleotide sequence
gcggaaaaggaatgggccga

SEQ ID NO: 45967 - DNA, 18 bp, Artificial sequence
  synthetic polynucleotide sequence
gcagcccaaaggccagca

SEQ ID NO: 45968 - DNA, 18 bp, Artificial sequence
  synthetic polynucleotide sequence
ccattgggagggaaggca

SEQ ID NO: 45969 - DNA, 19 bp, Artificial sequence
  synthetic polynucleotide sequence
ggcatcctggatcgacaca

SEQ ID NO: 45970 - DNA, 18 bp, Artificial sequence
  synthetic polynucleotide sequence
cgtctgcagcacagcgga

SEQ ID NO: 45971 - DNA, 20 bp, Artificial sequence
  synthetic polynucleotide sequence
ctgtggggaagggagaagga

SEQ ID NO: 45972 - DNA, 19 bp, Artificial sequence
  synthetic polynucleotide sequence
cgggggtctccgcacagca

SEQ ID NO: 45973 - DNA, 19 bp, Artificial sequence
  synthetic polynucleotide sequence
gttccaacagcagacggga

SEQ ID NO: 45974 - DNA, 19 bp, Artificial sequence
  synthetic polynucleotide sequence
caggatgtggtggaaccaa

SEQ ID NO: 45975 - DNA, 20 bp, Artificial sequence
  synthetic polynucleotide sequence
caggttcgacgggcagccaa

SEQ ID NO: 45976 - DNA, 18 bp, Artificial sequence
  synthetic polynucleotide sequence
ccaggctgctctccggca

SEQ ID NO: 45977 - DNA, 19 bp, Artificial sequence
  synthetic polynucleotide sequence
tgaaggtggcgggacagga

SEQ ID NO: 45978 - DNA, 22 bp, Artificial sequence
  synthetic polynucleotide sequence
attggttgcccaccaaatcgga

SEQ ID NO: 45979 - DNA, 19 bp, Artificial sequence
  synthetic polynucleotide sequence
ccccagtgtgtgccggaga

SEQ ID NO: 45980 - DNA, 19 bp, Artificial sequence
  synthetic polynucleotide sequence
caccatcccccagggtgca

SEQ ID NO: 45981 - DNA, 18 bp, Artificial sequence
  synthetic polynucleotide sequence
cgaagacctgcagcagga

SEQ ID NO: 45982 - DNA, 18 bp, Artificial sequence
  synthetic polynucleotide sequence
ggatccgcagctccacca

SEQ ID NO: 45983 - DNA, 22 bp, Artificial sequence
  synthetic polynucleotide sequence
gaccacacagaggaagtgtcaa

SEQ ID NO: 45984 - DNA, 20 bp, Artificial sequence
  synthetic polynucleotide sequence
ctccggccgacttcagggca

SEQ ID NO: 45985 - DNA, 20 bp, Artificial sequence
  synthetic polynucleotide sequence
gcggccaggtgaccatccaa

SEQ ID NO: 45986 - DNA, 22 bp, Artificial sequence
  synthetic polynucleotide sequence
tgaaactgaaatgcccccagga

SEQ ID NO: 45987 - DNA, 21 bp, Artificial sequence
  synthetic polynucleotide sequence
gtgagtgtgcagccagaggaa

SEQ ID NO: 45988 - DNA, 20 bp, Artificial sequence
  synthetic polynucleotide sequence
ggatcacagccctgccacca

SEQ ID NO: 45989 - DNA, 22 bp, Artificial sequence
  synthetic polynucleotide sequence
agataaccacggacttggggaa

SEQ ID NO: 45990 - DNA, 20 bp, Artificial sequence
  synthetic polynucleotide sequence
ctagtgggctgaaggaggca

SEQ ID NO: 45991 - DNA, 22 bp, Artificial sequence
  synthetic polynucleotide sequence
gtaaaacatcgacccccaccaa

SEQ ID NO: 45992 - DNA, 20 bp, Artificial sequence
  synthetic polynucleotide sequence
tgtgatgagctggcaggtga

SEQ ID NO: 45993 - DNA, 20 bp, Artificial sequence
  synthetic polynucleotide sequence
ggaccccttcagccatgcca

SEQ ID NO: 45994 - DNA, 20 bp, Artificial sequence
  synthetic polynucleotide sequence
tctgatgtggcagggctgga

SEQ ID NO: 45995 - DNA, 18 bp, Artificial sequence
  synthetic polynucleotide sequence
ccaagtggcagcgagtca

SEQ ID NO: 45996 - DNA, 18 bp, Artificial sequence
  synthetic polynucleotide sequence
ccttggggcaggcgacca

SEQ ID NO: 45997 - DNA, 18 bp, Artificial sequence
  synthetic polynucleotide sequence
gctcaggcatcgagcaga

SEQ ID NO: 45998 - DNA, 18 bp, Artificial sequence
  synthetic polynucleotide sequence
ccaggtaggtgtcccgca

SEQ ID NO: 45999 - DNA, 21 bp, Artificial sequence
  synthetic polynucleotide sequence
agtccaacagccatgcagcca

SEQ ID NO: 46000 - DNA, 19 bp, Artificial sequence
  synthetic polynucleotide sequence
cgatcatggggctggggga

SEQ ID NO: 46001 - DNA, 21 bp, Artificial sequence
  synthetic polynucleotide sequence
gcacaaccgacgtcttcgcaa

SEQ ID NO: 46002 - DNA, 20 bp, Artificial sequence
  synthetic polynucleotide sequence
ggaggtgacccagggcacga

SEQ ID NO: 46003 - DNA, 18 bp, Artificial sequence
  synthetic polynucleotide sequence
ggccccacaaacagtgga

SEQ ID NO: 46004 - DNA, 18 bp, Artificial sequence
  synthetic polynucleotide sequence
tcacatggcacaccagca

SEQ ID NO: 46005 - DNA, 20 bp, Artificial sequence
  synthetic polynucleotide sequence
atgccaacttccagagcaca

SEQ ID NO: 46006 - DNA, 21 bp, Artificial sequence
  synthetic polynucleotide sequence
agagtccataccaggtcacga

SEQ ID NO: 46007 - DNA, 21 bp, Artificial sequence
  synthetic polynucleotide sequence
ggaggatggggatggcactga

SEQ ID NO: 46008 - DNA, 20 bp, Artificial sequence
  synthetic polynucleotide sequence
cttcccgcgcttctggacca

SEQ ID NO: 46009 - DNA, 20 bp, Artificial sequence
  synthetic polynucleotide sequence
accacctggaactgcggcta

SEQ ID NO: 46010 - DNA, 22 bp, Artificial sequence
  synthetic polynucleotide sequence
tgattccaaagagcccgaagca

SEQ ID NO: 46011 - DNA, 20 bp, Artificial sequence
  synthetic polynucleotide sequence
gtggtggaggcaaccccaga

SEQ ID NO: 46012 - DNA, 18 bp, Artificial sequence
  synthetic polynucleotide sequence
tcccggtcagcggcgtga

SEQ ID NO: 46013 - DNA, 19 bp, Artificial sequence
  synthetic polynucleotide sequence
ccacgcctcagactgagga

SEQ ID NO: 46014 - DNA, 18 bp, Artificial sequence
  synthetic polynucleotide sequence
ctttggagggccagggga

SEQ ID NO: 46015 - DNA, 18 bp, Artificial sequence
  synthetic polynucleotide sequence
gctgagcttcaccgagca

SEQ ID NO: 46016 - DNA, 18 bp, Artificial sequence
  synthetic polynucleotide sequence
caggcagcaggacggaca

SEQ ID NO: 46017 - DNA, 18 bp, Artificial sequence
  synthetic polynucleotide sequence
tgcaaactggtgccacca

SEQ ID NO: 46018 - DNA, 18 bp, Artificial sequence
  synthetic polynucleotide sequence
ggaggcagcaggtgagga

SEQ ID NO: 46019 - DNA, 20 bp, Artificial sequence
  synthetic polynucleotide sequence
cttcggccctgcacagctca

SEQ ID NO: 46020 - DNA, 19 bp, Artificial sequence
  synthetic polynucleotide sequence
tggcagtgaaatcgggcta

SEQ ID NO: 46021 - DNA, 18 bp, Artificial sequence
  synthetic polynucleotide sequence
aagcgagggcatgaccca

SEQ ID NO: 46022 - DNA, 19 bp, Artificial sequence
  synthetic polynucleotide sequence
gccctcagtctcggaagca

SEQ ID NO: 46023 - DNA, 21 bp, Artificial sequence
  synthetic polynucleotide sequence
ggtggagaagatgaggcccca

SEQ ID NO: 46024 - DNA, 18 bp, Artificial sequence
  synthetic polynucleotide sequence
ggttccctgagccggcca

SEQ ID NO: 46025 - DNA, 18 bp, Artificial sequence
  synthetic polynucleotide sequence
acatggagagcacccgca

SEQ ID NO: 46026 - DNA, 19 bp, Artificial sequence
  synthetic polynucleotide sequence
ggcaggactcagtcccaca

SEQ ID NO: 46027 - DNA, 22 bp, Artificial sequence
  synthetic polynucleotide sequence
aagaagctgaaagacgaggaca

SEQ ID NO: 46028 - DNA, 18 bp, Artificial sequence
  synthetic polynucleotide sequence
cgtatcgagccgcatcca

SEQ ID NO: 46029 - DNA, 22 bp, Artificial sequence
  synthetic polynucleotide sequence
agatggggaagtagaacagcaa

SEQ ID NO: 46030 - DNA, 20 bp, Artificial sequence
  synthetic polynucleotide sequence
tgtggacggagaggtaagca

SEQ ID NO: 46031 - DNA, 19 bp, Artificial sequence
  synthetic polynucleotide sequence
cgtgacagggacgggcgaa

SEQ ID NO: 46032 - DNA, 21 bp, Artificial sequence
  synthetic polynucleotide sequence
acagtcaacacgtccagcgca

SEQ ID NO: 46033 - DNA, 21 bp, Artificial sequence
  synthetic polynucleotide sequence
tgtgtgatggggccctacaga

SEQ ID NO: 46034 - DNA, 20 bp, Artificial sequence
  synthetic polynucleotide sequence
tggcgccgtacacatgctca

SEQ ID NO: 46035 - DNA, 19 bp, Artificial sequence
  synthetic polynucleotide sequence
ccgggaaaagcggggcgaa

SEQ ID NO: 46036 - DNA, 22 bp, Artificial sequence
  synthetic polynucleotide sequence
aactgtgaaactggtaggccga

SEQ ID NO: 46037 - DNA, 19 bp, Artificial sequence
  synthetic polynucleotide sequence
gccccaggttcaaaccaga

SEQ ID NO: 46038 - DNA, 21 bp, Artificial sequence
  synthetic polynucleotide sequence
caattcagatgggaggaacca

SEQ ID NO: 46039 - DNA, 18 bp, Artificial sequence
  synthetic polynucleotide sequence
gccacccattgtggacca

SEQ ID NO: 46040 - DNA, 18 bp, Artificial sequence
  synthetic polynucleotide sequence
ccctgggcattgcagaga

SEQ ID NO: 46041 - DNA, 21 bp, Artificial sequence
  synthetic polynucleotide sequence
agaggctgcagagagaagaca

SEQ ID NO: 46042 - DNA, 18 bp, Artificial sequence
  synthetic polynucleotide sequence
ttctggtgggggcccgga

SEQ ID NO: 46043 - DNA, 22 bp, Artificial sequence
  synthetic polynucleotide sequence
aagaccgaggcaaaatgaggga

SEQ ID NO: 46044 - DNA, 20 bp, Artificial sequence
  synthetic polynucleotide sequence
actcaggtactcgcaggcca

SEQ ID NO: 46045 - DNA, 20 bp, Artificial sequence
  synthetic polynucleotide sequence
tgaggtctaccccaccacga

SEQ ID NO: 46046 - DNA, 22 bp, Artificial sequence
  synthetic polynucleotide sequence
accattgcaccaatgcgacaca

SEQ ID NO: 46047 - DNA, 18 bp, Artificial sequence
  synthetic polynucleotide sequence
ggaggaggttggcagcaa

SEQ ID NO: 46048 - DNA, 18 bp, Artificial sequence
  synthetic polynucleotide sequence
acacagtctgccggtcca

SEQ ID NO: 46049 - DNA, 22 bp, Artificial sequence
  synthetic polynucleotide sequence
aactggaggaccacattaccca

SEQ ID NO: 46050 - DNA, 19 bp, Artificial sequence
  synthetic polynucleotide sequence
ttggtggtgacacctcgga

SEQ ID NO: 46051 - DNA, 21 bp, Artificial sequence
  synthetic polynucleotide sequence
ggaggaagcaggtagtgggga

SEQ ID NO: 46052 - DNA, 18 bp, Artificial sequence
  synthetic polynucleotide sequence
gctccaggcaggctcgga

SEQ ID NO: 46053 - DNA, 20 bp, Artificial sequence
  synthetic polynucleotide sequence
cttccccaacccagcaggca

SEQ ID NO: 46054 - DNA, 22 bp, Artificial sequence
  synthetic polynucleotide sequence
agaatatccctcacagctgcca

SEQ ID NO: 46055 - DNA, 18 bp, Artificial sequence
  synthetic polynucleotide sequence
gtacggcccaaaacgcca

SEQ ID NO: 46056 - DNA, 19 bp, Artificial sequence
  synthetic polynucleotide sequence
gttacaggcatcgaaggca

SEQ ID NO: 46057 - DNA, 18 bp, Artificial sequence
  synthetic polynucleotide sequence
cagcctgcgtggaagaga

SEQ ID NO: 46058 - DNA, 18 bp, Artificial sequence
  synthetic polynucleotide sequence
cccacagaaccgtgggga

SEQ ID NO: 46059 - DNA, 22 bp, Artificial sequence
  synthetic polynucleotide sequence
aagtgccaacaacagcagcaga

SEQ ID NO: 46060 - DNA, 20 bp, Artificial sequence
  synthetic polynucleotide sequence
gagccacatctcctgggcca

SEQ ID NO: 46061 - DNA, 21 bp, Artificial sequence
  synthetic polynucleotide sequence
aagcgaggctcagaggttgga

SEQ ID NO: 46062 - DNA, 20 bp, Artificial sequence
  synthetic polynucleotide sequence
gcttctctccagggcacgga

SEQ ID NO: 46063 - DNA, 23 bp, Artificial sequence
  synthetic polynucleotide sequence
gaaaagctccaagagttcaccca

SEQ ID NO: 46064 - DNA, 20 bp, Artificial sequence
  synthetic polynucleotide sequence
ctagagtggtctggccccca

SEQ ID NO: 46065 - DNA, 21 bp, Artificial sequence
  synthetic polynucleotide sequence
gatgatgctgaccctgaggaa

SEQ ID NO: 46066 - DNA, 21 bp, Artificial sequence
  synthetic polynucleotide sequence
agttgacgaaggcatcctcca

SEQ ID NO: 46067 - DNA, 18 bp, Artificial sequence
  synthetic polynucleotide sequence
gtggtcccggcaaggcaa

SEQ ID NO: 46068 - DNA, 18 bp, Artificial sequence
  synthetic polynucleotide sequence
cctgcagtagagcgcgga

SEQ ID NO: 46069 - DNA, 18 bp, Artificial sequence
  synthetic polynucleotide sequence
tcagaccctgggaggcga

SEQ ID NO: 46070 - DNA, 18 bp, Artificial sequence
  synthetic polynucleotide sequence
cctgctcaagcacgggca

SEQ ID NO: 46071 - DNA, 21 bp, Artificial sequence
  synthetic polynucleotide sequence
ccagattcacaggcagcggaa

SEQ ID NO: 46072 - DNA, 20 bp, Artificial sequence
  synthetic polynucleotide sequence
acaggtgtccaacatgccca

SEQ ID NO: 46073 - DNA, 20 bp, Artificial sequence
  synthetic polynucleotide sequence
ctgaagatgaccgctgccta

SEQ ID NO: 46074 - DNA, 19 bp, Artificial sequence
  synthetic polynucleotide sequence
tgttgcgggaagtcaggga

SEQ ID NO: 46075 - DNA, 21 bp, Artificial sequence
  synthetic polynucleotide sequence
tctgggaagccgtctgtggaa

SEQ ID NO: 46076 - DNA, 20 bp, Artificial sequence
  synthetic polynucleotide sequence
attctgcacttcacccccca

SEQ ID NO: 46077 - DNA, 19 bp, Artificial sequence
  synthetic polynucleotide sequence
ccgggccagactacgacca

SEQ ID NO: 46078 - DNA, 19 bp, Artificial sequence
  synthetic polynucleotide sequence
gtgcgggttgaagggcgca

SEQ ID NO: 46079 - DNA, 22 bp, Artificial sequence
  synthetic polynucleotide sequence
tacatcctgcccattccacaga

SEQ ID NO: 46080 - DNA, 19 bp, Artificial sequence
  synthetic polynucleotide sequence
tgtagcagccaggatccca

SEQ ID NO: 46081 - DNA, 20 bp, Artificial sequence
  synthetic polynucleotide sequence
tactacaaggcccagaccca

SEQ ID NO: 46082 - DNA, 18 bp, Artificial sequence
  synthetic polynucleotide sequence
tggacaccctgcagggca

SEQ ID NO: 46083 - DNA, 18 bp, Artificial sequence
  synthetic polynucleotide sequence
ggcgccactcatcacaga

SEQ ID NO: 46084 - DNA, 19 bp, Artificial sequence
  synthetic polynucleotide sequence
gagctgaggtcgaggagga

SEQ ID NO: 46085 - DNA, 20 bp, Artificial sequence
  synthetic polynucleotide sequence
ggtggacacgtgctcagaga

SEQ ID NO: 46086 - DNA, 20 bp, Artificial sequence
  synthetic polynucleotide sequence
gtggtcaccaatgagcggca

SEQ ID NO: 46087 - DNA, 20 bp, Artificial sequence
  synthetic polynucleotide sequence
ccagcagccacagagcggaa

SEQ ID NO: 46088 - DNA, 19 bp, Artificial sequence
  synthetic polynucleotide sequence
tggccctactgcaatgcca

SEQ ID NO: 46089 - DNA, 20 bp, Artificial sequence
  synthetic polynucleotide sequence
ccggatctccacagcagcaa

SEQ ID NO: 46090 - DNA, 20 bp, Artificial sequence
  synthetic polynucleotide sequence
gctgtgaggcgagggtggca

SEQ ID NO: 46091 - DNA, 21 bp, Artificial sequence
  synthetic polynucleotide sequence
acaggaacctggaggaccaga

SEQ ID NO: 46092 - DNA, 21 bp, Artificial sequence
  synthetic polynucleotide sequence
tgttgctggagttgcacccca

SEQ ID NO: 46093 - DNA, 20 bp, Artificial sequence
  synthetic polynucleotide sequence
atggcaaagacttggaggga

SEQ ID NO: 46094 - DNA, 18 bp, Artificial sequence
  synthetic polynucleotide sequence
ctacctccacgccctcga

SEQ ID NO: 46095 - DNA, 21 bp, Artificial sequence
  synthetic polynucleotide sequence
gcccaccaaagacagcctcga

SEQ ID NO: 46096 - DNA, 22 bp, Artificial sequence
  synthetic polynucleotide sequence
atggagaagacactgaggccca

SEQ ID NO: 46097 - DNA, 20 bp, Artificial sequence
  synthetic polynucleotide sequence
catgccccatccagagccca

SEQ ID NO: 46098 - DNA, 20 bp, Artificial sequence
  synthetic polynucleotide sequence
gtgcccgaggcaggggagga

SEQ ID NO: 46099 - DNA, 21 bp, Artificial sequence
  synthetic polynucleotide sequence
tctcccagacgatgagcacga

SEQ ID NO: 46100 - DNA, 19 bp, Artificial sequence
  synthetic polynucleotide sequence
tggaggaaggctgtggaga

SEQ ID NO: 46101 - DNA, 18 bp, Artificial sequence
  synthetic polynucleotide sequence
tgagctcctggagcagca

SEQ ID NO: 46102 - DNA, 18 bp, Artificial sequence
  synthetic polynucleotide sequence
tgccgaacaccctggaca

SEQ ID NO: 46103 - DNA, 18 bp, Artificial sequence
  synthetic polynucleotide sequence
tcagggaagaggaccgca

SEQ ID NO: 46104 - DNA, 18 bp, Artificial sequence
  synthetic polynucleotide sequence
ggccattgtagcgcagca

SEQ ID NO: 46105 - DNA, 18 bp, Artificial sequence
  synthetic polynucleotide sequence
gaatccaggggcccccga

SEQ ID NO: 46106 - DNA, 20 bp, Artificial sequence
  synthetic polynucleotide sequence
ctcctgacgcgggcaggaga

SEQ ID NO: 46107 - DNA, 20 bp, Artificial sequence
  synthetic polynucleotide sequence
cagcagcaggcagagaagga

SEQ ID NO: 46108 - DNA, 18 bp, Artificial sequence
  synthetic polynucleotide sequence
cattccacggtggggcca

SEQ ID NO: 46109 - DNA, 18 bp, Artificial sequence
  synthetic polynucleotide sequence
aagccgtcctgtccgaca

SEQ ID NO: 46110 - DNA, 20 bp, Artificial sequence
  synthetic polynucleotide sequence
ctggttggccaggtagcaga

SEQ ID NO: 46111 - DNA, 18 bp, Artificial sequence
  synthetic polynucleotide sequence
caaggctggcgtggacga

SEQ ID NO: 46112 - DNA, 20 bp, Artificial sequence
  synthetic polynucleotide sequence
gcacctgggtaggaggcgta

SEQ ID NO: 46113 - DNA, 21 bp, Artificial sequence
  synthetic polynucleotide sequence
tggcattccaggacctccgaa

SEQ ID NO: 46114 - DNA, 19 bp, Artificial sequence
  synthetic polynucleotide sequence
gagcggtcagacaggggga

SEQ ID NO: 46115 - DNA, 23 bp, Artificial sequence
  synthetic polynucleotide sequence
gcagggaaggcacataccaccaa

SEQ ID NO: 46116 - DNA, 25 bp, Artificial sequence
  synthetic polynucleotide sequence
tactcgaacgtacgcagagaagaga

SEQ ID NO: 46117 - DNA, 18 bp, Artificial sequence
  synthetic polynucleotide sequence
gcgatgaagccagaggca

SEQ ID NO: 46118 - DNA, 18 bp, Artificial sequence
  synthetic polynucleotide sequence
ttggcagctgaagcgcca

SEQ ID NO: 46119 - DNA, 21 bp, Artificial sequence
  synthetic polynucleotide sequence
tgtctctgagagtgcagcaca

SEQ ID NO: 46120 - DNA, 21 bp, Artificial sequence
  synthetic polynucleotide sequence
gctgctaccatggtgagggca

SEQ ID NO: 46121 - DNA, 19 bp, Artificial sequence
  synthetic polynucleotide sequence
cacagctcgggacagcgca

SEQ ID NO: 46122 - DNA, 21 bp, Artificial sequence
  synthetic polynucleotide sequence
tccagacttcagaggggccga

SEQ ID NO: 46123 - DNA, 19 bp, Artificial sequence
  synthetic polynucleotide sequence
cgccagtcacggatggaga

SEQ ID NO: 46124 - DNA, 18 bp, Artificial sequence
  synthetic polynucleotide sequence
ggaccccgttctcaggca

SEQ ID NO: 46125 - DNA, 18 bp, Artificial sequence
  synthetic polynucleotide sequence
ccttctcgccaacccgaa

SEQ ID NO: 46126 - DNA, 18 bp, Artificial sequence
  synthetic polynucleotide sequence
gagaaggcgtcaggggga

SEQ ID NO: 46127 - DNA, 21 bp, Artificial sequence
  synthetic polynucleotide sequence
ctggaatccctgagccaccaa

SEQ ID NO: 46128 - DNA, 20 bp, Artificial sequence
  synthetic polynucleotide sequence
aagcaataggaggcggggca

SEQ ID NO: 46129 - DNA, 22 bp, Artificial sequence
  synthetic polynucleotide sequence
gaaagtaacctcagcatcgaca

SEQ ID NO: 46130 - DNA, 20 bp, Artificial sequence
  synthetic polynucleotide sequence
ctgaagacgaggagtcacca

SEQ ID NO: 46131 - DNA, 22 bp, Artificial sequence
  synthetic polynucleotide sequence
cgattcctcagaccagtgagca

SEQ ID NO: 46132 - DNA, 18 bp, Artificial sequence
  synthetic polynucleotide sequence
ggacgctgggctgggaca

SEQ ID NO: 46133 - DNA, 18 bp, Artificial sequence
  synthetic polynucleotide sequence
cgccagacagggaacaca

SEQ ID NO: 46134 - DNA, 20 bp, Artificial sequence
  synthetic polynucleotide sequence
ccagagcaccaggttcagga

SEQ ID NO: 46135 - DNA, 22 bp, Artificial sequence
  synthetic polynucleotide sequence
ttcatcaaggtcctcgagtgga

SEQ ID NO: 46136 - DNA, 19 bp, Artificial sequence
  synthetic polynucleotide sequence
tacacctggaggtggctga

SEQ ID NO: 46137 - DNA, 21 bp, Artificial sequence
  synthetic polynucleotide sequence
gtgtgccatggagaggaagca

SEQ ID NO: 46138 - DNA, 20 bp, Artificial sequence
  synthetic polynucleotide sequence
aaccaacagttcccggccca

SEQ ID NO: 46139 - DNA, 19 bp, Artificial sequence
  synthetic polynucleotide sequence
tccgcagctacgtgtggga

SEQ ID NO: 46140 - DNA, 18 bp, Artificial sequence
  synthetic polynucleotide sequence
cggcctggaggggtggaa

SEQ ID NO: 46141 - DNA, 20 bp, Artificial sequence
  synthetic polynucleotide sequence
caacgccacagagccagcca

SEQ ID NO: 46142 - DNA, 21 bp, Artificial sequence
  synthetic polynucleotide sequence
caattaaggcccacggtggca

SEQ ID NO: 46143 - DNA, 20 bp, Artificial sequence
  synthetic polynucleotide sequence
cagggcggaagcagcacaga

SEQ ID NO: 46144 - DNA, 21 bp, Artificial sequence
  synthetic polynucleotide sequence
gcatggccaacacagcttcca

SEQ ID NO: 46145 - DNA, 19 bp, Artificial sequence
  synthetic polynucleotide sequence
ggatgaccagacccaggga

SEQ ID NO: 46146 - DNA, 20 bp, Artificial sequence
  synthetic polynucleotide sequence
gaggacaaggaagtgcagca

SEQ ID NO: 46147 - DNA, 18 bp, Artificial sequence
  synthetic polynucleotide sequence
cgacaagaccacagcgga

SEQ ID NO: 46148 - DNA, 18 bp, Artificial sequence
  synthetic polynucleotide sequence
cacaatggctggcaccga

SEQ ID NO: 46149 - DNA, 18 bp, Artificial sequence
  synthetic polynucleotide sequence
accccgtgtggaacgaga

SEQ ID NO: 46150 - DNA, 18 bp, Artificial sequence
  synthetic polynucleotide sequence
ctgcagtggccaagcgca

SEQ ID NO: 46151 - DNA, 20 bp, Artificial sequence
  synthetic polynucleotide sequence
cccactgcagcaacagtcca

SEQ ID NO: 46152 - DNA, 21 bp, Artificial sequence
  synthetic polynucleotide sequence
tcttcagggctcaggactgca

SEQ ID NO: 46153 - DNA, 22 bp, Artificial sequence
  synthetic polynucleotide sequence
tccagcaagaccatcacccaga

SEQ ID NO: 46154 - DNA, 20 bp, Artificial sequence
  synthetic polynucleotide sequence
ctccagatgacacgccggca

SEQ ID NO: 46155 - DNA, 21 bp, Artificial sequence
  synthetic polynucleotide sequence
cccggaagatgacccgagaga

SEQ ID NO: 46156 - DNA, 19 bp, Artificial sequence
  synthetic polynucleotide sequence
ggcgcccctccatgagaca

SEQ ID NO: 46157 - DNA, 18 bp, Artificial sequence
  synthetic polynucleotide sequence
gaccggggtcaaacgcaa

SEQ ID NO: 46158 - DNA, 18 bp, Artificial sequence
  synthetic polynucleotide sequence
aatcagcgccttccacca

SEQ ID NO: 46159 - DNA, 18 bp, Artificial sequence
  synthetic polynucleotide sequence
cggccagcccattgagga

SEQ ID NO: 46160 - DNA, 18 bp, Artificial sequence
  synthetic polynucleotide sequence
ccgtgggcacatagcgca

SEQ ID NO: 46161 - DNA, 21 bp, Artificial sequence
  synthetic polynucleotide sequence
gctctggagggacatcgtgga

SEQ ID NO: 46162 - DNA, 21 bp, Artificial sequence
  synthetic polynucleotide sequence
gatcagggaggccttcacgta

SEQ ID NO: 46163 - DNA, 21 bp, Artificial sequence
  synthetic polynucleotide sequence
gaactggtggagagcactgga

SEQ ID NO: 46164 - DNA, 20 bp, Artificial sequence
  synthetic polynucleotide sequence
ccatcacagagcacgtgcca

SEQ ID NO: 46165 - DNA, 21 bp, Artificial sequence
  synthetic polynucleotide sequence
cgtcaaggtccacctgctgca

SEQ ID NO: 46166 - DNA, 20 bp, Artificial sequence
  synthetic polynucleotide sequence
cagggcacctcgaagctgaa

SEQ ID NO: 46167 - DNA, 22 bp, Artificial sequence
  synthetic polynucleotide sequence
gatatccccacggagaagctga

SEQ ID NO: 46168 - DNA, 19 bp, Artificial sequence
  synthetic polynucleotide sequence
ctggcccgctcttccagga

SEQ ID NO: 46169 - DNA, 19 bp, Artificial sequence
  synthetic polynucleotide sequence
ctccgtctgccactgggca

SEQ ID NO: 46170 - DNA, 20 bp, Artificial sequence
  synthetic polynucleotide sequence
agagaagcacagctccccga

SEQ ID NO: 46171 - DNA, 22 bp, Artificial sequence
  synthetic polynucleotide sequence
atgacaacgtggatctgggaga

SEQ ID NO: 46172 - DNA, 21 bp, Artificial sequence
  synthetic polynucleotide sequence
tctgccatcacacatcagcga

SEQ ID NO: 46173 - DNA, 20 bp, Artificial sequence
  synthetic polynucleotide sequence
tgtctgtgtggcaccgcgaa

SEQ ID NO: 46174 - DNA, 19 bp, Artificial sequence
  synthetic polynucleotide sequence
cccgagcctccttcaccca

SEQ ID NO: 46175 - DNA, 18 bp, Artificial sequence
  synthetic polynucleotide sequence
ccaaactccctggagcca

SEQ ID NO: 46176 - DNA, 19 bp, Artificial sequence
  synthetic polynucleotide sequence
ccgaccatggattagccca

SEQ ID NO: 46177 - DNA, 22 bp, Artificial sequence
  synthetic polynucleotide sequence
tcaagaagggacagatcagcca

SEQ ID NO: 46178 - DNA, 20 bp, Artificial sequence
  synthetic polynucleotide sequence
gttggtctggcagagtgaga

SEQ ID NO: 46179 - DNA, 20 bp, Artificial sequence
  synthetic polynucleotide sequence
aaaggtggggaagggggaga

SEQ ID NO: 46180 - DNA, 21 bp, Artificial sequence
  synthetic polynucleotide sequence
ccacacagtcagttccaggca

SEQ ID NO: 46181 - DNA, 20 bp, Artificial sequence
  synthetic polynucleotide sequence
agtggcatccatccccagga

SEQ ID NO: 46182 - DNA, 21 bp, Artificial sequence
  synthetic polynucleotide sequence
ttccccctgagagtccatcca

SEQ ID NO: 46183 - DNA, 21 bp, Artificial sequence
  synthetic polynucleotide sequence
agtggagcagctacaaccaca

SEQ ID NO: 46184 - DNA, 19 bp, Artificial sequence
  synthetic polynucleotide sequence
cagcccagcaaagcccgca

SEQ ID NO: 46185 - DNA, 21 bp, Artificial sequence
  synthetic polynucleotide sequence
aggaggagcaggagaaaccca

SEQ ID NO: 46186 - DNA, 21 bp, Artificial sequence
  synthetic polynucleotide sequence
aagccttgagacccatcagga

SEQ ID NO: 46187 - DNA, 21 bp, Artificial sequence
  synthetic polynucleotide sequence
ggagtgtgacaaggtgcggga

SEQ ID NO: 46188 - DNA, 21 bp, Artificial sequence
  synthetic polynucleotide sequence
tgggccaggaagtgtcgcaga

SEQ ID NO: 46189 - DNA, 21 bp, Artificial sequence
  synthetic polynucleotide sequence
catgtgaagcagcaaggccca

SEQ ID NO: 46190 - DNA, 20 bp, Artificial sequence
  synthetic polynucleotide sequence
ccagtcaccactggctgcca

SEQ ID NO: 46191 - DNA, 20 bp, Artificial sequence
  synthetic polynucleotide sequence
tatgctgagctcagcctcca

SEQ ID NO: 46192 - DNA, 21 bp, Artificial sequence
  synthetic polynucleotide sequence
gacagagcaacctcctctgca

SEQ ID NO: 46193 - DNA, 21 bp, Artificial sequence
  synthetic polynucleotide sequence
tcagaggcctatgcagatgga

SEQ ID NO: 46194 - DNA, 22 bp, Artificial sequence
  synthetic polynucleotide sequence
aatccccaccatcatagaccca

SEQ ID NO: 46195 - DNA, 21 bp, Artificial sequence
  synthetic polynucleotide sequence
ctaccagacaggctcagcaga

SEQ ID NO: 46196 - DNA, 23 bp, Artificial sequence
  synthetic polynucleotide sequence
gataaagtgaaggaggctgtcga

SEQ ID NO: 46197 - DNA, 20 bp, Artificial sequence
  synthetic polynucleotide sequence
gtggctagacgacaggcgaa

SEQ ID NO: 46198 - DNA, 21 bp, Artificial sequence
  synthetic polynucleotide sequence
atgctaccactgtgaccccca

SEQ ID NO: 46199 - DNA, 22 bp, Artificial sequence
  synthetic polynucleotide sequence
agcagctgcactctccaaccaa

SEQ ID NO: 46200 - DNA, 20 bp, Artificial sequence
  synthetic polynucleotide sequence
cccgacacagacacggtgaa

SEQ ID NO: 46201 - DNA, 20 bp, Artificial sequence
  synthetic polynucleotide sequence
cttactcgccaggtcctcga

SEQ ID NO: 46202 - DNA, 22 bp, Artificial sequence
  synthetic polynucleotide sequence
agtaccaacagctctccacaga

SEQ ID NO: 46203 - DNA, 20 bp, Artificial sequence
  synthetic polynucleotide sequence
gaagcgcatccacagcgaca

SEQ ID NO: 46204 - DNA, 20 bp, Artificial sequence
  synthetic polynucleotide sequence
ttcgcccagcgggtagccaa

SEQ ID NO: 46205 - DNA, 21 bp, Artificial sequence
  synthetic polynucleotide sequence
gtcatgcggaatcagcccaca

SEQ ID NO: 46206 - DNA, 20 bp, Artificial sequence
  synthetic polynucleotide sequence
attgggctgagtgactacca

SEQ ID NO: 46207 - DNA, 22 bp, Artificial sequence
  synthetic polynucleotide sequence
agcatcgaactggctccacaca

SEQ ID NO: 46208 - DNA, 21 bp, Artificial sequence
  synthetic polynucleotide sequence
atctcgcactgctcacagcga

SEQ ID NO: 46209 - DNA, 20 bp, Artificial sequence
  synthetic polynucleotide sequence
gcgtgcgctcggaggaacca

SEQ ID NO: 46210 - DNA, 20 bp, Artificial sequence
  synthetic polynucleotide sequence
gactgccaaggccacgagga

SEQ ID NO: 46211 - DNA, 22 bp, Artificial sequence
  synthetic polynucleotide sequence
ctcccgagaaacgtgacatgca

SEQ ID NO: 46212 - DNA, 21 bp, Artificial sequence
  synthetic polynucleotide sequence
tgaggatgccaaagctgggga

SEQ ID NO: 46213 - DNA, 20 bp, Artificial sequence
  synthetic polynucleotide sequence
caaggcccacactgaaccca

SEQ ID NO: 46214 - DNA, 20 bp, Artificial sequence
  synthetic polynucleotide sequence
gggagggcagagtcagtgca

SEQ ID NO: 46215 - DNA, 22 bp, Artificial sequence
  synthetic polynucleotide sequence
atagagaaggagacgtgccaga

SEQ ID NO: 46216 - DNA, 21 bp, Artificial sequence
  synthetic polynucleotide sequence
gattcgctgaggcagatccca

SEQ ID NO: 46217 - DNA, 18 bp, Artificial sequence
  synthetic polynucleotide sequence
cgatgccccgaagaagca

SEQ ID NO: 46218 - DNA, 18 bp, Artificial sequence
  synthetic polynucleotide sequence
tgaacacggcgtcgggga

SEQ ID NO: 46219 - DNA, 20 bp, Artificial sequence
  synthetic polynucleotide sequence
ggtaggagcggagcaggaga

SEQ ID NO: 46220 - DNA, 20 bp, Artificial sequence
  synthetic polynucleotide sequence
ggtgtcacctccgaacggga

SEQ ID NO: 46221 - DNA, 22 bp, Artificial sequence
  synthetic polynucleotide sequence
ccaaccctgagcacaacagcaa

SEQ ID NO: 46222 - DNA, 23 bp, Artificial sequence
  synthetic polynucleotide sequence
gataatgcctcgatgagcagaga

SEQ ID NO: 46223 - DNA, 18 bp, Artificial sequence
  synthetic polynucleotide sequence
atctccagacccagggca

SEQ ID NO: 46224 - DNA, 19 bp, Artificial sequence
  synthetic polynucleotide sequence
tggaggtcaggtccaggga

SEQ ID NO: 46225 - DNA, 21 bp, Artificial sequence
  synthetic polynucleotide sequence
cctacagcgtcatcggcctca

SEQ ID NO: 46226 - DNA, 21 bp, Artificial sequence
  synthetic polynucleotide sequence
agatggcaaacgtcagcacca

SEQ ID NO: 46227 - DNA, 18 bp, Artificial sequence
  synthetic polynucleotide sequence
cccacaagcgcatgagga

SEQ ID NO: 46228 - DNA, 20 bp, Artificial sequence
  synthetic polynucleotide sequence
aagaagttctggaagcggca

SEQ ID NO: 46229 - DNA, 20 bp, Artificial sequence
  synthetic polynucleotide sequence
cggtatcgtcccagacccaa

SEQ ID NO: 46230 - DNA, 20 bp, Artificial sequence
  synthetic polynucleotide sequence
aggagaccctgaggccagga

SEQ ID NO: 46231 - DNA, 21 bp, Artificial sequence
  synthetic polynucleotide sequence
gctggacaatgtcaccgagga

SEQ ID NO: 46232 - DNA, 20 bp, Artificial sequence
  synthetic polynucleotide sequence
ggggtgggtgagaagctgga

SEQ ID NO: 46233 - DNA, 20 bp, Artificial sequence
  synthetic polynucleotide sequence
caggtagacggagtgcacca

SEQ ID NO: 46234 - DNA, 19 bp, Artificial sequence
  synthetic polynucleotide sequence
gctccagggaccaacctca

SEQ ID NO: 46235 - DNA, 20 bp, Artificial sequence
  synthetic polynucleotide sequence
agtcggcagagtacgaggca

SEQ ID NO: 46236 - DNA, 22 bp, Artificial sequence
  synthetic polynucleotide sequence
accttctcgcgatctgacagga

SEQ ID NO: 46237 - DNA, 21 bp, Artificial sequence
  synthetic polynucleotide sequence
gcccagcatgaacagccggaa

SEQ ID NO: 46238 - DNA, 19 bp, Artificial sequence
  synthetic polynucleotide sequence
gggcggtcctcagactcca

SEQ ID NO: 46239 - DNA, 18 bp, Artificial sequence
  synthetic polynucleotide sequence
gctcagcagcatccggaa

SEQ ID NO: 46240 - DNA, 19 bp, Artificial sequence
  synthetic polynucleotide sequence
ccgtatgcgcacataggca

SEQ ID NO: 46241 - DNA, 18 bp, Artificial sequence
  synthetic polynucleotide sequence
agggcacggcctccggca

SEQ ID NO: 46242 - DNA, 18 bp, Artificial sequence
  synthetic polynucleotide sequence
cgctgagggcaggggtca

SEQ ID NO: 46243 - DNA, 21 bp, Artificial sequence
  synthetic polynucleotide sequence
aggcgagctcgagagtcagga

SEQ ID NO: 46244 - DNA, 20 bp, Artificial sequence
  synthetic polynucleotide sequence
tagggaaagctgagcggcga

SEQ ID NO: 46245 - DNA, 22 bp, Artificial sequence
  synthetic polynucleotide sequence
ataaaaccggaaccagccagca

SEQ ID NO: 46246 - DNA, 22 bp, Artificial sequence
  synthetic polynucleotide sequence
tcatcagcaatctgcagcagca

SEQ ID NO: 46247 - DNA, 21 bp, Artificial sequence
  synthetic polynucleotide sequence
cagatgaggaagaagacccca

SEQ ID NO: 46248 - DNA, 19 bp, Artificial sequence
  synthetic polynucleotide sequence
ctggtcatccccaaagcca

SEQ ID NO: 46249 - DNA, 21 bp, Artificial sequence
  synthetic polynucleotide sequence
tgaggcagagacatggagaca

SEQ ID NO: 46250 - DNA, 22 bp, Artificial sequence
  synthetic polynucleotide sequence
aaaagggtcccaaactccagga

SEQ ID NO: 46251 - DNA, 19 bp, Artificial sequence
  synthetic polynucleotide sequence
tggaagcgctaccttcaga

SEQ ID NO: 46252 - DNA, 21 bp, Artificial sequence
  synthetic polynucleotide sequence
tcagactgagactccgctcca

SEQ ID NO: 46253 - DNA, 19 bp, Artificial sequence
  synthetic polynucleotide sequence
ctaccaccccagagggaca

SEQ ID NO: 46254 - DNA, 21 bp, Artificial sequence
  synthetic polynucleotide sequence
ggaggggctgagagctagaga

SEQ ID NO: 46255 - DNA, 20 bp, Artificial sequence
  synthetic polynucleotide sequence
agctctaggacaccaggcca

SEQ ID NO: 46256 - DNA, 19 bp, Artificial sequence
  synthetic polynucleotide sequence
cagtggccccaaccgcgca

SEQ ID NO: 46257 - DNA, 21 bp, Artificial sequence
  synthetic polynucleotide sequence
gacagaagagcaggaggagga

SEQ ID NO: 46258 - DNA, 19 bp, Artificial sequence
  synthetic polynucleotide sequence
tctgcgaacctcatgcaca

SEQ ID NO: 46259 - DNA, 20 bp, Artificial sequence
  synthetic polynucleotide sequence
aatccaagcagtcacccaca

SEQ ID NO: 46260 - DNA, 18 bp, Artificial sequence
  synthetic polynucleotide sequence
cgggagctagctggccga

SEQ ID NO: 46261 - DNA, 18 bp, Artificial sequence
  synthetic polynucleotide sequence
ccgagatgagtggggcaa

SEQ ID NO: 46262 - DNA, 18 bp, Artificial sequence
  synthetic polynucleotide sequence
tcgcacacttggggcaga

SEQ ID NO: 46263 - DNA, 22 bp, Artificial sequence
  synthetic polynucleotide sequence
atcgggcccaggaaaaagagga

SEQ ID NO: 46264 - DNA, 20 bp, Artificial sequence
  synthetic polynucleotide sequence
cctgaggttgacccgcgtga

SEQ ID NO: 46265 - DNA, 21 bp, Artificial sequence
  synthetic polynucleotide sequence
atccagcctgacagccaccaa

SEQ ID NO: 46266 - DNA, 22 bp, Artificial sequence
  synthetic polynucleotide sequence
aagggccaggtatagagctcga

SEQ ID NO: 46267 - DNA, 22 bp, Artificial sequence
  synthetic polynucleotide sequence
caatgctccacctcagaacaga

SEQ ID NO: 46268 - DNA, 19 bp, Artificial sequence
  synthetic polynucleotide sequence
taccgaccacactctgaca

SEQ ID NO: 46269 - DNA, 19 bp, Artificial sequence
  synthetic polynucleotide sequence
ggtttggagccccccgaca

SEQ ID NO: 46270 - DNA, 22 bp, Artificial sequence
  synthetic polynucleotide sequence
agaagcagatggtagtgaggga

SEQ ID NO: 46271 - DNA, 19 bp, Artificial sequence
  synthetic polynucleotide sequence
ggctcaggttccaccacca

SEQ ID NO: 46272 - DNA, 18 bp, Artificial sequence
  synthetic polynucleotide sequence
cgggggaggaactggaga

SEQ ID NO: 46273 - DNA, 22 bp, Artificial sequence
  synthetic polynucleotide sequence
ctaatgcccaggtcaaagcaga

SEQ ID NO: 46274 - DNA, 21 bp, Artificial sequence
  synthetic polynucleotide sequence
agagaaggctgtcccatggca

SEQ ID NO: 46275 - DNA, 22 bp, Artificial sequence
  synthetic polynucleotide sequence
agaaggttccggaagacagcaa

SEQ ID NO: 46276 - DNA, 20 bp, Artificial sequence
  synthetic polynucleotide sequence
catggccctgcctgtgacca

SEQ ID NO: 46277 - DNA, 20 bp, Artificial sequence
  synthetic polynucleotide sequence
gaccccactcgaccatgaga

SEQ ID NO: 46278 - DNA, 21 bp, Artificial sequence
  synthetic polynucleotide sequence
aaggatcccttaagcccagga

SEQ ID NO: 46279 - DNA, 22 bp, Artificial sequence
  synthetic polynucleotide sequence
aggattctggagccgagaagga

SEQ ID NO: 46280 - DNA, 20 bp, Artificial sequence
  synthetic polynucleotide sequence
gcttcttcaccggccgcaga

SEQ ID NO: 46281 - DNA, 21 bp, Artificial sequence
  synthetic polynucleotide sequence
ttctcccaagagcatgccgaa

SEQ ID NO: 46282 - DNA, 20 bp, Artificial sequence
  synthetic polynucleotide sequence
agcgcggcactggattgcca

SEQ ID NO: 46283 - DNA, 22 bp, Artificial sequence
  synthetic polynucleotide sequence
ccaagggagactagttccacga

SEQ ID NO: 46284 - DNA, 19 bp, Artificial sequence
  synthetic polynucleotide sequence
tgacaggtgtggactgaga

SEQ ID NO: 46285 - DNA, 21 bp, Artificial sequence
  synthetic polynucleotide sequence
ggagatgcaggacgaggagga

SEQ ID NO: 46286 - DNA, 20 bp, Artificial sequence
  synthetic polynucleotide sequence
cttgctgatgaggtgcagca

SEQ ID NO: 46287 - DNA, 19 bp, Artificial sequence
  synthetic polynucleotide sequence
gcagcttggcagtgaccaa

SEQ ID NO: 46288 - DNA, 18 bp, Artificial sequence
  synthetic polynucleotide sequence
ctgcccatctgaaggcca

SEQ ID NO: 46289 - DNA, 18 bp, Artificial sequence
  synthetic polynucleotide sequence
agatccaggcctccacca

SEQ ID NO: 46290 - DNA, 18 bp, Artificial sequence
  synthetic polynucleotide sequence
tccgctgcacacaggcca

SEQ ID NO: 46291 - DNA, 21 bp, Artificial sequence
  synthetic polynucleotide sequence
tgggaagggaaggacatggca

SEQ ID NO: 46292 - DNA, 21 bp, Artificial sequence
  synthetic polynucleotide sequence
tcctcggaaaagcctctccga

SEQ ID NO: 46293 - DNA, 19 bp, Artificial sequence
  synthetic polynucleotide sequence
gcaagctgatccccacaca

SEQ ID NO: 46294 - DNA, 18 bp, Artificial sequence
  synthetic polynucleotide sequence
acttcatggccaggcgga

SEQ ID NO: 46295 - DNA, 19 bp, Artificial sequence
  synthetic polynucleotide sequence
ctgaggaagctcatcccca

SEQ ID NO: 46296 - DNA, 18 bp, Artificial sequence
  synthetic polynucleotide sequence
tgtcctccaggcctggca

SEQ ID NO: 46297 - DNA, 18 bp, Artificial sequence
  synthetic polynucleotide sequence
ggagctcgaggagcagca

SEQ ID NO: 46298 - DNA, 19 bp, Artificial sequence
  synthetic polynucleotide sequence
gccacatgccaatcaagga

SEQ ID NO: 46299 - DNA, 20 bp, Artificial sequence
  synthetic polynucleotide sequence
tcacttccccgaggagctga

SEQ ID NO: 46300 - DNA, 21 bp, Artificial sequence
  synthetic polynucleotide sequence
gaatgccatgcgacagggtca

SEQ ID NO: 46301 - DNA, 20 bp, Artificial sequence
  synthetic polynucleotide sequence
agccagaatgtccgcctgca

SEQ ID NO: 46302 - DNA, 20 bp, Artificial sequence
  synthetic polynucleotide sequence
gcgtccacagccacggagga

SEQ ID NO: 46303 - DNA, 20 bp, Artificial sequence
  synthetic polynucleotide sequence
agcagaatcggacctgggca

SEQ ID NO: 46304 - DNA, 19 bp, Artificial sequence
  synthetic polynucleotide sequence
tcacgtcgggataggagga

SEQ ID NO: 46305 - DNA, 21 bp, Artificial sequence
  synthetic polynucleotide sequence
gaaggcaaggaaggaggcaca

SEQ ID NO: 46306 - DNA, 18 bp, Artificial sequence
  synthetic polynucleotide sequence
ccccaccctggtcctcga

SEQ ID NO: 46307 - DNA, 21 bp, Artificial sequence
  synthetic polynucleotide sequence
aaggagtcaatgagcccagca

SEQ ID NO: 46308 - DNA, 21 bp, Artificial sequence
  synthetic polynucleotide sequence
tgggaaagagtacgcagggca

SEQ ID NO: 46309 - DNA, 21 bp, Artificial sequence
  synthetic polynucleotide sequence
ccacctggagaccataatgca

SEQ ID NO: 46310 - DNA, 19 bp, Artificial sequence
  synthetic polynucleotide sequence
cggggaatcgagtgaggga

SEQ ID NO: 46311 - DNA, 20 bp, Artificial sequence
  synthetic polynucleotide sequence
aaggaggaacagacccggaa

SEQ ID NO: 46312 - DNA, 20 bp, Artificial sequence
  synthetic polynucleotide sequence
atacgcattcaacagctcca

SEQ ID NO: 46313 - DNA, 18 bp, Artificial sequence
  synthetic polynucleotide sequence
ggggcagtacgatggcaa

SEQ ID NO: 46314 - DNA, 18 bp, Artificial sequence
  synthetic polynucleotide sequence
tgactggagcacggggga

SEQ ID NO: 46315 - DNA, 17 bp, Artificial sequence
  synthetic polynucleotide sequence
gtccgcggatagcacca

SEQ ID NO: 46316 - DNA, 19 bp, Artificial sequence
  synthetic polynucleotide sequence
gcctagaagccgacgcaca

SEQ ID NO: 46317 - DNA, 18 bp, Artificial sequence
  synthetic polynucleotide sequence
acatggaccgacagccaa

SEQ ID NO: 46318 - DNA, 18 bp, Artificial sequence
  synthetic polynucleotide sequence
agcgccgtcacctcacca

SEQ ID NO: 46319 - DNA, 22 bp, Artificial sequence
  synthetic polynucleotide sequence
aaagtgtccctgatgccagcaa

SEQ ID NO: 46320 - DNA, 18 bp, Artificial sequence
  synthetic polynucleotide sequence
tccacctccaggccccca

SEQ ID NO: 46321 - DNA, 19 bp, Artificial sequence
  synthetic polynucleotide sequence
cccaggttgtcccaccaga

SEQ ID NO: 46322 - DNA, 18 bp, Artificial sequence
  synthetic polynucleotide sequence
gccgtctctgaagcccca

SEQ ID NO: 46323 - DNA, 22 bp, Artificial sequence
  synthetic polynucleotide sequence
aagctgtcgaatcctcccgcaa

SEQ ID NO: 46324 - DNA, 19 bp, Artificial sequence
  synthetic polynucleotide sequence
ttggtgatggaggcagaca

SEQ ID NO: 46325 - DNA, 19 bp, Artificial sequence
  synthetic polynucleotide sequence
ggacagtggacaggagcca

SEQ ID NO: 46326 - DNA, 18 bp, Artificial sequence
  synthetic polynucleotide sequence
gggcccagcatggagaga

SEQ ID NO: 46327 - DNA, 18 bp, Artificial sequence
  synthetic polynucleotide sequence
cggttgccggagtacaca

SEQ ID NO: 46328 - DNA, 18 bp, Artificial sequence
  synthetic polynucleotide sequence
ccgtgtgcactcgaagca

SEQ ID NO: 46329 - DNA, 19 bp, Artificial sequence
  synthetic polynucleotide sequence
gcagaaccagtcaggccca

SEQ ID NO: 46330 - DNA, 20 bp, Artificial sequence
  synthetic polynucleotide sequence
ctgcaccagaattagagcca

SEQ ID NO: 46331 - DNA, 20 bp, Artificial sequence
  synthetic polynucleotide sequence
tgggcctcagaacccagtga

SEQ ID NO: 46332 - DNA, 23 bp, Artificial sequence
  synthetic polynucleotide sequence
gataaccacaattacggcagcca

SEQ ID NO: 46333 - DNA, 18 bp, Artificial sequence
  synthetic polynucleotide sequence
cccatgaactgcccagga

SEQ ID NO: 46334 - DNA, 18 bp, Artificial sequence
  synthetic polynucleotide sequence
cagctagccgcagaggca

SEQ ID NO: 46335 - DNA, 20 bp, Artificial sequence
  synthetic polynucleotide sequence
tggagaaccctgggacctca

SEQ ID NO: 46336 - DNA, 22 bp, Artificial sequence
  synthetic polynucleotide sequence
tggaggtcaaatctcaggggca

SEQ ID NO: 46337 - DNA, 21 bp, Artificial sequence
  synthetic polynucleotide sequence
tggtcatccctgtggggccaa

SEQ ID NO: 46338 - DNA, 20 bp, Artificial sequence
  synthetic polynucleotide sequence
tatactgagccagctgtgca

SEQ ID NO: 46339 - DNA, 19 bp, Artificial sequence
  synthetic polynucleotide sequence
ccctgtggtgaggtcagca

SEQ ID NO: 46340 - DNA, 18 bp, Artificial sequence
  synthetic polynucleotide sequence
gcgaactgtcaggcagga

SEQ ID NO: 46341 - DNA, 21 bp, Artificial sequence
  synthetic polynucleotide sequence
ccaccaactacaacgaggcca

SEQ ID NO: 46342 - DNA, 20 bp, Artificial sequence
  synthetic polynucleotide sequence
gcgctccgggtagaagagga

SEQ ID NO: 46343 - DNA, 19 bp, Artificial sequence
  synthetic polynucleotide sequence
ctcaggcccgccgtgcaga

SEQ ID NO: 46344 - DNA, 20 bp, Artificial sequence
  synthetic polynucleotide sequence
ccctggctgccgcatgagca

SEQ ID NO: 46345 - DNA, 18 bp, Artificial sequence
  synthetic polynucleotide sequence
gccagcgtccgtcaccca

SEQ ID NO: 46346 - DNA, 22 bp, Artificial sequence
  synthetic polynucleotide sequence
caatggcactgagaactcagca

SEQ ID NO: 46347 - DNA, 22 bp, Artificial sequence
  synthetic polynucleotide sequence
ctttggagacacaacaggcaga

SEQ ID NO: 46348 - DNA, 22 bp, Artificial sequence
  synthetic polynucleotide sequence
gataaatgagtgaccccaggga

SEQ ID NO: 46349 - DNA, 20 bp, Artificial sequence
  synthetic polynucleotide sequence
gaccccaggaccaaggtcca

SEQ ID NO: 46350 - DNA, 22 bp, Artificial sequence
  synthetic polynucleotide sequence
gaaaggagtggcttgaaggaga

SEQ ID NO: 46351 - DNA, 21 bp, Artificial sequence
  synthetic polynucleotide sequence
agcaccaaagcccacagagga

SEQ ID NO: 46352 - DNA, 19 bp, Artificial sequence
  synthetic polynucleotide sequence
gtgacctgagggctcccca

SEQ ID NO: 46353 - DNA, 22 bp, Artificial sequence
  synthetic polynucleotide sequence
atggcatcactgaccaagcaga

SEQ ID NO: 46354 - DNA, 20 bp, Artificial sequence
  synthetic polynucleotide sequence
caacgtagggctgctcagca

SEQ ID NO: 46355 - DNA, 20 bp, Artificial sequence
  synthetic polynucleotide sequence
aatgcctgggctgtaacgaa

SEQ ID NO: 46356 - DNA, 20 bp, Artificial sequence
  synthetic polynucleotide sequence
gggccccaacagtatcacca

SEQ ID NO: 46357 - DNA, 21 bp, Artificial sequence
  synthetic polynucleotide sequence
atcccagcaccaagatccaca

SEQ ID NO: 46358 - DNA, 20 bp, Artificial sequence
  synthetic polynucleotide sequence
gcccagcaagtcacctgcca

SEQ ID NO: 46359 - DNA, 21 bp, Artificial sequence
  synthetic polynucleotide sequence
atccaaccactgaggcccaca

SEQ ID NO: 46360 - DNA, 21 bp, Artificial sequence
  synthetic polynucleotide sequence
gatgaccagactcacaccgga

SEQ ID NO: 46361 - DNA, 22 bp, Artificial sequence
  synthetic polynucleotide sequence
atgtctgggcagtaaccaacca

SEQ ID NO: 46362 - DNA, 22 bp, Artificial sequence
  synthetic polynucleotide sequence
aaaggccccaacagtatcacca

SEQ ID NO: 46363 - DNA, 20 bp, Artificial sequence
  synthetic polynucleotide sequence
gtctgggcagtaaccggcca

SEQ ID NO: 46364 - DNA, 23 bp, Artificial sequence
  synthetic polynucleotide sequence
aaatagtaaaggccccaacagca

SEQ ID NO: 46365 - DNA, 22 bp, Artificial sequence
  synthetic polynucleotide sequence
cctatccactcctccaactcca

SEQ ID NO: 46366 - DNA, 19 bp, Artificial sequence
  synthetic polynucleotide sequence
gcccccatgtgagcctcca

SEQ ID NO: 46367 - DNA, 21 bp, Artificial sequence
  synthetic polynucleotide sequence
tgttcagcctgggcatcacca

SEQ ID NO: 46368 - DNA, 18 bp, Artificial sequence
  synthetic polynucleotide sequence
ccagcagcagcctgggga

SEQ ID NO: 46369 - DNA, 19 bp, Artificial sequence
  synthetic polynucleotide sequence
ctccccactggtgaccgca

SEQ ID NO: 46370 - DNA, 21 bp, Artificial sequence
  synthetic polynucleotide sequence
aagactttgagccaggcagca

SEQ ID NO: 46371 - DNA, 18 bp, Artificial sequence
  synthetic polynucleotide sequence
tgggggtctcggccgaca

SEQ ID NO: 46372 - DNA, 22 bp, Artificial sequence
  synthetic polynucleotide sequence
aaggagatcaggacagagccca

SEQ ID NO: 46373 - DNA, 21 bp, Artificial sequence
  synthetic polynucleotide sequence
ggctctagagactccagcaca

SEQ ID NO: 46374 - DNA, 20 bp, Artificial sequence
  synthetic polynucleotide sequence
agtggcacgagggaaaggca

SEQ ID NO: 46375 - DNA, 20 bp, Artificial sequence
  synthetic polynucleotide sequence
atctgggcagtgatcaacca

SEQ ID NO: 46376 - DNA, 22 bp, Artificial sequence
  synthetic polynucleotide sequence
aaaggccccaacaacatcacca

SEQ ID NO: 46377 - DNA, 21 bp, Artificial sequence
  synthetic polynucleotide sequence
atcccagcatgaaggtccaca

SEQ ID NO: 46378 - DNA, 21 bp, Artificial sequence
  synthetic polynucleotide sequence
cacccagtacctcacatgcca

SEQ ID NO: 46379 - DNA, 22 bp, Artificial sequence
  synthetic polynucleotide sequence
tccattcagctggtaggaggga

SEQ ID NO: 46380 - DNA, 21 bp, Artificial sequence
  synthetic polynucleotide sequence
acactggtgagatcaggagga

SEQ ID NO: 46381 - DNA, 22 bp, Artificial sequence
  synthetic polynucleotide sequence
agctccatggagaaggatcgca

SEQ ID NO: 46382 - DNA, 21 bp, Artificial sequence
  synthetic polynucleotide sequence
tcattccgcagcctcctagga

SEQ ID NO: 46383 - DNA, 20 bp, Artificial sequence
  synthetic polynucleotide sequence
acaacctcaggattccgaga

SEQ ID NO: 46384 - DNA, 18 bp, Artificial sequence
  synthetic polynucleotide sequence
ggggtgaactgctgcaca

SEQ ID NO: 46385 - DNA, 20 bp, Artificial sequence
  synthetic polynucleotide sequence
tagccttccagccactgaga

SEQ ID NO: 46386 - DNA, 20 bp, Artificial sequence
  synthetic polynucleotide sequence
tctgcaccctgtggcactga

SEQ ID NO: 46387 - DNA, 20 bp, Artificial sequence
  synthetic polynucleotide sequence
gaccccagtacagaggccca

SEQ ID NO: 46388 - DNA, 21 bp, Artificial sequence
  synthetic polynucleotide sequence
tacacgatgaggaggagcaga

SEQ ID NO: 46389 - DNA, 20 bp, Artificial sequence
  synthetic polynucleotide sequence
ggccttgaaacatccgggga

SEQ ID NO: 46390 - DNA, 19 bp, Artificial sequence
  synthetic polynucleotide sequence
cactccgccaagcacgcca

SEQ ID NO: 46391 - DNA, 20 bp, Artificial sequence
  synthetic polynucleotide sequence
ccatccctggactccggcca

SEQ ID NO: 46392 - DNA, 21 bp, Artificial sequence
  synthetic polynucleotide sequence
ctaaccgctccgtgaactcca

SEQ ID NO: 46393 - DNA, 21 bp, Artificial sequence
  synthetic polynucleotide sequence
gatggtaccaaggaagcagca

SEQ ID NO: 46394 - DNA, 20 bp, Artificial sequence
  synthetic polynucleotide sequence
tgactccacaccaaggtgca

SEQ ID NO: 46395 - DNA, 19 bp, Artificial sequence
  synthetic polynucleotide sequence
cgcctgtcccagaacagca

SEQ ID NO: 46396 - DNA, 19 bp, Artificial sequence
  synthetic polynucleotide sequence
ggtagctgccggtgaagca

SEQ ID NO: 46397 - DNA, 19 bp, Artificial sequence
  synthetic polynucleotide sequence
ccccggactttgaccgcga

SEQ ID NO: 46398 - DNA, 21 bp, Artificial sequence
  synthetic polynucleotide sequence
gatgaacacccaagcatggca

SEQ ID NO: 46399 - DNA, 21 bp, Artificial sequence
  synthetic polynucleotide sequence
cctcttggggactggaagaca

SEQ ID NO: 46400 - DNA, 21 bp, Artificial sequence
  synthetic polynucleotide sequence
caaaagcctgtcccatgccca

SEQ ID NO: 46401 - DNA, 19 bp, Artificial sequence
  synthetic polynucleotide sequence
gaggtggaatcgaccagga

SEQ ID NO: 46402 - DNA, 19 bp, Artificial sequence
  synthetic polynucleotide sequence
cagcagggcctccttcaga

SEQ ID NO: 46403 - DNA, 19 bp, Artificial sequence
  synthetic polynucleotide sequence
ggcgtctaccagaagggga

SEQ ID NO: 46404 - DNA, 18 bp, Artificial sequence
  synthetic polynucleotide sequence
catgccacaggggcagga

SEQ ID NO: 46405 - DNA, 20 bp, Artificial sequence
  synthetic polynucleotide sequence
atctcaccagggccagcaga

SEQ ID NO: 46406 - DNA, 19 bp, Artificial sequence
  synthetic polynucleotide sequence
ggagactaggggctgggga

SEQ ID NO: 46407 - DNA, 21 bp, Artificial sequence
  synthetic polynucleotide sequence
ctaccgtaatgccctgcggaa

SEQ ID NO: 46408 - DNA, 19 bp, Artificial sequence
  synthetic polynucleotide sequence
ggggtggctactcggagga

SEQ ID NO: 46409 - DNA, 21 bp, Artificial sequence
  synthetic polynucleotide sequence
ccccagccccaaatcaagcca

SEQ ID NO: 46410 - DNA, 19 bp, Artificial sequence
  synthetic polynucleotide sequence
gtgggctgagacctgggga

SEQ ID NO: 46411 - DNA, 21 bp, Artificial sequence
  synthetic polynucleotide sequence
ggcaacaggacctgtaccgaa

SEQ ID NO: 46412 - DNA, 20 bp, Artificial sequence
  synthetic polynucleotide sequence
cgcaggcatgtgcatgagca

SEQ ID NO: 46413 - DNA, 18 bp, Artificial sequence
  synthetic polynucleotide sequence
ccccccaggccccaacga

SEQ ID NO: 46414 - DNA, 20 bp, Artificial sequence
  synthetic polynucleotide sequence
gaaggaagccaagtccccga

SEQ ID NO: 46415 - DNA, 21 bp, Artificial sequence
  synthetic polynucleotide sequence
ctcgcaacacgttccaggtga

SEQ ID NO: 46416 - DNA, 20 bp, Artificial sequence
  synthetic polynucleotide sequence
tctggtgaagaagtccgcga

SEQ ID NO: 46417 - DNA, 22 bp, Artificial sequence
  synthetic polynucleotide sequence
aagcccagcgaaggaagaagca

SEQ ID NO: 46418 - DNA, 22 bp, Artificial sequence
  synthetic polynucleotide sequence
atgtcaaagagctcgtgggtga

SEQ ID NO: 46419 - DNA, 21 bp, Artificial sequence
  synthetic polynucleotide sequence
tagaatggactcaggccccaa

SEQ ID NO: 46420 - DNA, 23 bp, Artificial sequence
  synthetic polynucleotide sequence
gaataccaaataggaccagccca

SEQ ID NO: 46421 - DNA, 21 bp, Artificial sequence
  synthetic polynucleotide sequence
cgtggtccggacagatcggaa

SEQ ID NO: 46422 - DNA, 18 bp, Artificial sequence
  synthetic polynucleotide sequence
cccggggtgagctgacga

SEQ ID NO: 46423 - DNA, 21 bp, Artificial sequence
  synthetic polynucleotide sequence
caggagaccatgaagcggcaa

SEQ ID NO: 46424 - DNA, 20 bp, Artificial sequence
  synthetic polynucleotide sequence
tccatgtccaggatggcgca

SEQ ID NO: 46425 - DNA, 21 bp, Artificial sequence
  synthetic polynucleotide sequence
ttggggctcaaccacttcgca

SEQ ID NO: 46426 - DNA, 21 bp, Artificial sequence
  synthetic polynucleotide sequence
tgcttcagctgcagccagtga

SEQ ID NO: 46427 - DNA, 21 bp, Artificial sequence
  synthetic polynucleotide sequence
tccaggacctgctctcggaga

SEQ ID NO: 46428 - DNA, 22 bp, Artificial sequence
  synthetic polynucleotide sequence
atgagactgtccgcaaagacca

SEQ ID NO: 46429 - DNA, 20 bp, Artificial sequence
  synthetic polynucleotide sequence
ctgaccaagccaaggaccaa

SEQ ID NO: 46430 - DNA, 21 bp, Artificial sequence
  synthetic polynucleotide sequence
cagctgaaacttaggggccca

SEQ ID NO: 46431 - DNA, 19 bp, Artificial sequence
  synthetic polynucleotide sequence
cggggaagccctgcaggaa

SEQ ID NO: 46432 - DNA, 21 bp, Artificial sequence
  synthetic polynucleotide sequence
ggttgttgcaggccaggagga

SEQ ID NO: 46433 - DNA, 22 bp, Artificial sequence
  synthetic polynucleotide sequence
tgaacaacctgctgatgaggga

SEQ ID NO: 46434 - DNA, 20 bp, Artificial sequence
  synthetic polynucleotide sequence
tgtgggcaggttctggagga

SEQ ID NO: 46435 - DNA, 21 bp, Artificial sequence
  synthetic polynucleotide sequence
cccaatgactgtccgggagaa

SEQ ID NO: 46436 - DNA, 18 bp, Artificial sequence
  synthetic polynucleotide sequence
cctgggaacccctggcca

SEQ ID NO: 46437 - DNA, 18 bp, Artificial sequence
  synthetic polynucleotide sequence
tatggcactgcagcagca

SEQ ID NO: 46438 - DNA, 22 bp, Artificial sequence
  synthetic polynucleotide sequence
ccttgagcctgaggtactagca

SEQ ID NO: 46439 - DNA, 21 bp, Artificial sequence
  synthetic polynucleotide sequence
cagcgtgagggagatgagaga

SEQ ID NO: 46440 - DNA, 20 bp, Artificial sequence
  synthetic polynucleotide sequence
tccggtcccaaagaagccca

SEQ ID NO: 46441 - DNA, 20 bp, Artificial sequence
  synthetic polynucleotide sequence
aacatgggctccaggaggga

SEQ ID NO: 46442 - DNA, 20 bp, Artificial sequence
  synthetic polynucleotide sequence
gagagcagtgggtctgggga

SEQ ID NO: 46443 - DNA, 20 bp, Artificial sequence
  synthetic polynucleotide sequence
ttggaccagggatgccccca

SEQ ID NO: 46444 - DNA, 20 bp, Artificial sequence
  synthetic polynucleotide sequence
aacgcaggcagccgaagaga

SEQ ID NO: 46445 - DNA, 20 bp, Artificial sequence
  synthetic polynucleotide sequence
ggcctcggaaaggaaggcga

SEQ ID NO: 46446 - DNA, 21 bp, Artificial sequence
  synthetic polynucleotide sequence
gtgccaagagatcatggccca

SEQ ID NO: 46447 - DNA, 21 bp, Artificial sequence
  synthetic polynucleotide sequence
gcactggaagagccagaccca

SEQ ID NO: 46448 - DNA, 20 bp, Artificial sequence
  synthetic polynucleotide sequence
gtcctggcacccttggagga

SEQ ID NO: 46449 - DNA, 21 bp, Artificial sequence
  synthetic polynucleotide sequence
agaaggcgctggagaaacaga

SEQ ID NO: 46450 - DNA, 20 bp, Artificial sequence
  synthetic polynucleotide sequence
taggccttgacagtagccga

SEQ ID NO: 46451 - DNA, 20 bp, Artificial sequence
  synthetic polynucleotide sequence
ctgagctcagggtgcaccca

SEQ ID NO: 46452 - DNA, 19 bp, Artificial sequence
  synthetic polynucleotide sequence
caggggcttgacgctggga

SEQ ID NO: 46453 - DNA, 22 bp, Artificial sequence
  synthetic polynucleotide sequence
taggcaacaaggagagcggcaa

SEQ ID NO: 46454 - DNA, 19 bp, Artificial sequence
  synthetic polynucleotide sequence
taagcagtcgcctgtgcca

SEQ ID NO: 46455 - DNA, 18 bp, Artificial sequence
  synthetic polynucleotide sequence
ccagcgaggaccaggcga

SEQ ID NO: 46456 - DNA, 18 bp, Artificial sequence
  synthetic polynucleotide sequence
cactccagggaaggggca

SEQ ID NO: 46457 - DNA, 20 bp, Artificial sequence
  synthetic polynucleotide sequence
tggggctgtccgggaagaca

SEQ ID NO: 46458 - DNA, 20 bp, Artificial sequence
  synthetic polynucleotide sequence
ccaaggcccctctacgtcca

SEQ ID NO: 46459 - DNA, 21 bp, Artificial sequence
  synthetic polynucleotide sequence
agaaacgccagggtgcactga

SEQ ID NO: 46460 - DNA, 21 bp, Artificial sequence
  synthetic polynucleotide sequence
atctgagaacaccagtgggga

SEQ ID NO: 46461 - DNA, 22 bp, Artificial sequence
  synthetic polynucleotide sequence
tgtatcagctggagtctgggaa

SEQ ID NO: 46462 - DNA, 21 bp, Artificial sequence
  synthetic polynucleotide sequence
gattcaggcaaacatcccgca

SEQ ID NO: 46463 - DNA, 21 bp, Artificial sequence
  synthetic polynucleotide sequence
aagccatcgccacagtcacca

SEQ ID NO: 46464 - DNA, 20 bp, Artificial sequence
  synthetic polynucleotide sequence
agaaggagctgaagcccgca

SEQ ID NO: 46465 - DNA, 20 bp, Artificial sequence
  synthetic polynucleotide sequence
gctctctgcctgagcaccca

SEQ ID NO: 46466 - DNA, 22 bp, Artificial sequence
  synthetic polynucleotide sequence
tcaaagactgcctgatccacca

SEQ ID NO: 46467 - DNA, 19 bp, Artificial sequence
  synthetic polynucleotide sequence
gacacggtcctggtgcgga

SEQ ID NO: 46468 - DNA, 22 bp, Artificial sequence
  synthetic polynucleotide sequence
gtaatcctggccatcatgcaca

SEQ ID NO: 46469 - DNA, 20 bp, Artificial sequence
  synthetic polynucleotide sequence
ggaggacacggccaagagga

SEQ ID NO: 46470 - DNA, 21 bp, Artificial sequence
  synthetic polynucleotide sequence
agcagaggtgtgtgggagcca

SEQ ID NO: 46471 - DNA, 21 bp, Artificial sequence
  synthetic polynucleotide sequence
cctacgaccagaggcaagaca

SEQ ID NO: 46472 - DNA, 18 bp, Artificial sequence
  synthetic polynucleotide sequence
cctcacagcggctgccca

SEQ ID NO: 46473 - DNA, 19 bp, Artificial sequence
  synthetic polynucleotide sequence
tggagaagagagccagcga

SEQ ID NO: 46474 - DNA, 21 bp, Artificial sequence
  synthetic polynucleotide sequence
agtcactgcagtcctccagga

SEQ ID NO: 46475 - DNA, 20 bp, Artificial sequence
  synthetic polynucleotide sequence
aagagtggcccagtcccaga

SEQ ID NO: 46476 - DNA, 22 bp, Artificial sequence
  synthetic polynucleotide sequence
tcaataaggaagctgagcgcca

SEQ ID NO: 46477 - DNA, 18 bp, Artificial sequence
  synthetic polynucleotide sequence
cgctgatccggaagacca

SEQ ID NO: 46478 - DNA, 18 bp, Artificial sequence
  synthetic polynucleotide sequence
cgcccagaaggtcacaca

SEQ ID NO: 46479 - DNA, 21 bp, Artificial sequence
  synthetic polynucleotide sequence
cacagcccatcccagatacca

SEQ ID NO: 46480 - DNA, 21 bp, Artificial sequence
  synthetic polynucleotide sequence
gaattgtcatggagcccggca

SEQ ID NO: 46481 - DNA, 19 bp, Artificial sequence
  synthetic polynucleotide sequence
tccacaggaagaagtgcca

SEQ ID NO: 46482 - DNA, 19 bp, Artificial sequence
  synthetic polynucleotide sequence
tggtccagacgaatgctca

SEQ ID NO: 46483 - DNA, 18 bp, Artificial sequence
  synthetic polynucleotide sequence
caacctggaagcggcaga

SEQ ID NO: 46484 - DNA, 20 bp, Artificial sequence
  synthetic polynucleotide sequence
ctgccagtgatccacctgga

SEQ ID NO: 46485 - DNA, 20 bp, Artificial sequence
  synthetic polynucleotide sequence
gaagcggccactctccccaa

SEQ ID NO: 46486 - DNA, 18 bp, Artificial sequence
  synthetic polynucleotide sequence
gcgactcggggatgggga

SEQ ID NO: 46487 - DNA, 19 bp, Artificial sequence
  synthetic polynucleotide sequence
tccagggacacacaaacga

SEQ ID NO: 46488 - DNA, 18 bp, Artificial sequence
  synthetic polynucleotide sequence
ttgctggtggcgggccca

SEQ ID NO: 46489 - DNA, 20 bp, Artificial sequence
  synthetic polynucleotide sequence
ggggaggagaatggagcaca

SEQ ID NO: 46490 - DNA, 21 bp, Artificial sequence
  synthetic polynucleotide sequence
ctccagaccctgatgctagga

SEQ ID NO: 46491 - DNA, 19 bp, Artificial sequence
  synthetic polynucleotide sequence
gcaggctcggctgtgacca

SEQ ID NO: 46492 - DNA, 22 bp, Artificial sequence
  synthetic polynucleotide sequence
atgtcatgtcatccgagcagga

SEQ ID NO: 46493 - DNA, 20 bp, Artificial sequence
  synthetic polynucleotide sequence
ctccaacgactcacggagga

SEQ ID NO: 46494 - DNA, 18 bp, Artificial sequence
  synthetic polynucleotide sequence
tgccactggccaaggcca

SEQ ID NO: 46495 - DNA, 20 bp, Artificial sequence
  synthetic polynucleotide sequence
tggaacaccaactcgcggca

SEQ ID NO: 46496 - DNA, 20 bp, Artificial sequence
  synthetic polynucleotide sequence
gtgccgctcagtgtagggca

SEQ ID NO: 46497 - DNA, 21 bp, Artificial sequence
  synthetic polynucleotide sequence
gcttagcccgtagtctgcaga

SEQ ID NO: 46498 - DNA, 21 bp, Artificial sequence
  synthetic polynucleotide sequence
atccgatagcacacagcagga

SEQ ID NO: 46499 - DNA, 20 bp, Artificial sequence
  synthetic polynucleotide sequence
cagcgattccgacccgccaa

SEQ ID NO: 46500 - DNA, 19 bp, Artificial sequence
  synthetic polynucleotide sequence
gacgcgctgggtgggtcca

SEQ ID NO: 46501 - DNA, 21 bp, Artificial sequence
  synthetic polynucleotide sequence
aagatgacccccagaatgcca

SEQ ID NO: 46502 - DNA, 21 bp, Artificial sequence
  synthetic polynucleotide sequence
cagctggaagcaggttaggca

SEQ ID NO: 46503 - DNA, 18 bp, Artificial sequence
  synthetic polynucleotide sequence
cctgaacagagcgcagga

SEQ ID NO: 46504 - DNA, 18 bp, Artificial sequence
  synthetic polynucleotide sequence
gcacacacagggcccaca

SEQ ID NO: 46505 - DNA, 19 bp, Artificial sequence
  synthetic polynucleotide sequence
tcgcgaaaggcttccggga

SEQ ID NO: 46506 - DNA, 18 bp, Artificial sequence
  synthetic polynucleotide sequence
agccacggggttccgcga

SEQ ID NO: 46507 - DNA, 20 bp, Artificial sequence
  synthetic polynucleotide sequence
tcacagcaaggctgggacca

SEQ ID NO: 46508 - DNA, 20 bp, Artificial sequence
  synthetic polynucleotide sequence
ccccaaagcaagagggcaca

SEQ ID NO: 46509 - DNA, 20 bp, Artificial sequence
  synthetic polynucleotide sequence
gggcagccacatgcagcaga

SEQ ID NO: 46510 - DNA, 20 bp, Artificial sequence
  synthetic polynucleotide sequence
gtgctccatccctgacggca

SEQ ID NO: 46511 - DNA, 18 bp, Artificial sequence
  synthetic polynucleotide sequence
gccatcaccctccagcaa

SEQ ID NO: 46512 - DNA, 18 bp, Artificial sequence
  synthetic polynucleotide sequence
cactcggtgaggacccca

SEQ ID NO: 46513 - DNA, 19 bp, Artificial sequence
  synthetic polynucleotide sequence
gtctccgaggacaccggca

SEQ ID NO: 46514 - DNA, 19 bp, Artificial sequence
  synthetic polynucleotide sequence
tgctgatggtccacaggca

SEQ ID NO: 46515 - DNA, 19 bp, Artificial sequence
  synthetic polynucleotide sequence
tccacatagtgcgagccaa

SEQ ID NO: 46516 - DNA, 20 bp, Artificial sequence
  synthetic polynucleotide sequence
gtacaagcgtagagacggca

SEQ ID NO: 46517 - DNA, 21 bp, Artificial sequence
  synthetic polynucleotide sequence
caacacccattcctcacccca

SEQ ID NO: 46518 - DNA, 22 bp, Artificial sequence
  synthetic polynucleotide sequence
gaatgaagggaatgtggggcca

SEQ ID NO: 46519 - DNA, 18 bp, Artificial sequence
  synthetic polynucleotide sequence
ggactgagattgccccca

SEQ ID NO: 46520 - DNA, 20 bp, Artificial sequence
  synthetic polynucleotide sequence
gaggagctgtcaccactgga

SEQ ID NO: 46521 - DNA, 21 bp, Artificial sequence
  synthetic polynucleotide sequence
ggaagcagtaccatgtggcca

SEQ ID NO: 46522 - DNA, 20 bp, Artificial sequence
  synthetic polynucleotide sequence
gcagggtgagtccgggtgaa

SEQ ID NO: 46523 - DNA, 18 bp, Artificial sequence
  synthetic polynucleotide sequence
ccgaccccgaaatgccaa

SEQ ID NO: 46524 - DNA, 20 bp, Artificial sequence
  synthetic polynucleotide sequence
ctggtatgcagtcacagcga

SEQ ID NO: 46525 - DNA, 20 bp, Artificial sequence
  synthetic polynucleotide sequence
ctcaggttcagggcccgaga

SEQ ID NO: 46526 - DNA, 19 bp, Artificial sequence
  synthetic polynucleotide sequence
gcggtgaagtgcgtgggga

SEQ ID NO: 46527 - DNA, 20 bp, Artificial sequence
  synthetic polynucleotide sequence
cccacagctgggagagggaa

SEQ ID NO: 46528 - DNA, 19 bp, Artificial sequence
  synthetic polynucleotide sequence
gctgaagggtgccagggga

SEQ ID NO: 46529 - DNA, 20 bp, Artificial sequence
  synthetic polynucleotide sequence
ccaaatggggccacagacca

SEQ ID NO: 46530 - DNA, 20 bp, Artificial sequence
  synthetic polynucleotide sequence
ggggattgagcccctccaga

SEQ ID NO: 46531 - DNA, 20 bp, Artificial sequence
  synthetic polynucleotide sequence
gatggctcagctcctgggga

SEQ ID NO: 46532 - DNA, 18 bp, Artificial sequence
  synthetic polynucleotide sequence
tccaggtggccacgcgca

SEQ ID NO: 46533 - DNA, 22 bp, Artificial sequence
  synthetic polynucleotide sequence
accaaccctgactgccaagaga

SEQ ID NO: 46534 - DNA, 22 bp, Artificial sequence
  synthetic polynucleotide sequence
tgaatctgaaagctggcgggta

SEQ ID NO: 46535 - DNA, 19 bp, Artificial sequence
  synthetic polynucleotide sequence
cagttcatcccagcacgga

SEQ ID NO: 46536 - DNA, 22 bp, Artificial sequence
  synthetic polynucleotide sequence
aactactgggtacactggacaa

SEQ ID NO: 46537 - DNA, 19 bp, Artificial sequence
  synthetic polynucleotide sequence
ggagagctggccacggaca

SEQ ID NO: 46538 - DNA, 21 bp, Artificial sequence
  synthetic polynucleotide sequence
actgagatctgcacgtcggca

SEQ ID NO: 46539 - DNA, 21 bp, Artificial sequence
  synthetic polynucleotide sequence
agagaggagaatcaaggccca

SEQ ID NO: 46540 - DNA, 21 bp, Artificial sequence
  synthetic polynucleotide sequence
ccccaggcctcaaagaaggga

SEQ ID NO: 46541 - DNA, 21 bp, Artificial sequence
  synthetic polynucleotide sequence
taagccgcttagcacagcaga

SEQ ID NO: 46542 - DNA, 21 bp, Artificial sequence
  synthetic polynucleotide sequence
ttcctagcatcacatggccca

SEQ ID NO: 46543 - DNA, 18 bp, Artificial sequence
  synthetic polynucleotide sequence
ccccatccagcttcagga

SEQ ID NO: 46544 - DNA, 18 bp, Artificial sequence
  synthetic polynucleotide sequence
gcaccgggcttgctgaca

SEQ ID NO: 46545 - DNA, 20 bp, Artificial sequence
  synthetic polynucleotide sequence
gaaagtacttccagcggcaa

SEQ ID NO: 46546 - DNA, 20 bp, Artificial sequence
  synthetic polynucleotide sequence
ctccctacacttcaaccgca

SEQ ID NO: 46547 - DNA, 19 bp, Artificial sequence
  synthetic polynucleotide sequence
ccatcggtgcggactgcga

SEQ ID NO: 46548 - DNA, 21 bp, Artificial sequence
  synthetic polynucleotide sequence
gtgttatggccccacacagca

SEQ ID NO: 46549 - DNA, 21 bp, Artificial sequence
  synthetic polynucleotide sequence
tgacggcagaggaaatggcca

SEQ ID NO: 46550 - DNA, 20 bp, Artificial sequence
  synthetic polynucleotide sequence
tgctgcactggaagaggtca

SEQ ID NO: 46551 - DNA, 19 bp, Artificial sequence
  synthetic polynucleotide sequence
ggcgccctcccatggagca

SEQ ID NO: 46552 - DNA, 22 bp, Artificial sequence
  synthetic polynucleotide sequence
tctaaattgcgggcgagaacga

SEQ ID NO: 46553 - DNA, 22 bp, Artificial sequence
  synthetic polynucleotide sequence
aaaggcatctgagcagtgagga

SEQ ID NO: 46554 - DNA, 19 bp, Artificial sequence
  synthetic polynucleotide sequence
cccctacctccacccctca

SEQ ID NO: 46555 - DNA, 21 bp, Artificial sequence
  synthetic polynucleotide sequence
aggaaagcgcccagctgagga

SEQ ID NO: 46556 - DNA, 21 bp, Artificial sequence
  synthetic polynucleotide sequence
gcatccacaaaaacgccccca

SEQ ID NO: 46557 - DNA, 20 bp, Artificial sequence
  synthetic polynucleotide sequence
aaaaccgacagggggacgga

SEQ ID NO: 46558 - DNA, 21 bp, Artificial sequence
  synthetic polynucleotide sequence
tcctcctgagcccttgacaca

SEQ ID NO: 46559 - DNA, 22 bp, Artificial sequence
  synthetic polynucleotide sequence
gaaaaacagacagggggacgga

SEQ ID NO: 46560 - DNA, 21 bp, Artificial sequence
  synthetic polynucleotide sequence
tcctcctgagcccttgacaca

SEQ ID NO: 46561 - DNA, 21 bp, Artificial sequence
  synthetic polynucleotide sequence
aacgccagcaaacagaaggga

SEQ ID NO: 46562 - DNA, 21 bp, Artificial sequence
  synthetic polynucleotide sequence
atgggataaggacggtcccga

SEQ ID NO: 46563 - DNA, 21 bp, Artificial sequence
  synthetic polynucleotide sequence
agaggacacacccgttaggca

SEQ ID NO: 46564 - DNA, 21 bp, Artificial sequence
  synthetic polynucleotide sequence
aggataaggacggctgcgtga

SEQ ID NO: 46565 - DNA, 20 bp, Artificial sequence
  synthetic polynucleotide sequence
ccctgaggcccgtggaagga

SEQ ID NO: 46566 - DNA, 23 bp, Artificial sequence
  synthetic polynucleotide sequence
gctggaaacaacagccctgcaga

SEQ ID NO: 46567 - DNA, 21 bp, Artificial sequence
  synthetic polynucleotide sequence
agactcactccaaagcgagga

SEQ ID NO: 46568 - DNA, 22 bp, Artificial sequence
  synthetic polynucleotide sequence
gaattcgagctgcagatgccca

SEQ ID NO: 46569 - DNA, 20 bp, Artificial sequence
  synthetic polynucleotide sequence
cgtaccggcggacggtgaga

SEQ ID NO: 46570 - DNA, 21 bp, Artificial sequence
  synthetic polynucleotide sequence
gtacaaacgtgccgactggca

SEQ ID NO: 46571 - DNA, 20 bp, Artificial sequence
  synthetic polynucleotide sequence
ctacgaccagtagcccagca

SEQ ID NO: 46572 - DNA, 20 bp, Artificial sequence
  synthetic polynucleotide sequence
gtgtggctgtaggagcagga

SEQ ID NO: 46573 - DNA, 22 bp, Artificial sequence
  synthetic polynucleotide sequence
aaccaagaggaaccggaccgaa

SEQ ID NO: 46574 - DNA, 20 bp, Artificial sequence
  synthetic polynucleotide sequence
gggtcacacgctcctccaga

SEQ ID NO: 46575 - DNA, 21 bp, Artificial sequence
  synthetic polynucleotide sequence
caggtaccagtcagtggccaa

SEQ ID NO: 46576 - DNA, 19 bp, Artificial sequence
  synthetic polynucleotide sequence
ggtggaaggtcccacagca

SEQ ID NO: 46577 - DNA, 20 bp, Artificial sequence
  synthetic polynucleotide sequence
cgtggacatcggaggtcaga

SEQ ID NO: 46578 - DNA, 20 bp, Artificial sequence
  synthetic polynucleotide sequence
gctcagggcagcccccagaa

SEQ ID NO: 46579 - DNA, 19 bp, Artificial sequence
  synthetic polynucleotide sequence
ccgtcctcggaagtaccca

SEQ ID NO: 46580 - DNA, 18 bp, Artificial sequence
  synthetic polynucleotide sequence
tgcagccaacacaggcca

SEQ ID NO: 46581 - DNA, 18 bp, Artificial sequence
  synthetic polynucleotide sequence
tgcagcacagcacaggca

SEQ ID NO: 46582 - DNA, 18 bp, Artificial sequence
  synthetic polynucleotide sequence
gacattaggcagcgccca

SEQ ID NO: 46583 - DNA, 18 bp, Artificial sequence
  synthetic polynucleotide sequence
tcgcccacttgaggcaga

SEQ ID NO: 46584 - DNA, 18 bp, Artificial sequence
  synthetic polynucleotide sequence
ataagcggctcgcggtca

SEQ ID NO: 46585 - DNA, 18 bp, Artificial sequence
  synthetic polynucleotide sequence
gcccacctcacccgcaca

SEQ ID NO: 46586 - DNA, 21 bp, Artificial sequence
  synthetic polynucleotide sequence
agtcaagatcggagtacccca

SEQ ID NO: 46587 - DNA, 20 bp, Artificial sequence
  synthetic polynucleotide sequence
ctcctacgtcaggccagaga

SEQ ID NO: 46588 - DNA, 21 bp, Artificial sequence
  synthetic polynucleotide sequence
agttggccatcatgtcgcgca

SEQ ID NO: 46589 - DNA, 18 bp, Artificial sequence
  synthetic polynucleotide sequence
gcaagtgcgagagcggaa

SEQ ID NO: 46590 - DNA, 18 bp, Artificial sequence
  synthetic polynucleotide sequence
tgggggtctccaaccaca

SEQ ID NO: 46591 - DNA, 20 bp, Artificial sequence
  synthetic polynucleotide sequence
ctggagcagcaagtccgaga

SEQ ID NO: 46592 - DNA, 18 bp, Artificial sequence
  synthetic polynucleotide sequence
gccaaggagagaggggga

SEQ ID NO: 46593 - DNA, 18 bp, Artificial sequence
  synthetic polynucleotide sequence
gcggtcgagggaaaagca

SEQ ID NO: 46594 - DNA, 21 bp, Artificial sequence
  synthetic polynucleotide sequence
gagcactgtcatcggaaggaa

SEQ ID NO: 46595 - DNA, 19 bp, Artificial sequence
  synthetic polynucleotide sequence
ccctctccctcaccaccaa

SEQ ID NO: 46596 - DNA, 18 bp, Artificial sequence
  synthetic polynucleotide sequence
gctgtgggcatggaccca

SEQ ID NO: 46597 - DNA, 18 bp, Artificial sequence
  synthetic polynucleotide sequence
cgctacacacgacgggca

SEQ ID NO: 46598 - DNA, 22 bp, Artificial sequence
  synthetic polynucleotide sequence
tgaactatggagtgagccgaca

SEQ ID NO: 46599 - DNA, 18 bp, Artificial sequence
  synthetic polynucleotide sequence
gtgggccccagggaggaa

SEQ ID NO: 46600 - DNA, 21 bp, Artificial sequence
  synthetic polynucleotide sequence
tctcggcattgcagaacggca

SEQ ID NO: 46601 - DNA, 18 bp, Artificial sequence
  synthetic polynucleotide sequence
ggagcagaaacgtcgcca

SEQ ID NO: 46602 - DNA, 18 bp, Artificial sequence
  synthetic polynucleotide sequence
agagagggctggagcgca

SEQ ID NO: 46603 - DNA, 23 bp, Artificial sequence
  synthetic polynucleotide sequence
gcaaggtcaccctcagagagaga

SEQ ID NO: 46604 - DNA, 21 bp, Artificial sequence
  synthetic polynucleotide sequence
ttgggagagaaattgggggca

SEQ ID NO: 46605 - DNA, 21 bp, Artificial sequence
  synthetic polynucleotide sequence
tgagcgaggttctgacaggga

SEQ ID NO: 46606 - DNA, 21 bp, Artificial sequence
  synthetic polynucleotide sequence
ctctttctcgcgacgagccaa

SEQ ID NO: 46607 - DNA, 19 bp, Artificial sequence
  synthetic polynucleotide sequence
gctggacctgcctgacgca

SEQ ID NO: 46608 - DNA, 20 bp, Artificial sequence
  synthetic polynucleotide sequence
catgagcacctcggagggga

SEQ ID NO: 46609 - DNA, 19 bp, Artificial sequence
  synthetic polynucleotide sequence
cctatgacccccacccaga

SEQ ID NO: 46610 - DNA, 22 bp, Artificial sequence
  synthetic polynucleotide sequence
atgtggtacactaagcgccaga

SEQ ID NO: 46611 - DNA, 20 bp, Artificial sequence
  synthetic polynucleotide sequence
ccagagcctcagtgagccca

SEQ ID NO: 46612 - DNA, 25 bp, Artificial sequence
  synthetic polynucleotide sequence
taagcagaagcacaggccaaaccca

SEQ ID NO: 46613 - DNA, 18 bp, Artificial sequence
  synthetic polynucleotide sequence
tccaaacgctgcagccca

SEQ ID NO: 46614 - DNA, 22 bp, Artificial sequence
  synthetic polynucleotide sequence
gttataggctcatcagcggaga

SEQ ID NO: 46615 - DNA, 20 bp, Artificial sequence
  synthetic polynucleotide sequence
cagactgtctggcaccacga

SEQ ID NO: 46616 - DNA, 20 bp, Artificial sequence
  synthetic polynucleotide sequence
cggcggcaagagactaagca

SEQ ID NO: 46617 - DNA, 20 bp, Artificial sequence
  synthetic polynucleotide sequence
cagtgaggacagcagcgaca

SEQ ID NO: 46618 - DNA, 18 bp, Artificial sequence
  synthetic polynucleotide sequence
gagactgggatggcgcca

SEQ ID NO: 46619 - DNA, 20 bp, Artificial sequence
  synthetic polynucleotide sequence
gtgggggtgctgtagaagca

SEQ ID NO: 46620 - DNA, 18 bp, Artificial sequence
  synthetic polynucleotide sequence
cgcaagctgttcccgaga

SEQ ID NO: 46621 - DNA, 22 bp, Artificial sequence
  synthetic polynucleotide sequence
gaaatagcacaggccatggaca

SEQ ID NO: 46622 - DNA, 18 bp, Artificial sequence
  synthetic polynucleotide sequence
tggagggagcggcgtgca

SEQ ID NO: 46623 - DNA, 22 bp, Artificial sequence
  synthetic polynucleotide sequence
gcaagaatcgcacactctggca

SEQ ID NO: 46624 - DNA, 19 bp, Artificial sequence
  synthetic polynucleotide sequence
ttgtcccaggagagtggca

SEQ ID NO: 46625 - DNA, 21 bp, Artificial sequence
  synthetic polynucleotide sequence
tcccggtgcagaaagacggga

SEQ ID NO: 46626 - DNA, 18 bp, Artificial sequence
  synthetic polynucleotide sequence
agcgtggcggcctgggaa

SEQ ID NO: 46627 - DNA, 18 bp, Artificial sequence
  synthetic polynucleotide sequence
ggcagccaacaacccaga

SEQ ID NO: 46628 - DNA, 20 bp, Artificial sequence
  synthetic polynucleotide sequence
caccagcaagactgaggcca

SEQ ID NO: 46629 - DNA, 21 bp, Artificial sequence
  synthetic polynucleotide sequence
ccgatgaccccattcgcagga

SEQ ID NO: 46630 - DNA, 20 bp, Artificial sequence
  synthetic polynucleotide sequence
tatagttgaccaggcgagca

SEQ ID NO: 46631 - DNA, 21 bp, Artificial sequence
  synthetic polynucleotide sequence
ggcaaccggcttcgcaaccaa

SEQ ID NO: 46632 - DNA, 19 bp, Artificial sequence
  synthetic polynucleotide sequence
tgtctcagcacctccacga

SEQ ID NO: 46633 - DNA, 21 bp, Artificial sequence
  synthetic polynucleotide sequence
caccaaggccctaactgagga

SEQ ID NO: 46634 - DNA, 21 bp, Artificial sequence
  synthetic polynucleotide sequence
tgctcagagtagtgaggccca

SEQ ID NO: 46635 - DNA, 19 bp, Artificial sequence
  synthetic polynucleotide sequence
gagtgggaggcgcaggaca

SEQ ID NO: 46636 - DNA, 21 bp, Artificial sequence
  synthetic polynucleotide sequence
ccacgaagggaaatgcgtgga

SEQ ID NO: 46637 - DNA, 22 bp, Artificial sequence
  synthetic polynucleotide sequence
gcatcaacctgtcctgcaacca

SEQ ID NO: 46638 - DNA, 19 bp, Artificial sequence
  synthetic polynucleotide sequence
tcctgggccacatctgaca

SEQ ID NO: 46639 - DNA, 20 bp, Artificial sequence
  synthetic polynucleotide sequence
ccgaaccagacccctcagca

SEQ ID NO: 46640 - DNA, 23 bp, Artificial sequence
  synthetic polynucleotide sequence
caaaaggaggctccacatactga

SEQ ID NO: 46641 - DNA, 22 bp, Artificial sequence
  synthetic polynucleotide sequence
tggaagaacccagtcagcgtga

SEQ ID NO: 46642 - DNA, 22 bp, Artificial sequence
  synthetic polynucleotide sequence
atgattgacggtgaccacagga

SEQ ID NO: 46643 - DNA, 21 bp, Artificial sequence
  synthetic polynucleotide sequence
catgctgtgctcaaggaggaa

SEQ ID NO: 46644 - DNA, 21 bp, Artificial sequence
  synthetic polynucleotide sequence
tcagcatcccagaaacagcga

SEQ ID NO: 46645 - DNA, 20 bp, Artificial sequence
  synthetic polynucleotide sequence
ctgctgaatccacaggccaa

SEQ ID NO: 46646 - DNA, 20 bp, Artificial sequence
  synthetic polynucleotide sequence
caggtgcagacacatccaca

SEQ ID NO: 46647 - DNA, 20 bp, Artificial sequence
  synthetic polynucleotide sequence
cacgttgcaatgagaggcaa

SEQ ID NO: 46648 - DNA, 18 bp, Artificial sequence
  synthetic polynucleotide sequence
cggatgctcaggtgagca

SEQ ID NO: 46649 - DNA, 18 bp, Artificial sequence
  synthetic polynucleotide sequence
tcaacaggcactgcagca

SEQ ID NO: 46650 - DNA, 18 bp, Artificial sequence
  synthetic polynucleotide sequence
tgcgggttggacaggaga

SEQ ID NO: 46651 - DNA, 20 bp, Artificial sequence
  synthetic polynucleotide sequence
atggctgcttacaaagggca

SEQ ID NO: 46652 - DNA, 20 bp, Artificial sequence
  synthetic polynucleotide sequence
tggacctcactgagccctga

SEQ ID NO: 46653 - DNA, 21 bp, Artificial sequence
  synthetic polynucleotide sequence
cggacggaactgtgagcacga

SEQ ID NO: 46654 - DNA, 19 bp, Artificial sequence
  synthetic polynucleotide sequence
tctggagtcctggaagcca

SEQ ID NO: 46655 - DNA, 20 bp, Artificial sequence
  synthetic polynucleotide sequence
gacggctgtcatacagagca

SEQ ID NO: 46656 - DNA, 18 bp, Artificial sequence
  synthetic polynucleotide sequence
gaggaaccaccggtgcca

SEQ ID NO: 46657 - DNA, 22 bp, Artificial sequence
  synthetic polynucleotide sequence
ttgagccccttatacccacgaa

SEQ ID NO: 46658 - DNA, 21 bp, Artificial sequence
  synthetic polynucleotide sequence
cactccttgagagaaggggca

SEQ ID NO: 46659 - DNA, 21 bp, Artificial sequence
  synthetic polynucleotide sequence
gaaaatgcaagaggctccaga

SEQ ID NO: 46660 - DNA, 22 bp, Artificial sequence
  synthetic polynucleotide sequence
caaaaactcccagacatccaca

SEQ ID NO: 46661 - DNA, 18 bp, Artificial sequence
  synthetic polynucleotide sequence
caactgcaaagtggccga

SEQ ID NO: 46662 - DNA, 19 bp, Artificial sequence
  synthetic polynucleotide sequence
tcttcagaagcgtaagcca

SEQ ID NO: 46663 - DNA, 18 bp, Artificial sequence
  synthetic polynucleotide sequence
ccacccctgactcagcca

SEQ ID NO: 46664 - DNA, 18 bp, Artificial sequence
  synthetic polynucleotide sequence
taggatgtgcaacgccga

SEQ ID NO: 46665 - DNA, 22 bp, Artificial sequence
  synthetic polynucleotide sequence
caacagccacagcacaggacaa

SEQ ID NO: 46666 - DNA, 20 bp, Artificial sequence
  synthetic polynucleotide sequence
gctggccagtacactgagga

SEQ ID NO: 46667 - DNA, 25 bp, Artificial sequence
  synthetic polynucleotide sequence
atggcagagaggaagagtcatggaa

SEQ ID NO: 46668 - DNA, 22 bp, Artificial sequence
  synthetic polynucleotide sequence
gaagcaatctgtggaccagcaa

SEQ ID NO: 46669 - DNA, 19 bp, Artificial sequence
  synthetic polynucleotide sequence
tggaactgaaggtggacca

SEQ ID NO: 46670 - DNA, 19 bp, Artificial sequence
  synthetic polynucleotide sequence
ccaccaccacctcctccaa

SEQ ID NO: 46671 - DNA, 20 bp, Artificial sequence
  synthetic polynucleotide sequence
atgcctggagtcagtgacca

SEQ ID NO: 46672 - DNA, 18 bp, Artificial sequence
  synthetic polynucleotide sequence
aaggcctgaaggctgcca

SEQ ID NO: 46673 - DNA, 18 bp, Artificial sequence
  synthetic polynucleotide sequence
tgtgccatccccaccgca

SEQ ID NO: 46674 - DNA, 18 bp, Artificial sequence
  synthetic polynucleotide sequence
cccggtatacctgggcca

SEQ ID NO: 46675 - DNA, 21 bp, Artificial sequence
  synthetic polynucleotide sequence
gagctgactctcccaacagca

SEQ ID NO: 46676 - DNA, 20 bp, Artificial sequence
  synthetic polynucleotide sequence
aggccacaggcacatacaca

SEQ ID NO: 46677 - DNA, 20 bp, Artificial sequence
  synthetic polynucleotide sequence
gggccagagagagttgcgca

SEQ ID NO: 46678 - DNA, 20 bp, Artificial sequence
  synthetic polynucleotide sequence
gtcggcctgctccatgacca

SEQ ID NO: 46679 - DNA, 19 bp, Artificial sequence
  synthetic polynucleotide sequence
gacctcagggctctcagga

SEQ ID NO: 46680 - DNA, 19 bp, Artificial sequence
  synthetic polynucleotide sequence
ccactggtcacctgaggga

SEQ ID NO: 46681 - DNA, 19 bp, Artificial sequence
  synthetic polynucleotide sequence
tcagggagcaagtttccga

SEQ ID NO: 46682 - DNA, 20 bp, Artificial sequence
  synthetic polynucleotide sequence
gtgtcctcagggtcagccga

SEQ ID NO: 46683 - DNA, 21 bp, Artificial sequence
  synthetic polynucleotide sequence
agggcagccaggatcctcaca

SEQ ID NO: 46684 - DNA, 18 bp, Artificial sequence
  synthetic polynucleotide sequence
tgagggagctggggccga

SEQ ID NO: 46685 - DNA, 21 bp, Artificial sequence
  synthetic polynucleotide sequence
cgtccggcagatctacgacaa

SEQ ID NO: 46686 - DNA, 20 bp, Artificial sequence
  synthetic polynucleotide sequence
ccagttcaggtccgcccaga

SEQ ID NO: 46687 - DNA, 22 bp, Artificial sequence
  synthetic polynucleotide sequence
acctcaacagcaccatccagga

SEQ ID NO: 46688 - DNA, 21 bp, Artificial sequence
  synthetic polynucleotide sequence
acacaaagcgcccgttctcca

SEQ ID NO: 46689 - DNA, 21 bp, Artificial sequence
  synthetic polynucleotide sequence
ctgggcagacctcaacaccaa

SEQ ID NO: 46690 - DNA, 20 bp, Artificial sequence
  synthetic polynucleotide sequence
gagcagaccttcgtggagca

SEQ ID NO: 46691 - DNA, 18 bp, Artificial sequence
  synthetic polynucleotide sequence
cagccgcttcagcagcaa

SEQ ID NO: 46692 - DNA, 19 bp, Artificial sequence
  synthetic polynucleotide sequence
cggtggcctcgagtaacca

SEQ ID NO: 46693 - DNA, 19 bp, Artificial sequence
  synthetic polynucleotide sequence
ccgtccccaccgagacaga

SEQ ID NO: 46694 - DNA, 19 bp, Artificial sequence
  synthetic polynucleotide sequence
cccacggacactcggcaca

SEQ ID NO: 46695 - DNA, 20 bp, Artificial sequence
  synthetic polynucleotide sequence
aacgctcggggatcagcaga

SEQ ID NO: 46696 - DNA, 21 bp, Artificial sequence
  synthetic polynucleotide sequence
gcactgaagctgctgggacca

SEQ ID NO: 46697 - DNA, 20 bp, Artificial sequence
  synthetic polynucleotide sequence
agcgggccctctaagaccaa

SEQ ID NO: 46698 - DNA, 20 bp, Artificial sequence
  synthetic polynucleotide sequence
ctagctgcagaccaactcga

SEQ ID NO: 46699 - DNA, 20 bp, Artificial sequence
  synthetic polynucleotide sequence
gagctgggtgaagagggaca

SEQ ID NO: 46700 - DNA, 18 bp, Artificial sequence
  synthetic polynucleotide sequence
tggggatcaggctgcaca

SEQ ID NO: 46701 - DNA, 20 bp, Artificial sequence
  synthetic polynucleotide sequence
cacggcattgccccagtgaa

SEQ ID NO: 46702 - DNA, 21 bp, Artificial sequence
  synthetic polynucleotide sequence
tgggtcaccaaactcacagca

SEQ ID NO: 46703 - DNA, 21 bp, Artificial sequence
  synthetic polynucleotide sequence
tgcagagctgtgggctcccaa

SEQ ID NO: 46704 - DNA, 21 bp, Artificial sequence
  synthetic polynucleotide sequence
tcgtcctgccatgggtagcca

SEQ ID NO: 46705 - DNA, 21 bp, Artificial sequence
  synthetic polynucleotide sequence
tcccagtcccatcgaccccaa

SEQ ID NO: 46706 - DNA, 21 bp, Artificial sequence
  synthetic polynucleotide sequence
gcttcaggtcctcctcagcaa

SEQ ID NO: 46707 - DNA, 25 bp, Artificial sequence
  synthetic polynucleotide sequence
aggagcccgaaaatgcacttgacaa

SEQ ID NO: 46708 - DNA, 23 bp, Artificial sequence
  synthetic polynucleotide sequence
cttcttccacgaagcaatcggaa

SEQ ID NO: 46709 - DNA, 21 bp, Artificial sequence
  synthetic polynucleotide sequence
gaaggctgacaagcagcggaa

SEQ ID NO: 46710 - DNA, 20 bp, Artificial sequence
  synthetic polynucleotide sequence
gccgtgtccaccacatcaca

SEQ ID NO: 46711 - DNA, 18 bp, Artificial sequence
  synthetic polynucleotide sequence
caccgacgaggttcacca

SEQ ID NO: 46712 - DNA, 18 bp, Artificial sequence
  synthetic polynucleotide sequence
ggtgtccagcagcatgga

SEQ ID NO: 46713 - DNA, 20 bp, Artificial sequence
  synthetic polynucleotide sequence
gctcccagagtgaacgggca

SEQ ID NO: 46714 - DNA, 22 bp, Artificial sequence
  synthetic polynucleotide sequence
atctgcagtctcagcaatgcga

SEQ ID NO: 46715 - DNA, 19 bp, Artificial sequence
  synthetic polynucleotide sequence
ggagctgtgccgtgacgca

SEQ ID NO: 46716 - DNA, 19 bp, Artificial sequence
  synthetic polynucleotide sequence
cctcgaggttgcgcaggga

SEQ ID NO: 46717 - DNA, 20 bp, Artificial sequence
  synthetic polynucleotide sequence
cgctgaaggtggcccagaca

SEQ ID NO: 46718 - DNA, 18 bp, Artificial sequence
  synthetic polynucleotide sequence
gtgtctcccgcagccgca

SEQ ID NO: 46719 - DNA, 20 bp, Artificial sequence
  synthetic polynucleotide sequence
atcgatgcctacgtgcgcca

SEQ ID NO: 46720 - DNA, 19 bp, Artificial sequence
  synthetic polynucleotide sequence
ttctcagccacgtccgcca

SEQ ID NO: 46721 - DNA, 20 bp, Artificial sequence
  synthetic polynucleotide sequence
ctgatgggagcacgctgaga

SEQ ID NO: 46722 - DNA, 18 bp, Artificial sequence
  synthetic polynucleotide sequence
gcacgcgcgccttcacca

SEQ ID NO: 46723 - DNA, 20 bp, Artificial sequence
  synthetic polynucleotide sequence
aagtccagcctagggcagca

SEQ ID NO: 46724 - DNA, 21 bp, Artificial sequence
  synthetic polynucleotide sequence
tgacctcggctgctgaacaca

SEQ ID NO: 46725 - DNA, 21 bp, Artificial sequence
  synthetic polynucleotide sequence
gcgacctggtcacactaggca

SEQ ID NO: 46726 - DNA, 20 bp, Artificial sequence
  synthetic polynucleotide sequence
agtcctgccgttgaccagca

SEQ ID NO: 46727 - DNA, 21 bp, Artificial sequence
  synthetic polynucleotide sequence
catcttcggagtccagcagca

SEQ ID NO: 46728 - DNA, 20 bp, Artificial sequence
  synthetic polynucleotide sequence
gttgttgagcacggccgcca

SEQ ID NO: 46729 - DNA, 20 bp, Artificial sequence
  synthetic polynucleotide sequence
tggactagcccagaccacga

SEQ ID NO: 46730 - DNA, 18 bp, Artificial sequence
  synthetic polynucleotide sequence
tccaaaggtgagcagcca

SEQ ID NO: 46731 - DNA, 18 bp, Artificial sequence
  synthetic polynucleotide sequence
gatgatcacgagggcgga

SEQ ID NO: 46732 - DNA, 18 bp, Artificial sequence
  synthetic polynucleotide sequence
accctttggccagccaga

SEQ ID NO: 46733 - DNA, 20 bp, Artificial sequence
  synthetic polynucleotide sequence
atcaccgccacaggccagaa

SEQ ID NO: 46734 - DNA, 20 bp, Artificial sequence
  synthetic polynucleotide sequence
tcgatggcgcgcgtgaagca

SEQ ID NO: 46735 - DNA, 20 bp, Artificial sequence
  synthetic polynucleotide sequence
gcggtggagacctgaacgga

SEQ ID NO: 46736 - DNA, 18 bp, Artificial sequence
  synthetic polynucleotide sequence
tctcccgcagcagcccca

SEQ ID NO: 46737 - DNA, 22 bp, Artificial sequence
  synthetic polynucleotide sequence
tgaagagcactggaggaaagca

SEQ ID NO: 46738 - DNA, 20 bp, Artificial sequence
  synthetic polynucleotide sequence
tgctacctcgaccaatccga

SEQ ID NO: 46739 - DNA, 21 bp, Artificial sequence
  synthetic polynucleotide sequence
ggaacgatcagtgacccgcga

SEQ ID NO: 46740 - DNA, 22 bp, Artificial sequence
  synthetic polynucleotide sequence
tgaaatgacccaaagccaccga

SEQ ID NO: 46741 - DNA, 20 bp, Artificial sequence
  synthetic polynucleotide sequence
gagagaaacgacgaggagca

SEQ ID NO: 46742 - DNA, 20 bp, Artificial sequence
  synthetic polynucleotide sequence
gaggcagaggaaatcgagca

SEQ ID NO: 46743 - DNA, 21 bp, Artificial sequence
  synthetic polynucleotide sequence
tcccagcatcaccagccctca

SEQ ID NO: 46744 - DNA, 21 bp, Artificial sequence
  synthetic polynucleotide sequence
ggctgtcctcctccaagacca

SEQ ID NO: 46745 - DNA, 18 bp, Artificial sequence
  synthetic polynucleotide sequence
ggatagcggggaaccaca

SEQ ID NO: 46746 - DNA, 20 bp, Artificial sequence
  synthetic polynucleotide sequence
gagggctctcatccaccaca

SEQ ID NO: 46747 - DNA, 20 bp, Artificial sequence
  synthetic polynucleotide sequence
gtgctacggcgacatggaga

SEQ ID NO: 46748 - DNA, 20 bp, Artificial sequence
  synthetic polynucleotide sequence
cacgcagccatactcaggga

SEQ ID NO: 46749 - DNA, 18 bp, Artificial sequence
  synthetic polynucleotide sequence
gacagcgagaaaccccga

SEQ ID NO: 46750 - DNA, 20 bp, Artificial sequence
  synthetic polynucleotide sequence
gtggcatccttgacacacca

SEQ ID NO: 46751 - DNA, 19 bp, Artificial sequence
  synthetic polynucleotide sequence
ccgacggggccatgatgga

SEQ ID NO: 46752 - DNA, 21 bp, Artificial sequence
  synthetic polynucleotide sequence
caatgtcgatcccctgccaga

SEQ ID NO: 46753 - DNA, 19 bp, Artificial sequence
  synthetic polynucleotide sequence
cacaaggctgggctgggga

SEQ ID NO: 46754 - DNA, 19 bp, Artificial sequence
  synthetic polynucleotide sequence
cgggggcacatggacagga

SEQ ID NO: 46755 - DNA, 20 bp, Artificial sequence
  synthetic polynucleotide sequence
caggacctcatggggggcaa

SEQ ID NO: 46756 - DNA, 21 bp, Artificial sequence
  synthetic polynucleotide sequence
tgggggcccatcagatagcga

SEQ ID NO: 46757 - DNA, 20 bp, Artificial sequence
  synthetic polynucleotide sequence
atgccaattgaaagggggca

SEQ ID NO: 46758 - DNA, 22 bp, Artificial sequence
  synthetic polynucleotide sequence
aagcagacccgttgactaccga

SEQ ID NO: 46759 - DNA, 21 bp, Artificial sequence
  synthetic polynucleotide sequence
acctgtccatcacccagcaga

SEQ ID NO: 46760 - DNA, 18 bp, Artificial sequence
  synthetic polynucleotide sequence
ggtctgctgggccagcga

SEQ ID NO: 46761 - DNA, 22 bp, Artificial sequence
  synthetic polynucleotide sequence
cactgagaccgtgcaacctgaa

SEQ ID NO: 46762 - DNA, 19 bp, Artificial sequence
  synthetic polynucleotide sequence
tcactgggtgaggagcgga

SEQ ID NO: 46763 - DNA, 21 bp, Artificial sequence
  synthetic polynucleotide sequence
gtcccaaggtacagtggacca

SEQ ID NO: 46764 - DNA, 19 bp, Artificial sequence
  synthetic polynucleotide sequence
gtgccacacagtgactgca

SEQ ID NO: 46765 - DNA, 21 bp, Artificial sequence
  synthetic polynucleotide sequence
gaacctcaaccagcccaacca

SEQ ID NO: 46766 - DNA, 19 bp, Artificial sequence
  synthetic polynucleotide sequence
caaccacagtgccccccca

SEQ ID NO: 46767 - DNA, 21 bp, Artificial sequence
  synthetic polynucleotide sequence
ggtgaacagagttgggcctga

SEQ ID NO: 46768 - DNA, 21 bp, Artificial sequence
  synthetic polynucleotide sequence
atctgctgcaccaagatcgca

SEQ ID NO: 46769 - DNA, 20 bp, Artificial sequence
  synthetic polynucleotide sequence
gtgagggaagcgtgcccaca

SEQ ID NO: 46770 - DNA, 22 bp, Artificial sequence
  synthetic polynucleotide sequence
aatgatggcagcagcaatggca

SEQ ID NO: 46771 - DNA, 20 bp, Artificial sequence
  synthetic polynucleotide sequence
gtgccagatggggcgtcgaa

SEQ ID NO: 46772 - DNA, 21 bp, Artificial sequence
  synthetic polynucleotide sequence
ccaggacttgaccatcagcca

SEQ ID NO: 46773 - DNA, 20 bp, Artificial sequence
  synthetic polynucleotide sequence
gaaggtccccataccgcgaa

SEQ ID NO: 46774 - DNA, 20 bp, Artificial sequence
  synthetic polynucleotide sequence
cacattctcacaggcgccca

SEQ ID NO: 46775 - DNA, 22 bp, Artificial sequence
  synthetic polynucleotide sequence
gatactccgaacctcatcagca

SEQ ID NO: 46776 - DNA, 20 bp, Artificial sequence
  synthetic polynucleotide sequence
cccttcccacagtcgaagca

SEQ ID NO: 46777 - DNA, 22 bp, Artificial sequence
  synthetic polynucleotide sequence
ctccgaactccatcagcagaga

SEQ ID NO: 46778 - DNA, 20 bp, Artificial sequence
  synthetic polynucleotide sequence
gcctcccacagaggaagcaa

SEQ ID NO: 46779 - DNA, 21 bp, Artificial sequence
  synthetic polynucleotide sequence
taggggacagcaacagtcaca

SEQ ID NO: 46780 - DNA, 20 bp, Artificial sequence
  synthetic polynucleotide sequence
gctgtcccccaaggagacca

SEQ ID NO: 46781 - DNA, 20 bp, Artificial sequence
  synthetic polynucleotide sequence
tcagcactccactcagccca

SEQ ID NO: 46782 - DNA, 22 bp, Artificial sequence
  synthetic polynucleotide sequence
ttgactgttccagcaagaggca

SEQ ID NO: 46783 - DNA, 19 bp, Artificial sequence
  synthetic polynucleotide sequence
gcgggggagccacaagcaa

SEQ ID NO: 46784 - DNA, 22 bp, Artificial sequence
  synthetic polynucleotide sequence
ccaaggaacttctggaggcaca

SEQ ID NO: 46785 - DNA, 21 bp, Artificial sequence
  synthetic polynucleotide sequence
ggtcctcagggatggagctga

SEQ ID NO: 46786 - DNA, 19 bp, Artificial sequence
  synthetic polynucleotide sequence
gtgggggtccagacctgca

SEQ ID NO: 46787 - DNA, 21 bp, Artificial sequence
  synthetic polynucleotide sequence
tcaacattccaccacccccga

SEQ ID NO: 46788 - DNA, 21 bp, Artificial sequence
  synthetic polynucleotide sequence
aggaggcaggaagtagagcga

SEQ ID NO: 46789 - DNA, 20 bp, Artificial sequence
  synthetic polynucleotide sequence
ccatggtggcagcagagaca

SEQ ID NO: 46790 - DNA, 20 bp, Artificial sequence
  synthetic polynucleotide sequence
ctgcccctgtcccggcacca

SEQ ID NO: 46791 - DNA, 19 bp, Artificial sequence
  synthetic polynucleotide sequence
cagatgaccccaactggga

SEQ ID NO: 46792 - DNA, 18 bp, Artificial sequence
  synthetic polynucleotide sequence
ggcgaattaaggcaggca

SEQ ID NO: 46793 - DNA, 21 bp, Artificial sequence
  synthetic polynucleotide sequence
ttccccaccagcatgattgga

SEQ ID NO: 46794 - DNA, 18 bp, Artificial sequence
  synthetic polynucleotide sequence
gacgttctccccggccga

SEQ ID NO: 46795 - DNA, 20 bp, Artificial sequence
  synthetic polynucleotide sequence
caccttcccctacaccacca

SEQ ID NO: 46796 - DNA, 20 bp, Artificial sequence
  synthetic polynucleotide sequence
ggtagatctccagccgagga

SEQ ID NO: 46797 - DNA, 21 bp, Artificial sequence
  synthetic polynucleotide sequence
acggagaccttcaagagccga

SEQ ID NO: 46798 - DNA, 21 bp, Artificial sequence
  synthetic polynucleotide sequence
agaccaagaggacggttgcca

SEQ ID NO: 46799 - DNA, 20 bp, Artificial sequence
  synthetic polynucleotide sequence
cgcggcacctcctgaagcaa

SEQ ID NO: 46800 - DNA, 20 bp, Artificial sequence
  synthetic polynucleotide sequence
ctgtggcagcgcgacatcca

SEQ ID NO: 46801 - DNA, 18 bp, Artificial sequence
  synthetic polynucleotide sequence
ctgtggcggggcaggcga

SEQ ID NO: 46802 - DNA, 20 bp, Artificial sequence
  synthetic polynucleotide sequence
ggcaaaagtggccgcgggca

SEQ ID NO: 46803 - DNA, 20 bp, Artificial sequence
  synthetic polynucleotide sequence
gaggggctgctgaggagaca

SEQ ID NO: 46804 - DNA, 18 bp, Artificial sequence
  synthetic polynucleotide sequence
tctggtgccaccgcccca

SEQ ID NO: 46805 - DNA, 22 bp, Artificial sequence
  synthetic polynucleotide sequence
caaagtccgggagaagcaagca

SEQ ID NO: 46806 - DNA, 19 bp, Artificial sequence
  synthetic polynucleotide sequence
tcttacgtcccaggccgga

SEQ ID NO: 46807 - DNA, 21 bp, Artificial sequence
  synthetic polynucleotide sequence
accccaaccaggtcctccaga

SEQ ID NO: 46808 - DNA, 21 bp, Artificial sequence
  synthetic polynucleotide sequence
cccaccggttcaagatgggga

SEQ ID NO: 46809 - DNA, 20 bp, Artificial sequence
  synthetic polynucleotide sequence
acagcaaccccaaggcggaa

SEQ ID NO: 46810 - DNA, 19 bp, Artificial sequence
  synthetic polynucleotide sequence
gcagggggggtaggttgca

SEQ ID NO: 46811 - DNA, 20 bp, Artificial sequence
  synthetic polynucleotide sequence
tgccactgcccctgatggaa

SEQ ID NO: 46812 - DNA, 20 bp, Artificial sequence
  synthetic polynucleotide sequence
caggaagtggtccctgccga

SEQ ID NO: 46813 - DNA, 19 bp, Artificial sequence
  synthetic polynucleotide sequence
tgccatggggaagatcgta

SEQ ID NO: 46814 - DNA, 21 bp, Artificial sequence
  synthetic polynucleotide sequence
actagtcgcctcctgaagcca

SEQ ID NO: 46815 - DNA, 19 bp, Artificial sequence
  synthetic polynucleotide sequence
cctgcacagggacccccga

SEQ ID NO: 46816 - DNA, 20 bp, Artificial sequence
  synthetic polynucleotide sequence
gggaaccgtccagagcaaga

SEQ ID NO: 46817 - DNA, 19 bp, Artificial sequence
  synthetic polynucleotide sequence
gccgaagatggcggggcga

SEQ ID NO: 46818 - DNA, 20 bp, Artificial sequence
  synthetic polynucleotide sequence
gaacgggtggcgggaacgga

SEQ ID NO: 46819 - DNA, 18 bp, Artificial sequence
  synthetic polynucleotide sequence
ccgaagactgcatcgcca

SEQ ID NO: 46820 - DNA, 18 bp, Artificial sequence
  synthetic polynucleotide sequence
ctgccaagacaggcacca

SEQ ID NO: 46821 - DNA, 18 bp, Artificial sequence
  synthetic polynucleotide sequence
gcccagcgttggagggaa

SEQ ID NO: 46822 - DNA, 18 bp, Artificial sequence
  synthetic polynucleotide sequence
acctgccactccgcccta

SEQ ID NO: 46823 - DNA, 18 bp, Artificial sequence
  synthetic polynucleotide sequence
cgtggtgaaccccaacga

SEQ ID NO: 46824 - DNA, 18 bp, Artificial sequence
  synthetic polynucleotide sequence
cagcgacgcgttgagaca

SEQ ID NO: 46825 - DNA, 18 bp, Artificial sequence
  synthetic polynucleotide sequence
gcaggcgcaaagcagcaa

SEQ ID NO: 46826 - DNA, 18 bp, Artificial sequence
  synthetic polynucleotide sequence
gagacggctttggcggga

SEQ ID NO: 46827 - DNA, 20 bp, Artificial sequence
  synthetic polynucleotide sequence
aacctcccctgtcagaagga

SEQ ID NO: 46828 - DNA, 20 bp, Artificial sequence
  synthetic polynucleotide sequence
taagcattcaggtggggaca

SEQ ID NO: 46829 - DNA, 19 bp, Artificial sequence
  synthetic polynucleotide sequence
gtgtggtcaaccccacaga

SEQ ID NO: 46830 - DNA, 20 bp, Artificial sequence
  synthetic polynucleotide sequence
tgcctcccaagagtgaagca

SEQ ID NO: 46831 - DNA, 18 bp, Artificial sequence
  synthetic polynucleotide sequence
ctcatcctggagcccgga

SEQ ID NO: 46832 - DNA, 18 bp, Artificial sequence
  synthetic polynucleotide sequence
tggaaggcagtgagggca

SEQ ID NO: 46833 - DNA, 22 bp, Artificial sequence
  synthetic polynucleotide sequence
atcgtgcaggcaatccagcaca

SEQ ID NO: 46834 - DNA, 20 bp, Artificial sequence
  synthetic polynucleotide sequence
gagtcggaggcggtgtcaga

SEQ ID NO: 46835 - DNA, 20 bp, Artificial sequence
  synthetic polynucleotide sequence
ctggacttgaggctgacaga

SEQ ID NO: 46836 - DNA, 22 bp, Artificial sequence
  synthetic polynucleotide sequence
tcaaccaccagaagttcagcga

SEQ ID NO: 46837 - DNA, 20 bp, Artificial sequence
  synthetic polynucleotide sequence
ctctctgactcctctccgca

SEQ ID NO: 46838 - DNA, 18 bp, Artificial sequence
  synthetic polynucleotide sequence
gcgccagggtctcagcca

SEQ ID NO: 46839 - DNA, 21 bp, Artificial sequence
  synthetic polynucleotide sequence
ggaaccgacctggagacagaa

SEQ ID NO: 46840 - DNA, 20 bp, Artificial sequence
  synthetic polynucleotide sequence
agggtcccacaggaactcca

SEQ ID NO: 46841 - DNA, 18 bp, Artificial sequence
  synthetic polynucleotide sequence
gatccaggatgcccagca

SEQ ID NO: 46842 - DNA, 18 bp, Artificial sequence
  synthetic polynucleotide sequence
tggcgttgaagagccgga

SEQ ID NO: 46843 - DNA, 18 bp, Artificial sequence
  synthetic polynucleotide sequence
cctgaccaacggtgcaga

SEQ ID NO: 46844 - DNA, 18 bp, Artificial sequence
  synthetic polynucleotide sequence
ccgacgtaggacaccgga

SEQ ID NO: 46845 - DNA, 20 bp, Artificial sequence
  synthetic polynucleotide sequence
gtgccaccttaccccagtca

SEQ ID NO: 46846 - DNA, 18 bp, Artificial sequence
  synthetic polynucleotide sequence
gagcagtgagaggccgca

SEQ ID NO: 46847 - DNA, 22 bp, Artificial sequence
  synthetic polynucleotide sequence
gcatctccgacgacaaatcaga

SEQ ID NO: 46848 - DNA, 20 bp, Artificial sequence
  synthetic polynucleotide sequence
agctcccggactctagccca

SEQ ID NO: 46849 - DNA, 18 bp, Artificial sequence
  synthetic polynucleotide sequence
gcagcctgcagctccgaa

SEQ ID NO: 46850 - DNA, 18 bp, Artificial sequence
  synthetic polynucleotide sequence
tgcaggtccagaagggca

SEQ ID NO: 46851 - DNA, 19 bp, Artificial sequence
  synthetic polynucleotide sequence
ccagggagctggagaacca

SEQ ID NO: 46852 - DNA, 18 bp, Artificial sequence
  synthetic polynucleotide sequence
gttcatgccggacgggga

SEQ ID NO: 46853 - DNA, 20 bp, Artificial sequence
  synthetic polynucleotide sequence
gtcaccaaacagcagagcca

SEQ ID NO: 46854 - DNA, 22 bp, Artificial sequence
  synthetic polynucleotide sequence
ggaagtggcagatagcagagga

SEQ ID NO: 46855 - DNA, 21 bp, Artificial sequence
  synthetic polynucleotide sequence
ccaccatggagaacaaggtga

SEQ ID NO: 46856 - DNA, 18 bp, Artificial sequence
  synthetic polynucleotide sequence
cacgaacggtgtcgtcga

SEQ ID NO: 46857 - DNA, 21 bp, Artificial sequence
  synthetic polynucleotide sequence
agaccgaagaaactgtggcta

SEQ ID NO: 46858 - DNA, 21 bp, Artificial sequence
  synthetic polynucleotide sequence
gtaatggcagtcttccacaga

SEQ ID NO: 46859 - DNA, 18 bp, Artificial sequence
  synthetic polynucleotide sequence
ccacagccaggagggaga

SEQ ID NO: 46860 - DNA, 18 bp, Artificial sequence
  synthetic polynucleotide sequence
ggtttgcagacaggccca

SEQ ID NO: 46861 - DNA, 19 bp, Artificial sequence
  synthetic polynucleotide sequence
gggatatggccagcaacca

SEQ ID NO: 46862 - DNA, 19 bp, Artificial sequence
  synthetic polynucleotide sequence
tccaggttgagaggcagga

SEQ ID NO: 46863 - DNA, 20 bp, Artificial sequence
  synthetic polynucleotide sequence
gtgcctacatgcagccagga

SEQ ID NO: 46864 - DNA, 18 bp, Artificial sequence
  synthetic polynucleotide sequence
gcacagagctagcggcca

SEQ ID NO: 46865 - DNA, 21 bp, Artificial sequence
  synthetic polynucleotide sequence
gtatggtggatgcctgggcaa

SEQ ID NO: 46866 - DNA, 20 bp, Artificial sequence
  synthetic polynucleotide sequence
gttgattgcggagtcaggga

SEQ ID NO: 46867 - DNA, 18 bp, Artificial sequence
  synthetic polynucleotide sequence
cggtgggtgtcaccggaa

SEQ ID NO: 46868 - DNA, 18 bp, Artificial sequence
  synthetic polynucleotide sequence
ttggtgcgcagaagccca

SEQ ID NO: 46869 - DNA, 18 bp, Artificial sequence
  synthetic polynucleotide sequence
ggaggatgagggcagcca

SEQ ID NO: 46870 - DNA, 18 bp, Artificial sequence
  synthetic polynucleotide sequence
ggcgtccatcccgtggca

SEQ ID NO: 46871 - DNA, 20 bp, Artificial sequence
  synthetic polynucleotide sequence
gtcctcaggcacatcgggaa

SEQ ID NO: 46872 - DNA, 22 bp, Artificial sequence
  synthetic polynucleotide sequence
aggaagtagaactccacccgca

SEQ ID NO: 46873 - DNA, 18 bp, Artificial sequence
  synthetic polynucleotide sequence
gggaatccggctgaggaa

SEQ ID NO: 46874 - DNA, 20 bp, Artificial sequence
  synthetic polynucleotide sequence
taaggtagactgagccgcca

SEQ ID NO: 46875 - DNA, 21 bp, Artificial sequence
  synthetic polynucleotide sequence
gggtcagggcttcaaacaaga

SEQ ID NO: 46876 - DNA, 21 bp, Artificial sequence
  synthetic polynucleotide sequence
tggcaagctggacaactgaca

SEQ ID NO: 46877 - DNA, 18 bp, Artificial sequence
  synthetic polynucleotide sequence
gccagaagaagcaggcca

SEQ ID NO: 46878 - DNA, 20 bp, Artificial sequence
  synthetic polynucleotide sequence
ctggcagcagtgtatcagca

SEQ ID NO: 46879 - DNA, 19 bp, Artificial sequence
  synthetic polynucleotide sequence
tgcttcagctccacggaga

SEQ ID NO: 46880 - DNA, 18 bp, Artificial sequence
  synthetic polynucleotide sequence
ccgaggcagaagttggca

SEQ ID NO: 46881 - DNA, 21 bp, Artificial sequence
  synthetic polynucleotide sequence
gcaaccagcccatccgacaca

SEQ ID NO: 46882 - DNA, 20 bp, Artificial sequence
  synthetic polynucleotide sequence
acgaaacagtccgggtgcca

SEQ ID NO: 46883 - DNA, 20 bp, Artificial sequence
  synthetic polynucleotide sequence
aacagtgggaagaccccaca

SEQ ID NO: 46884 - DNA, 18 bp, Artificial sequence
  synthetic polynucleotide sequence
tacgggcatgctccagca

SEQ ID NO: 46885 - DNA, 18 bp, Artificial sequence
  synthetic polynucleotide sequence
gctcgacaacccgggcca

SEQ ID NO: 46886 - DNA, 21 bp, Artificial sequence
  synthetic polynucleotide sequence
agtcaatgtagagggggcgca

SEQ ID NO: 46887 - DNA, 19 bp, Artificial sequence
  synthetic polynucleotide sequence
gcagcctccagccaacaga

SEQ ID NO: 46888 - DNA, 19 bp, Artificial sequence
  synthetic polynucleotide sequence
gacaggggctagtcgcaca

SEQ ID NO: 46889 - DNA, 19 bp, Artificial sequence
  synthetic polynucleotide sequence
taggactggcagtaagaca

SEQ ID NO: 46890 - DNA, 18 bp, Artificial sequence
  synthetic polynucleotide sequence
cgagaacttcaggggcca

SEQ ID NO: 46891 - DNA, 18 bp, Artificial sequence
  synthetic polynucleotide sequence
agcccagtgtgtggcaga

SEQ ID NO: 46892 - DNA, 19 bp, Artificial sequence
  synthetic polynucleotide sequence
tagggagccgtcttcagga

SEQ ID NO: 46893 - DNA, 19 bp, Artificial sequence
  synthetic polynucleotide sequence
tcctgctcaactccccaca

SEQ ID NO: 46894 - DNA, 22 bp, Artificial sequence
  synthetic polynucleotide sequence
tggaccacagaaccctcagaca

SEQ ID NO: 46895 - DNA, 20 bp, Artificial sequence
  synthetic polynucleotide sequence
ccaggaccaacaggaccgga

SEQ ID NO: 46896 - DNA, 20 bp, Artificial sequence
  synthetic polynucleotide sequence
tgggagggacagggggagga

SEQ ID NO: 46897 - DNA, 18 bp, Artificial sequence
  synthetic polynucleotide sequence
cagtggcaagggtgcaga

SEQ ID NO: 46898 - DNA, 18 bp, Artificial sequence
  synthetic polynucleotide sequence
cctgcagctcgtgcacca

SEQ ID NO: 46899 - DNA, 18 bp, Artificial sequence
  synthetic polynucleotide sequence
ccaaccctagggaggcca

SEQ ID NO: 46900 - DNA, 18 bp, Artificial sequence
  synthetic polynucleotide sequence
ttgtcccacaccgaccga

SEQ ID NO: 46901 - DNA, 18 bp, Artificial sequence
  synthetic polynucleotide sequence
gccgcttcactcaggcca

SEQ ID NO: 46902 - DNA, 18 bp, Artificial sequence
  synthetic polynucleotide sequence
ggggcttgggagactcca

SEQ ID NO: 46903 - DNA, 25 bp, Artificial sequence
  synthetic polynucleotide sequence
tagcccagccgaagaaaaaggtcaa

SEQ ID NO: 46904 - DNA, 21 bp, Artificial sequence
  synthetic polynucleotide sequence
tgcatcgactagcagcaggaa

SEQ ID NO: 46905 - DNA, 20 bp, Artificial sequence
  synthetic polynucleotide sequence
taagatcctccgcgactgga

SEQ ID NO: 46906 - DNA, 19 bp, Artificial sequence
  synthetic polynucleotide sequence
caggtgggtggcatgggca

SEQ ID NO: 46907 - DNA, 18 bp, Artificial sequence
  synthetic polynucleotide sequence
tcccgtcaccctcaccaa

SEQ ID NO: 46908 - DNA, 18 bp, Artificial sequence
  synthetic polynucleotide sequence
cctggtcgcacaggcaca

SEQ ID NO: 46909 - DNA, 19 bp, Artificial sequence
  synthetic polynucleotide sequence
ggccgagaaggaggagaca

SEQ ID NO: 46910 - DNA, 18 bp, Artificial sequence
  synthetic polynucleotide sequence
acagagcaggaggcggca

SEQ ID NO: 46911 - DNA, 18 bp, Artificial sequence
  synthetic polynucleotide sequence
aggaacaggagcccagca

SEQ ID NO: 46912 - DNA, 19 bp, Artificial sequence
  synthetic polynucleotide sequence
ccagggacattgtggcaga

SEQ ID NO: 46913 - DNA, 21 bp, Artificial sequence
  synthetic polynucleotide sequence
tgaggagaggcaggtcatgga

SEQ ID NO: 46914 - DNA, 21 bp, Artificial sequence
  synthetic polynucleotide sequence
taacagagtttcccagcagca

SEQ ID NO: 46915 - DNA, 18 bp, Artificial sequence
  synthetic polynucleotide sequence
caaccttccaggcccaca

SEQ ID NO: 46916 - DNA, 18 bp, Artificial sequence
  synthetic polynucleotide sequence
tgcagcagagactgggca

SEQ ID NO: 46917 - DNA, 21 bp, Artificial sequence
  synthetic polynucleotide sequence
agggtcccggaaagagaggca

SEQ ID NO: 46918 - DNA, 19 bp, Artificial sequence
  synthetic polynucleotide sequence
ccagagacagcgaccccca

SEQ ID NO: 46919 - DNA, 22 bp, Artificial sequence
  synthetic polynucleotide sequence
attcaactggacctctacccga

SEQ ID NO: 46920 - DNA, 19 bp, Artificial sequence
  synthetic polynucleotide sequence
gccccagccacagtgacga

SEQ ID NO: 46921 - DNA, 19 bp, Artificial sequence
  synthetic polynucleotide sequence
gcaagtcgggtgcggagga

SEQ ID NO: 46922 - DNA, 18 bp, Artificial sequence
  synthetic polynucleotide sequence
ctgctcctccgcacccga

SEQ ID NO: 46923 - DNA, 20 bp, Artificial sequence
  synthetic polynucleotide sequence
gaagtgccagactcccgcca

SEQ ID NO: 46924 - DNA, 19 bp, Artificial sequence
  synthetic polynucleotide sequence
tgccagctcaggaacagca

SEQ ID NO: 46925 - DNA, 20 bp, Artificial sequence
  synthetic polynucleotide sequence
gtgcagccctaccaagacca

SEQ ID NO: 46926 - DNA, 18 bp, Artificial sequence
  synthetic polynucleotide sequence
cgctggatgcgtgaggca

SEQ ID NO: 46927 - DNA, 19 bp, Artificial sequence
  synthetic polynucleotide sequence
gcatgggtcggagtgggga

SEQ ID NO: 46928 - DNA, 20 bp, Artificial sequence
  synthetic polynucleotide sequence
tgtccgttaggctcggggaa

SEQ ID NO: 46929 - DNA, 21 bp, Artificial sequence
  synthetic polynucleotide sequence
ggcacctaagaggggagagga

SEQ ID NO: 46930 - DNA, 20 bp, Artificial sequence
  synthetic polynucleotide sequence
ggcgtgtacaggagactgga

SEQ ID NO: 46931 - DNA, 21 bp, Artificial sequence
  synthetic polynucleotide sequence
ctggagaagacgtgaagccca

SEQ ID NO: 46932 - DNA, 20 bp, Artificial sequence
  synthetic polynucleotide sequence
gtcggagccagtatcaggga

SEQ ID NO: 46933 - DNA, 22 bp, Artificial sequence
  synthetic polynucleotide sequence
catagcaggggaagagcaccta

SEQ ID NO: 46934 - DNA, 21 bp, Artificial sequence
  synthetic polynucleotide sequence
acaatgtaagcctggccacga

SEQ ID NO: 46935 - DNA, 22 bp, Artificial sequence
  synthetic polynucleotide sequence
gtagagacctaagggcgctgaa

SEQ ID NO: 46936 - DNA, 20 bp, Artificial sequence
  synthetic polynucleotide sequence
tagtggcacagcccgccgca

SEQ ID NO: 46937 - DNA, 21 bp, Artificial sequence
  synthetic polynucleotide sequence
agcccaagcagcacacggtca

SEQ ID NO: 46938 - DNA, 20 bp, Artificial sequence
  synthetic polynucleotide sequence
tgtggggtcctgaaaggcga

SEQ ID NO: 46939 - DNA, 20 bp, Artificial sequence
  synthetic polynucleotide sequence
cgcctcaagcccgacaccaa

SEQ ID NO: 46940 - DNA, 19 bp, Artificial sequence
  synthetic polynucleotide sequence
ggggctccttggcgaagga

SEQ ID NO: 46941 - DNA, 21 bp, Artificial sequence
  synthetic polynucleotide sequence
tgtgatcggcgagctagagga

SEQ ID NO: 46942 - DNA, 20 bp, Artificial sequence
  synthetic polynucleotide sequence
ctctcctgacaacagtccca

SEQ ID NO: 46943 - DNA, 21 bp, Artificial sequence
  synthetic polynucleotide sequence
aacacagctaccaggtgggca

SEQ ID NO: 46944 - DNA, 22 bp, Artificial sequence
  synthetic polynucleotide sequence
agcttggtcagtctcaaccgca

SEQ ID NO: 46945 - DNA, 20 bp, Artificial sequence
  synthetic polynucleotide sequence
caacagcccagacccttgga

SEQ ID NO: 46946 - DNA, 21 bp, Artificial sequence
  synthetic polynucleotide sequence
gcatccactgtggcaggtgca

SEQ ID NO: 46947 - DNA, 21 bp, Artificial sequence
  synthetic polynucleotide sequence
agtgggatcctagcagtcaca

SEQ ID NO: 46948 - DNA, 23 bp, Artificial sequence
  synthetic polynucleotide sequence
caatagtcagacgaagcagctga

SEQ ID NO: 46949 - DNA, 19 bp, Artificial sequence
  synthetic polynucleotide sequence
gcagcgctgtgtcaacaca

SEQ ID NO: 46950 - DNA, 19 bp, Artificial sequence
  synthetic polynucleotide sequence
gctggcactggtactcgca

SEQ ID NO: 46951 - DNA, 18 bp, Artificial sequence
  synthetic polynucleotide sequence
actcgtgcccaatcccga

SEQ ID NO: 46952 - DNA, 21 bp, Artificial sequence
  synthetic polynucleotide sequence
taacctacagcgagtccagga

SEQ ID NO: 46953 - DNA, 20 bp, Artificial sequence
  synthetic polynucleotide sequence
cactgtgaggacctggacga

SEQ ID NO: 46954 - DNA, 18 bp, Artificial sequence
  synthetic polynucleotide sequence
ggcaggcagtggaagcca

SEQ ID NO: 46955 - DNA, 18 bp, Artificial sequence
  synthetic polynucleotide sequence
gggatgggcatcaggaca

SEQ ID NO: 46956 - DNA, 18 bp, Artificial sequence
  synthetic polynucleotide sequence
attgggtaccaggcggca

SEQ ID NO: 46957 - DNA, 18 bp, Artificial sequence
  synthetic polynucleotide sequence
ctgcccagagaacgcaga

SEQ ID NO: 46958 - DNA, 19 bp, Artificial sequence
  synthetic polynucleotide sequence
cctggttcaggaccaccca

SEQ ID NO: 46959 - DNA, 18 bp, Artificial sequence
  synthetic polynucleotide sequence
cccaaatggcagtcccca

SEQ ID NO: 46960 - DNA, 19 bp, Artificial sequence
  synthetic polynucleotide sequence
gatctcggtcaggaacgca

SEQ ID NO: 46961 - DNA, 20 bp, Artificial sequence
  synthetic polynucleotide sequence
tgagaaccttgcccagccca

SEQ ID NO: 46962 - DNA, 22 bp, Artificial sequence
  synthetic polynucleotide sequence
atgcaggaggagtgatctccca

SEQ ID NO: 46963 - DNA, 21 bp, Artificial sequence
  synthetic polynucleotide sequence
ggcccttacctggaaggacca

SEQ ID NO: 46964 - DNA, 18 bp, Artificial sequence
  synthetic polynucleotide sequence
cccccagccatcattgca

SEQ ID NO: 46965 - DNA, 19 bp, Artificial sequence
  synthetic polynucleotide sequence
gagcccttcgaggtgcgca

SEQ ID NO: 46966 - DNA, 18 bp, Artificial sequence
  synthetic polynucleotide sequence
gcagctcagggggctcca

SEQ ID NO: 46967 - DNA, 20 bp, Artificial sequence
  synthetic polynucleotide sequence
tgttggctgccacaccagga

SEQ ID NO: 46968 - DNA, 22 bp, Artificial sequence
  synthetic polynucleotide sequence
catattcaagcggcccacagga

SEQ ID NO: 46969 - DNA, 21 bp, Artificial sequence
  synthetic polynucleotide sequence
gcctagactctgagcctggga

SEQ ID NO: 46970 - DNA, 21 bp, Artificial sequence
  synthetic polynucleotide sequence
cactgtggctatggggagaga

SEQ ID NO: 46971 - DNA, 22 bp, Artificial sequence
  synthetic polynucleotide sequence
tgatcgcgtatggacagagtga

SEQ ID NO: 46972 - DNA, 19 bp, Artificial sequence
  synthetic polynucleotide sequence
tccgtcaaagcctggggga

SEQ ID NO: 46973 - DNA, 21 bp, Artificial sequence
  synthetic polynucleotide sequence
ccccagaggaggtagctgaca

SEQ ID NO: 46974 - DNA, 21 bp, Artificial sequence
  synthetic polynucleotide sequence
agaggccaccatcagaagcca

SEQ ID NO: 46975 - DNA, 18 bp, Artificial sequence
  synthetic polynucleotide sequence
cgtggcagtgaaccgcaa

SEQ ID NO: 46976 - DNA, 19 bp, Artificial sequence
  synthetic polynucleotide sequence
cagagccagagagcagcca

SEQ ID NO: 46977 - DNA, 21 bp, Artificial sequence
  synthetic polynucleotide sequence
agacaagggaacacatgccca

SEQ ID NO: 46978 - DNA, 20 bp, Artificial sequence
  synthetic polynucleotide sequence
gtctcagggctctccaacca

SEQ ID NO: 46979 - DNA, 22 bp, Artificial sequence
  synthetic polynucleotide sequence
gaaagggaacaaaaacgccgca

SEQ ID NO: 46980 - DNA, 21 bp, Artificial sequence
  synthetic polynucleotide sequence
ctcttggacagtggtggagga

SEQ ID NO: 46981 - DNA, 19 bp, Artificial sequence
  synthetic polynucleotide sequence
ttgccacaggaagtgcaga

SEQ ID NO: 46982 - DNA, 18 bp, Artificial sequence
  synthetic polynucleotide sequence
ccgatgctgacgccagca

SEQ ID NO: 46983 - DNA, 18 bp, Artificial sequence
  synthetic polynucleotide sequence
cgaaaggggcacagccaa

SEQ ID NO: 46984 - DNA, 20 bp, Artificial sequence
  synthetic polynucleotide sequence
aacatccagcagcacacaca

SEQ ID NO: 46985 - DNA, 21 bp, Artificial sequence
  synthetic polynucleotide sequence
tccgatcctccacacccacca

SEQ ID NO: 46986 - DNA, 20 bp, Artificial sequence
  synthetic polynucleotide sequence
gtgaagacatccacccggca

SEQ ID NO: 46987 - DNA, 20 bp, Artificial sequence
  synthetic polynucleotide sequence
tatacggaagcgtctcctca

SEQ ID NO: 46988 - DNA, 21 bp, Artificial sequence
  synthetic polynucleotide sequence
ttcctgggacccagagttgca

SEQ ID NO: 46989 - DNA, 19 bp, Artificial sequence
  synthetic polynucleotide sequence
gtcccggcaggccaacaca

SEQ ID NO: 46990 - DNA, 20 bp, Artificial sequence
  synthetic polynucleotide sequence
cgtcgtagccacctgccaga

SEQ ID NO: 46991 - DNA, 18 bp, Artificial sequence
  synthetic polynucleotide sequence
aggctccctgccacccaa

SEQ ID NO: 46992 - DNA, 18 bp, Artificial sequence
  synthetic polynucleotide sequence
ggtgggcgttggagcaga

SEQ ID NO: 46993 - DNA, 18 bp, Artificial sequence
  synthetic polynucleotide sequence
cagcttggtgaagcggga

SEQ ID NO: 46994 - DNA, 18 bp, Artificial sequence
  synthetic polynucleotide sequence
accgctcgggcatggaga

SEQ ID NO: 46995 - DNA, 18 bp, Artificial sequence
  synthetic polynucleotide sequence
tgagcaggaggcagccaa

SEQ ID NO: 46996 - DNA, 20 bp, Artificial sequence
  synthetic polynucleotide sequence
caaggcggagatcaacagga

SEQ ID NO: 46997 - DNA, 18 bp, Artificial sequence
  synthetic polynucleotide sequence
gggtggtgtcagacgcca

SEQ ID NO: 46998 - DNA, 18 bp, Artificial sequence
  synthetic polynucleotide sequence
caggcaagccccgggcga

SEQ ID NO: 46999 - DNA, 20 bp, Artificial sequence
  synthetic polynucleotide sequence
gaaccgcagagacagaggaa

SEQ ID NO: 47000 - DNA, 20 bp, Artificial sequence
  synthetic polynucleotide sequence
atggaggctggagaagtgca

SEQ ID NO: 47001 - DNA, 20 bp, Artificial sequence
  synthetic polynucleotide sequence
cctcagagtcgaggtgccca

SEQ ID NO: 47002 - DNA, 19 bp, Artificial sequence
  synthetic polynucleotide sequence
ttcctcaagggctgcccca

SEQ ID NO: 47003 - DNA, 19 bp, Artificial sequence
  synthetic polynucleotide sequence
ggaacaaccggccggcaga

SEQ ID NO: 47004 - DNA, 20 bp, Artificial sequence
  synthetic polynucleotide sequence
ccgctcccacactcgatgga

SEQ ID NO: 47005 - DNA, 20 bp, Artificial sequence
  synthetic polynucleotide sequence
cagcatctgtgcccagagca

SEQ ID NO: 47006 - DNA, 22 bp, Artificial sequence
  synthetic polynucleotide sequence
gacaccacactgttcgggaaga

SEQ ID NO: 47007 - DNA, 21 bp, Artificial sequence
  synthetic polynucleotide sequence
tgcagctggacgtgtcgagga

SEQ ID NO: 47008 - DNA, 22 bp, Artificial sequence
  synthetic polynucleotide sequence
taaatggcagtctcctgggcaa

SEQ ID NO: 47009 - DNA, 21 bp, Artificial sequence
  synthetic polynucleotide sequence
ggtcaccttccgagacaccta

SEQ ID NO: 47010 - DNA, 20 bp, Artificial sequence
  synthetic polynucleotide sequence
ctaagacacctgctgctcca

SEQ ID NO: 47011 - DNA, 21 bp, Artificial sequence
  synthetic polynucleotide sequence
gaagcgcaaaggcaaggctca

SEQ ID NO: 47012 - DNA, 20 bp, Artificial sequence
  synthetic polynucleotide sequence
ctgtaggcctcctccacgca

SEQ ID NO: 47013 - DNA, 18 bp, Artificial sequence
  synthetic polynucleotide sequence
atagcgtgggcaatggca

SEQ ID NO: 47014 - DNA, 20 bp, Artificial sequence
  synthetic polynucleotide sequence
gtgagtcgctgacatcagca

SEQ ID NO: 47015 - DNA, 21 bp, Artificial sequence
  synthetic polynucleotide sequence
actgaagagagtctccaccga

SEQ ID NO: 47016 - DNA, 21 bp, Artificial sequence
  synthetic polynucleotide sequence
gtattgccccagttccacaca

SEQ ID NO: 47017 - DNA, 21 bp, Artificial sequence
  synthetic polynucleotide sequence
gacccgtgagacaaagaagca

SEQ ID NO: 47018 - DNA, 21 bp, Artificial sequence
  synthetic polynucleotide sequence
tgaaggcggataagtagagga

SEQ ID NO: 47019 - DNA, 22 bp, Artificial sequence
  synthetic polynucleotide sequence
gaggacaaccctaagtggtcca

SEQ ID NO: 47020 - DNA, 22 bp, Artificial sequence
  synthetic polynucleotide sequence
ctctggcgagtgaagagaacca

SEQ ID NO: 47021 - DNA, 23 bp, Artificial sequence
  synthetic polynucleotide sequence
gataaatcccgtgcaacagcaga

SEQ ID NO: 47022 - DNA, 20 bp, Artificial sequence
  synthetic polynucleotide sequence
atgcaggaacttgccaacca

SEQ ID NO: 47023 - DNA, 20 bp, Artificial sequence
  synthetic polynucleotide sequence
ggtgaggagagccgggtcca

SEQ ID NO: 47024 - DNA, 20 bp, Artificial sequence
  synthetic polynucleotide sequence
ggaggtgcggatggtccaca

SEQ ID NO: 47025 - DNA, 18 bp, Artificial sequence
  synthetic polynucleotide sequence
atggcaaatgggtggcaa

SEQ ID NO: 47026 - DNA, 18 bp, Artificial sequence
  synthetic polynucleotide sequence
ccttggggaggctgagca

SEQ ID NO: 47027 - DNA, 21 bp, Artificial sequence
  synthetic polynucleotide sequence
ccagaacccgaagcagcagca

SEQ ID NO: 47028 - DNA, 20 bp, Artificial sequence
  synthetic polynucleotide sequence
ctccgcatcggtcagggcga

SEQ ID NO: 47029 - DNA, 21 bp, Artificial sequence
  synthetic polynucleotide sequence
gaaaggaggagagcagcccaa

SEQ ID NO: 47030 - DNA, 21 bp, Artificial sequence
  synthetic polynucleotide sequence
tgtcaagggactggtgacgga

SEQ ID NO: 47031 - DNA, 20 bp, Artificial sequence
  synthetic polynucleotide sequence
ctgcaggacgccatagacca

SEQ ID NO: 47032 - DNA, 18 bp, Artificial sequence
  synthetic polynucleotide sequence
gtgcaggctcaggcgaca

SEQ ID NO: 47033 - DNA, 20 bp, Artificial sequence
  synthetic polynucleotide sequence
gatgaagccctcagagtcca

SEQ ID NO: 47034 - DNA, 21 bp, Artificial sequence
  synthetic polynucleotide sequence
catgcagacccatttacagca

SEQ ID NO: 47035 - DNA, 21 bp, Artificial sequence
  synthetic polynucleotide sequence
taaagactggcccaggaggaa

SEQ ID NO: 47036 - DNA, 20 bp, Artificial sequence
  synthetic polynucleotide sequence
ctggtctgggagctggcaca

SEQ ID NO: 47037 - DNA, 20 bp, Artificial sequence
  synthetic polynucleotide sequence
ggccctctcagactccgaga

SEQ ID NO: 47038 - DNA, 18 bp, Artificial sequence
  synthetic polynucleotide sequence
gccacctgcacctccaca

SEQ ID NO: 47039 - DNA, 22 bp, Artificial sequence
  synthetic polynucleotide sequence
tgatggagaaggaagatggcga

SEQ ID NO: 47040 - DNA, 21 bp, Artificial sequence
  synthetic polynucleotide sequence
aactgctttgggaggagcaga

SEQ ID NO: 47041 - DNA, 19 bp, Artificial sequence
  synthetic polynucleotide sequence
gtccccctgagcaccgtca

SEQ ID NO: 47042 - DNA, 22 bp, Artificial sequence
  synthetic polynucleotide sequence
taaatcaggggtgaagggctga

SEQ ID NO: 47043 - DNA, 22 bp, Artificial sequence
  synthetic polynucleotide sequence
ttcagacagcggtattccagga

SEQ ID NO: 47044 - DNA, 20 bp, Artificial sequence
  synthetic polynucleotide sequence
ctcagagtggctggtaagga

SEQ ID NO: 47045 - DNA, 21 bp, Artificial sequence
  synthetic polynucleotide sequence
caaagcccggatgacagcaca

SEQ ID NO: 47046 - DNA, 21 bp, Artificial sequence
  synthetic polynucleotide sequence
ccttgatccatgggctgcaga

SEQ ID NO: 47047 - DNA, 22 bp, Artificial sequence
  synthetic polynucleotide sequence
atcgtcaggctggctaactcga

SEQ ID NO: 47048 - DNA, 21 bp, Artificial sequence
  synthetic polynucleotide sequence
tctgcttgacctacacccaga

SEQ ID NO: 47049 - DNA, 21 bp, Artificial sequence
  synthetic polynucleotide sequence
tgccatccaaagcgagaggga

SEQ ID NO: 47050 - DNA, 20 bp, Artificial sequence
  synthetic polynucleotide sequence
tccaggtccacaaagcggga

SEQ ID NO: 47051 - DNA, 21 bp, Artificial sequence
  synthetic polynucleotide sequence
ggagggctgtaaccccagaga

SEQ ID NO: 47052 - DNA, 22 bp, Artificial sequence
  synthetic polynucleotide sequence
caaatcatcatccagggcagca

SEQ ID NO: 47053 - DNA, 19 bp, Artificial sequence
  synthetic polynucleotide sequence
gcgaggacagtgctgggca

SEQ ID NO: 47054 - DNA, 21 bp, Artificial sequence
  synthetic polynucleotide sequence
atcatcgtccaggtgcagcca

SEQ ID NO: 47055 - DNA, 21 bp, Artificial sequence
  synthetic polynucleotide sequence
gccaggatgaagagggcggaa

SEQ ID NO: 47056 - DNA, 21 bp, Artificial sequence
  synthetic polynucleotide sequence
cagcagtacagttggagggca

SEQ ID NO: 47057 - DNA, 22 bp, Artificial sequence
  synthetic polynucleotide sequence
gaaagaggacaacgggagccaa

SEQ ID NO: 47058 - DNA, 19 bp, Artificial sequence
  synthetic polynucleotide sequence
tcgcccaaaacaccgtgca

SEQ ID NO: 47059 - DNA, 18 bp, Artificial sequence
  synthetic polynucleotide sequence
aggaggaatggagcccca

SEQ ID NO: 47060 - DNA, 18 bp, Artificial sequence
  synthetic polynucleotide sequence
gtcatgcagctcggcaca

SEQ ID NO: 47061 - DNA, 21 bp, Artificial sequence
  synthetic polynucleotide sequence
caaccggaacaccactccaga

SEQ ID NO: 47062 - DNA, 21 bp, Artificial sequence
  synthetic polynucleotide sequence
ccttccttagaaggctcggga

SEQ ID NO: 47063 - DNA, 20 bp, Artificial sequence
  synthetic polynucleotide sequence
ctgcctgaggaagacagcga

SEQ ID NO: 47064 - DNA, 18 bp, Artificial sequence
  synthetic polynucleotide sequence
tggaacggcctgggagca

SEQ ID NO: 47065 - DNA, 18 bp, Artificial sequence
  synthetic polynucleotide sequence
cagtgcctgccaccggaa

SEQ ID NO: 47066 - DNA, 20 bp, Artificial sequence
  synthetic polynucleotide sequence
cttagagacacatcggtcca

SEQ ID NO: 47067 - DNA, 22 bp, Artificial sequence
  synthetic polynucleotide sequence
atccattccaaccaccgcctca

SEQ ID NO: 47068 - DNA, 20 bp, Artificial sequence
  synthetic polynucleotide sequence
tgcctgatggagagacccca

SEQ ID NO: 47069 - DNA, 18 bp, Artificial sequence
  synthetic polynucleotide sequence
cgtggccaacgcgcagga

SEQ ID NO: 47070 - DNA, 18 bp, Artificial sequence
  synthetic polynucleotide sequence
ttgtccagggagccccca

SEQ ID NO: 47071 - DNA, 22 bp, Artificial sequence
  synthetic polynucleotide sequence
aaccagggctccacagttagga

SEQ ID NO: 47072 - DNA, 18 bp, Artificial sequence
  synthetic polynucleotide sequence
gctcccgttaaggcacca

SEQ ID NO: 47073 - DNA, 21 bp, Artificial sequence
  synthetic polynucleotide sequence
gggcaaggaggatccctggaa

SEQ ID NO: 47074 - DNA, 21 bp, Artificial sequence
  synthetic polynucleotide sequence
ctgtgtagcgagtgaggagga

SEQ ID NO: 47075 - DNA, 21 bp, Artificial sequence
  synthetic polynucleotide sequence
cgtgcttgaagactgagccca

SEQ ID NO: 47076 - DNA, 19 bp, Artificial sequence
  synthetic polynucleotide sequence
ctcggtccctgcgtccaga

SEQ ID NO: 47077 - DNA, 21 bp, Artificial sequence
  synthetic polynucleotide sequence
cagccaagagtgaggagcaga

SEQ ID NO: 47078 - DNA, 21 bp, Artificial sequence
  synthetic polynucleotide sequence
atgccagcggtaaacacccca

SEQ ID NO: 47079 - DNA, 22 bp, Artificial sequence
  synthetic polynucleotide sequence
gatacctcgtgcaggatacaga

SEQ ID NO: 47080 - DNA, 20 bp, Artificial sequence
  synthetic polynucleotide sequence
accaaacgcagcccctgtca

SEQ ID NO: 47081 - DNA, 21 bp, Artificial sequence
  synthetic polynucleotide sequence
ggaagcggcgacaaaaccaca

SEQ ID NO: 47082 - DNA, 21 bp, Artificial sequence
  synthetic polynucleotide sequence
ggccagctcaaatctgcccca

SEQ ID NO: 47083 - DNA, 20 bp, Artificial sequence
  synthetic polynucleotide sequence
gtcaggaaccccaaaggcga

SEQ ID NO: 47084 - DNA, 20 bp, Artificial sequence
  synthetic polynucleotide sequence
gagatgtccaggagccgcca

SEQ ID NO: 47085 - DNA, 20 bp, Artificial sequence
  synthetic polynucleotide sequence
gagcactatgccctggagga

SEQ ID NO: 47086 - DNA, 18 bp, Artificial sequence
  synthetic polynucleotide sequence
caagcggctggtgaggga

SEQ ID NO: 47087 - DNA, 20 bp, Artificial sequence
  synthetic polynucleotide sequence
gtggacccgcagttgcagca

SEQ ID NO: 47088 - DNA, 21 bp, Artificial sequence
  synthetic polynucleotide sequence
acaaaacaggcctcagcccga

SEQ ID NO: 47089 - DNA, 18 bp, Artificial sequence
  synthetic polynucleotide sequence
cgagcagcagaaggcgca

SEQ ID NO: 47090 - DNA, 20 bp, Artificial sequence
  synthetic polynucleotide sequence
aagcggtctacacagctgga

SEQ ID NO: 47091 - DNA, 18 bp, Artificial sequence
  synthetic polynucleotide sequence
ctggcagccaaagcagga

SEQ ID NO: 47092 - DNA, 21 bp, Artificial sequence
  synthetic polynucleotide sequence
gtggctactgctttcagggga

SEQ ID NO: 47093 - DNA, 20 bp, Artificial sequence
  synthetic polynucleotide sequence
tacccggaatctggatggga

SEQ ID NO: 47094 - DNA, 19 bp, Artificial sequence
  synthetic polynucleotide sequence
tcccccatacacccagcca

SEQ ID NO: 47095 - DNA, 21 bp, Artificial sequence
  synthetic polynucleotide sequence
ccggggcttcaccaagaccta

SEQ ID NO: 47096 - DNA, 18 bp, Artificial sequence
  synthetic polynucleotide sequence
tggctcccgaggcaggca

SEQ ID NO: 47097 - DNA, 18 bp, Artificial sequence
  synthetic polynucleotide sequence
gggacggcaagatgcaca

SEQ ID NO: 47098 - DNA, 18 bp, Artificial sequence
  synthetic polynucleotide sequence
gcacgggatcatggggca

SEQ ID NO: 47099 - DNA, 19 bp, Artificial sequence
  synthetic polynucleotide sequence
gagaggtgggaccagctca

SEQ ID NO: 47100 - DNA, 19 bp, Artificial sequence
  synthetic polynucleotide sequence
tggagagcatgtcggtcca

SEQ ID NO: 47101 - DNA, 18 bp, Artificial sequence
  synthetic polynucleotide sequence
catcgagccctgggagga

SEQ ID NO: 47102 - DNA, 19 bp, Artificial sequence
  synthetic polynucleotide sequence
ttggcagccacagttcaga

SEQ ID NO: 47103 - DNA, 21 bp, Artificial sequence
  synthetic polynucleotide sequence
gtggctgctgaccgaatagca

SEQ ID NO: 47104 - DNA, 21 bp, Artificial sequence
  synthetic polynucleotide sequence
ctcaggtaccaccaagcccta

SEQ ID NO: 47105 - DNA, 18 bp, Artificial sequence
  synthetic polynucleotide sequence
tgatgcacagccgagcca

SEQ ID NO: 47106 - DNA, 18 bp, Artificial sequence
  synthetic polynucleotide sequence
agggcttggacagggcca

SEQ ID NO: 47107 - DNA, 18 bp, Artificial sequence
  synthetic polynucleotide sequence
gcctcgaagctgcaggaa

SEQ ID NO: 47108 - DNA, 18 bp, Artificial sequence
  synthetic polynucleotide sequence
agccaccccatgtccaca

SEQ ID NO: 47109 - DNA, 21 bp, Artificial sequence
  synthetic polynucleotide sequence
ccacaccagctcacttccaga

SEQ ID NO: 47110 - DNA, 20 bp, Artificial sequence
  synthetic polynucleotide sequence
caaacacgaggtcaagggaa

SEQ ID NO: 47111 - DNA, 23 bp, Artificial sequence
  synthetic polynucleotide sequence
gaagaggaaacactgctggacca

SEQ ID NO: 47112 - DNA, 20 bp, Artificial sequence
  synthetic polynucleotide sequence
acgccaagcttgcaggacga

SEQ ID NO: 47113 - DNA, 20 bp, Artificial sequence
  synthetic polynucleotide sequence
gacggcgtccaagacccaca

SEQ ID NO: 47114 - DNA, 21 bp, Artificial sequence
  synthetic polynucleotide sequence
caaagccagacccatgctgga

SEQ ID NO: 47115 - DNA, 18 bp, Artificial sequence
  synthetic polynucleotide sequence
ctgcaactccgggatgca

SEQ ID NO: 47116 - DNA, 18 bp, Artificial sequence
  synthetic polynucleotide sequence
ggcccgacagcaggggga

SEQ ID NO: 47117 - DNA, 20 bp, Artificial sequence
  synthetic polynucleotide sequence
gccctgtgagctacaggaca

SEQ ID NO: 47118 - DNA, 22 bp, Artificial sequence
  synthetic polynucleotide sequence
aatgactgaggtaggcaccaca

SEQ ID NO: 47119 - DNA, 18 bp, Artificial sequence
  synthetic polynucleotide sequence
tctgccgggacaacagca

SEQ ID NO: 47120 - DNA, 21 bp, Artificial sequence
  synthetic polynucleotide sequence
gatcacagtgtggtaagcgca

SEQ ID NO: 47121 - DNA, 18 bp, Artificial sequence
  synthetic polynucleotide sequence
tgatgccgaggaggagga

SEQ ID NO: 47122 - DNA, 18 bp, Artificial sequence
  synthetic polynucleotide sequence
gtcccggtatcgggcaga

SEQ ID NO: 47123 - DNA, 20 bp, Artificial sequence
  synthetic polynucleotide sequence
ggctccaatgctcgggccga

SEQ ID NO: 47124 - DNA, 20 bp, Artificial sequence
  synthetic polynucleotide sequence
agcggccctgtcgggtcaga

SEQ ID NO: 47125 - DNA, 18 bp, Artificial sequence
  synthetic polynucleotide sequence
aggcatcgacgaggggca

SEQ ID NO: 47126 - DNA, 18 bp, Artificial sequence
  synthetic polynucleotide sequence
cttcccggaagcactcca

SEQ ID NO: 47127 - DNA, 18 bp, Artificial sequence
  synthetic polynucleotide sequence
gaaatgtccgtggccaca

SEQ ID NO: 47128 - DNA, 18 bp, Artificial sequence
  synthetic polynucleotide sequence
ccagcatggtgagctgca

SEQ ID NO: 47129 - DNA, 18 bp, Artificial sequence
  synthetic polynucleotide sequence
ggccagagcaatccagga

SEQ ID NO: 47130 - DNA, 19 bp, Artificial sequence
  synthetic polynucleotide sequence
cgcagtcaggaacaggcca

SEQ ID NO: 47131 - DNA, 18 bp, Artificial sequence
  synthetic polynucleotide sequence
ccatcaagcccctggaca

SEQ ID NO: 47132 - DNA, 21 bp, Artificial sequence
  synthetic polynucleotide sequence
cgcccactactgcactggaca

SEQ ID NO: 47133 - DNA, 18 bp, Artificial sequence
  synthetic polynucleotide sequence
caaggtggcatcggggaa

SEQ ID NO: 47134 - DNA, 18 bp, Artificial sequence
  synthetic polynucleotide sequence
tcccgacactgccagcga

SEQ ID NO: 47135 - DNA, 18 bp, Artificial sequence
  synthetic polynucleotide sequence
gccgccaataccaaggga

SEQ ID NO: 47136 - DNA, 18 bp, Artificial sequence
  synthetic polynucleotide sequence
cattgacaccgtggcgga

SEQ ID NO: 47137 - DNA, 21 bp, Artificial sequence
  synthetic polynucleotide sequence
cacacacacgggctacaacga

SEQ ID NO: 47138 - DNA, 22 bp, Artificial sequence
  synthetic polynucleotide sequence
atcaacatccacccaaagccca

SEQ ID NO: 47139 - DNA, 20 bp, Artificial sequence
  synthetic polynucleotide sequence
ccccagctcctggactccca

SEQ ID NO: 47140 - DNA, 25 bp, Artificial sequence
  synthetic polynucleotide sequence
gaggacagtgattcaacagcaggaa

SEQ ID NO: 47141 - DNA, 18 bp, Artificial sequence
  synthetic polynucleotide sequence
gccacacagacggagcca

SEQ ID NO: 47142 - DNA, 18 bp, Artificial sequence
  synthetic polynucleotide sequence
acgtgcagcacctccaca

SEQ ID NO: 47143 - DNA, 22 bp, Artificial sequence
  synthetic polynucleotide sequence
atggagagtagcaacgtggaga

SEQ ID NO: 47144 - DNA, 20 bp, Artificial sequence
  synthetic polynucleotide sequence
accaccgtccgcaggaggca

SEQ ID NO: 47145 - DNA, 19 bp, Artificial sequence
  synthetic polynucleotide sequence
gccgacagctacagcagca

SEQ ID NO: 47146 - DNA, 18 bp, Artificial sequence
  synthetic polynucleotide sequence
acttgccgcagtaggcga

SEQ ID NO: 47147 - DNA, 18 bp, Artificial sequence
  synthetic polynucleotide sequence
cccacgcatcaaggcaga

SEQ ID NO: 47148 - DNA, 18 bp, Artificial sequence
  synthetic polynucleotide sequence
gcagatcccacacagcga

SEQ ID NO: 47149 - DNA, 21 bp, Artificial sequence
  synthetic polynucleotide sequence
agtggtgggcaagcgttggaa

SEQ ID NO: 47150 - DNA, 20 bp, Artificial sequence
  synthetic polynucleotide sequence
cccggagcctgtgacaacga

SEQ ID NO: 47151 - DNA, 18 bp, Artificial sequence
  synthetic polynucleotide sequence
cagctggcaaatgaccca

SEQ ID NO: 47152 - DNA, 20 bp, Artificial sequence
  synthetic polynucleotide sequence
gaagaagggggtgtagggga

SEQ ID NO: 47153 - DNA, 18 bp, Artificial sequence
  synthetic polynucleotide sequence
cgatgcttggcctaccga

SEQ ID NO: 47154 - DNA, 18 bp, Artificial sequence
  synthetic polynucleotide sequence
gccccagaggttgatgca

SEQ ID NO: 47155 - DNA, 22 bp, Artificial sequence
  synthetic polynucleotide sequence
ccatgaggcactgggaaaagca

SEQ ID NO: 47156 - DNA, 20 bp, Artificial sequence
  synthetic polynucleotide sequence
cctcgccgacctacatagga

SEQ ID NO: 47157 - DNA, 20 bp, Artificial sequence
  synthetic polynucleotide sequence
cgtcggctgcccagagagaa

SEQ ID NO: 47158 - DNA, 20 bp, Artificial sequence
  synthetic polynucleotide sequence
cagccaccatccgggcagca

SEQ ID NO: 47159 - DNA, 21 bp, Artificial sequence
  synthetic polynucleotide sequence
caatgcctccgttcagggaca

SEQ ID NO: 47160 - DNA, 21 bp, Artificial sequence
  synthetic polynucleotide sequence
atctgagcaatgccccccaca

SEQ ID NO: 47161 - DNA, 18 bp, Artificial sequence
  synthetic polynucleotide sequence
gctggaacccattccgca

SEQ ID NO: 47162 - DNA, 20 bp, Artificial sequence
  synthetic polynucleotide sequence
gctgcccttaagttagccca

SEQ ID NO: 47163 - DNA, 19 bp, Artificial sequence
  synthetic polynucleotide sequence
cagccacaacgacactgga

SEQ ID NO: 47164 - DNA, 22 bp, Artificial sequence
  synthetic polynucleotide sequence
tctaaatacctgagacctgcca

SEQ ID NO: 47165 - DNA, 18 bp, Artificial sequence
  synthetic polynucleotide sequence
gcagcaagcactggccaa

SEQ ID NO: 47166 - DNA, 18 bp, Artificial sequence
  synthetic polynucleotide sequence
ccgtgagcaggatcagca

SEQ ID NO: 47167 - DNA, 19 bp, Artificial sequence
  synthetic polynucleotide sequence
cacaggccaggaatggaga

SEQ ID NO: 47168 - DNA, 18 bp, Artificial sequence
  synthetic polynucleotide sequence
aggcttgggaccaaggca

SEQ ID NO: 47169 - DNA, 20 bp, Artificial sequence
  synthetic polynucleotide sequence
tggatcaaggaccagaggca

SEQ ID NO: 47170 - DNA, 18 bp, Artificial sequence
  synthetic polynucleotide sequence
tgcagccagcaagaagca

SEQ ID NO: 47171 - DNA, 22 bp, Artificial sequence
  synthetic polynucleotide sequence
caggtcctcaacaccactgaga

SEQ ID NO: 47172 - DNA, 20 bp, Artificial sequence
  synthetic polynucleotide sequence
ctggctcccgagctccagca

SEQ ID NO: 47173 - DNA, 22 bp, Artificial sequence
  synthetic polynucleotide sequence
ctaaagacccagctgtgaccga

SEQ ID NO: 47174 - DNA, 21 bp, Artificial sequence
  synthetic polynucleotide sequence
aactggctgccctggtaacca

SEQ ID NO: 47175 - DNA, 20 bp, Artificial sequence
  synthetic polynucleotide sequence
ctgccaagctccctacgcaa

SEQ ID NO: 47176 - DNA, 20 bp, Artificial sequence
  synthetic polynucleotide sequence
gggcattgaagcacctcgga

SEQ ID NO: 47177 - DNA, 22 bp, Artificial sequence
  synthetic polynucleotide sequence
tggcagactgggtgtacaacga

SEQ ID NO: 47178 - DNA, 18 bp, Artificial sequence
  synthetic polynucleotide sequence
gcggctgccatagaccga

SEQ ID NO: 47179 - DNA, 21 bp, Artificial sequence
  synthetic polynucleotide sequence
ccggtgtcacatagggacaga

SEQ ID NO: 47180 - DNA, 20 bp, Artificial sequence
  synthetic polynucleotide sequence
ccctaactccactgggccca

SEQ ID NO: 47181 - DNA, 21 bp, Artificial sequence
  synthetic polynucleotide sequence
gagcctcaacgactccatcca

SEQ ID NO: 47182 - DNA, 20 bp, Artificial sequence
  synthetic polynucleotide sequence
ccagggaggtgacagcggga

SEQ ID NO: 47183 - DNA, 21 bp, Artificial sequence
  synthetic polynucleotide sequence
cgaggacctcaaagtgggaca

SEQ ID NO: 47184 - DNA, 23 bp, Artificial sequence
  synthetic polynucleotide sequence
aaaaagagacaatgcgactgcca

SEQ ID NO: 47185 - DNA, 18 bp, Artificial sequence
  synthetic polynucleotide sequence
cggtcaggcctacagcga

SEQ ID NO: 47186 - DNA, 22 bp, Artificial sequence
  synthetic polynucleotide sequence
tagaaaggtcctaggactggca

SEQ ID NO: 47187 - DNA, 18 bp, Artificial sequence
  synthetic polynucleotide sequence
ctgcacggtgcgggacca

SEQ ID NO: 47188 - DNA, 18 bp, Artificial sequence
  synthetic polynucleotide sequence
ccaggccaccgaagctga

SEQ ID NO: 47189 - DNA, 20 bp, Artificial sequence
  synthetic polynucleotide sequence
gtgcactgaacccaagcaca

SEQ ID NO: 47190 - DNA, 20 bp, Artificial sequence
  synthetic polynucleotide sequence
tgctgttggtgagagcagca

SEQ ID NO: 47191 - DNA, 21 bp, Artificial sequence
  synthetic polynucleotide sequence
tccaagggccatattgccgca

SEQ ID NO: 47192 - DNA, 21 bp, Artificial sequence
  synthetic polynucleotide sequence
tgtgcaggttccaggcactga

SEQ ID NO: 47193 - DNA, 21 bp, Artificial sequence
  synthetic polynucleotide sequence
accatggcgagtggctggaga

SEQ ID NO: 47194 - DNA, 21 bp, Artificial sequence
  synthetic polynucleotide sequence
acagacagccaaggaaaccga

SEQ ID NO: 47195 - DNA, 22 bp, Artificial sequence
  synthetic polynucleotide sequence
atgacaacgaccacctttccca

SEQ ID NO: 47196 - DNA, 23 bp, Artificial sequence
  synthetic polynucleotide sequence
gataaacgagtatccagctccca

SEQ ID NO: 47197 - DNA, 20 bp, Artificial sequence
  synthetic polynucleotide sequence
atgaacggcgagtggggcta

SEQ ID NO: 47198 - DNA, 21 bp, Artificial sequence
  synthetic polynucleotide sequence
agagcgtcacattccagggga

SEQ ID NO: 47199 - DNA, 20 bp, Artificial sequence
  synthetic polynucleotide sequence
taccagcgtggtgaacctca

SEQ ID NO: 47200 - DNA, 21 bp, Artificial sequence
  synthetic polynucleotide sequence
ctatggctgccaccatcacca

SEQ ID NO: 47201 - DNA, 21 bp, Artificial sequence
  synthetic polynucleotide sequence
cctgcgcacacccttcaccta

SEQ ID NO: 47202 - DNA, 20 bp, Artificial sequence
  synthetic polynucleotide sequence
tggtggaagaatgcgggcca

SEQ ID NO: 47203 - DNA, 21 bp, Artificial sequence
  synthetic polynucleotide sequence
gagaccatctctacagccaca

SEQ ID NO: 47204 - DNA, 18 bp, Artificial sequence
  synthetic polynucleotide sequence
agggcaaggaccaagcca

SEQ ID NO: 47205 - DNA, 20 bp, Artificial sequence
  synthetic polynucleotide sequence
tgggacagaccaggactcca

SEQ ID NO: 47206 - DNA, 18 bp, Artificial sequence
  synthetic polynucleotide sequence
gccttcacctggggcaca

SEQ ID NO: 47207 - DNA, 18 bp, Artificial sequence
  synthetic polynucleotide sequence
ccggcagattggaggcga

SEQ ID NO: 47208 - DNA, 18 bp, Artificial sequence
  synthetic polynucleotide sequence
ccgtcagaagcagcagga

SEQ ID NO: 47209 - DNA, 20 bp, Artificial sequence
  synthetic polynucleotide sequence
tctaggatccgggacacaga

SEQ ID NO: 47210 - DNA, 21 bp, Artificial sequence
  synthetic polynucleotide sequence
ctggcagcaacatagcctgca

SEQ ID NO: 47211 - DNA, 22 bp, Artificial sequence
  synthetic polynucleotide sequence
gaaatctgtcaggtcagcccaa

SEQ ID NO: 47212 - DNA, 21 bp, Artificial sequence
  synthetic polynucleotide sequence
acaggataaccagcaccagca

SEQ ID NO: 47213 - DNA, 18 bp, Artificial sequence
  synthetic polynucleotide sequence
ggaccctccggaaggaca

SEQ ID NO: 47214 - DNA, 18 bp, Artificial sequence
  synthetic polynucleotide sequence
gcgacagcatcccaagca

SEQ ID NO: 47215 - DNA, 22 bp, Artificial sequence
  synthetic polynucleotide sequence
caaattacgagagaggcccaca

SEQ ID NO: 47216 - DNA, 19 bp, Artificial sequence
  synthetic polynucleotide sequence
tgatgacggtctcccggga

SEQ ID NO: 47217 - DNA, 19 bp, Artificial sequence
  synthetic polynucleotide sequence
ccaaggagatggacgagga

SEQ ID NO: 47218 - DNA, 19 bp, Artificial sequence
  synthetic polynucleotide sequence
tcctcaggcacaaggaaca

SEQ ID NO: 47219 - DNA, 22 bp, Artificial sequence
  synthetic polynucleotide sequence
gatgaccggaaagtgcgacaca

SEQ ID NO: 47220 - DNA, 20 bp, Artificial sequence
  synthetic polynucleotide sequence
aggcgctgacaggttccaca

SEQ ID NO: 47221 - DNA, 21 bp, Artificial sequence
  synthetic polynucleotide sequence
tcaaccccagcatccttccca

SEQ ID NO: 47222 - DNA, 22 bp, Artificial sequence
  synthetic polynucleotide sequence
aaagcaacaagctcagggctga

SEQ ID NO: 47223 - DNA, 23 bp, Artificial sequence
  synthetic polynucleotide sequence
cccagagaacaagcactgtggaa

SEQ ID NO: 47224 - DNA, 20 bp, Artificial sequence
  synthetic polynucleotide sequence
ggagagagtggctctgcaga

SEQ ID NO: 47225 - DNA, 20 bp, Artificial sequence
  synthetic polynucleotide sequence
gccatgaccaccctcgtaga

SEQ ID NO: 47226 - DNA, 21 bp, Artificial sequence
  synthetic polynucleotide sequence
tggttagggaagctggcagaa

SEQ ID NO: 47227 - DNA, 21 bp, Artificial sequence
  synthetic polynucleotide sequence
ccagaaagccacgatcccgga

SEQ ID NO: 47228 - DNA, 20 bp, Artificial sequence
  synthetic polynucleotide sequence
actgctggatgctgccgaca

SEQ ID NO: 47229 - DNA, 20 bp, Artificial sequence
  synthetic polynucleotide sequence
ctacactcggagtcgccaga

SEQ ID NO: 47230 - DNA, 19 bp, Artificial sequence
  synthetic polynucleotide sequence
gacagtctcccagcacgga

SEQ ID NO: 47231 - DNA, 21 bp, Artificial sequence
  synthetic polynucleotide sequence
ttgtctctacaggagtggcca

SEQ ID NO: 47232 - DNA, 20 bp, Artificial sequence
  synthetic polynucleotide sequence
gcagtaacagcaccgcccca

SEQ ID NO: 47233 - DNA, 20 bp, Artificial sequence
  synthetic polynucleotide sequence
tggggaactggtgtggagga

SEQ ID NO: 47234 - DNA, 21 bp, Artificial sequence
  synthetic polynucleotide sequence
agccaggtcagagtctgccca

SEQ ID NO: 47235 - DNA, 21 bp, Artificial sequence
  synthetic polynucleotide sequence
ccaggccgttcagagcatcca

SEQ ID NO: 47236 - DNA, 21 bp, Artificial sequence
  synthetic polynucleotide sequence
atggatgaaggactgcagcga

SEQ ID NO: 47237 - DNA, 20 bp, Artificial sequence
  synthetic polynucleotide sequence
aactaccctcccaacacgga

SEQ ID NO: 47238 - DNA, 19 bp, Artificial sequence
  synthetic polynucleotide sequence
ccacggagttctcccagca

SEQ ID NO: 47239 - DNA, 20 bp, Artificial sequence
  synthetic polynucleotide sequence
tatgcagtcaggccgaccca

SEQ ID NO: 47240 - DNA, 21 bp, Artificial sequence
  synthetic polynucleotide sequence
cctggtagacatgcagcagca

SEQ ID NO: 47241 - DNA, 19 bp, Artificial sequence
  synthetic polynucleotide sequence
cctatgagagggcacggga

SEQ ID NO: 47242 - DNA, 18 bp, Artificial sequence
  synthetic polynucleotide sequence
tggcgatggtggacacga

SEQ ID NO: 47243 - DNA, 21 bp, Artificial sequence
  synthetic polynucleotide sequence
gacagccaacctgaagcagga

SEQ ID NO: 47244 - DNA, 22 bp, Artificial sequence
  synthetic polynucleotide sequence
atgacagtcatgaaggccagga

SEQ ID NO: 47245 - DNA, 20 bp, Artificial sequence
  synthetic polynucleotide sequence
tggtggcggagtctacggaa

SEQ ID NO: 47246 - DNA, 19 bp, Artificial sequence
  synthetic polynucleotide sequence
tatgccctctgcgagcaga

SEQ ID NO: 47247 - DNA, 21 bp, Artificial sequence
  synthetic polynucleotide sequence
ccagaaggaagtggtctccga

SEQ ID NO: 47248 - DNA, 23 bp, Artificial sequence
  synthetic polynucleotide sequence
caaatgggggaagtaaaccctga

SEQ ID NO: 47249 - DNA, 20 bp, Artificial sequence
  synthetic polynucleotide sequence
tccatcgaacccatccgcga

SEQ ID NO: 47250 - DNA, 21 bp, Artificial sequence
  synthetic polynucleotide sequence
gaaaactcgctgacctgggca

SEQ ID NO: 47251 - DNA, 19 bp, Artificial sequence
  synthetic polynucleotide sequence
catcaggcgagacccccca

SEQ ID NO: 47252 - DNA, 19 bp, Artificial sequence
  synthetic polynucleotide sequence
tcagactggtccagcccta

SEQ ID NO: 47253 - DNA, 21 bp, Artificial sequence
  synthetic polynucleotide sequence
gatggagccctagaagagaca

SEQ ID NO: 47254 - DNA, 20 bp, Artificial sequence
  synthetic polynucleotide sequence
cttcacagagctgggtcaca

SEQ ID NO: 47255 - DNA, 21 bp, Artificial sequence
  synthetic polynucleotide sequence
tggggctgtccagaaaaccga

SEQ ID NO: 47256 - DNA, 21 bp, Artificial sequence
  synthetic polynucleotide sequence
aaggctgccacaacacgctca

SEQ ID NO: 47257 - DNA, 18 bp, Artificial sequence
  synthetic polynucleotide sequence
tggagcgcagcatccaga

SEQ ID NO: 47258 - DNA, 18 bp, Artificial sequence
  synthetic polynucleotide sequence
cgccacgttgacagctga

SEQ ID NO: 47259 - DNA, 21 bp, Artificial sequence
  synthetic polynucleotide sequence
atgcgtgataccaacgagtca

SEQ ID NO: 47260 - DNA, 19 bp, Artificial sequence
  synthetic polynucleotide sequence
gccttgaagaagcgtcgca

SEQ ID NO: 47261 - DNA, 19 bp, Artificial sequence
  synthetic polynucleotide sequence
ctggacatcgacgtggaga

SEQ ID NO: 47262 - DNA, 19 bp, Artificial sequence
  synthetic polynucleotide sequence
tccatccatgtgagcagca

SEQ ID NO: 47263 - DNA, 20 bp, Artificial sequence
  synthetic polynucleotide sequence
gtgattgactcccagacgca

SEQ ID NO: 47264 - DNA, 22 bp, Artificial sequence
  synthetic polynucleotide sequence
agtagcacctgactgaagctga

SEQ ID NO: 47265 - DNA, 18 bp, Artificial sequence
  synthetic polynucleotide sequence
gaaggaccccgacggcaa

SEQ ID NO: 47266 - DNA, 18 bp, Artificial sequence
  synthetic polynucleotide sequence
catgctccccaacctgga

SEQ ID NO: 47267 - DNA, 22 bp, Artificial sequence
  synthetic polynucleotide sequence
gaaactggaagacatcctggaa

SEQ ID NO: 47268 - DNA, 19 bp, Artificial sequence
  synthetic polynucleotide sequence
tgaatggctgacaccacca

SEQ ID NO: 47269 - DNA, 19 bp, Artificial sequence
  synthetic polynucleotide sequence
cagggtgttcggggccaga

SEQ ID NO: 47270 - DNA, 21 bp, Artificial sequence
  synthetic polynucleotide sequence
tgatcagtctcaggcccctca

SEQ ID NO: 47271 - DNA, 18 bp, Artificial sequence
  synthetic polynucleotide sequence
gggtgcaggctgctcgca

SEQ ID NO: 47272 - DNA, 20 bp, Artificial sequence
  synthetic polynucleotide sequence
gtcaggaagctcgaaggtga

SEQ ID NO: 47273 - DNA, 23 bp, Artificial sequence
  synthetic polynucleotide sequence
caaaagcaagctgggcaaagaga

SEQ ID NO: 47274 - DNA, 21 bp, Artificial sequence
  synthetic polynucleotide sequence
gtcatcggtcgcaaactccca

SEQ ID NO: 47275 - DNA, 20 bp, Artificial sequence
  synthetic polynucleotide sequence
aagcagcgggaggagtacca

SEQ ID NO: 47276 - DNA, 20 bp, Artificial sequence
  synthetic polynucleotide sequence
tgaacctgccctcggagcca

SEQ ID NO: 47277 - DNA, 20 bp, Artificial sequence
  synthetic polynucleotide sequence
cggcggcaaaggcaagagca

SEQ ID NO: 47278 - DNA, 20 bp, Artificial sequence
  synthetic polynucleotide sequence
tacaagcagcccttctgaga

SEQ ID NO: 47279 - DNA, 20 bp, Artificial sequence
  synthetic polynucleotide sequence
atgcatgggaagtgtgagca

SEQ ID NO: 47280 - DNA, 19 bp, Artificial sequence
  synthetic polynucleotide sequence
gtgatgcagaggaccacca

SEQ ID NO: 47281 - DNA, 19 bp, Artificial sequence
  synthetic polynucleotide sequence
ctgctacagggggtaccga

SEQ ID NO: 47282 - DNA, 20 bp, Artificial sequence
  synthetic polynucleotide sequence
tcactttccagcacaaggca

SEQ ID NO: 47283 - DNA, 21 bp, Artificial sequence
  synthetic polynucleotide sequence
cattagcacctacgccgccta

SEQ ID NO: 47284 - DNA, 21 bp, Artificial sequence
  synthetic polynucleotide sequence
tgtgctgcagtgagtaggcca

SEQ ID NO: 47285 - DNA, 20 bp, Artificial sequence
  synthetic polynucleotide sequence
ccagtcccaaagccgtcgga

SEQ ID NO: 47286 - DNA, 20 bp, Artificial sequence
  synthetic polynucleotide sequence
agggatcagagactcggcga

SEQ ID NO: 47287 - DNA, 21 bp, Artificial sequence
  synthetic polynucleotide sequence
gaagacactcttccaccgcga

SEQ ID NO: 47288 - DNA, 20 bp, Artificial sequence
  synthetic polynucleotide sequence
gtcgtgggtgcagaaggcca

SEQ ID NO: 47289 - DNA, 19 bp, Artificial sequence
  synthetic polynucleotide sequence
ggggactgtgctgagccca

SEQ ID NO: 47290 - DNA, 18 bp, Artificial sequence
  synthetic polynucleotide sequence
aggtgcagcccccctgca

SEQ ID NO: 47291 - DNA, 21 bp, Artificial sequence
  synthetic polynucleotide sequence
gctgaagcccaagcacacgaa

SEQ ID NO: 47292 - DNA, 18 bp, Artificial sequence
  synthetic polynucleotide sequence
ctgccccaccacgaggga

SEQ ID NO: 47293 - DNA, 20 bp, Artificial sequence
  synthetic polynucleotide sequence
ggcatgaagaagttgaggga

SEQ ID NO: 47294 - DNA, 21 bp, Artificial sequence
  synthetic polynucleotide sequence
accaatctgagtcagcaggga

SEQ ID NO: 47295 - DNA, 21 bp, Artificial sequence
  synthetic polynucleotide sequence
aacgagagcaggaagaagcca

SEQ ID NO: 47296 - DNA, 22 bp, Artificial sequence
  synthetic polynucleotide sequence
caaagcaggatggacaggagga

SEQ ID NO: 47297 - DNA, 21 bp, Artificial sequence
  synthetic polynucleotide sequence
ccatgttcaacagcacccaga

SEQ ID NO: 47298 - DNA, 21 bp, Artificial sequence
  synthetic polynucleotide sequence
tcagtgacagctggaagggca

SEQ ID NO: 47299 - DNA, 18 bp, Artificial sequence
  synthetic polynucleotide sequence
tggaagcctgggacagca

SEQ ID NO: 47300 - DNA, 18 bp, Artificial sequence
  synthetic polynucleotide sequence
gatggccaggatcaccca

SEQ ID NO: 47301 - DNA, 20 bp, Artificial sequence
  synthetic polynucleotide sequence
gatcgccgcacagctgctga

SEQ ID NO: 47302 - DNA, 19 bp, Artificial sequence
  synthetic polynucleotide sequence
cgggtggaagggtcaggca

SEQ ID NO: 47303 - DNA, 22 bp, Artificial sequence
  synthetic polynucleotide sequence
accaagtggagtacgacgccta

SEQ ID NO: 47304 - DNA, 19 bp, Artificial sequence
  synthetic polynucleotide sequence
cagtacaccagggcggcca

SEQ ID NO: 47305 - DNA, 21 bp, Artificial sequence
  synthetic polynucleotide sequence
ggactcgaggaatgggagcaa

SEQ ID NO: 47306 - DNA, 21 bp, Artificial sequence
  synthetic polynucleotide sequence
catcatccgctgagatcagga

SEQ ID NO: 47307 - DNA, 20 bp, Artificial sequence
  synthetic polynucleotide sequence
gaggagaaggccctcctgga

SEQ ID NO: 47308 - DNA, 20 bp, Artificial sequence
  synthetic polynucleotide sequence
tcgcgggctgctgccaggaa

SEQ ID NO: 47309 - DNA, 20 bp, Artificial sequence
  synthetic polynucleotide sequence
tccatctggcccagcatgga

SEQ ID NO: 47310 - DNA, 20 bp, Artificial sequence
  synthetic polynucleotide sequence
gggagctgcctcgaaggtga

SEQ ID NO: 47311 - DNA, 20 bp, Artificial sequence
  synthetic polynucleotide sequence
gagtgaacagtgggcagtga

SEQ ID NO: 47312 - DNA, 19 bp, Artificial sequence
  synthetic polynucleotide sequence
tgccgttagagcctggaga

SEQ ID NO: 47313 - DNA, 20 bp, Artificial sequence
  synthetic polynucleotide sequence
gtagggacctggatggggga

SEQ ID NO: 47314 - DNA, 22 bp, Artificial sequence
  synthetic polynucleotide sequence
atcactgggcaaaaatccccga

SEQ ID NO: 47315 - DNA, 18 bp, Artificial sequence
  synthetic polynucleotide sequence
accagaggcgcaggagga

SEQ ID NO: 47316 - DNA, 18 bp, Artificial sequence
  synthetic polynucleotide sequence
tggacactgctgcaagca

SEQ ID NO: 47317 - DNA, 20 bp, Artificial sequence
  synthetic polynucleotide sequence
ctcaactccagggtgacaga

SEQ ID NO: 47318 - DNA, 20 bp, Artificial sequence
  synthetic polynucleotide sequence
tacatgagaccgtcgggcca

SEQ ID NO: 47319 - DNA, 20 bp, Artificial sequence
  synthetic polynucleotide sequence
agctctccagccacgaggaa

SEQ ID NO: 47320 - DNA, 20 bp, Artificial sequence
  synthetic polynucleotide sequence
ctggagcttggcatgcacga

SEQ ID NO: 47321 - DNA, 20 bp, Artificial sequence
  synthetic polynucleotide sequence
cgagcacatagcgccgcaga

SEQ ID NO: 47322 - DNA, 19 bp, Artificial sequence
  synthetic polynucleotide sequence
ctgtcccggaacagcgcca

SEQ ID NO: 47323 - DNA, 21 bp, Artificial sequence
  synthetic polynucleotide sequence
ttccacacaactccagtgcta

SEQ ID NO: 47324 - DNA, 20 bp, Artificial sequence
  synthetic polynucleotide sequence
ctggagtctgaggcaactga

SEQ ID NO: 47325 - DNA, 20 bp, Artificial sequence
  synthetic polynucleotide sequence
agcagctggaggagttggga

SEQ ID NO: 47326 - DNA, 20 bp, Artificial sequence
  synthetic polynucleotide sequence
gccccgccttccatacacaa

SEQ ID NO: 47327 - DNA, 21 bp, Artificial sequence
  synthetic polynucleotide sequence
taaccagcttccagaagcaga

SEQ ID NO: 47328 - DNA, 21 bp, Artificial sequence
  synthetic polynucleotide sequence
cctgccattggtaagccagca

SEQ ID NO: 47329 - DNA, 21 bp, Artificial sequence
  synthetic polynucleotide sequence
ggctgggactaagccaaggga

SEQ ID NO: 47330 - DNA, 20 bp, Artificial sequence
  synthetic polynucleotide sequence
ctagagaaggactgggctga

SEQ ID NO: 47331 - DNA, 20 bp, Artificial sequence
  synthetic polynucleotide sequence
gttgcacatccacggaggca

SEQ ID NO: 47332 - DNA, 22 bp, Artificial sequence
  synthetic polynucleotide sequence
aaagcggagagactacacagga

SEQ ID NO: 47333 - DNA, 19 bp, Artificial sequence
  synthetic polynucleotide sequence
cgggccggaaacctccaca

SEQ ID NO: 47334 - DNA, 21 bp, Artificial sequence
  synthetic polynucleotide sequence
acaagcaacaaggcactgcca

SEQ ID NO: 47335 - DNA, 19 bp, Artificial sequence
  synthetic polynucleotide sequence
ccctctacgccctcccaca

SEQ ID NO: 47336 - DNA, 21 bp, Artificial sequence
  synthetic polynucleotide sequence
tctgtcacaatcacacgggca

SEQ ID NO: 47337 - DNA, 21 bp, Artificial sequence
  synthetic polynucleotide sequence
cagcgtacaacctgacccaca

SEQ ID NO: 47338 - DNA, 21 bp, Artificial sequence
  synthetic polynucleotide sequence
gctggattctggagggccaca

SEQ ID NO: 47339 - DNA, 18 bp, Artificial sequence
  synthetic polynucleotide sequence
caagagcccaggtgggaa

SEQ ID NO: 47340 - DNA, 18 bp, Artificial sequence
  synthetic polynucleotide sequence
tgctgacgggactccaca

SEQ ID NO: 47341 - DNA, 20 bp, Artificial sequence
  synthetic polynucleotide sequence
cctgtgagagtgggggagga

SEQ ID NO: 47342 - DNA, 20 bp, Artificial sequence
  synthetic polynucleotide sequence
gtcctcacacacccagcgga

SEQ ID NO: 47343 - DNA, 20 bp, Artificial sequence
  synthetic polynucleotide sequence
ccgggaataaccacggtgca

SEQ ID NO: 47344 - DNA, 20 bp, Artificial sequence
  synthetic polynucleotide sequence
ctgcactcccagctccgcga

SEQ ID NO: 47345 - DNA, 22 bp, Artificial sequence
  synthetic polynucleotide sequence
caacgtagaccacgccagtgaa

SEQ ID NO: 47346 - DNA, 20 bp, Artificial sequence
  synthetic polynucleotide sequence
tcctcctgcagccgcagcca

SEQ ID NO: 47347 - DNA, 19 bp, Artificial sequence
  synthetic polynucleotide sequence
ggacaaacacatggacgca

SEQ ID NO: 47348 - DNA, 18 bp, Artificial sequence
  synthetic polynucleotide sequence
cccacccacaggtgacca

SEQ ID NO: 47349 - DNA, 20 bp, Artificial sequence
  synthetic polynucleotide sequence
cctaccccatcccacagcca

SEQ ID NO: 47350 - DNA, 20 bp, Artificial sequence
  synthetic polynucleotide sequence
agctgctgcccccacctcca

SEQ ID NO: 47351 - DNA, 21 bp, Artificial sequence
  synthetic polynucleotide sequence
atctcctggtcaggtcacgaa

SEQ ID NO: 47352 - DNA, 22 bp, Artificial sequence
  synthetic polynucleotide sequence
aatcaacaggagacaggcagga

SEQ ID NO: 47353 - DNA, 20 bp, Artificial sequence
  synthetic polynucleotide sequence
tgatccagaagaaccgccga

SEQ ID NO: 47354 - DNA, 18 bp, Artificial sequence
  synthetic polynucleotide sequence
gtggcccttgaccgcgca

SEQ ID NO: 47355 - DNA, 21 bp, Artificial sequence
  synthetic polynucleotide sequence
ttccaggcagctgtcatggaa

SEQ ID NO: 47356 - DNA, 22 bp, Artificial sequence
  synthetic polynucleotide sequence
tatcttggatccaacctgggga

SEQ ID NO: 47357 - DNA, 22 bp, Artificial sequence
  synthetic polynucleotide sequence
aagcaccgaagctatgagtgga

SEQ ID NO: 47358 - DNA, 21 bp, Artificial sequence
  synthetic polynucleotide sequence
cagcatcaaggcaccctcaga

SEQ ID NO: 47359 - DNA, 22 bp, Artificial sequence
  synthetic polynucleotide sequence
caaagggaccatcatcctgaca

SEQ ID NO: 47360 - DNA, 21 bp, Artificial sequence
  synthetic polynucleotide sequence
catgaactccttgcgcagcca

SEQ ID NO: 47361 - DNA, 20 bp, Artificial sequence
  synthetic polynucleotide sequence
aatggcctcagaggggtcca

SEQ ID NO: 47362 - DNA, 20 bp, Artificial sequence
  synthetic polynucleotide sequence
gactgccgccaagctctgca

SEQ ID NO: 47363 - DNA, 20 bp, Artificial sequence
  synthetic polynucleotide sequence
gtggaatgaggacaccagca

SEQ ID NO: 47364 - DNA, 18 bp, Artificial sequence
  synthetic polynucleotide sequence
acacagccaggaagccca

SEQ ID NO: 47365 - DNA, 21 bp, Artificial sequence
  synthetic polynucleotide sequence
gtatgccgcatgccagtcaca

SEQ ID NO: 47366 - DNA, 20 bp, Artificial sequence
  synthetic polynucleotide sequence
tctcgtcaccccgtagctga

SEQ ID NO: 47367 - DNA, 21 bp, Artificial sequence
  synthetic polynucleotide sequence
gcaggacgagcacaccaagga

SEQ ID NO: 47368 - DNA, 21 bp, Artificial sequence
  synthetic polynucleotide sequence
gaaggtcacctcacagcctga

SEQ ID NO: 47369 - DNA, 20 bp, Artificial sequence
  synthetic polynucleotide sequence
tctggcctactgcatagcca

SEQ ID NO: 47370 - DNA, 22 bp, Artificial sequence
  synthetic polynucleotide sequence
ataaatcctggaccagcagtga

SEQ ID NO: 47371 - DNA, 19 bp, Artificial sequence
  synthetic polynucleotide sequence
tctgatcatgacccgccca

SEQ ID NO: 47372 - DNA, 20 bp, Artificial sequence
  synthetic polynucleotide sequence
gggaaggccttgtcagcgga

SEQ ID NO: 47373 - DNA, 20 bp, Artificial sequence
  synthetic polynucleotide sequence
tgtaccacaccttccggcca

SEQ ID NO: 47374 - DNA, 21 bp, Artificial sequence
  synthetic polynucleotide sequence
agtgcacattgacaacggcga

SEQ ID NO: 47375 - DNA, 20 bp, Artificial sequence
  synthetic polynucleotide sequence
gttatgcagccctcgtgaca

SEQ ID NO: 47376 - DNA, 22 bp, Artificial sequence
  synthetic polynucleotide sequence
taaacctgcaaccaaaccagca

SEQ ID NO: 47377 - DNA, 20 bp, Artificial sequence
  synthetic polynucleotide sequence
caaacctacagaggtggcga

SEQ ID NO: 47378 - DNA, 20 bp, Artificial sequence
  synthetic polynucleotide sequence
cagagccctgaaagctgaca

SEQ ID NO: 47379 - DNA, 20 bp, Artificial sequence
  synthetic polynucleotide sequence
ctcagccatcacggaatcca

SEQ ID NO: 47380 - DNA, 22 bp, Artificial sequence
  synthetic polynucleotide sequence
aaactatcagcaggcacctgca

SEQ ID NO: 47381 - DNA, 20 bp, Artificial sequence
  synthetic polynucleotide sequence
tgtggctcctatcccccaga

SEQ ID NO: 47382 - DNA, 21 bp, Artificial sequence
  synthetic polynucleotide sequence
caaacaaagagcagccccgca

SEQ ID NO: 47383 - DNA, 22 bp, Artificial sequence
  synthetic polynucleotide sequence
gaatgaaggacggagagttgga

SEQ ID NO: 47384 - DNA, 20 bp, Artificial sequence
  synthetic polynucleotide sequence
aagcacatgaccaggcccca

SEQ ID NO: 47385 - DNA, 20 bp, Artificial sequence
  synthetic polynucleotide sequence
gagtcttggcccaggggaca

SEQ ID NO: 47386 - DNA, 21 bp, Artificial sequence
  synthetic polynucleotide sequence
gccctcgttgaaagggaagga

SEQ ID NO: 47387 - DNA, 21 bp, Artificial sequence
  synthetic polynucleotide sequence
ggcagagttccagaccagaga

SEQ ID NO: 47388 - DNA, 22 bp, Artificial sequence
  synthetic polynucleotide sequence
ggaacatgcaagagagcaagga

SEQ ID NO: 47389 - DNA, 20 bp, Artificial sequence
  synthetic polynucleotide sequence
tacccagagtgtgccatgca

SEQ ID NO: 47390 - DNA, 18 bp, Artificial sequence
  synthetic polynucleotide sequence
tgtggggtgctgcgggga

SEQ ID NO: 47391 - DNA, 22 bp, Artificial sequence
  synthetic polynucleotide sequence
caggacttgccaagacatcaca

SEQ ID NO: 47392 - DNA, 22 bp, Artificial sequence
  synthetic polynucleotide sequence
ctccaagtggtcaaccagagga

SEQ ID NO: 47393 - DNA, 18 bp, Artificial sequence
  synthetic polynucleotide sequence
ggctgaaccgtaagccca

SEQ ID NO: 47394 - DNA, 18 bp, Artificial sequence
  synthetic polynucleotide sequence
ccatgccgttgggcagga

SEQ ID NO: 47395 - DNA, 21 bp, Artificial sequence
  synthetic polynucleotide sequence
gaggagccccagagtatctca

SEQ ID NO: 47396 - DNA, 21 bp, Artificial sequence
  synthetic polynucleotide sequence
agcagagcagccagggtggta

SEQ ID NO: 47397 - DNA, 21 bp, Artificial sequence
  synthetic polynucleotide sequence
tgcgaggacccatgcagctga

SEQ ID NO: 47398 - DNA, 19 bp, Artificial sequence
  synthetic polynucleotide sequence
catcagggccttccgcgga

SEQ ID NO: 47399 - DNA, 18 bp, Artificial sequence
  synthetic polynucleotide sequence
ggagcagctgcgaaggga

SEQ ID NO: 47400 - DNA, 18 bp, Artificial sequence
  synthetic polynucleotide sequence
cccagcgtcttgagcaga

SEQ ID NO: 47401 - DNA, 22 bp, Artificial sequence
  synthetic polynucleotide sequence
caaataacagtggcactgagca

SEQ ID NO: 47402 - DNA, 19 bp, Artificial sequence
  synthetic polynucleotide sequence
gcagcaatccaccaggtca

SEQ ID NO: 47403 - DNA, 21 bp, Artificial sequence
  synthetic polynucleotide sequence
cgctgcataggactgagcaga

SEQ ID NO: 47404 - DNA, 21 bp, Artificial sequence
  synthetic polynucleotide sequence
aggagagacttggaaccagga

SEQ ID NO: 47405 - DNA, 18 bp, Artificial sequence
  synthetic polynucleotide sequence
ctccagagcccctcagca

SEQ ID NO: 47406 - DNA, 18 bp, Artificial sequence
  synthetic polynucleotide sequence
gggtctgagatggccgga

SEQ ID NO: 47407 - DNA, 18 bp, Artificial sequence
  synthetic polynucleotide sequence
ccaccacagtcatcccca

SEQ ID NO: 47408 - DNA, 19 bp, Artificial sequence
  synthetic polynucleotide sequence
tgaccctcatcagggctca

SEQ ID NO: 47409 - DNA, 20 bp, Artificial sequence
  synthetic polynucleotide sequence
cacccagcctcctggacaga

SEQ ID NO: 47410 - DNA, 22 bp, Artificial sequence
  synthetic polynucleotide sequence
atgaagaggatgctgaaggcca

SEQ ID NO: 47411 - DNA, 17 bp, Artificial sequence
  synthetic polynucleotide sequence
ccagccgccatgacgaa

SEQ ID NO: 47412 - DNA, 18 bp, Artificial sequence
  synthetic polynucleotide sequence
gcaattgccacagcagca

SEQ ID NO: 47413 - DNA, 20 bp, Artificial sequence
  synthetic polynucleotide sequence
acagtggatggacccagaca

SEQ ID NO: 47414 - DNA, 19 bp, Artificial sequence
  synthetic polynucleotide sequence
ctccacctgctagagccca

SEQ ID NO: 47415 - DNA, 23 bp, Artificial sequence
  synthetic polynucleotide sequence
gaaaaagggtcagatggtggaca

SEQ ID NO: 47416 - DNA, 22 bp, Artificial sequence
  synthetic polynucleotide sequence
ggatgaaaaccacaggcaggca

SEQ ID NO: 47417 - DNA, 20 bp, Artificial sequence
  synthetic polynucleotide sequence
cggaccggtccagagtccaa

SEQ ID NO: 47418 - DNA, 22 bp, Artificial sequence
  synthetic polynucleotide sequence
tcataatgctgctcacccacca

SEQ ID NO: 47419 - DNA, 21 bp, Artificial sequence
  synthetic polynucleotide sequence
tgatgggcatcgtgggaccaa

SEQ ID NO: 47420 - DNA, 22 bp, Artificial sequence
  synthetic polynucleotide sequence
aaaaggagaccaccaagacgca

SEQ ID NO: 47421 - DNA, 20 bp, Artificial sequence
  synthetic polynucleotide sequence
gctgaggaacctcacggaga

SEQ ID NO: 47422 - DNA, 22 bp, Artificial sequence
  synthetic polynucleotide sequence
cctatgcctctgcagcatcaca

SEQ ID NO: 47423 - DNA, 20 bp, Artificial sequence
  synthetic polynucleotide sequence
gagagccgccagtttgccca

SEQ ID NO: 47424 - DNA, 18 bp, Artificial sequence
  synthetic polynucleotide sequence
cggggctctgagtcgcca

SEQ ID NO: 47425 - DNA, 18 bp, Artificial sequence
  synthetic polynucleotide sequence
acgccacccccttgcaga

SEQ ID NO: 47426 - DNA, 18 bp, Artificial sequence
  synthetic polynucleotide sequence
caggggcatctgccagga

SEQ ID NO: 47427 - DNA, 20 bp, Artificial sequence
  synthetic polynucleotide sequence
tgggactggtggggatcaca

SEQ ID NO: 47428 - DNA, 22 bp, Artificial sequence
  synthetic polynucleotide sequence
aatgtcaccccaactgacagca

SEQ ID NO: 47429 - DNA, 21 bp, Artificial sequence
  synthetic polynucleotide sequence
ggaccccaaggatgtgaagga

SEQ ID NO: 47430 - DNA, 19 bp, Artificial sequence
  synthetic polynucleotide sequence
cacccacgaaggccagcga

SEQ ID NO: 47431 - DNA, 18 bp, Artificial sequence
  synthetic polynucleotide sequence
acaacagtgcctgccgca

SEQ ID NO: 47432 - DNA, 20 bp, Artificial sequence
  synthetic polynucleotide sequence
aatccagacacccaagagca

SEQ ID NO: 47433 - DNA, 18 bp, Artificial sequence
  synthetic polynucleotide sequence
acagatggatgcggcgaa

SEQ ID NO: 47434 - DNA, 18 bp, Artificial sequence
  synthetic polynucleotide sequence
acagccaggaacagggca

SEQ ID NO: 47435 - DNA, 21 bp, Artificial sequence
  synthetic polynucleotide sequence
tcttgggcaaagacggggaga

SEQ ID NO: 47436 - DNA, 21 bp, Artificial sequence
  synthetic polynucleotide sequence
gattgagcatccccctccaca

SEQ ID NO: 47437 - DNA, 21 bp, Artificial sequence
  synthetic polynucleotide sequence
atgcacggccatcaagtacca

SEQ ID NO: 47438 - DNA, 21 bp, Artificial sequence
  synthetic polynucleotide sequence
tgaggaacaggagtccagcca

SEQ ID NO: 47439 - DNA, 18 bp, Artificial sequence
  synthetic polynucleotide sequence
gcacctgtgtggccggga

SEQ ID NO: 47440 - DNA, 21 bp, Artificial sequence
  synthetic polynucleotide sequence
ccgagatgagtgtgaggccca

SEQ ID NO: 47441 - DNA, 21 bp, Artificial sequence
  synthetic polynucleotide sequence
tcaccatgtggtgcgacacca

SEQ ID NO: 47442 - DNA, 22 bp, Artificial sequence
  synthetic polynucleotide sequence
caaactgatcgtagaaggcgga

SEQ ID NO: 47443 - DNA, 20 bp, Artificial sequence
  synthetic polynucleotide sequence
tatcccgtccctcagcacca

SEQ ID NO: 47444 - DNA, 21 bp, Artificial sequence
  synthetic polynucleotide sequence
ttgcagagagacctggtgcca

SEQ ID NO: 47445 - DNA, 21 bp, Artificial sequence
  synthetic polynucleotide sequence
tctttccccgtcagcatccca

SEQ ID NO: 47446 - DNA, 21 bp, Artificial sequence
  synthetic polynucleotide sequence
gtctgtagcttcgggaggaca

SEQ ID NO: 47447 - DNA, 21 bp, Artificial sequence
  synthetic polynucleotide sequence
gaccctcacatgtgcagggaa

SEQ ID NO: 47448 - DNA, 21 bp, Artificial sequence
  synthetic polynucleotide sequence
tgacgatgaaggtgagcacca

SEQ ID NO: 47449 - DNA, 21 bp, Artificial sequence
  synthetic polynucleotide sequence
ccaccgtccaagaactgcaca

SEQ ID NO: 47450 - DNA, 22 bp, Artificial sequence
  synthetic polynucleotide sequence
atgactacagcaactaccccca

SEQ ID NO: 47451 - DNA, 18 bp, Artificial sequence
  synthetic polynucleotide sequence
ggacggggctggaggaga

SEQ ID NO: 47452 - DNA, 21 bp, Artificial sequence
  synthetic polynucleotide sequence
atcggatcacacaagcccgga

SEQ ID NO: 47453 - DNA, 18 bp, Artificial sequence
  synthetic polynucleotide sequence
ggagaccagcggcgggaa

SEQ ID NO: 47454 - DNA, 20 bp, Artificial sequence
  synthetic polynucleotide sequence
ctccctgatgccgctggaga

SEQ ID NO: 47455 - DNA, 19 bp, Artificial sequence
  synthetic polynucleotide sequence
tctcacctgcctaccagca

SEQ ID NO: 47456 - DNA, 18 bp, Artificial sequence
  synthetic polynucleotide sequence
tcgttgtcgcgggcgcca

SEQ ID NO: 47457 - DNA, 18 bp, Artificial sequence
  synthetic polynucleotide sequence
ggccaccggactccagga

SEQ ID NO: 47458 - DNA, 21 bp, Artificial sequence
  synthetic polynucleotide sequence
tctgagacatcccacatggca

SEQ ID NO: 47459 - DNA, 21 bp, Artificial sequence
  synthetic polynucleotide sequence
agtctgggcacgaaatcctca

SEQ ID NO: 47460 - DNA, 22 bp, Artificial sequence
  synthetic polynucleotide sequence
acctgtcatgtcgaaagcccca

SEQ ID NO: 47461 - DNA, 20 bp, Artificial sequence
  synthetic polynucleotide sequence
taggtcgctggagctggaga

SEQ ID NO: 47462 - DNA, 21 bp, Artificial sequence
  synthetic polynucleotide sequence
acatgaggatccacaggggca

SEQ ID NO: 47463 - DNA, 21 bp, Artificial sequence
  synthetic polynucleotide sequence
ctctcaacaccgtgtgcctca

SEQ ID NO: 47464 - DNA, 21 bp, Artificial sequence
  synthetic polynucleotide sequence
tcaggggaatcacatctgcca

SEQ ID NO: 47465 - DNA, 20 bp, Artificial sequence
  synthetic polynucleotide sequence
agcaccacctcggctaccta

SEQ ID NO: 47466 - DNA, 22 bp, Artificial sequence
  synthetic polynucleotide sequence
tggaactggagcacgtcacaga

SEQ ID NO: 47467 - DNA, 20 bp, Artificial sequence
  synthetic polynucleotide sequence
cggcaccttcaccaaccaga

SEQ ID NO: 47468 - DNA, 20 bp, Artificial sequence
  synthetic polynucleotide sequence
gtggggtgagacgtggtgga

SEQ ID NO: 47469 - DNA, 22 bp, Artificial sequence
  synthetic polynucleotide sequence
gatagaaaatggccccggggaa

SEQ ID NO: 47470 - DNA, 22 bp, Artificial sequence
  synthetic polynucleotide sequence
aggtaccaccaaggagactgga

SEQ ID NO: 47471 - DNA, 21 bp, Artificial sequence
  synthetic polynucleotide sequence
tcctcctcctgagctgcagca

SEQ ID NO: 47472 - DNA, 19 bp, Artificial sequence
  synthetic polynucleotide sequence
ttggacagggcgactggca

SEQ ID NO: 47473 - DNA, 19 bp, Artificial sequence
  synthetic polynucleotide sequence
ggccccactcagacgccaa

SEQ ID NO: 47474 - DNA, 18 bp, Artificial sequence
  synthetic polynucleotide sequence
cgccggggtccaacagca

SEQ ID NO: 47475 - DNA, 19 bp, Artificial sequence
  synthetic polynucleotide sequence
ggccccactcagacgccaa

SEQ ID NO: 47476 - DNA, 20 bp, Artificial sequence
  synthetic polynucleotide sequence
cacgcaccgcctgatggcca

SEQ ID NO: 47477 - DNA, 22 bp, Artificial sequence
  synthetic polynucleotide sequence
aatgaggacaagtgcccaggaa

SEQ ID NO: 47478 - DNA, 20 bp, Artificial sequence
  synthetic polynucleotide sequence
ctgccaggctctgggaagga

SEQ ID NO: 47479 - DNA, 20 bp, Artificial sequence
  synthetic polynucleotide sequence
agttcctccgggcagtcaca

SEQ ID NO: 47480 - DNA, 21 bp, Artificial sequence
  synthetic polynucleotide sequence
tagtcgacaagtgagccagga

SEQ ID NO: 47481 - DNA, 20 bp, Artificial sequence
  synthetic polynucleotide sequence
tataaacggatcacccgcaa

SEQ ID NO: 47482 - DNA, 18 bp, Artificial sequence
  synthetic polynucleotide sequence
gacccaccacagaggcga

SEQ ID NO: 47483 - DNA, 22 bp, Artificial sequence
  synthetic polynucleotide sequence
tcaagatccaagcagccacaga

SEQ ID NO: 47484 - DNA, 22 bp, Artificial sequence
  synthetic polynucleotide sequence
actagtaaacaccacctgccga

SEQ ID NO: 47485 - DNA, 21 bp, Artificial sequence
  synthetic polynucleotide sequence
tcctggggctgccagaagaca

SEQ ID NO: 47486 - DNA, 19 bp, Artificial sequence
  synthetic polynucleotide sequence
tccgatccaacctaggcca

SEQ ID NO: 47487 - DNA, 20 bp, Artificial sequence
  synthetic polynucleotide sequence
tctgcgttcagagcccgcta

SEQ ID NO: 47488 - DNA, 20 bp, Artificial sequence
  synthetic polynucleotide sequence
gtggccagcttcggtgagca

SEQ ID NO: 47489 - DNA, 20 bp, Artificial sequence
  synthetic polynucleotide sequence
gaggccggcacctccaccga

SEQ ID NO: 47490 - DNA, 20 bp, Artificial sequence
  synthetic polynucleotide sequence
gctctgctccgcacccagaa

SEQ ID NO: 47491 - DNA, 20 bp, Artificial sequence
  synthetic polynucleotide sequence
atcaggctccggaggatcga

SEQ ID NO: 47492 - DNA, 21 bp, Artificial sequence
  synthetic polynucleotide sequence
cgtgtctagccagctaggcga

SEQ ID NO: 47493 - DNA, 22 bp, Artificial sequence
  synthetic polynucleotide sequence
aaaggcagcagcagcttatgga

SEQ ID NO: 47494 - DNA, 21 bp, Artificial sequence
  synthetic polynucleotide sequence
ctgtacccagttcagtgggga

SEQ ID NO: 47495 - DNA, 21 bp, Artificial sequence
  synthetic polynucleotide sequence
tcagcacctacttcaccacca

SEQ ID NO: 47496 - DNA, 20 bp, Artificial sequence
  synthetic polynucleotide sequence
acaggcgcggatcatgagca

SEQ ID NO: 47497 - DNA, 22 bp, Artificial sequence
  synthetic polynucleotide sequence
aggtggacgcacatgactgtga

SEQ ID NO: 47498 - DNA, 20 bp, Artificial sequence
  synthetic polynucleotide sequence
caccaggttgcaggcgcgca

SEQ ID NO: 47499 - DNA, 19 bp, Artificial sequence
  synthetic polynucleotide sequence
gccagctgcgagagaagga

SEQ ID NO: 47500 - DNA, 19 bp, Artificial sequence
  synthetic polynucleotide sequence
cagagcccattgctcagga

SEQ ID NO: 47501 - DNA, 21 bp, Artificial sequence
  synthetic polynucleotide sequence
gtagtgaggacttcagcgcca

SEQ ID NO: 47502 - DNA, 21 bp, Artificial sequence
  synthetic polynucleotide sequence
acatcttgacccaggtgcgga

SEQ ID NO: 47503 - DNA, 23 bp, Artificial sequence
  synthetic polynucleotide sequence
catataatgccaacacggggaga

SEQ ID NO: 47504 - DNA, 21 bp, Artificial sequence
  synthetic polynucleotide sequence
tgcagtcctcatgggaacaga

SEQ ID NO: 47505 - DNA, 20 bp, Artificial sequence
  synthetic polynucleotide sequence
ctactgacagccatcgtgca

SEQ ID NO: 47506 - DNA, 19 bp, Artificial sequence
  synthetic polynucleotide sequence
gcagtgaaccaggggccca

SEQ ID NO: 47507 - DNA, 22 bp, Artificial sequence
  synthetic polynucleotide sequence
accagtcccaagttcaccacca

SEQ ID NO: 47508 - DNA, 21 bp, Artificial sequence
  synthetic polynucleotide sequence
ggagaaggaggagaggggcta

SEQ ID NO: 47509 - DNA, 20 bp, Artificial sequence
  synthetic polynucleotide sequence
tggggtccaggaagatctca

SEQ ID NO: 47510 - DNA, 21 bp, Artificial sequence
  synthetic polynucleotide sequence
gctcctctgaagaagcctcca

SEQ ID NO: 47511 - DNA, 20 bp, Artificial sequence
  synthetic polynucleotide sequence
tgcaagggcctgttgcagca

SEQ ID NO: 47512 - DNA, 19 bp, Artificial sequence
  synthetic polynucleotide sequence
gcagtgtctcccccagcca

SEQ ID NO: 47513 - DNA, 19 bp, Artificial sequence
  synthetic polynucleotide sequence
gtgtccgtggccagctcca

SEQ ID NO: 47514 - DNA, 22 bp, Artificial sequence
  synthetic polynucleotide sequence
acgtccaaggcactgtaggtga

SEQ ID NO: 47515 - DNA, 21 bp, Artificial sequence
  synthetic polynucleotide sequence
gccagcgaaagatgccgctca

SEQ ID NO: 47516 - DNA, 23 bp, Artificial sequence
  synthetic polynucleotide sequence
caaatcctggagaaagcagccaa

SEQ ID NO: 47517 - DNA, 21 bp, Artificial sequence
  synthetic polynucleotide sequence
acaccaaagtacaggggtgca

SEQ ID NO: 47518 - DNA, 21 bp, Artificial sequence
  synthetic polynucleotide sequence
agtacaggaggaagcagctga

SEQ ID NO: 47519 - DNA, 21 bp, Artificial sequence
  synthetic polynucleotide sequence
tggtgaattcccagccccaga

SEQ ID NO: 47520 - DNA, 22 bp, Artificial sequence
  synthetic polynucleotide sequence
taaaaccaagaagaggcctcca

SEQ ID NO: 47521 - DNA, 21 bp, Artificial sequence
  synthetic polynucleotide sequence
gaaatgccaccctgagcccta

SEQ ID NO: 47522 - DNA, 22 bp, Artificial sequence
  synthetic polynucleotide sequence
agaaggccacagaagagaagca

SEQ ID NO: 47523 - DNA, 19 bp, Artificial sequence
  synthetic polynucleotide sequence
cgggcctgcaacggactca

SEQ ID NO: 47524 - DNA, 21 bp, Artificial sequence
  synthetic polynucleotide sequence
gatgcaagaggtaggacgcca

SEQ ID NO: 47525 - DNA, 18 bp, Artificial sequence
  synthetic polynucleotide sequence
cctgcagccctggaggga

SEQ ID NO: 47526 - DNA, 20 bp, Artificial sequence
  synthetic polynucleotide sequence
gtggcccagcattcgacgca

SEQ ID NO: 47527 - DNA, 18 bp, Artificial sequence
  synthetic polynucleotide sequence
ggacttcgcgggccccta

SEQ ID NO: 47528 - DNA, 22 bp, Artificial sequence
  synthetic polynucleotide sequence
tagcgcatcagattcagggcca

SEQ ID NO: 47529 - DNA, 19 bp, Artificial sequence
  synthetic polynucleotide sequence
gcacgacgctgcaacggga

SEQ ID NO: 47530 - DNA, 21 bp, Artificial sequence
  synthetic polynucleotide sequence
gaagaccagcaccgagtacga

SEQ ID NO: 47531 - DNA, 22 bp, Artificial sequence
  synthetic polynucleotide sequence
gttaccaatgcctcagcaacca

SEQ ID NO: 47532 - DNA, 20 bp, Artificial sequence
  synthetic polynucleotide sequence
actacggcccaggaggagaa

SEQ ID NO: 47533 - DNA, 19 bp, Artificial sequence
  synthetic polynucleotide sequence
gggacaaccagcggccaca

SEQ ID NO: 47534 - DNA, 19 bp, Artificial sequence
  synthetic polynucleotide sequence
cccaggaacaagccccgca

SEQ ID NO: 47535 - DNA, 18 bp, Artificial sequence
  synthetic polynucleotide sequence
caacgcctgcccctggga

SEQ ID NO: 47536 - DNA, 18 bp, Artificial sequence
  synthetic polynucleotide sequence
ggcggagggtgttgcgga

SEQ ID NO: 47537 - DNA, 21 bp, Artificial sequence
  synthetic polynucleotide sequence
ctccagcacagacgatggcta

SEQ ID NO: 47538 - DNA, 23 bp, Artificial sequence
  synthetic polynucleotide sequence
gtaaaatccgggtaggaacacca

SEQ ID NO: 47539 - DNA, 21 bp, Artificial sequence
  synthetic polynucleotide sequence
cctgaggctgcagcagaagca

SEQ ID NO: 47540 - DNA, 20 bp, Artificial sequence
  synthetic polynucleotide sequence
cctctcctggtaggcagcaa

SEQ ID NO: 47541 - DNA, 19 bp, Artificial sequence
  synthetic polynucleotide sequence
ccctgggctctggaaggca

SEQ ID NO: 47542 - DNA, 22 bp, Artificial sequence
  synthetic polynucleotide sequence
caaaggaagcatggtccagaga

SEQ ID NO: 47543 - DNA, 20 bp, Artificial sequence
  synthetic polynucleotide sequence
gaggacgtgcccatgcccaa

SEQ ID NO: 47544 - DNA, 22 bp, Artificial sequence
  synthetic polynucleotide sequence
aatgccgatgatgagaaggcca

SEQ ID NO: 47545 - DNA, 19 bp, Artificial sequence
  synthetic polynucleotide sequence
ctctgtggggtggcacgca

SEQ ID NO: 47546 - DNA, 22 bp, Artificial sequence
  synthetic polynucleotide sequence
ggatccacactggttgaggaga

SEQ ID NO: 47547 - DNA, 18 bp, Artificial sequence
  synthetic polynucleotide sequence
cactggcgggggtcagca

SEQ ID NO: 47548 - DNA, 19 bp, Artificial sequence
  synthetic polynucleotide sequence
cagccgaagctgacgcgga

SEQ ID NO: 47549 - DNA, 20 bp, Artificial sequence
  synthetic polynucleotide sequence
cgtgtggctggtcaccccaa

SEQ ID NO: 47550 - DNA, 21 bp, Artificial sequence
  synthetic polynucleotide sequence
ggtgtgatagtccccagggca

SEQ ID NO: 47551 - DNA, 22 bp, Artificial sequence
  synthetic polynucleotide sequence
caaagaaaacccagccagcaga

SEQ ID NO: 47552 - DNA, 21 bp, Artificial sequence
  synthetic polynucleotide sequence
tccaggaaggcttcacgtcca

SEQ ID NO: 47553 - DNA, 18 bp, Artificial sequence
  synthetic polynucleotide sequence
cgctggatgtggcgggca

SEQ ID NO: 47554 - DNA, 21 bp, Artificial sequence
  synthetic polynucleotide sequence
tgttgccggtgtaccagagga

SEQ ID NO: 47555 - DNA, 20 bp, Artificial sequence
  synthetic polynucleotide sequence
cagtggtggagcacctcgaa

SEQ ID NO: 47556 - DNA, 21 bp, Artificial sequence
  synthetic polynucleotide sequence
ggtgaagagtgcatggcacaa

SEQ ID NO: 47557 - DNA, 21 bp, Artificial sequence
  synthetic polynucleotide sequence
ccacaactacatcctcccgca

SEQ ID NO: 47558 - DNA, 20 bp, Artificial sequence
  synthetic polynucleotide sequence
gttctcggaggcgtccacca

SEQ ID NO: 47559 - DNA, 22 bp, Artificial sequence
  synthetic polynucleotide sequence
tggaaactgggctgggtagaga

SEQ ID NO: 47560 - DNA, 21 bp, Artificial sequence
  synthetic polynucleotide sequence
cacaggaatggccagtctgga

SEQ ID NO: 47561 - DNA, 21 bp, Artificial sequence
  synthetic polynucleotide sequence
gccacggctgcattaccggaa

SEQ ID NO: 47562 - DNA, 20 bp, Artificial sequence
  synthetic polynucleotide sequence
tcctcccactcaacagccga

SEQ ID NO: 47563 - DNA, 18 bp, Artificial sequence
  synthetic polynucleotide sequence
ccaggacctacggcacca

SEQ ID NO: 47564 - DNA, 22 bp, Artificial sequence
  synthetic polynucleotide sequence
actcaaagagatgcagacagca

SEQ ID NO: 47565 - DNA, 20 bp, Artificial sequence
  synthetic polynucleotide sequence
ggtcagagttgctccaagca

SEQ ID NO: 47566 - DNA, 18 bp, Artificial sequence
  synthetic polynucleotide sequence
caaacatcacgcagccca

SEQ ID NO: 47567 - DNA, 21 bp, Artificial sequence
  synthetic polynucleotide sequence
aagggttaggatgcaaggcca

SEQ ID NO: 47568 - DNA, 21 bp, Artificial sequence
  synthetic polynucleotide sequence
ggtagtatgctccaccggcca

SEQ ID NO: 47569 - DNA, 21 bp, Artificial sequence
  synthetic polynucleotide sequence
tgtcccaagtgtactgccaca

SEQ ID NO: 47570 - DNA, 21 bp, Artificial sequence
  synthetic polynucleotide sequence
ggagactggagaagagcccga

SEQ ID NO: 47571 - DNA, 21 bp, Artificial sequence
  synthetic polynucleotide sequence
atcccgagatggagctggaga

SEQ ID NO: 47572 - DNA, 21 bp, Artificial sequence
  synthetic polynucleotide sequence
gctgcagctgctccatcacca

SEQ ID NO: 47573 - DNA, 21 bp, Artificial sequence
  synthetic polynucleotide sequence
cgtcactgtacagccaccgca

SEQ ID NO: 47574 - DNA, 22 bp, Artificial sequence
  synthetic polynucleotide sequence
caatggcccccttataacacca

SEQ ID NO: 47575 - DNA, 20 bp, Artificial sequence
  synthetic polynucleotide sequence
cttctccatccagggccgca

SEQ ID NO: 47576 - DNA, 18 bp, Artificial sequence
  synthetic polynucleotide sequence
gccggtaggaggtggcca

SEQ ID NO: 47577 - DNA, 18 bp, Artificial sequence
  synthetic polynucleotide sequence
atcgaccaggatgggcca

SEQ ID NO: 47578 - DNA, 18 bp, Artificial sequence
  synthetic polynucleotide sequence
cttccacccgggtagcca

SEQ ID NO: 47579 - DNA, 21 bp, Artificial sequence
  synthetic polynucleotide sequence
gagccccttgaaggaaccaca

SEQ ID NO: 47580 - DNA, 21 bp, Artificial sequence
  synthetic polynucleotide sequence
ttgacaaatgcctggtggcga

SEQ ID NO: 47581 - DNA, 22 bp, Artificial sequence
  synthetic polynucleotide sequence
tgaagagagccttgaggtggaa

SEQ ID NO: 47582 - DNA, 18 bp, Artificial sequence
  synthetic polynucleotide sequence
tggggcctctgggtggga

SEQ ID NO: 47583 - DNA, 19 bp, Artificial sequence
  synthetic polynucleotide sequence
ccggaccctgcacacgcca

SEQ ID NO: 47584 - DNA, 22 bp, Artificial sequence
  synthetic polynucleotide sequence
aaggagatggatcgaaagggga

SEQ ID NO: 47585 - DNA, 20 bp, Artificial sequence
  synthetic polynucleotide sequence
cttggtggaccaccatcaca

SEQ ID NO: 47586 - DNA, 21 bp, Artificial sequence
  synthetic polynucleotide sequence
aaccagagtagctgagcccga

SEQ ID NO: 47587 - DNA, 20 bp, Artificial sequence
  synthetic polynucleotide sequence
cgcacgtatcctgcacccca

SEQ ID NO: 47588 - DNA, 25 bp, Artificial sequence
  synthetic polynucleotide sequence
aaaaggaccgataagaccagtggca

SEQ ID NO: 47589 - DNA, 20 bp, Artificial sequence
  synthetic polynucleotide sequence
cccagccgtcccaccacaga

SEQ ID NO: 47590 - DNA, 20 bp, Artificial sequence
  synthetic polynucleotide sequence
ggcagagggtaggacgagca

SEQ ID NO: 47591 - DNA, 20 bp, Artificial sequence
  synthetic polynucleotide sequence
cacggcgcccaattcccaga

SEQ ID NO: 47592 - DNA, 20 bp, Artificial sequence
  synthetic polynucleotide sequence
cgcaggggccaaagtctgga

SEQ ID NO: 47593 - DNA, 21 bp, Artificial sequence
  synthetic polynucleotide sequence
actcactagcatccccactga

SEQ ID NO: 47594 - DNA, 18 bp, Artificial sequence
  synthetic polynucleotide sequence
cttggcagggccctggga

SEQ ID NO: 47595 - DNA, 22 bp, Artificial sequence
  synthetic polynucleotide sequence
atataccagcccagtgaaccca

SEQ ID NO: 47596 - DNA, 22 bp, Artificial sequence
  synthetic polynucleotide sequence
gaggccactaaggagatgagga

SEQ ID NO: 47597 - DNA, 18 bp, Artificial sequence
  synthetic polynucleotide sequence
gccatcgccttccccgca

SEQ ID NO: 47598 - DNA, 20 bp, Artificial sequence
  synthetic polynucleotide sequence
tcatactggtccgcgagcca

SEQ ID NO: 47599 - DNA, 21 bp, Artificial sequence
  synthetic polynucleotide sequence
acagcggctgacatactggaa

SEQ ID NO: 47600 - DNA, 20 bp, Artificial sequence
  synthetic polynucleotide sequence
gcacgacaaggaaggggcca

SEQ ID NO: 47601 - DNA, 20 bp, Artificial sequence
  synthetic polynucleotide sequence
tgaggggttgaggcctgaca

SEQ ID NO: 47602 - DNA, 21 bp, Artificial sequence
  synthetic polynucleotide sequence
ggattccaccggttcccagga

SEQ ID NO: 47603 - DNA, 18 bp, Artificial sequence
  synthetic polynucleotide sequence
gccgacctccccagcaga

SEQ ID NO: 47604 - DNA, 21 bp, Artificial sequence
  synthetic polynucleotide sequence
acaacgataccccaggtggca

SEQ ID NO: 47605 - DNA, 19 bp, Artificial sequence
  synthetic polynucleotide sequence
ctgggctgccatggggtca

SEQ ID NO: 47606 - DNA, 20 bp, Artificial sequence
  synthetic polynucleotide sequence
ctcccggtactcgatggcca

SEQ ID NO: 47607 - DNA, 19 bp, Artificial sequence
  synthetic polynucleotide sequence
ccacagcagcagccaggca

SEQ ID NO: 47608 - DNA, 21 bp, Artificial sequence
  synthetic polynucleotide sequence
cagagacaccccctttcacca

SEQ ID NO: 47609 - DNA, 21 bp, Artificial sequence
  synthetic polynucleotide sequence
acgaggagaaggcagtggaga

SEQ ID NO: 47610 - DNA, 22 bp, Artificial sequence
  synthetic polynucleotide sequence
ttgatggcaaacaccagagcca

SEQ ID NO: 47611 - DNA, 21 bp, Artificial sequence
  synthetic polynucleotide sequence
tcaccacggccgcaatagaca

SEQ ID NO: 47612 - DNA, 19 bp, Artificial sequence
  synthetic polynucleotide sequence
gggtgactgagctgcggga

SEQ ID NO: 47613 - DNA, 21 bp, Artificial sequence
  synthetic polynucleotide sequence
catgggcggtagtcactggaa

SEQ ID NO: 47614 - DNA, 22 bp, Artificial sequence
  synthetic polynucleotide sequence
acatccagggaagaaagcacca

SEQ ID NO: 47615 - DNA, 19 bp, Artificial sequence
  synthetic polynucleotide sequence
caacagcggaggggcctga

SEQ ID NO: 47616 - DNA, 20 bp, Artificial sequence
  synthetic polynucleotide sequence
gtagccgccaaacactgcca

SEQ ID NO: 47617 - DNA, 22 bp, Artificial sequence
  synthetic polynucleotide sequence
aactctgtcaaccaggtgcaga

SEQ ID NO: 47618 - DNA, 21 bp, Artificial sequence
  synthetic polynucleotide sequence
tcaacagcaggaagggtgtga

SEQ ID NO: 47619 - DNA, 22 bp, Artificial sequence
  synthetic polynucleotide sequence
aggagacaacctggaagaacga

SEQ ID NO: 47620 - DNA, 20 bp, Artificial sequence
  synthetic polynucleotide sequence
atgctgcagtacgcatccaa

SEQ ID NO: 47621 - DNA, 19 bp, Artificial sequence
  synthetic polynucleotide sequence
ggcggccacaagctcctca

SEQ ID NO: 47622 - DNA, 22 bp, Artificial sequence
  synthetic polynucleotide sequence
accagcatgacaaagccggtga

SEQ ID NO: 47623 - DNA, 22 bp, Artificial sequence
  synthetic polynucleotide sequence
acaaagagcagacacacagcca

SEQ ID NO: 47624 - DNA, 21 bp, Artificial sequence
  synthetic polynucleotide sequence
atccactcagtaggccacgga

SEQ ID NO: 47625 - DNA, 18 bp, Artificial sequence
  synthetic polynucleotide sequence
accccgaacggcccccaa

SEQ ID NO: 47626 - DNA, 19 bp, Artificial sequence
  synthetic polynucleotide sequence
ttgatgcagcctcagagca

SEQ ID NO: 47627 - DNA, 20 bp, Artificial sequence
  synthetic polynucleotide sequence
cttgtgcctgggcgtcccaa

SEQ ID NO: 47628 - DNA, 20 bp, Artificial sequence
  synthetic polynucleotide sequence
cgagcaatcagcaggcggca

SEQ ID NO: 47629 - DNA, 21 bp, Artificial sequence
  synthetic polynucleotide sequence
gctaccagccagatcccctga

SEQ ID NO: 47630 - DNA, 19 bp, Artificial sequence
  synthetic polynucleotide sequence
ttcagagctgccaaggtga

SEQ ID NO: 47631 - DNA, 21 bp, Artificial sequence
  synthetic polynucleotide sequence
tgtcccagttgtgcgaggaca

SEQ ID NO: 47632 - DNA, 21 bp, Artificial sequence
  synthetic polynucleotide sequence
tgatggcgttcaggaagagga

SEQ ID NO: 47633 - DNA, 21 bp, Artificial sequence
  synthetic polynucleotide sequence
tgacagccacccactcacaca

SEQ ID NO: 47634 - DNA, 20 bp, Artificial sequence
  synthetic polynucleotide sequence
aatgctgagctcctggccca

SEQ ID NO: 47635 - DNA, 18 bp, Artificial sequence
  synthetic polynucleotide sequence
attccagcacacccagca

SEQ ID NO: 47636 - DNA, 18 bp, Artificial sequence
  synthetic polynucleotide sequence
gccaatgacccaacgcca

SEQ ID NO: 47637 - DNA, 21 bp, Artificial sequence
  synthetic polynucleotide sequence
tgggaggcttggccaaatcca

SEQ ID NO: 47638 - DNA, 23 bp, Artificial sequence
  synthetic polynucleotide sequence
caaaacacagggggagaaatgca

SEQ ID NO: 47639 - DNA, 21 bp, Artificial sequence
  synthetic polynucleotide sequence
gcaaacccctgcggatcctca

SEQ ID NO: 47640 - DNA, 20 bp, Artificial sequence
  synthetic polynucleotide sequence
tctctctgggggctagcaga

SEQ ID NO: 47641 - DNA, 21 bp, Artificial sequence
  synthetic polynucleotide sequence
tggagaagtggaggcctctca

SEQ ID NO: 47642 - DNA, 22 bp, Artificial sequence
  synthetic polynucleotide sequence
ctaaacttctggaagaggggga

SEQ ID NO: 47643 - DNA, 20 bp, Artificial sequence
  synthetic polynucleotide sequence
ctttgccatccccggctcca

SEQ ID NO: 47644 - DNA, 20 bp, Artificial sequence
  synthetic polynucleotide sequence
gtagcagcatgtggcaccca

SEQ ID NO: 47645 - DNA, 21 bp, Artificial sequence
  synthetic polynucleotide sequence
tcagcaaggctgtaccctcaa

SEQ ID NO: 47646 - DNA, 20 bp, Artificial sequence
  synthetic polynucleotide sequence
gcttgcctccgcaccacaga

SEQ ID NO: 47647 - DNA, 18 bp, Artificial sequence
  synthetic polynucleotide sequence
acctccaggcgggtgcga

SEQ ID NO: 47648 - DNA, 20 bp, Artificial sequence
  synthetic polynucleotide sequence
agaaactgaggccccggcta

SEQ ID NO: 47649 - DNA, 18 bp, Artificial sequence
  synthetic polynucleotide sequence
gctcctgcaccacgggga

SEQ ID NO: 47650 - DNA, 18 bp, Artificial sequence
  synthetic polynucleotide sequence
agagccagccagccgcca

SEQ ID NO: 47651 - DNA, 21 bp, Artificial sequence
  synthetic polynucleotide sequence
gtcgctacatggagctgacca

SEQ ID NO: 47652 - DNA, 18 bp, Artificial sequence
  synthetic polynucleotide sequence
gggtcctgcagggacgca

SEQ ID NO: 47653 - DNA, 18 bp, Artificial sequence
  synthetic polynucleotide sequence
tggcatggctggggagca

SEQ ID NO: 47654 - DNA, 22 bp, Artificial sequence
  synthetic polynucleotide sequence
cataagatatctgccacaccca

SEQ ID NO: 47655 - DNA, 20 bp, Artificial sequence
  synthetic polynucleotide sequence
acacgcggaagaacagccca

SEQ ID NO: 47656 - DNA, 20 bp, Artificial sequence
  synthetic polynucleotide sequence
aaccagtctgtccaccccca

SEQ ID NO: 47657 - DNA, 20 bp, Artificial sequence
  synthetic polynucleotide sequence
gctcagcagcgattggcaga

SEQ ID NO: 47658 - DNA, 20 bp, Artificial sequence
  synthetic polynucleotide sequence
cgccttcgagatcccacgca

SEQ ID NO: 47659 - DNA, 21 bp, Artificial sequence
  synthetic polynucleotide sequence
gaacactggcagcctcaggaa

SEQ ID NO: 47660 - DNA, 20 bp, Artificial sequence
  synthetic polynucleotide sequence
cagaggagcaccgtggtgca

SEQ ID NO: 47661 - DNA, 24 bp, Artificial sequence
  synthetic polynucleotide sequence
atgcagctgttatttatcccacca

SEQ ID NO: 47662 - DNA, 20 bp, Artificial sequence
  synthetic polynucleotide sequence
cgaaaagccaaatgcgagca

SEQ ID NO: 47663 - DNA, 20 bp, Artificial sequence
  synthetic polynucleotide sequence
taggaagaacaggtgctcga

SEQ ID NO: 47664 - DNA, 23 bp, Artificial sequence
  synthetic polynucleotide sequence
gaaaaaacacagctagtcccgga

SEQ ID NO: 47665 - DNA, 21 bp, Artificial sequence
  synthetic polynucleotide sequence
ttcccagctacgaggaagtga

SEQ ID NO: 47666 - DNA, 19 bp, Artificial sequence
  synthetic polynucleotide sequence
gtctcgtcgagccccgtca

SEQ ID NO: 47667 - DNA, 18 bp, Artificial sequence
  synthetic polynucleotide sequence
cagcctgtacaccccgga

SEQ ID NO: 47668 - DNA, 18 bp, Artificial sequence
  synthetic polynucleotide sequence
cccgaggccccaaggaga

SEQ ID NO: 47669 - DNA, 20 bp, Artificial sequence
  synthetic polynucleotide sequence
gcctgaccacagactgggta

SEQ ID NO: 47670 - DNA, 18 bp, Artificial sequence
  synthetic polynucleotide sequence
gggcccccatcttcccca

SEQ ID NO: 47671 - DNA, 20 bp, Artificial sequence
  synthetic polynucleotide sequence
acagccctcttccacaccca

SEQ ID NO: 47672 - DNA, 22 bp, Artificial sequence
  synthetic polynucleotide sequence
acgaaatccacagaacgcgcca

SEQ ID NO: 47673 - DNA, 18 bp, Artificial sequence
  synthetic polynucleotide sequence
ccttcgaccccacacgca

SEQ ID NO: 47674 - DNA, 18 bp, Artificial sequence
  synthetic polynucleotide sequence
agggcctcagctccagca

SEQ ID NO: 47675 - DNA, 21 bp, Artificial sequence
  synthetic polynucleotide sequence
gaacaaccagctcagcctgca

SEQ ID NO: 47676 - DNA, 21 bp, Artificial sequence
  synthetic polynucleotide sequence
ttcgtggaagtgcactaccca

SEQ ID NO: 47677 - DNA, 21 bp, Artificial sequence
  synthetic polynucleotide sequence
ttcacagaccgcactttggca

SEQ ID NO: 47678 - DNA, 21 bp, Artificial sequence
  synthetic polynucleotide sequence
cccaataaagagcccggccca

SEQ ID NO: 47679 - DNA, 24 bp, Artificial sequence
  synthetic polynucleotide sequence
aatggaactcaagggtagtatcca

SEQ ID NO: 47680 - DNA, 19 bp, Artificial sequence
  synthetic polynucleotide sequence
atgcatacagggacgcaca

SEQ ID NO: 47681 - DNA, 21 bp, Artificial sequence
  synthetic polynucleotide sequence
tcagccctctcagccatgcaa

SEQ ID NO: 47682 - DNA, 20 bp, Artificial sequence
  synthetic polynucleotide sequence
gtggggggaaacagggctca

SEQ ID NO: 47683 - DNA, 22 bp, Artificial sequence
  synthetic polynucleotide sequence
taaggaagaggagttgtacgca

SEQ ID NO: 47684 - DNA, 18 bp, Artificial sequence
  synthetic polynucleotide sequence
tcagcgaatggcagctga

SEQ ID NO: 47685 - DNA, 19 bp, Artificial sequence
  synthetic polynucleotide sequence
ccctggaggtgcacgtgga

SEQ ID NO: 47686 - DNA, 21 bp, Artificial sequence
  synthetic polynucleotide sequence
agcgccgggacatgcaactga

SEQ ID NO: 47687 - DNA, 21 bp, Artificial sequence
  synthetic polynucleotide sequence
tgaccctcgacatggatcaca

SEQ ID NO: 47688 - DNA, 19 bp, Artificial sequence
  synthetic polynucleotide sequence
tctgttaaagccccagcca

SEQ ID NO: 47689 - DNA, 20 bp, Artificial sequence
  synthetic polynucleotide sequence
atgcaacatacggcacccta

SEQ ID NO: 47690 - DNA, 22 bp, Artificial sequence
  synthetic polynucleotide sequence
cgaatgagaacaggtgtcagca

SEQ ID NO: 47691 - DNA, 19 bp, Artificial sequence
  synthetic polynucleotide sequence
tccgcatgatcatggccaa

SEQ ID NO: 47692 - DNA, 21 bp, Artificial sequence
  synthetic polynucleotide sequence
gcttggctgggaggtagacga

SEQ ID NO: 47693 - DNA, 20 bp, Artificial sequence
  synthetic polynucleotide sequence
accctcgctgggactgagca

SEQ ID NO: 47694 - DNA, 21 bp, Artificial sequence
  synthetic polynucleotide sequence
ccgttgtcgggcaggaacaca

SEQ ID NO: 47695 - DNA, 20 bp, Artificial sequence
  synthetic polynucleotide sequence
cgatcagaggcgccatgcca

SEQ ID NO: 47696 - DNA, 20 bp, Artificial sequence
  synthetic polynucleotide sequence
tgcagaagcacaggcgggca

SEQ ID NO: 47697 - DNA, 20 bp, Artificial sequence
  synthetic polynucleotide sequence
gtccgccgctaccttcacca

SEQ ID NO: 47698 - DNA, 19 bp, Artificial sequence
  synthetic polynucleotide sequence
ctctggatcctggcggcca

SEQ ID NO: 47699 - DNA, 21 bp, Artificial sequence
  synthetic polynucleotide sequence
ccccaagaaggagcccatgga

SEQ ID NO: 47700 - DNA, 22 bp, Artificial sequence
  synthetic polynucleotide sequence
gcaatagactcgaagcggtgca

SEQ ID NO: 47701 - DNA, 20 bp, Artificial sequence
  synthetic polynucleotide sequence
atcaaagatgccaacagcca

SEQ ID NO: 47702 - DNA, 20 bp, Artificial sequence
  synthetic polynucleotide sequence
aaaacagctagcccacccaa

SEQ ID NO: 47703 - DNA, 20 bp, Artificial sequence
  synthetic polynucleotide sequence
ggtgtggagcagttggagga

SEQ ID NO: 47704 - DNA, 20 bp, Artificial sequence
  synthetic polynucleotide sequence
taccatgccaaacggctgca

SEQ ID NO: 47705 - DNA, 21 bp, Artificial sequence
  synthetic polynucleotide sequence
tagccagaccctcaagcacca

SEQ ID NO: 47706 - DNA, 21 bp, Artificial sequence
  synthetic polynucleotide sequence
aaccccatctgatcccaccca

SEQ ID NO: 47707 - DNA, 18 bp, Artificial sequence
  synthetic polynucleotide sequence
gtccgggtcgagcgcaga

SEQ ID NO: 47708 - DNA, 20 bp, Artificial sequence
  synthetic polynucleotide sequence
accaaacactgctcgggcca

SEQ ID NO: 47709 - DNA, 21 bp, Artificial sequence
  synthetic polynucleotide sequence
ctccctggccaagaagaagca

SEQ ID NO: 47710 - DNA, 19 bp, Artificial sequence
  synthetic polynucleotide sequence
gaagagtggggcctgggga

SEQ ID NO: 47711 - DNA, 20 bp, Artificial sequence
  synthetic polynucleotide sequence
ctggggagcttggctgggaa

SEQ ID NO: 47712 - DNA, 18 bp, Artificial sequence
  synthetic polynucleotide sequence
ccatctcccgggctgcca

SEQ ID NO: 47713 - DNA, 21 bp, Artificial sequence
  synthetic polynucleotide sequence
acctgccccaggataccctca

SEQ ID NO: 47714 - DNA, 20 bp, Artificial sequence
  synthetic polynucleotide sequence
ccgtagccgaagcctcggaa

SEQ ID NO: 47715 - DNA, 22 bp, Artificial sequence
  synthetic polynucleotide sequence
ggatgagactgcaggagagaga

SEQ ID NO: 47716 - DNA, 21 bp, Artificial sequence
  synthetic polynucleotide sequence
agcactccgtgcaaaaggcaa

SEQ ID NO: 47717 - DNA, 22 bp, Artificial sequence
  synthetic polynucleotide sequence
agctgcaagaagctgtggggaa

SEQ ID NO: 47718 - DNA, 21 bp, Artificial sequence
  synthetic polynucleotide sequence
ttctcactccatcagggccca

SEQ ID NO: 47719 - DNA, 21 bp, Artificial sequence
  synthetic polynucleotide sequence
ggttctggacaccgctcacca

SEQ ID NO: 47720 - DNA, 18 bp, Artificial sequence
  synthetic polynucleotide sequence
gcacgaagaggccgccca

SEQ ID NO: 47721 - DNA, 19 bp, Artificial sequence
  synthetic polynucleotide sequence
gggctggcgagctatggca

SEQ ID NO: 47722 - DNA, 21 bp, Artificial sequence
  synthetic polynucleotide sequence
gtggacatgataagcgcccga

SEQ ID NO: 47723 - DNA, 18 bp, Artificial sequence
  synthetic polynucleotide sequence
ccagcacctcgagccgga

SEQ ID NO: 47724 - DNA, 21 bp, Artificial sequence
  synthetic polynucleotide sequence
agtgtgatgaggagctgggca

SEQ ID NO: 47725 - DNA, 20 bp, Artificial sequence
  synthetic polynucleotide sequence
aaacttggcaagatgcacca

SEQ ID NO: 47726 - DNA, 21 bp, Artificial sequence
  synthetic polynucleotide sequence
atctctccagtagcaggcaga

SEQ ID NO: 47727 - DNA, 22 bp, Artificial sequence
  synthetic polynucleotide sequence
gcaacactggactgtcaaccca

SEQ ID NO: 47728 - DNA, 21 bp, Artificial sequence
  synthetic polynucleotide sequence
atcacgccttcaacagctgca

SEQ ID NO: 47729 - DNA, 19 bp, Artificial sequence
  synthetic polynucleotide sequence
gttcctgcgctcccaggca

SEQ ID NO: 47730 - DNA, 18 bp, Artificial sequence
  synthetic polynucleotide sequence
gggctcggctgtagggca

SEQ ID NO: 47731 - DNA, 20 bp, Artificial sequence
  synthetic polynucleotide sequence
ctgtgccactcgagggtcca

SEQ ID NO: 47732 - DNA, 18 bp, Artificial sequence
  synthetic polynucleotide sequence
agcggcggcagcgagaga

SEQ ID NO: 47733 - DNA, 22 bp, Artificial sequence
  synthetic polynucleotide sequence
atgatcaccaccacgatgctga

SEQ ID NO: 47734 - DNA, 18 bp, Artificial sequence
  synthetic polynucleotide sequence
tggggcccgccgtttcca

SEQ ID NO: 47735 - DNA, 21 bp, Artificial sequence
  synthetic polynucleotide sequence
cctccgtctacgcctacacca

SEQ ID NO: 47736 - DNA, 21 bp, Artificial sequence
  synthetic polynucleotide sequence
agggccccagcatgttccaca

SEQ ID NO: 47737 - DNA, 18 bp, Artificial sequence
  synthetic polynucleotide sequence
ggcactgctacccaccca

SEQ ID NO: 47738 - DNA, 18 bp, Artificial sequence
  synthetic polynucleotide sequence
ggcagcaggaagcccaca

SEQ ID NO: 47739 - DNA, 19 bp, Artificial sequence
  synthetic polynucleotide sequence
gcgagtgcaggtacgagga

SEQ ID NO: 47740 - DNA, 19 bp, Artificial sequence
  synthetic polynucleotide sequence
cggatcagagggtccacca

SEQ ID NO: 47741 - DNA, 21 bp, Artificial sequence
  synthetic polynucleotide sequence
agaatgtgagacccctgccca

SEQ ID NO: 47742 - DNA, 19 bp, Artificial sequence
  synthetic polynucleotide sequence
cggagggaagaggcggtga

SEQ ID NO: 47743 - DNA, 20 bp, Artificial sequence
  synthetic polynucleotide sequence
agctgctgccaggagaacga

SEQ ID NO: 47744 - DNA, 21 bp, Artificial sequence
  synthetic polynucleotide sequence
tctgcagttgcgacagaagca

SEQ ID NO: 47745 - DNA, 18 bp, Artificial sequence
  synthetic polynucleotide sequence
ccgctaccagaagcgaca

SEQ ID NO: 47746 - DNA, 18 bp, Artificial sequence
  synthetic polynucleotide sequence
ccacgggtgcaggagcaa

SEQ ID NO: 47747 - DNA, 20 bp, Artificial sequence
  synthetic polynucleotide sequence
gactgatggggaatccggga

SEQ ID NO: 47748 - DNA, 20 bp, Artificial sequence
  synthetic polynucleotide sequence
gagggagggcatgcccgcga

SEQ ID NO: 47749 - DNA, 18 bp, Artificial sequence
  synthetic polynucleotide sequence
ctgctacaggagccccca

SEQ ID NO: 47750 - DNA, 20 bp, Artificial sequence
  synthetic polynucleotide sequence
tgaggaaggcatacgttgca

SEQ ID NO: 47751 - DNA, 22 bp, Artificial sequence
  synthetic polynucleotide sequence
atgtcgttatcaccaaccccca

SEQ ID NO: 47752 - DNA, 20 bp, Artificial sequence
  synthetic polynucleotide sequence
gctgatccgcttggccacca

SEQ ID NO: 47753 - DNA, 21 bp, Artificial sequence
  synthetic polynucleotide sequence
gagtccacctcagctcagcaa

SEQ ID NO: 47754 - DNA, 22 bp, Artificial sequence
  synthetic polynucleotide sequence
taaggtaagcctatcaccgcca

SEQ ID NO: 47755 - DNA, 21 bp, Artificial sequence
  synthetic polynucleotide sequence
cgggggcctgatgtagaagca

SEQ ID NO: 47756 - DNA, 18 bp, Artificial sequence
  synthetic polynucleotide sequence
gactgcgggagcgggcta

SEQ ID NO: 47757 - DNA, 22 bp, Artificial sequence
  synthetic polynucleotide sequence
caaaggatagtgaggcacagga

SEQ ID NO: 47758 - DNA, 22 bp, Artificial sequence
  synthetic polynucleotide sequence
tgtacgctgcaatgcaagccta

SEQ ID NO: 47759 - DNA, 19 bp, Artificial sequence
  synthetic polynucleotide sequence
ctgtggcacgtggtgggca

SEQ ID NO: 47760 - DNA, 21 bp, Artificial sequence
  synthetic polynucleotide sequence
agctcattgaggggtggcaca

SEQ ID NO: 47761 - DNA, 20 bp, Artificial sequence
  synthetic polynucleotide sequence
cgagaggaggggagagtgga

SEQ ID NO: 47762 - DNA, 20 bp, Artificial sequence
  synthetic polynucleotide sequence
gtaacattcagcaccaccga

SEQ ID NO: 47763 - DNA, 20 bp, Artificial sequence
  synthetic polynucleotide sequence
cagggacggctctcctggca

SEQ ID NO: 47764 - DNA, 21 bp, Artificial sequence
  synthetic polynucleotide sequence
cagcctcctccaactcaggaa

SEQ ID NO: 47765 - DNA, 19 bp, Artificial sequence
  synthetic polynucleotide sequence
ttgccagggatgacatgga

SEQ ID NO: 47766 - DNA, 19 bp, Artificial sequence
  synthetic polynucleotide sequence
ggacgtcctggagcggtca

SEQ ID NO: 47767 - DNA, 21 bp, Artificial sequence
  synthetic polynucleotide sequence
cctcccactcaagagcacaca

SEQ ID NO: 47768 - DNA, 21 bp, Artificial sequence
  synthetic polynucleotide sequence
gtgtcagtgtgccgatccaga

SEQ ID NO: 47769 - DNA, 20 bp, Artificial sequence
  synthetic polynucleotide sequence
ccatccccaccctcaaggca

SEQ ID NO: 47770 - DNA, 20 bp, Artificial sequence
  synthetic polynucleotide sequence
ctcagcaagggcatacgcca

SEQ ID NO: 47771 - DNA, 19 bp, Artificial sequence
  synthetic polynucleotide sequence
gaccgcgagcacctcctca

SEQ ID NO: 47772 - DNA, 21 bp, Artificial sequence
  synthetic polynucleotide sequence
tgtactccaaggacagctgca

SEQ ID NO: 47773 - DNA, 20 bp, Artificial sequence
  synthetic polynucleotide sequence
cttgcagccacccggagcaa

SEQ ID NO: 47774 - DNA, 21 bp, Artificial sequence
  synthetic polynucleotide sequence
ccagaatcccaactcccgtga

SEQ ID NO: 47775 - DNA, 21 bp, Artificial sequence
  synthetic polynucleotide sequence
acaaggagctggaggaggtga

SEQ ID NO: 47776 - DNA, 20 bp, Artificial sequence
  synthetic polynucleotide sequence
ccagactgaagctccgcaca

SEQ ID NO: 47777 - DNA, 21 bp, Artificial sequence
  synthetic polynucleotide sequence
cctcggtcctgacaaaagaca

SEQ ID NO: 47778 - DNA, 18 bp, Artificial sequence
  synthetic polynucleotide sequence
gccggttgcgagccgtga

SEQ ID NO: 47779 - DNA, 21 bp, Artificial sequence
  synthetic polynucleotide sequence
ggagtgaggatgaggactgga

SEQ ID NO: 47780 - DNA, 22 bp, Artificial sequence
  synthetic polynucleotide sequence
gcatgtgtgtgcccagaaagga

SEQ ID NO: 47781 - DNA, 23 bp, Artificial sequence
  synthetic polynucleotide sequence
gtagtcagactgactccagagga

SEQ ID NO: 47782 - DNA, 22 bp, Artificial sequence
  synthetic polynucleotide sequence
gtagaggggaactggaacacca

SEQ ID NO: 47783 - DNA, 19 bp, Artificial sequence
  synthetic polynucleotide sequence
tgtgggagacaagtagcca

SEQ ID NO: 47784 - DNA, 21 bp, Artificial sequence
  synthetic polynucleotide sequence
ctgctgatcagagaggctcca

SEQ ID NO: 47785 - DNA, 19 bp, Artificial sequence
  synthetic polynucleotide sequence
ctggccacacagttccaga

SEQ ID NO: 47786 - DNA, 18 bp, Artificial sequence
  synthetic polynucleotide sequence
caccctgacatgcgtcca

SEQ ID NO: 47787 - DNA, 21 bp, Artificial sequence
  synthetic polynucleotide sequence
cctgcagtgggatgggagtca

SEQ ID NO: 47788 - DNA, 22 bp, Artificial sequence
  synthetic polynucleotide sequence
aaaggaagcagtccatctggca

SEQ ID NO: 47789 - DNA, 20 bp, Artificial sequence
  synthetic polynucleotide sequence
caccacccgcagtgaaacga

SEQ ID NO: 47790 - DNA, 25 bp, Artificial sequence
  synthetic polynucleotide sequence
ccagtagagagctgaaccaaagcaa

SEQ ID NO: 47791 - DNA, 18 bp, Artificial sequence
  synthetic polynucleotide sequence
cgccctctggaaggcaca

SEQ ID NO: 47792 - DNA, 19 bp, Artificial sequence
  synthetic polynucleotide sequence
ccgagacccttgcaacaca

SEQ ID NO: 47793 - DNA, 21 bp, Artificial sequence
  synthetic polynucleotide sequence
tgcacttcggcaccacccaca

SEQ ID NO: 47794 - DNA, 21 bp, Artificial sequence
  synthetic polynucleotide sequence
cgtacaccttccagccctcca

SEQ ID NO: 47795 - DNA, 20 bp, Artificial sequence
  synthetic polynucleotide sequence
agggggattcaggaggacca

SEQ ID NO: 47796 - DNA, 22 bp, Artificial sequence
  synthetic polynucleotide sequence
ggtaaaccttgagaccctggca

SEQ ID NO: 47797 - DNA, 20 bp, Artificial sequence
  synthetic polynucleotide sequence
gaactcaagccgccagagca

SEQ ID NO: 47798 - DNA, 20 bp, Artificial sequence
  synthetic polynucleotide sequence
gatgatggagcctccgcaca

SEQ ID NO: 47799 - DNA, 21 bp, Artificial sequence
  synthetic polynucleotide sequence
caagatctgcaaccacaggga

SEQ ID NO: 47800 - DNA, 18 bp, Artificial sequence
  synthetic polynucleotide sequence
tggcagctgtccacgcca

SEQ ID NO: 47801 - DNA, 20 bp, Artificial sequence
  synthetic polynucleotide sequence
ctcaggcacagtcaggccca

SEQ ID NO: 47802 - DNA, 20 bp, Artificial sequence
  synthetic polynucleotide sequence
gacctggactgacgcctgca

SEQ ID NO: 47803 - DNA, 20 bp, Artificial sequence
  synthetic polynucleotide sequence
gggagtcaggaccctctcca

SEQ ID NO: 47804 - DNA, 20 bp, Artificial sequence
  synthetic polynucleotide sequence
tccagtgtacccaccccaca

SEQ ID NO: 47805 - DNA, 21 bp, Artificial sequence
  synthetic polynucleotide sequence
actgcttccaggaggacagca

SEQ ID NO: 47806 - DNA, 20 bp, Artificial sequence
  synthetic polynucleotide sequence
aggcggctcaccttgaagga

SEQ ID NO: 47807 - DNA, 21 bp, Artificial sequence
  synthetic polynucleotide sequence
aggctgtcagatcccacacca

SEQ ID NO: 47808 - DNA, 19 bp, Artificial sequence
  synthetic polynucleotide sequence
tacccagcacttctcccca

SEQ ID NO: 47809 - DNA, 20 bp, Artificial sequence
  synthetic polynucleotide sequence
cctgcagggagccctctgga

SEQ ID NO: 47810 - DNA, 20 bp, Artificial sequence
  synthetic polynucleotide sequence
ctgggaagtggggccggcca

SEQ ID NO: 47811 - DNA, 19 bp, Artificial sequence
  synthetic polynucleotide sequence
gcaagatggacacgagcca

SEQ ID NO: 47812 - DNA, 17 bp, Artificial sequence
  synthetic polynucleotide sequence
cggggcaaaccggagaa

SEQ ID NO: 47813 - DNA, 23 bp, Artificial sequence
  synthetic polynucleotide sequence
ggctaagaagtcagaggtagcca

SEQ ID NO: 47814 - DNA, 19 bp, Artificial sequence
  synthetic polynucleotide sequence
gaagcaatggaagcaccca

SEQ ID NO: 47815 - DNA, 20 bp, Artificial sequence
  synthetic polynucleotide sequence
ccccagtcatcacgtggcca

SEQ ID NO: 47816 - DNA, 20 bp, Artificial sequence
  synthetic polynucleotide sequence
ctgagccagtgccaagcgga

SEQ ID NO: 47817 - DNA, 18 bp, Artificial sequence
  synthetic polynucleotide sequence
acagcctcctcacccgca

SEQ ID NO: 47818 - DNA, 19 bp, Artificial sequence
  synthetic polynucleotide sequence
tttgagcagaggcacagca

SEQ ID NO: 47819 - DNA, 22 bp, Artificial sequence
  synthetic polynucleotide sequence
aacaggagttgttggaagagca

SEQ ID NO: 47820 - DNA, 21 bp, Artificial sequence
  synthetic polynucleotide sequence
ggcaaagtatacccctgggca

SEQ ID NO: 47821 - DNA, 20 bp, Artificial sequence
  synthetic polynucleotide sequence
ggattcggagccctgagcaa

SEQ ID NO: 47822 - DNA, 20 bp, Artificial sequence
  synthetic polynucleotide sequence
tagcattgaggggacacaca

SEQ ID NO: 47823 - DNA, 18 bp, Artificial sequence
  synthetic polynucleotide sequence
acacccagaccctgggca

SEQ ID NO: 47824 - DNA, 20 bp, Artificial sequence
  synthetic polynucleotide sequence
ctggatctggcagtaccaga

SEQ ID NO: 47825 - DNA, 19 bp, Artificial sequence
  synthetic polynucleotide sequence
cccccctgagatctgagga

SEQ ID NO: 47826 - DNA, 18 bp, Artificial sequence
  synthetic polynucleotide sequence
ttcagggcacccacggta

SEQ ID NO: 47827 - DNA, 21 bp, Artificial sequence
  synthetic polynucleotide sequence
ggcgctatcagggtccaagga

SEQ ID NO: 47828 - DNA, 20 bp, Artificial sequence
  synthetic polynucleotide sequence
atatgatccccacactggca

SEQ ID NO: 47829 - DNA, 18 bp, Artificial sequence
  synthetic polynucleotide sequence
gtgtattcggtgccgcga

SEQ ID NO: 47830 - DNA, 18 bp, Artificial sequence
  synthetic polynucleotide sequence
cttcgcgttgggtgggca

SEQ ID NO: 47831 - DNA, 18 bp, Artificial sequence
  synthetic polynucleotide sequence
ctgcggctctgcgccaca

SEQ ID NO: 47832 - DNA, 18 bp, Artificial sequence
  synthetic polynucleotide sequence
tggccacaccatggcgca

SEQ ID NO: 47833 - DNA, 21 bp, Artificial sequence
  synthetic polynucleotide sequence
ttgcaggatgcggaggaggaa

SEQ ID NO: 47834 - DNA, 21 bp, Artificial sequence
  synthetic polynucleotide sequence
ctctcctcatccacaccagca

SEQ ID NO: 47835 - DNA, 20 bp, Artificial sequence
  synthetic polynucleotide sequence
aggggtacagtgggacagca

SEQ ID NO: 47836 - DNA, 18 bp, Artificial sequence
  synthetic polynucleotide sequence
gcccttccagtggaacca

SEQ ID NO: 47837 - DNA, 19 bp, Artificial sequence
  synthetic polynucleotide sequence
caatggcgtggagctgaga

SEQ ID NO: 47838 - DNA, 20 bp, Artificial sequence
  synthetic polynucleotide sequence
gtgaggagcacatgggtgga

SEQ ID NO: 47839 - DNA, 19 bp, Artificial sequence
  synthetic polynucleotide sequence
gccaggcttcccccagtga

SEQ ID NO: 47840 - DNA, 20 bp, Artificial sequence
  synthetic polynucleotide sequence
atgggtagactggtggccga

SEQ ID NO: 47841 - DNA, 21 bp, Artificial sequence
  synthetic polynucleotide sequence
gcagccaaccaggcaacacca

SEQ ID NO: 47842 - DNA, 19 bp, Artificial sequence
  synthetic polynucleotide sequence
ccacccacgaggaggacag

SEQ ID NO: 47843 - DNA, 18 bp, Artificial sequence
  synthetic polynucleotide sequence
atcgagccagcgcagaga

SEQ ID NO: 47844 - DNA, 21 bp, Artificial sequence
  synthetic polynucleotide sequence
gatgctgacactccatgcaga

SEQ ID NO: 47845 - DNA, 20 bp, Artificial sequence
  synthetic polynucleotide sequence
tgaaggcggccatctcgcaa

SEQ ID NO: 47846 - DNA, 20 bp, Artificial sequence
  synthetic polynucleotide sequence
tagccatccatccagcagca

SEQ ID NO: 47847 - DNA, 22 bp, Artificial sequence
  synthetic polynucleotide sequence
aagacagtcatcaagctggcca

SEQ ID NO: 47848 - DNA, 19 bp, Artificial sequence
  synthetic polynucleotide sequence
ggcagtgaggtggcgctga

SEQ ID NO: 47849 - DNA, 20 bp, Artificial sequence
  synthetic polynucleotide sequence
accccacgcttccaaggcaa

SEQ ID NO: 47850 - DNA, 20 bp, Artificial sequence
  synthetic polynucleotide sequence
gacagcccaacagggacaca

SEQ ID NO: 47851 - DNA, 21 bp, Artificial sequence
  synthetic polynucleotide sequence
ggaacaccacctcacgcccaa

SEQ ID NO: 47852 - DNA, 22 bp, Artificial sequence
  synthetic polynucleotide sequence
atcttgccaaggtgctgagtga

SEQ ID NO: 47853 - DNA, 20 bp, Artificial sequence
  synthetic polynucleotide sequence
cacctgacgcccaggaccca

SEQ ID NO: 47854 - DNA, 20 bp, Artificial sequence
  synthetic polynucleotide sequence
gagggtggagaggaactcca

SEQ ID NO: 47855 - DNA, 20 bp, Artificial sequence
  synthetic polynucleotide sequence
gagctggtacagcaggccca

SEQ ID NO: 47856 - DNA, 21 bp, Artificial sequence
  synthetic polynucleotide sequence
tcttccatcctctccaaggca

SEQ ID NO: 47857 - DNA, 20 bp, Artificial sequence
  synthetic polynucleotide sequence
cacagcttcaagggggagga

SEQ ID NO: 47858 - DNA, 20 bp, Artificial sequence
  synthetic polynucleotide sequence
tgcacgggttacaggctcca

SEQ ID NO: 47859 - DNA, 18 bp, Artificial sequence
  synthetic polynucleotide sequence
cccgaacgtgtgcacaga

SEQ ID NO: 47860 - DNA, 18 bp, Artificial sequence
  synthetic polynucleotide sequence
agacctgggtgggctgca

SEQ ID NO: 47861 - DNA, 18 bp, Artificial sequence
  synthetic polynucleotide sequence
ctgcacaggctgccggaa

SEQ ID NO: 47862 - DNA, 18 bp, Artificial sequence
  synthetic polynucleotide sequence
agcctcccatcagcccca

SEQ ID NO: 47863 - DNA, 21 bp, Artificial sequence
  synthetic polynucleotide sequence
agaaagtgggagcagaagaca

SEQ ID NO: 47864 - DNA, 21 bp, Artificial sequence
  synthetic polynucleotide sequence
acaaactgagcagcttcagga

SEQ ID NO: 47865 - DNA, 20 bp, Artificial sequence
  synthetic polynucleotide sequence
acgatgccgcaggagagaga

SEQ ID NO: 47866 - DNA, 20 bp, Artificial sequence
  synthetic polynucleotide sequence
atcagcgccacagctgggca

SEQ ID NO: 47867 - DNA, 18 bp, Artificial sequence
  synthetic polynucleotide sequence
acgcgatggaagccggca

SEQ ID NO: 47868 - DNA, 18 bp, Artificial sequence
  synthetic polynucleotide sequence
gtgggcaaggctgcagga

SEQ ID NO: 47869 - DNA, 18 bp, Artificial sequence
  synthetic polynucleotide sequence
agcccctggacaaggtca

SEQ ID NO: 47870 - DNA, 18 bp, Artificial sequence
  synthetic polynucleotide sequence
ccaggaggaggccaggca

SEQ ID NO: 47871 - DNA, 21 bp, Artificial sequence
  synthetic polynucleotide sequence
tgcaaggaggacgagtaccca

SEQ ID NO: 47872 - DNA, 18 bp, Artificial sequence
  synthetic polynucleotide sequence
aggccattgaggtgggca

SEQ ID NO: 47873 - DNA, 20 bp, Artificial sequence
  synthetic polynucleotide sequence
ctgcatcaagagcaaaccga

SEQ ID NO: 47874 - DNA, 19 bp, Artificial sequence
  synthetic polynucleotide sequence
gcactcaaagcagctggca

SEQ ID NO: 47875 - DNA, 21 bp, Artificial sequence
  synthetic polynucleotide sequence
caggagggagagagagacaca

SEQ ID NO: 47876 - DNA, 20 bp, Artificial sequence
  synthetic polynucleotide sequence
gcactgcacacccacggaca

SEQ ID NO: 47877 - DNA, 20 bp, Artificial sequence
  synthetic polynucleotide sequence
aggcaagaaacgcaggccca

SEQ ID NO: 47878 - DNA, 21 bp, Artificial sequence
  synthetic polynucleotide sequence
atgttgtcaccacccatggga

SEQ ID NO: 47879 - DNA, 20 bp, Artificial sequence
  synthetic polynucleotide sequence
aagagggggagcttgaagga

SEQ ID NO: 47880 - DNA, 18 bp, Artificial sequence
  synthetic polynucleotide sequence
tgaaggtggaactgggca

SEQ ID NO: 47881 - DNA, 18 bp, Artificial sequence
  synthetic polynucleotide sequence
ccatgggacccaggtcaa

SEQ ID NO: 47882 - DNA, 19 bp, Artificial sequence
  synthetic polynucleotide sequence
tcctccttggagaagggga

SEQ ID NO: 47883 - DNA, 18 bp, Artificial sequence
  synthetic polynucleotide sequence
agaagtccagcacgccca

SEQ ID NO: 47884 - DNA, 20 bp, Artificial sequence
  synthetic polynucleotide sequence
tccggatactgcacaccaca

SEQ ID NO: 47885 - DNA, 18 bp, Artificial sequence
  synthetic polynucleotide sequence
ccttggacagcgcccaca

SEQ ID NO: 47886 - DNA, 18 bp, Artificial sequence
  synthetic polynucleotide sequence
atgtcacctgcgggcaga

SEQ ID NO: 47887 - DNA, 19 bp, Artificial sequence
  synthetic polynucleotide sequence
gcccagaacctcacaggga

SEQ ID NO: 47888 - DNA, 18 bp, Artificial sequence
  synthetic polynucleotide sequence
ggagcaggtacagggcca

SEQ ID NO: 47889 - DNA, 18 bp, Artificial sequence
  synthetic polynucleotide sequence
cgctgcgcgtggccagga

SEQ ID NO: 47890 - DNA, 20 bp, Artificial sequence
  synthetic polynucleotide sequence
ccaggatcagtgcacaggga

SEQ ID NO: 47891 - DNA, 20 bp, Artificial sequence
  synthetic polynucleotide sequence
ctgcatcacccacagccgca

SEQ ID NO: 47892 - DNA, 20 bp, Artificial sequence
  synthetic polynucleotide sequence
ctcccatcatgggcgccaga

SEQ ID NO: 47893 - DNA, 18 bp, Artificial sequence
  synthetic polynucleotide sequence
tgggacgaaggagaggga

SEQ ID NO: 47894 - DNA, 18 bp, Artificial sequence
  synthetic polynucleotide sequence
gcagtcgacgtcagcgca

SEQ ID NO: 47895 - DNA, 18 bp, Artificial sequence
  synthetic polynucleotide sequence
gacccagcctgggacaga

SEQ ID NO: 47896 - DNA, 23 bp, Artificial sequence
  synthetic polynucleotide sequence
cgtaagttacagccacacagaga

SEQ ID NO: 47897 - DNA, 21 bp, Artificial sequence
  synthetic polynucleotide sequence
acatcagagcagagaaagcga

SEQ ID NO: 47898 - DNA, 22 bp, Artificial sequence
  synthetic polynucleotide sequence
atcatggtaccaagaggacaga

SEQ ID NO: 47899 - DNA, 18 bp, Artificial sequence
  synthetic polynucleotide sequence
tctcagccactgcggcga

SEQ ID NO: 47900 - DNA, 22 bp, Artificial sequence
  synthetic polynucleotide sequence
aagagtccgaagtaggtgagga

SEQ ID NO: 47901 - DNA, 20 bp, Artificial sequence
  synthetic polynucleotide sequence
cagaggtgatgtggcaacca

SEQ ID NO: 47902 - DNA, 20 bp, Artificial sequence
  synthetic polynucleotide sequence
cttctcgagacaccacctga

SEQ ID NO: 47903 - DNA, 21 bp, Artificial sequence
  synthetic polynucleotide sequence
gtccgatcctccaaagacgga

SEQ ID NO: 47904 - DNA, 19 bp, Artificial sequence
  synthetic polynucleotide sequence
ctggccaggtccccttgca

SEQ ID NO: 47905 - DNA, 18 bp, Artificial sequence
  synthetic polynucleotide sequence
accccgctaccccgagga

SEQ ID NO: 47906 - DNA, 18 bp, Artificial sequence
  synthetic polynucleotide sequence
accgggtaccatcacgca

SEQ ID NO: 47907 - DNA, 21 bp, Artificial sequence
  synthetic polynucleotide sequence
ctggccttcaccaagaaccga

SEQ ID NO: 47908 - DNA, 20 bp, Artificial sequence
  synthetic polynucleotide sequence
ctcagaggtcatcccacgga

SEQ ID NO: 47909 - DNA, 21 bp, Artificial sequence
  synthetic polynucleotide sequence
ggccaagtggctcccaatgca

SEQ ID NO: 47910 - DNA, 22 bp, Artificial sequence
  synthetic polynucleotide sequence
tctatggtgtccccaacatgca

SEQ ID NO: 47911 - DNA, 20 bp, Artificial sequence
  synthetic polynucleotide sequence
gaatgtgggaaatgcagcca

SEQ ID NO: 47912 - DNA, 21 bp, Artificial sequence
  synthetic polynucleotide sequence
cctgaagagcagagaagtgca

SEQ ID NO: 47913 - DNA, 20 bp, Artificial sequence
  synthetic polynucleotide sequence
cgttcagaggacggactcca

SEQ ID NO: 47914 - DNA, 19 bp, Artificial sequence
  synthetic polynucleotide sequence
ccacttggaggtaggccca

SEQ ID NO: 47915 - DNA, 18 bp, Artificial sequence
  synthetic polynucleotide sequence
gcagcccacctggacaga

SEQ ID NO: 47916 - DNA, 18 bp, Artificial sequence
  synthetic polynucleotide sequence
ggaggtcagcagcaggga

SEQ ID NO: 47917 - DNA, 21 bp, Artificial sequence
  synthetic polynucleotide sequence
agataatgggctggggcgaga

SEQ ID NO: 47918 - DNA, 20 bp, Artificial sequence
  synthetic polynucleotide sequence
cttcctccagatcgcacgga

SEQ ID NO: 47919 - DNA, 18 bp, Artificial sequence
  synthetic polynucleotide sequence
ccggtccatgaagcagca

SEQ ID NO: 47920 - DNA, 18 bp, Artificial sequence
  synthetic polynucleotide sequence
tggacttggccaggagga

SEQ ID NO: 47921 - DNA, 18 bp, Artificial sequence
  synthetic polynucleotide sequence
gcccgagctgatgaggaa

SEQ ID NO: 47922 - DNA, 18 bp, Artificial sequence
  synthetic polynucleotide sequence
gcatctgcacccgctcca

SEQ ID NO: 47923 - DNA, 19 bp, Artificial sequence
  synthetic polynucleotide sequence
gacaacaggcaacgaggga

SEQ ID NO: 47924 - DNA, 20 bp, Artificial sequence
  synthetic polynucleotide sequence
ggaaaacatgaccaggcaca

SEQ ID NO: 47925 - DNA, 21 bp, Artificial sequence
  synthetic polynucleotide sequence
aacccccacacaatcacccca

SEQ ID NO: 47926 - DNA, 21 bp, Artificial sequence
  synthetic polynucleotide sequence
gcagaaaccacatctccccca

SEQ ID NO: 47927 - DNA, 20 bp, Artificial sequence
  synthetic polynucleotide sequence
tgggaagaccatgcccacca

SEQ ID NO: 47928 - DNA, 21 bp, Artificial sequence
  synthetic polynucleotide sequence
acgatgggcaggatgcaggga

SEQ ID NO: 47929 - DNA, 21 bp, Artificial sequence
  synthetic polynucleotide sequence
aggagcctccaatgcagggga

SEQ ID NO: 47930 - DNA, 21 bp, Artificial sequence
  synthetic polynucleotide sequence
tcccgaaggtgttcaaggcca

SEQ ID NO: 47931 - DNA, 20 bp, Artificial sequence
  synthetic polynucleotide sequence
cgagatcctcgacagtgcca

SEQ ID NO: 47932 - DNA, 20 bp, Artificial sequence
  synthetic polynucleotide sequence
tgctgcctccgacaggccca

SEQ ID NO: 47933 - DNA, 18 bp, Artificial sequence
  synthetic polynucleotide sequence
gctgcaagctgcacgaga

SEQ ID NO: 47934 - DNA, 19 bp, Artificial sequence
  synthetic polynucleotide sequence
atggagatgcagcagcaca

SEQ ID NO: 47935 - DNA, 21 bp, Artificial sequence
  synthetic polynucleotide sequence
tcacgccagacaagcaagtga

SEQ ID NO: 47936 - DNA, 19 bp, Artificial sequence
  synthetic polynucleotide sequence
gttcacagacgcggcggca

SEQ ID NO: 47937 - DNA, 20 bp, Artificial sequence
  synthetic polynucleotide sequence
catgcccaccaggcctcaga

SEQ ID NO: 47938 - DNA, 21 bp, Artificial sequence
  synthetic polynucleotide sequence
tgagcactcccacaaaaccca

SEQ ID NO: 47939 - DNA, 18 bp, Artificial sequence
  synthetic polynucleotide sequence
aggtggacgaggacggca

SEQ ID NO: 47940 - DNA, 20 bp, Artificial sequence
  synthetic polynucleotide sequence
aacatgcggaagaggtcaga

SEQ ID NO: 47941 - DNA, 19 bp, Artificial sequence
  synthetic polynucleotide sequence
gcaccatcgacttcgagga

SEQ ID NO: 47942 - DNA, 19 bp, Artificial sequence
  synthetic polynucleotide sequence
tcctgtcgaagatgcggaa

SEQ ID NO: 47943 - DNA, 18 bp, Artificial sequence
  synthetic polynucleotide sequence
catggatctgcgggccaa

SEQ ID NO: 47944 - DNA, 18 bp, Artificial sequence
  synthetic polynucleotide sequence
gtcggagacttggcggca

SEQ ID NO: 47945 - DNA, 19 bp, Artificial sequence
  synthetic polynucleotide sequence
gggtgcagaagaccagcaa

SEQ ID NO: 47946 - DNA, 18 bp, Artificial sequence
  synthetic polynucleotide sequence
agggccttgagcatggca

SEQ ID NO: 47947 - DNA, 22 bp, Artificial sequence
  synthetic polynucleotide sequence
gagactggcgcaagaacatcga

SEQ ID NO: 47948 - DNA, 20 bp, Artificial sequence
  synthetic polynucleotide sequence
gcaggggcagtaggcaggaa

SEQ ID NO: 47949 - DNA, 20 bp, Artificial sequence
  synthetic polynucleotide sequence
gccggagtcatgtggcagca

SEQ ID NO: 47950 - DNA, 23 bp, Artificial sequence
  synthetic polynucleotide sequence
ctttgggacaaagcagcatagga

SEQ ID NO: 47951 - DNA, 18 bp, Artificial sequence
  synthetic polynucleotide sequence
agcgtggtaagcggcaga

SEQ ID NO: 47952 - DNA, 20 bp, Artificial sequence
  synthetic polynucleotide sequence
ctggtggatccagtccgaca

SEQ ID NO: 47953 - DNA, 20 bp, Artificial sequence
  synthetic polynucleotide sequence
ggctgagaccgaggagacca

SEQ ID NO: 47954 - DNA, 18 bp, Artificial sequence
  synthetic polynucleotide sequence
gaggcaccaagttgggca

SEQ ID NO: 47955 - DNA, 21 bp, Artificial sequence
  synthetic polynucleotide sequence
aagaagcagacagcccgggaa

SEQ ID NO: 47956 - DNA, 20 bp, Artificial sequence
  synthetic polynucleotide sequence
ctggtgcagggtctcccaga

SEQ ID NO: 47957 - DNA, 19 bp, Artificial sequence
  synthetic polynucleotide sequence
gaggaggagcaagagccga

SEQ ID NO: 47958 - DNA, 19 bp, Artificial sequence
  synthetic polynucleotide sequence
gtgggagcggtaattgcga

SEQ ID NO: 47959 - DNA, 21 bp, Artificial sequence
  synthetic polynucleotide sequence
ccaactggagcccacagctca

SEQ ID NO: 47960 - DNA, 18 bp, Artificial sequence
  synthetic polynucleotide sequence
gcaggatggtgggccgca

SEQ ID NO: 47961 - DNA, 19 bp, Artificial sequence
  synthetic polynucleotide sequence
gaacagctggtagcccgaa

SEQ ID NO: 47962 - DNA, 20 bp, Artificial sequence
  synthetic polynucleotide sequence
tgaggtcacctaacagggca

SEQ ID NO: 47963 - DNA, 18 bp, Artificial sequence
  synthetic polynucleotide sequence
tgcccccactgatccaga

SEQ ID NO: 47964 - DNA, 19 bp, Artificial sequence
  synthetic polynucleotide sequence
tctgcaccagggtgacaca

SEQ ID NO: 47965 - DNA, 22 bp, Artificial sequence
  synthetic polynucleotide sequence
atcatgcaggttgacagaccga

SEQ ID NO: 47966 - DNA, 20 bp, Artificial sequence
  synthetic polynucleotide sequence
gtgaagtctcgcaaggccca

SEQ ID NO: 47967 - DNA, 18 bp, Artificial sequence
  synthetic polynucleotide sequence
ggatgccaccaagaggca

SEQ ID NO: 47968 - DNA, 18 bp, Artificial sequence
  synthetic polynucleotide sequence
gtggtgatggagcccaca

SEQ ID NO: 47969 - DNA, 20 bp, Artificial sequence
  synthetic polynucleotide sequence
gtgcagacggtgtcgcacaa

SEQ ID NO: 47970 - DNA, 20 bp, Artificial sequence
  synthetic polynucleotide sequence
ggtgcccgcgaggtagtaca

SEQ ID NO: 47971 - DNA, 21 bp, Artificial sequence
  synthetic polynucleotide sequence
actgtggagaccttcacggca

SEQ ID NO: 47972 - DNA, 19 bp, Artificial sequence
  synthetic polynucleotide sequence
gactctccacccccaccca

SEQ ID NO: 47973 - DNA, 18 bp, Artificial sequence
  synthetic polynucleotide sequence
tctccctggagcagcaca

SEQ ID NO: 47974 - DNA, 18 bp, Artificial sequence
  synthetic polynucleotide sequence
ggccatgctgcatgcaga

SEQ ID NO: 47975 - DNA, 20 bp, Artificial sequence
  synthetic polynucleotide sequence
gtactgcacccacgaggcca

SEQ ID NO: 47976 - DNA, 20 bp, Artificial sequence
  synthetic polynucleotide sequence
gtgctccaggcagaacccga

SEQ ID NO: 47977 - DNA, 18 bp, Artificial sequence
  synthetic polynucleotide sequence
gccttgccagagaagcga

SEQ ID NO: 47978 - DNA, 18 bp, Artificial sequence
  synthetic polynucleotide sequence
tggcgacaggcgaagaca

SEQ ID NO: 47979 - DNA, 21 bp, Artificial sequence
  synthetic polynucleotide sequence
tcagagactgagtcctggcga

SEQ ID NO: 47980 - DNA, 20 bp, Artificial sequence
  synthetic polynucleotide sequence
gccaggaagtgtggtgggca

SEQ ID NO: 47981 - DNA, 20 bp, Artificial sequence
  synthetic polynucleotide sequence
agcatcaccctggtccagga

SEQ ID NO: 47982 - DNA, 21 bp, Artificial sequence
  synthetic polynucleotide sequence
gtcttgtgggtccaaggcaca

SEQ ID NO: 47983 - DNA, 20 bp, Artificial sequence
  synthetic polynucleotide sequence
tgctgaggaaggaggagcca

SEQ ID NO: 47984 - DNA, 22 bp, Artificial sequence
  synthetic polynucleotide sequence
atgatggaatgctggcacacga

SEQ ID NO: 47985 - DNA, 18 bp, Artificial sequence
  synthetic polynucleotide sequence
gcaatgaggccctgcaca

SEQ ID NO: 47986 - DNA, 18 bp, Artificial sequence
  synthetic polynucleotide sequence
gtcccgatcacgggcaga

SEQ ID NO: 47987 - DNA, 18 bp, Artificial sequence
  synthetic polynucleotide sequence
catgccccggtccactca

SEQ ID NO: 47988 - DNA, 18 bp, Artificial sequence
  synthetic polynucleotide sequence
gccgaggttgatgggaga

SEQ ID NO: 47989 - DNA, 19 bp, Artificial sequence
  synthetic polynucleotide sequence
ccaccacagcagcctcgca

SEQ ID NO: 47990 - DNA, 21 bp, Artificial sequence
  synthetic polynucleotide sequence
ttgggtgagagctgggactga

SEQ ID NO: 47991 - DNA, 20 bp, Artificial sequence
  synthetic polynucleotide sequence
ccttccagcatgagggacca

SEQ ID NO: 47992 - DNA, 20 bp, Artificial sequence
  synthetic polynucleotide sequence
gggcaccagccataagccga

SEQ ID NO: 47993 - DNA, 18 bp, Artificial sequence
  synthetic polynucleotide sequence
cgcagggtacgccaagca

SEQ ID NO: 47994 - DNA, 18 bp, Artificial sequence
  synthetic polynucleotide sequence
gccaatctggcctgcaca

SEQ ID NO: 47995 - DNA, 20 bp, Artificial sequence
  synthetic polynucleotide sequence
ggctcagctgcaatggccca

SEQ ID NO: 47996 - DNA, 20 bp, Artificial sequence
  synthetic polynucleotide sequence
ggccttgcagagctccagga

SEQ ID NO: 47997 - DNA, 18 bp, Artificial sequence
  synthetic polynucleotide sequence
ccccaacatggaccagga

SEQ ID NO: 47998 - DNA, 18 bp, Artificial sequence
  synthetic polynucleotide sequence
agggagttgatggcggca

SEQ ID NO: 47999 - DNA, 21 bp, Artificial sequence
  synthetic polynucleotide sequence
ctcactggctgaccaacggaa

SEQ ID NO: 48000 - DNA, 20 bp, Artificial sequence
  synthetic polynucleotide sequence
gggtgactgggatcgcgcca

SEQ ID NO: 48001 - DNA, 20 bp, Artificial sequence
  synthetic polynucleotide sequence
aaccagaaggaagccaccaa

SEQ ID NO: 48002 - DNA, 18 bp, Artificial sequence
  synthetic polynucleotide sequence
ccagagtggccctaggca

SEQ ID NO: 48003 - DNA, 21 bp, Artificial sequence
  synthetic polynucleotide sequence
acagccacagcagttactgca

SEQ ID NO: 48004 - DNA, 22 bp, Artificial sequence
  synthetic polynucleotide sequence
atcttcagccaagctctgagca

SEQ ID NO: 48005 - DNA, 22 bp, Artificial sequence
  synthetic polynucleotide sequence
tgcaagaggtacggatgggaga

SEQ ID NO: 48006 - DNA, 22 bp, Artificial sequence
  synthetic polynucleotide sequence
ttgctcgcacactaaaagggca

SEQ ID NO: 48007 - DNA, 20 bp, Artificial sequence
  synthetic polynucleotide sequence
caacagcagcaactgcagca

SEQ ID NO: 48008 - DNA, 18 bp, Artificial sequence
  synthetic polynucleotide sequence
agggtagagcccctggca

SEQ ID NO: 48009 - DNA, 18 bp, Artificial sequence
  synthetic polynucleotide sequence
aagcccctgctgcggcga

SEQ ID NO: 48010 - DNA, 20 bp, Artificial sequence
  synthetic polynucleotide sequence
ctgagctgaaacaggcacca

SEQ ID NO: 48011 - DNA, 20 bp, Artificial sequence
  synthetic polynucleotide sequence
cacaaggatgcaggacacca

SEQ ID NO: 48012 - DNA, 18 bp, Artificial sequence
  synthetic polynucleotide sequence
gggccagtgtcaggggca

SEQ ID NO: 48013 - DNA, 20 bp, Artificial sequence
  synthetic polynucleotide sequence
catgcggcctatgcagggga

SEQ ID NO: 48014 - DNA, 22 bp, Artificial sequence
  synthetic polynucleotide sequence
aaccatgatcaccgactcccca

SEQ ID NO: 48015 - DNA, 18 bp, Artificial sequence
  synthetic polynucleotide sequence
tgagggcctcgcgccgaa

SEQ ID NO: 48016 - DNA, 23 bp, Artificial sequence
  synthetic polynucleotide sequence
gataaatggagtgactcgcagga

SEQ ID NO: 48017 - DNA, 22 bp, Artificial sequence
  synthetic polynucleotide sequence
aaataccggacaacgtgggaga

SEQ ID NO: 48018 - DNA, 21 bp, Artificial sequence
  synthetic polynucleotide sequence
ggctgaggtgccatgaggtca

SEQ ID NO: 48019 - DNA, 20 bp, Artificial sequence
  synthetic polynucleotide sequence
aagctgagcaaagaggccaa

SEQ ID NO: 48020 - DNA, 18 bp, Artificial sequence
  synthetic polynucleotide sequence
aagccccagcgaatggca

SEQ ID NO: 48021 - DNA, 18 bp, Artificial sequence
  synthetic polynucleotide sequence
gccaatgcagccaaacca

SEQ ID NO: 48022 - DNA, 19 bp, Artificial sequence
  synthetic polynucleotide sequence
ggatcgatgtcagcagcca

SEQ ID NO: 48023 - DNA, 20 bp, Artificial sequence
  synthetic polynucleotide sequence
tccaatcacctgggtcccga

SEQ ID NO: 48024 - DNA, 20 bp, Artificial sequence
  synthetic polynucleotide sequence
agggtgctgagtaaggggca

SEQ ID NO: 48025 - DNA, 20 bp, Artificial sequence
  synthetic polynucleotide sequence
gaggaaggagaaacagcgga

SEQ ID NO: 48026 - DNA, 20 bp, Artificial sequence
  synthetic polynucleotide sequence
atggagtccttcccgaggaa

SEQ ID NO: 48027 - DNA, 18 bp, Artificial sequence
  synthetic polynucleotide sequence
tggaccccaggatcagca

SEQ ID NO: 48028 - DNA, 18 bp, Artificial sequence
  synthetic polynucleotide sequence
tggcgagagcccaggcga

SEQ ID NO: 48029 - DNA, 20 bp, Artificial sequence
  synthetic polynucleotide sequence
tcaagccctcctgctacaca

SEQ ID NO: 48030 - DNA, 19 bp, Artificial sequence
  synthetic polynucleotide sequence
caccggtagtggaggtgga

SEQ ID NO: 48031 - DNA, 18 bp, Artificial sequence
  synthetic polynucleotide sequence
gtaaaggccgaggggcaa

SEQ ID NO: 48032 - DNA, 18 bp, Artificial sequence
  synthetic polynucleotide sequence
cgaccggttcgtggcaga

SEQ ID NO: 48033 - DNA, 21 bp, Artificial sequence
  synthetic polynucleotide sequence
atgagaacaccgctccaggga

SEQ ID NO: 48034 - DNA, 21 bp, Artificial sequence
  synthetic polynucleotide sequence
tgtggaccccatgtctgagga

SEQ ID NO: 48035 - DNA, 19 bp, Artificial sequence
  synthetic polynucleotide sequence
gcaaggccgactaccgcca

SEQ ID NO: 48036 - DNA, 21 bp, Artificial sequence
  synthetic polynucleotide sequence
ggtctcatcgcagtgggagca

SEQ ID NO: 48037 - DNA, 18 bp, Artificial sequence
  synthetic polynucleotide sequence
aaccccaagggcagagga

SEQ ID NO: 48038 - DNA, 18 bp, Artificial sequence
  synthetic polynucleotide sequence
tcgtccactgcgagcaga

SEQ ID NO: 48039 - DNA, 20 bp, Artificial sequence
  synthetic polynucleotide sequence
ttcggagggtaggcggagaa

SEQ ID NO: 48040 - DNA, 20 bp, Artificial sequence
  synthetic polynucleotide sequence
tctcggaggatgccggcgca

SEQ ID NO: 48041 - DNA, 21 bp, Artificial sequence
  synthetic polynucleotide sequence
tcagcaagatcatcgcagaga

SEQ ID NO: 48042 - DNA, 18 bp, Artificial sequence
  synthetic polynucleotide sequence
accccatccaccaggtca

SEQ ID NO: 48043 - DNA, 21 bp, Artificial sequence
  synthetic polynucleotide sequence
aagaggaaccggtggtggcta

SEQ ID NO: 48044 - DNA, 20 bp, Artificial sequence
  synthetic polynucleotide sequence
cttcagcatctcgggcagca

SEQ ID NO: 48045 - DNA, 19 bp, Artificial sequence
  synthetic polynucleotide sequence
ggaaggacctggcaggaca

SEQ ID NO: 48046 - DNA, 22 bp, Artificial sequence
  synthetic polynucleotide sequence
tctagcagaacagtcaggacca

SEQ ID NO: 48047 - DNA, 21 bp, Artificial sequence
  synthetic polynucleotide sequence
gcacagtggactgatcgacaa

SEQ ID NO: 48048 - DNA, 19 bp, Artificial sequence
  synthetic polynucleotide sequence
gcagaaccacgggccctca

SEQ ID NO: 48049 - DNA, 20 bp, Artificial sequence
  synthetic polynucleotide sequence
ctcctcccctccaccccaca

SEQ ID NO: 48050 - DNA, 21 bp, Artificial sequence
  synthetic polynucleotide sequence
taaaaccaggcccaagtggca

SEQ ID NO: 48051 - DNA, 18 bp, Artificial sequence
  synthetic polynucleotide sequence
gcggagaagctgcaccca

SEQ ID NO: 48052 - DNA, 19 bp, Artificial sequence
  synthetic polynucleotide sequence
gaccatccagccttgagca

SEQ ID NO: 48053 - DNA, 20 bp, Artificial sequence
  synthetic polynucleotide sequence
ctgctgctggacaagcggga

SEQ ID NO: 48054 - DNA, 20 bp, Artificial sequence
  synthetic polynucleotide sequence
gaagctgagctgcgcggcca

SEQ ID NO: 48055 - DNA, 21 bp, Artificial sequence
  synthetic polynucleotide sequence
cttacactcacccaccatgca

SEQ ID NO: 48056 - DNA, 19 bp, Artificial sequence
  synthetic polynucleotide sequence
cccgaacgcacatactcca

SEQ ID NO: 48057 - DNA, 22 bp, Artificial sequence
  synthetic polynucleotide sequence
caagagcactcaggcaaaccca

SEQ ID NO: 48058 - DNA, 20 bp, Artificial sequence
  synthetic polynucleotide sequence
cccactgcggaaggcctgca

SEQ ID NO: 48059 - DNA, 21 bp, Artificial sequence
  synthetic polynucleotide sequence
cagcagcatctccagcagcaa

SEQ ID NO: 48060 - DNA, 19 bp, Artificial sequence
  synthetic polynucleotide sequence
gacaggggagtgctgccga

SEQ ID NO: 48061 - DNA, 19 bp, Artificial sequence
  synthetic polynucleotide sequence
ggcccatacagtggaggca

SEQ ID NO: 48062 - DNA, 19 bp, Artificial sequence
  synthetic polynucleotide sequence
ctagaggctacccaggcca

SEQ ID NO: 48063 - DNA, 19 bp, Artificial sequence
  synthetic polynucleotide sequence
gcactgcccaacaacacca

SEQ ID NO: 48064 - DNA, 18 bp, Artificial sequence
  synthetic polynucleotide sequence
tcgaagcgctcacgccca

SEQ ID NO: 48065 - DNA, 21 bp, Artificial sequence
  synthetic polynucleotide sequence
ggcagggctcagacacacaca

SEQ ID NO: 48066 - DNA, 22 bp, Artificial sequence
  synthetic polynucleotide sequence
ggatccagacagttgctgagga

SEQ ID NO: 48067 - DNA, 18 bp, Artificial sequence
  synthetic polynucleotide sequence
ggtggaagggaagcggaa

SEQ ID NO: 48068 - DNA, 18 bp, Artificial sequence
  synthetic polynucleotide sequence
actcccatggaggcacga

SEQ ID NO: 48069 - DNA, 23 bp, Artificial sequence
  synthetic polynucleotide sequence
gataagtgcgaggaaatggagga

SEQ ID NO: 48070 - DNA, 19 bp, Artificial sequence
  synthetic polynucleotide sequence
tatcattaaggcgcgccca

SEQ ID NO: 48071 - DNA, 21 bp, Artificial sequence
  synthetic polynucleotide sequence
cgatggaccctgctcaccgaa

SEQ ID NO: 48072 - DNA, 22 bp, Artificial sequence
  synthetic polynucleotide sequence
acgacaaaaaggaggcggctga

SEQ ID NO: 48073 - DNA, 20 bp, Artificial sequence
  synthetic polynucleotide sequence
gtagggagagtaatgcccca

SEQ ID NO: 48074 - DNA, 18 bp, Artificial sequence
  synthetic polynucleotide sequence
gcgtggccagggtgagca

SEQ ID NO: 48075 - DNA, 20 bp, Artificial sequence
  synthetic polynucleotide sequence
gggccaggctcagtacgtca

SEQ ID NO: 48076 - DNA, 21 bp, Artificial sequence
  synthetic polynucleotide sequence
gtaacagctggaaggcggtga

SEQ ID NO: 48077 - DNA, 20 bp, Artificial sequence
  synthetic polynucleotide sequence
tctcttgagtgcttggctga

SEQ ID NO: 48078 - DNA, 19 bp, Artificial sequence
  synthetic polynucleotide sequence
cctcactgagaccagggca

SEQ ID NO: 48079 - DNA, 18 bp, Artificial sequence
  synthetic polynucleotide sequence
tcatcgagcaccccagca

SEQ ID NO: 48080 - DNA, 18 bp, Artificial sequence
  synthetic polynucleotide sequence
cgcgtccgggagcgggga

SEQ ID NO: 48081 - DNA, 20 bp, Artificial sequence
  synthetic polynucleotide sequence
cccgtaatccccacgtgaca

SEQ ID NO: 48082 - DNA, 20 bp, Artificial sequence
  synthetic polynucleotide sequence
tggcagcaggaagtgccgaa

SEQ ID NO: 48083 - DNA, 20 bp, Artificial sequence
  synthetic polynucleotide sequence
gggaggcaaccactcaccga

SEQ ID NO: 48084 - DNA, 18 bp, Artificial sequence
  synthetic polynucleotide sequence
cgtgtgggcagcccctca

SEQ ID NO: 48085 - DNA, 18 bp, Artificial sequence
  synthetic polynucleotide sequence
tcctgcggaccccaagca

SEQ ID NO: 48086 - DNA, 20 bp, Artificial sequence
  synthetic polynucleotide sequence
gaaagagatggtctggcgga

SEQ ID NO: 48087 - DNA, 20 bp, Artificial sequence
  synthetic polynucleotide sequence
gaccactaccgggagcagca

SEQ ID NO: 48088 - DNA, 21 bp, Artificial sequence
  synthetic polynucleotide sequence
cgcttcttcacaccggcacca

SEQ ID NO: 48089 - DNA, 20 bp, Artificial sequence
  synthetic polynucleotide sequence
acagaggtagtgcagggcaa

SEQ ID NO: 48090 - DNA, 20 bp, Artificial sequence
  synthetic polynucleotide sequence
ggtcacagtccaggtcagca

SEQ ID NO: 48091 - DNA, 20 bp, Artificial sequence
  synthetic polynucleotide sequence
gtcctggagctctaccggga

SEQ ID NO: 48092 - DNA, 21 bp, Artificial sequence
  synthetic polynucleotide sequence
atcgccgtcccagaaacacca

SEQ ID NO: 48093 - DNA, 21 bp, Artificial sequence
  synthetic polynucleotide sequence
gcagctggagtactgggccaa

SEQ ID NO: 48094 - DNA, 22 bp, Artificial sequence
  synthetic polynucleotide sequence
aagttctccagaatcagggcca

SEQ ID NO: 48095 - DNA, 20 bp, Artificial sequence
  synthetic polynucleotide sequence
atctccacccggatcaccta

SEQ ID NO: 48096 - DNA, 18 bp, Artificial sequence
  synthetic polynucleotide sequence
gcactgatcgtggcagca

SEQ ID NO: 48097 - DNA, 18 bp, Artificial sequence
  synthetic polynucleotide sequence
gcaacgttggaacggcca

SEQ ID NO: 48098 - DNA, 18 bp, Artificial sequence
  synthetic polynucleotide sequence
gggccgtggagctgagga

SEQ ID NO: 48099 - DNA, 20 bp, Artificial sequence
  synthetic polynucleotide sequence
cacaggtgtggctgcccgga

SEQ ID NO: 48100 - DNA, 20 bp, Artificial sequence
  synthetic polynucleotide sequence
ctgccaggacctggcgcaga

SEQ ID NO: 48101 - DNA, 21 bp, Artificial sequence
  synthetic polynucleotide sequence
ccttggtagggctgagacaga

SEQ ID NO: 48102 - DNA, 20 bp, Artificial sequence
  synthetic polynucleotide sequence
cctgcagatgagagtgccca

SEQ ID NO: 48103 - DNA, 20 bp, Artificial sequence
  synthetic polynucleotide sequence
tgggcatcacgcgcatccta

SEQ ID NO: 48104 - DNA, 21 bp, Artificial sequence
  synthetic polynucleotide sequence
atggaagactgggtgagctga

SEQ ID NO: 48105 - DNA, 20 bp, Artificial sequence
  synthetic polynucleotide sequence
ccagagccagatacctgcca

SEQ ID NO: 48106 - DNA, 18 bp, Artificial sequence
  synthetic polynucleotide sequence
gcctcctctgaagcgcca

SEQ ID NO: 48107 - DNA, 20 bp, Artificial sequence
  synthetic polynucleotide sequence
caggcccaggaagtacacga

SEQ ID NO: 48108 - DNA, 18 bp, Artificial sequence
  synthetic polynucleotide sequence
gtgctctgagccaccgca

SEQ ID NO: 48109 - DNA, 22 bp, Artificial sequence
  synthetic polynucleotide sequence
tagacactggaatggagggtga

SEQ ID NO: 48110 - DNA, 20 bp, Artificial sequence
  synthetic polynucleotide sequence
tccagaggagtgggtggtca

SEQ ID NO: 48111 - DNA, 20 bp, Artificial sequence
  synthetic polynucleotide sequence
gacctggaacgtgcagagga

SEQ ID NO: 48112 - DNA, 20 bp, Artificial sequence
  synthetic polynucleotide sequence
gcctccttcagcttgtcgga

SEQ ID NO: 48113 - DNA, 18 bp, Artificial sequence
  synthetic polynucleotide sequence
tggagcgctcggaggaga

SEQ ID NO: 48114 - DNA, 19 bp, Artificial sequence
  synthetic polynucleotide sequence
cctctgaggccatcaggga

SEQ ID NO: 48115 - DNA, 20 bp, Artificial sequence
  synthetic polynucleotide sequence
cagcgagaagttgagggaga

SEQ ID NO: 48116 - DNA, 18 bp, Artificial sequence
  synthetic polynucleotide sequence
gctcctgagcacggtcca

SEQ ID NO: 48117 - DNA, 20 bp, Artificial sequence
  synthetic polynucleotide sequence
cagctcaaagaggccaagca

SEQ ID NO: 48118 - DNA, 21 bp, Artificial sequence
  synthetic polynucleotide sequence
tccaggatgaccagcttacga

SEQ ID NO: 48119 - DNA, 20 bp, Artificial sequence
  synthetic polynucleotide sequence
ggcacgggtatgagctccaa

SEQ ID NO: 48120 - DNA, 20 bp, Artificial sequence
  synthetic polynucleotide sequence
gggtgggcaccgtctgcaca

SEQ ID NO: 48121 - DNA, 20 bp, Artificial sequence
  synthetic polynucleotide sequence
aacccaaggctctaccagca

SEQ ID NO: 48122 - DNA, 18 bp, Artificial sequence
  synthetic polynucleotide sequence
atcccagccaggaccaga

SEQ ID NO: 48123 - DNA, 21 bp, Artificial sequence
  synthetic polynucleotide sequence
tgagggtgcaacatgggctga

SEQ ID NO: 48124 - DNA, 21 bp, Artificial sequence
  synthetic polynucleotide sequence
atcactgagacttgcccacca

SEQ ID NO: 48125 - DNA, 21 bp, Artificial sequence
  synthetic polynucleotide sequence
gcacaggctcatcgagggcaa

SEQ ID NO: 48126 - DNA, 19 bp, Artificial sequence
  synthetic polynucleotide sequence
caccagatccacgcggcca

SEQ ID NO: 48127 - DNA, 21 bp, Artificial sequence
  synthetic polynucleotide sequence
caagacagtcacctccacgga

SEQ ID NO: 48128 - DNA, 19 bp, Artificial sequence
  synthetic polynucleotide sequence
ttgaagcgcttctggccca

SEQ ID NO: 48129 - DNA, 22 bp, Artificial sequence
  synthetic polynucleotide sequence
caatgtgggcgtcactaaagca

SEQ ID NO: 48130 - DNA, 21 bp, Artificial sequence
  synthetic polynucleotide sequence
cgtagccactgtcgtccagga

SEQ ID NO: 48131 - DNA, 18 bp, Artificial sequence
  synthetic polynucleotide sequence
ccacatccacttccccca

SEQ ID NO: 48132 - DNA, 20 bp, Artificial sequence
  synthetic polynucleotide sequence
ctggagtcaactgaaggcca

SEQ ID NO: 48133 - DNA, 18 bp, Artificial sequence
  synthetic polynucleotide sequence
cccgggccgtggtatcca

SEQ ID NO: 48134 - DNA, 20 bp, Artificial sequence
  synthetic polynucleotide sequence
cacactcagctcgatggcca

SEQ ID NO: 48135 - DNA, 21 bp, Artificial sequence
  synthetic polynucleotide sequence
aggacccgatgccaagacaga

SEQ ID NO: 48136 - DNA, 18 bp, Artificial sequence
  synthetic polynucleotide sequence
cccccggccgtgtagcaa

SEQ ID NO: 48137 - DNA, 19 bp, Artificial sequence
  synthetic polynucleotide sequence
ggacggcgagatccaggga

SEQ ID NO: 48138 - DNA, 18 bp, Artificial sequence
  synthetic polynucleotide sequence
ccgcaccacctgctggca

SEQ ID NO: 48139 - DNA, 21 bp, Artificial sequence
  synthetic polynucleotide sequence
gaagaagacggggattggcca

SEQ ID NO: 48140 - DNA, 20 bp, Artificial sequence
  synthetic polynucleotide sequence
ccccagtgcgtctcggaaga

SEQ ID NO: 48141 - DNA, 21 bp, Artificial sequence
  synthetic polynucleotide sequence
gaggaagaggaggaagaggga

SEQ ID NO: 48142 - DNA, 20 bp, Artificial sequence
  synthetic polynucleotide sequence
cttcggggtgtagctggaca

SEQ ID NO: 48143 - DNA, 20 bp, Artificial sequence
  synthetic polynucleotide sequence
caccctgctgcaggtggaca

SEQ ID NO: 48144 - DNA, 20 bp, Artificial sequence
  synthetic polynucleotide sequence
gagcagcgactccaatccca

SEQ ID NO: 48145 - DNA, 18 bp, Artificial sequence
  synthetic polynucleotide sequence
tggcgcctacacgggaga

SEQ ID NO: 48146 - DNA, 19 bp, Artificial sequence
  synthetic polynucleotide sequence
gtgccattcaccttgcaca

SEQ ID NO: 48147 - DNA, 21 bp, Artificial sequence
  synthetic polynucleotide sequence
cccctcctgtccaaaacacca

SEQ ID NO: 48148 - DNA, 20 bp, Artificial sequence
  synthetic polynucleotide sequence
caggcgtcaggcttaggaca

SEQ ID NO: 48149 - DNA, 19 bp, Artificial sequence
  synthetic polynucleotide sequence
ggaggtggaagtccccgta

SEQ ID NO: 48150 - DNA, 18 bp, Artificial sequence
  synthetic polynucleotide sequence
acagcatgtcatcgcgga

SEQ ID NO: 48151 - DNA, 23 bp, Artificial sequence
  synthetic polynucleotide sequence
ctgatggcaggaatccaagtgca

SEQ ID NO: 48152 - DNA, 19 bp, Artificial sequence
  synthetic polynucleotide sequence
gggagagggagggggcgga

SEQ ID NO: 48153 - DNA, 20 bp, Artificial sequence
  synthetic polynucleotide sequence
tcgctgtggagaggaaacca

SEQ ID NO: 48154 - DNA, 18 bp, Artificial sequence
  synthetic polynucleotide sequence
gcatggcagaatccagca

SEQ ID NO: 48155 - DNA, 18 bp, Artificial sequence
  synthetic polynucleotide sequence
gatcgagcggtccacgga

SEQ ID NO: 48156 - DNA, 18 bp, Artificial sequence
  synthetic polynucleotide sequence
gccatgtcccgcaccaca

SEQ ID NO: 48157 - DNA, 18 bp, Artificial sequence
  synthetic polynucleotide sequence
ggagcaaccgaggaggca

SEQ ID NO: 48158 - DNA, 20 bp, Artificial sequence
  synthetic polynucleotide sequence
gtcggcaaggatgagagtga

SEQ ID NO: 48159 - DNA, 22 bp, Artificial sequence
  synthetic polynucleotide sequence
tggaatctccctccaagacgga

SEQ ID NO: 48160 - DNA, 22 bp, Artificial sequence
  synthetic polynucleotide sequence
atcatacagaggtggaccgtca

SEQ ID NO: 48161 - DNA, 19 bp, Artificial sequence
  synthetic polynucleotide sequence
gaggctgaggagctcgaga

SEQ ID NO: 48162 - DNA, 18 bp, Artificial sequence
  synthetic polynucleotide sequence
ttgggcaagatgggccca

SEQ ID NO: 48163 - DNA, 22 bp, Artificial sequence
  synthetic polynucleotide sequence
aaaggaggctatggaaagggca

SEQ ID NO: 48164 - DNA, 18 bp, Artificial sequence
  synthetic polynucleotide sequence
cctcctccaccaccccca

SEQ ID NO: 48165 - DNA, 18 bp, Artificial sequence
  synthetic polynucleotide sequence
acggcacagccacagcca

SEQ ID NO: 48166 - DNA, 21 bp, Artificial sequence
  synthetic polynucleotide sequence
gtggtgtacaagctcagccca

SEQ ID NO: 48167 - DNA, 21 bp, Artificial sequence
  synthetic polynucleotide sequence
gtcagaccccatcagcaagga

SEQ ID NO: 48168 - DNA, 20 bp, Artificial sequence
  synthetic polynucleotide sequence
cgagacgatggtgcggtgca

SEQ ID NO: 48169 - DNA, 20 bp, Artificial sequence
  synthetic polynucleotide sequence
atcccctacacgacggagga

SEQ ID NO: 48170 - DNA, 21 bp, Artificial sequence
  synthetic polynucleotide sequence
tcctgaggtggtagcgtggca

SEQ ID NO: 48171 - DNA, 20 bp, Artificial sequence
  synthetic polynucleotide sequence
gggcaactgggagcgcaaga

SEQ ID NO: 48172 - DNA, 20 bp, Artificial sequence
  synthetic polynucleotide sequence
ctgggccaggtagaggtcga

SEQ ID NO: 48173 - DNA, 21 bp, Artificial sequence
  synthetic polynucleotide sequence
tgtgggtctcaaatggcgcaa

SEQ ID NO: 48174 - DNA, 18 bp, Artificial sequence
  synthetic polynucleotide sequence
cctccaccaggcgctgca

SEQ ID NO: 48175 - DNA, 20 bp, Artificial sequence
  synthetic polynucleotide sequence
gaacaaccgtgagcacgcca

SEQ ID NO: 48176 - DNA, 20 bp, Artificial sequence
  synthetic polynucleotide sequence
agggggaagaagagtgggca

SEQ ID NO: 48177 - DNA, 21 bp, Artificial sequence
  synthetic polynucleotide sequence
gtgcgagagcctggagaagaa

SEQ ID NO: 48178 - DNA, 18 bp, Artificial sequence
  synthetic polynucleotide sequence
ccaggtccttgaggccaa

SEQ ID NO: 48179 - DNA, 21 bp, Artificial sequence
  synthetic polynucleotide sequence
gaggaaagacctgcgagacca

SEQ ID NO: 48180 - DNA, 18 bp, Artificial sequence
  synthetic polynucleotide sequence
caccaccacgcagggaca

SEQ ID NO: 48181 - DNA, 21 bp, Artificial sequence
  synthetic polynucleotide sequence
agtcggcatggaagaaggaga

SEQ ID NO: 48182 - DNA, 21 bp, Artificial sequence
  synthetic polynucleotide sequence
ctgtgccacatctgcagctca

SEQ ID NO: 48183 - DNA, 18 bp, Artificial sequence
  synthetic polynucleotide sequence
gtcgcagctggacgagga

SEQ ID NO: 48184 - DNA, 18 bp, Artificial sequence
  synthetic polynucleotide sequence
tctgaagccaggtgggca

SEQ ID NO: 48185 - DNA, 20 bp, Artificial sequence
  synthetic polynucleotide sequence
gagaagggcaaagcgcagca

SEQ ID NO: 48186 - DNA, 21 bp, Artificial sequence
  synthetic polynucleotide sequence
ggtcagacagatccctgcaga

SEQ ID NO: 48187 - DNA, 18 bp, Artificial sequence
  synthetic polynucleotide sequence
acaggaggccaaggccaa

SEQ ID NO: 48188 - DNA, 20 bp, Artificial sequence
  synthetic polynucleotide sequence
caaagggccactcaaggaga

SEQ ID NO: 48189 - DNA, 18 bp, Artificial sequence
  synthetic polynucleotide sequence
gcggtggatgggcacaca

SEQ ID NO: 48190 - DNA, 18 bp, Artificial sequence
  synthetic polynucleotide sequence
gcctgaatggccactgca

SEQ ID NO: 48191 - DNA, 18 bp, Artificial sequence
  synthetic polynucleotide sequence
caatcccacggaacccaa

SEQ ID NO: 48192 - DNA, 18 bp, Artificial sequence
  synthetic polynucleotide sequence
gcgggtggagacctcaca

SEQ ID NO: 48193 - DNA, 20 bp, Artificial sequence
  synthetic polynucleotide sequence
ggccatcaaggtctgggaca

SEQ ID NO: 48194 - DNA, 21 bp, Artificial sequence
  synthetic polynucleotide sequence
ctgtacaggtagctctgggca

SEQ ID NO: 48195 - DNA, 18 bp, Artificial sequence
  synthetic polynucleotide sequence
gcggaatcgagacagcca

SEQ ID NO: 48196 - DNA, 18 bp, Artificial sequence
  synthetic polynucleotide sequence
ccctgaaggcccagggga

SEQ ID NO: 48197 - DNA, 21 bp, Artificial sequence
  synthetic polynucleotide sequence
atgcaaaggccccaggaagga

SEQ ID NO: 48198 - DNA, 21 bp, Artificial sequence
  synthetic polynucleotide sequence
cctaggatggcattccggaca

SEQ ID NO: 48199 - DNA, 20 bp, Artificial sequence
  synthetic polynucleotide sequence
ctgtgtcaccccgacagaga

SEQ ID NO: 48200 - DNA, 18 bp, Artificial sequence
  synthetic polynucleotide sequence
cctcgaaggcaactggca

SEQ ID NO: 48201 - DNA, 21 bp, Artificial sequence
  synthetic polynucleotide sequence
tgtcaccctcccagcaacaga

SEQ ID NO: 48202 - DNA, 22 bp, Artificial sequence
  synthetic polynucleotide sequence
gaatgtgccccaaacacaggca

SEQ ID NO: 48203 - DNA, 21 bp, Artificial sequence
  synthetic polynucleotide sequence
catcctgcagaatcatgcgga

SEQ ID NO: 48204 - DNA, 20 bp, Artificial sequence
  synthetic polynucleotide sequence
gttcctctgctgcagggaca

SEQ ID NO: 48205 - DNA, 21 bp, Artificial sequence
  synthetic polynucleotide sequence
ggaaattccccgccagctcca

SEQ ID NO: 48206 - DNA, 21 bp, Artificial sequence
  synthetic polynucleotide sequence
atgcgagccagtccaaagcca

SEQ ID NO: 48207 - DNA, 22 bp, Artificial sequence
  synthetic polynucleotide sequence
gaaagggaggagtgtcaggaga

SEQ ID NO: 48208 - DNA, 20 bp, Artificial sequence
  synthetic polynucleotide sequence
ctcgatgtcctgcaccacca

SEQ ID NO: 48209 - DNA, 21 bp, Artificial sequence
  synthetic polynucleotide sequence
ccgccgagtgcctatcagaga

SEQ ID NO: 48210 - DNA, 18 bp, Artificial sequence
  synthetic polynucleotide sequence
cgcaggaagtggcgggca

SEQ ID NO: 48211 - DNA, 22 bp, Artificial sequence
  synthetic polynucleotide sequence
agcaagatgtccccgctagaca

SEQ ID NO: 48212 - DNA, 22 bp, Artificial sequence
  synthetic polynucleotide sequence
ggattcttcaccaccagctcca

SEQ ID NO: 48213 - DNA, 19 bp, Artificial sequence
  synthetic polynucleotide sequence
tcaggactcaggccaagga

SEQ ID NO: 48214 - DNA, 20 bp, Artificial sequence
  synthetic polynucleotide sequence
atgtgagggaggacgaacca

SEQ ID NO: 48215 - DNA, 21 bp, Artificial sequence
  synthetic polynucleotide sequence
aggtggagtagcaaccgggca

SEQ ID NO: 48216 - DNA, 21 bp, Artificial sequence
  synthetic polynucleotide sequence
aacgactctctgacacgccca

SEQ ID NO: 48217 - DNA, 20 bp, Artificial sequence
  synthetic polynucleotide sequence
tacccagagcaagagcccca

SEQ ID NO: 48218 - DNA, 20 bp, Artificial sequence
  synthetic polynucleotide sequence
attctgcccgaggtgaagga

SEQ ID NO: 48219 - DNA, 22 bp, Artificial sequence
  synthetic polynucleotide sequence
gaaaggggaaggttacagacca

SEQ ID NO: 48220 - DNA, 21 bp, Artificial sequence
  synthetic polynucleotide sequence
agtaagggcaagacagagcga

SEQ ID NO: 48221 - DNA, 20 bp, Artificial sequence
  synthetic polynucleotide sequence
ttgccagctgggaaggcaga

SEQ ID NO: 48222 - DNA, 21 bp, Artificial sequence
  synthetic polynucleotide sequence
ctcatatgccccgcagtgaca

SEQ ID NO: 48223 - DNA, 20 bp, Artificial sequence
  synthetic polynucleotide sequence
ctgctctaccccacggagga

SEQ ID NO: 48224 - DNA, 22 bp, Artificial sequence
  synthetic polynucleotide sequence
tagcttccggaacatgctgcga

SEQ ID NO: 48225 - DNA, 20 bp, Artificial sequence
  synthetic polynucleotide sequence
aagagctccctgctgggcga

SEQ ID NO: 48226 - DNA, 25 bp, Artificial sequence
  synthetic polynucleotide sequence
gtaacatcagccgccaaatgaacca

SEQ ID NO: 48227 - DNA, 21 bp, Artificial sequence
  synthetic polynucleotide sequence
cgacgggaaagaggtgctgga

SEQ ID NO: 48228 - DNA, 21 bp, Artificial sequence
  synthetic polynucleotide sequence
ctgttcaggagacagctggga

SEQ ID NO: 48229 - DNA, 19 bp, Artificial sequence
  synthetic polynucleotide sequence
gccaacgatgacgcgcgca

SEQ ID NO: 48230 - DNA, 20 bp, Artificial sequence
  synthetic polynucleotide sequence
gtgtgtgagcaccgcctcca

SEQ ID NO: 48231 - DNA, 21 bp, Artificial sequence
  synthetic polynucleotide sequence
tggcggtgttccagaagcaga

SEQ ID NO: 48232 - DNA, 20 bp, Artificial sequence
  synthetic polynucleotide sequence
cctccagatactgcaggcca

SEQ ID NO: 48233 - DNA, 21 bp, Artificial sequence
  synthetic polynucleotide sequence
catatgcctacccatcagcca

SEQ ID NO: 48234 - DNA, 20 bp, Artificial sequence
  synthetic polynucleotide sequence
gcacaaggcagccatacaga

SEQ ID NO: 48235 - DNA, 18 bp, Artificial sequence
  synthetic polynucleotide sequence
tgacagacgaccagcgga

SEQ ID NO: 48236 - DNA, 18 bp, Artificial sequence
  synthetic polynucleotide sequence
tcgccactgctgagagga

SEQ ID NO: 48237 - DNA, 20 bp, Artificial sequence
  synthetic polynucleotide sequence
aatcccctccctgaagcgca

SEQ ID NO: 48238 - DNA, 19 bp, Artificial sequence
  synthetic polynucleotide sequence
ggctgtccgtccaccagca

SEQ ID NO: 48239 - DNA, 20 bp, Artificial sequence
  synthetic polynucleotide sequence
gaagcgtagaaagcccagga

SEQ ID NO: 48240 - DNA, 21 bp, Artificial sequence
  synthetic polynucleotide sequence
ctcttagcacggatcaatcca

SEQ ID NO: 48241 - DNA, 20 bp, Artificial sequence
  synthetic polynucleotide sequence
tgcacaagtggtggctgcca

SEQ ID NO: 48242 - DNA, 18 bp, Artificial sequence
  synthetic polynucleotide sequence
gctggcagggagggctca

SEQ ID NO: 48243 - DNA, 22 bp, Artificial sequence
  synthetic polynucleotide sequence
aaatcccccggaaaagtgctga

SEQ ID NO: 48244 - DNA, 22 bp, Artificial sequence
  synthetic polynucleotide sequence
taacgatggcaacagctgacca

SEQ ID NO: 48245 - DNA, 21 bp, Artificial sequence
  synthetic polynucleotide sequence
tctccagaagacaggccagca

SEQ ID NO: 48246 - DNA, 18 bp, Artificial sequence
  synthetic polynucleotide sequence
gccacttcctgggcccga

SEQ ID NO: 48247 - DNA, 20 bp, Artificial sequence
  synthetic polynucleotide sequence
ccaagctccacccaagtcaa

SEQ ID NO: 48248 - DNA, 19 bp, Artificial sequence
  synthetic polynucleotide sequence
gacctcagcgtgacagcaa

SEQ ID NO: 48249 - DNA, 21 bp, Artificial sequence
  synthetic polynucleotide sequence
tgaggctgacaccctcaggaa

SEQ ID NO: 48250 - DNA, 20 bp, Artificial sequence
  synthetic polynucleotide sequence
ctccacatgggcatcctcga

SEQ ID NO: 48251 - DNA, 20 bp, Artificial sequence
  synthetic polynucleotide sequence
tcgcagagctccagcgggca

SEQ ID NO: 48252 - DNA, 21 bp, Artificial sequence
  synthetic polynucleotide sequence
accatgcagccatactcgcca

SEQ ID NO: 48253 - DNA, 18 bp, Artificial sequence
  synthetic polynucleotide sequence
gccagggacccaggagga

SEQ ID NO: 48254 - DNA, 20 bp, Artificial sequence
  synthetic polynucleotide sequence
ctggtgctgaggtccccaga

SEQ ID NO: 48255 - DNA, 22 bp, Artificial sequence
  synthetic polynucleotide sequence
aagccctggacagcagttcaga

SEQ ID NO: 48256 - DNA, 21 bp, Artificial sequence
  synthetic polynucleotide sequence
tccacaccagtagaatcccga

SEQ ID NO: 48257 - DNA, 18 bp, Artificial sequence
  synthetic polynucleotide sequence
aatgagggcctcccccaa

SEQ ID NO: 48258 - DNA, 18 bp, Artificial sequence
  synthetic polynucleotide sequence
cagggacagacacgggca

SEQ ID NO: 48259 - DNA, 20 bp, Artificial sequence
  synthetic polynucleotide sequence
ctaggaccaagccaagacca

SEQ ID NO: 48260 - DNA, 20 bp, Artificial sequence
  synthetic polynucleotide sequence
cctccctggatagggctcca

SEQ ID NO: 48261 - DNA, 20 bp, Artificial sequence
  synthetic polynucleotide sequence
caccctggccgacgagaaga

SEQ ID NO: 48262 - DNA, 20 bp, Artificial sequence
  synthetic polynucleotide sequence
gctgccgcttcgggacagca

SEQ ID NO: 48263 - DNA, 22 bp, Artificial sequence
  synthetic polynucleotide sequence
ggaagacgtgtggctgaaggaa

SEQ ID NO: 48264 - DNA, 22 bp, Artificial sequence
  synthetic polynucleotide sequence
gatactggatgggaactggcca

SEQ ID NO: 48265 - DNA, 21 bp, Artificial sequence
  synthetic polynucleotide sequence
caggtcaccaagatgctggca

SEQ ID NO: 48266 - DNA, 22 bp, Artificial sequence
  synthetic polynucleotide sequence
agctttctgaaggctgcacgga

SEQ ID NO: 48267 - DNA, 20 bp, Artificial sequence
  synthetic polynucleotide sequence
ctcttcaagcgctaccagca

SEQ ID NO: 48268 - DNA, 18 bp, Artificial sequence
  synthetic polynucleotide sequence
catggcccatgaactcca

SEQ ID NO: 48269 - DNA, 20 bp, Artificial sequence
  synthetic polynucleotide sequence
agcctacgtgagccctgaga

SEQ ID NO: 48270 - DNA, 20 bp, Artificial sequence
  synthetic polynucleotide sequence
gaaggggtatcgtccaacca

SEQ ID NO: 48271 - DNA, 19 bp, Artificial sequence
  synthetic polynucleotide sequence
gcggctgacctcgcaggaa

SEQ ID NO: 48272 - DNA, 19 bp, Artificial sequence
  synthetic polynucleotide sequence
gtccggcaccagctggtca

SEQ ID NO: 48273 - DNA, 18 bp, Artificial sequence
  synthetic polynucleotide sequence
ggcctcatactcgggcaa

SEQ ID NO: 48274 - DNA, 18 bp, Artificial sequence
  synthetic polynucleotide sequence
ctcccgacgaaggaggca

SEQ ID NO: 48275 - DNA, 20 bp, Artificial sequence
  synthetic polynucleotide sequence
tgcccccaacatggccagaa

SEQ ID NO: 48276 - DNA, 23 bp, Artificial sequence
  synthetic polynucleotide sequence
gcagagatcaccaaaccagtgga

SEQ ID NO: 48277 - DNA, 20 bp, Artificial sequence
  synthetic polynucleotide sequence
aactcaccagacaaccccca

SEQ ID NO: 48278 - DNA, 18 bp, Artificial sequence
  synthetic polynucleotide sequence
gaaggagcccagagccga

SEQ ID NO: 48279 - DNA, 20 bp, Artificial sequence
  synthetic polynucleotide sequence
ctggactacgaggctggaca

SEQ ID NO: 48280 - DNA, 18 bp, Artificial sequence
  synthetic polynucleotide sequence
tgctggacaggggtgaga

SEQ ID NO: 48281 - DNA, 21 bp, Artificial sequence
  synthetic polynucleotide sequence
tactcgtggggagcacaccaa

SEQ ID NO: 48282 - DNA, 21 bp, Artificial sequence
  synthetic polynucleotide sequence
cgagaaagagcatctccccga

SEQ ID NO: 48283 - DNA, 18 bp, Artificial sequence
  synthetic polynucleotide sequence
cacggccaccgagcagga

SEQ ID NO: 48284 - DNA, 18 bp, Artificial sequence
  synthetic polynucleotide sequence
aaggagaggggcacggga

SEQ ID NO: 48285 - DNA, 20 bp, Artificial sequence
  synthetic polynucleotide sequence
tgaggcgagagaacagggga

SEQ ID NO: 48286 - DNA, 20 bp, Artificial sequence
  synthetic polynucleotide sequence
gagaaggccagagcgtcaca

SEQ ID NO: 48287 - DNA, 20 bp, Artificial sequence
  synthetic polynucleotide sequence
tgacccggacacagcacaca

SEQ ID NO: 48288 - DNA, 22 bp, Artificial sequence
  synthetic polynucleotide sequence
aggtacagactctgctgggaca

SEQ ID NO: 48289 - DNA, 18 bp, Artificial sequence
  synthetic polynucleotide sequence
caccacgccctgggagca

SEQ ID NO: 48290 - DNA, 21 bp, Artificial sequence
  synthetic polynucleotide sequence
tgcctgccccgaagatctcca

SEQ ID NO: 48291 - DNA, 21 bp, Artificial sequence
  synthetic polynucleotide sequence
tgtgcagagttcccggacaga

SEQ ID NO: 48292 - DNA, 21 bp, Artificial sequence
  synthetic polynucleotide sequence
gcacttgtagaacccccccca

SEQ ID NO: 48293 - DNA, 18 bp, Artificial sequence
  synthetic polynucleotide sequence
acggggagatcctggaca

SEQ ID NO: 48294 - DNA, 20 bp, Artificial sequence
  synthetic polynucleotide sequence
gtgggagacacatcagcgga

SEQ ID NO: 48295 - DNA, 18 bp, Artificial sequence
  synthetic polynucleotide sequence
aggtgccacagctcagca

SEQ ID NO: 48296 - DNA, 18 bp, Artificial sequence
  synthetic polynucleotide sequence
gccctggcacatggcaca

SEQ ID NO: 48297 - DNA, 19 bp, Artificial sequence
  synthetic polynucleotide sequence
ccagcggaggttgagggga

SEQ ID NO: 48298 - DNA, 19 bp, Artificial sequence
  synthetic polynucleotide sequence
tcagcatcacgtccaccca

SEQ ID NO: 48299 - DNA, 19 bp, Artificial sequence
  synthetic polynucleotide sequence
tgcagaaacagcagcagca

SEQ ID NO: 48300 - DNA, 22 bp, Artificial sequence
  synthetic polynucleotide sequence
caatcctaacgtaacgacccga

SEQ ID NO: 48301 - DNA, 18 bp, Artificial sequence
  synthetic polynucleotide sequence
catggccagccaagacca

SEQ ID NO: 48302 - DNA, 20 bp, Artificial sequence
  synthetic polynucleotide sequence
acgctggaggcactaggtga

SEQ ID NO: 48303 - DNA, 18 bp, Artificial sequence
  synthetic polynucleotide sequence
ctgcagccaaagccacca

SEQ ID NO: 48304 - DNA, 19 bp, Artificial sequence
  synthetic polynucleotide sequence
ctgaggcatctcagccaca

SEQ ID NO: 48305 - DNA, 18 bp, Artificial sequence
  synthetic polynucleotide sequence
gcatctgggccaacacca

SEQ ID NO: 48306 - DNA, 18 bp, Artificial sequence
  synthetic polynucleotide sequence
ctggccacttgagccaca

SEQ ID NO: 48307 - DNA, 20 bp, Artificial sequence
  synthetic polynucleotide sequence
gacgtgactctggacccaga

SEQ ID NO: 48308 - DNA, 18 bp, Artificial sequence
  synthetic polynucleotide sequence
ccggcgatgaagcatgga

SEQ ID NO: 48309 - DNA, 18 bp, Artificial sequence
  synthetic polynucleotide sequence
cgagacgcgcatgaacga

SEQ ID NO: 48310 - DNA, 18 bp, Artificial sequence
  synthetic polynucleotide sequence
tcctgggaactcaggcca

SEQ ID NO: 48311 - DNA, 18 bp, Artificial sequence
  synthetic polynucleotide sequence
gccgcttcaccaaggaga

SEQ ID NO: 48312 - DNA, 18 bp, Artificial sequence
  synthetic polynucleotide sequence
aggagctgccttggacga

SEQ ID NO: 48313 - DNA, 22 bp, Artificial sequence
  synthetic polynucleotide sequence
aggtgtacagtgccgatggaga

SEQ ID NO: 48314 - DNA, 20 bp, Artificial sequence
  synthetic polynucleotide sequence
gctgttgccccagtcagcca

SEQ ID NO: 48315 - DNA, 22 bp, Artificial sequence
  synthetic polynucleotide sequence
aaatcaccactcttcagcccca

SEQ ID NO: 48316 - DNA, 22 bp, Artificial sequence
  synthetic polynucleotide sequence
acctcacaaaaccaagcccgga

SEQ ID NO: 48317 - DNA, 22 bp, Artificial sequence
  synthetic polynucleotide sequence
agaatcggcagaatgagcacca

SEQ ID NO: 48318 - DNA, 23 bp, Artificial sequence
  synthetic polynucleotide sequence
gaataaggacactatagccccca

SEQ ID NO: 48319 - DNA, 18 bp, Artificial sequence
  synthetic polynucleotide sequence
caaaccgaggtcccacca

SEQ ID NO: 48320 - DNA, 18 bp, Artificial sequence
  synthetic polynucleotide sequence
ggcagagggacctggaga

SEQ ID NO: 48321 - DNA, 22 bp, Artificial sequence
  synthetic polynucleotide sequence
aggaggaagctgagaagctgga

SEQ ID NO: 48322 - DNA, 21 bp, Artificial sequence
  synthetic polynucleotide sequence
accactgactccgacactcca

SEQ ID NO: 48323 - DNA, 22 bp, Artificial sequence
  synthetic polynucleotide sequence
agatggagatgaaggaggacga

SEQ ID NO: 48324 - DNA, 20 bp, Artificial sequence
  synthetic polynucleotide sequence
cttccagacgcggtactgca

SEQ ID NO: 48325 - DNA, 19 bp, Artificial sequence
  synthetic polynucleotide sequence
tgctgcagaacgcatccaa

SEQ ID NO: 48326 - DNA, 21 bp, Artificial sequence
  synthetic polynucleotide sequence
ggactaactgcatcccgggga

SEQ ID NO: 48327 - DNA, 19 bp, Artificial sequence
  synthetic polynucleotide sequence
cagtctgggagcaggcaca

SEQ ID NO: 48328 - DNA, 18 bp, Artificial sequence
  synthetic polynucleotide sequence
tcaaccgcaggcaagcca

SEQ ID NO: 48329 - DNA, 22 bp, Artificial sequence
  synthetic polynucleotide sequence
tacacccaggagaatcaggaca

SEQ ID NO: 48330 - DNA, 21 bp, Artificial sequence
  synthetic polynucleotide sequence
agatgaagggaagttggggga

SEQ ID NO: 48331 - DNA, 20 bp, Artificial sequence
  synthetic polynucleotide sequence
tagactatgaggccggcaca

SEQ ID NO: 48332 - DNA, 18 bp, Artificial sequence
  synthetic polynucleotide sequence
tcttccgtccagcccgga

SEQ ID NO: 48333 - DNA, 20 bp, Artificial sequence
  synthetic polynucleotide sequence
tcgggaggacgtcatgggaa

SEQ ID NO: 48334 - DNA, 21 bp, Artificial sequence
  synthetic polynucleotide sequence
gtccacagcgctgtagaagga

SEQ ID NO: 48335 - DNA, 22 bp, Artificial sequence
  synthetic polynucleotide sequence
attgcagaacttcagcggctca

SEQ ID NO: 48336 - DNA, 21 bp, Artificial sequence
  synthetic polynucleotide sequence
ctgccctggagatgtcaagga

SEQ ID NO: 48337 - DNA, 21 bp, Artificial sequence
  synthetic polynucleotide sequence
gcaaacgctatcaggcccaga

SEQ ID NO: 48338 - DNA, 20 bp, Artificial sequence
  synthetic polynucleotide sequence
tgtagaagcccaggcgccca

SEQ ID NO: 48339 - DNA, 22 bp, Artificial sequence
  synthetic polynucleotide sequence
gagtactgccgcaatgacaaca

SEQ ID NO: 48340 - DNA, 20 bp, Artificial sequence
  synthetic polynucleotide sequence
agtgaggcggccctctcgga

SEQ ID NO: 48341 - DNA, 20 bp, Artificial sequence
  synthetic polynucleotide sequence
aggtggactgaaggccgcta

SEQ ID NO: 48342 - DNA, 21 bp, Artificial sequence
  synthetic polynucleotide sequence
cagtcacatgagctgtggcca

SEQ ID NO: 48343 - DNA, 20 bp, Artificial sequence
  synthetic polynucleotide sequence
aggagaaagcaccgcccaca

SEQ ID NO: 48344 - DNA, 21 bp, Artificial sequence
  synthetic polynucleotide sequence
ccacagcatgaccagtgggga

SEQ ID NO: 48345 - DNA, 20 bp, Artificial sequence
  synthetic polynucleotide sequence
ccctccagacattccggcca

SEQ ID NO: 48346 - DNA, 19 bp, Artificial sequence
  synthetic polynucleotide sequence
gcctcaggcactcgcagga

SEQ ID NO: 48347 - DNA, 20 bp, Artificial sequence
  synthetic polynucleotide sequence
tccccacaagagccctacga

SEQ ID NO: 48348 - DNA, 18 bp, Artificial sequence
  synthetic polynucleotide sequence
caatgggggaggccggga

SEQ ID NO: 48349 - DNA, 21 bp, Artificial sequence
  synthetic polynucleotide sequence
aactcacctgccccatctgca

SEQ ID NO: 48350 - DNA, 21 bp, Artificial sequence
  synthetic polynucleotide sequence
tctccctgtgaatgccacaca

SEQ ID NO: 48351 - DNA, 21 bp, Artificial sequence
  synthetic polynucleotide sequence
aaacctaccagccgagtagga

SEQ ID NO: 48352 - DNA, 22 bp, Artificial sequence
  synthetic polynucleotide sequence
tgagaggaggtgagaaagagca

SEQ ID NO: 48353 - DNA, 21 bp, Artificial sequence
  synthetic polynucleotide sequence
gcacaaagtcaacagggcaga

SEQ ID NO: 48354 - DNA, 20 bp, Artificial sequence
  synthetic polynucleotide sequence
cagcagccgactcaatggga

SEQ ID NO: 48355 - DNA, 22 bp, Artificial sequence
  synthetic polynucleotide sequence
aaaacctaccagccgagtagga

SEQ ID NO: 48356 - DNA, 20 bp, Artificial sequence
  synthetic polynucleotide sequence
aggcctgagaggaggtgaga

SEQ ID NO: 48357 - DNA, 21 bp, Artificial sequence
  synthetic polynucleotide sequence
tgaccgtcaaaatgcgcccca

SEQ ID NO: 48358 - DNA, 19 bp, Artificial sequence
  synthetic polynucleotide sequence
cccccacatggacctccca

SEQ ID NO: 48359 - DNA, 20 bp, Artificial sequence
  synthetic polynucleotide sequence
ctggactgggaggagagcaa

SEQ ID NO: 48360 - DNA, 21 bp, Artificial sequence
  synthetic polynucleotide sequence
gctccatcactgacccctgca

SEQ ID NO: 48361 - DNA, 21 bp, Artificial sequence
  synthetic polynucleotide sequence
ctgagcgcttcgactacagca

SEQ ID NO: 48362 - DNA, 20 bp, Artificial sequence
  synthetic polynucleotide sequence
tgtgcccttgatgaccccca

SEQ ID NO: 48363 - DNA, 22 bp, Artificial sequence
  synthetic polynucleotide sequence
aagacctaccagcacagtagga

SEQ ID NO: 48364 - DNA, 20 bp, Artificial sequence
  synthetic polynucleotide sequence
ggcctgagaggaggtgagaa

SEQ ID NO: 48365 - DNA, 20 bp, Artificial sequence
  synthetic polynucleotide sequence
atcgggggaatgctgacgaa

SEQ ID NO: 48366 - DNA, 20 bp, Artificial sequence
  synthetic polynucleotide sequence
caaggaaggaggcgggtgga

SEQ ID NO: 48367 - DNA, 19 bp, Artificial sequence
  synthetic polynucleotide sequence
gcccgggagcaagaggaga

SEQ ID NO: 48368 - DNA, 20 bp, Artificial sequence
  synthetic polynucleotide sequence
caccttcgacatggccccga

SEQ ID NO: 48369 - DNA, 20 bp, Artificial sequence
  synthetic polynucleotide sequence
accagcccatgtgcgaggaa

SEQ ID NO: 48370 - DNA, 18 bp, Artificial sequence
  synthetic polynucleotide sequence
gaggggagccacctggca

SEQ ID NO: 48371 - DNA, 20 bp, Artificial sequence
  synthetic polynucleotide sequence
cggatgagcagaaccgggca

SEQ ID NO: 48372 - DNA, 19 bp, Artificial sequence
  synthetic polynucleotide sequence
gcgctagcggagaaggcca

SEQ ID NO: 48373 - DNA, 22 bp, Artificial sequence
  synthetic polynucleotide sequence
aaccatggagggatgtccccaa

SEQ ID NO: 48374 - DNA, 21 bp, Artificial sequence
  synthetic polynucleotide sequence
ttctcccaccagaacctccca

SEQ ID NO: 48375 - DNA, 18 bp, Artificial sequence
  synthetic polynucleotide sequence
agcccccaaaccacgaga

SEQ ID NO: 48376 - DNA, 21 bp, Artificial sequence
  synthetic polynucleotide sequence
gagcatggcagtacacgagga

SEQ ID NO: 48377 - DNA, 21 bp, Artificial sequence
  synthetic polynucleotide sequence
tcacaaaccatggcttcccca

SEQ ID NO: 48378 - DNA, 21 bp, Artificial sequence
  synthetic polynucleotide sequence
agcttggacgacgcagggtca

SEQ ID NO: 48379 - DNA, 20 bp, Artificial sequence
  synthetic polynucleotide sequence
ctggccgacattactgggaa

SEQ ID NO: 48380 - DNA, 22 bp, Artificial sequence
  synthetic polynucleotide sequence
atgtatcgcccaattgcccaga

SEQ ID NO: 48381 - DNA, 20 bp, Artificial sequence
  synthetic polynucleotide sequence
agcagaggctagctgtccca

SEQ ID NO: 48382 - DNA, 20 bp, Artificial sequence
  synthetic polynucleotide sequence
gtggcaaaaggggcagggga

SEQ ID NO: 48383 - DNA, 21 bp, Artificial sequence
  synthetic polynucleotide sequence
gcagcatccagatccagccca

SEQ ID NO: 48384 - DNA, 20 bp, Artificial sequence
  synthetic polynucleotide sequence
tcgcggaaggtgtagagcca

SEQ ID NO: 48385 - DNA, 22 bp, Artificial sequence
  synthetic polynucleotide sequence
gtaaaggaagagctgagccaga

SEQ ID NO: 48386 - DNA, 18 bp, Artificial sequence
  synthetic polynucleotide sequence
ctcccccaggctcgtcca

SEQ ID NO: 48387 - DNA, 22 bp, Artificial sequence
  synthetic polynucleotide sequence
aagcattcacctccggcaagca

SEQ ID NO: 48388 - DNA, 22 bp, Artificial sequence
  synthetic polynucleotide sequence
aggtggagagttggtggagaga

SEQ ID NO: 48389 - DNA, 22 bp, Artificial sequence
  synthetic polynucleotide sequence
attccaggactgcagatgccaa

SEQ ID NO: 48390 - DNA, 21 bp, Artificial sequence
  synthetic polynucleotide sequence
gaaacaccccaactcgaccca

SEQ ID NO: 48391 - DNA, 21 bp, Artificial sequence
  synthetic polynucleotide sequence
tgacccactcctccaactgga

SEQ ID NO: 48392 - DNA, 21 bp, Artificial sequence
  synthetic polynucleotide sequence
caacccagaggcctttgcaca

SEQ ID NO: 48393 - DNA, 20 bp, Artificial sequence
  synthetic polynucleotide sequence
tctcctacccgcaactgcca

SEQ ID NO: 48394 - DNA, 21 bp, Artificial sequence
  synthetic polynucleotide sequence
caggctgtagaaggtgaggca

SEQ ID NO: 48395 - DNA, 19 bp, Artificial sequence
  synthetic polynucleotide sequence
cccccagccccaatagaga

SEQ ID NO: 48396 - DNA, 18 bp, Artificial sequence
  synthetic polynucleotide sequence
ctgagcaaggctggcaca

SEQ ID NO: 48397 - DNA, 21 bp, Artificial sequence
  synthetic polynucleotide sequence
tcccacaccaacaggacggaa

SEQ ID NO: 48398 - DNA, 20 bp, Artificial sequence
  synthetic polynucleotide sequence
tggcatgaagaccccgtcca

SEQ ID NO: 48399 - DNA, 20 bp, Artificial sequence
  synthetic polynucleotide sequence
ctgggtgataaggctgagga

SEQ ID NO: 48400 - DNA, 19 bp, Artificial sequence
  synthetic polynucleotide sequence
gggaagggatagcggggga

SEQ ID NO: 48401 - DNA, 22 bp, Artificial sequence
  synthetic polynucleotide sequence
gaatccatcattcggaagggca

SEQ ID NO: 48402 - DNA, 21 bp, Artificial sequence
  synthetic polynucleotide sequence
aggcaggggcagaagtaggga

SEQ ID NO: 48403 - DNA, 20 bp, Artificial sequence
  synthetic polynucleotide sequence
tctactgccaggacgacgga

SEQ ID NO: 48404 - DNA, 21 bp, Artificial sequence
  synthetic polynucleotide sequence
ggaacacctcacagtcctcca

SEQ ID NO: 48405 - DNA, 20 bp, Artificial sequence
  synthetic polynucleotide sequence
gagggggctctctggaagca

SEQ ID NO: 48406 - DNA, 22 bp, Artificial sequence
  synthetic polynucleotide sequence
atggttcctggaatccgccaca

SEQ ID NO: 48407 - DNA, 21 bp, Artificial sequence
  synthetic polynucleotide sequence
cgcatgaaggaggagctcgca

SEQ ID NO: 48408 - DNA, 21 bp, Artificial sequence
  synthetic polynucleotide sequence
cacccagctgaagacatccga

SEQ ID NO: 48409 - DNA, 25 bp, Artificial sequence
  synthetic polynucleotide sequence
ctggacaaagaggaatgacatgcga

SEQ ID NO: 48410 - DNA, 21 bp, Artificial sequence
  synthetic polynucleotide sequence
acagtggggaggtagagaaga

SEQ ID NO: 48411 - DNA, 20 bp, Artificial sequence
  synthetic polynucleotide sequence
tgccctcgcaggagtactca

SEQ ID NO: 48412 - DNA, 20 bp, Artificial sequence
  synthetic polynucleotide sequence
gtttggtggacggctgccca

SEQ ID NO: 48413 - DNA, 21 bp, Artificial sequence
  synthetic polynucleotide sequence
cagggccaaagaagccaagga

SEQ ID NO: 48414 - DNA, 21 bp, Artificial sequence
  synthetic polynucleotide sequence
tgagggcatcacattgggcca

SEQ ID NO: 48415 - DNA, 22 bp, Artificial sequence
  synthetic polynucleotide sequence
agatcttcaccagtgggagaca

SEQ ID NO: 48416 - DNA, 18 bp, Artificial sequence
  synthetic polynucleotide sequence
ccccaggtggcttgggga

SEQ ID NO: 48417 - DNA, 19 bp, Artificial sequence
  synthetic polynucleotide sequence
ggatggggctggcaaccca

SEQ ID NO: 48418 - DNA, 19 bp, Artificial sequence
  synthetic polynucleotide sequence
tttccacgtccacctccca

SEQ ID NO: 48419 - DNA, 18 bp, Artificial sequence
  synthetic polynucleotide sequence
ggagcttcagacgcagca

SEQ ID NO: 48420 - DNA, 19 bp, Artificial sequence
  synthetic polynucleotide sequence
gcgaggcatagtggccaga

SEQ ID NO: 48421 - DNA, 18 bp, Artificial sequence
  synthetic polynucleotide sequence
cccaggaggatggccaca

SEQ ID NO: 48422 - DNA, 18 bp, Artificial sequence
  synthetic polynucleotide sequence
gcggggtgaccttgggca

SEQ ID NO: 48423 - DNA, 18 bp, Artificial sequence
  synthetic polynucleotide sequence
aggaacccacatccccca

SEQ ID NO: 48424 - DNA, 19 bp, Artificial sequence
  synthetic polynucleotide sequence
tgagcgtgactcggaggta

SEQ ID NO: 48425 - DNA, 22 bp, Artificial sequence
  synthetic polynucleotide sequence
aagttcagcacagcattgggca

SEQ ID NO: 48426 - DNA, 21 bp, Artificial sequence
  synthetic polynucleotide sequence
agacactctgcagactgggga

SEQ ID NO: 48427 - DNA, 21 bp, Artificial sequence
  synthetic polynucleotide sequence
gaaccgagaggagctgctgaa

SEQ ID NO: 48428 - DNA, 21 bp, Artificial sequence
  synthetic polynucleotide sequence
gtaggcccaagacctgtacca

SEQ ID NO: 48429 - DNA, 20 bp, Artificial sequence
  synthetic polynucleotide sequence
gacagggctgacatcaagca

SEQ ID NO: 48430 - DNA, 18 bp, Artificial sequence
  synthetic polynucleotide sequence
gtcagcagctgctggcga

SEQ ID NO: 48431 - DNA, 22 bp, Artificial sequence
  synthetic polynucleotide sequence
tacacaagagagggacaggaca

SEQ ID NO: 48432 - DNA, 20 bp, Artificial sequence
  synthetic polynucleotide sequence
gttcacagacaatgcgccca

SEQ ID NO: 48433 - DNA, 20 bp, Artificial sequence
  synthetic polynucleotide sequence
tgagccaggtcaggaggaga

SEQ ID NO: 48434 - DNA, 20 bp, Artificial sequence
  synthetic polynucleotide sequence
agtggtgacggtggctgaga

SEQ ID NO: 48435 - DNA, 18 bp, Artificial sequence
  synthetic polynucleotide sequence
ctcaccacagcggaccaa

SEQ ID NO: 48436 - DNA, 23 bp, Artificial sequence
  synthetic polynucleotide sequence
cactcaggaaagtaaaaggccca

SEQ ID NO: 48437 - DNA, 22 bp, Artificial sequence
  synthetic polynucleotide sequence
gacaaacgcaaagtggccagga

SEQ ID NO: 48438 - DNA, 21 bp, Artificial sequence
  synthetic polynucleotide sequence
ttcagaggacctccaagggga

SEQ ID NO: 48439 - DNA, 22 bp, Artificial sequence
  synthetic polynucleotide sequence
accttgggcagctcagttcaca

SEQ ID NO: 48440 - DNA, 22 bp, Artificial sequence
  synthetic polynucleotide sequence
caaagccatcaccaaaccagca

SEQ ID NO: 48441 - DNA, 21 bp, Artificial sequence
  synthetic polynucleotide sequence
tctgtactacaccctggacca

SEQ ID NO: 48442 - DNA, 19 bp, Artificial sequence
  synthetic polynucleotide sequence
tccttctcccagcaacgca

SEQ ID NO: 48443 - DNA, 19 bp, Artificial sequence
  synthetic polynucleotide sequence
atgggaagagcaacgggaa

SEQ ID NO: 48444 - DNA, 20 bp, Artificial sequence
  synthetic polynucleotide sequence
ggcgaagggtgctatgaaca

SEQ ID NO: 48445 - DNA, 22 bp, Artificial sequence
  synthetic polynucleotide sequence
ggaagccaaacactcaggacca

SEQ ID NO: 48446 - DNA, 22 bp, Artificial sequence
  synthetic polynucleotide sequence
tgaatccagtgaggcagatcca

SEQ ID NO: 48447 - DNA, 22 bp, Artificial sequence
  synthetic polynucleotide sequence
aacggctgaacctggcaactga

SEQ ID NO: 48448 - DNA, 22 bp, Artificial sequence
  synthetic polynucleotide sequence
gaattgcagagcctcttgccaa

SEQ ID NO: 48449 - DNA, 21 bp, Artificial sequence
  synthetic polynucleotide sequence
agacccaaactgcatccctga

SEQ ID NO: 48450 - DNA, 22 bp, Artificial sequence
  synthetic polynucleotide sequence
agcacatgctatcagcaggcca

SEQ ID NO: 48451 - DNA, 21 bp, Artificial sequence
  synthetic polynucleotide sequence
gcgtctgatccaggtgccgaa

SEQ ID NO: 48452 - DNA, 18 bp, Artificial sequence
  synthetic polynucleotide sequence
aggcaggtggcccgggaa

SEQ ID NO: 48453 - DNA, 22 bp, Artificial sequence
  synthetic polynucleotide sequence
ggatggtactcgaactccagca

SEQ ID NO: 48454 - DNA, 21 bp, Artificial sequence
  synthetic polynucleotide sequence
tcacaagcatggacgaaggca

SEQ ID NO: 48455 - DNA, 21 bp, Artificial sequence
  synthetic polynucleotide sequence
ctaggccttggagcagtggaa

SEQ ID NO: 48456 - DNA, 22 bp, Artificial sequence
  synthetic polynucleotide sequence
tcaacactaagaagcccaggca

SEQ ID NO: 48457 - DNA, 18 bp, Artificial sequence
  synthetic polynucleotide sequence
gcccggcgtcactacgga

SEQ ID NO: 48458 - DNA, 23 bp, Artificial sequence
  synthetic polynucleotide sequence
caaaatgttccagagccactgca

SEQ ID NO: 48459 - DNA, 20 bp, Artificial sequence
  synthetic polynucleotide sequence
tcatccaggactgggcccaa

SEQ ID NO: 48460 - DNA, 20 bp, Artificial sequence
  synthetic polynucleotide sequence
ctgggcatagctcgacccca

SEQ ID NO: 48461 - DNA, 21 bp, Artificial sequence
  synthetic polynucleotide sequence
agcaggcagtggaggatgcaa

SEQ ID NO: 48462 - DNA, 22 bp, Artificial sequence
  synthetic polynucleotide sequence
attcaccatggagcttgcagga

SEQ ID NO: 48463 - DNA, 20 bp, Artificial sequence
  synthetic polynucleotide sequence
cctgccccaccatgtccaca

SEQ ID NO: 48464 - DNA, 21 bp, Artificial sequence
  synthetic polynucleotide sequence
gtggtgagaaacgctggcaga

SEQ ID NO: 48465 - DNA, 19 bp, Artificial sequence
  synthetic polynucleotide sequence
tggacatccctgacacaga

SEQ ID NO: 48466 - DNA, 20 bp, Artificial sequence
  synthetic polynucleotide sequence
gtcatgcctcggacatcaga

SEQ ID NO: 48467 - DNA, 21 bp, Artificial sequence
  synthetic polynucleotide sequence
aaccacccagaagaccaggaa

SEQ ID NO: 48468 - DNA, 22 bp, Artificial sequence
  synthetic polynucleotide sequence
aagtccagcaaagacagcagca

SEQ ID NO: 48469 - DNA, 19 bp, Artificial sequence
  synthetic polynucleotide sequence
gcgcactgtcagcctgcca

SEQ ID NO: 48470 - DNA, 19 bp, Artificial sequence
  synthetic polynucleotide sequence
tggtggcgaaggtcaggta

SEQ ID NO: 48471 - DNA, 21 bp, Artificial sequence
  synthetic polynucleotide sequence
agctgagactggggagggaga

SEQ ID NO: 48472 - DNA, 18 bp, Artificial sequence
  synthetic polynucleotide sequence
ggccggggaacttcccca

SEQ ID NO: 48473 - DNA, 21 bp, Artificial sequence
  synthetic polynucleotide sequence
ggtggagaaggacagcgtcaa

SEQ ID NO: 48474 - DNA, 20 bp, Artificial sequence
  synthetic polynucleotide sequence
tgcgggaggctcctccgcaa

SEQ ID NO: 48475 - DNA, 21 bp, Artificial sequence
  synthetic polynucleotide sequence
cgacctggaaccctacatgga

SEQ ID NO: 48476 - DNA, 20 bp, Artificial sequence
  synthetic polynucleotide sequence
agtagccagctgggatccca

SEQ ID NO: 48477 - DNA, 18 bp, Artificial sequence
  synthetic polynucleotide sequence
gaggtgccgaccgaccga

SEQ ID NO: 48478 - DNA, 18 bp, Artificial sequence
  synthetic polynucleotide sequence
gcccagggagaaagccga

SEQ ID NO: 48479 - DNA, 21 bp, Artificial sequence
  synthetic polynucleotide sequence
agcaggaggagcagtgaggga

SEQ ID NO: 48480 - DNA, 20 bp, Artificial sequence
  synthetic polynucleotide sequence
atcatccgaatcccagccga

SEQ ID NO: 48481 - DNA, 20 bp, Artificial sequence
  synthetic polynucleotide sequence
cggtggaggaccaggcacca

SEQ ID NO: 48482 - DNA, 21 bp, Artificial sequence
  synthetic polynucleotide sequence
ctagtgaccagtccaccacca

SEQ ID NO: 48483 - DNA, 18 bp, Artificial sequence
  synthetic polynucleotide sequence
caggccgaaagccaggca

SEQ ID NO: 48484 - DNA, 18 bp, Artificial sequence
  synthetic polynucleotide sequence
aaggggttccgaggctga

SEQ ID NO: 48485 - DNA, 22 bp, Artificial sequence
  synthetic polynucleotide sequence
cagtgctccgacataagcacaa

SEQ ID NO: 48486 - DNA, 20 bp, Artificial sequence
  synthetic polynucleotide sequence
aactgccagagcaagggcca

SEQ ID NO: 48487 - DNA, 21 bp, Artificial sequence
  synthetic polynucleotide sequence
tgggaaagccacccctctcca

SEQ ID NO: 48488 - DNA, 18 bp, Artificial sequence
  synthetic polynucleotide sequence
gctccctgggtggcagca

SEQ ID NO: 48489 - DNA, 25 bp, Artificial sequence
  synthetic polynucleotide sequence
catcaaaaggcaaggtcaaacggca

SEQ ID NO: 48490 - DNA, 23 bp, Artificial sequence
  synthetic polynucleotide sequence
gtaacgatgcactaggcagcaca

SEQ ID NO: 48491 - DNA, 20 bp, Artificial sequence
  synthetic polynucleotide sequence
aggcctaagggagcagacca

SEQ ID NO: 48492 - DNA, 22 bp, Artificial sequence
  synthetic polynucleotide sequence
ttgaacacaagcagacccagga

SEQ ID NO: 48493 - DNA, 20 bp, Artificial sequence
  synthetic polynucleotide sequence
cgcccagggagaagcagaga

SEQ ID NO: 48494 - DNA, 22 bp, Artificial sequence
  synthetic polynucleotide sequence
acattgttcactgagaccggga

SEQ ID NO: 48495 - DNA, 22 bp, Artificial sequence
  synthetic polynucleotide sequence
tcatgaagaaggagccagcaga

SEQ ID NO: 48496 - DNA, 21 bp, Artificial sequence
  synthetic polynucleotide sequence
ccaagaggcctcgcttcagca

SEQ ID NO: 48497 - DNA, 21 bp, Artificial sequence
  synthetic polynucleotide sequence
cctgatctcacccaggagcaa

SEQ ID NO: 48498 - DNA, 21 bp, Artificial sequence
  synthetic polynucleotide sequence
cattccacgacagttggggga

SEQ ID NO: 48499 - DNA, 22 bp, Artificial sequence
  synthetic polynucleotide sequence
gtaacatcccagtggtgcggaa

SEQ ID NO: 48500 - DNA, 22 bp, Artificial sequence
  synthetic polynucleotide sequence
gcaaagcatccccaactcgaga

SEQ ID NO: 48501 - DNA, 23 bp, Artificial sequence
  synthetic polynucleotide sequence
gcaaagacatttagcagcccaca

SEQ ID NO: 48502 - DNA, 20 bp, Artificial sequence
  synthetic polynucleotide sequence
ggacccctccccaccaagga

SEQ ID NO: 48503 - DNA, 21 bp, Artificial sequence
  synthetic polynucleotide sequence
tggccagttcaccaaccagca

SEQ ID NO: 48504 - DNA, 21 bp, Artificial sequence
  synthetic polynucleotide sequence
ggtgtgcttggcaacagacca

SEQ ID NO: 48505 - DNA, 21 bp, Artificial sequence
  synthetic polynucleotide sequence
ccaaccacacgctgtacccca

SEQ ID NO: 48506 - DNA, 19 bp, Artificial sequence
  synthetic polynucleotide sequence
tgtacacctccatgccgca

SEQ ID NO: 48507 - DNA, 21 bp, Artificial sequence
  synthetic polynucleotide sequence
ctgacaacgggaccactggaa

SEQ ID NO: 48508 - DNA, 19 bp, Artificial sequence
  synthetic polynucleotide sequence
cgatgcccgtccactccca

SEQ ID NO: 48509 - DNA, 20 bp, Artificial sequence
  synthetic polynucleotide sequence
ctaccgtccctacctgcaga

SEQ ID NO: 48510 - DNA, 19 bp, Artificial sequence
  synthetic polynucleotide sequence
tggcatactgggagacgca

SEQ ID NO: 48511 - DNA, 20 bp, Artificial sequence
  synthetic polynucleotide sequence
caccttccgtggaccaggaa

SEQ ID NO: 48512 - DNA, 22 bp, Artificial sequence
  synthetic polynucleotide sequence
ccaccaacacggtgtaagtgaa

SEQ ID NO: 48513 - DNA, 22 bp, Artificial sequence
  synthetic polynucleotide sequence
atacagaacagagcccaacgga

SEQ ID NO: 48514 - DNA, 21 bp, Artificial sequence
  synthetic polynucleotide sequence
ctgcatgcccccatgtacaga

SEQ ID NO: 48515 - DNA, 21 bp, Artificial sequence
  synthetic polynucleotide sequence
caggcaagggatccttaggca

SEQ ID NO: 48516 - DNA, 20 bp, Artificial sequence
  synthetic polynucleotide sequence
accatccacgtcactgggca

SEQ ID NO: 48517 - DNA, 22 bp, Artificial sequence
  synthetic polynucleotide sequence
atgagacctgcgaaacacccaa

SEQ ID NO: 48518 - DNA, 21 bp, Artificial sequence
  synthetic polynucleotide sequence
aagtagtgcggattcccagga

SEQ ID NO: 48519 - DNA, 20 bp, Artificial sequence
  synthetic polynucleotide sequence
atcagtggcatgcggtccca

SEQ ID NO: 48520 - DNA, 21 bp, Artificial sequence
  synthetic polynucleotide sequence
tacttgggaaggaggaagcca

SEQ ID NO: 48521 - DNA, 21 bp, Artificial sequence
  synthetic polynucleotide sequence
tcaccatcctggacacggaga

SEQ ID NO: 48522 - DNA, 21 bp, Artificial sequence
  synthetic polynucleotide sequence
agttcacctcgtccaccctga

SEQ ID NO: 48523 - DNA, 21 bp, Artificial sequence
  synthetic polynucleotide sequence
actgggcttcatgggagcaga

SEQ ID NO: 48524 - DNA, 19 bp, Artificial sequence
  synthetic polynucleotide sequence
gaggagctggacgggcaca

SEQ ID NO: 48525 - DNA, 20 bp, Artificial sequence
  synthetic polynucleotide sequence
ctggcgcctgcagagagcca

SEQ ID NO: 48526 - DNA, 21 bp, Artificial sequence
  synthetic polynucleotide sequence
gtcggaaatcatcctcggcca

SEQ ID NO: 48527 - DNA, 18 bp, Artificial sequence
  synthetic polynucleotide sequence
cctgaacccgtgtgccaa

SEQ ID NO: 48528 - DNA, 18 bp, Artificial sequence
  synthetic polynucleotide sequence
acgaggggtaagtgggca

SEQ ID NO: 48529 - DNA, 18 bp, Artificial sequence
  synthetic polynucleotide sequence
gcggctcaccaacaccaa

SEQ ID NO: 48530 - DNA, 18 bp, Artificial sequence
  synthetic polynucleotide sequence
gaccacagccatcagcca

SEQ ID NO: 48531 - DNA, 19 bp, Artificial sequence
  synthetic polynucleotide sequence
ggctggcagggcgtgagga

SEQ ID NO: 48532 - DNA, 20 bp, Artificial sequence
  synthetic polynucleotide sequence
gaccctggggtggagaccga

SEQ ID NO: 48533 - DNA, 18 bp, Artificial sequence
  synthetic polynucleotide sequence
tggcagatgccgtcgaca

SEQ ID NO: 48534 - DNA, 18 bp, Artificial sequence
  synthetic polynucleotide sequence
ttccctccgagccaacca

SEQ ID NO: 48535 - DNA, 21 bp, Artificial sequence
  synthetic polynucleotide sequence
ctgccattggagaactgggga

SEQ ID NO: 48536 - DNA, 21 bp, Artificial sequence
  synthetic polynucleotide sequence
atgcagaatagagggggggca

SEQ ID NO: 48537 - DNA, 21 bp, Artificial sequence
  synthetic polynucleotide sequence
cctcctgggcaaagctacaga

SEQ ID NO: 48538 - DNA, 21 bp, Artificial sequence
  synthetic polynucleotide sequence
gggagccttggataacggcca

SEQ ID NO: 48539 - DNA, 21 bp, Artificial sequence
  synthetic polynucleotide sequence
aagcaagttccccaccagcca

SEQ ID NO: 48540 - DNA, 20 bp, Artificial sequence
  synthetic polynucleotide sequence
gttgggcgagctgggtctga

SEQ ID NO: 48541 - DNA, 20 bp, Artificial sequence
  synthetic polynucleotide sequence
atcaccacagcagaggcaga

SEQ ID NO: 48542 - DNA, 18 bp, Artificial sequence
  synthetic polynucleotide sequence
agaactggaggctgccga

SEQ ID NO: 48543 - DNA, 18 bp, Artificial sequence
  synthetic polynucleotide sequence
tctcagccacagccagca

SEQ ID NO: 48544 - DNA, 18 bp, Artificial sequence
  synthetic polynucleotide sequence
gacgtgatgggccagaca

SEQ ID NO: 48545 - DNA, 20 bp, Artificial sequence
  synthetic polynucleotide sequence
ctgcaggagtaggagcagga

SEQ ID NO: 48546 - DNA, 21 bp, Artificial sequence
  synthetic polynucleotide sequence
tgactgccagtaggtacagca

SEQ ID NO: 48547 - DNA, 20 bp, Artificial sequence
  synthetic polynucleotide sequence
aggcacacacagcgcaccaa

SEQ ID NO: 48548 - DNA, 21 bp, Artificial sequence
  synthetic polynucleotide sequence
tctgcaacaggcggcttcaca

SEQ ID NO: 48549 - DNA, 21 bp, Artificial sequence
  synthetic polynucleotide sequence
gcagatccgagagctggtgga

SEQ ID NO: 48550 - DNA, 21 bp, Artificial sequence
  synthetic polynucleotide sequence
ctcttcagggctcagacagga

SEQ ID NO: 48551 - DNA, 18 bp, Artificial sequence
  synthetic polynucleotide sequence
ccagaccccttcggagca

SEQ ID NO: 48552 - DNA, 18 bp, Artificial sequence
  synthetic polynucleotide sequence
acctcctcccggaccgca

SEQ ID NO: 48553 - DNA, 19 bp, Artificial sequence
  synthetic polynucleotide sequence
cttcgtgggcccctgagga

SEQ ID NO: 48554 - DNA, 22 bp, Artificial sequence
  synthetic polynucleotide sequence
ccaacaaggcagatgagctgga

SEQ ID NO: 48555 - DNA, 21 bp, Artificial sequence
  synthetic polynucleotide sequence
gtgggactcaagtacgggaca

SEQ ID NO: 48556 - DNA, 20 bp, Artificial sequence
  synthetic polynucleotide sequence
ccaactgagaggcctgcgga

SEQ ID NO: 48557 - DNA, 18 bp, Artificial sequence
  synthetic polynucleotide sequence
tccttgtccagctggcca

SEQ ID NO: 48558 - DNA, 18 bp, Artificial sequence
  synthetic polynucleotide sequence
ccgaacttgccagccgca

SEQ ID NO: 48559 - DNA, 20 bp, Artificial sequence
  synthetic polynucleotide sequence
agctggcgggagtacaagga

SEQ ID NO: 48560 - DNA, 21 bp, Artificial sequence
  synthetic polynucleotide sequence
ccaagcccccagacttctcca

SEQ ID NO: 48561 - DNA, 19 bp, Artificial sequence
  synthetic polynucleotide sequence
gccccagccaaggcacaca

SEQ ID NO: 48562 - DNA, 20 bp, Artificial sequence
  synthetic polynucleotide sequence
tgtttgaggtccccgccaca

SEQ ID NO: 48563 - DNA, 19 bp, Artificial sequence
  synthetic polynucleotide sequence
ggggcgtgatagacctgga

SEQ ID NO: 48564 - DNA, 19 bp, Artificial sequence
  synthetic polynucleotide sequence
gaggtcactgagaccggca

SEQ ID NO: 48565 - DNA, 19 bp, Artificial sequence
  synthetic polynucleotide sequence
tgaaagggagagggccgta

SEQ ID NO: 48566 - DNA, 21 bp, Artificial sequence
  synthetic polynucleotide sequence
tcaggagatcgatggtgagca

SEQ ID NO: 48567 - DNA, 20 bp, Artificial sequence
  synthetic polynucleotide sequence
tgggagagcatcgccacaga

SEQ ID NO: 48568 - DNA, 20 bp, Artificial sequence
  synthetic polynucleotide sequence
cgcctggactgacgctggga

SEQ ID NO: 48569 - DNA, 22 bp, Artificial sequence
  synthetic polynucleotide sequence
aagtcagcgagtgaaaggccaa

SEQ ID NO: 48570 - DNA, 18 bp, Artificial sequence
  synthetic polynucleotide sequence
ggccctcccgttgcggaa

SEQ ID NO: 48571 - DNA, 21 bp, Artificial sequence
  synthetic polynucleotide sequence
gcccagtacgcagactctgaa

SEQ ID NO: 48572 - DNA, 20 bp, Artificial sequence
  synthetic polynucleotide sequence
ccagctgctgcagagtcaca

SEQ ID NO: 48573 - DNA, 21 bp, Artificial sequence
  synthetic polynucleotide sequence
tggcatcacctctgcgggaga

SEQ ID NO: 48574 - DNA, 21 bp, Artificial sequence
  synthetic polynucleotide sequence
agctcgtccaacgcctcctca

SEQ ID NO: 48575 - DNA, 18 bp, Artificial sequence
  synthetic polynucleotide sequence
cttgggcaaagccacgga

SEQ ID NO: 48576 - DNA, 20 bp, Artificial sequence
  synthetic polynucleotide sequence
aaacaggtagcgcctggaca

SEQ ID NO: 48577 - DNA, 25 bp, Artificial sequence
  synthetic polynucleotide sequence
agcacaaaccaagtcaccgtcagaa

SEQ ID NO: 48578 - DNA, 22 bp, Artificial sequence
  synthetic polynucleotide sequence
ttgcactgataggaagtcccca

SEQ ID NO: 48579 - DNA, 20 bp, Artificial sequence
  synthetic polynucleotide sequence
cttcggctggcccaagacga

SEQ ID NO: 48580 - DNA, 18 bp, Artificial sequence
  synthetic polynucleotide sequence
cactgctgcctcccccca

SEQ ID NO: 48581 - DNA, 18 bp, Artificial sequence
  synthetic polynucleotide sequence
acctcccggcactgcaga

SEQ ID NO: 48582 - DNA, 18 bp, Artificial sequence
  synthetic polynucleotide sequence
ctacgcagtgcagggcca

SEQ ID NO: 48583 - DNA, 21 bp, Artificial sequence
  synthetic polynucleotide sequence
tggtgcccaggctattcggaa

SEQ ID NO: 48584 - DNA, 22 bp, Artificial sequence
  synthetic polynucleotide sequence
aaggtcgattgaagcgacgcca

SEQ ID NO: 48585 - DNA, 18 bp, Artificial sequence
  synthetic polynucleotide sequence
tggctgccgagcaggaca

SEQ ID NO: 48586 - DNA, 20 bp, Artificial sequence
  synthetic polynucleotide sequence
caagaagaccaagcgctgca

SEQ ID NO: 48587 - DNA, 20 bp, Artificial sequence
  synthetic polynucleotide sequence
gctgcttcccatggcgcaga

SEQ ID NO: 48588 - DNA, 19 bp, Artificial sequence
  synthetic polynucleotide sequence
tcagtgatgtccgggagca

SEQ ID NO: 48589 - DNA, 22 bp, Artificial sequence
  synthetic polynucleotide sequence
tagcccaagagctatcagggga

SEQ ID NO: 48590 - DNA, 21 bp, Artificial sequence
  synthetic polynucleotide sequence
tcctgtgcatcagaggaggga

SEQ ID NO: 48591 - DNA, 21 bp, Artificial sequence
  synthetic polynucleotide sequence
tgagtcggaaatgccagagga

SEQ ID NO: 48592 - DNA, 20 bp, Artificial sequence
  synthetic polynucleotide sequence
ctggctctcgaggtcccaca

SEQ ID NO: 48593 - DNA, 20 bp, Artificial sequence
  synthetic polynucleotide sequence
caacgtcaccaacacagcca

SEQ ID NO: 48594 - DNA, 18 bp, Artificial sequence
  synthetic polynucleotide sequence
ccaattccagctgccaca

SEQ ID NO: 48595 - DNA, 19 bp, Artificial sequence
  synthetic polynucleotide sequence
tcctcctcgaccaagtcca

SEQ ID NO: 48596 - DNA, 18 bp, Artificial sequence
  synthetic polynucleotide sequence
caggaccccgaagccgca

SEQ ID NO: 48597 - DNA, 20 bp, Artificial sequence
  synthetic polynucleotide sequence
gagcagttcctggccgacca

SEQ ID NO: 48598 - DNA, 20 bp, Artificial sequence
  synthetic polynucleotide sequence
tggagcctctggtgcaagca

SEQ ID NO: 48599 - DNA, 22 bp, Artificial sequence
  synthetic polynucleotide sequence
acgagggtagaggaagcagtca

SEQ ID NO: 48600 - DNA, 22 bp, Artificial sequence
  synthetic polynucleotide sequence
tatgtccaaacgccacaagcca

SEQ ID NO: 48601 - DNA, 21 bp, Artificial sequence
  synthetic polynucleotide sequence
ggttccgaagtgttaacccaa

SEQ ID NO: 48602 - DNA, 20 bp, Artificial sequence
  synthetic polynucleotide sequence
gtaggtcagccaaacaccca

SEQ ID NO: 48603 - DNA, 22 bp, Artificial sequence
  synthetic polynucleotide sequence
aagagcaagtgggatgagtcca

SEQ ID NO: 48604 - DNA, 21 bp, Artificial sequence
  synthetic polynucleotide sequence
tctgcaacagcgagatggcga

SEQ ID NO: 48605 - DNA, 19 bp, Artificial sequence
  synthetic polynucleotide sequence
ctggcgtccctccgtgaca

SEQ ID NO: 48606 - DNA, 18 bp, Artificial sequence
  synthetic polynucleotide sequence
cggtagtcctccccgcca

SEQ ID NO: 48607 - DNA, 20 bp, Artificial sequence
  synthetic polynucleotide sequence
gtgtcctgtgacggacgcga

SEQ ID NO: 48608 - DNA, 21 bp, Artificial sequence
  synthetic polynucleotide sequence
tgtatcactgcagctcccaga

SEQ ID NO: 48609 - DNA, 21 bp, Artificial sequence
  synthetic polynucleotide sequence
agcagcagggcttcatccaca

SEQ ID NO: 48610 - DNA, 21 bp, Artificial sequence
  synthetic polynucleotide sequence
caaagatctggaggagggcga

SEQ ID NO: 48611 - DNA, 18 bp, Artificial sequence
  synthetic polynucleotide sequence
tgccggagggaaccccaa

SEQ ID NO: 48612 - DNA, 18 bp, Artificial sequence
  synthetic polynucleotide sequence
cggaagaggcacatggca

SEQ ID NO: 48613 - DNA, 20 bp, Artificial sequence
  synthetic polynucleotide sequence
cgaacgcagcatttcaggga

SEQ ID NO: 48614 - DNA, 18 bp, Artificial sequence
  synthetic polynucleotide sequence
gccatgcaccaaatccca

SEQ ID NO: 48615 - DNA, 19 bp, Artificial sequence
  synthetic polynucleotide sequence
ctggctggatcggccgtca

SEQ ID NO: 48616 - DNA, 18 bp, Artificial sequence
  synthetic polynucleotide sequence
atcagggccccggctcca

SEQ ID NO: 48617 - DNA, 21 bp, Artificial sequence
  synthetic polynucleotide sequence
ctacaatggaaccaaccctga

SEQ ID NO: 48618 - DNA, 20 bp, Artificial sequence
  synthetic polynucleotide sequence
ctagagcctcacacccctca

SEQ ID NO: 48619 - DNA, 22 bp, Artificial sequence
  synthetic polynucleotide sequence
acaagactcgggatgaactgga

SEQ ID NO: 48620 - DNA, 22 bp, Artificial sequence
  synthetic polynucleotide sequence
aagaagagtccaacacccccta

SEQ ID NO: 48621 - DNA, 18 bp, Artificial sequence
  synthetic polynucleotide sequence
accctgaccccacgagca

SEQ ID NO: 48622 - DNA, 18 bp, Artificial sequence
  synthetic polynucleotide sequence
cagccaggtggcaggaga

SEQ ID NO: 48623 - DNA, 21 bp, Artificial sequence
  synthetic polynucleotide sequence
acaaggctcgagggaaagtga

SEQ ID NO: 48624 - DNA, 21 bp, Artificial sequence
  synthetic polynucleotide sequence
cctgcataccttggccacaca

SEQ ID NO: 48625 - DNA, 18 bp, Artificial sequence
  synthetic polynucleotide sequence
gcacctgtacggcacgca

SEQ ID NO: 48626 - DNA, 22 bp, Artificial sequence
  synthetic polynucleotide sequence
agctctcactgaactccaagca

SEQ ID NO: 48627 - DNA, 20 bp, Artificial sequence
  synthetic polynucleotide sequence
ccaatgcaagtcgagagcga

SEQ ID NO: 48628 - DNA, 19 bp, Artificial sequence
  synthetic polynucleotide sequence
gcctggcatcatagccaca

SEQ ID NO: 48629 - DNA, 18 bp, Artificial sequence
  synthetic polynucleotide sequence
gggcaaggtgagcctgga

SEQ ID NO: 48630 - DNA, 18 bp, Artificial sequence
  synthetic polynucleotide sequence
ctacgatggcagcgacca

SEQ ID NO: 48631 - DNA, 21 bp, Artificial sequence
  synthetic polynucleotide sequence
tgaggacttacacggacgcta

SEQ ID NO: 48632 - DNA, 20 bp, Artificial sequence
  synthetic polynucleotide sequence
ctgcacaccacagcagctca

SEQ ID NO: 48633 - DNA, 21 bp, Artificial sequence
  synthetic polynucleotide sequence
gtggcgacaggtatcctagga

SEQ ID NO: 48634 - DNA, 20 bp, Artificial sequence
  synthetic polynucleotide sequence
atcagcagctccattgacca

SEQ ID NO: 48635 - DNA, 19 bp, Artificial sequence
  synthetic polynucleotide sequence
tgtggagaacgggctgcta

SEQ ID NO: 48636 - DNA, 22 bp, Artificial sequence
  synthetic polynucleotide sequence
tggatgtgctggaagagggtca

SEQ ID NO: 48637 - DNA, 21 bp, Artificial sequence
  synthetic polynucleotide sequence
accgggaaggcgacaaccaca

SEQ ID NO: 48638 - DNA, 20 bp, Artificial sequence
  synthetic polynucleotide sequence
tcccagtcgtaggcgccgga

SEQ ID NO: 48639 - DNA, 19 bp, Artificial sequence
  synthetic polynucleotide sequence
ggcacgctctactcagcca

SEQ ID NO: 48640 - DNA, 18 bp, Artificial sequence
  synthetic polynucleotide sequence
ccaccaaggcccagccca

SEQ ID NO: 48641 - DNA, 20 bp, Artificial sequence
  synthetic polynucleotide sequence
tcagctcaccatcagctgga

SEQ ID NO: 48642 - DNA, 19 bp, Artificial sequence
  synthetic polynucleotide sequence
gggcagcagtaacagggca

SEQ ID NO: 48643 - DNA, 18 bp, Artificial sequence
  synthetic polynucleotide sequence
ttggtggaagcagccgga

SEQ ID NO: 48644 - DNA, 18 bp, Artificial sequence
  synthetic polynucleotide sequence
ggccctcaattacgggga

SEQ ID NO: 48645 - DNA, 20 bp, Artificial sequence
  synthetic polynucleotide sequence
cctgggcccatgaccccaga

SEQ ID NO: 48646 - DNA, 21 bp, Artificial sequence
  synthetic polynucleotide sequence
cattaaccggctccagctcca

SEQ ID NO: 48647 - DNA, 20 bp, Artificial sequence
  synthetic polynucleotide sequence
aggtaagatcctccggccga

SEQ ID NO: 48648 - DNA, 21 bp, Artificial sequence
  synthetic polynucleotide sequence
ctctacggactccttcacgca

SEQ ID NO: 48649 - DNA, 18 bp, Artificial sequence
  synthetic polynucleotide sequence
cctgcaggcactggagga

SEQ ID NO: 48650 - DNA, 18 bp, Artificial sequence
  synthetic polynucleotide sequence
tgcgcttgagacgcagga

SEQ ID NO: 48651 - DNA, 21 bp, Artificial sequence
  synthetic polynucleotide sequence
acccccaggctcatatccaca

SEQ ID NO: 48652 - DNA, 19 bp, Artificial sequence
  synthetic polynucleotide sequence
tgtaggggattgggccaca

SEQ ID NO: 48653 - DNA, 22 bp, Artificial sequence
  synthetic polynucleotide sequence
agctggagaacatgaacgccca

SEQ ID NO: 48654 - DNA, 21 bp, Artificial sequence
  synthetic polynucleotide sequence
agaaaggatgctagctgggga

SEQ ID NO: 48655 - DNA, 20 bp, Artificial sequence
  synthetic polynucleotide sequence
caccctaggacaggctgcaa

SEQ ID NO: 48656 - DNA, 20 bp, Artificial sequence
  synthetic polynucleotide sequence
gacaccacttggccgaagga

SEQ ID NO: 48657 - DNA, 19 bp, Artificial sequence
  synthetic polynucleotide sequence
tccggacatctccatggga

SEQ ID NO: 48658 - DNA, 19 bp, Artificial sequence
  synthetic polynucleotide sequence
tgcctgaagcactcgacca

SEQ ID NO: 48659 - DNA, 18 bp, Artificial sequence
  synthetic polynucleotide sequence
ggggggtgcagtggagga

SEQ ID NO: 48660 - DNA, 19 bp, Artificial sequence
  synthetic polynucleotide sequence
gccccatcacccctctgga

SEQ ID NO: 48661 - DNA, 20 bp, Artificial sequence
  synthetic polynucleotide sequence
gacagacagctggtggcgca

SEQ ID NO: 48662 - DNA, 20 bp, Artificial sequence
  synthetic polynucleotide sequence
gcggccaccaggtagggcaa

SEQ ID NO: 48663 - DNA, 21 bp, Artificial sequence
  synthetic polynucleotide sequence
cggccacttggtagacgacga

SEQ ID NO: 48664 - DNA, 21 bp, Artificial sequence
  synthetic polynucleotide sequence
cctcccgtcatagctcaggga

SEQ ID NO: 48665 - DNA, 20 bp, Artificial sequence
  synthetic polynucleotide sequence
ccccgaacctggctctgaca

SEQ ID NO: 48666 - DNA, 21 bp, Artificial sequence
  synthetic polynucleotide sequence
ggatctccgactgcctggaca

SEQ ID NO: 48667 - DNA, 20 bp, Artificial sequence
  synthetic polynucleotide sequence
gagcttggcgtccagggcga

SEQ ID NO: 48668 - DNA, 20 bp, Artificial sequence
  synthetic polynucleotide sequence
cagtacttgacggcggagga

SEQ ID NO: 48669 - DNA, 19 bp, Artificial sequence
  synthetic polynucleotide sequence
cagcctatgctgcccccga

SEQ ID NO: 48670 - DNA, 21 bp, Artificial sequence
  synthetic polynucleotide sequence
ctcttgagcaggtcctggcaa

SEQ ID NO: 48671 - DNA, 22 bp, Artificial sequence
  synthetic polynucleotide sequence
cataccatctcccaggagtgca

SEQ ID NO: 48672 - DNA, 20 bp, Artificial sequence
  synthetic polynucleotide sequence
ctcaggctggaacttgagca

SEQ ID NO: 48673 - DNA, 21 bp, Artificial sequence
  synthetic polynucleotide sequence
agcaccacctactgcggctca

SEQ ID NO: 48674 - DNA, 18 bp, Artificial sequence
  synthetic polynucleotide sequence
caggccggcgatgtccga

SEQ ID NO: 48675 - DNA, 18 bp, Artificial sequence
  synthetic polynucleotide sequence
aagggcggttcctgggca

SEQ ID NO: 48676 - DNA, 18 bp, Artificial sequence
  synthetic polynucleotide sequence
ttgccgcagaggtaggca

SEQ ID NO: 48677 - DNA, 18 bp, Artificial sequence
  synthetic polynucleotide sequence
catcaaggaggcagccga

SEQ ID NO: 48678 - DNA, 20 bp, Artificial sequence
  synthetic polynucleotide sequence
cttgaagggtgtgaaccgga

SEQ ID NO: 48679 - DNA, 20 bp, Artificial sequence
  synthetic polynucleotide sequence
atggagccagctgccttcca

SEQ ID NO: 48680 - DNA, 20 bp, Artificial sequence
  synthetic polynucleotide sequence
cagcgtagttgcgagcccca

SEQ ID NO: 48681 - DNA, 22 bp, Artificial sequence
  synthetic polynucleotide sequence
taaagaggaatgcgagtgcaca

SEQ ID NO: 48682 - DNA, 22 bp, Artificial sequence
  synthetic polynucleotide sequence
cataagcactggcccatcctca

SEQ ID NO: 48683 - DNA, 25 bp, Artificial sequence
  synthetic polynucleotide sequence
aacagaatgtaacacccctccccaa

SEQ ID NO: 48684 - DNA, 20 bp, Artificial sequence
  synthetic polynucleotide sequence
ggacaggtgcaggatgggca

SEQ ID NO: 48685 - DNA, 18 bp, Artificial sequence
  synthetic polynucleotide sequence
ccaccaccaggaaagcca

SEQ ID NO: 48686 - DNA, 18 bp, Artificial sequence
  synthetic polynucleotide sequence
aatttgggccaggcggga

SEQ ID NO: 48687 - DNA, 21 bp, Artificial sequence
  synthetic polynucleotide sequence
caggagcggacaaggttgaga

SEQ ID NO: 48688 - DNA, 19 bp, Artificial sequence
  synthetic polynucleotide sequence
tttggaagcaggatgggca

SEQ ID NO: 48689 - DNA, 21 bp, Artificial sequence
  synthetic polynucleotide sequence
agcccactacccgaagacaca

SEQ ID NO: 48690 - DNA, 22 bp, Artificial sequence
  synthetic polynucleotide sequence
tccacagcccaaacctcagaga

SEQ ID NO: 48691 - DNA, 18 bp, Artificial sequence
  synthetic polynucleotide sequence
cagggttgcaaccccaca

SEQ ID NO: 48692 - DNA, 18 bp, Artificial sequence
  synthetic polynucleotide sequence
tgacctccaatgcggcca

SEQ ID NO: 48693 - DNA, 23 bp, Artificial sequence
  synthetic polynucleotide sequence
taaaacccaagcaggtagtagca

SEQ ID NO: 48694 - DNA, 21 bp, Artificial sequence
  synthetic polynucleotide sequence
cctcacagaacctggttccca

SEQ ID NO: 48695 - DNA, 20 bp, Artificial sequence
  synthetic polynucleotide sequence
caagaccacccggagcccaa

SEQ ID NO: 48696 - DNA, 21 bp, Artificial sequence
  synthetic polynucleotide sequence
tcttggtggaacttcggagca

SEQ ID NO: 48697 - DNA, 19 bp, Artificial sequence
  synthetic polynucleotide sequence
ccgtcacaggcacaaagga

SEQ ID NO: 48698 - DNA, 21 bp, Artificial sequence
  synthetic polynucleotide sequence
gtgcatccagggtagtagcca

SEQ ID NO: 48699 - DNA, 21 bp, Artificial sequence
  synthetic polynucleotide sequence
ttcagactccagccagaccca

SEQ ID NO: 48700 - DNA, 21 bp, Artificial sequence
  synthetic polynucleotide sequence
ttctccaggtcctcagcctca

SEQ ID NO: 48701 - DNA, 22 bp, Artificial sequence
  synthetic polynucleotide sequence
gaaagatcgtgactggggccaa

SEQ ID NO: 48702 - DNA, 22 bp, Artificial sequence
  synthetic polynucleotide sequence
gaattacccaggtctccatcca

SEQ ID NO: 48703 - DNA, 20 bp, Artificial sequence
  synthetic polynucleotide sequence
agactgcttcggcaaggcca

SEQ ID NO: 48704 - DNA, 22 bp, Artificial sequence
  synthetic polynucleotide sequence
atgttgcaggttccaatggcca

SEQ ID NO: 48705 - DNA, 20 bp, Artificial sequence
  synthetic polynucleotide sequence
tggggcccgcaagaaactga

SEQ ID NO: 48706 - DNA, 19 bp, Artificial sequence
  synthetic polynucleotide sequence
caaccttgggggccgtgga

SEQ ID NO: 48707 - DNA, 21 bp, Artificial sequence
  synthetic polynucleotide sequence
tgtacgaggaagctgctcaga

SEQ ID NO: 48708 - DNA, 19 bp, Artificial sequence
  synthetic polynucleotide sequence
ttggccagtaacgcactca

SEQ ID NO: 48709 - DNA, 21 bp, Artificial sequence
  synthetic polynucleotide sequence
ttgccccacgtttaccaagca

SEQ ID NO: 48710 - DNA, 20 bp, Artificial sequence
  synthetic polynucleotide sequence
tgggagggcctggacctaca

SEQ ID NO: 48711 - DNA, 22 bp, Artificial sequence
  synthetic polynucleotide sequence
agcagtgggaccatagtgagga

SEQ ID NO: 48712 - DNA, 20 bp, Artificial sequence
  synthetic polynucleotide sequence
ctcctgacaggcccttggca

SEQ ID NO: 48713 - DNA, 21 bp, Artificial sequence
  synthetic polynucleotide sequence
atgcccaagccaaagctgcaa

SEQ ID NO: 48714 - DNA, 22 bp, Artificial sequence
  synthetic polynucleotide sequence
tagcaccgagctaaccagctga

SEQ ID NO: 48715 - DNA, 21 bp, Artificial sequence
  synthetic polynucleotide sequence
ccagcacccactcctcaggaa

SEQ ID NO: 48716 - DNA, 19 bp, Artificial sequence
  synthetic polynucleotide sequence
tcagcacacagatccggca

SEQ ID NO: 48717 - DNA, 21 bp, Artificial sequence
  synthetic polynucleotide sequence
catccagaatgggcagcgcaa

SEQ ID NO: 48718 - DNA, 20 bp, Artificial sequence
  synthetic polynucleotide sequence
ggagggcaggattgggcaga

SEQ ID NO: 48719 - DNA, 21 bp, Artificial sequence
  synthetic polynucleotide sequence
tcctgcagagccaaggagaga

SEQ ID NO: 48720 - DNA, 22 bp, Artificial sequence
  synthetic polynucleotide sequence
tcatccatcagaggcatgctca

SEQ ID NO: 48721 - DNA, 21 bp, Artificial sequence
  synthetic polynucleotide sequence
ccactcagctgacagggccaa

SEQ ID NO: 48722 - DNA, 21 bp, Artificial sequence
  synthetic polynucleotide sequence
ggagactggcttgaacgcgca

SEQ ID NO: 48723 - DNA, 20 bp, Artificial sequence
  synthetic polynucleotide sequence
tggcctattacagcagccga

SEQ ID NO: 48724 - DNA, 21 bp, Artificial sequence
  synthetic polynucleotide sequence
catcaaagccctcggtggtca

SEQ ID NO: 48725 - DNA, 21 bp, Artificial sequence
  synthetic polynucleotide sequence
tgggcatgaccactgagggca

SEQ ID NO: 48726 - DNA, 20 bp, Artificial sequence
  synthetic polynucleotide sequence
gtgtagggtcacagggtcca

SEQ ID NO: 48727 - DNA, 19 bp, Artificial sequence
  synthetic polynucleotide sequence
ccctccagccacttcccca

SEQ ID NO: 48728 - DNA, 20 bp, Artificial sequence
  synthetic polynucleotide sequence
ggtcctggggcttgagagga

SEQ ID NO: 48729 - DNA, 22 bp, Artificial sequence
  synthetic polynucleotide sequence
tcaacaatggagagtacgcgga

SEQ ID NO: 48730 - DNA, 22 bp, Artificial sequence
  synthetic polynucleotide sequence
tagccaaatcctcagggctgca

SEQ ID NO: 48731 - DNA, 22 bp, Artificial sequence
  synthetic polynucleotide sequence
aggagcagcagaaggtagcaca

SEQ ID NO: 48732 - DNA, 21 bp, Artificial sequence
  synthetic polynucleotide sequence
gtctctatggccccagaagca

SEQ ID NO: 48733 - DNA, 18 bp, Artificial sequence
  synthetic polynucleotide sequence
gggcccccactgcacgca

SEQ ID NO: 48734 - DNA, 20 bp, Artificial sequence
  synthetic polynucleotide sequence
gtggtcggggtccaccagga

SEQ ID NO: 48735 - DNA, 20 bp, Artificial sequence
  synthetic polynucleotide sequence
gggacttcgagagggcggca

SEQ ID NO: 48736 - DNA, 20 bp, Artificial sequence
  synthetic polynucleotide sequence
ctgccccatcatgtcggcca

SEQ ID NO: 48737 - DNA, 18 bp, Artificial sequence
  synthetic polynucleotide sequence
atgcactccaaggccgca

SEQ ID NO: 48738 - DNA, 20 bp, Artificial sequence
  synthetic polynucleotide sequence
ctgtgcaacaactcgagaca

SEQ ID NO: 48739 - DNA, 18 bp, Artificial sequence
  synthetic polynucleotide sequence
cgcctgcagatggaagga

SEQ ID NO: 48740 - DNA, 18 bp, Artificial sequence
  synthetic polynucleotide sequence
ccagggatgccatcagga

SEQ ID NO: 48741 - DNA, 18 bp, Artificial sequence
  synthetic polynucleotide sequence
ccagcagcactggaagca

SEQ ID NO: 48742 - DNA, 18 bp, Artificial sequence
  synthetic polynucleotide sequence
agcttcaggcctggcaca

SEQ ID NO: 48743 - DNA, 20 bp, Artificial sequence
  synthetic polynucleotide sequence
aggtgcttcaggaaggagca

SEQ ID NO: 48744 - DNA, 18 bp, Artificial sequence
  synthetic polynucleotide sequence
ggaggaagggtgccagga

SEQ ID NO: 48745 - DNA, 22 bp, Artificial sequence
  synthetic polynucleotide sequence
caacctgcagaggatgagtcaa

SEQ ID NO: 48746 - DNA, 21 bp, Artificial sequence
  synthetic polynucleotide sequence
cgctggaagtactgaacagca

SEQ ID NO: 48747 - DNA, 21 bp, Artificial sequence
  synthetic polynucleotide sequence
cccagagtatgcccagtcgga

SEQ ID NO: 48748 - DNA, 20 bp, Artificial sequence
  synthetic polynucleotide sequence
ctcttggcaggcacccggta

SEQ ID NO: 48749 - DNA, 20 bp, Artificial sequence
  synthetic polynucleotide sequence
tgaccctggagctcaagcca

SEQ ID NO: 48750 - DNA, 21 bp, Artificial sequence
  synthetic polynucleotide sequence
gtctccaatgagcactcccca

SEQ ID NO: 48751 - DNA, 22 bp, Artificial sequence
  synthetic polynucleotide sequence
atccccacgtccatcgaagaga

SEQ ID NO: 48752 - DNA, 20 bp, Artificial sequence
  synthetic polynucleotide sequence
ctggccaaggacgctccgta

SEQ ID NO: 48753 - DNA, 20 bp, Artificial sequence
  synthetic polynucleotide sequence
ccccatgcagctgtggacca

SEQ ID NO: 48754 - DNA, 22 bp, Artificial sequence
  synthetic polynucleotide sequence
agtactgagtgagaagtgggga

SEQ ID NO: 48755 - DNA, 20 bp, Artificial sequence
  synthetic polynucleotide sequence
ctccggggaagcatggacga

SEQ ID NO: 48756 - DNA, 20 bp, Artificial sequence
  synthetic polynucleotide sequence
cgccagactgtagcggccta

SEQ ID NO: 48757 - DNA, 21 bp, Artificial sequence
  synthetic polynucleotide sequence
atgtggaagccatcgcatgca

SEQ ID NO: 48758 - DNA, 21 bp, Artificial sequence
  synthetic polynucleotide sequence
ttcccacagctacatgtccca

SEQ ID NO: 48759 - DNA, 23 bp, Artificial sequence
  synthetic polynucleotide sequence
cctcatccctccccaaaacaaga

SEQ ID NO: 48760 - DNA, 20 bp, Artificial sequence
  synthetic polynucleotide sequence
cccccaaagagtccatcgca

SEQ ID NO: 48761 - DNA, 21 bp, Artificial sequence
  synthetic polynucleotide sequence
ccgggaacccacagacaccaa

SEQ ID NO: 48762 - DNA, 20 bp, Artificial sequence
  synthetic polynucleotide sequence
catcccgagtctgggaccca

SEQ ID NO: 48763 - DNA, 21 bp, Artificial sequence
  synthetic polynucleotide sequence
ccgggaagggaagtaccgaga

SEQ ID NO: 48764 - DNA, 21 bp, Artificial sequence
  synthetic polynucleotide sequence
tcacgggctccatctgaagga

SEQ ID NO: 48765 - DNA, 22 bp, Artificial sequence
  synthetic polynucleotide sequence
caaaggcaggtatagcgaagga

SEQ ID NO: 48766 - DNA, 22 bp, Artificial sequence
  synthetic polynucleotide sequence
atctgtgagaacttgagggcca

SEQ ID NO: 48767 - DNA, 20 bp, Artificial sequence
  synthetic polynucleotide sequence
agacactcggaggcagcaga

SEQ ID NO: 48768 - DNA, 21 bp, Artificial sequence
  synthetic polynucleotide sequence
ttccattggatccagggccga

SEQ ID NO: 48769 - DNA, 19 bp, Artificial sequence
  synthetic polynucleotide sequence
ctagtcacccaggccccca

SEQ ID NO: 48770 - DNA, 21 bp, Artificial sequence
  synthetic polynucleotide sequence
tggaggaagacgctcctggca

SEQ ID NO: 48771 - DNA, 22 bp, Artificial sequence
  synthetic polynucleotide sequence
aaaccctgcactggaaaggaga

SEQ ID NO: 48772 - DNA, 22 bp, Artificial sequence
  synthetic polynucleotide sequence
aggatccccaacctgttcacga

SEQ ID NO: 48773 - DNA, 22 bp, Artificial sequence
  synthetic polynucleotide sequence
caccaagcagcaataccttgga

SEQ ID NO: 48774 - DNA, 21 bp, Artificial sequence
  synthetic polynucleotide sequence
tggaaacaggcaggttggcca

SEQ ID NO: 48775 - DNA, 19 bp, Artificial sequence
  synthetic polynucleotide sequence
tcatagacaaccagggcca

SEQ ID NO: 48776 - DNA, 20 bp, Artificial sequence
  synthetic polynucleotide sequence
tgatgatccaccaagaccca

SEQ ID NO: 48777 - DNA, 22 bp, Artificial sequence
  synthetic polynucleotide sequence
tccagcactgccaatgaccgaa

SEQ ID NO: 48778 - DNA, 18 bp, Artificial sequence
  synthetic polynucleotide sequence
cccgtcaccctgggccaa

SEQ ID NO: 48779 - DNA, 22 bp, Artificial sequence
  synthetic polynucleotide sequence
gatatggatctgcaagcccaca

SEQ ID NO: 48780 - DNA, 21 bp, Artificial sequence
  synthetic polynucleotide sequence
atgtagggtgtggtgcaggca

SEQ ID NO: 48781 - DNA, 20 bp, Artificial sequence
  synthetic polynucleotide sequence
aactccatgaccctggacca

SEQ ID NO: 48782 - DNA, 19 bp, Artificial sequence
  synthetic polynucleotide sequence
gggacaggtggtactcgca

SEQ ID NO: 48783 - DNA, 21 bp, Artificial sequence
  synthetic polynucleotide sequence
catccccgagtttgagaagca

SEQ ID NO: 48784 - DNA, 21 bp, Artificial sequence
  synthetic polynucleotide sequence
ttcagcatgaggtcgacggca

SEQ ID NO: 48785 - DNA, 21 bp, Artificial sequence
  synthetic polynucleotide sequence
gcccaagttacggagcaggca

SEQ ID NO: 48786 - DNA, 20 bp, Artificial sequence
  synthetic polynucleotide sequence
tgccacggtctgacaggaca

SEQ ID NO: 48787 - DNA, 21 bp, Artificial sequence
  synthetic polynucleotide sequence
accacttccccagcctccaca

SEQ ID NO: 48788 - DNA, 21 bp, Artificial sequence
  synthetic polynucleotide sequence
tcgacagggccttagtgccca

SEQ ID NO: 48789 - DNA, 20 bp, Artificial sequence
  synthetic polynucleotide sequence
tagcgacgccatctgggaga

SEQ ID NO: 48790 - DNA, 20 bp, Artificial sequence
  synthetic polynucleotide sequence
ctggagtggaggcttgggga

SEQ ID NO: 48791 - DNA, 22 bp, Artificial sequence
  synthetic polynucleotide sequence
cgaacaagtgctcagaagggca

SEQ ID NO: 48792 - DNA, 21 bp, Artificial sequence
  synthetic polynucleotide sequence
ctgtagagctggtgatgggca

SEQ ID NO: 48793 - DNA, 19 bp, Artificial sequence
  synthetic polynucleotide sequence
gctctggcgagaagaggca

SEQ ID NO: 48794 - DNA, 19 bp, Artificial sequence
  synthetic polynucleotide sequence
gctggagtggcaatcacca

SEQ ID NO: 48795 - DNA, 21 bp, Artificial sequence
  synthetic polynucleotide sequence
gtgtcacggccaacttctgca

SEQ ID NO: 48796 - DNA, 19 bp, Artificial sequence
  synthetic polynucleotide sequence
tgccgcaaagactcactca

SEQ ID NO: 48797 - DNA, 21 bp, Artificial sequence
  synthetic polynucleotide sequence
caggagtacaggttgcagcca

SEQ ID NO: 48798 - DNA, 23 bp, Artificial sequence
  synthetic polynucleotide sequence
cacagcaaagacaagatggtgga

SEQ ID NO: 48799 - DNA, 20 bp, Artificial sequence
  synthetic polynucleotide sequence
tggaggtcaatgcgtcccca

SEQ ID NO: 48800 - DNA, 22 bp, Artificial sequence
  synthetic polynucleotide sequence
ctaacagggccatcattccaca

SEQ ID NO: 48801 - DNA, 21 bp, Artificial sequence
  synthetic polynucleotide sequence
atccggaagaccacagcccaa

SEQ ID NO: 48802 - DNA, 22 bp, Artificial sequence
  synthetic polynucleotide sequence
ttcacaggtatagactgccgca

SEQ ID NO: 48803 - DNA, 20 bp, Artificial sequence
  synthetic polynucleotide sequence
ctcaacgcgctaccggacca

SEQ ID NO: 48804 - DNA, 20 bp, Artificial sequence
  synthetic polynucleotide sequence
taaccgccaggccaggtcca

SEQ ID NO: 48805 - DNA, 20 bp, Artificial sequence
  synthetic polynucleotide sequence
gattacgaccgggccctgca

SEQ ID NO: 48806 - DNA, 19 bp, Artificial sequence
  synthetic polynucleotide sequence
ctggggtcagtgtggggca

SEQ ID NO: 48807 - DNA, 18 bp, Artificial sequence
  synthetic polynucleotide sequence
aggctggccctacgggca

SEQ ID NO: 48808 - DNA, 18 bp, Artificial sequence
  synthetic polynucleotide sequence
acggccacattgatggca

SEQ ID NO: 48809 - DNA, 21 bp, Artificial sequence
  synthetic polynucleotide sequence
tctggccaacatccactccca

SEQ ID NO: 48810 - DNA, 18 bp, Artificial sequence
  synthetic polynucleotide sequence
cttcgcacaggccccgca

SEQ ID NO: 48811 - DNA, 18 bp, Artificial sequence
  synthetic polynucleotide sequence
cggctcacagtcccccga

SEQ ID NO: 48812 - DNA, 19 bp, Artificial sequence
  synthetic polynucleotide sequence
cggagacaggggcgttgga

SEQ ID NO: 48813 - DNA, 19 bp, Artificial sequence
  synthetic polynucleotide sequence
cccgcacacctggcagcaa

SEQ ID NO: 48814 - DNA, 20 bp, Artificial sequence
  synthetic polynucleotide sequence
acagctgtacaggctgggca

SEQ ID NO: 48815 - DNA, 19 bp, Artificial sequence
  synthetic polynucleotide sequence
ctatccgcccccgcaacga

SEQ ID NO: 48816 - DNA, 18 bp, Artificial sequence
  synthetic polynucleotide sequence
gcctgtgtgacgcgccca

SEQ ID NO: 48817 - DNA, 20 bp, Artificial sequence
  synthetic polynucleotide sequence
gagaaggcctaccacgagca

SEQ ID NO: 48818 - DNA, 21 bp, Artificial sequence
  synthetic polynucleotide sequence
ggcgagggtcacacttgacca

SEQ ID NO: 48819 - DNA, 20 bp, Artificial sequence
  synthetic polynucleotide sequence
ctggtacgtgggcgaaggca

SEQ ID NO: 48820 - DNA, 21 bp, Artificial sequence
  synthetic polynucleotide sequence
ttcagcctcagcttccacgga

SEQ ID NO: 48821 - DNA, 22 bp, Artificial sequence
  synthetic polynucleotide sequence
acctggcagctctagagaagga

SEQ ID NO: 48822 - DNA, 20 bp, Artificial sequence
  synthetic polynucleotide sequence
gggtggcaggggagaaccca

SEQ ID NO: 48823 - DNA, 18 bp, Artificial sequence
  synthetic polynucleotide sequence
acgctgccattgccgcca

SEQ ID NO: 48824 - DNA, 18 bp, Artificial sequence
  synthetic polynucleotide sequence
ttggccaggtcaccccca

SEQ ID NO: 48825 - DNA, 18 bp, Artificial sequence
  synthetic polynucleotide sequence
cgacgtggtgcccaagga

SEQ ID NO: 48826 - DNA, 19 bp, Artificial sequence
  synthetic polynucleotide sequence
tgaagcctgtgggacacca

SEQ ID NO: 48827 - DNA, 19 bp, Artificial sequence
  synthetic polynucleotide sequence
cccactccaccacagagca

SEQ ID NO: 48828 - DNA, 19 bp, Artificial sequence
  synthetic polynucleotide sequence
ggagggaggcagtgatgga

SEQ ID NO: 48829 - DNA, 20 bp, Artificial sequence
  synthetic polynucleotide sequence
ctctccgtgcagaccaggaa

SEQ ID NO: 48830 - DNA, 18 bp, Artificial sequence
  synthetic polynucleotide sequence
caatgaaggtggcggcca

SEQ ID NO: 48831 - DNA, 19 bp, Artificial sequence
  synthetic polynucleotide sequence
cctacggggacctcaacca

SEQ ID NO: 48832 - DNA, 18 bp, Artificial sequence
  synthetic polynucleotide sequence
agaagtgcaggcgaggga

SEQ ID NO: 48833 - DNA, 20 bp, Artificial sequence
  synthetic polynucleotide sequence
tgaggagtatcccgaccgca

SEQ ID NO: 48834 - DNA, 20 bp, Artificial sequence
  synthetic polynucleotide sequence
caccagctggtggatggaca

SEQ ID NO: 48835 - DNA, 20 bp, Artificial sequence
  synthetic polynucleotide sequence
cagatcttccggccggacaa

SEQ ID NO: 48836 - DNA, 21 bp, Artificial sequence
  synthetic polynucleotide sequence
tctcacaacatccagcaccga

SEQ ID NO: 48837 - DNA, 19 bp, Artificial sequence
  synthetic polynucleotide sequence
ccggaggctacgtgggaga

SEQ ID NO: 48838 - DNA, 22 bp, Artificial sequence
  synthetic polynucleotide sequence
aagatgaagttgtcaggccgga

SEQ ID NO: 48839 - DNA, 20 bp, Artificial sequence
  synthetic polynucleotide sequence
aaggggggaagcagtgtgga

SEQ ID NO: 48840 - DNA, 23 bp, Artificial sequence
  synthetic polynucleotide sequence
gcagcaggagatgtgaagacaca

SEQ ID NO: 48841 - DNA, 18 bp, Artificial sequence
  synthetic polynucleotide sequence
tcgcacatcagctgggaa

SEQ ID NO: 48842 - DNA, 18 bp, Artificial sequence
  synthetic polynucleotide sequence
cttgaggaggccagccca

SEQ ID NO: 48843 - DNA, 21 bp, Artificial sequence
  synthetic polynucleotide sequence
gccgcggtcaaccagaaagga

SEQ ID NO: 48844 - DNA, 21 bp, Artificial sequence
  synthetic polynucleotide sequence
aactttgtgacccacggccca

SEQ ID NO: 48845 - DNA, 18 bp, Artificial sequence
  synthetic polynucleotide sequence
cgggctcatgatggccaa

SEQ ID NO: 48846 - DNA, 18 bp, Artificial sequence
  synthetic polynucleotide sequence
aggcctcccgcttacgca

SEQ ID NO: 48847 - DNA, 20 bp, Artificial sequence
  synthetic polynucleotide sequence
cgagaccgccagaccaacca

SEQ ID NO: 48848 - DNA, 21 bp, Artificial sequence
  synthetic polynucleotide sequence
cccacgggatgaagttggcca

SEQ ID NO: 48849 - DNA, 20 bp, Artificial sequence
  synthetic polynucleotide sequence
gacctggcacatcctggaga

SEQ ID NO: 48850 - DNA, 18 bp, Artificial sequence
  synthetic polynucleotide sequence
tcaggcaggtgtccagga

SEQ ID NO: 48851 - DNA, 20 bp, Artificial sequence
  synthetic polynucleotide sequence
gacgaccagctctgacgaga

SEQ ID NO: 48852 - DNA, 19 bp, Artificial sequence
  synthetic polynucleotide sequence
gccccctggtacccagaga

SEQ ID NO: 48853 - DNA, 20 bp, Artificial sequence
  synthetic polynucleotide sequence
ctggcaccatctctgaagca

SEQ ID NO: 48854 - DNA, 20 bp, Artificial sequence
  synthetic polynucleotide sequence
ctcagccacagtgctgcgaa

SEQ ID NO: 48855 - DNA, 18 bp, Artificial sequence
  synthetic polynucleotide sequence
ccagcaggcagcacacca

SEQ ID NO: 48856 - DNA, 18 bp, Artificial sequence
  synthetic polynucleotide sequence
gcatcgacttgccagcca

SEQ ID NO: 48857 - DNA, 19 bp, Artificial sequence
  synthetic polynucleotide sequence
ggaggcgcactatgaggca

SEQ ID NO: 48858 - DNA, 18 bp, Artificial sequence
  synthetic polynucleotide sequence
agggccttgctcagcaca

SEQ ID NO: 48859 - DNA, 21 bp, Artificial sequence
  synthetic polynucleotide sequence
caggtacactagagcgtggca

SEQ ID NO: 48860 - DNA, 20 bp, Artificial sequence
  synthetic polynucleotide sequence
ccgcttcaagcctcggacca

SEQ ID NO: 48861 - DNA, 20 bp, Artificial sequence
  synthetic polynucleotide sequence
atcgcctatctggaggcaga

SEQ ID NO: 48862 - DNA, 18 bp, Artificial sequence
  synthetic polynucleotide sequence
ccactcggatgacaggca

SEQ ID NO: 48863 - DNA, 20 bp, Artificial sequence
  synthetic polynucleotide sequence
ttccaaggccgggtcaccca

SEQ ID NO: 48864 - DNA, 20 bp, Artificial sequence
  synthetic polynucleotide sequence
ggtgaaggcgtcctccgcca

SEQ ID NO: 48865 - DNA, 19 bp, Artificial sequence
  synthetic polynucleotide sequence
ccgtcgtgggacaaggaga

SEQ ID NO: 48866 - DNA, 18 bp, Artificial sequence
  synthetic polynucleotide sequence
ctcggccgaactggagca

SEQ ID NO: 48867 - DNA, 19 bp, Artificial sequence
  synthetic polynucleotide sequence
ttgctctcaaggtggcaga

SEQ ID NO: 48868 - DNA, 21 bp, Artificial sequence
  synthetic polynucleotide sequence
acgtcatctgccacacgtcca

SEQ ID NO: 48869 - DNA, 21 bp, Artificial sequence
  synthetic polynucleotide sequence
catgaagcgcacagaggacga

SEQ ID NO: 48870 - DNA, 21 bp, Artificial sequence
  synthetic polynucleotide sequence
tgatgacgaactctggccgca

SEQ ID NO: 48871 - DNA, 20 bp, Artificial sequence
  synthetic polynucleotide sequence
gccaacaacgaagggacgga

SEQ ID NO: 48872 - DNA, 25 bp, Artificial sequence
  synthetic polynucleotide sequence
caacaggttcgcacaacatccagaa

SEQ ID NO: 48873 - DNA, 21 bp, Artificial sequence
  synthetic polynucleotide sequence
ggatggggatctggctcacga

SEQ ID NO: 48874 - DNA, 19 bp, Artificial sequence
  synthetic polynucleotide sequence
cacgtggatgcgggggtga

SEQ ID NO: 48875 - DNA, 21 bp, Artificial sequence
  synthetic polynucleotide sequence
ataacaagactggttgggcca

SEQ ID NO: 48876 - DNA, 21 bp, Artificial sequence
  synthetic polynucleotide sequence
atccccatggtgatagcggca

SEQ ID NO: 48877 - DNA, 20 bp, Artificial sequence
  synthetic polynucleotide sequence
agcagaacagccagggccta

SEQ ID NO: 48878 - DNA, 20 bp, Artificial sequence
  synthetic polynucleotide sequence
ggcataggaggtggtggcga

SEQ ID NO: 48879 - DNA, 19 bp, Artificial sequence
  synthetic polynucleotide sequence
ggggacggtggggaagaca

SEQ ID NO: 48880 - DNA, 20 bp, Artificial sequence
  synthetic polynucleotide sequence
ctttccagtggtcaggggca

SEQ ID NO: 48881 - DNA, 22 bp, Artificial sequence
  synthetic polynucleotide sequence
aagatgggaggcaacagtgaca

SEQ ID NO: 48882 - DNA, 20 bp, Artificial sequence
  synthetic polynucleotide sequence
gtgaatctccagcccctcga

SEQ ID NO: 48883 - DNA, 20 bp, Artificial sequence
  synthetic polynucleotide sequence
ccgggccatccctcgaggaa

SEQ ID NO: 48884 - DNA, 20 bp, Artificial sequence
  synthetic polynucleotide sequence
gagccgcacgaagaggtgga

SEQ ID NO: 48885 - DNA, 21 bp, Artificial sequence
  synthetic polynucleotide sequence
gattctcagaatgcccaggga

SEQ ID NO: 48886 - DNA, 20 bp, Artificial sequence
  synthetic polynucleotide sequence
cagctgcagtcagtggggca

SEQ ID NO: 48887 - DNA, 20 bp, Artificial sequence
  synthetic polynucleotide sequence
gtgcacacagagcccacgga

SEQ ID NO: 48888 - DNA, 21 bp, Artificial sequence
  synthetic polynucleotide sequence
tgctgcacttgtaccccggca

SEQ ID NO: 48889 - DNA, 18 bp, Artificial sequence
  synthetic polynucleotide sequence
ggtcctccagagcgacga

SEQ ID NO: 48890 - DNA, 20 bp, Artificial sequence
  synthetic polynucleotide sequence
gaccgagaaggcgtagctga

SEQ ID NO: 48891 - DNA, 21 bp, Artificial sequence
  synthetic polynucleotide sequence
acaagctgagcaagatccaga

SEQ ID NO: 48892 - DNA, 18 bp, Artificial sequence
  synthetic polynucleotide sequence
ccatgcgccacacggaga

SEQ ID NO: 48893 - DNA, 21 bp, Artificial sequence
  synthetic polynucleotide sequence
cgccccgctaccttaacagga

SEQ ID NO: 48894 - DNA, 23 bp, Artificial sequence
  synthetic polynucleotide sequence
aaatatctccaagctctcccaca

SEQ ID NO: 48895 - DNA, 19 bp, Artificial sequence
  synthetic polynucleotide sequence
gcgaccaggagaccagcaa

SEQ ID NO: 48896 - DNA, 18 bp, Artificial sequence
  synthetic polynucleotide sequence
acttgtgccaggcaggca

SEQ ID NO: 48897 - DNA, 19 bp, Artificial sequence
  synthetic polynucleotide sequence
gaggagctgcatgaaccga

SEQ ID NO: 48898 - DNA, 20 bp, Artificial sequence
  synthetic polynucleotide sequence
cactggaataaggcgcgtga

SEQ ID NO: 48899 - DNA, 21 bp, Artificial sequence
  synthetic polynucleotide sequence
ctatatcgccctcacctggca

SEQ ID NO: 48900 - DNA, 21 bp, Artificial sequence
  synthetic polynucleotide sequence
caatctctgtgacagcccgca

SEQ ID NO: 48901 - DNA, 22 bp, Artificial sequence
  synthetic polynucleotide sequence
tgatgaagcagcaagagaccca

SEQ ID NO: 48902 - DNA, 20 bp, Artificial sequence
  synthetic polynucleotide sequence
ctcctcagccatctcaagca

SEQ ID NO: 48903 - DNA, 22 bp, Artificial sequence
  synthetic polynucleotide sequence
gaaacccaacccgaaataggca

SEQ ID NO: 48904 - DNA, 20 bp, Artificial sequence
  synthetic polynucleotide sequence
agcctgtgctccaacaggga

SEQ ID NO: 48905 - DNA, 21 bp, Artificial sequence
  synthetic polynucleotide sequence
gtgcagggctcttcagacaga

SEQ ID NO: 48906 - DNA, 19 bp, Artificial sequence
  synthetic polynucleotide sequence
ccggagcagagcctgtgga

SEQ ID NO: 48907 - DNA, 20 bp, Artificial sequence
  synthetic polynucleotide sequence
ggtgaagcagatcgagagca

SEQ ID NO: 48908 - DNA, 18 bp, Artificial sequence
  synthetic polynucleotide sequence
tttgcaaggcccacacca

SEQ ID NO: 48909 - DNA, 18 bp, Artificial sequence
  synthetic polynucleotide sequence
cccaacccagcccggaca

SEQ ID NO: 48910 - DNA, 21 bp, Artificial sequence
  synthetic polynucleotide sequence
tcttctctaacctcggcccca

SEQ ID NO: 48911 - DNA, 18 bp, Artificial sequence
  synthetic polynucleotide sequence
gcctgagctgcagaacca

SEQ ID NO: 48912 - DNA, 18 bp, Artificial sequence
  synthetic polynucleotide sequence
tgagtggagctcggagca

SEQ ID NO: 48913 - DNA, 18 bp, Artificial sequence
  synthetic polynucleotide sequence
ccagtggactgcccctga

SEQ ID NO: 48914 - DNA, 18 bp, Artificial sequence
  synthetic polynucleotide sequence
aacccccgtcagggctga

SEQ ID NO: 48915 - DNA, 18 bp, Artificial sequence
  synthetic polynucleotide sequence
ggcagcagaagaggccaa

SEQ ID NO: 48916 - DNA, 20 bp, Artificial sequence
  synthetic polynucleotide sequence
gtcctcagcttccccaggaa

SEQ ID NO: 48917 - DNA, 22 bp, Artificial sequence
  synthetic polynucleotide sequence
tttagtgagtagaggccaggga

SEQ ID NO: 48918 - DNA, 20 bp, Artificial sequence
  synthetic polynucleotide sequence
cagccttggcacgactacca

SEQ ID NO: 48919 - DNA, 21 bp, Artificial sequence
  synthetic polynucleotide sequence
caggctgaaccagtcgtacga

SEQ ID NO: 48920 - DNA, 19 bp, Artificial sequence
  synthetic polynucleotide sequence
tggcctgaagacactcaga

SEQ ID NO: 48921 - DNA, 21 bp, Artificial sequence
  synthetic polynucleotide sequence
agaagccaccccatccaagga

SEQ ID NO: 48922 - DNA, 21 bp, Artificial sequence
  synthetic polynucleotide sequence
agttgtcagcgtccacctcca

SEQ ID NO: 48923 - DNA, 18 bp, Artificial sequence
  synthetic polynucleotide sequence
ccgaggctgacaagggca

SEQ ID NO: 48924 - DNA, 19 bp, Artificial sequence
  synthetic polynucleotide sequence
tcctcccaagtaggagcca

SEQ ID NO: 48925 - DNA, 21 bp, Artificial sequence
  synthetic polynucleotide sequence
ggtgtggtccctgcaaaagga

SEQ ID NO: 48926 - DNA, 21 bp, Artificial sequence
  synthetic polynucleotide sequence
agtttcagccagctccggaga

SEQ ID NO: 48927 - DNA, 19 bp, Artificial sequence
  synthetic polynucleotide sequence
tcccacactagcactgcta

SEQ ID NO: 48928 - DNA, 21 bp, Artificial sequence
  synthetic polynucleotide sequence
gtcagaagaaccgagcctcca

SEQ ID NO: 48929 - DNA, 21 bp, Artificial sequence
  synthetic polynucleotide sequence
agcgacccggatttccagcca

SEQ ID NO: 48930 - DNA, 22 bp, Artificial sequence
  synthetic polynucleotide sequence
catagaactgaatgctggggca

SEQ ID NO: 48931 - DNA, 20 bp, Artificial sequence
  synthetic polynucleotide sequence
caagcaggagatggtggaca

SEQ ID NO: 48932 - DNA, 18 bp, Artificial sequence
  synthetic polynucleotide sequence
agtccttgggggacacca

SEQ ID NO: 48933 - DNA, 21 bp, Artificial sequence
  synthetic polynucleotide sequence
gtagatgtggaccaaactgca

SEQ ID NO: 48934 - DNA, 18 bp, Artificial sequence
  synthetic polynucleotide sequence
cccctcattgctcctcga

SEQ ID NO: 48935 - DNA, 20 bp, Artificial sequence
  synthetic polynucleotide sequence
gaaggcttatcaggagggca

SEQ ID NO: 48936 - DNA, 18 bp, Artificial sequence
  synthetic polynucleotide sequence
gccagacctcctgagcca

SEQ ID NO: 48937 - DNA, 18 bp, Artificial sequence
  synthetic polynucleotide sequence
ccacctctgtgccccaca

SEQ ID NO: 48938 - DNA, 18 bp, Artificial sequence
  synthetic polynucleotide sequence
cgaagagccgctgcacca

SEQ ID NO: 48939 - DNA, 21 bp, Artificial sequence
  synthetic polynucleotide sequence
aacgccggtgaggttacccaa

SEQ ID NO: 48940 - DNA, 22 bp, Artificial sequence
  synthetic polynucleotide sequence
caaagtcgtgaacacctcccca

SEQ ID NO: 48941 - DNA, 20 bp, Artificial sequence
  synthetic polynucleotide sequence
tgctcccacaccactgcaga

SEQ ID NO: 48942 - DNA, 20 bp, Artificial sequence
  synthetic polynucleotide sequence
tcctgggtggagggtacaga

SEQ ID NO: 48943 - DNA, 18 bp, Artificial sequence
  synthetic polynucleotide sequence
agctggccacactcacca

SEQ ID NO: 48944 - DNA, 18 bp, Artificial sequence
  synthetic polynucleotide sequence
aagtgaccctcgcccaga

SEQ ID NO: 48945 - DNA, 20 bp, Artificial sequence
  synthetic polynucleotide sequence
ctgctctggctcagcggaca

SEQ ID NO: 48946 - DNA, 20 bp, Artificial sequence
  synthetic polynucleotide sequence
gccgccagcatccgctcgaa

SEQ ID NO: 48947 - DNA, 20 bp, Artificial sequence
  synthetic polynucleotide sequence
caggacagggagttgaccaa

SEQ ID NO: 48948 - DNA, 18 bp, Artificial sequence
  synthetic polynucleotide sequence
aaggcacaccgaggccca

SEQ ID NO: 48949 - DNA, 18 bp, Artificial sequence
  synthetic polynucleotide sequence
aatggaacgcccgaggga

SEQ ID NO: 48950 - DNA, 21 bp, Artificial sequence
  synthetic polynucleotide sequence
ctacatcagctgaagagggga

SEQ ID NO: 48951 - DNA, 18 bp, Artificial sequence
  synthetic polynucleotide sequence
gcatgctggcagaggaca

SEQ ID NO: 48952 - DNA, 18 bp, Artificial sequence
  synthetic polynucleotide sequence
ccagccacttgacaggca

SEQ ID NO: 48953 - DNA, 18 bp, Artificial sequence
  synthetic polynucleotide sequence
ggcccaggcccagagcga

SEQ ID NO: 48954 - DNA, 18 bp, Artificial sequence
  synthetic polynucleotide sequence
aagtacacggccagggca

SEQ ID NO: 48955 - DNA, 18 bp, Artificial sequence
  synthetic polynucleotide sequence
gcaccgaggatgggccaa

SEQ ID NO: 48956 - DNA, 20 bp, Artificial sequence
  synthetic polynucleotide sequence
aacttccaagcactgagcga

SEQ ID NO: 48957 - DNA, 18 bp, Artificial sequence
  synthetic polynucleotide sequence
gtgcccaagggtgcgcca

SEQ ID NO: 48958 - DNA, 20 bp, Artificial sequence
  synthetic polynucleotide sequence
gccggccacgttgctgagca

SEQ ID NO: 48959 - DNA, 21 bp, Artificial sequence
  synthetic polynucleotide sequence
tccatgctccgagggagagga

SEQ ID NO: 48960 - DNA, 19 bp, Artificial sequence
  synthetic polynucleotide sequence
caccgccactcagtgccca

SEQ ID NO: 48961 - DNA, 21 bp, Artificial sequence
  synthetic polynucleotide sequence
catgtgccctggcatgaggaa

SEQ ID NO: 48962 - DNA, 21 bp, Artificial sequence
  synthetic polynucleotide sequence
catgtccaccattcaccacca

SEQ ID NO: 48963 - DNA, 21 bp, Artificial sequence
  synthetic polynucleotide sequence
gaagggcagtgttgacgagga

SEQ ID NO: 48964 - DNA, 20 bp, Artificial sequence
  synthetic polynucleotide sequence
accccggtcaaggagtagga

SEQ ID NO: 48965 - DNA, 20 bp, Artificial sequence
  synthetic polynucleotide sequence
ttggggccatgtacaagcaa

SEQ ID NO: 48966 - DNA, 20 bp, Artificial sequence
  synthetic polynucleotide sequence
tcagctgccctctggaccaa

SEQ ID NO: 48967 - DNA, 19 bp, Artificial sequence
  synthetic polynucleotide sequence
ttaatggacagccgatcca

SEQ ID NO: 48968 - DNA, 21 bp, Artificial sequence
  synthetic polynucleotide sequence
catctcatactgacggcagca

SEQ ID NO: 48969 - DNA, 20 bp, Artificial sequence
  synthetic polynucleotide sequence
aagttccggagggaggagga

SEQ ID NO: 48970 - DNA, 20 bp, Artificial sequence
  synthetic polynucleotide sequence
acagcctgcccgttgaacca

SEQ ID NO: 48971 - DNA, 18 bp, Artificial sequence
  synthetic polynucleotide sequence
acgtcacggatcaggcca

SEQ ID NO: 48972 - DNA, 18 bp, Artificial sequence
  synthetic polynucleotide sequence
ggcacttgcagggtcaca

SEQ ID NO: 48973 - DNA, 20 bp, Artificial sequence
  synthetic polynucleotide sequence
acagtacatcccccagccca

SEQ ID NO: 48974 - DNA, 21 bp, Artificial sequence
  synthetic polynucleotide sequence
gtgagatgacctggaccgtga

SEQ ID NO: 48975 - DNA, 22 bp, Artificial sequence
  synthetic polynucleotide sequence
atgagctcgctaagtcagagca

SEQ ID NO: 48976 - DNA, 21 bp, Artificial sequence
  synthetic polynucleotide sequence
tctcgcactcctcaaagctga

SEQ ID NO: 48977 - DNA, 22 bp, Artificial sequence
  synthetic polynucleotide sequence
aaaggagcagactgtggagcaa

SEQ ID NO: 48978 - DNA, 18 bp, Artificial sequence
  synthetic polynucleotide sequence
tccccgcattgaacagca

SEQ ID NO: 48979 - DNA, 20 bp, Artificial sequence
  synthetic polynucleotide sequence
cttaaggcggtcaccaggga

SEQ ID NO: 48980 - DNA, 21 bp, Artificial sequence
  synthetic polynucleotide sequence
tcccgcagcacttccaaggca

SEQ ID NO: 48981 - DNA, 21 bp, Artificial sequence
  synthetic polynucleotide sequence
tgggcccaaacgctgtccaca

SEQ ID NO: 48982 - DNA, 21 bp, Artificial sequence
  synthetic polynucleotide sequence
acttgggggtgaattcgggga

SEQ ID NO: 48983 - DNA, 18 bp, Artificial sequence
  synthetic polynucleotide sequence
cagccggcttcaagcaga

SEQ ID NO: 48984 - DNA, 18 bp, Artificial sequence
  synthetic polynucleotide sequence
gtggaggtggagggctga

SEQ ID NO: 48985 - DNA, 20 bp, Artificial sequence
  synthetic polynucleotide sequence
tggcgaggagccggagaaga

SEQ ID NO: 48986 - DNA, 20 bp, Artificial sequence
  synthetic polynucleotide sequence
gaagggtccagatcgctcga

SEQ ID NO: 48987 - DNA, 21 bp, Artificial sequence
  synthetic polynucleotide sequence
tttggagtgggggaaggacaa

SEQ ID NO: 48988 - DNA, 23 bp, Artificial sequence
  synthetic polynucleotide sequence
cctcatgcaacagacacaaggga

SEQ ID NO: 48989 - DNA, 22 bp, Artificial sequence
  synthetic polynucleotide sequence
ggagaaatacagtcgcaagcca

SEQ ID NO: 48990 - DNA, 20 bp, Artificial sequence
  synthetic polynucleotide sequence
gggcagtccaagagagccaa

SEQ ID NO: 48991 - DNA, 19 bp, Artificial sequence
  synthetic polynucleotide sequence
gccctgagcagcagaagga

SEQ ID NO: 48992 - DNA, 19 bp, Artificial sequence
  synthetic polynucleotide sequence
gctagctgccgctaccaca

SEQ ID NO: 48993 - DNA, 18 bp, Artificial sequence
  synthetic polynucleotide sequence
cagcgccaccgatgagga

SEQ ID NO: 48994 - DNA, 18 bp, Artificial sequence
  synthetic polynucleotide sequence
agccactcgcacgcggca

SEQ ID NO: 48995 - DNA, 18 bp, Artificial sequence
  synthetic polynucleotide sequence
cggctcatggagatggga

SEQ ID NO: 48996 - DNA, 18 bp, Artificial sequence
  synthetic polynucleotide sequence
gcaggaagttggtggcga

SEQ ID NO: 48997 - DNA, 19 bp, Artificial sequence
  synthetic polynucleotide sequence
cccaccccctcgtcagcca

SEQ ID NO: 48998 - DNA, 20 bp, Artificial sequence
  synthetic polynucleotide sequence
aggtgcaggggaggcatgca

SEQ ID NO: 48999 - DNA, 20 bp, Artificial sequence
  synthetic polynucleotide sequence
gttcgagaccgcgctgagca

SEQ ID NO: 49000 - DNA, 20 bp, Artificial sequence
  synthetic polynucleotide sequence
ggaagttgggcggcgtggca

SEQ ID NO: 49001 - DNA, 20 bp, Artificial sequence
  synthetic polynucleotide sequence
aacatgcccagctgtcccca

SEQ ID NO: 49002 - DNA, 19 bp, Artificial sequence
  synthetic polynucleotide sequence
tcatggctctgaggacaca

SEQ ID NO: 49003 - DNA, 20 bp, Artificial sequence
  synthetic polynucleotide sequence
agttctccgagagccaggca

SEQ ID NO: 49004 - DNA, 20 bp, Artificial sequence
  synthetic polynucleotide sequence
gcggttgccatggaccagca

SEQ ID NO: 49005 - DNA, 19 bp, Artificial sequence
  synthetic polynucleotide sequence
ccacacctcccttccagca

SEQ ID NO: 49006 - DNA, 18 bp, Artificial sequence
  synthetic polynucleotide sequence
aggcccagaacctgcaga

SEQ ID NO: 49007 - DNA, 21 bp, Artificial sequence
  synthetic polynucleotide sequence
caccataccacgcagcagaca

SEQ ID NO: 49008 - DNA, 20 bp, Artificial sequence
  synthetic polynucleotide sequence
tgttggaaaggggtggccga

SEQ ID NO: 49009 - DNA, 22 bp, Artificial sequence
  synthetic polynucleotide sequence
caaacggcaaggagtcttagca

SEQ ID NO: 49010 - DNA, 20 bp, Artificial sequence
  synthetic polynucleotide sequence
cagccatgccttcccgaaga

SEQ ID NO: 49011 - DNA, 19 bp, Artificial sequence
  synthetic polynucleotide sequence
ggccgctacatacgcacca

SEQ ID NO: 49012 - DNA, 17 bp, Artificial sequence
  synthetic polynucleotide sequence
gaagggacggggagcaa

SEQ ID NO: 49013 - DNA, 19 bp, Artificial sequence
  synthetic polynucleotide sequence
tcaagaggttgcaggagga

SEQ ID NO: 49014 - DNA, 18 bp, Artificial sequence
  synthetic polynucleotide sequence
tgaccgcgttccacacca

SEQ ID NO: 49015 - DNA, 20 bp, Artificial sequence
  synthetic polynucleotide sequence
cggaggaggctcatgcggga

SEQ ID NO: 49016 - DNA, 20 bp, Artificial sequence
  synthetic polynucleotide sequence
cagatggtgcgccactgaca

SEQ ID NO: 49017 - DNA, 18 bp, Artificial sequence
  synthetic polynucleotide sequence
gccctgctatcaccccaa

SEQ ID NO: 49018 - DNA, 21 bp, Artificial sequence
  synthetic polynucleotide sequence
gtcctgacatcatacagggca

SEQ ID NO: 49019 - DNA, 21 bp, Artificial sequence
  synthetic polynucleotide sequence
gatagcgcatatcaaggtgga

SEQ ID NO: 49020 - DNA, 22 bp, Artificial sequence
  synthetic polynucleotide sequence
atacagtcagagctggtgacca

SEQ ID NO: 49021 - DNA, 21 bp, Artificial sequence
  synthetic polynucleotide sequence
cgatcacagtggtctccagca

SEQ ID NO: 49022 - DNA, 21 bp, Artificial sequence
  synthetic polynucleotide sequence
agatccgagcaatctcaggca

SEQ ID NO: 49023 - DNA, 21 bp, Artificial sequence
  synthetic polynucleotide sequence
atgggacctaatgacagccca

SEQ ID NO: 49024 - DNA, 21 bp, Artificial sequence
  synthetic polynucleotide sequence
atctctggcactagggggtca

SEQ ID NO: 49025 - DNA, 19 bp, Artificial sequence
  synthetic polynucleotide sequence
taaccgacttgcagaggga

SEQ ID NO: 49026 - DNA, 19 bp, Artificial sequence
  synthetic polynucleotide sequence
ttgggggcttgaacgggta

SEQ ID NO: 49027 - DNA, 19 bp, Artificial sequence
  synthetic polynucleotide sequence
tggagtccagcactaacca

SEQ ID NO: 49028 - DNA, 20 bp, Artificial sequence
  synthetic polynucleotide sequence
gtggcaatacttcccaccaa

SEQ ID NO: 49029 - DNA, 21 bp, Artificial sequence
  synthetic polynucleotide sequence
gtgctggacccaaaggagaca

SEQ ID NO: 49030 - DNA, 22 bp, Artificial sequence
  synthetic polynucleotide sequence
agaagtgagcagatggagagga

SEQ ID NO: 49031 - DNA, 20 bp, Artificial sequence
  synthetic polynucleotide sequence
cgagacccagccgctccaga

SEQ ID NO: 49032 - DNA, 22 bp, Artificial sequence
  synthetic polynucleotide sequence
atatacagaacccggtggacca

SEQ ID NO: 49033 - DNA, 22 bp, Artificial sequence
  synthetic polynucleotide sequence
aacatggtgcctcccaaagtga

SEQ ID NO: 49034 - DNA, 19 bp, Artificial sequence
  synthetic polynucleotide sequence
tcttgtgggagcccagcca

SEQ ID NO: 49035 - DNA, 20 bp, Artificial sequence
  synthetic polynucleotide sequence
gcccactcaccctcgacgaa

SEQ ID NO: 49036 - DNA, 20 bp, Artificial sequence
  synthetic polynucleotide sequence
actggagaccagacgggcaa

SEQ ID NO: 49037 - DNA, 18 bp, Artificial sequence
  synthetic polynucleotide sequence
ctacgagagcagcgcgga

SEQ ID NO: 49038 - DNA, 18 bp, Artificial sequence
  synthetic polynucleotide sequence
ctgccagcatgctcacca

SEQ ID NO: 49039 - DNA, 23 bp, Artificial sequence
  synthetic polynucleotide sequence
gggactgccagcccctaactgaa

SEQ ID NO: 49040 - DNA, 20 bp, Artificial sequence
  synthetic polynucleotide sequence
gaagggaggagacagggcga

SEQ ID NO: 49041 - DNA, 18 bp, Artificial sequence
  synthetic polynucleotide sequence
gggactccgtgggaagga

SEQ ID NO: 49042 - DNA, 20 bp, Artificial sequence
  synthetic polynucleotide sequence
ctctaagatggacaggcaca

SEQ ID NO: 49043 - DNA, 21 bp, Artificial sequence
  synthetic polynucleotide sequence
gcccagcagcagagtcagaga

SEQ ID NO: 49044 - DNA, 21 bp, Artificial sequence
  synthetic polynucleotide sequence
acaatcagtacagctgaccca

SEQ ID NO: 49045 - DNA, 21 bp, Artificial sequence
  synthetic polynucleotide sequence
ccaccctgggcagtatagaga

SEQ ID NO: 49046 - DNA, 22 bp, Artificial sequence
  synthetic polynucleotide sequence
aatctcctccacgacttcagga

SEQ ID NO: 49047 - DNA, 21 bp, Artificial sequence
  synthetic polynucleotide sequence
gctgcagagccagatgatcca

SEQ ID NO: 49048 - DNA, 22 bp, Artificial sequence
  synthetic polynucleotide sequence
aactggtgctccagcatacaca

SEQ ID NO: 49049 - DNA, 20 bp, Artificial sequence
  synthetic polynucleotide sequence
cagcaaccaaaaccgaccaa

SEQ ID NO: 49050 - DNA, 20 bp, Artificial sequence
  synthetic polynucleotide sequence
cttcagctaggtcagcccga

SEQ ID NO: 49051 - DNA, 19 bp, Artificial sequence
  synthetic polynucleotide sequence
gtggacgagaacggacaga

SEQ ID NO: 49052 - DNA, 18 bp, Artificial sequence
  synthetic polynucleotide sequence
gcacattgagggcctcca

SEQ ID NO: 49053 - DNA, 21 bp, Artificial sequence
  synthetic polynucleotide sequence
cgaggacccactgaacaagga

SEQ ID NO: 49054 - DNA, 21 bp, Artificial sequence
  synthetic polynucleotide sequence
gcagcgctcaaagtaggtgga

SEQ ID NO: 49055 - DNA, 21 bp, Artificial sequence
  synthetic polynucleotide sequence
ccccgcaggatcatcaaggaa

SEQ ID NO: 49056 - DNA, 20 bp, Artificial sequence
  synthetic polynucleotide sequence
ctgagggccagcaatgacca

SEQ ID NO: 49057 - DNA, 18 bp, Artificial sequence
  synthetic polynucleotide sequence
tcaccttcaccagcgcca

SEQ ID NO: 49058 - DNA, 18 bp, Artificial sequence
  synthetic polynucleotide sequence
ccatgatgccctcaggca

SEQ ID NO: 49059 - DNA, 20 bp, Artificial sequence
  synthetic polynucleotide sequence
tggagagtccaccagtccca

SEQ ID NO: 49060 - DNA, 23 bp, Artificial sequence
  synthetic polynucleotide sequence
ccacagaggccttgaaaaccaga

SEQ ID NO: 49061 - DNA, 20 bp, Artificial sequence
  synthetic polynucleotide sequence
gaaccacgagcgattccgca

SEQ ID NO: 49062 - DNA, 18 bp, Artificial sequence
  synthetic polynucleotide sequence
tgccctgctgcggcacca

SEQ ID NO: 49063 - DNA, 21 bp, Artificial sequence
  synthetic polynucleotide sequence
tgtggcaggacatgaaggaga

SEQ ID NO: 49064 - DNA, 19 bp, Artificial sequence
  synthetic polynucleotide sequence
ccacggtgtaggcgctgga

SEQ ID NO: 49065 - DNA, 19 bp, Artificial sequence
  synthetic polynucleotide sequence
tctccccagccaatgtcga

SEQ ID NO: 49066 - DNA, 18 bp, Artificial sequence
  synthetic polynucleotide sequence
ccgccagggttgtgggga

SEQ ID NO: 49067 - DNA, 20 bp, Artificial sequence
  synthetic polynucleotide sequence
gaggacctcaccgacctcca

SEQ ID NO: 49068 - DNA, 20 bp, Artificial sequence
  synthetic polynucleotide sequence
gcgcccacgttcgggtggaa

SEQ ID NO: 49069 - DNA, 21 bp, Artificial sequence
  synthetic polynucleotide sequence
cacatgttagccacagagcca

SEQ ID NO: 49070 - DNA, 18 bp, Artificial sequence
  synthetic polynucleotide sequence
gagctcgcaggtcatcca

SEQ ID NO: 49071 - DNA, 20 bp, Artificial sequence
  synthetic polynucleotide sequence
cgcagatgaggaagtgccca

SEQ ID NO: 49072 - DNA, 25 bp, Artificial sequence
  synthetic polynucleotide sequence
ctagaacctcagaacggtaccaaga

SEQ ID NO: 49073 - DNA, 20 bp, Artificial sequence
  synthetic polynucleotide sequence
agtggtggacccaagagcca

SEQ ID NO: 49074 - DNA, 18 bp, Artificial sequence
  synthetic polynucleotide sequence
cttcgggcggctgaggga

SEQ ID NO: 49075 - DNA, 22 bp, Artificial sequence
  synthetic polynucleotide sequence
caaaaaggagtaggcgacggta

SEQ ID NO: 49076 - DNA, 19 bp, Artificial sequence
  synthetic polynucleotide sequence
ccgggcatccaccatccca

SEQ ID NO: 49077 - DNA, 23 bp, Artificial sequence
  synthetic polynucleotide sequence
cacaagaaggggctatctcagca

SEQ ID NO: 49078 - DNA, 20 bp, Artificial sequence
  synthetic polynucleotide sequence
gggcaagcagatcccctgca

SEQ ID NO: 49079 - DNA, 21 bp, Artificial sequence
  synthetic polynucleotide sequence
ccctgtcctgaacccctacga

SEQ ID NO: 49080 - DNA, 20 bp, Artificial sequence
  synthetic polynucleotide sequence
ctctccaaaagggtcctgca

SEQ ID NO: 49081 - DNA, 20 bp, Artificial sequence
  synthetic polynucleotide sequence
tgggaggggaagtggacaca

SEQ ID NO: 49082 - DNA, 19 bp, Artificial sequence
  synthetic polynucleotide sequence
ttccagggggtccactcga

SEQ ID NO: 49083 - DNA, 20 bp, Artificial sequence
  synthetic polynucleotide sequence
aacaggcagatccgccagca

SEQ ID NO: 49084 - DNA, 20 bp, Artificial sequence
  synthetic polynucleotide sequence
atgggaacttgtgcaccaga

SEQ ID NO: 49085 - DNA, 22 bp, Artificial sequence
  synthetic polynucleotide sequence
aaggtcctctaccagccatgca

SEQ ID NO: 49086 - DNA, 22 bp, Artificial sequence
  synthetic polynucleotide sequence
aggaattcacacggcgaaggga

SEQ ID NO: 49087 - DNA, 21 bp, Artificial sequence
  synthetic polynucleotide sequence
tgggccaatcagatgccagaa

SEQ ID NO: 49088 - DNA, 20 bp, Artificial sequence
  synthetic polynucleotide sequence
aaggtgaggagccgagagga

SEQ ID NO: 49089 - DNA, 20 bp, Artificial sequence
  synthetic polynucleotide sequence
cagttgccccgggatcagca

SEQ ID NO: 49090 - DNA, 20 bp, Artificial sequence
  synthetic polynucleotide sequence
tccaagctccggtctgagga

SEQ ID NO: 49091 - DNA, 19 bp, Artificial sequence
  synthetic polynucleotide sequence
ggagcgcctgccaacggta

SEQ ID NO: 49092 - DNA, 18 bp, Artificial sequence
  synthetic polynucleotide sequence
aggcttccgtggggccca

SEQ ID NO: 49093 - DNA, 20 bp, Artificial sequence
  synthetic polynucleotide sequence
ccagcgctcctggaggcaga

SEQ ID NO: 49094 - DNA, 20 bp, Artificial sequence
  synthetic polynucleotide sequence
ggatccaggacaccgtggga

SEQ ID NO: 49095 - DNA, 21 bp, Artificial sequence
  synthetic polynucleotide sequence
aagagcaggtcagcagtccaa

SEQ ID NO: 49096 - DNA, 21 bp, Artificial sequence
  synthetic polynucleotide sequence
tctctctggccaccaaatgca

SEQ ID NO: 49097 - DNA, 19 bp, Artificial sequence
  synthetic polynucleotide sequence
ccgcaggtctggcagctga

SEQ ID NO: 49098 - DNA, 19 bp, Artificial sequence
  synthetic polynucleotide sequence
cggctggccaaccgttcga

SEQ ID NO: 49099 - DNA, 19 bp, Artificial sequence
  synthetic polynucleotide sequence
cctgtggcaccagctggga

SEQ ID NO: 49100 - DNA, 20 bp, Artificial sequence
  synthetic polynucleotide sequence
gtgaggctcctctgccagga

SEQ ID NO: 49101 - DNA, 21 bp, Artificial sequence
  synthetic polynucleotide sequence
cacggatgataccatcgggga

SEQ ID NO: 49102 - DNA, 19 bp, Artificial sequence
  synthetic polynucleotide sequence
tcatagtcccccagagaca

SEQ ID NO: 49103 - DNA, 20 bp, Artificial sequence
  synthetic polynucleotide sequence
gactggcacctggcggtgaa

SEQ ID NO: 49104 - DNA, 21 bp, Artificial sequence
  synthetic polynucleotide sequence
tcgcagaacatggacagtgga

SEQ ID NO: 49105 - DNA, 21 bp, Artificial sequence
  synthetic polynucleotide sequence
tcttaggtccaccccctgaca

SEQ ID NO: 49106 - DNA, 22 bp, Artificial sequence
  synthetic polynucleotide sequence
attctaccccagtctctgcaca

SEQ ID NO: 49107 - DNA, 21 bp, Artificial sequence
  synthetic polynucleotide sequence
cgacccgtcccaagttcagca

SEQ ID NO: 49108 - DNA, 21 bp, Artificial sequence
  synthetic polynucleotide sequence
ccatcaaagaggagccggcca

SEQ ID NO: 49109 - DNA, 20 bp, Artificial sequence
  synthetic polynucleotide sequence
gtgtcacagatctccacgca

SEQ ID NO: 49110 - DNA, 21 bp, Artificial sequence
  synthetic polynucleotide sequence
tgacagagagggcttgggtga

SEQ ID NO: 49111 - DNA, 19 bp, Artificial sequence
  synthetic polynucleotide sequence
gagcatcctgggccccgaa

SEQ ID NO: 49112 - DNA, 20 bp, Artificial sequence
  synthetic polynucleotide sequence
gtgcacgtcatgggcaggga

SEQ ID NO: 49113 - DNA, 20 bp, Artificial sequence
  synthetic polynucleotide sequence
tggagaggagatgggggaca

SEQ ID NO: 49114 - DNA, 20 bp, Artificial sequence
  synthetic polynucleotide sequence
ccaacggccacatcagcaca

SEQ ID NO: 49115 - DNA, 20 bp, Artificial sequence
  synthetic polynucleotide sequence
caatccatgggctccacaga

SEQ ID NO: 49116 - DNA, 20 bp, Artificial sequence
  synthetic polynucleotide sequence
tactctgcccagaagtgcca

SEQ ID NO: 49117 - DNA, 20 bp, Artificial sequence
  synthetic polynucleotide sequence
accaccgccagctacccaga

SEQ ID NO: 49118 - DNA, 21 bp, Artificial sequence
  synthetic polynucleotide sequence
gcgacataattagcggcagca

SEQ ID NO: 49119 - DNA, 20 bp, Artificial sequence
  synthetic polynucleotide sequence
ggacgggtagtgtggcagga

SEQ ID NO: 49120 - DNA, 21 bp, Artificial sequence
  synthetic polynucleotide sequence
tcagaaagcccatggaccgca

SEQ ID NO: 49121 - DNA, 21 bp, Artificial sequence
  synthetic polynucleotide sequence
actacagaccttgcagaccga

SEQ ID NO: 49122 - DNA, 21 bp, Artificial sequence
  synthetic polynucleotide sequence
gctggaagcccctgttggaga

SEQ ID NO: 49123 - DNA, 20 bp, Artificial sequence
  synthetic polynucleotide sequence
cacagcatcctgcaacccga

SEQ ID NO: 49124 - DNA, 20 bp, Artificial sequence
  synthetic polynucleotide sequence
aagctggctgccgagtggca

SEQ ID NO: 49125 - DNA, 18 bp, Artificial sequence
  synthetic polynucleotide sequence
gctgcttgccaggaagca

SEQ ID NO: 49126 - DNA, 18 bp, Artificial sequence
  synthetic polynucleotide sequence
tccaggaaccaagacgca

SEQ ID NO: 49127 - DNA, 21 bp, Artificial sequence
  synthetic polynucleotide sequence
tggaatgttcggccgaggaga

SEQ ID NO: 49128 - DNA, 20 bp, Artificial sequence
  synthetic polynucleotide sequence
aaagggttgggacccctgca

SEQ ID NO: 49129 - DNA, 20 bp, Artificial sequence
  synthetic polynucleotide sequence
atggagatcaccacggcaga

SEQ ID NO: 49130 - DNA, 18 bp, Artificial sequence
  synthetic polynucleotide sequence
tcttcagaggaggggcca

SEQ ID NO: 49131 - DNA, 21 bp, Artificial sequence
  synthetic polynucleotide sequence
tgccgccctgcagaatgccaa

SEQ ID NO: 49132 - DNA, 21 bp, Artificial sequence
  synthetic polynucleotide sequence
tgaacgactgctccatggcga

SEQ ID NO: 49133 - DNA, 20 bp, Artificial sequence
  synthetic polynucleotide sequence
gtgaagggccacctctcaca

SEQ ID NO: 49134 - DNA, 21 bp, Artificial sequence
  synthetic polynucleotide sequence
ccatgaataccctgccgaaca

SEQ ID NO: 49135 - DNA, 20 bp, Artificial sequence
  synthetic polynucleotide sequence
ctgacaggagcgatccccta

SEQ ID NO: 49136 - DNA, 18 bp, Artificial sequence
  synthetic polynucleotide sequence
accgtgccttcatcagca

SEQ ID NO: 49137 - DNA, 20 bp, Artificial sequence
  synthetic polynucleotide sequence
gctgaaggtgcgcctgtcca

SEQ ID NO: 49138 - DNA, 21 bp, Artificial sequence
  synthetic polynucleotide sequence
ggagaagaaccaccgctgcca

SEQ ID NO: 49139 - DNA, 21 bp, Artificial sequence
  synthetic polynucleotide sequence
agtgctacgatgaactgggga

SEQ ID NO: 49140 - DNA, 21 bp, Artificial sequence
  synthetic polynucleotide sequence
gtgtctgtgctgcgaaccaca

SEQ ID NO: 49141 - DNA, 20 bp, Artificial sequence
  synthetic polynucleotide sequence
ctgcgaggcccaaaccccaa

SEQ ID NO: 49142 - DNA, 20 bp, Artificial sequence
  synthetic polynucleotide sequence
tcgccgccatcttcagagga

SEQ ID NO: 49143 - DNA, 21 bp, Artificial sequence
  synthetic polynucleotide sequence
atgggacctcactgacccaga

SEQ ID NO: 49144 - DNA, 18 bp, Artificial sequence
  synthetic polynucleotide sequence
cctgcagaggccgctcca

SEQ ID NO: 49145 - DNA, 20 bp, Artificial sequence
  synthetic polynucleotide sequence
atgagttgccaagcagccaa

SEQ ID NO: 49146 - DNA, 21 bp, Artificial sequence
  synthetic polynucleotide sequence
ttgagagaagaggaagcccca

SEQ ID NO: 49147 - DNA, 19 bp, Artificial sequence
  synthetic polynucleotide sequence
gtcacccaacacgccggca

SEQ ID NO: 49148 - DNA, 18 bp, Artificial sequence
  synthetic polynucleotide sequence
ggtagagggtgggcggga

SEQ ID NO: 49149 - DNA, 21 bp, Artificial sequence
  synthetic polynucleotide sequence
gtgtgtctcccgctgaacaga

SEQ ID NO: 49150 - DNA, 22 bp, Artificial sequence
  synthetic polynucleotide sequence
caaaaactgctgactggcacca

SEQ ID NO: 49151 - DNA, 19 bp, Artificial sequence
  synthetic polynucleotide sequence
gcccacggacaccacctca

SEQ ID NO: 49152 - DNA, 21 bp, Artificial sequence
  synthetic polynucleotide sequence
tcattcagagggacagcccca

SEQ ID NO: 49153 - DNA, 21 bp, Artificial sequence
  synthetic polynucleotide sequence
gcattggaccgtgcagagaga

SEQ ID NO: 49154 - DNA, 21 bp, Artificial sequence
  synthetic polynucleotide sequence
ttgccaacagtctgtgcagca

SEQ ID NO: 49155 - DNA, 22 bp, Artificial sequence
  synthetic polynucleotide sequence
acgagaacctggccttgaacga

SEQ ID NO: 49156 - DNA, 22 bp, Artificial sequence
  synthetic polynucleotide sequence
agcttctcgatggctgacagga

SEQ ID NO: 49157 - DNA, 21 bp, Artificial sequence
  synthetic polynucleotide sequence
ccacggacaggtcagaagcta

SEQ ID NO: 49158 - DNA, 21 bp, Artificial sequence
  synthetic polynucleotide sequence
ataaggctctctgaacgggca

SEQ ID NO: 49159 - DNA, 21 bp, Artificial sequence
  synthetic polynucleotide sequence
agtgggaatgtcctgaggaga

SEQ ID NO: 49160 - DNA, 18 bp, Artificial sequence
  synthetic polynucleotide sequence
gcgactggcctccctcca

SEQ ID NO: 49161 - DNA, 21 bp, Artificial sequence
  synthetic polynucleotide sequence
caggaaggccaatgtcgggta

SEQ ID NO: 49162 - DNA, 21 bp, Artificial sequence
  synthetic polynucleotide sequence
ccttggcagcgtccttcagca

SEQ ID NO: 49163 - DNA, 21 bp, Artificial sequence
  synthetic polynucleotide sequence
aaggtcagactgaggcaccaa

SEQ ID NO: 49164 - DNA, 19 bp, Artificial sequence
  synthetic polynucleotide sequence
tcatcagggtcgcgctcca

SEQ ID NO: 49165 - DNA, 20 bp, Artificial sequence
  synthetic polynucleotide sequence
agccaggagaagaaccagca

SEQ ID NO: 49166 - DNA, 22 bp, Artificial sequence
  synthetic polynucleotide sequence
tatggcttgagtagcacaagca

SEQ ID NO: 49167 - DNA, 18 bp, Artificial sequence
  synthetic polynucleotide sequence
ggagggcaaaacggtgga

SEQ ID NO: 49168 - DNA, 19 bp, Artificial sequence
  synthetic polynucleotide sequence
gagacagcctgacgtcgga

SEQ ID NO: 49169 - DNA, 18 bp, Artificial sequence
  synthetic polynucleotide sequence
cagcgagagaggcaggga

SEQ ID NO: 49170 - DNA, 18 bp, Artificial sequence
  synthetic polynucleotide sequence
agggccctccattcagga

SEQ ID NO: 49171 - DNA, 22 bp, Artificial sequence
  synthetic polynucleotide sequence
ccatcctcatccagaccaacca

SEQ ID NO: 49172 - DNA, 19 bp, Artificial sequence
  synthetic polynucleotide sequence
gccactgagtgcacgccca

SEQ ID NO: 49173 - DNA, 19 bp, Artificial sequence
  synthetic polynucleotide sequence
ctctacaaccgccaccaca

SEQ ID NO: 49174 - DNA, 18 bp, Artificial sequence
  synthetic polynucleotide sequence
ggccactgcagaccccaa

SEQ ID NO: 49175 - DNA, 18 bp, Artificial sequence
  synthetic polynucleotide sequence
ttgggactcgggacggca

SEQ ID NO: 49176 - DNA, 18 bp, Artificial sequence
  synthetic polynucleotide sequence
agggtccgcagcaggtga

SEQ ID NO: 49177 - DNA, 20 bp, Artificial sequence
  synthetic polynucleotide sequence
ccgacctgcggcctcagaga

SEQ ID NO: 49178 - DNA, 21 bp, Artificial sequence
  synthetic polynucleotide sequence
gggacatccagcgataggaca

SEQ ID NO: 49179 - DNA, 20 bp, Artificial sequence
  synthetic polynucleotide sequence
cgtgtcccaagcacagccca

SEQ ID NO: 49180 - DNA, 20 bp, Artificial sequence
  synthetic polynucleotide sequence
acgtcgagggacagggtgaa

SEQ ID NO: 49181 - DNA, 20 bp, Artificial sequence
  synthetic polynucleotide sequence
agcctcggacgtacacccga

SEQ ID NO: 49182 - DNA, 20 bp, Artificial sequence
  synthetic polynucleotide sequence
accttggacctggagccgga

SEQ ID NO: 49183 - DNA, 18 bp, Artificial sequence
  synthetic polynucleotide sequence
tgccctcctgaaagccaa

SEQ ID NO: 49184 - DNA, 18 bp, Artificial sequence
  synthetic polynucleotide sequence
ctgtactggcccagggca

SEQ ID NO: 49185 - DNA, 21 bp, Artificial sequence
  synthetic polynucleotide sequence
cactgacaacttcccctgcca

SEQ ID NO: 49186 - DNA, 21 bp, Artificial sequence
  synthetic polynucleotide sequence
tcatacagtcgagggggctga

SEQ ID NO: 49187 - DNA, 21 bp, Artificial sequence
  synthetic polynucleotide sequence
gctgtccaacagagccatgga

SEQ ID NO: 49188 - DNA, 21 bp, Artificial sequence
  synthetic polynucleotide sequence
ggttccaaggatgcaaggcaa

SEQ ID NO: 49189 - DNA, 21 bp, Artificial sequence
  synthetic polynucleotide sequence
gtgctgaagactaacgccgga

SEQ ID NO: 49190 - DNA, 19 bp, Artificial sequence
  synthetic polynucleotide sequence
tggactccagtcggaacca

SEQ ID NO: 49191 - DNA, 22 bp, Artificial sequence
  synthetic polynucleotide sequence
ttcaagtggccacctactccaa

SEQ ID NO: 49192 - DNA, 19 bp, Artificial sequence
  synthetic polynucleotide sequence
ttggtctccatcacacgca

SEQ ID NO: 49193 - DNA, 21 bp, Artificial sequence
  synthetic polynucleotide sequence
acacaggcactaactcagcga

SEQ ID NO: 49194 - DNA, 20 bp, Artificial sequence
  synthetic polynucleotide sequence
atcctgtctcccaccaacca

SEQ ID NO: 49195 - DNA, 20 bp, Artificial sequence
  synthetic polynucleotide sequence
gagacgtggacgtgagtgga

SEQ ID NO: 49196 - DNA, 23 bp, Artificial sequence
  synthetic polynucleotide sequence
gaatgaatccagaacacacgaca

SEQ ID NO: 49197 - DNA, 20 bp, Artificial sequence
  synthetic polynucleotide sequence
gcaccttggactgaggacga

SEQ ID NO: 49198 - DNA, 20 bp, Artificial sequence
  synthetic polynucleotide sequence
ggacaccagtgggaggtaca

SEQ ID NO: 49199 - DNA, 21 bp, Artificial sequence
  synthetic polynucleotide sequence
tctgcctcacgacagacccta

SEQ ID NO: 49200 - DNA, 21 bp, Artificial sequence
  synthetic polynucleotide sequence
agatcgataagcacagcccca

SEQ ID NO: 49201 - DNA, 18 bp, Artificial sequence
  synthetic polynucleotide sequence
tggatgggcagcccacca

SEQ ID NO: 49202 - DNA, 18 bp, Artificial sequence
  synthetic polynucleotide sequence
cgcggatgaaccaggcga

SEQ ID NO: 49203 - DNA, 18 bp, Artificial sequence
  synthetic polynucleotide sequence
tgtcccggctcgtgacca

SEQ ID NO: 49204 - DNA, 18 bp, Artificial sequence
  synthetic polynucleotide sequence
tccaggacacgccgtcca

SEQ ID NO: 49205 - DNA, 20 bp, Artificial sequence
  synthetic polynucleotide sequence
gcaggagctgacattgcgga

SEQ ID NO: 49206 - DNA, 20 bp, Artificial sequence
  synthetic polynucleotide sequence
catccctgcagtacacggca

SEQ ID NO: 49207 - DNA, 21 bp, Artificial sequence
  synthetic polynucleotide sequence
catggcctacaagttgccaga

SEQ ID NO: 49208 - DNA, 22 bp, Artificial sequence
  synthetic polynucleotide sequence
gttgaaagctcgccagagagca

SEQ ID NO: 49209 - DNA, 18 bp, Artificial sequence
  synthetic polynucleotide sequence
tgcaggagcaaaatgcca

SEQ ID NO: 49210 - DNA, 21 bp, Artificial sequence
  synthetic polynucleotide sequence
catcaccagcaagagatctga

SEQ ID NO: 49211 - DNA, 18 bp, Artificial sequence
  synthetic polynucleotide sequence
cgtgcacttggaggacca

SEQ ID NO: 49212 - DNA, 18 bp, Artificial sequence
  synthetic polynucleotide sequence
gtccgttcgcaacaacca

SEQ ID NO: 49213 - DNA, 21 bp, Artificial sequence
  synthetic polynucleotide sequence
taagtggctaccccaaaacga

SEQ ID NO: 49214 - DNA, 21 bp, Artificial sequence
  synthetic polynucleotide sequence
atcatcaccatgggaacgcca

SEQ ID NO: 49215 - DNA, 21 bp, Artificial sequence
  synthetic polynucleotide sequence
taacgaccaattcagaccaca

SEQ ID NO: 49216 - DNA, 18 bp, Artificial sequence
  synthetic polynucleotide sequence
tgcccccaatgaagacca

SEQ ID NO: 49217 - DNA, 21 bp, Artificial sequence
  synthetic polynucleotide sequence
agggagctggagtgaccctga

SEQ ID NO: 49218 - DNA, 20 bp, Artificial sequence
  synthetic polynucleotide sequence
ctccacccagaacacggcca

SEQ ID NO: 49219 - DNA, 21 bp, Artificial sequence
  synthetic polynucleotide sequence
ccatgaggtcggtggtggaga

SEQ ID NO: 49220 - DNA, 21 bp, Artificial sequence
  synthetic polynucleotide sequence
gccttgaactcccggtccaga

SEQ ID NO: 49221 - DNA, 22 bp, Artificial sequence
  synthetic polynucleotide sequence
tgtaaagcccctggatcgagca

SEQ ID NO: 49222 - DNA, 22 bp, Artificial sequence
  synthetic polynucleotide sequence
gttgtcacacagaccagcaaga

SEQ ID NO: 49223 - DNA, 20 bp, Artificial sequence
  synthetic polynucleotide sequence
tggccctgtgacatgagcca

SEQ ID NO: 49224 - DNA, 21 bp, Artificial sequence
  synthetic polynucleotide sequence
tgtggcatatggaccacctca

SEQ ID NO: 49225 - DNA, 22 bp, Artificial sequence
  synthetic polynucleotide sequence
gactccactgcaaacctgccaa

SEQ ID NO: 49226 - DNA, 20 bp, Artificial sequence
  synthetic polynucleotide sequence
tactgaccattgaccccaga

SEQ ID NO: 49227 - DNA, 21 bp, Artificial sequence
  synthetic polynucleotide sequence
gtaaagcccctggatcgagca

SEQ ID NO: 49228 - DNA, 20 bp, Artificial sequence
  synthetic polynucleotide sequence
ggtcatgggctgcaactcga

SEQ ID NO: 49229 - DNA, 21 bp, Artificial sequence
  synthetic polynucleotide sequence
atgaagcccctggatcgagca

SEQ ID NO: 49230 - DNA, 20 bp, Artificial sequence
  synthetic polynucleotide sequence
cacagttgccacgcaggcca

SEQ ID NO: 49231 - DNA, 18 bp, Artificial sequence
  synthetic polynucleotide sequence
ccttgcccagatcccaca

SEQ ID NO: 49232 - DNA, 18 bp, Artificial sequence
  synthetic polynucleotide sequence
acaagggaatgcccacca

SEQ ID NO: 49233 - DNA, 22 bp, Artificial sequence
  synthetic polynucleotide sequence
agtaaagcccctgcatcgagca

SEQ ID NO: 49234 - DNA, 20 bp, Artificial sequence
  synthetic polynucleotide sequence
cacaggccagcagaaaccca

SEQ ID NO: 49235 - DNA, 18 bp, Artificial sequence
  synthetic polynucleotide sequence
aagccccttgatcgagca

SEQ ID NO: 49236 - DNA, 18 bp, Artificial sequence
  synthetic polynucleotide sequence
cgtgggctgcaacccgaa

SEQ ID NO: 49237 - DNA, 20 bp, Artificial sequence
  synthetic polynucleotide sequence
caatggggaaagctgacgta

SEQ ID NO: 49238 - DNA, 20 bp, Artificial sequence
  synthetic polynucleotide sequence
tactgaccattgaccccaga

SEQ ID NO: 49239 - DNA, 18 bp, Artificial sequence
  synthetic polynucleotide sequence
gactgggggagcgacgca

SEQ ID NO: 49240 - DNA, 18 bp, Artificial sequence
  synthetic polynucleotide sequence
acccagcagcttcccaca

SEQ ID NO: 49241 - DNA, 20 bp, Artificial sequence
  synthetic polynucleotide sequence
cagcagccctggcatgagca

SEQ ID NO: 49242 - DNA, 20 bp, Artificial sequence
  synthetic polynucleotide sequence
acgcagccaccagacagcca

SEQ ID NO: 49243 - DNA, 22 bp, Artificial sequence
  synthetic polynucleotide sequence
accagagtacaggcaaaaggca

SEQ ID NO: 49244 - DNA, 19 bp, Artificial sequence
  synthetic polynucleotide sequence
tcgattgacagggtgacca

SEQ ID NO: 49245 - DNA, 20 bp, Artificial sequence
  synthetic polynucleotide sequence
gcggctgtggcaggtacaga

SEQ ID NO: 49246 - DNA, 21 bp, Artificial sequence
  synthetic polynucleotide sequence
cggaaaccatactcggcggca

SEQ ID NO: 49247 - DNA, 19 bp, Artificial sequence
  synthetic polynucleotide sequence
ctcacggcccagcagagca

SEQ ID NO: 49248 - DNA, 20 bp, Artificial sequence
  synthetic polynucleotide sequence
agctgaacacctgtgcccga

SEQ ID NO: 49249 - DNA, 21 bp, Artificial sequence
  synthetic polynucleotide sequence
ccagctgcattgaagccccca

SEQ ID NO: 49250 - DNA, 22 bp, Artificial sequence
  synthetic polynucleotide sequence
atctctgcccaaactgaaggca

SEQ ID NO: 49251 - DNA, 21 bp, Artificial sequence
  synthetic polynucleotide sequence
attactggaggggcaatgcaa

SEQ ID NO: 49252 - DNA, 20 bp, Artificial sequence
  synthetic polynucleotide sequence
gtgtgtgctggggagaggca

SEQ ID NO: 49253 - DNA, 18 bp, Artificial sequence
  synthetic polynucleotide sequence
gcggatgaagtcgaccga

SEQ ID NO: 49254 - DNA, 20 bp, Artificial sequence
  synthetic polynucleotide sequence
gatcagctgaaggtgcacca

SEQ ID NO: 49255 - DNA, 20 bp, Artificial sequence
  synthetic polynucleotide sequence
cagtgggacagctgcccaga

SEQ ID NO: 49256 - DNA, 21 bp, Artificial sequence
  synthetic polynucleotide sequence
tgctgccacttcccctccaca

SEQ ID NO: 49257 - DNA, 19 bp, Artificial sequence
  synthetic polynucleotide sequence
cttgtgagcatgaagccca

SEQ ID NO: 49258 - DNA, 21 bp, Artificial sequence
  synthetic polynucleotide sequence
gtcatcttcttggctccagga

SEQ ID NO: 49259 - DNA, 22 bp, Artificial sequence
  synthetic polynucleotide sequence
cagctggagaattacacaccca

SEQ ID NO: 49260 - DNA, 22 bp, Artificial sequence
  synthetic polynucleotide sequence
aaagaggaggaagatctgccca

SEQ ID NO: 49261 - DNA, 19 bp, Artificial sequence
  synthetic polynucleotide sequence
ctgagagaggtggggcaga

SEQ ID NO: 49262 - DNA, 19 bp, Artificial sequence
  synthetic polynucleotide sequence
cgaagctgaactgccaaga

SEQ ID NO: 49263 - DNA, 20 bp, Artificial sequence
  synthetic polynucleotide sequence
gtcggctgccctggacgaga

SEQ ID NO: 49264 - DNA, 20 bp, Artificial sequence
  synthetic polynucleotide sequence
gtcggcctggtccgagagca

SEQ ID NO: 49265 - DNA, 22 bp, Artificial sequence
  synthetic polynucleotide sequence
atggagcgggaacacacagaca

SEQ ID NO: 49266 - DNA, 21 bp, Artificial sequence
  synthetic polynucleotide sequence
ccaccaccacactctcctgga

SEQ ID NO: 49267 - DNA, 18 bp, Artificial sequence
  synthetic polynucleotide sequence
cgtgtcccgggctgagga

SEQ ID NO: 49268 - DNA, 21 bp, Artificial sequence
  synthetic polynucleotide sequence
gctgaagccacttccagggca

SEQ ID NO: 49269 - DNA, 21 bp, Artificial sequence
  synthetic polynucleotide sequence
gctgccacgaatcctgggtga

SEQ ID NO: 49270 - DNA, 22 bp, Artificial sequence
  synthetic polynucleotide sequence
acgaggtgaagcactacaggca

SEQ ID NO: 49271 - DNA, 22 bp, Artificial sequence
  synthetic polynucleotide sequence
tcattaatggccgagctcctga

SEQ ID NO: 49272 - DNA, 22 bp, Artificial sequence
  synthetic polynucleotide sequence
ataggagagtaagtggtcggga

SEQ ID NO: 49273 - DNA, 18 bp, Artificial sequence
  synthetic polynucleotide sequence
ccaggacagatgcccaca

SEQ ID NO: 49274 - DNA, 18 bp, Artificial sequence
  synthetic polynucleotide sequence
ccggaacatctggacgga

SEQ ID NO: 49275 - DNA, 20 bp, Artificial sequence
  synthetic polynucleotide sequence
aggaccacgctgaggaacga

SEQ ID NO: 49276 - DNA, 21 bp, Artificial sequence
  synthetic polynucleotide sequence
gatgatggtgtaaacccccca

SEQ ID NO: 49277 - DNA, 21 bp, Artificial sequence
  synthetic polynucleotide sequence
gatgctgagacagttgggaga

SEQ ID NO: 49278 - DNA, 18 bp, Artificial sequence
  synthetic polynucleotide sequence
gctctgcacgtgcaccga

SEQ ID NO: 49279 - DNA, 19 bp, Artificial sequence
  synthetic polynucleotide sequence
ggcactacttccgcaacca

SEQ ID NO: 49280 - DNA, 21 bp, Artificial sequence
  synthetic polynucleotide sequence
ctgatcagctcctcggagaga

SEQ ID NO: 49281 - DNA, 18 bp, Artificial sequence
  synthetic polynucleotide sequence
gtggacatcagcgcagga

SEQ ID NO: 49282 - DNA, 18 bp, Artificial sequence
  synthetic polynucleotide sequence
actccaccgtagccccga

SEQ ID NO: 49283 - DNA, 19 bp, Artificial sequence
  synthetic polynucleotide sequence
tccagcagacctcagagca

SEQ ID NO: 49284 - DNA, 20 bp, Artificial sequence
  synthetic polynucleotide sequence
ccacgatctgagggtcggga

SEQ ID NO: 49285 - DNA, 20 bp, Artificial sequence
  synthetic polynucleotide sequence
atccctgaagctcgaggaga

SEQ ID NO: 49286 - DNA, 18 bp, Artificial sequence
  synthetic polynucleotide sequence
actgctggcacaccagga

SEQ ID NO: 49287 - DNA, 25 bp, Artificial sequence
  synthetic polynucleotide sequence
aatccatgggagggaaggagctaga

SEQ ID NO: 49288 - DNA, 20 bp, Artificial sequence
  synthetic polynucleotide sequence
gacgctgagctcatccagga

SEQ ID NO: 49289 - DNA, 21 bp, Artificial sequence
  synthetic polynucleotide sequence
tcaccgtgctggactacgaca

SEQ ID NO: 49290 - DNA, 20 bp, Artificial sequence
  synthetic polynucleotide sequence
gggtctgaggcacctcacca

SEQ ID NO: 49291 - DNA, 20 bp, Artificial sequence
  synthetic polynucleotide sequence
atgagatgatccgccgggca

SEQ ID NO: 49292 - DNA, 21 bp, Artificial sequence
  synthetic polynucleotide sequence
tgggccgcatggaggtaagca

SEQ ID NO: 49293 - DNA, 20 bp, Artificial sequence
  synthetic polynucleotide sequence
gtggctcaaggtggtggcaa

SEQ ID NO: 49294 - DNA, 21 bp, Artificial sequence
  synthetic polynucleotide sequence
acctcatacacccgctcccca

SEQ ID NO: 49295 - DNA, 20 bp, Artificial sequence
  synthetic polynucleotide sequence
ccttagtgcaggggaacgga

SEQ ID NO: 49296 - DNA, 22 bp, Artificial sequence
  synthetic polynucleotide sequence
tgaacaggtagagcatctgcca

SEQ ID NO: 49297 - DNA, 20 bp, Artificial sequence
  synthetic polynucleotide sequence
ccacaacctgcgcctatcca

SEQ ID NO: 49298 - DNA, 20 bp, Artificial sequence
  synthetic polynucleotide sequence
gcaagtaccgctgcgtgcca

SEQ ID NO: 49299 - DNA, 21 bp, Artificial sequence
  synthetic polynucleotide sequence
tcccactgtccatccgccaga

SEQ ID NO: 49300 - DNA, 20 bp, Artificial sequence
  synthetic polynucleotide sequence
agcttcccagaggtccagga

SEQ ID NO: 49301 - DNA, 21 bp, Artificial sequence
  synthetic polynucleotide sequence
cagcctgtgaacatcaaggca

SEQ ID NO: 49302 - DNA, 20 bp, Artificial sequence
  synthetic polynucleotide sequence
ctgagacgtcatgcagggca

SEQ ID NO: 49303 - DNA, 20 bp, Artificial sequence
  synthetic polynucleotide sequence
ctgaccaacgagcagcccca

SEQ ID NO: 49304 - DNA, 20 bp, Artificial sequence
  synthetic polynucleotide sequence
cagaaggagcggaaggggca

SEQ ID NO: 49305 - DNA, 23 bp, Artificial sequence
  synthetic polynucleotide sequence
caggaatcgtgaaggagctgaga

SEQ ID NO: 49306 - DNA, 25 bp, Artificial sequence
  synthetic polynucleotide sequence
gaggaaacaatgacaatgggccaca

SEQ ID NO: 49307 - DNA, 21 bp, Artificial sequence
  synthetic polynucleotide sequence
gagatccagtcctcggaagca

SEQ ID NO: 49308 - DNA, 20 bp, Artificial sequence
  synthetic polynucleotide sequence
ttgacactgagcgccgagga

SEQ ID NO: 49309 - DNA, 18 bp, Artificial sequence
  synthetic polynucleotide sequence
ccagggttctccagggca

SEQ ID NO: 49310 - DNA, 18 bp, Artificial sequence
  synthetic polynucleotide sequence
tggccagacggaaggtga

SEQ ID NO: 49311 - DNA, 21 bp, Artificial sequence
  synthetic polynucleotide sequence
aggtctcgcagtacacgggca

SEQ ID NO: 49312 - DNA, 21 bp, Artificial sequence
  synthetic polynucleotide sequence
cgaaggcaatgacgaagccca

SEQ ID NO: 49313 - DNA, 20 bp, Artificial sequence
  synthetic polynucleotide sequence
ggaggagatcgatctgcgca

SEQ ID NO: 49314 - DNA, 20 bp, Artificial sequence
  synthetic polynucleotide sequence
cacctcgaagccgctgtaga

SEQ ID NO: 49315 - DNA, 20 bp, Artificial sequence
  synthetic polynucleotide sequence
accaacttcaccggctggca

SEQ ID NO: 49316 - DNA, 20 bp, Artificial sequence
  synthetic polynucleotide sequence
ctcgaccaggtctaggcgca

SEQ ID NO: 49317 - DNA, 21 bp, Artificial sequence
  synthetic polynucleotide sequence
ggttcgtgcccatcaagccaa

SEQ ID NO: 49318 - DNA, 20 bp, Artificial sequence
  synthetic polynucleotide sequence
ttagccaggacacaactgca

SEQ ID NO: 49319 - DNA, 21 bp, Artificial sequence
  synthetic polynucleotide sequence
tggacaaggccgtgttccaca

SEQ ID NO: 49320 - DNA, 19 bp, Artificial sequence
  synthetic polynucleotide sequence
caggctggcagatggggca

SEQ ID NO: 49321 - DNA, 18 bp, Artificial sequence
  synthetic polynucleotide sequence
ggcgcaggaggccaagga

SEQ ID NO: 49322 - DNA, 18 bp, Artificial sequence
  synthetic polynucleotide sequence
ggtgctgacagggccgca

SEQ ID NO: 49323 - DNA, 18 bp, Artificial sequence
  synthetic polynucleotide sequence
cgagcacttcccgaacga

SEQ ID NO: 49324 - DNA, 18 bp, Artificial sequence
  synthetic polynucleotide sequence
agcagtccatcccggcta

SEQ ID NO: 49325 - DNA, 18 bp, Artificial sequence
  synthetic polynucleotide sequence
gcccgcttcatgaccaca

SEQ ID NO: 49326 - DNA, 18 bp, Artificial sequence
  synthetic polynucleotide sequence
gcatgggtggcatgacca

SEQ ID NO: 49327 - DNA, 22 bp, Artificial sequence
  synthetic polynucleotide sequence
tgtagccaacctcttagcagga

SEQ ID NO: 49328 - DNA, 19 bp, Artificial sequence
  synthetic polynucleotide sequence
gctcaggtgggtccaggga

SEQ ID NO: 49329 - DNA, 21 bp, Artificial sequence
  synthetic polynucleotide sequence
aggccatggagagactgggaa

SEQ ID NO: 49330 - DNA, 20 bp, Artificial sequence
  synthetic polynucleotide sequence
ctcggaagcgagctcctgga

SEQ ID NO: 49331 - DNA, 18 bp, Artificial sequence
  synthetic polynucleotide sequence
gagaggctgaagcggcaa

SEQ ID NO: 49332 - DNA, 18 bp, Artificial sequence
  synthetic polynucleotide sequence
agctgcatcgctggacga

SEQ ID NO: 49333 - DNA, 20 bp, Artificial sequence
  synthetic polynucleotide sequence
aggtgtgccctgaaacccca

SEQ ID NO: 49334 - DNA, 23 bp, Artificial sequence
  synthetic polynucleotide sequence
gccatgaaggaggaggtcagaga

SEQ ID NO: 49335 - DNA, 21 bp, Artificial sequence
  synthetic polynucleotide sequence
acaggctcatgctccaggaca

SEQ ID NO: 49336 - DNA, 21 bp, Artificial sequence
  synthetic polynucleotide sequence
tccaaaccaggcaacccccca

SEQ ID NO: 49337 - DNA, 21 bp, Artificial sequence
  synthetic polynucleotide sequence
agtccagcagagagatcccaa

SEQ ID NO: 49338 - DNA, 21 bp, Artificial sequence
  synthetic polynucleotide sequence
ccagggcaatgatgaagccca

SEQ ID NO: 49339 - DNA, 20 bp, Artificial sequence
  synthetic polynucleotide sequence
aacaagaagctggtgcagga

SEQ ID NO: 49340 - DNA, 19 bp, Artificial sequence
  synthetic polynucleotide sequence
gtaggagcagagagcccca

SEQ ID NO: 49341 - DNA, 21 bp, Artificial sequence
  synthetic polynucleotide sequence
atctgtgctgggacagacaga

SEQ ID NO: 49342 - DNA, 20 bp, Artificial sequence
  synthetic polynucleotide sequence
tgacatcgcagcaccgtgca

SEQ ID NO: 49343 - DNA, 20 bp, Artificial sequence
  synthetic polynucleotide sequence
gagcagctgcgacctggcga

SEQ ID NO: 49344 - DNA, 20 bp, Artificial sequence
  synthetic polynucleotide sequence
agagtccagctcggccggca

SEQ ID NO: 49345 - DNA, 18 bp, Artificial sequence
  synthetic polynucleotide sequence
gccgctgccctctggaga

SEQ ID NO: 49346 - DNA, 21 bp, Artificial sequence
  synthetic polynucleotide sequence
tcggagaatggggcttcagga

SEQ ID NO: 49347 - DNA, 21 bp, Artificial sequence
  synthetic polynucleotide sequence
aggaatggccagtggacgaga

SEQ ID NO: 49348 - DNA, 20 bp, Artificial sequence
  synthetic polynucleotide sequence
cacaggcctcaggctctgca

SEQ ID NO: 49349 - DNA, 20 bp, Artificial sequence
  synthetic polynucleotide sequence
gacccaaggagcagggagga

SEQ ID NO: 49350 - DNA, 18 bp, Artificial sequence
  synthetic polynucleotide sequence
cgccttcgccgccaacca

SEQ ID NO: 49351 - DNA, 18 bp, Artificial sequence
  synthetic polynucleotide sequence
cgcgacgttgacttcgaa

SEQ ID NO: 49352 - DNA, 21 bp, Artificial sequence
  synthetic polynucleotide sequence
cccctcgttgatgtggtcgta

SEQ ID NO: 49353 - DNA, 18 bp, Artificial sequence
  synthetic polynucleotide sequence
gtcccgacggcctacaca

SEQ ID NO: 49354 - DNA, 22 bp, Artificial sequence
  synthetic polynucleotide sequence
atgtaaggtacccagtccagga

SEQ ID NO: 49355 - DNA, 21 bp, Artificial sequence
  synthetic polynucleotide sequence
tgcctaaagagcagtggacca

SEQ ID NO: 49356 - DNA, 21 bp, Artificial sequence
  synthetic polynucleotide sequence
cataacagctgcatccacaga

SEQ ID NO: 49357 - DNA, 18 bp, Artificial sequence
  synthetic polynucleotide sequence
cccctggctgaatgggaa

SEQ ID NO: 49358 - DNA, 18 bp, Artificial sequence
  synthetic polynucleotide sequence
agctgctcaatggggcca

SEQ ID NO: 49359 - DNA, 20 bp, Artificial sequence
  synthetic polynucleotide sequence
atactatctcccaggccaca

SEQ ID NO: 49360 - DNA, 22 bp, Artificial sequence
  synthetic polynucleotide sequence
aaccagcaactagagcctggga

SEQ ID NO: 49361 - DNA, 21 bp, Artificial sequence
  synthetic polynucleotide sequence
gaaattgagcaggaagctgca

SEQ ID NO: 49362 - DNA, 19 bp, Artificial sequence
  synthetic polynucleotide sequence
tgcaatgggtacacagcca

SEQ ID NO: 49363 - DNA, 22 bp, Artificial sequence
  synthetic polynucleotide sequence
gagagcaatgcgagcagttgga

SEQ ID NO: 49364 - DNA, 21 bp, Artificial sequence
  synthetic polynucleotide sequence
gtcaaagagctcctccgtgca

SEQ ID NO: 49365 - DNA, 21 bp, Artificial sequence
  synthetic polynucleotide sequence
agagcaatgcgagcagttgga

SEQ ID NO: 49366 - DNA, 21 bp, Artificial sequence
  synthetic polynucleotide sequence
gtcaaagagctcctccgtgca

SEQ ID NO: 49367 - DNA, 18 bp, Artificial sequence
  synthetic polynucleotide sequence
cgcggatgcggcatgtga

SEQ ID NO: 49368 - DNA, 18 bp, Artificial sequence
  synthetic polynucleotide sequence
aactgcggcaccacgcga

SEQ ID NO: 49369 - DNA, 21 bp, Artificial sequence
  synthetic polynucleotide sequence
aggagcctgtggactcagcca

SEQ ID NO: 49370 - DNA, 21 bp, Artificial sequence
  synthetic polynucleotide sequence
aggaggtcagccacgaccaca

SEQ ID NO: 49371 - DNA, 18 bp, Artificial sequence
  synthetic polynucleotide sequence
cacgctcttggaagccga

SEQ ID NO: 49372 - DNA, 20 bp, Artificial sequence
  synthetic polynucleotide sequence
aaacaccctggtagagggca

SEQ ID NO: 49373 - DNA, 22 bp, Artificial sequence
  synthetic polynucleotide sequence
aagtccacactcctcaacacca

SEQ ID NO: 49374 - DNA, 21 bp, Artificial sequence
  synthetic polynucleotide sequence
atctgtccccagctgacgtca

SEQ ID NO: 49375 - DNA, 22 bp, Artificial sequence
  synthetic polynucleotide sequence
aaatgagcgatgctgcaggtga

SEQ ID NO: 49376 - DNA, 19 bp, Artificial sequence
  synthetic polynucleotide sequence
tcttcaagtcgagcccaca

SEQ ID NO: 49377 - DNA, 21 bp, Artificial sequence
  synthetic polynucleotide sequence
aacgatgccgactgggagcta

SEQ ID NO: 49378 - DNA, 19 bp, Artificial sequence
  synthetic polynucleotide sequence
gtgcctgaggagaggccca

SEQ ID NO: 49379 - DNA, 20 bp, Artificial sequence
  synthetic polynucleotide sequence
ccggtggtcctgagccgaga

SEQ ID NO: 49380 - DNA, 21 bp, Artificial sequence
  synthetic polynucleotide sequence
ccacgaagttctgcacagcca

SEQ ID NO: 49381 - DNA, 18 bp, Artificial sequence
  synthetic polynucleotide sequence
ccgtgatgtggccaagca

SEQ ID NO: 49382 - DNA, 20 bp, Artificial sequence
  synthetic polynucleotide sequence
gcccaaccacctcatagcca

SEQ ID NO: 49383 - DNA, 21 bp, Artificial sequence
  synthetic polynucleotide sequence
cagagcagtggaagcagcaga

SEQ ID NO: 49384 - DNA, 22 bp, Artificial sequence
  synthetic polynucleotide sequence
atagaagaggcagtgctgagga

SEQ ID NO: 49385 - DNA, 20 bp, Artificial sequence
  synthetic polynucleotide sequence
gccaaggaggagttcctgga

SEQ ID NO: 49386 - DNA, 20 bp, Artificial sequence
  synthetic polynucleotide sequence
gaggatccagtggtggcgca

SEQ ID NO: 49387 - DNA, 25 bp, Artificial sequence
  synthetic polynucleotide sequence
agaacctggagaaactgaagacgga

SEQ ID NO: 49388 - DNA, 22 bp, Artificial sequence
  synthetic polynucleotide sequence
ataatgagcatggcccagagca

SEQ ID NO: 49389 - DNA, 22 bp, Artificial sequence
  synthetic polynucleotide sequence
agaactgcagggacttgaccaa

SEQ ID NO: 49390 - DNA, 21 bp, Artificial sequence
  synthetic polynucleotide sequence
ctctaatccgtggtgccgcaa

SEQ ID NO: 49391 - DNA, 22 bp, Artificial sequence
  synthetic polynucleotide sequence
taccagttccgcacagagacaa

SEQ ID NO: 49392 - DNA, 20 bp, Artificial sequence
  synthetic polynucleotide sequence
acacgacgctgacggcgcca

SEQ ID NO: 49393 - DNA, 20 bp, Artificial sequence
  synthetic polynucleotide sequence
agtcatgccaccaagggcca

SEQ ID NO: 49394 - DNA, 20 bp, Artificial sequence
  synthetic polynucleotide sequence
cagcagggccttgatcgcca

SEQ ID NO: 49395 - DNA, 22 bp, Artificial sequence
  synthetic polynucleotide sequence
gagatcatggcaatcaacggca

SEQ ID NO: 49396 - DNA, 21 bp, Artificial sequence
  synthetic polynucleotide sequence
ggcaaccacaaggtcgatcca

SEQ ID NO: 49397 - DNA, 19 bp, Artificial sequence
  synthetic polynucleotide sequence
ggccacccccaagtgccga

SEQ ID NO: 49398 - DNA, 20 bp, Artificial sequence
  synthetic polynucleotide sequence
ggtacagtggtgggagcaca

SEQ ID NO: 49399 - DNA, 22 bp, Artificial sequence
  synthetic polynucleotide sequence
ttcagtgtgacacctgcagaga

SEQ ID NO: 49400 - DNA, 20 bp, Artificial sequence
  synthetic polynucleotide sequence
gttgcaaggcagacagagga

SEQ ID NO: 49401 - DNA, 21 bp, Artificial sequence
  synthetic polynucleotide sequence
gcaggaagagcaacgccggaa

SEQ ID NO: 49402 - DNA, 18 bp, Artificial sequence
  synthetic polynucleotide sequence
caagctggggaggcggga

SEQ ID NO: 49403 - DNA, 18 bp, Artificial sequence
  synthetic polynucleotide sequence
ccagaaagtgatgcgcaa

SEQ ID NO: 49404 - DNA, 19 bp, Artificial sequence
  synthetic polynucleotide sequence
agcttctccaggcatggga

SEQ ID NO: 49405 - DNA, 21 bp, Artificial sequence
  synthetic polynucleotide sequence
agcacacagaagccgagacga

SEQ ID NO: 49406 - DNA, 20 bp, Artificial sequence
  synthetic polynucleotide sequence
atacccacttccaagcggta

SEQ ID NO: 49407 - DNA, 22 bp, Artificial sequence
  synthetic polynucleotide sequence
gaaacaaggaatccagtgacca

SEQ ID NO: 49408 - DNA, 20 bp, Artificial sequence
  synthetic polynucleotide sequence
aaagcaaccacttcccctca

SEQ ID NO: 49409 - DNA, 21 bp, Artificial sequence
  synthetic polynucleotide sequence
ccttcctgtcagccagcccaa

SEQ ID NO: 49410 - DNA, 22 bp, Artificial sequence
  synthetic polynucleotide sequence
tacaggatcctctgaaaccgga

SEQ ID NO: 49411 - DNA, 18 bp, Artificial sequence
  synthetic polynucleotide sequence
caacaaggacagcggcca

SEQ ID NO: 49412 - DNA, 18 bp, Artificial sequence
  synthetic polynucleotide sequence
ctcagagctgggtgggga

SEQ ID NO: 49413 - DNA, 20 bp, Artificial sequence
  synthetic polynucleotide sequence
acaggaagcacacaaacgga

SEQ ID NO: 49414 - DNA, 22 bp, Artificial sequence
  synthetic polynucleotide sequence
attgggaccacttccacagtga

SEQ ID NO: 49415 - DNA, 19 bp, Artificial sequence
  synthetic polynucleotide sequence
ccagacatcagccccccca

SEQ ID NO: 49416 - DNA, 20 bp, Artificial sequence
  synthetic polynucleotide sequence
caggcatggtcagcggctca

SEQ ID NO: 49417 - DNA, 21 bp, Artificial sequence
  synthetic polynucleotide sequence
gccgagaaaggtgaacaagga

SEQ ID NO: 49418 - DNA, 20 bp, Artificial sequence
  synthetic polynucleotide sequence
gctgccgatgcagatgagga

SEQ ID NO: 49419 - DNA, 22 bp, Artificial sequence
  synthetic polynucleotide sequence
gaaaggggacacctggtaccta

SEQ ID NO: 49420 - DNA, 20 bp, Artificial sequence
  synthetic polynucleotide sequence
taagtgactgggcatcacca

SEQ ID NO: 49421 - DNA, 18 bp, Artificial sequence
  synthetic polynucleotide sequence
ccaaggcaagaaccgcaa

SEQ ID NO: 49422 - DNA, 19 bp, Artificial sequence
  synthetic polynucleotide sequence
tgtaggcacagcttgcaca

SEQ ID NO: 49423 - DNA, 20 bp, Artificial sequence
  synthetic polynucleotide sequence
ggccaggagatccaaaggga

SEQ ID NO: 49424 - DNA, 21 bp, Artificial sequence
  synthetic polynucleotide sequence
cttccactgagaccactggca

SEQ ID NO: 49425 - DNA, 22 bp, Artificial sequence
  synthetic polynucleotide sequence
cgctgaagacacagacaggcca

SEQ ID NO: 49426 - DNA, 20 bp, Artificial sequence
  synthetic polynucleotide sequence
actcgggtacctggaggcaa

SEQ ID NO: 49427 - DNA, 20 bp, Artificial sequence
  synthetic polynucleotide sequence
agtgccgtgacatgcagcca

SEQ ID NO: 49428 - DNA, 21 bp, Artificial sequence
  synthetic polynucleotide sequence
caggacagaggtgatgccaga

SEQ ID NO: 49429 - DNA, 18 bp, Artificial sequence
  synthetic polynucleotide sequence
gcacgtgggaatggcaga

SEQ ID NO: 49430 - DNA, 21 bp, Artificial sequence
  synthetic polynucleotide sequence
gatgtcttcccaggacaccaa

SEQ ID NO: 49431 - DNA, 20 bp, Artificial sequence
  synthetic polynucleotide sequence
ccactggagctgggtgacga

SEQ ID NO: 49432 - DNA, 21 bp, Artificial sequence
  synthetic polynucleotide sequence
gcagagcctggatcctcagca

SEQ ID NO: 49433 - DNA, 20 bp, Artificial sequence
  synthetic polynucleotide sequence
ctgggacctctcactgccca

SEQ ID NO: 49434 - DNA, 21 bp, Artificial sequence
  synthetic polynucleotide sequence
agaaccgcttcagatggagca

SEQ ID NO: 49435 - DNA, 21 bp, Artificial sequence
  synthetic polynucleotide sequence
ccaagcgcaggaggatcgaga

SEQ ID NO: 49436 - DNA, 19 bp, Artificial sequence
  synthetic polynucleotide sequence
cctcccactcccggaacca

SEQ ID NO: 49437 - DNA, 18 bp, Artificial sequence
  synthetic polynucleotide sequence
gccagtgacaaagccgga

SEQ ID NO: 49438 - DNA, 18 bp, Artificial sequence
  synthetic polynucleotide sequence
accagtctggcaccggca

SEQ ID NO: 49439 - DNA, 20 bp, Artificial sequence
  synthetic polynucleotide sequence
ctgtgagatgcagagcccca

SEQ ID NO: 49440 - DNA, 18 bp, Artificial sequence
  synthetic polynucleotide sequence
tcgcgtgggtccacacca

SEQ ID NO: 49441 - DNA, 20 bp, Artificial sequence
  synthetic polynucleotide sequence
agtagccctgcatgcgggaa

SEQ ID NO: 49442 - DNA, 20 bp, Artificial sequence
  synthetic polynucleotide sequence
gatcacaggcaacccggcga

SEQ ID NO: 49443 - DNA, 20 bp, Artificial sequence
  synthetic polynucleotide sequence
caggcattgggaagaccaga

SEQ ID NO: 49444 - DNA, 18 bp, Artificial sequence
  synthetic polynucleotide sequence
cgtttgggaccggaacca

SEQ ID NO: 49445 - DNA, 20 bp, Artificial sequence
  synthetic polynucleotide sequence
catggcaatgcacagaacga

SEQ ID NO: 49446 - DNA, 21 bp, Artificial sequence
  synthetic polynucleotide sequence
gaaaacccactggtgtcagga

SEQ ID NO: 49447 - DNA, 21 bp, Artificial sequence
  synthetic polynucleotide sequence
gtctccaccacgatagaccca

SEQ ID NO: 49448 - DNA, 21 bp, Artificial sequence
  synthetic polynucleotide sequence
acctccgcaagcagtccgtga

SEQ ID NO: 49449 - DNA, 20 bp, Artificial sequence
  synthetic polynucleotide sequence
atgaaggtggctcaagcgaa

SEQ ID NO: 49450 - DNA, 18 bp, Artificial sequence
  synthetic polynucleotide sequence
cccttcatcagcagggca

SEQ ID NO: 49451 - DNA, 18 bp, Artificial sequence
  synthetic polynucleotide sequence
tgcaagccaagagcagca

SEQ ID NO: 49452 - DNA, 20 bp, Artificial sequence
  synthetic polynucleotide sequence
gtccatcagtgagtcagcca

SEQ ID NO: 49453 - DNA, 20 bp, Artificial sequence
  synthetic polynucleotide sequence
gtgtccacacctgagctcca

SEQ ID NO: 49454 - DNA, 18 bp, Artificial sequence
  synthetic polynucleotide sequence
ggaccggcacacgctgca

SEQ ID NO: 49455 - DNA, 19 bp, Artificial sequence
  synthetic polynucleotide sequence
gaatggcgcctgctcccca

SEQ ID NO: 49456 - DNA, 19 bp, Artificial sequence
  synthetic polynucleotide sequence
tgcggacagtgtcatcgga

SEQ ID NO: 49457 - DNA, 22 bp, Artificial sequence
  synthetic polynucleotide sequence
aagagcagcttgtcaccaagga

SEQ ID NO: 49458 - DNA, 19 bp, Artificial sequence
  synthetic polynucleotide sequence
tttgagaaggccgtgcaga

SEQ ID NO: 49459 - DNA, 22 bp, Artificial sequence
  synthetic polynucleotide sequence
ctaacatcatcagcagcccgaa

SEQ ID NO: 49460 - DNA, 21 bp, Artificial sequence
  synthetic polynucleotide sequence
tcacatatctgcccagcccca

SEQ ID NO: 49461 - DNA, 19 bp, Artificial sequence
  synthetic polynucleotide sequence
tgtggaggactagctcgaa

SEQ ID NO: 49462 - DNA, 22 bp, Artificial sequence
  synthetic polynucleotide sequence
atcctgctgagaatacccccga

SEQ ID NO: 49463 - DNA, 20 bp, Artificial sequence
  synthetic polynucleotide sequence
cgactggtggccaatgcaga

SEQ ID NO: 49464 - DNA, 21 bp, Artificial sequence
  synthetic polynucleotide sequence
cgagtgacacatgaacgacca

SEQ ID NO: 49465 - DNA, 20 bp, Artificial sequence
  synthetic polynucleotide sequence
tagagtccggacagagccca

SEQ ID NO: 49466 - DNA, 21 bp, Artificial sequence
  synthetic polynucleotide sequence
ttcatcaaagcccctccccca

SEQ ID NO: 49467 - DNA, 21 bp, Artificial sequence
  synthetic polynucleotide sequence
accaggacccacttcggcaca

SEQ ID NO: 49468 - DNA, 19 bp, Artificial sequence
  synthetic polynucleotide sequence
cagctgctggactcgggga

SEQ ID NO: 49469 - DNA, 21 bp, Artificial sequence
  synthetic polynucleotide sequence
tagcagagctggatccaagga

SEQ ID NO: 49470 - DNA, 22 bp, Artificial sequence
  synthetic polynucleotide sequence
agaaagaggaactggctgagga

SEQ ID NO: 49471 - DNA, 20 bp, Artificial sequence
  synthetic polynucleotide sequence
gcacgataccaccggccaga

SEQ ID NO: 49472 - DNA, 20 bp, Artificial sequence
  synthetic polynucleotide sequence
gaaggtcgctcagtcgggca

SEQ ID NO: 49473 - DNA, 18 bp, Artificial sequence
  synthetic polynucleotide sequence
ggcacatgtgtctcccca

SEQ ID NO: 49474 - DNA, 18 bp, Artificial sequence
  synthetic polynucleotide sequence
tcctcatggacccctgga

SEQ ID NO: 49475 - DNA, 19 bp, Artificial sequence
  synthetic polynucleotide sequence
ttcagcaaggcagacacca

SEQ ID NO: 49476 - DNA, 21 bp, Artificial sequence
  synthetic polynucleotide sequence
acctgaccctggtatagccca

SEQ ID NO: 49477 - DNA, 20 bp, Artificial sequence
  synthetic polynucleotide sequence
ctgggaacgagcctgcgcaa

SEQ ID NO: 49478 - DNA, 20 bp, Artificial sequence
  synthetic polynucleotide sequence
ggacgggacaccgaactcca

SEQ ID NO: 49479 - DNA, 20 bp, Artificial sequence
  synthetic polynucleotide sequence
gaggagcagtctggagggca

SEQ ID NO: 49480 - DNA, 20 bp, Artificial sequence
  synthetic polynucleotide sequence
tccatccacagcattccgga

SEQ ID NO: 49481 - DNA, 20 bp, Artificial sequence
  synthetic polynucleotide sequence
aggagcaagactgagggcca

SEQ ID NO: 49482 - DNA, 20 bp, Artificial sequence
  synthetic polynucleotide sequence
tagaacttctcccggcccca

SEQ ID NO: 49483 - DNA, 21 bp, Artificial sequence
  synthetic polynucleotide sequence
tccctcggctcaacccaacca

SEQ ID NO: 49484 - DNA, 20 bp, Artificial sequence
  synthetic polynucleotide sequence
ctcatgctccactgaaggca

SEQ ID NO: 49485 - DNA, 22 bp, Artificial sequence
  synthetic polynucleotide sequence
caaacgccagcatcaccagcaa

SEQ ID NO: 49486 - DNA, 20 bp, Artificial sequence
  synthetic polynucleotide sequence
ctcgctagcagtcatagcca

SEQ ID NO: 49487 - DNA, 21 bp, Artificial sequence
  synthetic polynucleotide sequence
tggctcgatgagagaaggcca

SEQ ID NO: 49488 - DNA, 19 bp, Artificial sequence
  synthetic polynucleotide sequence
ggacccactggcctgctga

SEQ ID NO: 49489 - DNA, 22 bp, Artificial sequence
  synthetic polynucleotide sequence
aaggttggcgtcatcccaccaa

SEQ ID NO: 49490 - DNA, 21 bp, Artificial sequence
  synthetic polynucleotide sequence
tcctcctgaaggatgtccgca

SEQ ID NO: 49491 - DNA, 21 bp, Artificial sequence
  synthetic polynucleotide sequence
gacggtggaagccttcagaga

SEQ ID NO: 49492 - DNA, 20 bp, Artificial sequence
  synthetic polynucleotide sequence
atgaccgcaccatcatcaca

SEQ ID NO: 49493 - DNA, 22 bp, Artificial sequence
  synthetic polynucleotide sequence
tgatcccaactgtgagaggaga

SEQ ID NO: 49494 - DNA, 19 bp, Artificial sequence
  synthetic polynucleotide sequence
tggatgccgtctcccagca

SEQ ID NO: 49495 - DNA, 20 bp, Artificial sequence
  synthetic polynucleotide sequence
accaacagctcggccacgga

SEQ ID NO: 49496 - DNA, 20 bp, Artificial sequence
  synthetic polynucleotide sequence
ggatgagctccagactccga

SEQ ID NO: 49497 - DNA, 20 bp, Artificial sequence
  synthetic polynucleotide sequence
cttgaaagcgctgcgggcca

SEQ ID NO: 49498 - DNA, 21 bp, Artificial sequence
  synthetic polynucleotide sequence
cacacatggtagaggtgccca

SEQ ID NO: 49499 - DNA, 22 bp, Artificial sequence
  synthetic polynucleotide sequence
ctgagacatccatcatcaccca

SEQ ID NO: 49500 - DNA, 25 bp, Artificial sequence
  synthetic polynucleotide sequence
atggggagtgagaagacagtgaaga

SEQ ID NO: 49501 - DNA, 21 bp, Artificial sequence
  synthetic polynucleotide sequence
gcaggaggccaataaccccaa

SEQ ID NO: 49502 - DNA, 21 bp, Artificial sequence
  synthetic polynucleotide sequence
atgtggcacaagagccaggca

SEQ ID NO: 49503 - DNA, 21 bp, Artificial sequence
  synthetic polynucleotide sequence
acaggtgtagggaaaggacca

SEQ ID NO: 49504 - DNA, 19 bp, Artificial sequence
  synthetic polynucleotide sequence
tggggcaggaggtgatcca

SEQ ID NO: 49505 - DNA, 20 bp, Artificial sequence
  synthetic polynucleotide sequence
aactaccagagcctccccca

SEQ ID NO: 49506 - DNA, 21 bp, Artificial sequence
  synthetic polynucleotide sequence
ctccaggactgagtgtgagga

SEQ ID NO: 49507 - DNA, 21 bp, Artificial sequence
  synthetic polynucleotide sequence
cccaaatggtgggacagtcca

SEQ ID NO: 49508 - DNA, 20 bp, Artificial sequence
  synthetic polynucleotide sequence
gaaggcagcctaacgaggca

SEQ ID NO: 49509 - DNA, 20 bp, Artificial sequence
  synthetic polynucleotide sequence
cgggcaattcagggtcacca

SEQ ID NO: 49510 - DNA, 20 bp, Artificial sequence
  synthetic polynucleotide sequence
cagggaggccatggtcctga

SEQ ID NO: 49511 - DNA, 21 bp, Artificial sequence
  synthetic polynucleotide sequence
ttggggagaaagcatcaggga

SEQ ID NO: 49512 - DNA, 22 bp, Artificial sequence
  synthetic polynucleotide sequence
aaatgcgccactgtgacaagca

SEQ ID NO: 49513 - DNA, 19 bp, Artificial sequence
  synthetic polynucleotide sequence
ggggaggatcgtaccagga

SEQ ID NO: 49514 - DNA, 20 bp, Artificial sequence
  synthetic polynucleotide sequence
gagttggaggggtggaagga

SEQ ID NO: 49515 - DNA, 20 bp, Artificial sequence
  synthetic polynucleotide sequence
taggtgtggcagagaagaca

SEQ ID NO: 49516 - DNA, 23 bp, Artificial sequence
  synthetic polynucleotide sequence
caaaaggattgggaagaggagga

SEQ ID NO: 49517 - DNA, 20 bp, Artificial sequence
  synthetic polynucleotide sequence
ctccagaggaacaagggcaa

SEQ ID NO: 49518 - DNA, 19 bp, Artificial sequence
  synthetic polynucleotide sequence
gcaaaacaggaaccaccca

SEQ ID NO: 49519 - DNA, 21 bp, Artificial sequence
  synthetic polynucleotide sequence
cctcctcccatcagtaagcca

SEQ ID NO: 49520 - DNA, 20 bp, Artificial sequence
  synthetic polynucleotide sequence
catgagcatgtgggtgggca

SEQ ID NO: 49521 - DNA, 21 bp, Artificial sequence
  synthetic polynucleotide sequence
caaagacccagagcacaggaa

SEQ ID NO: 49522 - DNA, 20 bp, Artificial sequence
  synthetic polynucleotide sequence
ggatctgcacagcctcagga

SEQ ID NO: 49523 - DNA, 20 bp, Artificial sequence
  synthetic polynucleotide sequence
cacctgggcgacatcgcgaa

SEQ ID NO: 49524 - DNA, 21 bp, Artificial sequence
  synthetic polynucleotide sequence
cgctgcccagaatgaagccca

SEQ ID NO: 49525 - DNA, 21 bp, Artificial sequence
  synthetic polynucleotide sequence
gccctgatgcccctaaggaga

SEQ ID NO: 49526 - DNA, 20 bp, Artificial sequence
  synthetic polynucleotide sequence
gccccagccaggtagtgtca

SEQ ID NO: 49527 - DNA, 21 bp, Artificial sequence
  synthetic polynucleotide sequence
agcagtcagagaggaccccaa

SEQ ID NO: 49528 - DNA, 21 bp, Artificial sequence
  synthetic polynucleotide sequence
aactgccaaagacctcacgga

SEQ ID NO: 49529 - DNA, 20 bp, Artificial sequence
  synthetic polynucleotide sequence
gcatgggcagccagtggaga

SEQ ID NO: 49530 - DNA, 21 bp, Artificial sequence
  synthetic polynucleotide sequence
cataacgacctcctgctgaca

SEQ ID NO: 49531 - DNA, 21 bp, Artificial sequence
  synthetic polynucleotide sequence
tgccccttcatcccagcggaa

SEQ ID NO: 49532 - DNA, 20 bp, Artificial sequence
  synthetic polynucleotide sequence
ctcgacgtcgccgaagacca

SEQ ID NO: 49533 - DNA, 19 bp, Artificial sequence
  synthetic polynucleotide sequence
cagtagccccagcaccaga

SEQ ID NO: 49534 - DNA, 18 bp, Artificial sequence
  synthetic polynucleotide sequence
ctcagatgcagcagccga

SEQ ID NO: 49535 - DNA, 19 bp, Artificial sequence
  synthetic polynucleotide sequence
gagtccgcgagccgtacca

SEQ ID NO: 49536 - DNA, 19 bp, Artificial sequence
  synthetic polynucleotide sequence
cacagctgcgtctccccca

SEQ ID NO: 49537 - DNA, 21 bp, Artificial sequence
  synthetic polynucleotide sequence
gggagctccgtgcaaagtgaa

SEQ ID NO: 49538 - DNA, 20 bp, Artificial sequence
  synthetic polynucleotide sequence
gccggcctcgggacttggaa

SEQ ID NO: 49539 - DNA, 18 bp, Artificial sequence
  synthetic polynucleotide sequence
gtcatccggaggcgcaca

SEQ ID NO: 49540 - DNA, 18 bp, Artificial sequence
  synthetic polynucleotide sequence
ggtggtgggagctgagca

SEQ ID NO: 49541 - DNA, 19 bp, Artificial sequence
  synthetic polynucleotide sequence
ttgtgcacctgaaacccca

SEQ ID NO: 49542 - DNA, 20 bp, Artificial sequence
  synthetic polynucleotide sequence
ctgagtcggcacctatgaca

SEQ ID NO: 49543 - DNA, 19 bp, Artificial sequence
  synthetic polynucleotide sequence
gctggaagcccgtgggaga

SEQ ID NO: 49544 - DNA, 22 bp, Artificial sequence
  synthetic polynucleotide sequence
aggtcatctagctggcgagaca

SEQ ID NO: 49545 - DNA, 20 bp, Artificial sequence
  synthetic polynucleotide sequence
gacgcgcgcttaactccgga

SEQ ID NO: 49546 - DNA, 20 bp, Artificial sequence
  synthetic polynucleotide sequence
tgcacccagcatctctggca

SEQ ID NO: 49547 - DNA, 20 bp, Artificial sequence
  synthetic polynucleotide sequence
aaggtggtgacccccctgga

SEQ ID NO: 49548 - DNA, 20 bp, Artificial sequence
  synthetic polynucleotide sequence
ggcggatcagcaggttgaga

SEQ ID NO: 49549 - DNA, 20 bp, Artificial sequence
  synthetic polynucleotide sequence
agcccagtatcaccaggcaa

SEQ ID NO: 49550 - DNA, 21 bp, Artificial sequence
  synthetic polynucleotide sequence
caggagaggtgactgtcagca

SEQ ID NO: 49551 - DNA, 18 bp, Artificial sequence
  synthetic polynucleotide sequence
aaacggaggccacgcgaa

SEQ ID NO: 49552 - DNA, 18 bp, Artificial sequence
  synthetic polynucleotide sequence
actcgcctggaagctgga

SEQ ID NO: 49553 - DNA, 21 bp, Artificial sequence
  synthetic polynucleotide sequence
aaggcagggggaagaagagga

SEQ ID NO: 49554 - DNA, 19 bp, Artificial sequence
  synthetic polynucleotide sequence
gctgccactaccctccgca

SEQ ID NO: 49555 - DNA, 18 bp, Artificial sequence
  synthetic polynucleotide sequence
gaagtgcgagtggccaga

SEQ ID NO: 49556 - DNA, 18 bp, Artificial sequence
  synthetic polynucleotide sequence
cctggagcgcctgcagga

SEQ ID NO: 49557 - DNA, 20 bp, Artificial sequence
  synthetic polynucleotide sequence
caggaagctaagcactcgga

SEQ ID NO: 49558 - DNA, 21 bp, Artificial sequence
  synthetic polynucleotide sequence
gtgaggagagagctcttacga

SEQ ID NO: 49559 - DNA, 21 bp, Artificial sequence
  synthetic polynucleotide sequence
acctcaagttcgcctcgacca

SEQ ID NO: 49560 - DNA, 20 bp, Artificial sequence
  synthetic polynucleotide sequence
gttctgggtgaggaagcaga

SEQ ID NO: 49561 - DNA, 20 bp, Artificial sequence
  synthetic polynucleotide sequence
ggacagaagggactgcccca

SEQ ID NO: 49562 - DNA, 21 bp, Artificial sequence
  synthetic polynucleotide sequence
tgatgtccaccacctcctcca

SEQ ID NO: 49563 - DNA, 20 bp, Artificial sequence
  synthetic polynucleotide sequence
aggagactgcagcagaccca

SEQ ID NO: 49564 - DNA, 20 bp, Artificial sequence
  synthetic polynucleotide sequence
gcacggtcgtccagctccga

SEQ ID NO: 49565 - DNA, 22 bp, Artificial sequence
  synthetic polynucleotide sequence
acaaggttctggaaagagacca

SEQ ID NO: 49566 - DNA, 18 bp, Artificial sequence
  synthetic polynucleotide sequence
gagaagcgcctgcctgca

SEQ ID NO: 49567 - DNA, 22 bp, Artificial sequence
  synthetic polynucleotide sequence
ggtaattgagagaggggagaga

SEQ ID NO: 49568 - DNA, 18 bp, Artificial sequence
  synthetic polynucleotide sequence
tgcatccacgccaccaca

SEQ ID NO: 49569 - DNA, 19 bp, Artificial sequence
  synthetic polynucleotide sequence
gcagcagcgttcagaccaa

SEQ ID NO: 49570 - DNA, 21 bp, Artificial sequence
  synthetic polynucleotide sequence
caatcaggatgatgagcagga

SEQ ID NO: 49571 - DNA, 20 bp, Artificial sequence
  synthetic polynucleotide sequence
acggttcaagagcacagaca

SEQ ID NO: 49572 - DNA, 21 bp, Artificial sequence
  synthetic polynucleotide sequence
ttcagctgtgcagctaagaca

SEQ ID NO: 49573 - DNA, 20 bp, Artificial sequence
  synthetic polynucleotide sequence
gtgcggaacctgcaaagtga

SEQ ID NO: 49574 - DNA, 18 bp, Artificial sequence
  synthetic polynucleotide sequence
gggccaggatccgctcca

SEQ ID NO: 49575 - DNA, 18 bp, Artificial sequence
  synthetic polynucleotide sequence
caacggcatgacccccaa

SEQ ID NO: 49576 - DNA, 20 bp, Artificial sequence
  synthetic polynucleotide sequence
acgaggctgaagtccaagca

SEQ ID NO: 49577 - DNA, 21 bp, Artificial sequence
  synthetic polynucleotide sequence
cacgcatgacatgacgcccaa

SEQ ID NO: 49578 - DNA, 18 bp, Artificial sequence
  synthetic polynucleotide sequence
ccggctcctcgctcacca

SEQ ID NO: 49579 - DNA, 19 bp, Artificial sequence
  synthetic polynucleotide sequence
tcaaaggccccttcacaga

SEQ ID NO: 49580 - DNA, 22 bp, Artificial sequence
  synthetic polynucleotide sequence
tcatagtcaaagggctgtagca

SEQ ID NO: 49581 - DNA, 19 bp, Artificial sequence
  synthetic polynucleotide sequence
tccgaggtcccttcaccga

SEQ ID NO: 49582 - DNA, 21 bp, Artificial sequence
  synthetic polynucleotide sequence
taattgaggcccctgcatcga

SEQ ID NO: 49583 - DNA, 19 bp, Artificial sequence
  synthetic polynucleotide sequence
ctgcacgggagctgggcaa

SEQ ID NO: 49584 - DNA, 20 bp, Artificial sequence
  synthetic polynucleotide sequence
ctcctggacttcgagcggca

SEQ ID NO: 49585 - DNA, 20 bp, Artificial sequence
  synthetic polynucleotide sequence
aggaccccatcagaagggga

SEQ ID NO: 49586 - DNA, 20 bp, Artificial sequence
  synthetic polynucleotide sequence
atcagctgccggaggtgaga

SEQ ID NO: 49587 - DNA, 18 bp, Artificial sequence
  synthetic polynucleotide sequence
agaaggtggcgcaacgga

SEQ ID NO: 49588 - DNA, 18 bp, Artificial sequence
  synthetic polynucleotide sequence
acagcttccaggcgctca

SEQ ID NO: 49589 - DNA, 21 bp, Artificial sequence
  synthetic polynucleotide sequence
agtggaagcagctggtcctca

SEQ ID NO: 49590 - DNA, 20 bp, Artificial sequence
  synthetic polynucleotide sequence
cttgggtcggagagtgggca

SEQ ID NO: 49591 - DNA, 20 bp, Artificial sequence
  synthetic polynucleotide sequence
cagtgaaggaagctcccgga

SEQ ID NO: 49592 - DNA, 23 bp, Artificial sequence
  synthetic polynucleotide sequence
ggggccaagactagagtcacaca

SEQ ID NO: 49593 - DNA, 20 bp, Artificial sequence
  synthetic polynucleotide sequence
gtgaccacttccgagaccca

SEQ ID NO: 49594 - DNA, 19 bp, Artificial sequence
  synthetic polynucleotide sequence
tcctcagctcctggacgaa

SEQ ID NO: 49595 - DNA, 22 bp, Artificial sequence
  synthetic polynucleotide sequence
tgaaggagaatggggtcacaca

SEQ ID NO: 49596 - DNA, 20 bp, Artificial sequence
  synthetic polynucleotide sequence
attccaccatgtccgggcca

SEQ ID NO: 49597 - DNA, 21 bp, Artificial sequence
  synthetic polynucleotide sequence
cgagctcaagatccgcgtcaa

SEQ ID NO: 49598 - DNA, 21 bp, Artificial sequence
  synthetic polynucleotide sequence
cccagagcttcaacaatccca

SEQ ID NO: 49599 - DNA, 18 bp, Artificial sequence
  synthetic polynucleotide sequence
atcgcagggctcaggaca

SEQ ID NO: 49600 - DNA, 18 bp, Artificial sequence
  synthetic polynucleotide sequence
tgaggagggccatggaca

SEQ ID NO: 49601 - DNA, 19 bp, Artificial sequence
  synthetic polynucleotide sequence
gggcaccttctaccaggga

SEQ ID NO: 49602 - DNA, 18 bp, Artificial sequence
  synthetic polynucleotide sequence
accctcccaccacggaga

SEQ ID NO: 49603 - DNA, 20 bp, Artificial sequence
  synthetic polynucleotide sequence
aagtccaaaagtgctgggca

SEQ ID NO: 49604 - DNA, 18 bp, Artificial sequence
  synthetic polynucleotide sequence
aaccagcccaccctgcca

SEQ ID NO: 49605 - DNA, 20 bp, Artificial sequence
  synthetic polynucleotide sequence
cctaagggcctggacctgga

SEQ ID NO: 49606 - DNA, 20 bp, Artificial sequence
  synthetic polynucleotide sequence
cggcccaccacatactggca

SEQ ID NO: 49607 - DNA, 19 bp, Artificial sequence
  synthetic polynucleotide sequence
ccagttgaaggatgcggga

SEQ ID NO: 49608 - DNA, 20 bp, Artificial sequence
  synthetic polynucleotide sequence
agagcacgagaagctcagga

SEQ ID NO: 49609 - DNA, 19 bp, Artificial sequence
  synthetic polynucleotide sequence
gggcacagaccactgagca

SEQ ID NO: 49610 - DNA, 19 bp, Artificial sequence
  synthetic polynucleotide sequence
cggcagcagcttctccaga

SEQ ID NO: 49611 - DNA, 18 bp, Artificial sequence
  synthetic polynucleotide sequence
ccacagtgaaggccacca

SEQ ID NO: 49612 - DNA, 18 bp, Artificial sequence
  synthetic polynucleotide sequence
gggcattgtgaaccagca

SEQ ID NO: 49613 - DNA, 21 bp, Artificial sequence
  synthetic polynucleotide sequence
caagtccccagttgccaagga

SEQ ID NO: 49614 - DNA, 20 bp, Artificial sequence
  synthetic polynucleotide sequence
cactgacagaacggcgcgca

SEQ ID NO: 49615 - DNA, 18 bp, Artificial sequence
  synthetic polynucleotide sequence
tgccaccacaggcaggaa

SEQ ID NO: 49616 - DNA, 20 bp, Artificial sequence
  synthetic polynucleotide sequence
gtgctgcagcagactgacca

SEQ ID NO: 49617 - DNA, 20 bp, Artificial sequence
  synthetic polynucleotide sequence
gctggaggacccactgcgga

SEQ ID NO: 49618 - DNA, 21 bp, Artificial sequence
  synthetic polynucleotide sequence
aaggacaatggcagcgtccca

SEQ ID NO: 49619 - DNA, 20 bp, Artificial sequence
  synthetic polynucleotide sequence
ccgagtgtgtagacggccaa

SEQ ID NO: 49620 - DNA, 20 bp, Artificial sequence
  synthetic polynucleotide sequence
caagcaccccgctggtgaga

SEQ ID NO: 49621 - DNA, 20 bp, Artificial sequence
  synthetic polynucleotide sequence
tggagggagacgcgggaaga

SEQ ID NO: 49622 - DNA, 20 bp, Artificial sequence
  synthetic polynucleotide sequence
cggcagctcgtgctgaggga

SEQ ID NO: 49623 - DNA, 19 bp, Artificial sequence
  synthetic polynucleotide sequence
gggtacaagcgggagcaca

SEQ ID NO: 49624 - DNA, 18 bp, Artificial sequence
  synthetic polynucleotide sequence
ggccagccagccctcgta

SEQ ID NO: 49625 - DNA, 21 bp, Artificial sequence
  synthetic polynucleotide sequence
ggacatcaggtaccaactgca

SEQ ID NO: 49626 - DNA, 18 bp, Artificial sequence
  synthetic polynucleotide sequence
aactccagggcgagccca

SEQ ID NO: 49627 - DNA, 21 bp, Artificial sequence
  synthetic polynucleotide sequence
gaaggcctcctataaacggga

SEQ ID NO: 49628 - DNA, 18 bp, Artificial sequence
  synthetic polynucleotide sequence
tgcagctggaagtccgca

SEQ ID NO: 49629 - DNA, 18 bp, Artificial sequence
  synthetic polynucleotide sequence
cgtgaccaaagccggaca

SEQ ID NO: 49630 - DNA, 18 bp, Artificial sequence
  synthetic polynucleotide sequence
tcctgcaccccaggacga

SEQ ID NO: 49631 - DNA, 21 bp, Artificial sequence
  synthetic polynucleotide sequence
caatcgagaccctggtggaca

SEQ ID NO: 49632 - DNA, 20 bp, Artificial sequence
  synthetic polynucleotide sequence
cacactccaggccctcgtca

SEQ ID NO: 49633 - DNA, 19 bp, Artificial sequence
  synthetic polynucleotide sequence
ccctggaagaacacagcca

SEQ ID NO: 49634 - DNA, 18 bp, Artificial sequence
  synthetic polynucleotide sequence
acagaacggggctgggga

SEQ ID NO: 49635 - DNA, 18 bp, Artificial sequence
  synthetic polynucleotide sequence
acaagacctgccccacca

SEQ ID NO: 49636 - DNA, 18 bp, Artificial sequence
  synthetic polynucleotide sequence
ccacagctggcaggccga

SEQ ID NO: 49637 - DNA, 21 bp, Artificial sequence
  synthetic polynucleotide sequence
gctcagcatcccatcggtcca

SEQ ID NO: 49638 - DNA, 20 bp, Artificial sequence
  synthetic polynucleotide sequence
cttccccagctcactggcca

SEQ ID NO: 49639 - DNA, 20 bp, Artificial sequence
  synthetic polynucleotide sequence
ggcgtcttccagcaccacca

SEQ ID NO: 49640 - DNA, 20 bp, Artificial sequence
  synthetic polynucleotide sequence
agtagaaagctgggggcgca

SEQ ID NO: 49641 - DNA, 21 bp, Artificial sequence
  synthetic polynucleotide sequence
cctgacatacctggtgagcca

SEQ ID NO: 49642 - DNA, 19 bp, Artificial sequence
  synthetic polynucleotide sequence
gagggcccaagattgagga

SEQ ID NO: 49643 - DNA, 18 bp, Artificial sequence
  synthetic polynucleotide sequence
ccatcgctggggacagca

SEQ ID NO: 49644 - DNA, 20 bp, Artificial sequence
  synthetic polynucleotide sequence
gacagactgggtcactggca

SEQ ID NO: 49645 - DNA, 22 bp, Artificial sequence
  synthetic polynucleotide sequence
aagagccaacttccaagcagca

SEQ ID NO: 49646 - DNA, 21 bp, Artificial sequence
  synthetic polynucleotide sequence
ctctgaactctgtgccaccca

SEQ ID NO: 49647 - DNA, 20 bp, Artificial sequence
  synthetic polynucleotide sequence
ccctggccagatagctggaa

SEQ ID NO: 49648 - DNA, 19 bp, Artificial sequence
  synthetic polynucleotide sequence
tggaaggctggtactggca

SEQ ID NO: 49649 - DNA, 25 bp, Artificial sequence
  synthetic polynucleotide sequence
actaggaatcaccacaaggggaaga

SEQ ID NO: 49650 - DNA, 23 bp, Artificial sequence
  synthetic polynucleotide sequence
ctgtcccaacactaaagtgacca

SEQ ID NO: 49651 - DNA, 20 bp, Artificial sequence
  synthetic polynucleotide sequence
cttaccagcccccacctgca

SEQ ID NO: 49652 - DNA, 22 bp, Artificial sequence
  synthetic polynucleotide sequence
caaaggataaggccaggactca

SEQ ID NO: 49653 - DNA, 18 bp, Artificial sequence
  synthetic polynucleotide sequence
aaggagcccgagccggca

SEQ ID NO: 49654 - DNA, 19 bp, Artificial sequence
  synthetic polynucleotide sequence
cggactcagggctgctgga

SEQ ID NO: 49655 - DNA, 20 bp, Artificial sequence
  synthetic polynucleotide sequence
atccacagctaccgaggtca

SEQ ID NO: 49656 - DNA, 18 bp, Artificial sequence
  synthetic polynucleotide sequence
ggctccggacaacctgga

SEQ ID NO: 49657 - DNA, 21 bp, Artificial sequence
  synthetic polynucleotide sequence
atctgcaatcacagcccacga

SEQ ID NO: 49658 - DNA, 20 bp, Artificial sequence
  synthetic polynucleotide sequence
gaagtccctgccgggcagca

SEQ ID NO: 49659 - DNA, 20 bp, Artificial sequence
  synthetic polynucleotide sequence
gccgcagcaaccactgcaca

SEQ ID NO: 49660 - DNA, 21 bp, Artificial sequence
  synthetic polynucleotide sequence
acttgaagggatcccaagcca

SEQ ID NO: 49661 - DNA, 21 bp, Artificial sequence
  synthetic polynucleotide sequence
ggaagctgcaagtgagtggaa

SEQ ID NO: 49662 - DNA, 20 bp, Artificial sequence
  synthetic polynucleotide sequence
atggccctgcttgaccagca

SEQ ID NO: 49663 - DNA, 20 bp, Artificial sequence
  synthetic polynucleotide sequence
gagggagcaaatgaacctga

SEQ ID NO: 49664 - DNA, 18 bp, Artificial sequence
  synthetic polynucleotide sequence
ccatcagcatgcctggca

SEQ ID NO: 49665 - DNA, 21 bp, Artificial sequence
  synthetic polynucleotide sequence
tcagcagtcccgtcaacctga

SEQ ID NO: 49666 - DNA, 20 bp, Artificial sequence
  synthetic polynucleotide sequence
cgacaacccgatggaagcca

SEQ ID NO: 49667 - DNA, 18 bp, Artificial sequence
  synthetic polynucleotide sequence
gaaccccaaataccggca

SEQ ID NO: 49668 - DNA, 18 bp, Artificial sequence
  synthetic polynucleotide sequence
ggcttggaagctggagga

SEQ ID NO: 49669 - DNA, 20 bp, Artificial sequence
  synthetic polynucleotide sequence
cagtacaagaggctggccaa

SEQ ID NO: 49670 - DNA, 19 bp, Artificial sequence
  synthetic polynucleotide sequence
cagtagaggacggccacca

SEQ ID NO: 49671 - DNA, 18 bp, Artificial sequence
  synthetic polynucleotide sequence
caacttcgccctggagca

SEQ ID NO: 49672 - DNA, 18 bp, Artificial sequence
  synthetic polynucleotide sequence
ccttcagatgggcagcca

SEQ ID NO: 49673 - DNA, 18 bp, Artificial sequence
  synthetic polynucleotide sequence
cgctctgcgacgtgggca

SEQ ID NO: 49674 - DNA, 19 bp, Artificial sequence
  synthetic polynucleotide sequence
cagcgagagacaccaggga

SEQ ID NO: 49675 - DNA, 18 bp, Artificial sequence
  synthetic polynucleotide sequence
gcgggagaaggagcggga

SEQ ID NO: 49676 - DNA, 22 bp, Artificial sequence
  synthetic polynucleotide sequence
gaatgtaggccaggtacaggga

SEQ ID NO: 49677 - DNA, 18 bp, Artificial sequence
  synthetic polynucleotide sequence
gcctgccagcaccacaga

SEQ ID NO: 49678 - DNA, 18 bp, Artificial sequence
  synthetic polynucleotide sequence
agaatggcccatgcggca

SEQ ID NO: 49679 - DNA, 19 bp, Artificial sequence
  synthetic polynucleotide sequence
cggcgctgaacgcactgca

SEQ ID NO: 49680 - DNA, 20 bp, Artificial sequence
  synthetic polynucleotide sequence
cagcaccacatggacggcga

SEQ ID NO: 49681 - DNA, 20 bp, Artificial sequence
  synthetic polynucleotide sequence
gtcacaccaggaaccggcga

SEQ ID NO: 49682 - DNA, 20 bp, Artificial sequence
  synthetic polynucleotide sequence
caggcgggcgccatcctgaa

SEQ ID NO: 49683 - DNA, 20 bp, Artificial sequence
  synthetic polynucleotide sequence
acgcacgtggtagagtccca

SEQ ID NO: 49684 - DNA, 20 bp, Artificial sequence
  synthetic polynucleotide sequence
cgtgggtgcctccacgcgaa

SEQ ID NO: 49685 - DNA, 21 bp, Artificial sequence
  synthetic polynucleotide sequence
aagagggcactgaaggaacca

SEQ ID NO: 49686 - DNA, 20 bp, Artificial sequence
  synthetic polynucleotide sequence
gttcagcacctgagaggcga

SEQ ID NO: 49687 - DNA, 20 bp, Artificial sequence
  synthetic polynucleotide sequence
tgcaaacccaggccagtgga

SEQ ID NO: 49688 - DNA, 20 bp, Artificial sequence
  synthetic polynucleotide sequence
aaagggctgcgtgctgggaa

SEQ ID NO: 49689 - DNA, 21 bp, Artificial sequence
  synthetic polynucleotide sequence
ggaactccaggtgggcagaga

SEQ ID NO: 49690 - DNA, 19 bp, Artificial sequence
  synthetic polynucleotide sequence
gcccagagcatgagcccca

SEQ ID NO: 49691 - DNA, 21 bp, Artificial sequence
  synthetic polynucleotide sequence
catactgcacaggcacaagca

SEQ ID NO: 49692 - DNA, 21 bp, Artificial sequence
  synthetic polynucleotide sequence
acacaaaggtgctcaccagga

SEQ ID NO: 49693 - DNA, 22 bp, Artificial sequence
  synthetic polynucleotide sequence
aatgtacccaaggagcctgaga

SEQ ID NO: 49694 - DNA, 18 bp, Artificial sequence
  synthetic polynucleotide sequence
cctcatgcccatagccca

SEQ ID NO: 49695 - DNA, 21 bp, Artificial sequence
  synthetic polynucleotide sequence
ccgtgtcaagacccccacaga

SEQ ID NO: 49696 - DNA, 20 bp, Artificial sequence
  synthetic polynucleotide sequence
ggacatgtggagtcacggga

SEQ ID NO: 49697 - DNA, 21 bp, Artificial sequence
  synthetic polynucleotide sequence
actgcacacagtagaaggcca

SEQ ID NO: 49698 - DNA, 18 bp, Artificial sequence
  synthetic polynucleotide sequence
ggggcaagctgactccca

SEQ ID NO: 49699 - DNA, 19 bp, Artificial sequence
  synthetic polynucleotide sequence
cccaaatcccggcccagga

SEQ ID NO: 49700 - DNA, 20 bp, Artificial sequence
  synthetic polynucleotide sequence
gggtgggacctggaaagcca

SEQ ID NO: 49701 - DNA, 20 bp, Artificial sequence
  synthetic polynucleotide sequence
cctgaggaacgaccatgaca

SEQ ID NO: 49702 - DNA, 19 bp, Artificial sequence
  synthetic polynucleotide sequence
cctcaggctgcagctcaga

SEQ ID NO: 49703 - DNA, 20 bp, Artificial sequence
  synthetic polynucleotide sequence
tactaccgctcggaggagga

SEQ ID NO: 49704 - DNA, 21 bp, Artificial sequence
  synthetic polynucleotide sequence
gctgcacgggactaatggtga

SEQ ID NO: 49705 - DNA, 21 bp, Artificial sequence
  synthetic polynucleotide sequence
ctgcctccctgaaaaccggaa

SEQ ID NO: 49706 - DNA, 19 bp, Artificial sequence
  synthetic polynucleotide sequence
gtgggagggtcggtcagca

SEQ ID NO: 49707 - DNA, 22 bp, Artificial sequence
  synthetic polynucleotide sequence
caatgaccagcctaagcagcaa

SEQ ID NO: 49708 - DNA, 19 bp, Artificial sequence
  synthetic polynucleotide sequence
tatctgcactggggagcga

SEQ ID NO: 49709 - DNA, 20 bp, Artificial sequence
  synthetic polynucleotide sequence
tggcgtctccagagggacca

SEQ ID NO: 49710 - DNA, 20 bp, Artificial sequence
  synthetic polynucleotide sequence
atccagtgagagccggtcca

SEQ ID NO: 49711 - DNA, 19 bp, Artificial sequence
  synthetic polynucleotide sequence
tgggaaaggtttggcagca

SEQ ID NO: 49712 - DNA, 22 bp, Artificial sequence
  synthetic polynucleotide sequence
tccaccaacaactcctcgcaga

SEQ ID NO: 49713 - DNA, 21 bp, Artificial sequence
  synthetic polynucleotide sequence
gcttgcaggagggaacaggca

SEQ ID NO: 49714 - DNA, 20 bp, Artificial sequence
  synthetic polynucleotide sequence
tcactgcagcgagaccagca

SEQ ID NO: 49715 - DNA, 21 bp, Artificial sequence
  synthetic polynucleotide sequence
tgacccttcggaatcagccca

SEQ ID NO: 49716 - DNA, 20 bp, Artificial sequence
  synthetic polynucleotide sequence
tcggatgtggaagctgccca

SEQ ID NO: 49717 - DNA, 20 bp, Artificial sequence
  synthetic polynucleotide sequence
tggctgaagatcgcacggca

SEQ ID NO: 49718 - DNA, 23 bp, Artificial sequence
  synthetic polynucleotide sequence
gaaatcaggaaagaagggcagca

SEQ ID NO: 49719 - DNA, 21 bp, Artificial sequence
  synthetic polynucleotide sequence
gggtttccaggagtggccaga

SEQ ID NO: 49720 - DNA, 20 bp, Artificial sequence
  synthetic polynucleotide sequence
tagggcctgcagagcccgca

SEQ ID NO: 49721 - DNA, 23 bp, Artificial sequence
  synthetic polynucleotide sequence
gaaagaggctagaacaccaagga

SEQ ID NO: 49722 - DNA, 18 bp, Artificial sequence
  synthetic polynucleotide sequence
agcggacattggcaccga

SEQ ID NO: 49723 - DNA, 20 bp, Artificial sequence
  synthetic polynucleotide sequence
gtgctgatagacgaggagga

SEQ ID NO: 49724 - DNA, 19 bp, Artificial sequence
  synthetic polynucleotide sequence
cagggaggtggtgccctca

SEQ ID NO: 49725 - DNA, 18 bp, Artificial sequence
  synthetic polynucleotide sequence
catgcaccgcatgagcca

SEQ ID NO: 49726 - DNA, 18 bp, Artificial sequence
  synthetic polynucleotide sequence
acgccgacatgccgctca

SEQ ID NO: 49727 - DNA, 20 bp, Artificial sequence
  synthetic polynucleotide sequence
tatctcgggacacacacaca

SEQ ID NO: 49728 - DNA, 21 bp, Artificial sequence
  synthetic polynucleotide sequence
tgaccactgtagaagcctgga

SEQ ID NO: 49729 - DNA, 22 bp, Artificial sequence
  synthetic polynucleotide sequence
aatgagcaaaaccccacggaca

SEQ ID NO: 49730 - DNA, 20 bp, Artificial sequence
  synthetic polynucleotide sequence
ctcaaagtggggccctggga

SEQ ID NO: 49731 - DNA, 20 bp, Artificial sequence
  synthetic polynucleotide sequence
gaccgacaaggctgcaggaa

SEQ ID NO: 49732 - DNA, 20 bp, Artificial sequence
  synthetic polynucleotide sequence
ctcgccgtccacacgtggga

SEQ ID NO: 49733 - DNA, 21 bp, Artificial sequence
  synthetic polynucleotide sequence
ctggtctggcagaaacacgga

SEQ ID NO: 49734 - DNA, 21 bp, Artificial sequence
  synthetic polynucleotide sequence
ttgtagagaggggtccatgca

SEQ ID NO: 49735 - DNA, 21 bp, Artificial sequence
  synthetic polynucleotide sequence
gctcaggcacacagtaccaca

SEQ ID NO: 49736 - DNA, 21 bp, Artificial sequence
  synthetic polynucleotide sequence
tgtcaaacacacggagcctga

SEQ ID NO: 49737 - DNA, 21 bp, Artificial sequence
  synthetic polynucleotide sequence
ggagcccagcttggaagccaa

SEQ ID NO: 49738 - DNA, 19 bp, Artificial sequence
  synthetic polynucleotide sequence
tgcctgaagggcacttgca

SEQ ID NO: 49739 - DNA, 19 bp, Artificial sequence
  synthetic polynucleotide sequence
cctccccactcagcaagga

SEQ ID NO: 49740 - DNA, 18 bp, Artificial sequence
  synthetic polynucleotide sequence
ccggctggtgtggaggga

SEQ ID NO: 49741 - DNA, 20 bp, Artificial sequence
  synthetic polynucleotide sequence
gggctatcctgggaccccaa

SEQ ID NO: 49742 - DNA, 20 bp, Artificial sequence
  synthetic polynucleotide sequence
ctggcctggaaagctgggga

SEQ ID NO: 49743 - DNA, 18 bp, Artificial sequence
  synthetic polynucleotide sequence
gcatcgctggagtcccca

SEQ ID NO: 49744 - DNA, 18 bp, Artificial sequence
  synthetic polynucleotide sequence
aacgctcccgacgccgca

SEQ ID NO: 49745 - DNA, 21 bp, Artificial sequence
  synthetic polynucleotide sequence
ggaagagggtgagctgggaga

SEQ ID NO: 49746 - DNA, 21 bp, Artificial sequence
  synthetic polynucleotide sequence
atgtttccccatgcgccccaa

SEQ ID NO: 49747 - DNA, 19 bp, Artificial sequence
  synthetic polynucleotide sequence
tggcacacatgttgaccca

SEQ ID NO: 49748 - DNA, 22 bp, Artificial sequence
  synthetic polynucleotide sequence
aataggggaaaggcacgactca

SEQ ID NO: 49749 - DNA, 21 bp, Artificial sequence
  synthetic polynucleotide sequence
cagctctcatcagaggcagca

SEQ ID NO: 49750 - DNA, 18 bp, Artificial sequence
  synthetic polynucleotide sequence
agcaatggggtgatggca

SEQ ID NO: 49751 - DNA, 19 bp, Artificial sequence
  synthetic polynucleotide sequence
gagctggccaggcagcaca

SEQ ID NO: 49752 - DNA, 18 bp, Artificial sequence
  synthetic polynucleotide sequence
gggcagcttcctccggca

SEQ ID NO: 49753 - DNA, 22 bp, Artificial sequence
  synthetic polynucleotide sequence
agaacagtctcacggaagcaga

SEQ ID NO: 49754 - DNA, 18 bp, Artificial sequence
  synthetic polynucleotide sequence
tcaatggcaccagggtca

SEQ ID NO: 49755 - DNA, 20 bp, Artificial sequence
  synthetic polynucleotide sequence
gagaaggtgccaagtccaca

SEQ ID NO: 49756 - DNA, 19 bp, Artificial sequence
  synthetic polynucleotide sequence
gactgcaggcatcacagca

SEQ ID NO: 49757 - DNA, 20 bp, Artificial sequence
  synthetic polynucleotide sequence
atgaagcgggtggtggagga

SEQ ID NO: 49758 - DNA, 21 bp, Artificial sequence
  synthetic polynucleotide sequence
ccgagagctgctgtacacgga

SEQ ID NO: 49759 - DNA, 20 bp, Artificial sequence
  synthetic polynucleotide sequence
atcacacgccgctatgcaga

SEQ ID NO: 49760 - DNA, 21 bp, Artificial sequence
  synthetic polynucleotide sequence
agaactcagctgccactcgga

SEQ ID NO: 49761 - DNA, 21 bp, Artificial sequence
  synthetic polynucleotide sequence
tcagcaccgtcatctccagca

SEQ ID NO: 49762 - DNA, 21 bp, Artificial sequence
  synthetic polynucleotide sequence
acgtaggggctctggtcacca

SEQ ID NO: 49763 - DNA, 21 bp, Artificial sequence
  synthetic polynucleotide sequence
tagtgagccctgcagcagtga

SEQ ID NO: 49764 - DNA, 19 bp, Artificial sequence
  synthetic polynucleotide sequence
tgacagctcgatcatggca

SEQ ID NO: 49765 - DNA, 21 bp, Artificial sequence
  synthetic polynucleotide sequence
agccaggccccaaggaagaga

SEQ ID NO: 49766 - DNA, 21 bp, Artificial sequence
  synthetic polynucleotide sequence
gtctgtaacagggtcccggta

SEQ ID NO: 49767 - DNA, 21 bp, Artificial sequence
  synthetic polynucleotide sequence
tcgactcatccggatggcaga

SEQ ID NO: 49768 - DNA, 20 bp, Artificial sequence
  synthetic polynucleotide sequence
acaaggcttcagggacacga

SEQ ID NO: 49769 - DNA, 20 bp, Artificial sequence
  synthetic polynucleotide sequence
ccccagaaccctgaggccaa

SEQ ID NO: 49770 - DNA, 22 bp, Artificial sequence
  synthetic polynucleotide sequence
agtagtcttccgcacagacaca

SEQ ID NO: 49771 - DNA, 20 bp, Artificial sequence
  synthetic polynucleotide sequence
gagctgcaaaaccagagcaa

SEQ ID NO: 49772 - DNA, 21 bp, Artificial sequence
  synthetic polynucleotide sequence
gtcatgtagaccagaccccca

SEQ ID NO: 49773 - DNA, 21 bp, Artificial sequence
  synthetic polynucleotide sequence
tgtgggaaacttccctgggaa

SEQ ID NO: 49774 - DNA, 21 bp, Artificial sequence
  synthetic polynucleotide sequence
actgcttccagaaggagccca

SEQ ID NO: 49775 - DNA, 20 bp, Artificial sequence
  synthetic polynucleotide sequence
tgtggatccagaggaccaga

SEQ ID NO: 49776 - DNA, 21 bp, Artificial sequence
  synthetic polynucleotide sequence
acttcagcatgcagtagccca

SEQ ID NO: 49777 - DNA, 20 bp, Artificial sequence
  synthetic polynucleotide sequence
gaccctgcagtcctcggcca

SEQ ID NO: 49778 - DNA, 20 bp, Artificial sequence
  synthetic polynucleotide sequence
ctccgagaagacgctcagca

SEQ ID NO: 49779 - DNA, 21 bp, Artificial sequence
  synthetic polynucleotide sequence
actggccctgataccatccaa

SEQ ID NO: 49780 - DNA, 22 bp, Artificial sequence
  synthetic polynucleotide sequence
agctcgatgtcaaggtcaggca

SEQ ID NO: 49781 - DNA, 18 bp, Artificial sequence
  synthetic polynucleotide sequence
ccagctgtcggatggcaa

SEQ ID NO: 49782 - DNA, 18 bp, Artificial sequence
  synthetic polynucleotide sequence
agcgtcacattgccccca

SEQ ID NO: 49783 - DNA, 21 bp, Artificial sequence
  synthetic polynucleotide sequence
gcctggattgggacctgggaa

SEQ ID NO: 49784 - DNA, 20 bp, Artificial sequence
  synthetic polynucleotide sequence
ctctgaagcctccacgagga

SEQ ID NO: 49785 - DNA, 20 bp, Artificial sequence
  synthetic polynucleotide sequence
ctgacctcctcgggcaccta

SEQ ID NO: 49786 - DNA, 20 bp, Artificial sequence
  synthetic polynucleotide sequence
tgacagcaacagcacgccca

SEQ ID NO: 49787 - DNA, 22 bp, Artificial sequence
  synthetic polynucleotide sequence
tgtatcagtgcacagtggccaa

SEQ ID NO: 49788 - DNA, 18 bp, Artificial sequence
  synthetic polynucleotide sequence
gcagcagacgagccccca

SEQ ID NO: 49789 - DNA, 18 bp, Artificial sequence
  synthetic polynucleotide sequence
cgaggccaaagtcaggca

SEQ ID NO: 49790 - DNA, 18 bp, Artificial sequence
  synthetic polynucleotide sequence
agggacagggtccaggga

SEQ ID NO: 49791 - DNA, 21 bp, Artificial sequence
  synthetic polynucleotide sequence
ggcccctgaagtgatggagga

SEQ ID NO: 49792 - DNA, 21 bp, Artificial sequence
  synthetic polynucleotide sequence
aagtcaatggtgccgtcccca

SEQ ID NO: 49793 - DNA, 20 bp, Artificial sequence
  synthetic polynucleotide sequence
cagagctcggcagaaaacga

SEQ ID NO: 49794 - DNA, 18 bp, Artificial sequence
  synthetic polynucleotide sequence
tgcagctgaagatggcga

SEQ ID NO: 49795 - DNA, 19 bp, Artificial sequence
  synthetic polynucleotide sequence
gaggggcagaatgtggaga

SEQ ID NO: 49796 - DNA, 18 bp, Artificial sequence
  synthetic polynucleotide sequence
tgtcgggcaagagctcca

SEQ ID NO: 49797 - DNA, 21 bp, Artificial sequence
  synthetic polynucleotide sequence
cggccgtagctacaccacaga

SEQ ID NO: 49798 - DNA, 18 bp, Artificial sequence
  synthetic polynucleotide sequence
ccaagagcaggcgcagga

SEQ ID NO: 49799 - DNA, 18 bp, Artificial sequence
  synthetic polynucleotide sequence
cgacttcagcgacggcaa

SEQ ID NO: 49800 - DNA, 18 bp, Artificial sequence
  synthetic polynucleotide sequence
cgggaggggcttcgggca

SEQ ID NO: 49801 - DNA, 21 bp, Artificial sequence
  synthetic polynucleotide sequence
ctcccagaaaaggcggaagga

SEQ ID NO: 49802 - DNA, 21 bp, Artificial sequence
  synthetic polynucleotide sequence
catagtactgcaccacccgga

SEQ ID NO: 49803 - DNA, 19 bp, Artificial sequence
  synthetic polynucleotide sequence
tcagcgtgggagtgaggga

SEQ ID NO: 49804 - DNA, 23 bp, Artificial sequence
  synthetic polynucleotide sequence
gaaaagcaaggatgacagcgaca

SEQ ID NO: 49805 - DNA, 20 bp, Artificial sequence
  synthetic polynucleotide sequence
cggagcagtgtcatggcgga

SEQ ID NO: 49806 - DNA, 21 bp, Artificial sequence
  synthetic polynucleotide sequence
gcacaggagtccatgatgcca

SEQ ID NO: 49807 - DNA, 20 bp, Artificial sequence
  synthetic polynucleotide sequence
gggtgcacacgctccagcta

SEQ ID NO: 49808 - DNA, 22 bp, Artificial sequence
  synthetic polynucleotide sequence
atactgcaaagcactgccagca

SEQ ID NO: 49809 - DNA, 22 bp, Artificial sequence
  synthetic polynucleotide sequence
acattgccaaagcaacagggga

SEQ ID NO: 49810 - DNA, 21 bp, Artificial sequence
  synthetic polynucleotide sequence
gctgagaggcagaagtgccca

SEQ ID NO: 49811 - DNA, 20 bp, Artificial sequence
  synthetic polynucleotide sequence
cacgtgaaagacttcgggaa

SEQ ID NO: 49812 - DNA, 20 bp, Artificial sequence
  synthetic polynucleotide sequence
gatccctaggatgacgagca

SEQ ID NO: 49813 - DNA, 21 bp, Artificial sequence
  synthetic polynucleotide sequence
gctgggggaacaacgagacca

SEQ ID NO: 49814 - DNA, 20 bp, Artificial sequence
  synthetic polynucleotide sequence
gtagtaaaccaggcctccca

SEQ ID NO: 49815 - DNA, 18 bp, Artificial sequence
  synthetic polynucleotide sequence
ctgccacctgtgaaccca

SEQ ID NO: 49816 - DNA, 19 bp, Artificial sequence
  synthetic polynucleotide sequence
cccagccagtactgagcga

SEQ ID NO: 49817 - DNA, 18 bp, Artificial sequence
  synthetic polynucleotide sequence
ccagcagctgccagggaa

SEQ ID NO: 49818 - DNA, 18 bp, Artificial sequence
  synthetic polynucleotide sequence
gcacgttggactcaggca

SEQ ID NO: 49819 - DNA, 19 bp, Artificial sequence
  synthetic polynucleotide sequence
gcctcagtagggcccgaga

SEQ ID NO: 49820 - DNA, 20 bp, Artificial sequence
  synthetic polynucleotide sequence
gccatacaccaccaggccga

SEQ ID NO: 49821 - DNA, 20 bp, Artificial sequence
  synthetic polynucleotide sequence
gaccacgcagacctctcgca

SEQ ID NO: 49822 - DNA, 20 bp, Artificial sequence
  synthetic polynucleotide sequence
ctgcagatcctgggacacca

SEQ ID NO: 49823 - DNA, 18 bp, Artificial sequence
  synthetic polynucleotide sequence
gacgcgagaaggaagcca

SEQ ID NO: 49824 - DNA, 18 bp, Artificial sequence
  synthetic polynucleotide sequence
tgcttgtccaggacggga

SEQ ID NO: 49825 - DNA, 18 bp, Artificial sequence
  synthetic polynucleotide sequence
atgcccagctgaccggga

SEQ ID NO: 49826 - DNA, 19 bp, Artificial sequence
  synthetic polynucleotide sequence
gagcaaggacttggcagca

SEQ ID NO: 49827 - DNA, 25 bp, Artificial sequence
  synthetic polynucleotide sequence
agatgagagaacccagtgacctcaa

SEQ ID NO: 49828 - DNA, 20 bp, Artificial sequence
  synthetic polynucleotide sequence
cctgtcctacaggcaccaga

SEQ ID NO: 49829 - DNA, 21 bp, Artificial sequence
  synthetic polynucleotide sequence
gctgccttcgacgagtgggaa

SEQ ID NO: 49830 - DNA, 20 bp, Artificial sequence
  synthetic polynucleotide sequence
ccagtggcgcagtagcagga

SEQ ID NO: 49831 - DNA, 21 bp, Artificial sequence
  synthetic polynucleotide sequence
catctgacccgatcctcacca

SEQ ID NO: 49832 - DNA, 19 bp, Artificial sequence
  synthetic polynucleotide sequence
cccctccaactgtgcccca

SEQ ID NO: 49833 - DNA, 22 bp, Artificial sequence
  synthetic polynucleotide sequence
tgaatgctgctctggaaggcaa

SEQ ID NO: 49834 - DNA, 20 bp, Artificial sequence
  synthetic polynucleotide sequence
ctctcagcagcctagaacca

SEQ ID NO: 49835 - DNA, 18 bp, Artificial sequence
  synthetic polynucleotide sequence
ccacgtcgacacgagcca

SEQ ID NO: 49836 - DNA, 19 bp, Artificial sequence
  synthetic polynucleotide sequence
cacacactccgtctgggga

SEQ ID NO: 49837 - DNA, 21 bp, Artificial sequence
  synthetic polynucleotide sequence
tcgagggaaagggtgtgtcga

SEQ ID NO: 49838 - DNA, 20 bp, Artificial sequence
  synthetic polynucleotide sequence
tgcactcaggacagcatcca

SEQ ID NO: 49839 - DNA, 18 bp, Artificial sequence
  synthetic polynucleotide sequence
gggaaggaaggtggcgaa

SEQ ID NO: 49840 - DNA, 18 bp, Artificial sequence
  synthetic polynucleotide sequence
agcagtccccaggaagca

SEQ ID NO: 49841 - DNA, 18 bp, Artificial sequence
  synthetic polynucleotide sequence
gaaaacaaccagccccca

SEQ ID NO: 49842 - DNA, 18 bp, Artificial sequence
  synthetic polynucleotide sequence
tgccccttcaggaccaga

SEQ ID NO: 49843 - DNA, 18 bp, Artificial sequence
  synthetic polynucleotide sequence
actgcagctcagccccaa

SEQ ID NO: 49844 - DNA, 21 bp, Artificial sequence
  synthetic polynucleotide sequence
caagacactgctcctccagga

SEQ ID NO: 49845 - DNA, 21 bp, Artificial sequence
  synthetic polynucleotide sequence
tgtgacacaagcctcactgca

SEQ ID NO: 49846 - DNA, 22 bp, Artificial sequence
  synthetic polynucleotide sequence
atcttggggatgacgcatcaga

SEQ ID NO: 49847 - DNA, 21 bp, Artificial sequence
  synthetic polynucleotide sequence
agatgctcccaccactcagca

SEQ ID NO: 49848 - DNA, 19 bp, Artificial sequence
  synthetic polynucleotide sequence
ttcctggcagagacaccca

SEQ ID NO: 49849 - DNA, 18 bp, Artificial sequence
  synthetic polynucleotide sequence
cgacgacaagctcgagca

SEQ ID NO: 49850 - DNA, 18 bp, Artificial sequence
  synthetic polynucleotide sequence
ctgcgatcaagggctgca

SEQ ID NO: 49851 - DNA, 21 bp, Artificial sequence
  synthetic polynucleotide sequence
tgggcaattacctgggagcca

SEQ ID NO: 49852 - DNA, 21 bp, Artificial sequence
  synthetic polynucleotide sequence
atgtccaggatgctctgccga

SEQ ID NO: 49853 - DNA, 18 bp, Artificial sequence
  synthetic polynucleotide sequence
cagggcaggaatcagcga

SEQ ID NO: 49854 - DNA, 18 bp, Artificial sequence
  synthetic polynucleotide sequence
acagggggcagtggacca

SEQ ID NO: 49855 - DNA, 20 bp, Artificial sequence
  synthetic polynucleotide sequence
aagagcagcgtgaacaggaa

SEQ ID NO: 49856 - DNA, 20 bp, Artificial sequence
  synthetic polynucleotide sequence
tcaacagcaatacggcgaga

SEQ ID NO: 49857 - DNA, 19 bp, Artificial sequence
  synthetic polynucleotide sequence
ccagccaacaggaggagca

SEQ ID NO: 49858 - DNA, 18 bp, Artificial sequence
  synthetic polynucleotide sequence
agcaggtcgctacgggca

SEQ ID NO: 49859 - DNA, 18 bp, Artificial sequence
  synthetic polynucleotide sequence
agcctgcacagccaccaa

SEQ ID NO: 49860 - DNA, 18 bp, Artificial sequence
  synthetic polynucleotide sequence
cgctgtactccacggcaa

SEQ ID NO: 49861 - DNA, 21 bp, Artificial sequence
  synthetic polynucleotide sequence
caagtgagagccacgagccaa

SEQ ID NO: 49862 - DNA, 21 bp, Artificial sequence
  synthetic polynucleotide sequence
ggatggagtctgacacgcgga

SEQ ID NO: 49863 - DNA, 19 bp, Artificial sequence
  synthetic polynucleotide sequence
cccacagcggcttcccaga

SEQ ID NO: 49864 - DNA, 20 bp, Artificial sequence
  synthetic polynucleotide sequence
tctcgctggactcctgagca

SEQ ID NO: 49865 - DNA, 19 bp, Artificial sequence
  synthetic polynucleotide sequence
cccacagcggcttcccaga

SEQ ID NO: 49866 - DNA, 20 bp, Artificial sequence
  synthetic polynucleotide sequence
cctcgctggactcctgagca

SEQ ID NO: 49867 - DNA, 22 bp, Artificial sequence
  synthetic polynucleotide sequence
aatggagcacatcctgaagcca

SEQ ID NO: 49868 - DNA, 20 bp, Artificial sequence
  synthetic polynucleotide sequence
tgccatcactggtacaccca

SEQ ID NO: 49869 - DNA, 22 bp, Artificial sequence
  synthetic polynucleotide sequence
atgccagcatggtggaaggtga

SEQ ID NO: 49870 - DNA, 20 bp, Artificial sequence
  synthetic polynucleotide sequence
gagggcagccaactggtgga

SEQ ID NO: 49871 - DNA, 21 bp, Artificial sequence
  synthetic polynucleotide sequence
atctggcagctgctctggaga

SEQ ID NO: 49872 - DNA, 20 bp, Artificial sequence
  synthetic polynucleotide sequence
gtgaatgccagctgcctcca

SEQ ID NO: 49873 - DNA, 18 bp, Artificial sequence
  synthetic polynucleotide sequence
cctgccttctgatgggga

SEQ ID NO: 49874 - DNA, 20 bp, Artificial sequence
  synthetic polynucleotide sequence
gtggtgtagactcttggcca

SEQ ID NO: 49875 - DNA, 19 bp, Artificial sequence
  synthetic polynucleotide sequence
ggtgacccctgcctccaca

SEQ ID NO: 49876 - DNA, 19 bp, Artificial sequence
  synthetic polynucleotide sequence
ggggtagtgcacacgggga

SEQ ID NO: 49877 - DNA, 18 bp, Artificial sequence
  synthetic polynucleotide sequence
cctggcatgatgcgccca

SEQ ID NO: 49878 - DNA, 18 bp, Artificial sequence
  synthetic polynucleotide sequence
ccagggtttggcaaggga

SEQ ID NO: 49879 - DNA, 22 bp, Artificial sequence
  synthetic polynucleotide sequence
gaatgtagggaggagctgctga

SEQ ID NO: 49880 - DNA, 18 bp, Artificial sequence
  synthetic polynucleotide sequence
ggtggccccggttgcaca

SEQ ID NO: 49881 - DNA, 18 bp, Artificial sequence
  synthetic polynucleotide sequence
ccctatccaccgccccca

SEQ ID NO: 49882 - DNA, 18 bp, Artificial sequence
  synthetic polynucleotide sequence
ggacatcggggccgctga

SEQ ID NO: 49883 - DNA, 21 bp, Artificial sequence
  synthetic polynucleotide sequence
cctgcgggatacagagcctca

SEQ ID NO: 49884 - DNA, 22 bp, Artificial sequence
  synthetic polynucleotide sequence
atggacctgagaagaggaggca

SEQ ID NO: 49885 - DNA, 17 bp, Artificial sequence
  synthetic polynucleotide sequence
gccaacagccaggagca

SEQ ID NO: 49886 - DNA, 21 bp, Artificial sequence
  synthetic polynucleotide sequence
gctttgaagtgaactggggca

SEQ ID NO: 49887 - DNA, 21 bp, Artificial sequence
  synthetic polynucleotide sequence
actgcgacaaggtcaagagca

SEQ ID NO: 49888 - DNA, 21 bp, Artificial sequence
  synthetic polynucleotide sequence
ggatgaggtcgatgccagcca

SEQ ID NO: 49889 - DNA, 20 bp, Artificial sequence
  synthetic polynucleotide sequence
agcaggctgggatgtgggaa

SEQ ID NO: 49890 - DNA, 22 bp, Artificial sequence
  synthetic polynucleotide sequence
ggtacaggtagacaatgccgga

SEQ ID NO: 49891 - DNA, 21 bp, Artificial sequence
  synthetic polynucleotide sequence
tgctacagggacccaggctga

SEQ ID NO: 49892 - DNA, 19 bp, Artificial sequence
  synthetic polynucleotide sequence
gctgcctgcccagtcggaa

SEQ ID NO: 49893 - DNA, 20 bp, Artificial sequence
  synthetic polynucleotide sequence
cagccctatggagtcaagca

SEQ ID NO: 49894 - DNA, 18 bp, Artificial sequence
  synthetic polynucleotide sequence
accaccagcctcaggcca

SEQ ID NO: 49895 - DNA, 21 bp, Artificial sequence
  synthetic polynucleotide sequence
caagacgctggggctaagaca

SEQ ID NO: 49896 - DNA, 22 bp, Artificial sequence
  synthetic polynucleotide sequence
aaaggtcgctagagaagtccga

SEQ ID NO: 49897 - DNA, 21 bp, Artificial sequence
  synthetic polynucleotide sequence
gagcacaggacaggacaagca

SEQ ID NO: 49898 - DNA, 21 bp, Artificial sequence
  synthetic polynucleotide sequence
ctgagaacaacacccgctgga

SEQ ID NO: 49899 - DNA, 21 bp, Artificial sequence
  synthetic polynucleotide sequence
tcacaggtaggagccagcaga

SEQ ID NO: 49900 - DNA, 22 bp, Artificial sequence
  synthetic polynucleotide sequence
taggacttcagcaggctcagga

SEQ ID NO: 49901 - DNA, 20 bp, Artificial sequence
  synthetic polynucleotide sequence
ccctggccagcatcaccaca

SEQ ID NO: 49902 - DNA, 21 bp, Artificial sequence
  synthetic polynucleotide sequence
ccagctctcgactcaaggcca

SEQ ID NO: 49903 - DNA, 20 bp, Artificial sequence
  synthetic polynucleotide sequence
gtgaccccagtggaaagaca

SEQ ID NO: 49904 - DNA, 21 bp, Artificial sequence
  synthetic polynucleotide sequence
gtctaggacgacctgaagcca

SEQ ID NO: 49905 - DNA, 20 bp, Artificial sequence
  synthetic polynucleotide sequence
tacccagggagactctgcaa

SEQ ID NO: 49906 - DNA, 19 bp, Artificial sequence
  synthetic polynucleotide sequence
caggcccagctgtcctcga

SEQ ID NO: 49907 - DNA, 21 bp, Artificial sequence
  synthetic polynucleotide sequence
cacgctgaaggatgagggcaa

SEQ ID NO: 49908 - DNA, 22 bp, Artificial sequence
  synthetic polynucleotide sequence
gcaacgctgaacactgtgacca

SEQ ID NO: 49909 - DNA, 18 bp, Artificial sequence
  synthetic polynucleotide sequence
cttgctgcaggaggcaga

SEQ ID NO: 49910 - DNA, 18 bp, Artificial sequence
  synthetic polynucleotide sequence
tctggtggaatccgagca

SEQ ID NO: 49911 - DNA, 21 bp, Artificial sequence
  synthetic polynucleotide sequence
tagtgaccctctctggccaca

SEQ ID NO: 49912 - DNA, 19 bp, Artificial sequence
  synthetic polynucleotide sequence
ttagttcggggatcccaca

SEQ ID NO: 49913 - DNA, 21 bp, Artificial sequence
  synthetic polynucleotide sequence
tggtgacgggcagtgaggaca

SEQ ID NO: 49914 - DNA, 18 bp, Artificial sequence
  synthetic polynucleotide sequence
gctcccgcctccagacga

SEQ ID NO: 49915 - DNA, 22 bp, Artificial sequence
  synthetic polynucleotide sequence
aatgcagaggagagctgaccaa

SEQ ID NO: 49916 - DNA, 21 bp, Artificial sequence
  synthetic polynucleotide sequence
aagcagcctgtgcaacaagca

SEQ ID NO: 49917 - DNA, 21 bp, Artificial sequence
  synthetic polynucleotide sequence
gctgccccacttcaacaagca

SEQ ID NO: 49918 - DNA, 20 bp, Artificial sequence
  synthetic polynucleotide sequence
ctccatggtgctgcacagga

SEQ ID NO: 49919 - DNA, 20 bp, Artificial sequence
  synthetic polynucleotide sequence
agaagctgcccagactgcca

SEQ ID NO: 49920 - DNA, 19 bp, Artificial sequence
  synthetic polynucleotide sequence
ggtggccatctcggaggga

SEQ ID NO: 49921 - DNA, 22 bp, Artificial sequence
  synthetic polynucleotide sequence
gcaagagcaaatccacgaggaa

SEQ ID NO: 49922 - DNA, 20 bp, Artificial sequence
  synthetic polynucleotide sequence
aacccgtcctggctcacgca

SEQ ID NO: 49923 - DNA, 18 bp, Artificial sequence
  synthetic polynucleotide sequence
gcacgtcaactgcagcca

SEQ ID NO: 49924 - DNA, 18 bp, Artificial sequence
  synthetic polynucleotide sequence
tgcagccctggcaccaca

SEQ ID NO: 49925 - DNA, 18 bp, Artificial sequence
  synthetic polynucleotide sequence
agaggttcacctgcccca

SEQ ID NO: 49926 - DNA, 20 bp, Artificial sequence
  synthetic polynucleotide sequence
gcccactgagtagccctcca

SEQ ID NO: 49927 - DNA, 20 bp, Artificial sequence
  synthetic polynucleotide sequence
tcttccttggccaccccaga

SEQ ID NO: 49928 - DNA, 21 bp, Artificial sequence
  synthetic polynucleotide sequence
gtctggttgagccctaagcca

SEQ ID NO: 49929 - DNA, 21 bp, Artificial sequence
  synthetic polynucleotide sequence
tgtgggacctgagaaccctga

SEQ ID NO: 49930 - DNA, 19 bp, Artificial sequence
  synthetic polynucleotide sequence
gtctgtcctcggccccaca

SEQ ID NO: 49931 - DNA, 19 bp, Artificial sequence
  synthetic polynucleotide sequence
ttgtgacaggtggtgcaga

SEQ ID NO: 49932 - DNA, 21 bp, Artificial sequence
  synthetic polynucleotide sequence
agtccagcaaagacacagcca

SEQ ID NO: 49933 - DNA, 21 bp, Artificial sequence
  synthetic polynucleotide sequence
ttcctcacaaccaaggcagca

SEQ ID NO: 49934 - DNA, 21 bp, Artificial sequence
  synthetic polynucleotide sequence
ctgtcctgtcaccacatccca

SEQ ID NO: 49935 - DNA, 19 bp, Artificial sequence
  synthetic polynucleotide sequence
ccccacgaggaggaaggaa

SEQ ID NO: 49936 - DNA, 18 bp, Artificial sequence
  synthetic polynucleotide sequence
tgaccgtcgtgaggggga

SEQ ID NO: 49937 - DNA, 21 bp, Artificial sequence
  synthetic polynucleotide sequence
tgggactgacgggcatgtcca

SEQ ID NO: 49938 - DNA, 21 bp, Artificial sequence
  synthetic polynucleotide sequence
acgtcacctttcccagaggca

SEQ ID NO: 49939 - DNA, 19 bp, Artificial sequence
  synthetic polynucleotide sequence
ttgtgaagcgcttgggcaa

SEQ ID NO: 49940 - DNA, 22 bp, Artificial sequence
  synthetic polynucleotide sequence
caatcccccaatttcagccgga

SEQ ID NO: 49941 - DNA, 22 bp, Artificial sequence
  synthetic polynucleotide sequence
gaaagaatcaggcccatcagga

SEQ ID NO: 49942 - DNA, 22 bp, Artificial sequence
  synthetic polynucleotide sequence
agtactggctctgaaggaagca

SEQ ID NO: 49943 - DNA, 18 bp, Artificial sequence
  synthetic polynucleotide sequence
cccccatgacaaccgaca

SEQ ID NO: 49944 - DNA, 18 bp, Artificial sequence
  synthetic polynucleotide sequence
actccatgccgagcagca

SEQ ID NO: 49945 - DNA, 20 bp, Artificial sequence
  synthetic polynucleotide sequence
cggctcctgggacaagacca

SEQ ID NO: 49946 - DNA, 19 bp, Artificial sequence
  synthetic polynucleotide sequence
cagccacagctcgtcggga

SEQ ID NO: 49947 - DNA, 21 bp, Artificial sequence
  synthetic polynucleotide sequence
cgtggctttcgaggagaccca

SEQ ID NO: 49948 - DNA, 19 bp, Artificial sequence
  synthetic polynucleotide sequence
tcccacgaagaacaccaga

SEQ ID NO: 49949 - DNA, 19 bp, Artificial sequence
  synthetic polynucleotide sequence
tgcctgccagaaaactgca

SEQ ID NO: 49950 - DNA, 19 bp, Artificial sequence
  synthetic polynucleotide sequence
tggtacaggctcagctgca

SEQ ID NO: 49951 - DNA, 21 bp, Artificial sequence
  synthetic polynucleotide sequence
ttcacaggacatgcaacgcca

SEQ ID NO: 49952 - DNA, 20 bp, Artificial sequence
  synthetic polynucleotide sequence
ctgatcggacctgccagaca

SEQ ID NO: 49953 - DNA, 21 bp, Artificial sequence
  synthetic polynucleotide sequence
ccctgccaaacccccaagaca

SEQ ID NO: 49954 - DNA, 20 bp, Artificial sequence
  synthetic polynucleotide sequence
aaggaggtgggggtctagga

SEQ ID NO: 49955 - DNA, 19 bp, Artificial sequence
  synthetic polynucleotide sequence
tgtggacctggcgagcaca

SEQ ID NO: 49956 - DNA, 21 bp, Artificial sequence
  synthetic polynucleotide sequence
ggaaggaggagtcgtggctga

SEQ ID NO: 49957 - DNA, 23 bp, Artificial sequence
  synthetic polynucleotide sequence
aaaaagccgaaataccctcccaa

SEQ ID NO: 49958 - DNA, 19 bp, Artificial sequence
  synthetic polynucleotide sequence
gtgcccggaaaggccagga

SEQ ID NO: 49959 - DNA, 21 bp, Artificial sequence
  synthetic polynucleotide sequence
tgaacagccctacctcaccca

SEQ ID NO: 49960 - DNA, 19 bp, Artificial sequence
  synthetic polynucleotide sequence
cagggctcgtgggtccaga

SEQ ID NO: 49961 - DNA, 21 bp, Artificial sequence
  synthetic polynucleotide sequence
caatgggtagagcacaccgca

SEQ ID NO: 49962 - DNA, 23 bp, Artificial sequence
  synthetic polynucleotide sequence
cactgcggaataacaccacccaa

SEQ ID NO: 49963 - DNA, 18 bp, Artificial sequence
  synthetic polynucleotide sequence
tcccttggccagcagaga

SEQ ID NO: 49964 - DNA, 20 bp, Artificial sequence
  synthetic polynucleotide sequence
gcaggaggaggatcagctga

SEQ ID NO: 49965 - DNA, 20 bp, Artificial sequence
  synthetic polynucleotide sequence
ccaacctcatgaggaccgaa

SEQ ID NO: 49966 - DNA, 21 bp, Artificial sequence
  synthetic polynucleotide sequence
caaacaggagcattgcagaca

SEQ ID NO: 49967 - DNA, 20 bp, Artificial sequence
  synthetic polynucleotide sequence
ctccgtgaaattcagcccga

SEQ ID NO: 49968 - DNA, 20 bp, Artificial sequence
  synthetic polynucleotide sequence
attcccagcttgtgaccaga

SEQ ID NO: 49969 - DNA, 19 bp, Artificial sequence
  synthetic polynucleotide sequence
taaaccctgccctagccca

SEQ ID NO: 49970 - DNA, 22 bp, Artificial sequence
  synthetic polynucleotide sequence
tcattccctccagtaagcagca

SEQ ID NO: 49971 - DNA, 20 bp, Artificial sequence
  synthetic polynucleotide sequence
tattgacccgcattccagga

SEQ ID NO: 49972 - DNA, 21 bp, Artificial sequence
  synthetic polynucleotide sequence
gcttgcccacctcagaagcca

SEQ ID NO: 49973 - DNA, 21 bp, Artificial sequence
  synthetic polynucleotide sequence
catggctctggatccagccaa

SEQ ID NO: 49974 - DNA, 21 bp, Artificial sequence
  synthetic polynucleotide sequence
gctctcagggcaaagcggtca

SEQ ID NO: 49975 - DNA, 18 bp, Artificial sequence
  synthetic polynucleotide sequence
cgcccatgaagatccgca

SEQ ID NO: 49976 - DNA, 19 bp, Artificial sequence
  synthetic polynucleotide sequence
tgtgaacaggcaggaggca

SEQ ID NO: 49977 - DNA, 21 bp, Artificial sequence
  synthetic polynucleotide sequence
ggacacacggaagcagtgtca

SEQ ID NO: 49978 - DNA, 21 bp, Artificial sequence
  synthetic polynucleotide sequence
tgatgaccaggcaacatccga

SEQ ID NO: 49979 - DNA, 20 bp, Artificial sequence
  synthetic polynucleotide sequence
taaggtagacccagagacca

SEQ ID NO: 49980 - DNA, 21 bp, Artificial sequence
  synthetic polynucleotide sequence
catcagtagctgcgctgcaca

SEQ ID NO: 49981 - DNA, 19 bp, Artificial sequence
  synthetic polynucleotide sequence
gggacctcctccagagcga

SEQ ID NO: 49982 - DNA, 21 bp, Artificial sequence
  synthetic polynucleotide sequence
tgctggatgtcgatggagcca

SEQ ID NO: 49983 - DNA, 21 bp, Artificial sequence
  synthetic polynucleotide sequence
ccacaggaactcatgtcggga

SEQ ID NO: 49984 - DNA, 22 bp, Artificial sequence
  synthetic polynucleotide sequence
aagcagtgacaaggagctggga

SEQ ID NO: 49985 - DNA, 19 bp, Artificial sequence
  synthetic polynucleotide sequence
cccaccccagtaaccccca

SEQ ID NO: 49986 - DNA, 21 bp, Artificial sequence
  synthetic polynucleotide sequence
accctgctcagctcaagggga

SEQ ID NO: 49987 - DNA, 21 bp, Artificial sequence
  synthetic polynucleotide sequence
ttggaggttggaacgtggcca

SEQ ID NO: 49988 - DNA, 20 bp, Artificial sequence
  synthetic polynucleotide sequence
actccgggccgagtcaggga

SEQ ID NO: 49989 - DNA, 20 bp, Artificial sequence
  synthetic polynucleotide sequence
aaggtgttgccggaggggaa

SEQ ID NO: 49990 - DNA, 19 bp, Artificial sequence
  synthetic polynucleotide sequence
ccgttgcgctccaaggcca

SEQ ID NO: 49991 - DNA, 21 bp, Artificial sequence
  synthetic polynucleotide sequence
cccagtgagaagcatggcgga

SEQ ID NO: 49992 - DNA, 22 bp, Artificial sequence
  synthetic polynucleotide sequence
tgattttccactgcaccaccga

SEQ ID NO: 49993 - DNA, 22 bp, Artificial sequence
  synthetic polynucleotide sequence
aatccatggacacaagggacca

SEQ ID NO: 49994 - DNA, 19 bp, Artificial sequence
  synthetic polynucleotide sequence
gtccagatgagccgggcca

SEQ ID NO: 49995 - DNA, 22 bp, Artificial sequence
  synthetic polynucleotide sequence
aacaagagtcagaggggagcaa

SEQ ID NO: 49996 - DNA, 20 bp, Artificial sequence
  synthetic polynucleotide sequence
atgcgacttcaggggatcca

SEQ ID NO: 49997 - DNA, 19 bp, Artificial sequence
  synthetic polynucleotide sequence
ccggtcaagcatgacagca

SEQ ID NO: 49998 - DNA, 20 bp, Artificial sequence
  synthetic polynucleotide sequence
caaggcacatctgtcaggca

SEQ ID NO: 49999 - DNA, 21 bp, Artificial sequence
  synthetic polynucleotide sequence
ggcttgttgacacccggcaga

SEQ ID NO: 50000 - DNA, 21 bp, Artificial sequence
  synthetic polynucleotide sequence
gctaggtacggatactgggca

SEQ ID NO: 50001 - DNA, 18 bp, Artificial sequence
  synthetic polynucleotide sequence
tgaaggggctggcaggca

SEQ ID NO: 50002 - DNA, 20 bp, Artificial sequence
  synthetic polynucleotide sequence
gtccctgcctgacaagagga

SEQ ID NO: 50003 - DNA, 20 bp, Artificial sequence
  synthetic polynucleotide sequence
aaacacaggcaacagcagga

SEQ ID NO: 50004 - DNA, 20 bp, Artificial sequence
  synthetic polynucleotide sequence
gaaagcagcagatggcagga

SEQ ID NO: 50005 - DNA, 22 bp, Artificial sequence
  synthetic polynucleotide sequence
atgtccacccagtgcatagaca

SEQ ID NO: 50006 - DNA, 20 bp, Artificial sequence
  synthetic polynucleotide sequence
tgatggtggtgaggagcgga

SEQ ID NO: 50007 - DNA, 21 bp, Artificial sequence
  synthetic polynucleotide sequence
gtcccaagccagcatcacaga

SEQ ID NO: 50008 - DNA, 22 bp, Artificial sequence
  synthetic polynucleotide sequence
aaggcttgagtccagcacagca

SEQ ID NO: 50009 - DNA, 21 bp, Artificial sequence
  synthetic polynucleotide sequence
caggcagtcacaagcagcaga

SEQ ID NO: 50010 - DNA, 22 bp, Artificial sequence
  synthetic polynucleotide sequence
tggatggtaaagaggtcgggga

SEQ ID NO: 50011 - DNA, 20 bp, Artificial sequence
  synthetic polynucleotide sequence
aagcctggtctgcagcacga

SEQ ID NO: 50012 - DNA, 22 bp, Artificial sequence
  synthetic polynucleotide sequence
tcaaggaatggtcagaggagga

SEQ ID NO: 50013 - DNA, 20 bp, Artificial sequence
  synthetic polynucleotide sequence
gaccgacagcgtgttgcgga

SEQ ID NO: 50014 - DNA, 21 bp, Artificial sequence
  synthetic polynucleotide sequence
cctggcagtcatagagcacga

SEQ ID NO: 50015 - DNA, 22 bp, Artificial sequence
  synthetic polynucleotide sequence
acaagggccataagaaccagga

SEQ ID NO: 50016 - DNA, 19 bp, Artificial sequence
  synthetic polynucleotide sequence
cactggacgctgcctccca

SEQ ID NO: 50017 - DNA, 21 bp, Artificial sequence
  synthetic polynucleotide sequence
atgtaacccggccttggacga

SEQ ID NO: 50018 - DNA, 22 bp, Artificial sequence
  synthetic polynucleotide sequence
atgaaggagcagtagacagcga

SEQ ID NO: 50019 - DNA, 20 bp, Artificial sequence
  synthetic polynucleotide sequence
agctcccccagccccacgaa

SEQ ID NO: 50020 - DNA, 21 bp, Artificial sequence
  synthetic polynucleotide sequence
tcgagacggacgatttgccaa

SEQ ID NO: 50021 - DNA, 21 bp, Artificial sequence
  synthetic polynucleotide sequence
acagagctagttcccggggaa

SEQ ID NO: 50022 - DNA, 20 bp, Artificial sequence
  synthetic polynucleotide sequence
caggcaggctcttccaggca

SEQ ID NO: 50023 - DNA, 20 bp, Artificial sequence
  synthetic polynucleotide sequence
tgggacctggagacaggcaa

SEQ ID NO: 50024 - DNA, 21 bp, Artificial sequence
  synthetic polynucleotide sequence
gatccacgtcgaagcctgaga

SEQ ID NO: 50025 - DNA, 20 bp, Artificial sequence
  synthetic polynucleotide sequence
actagccttcagggagggca

SEQ ID NO: 50026 - DNA, 21 bp, Artificial sequence
  synthetic polynucleotide sequence
tactcgttggtgcacagagga

SEQ ID NO: 50027 - DNA, 18 bp, Artificial sequence
  synthetic polynucleotide sequence
cgtcggttacagcgggaa

SEQ ID NO: 50028 - DNA, 19 bp, Artificial sequence
  synthetic polynucleotide sequence
gagtgcaggtcctccacca

SEQ ID NO: 50029 - DNA, 18 bp, Artificial sequence
  synthetic polynucleotide sequence
ccctggatccagaaccca

SEQ ID NO: 50030 - DNA, 18 bp, Artificial sequence
  synthetic polynucleotide sequence
aacagccggatgacgcca

SEQ ID NO: 50031 - DNA, 21 bp, Artificial sequence
  synthetic polynucleotide sequence
gcagccgagatggaactgtga

SEQ ID NO: 50032 - DNA, 20 bp, Artificial sequence
  synthetic polynucleotide sequence
tgtctcccaccgtaatgcca

SEQ ID NO: 50033 - DNA, 22 bp, Artificial sequence
  synthetic polynucleotide sequence
ccaagaggaagtcagacccaga

SEQ ID NO: 50034 - DNA, 20 bp, Artificial sequence
  synthetic polynucleotide sequence
ctcatctggatccacgagga

SEQ ID NO: 50035 - DNA, 21 bp, Artificial sequence
  synthetic polynucleotide sequence
catcaggggcagctgatggaa

SEQ ID NO: 50036 - DNA, 22 bp, Artificial sequence
  synthetic polynucleotide sequence
taaatcaccacatgaggagcca

SEQ ID NO: 50037 - DNA, 20 bp, Artificial sequence
  synthetic polynucleotide sequence
ctggaacccccgaccagaga

SEQ ID NO: 50038 - DNA, 21 bp, Artificial sequence
  synthetic polynucleotide sequence
ggtagcccatgttgagcagca

SEQ ID NO: 50039 - DNA, 20 bp, Artificial sequence
  synthetic polynucleotide sequence
aggcgagacctggagatgga

SEQ ID NO: 50040 - DNA, 23 bp, Artificial sequence
  synthetic polynucleotide sequence
cataagtgtcaaagaggcaggga

SEQ ID NO: 50041 - DNA, 22 bp, Artificial sequence
  synthetic polynucleotide sequence
atgctgcctctgaagaaggaga

SEQ ID NO: 50042 - DNA, 18 bp, Artificial sequence
  synthetic polynucleotide sequence
actgtgagggcaagcgca

SEQ ID NO: 50043 - DNA, 20 bp, Artificial sequence
  synthetic polynucleotide sequence
tggggagaggcttcagggaa

SEQ ID NO: 50044 - DNA, 20 bp, Artificial sequence
  synthetic polynucleotide sequence
cagcaagagaggcagggcaa

SEQ ID NO: 50045 - DNA, 18 bp, Artificial sequence
  synthetic polynucleotide sequence
cctggatggccctgagga

SEQ ID NO: 50046 - DNA, 20 bp, Artificial sequence
  synthetic polynucleotide sequence
atgtggcactcatagcccga

SEQ ID NO: 50047 - DNA, 20 bp, Artificial sequence
  synthetic polynucleotide sequence
atcaaagtctgccagcagca

SEQ ID NO: 50048 - DNA, 20 bp, Artificial sequence
  synthetic polynucleotide sequence
ctcatgcaaacattcccaca

SEQ ID NO: 50049 - DNA, 18 bp, Artificial sequence
  synthetic polynucleotide sequence
gtgagaagcgacccagca

SEQ ID NO: 50050 - DNA, 21 bp, Artificial sequence
  synthetic polynucleotide sequence
cccacagaaggctgaacagca

SEQ ID NO: 50051 - DNA, 22 bp, Artificial sequence
  synthetic polynucleotide sequence
aggactgtctgggggaaaggaa

SEQ ID NO: 50052 - DNA, 20 bp, Artificial sequence
  synthetic polynucleotide sequence
cctggacacttggcctccca

SEQ ID NO: 50053 - DNA, 18 bp, Artificial sequence
  synthetic polynucleotide sequence
gcctggtcaaacccagca

SEQ ID NO: 50054 - DNA, 19 bp, Artificial sequence
  synthetic polynucleotide sequence
gctaggcagaacaccacca

SEQ ID NO: 50055 - DNA, 20 bp, Artificial sequence
  synthetic polynucleotide sequence
ggctgagcagtgaggagaga

SEQ ID NO: 50056 - DNA, 20 bp, Artificial sequence
  synthetic polynucleotide sequence
gtggtcagcccaagagggaa

SEQ ID NO: 50057 - DNA, 18 bp, Artificial sequence
  synthetic polynucleotide sequence
gcacctgcctcggagaca

SEQ ID NO: 50058 - DNA, 18 bp, Artificial sequence
  synthetic polynucleotide sequence
gggacacagaagcggcca

SEQ ID NO: 50059 - DNA, 20 bp, Artificial sequence
  synthetic polynucleotide sequence
caccccagtactctgcacca

SEQ ID NO: 50060 - DNA, 22 bp, Artificial sequence
  synthetic polynucleotide sequence
tggaggaagcagcatgtacgga

SEQ ID NO: 50061 - DNA, 21 bp, Artificial sequence
  synthetic polynucleotide sequence
tccagaaactgaaccccagga

SEQ ID NO: 50062 - DNA, 22 bp, Artificial sequence
  synthetic polynucleotide sequence
gaagtggtcaaggggaagagca

SEQ ID NO: 50063 - DNA, 20 bp, Artificial sequence
  synthetic polynucleotide sequence
agtgctgggtacagcctcca

SEQ ID NO: 50064 - DNA, 20 bp, Artificial sequence
  synthetic polynucleotide sequence
ccacagtaggtccagcagca

SEQ ID NO: 50065 - DNA, 20 bp, Artificial sequence
  synthetic polynucleotide sequence
gtctctgagctgaccgagga

SEQ ID NO: 50066 - DNA, 18 bp, Artificial sequence
  synthetic polynucleotide sequence
cccagtccacgtgaagca

SEQ ID NO: 50067 - DNA, 18 bp, Artificial sequence
  synthetic polynucleotide sequence
catcgacaacagcgccga

SEQ ID NO: 50068 - DNA, 18 bp, Artificial sequence
  synthetic polynucleotide sequence
gccagcagcttaaggcga

SEQ ID NO: 50069 - DNA, 21 bp, Artificial sequence
  synthetic polynucleotide sequence
atcttggcccaaaccccagca

SEQ ID NO: 50070 - DNA, 21 bp, Artificial sequence
  synthetic polynucleotide sequence
ctgtcctcctcagagtcagca

SEQ ID NO: 50071 - DNA, 20 bp, Artificial sequence
  synthetic polynucleotide sequence
gcctcggaacgagaggccca

SEQ ID NO: 50072 - DNA, 20 bp, Artificial sequence
  synthetic polynucleotide sequence
accctcgatggcgatgccca

SEQ ID NO: 50073 - DNA, 18 bp, Artificial sequence
  synthetic polynucleotide sequence
caggatggggtggcagca

SEQ ID NO: 50074 - DNA, 18 bp, Artificial sequence
  synthetic polynucleotide sequence
cccatcaggacactcgca

SEQ ID NO: 50075 - DNA, 18 bp, Artificial sequence
  synthetic polynucleotide sequence
gtcccaggagtggaccca

SEQ ID NO: 50076 - DNA, 21 bp, Artificial sequence
  synthetic polynucleotide sequence
catggagagtcttggaagcca

SEQ ID NO: 50077 - DNA, 21 bp, Artificial sequence
  synthetic polynucleotide sequence
ttccggaaacccaacctgcaa

SEQ ID NO: 50078 - DNA, 20 bp, Artificial sequence
  synthetic polynucleotide sequence
cttgaccacatggccaggga

SEQ ID NO: 50079 - DNA, 18 bp, Artificial sequence
  synthetic polynucleotide sequence
ctggaccccgacgcagca

SEQ ID NO: 50080 - DNA, 20 bp, Artificial sequence
  synthetic polynucleotide sequence
cttccgcttggagccaggga

SEQ ID NO: 50081 - DNA, 21 bp, Artificial sequence
  synthetic polynucleotide sequence
tccctacccaggtgtcagaca

SEQ ID NO: 50082 - DNA, 18 bp, Artificial sequence
  synthetic polynucleotide sequence
caactagcagccgtggca

SEQ ID NO: 50083 - DNA, 22 bp, Artificial sequence
  synthetic polynucleotide sequence
agcaacactgagaccgtgcaca

SEQ ID NO: 50084 - DNA, 21 bp, Artificial sequence
  synthetic polynucleotide sequence
tgtcacttgggaaggcaggta

SEQ ID NO: 50085 - DNA, 18 bp, Artificial sequence
  synthetic polynucleotide sequence
gcgggctgcatcagcaca

SEQ ID NO: 50086 - DNA, 18 bp, Artificial sequence
  synthetic polynucleotide sequence
ccataggacctggcggga

SEQ ID NO: 50087 - DNA, 18 bp, Artificial sequence
  synthetic polynucleotide sequence
tgggtgtgcggccaagga

SEQ ID NO: 50088 - DNA, 20 bp, Artificial sequence
  synthetic polynucleotide sequence
gcagggaagagacaaggcca

SEQ ID NO: 50089 - DNA, 20 bp, Artificial sequence
  synthetic polynucleotide sequence
ctgctgcagggtacagggca

SEQ ID NO: 50090 - DNA, 20 bp, Artificial sequence
  synthetic polynucleotide sequence
tgagggcatttgcagggcca

SEQ ID NO: 50091 - DNA, 19 bp, Artificial sequence
  synthetic polynucleotide sequence
ccagcagaggtcaaggcca

SEQ ID NO: 50092 - DNA, 18 bp, Artificial sequence
  synthetic polynucleotide sequence
gtctcgatgggcgagcca

SEQ ID NO: 50093 - DNA, 19 bp, Artificial sequence
  synthetic polynucleotide sequence
cagtccagcctgccagcta

SEQ ID NO: 50094 - DNA, 18 bp, Artificial sequence
  synthetic polynucleotide sequence
tcatggcagcgcaggcca

SEQ ID NO: 50095 - DNA, 20 bp, Artificial sequence
  synthetic polynucleotide sequence
aaccagagggtgatcaggga

SEQ ID NO: 50096 - DNA, 18 bp, Artificial sequence
  synthetic polynucleotide sequence
ggcatggaagacgcagga

SEQ ID NO: 50097 - DNA, 21 bp, Artificial sequence
  synthetic polynucleotide sequence
tggggctcactgcagacagca

SEQ ID NO: 50098 - DNA, 21 bp, Artificial sequence
  synthetic polynucleotide sequence
atcactggctaagccggagca

SEQ ID NO: 50099 - DNA, 21 bp, Artificial sequence
  synthetic polynucleotide sequence
catgccaacagtctccagcca

SEQ ID NO: 50100 - DNA, 20 bp, Artificial sequence
  synthetic polynucleotide sequence
gtggcaaggaagttgggaca

SEQ ID NO: 50101 - DNA, 19 bp, Artificial sequence
  synthetic polynucleotide sequence
gggctggagttgaggagga

SEQ ID NO: 50102 - DNA, 19 bp, Artificial sequence
  synthetic polynucleotide sequence
gactctgcagctcagccca

SEQ ID NO: 50103 - DNA, 20 bp, Artificial sequence
  synthetic polynucleotide sequence
cccaacccaatccctctcca

SEQ ID NO: 50104 - DNA, 21 bp, Artificial sequence
  synthetic polynucleotide sequence
ctgaggagagaagagggacca

SEQ ID NO: 50105 - DNA, 23 bp, Artificial sequence
  synthetic polynucleotide sequence
cacagatgtgagtaagcgagaca

SEQ ID NO: 50106 - DNA, 20 bp, Artificial sequence
  synthetic polynucleotide sequence
cccatgcctccccccagcaa

SEQ ID NO: 50107 - DNA, 18 bp, Artificial sequence
  synthetic polynucleotide sequence
gggcctgcaacaagacca

SEQ ID NO: 50108 - DNA, 18 bp, Artificial sequence
  synthetic polynucleotide sequence
gcaccagtggaagcggca

SEQ ID NO: 50109 - DNA, 18 bp, Artificial sequence
  synthetic polynucleotide sequence
cgggacacaagacaggca

SEQ ID NO: 50110 - DNA, 19 bp, Artificial sequence
  synthetic polynucleotide sequence
ggcaggtgacgtagcagca

SEQ ID NO: 50111 - DNA, 19 bp, Artificial sequence
  synthetic polynucleotide sequence
cccagggacacaaggcaga

SEQ ID NO: 50112 - DNA, 18 bp, Artificial sequence
  synthetic polynucleotide sequence
tccacgtgcctgaccaca

SEQ ID NO: 50113 - DNA, 18 bp, Artificial sequence
  synthetic polynucleotide sequence
ggctccctgggtacagca

SEQ ID NO: 50114 - DNA, 18 bp, Artificial sequence
  synthetic polynucleotide sequence
catccgggtgacatggga

SEQ ID NO: 50115 - DNA, 18 bp, Artificial sequence
  synthetic polynucleotide sequence
atcgccgtgccacccgga

SEQ ID NO: 50116 - DNA, 21 bp, Artificial sequence
  synthetic polynucleotide sequence
cacactgggtaacacgggtga

SEQ ID NO: 50117 - DNA, 21 bp, Artificial sequence
  synthetic polynucleotide sequence
gcacgactatcctggaccaca

SEQ ID NO: 50118 - DNA, 20 bp, Artificial sequence
  synthetic polynucleotide sequence
gaagtcaccgatggcacgga

SEQ ID NO: 50119 - DNA, 20 bp, Artificial sequence
  synthetic polynucleotide sequence
gagatggtggtggagaagca

SEQ ID NO: 50120 - DNA, 21 bp, Artificial sequence
  synthetic polynucleotide sequence
gcgaggcctcgtagtagacca

SEQ ID NO: 50121 - DNA, 18 bp, Artificial sequence
  synthetic polynucleotide sequence
tgcggctgtgacaggaca

SEQ ID NO: 50122 - DNA, 18 bp, Artificial sequence
  synthetic polynucleotide sequence
ctctcccgcacatccaca

SEQ ID NO: 50123 - DNA, 18 bp, Artificial sequence
  synthetic polynucleotide sequence
acaagacgtcggagggca

SEQ ID NO: 50124 - DNA, 19 bp, Artificial sequence
  synthetic polynucleotide sequence
tgcacttgacgtagcagca

SEQ ID NO: 50125 - DNA, 18 bp, Artificial sequence
  synthetic polynucleotide sequence
acaagacctcggagggca

SEQ ID NO: 50126 - DNA, 18 bp, Artificial sequence
  synthetic polynucleotide sequence
cgaagcagcaccagtgga

SEQ ID NO: 50127 - DNA, 20 bp, Artificial sequence
  synthetic polynucleotide sequence
acagcgggcgatctgccaga

SEQ ID NO: 50128 - DNA, 20 bp, Artificial sequence
  synthetic polynucleotide sequence
cagagcagttccagcggcca

SEQ ID NO: 50129 - DNA, 18 bp, Artificial sequence
  synthetic polynucleotide sequence
ccgacgtgcgttacggca

SEQ ID NO: 50130 - DNA, 18 bp, Artificial sequence
  synthetic polynucleotide sequence
gggcagcgtggtccagca

SEQ ID NO: 50131 - DNA, 18 bp, Artificial sequence
  synthetic polynucleotide sequence
acatccaggtgggagcga

SEQ ID NO: 50132 - DNA, 20 bp, Artificial sequence
  synthetic polynucleotide sequence
cacttgaccgtacagcacca

SEQ ID NO: 50133 - DNA, 18 bp, Artificial sequence
  synthetic polynucleotide sequence
aggcggtgaagggcacca

SEQ ID NO: 50134 - DNA, 18 bp, Artificial sequence
  synthetic polynucleotide sequence
tgccagcaccctgcagca

SEQ ID NO: 50135 - DNA, 18 bp, Artificial sequence
  synthetic polynucleotide sequence
ccatgaggtgggcaagca

SEQ ID NO: 50136 - DNA, 18 bp, Artificial sequence
  synthetic polynucleotide sequence
gggagaagcggccagcca

SEQ ID NO: 50137 - DNA, 18 bp, Artificial sequence
  synthetic polynucleotide sequence
gttccgtgagacgggcca

SEQ ID NO: 50138 - DNA, 20 bp, Artificial sequence
  synthetic polynucleotide sequence
ccatgtacaccaggtcccca

SEQ ID NO: 50139 - DNA, 19 bp, Artificial sequence
  synthetic polynucleotide sequence
ggtcgagaggtgaccacca

SEQ ID NO: 50140 - DNA, 18 bp, Artificial sequence
  synthetic polynucleotide sequence
ccgtccgtgtcccacaca

SEQ ID NO: 50141 - DNA, 21 bp, Artificial sequence
  synthetic polynucleotide sequence
taccgacagagcaaacccgaa

SEQ ID NO: 50142 - DNA, 20 bp, Artificial sequence
  synthetic polynucleotide sequence
tgtcccagacccagacggca

SEQ ID NO: 50143 - DNA, 20 bp, Artificial sequence
  synthetic polynucleotide sequence
gccagatatgccaggctgga

SEQ ID NO: 50144 - DNA, 21 bp, Artificial sequence
  synthetic polynucleotide sequence
agatcatcagggcagcctgca

SEQ ID NO: 50145 - DNA, 18 bp, Artificial sequence
  synthetic polynucleotide sequence
cggcacaagagcaggaga

SEQ ID NO: 50146 - DNA, 18 bp, Artificial sequence
  synthetic polynucleotide sequence
agaggggccaacatggca

SEQ ID NO: 50147 - DNA, 20 bp, Artificial sequence
  synthetic polynucleotide sequence
ctgcatctccgccctgcaca

SEQ ID NO: 50148 - DNA, 21 bp, Artificial sequence
  synthetic polynucleotide sequence
tgtcctcgctggcaaacctga

SEQ ID NO: 50149 - DNA, 20 bp, Artificial sequence
  synthetic polynucleotide sequence
cagtcggagccagtaaagca

SEQ ID NO: 50150 - DNA, 20 bp, Artificial sequence
  synthetic polynucleotide sequence
cagatcgtacccaccggtca

SEQ ID NO: 50151 - DNA, 19 bp, Artificial sequence
  synthetic polynucleotide sequence
ggtcactccaccacaccca

SEQ ID NO: 50152 - DNA, 18 bp, Artificial sequence
  synthetic polynucleotide sequence
cagaactggacgtggcca

SEQ ID NO: 50153 - DNA, 18 bp, Artificial sequence
  synthetic polynucleotide sequence
gagcaaagagtggccgga

SEQ ID NO: 50154 - DNA, 18 bp, Artificial sequence
  synthetic polynucleotide sequence
cgttgaggaaggccacca

SEQ ID NO: 50155 - DNA, 22 bp, Artificial sequence
  synthetic polynucleotide sequence
ccatctgcatcaagacgcacga

SEQ ID NO: 50156 - DNA, 20 bp, Artificial sequence
  synthetic polynucleotide sequence
cttgcggttgaactcagcca

SEQ ID NO: 50157 - DNA, 19 bp, Artificial sequence
  synthetic polynucleotide sequence
ccgaccacctgaagaccca

SEQ ID NO: 50158 - DNA, 18 bp, Artificial sequence
  synthetic polynucleotide sequence
tgacaacttggccaccga

SEQ ID NO: 50159 - DNA, 20 bp, Artificial sequence
  synthetic polynucleotide sequence
aggagtctgcacgcagggaa

SEQ ID NO: 50160 - DNA, 20 bp, Artificial sequence
  synthetic polynucleotide sequence
ggcaacgctcggctgctgga

SEQ ID NO: 50161 - DNA, 21 bp, Artificial sequence
  synthetic polynucleotide sequence
tgtactccgggttccagcaga

SEQ ID NO: 50162 - DNA, 18 bp, Artificial sequence
  synthetic polynucleotide sequence
acgggcacaggaggcgca

SEQ ID NO: 50163 - DNA, 19 bp, Artificial sequence
  synthetic polynucleotide sequence
cgaggcttccgtgcagaga

SEQ ID NO: 50164 - DNA, 18 bp, Artificial sequence
  synthetic polynucleotide sequence
gaattcgggtcgcaccca

SEQ ID NO: 50165 - DNA, 22 bp, Artificial sequence
  synthetic polynucleotide sequence
caaagacctcagaagtcagcca

SEQ ID NO: 50166 - DNA, 21 bp, Artificial sequence
  synthetic polynucleotide sequence
acactgctcctcacaaacgga

SEQ ID NO: 50167 - DNA, 20 bp, Artificial sequence
  synthetic polynucleotide sequence
agttcaacgctgccccggaa

SEQ ID NO: 50168 - DNA, 21 bp, Artificial sequence
  synthetic polynucleotide sequence
atccagctccaagtccaggga

SEQ ID NO: 50169 - DNA, 22 bp, Artificial sequence
  synthetic polynucleotide sequence
agaaccacctacttggacccaa

SEQ ID NO: 50170 - DNA, 20 bp, Artificial sequence
  synthetic polynucleotide sequence
agctccagtgaccacaacca

SEQ ID NO: 50171 - DNA, 21 bp, Artificial sequence
  synthetic polynucleotide sequence
gtggcaatctcagcggaacca

SEQ ID NO: 50172 - DNA, 19 bp, Artificial sequence
  synthetic polynucleotide sequence
tttcccagcctggtggcaa

SEQ ID NO: 50173 - DNA, 21 bp, Artificial sequence
  synthetic polynucleotide sequence
ctgaaggagaggaacccagca

SEQ ID NO: 50174 - DNA, 21 bp, Artificial sequence
  synthetic polynucleotide sequence
aatagacacgtccgttgggca

SEQ ID NO: 50175 - DNA, 18 bp, Artificial sequence
  synthetic polynucleotide sequence
ctgtcaacccacccacga

SEQ ID NO: 50176 - DNA, 21 bp, Artificial sequence
  synthetic polynucleotide sequence
tggggacactgtagcacccta

SEQ ID NO: 50177 - DNA, 19 bp, Artificial sequence
  synthetic polynucleotide sequence
tctggcagacgtggaagga

SEQ ID NO: 50178 - DNA, 20 bp, Artificial sequence
  synthetic polynucleotide sequence
actgcccgagaccttgagca

SEQ ID NO: 50179 - DNA, 19 bp, Artificial sequence
  synthetic polynucleotide sequence
aggagcataggacagggca

SEQ ID NO: 50180 - DNA, 18 bp, Artificial sequence
  synthetic polynucleotide sequence
ccgatgggaagacgccca

SEQ ID NO: 50181 - DNA, 18 bp, Artificial sequence
  synthetic polynucleotide sequence
tcctacacctgggcagca

SEQ ID NO: 50182 - DNA, 18 bp, Artificial sequence
  synthetic polynucleotide sequence
cttgacgccggaacccaa

SEQ ID NO: 50183 - DNA, 20 bp, Artificial sequence
  synthetic polynucleotide sequence
accgctggggagctgtgaga

SEQ ID NO: 50184 - DNA, 20 bp, Artificial sequence
  synthetic polynucleotide sequence
tgggaggactggcctgcgga

SEQ ID NO: 50185 - DNA, 20 bp, Artificial sequence
  synthetic polynucleotide sequence
ggccgaggagaagtgtacca

SEQ ID NO: 50186 - DNA, 20 bp, Artificial sequence
  synthetic polynucleotide sequence
gaccaggtgcaggatcccga

SEQ ID NO: 50187 - DNA, 18 bp, Artificial sequence
  synthetic polynucleotide sequence
cctggaggagctcccaga

SEQ ID NO: 50188 - DNA, 19 bp, Artificial sequence
  synthetic polynucleotide sequence
gatgacgtccccactgaca

SEQ ID NO: 50189 - DNA, 20 bp, Artificial sequence
  synthetic polynucleotide sequence
tgtgtgagcctcactaccca

SEQ ID NO: 50190 - DNA, 20 bp, Artificial sequence
  synthetic polynucleotide sequence
ctgaccacgtctctcaccca

SEQ ID NO: 50191 - DNA, 20 bp, Artificial sequence
  synthetic polynucleotide sequence
cggaaggctccttgagagca

SEQ ID NO: 50192 - DNA, 20 bp, Artificial sequence
  synthetic polynucleotide sequence
ctgaccacgtctctcaccca

SEQ ID NO: 50193 - DNA, 21 bp, Artificial sequence
  synthetic polynucleotide sequence
cgaggccaaacagcagctaga

SEQ ID NO: 50194 - DNA, 20 bp, Artificial sequence
  synthetic polynucleotide sequence
tgtgcggaacttgaccccca

SEQ ID NO: 50195 - DNA, 18 bp, Artificial sequence
  synthetic polynucleotide sequence
ggcggctgtgcaaaacca

SEQ ID NO: 50196 - DNA, 18 bp, Artificial sequence
  synthetic polynucleotide sequence
ctctgcaggcatcccaca

SEQ ID NO: 50197 - DNA, 25 bp, Artificial sequence
  synthetic polynucleotide sequence
caacgtatggcaatccagaaggcaa

SEQ ID NO: 50198 - DNA, 20 bp, Artificial sequence
  synthetic polynucleotide sequence
agtgtcaccaccaccacgga

SEQ ID NO: 50199 - DNA, 18 bp, Artificial sequence
  synthetic polynucleotide sequence
ggcgcctgcaagaggaga

SEQ ID NO: 50200 - DNA, 21 bp, Artificial sequence
  synthetic polynucleotide sequence
gactgtgtagcacatgggaca

SEQ ID NO: 50201 - DNA, 20 bp, Artificial sequence
  synthetic polynucleotide sequence
gaggctgccaactccaggca

SEQ ID NO: 50202 - DNA, 20 bp, Artificial sequence
  synthetic polynucleotide sequence
tctcctgcatcaccagccca

SEQ ID NO: 50203 - DNA, 18 bp, Artificial sequence
  synthetic polynucleotide sequence
caacagaagctgcccgca

SEQ ID NO: 50204 - DNA, 20 bp, Artificial sequence
  synthetic polynucleotide sequence
ctgcacctccactctgggaa

SEQ ID NO: 50205 - DNA, 19 bp, Artificial sequence
  synthetic polynucleotide sequence
gccctgacctcatcagcaa

SEQ ID NO: 50206 - DNA, 19 bp, Artificial sequence
  synthetic polynucleotide sequence
ccaatgagcagctgcagga

SEQ ID NO: 50207 - DNA, 22 bp, Artificial sequence
  synthetic polynucleotide sequence
aacacgatgctggaaagggaga

SEQ ID NO: 50208 - DNA, 21 bp, Artificial sequence
  synthetic polynucleotide sequence
atattgcagcgaatggcccca

SEQ ID NO: 50209 - DNA, 21 bp, Artificial sequence
  synthetic polynucleotide sequence
ccagattcgggcagtcaccaa

SEQ ID NO: 50210 - DNA, 20 bp, Artificial sequence
  synthetic polynucleotide sequence
atgatggggtggatggggca

SEQ ID NO: 50211 - DNA, 21 bp, Artificial sequence
  synthetic polynucleotide sequence
agctactctgcaaacggccca

SEQ ID NO: 50212 - DNA, 18 bp, Artificial sequence
  synthetic polynucleotide sequence
tgtcggggaagggcgcca

SEQ ID NO: 50213 - DNA, 20 bp, Artificial sequence
  synthetic polynucleotide sequence
gcgtgctgcatcccacagga

SEQ ID NO: 50214 - DNA, 20 bp, Artificial sequence
  synthetic polynucleotide sequence
cccagggatctcaggcgcca

SEQ ID NO: 50215 - DNA, 18 bp, Artificial sequence
  synthetic polynucleotide sequence
cgggagagcgtgcaggga

SEQ ID NO: 50216 - DNA, 20 bp, Artificial sequence
  synthetic polynucleotide sequence
gcgaggcaagtcaatccgga

SEQ ID NO: 50217 - DNA, 21 bp, Artificial sequence
  synthetic polynucleotide sequence
ggtctggcttcagggcacaga

SEQ ID NO: 50218 - DNA, 21 bp, Artificial sequence
  synthetic polynucleotide sequence
ccaggagctatgagtcaccca

SEQ ID NO: 50219 - DNA, 21 bp, Artificial sequence
  synthetic polynucleotide sequence
acctacctggaaggctgccca

SEQ ID NO: 50220 - DNA, 21 bp, Artificial sequence
  synthetic polynucleotide sequence
caagagaccatgatggccgca

SEQ ID NO: 50221 - DNA, 21 bp, Artificial sequence
  synthetic polynucleotide sequence
caaagggcagaactggggaca

SEQ ID NO: 50222 - DNA, 21 bp, Artificial sequence
  synthetic polynucleotide sequence
gagctgcaaggcaatcaagga

SEQ ID NO: 50223 - DNA, 20 bp, Artificial sequence
  synthetic polynucleotide sequence
gcggcgagcagtaagaagca

SEQ ID NO: 50224 - DNA, 21 bp, Artificial sequence
  synthetic polynucleotide sequence
tcatatgtcagttcatggcca

SEQ ID NO: 50225 - DNA, 19 bp, Artificial sequence
  synthetic polynucleotide sequence
ggccgagaccttgagacca

SEQ ID NO: 50226 - DNA, 18 bp, Artificial sequence
  synthetic polynucleotide sequence
agatgccgcttcagggca

SEQ ID NO: 50227 - DNA, 18 bp, Artificial sequence
  synthetic polynucleotide sequence
cttgcacgggactggaca

SEQ ID NO: 50228 - DNA, 18 bp, Artificial sequence
  synthetic polynucleotide sequence
ccgggctcatcagtgaca

SEQ ID NO: 50229 - DNA, 20 bp, Artificial sequence
  synthetic polynucleotide sequence
aggcgccagctactagagga

SEQ ID NO: 50230 - DNA, 18 bp, Artificial sequence
  synthetic polynucleotide sequence
ggatggcaagggtggaga

SEQ ID NO: 50231 - DNA, 20 bp, Artificial sequence
  synthetic polynucleotide sequence
ggatgaggccctcacatgca

SEQ ID NO: 50232 - DNA, 21 bp, Artificial sequence
  synthetic polynucleotide sequence
caggagacttgatcagccgga

SEQ ID NO: 50233 - DNA, 19 bp, Artificial sequence
  synthetic polynucleotide sequence
tgcacaagaagaagctgca

SEQ ID NO: 50234 - DNA, 18 bp, Artificial sequence
  synthetic polynucleotide sequence
taggtgagggaaggccga

SEQ ID NO: 50235 - DNA, 21 bp, Artificial sequence
  synthetic polynucleotide sequence
cagtacagcgttcggagcaga

SEQ ID NO: 50236 - DNA, 22 bp, Artificial sequence
  synthetic polynucleotide sequence
caaagtgacaaggagctgcaca

SEQ ID NO: 50237 - DNA, 21 bp, Artificial sequence
  synthetic polynucleotide sequence
tggaggagcaactggtgagga

SEQ ID NO: 50238 - DNA, 20 bp, Artificial sequence
  synthetic polynucleotide sequence
tgccatagctgagggggtga

SEQ ID NO: 50239 - DNA, 22 bp, Artificial sequence
  synthetic polynucleotide sequence
agcagatggagaatgagcccca

SEQ ID NO: 50240 - DNA, 21 bp, Artificial sequence
  synthetic polynucleotide sequence
catgggacttgtggaccagga

SEQ ID NO: 50241 - DNA, 19 bp, Artificial sequence
  synthetic polynucleotide sequence
gagctgctacagagcgcca

SEQ ID NO: 50242 - DNA, 20 bp, Artificial sequence
  synthetic polynucleotide sequence
cccgacagacaagctcacca

SEQ ID NO: 50243 - DNA, 22 bp, Artificial sequence
  synthetic polynucleotide sequence
aaaggcaagcctctctagcaga

SEQ ID NO: 50244 - DNA, 21 bp, Artificial sequence
  synthetic polynucleotide sequence
gaagcagatggaatgaacgga

SEQ ID NO: 50245 - DNA, 20 bp, Artificial sequence
  synthetic polynucleotide sequence
atggttggagacaggctgga

SEQ ID NO: 50246 - DNA, 19 bp, Artificial sequence
  synthetic polynucleotide sequence
taagcagccaaaaccggga

SEQ ID NO: 50247 - DNA, 21 bp, Artificial sequence
  synthetic polynucleotide sequence
ggacagtgaggaacaccagga

SEQ ID NO: 50248 - DNA, 18 bp, Artificial sequence
  synthetic polynucleotide sequence
ttccgccgctcgtcccca

SEQ ID NO: 50249 - DNA, 23 bp, Artificial sequence
  synthetic polynucleotide sequence
gtgtactgcagtagtagcaccca

SEQ ID NO: 50250 - DNA, 23 bp, Artificial sequence
  synthetic polynucleotide sequence
caaaaagaaccaggcgatagtca

SEQ ID NO: 50251 - DNA, 18 bp, Artificial sequence
  synthetic polynucleotide sequence
atggaggagcagggcgca

SEQ ID NO: 50252 - DNA, 18 bp, Artificial sequence
  synthetic polynucleotide sequence
gggcagagagcacccgca

SEQ ID NO: 50253 - DNA, 23 bp, Artificial sequence
  synthetic polynucleotide sequence
gcagctcaagaacgagaaaagga

SEQ ID NO: 50254 - DNA, 18 bp, Artificial sequence
  synthetic polynucleotide sequence
gcagctgaagccaaccca

SEQ ID NO: 50255 - DNA, 21 bp, Artificial sequence
  synthetic polynucleotide sequence
gcagcaagagatgatgaggca

SEQ ID NO: 50256 - DNA, 18 bp, Artificial sequence
  synthetic polynucleotide sequence
gccacgccgacttgagga

SEQ ID NO: 50257 - DNA, 20 bp, Artificial sequence
  synthetic polynucleotide sequence
ctgcagcagcacttcaggaa

SEQ ID NO: 50258 - DNA, 18 bp, Artificial sequence
  synthetic polynucleotide sequence
catccaccaaggagccca

SEQ ID NO: 50259 - DNA, 21 bp, Artificial sequence
  synthetic polynucleotide sequence
agttcagactagccagccaga

SEQ ID NO: 50260 - DNA, 20 bp, Artificial sequence
  synthetic polynucleotide sequence
gcaggttgagcaatcggaga

SEQ ID NO: 50261 - DNA, 22 bp, Artificial sequence
  synthetic polynucleotide sequence
atgcagccttccagccaaacca

SEQ ID NO: 50262 - DNA, 21 bp, Artificial sequence
  synthetic polynucleotide sequence
tcttcctgagggtggtggcaa

SEQ ID NO: 50263 - DNA, 21 bp, Artificial sequence
  synthetic polynucleotide sequence
caagcagtacctggaggccaa

SEQ ID NO: 50264 - DNA, 21 bp, Artificial sequence
  synthetic polynucleotide sequence
tgaactcgaggaagtggccga

SEQ ID NO: 50265 - DNA, 18 bp, Artificial sequence
  synthetic polynucleotide sequence
ccacctcggggaccagga

SEQ ID NO: 50266 - DNA, 20 bp, Artificial sequence
  synthetic polynucleotide sequence
gtccctccaccaggtgcaca

SEQ ID NO: 50267 - DNA, 20 bp, Artificial sequence
  synthetic polynucleotide sequence
actacgtccagcgctacgga

SEQ ID NO: 50268 - DNA, 20 bp, Artificial sequence
  synthetic polynucleotide sequence
tggtgcccaggctgaccgca

SEQ ID NO: 50269 - DNA, 18 bp, Artificial sequence
  synthetic polynucleotide sequence
tcgcagccacctacgaca

SEQ ID NO: 50270 - DNA, 19 bp, Artificial sequence
  synthetic polynucleotide sequence
cgagaaggtcagaggcgca

SEQ ID NO: 50271 - DNA, 18 bp, Artificial sequence
  synthetic polynucleotide sequence
caacctgcgggtcaccaa

SEQ ID NO: 50272 - DNA, 18 bp, Artificial sequence
  synthetic polynucleotide sequence
agacttgctgcagccgga

SEQ ID NO: 50273 - DNA, 22 bp, Artificial sequence
  synthetic polynucleotide sequence
ctatggacgactccgaggaaca

SEQ ID NO: 50274 - DNA, 21 bp, Artificial sequence
  synthetic polynucleotide sequence
cactggccaactgcatccaga

SEQ ID NO: 50275 - DNA, 20 bp, Artificial sequence
  synthetic polynucleotide sequence
cagccgaagccgtcctcgga

SEQ ID NO: 50276 - DNA, 19 bp, Artificial sequence
  synthetic polynucleotide sequence
gtggaggtgcccttccgca

SEQ ID NO: 50277 - DNA, 18 bp, Artificial sequence
  synthetic polynucleotide sequence
gctgcggctgaaacagca

SEQ ID NO: 50278 - DNA, 20 bp, Artificial sequence
  synthetic polynucleotide sequence
taactggctacgcagggcta

SEQ ID NO: 50279 - DNA, 21 bp, Artificial sequence
  synthetic polynucleotide sequence
tgggggaagctgaaccacgga

SEQ ID NO: 50280 - DNA, 21 bp, Artificial sequence
  synthetic polynucleotide sequence
acacagaagcatgccttggga

SEQ ID NO: 50281 - DNA, 22 bp, Artificial sequence
  synthetic polynucleotide sequence
agctgggaaagtctgctggcaa

SEQ ID NO: 50282 - DNA, 22 bp, Artificial sequence
  synthetic polynucleotide sequence
tgatcaatctctggaaggggca

SEQ ID NO: 50283 - DNA, 21 bp, Artificial sequence
  synthetic polynucleotide sequence
cgagtcatccccatcaggaga

SEQ ID NO: 50284 - DNA, 22 bp, Artificial sequence
  synthetic polynucleotide sequence
agaaagcacatcggttgggaca

SEQ ID NO: 50285 - DNA, 18 bp, Artificial sequence
  synthetic polynucleotide sequence
cagcagggagatgagcga

SEQ ID NO: 50286 - DNA, 18 bp, Artificial sequence
  synthetic polynucleotide sequence
cgggaaccatcagcggga

SEQ ID NO: 50287 - DNA, 18 bp, Artificial sequence
  synthetic polynucleotide sequence
tgccccagcagttggaga

SEQ ID NO: 50288 - DNA, 18 bp, Artificial sequence
  synthetic polynucleotide sequence
tagggacgccggtatcca

SEQ ID NO: 50289 - DNA, 18 bp, Artificial sequence
  synthetic polynucleotide sequence
cggcctgcggtggacaga

SEQ ID NO: 50290 - DNA, 20 bp, Artificial sequence
  synthetic polynucleotide sequence
gtgggaggcacactggggta

SEQ ID NO: 50291 - DNA, 19 bp, Artificial sequence
  synthetic polynucleotide sequence
cctcagcctctccgagcca

SEQ ID NO: 50292 - DNA, 21 bp, Artificial sequence
  synthetic polynucleotide sequence
gatcatgtcctccaccacgga

SEQ ID NO: 50293 - DNA, 21 bp, Artificial sequence
  synthetic polynucleotide sequence
tacacagcaagacaaggtgca

SEQ ID NO: 50294 - DNA, 18 bp, Artificial sequence
  synthetic polynucleotide sequence
agccctgagggcacggca

SEQ ID NO: 50295 - DNA, 20 bp, Artificial sequence
  synthetic polynucleotide sequence
cagaaaaggttctccccgga

SEQ ID NO: 50296 - DNA, 18 bp, Artificial sequence
  synthetic polynucleotide sequence
acagcagccccgtgagca

SEQ ID NO: 50297 - DNA, 18 bp, Artificial sequence
  synthetic polynucleotide sequence
ccctggaggtgctggcca

SEQ ID NO: 50298 - DNA, 21 bp, Artificial sequence
  synthetic polynucleotide sequence
ctgccaagatcttcagccgca

SEQ ID NO: 50299 - DNA, 21 bp, Artificial sequence
  synthetic polynucleotide sequence
gatccccaagaggctcaggaa

SEQ ID NO: 50300 - DNA, 22 bp, Artificial sequence
  synthetic polynucleotide sequence
aaaggggccatagagatctgga

SEQ ID NO: 50301 - DNA, 20 bp, Artificial sequence
  synthetic polynucleotide sequence
caagggtgtccaggagcgca

SEQ ID NO: 50302 - DNA, 18 bp, Artificial sequence
  synthetic polynucleotide sequence
ccaggagggcgtggagca

SEQ ID NO: 50303 - DNA, 21 bp, Artificial sequence
  synthetic polynucleotide sequence
tggtagaggggatcctggaca

SEQ ID NO: 50304 - DNA, 20 bp, Artificial sequence
  synthetic polynucleotide sequence
ggacggtggtgggaagccga

SEQ ID NO: 50305 - DNA, 21 bp, Artificial sequence
  synthetic polynucleotide sequence
cagcagacgcggaagatctca

SEQ ID NO: 50306 - DNA, 22 bp, Artificial sequence
  synthetic polynucleotide sequence
ttcaacttccagaagccagcca

SEQ ID NO: 50307 - DNA, 19 bp, Artificial sequence
  synthetic polynucleotide sequence
ttaccagccaactcaggca

SEQ ID NO: 50308 - DNA, 22 bp, Artificial sequence
  synthetic polynucleotide sequence
atgtggctccaaaagcaaggca

SEQ ID NO: 50309 - DNA, 18 bp, Artificial sequence
  synthetic polynucleotide sequence
cggggacagcatcgccca

SEQ ID NO: 50310 - DNA, 18 bp, Artificial sequence
  synthetic polynucleotide sequence
cccggatgcgagatctca

SEQ ID NO: 50311 - DNA, 20 bp, Artificial sequence
  synthetic polynucleotide sequence
aacggacctcactggaccca

SEQ ID NO: 50312 - DNA, 20 bp, Artificial sequence
  synthetic polynucleotide sequence
cccagcacgctggccacaca

SEQ ID NO: 50313 - DNA, 21 bp, Artificial sequence
  synthetic polynucleotide sequence
cacccagtgcgagaagatgga

SEQ ID NO: 50314 - DNA, 18 bp, Artificial sequence
  synthetic polynucleotide sequence
ccagcacgtcaggccgca

SEQ ID NO: 50315 - DNA, 20 bp, Artificial sequence
  synthetic polynucleotide sequence
agagatccagcgttcaggaa

SEQ ID NO: 50316 - DNA, 20 bp, Artificial sequence
  synthetic polynucleotide sequence
cagcaatgaccacacctgca

SEQ ID NO: 50317 - DNA, 21 bp, Artificial sequence
  synthetic polynucleotide sequence
ccatggagaagagcgagggca

SEQ ID NO: 50318 - DNA, 21 bp, Artificial sequence
  synthetic polynucleotide sequence
tctctcccaatcatcccacca

SEQ ID NO: 50319 - DNA, 22 bp, Artificial sequence
  synthetic polynucleotide sequence
aataggagccacaaacttccca

SEQ ID NO: 50320 - DNA, 22 bp, Artificial sequence
  synthetic polynucleotide sequence
attctccaactctgctccggaa

SEQ ID NO: 50321 - DNA, 21 bp, Artificial sequence
  synthetic polynucleotide sequence
aggcccagaagttcacctgca

SEQ ID NO: 50322 - DNA, 21 bp, Artificial sequence
  synthetic polynucleotide sequence
gcgtctcatctcaggggcaca

SEQ ID NO: 50323 - DNA, 18 bp, Artificial sequence
  synthetic polynucleotide sequence
cctggccaatcatgacga

SEQ ID NO: 50324 - DNA, 18 bp, Artificial sequence
  synthetic polynucleotide sequence
ccgcatgcagcccggtga

SEQ ID NO: 50325 - DNA, 20 bp, Artificial sequence
  synthetic polynucleotide sequence
ccaccggacctacagctgca

SEQ ID NO: 50326 - DNA, 18 bp, Artificial sequence
  synthetic polynucleotide sequence
ctgcaggcccacagccca

SEQ ID NO: 50327 - DNA, 21 bp, Artificial sequence
  synthetic polynucleotide sequence
tctccaagtccttccagggca

SEQ ID NO: 50328 - DNA, 20 bp, Artificial sequence
  synthetic polynucleotide sequence
cgcagtggatgtcggcgaca

SEQ ID NO: 50329 - DNA, 21 bp, Artificial sequence
  synthetic polynucleotide sequence
tgaccaaccgctcagaactca

SEQ ID NO: 50330 - DNA, 20 bp, Artificial sequence
  synthetic polynucleotide sequence
catgtggcggccagtgagca

SEQ ID NO: 50331 - DNA, 18 bp, Artificial sequence
  synthetic polynucleotide sequence
tgccaacctcagctccca

SEQ ID NO: 50332 - DNA, 19 bp, Artificial sequence
  synthetic polynucleotide sequence
cacagttgagccaaggcga

SEQ ID NO: 50333 - DNA, 22 bp, Artificial sequence
  synthetic polynucleotide sequence
gatcggacgtgatggacaggaa

SEQ ID NO: 50334 - DNA, 20 bp, Artificial sequence
  synthetic polynucleotide sequence
acgccttcccacatcccgga

SEQ ID NO: 50335 - DNA, 23 bp, Artificial sequence
  synthetic polynucleotide sequence
aaaatctccttcgccaagaccaa

SEQ ID NO: 50336 - DNA, 20 bp, Artificial sequence
  synthetic polynucleotide sequence
cagcagagccccagtcctga

SEQ ID NO: 50337 - DNA, 21 bp, Artificial sequence
  synthetic polynucleotide sequence
gtgtagcacagagcacggcaa

SEQ ID NO: 50338 - DNA, 20 bp, Artificial sequence
  synthetic polynucleotide sequence
acttcatctcggccacccca

SEQ ID NO: 50339 - DNA, 18 bp, Artificial sequence
  synthetic polynucleotide sequence
tgtcaacggcagtggaca

SEQ ID NO: 50340 - DNA, 18 bp, Artificial sequence
  synthetic polynucleotide sequence
tgggaccacacacctgca

SEQ ID NO: 50341 - DNA, 21 bp, Artificial sequence
  synthetic polynucleotide sequence
cagcctcaaccaccacaacca

SEQ ID NO: 50342 - DNA, 21 bp, Artificial sequence
  synthetic polynucleotide sequence
cctgttacgaggagctaccca

SEQ ID NO: 50343 - DNA, 18 bp, Artificial sequence
  synthetic polynucleotide sequence
agcctggcaaaaacggca

SEQ ID NO: 50344 - DNA, 19 bp, Artificial sequence
  synthetic polynucleotide sequence
tccgatgtccacagagtga

SEQ ID NO: 50345 - DNA, 19 bp, Artificial sequence
  synthetic polynucleotide sequence
ggctgcggagaacagccta

SEQ ID NO: 50346 - DNA, 18 bp, Artificial sequence
  synthetic polynucleotide sequence
aacctgcaggcacggtca

SEQ ID NO: 50347 - DNA, 19 bp, Artificial sequence
  synthetic polynucleotide sequence
ccgagaaggcctacagcga

SEQ ID NO: 50348 - DNA, 21 bp, Artificial sequence
  synthetic polynucleotide sequence
agtagttaagagccaggccta

SEQ ID NO: 50349 - DNA, 21 bp, Artificial sequence
  synthetic polynucleotide sequence
tgagctggacacactaaacga

SEQ ID NO: 50350 - DNA, 18 bp, Artificial sequence
  synthetic polynucleotide sequence
cgctcgtccagagggtga

SEQ ID NO: 50351 - DNA, 20 bp, Artificial sequence
  synthetic polynucleotide sequence
catcgagcagaagaccgaca

SEQ ID NO: 50352 - DNA, 21 bp, Artificial sequence
  synthetic polynucleotide sequence
caacttcagcaaggtaccgga

SEQ ID NO: 50353 - DNA, 18 bp, Artificial sequence
  synthetic polynucleotide sequence
cggcaagaagagcggcaa

SEQ ID NO: 50354 - DNA, 18 bp, Artificial sequence
  synthetic polynucleotide sequence
ggaccacatggtgaccga

SEQ ID NO: 50355 - DNA, 21 bp, Artificial sequence
  synthetic polynucleotide sequence
tgggggtcagtggaggtgaga

SEQ ID NO: 50356 - DNA, 22 bp, Artificial sequence
  synthetic polynucleotide sequence
gaaacatggaagaggcagggga

SEQ ID NO: 50357 - DNA, 19 bp, Artificial sequence
  synthetic polynucleotide sequence
gggcagtgggtgaaggcca

SEQ ID NO: 50358 - DNA, 20 bp, Artificial sequence
  synthetic polynucleotide sequence
catggcggcgtaatcccgga

SEQ ID NO: 50359 - DNA, 21 bp, Artificial sequence
  synthetic polynucleotide sequence
agtgccctcagtgaaacccga

SEQ ID NO: 50360 - DNA, 20 bp, Artificial sequence
  synthetic polynucleotide sequence
caaactggcccgttccccca

SEQ ID NO: 50361 - DNA, 20 bp, Artificial sequence
  synthetic polynucleotide sequence
cgggcctccaagtgtccgaa

SEQ ID NO: 50362 - DNA, 20 bp, Artificial sequence
  synthetic polynucleotide sequence
ccaccgtctggtgacaggca

SEQ ID NO: 50363 - DNA, 19 bp, Artificial sequence
  synthetic polynucleotide sequence
ccttcatcgagcagggcaa

SEQ ID NO: 50364 - DNA, 18 bp, Artificial sequence
  synthetic polynucleotide sequence
gctgctccacggtcagga

SEQ ID NO: 50365 - DNA, 21 bp, Artificial sequence
  synthetic polynucleotide sequence
tgtgcggtagatgcaaaggca

SEQ ID NO: 50366 - DNA, 20 bp, Artificial sequence
  synthetic polynucleotide sequence
ggtggaggagaggcacggaa

SEQ ID NO: 50367 - DNA, 21 bp, Artificial sequence
  synthetic polynucleotide sequence
aggagctgacaggcaggagga

SEQ ID NO: 50368 - DNA, 18 bp, Artificial sequence
  synthetic polynucleotide sequence
tcggaggcggcgtctcca

SEQ ID NO: 50369 - DNA, 18 bp, Artificial sequence
  synthetic polynucleotide sequence
cgcgttcacatgcaccca

SEQ ID NO: 50370 - DNA, 20 bp, Artificial sequence
  synthetic polynucleotide sequence
gagcaggctgaggaagacga

SEQ ID NO: 50371 - DNA, 21 bp, Artificial sequence
  synthetic polynucleotide sequence
tcgcgtggtggaagaggccaa

SEQ ID NO: 50372 - DNA, 21 bp, Artificial sequence
  synthetic polynucleotide sequence
agttgctcagctcctccacca

SEQ ID NO: 50373 - DNA, 21 bp, Artificial sequence
  synthetic polynucleotide sequence
tccccacaggcattgagggta

SEQ ID NO: 50374 - DNA, 18 bp, Artificial sequence
  synthetic polynucleotide sequence
cacagccctctcccgcca

SEQ ID NO: 50375 - DNA, 21 bp, Artificial sequence
  synthetic polynucleotide sequence
tcgaagccagagcagaaccaa

SEQ ID NO: 50376 - DNA, 20 bp, Artificial sequence
  synthetic polynucleotide sequence
tgcccacgaaaggccgccca

SEQ ID NO: 50377 - DNA, 20 bp, Artificial sequence
  synthetic polynucleotide sequence
ccgggagatgagcacgcaga

SEQ ID NO: 50378 - DNA, 19 bp, Artificial sequence
  synthetic polynucleotide sequence
ggtcgtggagggtggcaga

SEQ ID NO: 50379 - DNA, 21 bp, Artificial sequence
  synthetic polynucleotide sequence
cacgggactatgagagcctga

SEQ ID NO: 50380 - DNA, 20 bp, Artificial sequence
  synthetic polynucleotide sequence
cacgcactgcacgccttgca

SEQ ID NO: 50381 - DNA, 19 bp, Artificial sequence
  synthetic polynucleotide sequence
tgacccaggttgccatcca

SEQ ID NO: 50382 - DNA, 20 bp, Artificial sequence
  synthetic polynucleotide sequence
ctgctcaggatcccagctca

SEQ ID NO: 50383 - DNA, 20 bp, Artificial sequence
  synthetic polynucleotide sequence
catgggggtgaggggacaga

SEQ ID NO: 50384 - DNA, 20 bp, Artificial sequence
  synthetic polynucleotide sequence
ggctgacaacccatccagga

SEQ ID NO: 50385 - DNA, 22 bp, Artificial sequence
  synthetic polynucleotide sequence
tagatggaactcagcgtccaca

SEQ ID NO: 50386 - DNA, 21 bp, Artificial sequence
  synthetic polynucleotide sequence
agatcatgcccagctacacca

SEQ ID NO: 50387 - DNA, 21 bp, Artificial sequence
  synthetic polynucleotide sequence
gctctgagtcaactgcgggaa

SEQ ID NO: 50388 - DNA, 20 bp, Artificial sequence
  synthetic polynucleotide sequence
ctcccgcacccaagactgga

SEQ ID NO: 50389 - DNA, 20 bp, Artificial sequence
  synthetic polynucleotide sequence
ggagtcgcagggtctggaga

SEQ ID NO: 50390 - DNA, 20 bp, Artificial sequence
  synthetic polynucleotide sequence
gggagtgatgggctgaccaa

SEQ ID NO: 50391 - DNA, 21 bp, Artificial sequence
  synthetic polynucleotide sequence
gcgagccccaagatctgacca

SEQ ID NO: 50392 - DNA, 22 bp, Artificial sequence
  synthetic polynucleotide sequence
aggacatcgaaaagggcaggca

SEQ ID NO: 50393 - DNA, 20 bp, Artificial sequence
  synthetic polynucleotide sequence
ggggccagatggtgatagga

SEQ ID NO: 50394 - DNA, 20 bp, Artificial sequence
  synthetic polynucleotide sequence
aaggaccaggcatcaaacca

SEQ ID NO: 50395 - DNA, 21 bp, Artificial sequence
  synthetic polynucleotide sequence
aagggcagaaccaagcgggaa

SEQ ID NO: 50396 - DNA, 19 bp, Artificial sequence
  synthetic polynucleotide sequence
tccacagacctggcatgca

SEQ ID NO: 50397 - DNA, 21 bp, Artificial sequence
  synthetic polynucleotide sequence
tcaagtcacactcgtgcggca

SEQ ID NO: 50398 - DNA, 20 bp, Artificial sequence
  synthetic polynucleotide sequence
cgcacgtcgcagtaggagca

SEQ ID NO: 50399 - DNA, 20 bp, Artificial sequence
  synthetic polynucleotide sequence
gtggctcctgcaccaaggca

SEQ ID NO: 50400 - DNA, 18 bp, Artificial sequence
  synthetic polynucleotide sequence
ccatcgctgccgcctgca

SEQ ID NO: 50401 - DNA, 18 bp, Artificial sequence
  synthetic polynucleotide sequence
gcatcagctggagacgca

SEQ ID NO: 50402 - DNA, 18 bp, Artificial sequence
  synthetic polynucleotide sequence
ggtgcactggtagggcga

SEQ ID NO: 50403 - DNA, 18 bp, Artificial sequence
  synthetic polynucleotide sequence
gtgcagcgtgtgcagcaa

SEQ ID NO: 50404 - DNA, 18 bp, Artificial sequence
  synthetic polynucleotide sequence
cggttgaagccacgccca

SEQ ID NO: 50405 - DNA, 21 bp, Artificial sequence
  synthetic polynucleotide sequence
tggagggaggcatggagagca

SEQ ID NO: 50406 - DNA, 18 bp, Artificial sequence
  synthetic polynucleotide sequence
tgccgtcctgctcgcgga

SEQ ID NO: 50407 - DNA, 21 bp, Artificial sequence
  synthetic polynucleotide sequence
caatgcagctgacctcgggaa

SEQ ID NO: 50408 - DNA, 19 bp, Artificial sequence
  synthetic polynucleotide sequence
ttccgactgctgctgccca

SEQ ID NO: 50409 - DNA, 21 bp, Artificial sequence
  synthetic polynucleotide sequence
acacacacaggagtgagggca

SEQ ID NO: 50410 - DNA, 19 bp, Artificial sequence
  synthetic polynucleotide sequence
gccacgtgtcgctccagga

SEQ ID NO: 50411 - DNA, 21 bp, Artificial sequence
  synthetic polynucleotide sequence
gccctgcgagaagtgtgggaa

SEQ ID NO: 50412 - DNA, 19 bp, Artificial sequence
  synthetic polynucleotide sequence
cggtggcagaggtggtgga

SEQ ID NO: 50413 - DNA, 19 bp, Artificial sequence
  synthetic polynucleotide sequence
ctggcagtggggacgggaa

SEQ ID NO: 50414 - DNA, 20 bp, Artificial sequence
  synthetic polynucleotide sequence
tgttgcacacggggcagtca

SEQ ID NO: 50415 - DNA, 21 bp, Artificial sequence
  synthetic polynucleotide sequence
gggccctcacaaacagagcca

SEQ ID NO: 50416 - DNA, 21 bp, Artificial sequence
  synthetic polynucleotide sequence
agctgcaggtgctgagctgga

SEQ ID NO: 50417 - DNA, 22 bp, Artificial sequence
  synthetic polynucleotide sequence
ttcacagtggagataagcccca

SEQ ID NO: 50418 - DNA, 21 bp, Artificial sequence
  synthetic polynucleotide sequence
agttcaggacagcttgggcca

SEQ ID NO: 50419 - DNA, 21 bp, Artificial sequence
  synthetic polynucleotide sequence
ggacctggccaaacgcagcaa

SEQ ID NO: 50420 - DNA, 21 bp, Artificial sequence
  synthetic polynucleotide sequence
tctttaggtggccctccacca

SEQ ID NO: 50421 - DNA, 21 bp, Artificial sequence
  synthetic polynucleotide sequence
cagatggagacgcactaccga

SEQ ID NO: 50422 - DNA, 22 bp, Artificial sequence
  synthetic polynucleotide sequence
ggcctcgaggaggagtagagga

SEQ ID NO: 50423 - DNA, 21 bp, Artificial sequence
  synthetic polynucleotide sequence
catctcaggtacagcgcagga

SEQ ID NO: 50424 - DNA, 19 bp, Artificial sequence
  synthetic polynucleotide sequence
ttgtgggcagaatctcgga

SEQ ID NO: 50425 - DNA, 21 bp, Artificial sequence
  synthetic polynucleotide sequence
ccacatccggggccatacaga

SEQ ID NO: 50426 - DNA, 20 bp, Artificial sequence
  synthetic polynucleotide sequence
tctcgggggactcaatgcga

SEQ ID NO: 50427 - DNA, 21 bp, Artificial sequence
  synthetic polynucleotide sequence
aggagtccaccagccctcaga

SEQ ID NO: 50428 - DNA, 21 bp, Artificial sequence
  synthetic polynucleotide sequence
tcatcatcactccgaccccca

SEQ ID NO: 50429 - DNA, 21 bp, Artificial sequence
  synthetic polynucleotide sequence
tgagatgtcacaccggggaga

SEQ ID NO: 50430 - DNA, 21 bp, Artificial sequence
  synthetic polynucleotide sequence
agacgaactccttcaagccca

SEQ ID NO: 50431 - DNA, 22 bp, Artificial sequence
  synthetic polynucleotide sequence
gaattcaactaccaccggcgga

SEQ ID NO: 50432 - DNA, 19 bp, Artificial sequence
  synthetic polynucleotide sequence
ggtacatgagggcccccga

SEQ ID NO: 50433 - DNA, 21 bp, Artificial sequence
  synthetic polynucleotide sequence
aggagcccccagtagtggcaa

SEQ ID NO: 50434 - DNA, 20 bp, Artificial sequence
  synthetic polynucleotide sequence
attttcccctgccaccgcca

SEQ ID NO: 50435 - DNA, 21 bp, Artificial sequence
  synthetic polynucleotide sequence
cacctggaatctgagcaccca

SEQ ID NO: 50436 - DNA, 20 bp, Artificial sequence
  synthetic polynucleotide sequence
caaacacctgcgacccggca

SEQ ID NO: 50437 - DNA, 22 bp, Artificial sequence
  synthetic polynucleotide sequence
tcgaagaccacacttggaggaa

SEQ ID NO: 50438 - DNA, 21 bp, Artificial sequence
  synthetic polynucleotide sequence
ccagtgtcgttaaactggcga

SEQ ID NO: 50439 - DNA, 21 bp, Artificial sequence
  synthetic polynucleotide sequence
acttccgtgagcgagacagca

SEQ ID NO: 50440 - DNA, 18 bp, Artificial sequence
  synthetic polynucleotide sequence
gcgctcacaccaccggca

SEQ ID NO: 50441 - DNA, 21 bp, Artificial sequence
  synthetic polynucleotide sequence
agagagatcggcacatgagca

SEQ ID NO: 50442 - DNA, 21 bp, Artificial sequence
  synthetic polynucleotide sequence
aagaagtcacatgccggtgga

SEQ ID NO: 50443 - DNA, 22 bp, Artificial sequence
  synthetic polynucleotide sequence
tgatcagcagacagttccagga

SEQ ID NO: 50444 - DNA, 22 bp, Artificial sequence
  synthetic polynucleotide sequence
gaagtgtaggcaagccctcaga

SEQ ID NO: 50445 - DNA, 20 bp, Artificial sequence
  synthetic polynucleotide sequence
cccaggtgctgagccaccta

SEQ ID NO: 50446 - DNA, 21 bp, Artificial sequence
  synthetic polynucleotide sequence
gagcaggtagtcgcgtagaga

SEQ ID NO: 50447 - DNA, 20 bp, Artificial sequence
  synthetic polynucleotide sequence
ctgctgtcgctgaaggccga

SEQ ID NO: 50448 - DNA, 20 bp, Artificial sequence
  synthetic polynucleotide sequence
ccgcagatctcgcaggggta

SEQ ID NO: 50449 - DNA, 20 bp, Artificial sequence
  synthetic polynucleotide sequence
catgccagaagtgcccacga

SEQ ID NO: 50450 - DNA, 20 bp, Artificial sequence
  synthetic polynucleotide sequence
agcaggaagcgcttgccgca

SEQ ID NO: 50451 - DNA, 19 bp, Artificial sequence
  synthetic polynucleotide sequence
ccagctccccggccagaga

SEQ ID NO: 50452 - DNA, 20 bp, Artificial sequence
  synthetic polynucleotide sequence
tgagggagggctccaggaca

SEQ ID NO: 50453 - DNA, 20 bp, Artificial sequence
  synthetic polynucleotide sequence
actcggatgtggacacccca

SEQ ID NO: 50454 - DNA, 21 bp, Artificial sequence
  synthetic polynucleotide sequence
tggaagatgctcgactgccca

SEQ ID NO: 50455 - DNA, 21 bp, Artificial sequence
  synthetic polynucleotide sequence
ttcaggctaccaaggaggaga

SEQ ID NO: 50456 - DNA, 19 bp, Artificial sequence
  synthetic polynucleotide sequence
tgggagctatgcggcggta

SEQ ID NO: 50457 - DNA, 19 bp, Artificial sequence
  synthetic polynucleotide sequence
gtgccccaggtgtcctcga

SEQ ID NO: 50458 - DNA, 21 bp, Artificial sequence
  synthetic polynucleotide sequence
actgaaagggccgtatgccca

SEQ ID NO: 50459 - DNA, 20 bp, Artificial sequence
  synthetic polynucleotide sequence
ctcaccgtcagcacagccaa

SEQ ID NO: 50460 - DNA, 20 bp, Artificial sequence
  synthetic polynucleotide sequence
cgccaggatctgccggtcca

SEQ ID NO: 50461 - DNA, 20 bp, Artificial sequence
  synthetic polynucleotide sequence
cgccacctcaaaggccagaa

SEQ ID NO: 50462 - DNA, 18 bp, Artificial sequence
  synthetic polynucleotide sequence
ccagcgggggatgcagca

SEQ ID NO: 50463 - DNA, 20 bp, Artificial sequence
  synthetic polynucleotide sequence
caccaccggatgccactcca

SEQ ID NO: 50464 - DNA, 20 bp, Artificial sequence
  synthetic polynucleotide sequence
gagaggcggctgcccaggca

SEQ ID NO: 50465 - DNA, 22 bp, Artificial sequence
  synthetic polynucleotide sequence
gagtcagccaaccacagctaca

SEQ ID NO: 50466 - DNA, 21 bp, Artificial sequence
  synthetic polynucleotide sequence
gaaggaagctagcagccgaca

SEQ ID NO: 50467 - DNA, 19 bp, Artificial sequence
  synthetic polynucleotide sequence
tcacgagtcacctgtccca

SEQ ID NO: 50468 - DNA, 19 bp, Artificial sequence
  synthetic polynucleotide sequence
tcagatgaagcctccacca

SEQ ID NO: 50469 - DNA, 22 bp, Artificial sequence
  synthetic polynucleotide sequence
tccagttacacgcatggggaga

SEQ ID NO: 50470 - DNA, 19 bp, Artificial sequence
  synthetic polynucleotide sequence
gaggggctccactgtccca

SEQ ID NO: 50471 - DNA, 21 bp, Artificial sequence
  synthetic polynucleotide sequence
ggacaccccctgcagatggaa

SEQ ID NO: 50472 - DNA, 18 bp, Artificial sequence
  synthetic polynucleotide sequence
cgacggccacagtgggga

SEQ ID NO: 50473 - DNA, 22 bp, Artificial sequence
  synthetic polynucleotide sequence
caaaccccgaaattccacacca

SEQ ID NO: 50474 - DNA, 22 bp, Artificial sequence
  synthetic polynucleotide sequence
aagggaagatgcacagtcccca

SEQ ID NO: 50475 - DNA, 22 bp, Artificial sequence
  synthetic polynucleotide sequence
atccagctcagacagcagccaa

SEQ ID NO: 50476 - DNA, 19 bp, Artificial sequence
  synthetic polynucleotide sequence
tcattcgtggccaccagga

SEQ ID NO: 50477 - DNA, 18 bp, Artificial sequence
  synthetic polynucleotide sequence
tggcactgatggggacca

SEQ ID NO: 50478 - DNA, 18 bp, Artificial sequence
  synthetic polynucleotide sequence
tccgcctgcgtggcagca

SEQ ID NO: 50479 - DNA, 21 bp, Artificial sequence
  synthetic polynucleotide sequence
cctcgtccagtgtcccagcaa

SEQ ID NO: 50480 - DNA, 21 bp, Artificial sequence
  synthetic polynucleotide sequence
cagatacagccacaggagcca

SEQ ID NO: 50481 - DNA, 18 bp, Artificial sequence
  synthetic polynucleotide sequence
cccccagccaaaaaggca

SEQ ID NO: 50482 - DNA, 18 bp, Artificial sequence
  synthetic polynucleotide sequence
tgggatgaggaagggcca

SEQ ID NO: 50483 - DNA, 21 bp, Artificial sequence
  synthetic polynucleotide sequence
ctggagagccagatgtcggaa

SEQ ID NO: 50484 - DNA, 20 bp, Artificial sequence
  synthetic polynucleotide sequence
tggctgggagctcagatcca

SEQ ID NO: 50485 - DNA, 20 bp, Artificial sequence
  synthetic polynucleotide sequence
cccagcacccatcaactgga

SEQ ID NO: 50486 - DNA, 20 bp, Artificial sequence
  synthetic polynucleotide sequence
tccgagtcatcaccagggca

SEQ ID NO: 50487 - DNA, 21 bp, Artificial sequence
  synthetic polynucleotide sequence
aggtccttggtggccacgaga

SEQ ID NO: 50488 - DNA, 21 bp, Artificial sequence
  synthetic polynucleotide sequence
tgtggagttatcgggcaagga

SEQ ID NO: 50489 - DNA, 20 bp, Artificial sequence
  synthetic polynucleotide sequence
ggaggaaggacccaccaaga

SEQ ID NO: 50490 - DNA, 20 bp, Artificial sequence
  synthetic polynucleotide sequence
gaccaggcgcttgccgtgca

SEQ ID NO: 50491 - DNA, 21 bp, Artificial sequence
  synthetic polynucleotide sequence
acagggacagagacagagaca

SEQ ID NO: 50492 - DNA, 22 bp, Artificial sequence
  synthetic polynucleotide sequence
aaatccctgcacagatcccaga

SEQ ID NO: 50493 - DNA, 18 bp, Artificial sequence
  synthetic polynucleotide sequence
cctgcaaagccttcccca

SEQ ID NO: 50494 - DNA, 20 bp, Artificial sequence
  synthetic polynucleotide sequence
caagcagggaagtaacggca

SEQ ID NO: 50495 - DNA, 21 bp, Artificial sequence
  synthetic polynucleotide sequence
aagaagcacggtgaggcggaa

SEQ ID NO: 50496 - DNA, 22 bp, Artificial sequence
  synthetic polynucleotide sequence
tccaggaggaagtgcatgacga

SEQ ID NO: 50497 - DNA, 19 bp, Artificial sequence
  synthetic polynucleotide sequence
ctcgacaccccagcaggca

SEQ ID NO: 50498 - DNA, 21 bp, Artificial sequence
  synthetic polynucleotide sequence
acctgacttccggtcccgaga

SEQ ID NO: 50499 - DNA, 21 bp, Artificial sequence
  synthetic polynucleotide sequence
ccaccgtacccagaaacgcca

SEQ ID NO: 50500 - DNA, 20 bp, Artificial sequence
  synthetic polynucleotide sequence
gaagcgggaggggatgagga

SEQ ID NO: 50501 - DNA, 20 bp, Artificial sequence
  synthetic polynucleotide sequence
ccacggtcacagctgcagca

SEQ ID NO: 50502 - DNA, 20 bp, Artificial sequence
  synthetic polynucleotide sequence
cttggggatgggtaggggga

SEQ ID NO: 50503 - DNA, 21 bp, Artificial sequence
  synthetic polynucleotide sequence
taggcttcacagactgcccaa

SEQ ID NO: 50504 - DNA, 19 bp, Artificial sequence
  synthetic polynucleotide sequence
ttaggggcatatggaggca

SEQ ID NO: 50505 - DNA, 20 bp, Artificial sequence
  synthetic polynucleotide sequence
tgtgcgcccagtgtctgaga

SEQ ID NO: 50506 - DNA, 20 bp, Artificial sequence
  synthetic polynucleotide sequence
ctttgtggggagaggacgga

SEQ ID NO: 50507 - DNA, 21 bp, Artificial sequence
  synthetic polynucleotide sequence
agaagcagtggcagcagcaca

SEQ ID NO: 50508 - DNA, 19 bp, Artificial sequence
  synthetic polynucleotide sequence
gcagcggcacttgtcccca

SEQ ID NO: 50509 - DNA, 20 bp, Artificial sequence
  synthetic polynucleotide sequence
gatgggacagagagctggga

SEQ ID NO: 50510 - DNA, 20 bp, Artificial sequence
  synthetic polynucleotide sequence
accagccatcacctctgcca

SEQ ID NO: 50511 - DNA, 20 bp, Artificial sequence
  synthetic polynucleotide sequence
atgaccaaggcgccaggaga

SEQ ID NO: 50512 - DNA, 21 bp, Artificial sequence
  synthetic polynucleotide sequence
taaaaagagggccaggctgga

SEQ ID NO: 50513 - DNA, 21 bp, Artificial sequence
  synthetic polynucleotide sequence
tcagacctgcaaacggtccca

SEQ ID NO: 50514 - DNA, 20 bp, Artificial sequence
  synthetic polynucleotide sequence
cttggccgactgagcaggga

SEQ ID NO: 50515 - DNA, 21 bp, Artificial sequence
  synthetic polynucleotide sequence
gctggaaagcagtgctgacca

SEQ ID NO: 50516 - DNA, 21 bp, Artificial sequence
  synthetic polynucleotide sequence
cacagagattcccactgccga

SEQ ID NO: 50517 - DNA, 20 bp, Artificial sequence
  synthetic polynucleotide sequence
ccgactgatccacgctgaca

SEQ ID NO: 50518 - DNA, 20 bp, Artificial sequence
  synthetic polynucleotide sequence
caggcccagagtcatgcgca

SEQ ID NO: 50519 - DNA, 20 bp, Artificial sequence
  synthetic polynucleotide sequence
ctcctcagaggacagtgaca

SEQ ID NO: 50520 - DNA, 20 bp, Artificial sequence
  synthetic polynucleotide sequence
ctgctactggaagagctgga

SEQ ID NO: 50521 - DNA, 20 bp, Artificial sequence
  synthetic polynucleotide sequence
gaacatgcaccgcgtcccca

SEQ ID NO: 50522 - DNA, 21 bp, Artificial sequence
  synthetic polynucleotide sequence
ggacaacgctctctacaccga

SEQ ID NO: 50523 - DNA, 22 bp, Artificial sequence
  synthetic polynucleotide sequence
atgcgtagagccaggaagcgaa

SEQ ID NO: 50524 - DNA, 21 bp, Artificial sequence
  synthetic polynucleotide sequence
gtatgggtcagctcctggaga

SEQ ID NO: 50525 - DNA, 19 bp, Artificial sequence
  synthetic polynucleotide sequence
tgcggcaaacttgggcaca

SEQ ID NO: 50526 - DNA, 21 bp, Artificial sequence
  synthetic polynucleotide sequence
ggatttgccgcagcggtagca

SEQ ID NO: 50527 - DNA, 20 bp, Artificial sequence
  synthetic polynucleotide sequence
ggctacgtcagcgcccagca

SEQ ID NO: 50528 - DNA, 20 bp, Artificial sequence
  synthetic polynucleotide sequence
ctgcatgggtggcacggcaa

SEQ ID NO: 50529 - DNA, 21 bp, Artificial sequence
  synthetic polynucleotide sequence
cctctcaccccagccaaacga

SEQ ID NO: 50530 - DNA, 20 bp, Artificial sequence
  synthetic polynucleotide sequence
gtcgttgccggagctcgaga

SEQ ID NO: 50531 - DNA, 22 bp, Artificial sequence
  synthetic polynucleotide sequence
aggaaggcctgagaccatggaa

SEQ ID NO: 50532 - DNA, 21 bp, Artificial sequence
  synthetic polynucleotide sequence
tcagagggcttatccacccga

SEQ ID NO: 50533 - DNA, 21 bp, Artificial sequence
  synthetic polynucleotide sequence
cggccgaaaaggtctgagcca

SEQ ID NO: 50534 - DNA, 21 bp, Artificial sequence
  synthetic polynucleotide sequence
aagggtacagagacaccacca

SEQ ID NO: 50535 - DNA, 21 bp, Artificial sequence
  synthetic polynucleotide sequence
agtcatggggagccaagccaa

SEQ ID NO: 50536 - DNA, 21 bp, Artificial sequence
  synthetic polynucleotide sequence
ttcttcttgggccccgaacca

SEQ ID NO: 50537 - DNA, 21 bp, Artificial sequence
  synthetic polynucleotide sequence
gcaggagtgcatcaagtgcca

SEQ ID NO: 50538 - DNA, 20 bp, Artificial sequence
  synthetic polynucleotide sequence
gcgacggcagtagtagccca

SEQ ID NO: 50539 - DNA, 20 bp, Artificial sequence
  synthetic polynucleotide sequence
cttcttcctgggggccgaga

SEQ ID NO: 50540 - DNA, 21 bp, Artificial sequence
  synthetic polynucleotide sequence
ccttccggcagtaagggctca

SEQ ID NO: 50541 - DNA, 21 bp, Artificial sequence
  synthetic polynucleotide sequence
ctgggggcaacatagtgagca

SEQ ID NO: 50542 - DNA, 21 bp, Artificial sequence
  synthetic polynucleotide sequence
aactgacagctccgatcagca

SEQ ID NO: 50543 - DNA, 21 bp, Artificial sequence
  synthetic polynucleotide sequence
ctgcaatcaactgcccacaca

SEQ ID NO: 50544 - DNA, 21 bp, Artificial sequence
  synthetic polynucleotide sequence
ttgacagggcaatctctggca

SEQ ID NO: 50545 - DNA, 20 bp, Artificial sequence
  synthetic polynucleotide sequence
gacggcggcgagatcaggaa

SEQ ID NO: 50546 - DNA, 18 bp, Artificial sequence
  synthetic polynucleotide sequence
ggtcagcagctgcccgca

SEQ ID NO: 50547 - DNA, 22 bp, Artificial sequence
  synthetic polynucleotide sequence
ggaaaagcaacaggtggcctca

SEQ ID NO: 50548 - DNA, 21 bp, Artificial sequence
  synthetic polynucleotide sequence
gggcccctgggaaaatcctca

SEQ ID NO: 50549 - DNA, 21 bp, Artificial sequence
  synthetic polynucleotide sequence
tcaccccagaccagaacagca

SEQ ID NO: 50550 - DNA, 20 bp, Artificial sequence
  synthetic polynucleotide sequence
gcctgctcaagagctgccca

SEQ ID NO: 50551 - DNA, 22 bp, Artificial sequence
  synthetic polynucleotide sequence
aatcaagacatgggcactggga

SEQ ID NO: 50552 - DNA, 20 bp, Artificial sequence
  synthetic polynucleotide sequence
tgcaaccgccaccatcagca

SEQ ID NO: 50553 - DNA, 21 bp, Artificial sequence
  synthetic polynucleotide sequence
tcggagaacgtgagcctccaa

SEQ ID NO: 50554 - DNA, 21 bp, Artificial sequence
  synthetic polynucleotide sequence
tgactgaggctgtcaagagca

SEQ ID NO: 50555 - DNA, 20 bp, Artificial sequence
  synthetic polynucleotide sequence
atgcctcctacatcccagga

SEQ ID NO: 50556 - DNA, 21 bp, Artificial sequence
  synthetic polynucleotide sequence
catgactgatagctccaggga

SEQ ID NO: 50557 - DNA, 21 bp, Artificial sequence
  synthetic polynucleotide sequence
aagcactgcaacccacagcca

SEQ ID NO: 50558 - DNA, 21 bp, Artificial sequence
  synthetic polynucleotide sequence
tcaaacagactgcctgcagga

SEQ ID NO: 50559 - DNA, 20 bp, Artificial sequence
  synthetic polynucleotide sequence
gaggcagaccttcagaagga

SEQ ID NO: 50560 - DNA, 18 bp, Artificial sequence
  synthetic polynucleotide sequence
cactatcaccgggcacca

SEQ ID NO: 50561 - DNA, 21 bp, Artificial sequence
  synthetic polynucleotide sequence
tcatgtggcacaagctcacca

SEQ ID NO: 50562 - DNA, 19 bp, Artificial sequence
  synthetic polynucleotide sequence
gggccgcatcttgggagga

SEQ ID NO: 50563 - DNA, 20 bp, Artificial sequence
  synthetic polynucleotide sequence
ccctcagagcccagcatcca

SEQ ID NO: 50564 - DNA, 20 bp, Artificial sequence
  synthetic polynucleotide sequence
ctggctggctggacagcaca

SEQ ID NO: 50565 - DNA, 18 bp, Artificial sequence
  synthetic polynucleotide sequence
ccgcacggaccccaggta

SEQ ID NO: 50566 - DNA, 21 bp, Artificial sequence
  synthetic polynucleotide sequence
ggaagatgagcagctggccca

SEQ ID NO: 50567 - DNA, 20 bp, Artificial sequence
  synthetic polynucleotide sequence
tcctcacaccgcatcgccta

SEQ ID NO: 50568 - DNA, 19 bp, Artificial sequence
  synthetic polynucleotide sequence
tcctcctcctcagcccaga

SEQ ID NO: 50569 - DNA, 21 bp, Artificial sequence
  synthetic polynucleotide sequence
ttcagcagcatccacctggca

SEQ ID NO: 50570 - DNA, 19 bp, Artificial sequence
  synthetic polynucleotide sequence
ttcctgctgcaactgccca

SEQ ID NO: 50571 - DNA, 20 bp, Artificial sequence
  synthetic polynucleotide sequence
caccagttcctgacgcccga

SEQ ID NO: 50572 - DNA, 18 bp, Artificial sequence
  synthetic polynucleotide sequence
gcttcaccaggccgcgca

SEQ ID NO: 50573 - DNA, 21 bp, Artificial sequence
  synthetic polynucleotide sequence
ctacacagacaaggagcgcta

SEQ ID NO: 50574 - DNA, 21 bp, Artificial sequence
  synthetic polynucleotide sequence
gatcagatgacaccggtcaca

SEQ ID NO: 50575 - DNA, 21 bp, Artificial sequence
  synthetic polynucleotide sequence
ctgtgtaggtgcaggcaacca

SEQ ID NO: 50576 - DNA, 21 bp, Artificial sequence
  synthetic polynucleotide sequence
atccaaggtgaacacgtggca

SEQ ID NO: 50577 - DNA, 21 bp, Artificial sequence
  synthetic polynucleotide sequence
acctcgtcgcctccaacctga

SEQ ID NO: 50578 - DNA, 18 bp, Artificial sequence
  synthetic polynucleotide sequence
ctgggaggtagggggcca

SEQ ID NO: 50579 - DNA, 20 bp, Artificial sequence
  synthetic polynucleotide sequence
tgtgcaccactgggacccaa

SEQ ID NO: 50580 - DNA, 19 bp, Artificial sequence
  synthetic polynucleotide sequence
ggctggggggttgagagca

SEQ ID NO: 50581 - DNA, 22 bp, Artificial sequence
  synthetic polynucleotide sequence
cgagcagccaaggatcttccca

SEQ ID NO: 50582 - DNA, 20 bp, Artificial sequence
  synthetic polynucleotide sequence
cagacggagcagtgatggca

SEQ ID NO: 50583 - DNA, 19 bp, Artificial sequence
  synthetic polynucleotide sequence
ctcccgcttccccctccaa

SEQ ID NO: 50584 - DNA, 22 bp, Artificial sequence
  synthetic polynucleotide sequence
tacatgagtcacaggctgagca

SEQ ID NO: 50585 - DNA, 21 bp, Artificial sequence
  synthetic polynucleotide sequence
tgagaaccccaagatcccaca

SEQ ID NO: 50586 - DNA, 20 bp, Artificial sequence
  synthetic polynucleotide sequence
ctcctcacacagtggccgca

SEQ ID NO: 50587 - DNA, 21 bp, Artificial sequence
  synthetic polynucleotide sequence
cctagcacccacttctgccga

SEQ ID NO: 50588 - DNA, 20 bp, Artificial sequence
  synthetic polynucleotide sequence
ctggctgatggaggtgggca

SEQ ID NO: 50589 - DNA, 22 bp, Artificial sequence
  synthetic polynucleotide sequence
atcacactgaccttggacacca

SEQ ID NO: 50590 - DNA, 22 bp, Artificial sequence
  synthetic polynucleotide sequence
tgatcacagagtaccacacgca

SEQ ID NO: 50591 - DNA, 19 bp, Artificial sequence
  synthetic polynucleotide sequence
ctcggggccagcactccta

SEQ ID NO: 50592 - DNA, 21 bp, Artificial sequence
  synthetic polynucleotide sequence
tggaaggtgatcccatcccca

SEQ ID NO: 50593 - DNA, 19 bp, Artificial sequence
  synthetic polynucleotide sequence
gaccgagcccaccactgca

SEQ ID NO: 50594 - DNA, 21 bp, Artificial sequence
  synthetic polynucleotide sequence
tgtggtgggtggagagaagga

SEQ ID NO: 50595 - DNA, 21 bp, Artificial sequence
  synthetic polynucleotide sequence
ccgtcgccattgtgagcacca

SEQ ID NO: 50596 - DNA, 19 bp, Artificial sequence
  synthetic polynucleotide sequence
ctggttggtggccgccaga

SEQ ID NO: 50597 - DNA, 21 bp, Artificial sequence
  synthetic polynucleotide sequence
gcaacgggaagctgagaggca

SEQ ID NO: 50598 - DNA, 20 bp, Artificial sequence
  synthetic polynucleotide sequence
tcgttcctggagagaggcca

SEQ ID NO: 50599 - DNA, 22 bp, Artificial sequence
  synthetic polynucleotide sequence
catacaaggcaccacgttcaca

SEQ ID NO: 50600 - DNA, 21 bp, Artificial sequence
  synthetic polynucleotide sequence
ttccacccaaaggagagccga

SEQ ID NO: 50601 - DNA, 22 bp, Artificial sequence
  synthetic polynucleotide sequence
acctgagaaccatgctcaccga

SEQ ID NO: 50602 - DNA, 21 bp, Artificial sequence
  synthetic polynucleotide sequence
aatacagcagcacttggggca

SEQ ID NO: 50603 - DNA, 21 bp, Artificial sequence
  synthetic polynucleotide sequence
gcgctatggctccagagacga

SEQ ID NO: 50604 - DNA, 20 bp, Artificial sequence
  synthetic polynucleotide sequence
gcctgatcagcctgcaggga

SEQ ID NO: 50605 - DNA, 22 bp, Artificial sequence
  synthetic polynucleotide sequence
agaatccctacagccatggcaa

SEQ ID NO: 50606 - DNA, 21 bp, Artificial sequence
  synthetic polynucleotide sequence
tcttgagtactgggaggtcga

SEQ ID NO: 50607 - DNA, 18 bp, Artificial sequence
  synthetic polynucleotide sequence
caccaagtgccaacccca

SEQ ID NO: 50608 - DNA, 19 bp, Artificial sequence
  synthetic polynucleotide sequence
gactgcagggctgaccgta

SEQ ID NO: 50609 - DNA, 18 bp, Artificial sequence
  synthetic polynucleotide sequence
gtccccaacaaagccgga

SEQ ID NO: 50610 - DNA, 18 bp, Artificial sequence
  synthetic polynucleotide sequence
tgaggaaggcccacagca

SEQ ID NO: 50611 - DNA, 21 bp, Artificial sequence
  synthetic polynucleotide sequence
cctgttggagagcaaggccga

SEQ ID NO: 50612 - DNA, 19 bp, Artificial sequence
  synthetic polynucleotide sequence
ctggggaaggaggcggaga

SEQ ID NO: 50613 - DNA, 22 bp, Artificial sequence
  synthetic polynucleotide sequence
aacacagaagcagggagtctca

SEQ ID NO: 50614 - DNA, 20 bp, Artificial sequence
  synthetic polynucleotide sequence
tctgagtggcagccattcga

SEQ ID NO: 50615 - DNA, 19 bp, Artificial sequence
  synthetic polynucleotide sequence
tcacgtcccagtatgccca

SEQ ID NO: 50616 - DNA, 19 bp, Artificial sequence
  synthetic polynucleotide sequence
tgccgtgacattgggcaca

SEQ ID NO: 50617 - DNA, 21 bp, Artificial sequence
  synthetic polynucleotide sequence
tccccagcccaagtcaaacca

SEQ ID NO: 50618 - DNA, 20 bp, Artificial sequence
  synthetic polynucleotide sequence
catttccagggcccgctgca

SEQ ID NO: 50619 - DNA, 21 bp, Artificial sequence
  synthetic polynucleotide sequence
cggtccgaggaaaccagtcga

SEQ ID NO: 50620 - DNA, 18 bp, Artificial sequence
  synthetic polynucleotide sequence
tgctgctcggggaggcga

SEQ ID NO: 50621 - DNA, 22 bp, Artificial sequence
  synthetic polynucleotide sequence
ttgaggctcgggatatcacaga

SEQ ID NO: 50622 - DNA, 20 bp, Artificial sequence
  synthetic polynucleotide sequence
gtagacagcccagttccaga

SEQ ID NO: 50623 - DNA, 21 bp, Artificial sequence
  synthetic polynucleotide sequence
tgctgctggcagcacatctga

SEQ ID NO: 50624 - DNA, 21 bp, Artificial sequence
  synthetic polynucleotide sequence
gatggactgggctgagtgaca

SEQ ID NO: 50625 - DNA, 21 bp, Artificial sequence
  synthetic polynucleotide sequence
cacagcacagcagccatctga

SEQ ID NO: 50626 - DNA, 21 bp, Artificial sequence
  synthetic polynucleotide sequence
ccacaccggcattcaaaccca

SEQ ID NO: 50627 - DNA, 19 bp, Artificial sequence
  synthetic polynucleotide sequence
tgctgaagtgtcccaccga

SEQ ID NO: 50628 - DNA, 20 bp, Artificial sequence
  synthetic polynucleotide sequence
cagctgaaccctcctcccga

SEQ ID NO: 50629 - DNA, 21 bp, Artificial sequence
  synthetic polynucleotide sequence
tcagatcctgacctgaggcga

SEQ ID NO: 50630 - DNA, 21 bp, Artificial sequence
  synthetic polynucleotide sequence
cactggtgaaggagctggaga

SEQ ID NO: 50631 - DNA, 21 bp, Artificial sequence
  synthetic polynucleotide sequence
ccaacacctccacagcaggca

SEQ ID NO: 50632 - DNA, 20 bp, Artificial sequence
  synthetic polynucleotide sequence
agggggcaatggaaagggca

SEQ ID NO: 50633 - DNA, 21 bp, Artificial sequence
  synthetic polynucleotide sequence
cacagcattgctcacaagcca

SEQ ID NO: 50634 - DNA, 20 bp, Artificial sequence
  synthetic polynucleotide sequence
ggaacaggccttccatgcca

SEQ ID NO: 50635 - DNA, 18 bp, Artificial sequence
  synthetic polynucleotide sequence
gcagcgaaacgtccagca

SEQ ID NO: 50636 - DNA, 18 bp, Artificial sequence
  synthetic polynucleotide sequence
acgcgtttgggcagacca

SEQ ID NO: 50637 - DNA, 21 bp, Artificial sequence
  synthetic polynucleotide sequence
tcacacgggggagaaacgcta

SEQ ID NO: 50638 - DNA, 21 bp, Artificial sequence
  synthetic polynucleotide sequence
ctgatggacactgagtcggga

SEQ ID NO: 50639 - DNA, 21 bp, Artificial sequence
  synthetic polynucleotide sequence
caactggctcgacatcagaga

SEQ ID NO: 50640 - DNA, 20 bp, Artificial sequence
  synthetic polynucleotide sequence
aaggtctggaccacatacga

SEQ ID NO: 50641 - DNA, 20 bp, Artificial sequence
  synthetic polynucleotide sequence
ggacttcccagctggaacga

SEQ ID NO: 50642 - DNA, 25 bp, Artificial sequence
  synthetic polynucleotide sequence
agagctgagcacagcactcagtcaa

SEQ ID NO: 50643 - DNA, 22 bp, Artificial sequence
  synthetic polynucleotide sequence
ggaaagctatcccaggcagtga

SEQ ID NO: 50644 - DNA, 21 bp, Artificial sequence
  synthetic polynucleotide sequence
tgtagctgctggcggaagtca

SEQ ID NO: 50645 - DNA, 21 bp, Artificial sequence
  synthetic polynucleotide sequence
gtggaaaggctttcaggcgga

SEQ ID NO: 50646 - DNA, 20 bp, Artificial sequence
  synthetic polynucleotide sequence
tctggtggagaagcagctca

SEQ ID NO: 50647 - DNA, 20 bp, Artificial sequence
  synthetic polynucleotide sequence
tgtgcccacctcagtcgaca

SEQ ID NO: 50648 - DNA, 22 bp, Artificial sequence
  synthetic polynucleotide sequence
atactgcctaaaggccttccca

SEQ ID NO: 50649 - DNA, 18 bp, Artificial sequence
  synthetic polynucleotide sequence
cgaagagaccccacccca

SEQ ID NO: 50650 - DNA, 21 bp, Artificial sequence
  synthetic polynucleotide sequence
ggatcccagggactgtacaga

SEQ ID NO: 50651 - DNA, 18 bp, Artificial sequence
  synthetic polynucleotide sequence
cctgcccgatggcaccaa

SEQ ID NO: 50652 - DNA, 20 bp, Artificial sequence
  synthetic polynucleotide sequence
aacatgtgaggggactcgga

SEQ ID NO: 50653 - DNA, 20 bp, Artificial sequence
  synthetic polynucleotide sequence
cggaccgcgacagctaccta

SEQ ID NO: 50654 - DNA, 18 bp, Artificial sequence
  synthetic polynucleotide sequence
agatggagaggcggctga

SEQ ID NO: 50655 - DNA, 20 bp, Artificial sequence
  synthetic polynucleotide sequence
accggaggagaagtgcggaa

SEQ ID NO: 50656 - DNA, 22 bp, Artificial sequence
  synthetic polynucleotide sequence
aggttgctctgagcaggatcca

SEQ ID NO: 50657 - DNA, 20 bp, Artificial sequence
  synthetic polynucleotide sequence
gtgcagtgagtgtgggcgga

SEQ ID NO: 50658 - DNA, 20 bp, Artificial sequence
  synthetic polynucleotide sequence
gacgtcagagctgtgccgga

SEQ ID NO: 50659 - DNA, 18 bp, Artificial sequence
  synthetic polynucleotide sequence
agaccacgtctgtgcgga

SEQ ID NO: 50660 - DNA, 18 bp, Artificial sequence
  synthetic polynucleotide sequence
tggatgcgcacgtgcgta

SEQ ID NO: 50661 - DNA, 22 bp, Artificial sequence
  synthetic polynucleotide sequence
caaggcaaacgtgtggagaaca

SEQ ID NO: 50662 - DNA, 20 bp, Artificial sequence
  synthetic polynucleotide sequence
aaggctcgagctgctccgga

SEQ ID NO: 50663 - DNA, 18 bp, Artificial sequence
  synthetic polynucleotide sequence
ggccaagatcgtgacgca

SEQ ID NO: 50664 - DNA, 18 bp, Artificial sequence
  synthetic polynucleotide sequence
ctgagctgtcccgaggca

SEQ ID NO: 50665 - DNA, 21 bp, Artificial sequence
  synthetic polynucleotide sequence
gaggatgaagtgacccctgga

SEQ ID NO: 50666 - DNA, 21 bp, Artificial sequence
  synthetic polynucleotide sequence
gattctggtgagcaggagcca

SEQ ID NO: 50667 - DNA, 18 bp, Artificial sequence
  synthetic polynucleotide sequence
tgcccaccgaggccagca

SEQ ID NO: 50668 - DNA, 21 bp, Artificial sequence
  synthetic polynucleotide sequence
ctgtcagggatccaagggtca

SEQ ID NO: 50669 - DNA, 21 bp, Artificial sequence
  synthetic polynucleotide sequence
cacacctgactcggcatcaga

SEQ ID NO: 50670 - DNA, 21 bp, Artificial sequence
  synthetic polynucleotide sequence
cactctaaaggccttcccgca

SEQ ID NO: 50671 - DNA, 20 bp, Artificial sequence
  synthetic polynucleotide sequence
cgccccaggaatcagtgaca

SEQ ID NO: 50672 - DNA, 20 bp, Artificial sequence
  synthetic polynucleotide sequence
gctcctctgagcagggtcga

SEQ ID NO: 50673 - DNA, 21 bp, Artificial sequence
  synthetic polynucleotide sequence
gaaaccccaaagccacggaga

SEQ ID NO: 50674 - DNA, 22 bp, Artificial sequence
  synthetic polynucleotide sequence
aaatagcgaggatgggcaagga

SEQ ID NO: 50675 - DNA, 21 bp, Artificial sequence
  synthetic polynucleotide sequence
cccaaagccaagtccaccaga

SEQ ID NO: 50676 - DNA, 20 bp, Artificial sequence
  synthetic polynucleotide sequence
aggctggagacccgggagga

SEQ ID NO: 50677 - DNA, 19 bp, Artificial sequence
  synthetic polynucleotide sequence
cccccctcctactcggaca

SEQ ID NO: 50678 - DNA, 21 bp, Artificial sequence
  synthetic polynucleotide sequence
tgaaggtggacaggctgctga

SEQ ID NO: 50679 - DNA, 19 bp, Artificial sequence
  synthetic polynucleotide sequence
ggacgaccacgtctcccaa

SEQ ID NO: 50680 - DNA, 19 bp, Artificial sequence
  synthetic polynucleotide sequence
gatgtgcagtaaccgggca

SEQ ID NO: 50681 - DNA, 21 bp, Artificial sequence
  synthetic polynucleotide sequence
ccggacgtcttggacaggcaa

SEQ ID NO: 50682 - DNA, 19 bp, Artificial sequence
  synthetic polynucleotide sequence
cccagggctctgagggcta

SEQ ID NO: 50683 - DNA, 18 bp, Artificial sequence
  synthetic polynucleotide sequence
actcccccggcccttgca

SEQ ID NO: 50684 - DNA, 22 bp, Artificial sequence
  synthetic polynucleotide sequence
taagatggagcagatgcaggca

SEQ ID NO: 50685 - DNA, 22 bp, Artificial sequence
  synthetic polynucleotide sequence
accatcccgaacaccttgccaa

SEQ ID NO: 50686 - DNA, 23 bp, Artificial sequence
  synthetic polynucleotide sequence
gtaaacaaagcccctgcatgaga

SEQ ID NO: 50687 - DNA, 25 bp, Artificial sequence
  synthetic polynucleotide sequence
tggcagactggctaaacagaaacca

SEQ ID NO: 50688 - DNA, 21 bp, Artificial sequence
  synthetic polynucleotide sequence
aaggatgaccatcagggccaa

SEQ ID NO: 50689 - DNA, 21 bp, Artificial sequence
  synthetic polynucleotide sequence
tgagctgcaacaagtgtgcga

SEQ ID NO: 50690 - DNA, 22 bp, Artificial sequence
  synthetic polynucleotide sequence
tagcagttgtcacagacccgca

SEQ ID NO: 50691 - DNA, 21 bp, Artificial sequence
  synthetic polynucleotide sequence
gatgaggacagtttgccccca

SEQ ID NO: 50692 - DNA, 19 bp, Artificial sequence
  synthetic polynucleotide sequence
ttctgcctgtcccaagcca

SEQ ID NO: 50693 - DNA, 22 bp, Artificial sequence
  synthetic polynucleotide sequence
ccatccaaagagtcctgcagca

SEQ ID NO: 50694 - DNA, 20 bp, Artificial sequence
  synthetic polynucleotide sequence
gggcacagaagaggtcccca

SEQ ID NO: 50695 - DNA, 18 bp, Artificial sequence
  synthetic polynucleotide sequence
gacggagggtgtgaccca

SEQ ID NO: 50696 - DNA, 18 bp, Artificial sequence
  synthetic polynucleotide sequence
tggccactagccacgcca

SEQ ID NO: 50697 - DNA, 18 bp, Artificial sequence
  synthetic polynucleotide sequence
gaatccctgaccccacca

SEQ ID NO: 50698 - DNA, 18 bp, Artificial sequence
  synthetic polynucleotide sequence
tcacggtgtcggacagca

SEQ ID NO: 50699 - DNA, 22 bp, Artificial sequence
  synthetic polynucleotide sequence
aggacaacgggttcctgagcaa

SEQ ID NO: 50700 - DNA, 20 bp, Artificial sequence
  synthetic polynucleotide sequence
agcactgagaaggtggccga

SEQ ID NO: 50701 - DNA, 21 bp, Artificial sequence
  synthetic polynucleotide sequence
gctgcgggacctgaacaccta

SEQ ID NO: 50702 - DNA, 20 bp, Artificial sequence
  synthetic polynucleotide sequence
cctctccaccgtctcgcaga

SEQ ID NO: 50703 - DNA, 18 bp, Artificial sequence
  synthetic polynucleotide sequence
cccagagagcagaggcga

SEQ ID NO: 50704 - DNA, 19 bp, Artificial sequence
  synthetic polynucleotide sequence
gggtcgtgtgacacagcca

SEQ ID NO: 50705 - DNA, 21 bp, Artificial sequence
  synthetic polynucleotide sequence
ggaggtggtggtggaaagcga

SEQ ID NO: 50706 - DNA, 21 bp, Artificial sequence
  synthetic polynucleotide sequence
accacccacatagtcgctcca

SEQ ID NO: 50707 - DNA, 19 bp, Artificial sequence
  synthetic polynucleotide sequence
gggaagcttgatggccaga

SEQ ID NO: 50708 - DNA, 20 bp, Artificial sequence
  synthetic polynucleotide sequence
tggtcggctcctctagtgga

SEQ ID NO: 50709 - DNA, 22 bp, Artificial sequence
  synthetic polynucleotide sequence
agtgggagaatgggcagaagca

SEQ ID NO: 50710 - DNA, 20 bp, Artificial sequence
  synthetic polynucleotide sequence
ggccaaggctgactggagaa

SEQ ID NO: 50711 - DNA, 20 bp, Artificial sequence
  synthetic polynucleotide sequence
ggggaggaggagcaaggaca

SEQ ID NO: 50712 - DNA, 18 bp, Artificial sequence
  synthetic polynucleotide sequence
gccacgctatgccggcca

SEQ ID NO: 50713 - DNA, 22 bp, Artificial sequence
  synthetic polynucleotide sequence
atagccctcctgaagtgaggaa

SEQ ID NO: 50714 - DNA, 22 bp, Artificial sequence
  synthetic polynucleotide sequence
cttcccgaggaagagaactgca

SEQ ID NO: 50715 - DNA, 22 bp, Artificial sequence
  synthetic polynucleotide sequence
tgatgaaaccacggaatcccca

SEQ ID NO: 50716 - DNA, 23 bp, Artificial sequence
  synthetic polynucleotide sequence
gaaaacttgcctgaaggacacga

SEQ ID NO: 50717 - DNA, 22 bp, Artificial sequence
  synthetic polynucleotide sequence
gtgaccgcaagaagacaaagga

SEQ ID NO: 50718 - DNA, 20 bp, Artificial sequence
  synthetic polynucleotide sequence
ggcaaggccagtcacctcga

SEQ ID NO: 50719 - DNA, 21 bp, Artificial sequence
  synthetic polynucleotide sequence
ggaagaggaggctgctgagga

SEQ ID NO: 50720 - DNA, 21 bp, Artificial sequence
  synthetic polynucleotide sequence
tcatcctcagggtcacaggca

SEQ ID NO: 50721 - DNA, 19 bp, Artificial sequence
  synthetic polynucleotide sequence
cgccagctctggctacgaa

SEQ ID NO: 50722 - DNA, 18 bp, Artificial sequence
  synthetic polynucleotide sequence
gtggactgcggaggagga

SEQ ID NO: 50723 - DNA, 20 bp, Artificial sequence
  synthetic polynucleotide sequence
cacagcggcctctcctccaa

SEQ ID NO: 50724 - DNA, 20 bp, Artificial sequence
  synthetic polynucleotide sequence
tggggacagggagagggaga

SEQ ID NO: 50725 - DNA, 20 bp, Artificial sequence
  synthetic polynucleotide sequence
caagtcctacacgcacccga

SEQ ID NO: 50726 - DNA, 20 bp, Artificial sequence
  synthetic polynucleotide sequence
catagcctgaactggcagca

SEQ ID NO: 50727 - DNA, 18 bp, Artificial sequence
  synthetic polynucleotide sequence
agcattcgcacgtgcaca

SEQ ID NO: 50728 - DNA, 18 bp, Artificial sequence
  synthetic polynucleotide sequence
ggcagacggtgtagccga

SEQ ID NO: 50729 - DNA, 19 bp, Artificial sequence
  synthetic polynucleotide sequence
ctttccccggctgcggcaa

SEQ ID NO: 50730 - DNA, 20 bp, Artificial sequence
  synthetic polynucleotide sequence
gtggcggggacttgcagtga

SEQ ID NO: 50731 - DNA, 22 bp, Artificial sequence
  synthetic polynucleotide sequence
accatcaccagcaccagaagca

SEQ ID NO: 50732 - DNA, 21 bp, Artificial sequence
  synthetic polynucleotide sequence
actgcgaatgtcctccccaca

SEQ ID NO: 50733 - DNA, 20 bp, Artificial sequence
  synthetic polynucleotide sequence
gaggggcagaagcagagaca

SEQ ID NO: 50734 - DNA, 18 bp, Artificial sequence
  synthetic polynucleotide sequence
cctcagcgaggtccacca

SEQ ID NO: 50735 - DNA, 23 bp, Artificial sequence
  synthetic polynucleotide sequence
aataaggaaacgctgactacgca

SEQ ID NO: 50736 - DNA, 19 bp, Artificial sequence
  synthetic polynucleotide sequence
tgacaggcatgcctcctca

SEQ ID NO: 50737 - DNA, 20 bp, Artificial sequence
  synthetic polynucleotide sequence
gccttcagccagagctcgga

SEQ ID NO: 50738 - DNA, 20 bp, Artificial sequence
  synthetic polynucleotide sequence
cgggtgaaggccttgccaca

SEQ ID NO: 50739 - DNA, 22 bp, Artificial sequence
  synthetic polynucleotide sequence
gaaagatgtccacgtggccaga

SEQ ID NO: 50740 - DNA, 20 bp, Artificial sequence
  synthetic polynucleotide sequence
ccagggagaccacgttccca

SEQ ID NO: 50741 - DNA, 21 bp, Artificial sequence
  synthetic polynucleotide sequence
cacccctgaatggacacagca

SEQ ID NO: 50742 - DNA, 20 bp, Artificial sequence
  synthetic polynucleotide sequence
ctggaagctcctcagctgga

SEQ ID NO: 50743 - DNA, 22 bp, Artificial sequence
  synthetic polynucleotide sequence
atgccatagggagtaggcgaca

SEQ ID NO: 50744 - DNA, 21 bp, Artificial sequence
  synthetic polynucleotide sequence
atgacaagggcagagctccca

SEQ ID NO: 50745 - DNA, 18 bp, Artificial sequence
  synthetic polynucleotide sequence
catcagcgcgtccacaca

SEQ ID NO: 50746 - DNA, 20 bp, Artificial sequence
  synthetic polynucleotide sequence
gagtcgaagatgtccagcca

SEQ ID NO: 50747 - DNA, 21 bp, Artificial sequence
  synthetic polynucleotide sequence
tcaccctgagagtggtgagga

SEQ ID NO: 50748 - DNA, 22 bp, Artificial sequence
  synthetic polynucleotide sequence
agtacattgagcgaagtcccca

SEQ ID NO: 50749 - DNA, 20 bp, Artificial sequence
  synthetic polynucleotide sequence
cccgagaccttctgggcaga

SEQ ID NO: 50750 - DNA, 21 bp, Artificial sequence
  synthetic polynucleotide sequence
ccagtggcgaacaaggcctga

SEQ ID NO: 50751 - DNA, 20 bp, Artificial sequence
  synthetic polynucleotide sequence
ccggtcccacatgcaaggaa

SEQ ID NO: 50752 - DNA, 21 bp, Artificial sequence
  synthetic polynucleotide sequence
gtctgggtctggaatcgacca

SEQ ID NO: 50753 - DNA, 22 bp, Artificial sequence
  synthetic polynucleotide sequence
ggaatccaagcttgggaagaca

SEQ ID NO: 50754 - DNA, 21 bp, Artificial sequence
  synthetic polynucleotide sequence
ccacacgcatagacatgccca

SEQ ID NO: 50755 - DNA, 20 bp, Artificial sequence
  synthetic polynucleotide sequence
tcgagcctgcagctactcca

SEQ ID NO: 50756 - DNA, 21 bp, Artificial sequence
  synthetic polynucleotide sequence
cttgatagtgagcctgagcca

SEQ ID NO: 50757 - DNA, 21 bp, Artificial sequence
  synthetic polynucleotide sequence
agtgcacagctgatctccgaa

SEQ ID NO: 50758 - DNA, 20 bp, Artificial sequence
  synthetic polynucleotide sequence
ctgaccggagcctcttggca

SEQ ID NO: 50759 - DNA, 22 bp, Artificial sequence
  synthetic polynucleotide sequence
tagcagggctgaacccatcaga

SEQ ID NO: 50760 - DNA, 20 bp, Artificial sequence
  synthetic polynucleotide sequence
actggactctgggctgcaga

SEQ ID NO: 50761 - DNA, 18 bp, Artificial sequence
  synthetic polynucleotide sequence
cagccatccacacagcga

SEQ ID NO: 50762 - DNA, 19 bp, Artificial sequence
  synthetic polynucleotide sequence
cgggaaggagatccagcga

SEQ ID NO: 50763 - DNA, 21 bp, Artificial sequence
  synthetic polynucleotide sequence
caccattcaaaccctccccca

SEQ ID NO: 50764 - DNA, 21 bp, Artificial sequence
  synthetic polynucleotide sequence
ggttggtcagttccgggagca

SEQ ID NO: 50765 - DNA, 21 bp, Artificial sequence
  synthetic polynucleotide sequence
taccaccggagttaggacaga

SEQ ID NO: 50766 - DNA, 22 bp, Artificial sequence
  synthetic polynucleotide sequence
ccaacagcagaaacaccaggga

SEQ ID NO: 50767 - DNA, 21 bp, Artificial sequence
  synthetic polynucleotide sequence
tgacaaggcagtggcatcaca

SEQ ID NO: 50768 - DNA, 20 bp, Artificial sequence
  synthetic polynucleotide sequence
attcacgccagatgatgcca

SEQ ID NO: 50769 - DNA, 21 bp, Artificial sequence
  synthetic polynucleotide sequence
ccagccgtctgtccaacagca

SEQ ID NO: 50770 - DNA, 20 bp, Artificial sequence
  synthetic polynucleotide sequence
gcaggcttgtgggagaagga

SEQ ID NO: 50771 - DNA, 19 bp, Artificial sequence
  synthetic polynucleotide sequence
ggctgcagacagctgagga

SEQ ID NO: 50772 - DNA, 18 bp, Artificial sequence
  synthetic polynucleotide sequence
acttgacagggcagcgga

SEQ ID NO: 50773 - DNA, 18 bp, Artificial sequence
  synthetic polynucleotide sequence
gccggaggaggtagcaca

SEQ ID NO: 50774 - DNA, 18 bp, Artificial sequence
  synthetic polynucleotide sequence
acatgctgggactgggca

SEQ ID NO: 50775 - DNA, 22 bp, Artificial sequence
  synthetic polynucleotide sequence
gaatttccagcctacagcccaa

SEQ ID NO: 50776 - DNA, 22 bp, Artificial sequence
  synthetic polynucleotide sequence
aagaaaggcaggtggtagagca

SEQ ID NO: 50777 - DNA, 21 bp, Artificial sequence
  synthetic polynucleotide sequence
agtccataaagtggcgaggca

SEQ ID NO: 50778 - DNA, 21 bp, Artificial sequence
  synthetic polynucleotide sequence
ttgcagaagggagctccgtca

SEQ ID NO: 50779 - DNA, 18 bp, Artificial sequence
  synthetic polynucleotide sequence
gctgctcacgatgccaga

SEQ ID NO: 50780 - DNA, 18 bp, Artificial sequence
  synthetic polynucleotide sequence
ctgggctgccaggacaca

SEQ ID NO: 50781 - DNA, 18 bp, Artificial sequence
  synthetic polynucleotide sequence
ccacgatgcctcagccca

SEQ ID NO: 50782 - DNA, 18 bp, Artificial sequence
  synthetic polynucleotide sequence
gggtgctccgatgcagca

SEQ ID NO: 50783 - DNA, 22 bp, Artificial sequence
  synthetic polynucleotide sequence
tacatctgacaaagccccccaa

SEQ ID NO: 50784 - DNA, 20 bp, Artificial sequence
  synthetic polynucleotide sequence
ggctagactgagggccctca

SEQ ID NO: 50785 - DNA, 19 bp, Artificial sequence
  synthetic polynucleotide sequence
tcttcaccgagagcagcga

SEQ ID NO: 50786 - DNA, 20 bp, Artificial sequence
  synthetic polynucleotide sequence
gctctgaggcgaaaggggga

SEQ ID NO: 50787 - DNA, 21 bp, Artificial sequence
  synthetic polynucleotide sequence
tccagcaagcagagggagcaa

SEQ ID NO: 50788 - DNA, 18 bp, Artificial sequence
  synthetic polynucleotide sequence
cacctggcagcgcccaca

SEQ ID NO: 50789 - DNA, 19 bp, Artificial sequence
  synthetic polynucleotide sequence
cgcaggctgaggatcgaga

SEQ ID NO: 50790 - DNA, 18 bp, Artificial sequence
  synthetic polynucleotide sequence
cttgcagttggcgcacca

SEQ ID NO: 50791 - DNA, 21 bp, Artificial sequence
  synthetic polynucleotide sequence
ccatgtgagagtgaggcccta

SEQ ID NO: 50792 - DNA, 22 bp, Artificial sequence
  synthetic polynucleotide sequence
ataagggcagaactctggctga

SEQ ID NO: 50793 - DNA, 21 bp, Artificial sequence
  synthetic polynucleotide sequence
cgcgctggagaaatcccacca

SEQ ID NO: 50794 - DNA, 21 bp, Artificial sequence
  synthetic polynucleotide sequence
tgtgcttgaagggacgtggga

SEQ ID NO: 50795 - DNA, 20 bp, Artificial sequence
  synthetic polynucleotide sequence
tacgcgatgcccggaatgga

SEQ ID NO: 50796 - DNA, 21 bp, Artificial sequence
  synthetic polynucleotide sequence
actgactgatcactggagcca

SEQ ID NO: 50797 - DNA, 22 bp, Artificial sequence
  synthetic polynucleotide sequence
caagacctttggccagagcaga

SEQ ID NO: 50798 - DNA, 20 bp, Artificial sequence
  synthetic polynucleotide sequence
gtgccccgtacactcatcca

SEQ ID NO: 50799 - DNA, 22 bp, Artificial sequence
  synthetic polynucleotide sequence
cacatcagcccttcaagccaga

SEQ ID NO: 50800 - DNA, 20 bp, Artificial sequence
  synthetic polynucleotide sequence
tgccaggtctgacgggagga

SEQ ID NO: 50801 - DNA, 19 bp, Artificial sequence
  synthetic polynucleotide sequence
ccacacaggcagggggtga

SEQ ID NO: 50802 - DNA, 21 bp, Artificial sequence
  synthetic polynucleotide sequence
ctgtgaaggcacaagcctgca

SEQ ID NO: 50803 - DNA, 19 bp, Artificial sequence
  synthetic polynucleotide sequence
tgccagaagacacacctca

SEQ ID NO: 50804 - DNA, 20 bp, Artificial sequence
  synthetic polynucleotide sequence
gtgagagtagacttgcggca

SEQ ID NO: 50805 - DNA, 22 bp, Artificial sequence
  synthetic polynucleotide sequence
acaatggaggggaactctgtga

SEQ ID NO: 50806 - DNA, 20 bp, Artificial sequence
  synthetic polynucleotide sequence
gtgtctctccagcaggggca

SEQ ID NO: 50807 - DNA, 21 bp, Artificial sequence
  synthetic polynucleotide sequence
ggaaagccttcagatacgcca

SEQ ID NO: 50808 - DNA, 22 bp, Artificial sequence
  synthetic polynucleotide sequence
catggtcacgaagggaactgga

SEQ ID NO: 50809 - DNA, 21 bp, Artificial sequence
  synthetic polynucleotide sequence
ttccagagcaggtccaagtga

SEQ ID NO: 50810 - DNA, 20 bp, Artificial sequence
  synthetic polynucleotide sequence
tctggggtcacgtggtccaa

SEQ ID NO: 50811 - DNA, 21 bp, Artificial sequence
  synthetic polynucleotide sequence
gaaggagcacagtggagggaa

SEQ ID NO: 50812 - DNA, 20 bp, Artificial sequence
  synthetic polynucleotide sequence
gaggaggtcacagctgccca

SEQ ID NO: 50813 - DNA, 21 bp, Artificial sequence
  synthetic polynucleotide sequence
gaagccctacatgtgcaggca

SEQ ID NO: 50814 - DNA, 19 bp, Artificial sequence
  synthetic polynucleotide sequence
ttggagaaagccttggcca

SEQ ID NO: 50815 - DNA, 20 bp, Artificial sequence
  synthetic polynucleotide sequence
cagcaggaggggcttggaca

SEQ ID NO: 50816 - DNA, 22 bp, Artificial sequence
  synthetic polynucleotide sequence
agatggggccacatatgtcaca

SEQ ID NO: 50817 - DNA, 21 bp, Artificial sequence
  synthetic polynucleotide sequence
tgtgggaggaccttcaaccaa

SEQ ID NO: 50818 - DNA, 20 bp, Artificial sequence
  synthetic polynucleotide sequence
tcgtgctggctgaaggagga

SEQ ID NO: 50819 - DNA, 22 bp, Artificial sequence
  synthetic polynucleotide sequence
gaaaggtcacacactggagaga

SEQ ID NO: 50820 - DNA, 21 bp, Artificial sequence
  synthetic polynucleotide sequence
gaacgaaggaaggccttacca

SEQ ID NO: 50821 - DNA, 21 bp, Artificial sequence
  synthetic polynucleotide sequence
tgcctccaacctcactcgaca

SEQ ID NO: 50822 - DNA, 22 bp, Artificial sequence
  synthetic polynucleotide sequence
agtaaggtgtgagaaacggcga

SEQ ID NO: 50823 - DNA, 20 bp, Artificial sequence
  synthetic polynucleotide sequence
agacccggcatcgagaagca

SEQ ID NO: 50824 - DNA, 19 bp, Artificial sequence
  synthetic polynucleotide sequence
gtcggtgtgggtgagggca

SEQ ID NO: 50825 - DNA, 18 bp, Artificial sequence
  synthetic polynucleotide sequence
gcaggctgtgggaaggca

SEQ ID NO: 50826 - DNA, 20 bp, Artificial sequence
  synthetic polynucleotide sequence
gttgtaaaggaccgaccgca

SEQ ID NO: 50827 - DNA, 22 bp, Artificial sequence
  synthetic polynucleotide sequence
gaaaacctccttacgcaccaga

SEQ ID NO: 50828 - DNA, 21 bp, Artificial sequence
  synthetic polynucleotide sequence
ttctggccaaaggctgttcca

SEQ ID NO: 50829 - DNA, 21 bp, Artificial sequence
  synthetic polynucleotide sequence
tctgaaacagccactggagca

SEQ ID NO: 50830 - DNA, 19 bp, Artificial sequence
  synthetic polynucleotide sequence
ttactgggcccctcctgca

SEQ ID NO: 50831 - DNA, 22 bp, Artificial sequence
  synthetic polynucleotide sequence
ttcacactgcagtacgacctca

SEQ ID NO: 50832 - DNA, 21 bp, Artificial sequence
  synthetic polynucleotide sequence
tccccagtgtgaactccccga

SEQ ID NO: 50833 - DNA, 20 bp, Artificial sequence
  synthetic polynucleotide sequence
tggtcccgggccaagctgaa

SEQ ID NO: 50834 - DNA, 19 bp, Artificial sequence
  synthetic polynucleotide sequence
ggaccttggcccgggacca

SEQ ID NO: 50835 - DNA, 20 bp, Artificial sequence
  synthetic polynucleotide sequence
actcgccgtgaggaggcaga

SEQ ID NO: 50836 - DNA, 21 bp, Artificial sequence
  synthetic polynucleotide sequence
gtaccacaggctgcagatcca

SEQ ID NO: 50837 - DNA, 22 bp, Artificial sequence
  synthetic polynucleotide sequence
acaaatgcagtgagtgcggcaa

SEQ ID NO: 50838 - DNA, 22 bp, Artificial sequence
  synthetic polynucleotide sequence
attgtgcctgaagaccttgcca

SEQ ID NO: 50839 - DNA, 20 bp, Artificial sequence
  synthetic polynucleotide sequence
tggagaggaggcagtgacca

SEQ ID NO: 50840 - DNA, 19 bp, Artificial sequence
  synthetic polynucleotide sequence
gctggtccaggaggtgaca

SEQ ID NO: 50841 - DNA, 21 bp, Artificial sequence
  synthetic polynucleotide sequence
agcggacccattctggggaga

SEQ ID NO: 50842 - DNA, 20 bp, Artificial sequence
  synthetic polynucleotide sequence
ggggtaggagctgatgacca

SEQ ID NO: 50843 - DNA, 20 bp, Artificial sequence
  synthetic polynucleotide sequence
tacctgcaccaaaaggagca

SEQ ID NO: 50844 - DNA, 19 bp, Artificial sequence
  synthetic polynucleotide sequence
ttgaaaggcctccacacca

SEQ ID NO: 50845 - DNA, 18 bp, Artificial sequence
  synthetic polynucleotide sequence
ccatcctgcccccggaga

SEQ ID NO: 50846 - DNA, 20 bp, Artificial sequence
  synthetic polynucleotide sequence
cctgggaaggctctgctgga

SEQ ID NO: 50847 - DNA, 20 bp, Artificial sequence
  synthetic polynucleotide sequence
atgattcgcacgaggcccca

SEQ ID NO: 50848 - DNA, 21 bp, Artificial sequence
  synthetic polynucleotide sequence
tgaccagacccaacaacgtca

SEQ ID NO: 50849 - DNA, 22 bp, Artificial sequence
  synthetic polynucleotide sequence
aagaactcacaccggagagaca

SEQ ID NO: 50850 - DNA, 20 bp, Artificial sequence
  synthetic polynucleotide sequence
gtggtggcgcaatcctgaga

SEQ ID NO: 50851 - DNA, 21 bp, Artificial sequence
  synthetic polynucleotide sequence
gtggaaaaccccctcagagca

SEQ ID NO: 50852 - DNA, 20 bp, Artificial sequence
  synthetic polynucleotide sequence
tggggttcaaaacctgccca

SEQ ID NO: 50853 - DNA, 22 bp, Artificial sequence
  synthetic polynucleotide sequence
aatcctcaatcgccactggaga

SEQ ID NO: 50854 - DNA, 21 bp, Artificial sequence
  synthetic polynucleotide sequence
acatggctaaaggccttccca

SEQ ID NO: 50855 - DNA, 21 bp, Artificial sequence
  synthetic polynucleotide sequence
aggaggagtggcagtacctga

SEQ ID NO: 50856 - DNA, 19 bp, Artificial sequence
  synthetic polynucleotide sequence
ttggtaacctgctgcccca

SEQ ID NO: 50857 - DNA, 20 bp, Artificial sequence
  synthetic polynucleotide sequence
ctggaccctggccagagaga

SEQ ID NO: 50858 - DNA, 20 bp, Artificial sequence
  synthetic polynucleotide sequence
gtcaggctctggggctgaca

SEQ ID NO: 50859 - DNA, 20 bp, Artificial sequence
  synthetic polynucleotide sequence
ctgctccagagagctccaga

SEQ ID NO: 50860 - DNA, 18 bp, Artificial sequence
  synthetic polynucleotide sequence
gtggctccggatcccaca

SEQ ID NO: 50861 - DNA, 19 bp, Artificial sequence
  synthetic polynucleotide sequence
gccccccgccggagtcgaa

SEQ ID NO: 50862 - DNA, 25 bp, Artificial sequence
  synthetic polynucleotide sequence
ccactcctcctgggtaaaaaacaca

SEQ ID NO: 50863 - DNA, 23 bp, Artificial sequence
  synthetic polynucleotide sequence
caaaactaactcggcaccagaga

SEQ ID NO: 50864 - DNA, 22 bp, Artificial sequence
  synthetic polynucleotide sequence
acctagctgggaagaagtccca

SEQ ID NO: 50865 - DNA, 20 bp, Artificial sequence
  synthetic polynucleotide sequence
cctggacctcgctcagcaga

SEQ ID NO: 50866 - DNA, 20 bp, Artificial sequence
  synthetic polynucleotide sequence
gatcaggcctggcttacaga

SEQ ID NO: 50867 - DNA, 19 bp, Artificial sequence
  synthetic polynucleotide sequence
tcctggcagccacatagca

SEQ ID NO: 50868 - DNA, 21 bp, Artificial sequence
  synthetic polynucleotide sequence
agggcagaagcttcaggggca

SEQ ID NO: 50869 - DNA, 21 bp, Artificial sequence
  synthetic polynucleotide sequence
catcccttactcgacaccaga

SEQ ID NO: 50870 - DNA, 21 bp, Artificial sequence
  synthetic polynucleotide sequence
tgtgtaagggatgagcggtca

SEQ ID NO: 50871 - DNA, 23 bp, Artificial sequence
  synthetic polynucleotide sequence
gaagagagacttgcgataggaca

SEQ ID NO: 50872 - DNA, 20 bp, Artificial sequence
  synthetic polynucleotide sequence
gctggaagcgggtagccaca

SEQ ID NO: 50873 - DNA, 22 bp, Artificial sequence
  synthetic polynucleotide sequence
tcatcggagtcgtcatgaagga

SEQ ID NO: 50874 - DNA, 22 bp, Artificial sequence
  synthetic polynucleotide sequence
ggtacagtttgacagccgacca
